United States Patent 7,655,785 (BIOINFORMATICALLY DETECTABLE GROUP OF NOVEL REGULATORY OLIGONUCLEOTIDES AND USES THEREOF) - sequence listing, part 44

SEQ ID NO: 1818637 - RNA, 17 nt, Homo sapiens
caggagacaaaagagca

SEQ ID NO: 1818638 - RNA, 15 nt, Homo sapiens
aauuauucagaugua

SEQ ID NO: 1818639 - RNA, 15 nt, Homo sapiens
acugguuucaguuga

SEQ ID NO: 1818640 - RNA, 20 nt, Homo sapiens
cuggaccgcugacugcacca

SEQ ID NO: 1818641 - RNA, 16 nt, Homo sapiens
acugcauccucugccu

SEQ ID NO: 1818642 - RNA, 18 nt, Homo sapiens
gacagacaacacugggaa

SEQ ID NO: 1818643 - RNA, 22 nt, Homo sapiens
aagaaugaucagcaucugugau

SEQ ID NO: 1818644 - RNA, 17 nt, Homo sapiens
auccaaaugcugugcaa

SEQ ID NO: 1818645 - RNA, 21 nt, Homo sapiens
agccuggcccuggaacuagaa

SEQ ID NO: 1818646 - RNA, 16 nt, Homo sapiens
ugucccacugcugcuu

SEQ ID NO: 1818647 - RNA, 17 nt, Homo sapiens
ggucucaagguucucau

SEQ ID NO: 1818648 - RNA, 16 nt, Homo sapiens
uaaagcuucucucuga

SEQ ID NO: 1818649 - RNA, 23 nt, Homo sapiens
guccaucuucuuuauacaaugac

SEQ ID NO: 1818650 - RNA, 21 nt, Homo sapiens
ucauuuuucacuguacauuau

SEQ ID NO: 1818651 - RNA, 17 nt, Homo sapiens
cugggaggagaggucca

SEQ ID NO: 1818652 - RNA, 14 nt, Homo sapiens
gccuuaucuugcac

SEQ ID NO: 1818653 - RNA, 23 nt, Homo sapiens
ucucaaggagaggcaaagaaagg

SEQ ID NO: 1818654 - RNA, 15 nt, Homo sapiens
ucaucuuaggaccua

SEQ ID NO: 1818655 - RNA, 20 nt, Homo sapiens
cauguuuuauacugcucuau

SEQ ID NO: 1818656 - RNA, 23 nt, Homo sapiens
uccuuuccugcuaggcagugcug

SEQ ID NO: 1818657 - RNA, 20 nt, Homo sapiens
uccaacuccuaccgcgauac

SEQ ID NO: 1818658 - RNA, 15 nt, Homo sapiens
gagaucacauuucag

SEQ ID NO: 1818659 - RNA, 17 nt, Homo sapiens
cucggacuauacugcug

SEQ ID NO: 1818660 - RNA, 13 nt, Homo sapiens
acuacugcuccug

SEQ ID NO: 1818661 - RNA, 22 nt, Homo sapiens
cauaauuccauaugcuguuuca

SEQ ID NO: 1818662 - RNA, 21 nt, Homo sapiens
auaccagguuuuacacuugca

SEQ ID NO: 1818663 - RNA, 23 nt, Homo sapiens
auugaccucagcugcacauuccu

SEQ ID NO: 1818664 - RNA, 14 nt, Homo sapiens
cggcugcaccugca

SEQ ID NO: 1818665 - RNA, 23 nt, Homo sapiens
cauuugcugaauagcuacuauau

SEQ ID NO: 1818666 - RNA, 23 nt, Homo sapiens
ugcuaaacagaugucuucuugca

SEQ ID NO: 1818667 - RNA, 22 nt, Homo sapiens
cgugccacugcacuccaggcug

SEQ ID NO: 1818668 - RNA, 23 nt, Homo sapiens
ugauuuagcauucauauuuucca

SEQ ID NO: 1818669 - RNA, 15 nt, Homo sapiens
gaaaucaugauuucc

SEQ ID NO: 1818670 - RNA, 15 nt, Homo sapiens
ucaaccucuacaggg

SEQ ID NO: 1818671 - RNA, 13 nt, Homo sapiens
uugcugaugaaag

SEQ ID NO: 1818672 - RNA, 19 nt, Homo sapiens
gcaggucuagaagaacaac

SEQ ID NO: 1818673 - RNA, 18 nt, Homo sapiens
uugccaagaaaaugaagg

SEQ ID NO: 1818674 - RNA, 23 nt, Homo sapiens
ucacagagugagacuccaucuca

SEQ ID NO: 1818675 - RNA, 15 nt, Homo sapiens
caagccucaugucca

SEQ ID NO: 1818676 - RNA, 12 nt, Homo sapiens
aaacugugagau

SEQ ID NO: 1818677 - RNA, 12 nt, Homo sapiens
agacccacugaa

SEQ ID NO: 1818678 - RNA, 18 nt, Homo sapiens
gaagucuggaacacuuuc

SEQ ID NO: 1818679 - RNA, 12 nt, Homo sapiens
uuagaaauucag

SEQ ID NO: 1818680 - RNA, 12 nt, Homo sapiens
uucaaaauucca

SEQ ID NO: 1818681 - RNA, 16 nt, Homo sapiens
agaucuugaugguguu

SEQ ID NO: 1818682 - RNA, 16 nt, Homo sapiens
gcccuucauugccaca

SEQ ID NO: 1818683 - RNA, 20 nt, Homo sapiens
cuuccccaggcccaccauca

SEQ ID NO: 1818684 - RNA, 14 nt, Homo sapiens
uauuccagugucca

SEQ ID NO: 1818685 - RNA, 12 nt, Homo sapiens
aaaugccagucu

SEQ ID NO: 1818686 - RNA, 23 nt, Homo sapiens
agguccugcgaaggcugggcacu

SEQ ID NO: 1818687 - RNA, 21 nt, Homo sapiens
auuaagcccaauuaauuccug

SEQ ID NO: 1818688 - RNA, 14 nt, Homo sapiens
ucuuaacuauucaa

SEQ ID NO: 1818689 - RNA, 13 nt, Homo sapiens
ggccagguggcca

SEQ ID NO: 1818690 - RNA, 13 nt, Homo sapiens
ccagggguccagg

SEQ ID NO: 1818691 - RNA, 16 nt, Homo sapiens
gaaaacaguggugauu

SEQ ID NO: 1818692 - RNA, 14 nt, Homo sapiens
aagugguacaggaa

SEQ ID NO: 1818693 - RNA, 17 nt, Homo sapiens
gaacacagcaugugcca

SEQ ID NO: 1818694 - RNA, 22 nt, Homo sapiens
gcugaacaggccgcacaucuca

SEQ ID NO: 1818695 - RNA, 21 nt, Homo sapiens
uaaaaaaaaaacuucauucua

SEQ ID NO: 1818696 - RNA, 17 nt, Homo sapiens
aucuuuaaacauuucaa

SEQ ID NO: 1818697 - RNA, 23 nt, Homo sapiens
gcauggaaaaaugguugauggaa

SEQ ID NO: 1818698 - RNA, 20 nt, Homo sapiens
gcuuuuacuaagcacugugu

SEQ ID NO: 1818699 - RNA, 14 nt, Homo sapiens
cugcuaaggcugcc

SEQ ID NO: 1818700 - RNA, 18 nt, Homo sapiens
agucccuuugugacuuca

SEQ ID NO: 1818701 - RNA, 18 nt, Homo sapiens
uauccaggugugccccuc

SEQ ID NO: 1818702 - RNA, 21 nt, Homo sapiens
acuugaaauucuuucagcuau

SEQ ID NO: 1818703 - RNA, 22 nt, Homo sapiens
caugcucaccgcccugcuucac

SEQ ID NO: 1818704 - RNA, 22 nt, Homo sapiens
aagcagcaucuucugguuuaaa

SEQ ID NO: 1818705 - RNA, 15 nt, Homo sapiens
aaugccaaauugcag

SEQ ID NO: 1818706 - RNA, 15 nt, Homo sapiens
ucacuuaauaaucaa

SEQ ID NO: 1818707 - RNA, 17 nt, Homo sapiens
uucauucuggucuuuga

SEQ ID NO: 1818708 - RNA, 17 nt, Homo sapiens
agugugaauaaaguuag

SEQ ID NO: 1818709 - RNA, 23 nt, Homo sapiens
uggcccuuaauuauuaacaaagu

SEQ ID NO: 1818710 - RNA, 21 nt, Homo sapiens
caccuaccacucacaugacac

SEQ ID NO: 1818711 - RNA, 13 nt, Homo sapiens
ugggcccacaaag

SEQ ID NO: 1818712 - RNA, 19 nt, Homo sapiens
ugagauacugaagugcagc

SEQ ID NO: 1818713 - RNA, 20 nt, Homo sapiens
cagacgggucugagacugaa

SEQ ID NO: 1818714 - RNA, 18 nt, Homo sapiens
cagaucaagcugugagac

SEQ ID NO: 1818715 - RNA, 13 nt, Homo sapiens
aucagugugcaau

SEQ ID NO: 1818716 - RNA, 20 nt, Homo sapiens
agggggccaugaggccucag

SEQ ID NO: 1818717 - RNA, 21 nt, Homo sapiens
gcaauaaaucugacccagugc

SEQ ID NO: 1818718 - RNA, 23 nt, Homo sapiens
gggcugcaugaccuaccaggaca

SEQ ID NO: 1818719 - RNA, 17 nt, Homo sapiens
caggaggaucacuugag

SEQ ID NO: 1818720 - RNA, 14 nt, Homo sapiens
gguuuccacugucu

SEQ ID NO: 1818721 - RNA, 14 nt, Homo sapiens
uugauuugugcugu

SEQ ID NO: 1818722 - RNA, 20 nt, Homo sapiens
auccacucuucuagggauau

SEQ ID NO: 1818723 - RNA, 15 nt, Homo sapiens
caugucuuuacugga

SEQ ID NO: 1818724 - RNA, 20 nt, Homo sapiens
uugcacacuuugguaccaga

SEQ ID NO: 1818725 - RNA, 22 nt, Homo sapiens
uacauggcguaccguacacaga

SEQ ID NO: 1818726 - RNA, 23 nt, Homo sapiens
acuucuuggaaaaaaauuacaaa

SEQ ID NO: 1818727 - RNA, 15 nt, Homo sapiens
aauaaauucuaccuc

SEQ ID NO: 1818728 - RNA, 22 nt, Homo sapiens
gaaaaccugaagacugaggaca

SEQ ID NO: 1818729 - RNA, 15 nt, Homo sapiens
aucacaauucucuga

SEQ ID NO: 1818730 - RNA, 18 nt, Homo sapiens
uucaaaagguuauauacc

SEQ ID NO: 1818731 - RNA, 19 nt, Homo sapiens
cauaaucaauauaaucuga

SEQ ID NO: 1818732 - RNA, 17 nt, Homo sapiens
ugccacuccugcuucuc

SEQ ID NO: 1818733 - RNA, 12 nt, Homo sapiens
aaagccaugugu

SEQ ID NO: 1818734 - RNA, 22 nt, Homo sapiens
uuagucucuggaaaaagacuga

SEQ ID NO: 1818735 - RNA, 15 nt, Homo sapiens
guuugguguguuccc

SEQ ID NO: 1818736 - RNA, 21 nt, Homo sapiens
ugcaacuuaaaugaaaugcau

SEQ ID NO: 1818737 - RNA, 18 nt, Homo sapiens
cucuaacuuaagaaauaa

SEQ ID NO: 1818738 - RNA, 13 nt, Homo sapiens
cuuaaacucuguu

SEQ ID NO: 1818739 - RNA, 19 nt, Homo sapiens
agacuaacaaaggcagcug

SEQ ID NO: 1818740 - RNA, 13 nt, Homo sapiens
augaugucuuuaa

SEQ ID NO: 1818741 - RNA, 16 nt, Homo sapiens
uuaaaauuagugagau

SEQ ID NO: 1818742 - RNA, 15 nt, Homo sapiens
aaacauugugccaug

SEQ ID NO: 1818743 - RNA, 14 nt, Homo sapiens
cuacaacaaaagga

SEQ ID NO: 1818744 - RNA, 17 nt, Homo sapiens
aaagacauccucaaaag

SEQ ID NO: 1818745 - RNA, 19 nt, Homo sapiens
ugaggcuaaaacaaaucuc

SEQ ID NO: 1818746 - RNA, 17 nt, Homo sapiens
aacaaacacauugugaa

SEQ ID NO: 1818747 - RNA, 22 nt, Homo sapiens
agccagaugugaaaacaucuca

SEQ ID NO: 1818748 - RNA, 16 nt, Homo sapiens
uagucaaggugcucaa

SEQ ID NO: 1818749 - RNA, 16 nt, Homo sapiens
ucucccaaccccguga

SEQ ID NO: 1818750 - RNA, 22 nt, Homo sapiens
aguggacccuggaccauuccag

SEQ ID NO: 1818751 - RNA, 20 nt, Homo sapiens
uucaauaaagcugcugagaa

SEQ ID NO: 1818752 - RNA, 17 nt, Homo sapiens
aucauuuuaacaggugc

SEQ ID NO: 1818753 - RNA, 16 nt, Homo sapiens
agguagauaccaaaug

SEQ ID NO: 1818754 - RNA, 22 nt, Homo sapiens
ugcucuuguuucuaacaaggac

SEQ ID NO: 1818755 - RNA, 14 nt, Homo sapiens
acuuuguguucacc

SEQ ID NO: 1818756 - RNA, 17 nt, Homo sapiens
uggagcauuucucauca

SEQ ID NO: 1818757 - RNA, 14 nt, Homo sapiens
ugaagcagcacugu

SEQ ID NO: 1818758 - RNA, 21 nt, Homo sapiens
uuagaaguucgaaaacucagc

SEQ ID NO: 1818759 - RNA, 19 nt, Homo sapiens
cagaaucaugcuguucucu

SEQ ID NO: 1818760 - RNA, 22 nt, Homo sapiens
agcacuaccuaaguaauucucu

SEQ ID NO: 1818761 - RNA, 13 nt, Homo sapiens
caaauaguuucaa

SEQ ID NO: 1818762 - RNA, 15 nt, Homo sapiens
ucaccaagcccaguu

SEQ ID NO: 1818763 - RNA, 23 nt, Homo sapiens
uaaauaauagacauacagagaua

SEQ ID NO: 1818764 - RNA, 13 nt, Homo sapiens
ucaucugcaaagg

SEQ ID NO: 1818765 - RNA, 19 nt, Homo sapiens
gucuucaaggaucuccugu

SEQ ID NO: 1818766 - RNA, 21 nt, Homo sapiens
ggguugggggacagccuucag

SEQ ID NO: 1818767 - RNA, 16 nt, Homo sapiens
agaccaccaacguguc

SEQ ID NO: 1818768 - RNA, 22 nt, Homo sapiens
uccuaaugagcuuuacagcaga

SEQ ID NO: 1818769 - RNA, 14 nt, Homo sapiens
ucugguuccacuca

SEQ ID NO: 1818770 - RNA, 15 nt, Homo sapiens
gcaagagaacauuuu

SEQ ID NO: 1818771 - RNA, 19 nt, Homo sapiens
uaauguagauaaagcacug

SEQ ID NO: 1818772 - RNA, 23 nt, Homo sapiens
uucugcuaugugugguacuuugc

SEQ ID NO: 1818773 - RNA, 14 nt, Homo sapiens
acaacucuagucag

SEQ ID NO: 1818774 - RNA, 14 nt, Homo sapiens
cugugaucuauacc

SEQ ID NO: 1818775 - RNA, 13 nt, Homo sapiens
augacuacuacac

SEQ ID NO: 1818776 - RNA, 17 nt, Homo sapiens
caccugagcuuuggaca

SEQ ID NO: 1818777 - RNA, 20 nt, Homo sapiens
cugcacagaaauuuucaauu

SEQ ID NO: 1818778 - RNA, 16 nt, Homo sapiens
cauuucuucagauaua

SEQ ID NO: 1818779 - RNA, 17 nt, Homo sapiens
ugagacacuaggaugaa

SEQ ID NO: 1818780 - RNA, 16 nt, Homo sapiens
cauuauuaguuuguua

SEQ ID NO: 1818781 - RNA, 19 nt, Homo sapiens
cuuguuucucauucccaca

SEQ ID NO: 1818782 - RNA, 21 nt, Homo sapiens
cuuuuuguacugaaaacaauu

SEQ ID NO: 1818783 - RNA, 23 nt, Homo sapiens
ucacugaugggaaaacugccaau

SEQ ID NO: 1818784 - RNA, 13 nt, Homo sapiens
ucucaaaucugcu

SEQ ID NO: 1818785 - RNA, 16 nt, Homo sapiens
agucggaucuagucca

SEQ ID NO: 1818786 - RNA, 20 nt, Homo sapiens
gaauucacaaacaaauggcu

SEQ ID NO: 1818787 - RNA, 22 nt, Homo sapiens
uccucugauuucacauauugca

SEQ ID NO: 1818788 - RNA, 13 nt, Homo sapiens
aaugugcuuuauu

SEQ ID NO: 1818789 - RNA, 14 nt, Homo sapiens
gaaaccaagagaca

SEQ ID NO: 1818790 - RNA, 13 nt, Homo sapiens
ugcuauauugccc

SEQ ID NO: 1818791 - RNA, 13 nt, Homo sapiens
auacauauauauc

SEQ ID NO: 1818792 - RNA, 23 nt, Homo sapiens
accagugaaccaaagagacugga

SEQ ID NO: 1818793 - RNA, 23 nt, Homo sapiens
aaauaguugagccagcagacauu

SEQ ID NO: 1818794 - RNA, 22 nt, Homo sapiens
gucuaaagcagggaagugacag

SEQ ID NO: 1818795 - RNA, 19 nt, Homo sapiens
uccucuuccagagucaccu

SEQ ID NO: 1818796 - RNA, 17 nt, Homo sapiens
uuggccaacauggugaa

SEQ ID NO: 1818797 - RNA, 20 nt, Homo sapiens
uuuuuaccuauaccuaugug

SEQ ID NO: 1818798 - RNA, 15 nt, Homo sapiens
aauuuagucccuuaa

SEQ ID NO: 1818799 - RNA, 16 nt, Homo sapiens
gccagaugccucccca

SEQ ID NO: 1818800 - RNA, 18 nt, Homo sapiens
caccugucaucauggagg

SEQ ID NO: 1818801 - RNA, 15 nt, Homo sapiens
aggagagggaaaaug

SEQ ID NO: 1818802 - RNA, 22 nt, Homo sapiens
ugugauuauugaaguucaugaa

SEQ ID NO: 1818803 - RNA, 19 nt, Homo sapiens
aucuucaaaacugccauua

SEQ ID NO: 1818804 - RNA, 18 nt, Homo sapiens
gacaaaauccaugaacaa

SEQ ID NO: 1818805 - RNA, 21 nt, Homo sapiens
guaacuuuuuuucaguucaua

SEQ ID NO: 1818806 - RNA, 16 nt, Homo sapiens
gaaagggucagguuag

SEQ ID NO: 1818807 - RNA, 14 nt, Homo sapiens
acacuucuauuuaa

SEQ ID NO: 1818808 - RNA, 21 nt, Homo sapiens
cauggcaacauaauucacuuu

SEQ ID NO: 1818809 - RNA, 20 nt, Homo sapiens
ugcaagggauuguagauaac

SEQ ID NO: 1818810 - RNA, 14 nt, Homo sapiens
ucaggaggagacag

SEQ ID NO: 1818811 - RNA, 17 nt, Homo sapiens
ggagucuuguacacuua

SEQ ID NO: 1818812 - RNA, 15 nt, Homo sapiens
acaaaaauuaacuca

SEQ ID NO: 1818813 - RNA, 16 nt, Homo sapiens
ucccaaucaaagaauu

SEQ ID NO: 1818814 - RNA, 13 nt, Homo sapiens
gauaaccacaggg

SEQ ID NO: 1818815 - RNA, 17 nt, Homo sapiens
cugaccuaccucaaagg

SEQ ID NO: 1818816 - RNA, 22 nt, Homo sapiens
uaauggaauauguaaauagaaa

SEQ ID NO: 1818817 - RNA, 17 nt, Homo sapiens
cuggaauugauauugaa

SEQ ID NO: 1818818 - RNA, 17 nt, Homo sapiens
acccaacccaaucccuc

SEQ ID NO: 1818819 - RNA, 18 nt, Homo sapiens
agaagcguuaugugcagu

SEQ ID NO: 1818820 - RNA, 17 nt, Homo sapiens
aacacuuugugaucuca

SEQ ID NO: 1818821 - RNA, 17 nt, Homo sapiens
aguucauaggucuccaa

SEQ ID NO: 1818822 - RNA, 17 nt, Homo sapiens
gaaggugcccaaccuaa

SEQ ID NO: 1818823 - RNA, 16 nt, Homo sapiens
ccaacuacaaccaagc

SEQ ID NO: 1818824 - RNA, 13 nt, Homo sapiens
cauaacaaaaaga

SEQ ID NO: 1818825 - RNA, 13 nt, Homo sapiens
cauaucaaaaagu

SEQ ID NO: 1818826 - RNA, 18 nt, Homo sapiens
ccaggagaaugcugcaau

SEQ ID NO: 1818827 - RNA, 15 nt, Homo sapiens
auggaagcaaagaca

SEQ ID NO: 1818828 - RNA, 20 nt, Homo sapiens
gauuagucagaaacugccau

SEQ ID NO: 1818829 - RNA, 16 nt, Homo sapiens
uuggccacacacugag

SEQ ID NO: 1818830 - RNA, 17 nt, Homo sapiens
ugcauaacgucugccuu

SEQ ID NO: 1818831 - RNA, 19 nt, Homo sapiens
ucaaugaaaugaugucaua

SEQ ID NO: 1818832 - RNA, 20 nt, Homo sapiens
auggaguuaaacuugaugcc

SEQ ID NO: 1818833 - RNA, 16 nt, Homo sapiens
gccaguguguguuucc

SEQ ID NO: 1818834 - RNA, 17 nt, Homo sapiens
cccacuguccugugagg

SEQ ID NO: 1818835 - RNA, 12 nt, Homo sapiens
uccaggcacuca

SEQ ID NO: 1818836 - RNA, 17 nt, Homo sapiens
aaaaucuaacaguaaca

SEQ ID NO: 1818837 - RNA, 21 nt, Homo sapiens
aucccuuugcagucaguucau

SEQ ID NO: 1818838 - RNA, 19 nt, Homo sapiens
uaagucagguucuuuacaa

SEQ ID NO: 1818839 - RNA, 15 nt, Homo sapiens
gcuguccaguuccca

SEQ ID NO: 1818840 - RNA, 14 nt, Homo sapiens
ucccugguggagcu

SEQ ID NO: 1818841 - RNA, 19 nt, Homo sapiens
ugguccuacccgcuuccca

SEQ ID NO: 1818842 - RNA, 16 nt, Homo sapiens
uauccccccaaaugga

SEQ ID NO: 1818843 - RNA, 18 nt, Homo sapiens
uucuuuaccuucauuuca

SEQ ID NO: 1818844 - RNA, 15 nt, Homo sapiens
aauagacacaucaaa

SEQ ID NO: 1818845 - RNA, 15 nt, Homo sapiens
guacauaacuuagag

SEQ ID NO: 1818846 - RNA, 14 nt, Homo sapiens
gaacuccugacccc

SEQ ID NO: 1818847 - RNA, 14 nt, Homo sapiens
gagcaucucugugu

SEQ ID NO: 1818848 - RNA, 23 nt, Homo sapiens
auguucacccaaccacaucccac

SEQ ID NO: 1818849 - RNA, 15 nt, Homo sapiens
ccugccaagagucaa

SEQ ID NO: 1818850 - RNA, 18 nt, Homo sapiens
aaauaacugagcacuuug

SEQ ID NO: 1818851 - RNA, 18 nt, Homo sapiens
agcuuuucauaauaucua

SEQ ID NO: 1818852 - RNA, 18 nt, Homo sapiens
ugcaaaugcuauauugca

SEQ ID NO: 1818853 - RNA, 12 nt, Homo sapiens
gauuuccauuug

SEQ ID NO: 1818854 - RNA, 19 nt, Homo sapiens
cccaauuacagggugacuc

SEQ ID NO: 1818855 - RNA, 18 nt, Homo sapiens
cauccuugggaccugaau

SEQ ID NO: 1818856 - RNA, 18 nt, Homo sapiens
cuugcggucccuucuuac

SEQ ID NO: 1818857 - RNA, 16 nt, Homo sapiens
ggcaacgcacaaaaca

SEQ ID NO: 1818858 - RNA, 13 nt, Homo sapiens
aguugacaguauu

SEQ ID NO: 1818859 - RNA, 15 nt, Homo sapiens
uggagagcacaccua

SEQ ID NO: 1818860 - RNA, 17 nt, Homo sapiens
uccuaaugcuugcugcu

SEQ ID NO: 1818861 - RNA, 17 nt, Homo sapiens
ucccaggauuaggccau

SEQ ID NO: 1818862 - RNA, 22 nt, Homo sapiens
gcaacugacuucauuugugcca

SEQ ID NO: 1818863 - RNA, 21 nt, Homo sapiens
guguucccucucucccuccag

SEQ ID NO: 1818864 - RNA, 22 nt, Homo sapiens
ugggcuccggaggacucaccac

SEQ ID NO: 1818865 - RNA, 21 nt, Homo sapiens
auguaucaagccaaaugugca

SEQ ID NO: 1818866 - RNA, 14 nt, Homo sapiens
caugucagcaaaaa

SEQ ID NO: 1818867 - RNA, 15 nt, Homo sapiens
cucuugaaaaaugca

SEQ ID NO: 1818868 - RNA, 15 nt, Homo sapiens
uaaaauacacacuca

SEQ ID NO: 1818869 - RNA, 13 nt, Homo sapiens
ucauucaucauag

SEQ ID NO: 1818870 - RNA, 21 nt, Homo sapiens
ggccauacuucuguuuccauc

SEQ ID NO: 1818871 - RNA, 19 nt, Homo sapiens
ugauauguauccaucagga

SEQ ID NO: 1818872 - RNA, 21 nt, Homo sapiens
acacuguauguuauagaacuu

SEQ ID NO: 1818873 - RNA, 23 nt, Homo sapiens
ggaccugccaaugauuccagacg

SEQ ID NO: 1818874 - RNA, 19 nt, Homo sapiens
ugaacguggggugagggau

SEQ ID NO: 1818875 - RNA, 16 nt, Homo sapiens
uaaaacaaaagcauuu

SEQ ID NO: 1818876 - RNA, 17 nt, Homo sapiens
acauuuaguacccugca

SEQ ID NO: 1818877 - RNA, 22 nt, Homo sapiens
ccuuuggagggagggcugaccc

SEQ ID NO: 1818878 - RNA, 15 nt, Homo sapiens
acccaggcaugcaau

SEQ ID NO: 1818879 - RNA, 11 nt, Homo sapiens
auuguccuugg

SEQ ID NO: 1818880 - RNA, 18 nt, Homo sapiens
aaauaaagaaauugcaau

SEQ ID NO: 1818881 - RNA, 21 nt, Homo sapiens
cugcugccauauuguagcuca

SEQ ID NO: 1818882 - RNA, 21 nt, Homo sapiens
ccugccgacggagccacuggg

SEQ ID NO: 1818883 - RNA, 13 nt, Homo sapiens
ugaaaacauacac

SEQ ID NO: 1818884 - RNA, 13 nt, Homo sapiens
uucagagcacuca

SEQ ID NO: 1818885 - RNA, 13 nt, Homo sapiens
uauaacugugaug

SEQ ID NO: 1818886 - RNA, 23 nt, Homo sapiens
agaguggaaugcuuccuagaagu

SEQ ID NO: 1818887 - RNA, 14 nt, Homo sapiens
uaauucagcucuuc

SEQ ID NO: 1818888 - RNA, 16 nt, Homo sapiens
aaccauaaugucuuua

SEQ ID NO: 1818889 - RNA, 18 nt, Homo sapiens
ucuauuuagagaaacauu

SEQ ID NO: 1818890 - RNA, 23 nt, Homo sapiens
cuacccggcccagagaccccuuc

SEQ ID NO: 1818891 - RNA, 14 nt, Homo sapiens
cuguauugagcaag

SEQ ID NO: 1818892 - RNA, 17 nt, Homo sapiens
acaaacucacucaguaa

SEQ ID NO: 1818893 - RNA, 21 nt, Homo sapiens
uugcccugaggggccugccac

SEQ ID NO: 1818894 - RNA, 16 nt, Homo sapiens
aauuuaaacucugaag

SEQ ID NO: 1818895 - RNA, 20 nt, Homo sapiens
cuuuauuucggagcgcaaug

SEQ ID NO: 1818896 - RNA, 15 nt, Homo sapiens
cauucuugcuugugu

SEQ ID NO: 1818897 - RNA, 17 nt, Homo sapiens
agagagcaguggcagag

SEQ ID NO: 1818898 - RNA, 23 nt, Homo sapiens
uauuaaggaaauacuuugcauaa

SEQ ID NO: 1818899 - RNA, 23 nt, Homo sapiens
gccauucuuauggccacaagcaa

SEQ ID NO: 1818900 - RNA, 14 nt, Homo sapiens
cagucugaaccuga

SEQ ID NO: 1818901 - RNA, 21 nt, Homo sapiens
uaucaguugagcuucauauac

SEQ ID NO: 1818902 - RNA, 16 nt, Homo sapiens
cucuacagacuccaaa

SEQ ID NO: 1818903 - RNA, 15 nt, Homo sapiens
uguucacuguggcau

SEQ ID NO: 1818904 - RNA, 19 nt, Homo sapiens
ucucagcguuuugaguuua

SEQ ID NO: 1818905 - RNA, 20 nt, Homo sapiens
ugucaacacaaagacaugga

SEQ ID NO: 1818906 - RNA, 13 nt, Homo sapiens
gcacuucacugga

SEQ ID NO: 1818907 - RNA, 15 nt, Homo sapiens
gaaaaauuccaggag

SEQ ID NO: 1818908 - RNA, 16 nt, Homo sapiens
aucuaaugacauucaa

SEQ ID NO: 1818909 - RNA, 19 nt, Homo sapiens
ugucaauuucccucagguu

SEQ ID NO: 1818910 - RNA, 23 nt, Homo sapiens
aagcccaaauauaaaaacagacu

SEQ ID NO: 1818911 - RNA, 22 nt, Homo sapiens
aauaaugcuggauggccugagg

SEQ ID NO: 1818912 - RNA, 13 nt, Homo sapiens
acguuuacauucu

SEQ ID NO: 1818913 - RNA, 22 nt, Homo sapiens
cucuucccuuuccccagcauca

SEQ ID NO: 1818914 - RNA, 14 nt, Homo sapiens
agacagaagccuca

SEQ ID NO: 1818915 - RNA, 13 nt, Homo sapiens
cuacuuccuccua

SEQ ID NO: 1818916 - RNA, 11 nt, Homo sapiens
aagauagcaau

SEQ ID NO: 1818917 - RNA, 23 nt, Homo sapiens
aagacuuagaauagaaacuuuua

SEQ ID NO: 1818918 - RNA, 18 nt, Homo sapiens
auaaacuuugcuguguac

SEQ ID NO: 1818919 - RNA, 18 nt, Homo sapiens
gagauuacuuugcugccu

SEQ ID NO: 1818920 - RNA, 17 nt, Homo sapiens
uggagugucacaucucu

SEQ ID NO: 1818921 - RNA, 20 nt, Homo sapiens
cauucuguggccagccaaaa

SEQ ID NO: 1818922 - RNA, 17 nt, Homo sapiens
gaggcuccugucugaua

SEQ ID NO: 1818923 - RNA, 16 nt, Homo sapiens
uuuccccuugccuuau

SEQ ID NO: 1818924 - RNA, 14 nt, Homo sapiens
ccacuguaugauuc

SEQ ID NO: 1818925 - RNA, 23 nt, Homo sapiens
caaauccuuucugccccccaggg

SEQ ID NO: 1818926 - RNA, 16 nt, Homo sapiens
acgucagccuguggau

SEQ ID NO: 1818927 - RNA, 17 nt, Homo sapiens
guauacccucuguuucc

SEQ ID NO: 1818928 - RNA, 12 nt, Homo sapiens
uaugugccaaag

SEQ ID NO: 1818929 - RNA, 18 nt, Homo sapiens
uuauucaacaacuacuac

SEQ ID NO: 1818930 - RNA, 14 nt, Homo sapiens
ccauaugucugcuu

SEQ ID NO: 1818931 - RNA, 14 nt, Homo sapiens
acuuuaacacagug

SEQ ID NO: 1818932 - RNA, 16 nt, Homo sapiens
gucauuguaaucacug

SEQ ID NO: 1818933 - RNA, 15 nt, Homo sapiens
cuaccugcaacacaa

SEQ ID NO: 1818934 - RNA, 12 nt, Homo sapiens
ugucagggucuu

SEQ ID NO: 1818935 - RNA, 12 nt, Homo sapiens
caguaagggaua

SEQ ID NO: 1818936 - RNA, 17 nt, Homo sapiens
aauugguguauaucaug

SEQ ID NO: 1818937 - RNA, 19 nt, Homo sapiens
acugugaaaguuggaauau

SEQ ID NO: 1818938 - RNA, 14 nt, Homo sapiens
acacggaugcacac

SEQ ID NO: 1818939 - RNA, 15 nt, Homo sapiens
ucuaugucucaugau

SEQ ID NO: 1818940 - RNA, 15 nt, Homo sapiens
agaaugucaguugau

SEQ ID NO: 1818941 - RNA, 13 nt, Homo sapiens
agaggaaagggau

SEQ ID NO: 1818942 - RNA, 12 nt, Homo sapiens
uauuagcaguag

SEQ ID NO: 1818943 - RNA, 20 nt, Homo sapiens
uccaucagugaaaacauuuc

SEQ ID NO: 1818944 - RNA, 17 nt, Homo sapiens
ucuacuggacuguaaaa

SEQ ID NO: 1818945 - RNA, 16 nt, Homo sapiens
aucgaccacaccagcc

SEQ ID NO: 1818946 - RNA, 18 nt, Homo sapiens
gggaagagacagcccagg

SEQ ID NO: 1818947 - RNA, 18 nt, Homo sapiens
ggccaccagccacuuuag

SEQ ID NO: 1818948 - RNA, 13 nt, Homo sapiens
ugcugccauuaau

SEQ ID NO: 1818949 - RNA, 16 nt, Homo sapiens
uaauuuacagaaauca

SEQ ID NO: 1818950 - RNA, 19 nt, Homo sapiens
uuuaagcucugagcuguca

SEQ ID NO: 1818951 - RNA, 21 nt, Homo sapiens
gccugaggucaggaguucaag

SEQ ID NO: 1818952 - RNA, 17 nt, Homo sapiens
cagaccucggugggcau

SEQ ID NO: 1818953 - RNA, 17 nt, Homo sapiens
ugaugcgaaaacuugaa

SEQ ID NO: 1818954 - RNA, 13 nt, Homo sapiens
agggaaaaaccag

SEQ ID NO: 1818955 - RNA, 20 nt, Homo sapiens
gcaauaaaagacaaaugcaa

SEQ ID NO: 1818956 - RNA, 16 nt, Homo sapiens
augcggugaaguuuaa

SEQ ID NO: 1818957 - RNA, 14 nt, Homo sapiens
ucuucucaagaucc

SEQ ID NO: 1818958 - RNA, 22 nt, Homo sapiens
ucagacaauccacucucaggag

SEQ ID NO: 1818959 - RNA, 21 nt, Homo sapiens
cucaucaacugaaugagguca

SEQ ID NO: 1818960 - RNA, 20 nt, Homo sapiens
gucauggaggccaagaacuu

SEQ ID NO: 1818961 - RNA, 17 nt, Homo sapiens
cuccugaggucuggauu

SEQ ID NO: 1818962 - RNA, 20 nt, Homo sapiens
agcucacauagauaugacuu

SEQ ID NO: 1818963 - RNA, 13 nt, Homo sapiens
ggcuucccagaga

SEQ ID NO: 1818964 - RNA, 22 nt, Homo sapiens
cucacaggagcagacagagaaa

SEQ ID NO: 1818965 - RNA, 22 nt, Homo sapiens
ugcaaguggccauuaccaucuc

SEQ ID NO: 1818966 - RNA, 12 nt, Homo sapiens
gucaguugccaa

SEQ ID NO: 1818967 - RNA, 13 nt, Homo sapiens
aaacccucuccau

SEQ ID NO: 1818968 - RNA, 17 nt, Homo sapiens
ggcucuuguccaucugu

SEQ ID NO: 1818969 - RNA, 15 nt, Homo sapiens
uccgcucucucaugu

SEQ ID NO: 1818970 - RNA, 15 nt, Homo sapiens
ucacccaagccacaa

SEQ ID NO: 1818971 - RNA, 17 nt, Homo sapiens
agauagguuaccaguaa

SEQ ID NO: 1818972 - RNA, 11 nt, Homo sapiens
uucucugagau

SEQ ID NO: 1818973 - RNA, 16 nt, Homo sapiens
caucuggacacugggc

SEQ ID NO: 1818974 - RNA, 19 nt, Homo sapiens
cagcccagacccaguggac

SEQ ID NO: 1818975 - RNA, 17 nt, Homo sapiens
uccuagugucuauuccc

SEQ ID NO: 1818976 - RNA, 18 nt, Homo sapiens
uuacacugccuguauacu

SEQ ID NO: 1818977 - RNA, 13 nt, Homo sapiens
auggucauaucca

SEQ ID NO: 1818978 - RNA, 17 nt, Homo sapiens
acuuggccaccaggacu

SEQ ID NO: 1818979 - RNA, 17 nt, Homo sapiens
gauaguccuuccuggca

SEQ ID NO: 1818980 - RNA, 20 nt, Homo sapiens
cggagacaaaagcaguuucu

SEQ ID NO: 1818981 - RNA, 18 nt, Homo sapiens
caggagaacuacuugaac

SEQ ID NO: 1818982 - RNA, 20 nt, Homo sapiens
ucucugaacugcaacacugg

SEQ ID NO: 1818983 - RNA, 16 nt, Homo sapiens
uaguugcauaagcauu

SEQ ID NO: 1818984 - RNA, 22 nt, Homo sapiens
ggccaauaacuuuucaccaaug

SEQ ID NO: 1818985 - RNA, 21 nt, Homo sapiens
acagccauuauaaaaaauuaa

SEQ ID NO: 1818986 - RNA, 16 nt, Homo sapiens
aucagaaaaugcagcc

SEQ ID NO: 1818987 - RNA, 17 nt, Homo sapiens
cuuuuuggacacacaaa

SEQ ID NO: 1818988 - RNA, 14 nt, Homo sapiens
aucagcagggcagu

SEQ ID NO: 1818989 - RNA, 14 nt, Homo sapiens
cagacucccauucc

SEQ ID NO: 1818990 - RNA, 19 nt, Homo sapiens
ucuuccaucaugggguuca

SEQ ID NO: 1818991 - RNA, 15 nt, Homo sapiens
ccuuuuucuaccuuu

SEQ ID NO: 1818992 - RNA, 22 nt, Homo sapiens
gacgcauuccaaaucauacuca

SEQ ID NO: 1818993 - RNA, 15 nt, Homo sapiens
agguaacacauuaua

SEQ ID NO: 1818994 - RNA, 15 nt, Homo sapiens
caagucuguaccuca

SEQ ID NO: 1818995 - RNA, 14 nt, Homo sapiens
accucuacugccuu

SEQ ID NO: 1818996 - RNA, 14 nt, Homo sapiens
agugggcuccagua

SEQ ID NO: 1818997 - RNA, 15 nt, Homo sapiens
agcgagaacccucaa

SEQ ID NO: 1818998 - RNA, 14 nt, Homo sapiens
uuucagaauuuugu

SEQ ID NO: 1818999 - RNA, 20 nt, Homo sapiens
ugcauaauacuauucuuuaa

SEQ ID NO: 1819000 - RNA, 13 nt, Homo sapiens
guguguccaugca

SEQ ID NO: 1819001 - RNA, 18 nt, Homo sapiens
uaagguaccaagaucaca

SEQ ID NO: 1819002 - RNA, 23 nt, Homo sapiens
aaguaacuucugacuuacuguca

SEQ ID NO: 1819003 - RNA, 14 nt, Homo sapiens
augcucccucugug

SEQ ID NO: 1819004 - RNA, 22 nt, Homo sapiens
gagggaguacaaagacagggaa

SEQ ID NO: 1819005 - RNA, 19 nt, Homo sapiens
guagccauguuaacaugac

SEQ ID NO: 1819006 - RNA, 12 nt, Homo sapiens
cuuccacaaaca

SEQ ID NO: 1819007 - RNA, 22 nt, Homo sapiens
auaaacuagauauuagguccau

SEQ ID NO: 1819008 - RNA, 17 nt, Homo sapiens
gcuauguaaauauacaa

SEQ ID NO: 1819009 - RNA, 13 nt, Homo sapiens
uuuccucuugggc

SEQ ID NO: 1819010 - RNA, 15 nt, Homo sapiens
cugcaggaaucaaaa

SEQ ID NO: 1819011 - RNA, 22 nt, Homo sapiens
uuucauuagggcaaagaucuca

SEQ ID NO: 1819012 - RNA, 19 nt, Homo sapiens
ugagagacccucaccuucc

SEQ ID NO: 1819013 - RNA, 18 nt, Homo sapiens
agaaaugacaacaaggcc

SEQ ID NO: 1819014 - RNA, 20 nt, Homo sapiens
gcugccaugccacugccagg

SEQ ID NO: 1819015 - RNA, 19 nt, Homo sapiens
cuggggcccuuuucuuaca

SEQ ID NO: 1819016 - RNA, 16 nt, Homo sapiens
caaguugcugucacug

SEQ ID NO: 1819017 - RNA, 20 nt, Homo sapiens
guaucagcaucuguccucau

SEQ ID NO: 1819018 - RNA, 23 nt, Homo sapiens
agugauuccuucuugcucagucc

SEQ ID NO: 1819019 - RNA, 19 nt, Homo sapiens
uaggugggggaacacugag

SEQ ID NO: 1819020 - RNA, 23 nt, Homo sapiens
uucacugaggggagacaaaggga

SEQ ID NO: 1819021 - RNA, 23 nt, Homo sapiens
agccuacaugaugcaaacugugg

SEQ ID NO: 1819022 - RNA, 21 nt, Homo sapiens
acuuaauguuuguaagacuua

SEQ ID NO: 1819023 - RNA, 15 nt, Homo sapiens
agaugagaguacacc

SEQ ID NO: 1819024 - RNA, 20 nt, Homo sapiens
cugcagcagaggcacugggg

SEQ ID NO: 1819025 - RNA, 14 nt, Homo sapiens
aggaaaggcuccag

SEQ ID NO: 1819026 - RNA, 21 nt, Homo sapiens
gaagguguguccucaagaaga

SEQ ID NO: 1819027 - RNA, 15 nt, Homo sapiens
gugccccaccacucc

SEQ ID NO: 1819028 - RNA, 20 nt, Homo sapiens
gcuccuuggcggacacuggg

SEQ ID NO: 1819029 - RNA, 20 nt, Homo sapiens
uguguccauugaugucauuc

SEQ ID NO: 1819030 - RNA, 14 nt, Homo sapiens
cuguguaccacugg

SEQ ID NO: 1819031 - RNA, 20 nt, Homo sapiens
ucugagauuuuugauaucuc

SEQ ID NO: 1819032 - RNA, 13 nt, Homo sapiens
gagacaaaucuca

SEQ ID NO: 1819033 - RNA, 14 nt, Homo sapiens
auggcauuagcuga

SEQ ID NO: 1819034 - RNA, 15 nt, Homo sapiens
aguaauagagcaaaa

SEQ ID NO: 1819035 - RNA, 15 nt, Homo sapiens
accuuaacucagcca

SEQ ID NO: 1819036 - RNA, 19 nt, Homo sapiens
cagaucgcaccacugcacu

SEQ ID NO: 1819037 - RNA, 20 nt, Homo sapiens
acagagcgagacucugucuc

SEQ ID NO: 1819038 - RNA, 18 nt, Homo sapiens
ugauucagacagcuuaug

SEQ ID NO: 1819039 - RNA, 13 nt, Homo sapiens
ugugaugucagaa

SEQ ID NO: 1819040 - RNA, 15 nt, Homo sapiens
ucaagacaaugcacc

SEQ ID NO: 1819041 - RNA, 21 nt, Homo sapiens
uagauuauuccaagccuuauu

SEQ ID NO: 1819042 - RNA, 20 nt, Homo sapiens
ucccaaaagauugcugaaaa

SEQ ID NO: 1819043 - RNA, 17 nt, Homo sapiens
auaguggggucagggcu

SEQ ID NO: 1819044 - RNA, 21 nt, Homo sapiens
cgguccuguguuccugugauc

SEQ ID NO: 1819045 - RNA, 14 nt, Homo sapiens
aaacucaguuccaa

SEQ ID NO: 1819046 - RNA, 15 nt, Homo sapiens
ccauuuugugucugu

SEQ ID NO: 1819047 - RNA, 15 nt, Homo sapiens
ccauguuuaaacuuu

SEQ ID NO: 1819048 - RNA, 21 nt, Homo sapiens
uagaaguauaaggugcucuga

SEQ ID NO: 1819049 - RNA, 18 nt, Homo sapiens
uauaugauauacuaugac

SEQ ID NO: 1819050 - RNA, 16 nt, Homo sapiens
ugaccaguaauuguga

SEQ ID NO: 1819051 - RNA, 20 nt, Homo sapiens
augagccauauuaauugccu

SEQ ID NO: 1819052 - RNA, 23 nt, Homo sapiens
ccuaugccaauaaaaaugucuca

SEQ ID NO: 1819053 - RNA, 14 nt, Homo sapiens
cugggcucaaguga

SEQ ID NO: 1819054 - RNA, 18 nt, Homo sapiens
uucccugccuugcugaca

SEQ ID NO: 1819055 - RNA, 15 nt, Homo sapiens
auuccucuugccucu

SEQ ID NO: 1819056 - RNA, 22 nt, Homo sapiens
auauauuggccaaacuggugca

SEQ ID NO: 1819057 - RNA, 23 nt, Homo sapiens
gugccaaagcuuuacuacugugg

SEQ ID NO: 1819058 - RNA, 14 nt, Homo sapiens
ccgugccugggaga

SEQ ID NO: 1819059 - RNA, 14 nt, Homo sapiens
uggaaucagcucag

SEQ ID NO: 1819060 - RNA, 22 nt, Homo sapiens
caaaguguugggauuacaggcg

SEQ ID NO: 1819061 - RNA, 22 nt, Homo sapiens
ucuuuuuuuuuaaguucuuaug

SEQ ID NO: 1819062 - RNA, 21 nt, Homo sapiens
aagccaauucagacaggcaaa

SEQ ID NO: 1819063 - RNA, 15 nt, Homo sapiens
accaaccugcucugu

SEQ ID NO: 1819064 - RNA, 20 nt, Homo sapiens
ggagaaguguguucugauga

SEQ ID NO: 1819065 - RNA, 15 nt, Homo sapiens
uaacaaaagaagauu

SEQ ID NO: 1819066 - RNA, 20 nt, Homo sapiens
agcaugugccuuaaugcuuc

SEQ ID NO: 1819067 - RNA, 20 nt, Homo sapiens
uccuuacugaagccaggcac

SEQ ID NO: 1819068 - RNA, 16 nt, Homo sapiens
uaugcauaaagccaaa

SEQ ID NO: 1819069 - RNA, 18 nt, Homo sapiens
agugcaguggugccauca

SEQ ID NO: 1819070 - RNA, 18 nt, Homo sapiens
uggcucaagucugcacag

SEQ ID NO: 1819071 - RNA, 15 nt, Homo sapiens
cuggucuaagaauga

SEQ ID NO: 1819072 - RNA, 16 nt, Homo sapiens
uuaacccugaacaaga

SEQ ID NO: 1819073 - RNA, 15 nt, Homo sapiens
cuagggaucccucau

SEQ ID NO: 1819074 - RNA, 15 nt, Homo sapiens
auuuauaauccacag

SEQ ID NO: 1819075 - RNA, 15 nt, Homo sapiens
auaaugagcuauuaa

SEQ ID NO: 1819076 - RNA, 17 nt, Homo sapiens
uucuauguucacuaaaa

SEQ ID NO: 1819077 - RNA, 19 nt, Homo sapiens
uuucuuuuucccaggccag

SEQ ID NO: 1819078 - RNA, 22 nt, Homo sapiens
uaaaaaauaaauauaauuggga

SEQ ID NO: 1819079 - RNA, 18 nt, Homo sapiens
ggcgugcuccuuuucucu

SEQ ID NO: 1819080 - RNA, 17 nt, Homo sapiens
gaaucauugugcuuaau

SEQ ID NO: 1819081 - RNA, 21 nt, Homo sapiens
agaaauaauagaaaugucuca

SEQ ID NO: 1819082 - RNA, 17 nt, Homo sapiens
aagggaggcccauguga

SEQ ID NO: 1819083 - RNA, 18 nt, Homo sapiens
acggucacuuuacugucc

SEQ ID NO: 1819084 - RNA, 15 nt, Homo sapiens
auaacugaaccaaau

SEQ ID NO: 1819085 - RNA, 13 nt, Homo sapiens
augcccaaggcga

SEQ ID NO: 1819086 - RNA, 13 nt, Homo sapiens
gcuuuugccauua

SEQ ID NO: 1819087 - RNA, 23 nt, Homo sapiens
uacuguuuaaauucccauuccac

SEQ ID NO: 1819088 - RNA, 11 nt, Homo sapiens
uuuggugccag

SEQ ID NO: 1819089 - RNA, 19 nt, Homo sapiens
uaucguccagugacuuuca

SEQ ID NO: 1819090 - RNA, 15 nt, Homo sapiens
ggagaaucacuugaa

SEQ ID NO: 1819091 - RNA, 21 nt, Homo sapiens
gaaaccccuucuuuacuuccc

SEQ ID NO: 1819092 - RNA, 16 nt, Homo sapiens
gcacuccuacugaguu

SEQ ID NO: 1819093 - RNA, 12 nt, Homo sapiens
ccugagccaugg

SEQ ID NO: 1819094 - RNA, 16 nt, Homo sapiens
cauaguucucuuuaag

SEQ ID NO: 1819095 - RNA, 17 nt, Homo sapiens
ccugguaaguggcuuuu

SEQ ID NO: 1819096 - RNA, 20 nt, Homo sapiens
gcacguggccaggagccaug

SEQ ID NO: 1819097 - RNA, 21 nt, Homo sapiens
uuccaguuauuuauuuccaaa

SEQ ID NO: 1819098 - RNA, 14 nt, Homo sapiens
cuuauuguacuugu

SEQ ID NO: 1819099 - RNA, 12 nt, Homo sapiens
uuuaucaucucg

SEQ ID NO: 1819100 - RNA, 13 nt, Homo sapiens
uguuuuguagcaa

SEQ ID NO: 1819101 - RNA, 20 nt, Homo sapiens
gagaucacgccacugcacuc

SEQ ID NO: 1819102 - RNA, 14 nt, Homo sapiens
uccaaggaacuaau

SEQ ID NO: 1819103 - RNA, 12 nt, Homo sapiens
uauaaccuuaau

SEQ ID NO: 1819104 - RNA, 17 nt, Homo sapiens
uguuucauuggucucua

SEQ ID NO: 1819105 - RNA, 20 nt, Homo sapiens
guguauuuuauaagcauuua

SEQ ID NO: 1819106 - RNA, 15 nt, Homo sapiens
uguugguuuccaaaa

SEQ ID NO: 1819107 - RNA, 22 nt, Homo sapiens
ggcugguccagggcuagugacu

SEQ ID NO: 1819108 - RNA, 18 nt, Homo sapiens
uguguaauaagaaaguau

SEQ ID NO: 1819109 - RNA, 13 nt, Homo sapiens
gcuuaccugacac

SEQ ID NO: 1819110 - RNA, 16 nt, Homo sapiens
agauggcauguguuua

SEQ ID NO: 1819111 - RNA, 14 nt, Homo sapiens
uuuguauuugccau

SEQ ID NO: 1819112 - RNA, 13 nt, Homo sapiens
ugcgaaauccaga

SEQ ID NO: 1819113 - RNA, 16 nt, Homo sapiens
uucuguaaaacagguu

SEQ ID NO: 1819114 - RNA, 21 nt, Homo sapiens
uacgacagcucucugugcacu

SEQ ID NO: 1819115 - RNA, 14 nt, Homo sapiens
uauaguaugugacu

SEQ ID NO: 1819116 - RNA, 16 nt, Homo sapiens
ucaacugcuguaaaau

SEQ ID NO: 1819117 - RNA, 13 nt, Homo sapiens
gacccaugggaga

SEQ ID NO: 1819118 - RNA, 14 nt, Homo sapiens
cacaaugcugaaua

SEQ ID NO: 1819119 - RNA, 17 nt, Homo sapiens
cccaaagccaucuuccu

SEQ ID NO: 1819120 - RNA, 17 nt, Homo sapiens
agugauauguaaauuaa

SEQ ID NO: 1819121 - RNA, 16 nt, Homo sapiens
ugggacaaaggacauu

SEQ ID NO: 1819122 - RNA, 14 nt, Homo sapiens
cuuugccacacaca

SEQ ID NO: 1819123 - RNA, 12 nt, Homo sapiens
ccugcucccgcc

SEQ ID NO: 1819124 - RNA, 22 nt, Homo sapiens
cucauaguucucuuuaagccag

SEQ ID NO: 1819125 - RNA, 15 nt, Homo sapiens
aaagauguauuugaa

SEQ ID NO: 1819126 - RNA, 22 nt, Homo sapiens
uaaauaauauagccugguguga

SEQ ID NO: 1819127 - RNA, 23 nt, Homo sapiens
cugucaugugcgaacacagugac

SEQ ID NO: 1819128 - RNA, 14 nt, Homo sapiens
ccaccucuucacuc

SEQ ID NO: 1819129 - RNA, 16 nt, Homo sapiens
cugcauaaacuguugu

SEQ ID NO: 1819130 - RNA, 22 nt, Homo sapiens
uauuuuaaagcuuggugcuaaa

SEQ ID NO: 1819131 - RNA, 16 nt, Homo sapiens
gacuccaaccucaggg

SEQ ID NO: 1819132 - RNA, 23 nt, Homo sapiens
agccugcaaacucacugcucaag

SEQ ID NO: 1819133 - RNA, 18 nt, Homo sapiens
ucccuuugaguccagugu

SEQ ID NO: 1819134 - RNA, 13 nt, Homo sapiens
ccugggcaaugca

SEQ ID NO: 1819135 - RNA, 14 nt, Homo sapiens
guaaauaaagcuca

SEQ ID NO: 1819136 - RNA, 12 nt, Homo sapiens
acaccuucaucc

SEQ ID NO: 1819137 - RNA, 21 nt, Homo sapiens
aacaggcuguucugcacugaa

SEQ ID NO: 1819138 - RNA, 15 nt, Homo sapiens
acaagauaccaaggc

SEQ ID NO: 1819139 - RNA, 14 nt, Homo sapiens
uucaaaagucagac

SEQ ID NO: 1819140 - RNA, 18 nt, Homo sapiens
acugggagauacagccau

SEQ ID NO: 1819141 - RNA, 13 nt, Homo sapiens
uggaggugagaaa

SEQ ID NO: 1819142 - RNA, 22 nt, Homo sapiens
aaaugacaaccugaauuaucua

SEQ ID NO: 1819143 - RNA, 16 nt, Homo sapiens
ggcugcaggggucuca

SEQ ID NO: 1819144 - RNA, 21 nt, Homo sapiens
aggagaauugcuugaacccag

SEQ ID NO: 1819145 - RNA, 14 nt, Homo sapiens
accaguucuggcca

SEQ ID NO: 1819146 - RNA, 19 nt, Homo sapiens
ugucacuugccacauggug

SEQ ID NO: 1819147 - RNA, 13 nt, Homo sapiens
accuagggacaca

SEQ ID NO: 1819148 - RNA, 14 nt, Homo sapiens
acauauucuuucac

SEQ ID NO: 1819149 - RNA, 18 nt, Homo sapiens
cuuuguaguagaauuuac

SEQ ID NO: 1819150 - RNA, 12 nt, Homo sapiens
auucuucuguac

SEQ ID NO: 1819151 - RNA, 18 nt, Homo sapiens
uaggccuuccagugcagg

SEQ ID NO: 1819152 - RNA, 13 nt, Homo sapiens
ugcuuaguauuag

SEQ ID NO: 1819153 - RNA, 18 nt, Homo sapiens
aaggcauguggccuuuau

SEQ ID NO: 1819154 - RNA, 19 nt, Homo sapiens
agaagauggauguaauucu

SEQ ID NO: 1819155 - RNA, 15 nt, Homo sapiens
cuaggucaugaagga

SEQ ID NO: 1819156 - RNA, 23 nt, Homo sapiens
aaaagcaaaaauugucaguguuu

SEQ ID NO: 1819157 - RNA, 11 nt, Homo sapiens
aaaguccaggc

SEQ ID NO: 1819158 - RNA, 16 nt, Homo sapiens
gcauucagccaggaga

SEQ ID NO: 1819159 - RNA, 19 nt, Homo sapiens
guuuucuugcucaaaggga

SEQ ID NO: 1819160 - RNA, 18 nt, Homo sapiens
uuguuuacagucauugga

SEQ ID NO: 1819161 - RNA, 19 nt, Homo sapiens
ccaaaaccuuccucuucca

SEQ ID NO: 1819162 - RNA, 15 nt, Homo sapiens
uuacuguaagacauu

SEQ ID NO: 1819163 - RNA, 18 nt, Homo sapiens
uaaucaguuuuauccaca

SEQ ID NO: 1819164 - RNA, 23 nt, Homo sapiens
auaugaagcaggaucacaaaaga

SEQ ID NO: 1819165 - RNA, 16 nt, Homo sapiens
gagcccauacucagcc

SEQ ID NO: 1819166 - RNA, 19 nt, Homo sapiens
uaaagcaguguuugcucca

SEQ ID NO: 1819167 - RNA, 22 nt, Homo sapiens
agcuucuauaagugugaccagu

SEQ ID NO: 1819168 - RNA, 19 nt, Homo sapiens
cccugggccccaccaccua

SEQ ID NO: 1819169 - RNA, 17 nt, Homo sapiens
gugaucauuacucugcu

SEQ ID NO: 1819170 - RNA, 16 nt, Homo sapiens
aguugaaaaugcaacu

SEQ ID NO: 1819171 - RNA, 17 nt, Homo sapiens
guuauccucuugcuaua

SEQ ID NO: 1819172 - RNA, 21 nt, Homo sapiens
cacuauuuccaaaagcacaug

SEQ ID NO: 1819173 - RNA, 20 nt, Homo sapiens
cccagggaauccagccauga

SEQ ID NO: 1819174 - RNA, 20 nt, Homo sapiens
uauucaauaaaucgugcugg

SEQ ID NO: 1819175 - RNA, 19 nt, Homo sapiens
gacugaauaccuauaauua

SEQ ID NO: 1819176 - RNA, 14 nt, Homo sapiens
uaaaagagaagcca

SEQ ID NO: 1819177 - RNA, 18 nt, Homo sapiens
ggucaacagaugacaaca

SEQ ID NO: 1819178 - RNA, 14 nt, Homo sapiens
uaacugccaagaaa

SEQ ID NO: 1819179 - RNA, 17 nt, Homo sapiens
uauuagcauggcauauu

SEQ ID NO: 1819180 - RNA, 21 nt, Homo sapiens
agccuaggaggacugggguaa

SEQ ID NO: 1819181 - RNA, 22 nt, Homo sapiens
cagcuggccgggagccugauca

SEQ ID NO: 1819182 - RNA, 17 nt, Homo sapiens
auuucucuacugucuca

SEQ ID NO: 1819183 - RNA, 15 nt, Homo sapiens
ucuccccuguucccc

SEQ ID NO: 1819184 - RNA, 22 nt, Homo sapiens
cuggagaagucuuagacuugaa

SEQ ID NO: 1819185 - RNA, 14 nt, Homo sapiens
acauagacugcaaa

SEQ ID NO: 1819186 - RNA, 19 nt, Homo sapiens
cacuuuaaagcaauugcau

SEQ ID NO: 1819187 - RNA, 19 nt, Homo sapiens
aguguguaaauaauuugca

SEQ ID NO: 1819188 - RNA, 12 nt, Homo sapiens
uccuaagcacuu

SEQ ID NO: 1819189 - RNA, 19 nt, Homo sapiens
uaaugaaaaacuaugucag

SEQ ID NO: 1819190 - RNA, 21 nt, Homo sapiens
gcagccccaccucacagccag

SEQ ID NO: 1819191 - RNA, 21 nt, Homo sapiens
auauuacauuucaaaccaauu

SEQ ID NO: 1819192 - RNA, 20 nt, Homo sapiens
auguggaguggacauucaaa

SEQ ID NO: 1819193 - RNA, 18 nt, Homo sapiens
ccgacugccaucuuggac

SEQ ID NO: 1819194 - RNA, 22 nt, Homo sapiens
acucuguaaaaugcaccaauca

SEQ ID NO: 1819195 - RNA, 15 nt, Homo sapiens
aauauggacaucugg

SEQ ID NO: 1819196 - RNA, 15 nt, Homo sapiens
cagacauaaagccau

SEQ ID NO: 1819197 - RNA, 15 nt, Homo sapiens
caccucuaaacaucu

SEQ ID NO: 1819198 - RNA, 15 nt, Homo sapiens
cuagacuccucagga

SEQ ID NO: 1819199 - RNA, 23 nt, Homo sapiens
cugcagggccucugucaauugua

SEQ ID NO: 1819200 - RNA, 14 nt, Homo sapiens
aaauguuaugacua

SEQ ID NO: 1819201 - RNA, 17 nt, Homo sapiens
ccagucuggaaaacaga

SEQ ID NO: 1819202 - RNA, 21 nt, Homo sapiens
agcaaugugccuugauugauu

SEQ ID NO: 1819203 - RNA, 19 nt, Homo sapiens
uggagaaagggaaguggaa

SEQ ID NO: 1819204 - RNA, 15 nt, Homo sapiens
gcaagcguguucuca

SEQ ID NO: 1819205 - RNA, 17 nt, Homo sapiens
aauucugaauuugcaaa

SEQ ID NO: 1819206 - RNA, 15 nt, Homo sapiens
gcuguuuccuugccu

SEQ ID NO: 1819207 - RNA, 14 nt, Homo sapiens
ggugcuccaucucc

SEQ ID NO: 1819208 - RNA, 18 nt, Homo sapiens
aacacaucacucauuuua

SEQ ID NO: 1819209 - RNA, 23 nt, Homo sapiens
gugcagguaccugcgauguuuac

SEQ ID NO: 1819210 - RNA, 13 nt, Homo sapiens
uuguaagccauaa

SEQ ID NO: 1819211 - RNA, 14 nt, Homo sapiens
ggcuucacauucau

SEQ ID NO: 1819212 - RNA, 17 nt, Homo sapiens
uucuaugguacccugug

SEQ ID NO: 1819213 - RNA, 14 nt, Homo sapiens
ugacgcaaaaccac

SEQ ID NO: 1819214 - RNA, 23 nt, Homo sapiens
aggcaacaggauugaucauucuu

SEQ ID NO: 1819215 - RNA, 10 nt, Homo sapiens
aaaugucaac

SEQ ID NO: 1819216 - RNA, 16 nt, Homo sapiens
accauggcacugacaa

SEQ ID NO: 1819217 - RNA, 13 nt, Homo sapiens
ucucuggaguauu

SEQ ID NO: 1819218 - RNA, 22 nt, Homo sapiens
uucaugugaaucccuuuaggau

SEQ ID NO: 1819219 - RNA, 20 nt, Homo sapiens
uccucccuuccuuuucccug

SEQ ID NO: 1819220 - RNA, 20 nt, Homo sapiens
agggacaggcuccucugggg

SEQ ID NO: 1819221 - RNA, 19 nt, Homo sapiens
acuugcagucuuguagcua

SEQ ID NO: 1819222 - RNA, 21 nt, Homo sapiens
ugcaggagucccugccaucau

SEQ ID NO: 1819223 - RNA, 17 nt, Homo sapiens
aaauuguauggugauaa

SEQ ID NO: 1819224 - RNA, 19 nt, Homo sapiens
aggaaagccacaucuugcu

SEQ ID NO: 1819225 - RNA, 11 nt, Homo sapiens
uuuauugccuc

SEQ ID NO: 1819226 - RNA, 11 nt, Homo sapiens
uucauugccuu

SEQ ID NO: 1819227 - RNA, 23 nt, Homo sapiens
auuacuacuuaccauuugcuacu

SEQ ID NO: 1819228 - RNA, 22 nt, Homo sapiens
aaaugguauccagaauggaauu

SEQ ID NO: 1819229 - RNA, 14 nt, Homo sapiens
acuaacuguuuaca

SEQ ID NO: 1819230 - RNA, 21 nt, Homo sapiens
auacuuguuguuuaauguuua

SEQ ID NO: 1819231 - RNA, 20 nt, Homo sapiens
gugggagcagcuucuugggc

SEQ ID NO: 1819232 - RNA, 22 nt, Homo sapiens
gcuuguuuuccagucucuugua

SEQ ID NO: 1819233 - RNA, 14 nt, Homo sapiens
ccuaccagcagcug

SEQ ID NO: 1819234 - RNA, 14 nt, Homo sapiens
caucauugcauaac

SEQ ID NO: 1819235 - RNA, 14 nt, Homo sapiens
acagcugcucuuac

SEQ ID NO: 1819236 - RNA, 16 nt, Homo sapiens
ggccagguuaugccuc

SEQ ID NO: 1819237 - RNA, 18 nt, Homo sapiens
gucccucgagcucuguag

SEQ ID NO: 1819238 - RNA, 16 nt, Homo sapiens
aacuacauuuugcaac

SEQ ID NO: 1819239 - RNA, 21 nt, Homo sapiens
uuccuugauggagauauuuac

SEQ ID NO: 1819240 - RNA, 22 nt, Homo sapiens
ggccacacacugaguugcacau

SEQ ID NO: 1819241 - RNA, 23 nt, Homo sapiens
augaaaaauguguuccauugcca

SEQ ID NO: 1819242 - RNA, 23 nt, Homo sapiens
ccagagccagccagcauggccac

SEQ ID NO: 1819243 - RNA, 18 nt, Homo sapiens
caugcucccaacucccuu

SEQ ID NO: 1819244 - RNA, 16 nt, Homo sapiens
cuuaaacccauacaau

SEQ ID NO: 1819245 - RNA, 17 nt, Homo sapiens
agaaaaccuagaucugc

SEQ ID NO: 1819246 - RNA, 15 nt, Homo sapiens
aaaaaauacaguauu

SEQ ID NO: 1819247 - RNA, 18 nt, Homo sapiens
uuaauuuauuuuuuaccg

SEQ ID NO: 1819248 - RNA, 18 nt, Homo sapiens
uucauuggggacauuccu

SEQ ID NO: 1819249 - RNA, 20 nt, Homo sapiens
agcugcaccccggacgggcg

SEQ ID NO: 1819250 - RNA, 15 nt, Homo sapiens
augcgagacucugau

SEQ ID NO: 1819251 - RNA, 15 nt, Homo sapiens
aaugguuccauucuc

SEQ ID NO: 1819252 - RNA, 17 nt, Homo sapiens
ggcagcaguaccaucua

SEQ ID NO: 1819253 - RNA, 12 nt, Homo sapiens
ccauccaucucu

SEQ ID NO: 1819254 - RNA, 13 nt, Homo sapiens
caauuugaagaga

SEQ ID NO: 1819255 - RNA, 13 nt, Homo sapiens
ccuagagugcagg

SEQ ID NO: 1819256 - RNA, 21 nt, Homo sapiens
gagaauauuauaaaaauauca

SEQ ID NO: 1819257 - RNA, 16 nt, Homo sapiens
gagcacuguagcacuu

SEQ ID NO: 1819258 - RNA, 16 nt, Homo sapiens
gggcaugguggcaugu

SEQ ID NO: 1819259 - RNA, 20 nt, Homo sapiens
aaucagagagcucacuaaaa

SEQ ID NO: 1819260 - RNA, 17 nt, Homo sapiens
ccagacacagacuggca

SEQ ID NO: 1819261 - RNA, 15 nt, Homo sapiens
gagaauguacuggcg

SEQ ID NO: 1819262 - RNA, 14 nt, Homo sapiens
ugcaaguugaggac

SEQ ID NO: 1819263 - RNA, 14 nt, Homo sapiens
caaacucaguucga

SEQ ID NO: 1819264 - RNA, 21 nt, Homo sapiens
aggugggcaugccacccucac

SEQ ID NO: 1819265 - RNA, 15 nt, Homo sapiens
cauuuuaagaguuac

SEQ ID NO: 1819266 - RNA, 16 nt, Homo sapiens
aucugucucuucuaca

SEQ ID NO: 1819267 - RNA, 13 nt, Homo sapiens
cacccccagucuc

SEQ ID NO: 1819268 - RNA, 13 nt, Homo sapiens
cucagaucacugc

SEQ ID NO: 1819269 - RNA, 19 nt, Homo sapiens
aguggcuugagcuucuggg

SEQ ID NO: 1819270 - RNA, 17 nt, Homo sapiens
acaaacuaucagaggaa

SEQ ID NO: 1819271 - RNA, 22 nt, Homo sapiens
uaaaaugguaugccaacuuaag

SEQ ID NO: 1819272 - RNA, 20 nt, Homo sapiens
ccgggaagagggugauugcu

SEQ ID NO: 1819273 - RNA, 14 nt, Homo sapiens
gcagagagcaccug

SEQ ID NO: 1819274 - RNA, 16 nt, Homo sapiens
aaguacuaaagcaccu

SEQ ID NO: 1819275 - RNA, 19 nt, Homo sapiens
uccaaaaguggaagugaca

SEQ ID NO: 1819276 - RNA, 23 nt, Homo sapiens
cccgaucaucuuuccuguuccag

SEQ ID NO: 1819277 - RNA, 13 nt, Homo sapiens
acaugagucugua

SEQ ID NO: 1819278 - RNA, 21 nt, Homo sapiens
cccuaaggugagugugcagua

SEQ ID NO: 1819279 - RNA, 21 nt, Homo sapiens
auuuuuggggaaaaaagcaca

SEQ ID NO: 1819280 - RNA, 16 nt, Homo sapiens
cccaagaugagcugca

SEQ ID NO: 1819281 - RNA, 12 nt, Homo sapiens
acuggauccugc

SEQ ID NO: 1819282 - RNA, 13 nt, Homo sapiens
cagacugucucaa

SEQ ID NO: 1819283 - RNA, 16 nt, Homo sapiens
aagauauuucuuuaaa

SEQ ID NO: 1819284 - RNA, 16 nt, Homo sapiens
agccuugcugccaagu

SEQ ID NO: 1819285 - RNA, 19 nt, Homo sapiens
ugauccugcuccagcagca

SEQ ID NO: 1819286 - RNA, 17 nt, Homo sapiens
caggagaaacacuugaa

SEQ ID NO: 1819287 - RNA, 20 nt, Homo sapiens
gaaaaguagaauuauaucua

SEQ ID NO: 1819288 - RNA, 17 nt, Homo sapiens
uauuuucacacugguaa

SEQ ID NO: 1819289 - RNA, 17 nt, Homo sapiens
ucuacugcugcugacau

SEQ ID NO: 1819290 - RNA, 16 nt, Homo sapiens
uaaaauccaguauuau

SEQ ID NO: 1819291 - RNA, 20 nt, Homo sapiens
acugcaagcugcuugcccaa

SEQ ID NO: 1819292 - RNA, 21 nt, Homo sapiens
gaacauagacucacucuucca

SEQ ID NO: 1819293 - RNA, 16 nt, Homo sapiens
gaaggauuuacugcaa

SEQ ID NO: 1819294 - RNA, 19 nt, Homo sapiens
gucauaaaucagaaaguuu

SEQ ID NO: 1819295 - RNA, 21 nt, Homo sapiens
ucagaucuggggcagcacccu

SEQ ID NO: 1819296 - RNA, 16 nt, Homo sapiens
ugggauguccacagau

SEQ ID NO: 1819297 - RNA, 20 nt, Homo sapiens
acuuuggaggcaaaucuuuc

SEQ ID NO: 1819298 - RNA, 16 nt, Homo sapiens
gggaagaaggggccau

SEQ ID NO: 1819299 - RNA, 12 nt, Homo sapiens
ggccacacuggg

SEQ ID NO: 1819300 - RNA, 19 nt, Homo sapiens
ugcucaggagccaccagca

SEQ ID NO: 1819301 - RNA, 15 nt, Homo sapiens
auucuagagccagcu

SEQ ID NO: 1819302 - RNA, 13 nt, Homo sapiens
cagaacuccauac

SEQ ID NO: 1819303 - RNA, 22 nt, Homo sapiens
agauagugcuggaacacugcug

SEQ ID NO: 1819304 - RNA, 12 nt, Homo sapiens
ugaaaauguauc

SEQ ID NO: 1819305 - RNA, 18 nt, Homo sapiens
uuucucuuuacaggggag

SEQ ID NO: 1819306 - RNA, 22 nt, Homo sapiens
caaagugcagggauuacaggca

SEQ ID NO: 1819307 - RNA, 17 nt, Homo sapiens
ccaaaacaguucuaggu

SEQ ID NO: 1819308 - RNA, 14 nt, Homo sapiens
cagcugggccucug

SEQ ID NO: 1819309 - RNA, 20 nt, Homo sapiens
ugucuuuggugaacauugca

SEQ ID NO: 1819310 - RNA, 12 nt, Homo sapiens
gcucaagcugac

SEQ ID NO: 1819311 - RNA, 15 nt, Homo sapiens
caucuugcugcuaau

SEQ ID NO: 1819312 - RNA, 19 nt, Homo sapiens
ggcacccuccaaacacugg

SEQ ID NO: 1819313 - RNA, 19 nt, Homo sapiens
gugcaccccuccccauuca

SEQ ID NO: 1819314 - RNA, 18 nt, Homo sapiens
cagaaaaacuggcucuga

SEQ ID NO: 1819315 - RNA, 14 nt, Homo sapiens
uucuguauuugcca

SEQ ID NO: 1819316 - RNA, 11 nt, Homo sapiens
agauugccacu

SEQ ID NO: 1819317 - RNA, 15 nt, Homo sapiens
ucaugguuuccucca

SEQ ID NO: 1819318 - RNA, 15 nt, Homo sapiens
gcuacccgcagaguu

SEQ ID NO: 1819319 - RNA, 23 nt, Homo sapiens
cagaggagcggccagaagaucua

SEQ ID NO: 1819320 - RNA, 16 nt, Homo sapiens
uacagaccauggauau

SEQ ID NO: 1819321 - RNA, 17 nt, Homo sapiens
uuugaugguaagacugu

SEQ ID NO: 1819322 - RNA, 22 nt, Homo sapiens
aaagagaguggaaauuacccac

SEQ ID NO: 1819323 - RNA, 16 nt, Homo sapiens
gcacaugaaacauuau

SEQ ID NO: 1819324 - RNA, 14 nt, Homo sapiens
ucaugagaagucac

SEQ ID NO: 1819325 - RNA, 20 nt, Homo sapiens
cuuuuuggcuuuaagccauu

SEQ ID NO: 1819326 - RNA, 18 nt, Homo sapiens
acaaauugggccaaagaa

SEQ ID NO: 1819327 - RNA, 16 nt, Homo sapiens
gcaacaucuuacuugu

SEQ ID NO: 1819328 - RNA, 16 nt, Homo sapiens
guuacaaguguucuua

SEQ ID NO: 1819329 - RNA, 14 nt, Homo sapiens
uuaguaaacugugc

SEQ ID NO: 1819330 - RNA, 23 nt, Homo sapiens
ccaguaauggaaugaagguaaua

SEQ ID NO: 1819331 - RNA, 17 nt, Homo sapiens
acagucucaagcacuaa

SEQ ID NO: 1819332 - RNA, 15 nt, Homo sapiens
uacaagucaugguca

SEQ ID NO: 1819333 - RNA, 13 nt, Homo sapiens
gacuccuaccugc

SEQ ID NO: 1819334 - RNA, 16 nt, Homo sapiens
ccacaaccgaccagau

SEQ ID NO: 1819335 - RNA, 22 nt, Homo sapiens
ucaagcacuuuuccugucucag

SEQ ID NO: 1819336 - RNA, 20 nt, Homo sapiens
uggauaauuccaacacaaga

SEQ ID NO: 1819337 - RNA, 14 nt, Homo sapiens
agggacgugauaau

SEQ ID NO: 1819338 - RNA, 19 nt, Homo sapiens
cacaagugugcauuaccac

SEQ ID NO: 1819339 - RNA, 17 nt, Homo sapiens
caaaugcuacucaguau

SEQ ID NO: 1819340 - RNA, 20 nt, Homo sapiens
aacagaaugcauugcaucau

SEQ ID NO: 1819341 - RNA, 22 nt, Homo sapiens
uccagccaacauuuaaugagca

SEQ ID NO: 1819342 - RNA, 23 nt, Homo sapiens
uugccugcacaaacucaccaucu

SEQ ID NO: 1819343 - RNA, 12 nt, Homo sapiens
uuacuacuccuu

SEQ ID NO: 1819344 - RNA, 15 nt, Homo sapiens
auaugauaccaaaga

SEQ ID NO: 1819345 - RNA, 17 nt, Homo sapiens
caggugaaaaggguaca

SEQ ID NO: 1819346 - RNA, 15 nt, Homo sapiens
cuuuucaaguuuccc

SEQ ID NO: 1819347 - RNA, 20 nt, Homo sapiens
ugaaucauuuuaccuuugac

SEQ ID NO: 1819348 - RNA, 21 nt, Homo sapiens
augaagaugucuaauaguuau

SEQ ID NO: 1819349 - RNA, 17 nt, Homo sapiens
acuuguuugucuuccau

SEQ ID NO: 1819350 - RNA, 17 nt, Homo sapiens
uuagcaugcuacaguua

SEQ ID NO: 1819351 - RNA, 20 nt, Homo sapiens
cacuuacuaaccugguccua

SEQ ID NO: 1819352 - RNA, 20 nt, Homo sapiens
gagcauaacuguucucauuu

SEQ ID NO: 1819353 - RNA, 20 nt, Homo sapiens
cuuuucacaaacauuaguau

SEQ ID NO: 1819354 - RNA, 15 nt, Homo sapiens
guacaacuuaacuca

SEQ ID NO: 1819355 - RNA, 14 nt, Homo sapiens
cuccaaaucuugcc

SEQ ID NO: 1819356 - RNA, 22 nt, Homo sapiens
uacuacuuggaaggaaaaggaa

SEQ ID NO: 1819357 - RNA, 21 nt, Homo sapiens
agcucuugcuucagagcagau

SEQ ID NO: 1819358 - RNA, 20 nt, Homo sapiens
cagcacaccugccgucuuca

SEQ ID NO: 1819359 - RNA, 13 nt, Homo sapiens
cuggagugcaguu

SEQ ID NO: 1819360 - RNA, 22 nt, Homo sapiens
cauagggacauaaguucauuca

SEQ ID NO: 1819361 - RNA, 22 nt, Homo sapiens
cucuucuuuauugcacuaggaa

SEQ ID NO: 1819362 - RNA, 13 nt, Homo sapiens
agaaaagaaugua

SEQ ID NO: 1819363 - RNA, 21 nt, Homo sapiens
auucugaaaauaccagugugu

SEQ ID NO: 1819364 - RNA, 13 nt, Homo sapiens
uguugauagcaag

SEQ ID NO: 1819365 - RNA, 17 nt, Homo sapiens
accacgugacuuucaac

SEQ ID NO: 1819366 - RNA, 18 nt, Homo sapiens
uccagcacagaaggaauc

SEQ ID NO: 1819367 - RNA, 14 nt, Homo sapiens
cucuuggcauuuuc

SEQ ID NO: 1819368 - RNA, 22 nt, Homo sapiens
uggaacuagucauuaacccauc

SEQ ID NO: 1819369 - RNA, 19 nt, Homo sapiens
accugagcugguggcugug

SEQ ID NO: 1819370 - RNA, 17 nt, Homo sapiens
uaaauuaugacugcuga

SEQ ID NO: 1819371 - RNA, 20 nt, Homo sapiens
aacucuacccuggcacuaua

SEQ ID NO: 1819372 - RNA, 18 nt, Homo sapiens
augguauugcuacaauau

SEQ ID NO: 1819373 - RNA, 21 nt, Homo sapiens
ucuuucuuuucuauuagugaa

SEQ ID NO: 1819374 - RNA, 15 nt, Homo sapiens
gaggucacaguccac

SEQ ID NO: 1819375 - RNA, 18 nt, Homo sapiens
cuucuuuagaacagggaa

SEQ ID NO: 1819376 - RNA, 20 nt, Homo sapiens
acuccccagccuccucugga

SEQ ID NO: 1819377 - RNA, 18 nt, Homo sapiens
gacaggagaaucaccuga

SEQ ID NO: 1819378 - RNA, 23 nt, Homo sapiens
cuaucggagcaguucaauaacaa

SEQ ID NO: 1819379 - RNA, 20 nt, Homo sapiens
uuuccugaucuagcacuccu

SEQ ID NO: 1819380 - RNA, 20 nt, Homo sapiens
uauuugcagaauacauucaa

SEQ ID NO: 1819381 - RNA, 18 nt, Homo sapiens
agcugagaucacgccauu

SEQ ID NO: 1819382 - RNA, 14 nt, Homo sapiens
uucuauguccaaac

SEQ ID NO: 1819383 - RNA, 19 nt, Homo sapiens
cuucacuccccuaucccau

SEQ ID NO: 1819384 - RNA, 19 nt, Homo sapiens
accuuuuuggacacacaaa

SEQ ID NO: 1819385 - RNA, 15 nt, Homo sapiens
aaugcuuagacucuu

SEQ ID NO: 1819386 - RNA, 14 nt, Homo sapiens
aaaggcucccaugu

SEQ ID NO: 1819387 - RNA, 20 nt, Homo sapiens
cuauguuugcggaaugcauu

SEQ ID NO: 1819388 - RNA, 11 nt, Homo sapiens
ucugcuucugc

SEQ ID NO: 1819389 - RNA, 16 nt, Homo sapiens
agacugcaauauagag

SEQ ID NO: 1819390 - RNA, 22 nt, Homo sapiens
agcauaugggugggauuuugca

SEQ ID NO: 1819391 - RNA, 20 nt, Homo sapiens
gaaggcaugacacaccuggg

SEQ ID NO: 1819392 - RNA, 14 nt, Homo sapiens
cuucacuuacagau

SEQ ID NO: 1819393 - RNA, 13 nt, Homo sapiens
uucuauugggaua

SEQ ID NO: 1819394 - RNA, 13 nt, Homo sapiens
aaccacucaaauu

SEQ ID NO: 1819395 - RNA, 22 nt, Homo sapiens
cacaggaaucgguggucuccac

SEQ ID NO: 1819396 - RNA, 20 nt, Homo sapiens
uaaaugagaaaggauuuccu

SEQ ID NO: 1819397 - RNA, 17 nt, Homo sapiens
caucacugcacuccagc

SEQ ID NO: 1819398 - RNA, 21 nt, Homo sapiens
cugucaacacuucucacaucu

SEQ ID NO: 1819399 - RNA, 14 nt, Homo sapiens
uauguaguaugcua

SEQ ID NO: 1819400 - RNA, 17 nt, Homo sapiens
uuuauaagcacagacaa

SEQ ID NO: 1819401 - RNA, 21 nt, Homo sapiens
cuaucaaccuaagcaacagaa

SEQ ID NO: 1819402 - RNA, 19 nt, Homo sapiens
ucaguaagacagugcagug

SEQ ID NO: 1819403 - RNA, 15 nt, Homo sapiens
gggccugucacugau

SEQ ID NO: 1819404 - RNA, 18 nt, Homo sapiens
auguacgaaacuguauga

SEQ ID NO: 1819405 - RNA, 21 nt, Homo sapiens
caggcccuuccucuccacugc

SEQ ID NO: 1819406 - RNA, 15 nt, Homo sapiens
aggagcugucuccag

SEQ ID NO: 1819407 - RNA, 13 nt, Homo sapiens
aucucagaaccuu

SEQ ID NO: 1819408 - RNA, 14 nt, Homo sapiens
aggcagugugguua

SEQ ID NO: 1819409 - RNA, 15 nt, Homo sapiens
cucccuuguccuucu

SEQ ID NO: 1819410 - RNA, 23 nt, Homo sapiens
ggacaagaguugagcagccuuuc

SEQ ID NO: 1819411 - RNA, 21 nt, Homo sapiens
gauaaauuugacuguuauuug

SEQ ID NO: 1819412 - RNA, 21 nt, Homo sapiens
agauauacuugguucucucca

SEQ ID NO: 1819413 - RNA, 18 nt, Homo sapiens
agacaaaccugggcaaug

SEQ ID NO: 1819414 - RNA, 15 nt, Homo sapiens
auaucuuugugauaa

SEQ ID NO: 1819415 - RNA, 17 nt, Homo sapiens
guagaagccacuauuac

SEQ ID NO: 1819416 - RNA, 19 nt, Homo sapiens
aaacacacauugcagcuuc

SEQ ID NO: 1819417 - RNA, 22 nt, Homo sapiens
acuggaaaaucuucuagcaugu

SEQ ID NO: 1819418 - RNA, 17 nt, Homo sapiens
cuccaggcaucacugau

SEQ ID NO: 1819419 - RNA, 14 nt, Homo sapiens
agauggauguaauu

SEQ ID NO: 1819420 - RNA, 22 nt, Homo sapiens
aaauuuuauugguaggauuuau

SEQ ID NO: 1819421 - RNA, 12 nt, Homo sapiens
acacacaaaaga

SEQ ID NO: 1819422 - RNA, 13 nt, Homo sapiens
auuguggagccaa

SEQ ID NO: 1819423 - RNA, 21 nt, Homo sapiens
uuuccaaaccuccacugcugc

SEQ ID NO: 1819424 - RNA, 19 nt, Homo sapiens
aaacauguccccuucccuu

SEQ ID NO: 1819425 - RNA, 18 nt, Homo sapiens
cacaaauauccaccacuu

SEQ ID NO: 1819426 - RNA, 12 nt, Homo sapiens
cauuccaggaaa

SEQ ID NO: 1819427 - RNA, 13 nt, Homo sapiens
agaugaaccacau

SEQ ID NO: 1819428 - RNA, 16 nt, Homo sapiens
gacagugggaaauauu

SEQ ID NO: 1819429 - RNA, 18 nt, Homo sapiens
uuauguccaccacuucag

SEQ ID NO: 1819430 - RNA, 22 nt, Homo sapiens
agccccuugcucucagcugcca

SEQ ID NO: 1819431 - RNA, 17 nt, Homo sapiens
uggugagcgaggacauu

SEQ ID NO: 1819432 - RNA, 18 nt, Homo sapiens
auagcuccuucaugcuuu

SEQ ID NO: 1819433 - RNA, 23 nt, Homo sapiens
caaaugaugauuaugaguucccu

SEQ ID NO: 1819434 - RNA, 15 nt, Homo sapiens
caucugaggagucca

SEQ ID NO: 1819435 - RNA, 21 nt, Homo sapiens
ggcucgaagaaaauaauucuc

SEQ ID NO: 1819436 - RNA, 13 nt, Homo sapiens
cuuaagugacuuc

SEQ ID NO: 1819437 - RNA, 14 nt, Homo sapiens
cccuuccuuucuau

SEQ ID NO: 1819438 - RNA, 17 nt, Homo sapiens
aaauacucaugugcaau

SEQ ID NO: 1819439 - RNA, 18 nt, Homo sapiens
cauugagccaguggugcu

SEQ ID NO: 1819440 - RNA, 15 nt, Homo sapiens
auuuaaugcacuaaa

SEQ ID NO: 1819441 - RNA, 21 nt, Homo sapiens
agaccaucuacauacacagug

SEQ ID NO: 1819442 - RNA, 23 nt, Homo sapiens
ucacaucacugauugggugccau

SEQ ID NO: 1819443 - RNA, 16 nt, Homo sapiens
aaauuauaaguagauu

SEQ ID NO: 1819444 - RNA, 21 nt, Homo sapiens
gcuucccagcaccaacaugua

SEQ ID NO: 1819445 - RNA, 21 nt, Homo sapiens
aacuagacuaagaagauuuag

SEQ ID NO: 1819446 - RNA, 15 nt, Homo sapiens
aggaggaugggcucg

SEQ ID NO: 1819447 - RNA, 17 nt, Homo sapiens
cugugaaaccccuaugu

SEQ ID NO: 1819448 - RNA, 19 nt, Homo sapiens
cuucauggaucagaucugg

SEQ ID NO: 1819449 - RNA, 17 nt, Homo sapiens
augacuuuuuauacuuu

SEQ ID NO: 1819450 - RNA, 17 nt, Homo sapiens
acaaugauuaaucagcu

SEQ ID NO: 1819451 - RNA, 14 nt, Homo sapiens
agggcagaggaaug

SEQ ID NO: 1819452 - RNA, 15 nt, Homo sapiens
cccccuuccauggac

SEQ ID NO: 1819453 - RNA, 19 nt, Homo sapiens
acuggauuuuugcucugcc

SEQ ID NO: 1819454 - RNA, 14 nt, Homo sapiens
ugcugccauuugau

SEQ ID NO: 1819455 - RNA, 16 nt, Homo sapiens
caggcaugcaagugag

SEQ ID NO: 1819456 - RNA, 16 nt, Homo sapiens
agagugagagggcaug

SEQ ID NO: 1819457 - RNA, 12 nt, Homo sapiens
ccacaagugugc

SEQ ID NO: 1819458 - RNA, 13 nt, Homo sapiens
ucaugaugugcaa

SEQ ID NO: 1819459 - RNA, 19 nt, Homo sapiens
gacacauagaaaacaauca

SEQ ID NO: 1819460 - RNA, 22 nt, Homo sapiens
aaucucuguucuguuuggcacu

SEQ ID NO: 1819461 - RNA, 18 nt, Homo sapiens
acccagccucagauccag

SEQ ID NO: 1819462 - RNA, 13 nt, Homo sapiens
uucugagugaaug

SEQ ID NO: 1819463 - RNA, 12 nt, Homo sapiens
aacaugcuugug

SEQ ID NO: 1819464 - RNA, 20 nt, Homo sapiens
gaaauuuuuuuccagaauug

SEQ ID NO: 1819465 - RNA, 23 nt, Homo sapiens
gcugggcaugguggcucaugccu

SEQ ID NO: 1819466 - RNA, 17 nt, Homo sapiens
agaaggccaagaaucaa

SEQ ID NO: 1819467 - RNA, 22 nt, Homo sapiens
ucaaccccuccccuccaucccu

SEQ ID NO: 1819468 - RNA, 12 nt, Homo sapiens
cacucaaucuag

SEQ ID NO: 1819469 - RNA, 15 nt, Homo sapiens
uggauucaucagcau

SEQ ID NO: 1819470 - RNA, 13 nt, Homo sapiens
uaccauacauuua

SEQ ID NO: 1819471 - RNA, 23 nt, Homo sapiens
ggaaaggagggggcucaggccau

SEQ ID NO: 1819472 - RNA, 13 nt, Homo sapiens
uugcacauaguag

SEQ ID NO: 1819473 - RNA, 20 nt, Homo sapiens
ugucccagggcugaugcugu

SEQ ID NO: 1819474 - RNA, 19 nt, Homo sapiens
uccagggucaaaguacaga

SEQ ID NO: 1819475 - RNA, 11 nt, Homo sapiens
auguguugcau

SEQ ID NO: 1819476 - RNA, 13 nt, Homo sapiens
ccaauuuauaugu

SEQ ID NO: 1819477 - RNA, 23 nt, Homo sapiens
aguucuuaaaguuuaaaguugca

SEQ ID NO: 1819478 - RNA, 20 nt, Homo sapiens
ucauuaggcaaaguacaaaa

SEQ ID NO: 1819479 - RNA, 14 nt, Homo sapiens
cccuggagaguuca

SEQ ID NO: 1819480 - RNA, 20 nt, Homo sapiens
acauguaaaagggugaaagu

SEQ ID NO: 1819481 - RNA, 21 nt, Homo sapiens
caaaaacaaaaaacugcagug

SEQ ID NO: 1819482 - RNA, 19 nt, Homo sapiens
augcagaauuuuaugugac

SEQ ID NO: 1819483 - RNA, 23 nt, Homo sapiens
ucaucugccuggaaaguccuccu

SEQ ID NO: 1819484 - RNA, 12 nt, Homo sapiens
uccuccguccac

SEQ ID NO: 1819485 - RNA, 17 nt, Homo sapiens
ggcaagugcaucuuugc

SEQ ID NO: 1819486 - RNA, 16 nt, Homo sapiens
acccugugguuuccaa

SEQ ID NO: 1819487 - RNA, 22 nt, Homo sapiens
gccuggagggggagcaccagcg

SEQ ID NO: 1819488 - RNA, 17 nt, Homo sapiens
cagcaggggggcugugc

SEQ ID NO: 1819489 - RNA, 12 nt, Homo sapiens
uuaaugugauga

SEQ ID NO: 1819490 - RNA, 14 nt, Homo sapiens
aucucagucccuga

SEQ ID NO: 1819491 - RNA, 16 nt, Homo sapiens
uggagaagacauucug

SEQ ID NO: 1819492 - RNA, 23 nt, Homo sapiens
ugcuggaaauggacacagucuaa

SEQ ID NO: 1819493 - RNA, 17 nt, Homo sapiens
uaaagaaaugcacuugc

SEQ ID NO: 1819494 - RNA, 14 nt, Homo sapiens
gcuccagagggcac

SEQ ID NO: 1819495 - RNA, 14 nt, Homo sapiens
cuuucuaaugggcu

SEQ ID NO: 1819496 - RNA, 12 nt, Homo sapiens
cacucaauggga

SEQ ID NO: 1819497 - RNA, 18 nt, Homo sapiens
ucuuguauacacauauau

SEQ ID NO: 1819498 - RNA, 11 nt, Homo sapiens
cacagcaguuu

SEQ ID NO: 1819499 - RNA, 21 nt, Homo sapiens
aagcaaagacuaugaggaaua

SEQ ID NO: 1819500 - RNA, 19 nt, Homo sapiens
cuucauauaccagcaauau

SEQ ID NO: 1819501 - RNA, 15 nt, Homo sapiens
uuaaagagucuagau

SEQ ID NO: 1819502 - RNA, 17 nt, Homo sapiens
gccaggcucugugcuga

SEQ ID NO: 1819503 - RNA, 12 nt, Homo sapiens
uguaaccuucca

SEQ ID NO: 1819504 - RNA, 21 nt, Homo sapiens
gcccucagccccacuucucag

SEQ ID NO: 1819505 - RNA, 15 nt, Homo sapiens
cucucuguggugaga

SEQ ID NO: 1819506 - RNA, 16 nt, Homo sapiens
auauucuuugguugug

SEQ ID NO: 1819507 - RNA, 13 nt, Homo sapiens
gauugcugcaaac

SEQ ID NO: 1819508 - RNA, 13 nt, Homo sapiens
cagcaaacugucc

SEQ ID NO: 1819509 - RNA, 15 nt, Homo sapiens
cugcugcaggacauu

SEQ ID NO: 1819510 - RNA, 16 nt, Homo sapiens
acuacagaaguggaag

SEQ ID NO: 1819511 - RNA, 16 nt, Homo sapiens
gucauggcagugccug

SEQ ID NO: 1819512 - RNA, 18 nt, Homo sapiens
cgugagagaaucugccug

SEQ ID NO: 1819513 - RNA, 17 nt, Homo sapiens
ucugacuccacucaaag

SEQ ID NO: 1819514 - RNA, 18 nt, Homo sapiens
ugcuaauggauguagcca

SEQ ID NO: 1819515 - RNA, 15 nt, Homo sapiens
uugaaaaacauacau

SEQ ID NO: 1819516 - RNA, 13 nt, Homo sapiens
ccuucagaucucu

SEQ ID NO: 1819517 - RNA, 19 nt, Homo sapiens
uaauaguauccagcacaga

SEQ ID NO: 1819518 - RNA, 19 nt, Homo sapiens
cccaggaggagaugaccag

SEQ ID NO: 1819519 - RNA, 19 nt, Homo sapiens
cugagcucgugaucugccc

SEQ ID NO: 1819520 - RNA, 21 nt, Homo sapiens
gaugaaggaaggacuaugaca

SEQ ID NO: 1819521 - RNA, 13 nt, Homo sapiens
uaagggaccucaa

SEQ ID NO: 1819522 - RNA, 19 nt, Homo sapiens
acucugcacaugucuugua

SEQ ID NO: 1819523 - RNA, 19 nt, Homo sapiens
agcagcacaauucuguccc

SEQ ID NO: 1819524 - RNA, 15 nt, Homo sapiens
uuacauccucugaua

SEQ ID NO: 1819525 - RNA, 13 nt, Homo sapiens
gggauguguccug

SEQ ID NO: 1819526 - RNA, 14 nt, Homo sapiens
aaccaggcagcccu

SEQ ID NO: 1819527 - RNA, 20 nt, Homo sapiens
acacuuuuuuuuaaagcuca

SEQ ID NO: 1819528 - RNA, 16 nt, Homo sapiens
gcaaaaguaaucacuu

SEQ ID NO: 1819529 - RNA, 15 nt, Homo sapiens
aauaauaugauuuau

SEQ ID NO: 1819530 - RNA, 14 nt, Homo sapiens
cugacauuuaucag

SEQ ID NO: 1819531 - RNA, 17 nt, Homo sapiens
cagccuccccgugccaa

SEQ ID NO: 1819532 - RNA, 16 nt, Homo sapiens
cuuucucuaauguugu

SEQ ID NO: 1819533 - RNA, 20 nt, Homo sapiens
gccacaauccacgcuucucc

SEQ ID NO: 1819534 - RNA, 14 nt, Homo sapiens
cagaagaaaggaac

SEQ ID NO: 1819535 - RNA, 19 nt, Homo sapiens
uccucgcucugggaugcag

SEQ ID NO: 1819536 - RNA, 11 nt, Homo sapiens
ggaaugucaua

SEQ ID NO: 1819537 - RNA, 16 nt, Homo sapiens
gagauaaaccaauaaa

SEQ ID NO: 1819538 - RNA, 16 nt, Homo sapiens
ccaugugugagugugu

SEQ ID NO: 1819539 - RNA, 19 nt, Homo sapiens
accugagcaggaccucuga

SEQ ID NO: 1819540 - RNA, 13 nt, Homo sapiens
ggcugaacaggcc

SEQ ID NO: 1819541 - RNA, 13 nt, Homo sapiens
uuauuucuaugaa

SEQ ID NO: 1819542 - RNA, 19 nt, Homo sapiens
aggcugggaggcucggggc

SEQ ID NO: 1819543 - RNA, 15 nt, Homo sapiens
ggcccuucacuucca

SEQ ID NO: 1819544 - RNA, 17 nt, Homo sapiens
aauacauacuaaugaag

SEQ ID NO: 1819545 - RNA, 16 nt, Homo sapiens
uagugaugaaccagag

SEQ ID NO: 1819546 - RNA, 22 nt, Homo sapiens
gaaaaagguauaugugauaaau

SEQ ID NO: 1819547 - RNA, 21 nt, Homo sapiens
uacuuuuuguaaaaagcuuca

SEQ ID NO: 1819548 - RNA, 15 nt, Homo sapiens
uuucugauaccacug

SEQ ID NO: 1819549 - RNA, 22 nt, Homo sapiens
ucaaagaaauccaaauuucuca

SEQ ID NO: 1819550 - RNA, 12 nt, Homo sapiens
caggaacccagc

SEQ ID NO: 1819551 - RNA, 11 nt, Homo sapiens
cucccagugac

SEQ ID NO: 1819552 - RNA, 20 nt, Homo sapiens
aggaaguucagucuugucuu

SEQ ID NO: 1819553 - RNA, 16 nt, Homo sapiens
aaacccaguaauucua

SEQ ID NO: 1819554 - RNA, 20 nt, Homo sapiens
acaguggcaggggcuggaga

SEQ ID NO: 1819555 - RNA, 16 nt, Homo sapiens
gucagcaugccucuag

SEQ ID NO: 1819556 - RNA, 19 nt, Homo sapiens
ggugggggugcugcucucu

SEQ ID NO: 1819557 - RNA, 15 nt, Homo sapiens
aggcccacuguaaua

SEQ ID NO: 1819558 - RNA, 15 nt, Homo sapiens
agauuuccuaacucu

SEQ ID NO: 1819559 - RNA, 11 nt, Homo sapiens
gucacauucag

SEQ ID NO: 1819560 - RNA, 14 nt, Homo sapiens
gcaggggaggggug

SEQ ID NO: 1819561 - RNA, 20 nt, Homo sapiens
gcucugaaucuguacauguu

SEQ ID NO: 1819562 - RNA, 22 nt, Homo sapiens
aucuuaccuugugcagucauca

SEQ ID NO: 1819563 - RNA, 17 nt, Homo sapiens
gcagccuccucugugac

SEQ ID NO: 1819564 - RNA, 18 nt, Homo sapiens
gcaggaagcucugaugca

SEQ ID NO: 1819565 - RNA, 11 nt, Homo sapiens
caaaacuguaa

SEQ ID NO: 1819566 - RNA, 12 nt, Homo sapiens
uagagcacuuuu

SEQ ID NO: 1819567 - RNA, 18 nt, Homo sapiens
caggcaccaucugccaau

SEQ ID NO: 1819568 - RNA, 18 nt, Homo sapiens
aaauaaacaccacaccca

SEQ ID NO: 1819569 - RNA, 12 nt, Homo sapiens
aauacaaacuau

SEQ ID NO: 1819570 - RNA, 15 nt, Homo sapiens
cgcaucaaaagacaa

SEQ ID NO: 1819571 - RNA, 13 nt, Homo sapiens
aaaacacagguuu

SEQ ID NO: 1819572 - RNA, 21 nt, Homo sapiens
gccaggccucugcuggcucag

SEQ ID NO: 1819573 - RNA, 17 nt, Homo sapiens
aacgccgcugacugcca

SEQ ID NO: 1819574 - RNA, 15 nt, Homo sapiens
ucaccccagacuccu

SEQ ID NO: 1819575 - RNA, 19 nt, Homo sapiens
acgugucuuccacuuugca

SEQ ID NO: 1819576 - RNA, 15 nt, Homo sapiens
cccuacccucacuca

SEQ ID NO: 1819577 - RNA, 17 nt, Homo sapiens
uucagcgaagucucaug

SEQ ID NO: 1819578 - RNA, 16 nt, Homo sapiens
ucccaucaauucuuag

SEQ ID NO: 1819579 - RNA, 23 nt, Homo sapiens
ucuaccaaaaaucucaauauuuc

SEQ ID NO: 1819580 - RNA, 15 nt, Homo sapiens
agcaauaaauaacac

SEQ ID NO: 1819581 - RNA, 21 nt, Homo sapiens
gaaaugggcuuuaacaaaaca

SEQ ID NO: 1819582 - RNA, 17 nt, Homo sapiens
acggagaucuccuugcc

SEQ ID NO: 1819583 - RNA, 14 nt, Homo sapiens
uugacuccacuuuu

SEQ ID NO: 1819584 - RNA, 19 nt, Homo sapiens
aauugacucucacacugaa

SEQ ID NO: 1819585 - RNA, 19 nt, Homo sapiens
caaguucauaguuucugua

SEQ ID NO: 1819586 - RNA, 17 nt, Homo sapiens
agacuugggaucugcaa

SEQ ID NO: 1819587 - RNA, 15 nt, Homo sapiens
ccaacucugcacucc

SEQ ID NO: 1819588 - RNA, 14 nt, Homo sapiens
cacaacucucuggu

SEQ ID NO: 1819589 - RNA, 19 nt, Homo sapiens
ugucugaagccauagccuc

SEQ ID NO: 1819590 - RNA, 14 nt, Homo sapiens
agcaauguaagugc

SEQ ID NO: 1819591 - RNA, 22 nt, Homo sapiens
cagcuggagaaauggcaucauu

SEQ ID NO: 1819592 - RNA, 14 nt, Homo sapiens
acaaugccuacuuc

SEQ ID NO: 1819593 - RNA, 14 nt, Homo sapiens
uccaagccaaauac

SEQ ID NO: 1819594 - RNA, 23 nt, Homo sapiens
cugccggggguucaggguuggua

SEQ ID NO: 1819595 - RNA, 15 nt, Homo sapiens
uaaaggaaaaucaca

SEQ ID NO: 1819596 - RNA, 23 nt, Homo sapiens
aucauggggaguaauaggaccag

SEQ ID NO: 1819597 - RNA, 20 nt, Homo sapiens
ugaagcuuuuuguugccuua

SEQ ID NO: 1819598 - RNA, 18 nt, Homo sapiens
cagcccuagagccugccu

SEQ ID NO: 1819599 - RNA, 12 nt, Homo sapiens
cuugucucucau

SEQ ID NO: 1819600 - RNA, 17 nt, Homo sapiens
agcaugaggacagacca

SEQ ID NO: 1819601 - RNA, 18 nt, Homo sapiens
agguacccaaggucacau

SEQ ID NO: 1819602 - RNA, 14 nt, Homo sapiens
ccagucgaccccaa

SEQ ID NO: 1819603 - RNA, 13 nt, Homo sapiens
gcaugaguuuaaa

SEQ ID NO: 1819604 - RNA, 19 nt, Homo sapiens
gggucucccucuguugcca

SEQ ID NO: 1819605 - RNA, 20 nt, Homo sapiens
gugcaugggucaggguguga

SEQ ID NO: 1819606 - RNA, 17 nt, Homo sapiens
ggaagcagcucaaggga

SEQ ID NO: 1819607 - RNA, 23 nt, Homo sapiens
caccaugcacuguaaauaucccu

SEQ ID NO: 1819608 - RNA, 16 nt, Homo sapiens
ucugcagaacauauca

SEQ ID NO: 1819609 - RNA, 15 nt, Homo sapiens
acugagagucugcac

SEQ ID NO: 1819610 - RNA, 17 nt, Homo sapiens
uugcuaccaaucuguga

SEQ ID NO: 1819611 - RNA, 15 nt, Homo sapiens
cugguauauacauau

SEQ ID NO: 1819612 - RNA, 13 nt, Homo sapiens
uuacaaaagaaga

SEQ ID NO: 1819613 - RNA, 20 nt, Homo sapiens
auauaacuaacaaccaaaga

SEQ ID NO: 1819614 - RNA, 18 nt, Homo sapiens
uucccgagggagcugcug

SEQ ID NO: 1819615 - RNA, 15 nt, Homo sapiens
ugaaauaaagaacca

SEQ ID NO: 1819616 - RNA, 19 nt, Homo sapiens
auugccacggaaacauaca

SEQ ID NO: 1819617 - RNA, 18 nt, Homo sapiens
ucuacuugaauacucuca

SEQ ID NO: 1819618 - RNA, 23 nt, Homo sapiens
ggcuacaaagcguuucuuuacuu

SEQ ID NO: 1819619 - RNA, 12 nt, Homo sapiens
gucacagacucg

SEQ ID NO: 1819620 - RNA, 15 nt, Homo sapiens
aggacagugcugacc

SEQ ID NO: 1819621 - RNA, 22 nt, Homo sapiens
acucagcugcuucuuuggucau

SEQ ID NO: 1819622 - RNA, 12 nt, Homo sapiens
gggcccaggacu

SEQ ID NO: 1819623 - RNA, 15 nt, Homo sapiens
acgagcgaaugauuu

SEQ ID NO: 1819624 - RNA, 15 nt, Homo sapiens
augcccccucaguga

SEQ ID NO: 1819625 - RNA, 9 nt, Homo sapiens
gcuggccaa

SEQ ID NO: 1819626 - RNA, 15 nt, Homo sapiens
aauuguuuggggaug

SEQ ID NO: 1819627 - RNA, 19 nt, Homo sapiens
ggaggugaccaaaucagug

SEQ ID NO: 1819628 - RNA, 15 nt, Homo sapiens
cagagauccaaaaga

SEQ ID NO: 1819629 - RNA, 19 nt, Homo sapiens
uucuucaugucaucaaaau

SEQ ID NO: 1819630 - RNA, 15 nt, Homo sapiens
gucucaauaaacuga

SEQ ID NO: 1819631 - RNA, 13 nt, Homo sapiens
guaaagaauuauu

SEQ ID NO: 1819632 - RNA, 12 nt, Homo sapiens
ggcaacugugag

SEQ ID NO: 1819633 - RNA, 21 nt, Homo sapiens
ugggcuaggguggucagagga

SEQ ID NO: 1819634 - RNA, 17 nt, Homo sapiens
gaucuggaagggccaag

SEQ ID NO: 1819635 - RNA, 23 nt, Homo sapiens
cccaguaggguuugacauuucau

SEQ ID NO: 1819636 - RNA, 18 nt, Homo sapiens
aaauucuguaauuugaau

SEQ ID NO: 1819637 - RNA, 19 nt, Homo sapiens
aaccagcugaaccuuucag

SEQ ID NO: 1819638 - RNA, 16 nt, Homo sapiens
caucaguaugucacuc

SEQ ID NO: 1819639 - RNA, 22 nt, Homo sapiens
ugcggggagccaucaccuagga

SEQ ID NO: 1819640 - RNA, 23 nt, Homo sapiens
agagagguuccuguuugaaccca

SEQ ID NO: 1819641 - RNA, 14 nt, Homo sapiens
aaguucucauugaa

SEQ ID NO: 1819642 - RNA, 23 nt, Homo sapiens
cagagauaaagcuuaggucaaag

SEQ ID NO: 1819643 - RNA, 20 nt, Homo sapiens
ccucuaacauuugcaaaaug

SEQ ID NO: 1819644 - RNA, 22 nt, Homo sapiens
uggccacgugggcaaacaggca

SEQ ID NO: 1819645 - RNA, 21 nt, Homo sapiens
ccaaugguccuagaacuuugu

SEQ ID NO: 1819646 - RNA, 19 nt, Homo sapiens
cacagaaggggacugccac

SEQ ID NO: 1819647 - RNA, 13 nt, Homo sapiens
uuguggugugcca

SEQ ID NO: 1819648 - RNA, 20 nt, Homo sapiens
acgguggugcaugccuguaa

SEQ ID NO: 1819649 - RNA, 17 nt, Homo sapiens
accccugccuacuuccu

SEQ ID NO: 1819650 - RNA, 19 nt, Homo sapiens
cacuugcacgcccaugugu

SEQ ID NO: 1819651 - RNA, 16 nt, Homo sapiens
gagcuaugauaugugc

SEQ ID NO: 1819652 - RNA, 22 nt, Homo sapiens
uagcaguaugugugcucuuauc

SEQ ID NO: 1819653 - RNA, 15 nt, Homo sapiens
uuuauaaccaugaga

SEQ ID NO: 1819654 - RNA, 12 nt, Homo sapiens
gccccaugggcc

SEQ ID NO: 1819655 - RNA, 18 nt, Homo sapiens
uuauuuaaaacucaccuc

SEQ ID NO: 1819656 - RNA, 19 nt, Homo sapiens
acaaaaaagaaaaguagaa

SEQ ID NO: 1819657 - RNA, 19 nt, Homo sapiens
uguugcaccaggcacugcu

SEQ ID NO: 1819658 - RNA, 19 nt, Homo sapiens
caaacgaaaaacauuucaa

SEQ ID NO: 1819659 - RNA, 14 nt, Homo sapiens
ucuucuccaucucc

SEQ ID NO: 1819660 - RNA, 15 nt, Homo sapiens
acauucaucaauauc

SEQ ID NO: 1819661 - RNA, 12 nt, Homo sapiens
acccagucccac

SEQ ID NO: 1819662 - RNA, 16 nt, Homo sapiens
aaaugcagaaccacaa

SEQ ID NO: 1819663 - RNA, 21 nt, Homo sapiens
caguguauguacuaagcagua

SEQ ID NO: 1819664 - RNA, 11 nt, Homo sapiens
ccacucaggcc

SEQ ID NO: 1819665 - RNA, 14 nt, Homo sapiens
guuuuaaaguucau

SEQ ID NO: 1819666 - RNA, 12 nt, Homo sapiens
cuccagcugucu

SEQ ID NO: 1819667 - RNA, 15 nt, Homo sapiens
agcccaagugccauc

SEQ ID NO: 1819668 - RNA, 14 nt, Homo sapiens
ugcauauagauuua

SEQ ID NO: 1819669 - RNA, 11 nt, Homo sapiens
cugaagccaca

SEQ ID NO: 1819670 - RNA, 21 nt, Homo sapiens
auuuauacuaaauguauuccu

SEQ ID NO: 1819671 - RNA, 23 nt, Homo sapiens
ccacucucgcucuggauuccauu

SEQ ID NO: 1819672 - RNA, 13 nt, Homo sapiens
aauacuucacaca

SEQ ID NO: 1819673 - RNA, 13 nt, Homo sapiens
aggaggaucacuu

SEQ ID NO: 1819674 - RNA, 11 nt, Homo sapiens
ggauggcacuc

SEQ ID NO: 1819675 - RNA, 22 nt, Homo sapiens
ccaugcuguuuucccuuugcca

SEQ ID NO: 1819676 - RNA, 20 nt, Homo sapiens
uuccagacaggguggggcuu

SEQ ID NO: 1819677 - RNA, 15 nt, Homo sapiens
cuguugcuguugcug

SEQ ID NO: 1819678 - RNA, 15 nt, Homo sapiens
cucagcauuguguac

SEQ ID NO: 1819679 - RNA, 17 nt, Homo sapiens
acuguguuucugugcuc

SEQ ID NO: 1819680 - RNA, 19 nt, Homo sapiens
uuccaguaggaaaagcaau

SEQ ID NO: 1819681 - RNA, 14 nt, Homo sapiens
ugaccucagcuuug

SEQ ID NO: 1819682 - RNA, 13 nt, Homo sapiens
gccucucccugcc

SEQ ID NO: 1819683 - RNA, 15 nt, Homo sapiens
uagcugggaccacag

SEQ ID NO: 1819684 - RNA, 15 nt, Homo sapiens
uggggcuccuaccug

SEQ ID NO: 1819685 - RNA, 13 nt, Homo sapiens
cugcugaucucag

SEQ ID NO: 1819686 - RNA, 13 nt, Homo sapiens
cagcugaucacag

SEQ ID NO: 1819687 - RNA, 22 nt, Homo sapiens
aauguuuaaaagcaaaacugca

SEQ ID NO: 1819688 - RNA, 13 nt, Homo sapiens
aauucucuuucac

SEQ ID NO: 1819689 - RNA, 14 nt, Homo sapiens
auacaaacaaugca

SEQ ID NO: 1819690 - RNA, 14 nt, Homo sapiens
auuccuacaaagau

SEQ ID NO: 1819691 - RNA, 12 nt, Homo sapiens
cuccagccagag

SEQ ID NO: 1819692 - RNA, 12 nt, Homo sapiens
cuacagccagcg

SEQ ID NO: 1819693 - RNA, 14 nt, Homo sapiens
gaaacuuacuaaaa

SEQ ID NO: 1819694 - RNA, 21 nt, Homo sapiens
uacauauaucuacacauacag

SEQ ID NO: 1819695 - RNA, 20 nt, Homo sapiens
cccagcucugguccauagag

SEQ ID NO: 1819696 - RNA, 16 nt, Homo sapiens
uugggacccaguggca

SEQ ID NO: 1819697 - RNA, 24 nt, Homo sapiens
ccucagacccagcgguccaaugcc

SEQ ID NO: 1819698 - RNA, 23 nt, Homo sapiens
agaaccacggugaaagugcugcu

SEQ ID NO: 1819699 - RNA, 20 nt, Homo sapiens
ccccagugggaacugugcaa

SEQ ID NO: 1819700 - RNA, 16 nt, Homo sapiens
caccuagaacacuaac

SEQ ID NO: 1819701 - RNA, 18 nt, Homo sapiens
uguggcuuuuaugcuuuc

SEQ ID NO: 1819702 - RNA, 16 nt, Homo sapiens
ccuucuugucauugaa

SEQ ID NO: 1819703 - RNA, 16 nt, Homo sapiens
ccuccuugucacugaa

SEQ ID NO: 1819704 - RNA, 11 nt, Homo sapiens
aguuugcaguu

SEQ ID NO: 1819705 - RNA, 23 nt, Homo sapiens
auauguuuguucuuggacuuuau

SEQ ID NO: 1819706 - RNA, 16 nt, Homo sapiens
ccuguauucucagcac

SEQ ID NO: 1819707 - RNA, 22 nt, Homo sapiens
acugucagggagggccagggag

SEQ ID NO: 1819708 - RNA, 19 nt, Homo sapiens
caaauauuugaucacuuaa

SEQ ID NO: 1819709 - RNA, 20 nt, Homo sapiens
cccagagcaggaagcauuca

SEQ ID NO: 1819710 - RNA, 23 nt, Homo sapiens
cuacccagacucagagaccguga

SEQ ID NO: 1819711 - RNA, 18 nt, Homo sapiens
aucaccugaaacacugga

SEQ ID NO: 1819712 - RNA, 17 nt, Homo sapiens
ccaagauuuuuuauuug

SEQ ID NO: 1819713 - RNA, 19 nt, Homo sapiens
cuucugaacuacacugcau

SEQ ID NO: 1819714 - RNA, 16 nt, Homo sapiens
cugugcugguguccug

SEQ ID NO: 1819715 - RNA, 15 nt, Homo sapiens
aucccagcuacucaa

SEQ ID NO: 1819716 - RNA, 20 nt, Homo sapiens
uucagccuagccgaccucag

SEQ ID NO: 1819717 - RNA, 15 nt, Homo sapiens
gcuauuguagagcca

SEQ ID NO: 1819718 - RNA, 21 nt, Homo sapiens
cagugcuggggaacaaccaga

SEQ ID NO: 1819719 - RNA, 20 nt, Homo sapiens
augaagucuuguucagggua

SEQ ID NO: 1819720 - RNA, 20 nt, Homo sapiens
agaaugucaauaaauuugcu

SEQ ID NO: 1819721 - RNA, 19 nt, Homo sapiens
aaguagaucuuuucuugac

SEQ ID NO: 1819722 - RNA, 14 nt, Homo sapiens
cccguuucuugccc

SEQ ID NO: 1819723 - RNA, 16 nt, Homo sapiens
uuacaguuugagacuu

SEQ ID NO: 1819724 - RNA, 21 nt, Homo sapiens
gcuuucuccauuguaaaccac

SEQ ID NO: 1819725 - RNA, 16 nt, Homo sapiens
aguuugauaccugcac

SEQ ID NO: 1819726 - RNA, 20 nt, Homo sapiens
gaaauuuuuaccaacucuau

SEQ ID NO: 1819727 - RNA, 16 nt, Homo sapiens
ggcucugaacugcaca

SEQ ID NO: 1819728 - RNA, 19 nt, Homo sapiens
ugagugccuguaaucacag

SEQ ID NO: 1819729 - RNA, 17 nt, Homo sapiens
cauugggucuauuccag

SEQ ID NO: 1819730 - RNA, 19 nt, Homo sapiens
aauauggacaaagaaggca

SEQ ID NO: 1819731 - RNA, 16 nt, Homo sapiens
ucaucccauugucuuc

SEQ ID NO: 1819732 - RNA, 16 nt, Homo sapiens
uacaaacaagcacaga

SEQ ID NO: 1819733 - RNA, 18 nt, Homo sapiens
aaaggucuaguauccaaa

SEQ ID NO: 1819734 - RNA, 23 nt, Homo sapiens
augaugggggaaaaaaaguaauc

SEQ ID NO: 1819735 - RNA, 22 nt, Homo sapiens
gacaagaauuguuaccugucau

SEQ ID NO: 1819736 - RNA, 23 nt, Homo sapiens
acaucuggcuuauuuuaauguga

SEQ ID NO: 1819737 - RNA, 11 nt, Homo sapiens
agauguuccuc

SEQ ID NO: 1819738 - RNA, 20 nt, Homo sapiens
aagcuuaaacauugccuuau

SEQ ID NO: 1819739 - RNA, 18 nt, Homo sapiens
gggcuacaguccuuccag

SEQ ID NO: 1819740 - RNA, 15 nt, Homo sapiens
aagaaccauugauuu

SEQ ID NO: 1819741 - RNA, 19 nt, Homo sapiens
agaaucacuuaagccugga

SEQ ID NO: 1819742 - RNA, 19 nt, Homo sapiens
agagauggaauaaagcccu

SEQ ID NO: 1819743 - RNA, 19 nt, Homo sapiens
guguucuacacucaucuua

SEQ ID NO: 1819744 - RNA, 16 nt, Homo sapiens
auauaaguacugacca

SEQ ID NO: 1819745 - RNA, 18 nt, Homo sapiens
uaugacugauuacucaga

SEQ ID NO: 1819746 - RNA, 20 nt, Homo sapiens
cuaauguaccaaugaugaau

SEQ ID NO: 1819747 - RNA, 11 nt, Homo sapiens
aagagaagcuu

SEQ ID NO: 1819748 - RNA, 22 nt, Homo sapiens
agaagagugcccugcuuugcaa

SEQ ID NO: 1819749 - RNA, 22 nt, Homo sapiens
ugagaaggucacuacugcauuu

SEQ ID NO: 1819750 - RNA, 21 nt, Homo sapiens
uuucugauaaaagauggccau

SEQ ID NO: 1819751 - RNA, 22 nt, Homo sapiens
aaaaaagauuuguagagucaau

SEQ ID NO: 1819752 - RNA, 13 nt, Homo sapiens
gaagccagugucu

SEQ ID NO: 1819753 - RNA, 17 nt, Homo sapiens
ccagccguauuuuacau

SEQ ID NO: 1819754 - RNA, 16 nt, Homo sapiens
gggccucccacuccca

SEQ ID NO: 1819755 - RNA, 13 nt, Homo sapiens
gcuucagccugag

SEQ ID NO: 1819756 - RNA, 21 nt, Homo sapiens
cacagaggauggcuuccccau

SEQ ID NO: 1819757 - RNA, 13 nt, Homo sapiens
gauucuucacugu

SEQ ID NO: 1819758 - RNA, 15 nt, Homo sapiens
gaucuuugagcccau

SEQ ID NO: 1819759 - RNA, 19 nt, Homo sapiens
gugcugggugggcaucuca

SEQ ID NO: 1819760 - RNA, 19 nt, Homo sapiens
uuggaaaacauaaaaauca

SEQ ID NO: 1819761 - RNA, 18 nt, Homo sapiens
uaaggcucugugccuugg

SEQ ID NO: 1819762 - RNA, 18 nt, Homo sapiens
uaccuccuguguggaaga

SEQ ID NO: 1819763 - RNA, 21 nt, Homo sapiens
cacucuugccaaccuguaaua

SEQ ID NO: 1819764 - RNA, 18 nt, Homo sapiens
aaguauuacugaguauua

SEQ ID NO: 1819765 - RNA, 22 nt, Homo sapiens
cugccaacuccaugaccaggcc

SEQ ID NO: 1819766 - RNA, 16 nt, Homo sapiens
gcccagagccaagcug

SEQ ID NO: 1819767 - RNA, 14 nt, Homo sapiens
caaaaccuguauua

SEQ ID NO: 1819768 - RNA, 16 nt, Homo sapiens
ucugaugggucccaaa

SEQ ID NO: 1819769 - RNA, 14 nt, Homo sapiens
aacugcacugucaa

SEQ ID NO: 1819770 - RNA, 20 nt, Homo sapiens
agcuuacugauaaaccuaau

SEQ ID NO: 1819771 - RNA, 21 nt, Homo sapiens
caguucuagaagccacagugc

SEQ ID NO: 1819772 - RNA, 14 nt, Homo sapiens
uaucacgauauuau

SEQ ID NO: 1819773 - RNA, 13 nt, Homo sapiens
gccugcauucugc

SEQ ID NO: 1819774 - RNA, 23 nt, Homo sapiens
uucccuggucuggcucugcugga

SEQ ID NO: 1819775 - RNA, 18 nt, Homo sapiens
aggauacgacaguacacu

SEQ ID NO: 1819776 - RNA, 19 nt, Homo sapiens
cacuccuggacaaccugga

SEQ ID NO: 1819777 - RNA, 22 nt, Homo sapiens
agggaaaugacuucuccaggca

SEQ ID NO: 1819778 - RNA, 15 nt, Homo sapiens
gaauauugcaaaaua

SEQ ID NO: 1819779 - RNA, 23 nt, Homo sapiens
cucagcaugcauccuuugcacug

SEQ ID NO: 1819780 - RNA, 19 nt, Homo sapiens
acccagauuuccuaacucu

SEQ ID NO: 1819781 - RNA, 18 nt, Homo sapiens
uuucccguuagucucuga

SEQ ID NO: 1819782 - RNA, 16 nt, Homo sapiens
agaaggacaugugcua

SEQ ID NO: 1819783 - RNA, 20 nt, Homo sapiens
aucuacaaaaauuuauuaua

SEQ ID NO: 1819784 - RNA, 18 nt, Homo sapiens
agcagaagcucucgaugg

SEQ ID NO: 1819785 - RNA, 16 nt, Homo sapiens
gccucugcauauaugu

SEQ ID NO: 1819786 - RNA, 13 nt, Homo sapiens
gcccugucaucca

SEQ ID NO: 1819787 - RNA, 14 nt, Homo sapiens
aagagccauguacc

SEQ ID NO: 1819788 - RNA, 18 nt, Homo sapiens
uacauucccaucuacuaa

SEQ ID NO: 1819789 - RNA, 23 nt, Homo sapiens
cugcaaaaauauaaccauuacau

SEQ ID NO: 1819790 - RNA, 16 nt, Homo sapiens
agucagacugucagaa

SEQ ID NO: 1819791 - RNA, 14 nt, Homo sapiens
uggacauggcucac

SEQ ID NO: 1819792 - RNA, 22 nt, Homo sapiens
aaugcagucagucacaaaccag

SEQ ID NO: 1819793 - RNA, 19 nt, Homo sapiens
ugucaucuuucuuguuuca

SEQ ID NO: 1819794 - RNA, 21 nt, Homo sapiens
ucucuaaaugugacaugcaaa

SEQ ID NO: 1819795 - RNA, 20 nt, Homo sapiens
ucagauauuaauaauuccaa

SEQ ID NO: 1819796 - RNA, 14 nt, Homo sapiens
uguuaucagucaua

SEQ ID NO: 1819797 - RNA, 16 nt, Homo sapiens
cugagucagagccaug

SEQ ID NO: 1819798 - RNA, 19 nt, Homo sapiens
caucaucagucuuaauauu

SEQ ID NO: 1819799 - RNA, 12 nt, Homo sapiens
ugaauaucgaga

SEQ ID NO: 1819800 - RNA, 20 nt, Homo sapiens
aacucauuugagaucagucu

SEQ ID NO: 1819801 - RNA, 13 nt, Homo sapiens
ccugcguggcuga

SEQ ID NO: 1819802 - RNA, 13 nt, Homo sapiens
aagagaccaaaaa

SEQ ID NO: 1819803 - RNA, 14 nt, Homo sapiens
auucuucaauuuga

SEQ ID NO: 1819804 - RNA, 22 nt, Homo sapiens
aagacucuacccauauuacaga

SEQ ID NO: 1819805 - RNA, 17 nt, Homo sapiens
ucuagcacaucauggca

SEQ ID NO: 1819806 - RNA, 19 nt, Homo sapiens
gucacagauucuuuucuau

SEQ ID NO: 1819807 - RNA, 18 nt, Homo sapiens
uggcauuuuggcucagag

SEQ ID NO: 1819808 - RNA, 11 nt, Homo sapiens
acuacagugag

SEQ ID NO: 1819809 - RNA, 21 nt, Homo sapiens
uucaguauguugucaaagaga

SEQ ID NO: 1819810 - RNA, 17 nt, Homo sapiens
cucuuuucaaaacauuu

SEQ ID NO: 1819811 - RNA, 24 nt, Homo sapiens
cuauaaaaugcaguaacauucuac

SEQ ID NO: 1819812 - RNA, 14 nt, Homo sapiens
ucuuauaucccagg

SEQ ID NO: 1819813 - RNA, 21 nt, Homo sapiens
agucacuuugccagagccuga

SEQ ID NO: 1819814 - RNA, 23 nt, Homo sapiens
agaucuguccugggggaugcaaa

SEQ ID NO: 1819815 - RNA, 14 nt, Homo sapiens
gaaggugcuuugua

SEQ ID NO: 1819816 - RNA, 14 nt, Homo sapiens
uccaaaggccaugg

SEQ ID NO: 1819817 - RNA, 16 nt, Homo sapiens
cuugccuguuuuucaa

SEQ ID NO: 1819818 - RNA, 20 nt, Homo sapiens
ccuauggcagagcauccucu

SEQ ID NO: 1819819 - RNA, 17 nt, Homo sapiens
acuuugugccaaaugac

SEQ ID NO: 1819820 - RNA, 16 nt, Homo sapiens
cugauaagacaugaaa

SEQ ID NO: 1819821 - RNA, 10 nt, Homo sapiens
gcacuuugaa

SEQ ID NO: 1819822 - RNA, 23 nt, Homo sapiens
aguguggccacgugggcaaacag

SEQ ID NO: 1819823 - RNA, 19 nt, Homo sapiens
cuuugaagcaguuguguca

SEQ ID NO: 1819824 - RNA, 20 nt, Homo sapiens
agguaaugcacauccucauu

SEQ ID NO: 1819825 - RNA, 15 nt, Homo sapiens
ugcgguaggugcugg

SEQ ID NO: 1819826 - RNA, 13 nt, Homo sapiens
aguguguaaaauu

SEQ ID NO: 1819827 - RNA, 14 nt, Homo sapiens
augacucaaggcca

SEQ ID NO: 1819828 - RNA, 15 nt, Homo sapiens
aaacgagauuugcca

SEQ ID NO: 1819829 - RNA, 16 nt, Homo sapiens
ugacaacuuagcucag

SEQ ID NO: 1819830 - RNA, 20 nt, Homo sapiens
caaauguccucaacugucau

SEQ ID NO: 1819831 - RNA, 16 nt, Homo sapiens
agucaauuacucuaua

SEQ ID NO: 1819832 - RNA, 19 nt, Homo sapiens
ucagagggccucaucucag

SEQ ID NO: 1819833 - RNA, 16 nt, Homo sapiens
aauaaaugugacucag

SEQ ID NO: 1819834 - RNA, 17 nt, Homo sapiens
ggucaggagggugcagu

SEQ ID NO: 1819835 - RNA, 18 nt, Homo sapiens
uaauguugcccaguguga

SEQ ID NO: 1819836 - RNA, 16 nt, Homo sapiens
ccugcuagcuguagaa

SEQ ID NO: 1819837 - RNA, 16 nt, Homo sapiens
ucacagaggucuuuca

SEQ ID NO: 1819838 - RNA, 12 nt, Homo sapiens
auugacuucuuu

SEQ ID NO: 1819839 - RNA, 19 nt, Homo sapiens
ccuuauuaaugaucagcua

SEQ ID NO: 1819840 - RNA, 13 nt, Homo sapiens
gagauucuucccc

SEQ ID NO: 1819841 - RNA, 17 nt, Homo sapiens
guugccauggauucacc

SEQ ID NO: 1819842 - RNA, 16 nt, Homo sapiens
acaaauaggcucugcc

SEQ ID NO: 1819843 - RNA, 23 nt, Homo sapiens
agacugccuucuccaucaugccc

SEQ ID NO: 1819844 - RNA, 20 nt, Homo sapiens
gagcugggggaagaagggau

SEQ ID NO: 1819845 - RNA, 20 nt, Homo sapiens
gccauccauuugugcaaaau

SEQ ID NO: 1819846 - RNA, 19 nt, Homo sapiens
auaugugguuugguaguau

SEQ ID NO: 1819847 - RNA, 19 nt, Homo sapiens
cuauuaaaugagcacguuu

SEQ ID NO: 1819848 - RNA, 13 nt, Homo sapiens
gauaaaagcaauu

SEQ ID NO: 1819849 - RNA, 20 nt, Homo sapiens
ucucacugucugcuggcaaa

SEQ ID NO: 1819850 - RNA, 23 nt, Homo sapiens
gcguauccuaugguaacugauga

SEQ ID NO: 1819851 - RNA, 15 nt, Homo sapiens
cucagccacuugccu

SEQ ID NO: 1819852 - RNA, 16 nt, Homo sapiens
aagaaaaaaguacaga

SEQ ID NO: 1819853 - RNA, 19 nt, Homo sapiens
uucuuggagcuuuggaaua

SEQ ID NO: 1819854 - RNA, 17 nt, Homo sapiens
agaguaggaagacuuug

SEQ ID NO: 1819855 - RNA, 19 nt, Homo sapiens
uagugaacagguucuccag

SEQ ID NO: 1819856 - RNA, 19 nt, Homo sapiens
auuuugcuaaaugugaaug

SEQ ID NO: 1819857 - RNA, 14 nt, Homo sapiens
acaaacaauaugaa

SEQ ID NO: 1819858 - RNA, 17 nt, Homo sapiens
gauauggugaagggaag

SEQ ID NO: 1819859 - RNA, 12 nt, Homo sapiens
gccacacucugg

SEQ ID NO: 1819860 - RNA, 16 nt, Homo sapiens
ggagaacugggguuca

SEQ ID NO: 1819861 - RNA, 18 nt, Homo sapiens
gggucgucuuuguguaug

SEQ ID NO: 1819862 - RNA, 18 nt, Homo sapiens
aauauucaugcuugccau

SEQ ID NO: 1819863 - RNA, 16 nt, Homo sapiens
cuggccgcaugaccac

SEQ ID NO: 1819864 - RNA, 15 nt, Homo sapiens
auauguucacaguua

SEQ ID NO: 1819865 - RNA, 12 nt, Homo sapiens
gcugagugcagc

SEQ ID NO: 1819866 - RNA, 11 nt, Homo sapiens
aaccauuguug

SEQ ID NO: 1819867 - RNA, 21 nt, Homo sapiens
agagcaacaauccaucucuca

SEQ ID NO: 1819868 - RNA, 17 nt, Homo sapiens
caguccugguugucuga

SEQ ID NO: 1819869 - RNA, 21 nt, Homo sapiens
uauuuuuuuuaacugcauucu

SEQ ID NO: 1819870 - RNA, 12 nt, Homo sapiens
auuucucugcac

SEQ ID NO: 1819871 - RNA, 18 nt, Homo sapiens
uucuguccucuucuguga

SEQ ID NO: 1819872 - RNA, 13 nt, Homo sapiens
ugaaccaucucag

SEQ ID NO: 1819873 - RNA, 23 nt, Homo sapiens
caugggugcagacccugaaccca

SEQ ID NO: 1819874 - RNA, 21 nt, Homo sapiens
ugcaggcccaccccagccacc

SEQ ID NO: 1819875 - RNA, 13 nt, Homo sapiens
ucccuaccuacca

SEQ ID NO: 1819876 - RNA, 20 nt, Homo sapiens
uggcccccucauucagagac

SEQ ID NO: 1819877 - RNA, 21 nt, Homo sapiens
uaucuguguagacuauuugcu

SEQ ID NO: 1819878 - RNA, 13 nt, Homo sapiens
acaaccuuugugu

SEQ ID NO: 1819879 - RNA, 22 nt, Homo sapiens
uauaauaacuuuauugcauaua

SEQ ID NO: 1819880 - RNA, 22 nt, Homo sapiens
uaggcaaacuuuuaugcaggca

SEQ ID NO: 1819881 - RNA, 20 nt, Homo sapiens
gccuucuuuuguacuuuuca

SEQ ID NO: 1819882 - RNA, 20 nt, Homo sapiens
aggauugugcugauguagug

SEQ ID NO: 1819883 - RNA, 18 nt, Homo sapiens
acauuaccuuacugugga

SEQ ID NO: 1819884 - RNA, 18 nt, Homo sapiens
acccuccccacagugcca

SEQ ID NO: 1819885 - RNA, 22 nt, Homo sapiens
aaaggaccuucccaagucuccc

SEQ ID NO: 1819886 - RNA, 22 nt, Homo sapiens
cccaaaagcccauucauuccau

SEQ ID NO: 1819887 - RNA, 19 nt, Homo sapiens
aguuuaccuauguaacaaa

SEQ ID NO: 1819888 - RNA, 17 nt, Homo sapiens
agucacucaucucagaa

SEQ ID NO: 1819889 - RNA, 14 nt, Homo sapiens
uaaagcagaagcaa

SEQ ID NO: 1819890 - RNA, 13 nt, Homo sapiens
cacucuucuugca

SEQ ID NO: 1819891 - RNA, 18 nt, Homo sapiens
caucccucucacccagaa

SEQ ID NO: 1819892 - RNA, 19 nt, Homo sapiens
caucaauuccaucagcaca

SEQ ID NO: 1819893 - RNA, 23 nt, Homo sapiens
gaaauaaaguauuuaucuccugu

SEQ ID NO: 1819894 - RNA, 18 nt, Homo sapiens
aagcccaguaacugcccu

SEQ ID NO: 1819895 - RNA, 19 nt, Homo sapiens
ugguagcgggcgccuguag

SEQ ID NO: 1819896 - RNA, 19 nt, Homo sapiens
gacuugcccucucccuucc

SEQ ID NO: 1819897 - RNA, 22 nt, Homo sapiens
uuuaagcagcucuugcuaauca

SEQ ID NO: 1819898 - RNA, 19 nt, Homo sapiens
gccucugcccagauuugcc

SEQ ID NO: 1819899 - RNA, 22 nt, Homo sapiens
uuguucauccaaggaaccuaau

SEQ ID NO: 1819900 - RNA, 17 nt, Homo sapiens
uggggcuuuuuccaucu

SEQ ID NO: 1819901 - RNA, 21 nt, Homo sapiens
uuaggucaguuuagcaagaac

SEQ ID NO: 1819902 - RNA, 15 nt, Homo sapiens
aauuacaauuucuuu

SEQ ID NO: 1819903 - RNA, 22 nt, Homo sapiens
cagaugcaagacacugugccac

SEQ ID NO: 1819904 - RNA, 16 nt, Homo sapiens
acuucccacggcuccu

SEQ ID NO: 1819905 - RNA, 13 nt, Homo sapiens
agcauaauuccuc

SEQ ID NO: 1819906 - RNA, 21 nt, Homo sapiens
ugcaucaauuuaccuacucua

SEQ ID NO: 1819907 - RNA, 21 nt, Homo sapiens
cauaagaauuuuuuauaagua

SEQ ID NO: 1819908 - RNA, 13 nt, Homo sapiens
cgacggcugugac

SEQ ID NO: 1819909 - RNA, 15 nt, Homo sapiens
uaaacuuuagugcua

SEQ ID NO: 1819910 - RNA, 19 nt, Homo sapiens
gugcaaaaaaaaacuuaaa

SEQ ID NO: 1819911 - RNA, 23 nt, Homo sapiens
acccaucugcucaccagaucuca

SEQ ID NO: 1819912 - RNA, 22 nt, Homo sapiens
gcauaccaauuacccauaaaca

SEQ ID NO: 1819913 - RNA, 14 nt, Homo sapiens
aauaaaaacacuua

SEQ ID NO: 1819914 - RNA, 14 nt, Homo sapiens
aauuaccuugccaa

SEQ ID NO: 1819915 - RNA, 16 nt, Homo sapiens
ucugcuucagugcagu

SEQ ID NO: 1819916 - RNA, 17 nt, Homo sapiens
aucacggcucacugcag

SEQ ID NO: 1819917 - RNA, 22 nt, Homo sapiens
gguaacuaagaagugguguucc

SEQ ID NO: 1819918 - RNA, 20 nt, Homo sapiens
aauucacccaccagacuuuu

SEQ ID NO: 1819919 - RNA, 13 nt, Homo sapiens
aaggucucuggag

SEQ ID NO: 1819920 - RNA, 22 nt, Homo sapiens
ugcaaaaacucuuauggccaaa

SEQ ID NO: 1819921 - RNA, 17 nt, Homo sapiens
aaucaacagcaugucua

SEQ ID NO: 1819922 - RNA, 22 nt, Homo sapiens
aacaaucugcuuucuuuguaac

SEQ ID NO: 1819923 - RNA, 19 nt, Homo sapiens
agccagagccugucuuuca

SEQ ID NO: 1819924 - RNA, 12 nt, Homo sapiens
aggacugaacaa

SEQ ID NO: 1819925 - RNA, 16 nt, Homo sapiens
aaccaaauaagcaucu

SEQ ID NO: 1819926 - RNA, 18 nt, Homo sapiens
uauaaaugccagagccaa

SEQ ID NO: 1819927 - RNA, 23 nt, Homo sapiens
cucaacauggaaaaauccuguca

SEQ ID NO: 1819928 - RNA, 15 nt, Homo sapiens
gcuccgggcuuucac

SEQ ID NO: 1819929 - RNA, 21 nt, Homo sapiens
ccaagcuguuccacuucucua

SEQ ID NO: 1819930 - RNA, 15 nt, Homo sapiens
uauggaaugccaaaa

SEQ ID NO: 1819931 - RNA, 15 nt, Homo sapiens
uacuuuaaaauuaca

SEQ ID NO: 1819932 - RNA, 23 nt, Homo sapiens
aaucacugcucacacugcugaug

SEQ ID NO: 1819933 - RNA, 16 nt, Homo sapiens
auaaccaacauuuuaa

SEQ ID NO: 1819934 - RNA, 13 nt, Homo sapiens
ccuaagugccucu

SEQ ID NO: 1819935 - RNA, 15 nt, Homo sapiens
cauaaccauacacag

SEQ ID NO: 1819936 - RNA, 15 nt, Homo sapiens
agguuuuuaugcaug

SEQ ID NO: 1819937 - RNA, 11 nt, Homo sapiens
acauugaacaa

SEQ ID NO: 1819938 - RNA, 19 nt, Homo sapiens
auuuacugacauauaucua

SEQ ID NO: 1819939 - RNA, 16 nt, Homo sapiens
cauuuauuugacauag

SEQ ID NO: 1819940 - RNA, 14 nt, Homo sapiens
cucaguggguggua

SEQ ID NO: 1819941 - RNA, 17 nt, Homo sapiens
ugaccucaucacugaga

SEQ ID NO: 1819942 - RNA, 18 nt, Homo sapiens
cagggcccccaaagagca

SEQ ID NO: 1819943 - RNA, 22 nt, Homo sapiens
gaagccuccguggaacauucug

SEQ ID NO: 1819944 - RNA, 20 nt, Homo sapiens
agcagagcccccauggccua

SEQ ID NO: 1819945 - RNA, 11 nt, Homo sapiens
uauacauauca

SEQ ID NO: 1819946 - RNA, 15 nt, Homo sapiens
cagcaguaccaucua

SEQ ID NO: 1819947 - RNA, 21 nt, Homo sapiens
gguuuaacaaaauguauguga

SEQ ID NO: 1819948 - RNA, 21 nt, Homo sapiens
cuucauaagauauucuuuaca

SEQ ID NO: 1819949 - RNA, 21 nt, Homo sapiens
cuuuuuggcugacuucaucug

SEQ ID NO: 1819950 - RNA, 15 nt, Homo sapiens
augucaacaccagaa

SEQ ID NO: 1819951 - RNA, 23 nt, Homo sapiens
ucaaucucagcuaacauuccaug

SEQ ID NO: 1819952 - RNA, 19 nt, Homo sapiens
agucacugacccugugcag

SEQ ID NO: 1819953 - RNA, 22 nt, Homo sapiens
gugaugacuuagcgucaagaca

SEQ ID NO: 1819954 - RNA, 16 nt, Homo sapiens
cauauuaccacagaca

SEQ ID NO: 1819955 - RNA, 12 nt, Homo sapiens
uccugccuugau

SEQ ID NO: 1819956 - RNA, 23 nt, Homo sapiens
cagguagcugggauuacaggcau

SEQ ID NO: 1819957 - RNA, 23 nt, Homo sapiens
aaagagagagauacaucuuauaa

SEQ ID NO: 1819958 - RNA, 20 nt, Homo sapiens
ugagggucucuuucuuuucu

SEQ ID NO: 1819959 - RNA, 21 nt, Homo sapiens
ucagccccugaucucugaccu

SEQ ID NO: 1819960 - RNA, 22 nt, Homo sapiens
auugauuaaugaacuauuguua

SEQ ID NO: 1819961 - RNA, 19 nt, Homo sapiens
cccugggcaaggaagcuuu

SEQ ID NO: 1819962 - RNA, 23 nt, Homo sapiens
gcccccagccccuccucccucaa

SEQ ID NO: 1819963 - RNA, 18 nt, Homo sapiens
gccuugcccagccuggau

SEQ ID NO: 1819964 - RNA, 19 nt, Homo sapiens
ucuaacuagaaaucugcca

SEQ ID NO: 1819965 - RNA, 14 nt, Homo sapiens
gguaguacugggaa

SEQ ID NO: 1819966 - RNA, 18 nt, Homo sapiens
uugaauaaauguaucuga

SEQ ID NO: 1819967 - RNA, 16 nt, Homo sapiens
ucuccuuggcugucug

SEQ ID NO: 1819968 - RNA, 17 nt, Homo sapiens
ggcaggacccugcugac

SEQ ID NO: 1819969 - RNA, 19 nt, Homo sapiens
agcuagugguggcuucucc

SEQ ID NO: 1819970 - RNA, 15 nt, Homo sapiens
cuauaauguuucccu

SEQ ID NO: 1819971 - RNA, 14 nt, Homo sapiens
uaucccucauuuca

SEQ ID NO: 1819972 - RNA, 14 nt, Homo sapiens
cacguggcuuggag

SEQ ID NO: 1819973 - RNA, 22 nt, Homo sapiens
uguuuauaaauagcauuuggaa

SEQ ID NO: 1819974 - RNA, 21 nt, Homo sapiens
gcacucauggagggggcugca

SEQ ID NO: 1819975 - RNA, 17 nt, Homo sapiens
cuguacucccagcacuu

SEQ ID NO: 1819976 - RNA, 19 nt, Homo sapiens
ucaguagugagcagcaucu

SEQ ID NO: 1819977 - RNA, 19 nt, Homo sapiens
cagauuuuaauugucaugg

SEQ ID NO: 1819978 - RNA, 14 nt, Homo sapiens
aaguucacuucccc

SEQ ID NO: 1819979 - RNA, 23 nt, Homo sapiens
uggagcgcaguggggugaucuca

SEQ ID NO: 1819980 - RNA, 13 nt, Homo sapiens
ccccacaccccag

SEQ ID NO: 1819981 - RNA, 12 nt, Homo sapiens
aaauggaacaau

SEQ ID NO: 1819982 - RNA, 12 nt, Homo sapiens
cucacccaugca

SEQ ID NO: 1819983 - RNA, 20 nt, Homo sapiens
agaaguauaaggugcucuga

SEQ ID NO: 1819984 - RNA, 16 nt, Homo sapiens
guacucagcgaaugaa

SEQ ID NO: 1819985 - RNA, 16 nt, Homo sapiens
uccacauguucaacua

SEQ ID NO: 1819986 - RNA, 24 nt, Homo sapiens
agugggugguggaucuguccaagg

SEQ ID NO: 1819987 - RNA, 16 nt, Homo sapiens
acgugccggcccuccu

SEQ ID NO: 1819988 - RNA, 13 nt, Homo sapiens
uaaugcuguguuu

SEQ ID NO: 1819989 - RNA, 22 nt, Homo sapiens
aauaucacaucacuuaacugau

SEQ ID NO: 1819990 - RNA, 14 nt, Homo sapiens
uuuccaagaccaac

SEQ ID NO: 1819991 - RNA, 12 nt, Homo sapiens
gcaccacucugg

SEQ ID NO: 1819992 - RNA, 14 nt, Homo sapiens
cuaacucugaugua

SEQ ID NO: 1819993 - RNA, 14 nt, Homo sapiens
uauagacaguuugu

SEQ ID NO: 1819994 - RNA, 22 nt, Homo sapiens
uggguauugugugagugcaugu

SEQ ID NO: 1819995 - RNA, 22 nt, Homo sapiens
gugaguuuaccuuguauacugu

SEQ ID NO: 1819996 - RNA, 21 nt, Homo sapiens
ugcccuccccagagcacuggg

SEQ ID NO: 1819997 - RNA, 19 nt, Homo sapiens
uacacacacacgcacacaa

SEQ ID NO: 1819998 - RNA, 23 nt, Homo sapiens
uuuuaacauagagaacugucacc

SEQ ID NO: 1819999 - RNA, 14 nt, Homo sapiens
acgccugagcucac

SEQ ID NO: 1820000 - RNA, 20 nt, Homo sapiens
ccauauggaggacugugaca

SEQ ID NO: 1820001 - RNA, 14 nt, Homo sapiens
ugaagacugcacag

SEQ ID NO: 1820002 - RNA, 15 nt, Homo sapiens
uggccauuaacaaug

SEQ ID NO: 1820003 - RNA, 18 nt, Homo sapiens
uagagaaagaacuaugaa

SEQ ID NO: 1820004 - RNA, 18 nt, Homo sapiens
ggaagaaauggcuaugaa

SEQ ID NO: 1820005 - RNA, 17 nt, Homo sapiens
cugguucuguacaugug

SEQ ID NO: 1820006 - RNA, 19 nt, Homo sapiens
ugccacgcuuuaugcccuu

SEQ ID NO: 1820007 - RNA, 12 nt, Homo sapiens
aguccucugaau

SEQ ID NO: 1820008 - RNA, 15 nt, Homo sapiens
gagaugggaaggcac

SEQ ID NO: 1820009 - RNA, 15 nt, Homo sapiens
aagaaacgcuucaga

SEQ ID NO: 1820010 - RNA, 16 nt, Homo sapiens
cuuauuugcugcagaa

SEQ ID NO: 1820011 - RNA, 15 nt, Homo sapiens
ugaugauacaguguu

SEQ ID NO: 1820012 - RNA, 17 nt, Homo sapiens
ccgagccaggaacugug

SEQ ID NO: 1820013 - RNA, 16 nt, Homo sapiens
uagugccccgcacugu

SEQ ID NO: 1820014 - RNA, 18 nt, Homo sapiens
gguuaaaagaacaacacu

SEQ ID NO: 1820015 - RNA, 13 nt, Homo sapiens
aauuacagaagaa

SEQ ID NO: 1820016 - RNA, 17 nt, Homo sapiens
cagucuauuugagacuc

SEQ ID NO: 1820017 - RNA, 22 nt, Homo sapiens
accccuuucugucccacuacau

SEQ ID NO: 1820018 - RNA, 13 nt, Homo sapiens
augcaauucaaug

SEQ ID NO: 1820019 - RNA, 17 nt, Homo sapiens
caaaauuugggggaaaa

SEQ ID NO: 1820020 - RNA, 19 nt, Homo sapiens
agcaccuacaguguacagu

SEQ ID NO: 1820021 - RNA, 13 nt, Homo sapiens
acccuccuugaga

SEQ ID NO: 1820022 - RNA, 22 nt, Homo sapiens
uuugaagccugcuaaaugaaga

SEQ ID NO: 1820023 - RNA, 12 nt, Homo sapiens
aacaaguagcua

SEQ ID NO: 1820024 - RNA, 14 nt, Homo sapiens
agggcagagacaau

SEQ ID NO: 1820025 - RNA, 15 nt, Homo sapiens
gaguucaaugaucua

SEQ ID NO: 1820026 - RNA, 14 nt, Homo sapiens
uggcaaagugcugu

SEQ ID NO: 1820027 - RNA, 18 nt, Homo sapiens
gugacaagaauuguuacc

SEQ ID NO: 1820028 - RNA, 15 nt, Homo sapiens
uucccagucuucuga

SEQ ID NO: 1820029 - RNA, 19 nt, Homo sapiens
uuccuccuccaucaccuga

SEQ ID NO: 1820030 - RNA, 14 nt, Homo sapiens
gacacagcucuuca

SEQ ID NO: 1820031 - RNA, 13 nt, Homo sapiens
ggaggcuucugau

SEQ ID NO: 1820032 - RNA, 15 nt, Homo sapiens
cagagccuuguucua

SEQ ID NO: 1820033 - RNA, 18 nt, Homo sapiens
auuuuaguuccuucuaua

SEQ ID NO: 1820034 - RNA, 13 nt, Homo sapiens
uuacugacuccuc

SEQ ID NO: 1820035 - RNA, 16 nt, Homo sapiens
aggauuaugugcccca

SEQ ID NO: 1820036 - RNA, 13 nt, Homo sapiens
cuuuuccaaugau

SEQ ID NO: 1820037 - RNA, 14 nt, Homo sapiens
caucuaauguaaua

SEQ ID NO: 1820038 - RNA, 15 nt, Homo sapiens
aacaaauguauuuca

SEQ ID NO: 1820039 - RNA, 10 nt, Homo sapiens
ucucaucucc

SEQ ID NO: 1820040 - RNA, 16 nt, Homo sapiens
accgacagcucuuacu

SEQ ID NO: 1820041 - RNA, 19 nt, Homo sapiens
uucccuccgcaucccguca

SEQ ID NO: 1820042 - RNA, 12 nt, Homo sapiens
uucuuucuagag

SEQ ID NO: 1820043 - RNA, 21 nt, Homo sapiens
cgcuaaauauuuaccuugaaa

SEQ ID NO: 1820044 - RNA, 20 nt, Homo sapiens
accugcaccccugauguggc

SEQ ID NO: 1820045 - RNA, 14 nt, Homo sapiens
ugugcaugcucagc

SEQ ID NO: 1820046 - RNA, 14 nt, Homo sapiens
gcugacucauucuu

SEQ ID NO: 1820047 - RNA, 14 nt, Homo sapiens
uggggccaugccuc

SEQ ID NO: 1820048 - RNA, 15 nt, Homo sapiens
uagguugaaggcaaa

SEQ ID NO: 1820049 - RNA, 18 nt, Homo sapiens
guggagaaagcacugacc

SEQ ID NO: 1820050 - RNA, 18 nt, Homo sapiens
guacaguggugugauccc

SEQ ID NO: 1820051 - RNA, 19 nt, Homo sapiens
cuuaucugagucacuugaa

SEQ ID NO: 1820052 - RNA, 14 nt, Homo sapiens
gaccagaaguggac

SEQ ID NO: 1820053 - RNA, 21 nt, Homo sapiens
uccaagcccgcucccugcuca

SEQ ID NO: 1820054 - RNA, 13 nt, Homo sapiens
gcacaagcauucc

SEQ ID NO: 1820055 - RNA, 16 nt, Homo sapiens
accagcuccacuggcc

SEQ ID NO: 1820056 - RNA, 16 nt, Homo sapiens
aacauguccccuuccc

SEQ ID NO: 1820057 - RNA, 15 nt, Homo sapiens
aagggcccucacuca

SEQ ID NO: 1820058 - RNA, 21 nt, Homo sapiens
aggugucuauuuggacucuaa

SEQ ID NO: 1820059 - RNA, 18 nt, Homo sapiens
auggcaggacuccuggca

SEQ ID NO: 1820060 - RNA, 22 nt, Homo sapiens
uccuccacagucccccacccac

SEQ ID NO: 1820061 - RNA, 21 nt, Homo sapiens
aggcacuagccuuuggcucug

SEQ ID NO: 1820062 - RNA, 13 nt, Homo sapiens
cauuuaguuuaaa

SEQ ID NO: 1820063 - RNA, 22 nt, Homo sapiens
uccguggccccgcccucaggcu

SEQ ID NO: 1820064 - RNA, 19 nt, Homo sapiens
gaucuauagcagaguccuu

SEQ ID NO: 1820065 - RNA, 17 nt, Homo sapiens
agcucauccccuuggcu

SEQ ID NO: 1820066 - RNA, 19 nt, Homo sapiens
cagacucuggggguggaca

SEQ ID NO: 1820067 - RNA, 19 nt, Homo sapiens
gcugacagauguuccaucc

SEQ ID NO: 1820068 - RNA, 22 nt, Homo sapiens
ugacucuccugccucagccucc

SEQ ID NO: 1820069 - RNA, 23 nt, Homo sapiens
uugugcuccugccagcucaggau

SEQ ID NO: 1820070 - RNA, 14 nt, Homo sapiens
uuauaaaaucuuuc

SEQ ID NO: 1820071 - RNA, 22 nt, Homo sapiens
ucccaacaagugcucuuuccac

SEQ ID NO: 1820072 - RNA, 14 nt, Homo sapiens
uuucugucuuugga

SEQ ID NO: 1820073 - RNA, 13 nt, Homo sapiens
gcuccccaagaaa

SEQ ID NO: 1820074 - RNA, 16 nt, Homo sapiens
aaucuacuaauuccac

SEQ ID NO: 1820075 - RNA, 20 nt, Homo sapiens
uggggccgaaagaacagucc

SEQ ID NO: 1820076 - RNA, 20 nt, Homo sapiens
gccacaccuuaguauacugc

SEQ ID NO: 1820077 - RNA, 15 nt, Homo sapiens
accguugcacaaaaa

SEQ ID NO: 1820078 - RNA, 22 nt, Homo sapiens
uugcacuggauaaacaaaggua

SEQ ID NO: 1820079 - RNA, 19 nt, Homo sapiens
aggcgggauuuaugugcac

SEQ ID NO: 1820080 - RNA, 13 nt, Homo sapiens
accugcaccguug

SEQ ID NO: 1820081 - RNA, 13 nt, Homo sapiens
ucucauccacaga

SEQ ID NO: 1820082 - RNA, 16 nt, Homo sapiens
gauaacauaaauaaaa

SEQ ID NO: 1820083 - RNA, 14 nt, Homo sapiens
acgaucucagcuca

SEQ ID NO: 1820084 - RNA, 18 nt, Homo sapiens
cucugggcuugggcacca

SEQ ID NO: 1820085 - RNA, 21 nt, Homo sapiens
ccugacaucaaaaaaggcagu

SEQ ID NO: 1820086 - RNA, 15 nt, Homo sapiens
uucuuuauaauggcu

SEQ ID NO: 1820087 - RNA, 21 nt, Homo sapiens
acauuuuuuaugggcauugac

SEQ ID NO: 1820088 - RNA, 20 nt, Homo sapiens
cugaacucugaccacuuaaa

SEQ ID NO: 1820089 - RNA, 19 nt, Homo sapiens
aucauauuguuacugguac

SEQ ID NO: 1820090 - RNA, 18 nt, Homo sapiens
caccaugcugcuggggaa

SEQ ID NO: 1820091 - RNA, 17 nt, Homo sapiens
cuggccuguacccagua

SEQ ID NO: 1820092 - RNA, 16 nt, Homo sapiens
uucuccaugcugagaa

SEQ ID NO: 1820093 - RNA, 22 nt, Homo sapiens
guaacuuccugcugcacccugc

SEQ ID NO: 1820094 - RNA, 12 nt, Homo sapiens
accugcucugcu

SEQ ID NO: 1820095 - RNA, 21 nt, Homo sapiens
uuaccugucacauugcauucu

SEQ ID NO: 1820096 - RNA, 18 nt, Homo sapiens
gcauuagaaaccaugaaa

SEQ ID NO: 1820097 - RNA, 15 nt, Homo sapiens
caacacccaacuguc

SEQ ID NO: 1820098 - RNA, 14 nt, Homo sapiens
gugauugcacagaa

SEQ ID NO: 1820099 - RNA, 14 nt, Homo sapiens
uagcucaccaggcc

SEQ ID NO: 1820100 - RNA, 21 nt, Homo sapiens
cugaguguccagcacaccugc

SEQ ID NO: 1820101 - RNA, 14 nt, Homo sapiens
acuauugcauuuau

SEQ ID NO: 1820102 - RNA, 21 nt, Homo sapiens
gugcugagacuacagguguga

SEQ ID NO: 1820103 - RNA, 22 nt, Homo sapiens
ucuccuagcucccugccagcuu

SEQ ID NO: 1820104 - RNA, 21 nt, Homo sapiens
gcaguuuugcuaucugggcug

SEQ ID NO: 1820105 - RNA, 22 nt, Homo sapiens
uuagaguccccccgaccagauc

SEQ ID NO: 1820106 - RNA, 14 nt, Homo sapiens
ugugugaccccaaa

SEQ ID NO: 1820107 - RNA, 13 nt, Homo sapiens
ccaaacaugcacu

SEQ ID NO: 1820108 - RNA, 18 nt, Homo sapiens
agugguugccuggacacc

SEQ ID NO: 1820109 - RNA, 16 nt, Homo sapiens
ccagcaaccagcacau

SEQ ID NO: 1820110 - RNA, 16 nt, Homo sapiens
caccaguggccuuuca

SEQ ID NO: 1820111 - RNA, 20 nt, Homo sapiens
uggaugaaucucccacucca

SEQ ID NO: 1820112 - RNA, 18 nt, Homo sapiens
cggauguuucugugacac

SEQ ID NO: 1820113 - RNA, 17 nt, Homo sapiens
cuggugagguuguggag

SEQ ID NO: 1820114 - RNA, 17 nt, Homo sapiens
uccgaggccgugcagug

SEQ ID NO: 1820115 - RNA, 13 nt, Homo sapiens
ccuccacaccucu

SEQ ID NO: 1820116 - RNA, 13 nt, Homo sapiens
uauacacauauau

SEQ ID NO: 1820117 - RNA, 17 nt, Homo sapiens
uuucaaaauauguguau

SEQ ID NO: 1820118 - RNA, 16 nt, Homo sapiens
cacagcacaugcacac

SEQ ID NO: 1820119 - RNA, 19 nt, Homo sapiens
gcauccuuuucaaaaccua

SEQ ID NO: 1820120 - RNA, 17 nt, Homo sapiens
ugaacuaccaucugaug

SEQ ID NO: 1820121 - RNA, 17 nt, Homo sapiens
accaaagccaccacauu

SEQ ID NO: 1820122 - RNA, 11 nt, Homo sapiens
uauaccuugcc

SEQ ID NO: 1820123 - RNA, 16 nt, Homo sapiens
agaucagaacaugaaa

SEQ ID NO: 1820124 - RNA, 21 nt, Homo sapiens
caauguugguuucacugagag

SEQ ID NO: 1820125 - RNA, 23 nt, Homo sapiens
ucagaagaaaggacagcucagaa

SEQ ID NO: 1820126 - RNA, 23 nt, Homo sapiens
gugaagucucuggguggaagugu

SEQ ID NO: 1820127 - RNA, 20 nt, Homo sapiens
uucgcaaccgcaauccggag

SEQ ID NO: 1820128 - RNA, 23 nt, Homo sapiens
aaggccugucccuggccaucucu

SEQ ID NO: 1820129 - RNA, 14 nt, Homo sapiens
cuauguaacaugua

SEQ ID NO: 1820130 - RNA, 15 nt, Homo sapiens
cuggcccauucuuga

SEQ ID NO: 1820131 - RNA, 14 nt, Homo sapiens
agaaggaagacuuu

SEQ ID NO: 1820132 - RNA, 18 nt, Homo sapiens
aguccugacacuauucau

SEQ ID NO: 1820133 - RNA, 18 nt, Homo sapiens
ccuggaugacauuaaaga

SEQ ID NO: 1820134 - RNA, 19 nt, Homo sapiens
uuugccaccagaaaccaca

SEQ ID NO: 1820135 - RNA, 13 nt, Homo sapiens
gcacacugcacug

SEQ ID NO: 1820136 - RNA, 14 nt, Homo sapiens
cacaccugcagugc

SEQ ID NO: 1820137 - RNA, 14 nt, Homo sapiens
caccugugauccca

SEQ ID NO: 1820138 - RNA, 20 nt, Homo sapiens
uuaauaaaaauacacaugaa

SEQ ID NO: 1820139 - RNA, 18 nt, Homo sapiens
gcacucuugaacugggcg

SEQ ID NO: 1820140 - RNA, 21 nt, Homo sapiens
caagcauuucaugaaaaagcu

SEQ ID NO: 1820141 - RNA, 18 nt, Homo sapiens
uacaguuugcuguacuag

SEQ ID NO: 1820142 - RNA, 17 nt, Homo sapiens
aguauugucgguuaccu

SEQ ID NO: 1820143 - RNA, 20 nt, Homo sapiens
aauugagacagugcacauga

SEQ ID NO: 1820144 - RNA, 20 nt, Homo sapiens
gggucucuagugcugugaaa

SEQ ID NO: 1820145 - RNA, 16 nt, Homo sapiens
ucugggagacuuuccc

SEQ ID NO: 1820146 - RNA, 15 nt, Homo sapiens
ugucuucgaggacag

SEQ ID NO: 1820147 - RNA, 20 nt, Homo sapiens
gucaucaugcuccacagaag

SEQ ID NO: 1820148 - RNA, 13 nt, Homo sapiens
uccucuuugccca

SEQ ID NO: 1820149 - RNA, 15 nt, Homo sapiens
uaccuucuagcuuua

SEQ ID NO: 1820150 - RNA, 16 nt, Homo sapiens
ugcaagggucccuuaa

SEQ ID NO: 1820151 - RNA, 16 nt, Homo sapiens
aaauucaguaguaaca

SEQ ID NO: 1820152 - RNA, 14 nt, Homo sapiens
ucuccuggcuuuac

SEQ ID NO: 1820153 - RNA, 10 nt, Homo sapiens
aaucucucuc

SEQ ID NO: 1820154 - RNA, 19 nt, Homo sapiens
agugaauaaaccaucaucu

SEQ ID NO: 1820155 - RNA, 20 nt, Homo sapiens
acuaagauaaauucaugcac

SEQ ID NO: 1820156 - RNA, 21 nt, Homo sapiens
guggagaguugggggccagca

SEQ ID NO: 1820157 - RNA, 23 nt, Homo sapiens
auucuucaguucucuacucccuc

SEQ ID NO: 1820158 - RNA, 18 nt, Homo sapiens
gcccuuauugaacauucu

SEQ ID NO: 1820159 - RNA, 18 nt, Homo sapiens
uccacaugaaaauaaaga

SEQ ID NO: 1820160 - RNA, 13 nt, Homo sapiens
ugucaacauuugg

SEQ ID NO: 1820161 - RNA, 20 nt, Homo sapiens
uggggauccaguuagcaaca

SEQ ID NO: 1820162 - RNA, 18 nt, Homo sapiens
cugccucccacgcuggga

SEQ ID NO: 1820163 - RNA, 17 nt, Homo sapiens
acauuugcaaaauggaa

SEQ ID NO: 1820164 - RNA, 17 nt, Homo sapiens
acucagaacccaggaca

SEQ ID NO: 1820165 - RNA, 13 nt, Homo sapiens
aaaggucaucuca

SEQ ID NO: 1820166 - RNA, 14 nt, Homo sapiens
uaacacuacuuaaa

SEQ ID NO: 1820167 - RNA, 15 nt, Homo sapiens
ccaaguagcugagau

SEQ ID NO: 1820168 - RNA, 18 nt, Homo sapiens
cuggaugagcaacuccug

SEQ ID NO: 1820169 - RNA, 19 nt, Homo sapiens
acuuguuuucacuuuauca

SEQ ID NO: 1820170 - RNA, 23 nt, Homo sapiens
uauaacauagcugucacaguaua

SEQ ID NO: 1820171 - RNA, 22 nt, Homo sapiens
ggacuggaggugggcaugccac

SEQ ID NO: 1820172 - RNA, 19 nt, Homo sapiens
gagcagggagaccaugccu

SEQ ID NO: 1820173 - RNA, 21 nt, Homo sapiens
cucauggcuguguccacugca

SEQ ID NO: 1820174 - RNA, 23 nt, Homo sapiens
agcacuuugggaggccaaggugg

SEQ ID NO: 1820175 - RNA, 15 nt, Homo sapiens
cagagcuauggugcu

SEQ ID NO: 1820176 - RNA, 15 nt, Homo sapiens
ugauagaacaaaaga

SEQ ID NO: 1820177 - RNA, 21 nt, Homo sapiens
ccugauagaagugcauucucc

SEQ ID NO: 1820178 - RNA, 16 nt, Homo sapiens
cuugccugggauauca

SEQ ID NO: 1820179 - RNA, 14 nt, Homo sapiens
aaaaaaaaaaccac

SEQ ID NO: 1820180 - RNA, 22 nt, Homo sapiens
gcagcucuugcuaaucaguguc

SEQ ID NO: 1820181 - RNA, 16 nt, Homo sapiens
ugcaauccaggcuguu

SEQ ID NO: 1820182 - RNA, 14 nt, Homo sapiens
aauacaauacauuu

SEQ ID NO: 1820183 - RNA, 21 nt, Homo sapiens
augaguuucacuguacugcau

SEQ ID NO: 1820184 - RNA, 14 nt, Homo sapiens
caaggucaagagau

SEQ ID NO: 1820185 - RNA, 14 nt, Homo sapiens
ggcuacaacuucag

SEQ ID NO: 1820186 - RNA, 17 nt, Homo sapiens
agccucuauugccauga

SEQ ID NO: 1820187 - RNA, 20 nt, Homo sapiens
ugcacacgggaaagccuuaa

SEQ ID NO: 1820188 - RNA, 15 nt, Homo sapiens
ggccaggacuuugag

SEQ ID NO: 1820189 - RNA, 22 nt, Homo sapiens
caaaagcugggaaccagcaucu

SEQ ID NO: 1820190 - RNA, 23 nt, Homo sapiens
auggccuugaaacaguuccauuu

SEQ ID NO: 1820191 - RNA, 18 nt, Homo sapiens
ucugcaggcuucagccau

SEQ ID NO: 1820192 - RNA, 13 nt, Homo sapiens
gaucccuagcugu

SEQ ID NO: 1820193 - RNA, 14 nt, Homo sapiens
aaugaauaaagcau

SEQ ID NO: 1820194 - RNA, 14 nt, Homo sapiens
uuggauuauuucaa

SEQ ID NO: 1820195 - RNA, 15 nt, Homo sapiens
auggcagggugcuag

SEQ ID NO: 1820196 - RNA, 18 nt, Homo sapiens
gcauacaccaaacauuuc

SEQ ID NO: 1820197 - RNA, 23 nt, Homo sapiens
cauguuuugauuuguagcacuga

SEQ ID NO: 1820198 - RNA, 15 nt, Homo sapiens
agugcagugauguuu

SEQ ID NO: 1820199 - RNA, 18 nt, Homo sapiens
ucuaauuuuacacucugu

SEQ ID NO: 1820200 - RNA, 20 nt, Homo sapiens
gggaaacauagccucaccaa

SEQ ID NO: 1820201 - RNA, 20 nt, Homo sapiens
ugcuggagggaagaucuuga

SEQ ID NO: 1820202 - RNA, 20 nt, Homo sapiens
uacuaacuuuccuucauuca

SEQ ID NO: 1820203 - RNA, 15 nt, Homo sapiens
gcccugcccaaccuc

SEQ ID NO: 1820204 - RNA, 17 nt, Homo sapiens
ccuuccuggacacacuc

SEQ ID NO: 1820205 - RNA, 13 nt, Homo sapiens
aucccaguccuga

SEQ ID NO: 1820206 - RNA, 11 nt, Homo sapiens
gcaagugcccg

SEQ ID NO: 1820207 - RNA, 17 nt, Homo sapiens
gaauauauucuauucca

SEQ ID NO: 1820208 - RNA, 15 nt, Homo sapiens
aggaacaaacagggc

SEQ ID NO: 1820209 - RNA, 14 nt, Homo sapiens
acaacaaaccaaaa

SEQ ID NO: 1820210 - RNA, 14 nt, Homo sapiens
aaguaaaacaguca

SEQ ID NO: 1820211 - RNA, 23 nt, Homo sapiens
auuuuaccugggauaugacaagc

SEQ ID NO: 1820212 - RNA, 22 nt, Homo sapiens
aaaucugcuuuucauguugaaa

SEQ ID NO: 1820213 - RNA, 13 nt, Homo sapiens
aauauaagcauaa

SEQ ID NO: 1820214 - RNA, 17 nt, Homo sapiens
auuucacccaucucuca

SEQ ID NO: 1820215 - RNA, 19 nt, Homo sapiens
aacuuggucuuacaucugu

SEQ ID NO: 1820216 - RNA, 13 nt, Homo sapiens
cccugcuugcaca

SEQ ID NO: 1820217 - RNA, 21 nt, Homo sapiens
cccaggccuguacagauguau

SEQ ID NO: 1820218 - RNA, 22 nt, Homo sapiens
cacaauaaaagaaacugugguc

SEQ ID NO: 1820219 - RNA, 14 nt, Homo sapiens
aaucuaguuuacag

SEQ ID NO: 1820220 - RNA, 10 nt, Homo sapiens
gaaggccagc

SEQ ID NO: 1820221 - RNA, 16 nt, Homo sapiens
accaugcaaaggauaa

SEQ ID NO: 1820222 - RNA, 23 nt, Homo sapiens
ugccggucccccaugccaccacc

SEQ ID NO: 1820223 - RNA, 13 nt, Homo sapiens
uuguauuugccau

SEQ ID NO: 1820224 - RNA, 16 nt, Homo sapiens
aaagaaauuaaagaag

SEQ ID NO: 1820225 - RNA, 22 nt, Homo sapiens
aaagucaauaaaagagcugucu

SEQ ID NO: 1820226 - RNA, 16 nt, Homo sapiens
gcuccgcugcuccuug

SEQ ID NO: 1820227 - RNA, 17 nt, Homo sapiens
aaaaguauccaagguua

SEQ ID NO: 1820228 - RNA, 19 nt, Homo sapiens
aauucuuucaauucuucau

SEQ ID NO: 1820229 - RNA, 18 nt, Homo sapiens
accugaaccugggaacca

SEQ ID NO: 1820230 - RNA, 13 nt, Homo sapiens
guggaacaagcag

SEQ ID NO: 1820231 - RNA, 20 nt, Homo sapiens
ccaggccacccaaaggagcu

SEQ ID NO: 1820232 - RNA, 15 nt, Homo sapiens
caccaccagcuuaaa

SEQ ID NO: 1820233 - RNA, 15 nt, Homo sapiens
caaggugaacacuuc

SEQ ID NO: 1820234 - RNA, 15 nt, Homo sapiens
ucuuccagguucacu

SEQ ID NO: 1820235 - RNA, 16 nt, Homo sapiens
cacagugugauuuuga

SEQ ID NO: 1820236 - RNA, 23 nt, Homo sapiens
uucauggaagccaccagugagau

SEQ ID NO: 1820237 - RNA, 18 nt, Homo sapiens
ggaugaagcccagccaca

SEQ ID NO: 1820238 - RNA, 20 nt, Homo sapiens
aaagcaguaaauuugcuagc

SEQ ID NO: 1820239 - RNA, 23 nt, Homo sapiens
auagagccaaguccaaacuggca

SEQ ID NO: 1820240 - RNA, 17 nt, Homo sapiens
ccgagugaggccauagc

SEQ ID NO: 1820241 - RNA, 16 nt, Homo sapiens
ggggaggggccucccc

SEQ ID NO: 1820242 - RNA, 22 nt, Homo sapiens
aacaauggaagauuugcccauu

SEQ ID NO: 1820243 - RNA, 19 nt, Homo sapiens
ugcucaauaaaaauguguu

SEQ ID NO: 1820244 - RNA, 14 nt, Homo sapiens
gggauguggcugca

SEQ ID NO: 1820245 - RNA, 21 nt, Homo sapiens
ucucugaguccuggcccaaag

SEQ ID NO: 1820246 - RNA, 17 nt, Homo sapiens
ucaucugaggaguccaa

SEQ ID NO: 1820247 - RNA, 17 nt, Homo sapiens
auaaaaggaaucuuccu

SEQ ID NO: 1820248 - RNA, 17 nt, Homo sapiens
aagcucuguugcaauua

SEQ ID NO: 1820249 - RNA, 12 nt, Homo sapiens
acuuauuacaau

SEQ ID NO: 1820250 - RNA, 20 nt, Homo sapiens
ugcccacguccccacccacg

SEQ ID NO: 1820251 - RNA, 16 nt, Homo sapiens
auccauccugcucagg

SEQ ID NO: 1820252 - RNA, 15 nt, Homo sapiens
uucuauagugaugau

SEQ ID NO: 1820253 - RNA, 20 nt, Homo sapiens
auagaaugagugaaucaccu

SEQ ID NO: 1820254 - RNA, 13 nt, Homo sapiens
acaccucccugaa

SEQ ID NO: 1820255 - RNA, 12 nt, Homo sapiens
agugaucccaau

SEQ ID NO: 1820256 - RNA, 17 nt, Homo sapiens
agccugaccccaggcag

SEQ ID NO: 1820257 - RNA, 21 nt, Homo sapiens
ugcugagauacauacagaauu

SEQ ID NO: 1820258 - RNA, 15 nt, Homo sapiens
ccaacaugcacugau

SEQ ID NO: 1820259 - RNA, 22 nt, Homo sapiens
agcucugaaaucaacucucuuc

SEQ ID NO: 1820260 - RNA, 18 nt, Homo sapiens
acuaaaaguugcauuuua

SEQ ID NO: 1820261 - RNA, 23 nt, Homo sapiens
aaugccagcauaaauccauccau

SEQ ID NO: 1820262 - RNA, 20 nt, Homo sapiens
aauaaagcccuugaaccagc

SEQ ID NO: 1820263 - RNA, 14 nt, Homo sapiens
caguugacagcagg

SEQ ID NO: 1820264 - RNA, 14 nt, Homo sapiens
agcuucaccagagc

SEQ ID NO: 1820265 - RNA, 20 nt, Homo sapiens
uacuauaaauauacauauaa

SEQ ID NO: 1820266 - RNA, 14 nt, Homo sapiens
ccagacggugugca

SEQ ID NO: 1820267 - RNA, 21 nt, Homo sapiens
uuuuaaccuuccaagacugaa

SEQ ID NO: 1820268 - RNA, 22 nt, Homo sapiens
gauucuuccauuaaauugccuu

SEQ ID NO: 1820269 - RNA, 18 nt, Homo sapiens
acauuuuguggugacaga

SEQ ID NO: 1820270 - RNA, 18 nt, Homo sapiens
caagaaaauaagagcuca

SEQ ID NO: 1820271 - RNA, 14 nt, Homo sapiens
cuucaccucuucca

SEQ ID NO: 1820272 - RNA, 15 nt, Homo sapiens
ucagccagucucaga

SEQ ID NO: 1820273 - RNA, 18 nt, Homo sapiens
gcaacccagucacacugu

SEQ ID NO: 1820274 - RNA, 14 nt, Homo sapiens
aguugauuuuacaa

SEQ ID NO: 1820275 - RNA, 13 nt, Homo sapiens
cuguucagcuuuu

SEQ ID NO: 1820276 - RNA, 21 nt, Homo sapiens
uaugaaaacaaguuccaaauc

SEQ ID NO: 1820277 - RNA, 16 nt, Homo sapiens
ugcacuaugagccuau

SEQ ID NO: 1820278 - RNA, 14 nt, Homo sapiens
ugagcaaguuuaua

SEQ ID NO: 1820279 - RNA, 19 nt, Homo sapiens
uuguuguuuauaaagggag

SEQ ID NO: 1820280 - RNA, 18 nt, Homo sapiens
gccuuugucuuacuggca

SEQ ID NO: 1820281 - RNA, 15 nt, Homo sapiens
ugcacacguguggac

SEQ ID NO: 1820282 - RNA, 15 nt, Homo sapiens
aucuuuaacaaccuc

SEQ ID NO: 1820283 - RNA, 16 nt, Homo sapiens
auuuucucucagguga

SEQ ID NO: 1820284 - RNA, 17 nt, Homo sapiens
agggauuagguguucag

SEQ ID NO: 1820285 - RNA, 16 nt, Homo sapiens
ugaagcaggucuuuca

SEQ ID NO: 1820286 - RNA, 18 nt, Homo sapiens
auuguucuccucguccau

SEQ ID NO: 1820287 - RNA, 13 nt, Homo sapiens
auccacugcaaua

SEQ ID NO: 1820288 - RNA, 23 nt, Homo sapiens
aauggggguggggaggcaagaac

SEQ ID NO: 1820289 - RNA, 16 nt, Homo sapiens
uuaucaaccaacugca

SEQ ID NO: 1820290 - RNA, 17 nt, Homo sapiens
cagaaaaagaucuuuca

SEQ ID NO: 1820291 - RNA, 20 nt, Homo sapiens
uuuucacaaagaacaggaaa

SEQ ID NO: 1820292 - RNA, 22 nt, Homo sapiens
caagugaucaaaauuaacguca

SEQ ID NO: 1820293 - RNA, 17 nt, Homo sapiens
acacaauugauacuuca

SEQ ID NO: 1820294 - RNA, 17 nt, Homo sapiens
aaccacauuaauuaauu

SEQ ID NO: 1820295 - RNA, 19 nt, Homo sapiens
aaagaacaugcaguuugaa

SEQ ID NO: 1820296 - RNA, 14 nt, Homo sapiens
gucuguaguguuuu

SEQ ID NO: 1820297 - RNA, 23 nt, Homo sapiens
cagagugggucuuggaccagggc

SEQ ID NO: 1820298 - RNA, 22 nt, Homo sapiens
ugcauuagaaagauuagugauu

SEQ ID NO: 1820299 - RNA, 22 nt, Homo sapiens
gggcccggcccgcgccacagga

SEQ ID NO: 1820300 - RNA, 11 nt, Homo sapiens
aacuauggaaa

SEQ ID NO: 1820301 - RNA, 16 nt, Homo sapiens
gcaaucuacuggaaau

SEQ ID NO: 1820302 - RNA, 18 nt, Homo sapiens
aaauaucuucacuuguca

SEQ ID NO: 1820303 - RNA, 19 nt, Homo sapiens
ugcuuuguaguuugcccag

SEQ ID NO: 1820304 - RNA, 23 nt, Homo sapiens
ugcugagggaccuuggagagcuc

SEQ ID NO: 1820305 - RNA, 15 nt, Homo sapiens
ugugaaagugacucu

SEQ ID NO: 1820306 - RNA, 19 nt, Homo sapiens
caugcacccgcauguacaa

SEQ ID NO: 1820307 - RNA, 15 nt, Homo sapiens
uccagucagugugca

SEQ ID NO: 1820308 - RNA, 20 nt, Homo sapiens
uagcuauuuguuuacaugca

SEQ ID NO: 1820309 - RNA, 16 nt, Homo sapiens
uaagaguuuacaguuu

SEQ ID NO: 1820310 - RNA, 14 nt, Homo sapiens
auaacuuacuguau

SEQ ID NO: 1820311 - RNA, 16 nt, Homo sapiens
cccaagauagagucaa

SEQ ID NO: 1820312 - RNA, 13 nt, Homo sapiens
ugaaagugcaaag

SEQ ID NO: 1820313 - RNA, 19 nt, Homo sapiens
aaaccaagccguggcuucc

SEQ ID NO: 1820314 - RNA, 23 nt, Homo sapiens
uacaaguaaagcccagaucucug

SEQ ID NO: 1820315 - RNA, 16 nt, Homo sapiens
aaaaucauaguacucu

SEQ ID NO: 1820316 - RNA, 13 nt, Homo sapiens
ucacaauacuguu

SEQ ID NO: 1820317 - RNA, 22 nt, Homo sapiens
gaguucuugugccauagucaca

SEQ ID NO: 1820318 - RNA, 21 nt, Homo sapiens
auaauacaaauaacugaugaa

SEQ ID NO: 1820319 - RNA, 17 nt, Homo sapiens
guaugcauugauuuaau

SEQ ID NO: 1820320 - RNA, 22 nt, Homo sapiens
uaaauucagucuuuucucugaa

SEQ ID NO: 1820321 - RNA, 23 nt, Homo sapiens
ugauuauacgacuuuuaagcaaa

SEQ ID NO: 1820322 - RNA, 16 nt, Homo sapiens
ugguguaaaccauucu

SEQ ID NO: 1820323 - RNA, 12 nt, Homo sapiens
uucaugcacugu

SEQ ID NO: 1820324 - RNA, 22 nt, Homo sapiens
caucgaaucuacuaauuccaca

SEQ ID NO: 1820325 - RNA, 14 nt, Homo sapiens
gcucuggggacuga

SEQ ID NO: 1820326 - RNA, 13 nt, Homo sapiens
uguauaacaagcc

SEQ ID NO: 1820327 - RNA, 15 nt, Homo sapiens
auuauuuucugucag

SEQ ID NO: 1820328 - RNA, 21 nt, Homo sapiens
acauuuagaaccugcauuuaa

SEQ ID NO: 1820329 - RNA, 24 nt, Homo sapiens
cccaggaguggauaacacuggcuu

SEQ ID NO: 1820330 - RNA, 17 nt, Homo sapiens
uccucaaaccacuugcc

SEQ ID NO: 1820331 - RNA, 20 nt, Homo sapiens
ccuaacugaauacagucuca

SEQ ID NO: 1820332 - RNA, 15 nt, Homo sapiens
uucuuuguaugauug

SEQ ID NO: 1820333 - RNA, 14 nt, Homo sapiens
ggacaagaccccca

SEQ ID NO: 1820334 - RNA, 21 nt, Homo sapiens
cacugcaccugaccugcugaa

SEQ ID NO: 1820335 - RNA, 21 nt, Homo sapiens
guacaccagcaggacacugau

SEQ ID NO: 1820336 - RNA, 23 nt, Homo sapiens
auuccaauaaauugucaagacca

SEQ ID NO: 1820337 - RNA, 16 nt, Homo sapiens
aggacugcaccauugc

SEQ ID NO: 1820338 - RNA, 19 nt, Homo sapiens
cugacauauucaagugaua

SEQ ID NO: 1820339 - RNA, 12 nt, Homo sapiens
cugcaagagcca

SEQ ID NO: 1820340 - RNA, 22 nt, Homo sapiens
uugucaauaguauuaacuauua

SEQ ID NO: 1820341 - RNA, 13 nt, Homo sapiens
agagguuucagug

SEQ ID NO: 1820342 - RNA, 13 nt, Homo sapiens
uccaaaagcacuu

SEQ ID NO: 1820343 - RNA, 20 nt, Homo sapiens
ugcuagccccagagaugcca

SEQ ID NO: 1820344 - RNA, 16 nt, Homo sapiens
uuccuggcucacacau

SEQ ID NO: 1820345 - RNA, 15 nt, Homo sapiens
ccaaguguccuggac

SEQ ID NO: 1820346 - RNA, 16 nt, Homo sapiens
uuuuagggcuguagac

SEQ ID NO: 1820347 - RNA, 19 nt, Homo sapiens
cagagccuucaagugccaa

SEQ ID NO: 1820348 - RNA, 14 nt, Homo sapiens
uccuguaaucacaa

SEQ ID NO: 1820349 - RNA, 18 nt, Homo sapiens
uccaccggcgggucucca

SEQ ID NO: 1820350 - RNA, 15 nt, Homo sapiens
aggcugcagauuucc

SEQ ID NO: 1820351 - RNA, 16 nt, Homo sapiens
cuuuuggauaugcuga

SEQ ID NO: 1820352 - RNA, 23 nt, Homo sapiens
agaagccucacugcaagcacugc

SEQ ID NO: 1820353 - RNA, 22 nt, Homo sapiens
uuaaauaaguaaaagcuacuau

SEQ ID NO: 1820354 - RNA, 18 nt, Homo sapiens
aaacaccuuguacuuuau

SEQ ID NO: 1820355 - RNA, 14 nt, Homo sapiens
uuaauggacuguga

SEQ ID NO: 1820356 - RNA, 22 nt, Homo sapiens
ggaaaaauaagaugggcccaaa

SEQ ID NO: 1820357 - RNA, 16 nt, Homo sapiens
cuaacauauugccaug

SEQ ID NO: 1820358 - RNA, 22 nt, Homo sapiens
uuuuagauuauuccaagccuua

SEQ ID NO: 1820359 - RNA, 18 nt, Homo sapiens
uauugaaugaugugauac

SEQ ID NO: 1820360 - RNA, 16 nt, Homo sapiens
gacuacauauuugcac

SEQ ID NO: 1820361 - RNA, 12 nt, Homo sapiens
gacuuuucuccc

SEQ ID NO: 1820362 - RNA, 14 nt, Homo sapiens
ggcaugguggcaca

SEQ ID NO: 1820363 - RNA, 18 nt, Homo sapiens
ugaaauguucuguucacc

SEQ ID NO: 1820364 - RNA, 14 nt, Homo sapiens
uagaaccacagcag

SEQ ID NO: 1820365 - RNA, 21 nt, Homo sapiens
cugcaguuuccucaucuguca

SEQ ID NO: 1820366 - RNA, 19 nt, Homo sapiens
uuagugaccauuauucaca

SEQ ID NO: 1820367 - RNA, 21 nt, Homo sapiens
ugggauuaugggucacaggaa

SEQ ID NO: 1820368 - RNA, 16 nt, Homo sapiens
aagcucuacauuugca

SEQ ID NO: 1820369 - RNA, 19 nt, Homo sapiens
uaugugacuuaaagucaga

SEQ ID NO: 1820370 - RNA, 20 nt, Homo sapiens
agagcuuuuauuuggugugu

SEQ ID NO: 1820371 - RNA, 20 nt, Homo sapiens
aauggcauugacagcugcuc

SEQ ID NO: 1820372 - RNA, 20 nt, Homo sapiens
uucucagcgcaacagcugug

SEQ ID NO: 1820373 - RNA, 17 nt, Homo sapiens
uggaauggcucagggau

SEQ ID NO: 1820374 - RNA, 16 nt, Homo sapiens
aacucaacuuugacaa

SEQ ID NO: 1820375 - RNA, 16 nt, Homo sapiens
cuaucuucaucugaga

SEQ ID NO: 1820376 - RNA, 15 nt, Homo sapiens
aacacacgugcugug

SEQ ID NO: 1820377 - RNA, 21 nt, Homo sapiens
uaauauuucuucaaauaucuc

SEQ ID NO: 1820378 - RNA, 22 nt, Homo sapiens
aaugucucaugucaaugaccau

SEQ ID NO: 1820379 - RNA, 12 nt, Homo sapiens
uaacugugaaca

SEQ ID NO: 1820380 - RNA, 20 nt, Homo sapiens
cuaacuuauuuuauuuccau

SEQ ID NO: 1820381 - RNA, 19 nt, Homo sapiens
gcauuuccaacaccacaga

SEQ ID NO: 1820382 - RNA, 16 nt, Homo sapiens
accuuccgacauccca

SEQ ID NO: 1820383 - RNA, 19 nt, Homo sapiens
cuaugugccuuucacuuua

SEQ ID NO: 1820384 - RNA, 13 nt, Homo sapiens
gcuucagccucuc

SEQ ID NO: 1820385 - RNA, 21 nt, Homo sapiens
uuucucagcucccaaggcucu

SEQ ID NO: 1820386 - RNA, 22 nt, Homo sapiens
aggauaccaaauaccauguaca

SEQ ID NO: 1820387 - RNA, 14 nt, Homo sapiens
aacuacuaguguga

SEQ ID NO: 1820388 - RNA, 16 nt, Homo sapiens
uggauaugcuagcauu

SEQ ID NO: 1820389 - RNA, 21 nt, Homo sapiens
cccuaccuugucuguuagcca

SEQ ID NO: 1820390 - RNA, 14 nt, Homo sapiens
cccaaaccaggggg

SEQ ID NO: 1820391 - RNA, 20 nt, Homo sapiens
aaugccagaaggauaauauu

SEQ ID NO: 1820392 - RNA, 15 nt, Homo sapiens
ccucccaaagugcug

SEQ ID NO: 1820393 - RNA, 21 nt, Homo sapiens
cuauugauguacagucuguca

SEQ ID NO: 1820394 - RNA, 15 nt, Homo sapiens
auuucaccaagaagu

SEQ ID NO: 1820395 - RNA, 15 nt, Homo sapiens
auggcugaagugcau

SEQ ID NO: 1820396 - RNA, 22 nt, Homo sapiens
caaagcaggaauugguggcaga

SEQ ID NO: 1820397 - RNA, 21 nt, Homo sapiens
uguaauuuugaguacagaauu

SEQ ID NO: 1820398 - RNA, 16 nt, Homo sapiens
uugccagccauucuuu

SEQ ID NO: 1820399 - RNA, 16 nt, Homo sapiens
aacacaccgaugcaca

SEQ ID NO: 1820400 - RNA, 16 nt, Homo sapiens
ggugaacaagcaaacc

SEQ ID NO: 1820401 - RNA, 23 nt, Homo sapiens
aggacugcauuguuuucuagccc

SEQ ID NO: 1820402 - RNA, 15 nt, Homo sapiens
ucuaaugcauguauu

SEQ ID NO: 1820403 - RNA, 15 nt, Homo sapiens
cuggcacaggacuga

SEQ ID NO: 1820404 - RNA, 21 nt, Homo sapiens
cucccaggucgggcaguggag

SEQ ID NO: 1820405 - RNA, 16 nt, Homo sapiens
ggcaugugaugugcaa

SEQ ID NO: 1820406 - RNA, 15 nt, Homo sapiens
uccaguacaguauuc

SEQ ID NO: 1820407 - RNA, 19 nt, Homo sapiens
uucuucggacuauuuucca

SEQ ID NO: 1820408 - RNA, 12 nt, Homo sapiens
ggugcacuggaa

SEQ ID NO: 1820409 - RNA, 15 nt, Homo sapiens
uccuuccaggugauu

SEQ ID NO: 1820410 - RNA, 21 nt, Homo sapiens
gaauucgaugcguauucugug

SEQ ID NO: 1820411 - RNA, 24 nt, Homo sapiens
ucaggacggaaggucaguugccau

SEQ ID NO: 1820412 - RNA, 18 nt, Homo sapiens
cuacaccaacugcucuca

SEQ ID NO: 1820413 - RNA, 17 nt, Homo sapiens
uggaagcucugaaguca

SEQ ID NO: 1820414 - RNA, 17 nt, Homo sapiens
caaagcaaaaagagaug

SEQ ID NO: 1820415 - RNA, 15 nt, Homo sapiens
agaacuaagcacuuu

SEQ ID NO: 1820416 - RNA, 20 nt, Homo sapiens
cuugggggaacgaugugucu

SEQ ID NO: 1820417 - RNA, 11 nt, Homo sapiens
gacuucaucug

SEQ ID NO: 1820418 - RNA, 16 nt, Homo sapiens
uguauuuagugauuau

SEQ ID NO: 1820419 - RNA, 21 nt, Homo sapiens
cucccuucguccaccacucua

SEQ ID NO: 1820420 - RNA, 21 nt, Homo sapiens
gaaaaguuugguaaugggaua

SEQ ID NO: 1820421 - RNA, 21 nt, Homo sapiens
cauauacuuuggggacuugua

SEQ ID NO: 1820422 - RNA, 14 nt, Homo sapiens
cucuacacugugaa

SEQ ID NO: 1820423 - RNA, 23 nt, Homo sapiens
caguuuuguacauagcaaauaaa

SEQ ID NO: 1820424 - RNA, 22 nt, Homo sapiens
uuucaaagcuaaaauauauaau

SEQ ID NO: 1820425 - RNA, 23 nt, Homo sapiens
caccucuuccgacucuuucugag

SEQ ID NO: 1820426 - RNA, 11 nt, Homo sapiens
uucagcauuuu

SEQ ID NO: 1820427 - RNA, 22 nt, Homo sapiens
ucccagaggcagagccugaguc

SEQ ID NO: 1820428 - RNA, 18 nt, Homo sapiens
cugcgccaccucacugca

SEQ ID NO: 1820429 - RNA, 20 nt, Homo sapiens
cuuguuaauuucauuccaaa

SEQ ID NO: 1820430 - RNA, 20 nt, Homo sapiens
ugcaacaauaaaguacuuua

SEQ ID NO: 1820431 - RNA, 22 nt, Homo sapiens
ccagcgcuggcuccaggcuccu

SEQ ID NO: 1820432 - RNA, 18 nt, Homo sapiens
cacauuuauauauauaug

SEQ ID NO: 1820433 - RNA, 18 nt, Homo sapiens
auuacugcaugcacuucu

SEQ ID NO: 1820434 - RNA, 13 nt, Homo sapiens
ugauacguguaug

SEQ ID NO: 1820435 - RNA, 21 nt, Homo sapiens
augacauaaaauuuacauuua

SEQ ID NO: 1820436 - RNA, 18 nt, Homo sapiens
cugcaaaccuuccuggga

SEQ ID NO: 1820437 - RNA, 13 nt, Homo sapiens
caugccucugaua

SEQ ID NO: 1820438 - RNA, 19 nt, Homo sapiens
ccugaagaugggagccuuu

SEQ ID NO: 1820439 - RNA, 15 nt, Homo sapiens
ccugaagaaccaguc

SEQ ID NO: 1820440 - RNA, 17 nt, Homo sapiens
acagaguauauauguac

SEQ ID NO: 1820441 - RNA, 19 nt, Homo sapiens
agucauuguaaucuuucau

SEQ ID NO: 1820442 - RNA, 22 nt, Homo sapiens
aagaacauucuuauauuuuauc

SEQ ID NO: 1820443 - RNA, 23 nt, Homo sapiens
aaaaauuaacaaaagauucugua

SEQ ID NO: 1820444 - RNA, 22 nt, Homo sapiens
acaggcuguucugcacugaaaa

SEQ ID NO: 1820445 - RNA, 14 nt, Homo sapiens
cucugccuuuauga

SEQ ID NO: 1820446 - RNA, 15 nt, Homo sapiens
uugauaagcacauua

SEQ ID NO: 1820447 - RNA, 18 nt, Homo sapiens
ugagggcgucuucuaggg

SEQ ID NO: 1820448 - RNA, 21 nt, Homo sapiens
aauuccaaagcaaaaccagaa

SEQ ID NO: 1820449 - RNA, 13 nt, Homo sapiens
gauggagcuuugu

SEQ ID NO: 1820450 - RNA, 21 nt, Homo sapiens
gcuaagauagaggggcucugg

SEQ ID NO: 1820451 - RNA, 17 nt, Homo sapiens
aaaauaaguaacauaua

SEQ ID NO: 1820452 - RNA, 14 nt, Homo sapiens
uagacaaaaaccau

SEQ ID NO: 1820453 - RNA, 15 nt, Homo sapiens
uaguauuaacuauua

SEQ ID NO: 1820454 - RNA, 15 nt, Homo sapiens
acugaguagcuuuca

SEQ ID NO: 1820455 - RNA, 12 nt, Homo sapiens
ggggugggccac

SEQ ID NO: 1820456 - RNA, 17 nt, Homo sapiens
cuaaacugcugcaaaag

SEQ ID NO: 1820457 - RNA, 18 nt, Homo sapiens
aagaaauccuccaaucaa

SEQ ID NO: 1820458 - RNA, 17 nt, Homo sapiens
uaaguaucuugugcuuc

SEQ ID NO: 1820459 - RNA, 13 nt, Homo sapiens
gacaucaggaaac

SEQ ID NO: 1820460 - RNA, 22 nt, Homo sapiens
agcccuguggccgccaccugag

SEQ ID NO: 1820461 - RNA, 15 nt, Homo sapiens
cccaacuaacaguca

SEQ ID NO: 1820462 - RNA, 15 nt, Homo sapiens
aaccuugcagcauuu

SEQ ID NO: 1820463 - RNA, 20 nt, Homo sapiens
auaaaauauuuuaaguauga

SEQ ID NO: 1820464 - RNA, 18 nt, Homo sapiens
agucaguucucauuauuc

SEQ ID NO: 1820465 - RNA, 19 nt, Homo sapiens
auaaaagaugauuucucaa

SEQ ID NO: 1820466 - RNA, 14 nt, Homo sapiens
auuucugccuauaa

SEQ ID NO: 1820467 - RNA, 12 nt, Homo sapiens
accucugacaca

SEQ ID NO: 1820468 - RNA, 19 nt, Homo sapiens
ucuccugaggaucagaaag

SEQ ID NO: 1820469 - RNA, 11 nt, Homo sapiens
aaugucuccca

SEQ ID NO: 1820470 - RNA, 13 nt, Homo sapiens
ggauugggguccc

SEQ ID NO: 1820471 - RNA, 20 nt, Homo sapiens
cagccaccagggaguggcca

SEQ ID NO: 1820472 - RNA, 14 nt, Homo sapiens
ccaagcugaagcua

SEQ ID NO: 1820473 - RNA, 16 nt, Homo sapiens
ccacccugcaccucau

SEQ ID NO: 1820474 - RNA, 21 nt, Homo sapiens
ucuuagauguauauauuuccu

SEQ ID NO: 1820475 - RNA, 20 nt, Homo sapiens
auauuuauauguacauacau

SEQ ID NO: 1820476 - RNA, 14 nt, Homo sapiens
aguacagacagaag

SEQ ID NO: 1820477 - RNA, 23 nt, Homo sapiens
auaaaggcauuucaaagucucac

SEQ ID NO: 1820478 - RNA, 20 nt, Homo sapiens
acaguguccuaccacucuaa

SEQ ID NO: 1820479 - RNA, 22 nt, Homo sapiens
ucuuccacccauucccccaugu

SEQ ID NO: 1820480 - RNA, 18 nt, Homo sapiens
cucaacucugcugagggu

SEQ ID NO: 1820481 - RNA, 23 nt, Homo sapiens
aaagccaaggucuggagaagcuc

SEQ ID NO: 1820482 - RNA, 23 nt, Homo sapiens
gccauuauuucaaccgcuugcca

SEQ ID NO: 1820483 - RNA, 23 nt, Homo sapiens
auggauucugcaucgguucgcau

SEQ ID NO: 1820484 - RNA, 17 nt, Homo sapiens
gccuugaugacugccuu

SEQ ID NO: 1820485 - RNA, 17 nt, Homo sapiens
auucauuuauuugacau

SEQ ID NO: 1820486 - RNA, 18 nt, Homo sapiens
gugaaaaaggaaugauau

SEQ ID NO: 1820487 - RNA, 16 nt, Homo sapiens
agacugaaccagucca

SEQ ID NO: 1820488 - RNA, 17 nt, Homo sapiens
ggaugaauugccugucc

SEQ ID NO: 1820489 - RNA, 17 nt, Homo sapiens
agagagggcacaucucc

SEQ ID NO: 1820490 - RNA, 21 nt, Homo sapiens
uccccuucucuaaaucagggu

SEQ ID NO: 1820491 - RNA, 19 nt, Homo sapiens
caaaucucaaaguguacaa

SEQ ID NO: 1820492 - RNA, 20 nt, Homo sapiens
uucuuuauugcuuacugugu

SEQ ID NO: 1820493 - RNA, 20 nt, Homo sapiens
ggccacugcagcaccugcca

SEQ ID NO: 1820494 - RNA, 20 nt, Homo sapiens
uaaaaaagaaagaaauuuga

SEQ ID NO: 1820495 - RNA, 12 nt, Homo sapiens
uguucuuugcau

SEQ ID NO: 1820496 - RNA, 21 nt, Homo sapiens
cauauauauauacacauacau

SEQ ID NO: 1820497 - RNA, 20 nt, Homo sapiens
uguucuuaaaaaugcauuua

SEQ ID NO: 1820498 - RNA, 23 nt, Homo sapiens
ugcuauuucagcaacaaccaucu

SEQ ID NO: 1820499 - RNA, 17 nt, Homo sapiens
cuguuuggaagaccaga

SEQ ID NO: 1820500 - RNA, 14 nt, Homo sapiens
augccauucugccu

SEQ ID NO: 1820501 - RNA, 16 nt, Homo sapiens
cauccagcuucucaug

SEQ ID NO: 1820502 - RNA, 21 nt, Homo sapiens
ggcuccugccuugaugaagcc

SEQ ID NO: 1820503 - RNA, 18 nt, Homo sapiens
cugggcaagggaccugcu

SEQ ID NO: 1820504 - RNA, 21 nt, Homo sapiens
auucaauucuuuuaacuguug

SEQ ID NO: 1820505 - RNA, 16 nt, Homo sapiens
uaauauggacauuuau

SEQ ID NO: 1820506 - RNA, 22 nt, Homo sapiens
gacgaagcggagagagccaaga

SEQ ID NO: 1820507 - RNA, 16 nt, Homo sapiens
gugcacugacagccuu

SEQ ID NO: 1820508 - RNA, 17 nt, Homo sapiens
uuuguaccuguaggucu

SEQ ID NO: 1820509 - RNA, 18 nt, Homo sapiens
gaccccucgcaacugucc

SEQ ID NO: 1820510 - RNA, 23 nt, Homo sapiens
caggauuccaguugcgugucugu

SEQ ID NO: 1820511 - RNA, 22 nt, Homo sapiens
uucaauaaacuuuuuuugucug

SEQ ID NO: 1820512 - RNA, 19 nt, Homo sapiens
cuccucccucagacccagg

SEQ ID NO: 1820513 - RNA, 15 nt, Homo sapiens
gucccccccaggugc

SEQ ID NO: 1820514 - RNA, 20 nt, Homo sapiens
guagguucuugggagggaau

SEQ ID NO: 1820515 - RNA, 23 nt, Homo sapiens
aaccguuuccuuucauuuacugu

SEQ ID NO: 1820516 - RNA, 18 nt, Homo sapiens
aaaagucaacaaacugca

SEQ ID NO: 1820517 - RNA, 12 nt, Homo sapiens
ucagauuugccu

SEQ ID NO: 1820518 - RNA, 17 nt, Homo sapiens
acagaaaacaauuguuc

SEQ ID NO: 1820519 - RNA, 21 nt, Homo sapiens
ugagaagaaugaaaaugcagu

SEQ ID NO: 1820520 - RNA, 14 nt, Homo sapiens
cagguucuuuacaa

SEQ ID NO: 1820521 - RNA, 22 nt, Homo sapiens
aaacauuuucaugcacaguaga

SEQ ID NO: 1820522 - RNA, 18 nt, Homo sapiens
gggaaggugggcgggcag

SEQ ID NO: 1820523 - RNA, 18 nt, Homo sapiens
uggagaaguaguauuugc

SEQ ID NO: 1820524 - RNA, 23 nt, Homo sapiens
guuaaucauauuugaaaaccaua

SEQ ID NO: 1820525 - RNA, 18 nt, Homo sapiens
uccugauguuccacucca

SEQ ID NO: 1820526 - RNA, 22 nt, Homo sapiens
uaaagccuuggauguauauguc

SEQ ID NO: 1820527 - RNA, 15 nt, Homo sapiens
uggcuccaacacugc

SEQ ID NO: 1820528 - RNA, 18 nt, Homo sapiens
acaaccaucccugccaca

SEQ ID NO: 1820529 - RNA, 22 nt, Homo sapiens
ucaaagcggaugcuggccacag

SEQ ID NO: 1820530 - RNA, 13 nt, Homo sapiens
cggcugugggugg

SEQ ID NO: 1820531 - RNA, 14 nt, Homo sapiens
cuugcagcuguaaa

SEQ ID NO: 1820532 - RNA, 24 nt, Homo sapiens
auuaauauauaguccagacacuua

SEQ ID NO: 1820533 - RNA, 24 nt, Homo sapiens
agaaguauuuucuaguucugguca

SEQ ID NO: 1820534 - RNA, 23 nt, Homo sapiens
auauugggguuggaacauuucag

SEQ ID NO: 1820535 - RNA, 13 nt, Homo sapiens
ccagcuacauucc

SEQ ID NO: 1820536 - RNA, 19 nt, Homo sapiens
gcucaugccucuaaucuca

SEQ ID NO: 1820537 - RNA, 13 nt, Homo sapiens
gacucagugcaga

SEQ ID NO: 1820538 - RNA, 16 nt, Homo sapiens
gcccagcccuauucau

SEQ ID NO: 1820539 - RNA, 19 nt, Homo sapiens
acagaacucgaugcacuga

SEQ ID NO: 1820540 - RNA, 21 nt, Homo sapiens
aggcaaccgugguuacuguau

SEQ ID NO: 1820541 - RNA, 17 nt, Homo sapiens
ccuguagcagccagucc

SEQ ID NO: 1820542 - RNA, 13 nt, Homo sapiens
gcuuccagugcau

SEQ ID NO: 1820543 - RNA, 18 nt, Homo sapiens
aauguaauauucuuuugu

SEQ ID NO: 1820544 - RNA, 21 nt, Homo sapiens
uggcuagcaaucugccuguau

SEQ ID NO: 1820545 - RNA, 19 nt, Homo sapiens
cuaaaguccagacuaugga

SEQ ID NO: 1820546 - RNA, 18 nt, Homo sapiens
uucaaggaacagccacaa

SEQ ID NO: 1820547 - RNA, 22 nt, Homo sapiens
aggggaacuagguuaccgcuua

SEQ ID NO: 1820548 - RNA, 19 nt, Homo sapiens
aauuagguuuuguacaauu

SEQ ID NO: 1820549 - RNA, 21 nt, Homo sapiens
accaagaauguuaugugcaag

SEQ ID NO: 1820550 - RNA, 19 nt, Homo sapiens
cuccaagcuccucugugaa

SEQ ID NO: 1820551 - RNA, 20 nt, Homo sapiens
caggaagguaaaaacccagc

SEQ ID NO: 1820552 - RNA, 19 nt, Homo sapiens
caucugcaguacagucuua

SEQ ID NO: 1820553 - RNA, 15 nt, Homo sapiens
gugcuaaaaggaaua

SEQ ID NO: 1820554 - RNA, 19 nt, Homo sapiens
cuuuuucccaacuuuggaa

SEQ ID NO: 1820555 - RNA, 18 nt, Homo sapiens
cuuucuuauccuagcaca

SEQ ID NO: 1820556 - RNA, 20 nt, Homo sapiens
gugaucucccaagcuaucua

SEQ ID NO: 1820557 - RNA, 12 nt, Homo sapiens
uucacagugaag

SEQ ID NO: 1820558 - RNA, 14 nt, Homo sapiens
gccccugcccugag

SEQ ID NO: 1820559 - RNA, 21 nt, Homo sapiens
ucaggaaggucuucaaucuua

SEQ ID NO: 1820560 - RNA, 13 nt, Homo sapiens
gacuagcuuucag

SEQ ID NO: 1820561 - RNA, 17 nt, Homo sapiens
caauuccaaagccagac

SEQ ID NO: 1820562 - RNA, 21 nt, Homo sapiens
cugacaaucaguuaaacacac

SEQ ID NO: 1820563 - RNA, 12 nt, Homo sapiens
acugugauuaga

SEQ ID NO: 1820564 - RNA, 15 nt, Homo sapiens
uaguugaacaucuca

SEQ ID NO: 1820565 - RNA, 18 nt, Homo sapiens
ucagacuuaaagcacuga

SEQ ID NO: 1820566 - RNA, 16 nt, Homo sapiens
ggacauacauuuaaua

SEQ ID NO: 1820567 - RNA, 20 nt, Homo sapiens
cccacucugcauacccucau

SEQ ID NO: 1820568 - RNA, 22 nt, Homo sapiens
uuugugccauccccauaguaau

SEQ ID NO: 1820569 - RNA, 20 nt, Homo sapiens
aaucaaucuggcuucugcau

SEQ ID NO: 1820570 - RNA, 18 nt, Homo sapiens
gcagaacaaaugaagaca

SEQ ID NO: 1820571 - RNA, 19 nt, Homo sapiens
uucuucacagugcagugaa

SEQ ID NO: 1820572 - RNA, 22 nt, Homo sapiens
guccucaggggaggacuaggaa

SEQ ID NO: 1820573 - RNA, 21 nt, Homo sapiens
acucuguccuuacauacucaa

SEQ ID NO: 1820574 - RNA, 20 nt, Homo sapiens
aaguuccaaaauaaagcaua

SEQ ID NO: 1820575 - RNA, 18 nt, Homo sapiens
auuaaucaaggcauaaaa

SEQ ID NO: 1820576 - RNA, 15 nt, Homo sapiens
gcaaaauaaagccau

SEQ ID NO: 1820577 - RNA, 20 nt, Homo sapiens
uaacuaaauuugucuuucaa

SEQ ID NO: 1820578 - RNA, 17 nt, Homo sapiens
ucacucuguugccauua

SEQ ID NO: 1820579 - RNA, 16 nt, Homo sapiens
uagagcagacuacagc

SEQ ID NO: 1820580 - RNA, 18 nt, Homo sapiens
auugcucccaggaucucc

SEQ ID NO: 1820581 - RNA, 14 nt, Homo sapiens
ccagcccugacuaa

SEQ ID NO: 1820582 - RNA, 13 nt, Homo sapiens
augaauugucuaa

SEQ ID NO: 1820583 - RNA, 14 nt, Homo sapiens
ccuuguuucuacug

SEQ ID NO: 1820584 - RNA, 20 nt, Homo sapiens
cuaugaacuuggauauucaa

SEQ ID NO: 1820585 - RNA, 15 nt, Homo sapiens
acugauuacuguaga

SEQ ID NO: 1820586 - RNA, 17 nt, Homo sapiens
acuuaaggaaguuugau

SEQ ID NO: 1820587 - RNA, 15 nt, Homo sapiens
ggaucuucacugucu

SEQ ID NO: 1820588 - RNA, 14 nt, Homo sapiens
agguugaauuaauu

SEQ ID NO: 1820589 - RNA, 20 nt, Homo sapiens
cacacaaaaaaucaaguuga

SEQ ID NO: 1820590 - RNA, 15 nt, Homo sapiens
gaagaccccugccca

SEQ ID NO: 1820591 - RNA, 18 nt, Homo sapiens
uaugcugguagaugcuga

SEQ ID NO: 1820592 - RNA, 21 nt, Homo sapiens
cucuuggaauuacaagcccug

SEQ ID NO: 1820593 - RNA, 17 nt, Homo sapiens
acaggggugucuugucu

SEQ ID NO: 1820594 - RNA, 17 nt, Homo sapiens
augaugaagaccaaaga

SEQ ID NO: 1820595 - RNA, 16 nt, Homo sapiens
aggacucaaaguuuca

SEQ ID NO: 1820596 - RNA, 12 nt, Homo sapiens
uuucugugagaa

SEQ ID NO: 1820597 - RNA, 22 nt, Homo sapiens
aacauauaacuauugaguuaca

SEQ ID NO: 1820598 - RNA, 20 nt, Homo sapiens
uucugaguaaguguguucau

SEQ ID NO: 1820599 - RNA, 21 nt, Homo sapiens
aggcugagugcauaggugaca

SEQ ID NO: 1820600 - RNA, 20 nt, Homo sapiens
ugcauuuucuacauguauua

SEQ ID NO: 1820601 - RNA, 22 nt, Homo sapiens
cuauuggcauaaaacaaaccag

SEQ ID NO: 1820602 - RNA, 14 nt, Homo sapiens
cccaguguccuucc

SEQ ID NO: 1820603 - RNA, 14 nt, Homo sapiens
gagcuuacauugaa

SEQ ID NO: 1820604 - RNA, 15 nt, Homo sapiens
auauggugucuugau

SEQ ID NO: 1820605 - RNA, 19 nt, Homo sapiens
caucguuuucuucacuguc

SEQ ID NO: 1820606 - RNA, 20 nt, Homo sapiens
agcucucgauggacaaugaa

SEQ ID NO: 1820607 - RNA, 13 nt, Homo sapiens
cugacaguagccu

SEQ ID NO: 1820608 - RNA, 13 nt, Homo sapiens
gaauaauuucacu

SEQ ID NO: 1820609 - RNA, 15 nt, Homo sapiens
uacugagauagcuua

SEQ ID NO: 1820610 - RNA, 18 nt, Homo sapiens
acccugucaccuagcuca

SEQ ID NO: 1820611 - RNA, 22 nt, Homo sapiens
uccagugaguaccugcaaaaau

SEQ ID NO: 1820612 - RNA, 13 nt, Homo sapiens
aaaacaguucuca

SEQ ID NO: 1820613 - RNA, 23 nt, Homo sapiens
aaaggacuagccacauacuagca

SEQ ID NO: 1820614 - RNA, 13 nt, Homo sapiens
aacacaucacuua

SEQ ID NO: 1820615 - RNA, 13 nt, Homo sapiens
aauugugccuuug

SEQ ID NO: 1820616 - RNA, 17 nt, Homo sapiens
acuauuuuugcacauug

SEQ ID NO: 1820617 - RNA, 22 nt, Homo sapiens
aaacuuuuaauuaaaugcucau

SEQ ID NO: 1820618 - RNA, 15 nt, Homo sapiens
cuguggguauucacc

SEQ ID NO: 1820619 - RNA, 15 nt, Homo sapiens
auccagucuauucac

SEQ ID NO: 1820620 - RNA, 20 nt, Homo sapiens
cagucuggugcccagacuca

SEQ ID NO: 1820621 - RNA, 17 nt, Homo sapiens
ugcuuugaaacuugccu

SEQ ID NO: 1820622 - RNA, 13 nt, Homo sapiens
aacauuuguuaga

SEQ ID NO: 1820623 - RNA, 18 nt, Homo sapiens
ugacgaagacgccaaaaa

SEQ ID NO: 1820624 - RNA, 16 nt, Homo sapiens
uccuccccaccagagc

SEQ ID NO: 1820625 - RNA, 15 nt, Homo sapiens
ugaagcagguuccca

SEQ ID NO: 1820626 - RNA, 23 nt, Homo sapiens
auauuacuuguuuucacuuuauc

SEQ ID NO: 1820627 - RNA, 20 nt, Homo sapiens
aggccugcuuuuguguccca

SEQ ID NO: 1820628 - RNA, 15 nt, Homo sapiens
ucccaagagcauaac

SEQ ID NO: 1820629 - RNA, 14 nt, Homo sapiens
ccacuguuuugaau

SEQ ID NO: 1820630 - RNA, 19 nt, Homo sapiens
guugacuggcuuuccucuc

SEQ ID NO: 1820631 - RNA, 18 nt, Homo sapiens
uauaugaauuuccacuuu

SEQ ID NO: 1820632 - RNA, 22 nt, Homo sapiens
gacucuauucuuuaacucccau

SEQ ID NO: 1820633 - RNA, 22 nt, Homo sapiens
aggaaauucuugaaaauauaag

SEQ ID NO: 1820634 - RNA, 21 nt, Homo sapiens
gagagcccccacccaguuccu

SEQ ID NO: 1820635 - RNA, 16 nt, Homo sapiens
aguaaugccacacauu

SEQ ID NO: 1820636 - RNA, 13 nt, Homo sapiens
agggaacagugag

SEQ ID NO: 1820637 - RNA, 21 nt, Homo sapiens
gguauuuugauagauacugga

SEQ ID NO: 1820638 - RNA, 15 nt, Homo sapiens
guauaaugaacacuc

SEQ ID NO: 1820639 - RNA, 22 nt, Homo sapiens
ugauaauaguuuuuucuuuuaa

SEQ ID NO: 1820640 - RNA, 23 nt, Homo sapiens
gcagacugcugcuagagccagca

SEQ ID NO: 1820641 - RNA, 14 nt, Homo sapiens
ccccacucagcugu

SEQ ID NO: 1820642 - RNA, 20 nt, Homo sapiens
gcaaauuucuauaaauuuaa

SEQ ID NO: 1820643 - RNA, 14 nt, Homo sapiens
cauccccacagcug

SEQ ID NO: 1820644 - RNA, 18 nt, Homo sapiens
gauuguauaaaugcaaua

SEQ ID NO: 1820645 - RNA, 18 nt, Homo sapiens
uaaaucgugauauugaaa

SEQ ID NO: 1820646 - RNA, 20 nt, Homo sapiens
ccugcacagauaccucauca

SEQ ID NO: 1820647 - RNA, 16 nt, Homo sapiens
gaaguggguggggaca

SEQ ID NO: 1820648 - RNA, 15 nt, Homo sapiens
aucaaaaucaaugca

SEQ ID NO: 1820649 - RNA, 20 nt, Homo sapiens
auauggggaaaaaacugugc

SEQ ID NO: 1820650 - RNA, 22 nt, Homo sapiens
ugaacuuaucaaaaaugcaaau

SEQ ID NO: 1820651 - RNA, 12 nt, Homo sapiens
caucuuuccauc

SEQ ID NO: 1820652 - RNA, 18 nt, Homo sapiens
ucuagccuagaagauaca

SEQ ID NO: 1820653 - RNA, 18 nt, Homo sapiens
accacacuguuacgaugc

SEQ ID NO: 1820654 - RNA, 22 nt, Homo sapiens
cugcaaagcccuuggaacaccc

SEQ ID NO: 1820655 - RNA, 16 nt, Homo sapiens
agugaagugaaucuga

SEQ ID NO: 1820656 - RNA, 16 nt, Homo sapiens
gugccuuguccaggaa

SEQ ID NO: 1820657 - RNA, 20 nt, Homo sapiens
cucuguguacccacuccuca

SEQ ID NO: 1820658 - RNA, 14 nt, Homo sapiens
ggucccagagggug

SEQ ID NO: 1820659 - RNA, 13 nt, Homo sapiens
gagaggcaggcau

SEQ ID NO: 1820660 - RNA, 13 nt, Homo sapiens
aaauucuaauggu

SEQ ID NO: 1820661 - RNA, 14 nt, Homo sapiens
aauuucauuuccag

SEQ ID NO: 1820662 - RNA, 18 nt, Homo sapiens
uuagcacauauuucacau

SEQ ID NO: 1820663 - RNA, 19 nt, Homo sapiens
ucucacuaaagauguuagu

SEQ ID NO: 1820664 - RNA, 14 nt, Homo sapiens
uuacaacuccugca

SEQ ID NO: 1820665 - RNA, 14 nt, Homo sapiens
uuaguucuuuggaa

SEQ ID NO: 1820666 - RNA, 17 nt, Homo sapiens
gcaacugcgacaaaaca

SEQ ID NO: 1820667 - RNA, 22 nt, Homo sapiens
gucucuguggcaggccugguca

SEQ ID NO: 1820668 - RNA, 17 nt, Homo sapiens
aaagagagcaagacaga

SEQ ID NO: 1820669 - RNA, 20 nt, Homo sapiens
augaaaugcuaugucauuuc

SEQ ID NO: 1820670 - RNA, 9 nt, Homo sapiens
ccucaggcu

SEQ ID NO: 1820671 - RNA, 23 nt, Homo sapiens
agaauugcaauuuuaacacacau

SEQ ID NO: 1820672 - RNA, 23 nt, Homo sapiens
auuaaucuucagcugaacacaag

SEQ ID NO: 1820673 - RNA, 17 nt, Homo sapiens
ccugagcgggagucagg

SEQ ID NO: 1820674 - RNA, 15 nt, Homo sapiens
ucuucagcugccagu

SEQ ID NO: 1820675 - RNA, 13 nt, Homo sapiens
aagacuacugaag

SEQ ID NO: 1820676 - RNA, 22 nt, Homo sapiens
gagucauguugaaggugcccaa

SEQ ID NO: 1820677 - RNA, 21 nt, Homo sapiens
uagcaaacuuuguaugucauu

SEQ ID NO: 1820678 - RNA, 21 nt, Homo sapiens
gcucagccaggugcugugaca

SEQ ID NO: 1820679 - RNA, 20 nt, Homo sapiens
uacuuauugauuuaaaaaca

SEQ ID NO: 1820680 - RNA, 21 nt, Homo sapiens
ucuaauugcccacccaguaug

SEQ ID NO: 1820681 - RNA, 16 nt, Homo sapiens
aggcauaagucauucc

SEQ ID NO: 1820682 - RNA, 17 nt, Homo sapiens
ccacauugcuucauuaa

SEQ ID NO: 1820683 - RNA, 17 nt, Homo sapiens
gaucuuugcccauggaa

SEQ ID NO: 1820684 - RNA, 16 nt, Homo sapiens
auuuaucaagcauuua

SEQ ID NO: 1820685 - RNA, 14 nt, Homo sapiens
uuucuuuugcagga

SEQ ID NO: 1820686 - RNA, 19 nt, Homo sapiens
auauuaguauguaugugua

SEQ ID NO: 1820687 - RNA, 18 nt, Homo sapiens
agucaauccugucauaua

SEQ ID NO: 1820688 - RNA, 19 nt, Homo sapiens
ugccaccaacacugcucac

SEQ ID NO: 1820689 - RNA, 20 nt, Homo sapiens
cccuggcaucugacacugac

SEQ ID NO: 1820690 - RNA, 18 nt, Homo sapiens
aagcuagagagaaaaaga

SEQ ID NO: 1820691 - RNA, 18 nt, Homo sapiens
aggcuggagugcaauggu

SEQ ID NO: 1820692 - RNA, 15 nt, Homo sapiens
gcucauaaacugcca

SEQ ID NO: 1820693 - RNA, 14 nt, Homo sapiens
augcauucauccaa

SEQ ID NO: 1820694 - RNA, 14 nt, Homo sapiens
acaaugcagugccu

SEQ ID NO: 1820695 - RNA, 18 nt, Homo sapiens
auuuaagacacuguuaca

SEQ ID NO: 1820696 - RNA, 15 nt, Homo sapiens
aauauauucaguaau

SEQ ID NO: 1820697 - RNA, 20 nt, Homo sapiens
guaauuugugauacaaugcu

SEQ ID NO: 1820698 - RNA, 14 nt, Homo sapiens
ugacugaacuguaa

SEQ ID NO: 1820699 - RNA, 14 nt, Homo sapiens
agcacaaauuugcu

SEQ ID NO: 1820700 - RNA, 23 nt, Homo sapiens
cccuguccggaaugccacccaca

SEQ ID NO: 1820701 - RNA, 21 nt, Homo sapiens
aaaggguuuuaagccagggca

SEQ ID NO: 1820702 - RNA, 12 nt, Homo sapiens
aaagaugggcaa

SEQ ID NO: 1820703 - RNA, 20 nt, Homo sapiens
gcccagcacugcccauccca

SEQ ID NO: 1820704 - RNA, 23 nt, Homo sapiens
uguggaggagagggguggaggcu

SEQ ID NO: 1820705 - RNA, 20 nt, Homo sapiens
caggguugaucacacucugg

SEQ ID NO: 1820706 - RNA, 19 nt, Homo sapiens
agaacuucagcauuguaau

SEQ ID NO: 1820707 - RNA, 16 nt, Homo sapiens
agacucauuguaauuc

SEQ ID NO: 1820708 - RNA, 20 nt, Homo sapiens
caguaacaaucugcuuucuu

SEQ ID NO: 1820709 - RNA, 20 nt, Homo sapiens
uguauaucaugaaacacuuc

SEQ ID NO: 1820710 - RNA, 18 nt, Homo sapiens
caaaauaaugucuuguua

SEQ ID NO: 1820711 - RNA, 23 nt, Homo sapiens
aagcagaagaccagauccaagau

SEQ ID NO: 1820712 - RNA, 19 nt, Homo sapiens
caaaucugaaucgaauuac

SEQ ID NO: 1820713 - RNA, 23 nt, Homo sapiens
uauauaaacgguuaacaauauua

SEQ ID NO: 1820714 - RNA, 18 nt, Homo sapiens
auuuauuuuccuaaagag

SEQ ID NO: 1820715 - RNA, 22 nt, Homo sapiens
uccuggguguggggacacaguc

SEQ ID NO: 1820716 - RNA, 16 nt, Homo sapiens
cuccacccacagugga

SEQ ID NO: 1820717 - RNA, 22 nt, Homo sapiens
ugcagcgacccuugguguuucc

SEQ ID NO: 1820718 - RNA, 13 nt, Homo sapiens
ucagccugcacag

SEQ ID NO: 1820719 - RNA, 13 nt, Homo sapiens
ggaaguccuugcc

SEQ ID NO: 1820720 - RNA, 14 nt, Homo sapiens
cauccugugugcug

SEQ ID NO: 1820721 - RNA, 19 nt, Homo sapiens
aagcuuucagguguuacag

SEQ ID NO: 1820722 - RNA, 17 nt, Homo sapiens
agacucacgcugacugc

SEQ ID NO: 1820723 - RNA, 17 nt, Homo sapiens
aagcugagcaaccucuu

SEQ ID NO: 1820724 - RNA, 17 nt, Homo sapiens
uguuaugaggagcugca

SEQ ID NO: 1820725 - RNA, 13 nt, Homo sapiens
gauguacacacac

SEQ ID NO: 1820726 - RNA, 23 nt, Homo sapiens
acaguuggauuuauucugccaaa

SEQ ID NO: 1820727 - RNA, 20 nt, Homo sapiens
guaucuaccuuuugcuacuu

SEQ ID NO: 1820728 - RNA, 19 nt, Homo sapiens
ggguaaccaaauguuggcc

SEQ ID NO: 1820729 - RNA, 22 nt, Homo sapiens
acuuggacacgguaacuguugc

SEQ ID NO: 1820730 - RNA, 16 nt, Homo sapiens
gggcuguucacucucu

SEQ ID NO: 1820731 - RNA, 23 nt, Homo sapiens
accgauuugcacccaugccauag

SEQ ID NO: 1820732 - RNA, 19 nt, Homo sapiens
gacacauaugcaccuugug

SEQ ID NO: 1820733 - RNA, 17 nt, Homo sapiens
acuauccugauuccaaa

SEQ ID NO: 1820734 - RNA, 22 nt, Homo sapiens
uggcuggcuuguuugauuucaa

SEQ ID NO: 1820735 - RNA, 23 nt, Homo sapiens
uaaaucauucuacuuuugcacuu

SEQ ID NO: 1820736 - RNA, 19 nt, Homo sapiens
uaaagugucauccaccagu

SEQ ID NO: 1820737 - RNA, 12 nt, Homo sapiens
agcguucccaac

SEQ ID NO: 1820738 - RNA, 22 nt, Homo sapiens
uacaugacaucaaaaugaguca

SEQ ID NO: 1820739 - RNA, 20 nt, Homo sapiens
cccccaaccaucuucacugg

SEQ ID NO: 1820740 - RNA, 15 nt, Homo sapiens
agaagagaaggggag

SEQ ID NO: 1820741 - RNA, 19 nt, Homo sapiens
ucagauuuuuaaaagcccu

SEQ ID NO: 1820742 - RNA, 22 nt, Homo sapiens
agcugaaaugguccaguacaaa

SEQ ID NO: 1820743 - RNA, 22 nt, Homo sapiens
uaauauugauaagcuauugucu

SEQ ID NO: 1820744 - RNA, 14 nt, Homo sapiens
cauuuaaaaaacau

SEQ ID NO: 1820745 - RNA, 16 nt, Homo sapiens
uaacuggcacccagag

SEQ ID NO: 1820746 - RNA, 19 nt, Homo sapiens
gaguugaucaaaaucaauu

SEQ ID NO: 1820747 - RNA, 16 nt, Homo sapiens
agccacaacacccagc

SEQ ID NO: 1820748 - RNA, 16 nt, Homo sapiens
auucuggaaucacaaa

SEQ ID NO: 1820749 - RNA, 16 nt, Homo sapiens
guugaaaccaccguga

SEQ ID NO: 1820750 - RNA, 16 nt, Homo sapiens
ugaaaagaugguauca

SEQ ID NO: 1820751 - RNA, 13 nt, Homo sapiens
caaauacauuccu

SEQ ID NO: 1820752 - RNA, 21 nt, Homo sapiens
ccaacuuuuaaugggauuuca

SEQ ID NO: 1820753 - RNA, 23 nt, Homo sapiens
aauaggcggggcacgguggcuca

SEQ ID NO: 1820754 - RNA, 19 nt, Homo sapiens
agucuccccaccucuuccc

SEQ ID NO: 1820755 - RNA, 17 nt, Homo sapiens
uuuauaagcauugccau

SEQ ID NO: 1820756 - RNA, 16 nt, Homo sapiens
cuguaggaauaagcau

SEQ ID NO: 1820757 - RNA, 19 nt, Homo sapiens
cgccaaguuggagugcaau

SEQ ID NO: 1820758 - RNA, 17 nt, Homo sapiens
uccaaauaauuugaaca

SEQ ID NO: 1820759 - RNA, 20 nt, Homo sapiens
ugugcauuuugugugaugca

SEQ ID NO: 1820760 - RNA, 21 nt, Homo sapiens
ugcagaaaauucugugccuug

SEQ ID NO: 1820761 - RNA, 22 nt, Homo sapiens
ucggcagccuuaaggcccucau

SEQ ID NO: 1820762 - RNA, 14 nt, Homo sapiens
ccucaagugagcca

SEQ ID NO: 1820763 - RNA, 12 nt, Homo sapiens
ccacacuugaau

SEQ ID NO: 1820764 - RNA, 18 nt, Homo sapiens
aaaauuauuuuguucaua

SEQ ID NO: 1820765 - RNA, 20 nt, Homo sapiens
aaucaaguuguaacuuauau

SEQ ID NO: 1820766 - RNA, 15 nt, Homo sapiens
gcugcgggcacccau

SEQ ID NO: 1820767 - RNA, 22 nt, Homo sapiens
acuaucuuuucaucucauuaau

SEQ ID NO: 1820768 - RNA, 16 nt, Homo sapiens
auuccagucuacuuga

SEQ ID NO: 1820769 - RNA, 18 nt, Homo sapiens
gcugauggccuuguuuca

SEQ ID NO: 1820770 - RNA, 16 nt, Homo sapiens
caaacagccccaaagu

SEQ ID NO: 1820771 - RNA, 14 nt, Homo sapiens
accggcguccugcc

SEQ ID NO: 1820772 - RNA, 13 nt, Homo sapiens
uaugaaaugaccu

SEQ ID NO: 1820773 - RNA, 13 nt, Homo sapiens
guaucugugaaca

SEQ ID NO: 1820774 - RNA, 14 nt, Homo sapiens
gaguacauacucaa

SEQ ID NO: 1820775 - RNA, 17 nt, Homo sapiens
ucaaaauaaaaaguaau

SEQ ID NO: 1820776 - RNA, 18 nt, Homo sapiens
agugccauuacuacugua

SEQ ID NO: 1820777 - RNA, 20 nt, Homo sapiens
cccuguccuaugacuugauc

SEQ ID NO: 1820778 - RNA, 20 nt, Homo sapiens
cccagccugggcuccucugc

SEQ ID NO: 1820779 - RNA, 19 nt, Homo sapiens
uccagaucauuccucagaa

SEQ ID NO: 1820780 - RNA, 23 nt, Homo sapiens
ccauuggaggggcuggcacugga

SEQ ID NO: 1820781 - RNA, 19 nt, Homo sapiens
ggagaauaauucuuugauu

SEQ ID NO: 1820782 - RNA, 14 nt, Homo sapiens
uccuucugugaaag

SEQ ID NO: 1820783 - RNA, 23 nt, Homo sapiens
ggaggccauccaagauggcauga

SEQ ID NO: 1820784 - RNA, 15 nt, Homo sapiens
auccuaggcauuugc

SEQ ID NO: 1820785 - RNA, 17 nt, Homo sapiens
gagcguuagaggggcca

SEQ ID NO: 1820786 - RNA, 16 nt, Homo sapiens
cucccaguucuacaag

SEQ ID NO: 1820787 - RNA, 20 nt, Homo sapiens
ucuuucucugagaaccaaaa

SEQ ID NO: 1820788 - RNA, 21 nt, Homo sapiens
aauuuguggaaaauaacucac

SEQ ID NO: 1820789 - RNA, 14 nt, Homo sapiens
uuuauuugagguca

SEQ ID NO: 1820790 - RNA, 13 nt, Homo sapiens
cugcuagaacuuu

SEQ ID NO: 1820791 - RNA, 23 nt, Homo sapiens
gugcaaggaccuaaaacaucuca

SEQ ID NO: 1820792 - RNA, 19 nt, Homo sapiens
cugcucaagucuacccuga

SEQ ID NO: 1820793 - RNA, 20 nt, Homo sapiens
ucaggacucaaucuacaggc

SEQ ID NO: 1820794 - RNA, 16 nt, Homo sapiens
aagagggucugaggaa

SEQ ID NO: 1820795 - RNA, 14 nt, Homo sapiens
acacuccaggugug

SEQ ID NO: 1820796 - RNA, 22 nt, Homo sapiens
ucuuguaacuggguucaaaaag

SEQ ID NO: 1820797 - RNA, 23 nt, Homo sapiens
uccacggagccacuccucugacu

SEQ ID NO: 1820798 - RNA, 21 nt, Homo sapiens
gccagcaggagcucugacuaa

SEQ ID NO: 1820799 - RNA, 18 nt, Homo sapiens
agaauuuucugcauuauc

SEQ ID NO: 1820800 - RNA, 14 nt, Homo sapiens
cuuccaauguggug

SEQ ID NO: 1820801 - RNA, 18 nt, Homo sapiens
agccaauaacacacagcu

SEQ ID NO: 1820802 - RNA, 13 nt, Homo sapiens
agaaccagugcuu

SEQ ID NO: 1820803 - RNA, 14 nt, Homo sapiens
uaauucaugauuca

SEQ ID NO: 1820804 - RNA, 16 nt, Homo sapiens
uuaaaauaacuuguau

SEQ ID NO: 1820805 - RNA, 22 nt, Homo sapiens
guaauuggaaucuucaccucag

SEQ ID NO: 1820806 - RNA, 20 nt, Homo sapiens
aguacuauugcuaguacuag

SEQ ID NO: 1820807 - RNA, 13 nt, Homo sapiens
caagaguauucca

SEQ ID NO: 1820808 - RNA, 15 nt, Homo sapiens
auuuguagcacugag

SEQ ID NO: 1820809 - RNA, 15 nt, Homo sapiens
cuuuuaggaacuuua

SEQ ID NO: 1820810 - RNA, 20 nt, Homo sapiens
accuccgggaaaagauucua

SEQ ID NO: 1820811 - RNA, 21 nt, Homo sapiens
agccaggugugguggugcaca

SEQ ID NO: 1820812 - RNA, 15 nt, Homo sapiens
augugcaaguuuauc

SEQ ID NO: 1820813 - RNA, 18 nt, Homo sapiens
cuuguuaaagagcacugg

SEQ ID NO: 1820814 - RNA, 15 nt, Homo sapiens
gccuuuguggugggc

SEQ ID NO: 1820815 - RNA, 20 nt, Homo sapiens
cucaaaugcuggcaaaucca

SEQ ID NO: 1820816 - RNA, 13 nt, Homo sapiens
auauaaauucugu

SEQ ID NO: 1820817 - RNA, 14 nt, Homo sapiens
augggccugaguga

SEQ ID NO: 1820818 - RNA, 21 nt, Homo sapiens
uugcgaccaccaacacacagg

SEQ ID NO: 1820819 - RNA, 19 nt, Homo sapiens
cccuaaccucugagucacc

SEQ ID NO: 1820820 - RNA, 17 nt, Homo sapiens
uuucaccguauuagcca

SEQ ID NO: 1820821 - RNA, 20 nt, Homo sapiens
acccugccccuuucuucccc

SEQ ID NO: 1820822 - RNA, 19 nt, Homo sapiens
auauuucuuuucuaucuca

SEQ ID NO: 1820823 - RNA, 16 nt, Homo sapiens
guuuuauuagcauuuu

SEQ ID NO: 1820824 - RNA, 20 nt, Homo sapiens
cagaccuuuuaacuccucaa

SEQ ID NO: 1820825 - RNA, 15 nt, Homo sapiens
auaaagugauugacu

SEQ ID NO: 1820826 - RNA, 17 nt, Homo sapiens
ucugcuacccacugcca

SEQ ID NO: 1820827 - RNA, 23 nt, Homo sapiens
uucugcuaguggugagcauguaa

SEQ ID NO: 1820828 - RNA, 20 nt, Homo sapiens
gcaaugauaaauaaagucau

SEQ ID NO: 1820829 - RNA, 15 nt, Homo sapiens
uaugcaggacugauc

SEQ ID NO: 1820830 - RNA, 20 nt, Homo sapiens
caggcuacaaucuucauuua

SEQ ID NO: 1820831 - RNA, 21 nt, Homo sapiens
caaagcaggggaguaugcaaa

SEQ ID NO: 1820832 - RNA, 21 nt, Homo sapiens
acuaaggaagauuacucagua

SEQ ID NO: 1820833 - RNA, 19 nt, Homo sapiens
ugggggacgugggcauuuu

SEQ ID NO: 1820834 - RNA, 18 nt, Homo sapiens
caagccacagaagccagg

SEQ ID NO: 1820835 - RNA, 19 nt, Homo sapiens
uagaauaaauauaaaaugg

SEQ ID NO: 1820836 - RNA, 19 nt, Homo sapiens
aucacauccuuauccuuca

SEQ ID NO: 1820837 - RNA, 20 nt, Homo sapiens
aucacccaaaacuuuuggca

SEQ ID NO: 1820838 - RNA, 18 nt, Homo sapiens
caauucuacccagagccu

SEQ ID NO: 1820839 - RNA, 21 nt, Homo sapiens
uggccuagcaggcacaggaca

SEQ ID NO: 1820840 - RNA, 17 nt, Homo sapiens
aaaaauucucaguucuc

SEQ ID NO: 1820841 - RNA, 21 nt, Homo sapiens
caaaaucauuuuauaugucaa

SEQ ID NO: 1820842 - RNA, 14 nt, Homo sapiens
cugaggaugcuuuu

SEQ ID NO: 1820843 - RNA, 21 nt, Homo sapiens
uucaccaaaauagucuucuca

SEQ ID NO: 1820844 - RNA, 11 nt, Homo sapiens
aaaagaacaau

SEQ ID NO: 1820845 - RNA, 21 nt, Homo sapiens
gagcucagacaccugugugcu

SEQ ID NO: 1820846 - RNA, 13 nt, Homo sapiens
aggaucccuccau

SEQ ID NO: 1820847 - RNA, 23 nt, Homo sapiens
uuguuuucccgagcaaagucuaa

SEQ ID NO: 1820848 - RNA, 23 nt, Homo sapiens
ccuuucccuuuagcacguuuaaa

SEQ ID NO: 1820849 - RNA, 20 nt, Homo sapiens
aaaaucacaagcaauaauua

SEQ ID NO: 1820850 - RNA, 14 nt, Homo sapiens
uacucaacauuauu

SEQ ID NO: 1820851 - RNA, 14 nt, Homo sapiens
ucauuuuacucaga

SEQ ID NO: 1820852 - RNA, 17 nt, Homo sapiens
ugaucuuugucuuuauu

SEQ ID NO: 1820853 - RNA, 13 nt, Homo sapiens
aacuccuagacuc

SEQ ID NO: 1820854 - RNA, 20 nt, Homo sapiens
uguaggaaauguaagauuuc

SEQ ID NO: 1820855 - RNA, 14 nt, Homo sapiens
aagagauauuuucc

SEQ ID NO: 1820856 - RNA, 15 nt, Homo sapiens
gcccuccauccgugc

SEQ ID NO: 1820857 - RNA, 19 nt, Homo sapiens
ucaguggagagauguuugg

SEQ ID NO: 1820858 - RNA, 18 nt, Homo sapiens
uagcacugacugaacugu

SEQ ID NO: 1820859 - RNA, 21 nt, Homo sapiens
cugaaacccgcccucaggggc

SEQ ID NO: 1820860 - RNA, 18 nt, Homo sapiens
aaugauaagugacaaaag

SEQ ID NO: 1820861 - RNA, 13 nt, Homo sapiens
ccagaucuuucag

SEQ ID NO: 1820862 - RNA, 20 nt, Homo sapiens
cuaagggcgcuugucccauc

SEQ ID NO: 1820863 - RNA, 19 nt, Homo sapiens
cucucagaacccacaccag

SEQ ID NO: 1820864 - RNA, 14 nt, Homo sapiens
auccuugaugaauc

SEQ ID NO: 1820865 - RNA, 24 nt, Homo sapiens
aaauguaaaacacaagacugucau

SEQ ID NO: 1820866 - RNA, 21 nt, Homo sapiens
ugaaaugaccaagacagguuc

SEQ ID NO: 1820867 - RNA, 16 nt, Homo sapiens
uuuaugaagugcuaca

SEQ ID NO: 1820868 - RNA, 23 nt, Homo sapiens
auaucaugccccuguacuccagc

SEQ ID NO: 1820869 - RNA, 15 nt, Homo sapiens
ugcucccuagccaga

SEQ ID NO: 1820870 - RNA, 22 nt, Homo sapiens
guaucuaauucuccugacuguu

SEQ ID NO: 1820871 - RNA, 15 nt, Homo sapiens
uaccagcuaacucca

SEQ ID NO: 1820872 - RNA, 23 nt, Homo sapiens
cuggccaguuggaaccacggaga

SEQ ID NO: 1820873 - RNA, 17 nt, Homo sapiens
cuugagaagauucuucc

SEQ ID NO: 1820874 - RNA, 16 nt, Homo sapiens
gccuuagugggccagg

SEQ ID NO: 1820875 - RNA, 16 nt, Homo sapiens
cuuggccuuacuguau

SEQ ID NO: 1820876 - RNA, 16 nt, Homo sapiens
ggccacugucaaggca

SEQ ID NO: 1820877 - RNA, 18 nt, Homo sapiens
gugccuucauacacugua

SEQ ID NO: 1820878 - RNA, 18 nt, Homo sapiens
aagagaaucacagaguca

SEQ ID NO: 1820879 - RNA, 18 nt, Homo sapiens
aacaauaaaugaaugaau

SEQ ID NO: 1820880 - RNA, 16 nt, Homo sapiens
uacugccgaagaauug

SEQ ID NO: 1820881 - RNA, 24 nt, Homo sapiens
guacuaagcaguaagcuaucuuca

SEQ ID NO: 1820882 - RNA, 13 nt, Homo sapiens
cugauucaguggg

SEQ ID NO: 1820883 - RNA, 14 nt, Homo sapiens
acuagccaaaccuc

SEQ ID NO: 1820884 - RNA, 18 nt, Homo sapiens
ccaucacuauucaaggau

SEQ ID NO: 1820885 - RNA, 20 nt, Homo sapiens
uauuguuacuauuauuugcu

SEQ ID NO: 1820886 - RNA, 21 nt, Homo sapiens
cagagccuacagaagggcagu

SEQ ID NO: 1820887 - RNA, 22 nt, Homo sapiens
cuguuucuaauuugcugcugau

SEQ ID NO: 1820888 - RNA, 14 nt, Homo sapiens
aauuuggaucucuu

SEQ ID NO: 1820889 - RNA, 23 nt, Homo sapiens
agccucugagccccugggacugc

SEQ ID NO: 1820890 - RNA, 24 nt, Homo sapiens
gaccucaugagugucaaacgugcc

SEQ ID NO: 1820891 - RNA, 18 nt, Homo sapiens
gcacuggguuugcucccu

SEQ ID NO: 1820892 - RNA, 13 nt, Homo sapiens
ugcugguucucca

SEQ ID NO: 1820893 - RNA, 14 nt, Homo sapiens
caucagaacugaaa

SEQ ID NO: 1820894 - RNA, 21 nt, Homo sapiens
cagggugaauaaagcagggaa

SEQ ID NO: 1820895 - RNA, 20 nt, Homo sapiens
uacuuuauuuguauuugcca

SEQ ID NO: 1820896 - RNA, 19 nt, Homo sapiens
agaauuucuuuaugaucuu

SEQ ID NO: 1820897 - RNA, 18 nt, Homo sapiens
gggauccagcucaucccc

SEQ ID NO: 1820898 - RNA, 21 nt, Homo sapiens
aguuuaggugauggccaguca

SEQ ID NO: 1820899 - RNA, 23 nt, Homo sapiens
gaaaugggaaaugagaacauucc

SEQ ID NO: 1820900 - RNA, 19 nt, Homo sapiens
ugcagccucagagacauca

SEQ ID NO: 1820901 - RNA, 16 nt, Homo sapiens
caagucuguaccucaa

SEQ ID NO: 1820902 - RNA, 16 nt, Homo sapiens
guugcuggacugucau

SEQ ID NO: 1820903 - RNA, 16 nt, Homo sapiens
ccugggaaagccauga

SEQ ID NO: 1820904 - RNA, 14 nt, Homo sapiens
agcuaguugaauac

SEQ ID NO: 1820905 - RNA, 17 nt, Homo sapiens
ucuugcucaaguugaug

SEQ ID NO: 1820906 - RNA, 14 nt, Homo sapiens
ucaaauaugcaaag

SEQ ID NO: 1820907 - RNA, 15 nt, Homo sapiens
uuuuaugaucuuggc

SEQ ID NO: 1820908 - RNA, 22 nt, Homo sapiens
aaggcaaccgugguuacuguau

SEQ ID NO: 1820909 - RNA, 13 nt, Homo sapiens
cugcagaucuucc

SEQ ID NO: 1820910 - RNA, 17 nt, Homo sapiens
cagcccuccuucagggg

SEQ ID NO: 1820911 - RNA, 19 nt, Homo sapiens
ugcaguuuuuuucuugucu

SEQ ID NO: 1820912 - RNA, 21 nt, Homo sapiens
uuaccagacgguucaccagcc

SEQ ID NO: 1820913 - RNA, 14 nt, Homo sapiens
gccccagcugugac

SEQ ID NO: 1820914 - RNA, 14 nt, Homo sapiens
cuagucaagcuccu

SEQ ID NO: 1820915 - RNA, 14 nt, Homo sapiens
cuacucaagcugcu

SEQ ID NO: 1820916 - RNA, 22 nt, Homo sapiens
cuccucuggacggcaggcucac

SEQ ID NO: 1820917 - RNA, 13 nt, Homo sapiens
gacagaagcuauu

SEQ ID NO: 1820918 - RNA, 14 nt, Homo sapiens
uacauuacaaaaga

SEQ ID NO: 1820919 - RNA, 18 nt, Homo sapiens
ugccucauggcaucaucc

SEQ ID NO: 1820920 - RNA, 18 nt, Homo sapiens
cuaggucuuuaauccacu

SEQ ID NO: 1820921 - RNA, 17 nt, Homo sapiens
agagacuagacaaauaa

SEQ ID NO: 1820922 - RNA, 17 nt, Homo sapiens
uaucuguguuugcugag

SEQ ID NO: 1820923 - RNA, 21 nt, Homo sapiens
aacagcaagugugaauacugc

SEQ ID NO: 1820924 - RNA, 15 nt, Homo sapiens
guaaaggauauuaaa

SEQ ID NO: 1820925 - RNA, 14 nt, Homo sapiens
ugacaaucaacucu

SEQ ID NO: 1820926 - RNA, 20 nt, Homo sapiens
aaaacauacacaaugugucu

SEQ ID NO: 1820927 - RNA, 16 nt, Homo sapiens
uuauuuacaugugauu

SEQ ID NO: 1820928 - RNA, 15 nt, Homo sapiens
guccuuacucagagc

SEQ ID NO: 1820929 - RNA, 14 nt, Homo sapiens
gaguucugaagcug

SEQ ID NO: 1820930 - RNA, 17 nt, Homo sapiens
aggcagguagaucacuu

SEQ ID NO: 1820931 - RNA, 19 nt, Homo sapiens
uuccaauuccaaaauucca

SEQ ID NO: 1820932 - RNA, 22 nt, Homo sapiens
gaagcaggugcuacaacaugug

SEQ ID NO: 1820933 - RNA, 19 nt, Homo sapiens
uggaaggggccuugcugag

SEQ ID NO: 1820934 - RNA, 16 nt, Homo sapiens
ugccccucuguaacaa

SEQ ID NO: 1820935 - RNA, 17 nt, Homo sapiens
cuuaaaagguacuggua

SEQ ID NO: 1820936 - RNA, 15 nt, Homo sapiens
ucccagccucuuccc

SEQ ID NO: 1820937 - RNA, 18 nt, Homo sapiens
ccgacauguguaccucag

SEQ ID NO: 1820938 - RNA, 22 nt, Homo sapiens
cuccuggggggccugaaagcaa

SEQ ID NO: 1820939 - RNA, 19 nt, Homo sapiens
aucugaagcuuuaccaggu

SEQ ID NO: 1820940 - RNA, 23 nt, Homo sapiens
gagagcaaaaaggggaaauaugu

SEQ ID NO: 1820941 - RNA, 21 nt, Homo sapiens
ggcaggaaggaacucaaggug

SEQ ID NO: 1820942 - RNA, 20 nt, Homo sapiens
ucaaggggcuggaaucucau

SEQ ID NO: 1820943 - RNA, 21 nt, Homo sapiens
cugugacauacauauuaucuc

SEQ ID NO: 1820944 - RNA, 19 nt, Homo sapiens
ccuacagaauacuagccag

SEQ ID NO: 1820945 - RNA, 17 nt, Homo sapiens
accuguccccacccucc

SEQ ID NO: 1820946 - RNA, 11 nt, Homo sapiens
uaaaguaccac

SEQ ID NO: 1820947 - RNA, 12 nt, Homo sapiens
acuuuucauccu

SEQ ID NO: 1820948 - RNA, 14 nt, Homo sapiens
auguaaaacugaac

SEQ ID NO: 1820949 - RNA, 16 nt, Homo sapiens
aaacuuuaagaacaaa

SEQ ID NO: 1820950 - RNA, 23 nt, Homo sapiens
gcauaggaggggucuggacaugu

SEQ ID NO: 1820951 - RNA, 20 nt, Homo sapiens
ccugagcucgguggacccag

SEQ ID NO: 1820952 - RNA, 18 nt, Homo sapiens
aacuugugcuuuugcaaa

SEQ ID NO: 1820953 - RNA, 13 nt, Homo sapiens
acuucaagcucuc

SEQ ID NO: 1820954 - RNA, 19 nt, Homo sapiens
uugugccaucacugagcau

SEQ ID NO: 1820955 - RNA, 18 nt, Homo sapiens
cguguucacucagcacuu

SEQ ID NO: 1820956 - RNA, 17 nt, Homo sapiens
cucauuagcugaauuga

SEQ ID NO: 1820957 - RNA, 22 nt, Homo sapiens
ccacaagacccuugugguccca

SEQ ID NO: 1820958 - RNA, 21 nt, Homo sapiens
cauagguaacaguuauaucaa

SEQ ID NO: 1820959 - RNA, 22 nt, Homo sapiens
gagucuagccuggacaacacag

SEQ ID NO: 1820960 - RNA, 18 nt, Homo sapiens
aauguuacauuauuauca

SEQ ID NO: 1820961 - RNA, 18 nt, Homo sapiens
auaagccccgaggccuag

SEQ ID NO: 1820962 - RNA, 15 nt, Homo sapiens
auuuugaagugcugu

SEQ ID NO: 1820963 - RNA, 13 nt, Homo sapiens
aauguaugugaaa

SEQ ID NO: 1820964 - RNA, 21 nt, Homo sapiens
cacaggaacucugugugagag

SEQ ID NO: 1820965 - RNA, 20 nt, Homo sapiens
ugaagauggcauccugugaa

SEQ ID NO: 1820966 - RNA, 14 nt, Homo sapiens
uccagcauggauga

SEQ ID NO: 1820967 - RNA, 23 nt, Homo sapiens
cuggguuuugucucugcaucuca

SEQ ID NO: 1820968 - RNA, 22 nt, Homo sapiens
cccagaaaaacuggcucugauu

SEQ ID NO: 1820969 - RNA, 17 nt, Homo sapiens
gcugggggagggacugc

SEQ ID NO: 1820970 - RNA, 20 nt, Homo sapiens
auacaauaauguaauuuagu

SEQ ID NO: 1820971 - RNA, 13 nt, Homo sapiens
aagagcucuccag

SEQ ID NO: 1820972 - RNA, 23 nt, Homo sapiens
uuucccaugauccagaacugagg

SEQ ID NO: 1820973 - RNA, 17 nt, Homo sapiens
guaaucuacaccaauga

SEQ ID NO: 1820974 - RNA, 20 nt, Homo sapiens
uguguggucauaucuaguca

SEQ ID NO: 1820975 - RNA, 20 nt, Homo sapiens
uuccauugcucccagugcca

SEQ ID NO: 1820976 - RNA, 11 nt, Homo sapiens
aaaacaauccu

SEQ ID NO: 1820977 - RNA, 22 nt, Homo sapiens
cagauuuucuaagaaccaaaaa

SEQ ID NO: 1820978 - RNA, 20 nt, Homo sapiens
aguuuuaauaagaacagauc

SEQ ID NO: 1820979 - RNA, 12 nt, Homo sapiens
gcuuugucauag

SEQ ID NO: 1820980 - RNA, 21 nt, Homo sapiens
caugacccagccugaaagaua

SEQ ID NO: 1820981 - RNA, 19 nt, Homo sapiens
uggagacggccaagugaag

SEQ ID NO: 1820982 - RNA, 12 nt, Homo sapiens
caggcguucucu

SEQ ID NO: 1820983 - RNA, 13 nt, Homo sapiens
ugugucugucagc

SEQ ID NO: 1820984 - RNA, 15 nt, Homo sapiens
gcaggcuacucugcc

SEQ ID NO: 1820985 - RNA, 16 nt, Homo sapiens
aagggguuuucuugau

SEQ ID NO: 1820986 - RNA, 19 nt, Homo sapiens
uacggucaugaugucugca

SEQ ID NO: 1820987 - RNA, 21 nt, Homo sapiens
aaagagcccaaaugaccaaau

SEQ ID NO: 1820988 - RNA, 18 nt, Homo sapiens
auaugcagauacuuauua

SEQ ID NO: 1820989 - RNA, 16 nt, Homo sapiens
gaugcuuuuagcucaa

SEQ ID NO: 1820990 - RNA, 14 nt, Homo sapiens
cugagacugugcug

SEQ ID NO: 1820991 - RNA, 17 nt, Homo sapiens
aggcaaggggcauuuca

SEQ ID NO: 1820992 - RNA, 13 nt, Homo sapiens
uaaaagucugccu

SEQ ID NO: 1820993 - RNA, 13 nt, Homo sapiens
gaagcuucuugcu

SEQ ID NO: 1820994 - RNA, 15 nt, Homo sapiens
ugcucagagacacug

SEQ ID NO: 1820995 - RNA, 23 nt, Homo sapiens
ucugauguucuuuccaugaauca

SEQ ID NO: 1820996 - RNA, 20 nt, Homo sapiens
caagacagugcccaugaaug

SEQ ID NO: 1820997 - RNA, 20 nt, Homo sapiens
agaggcuuccuucauuuccu

SEQ ID NO: 1820998 - RNA, 11 nt, Homo sapiens
cagugcuuccc

SEQ ID NO: 1820999 - RNA, 20 nt, Homo sapiens
uugugucauaaauuacacaa

SEQ ID NO: 1821000 - RNA, 21 nt, Homo sapiens
ucaguggaagaagcagaugag

SEQ ID NO: 1821001 - RNA, 15 nt, Homo sapiens
gauguuucaaaaaau

SEQ ID NO: 1821002 - RNA, 22 nt, Homo sapiens
aaugcugaaauaaaaugauuaa

SEQ ID NO: 1821003 - RNA, 22 nt, Homo sapiens
cagaguagaaccacuuguggau

SEQ ID NO: 1821004 - RNA, 15 nt, Homo sapiens
agucuguuugaaaug

SEQ ID NO: 1821005 - RNA, 22 nt, Homo sapiens
aacuguuuuagaaauugguaca

SEQ ID NO: 1821006 - RNA, 12 nt, Homo sapiens
gacaaugccaau

SEQ ID NO: 1821007 - RNA, 14 nt, Homo sapiens
uaagcucgagugaa

SEQ ID NO: 1821008 - RNA, 17 nt, Homo sapiens
aaguucagcaugaagga

SEQ ID NO: 1821009 - RNA, 20 nt, Homo sapiens
gagacuuugacucuccagaa

SEQ ID NO: 1821010 - RNA, 20 nt, Homo sapiens
caggaggcagagguugcagu

SEQ ID NO: 1821011 - RNA, 14 nt, Homo sapiens
ccauaaaguacaaa

SEQ ID NO: 1821012 - RNA, 23 nt, Homo sapiens
ucccuguggaauguaccuaugug

SEQ ID NO: 1821013 - RNA, 22 nt, Homo sapiens
caccuguagucccagcuacuca

SEQ ID NO: 1821014 - RNA, 14 nt, Homo sapiens
caagcgauucuccc

SEQ ID NO: 1821015 - RNA, 18 nt, Homo sapiens
auuccacuuuuauucauu

SEQ ID NO: 1821016 - RNA, 19 nt, Homo sapiens
cugagauacaagucaucca

SEQ ID NO: 1821017 - RNA, 19 nt, Homo sapiens
uuuccaggagacauauaua

SEQ ID NO: 1821018 - RNA, 13 nt, Homo sapiens
ccuguggggccug

SEQ ID NO: 1821019 - RNA, 21 nt, Homo sapiens
gucuuuggugaacauugcaau

SEQ ID NO: 1821020 - RNA, 21 nt, Homo sapiens
gagucucugaaugaagcugaa

SEQ ID NO: 1821021 - RNA, 12 nt, Homo sapiens
uucgguuucaaa

SEQ ID NO: 1821022 - RNA, 15 nt, Homo sapiens
ccagucccacacugu

SEQ ID NO: 1821023 - RNA, 19 nt, Homo sapiens
uaggauacagaaaugcaaa

SEQ ID NO: 1821024 - RNA, 23 nt, Homo sapiens
gcugugugagaccaggggaccag

SEQ ID NO: 1821025 - RNA, 14 nt, Homo sapiens
aaaguccugucacc

SEQ ID NO: 1821026 - RNA, 22 nt, Homo sapiens
accaggcuggccagcaugguga

SEQ ID NO: 1821027 - RNA, 18 nt, Homo sapiens
cuaagaugugauauucua

SEQ ID NO: 1821028 - RNA, 19 nt, Homo sapiens
ugccaagggguuaaugaaa

SEQ ID NO: 1821029 - RNA, 19 nt, Homo sapiens
cucauucugcaaugagcca

SEQ ID NO: 1821030 - RNA, 18 nt, Homo sapiens
cuacauagugacaugcac

SEQ ID NO: 1821031 - RNA, 14 nt, Homo sapiens
acaacaucgcaaua

SEQ ID NO: 1821032 - RNA, 18 nt, Homo sapiens
ugaauaaaauugaugugc

SEQ ID NO: 1821033 - RNA, 16 nt, Homo sapiens
acagagccaugacuca

SEQ ID NO: 1821034 - RNA, 20 nt, Homo sapiens
aagaugcaucaucucuuccu

SEQ ID NO: 1821035 - RNA, 20 nt, Homo sapiens
cccucugcuaugucugugau

SEQ ID NO: 1821036 - RNA, 16 nt, Homo sapiens
accauaaagccuuuaa

SEQ ID NO: 1821037 - RNA, 13 nt, Homo sapiens
aucucucuacuca

SEQ ID NO: 1821038 - RNA, 13 nt, Homo sapiens
uacuuguucugua

SEQ ID NO: 1821039 - RNA, 21 nt, Homo sapiens
uccugaggaaggaagauuuga

SEQ ID NO: 1821040 - RNA, 14 nt, Homo sapiens
guauuauaccuuuu

SEQ ID NO: 1821041 - RNA, 13 nt, Homo sapiens
ugaacacacugug

SEQ ID NO: 1821042 - RNA, 22 nt, Homo sapiens
gacugcacguggcuucugauga

SEQ ID NO: 1821043 - RNA, 17 nt, Homo sapiens
aucccauguuagcucca

SEQ ID NO: 1821044 - RNA, 16 nt, Homo sapiens
cuauauagaaugcugc

SEQ ID NO: 1821045 - RNA, 18 nt, Homo sapiens
acuuuauggagaguucag

SEQ ID NO: 1821046 - RNA, 23 nt, Homo sapiens
uuugagcccacaaagccuuauca

SEQ ID NO: 1821047 - RNA, 24 nt, Homo sapiens
aagguaaagcaguugagauucucu

SEQ ID NO: 1821048 - RNA, 18 nt, Homo sapiens
ccacauacugcggaccaa

SEQ ID NO: 1821049 - RNA, 21 nt, Homo sapiens
caugucuauuagcuccacaaa

SEQ ID NO: 1821050 - RNA, 16 nt, Homo sapiens
agucugccucuuccuc

SEQ ID NO: 1821051 - RNA, 21 nt, Homo sapiens
gcuucaaggauauacugcagc

SEQ ID NO: 1821052 - RNA, 18 nt, Homo sapiens
aaugcuugcucaggcuca

SEQ ID NO: 1821053 - RNA, 12 nt, Homo sapiens
uuugauucucau

SEQ ID NO: 1821054 - RNA, 12 nt, Homo sapiens
uuagauucucuu

SEQ ID NO: 1821055 - RNA, 22 nt, Homo sapiens
uacacaguggccaagcggccau

SEQ ID NO: 1821056 - RNA, 21 nt, Homo sapiens
ccaacguuccacaacaguccc

SEQ ID NO: 1821057 - RNA, 16 nt, Homo sapiens
uguccagagucucuuu

SEQ ID NO: 1821058 - RNA, 20 nt, Homo sapiens
cuauuuuaguuaacuaugau

SEQ ID NO: 1821059 - RNA, 18 nt, Homo sapiens
cauuccauggugauuccu

SEQ ID NO: 1821060 - RNA, 19 nt, Homo sapiens
acugaacgacaaagcaugg

SEQ ID NO: 1821061 - RNA, 22 nt, Homo sapiens
aaucaacagaaguaucaagcca

SEQ ID NO: 1821062 - RNA, 17 nt, Homo sapiens
cacaauuaaaucucucc

SEQ ID NO: 1821063 - RNA, 14 nt, Homo sapiens
aaauugcagaauuc

SEQ ID NO: 1821064 - RNA, 12 nt, Homo sapiens
uuagccauucau

SEQ ID NO: 1821065 - RNA, 14 nt, Homo sapiens
ggucucgaacugcu

SEQ ID NO: 1821066 - RNA, 15 nt, Homo sapiens
ugacaaaggaugaag

SEQ ID NO: 1821067 - RNA, 15 nt, Homo sapiens
uaaccuuuacacucc

SEQ ID NO: 1821068 - RNA, 10 nt, Homo sapiens
ccauggacuu

SEQ ID NO: 1821069 - RNA, 23 nt, Homo sapiens
caugccuuauauuuguccaacaa

SEQ ID NO: 1821070 - RNA, 14 nt, Homo sapiens
guuccuacuaggca

SEQ ID NO: 1821071 - RNA, 14 nt, Homo sapiens
gugaaaugcuggca

SEQ ID NO: 1821072 - RNA, 12 nt, Homo sapiens
acaacacugugu

SEQ ID NO: 1821073 - RNA, 14 nt, Homo sapiens
uuucauuuugccaa

SEQ ID NO: 1821074 - RNA, 20 nt, Homo sapiens
ggucuuugcaagaaucauua

SEQ ID NO: 1821075 - RNA, 15 nt, Homo sapiens
ccacacacaacagcc

SEQ ID NO: 1821076 - RNA, 21 nt, Homo sapiens
ugucagaauaaagaacauucu

SEQ ID NO: 1821077 - RNA, 15 nt, Homo sapiens
cauuugucucuacuu

SEQ ID NO: 1821078 - RNA, 17 nt, Homo sapiens
ucuguuuugaaggcaaa

SEQ ID NO: 1821079 - RNA, 19 nt, Homo sapiens
ugaaaauuaacaugaauau

SEQ ID NO: 1821080 - RNA, 16 nt, Homo sapiens
cucuccuuuggccauu

SEQ ID NO: 1821081 - RNA, 15 nt, Homo sapiens
cucucucugcuccuc

SEQ ID NO: 1821082 - RNA, 19 nt, Homo sapiens
ccaaaaaaauacugccaga

SEQ ID NO: 1821083 - RNA, 12 nt, Homo sapiens
aaugacauuuau

SEQ ID NO: 1821084 - RNA, 12 nt, Homo sapiens
gauagggacuga

SEQ ID NO: 1821085 - RNA, 17 nt, Homo sapiens
ucaaaccugaccacaga

SEQ ID NO: 1821086 - RNA, 16 nt, Homo sapiens
auagaggguacuugaa

SEQ ID NO: 1821087 - RNA, 16 nt, Homo sapiens
ccaugcugauaaacug

SEQ ID NO: 1821088 - RNA, 19 nt, Homo sapiens
cugucacuggcagagcaca

SEQ ID NO: 1821089 - RNA, 18 nt, Homo sapiens
aagccgugccuuucucug

SEQ ID NO: 1821090 - RNA, 17 nt, Homo sapiens
aaggaggggaaccagau

SEQ ID NO: 1821091 - RNA, 20 nt, Homo sapiens
ggaccuuguuguuguuaaau

SEQ ID NO: 1821092 - RNA, 20 nt, Homo sapiens
gccuugggauagcaaacucc

SEQ ID NO: 1821093 - RNA, 23 nt, Homo sapiens
agcuggcaggagagagccuuggc

SEQ ID NO: 1821094 - RNA, 19 nt, Homo sapiens
agagcuacccgcagaguuc

SEQ ID NO: 1821095 - RNA, 23 nt, Homo sapiens
aauacuucuuaaaaugugcuauu

SEQ ID NO: 1821096 - RNA, 13 nt, Homo sapiens
cacgaacuguuca

SEQ ID NO: 1821097 - RNA, 17 nt, Homo sapiens
cuaaaggagauuuacac

SEQ ID NO: 1821098 - RNA, 20 nt, Homo sapiens
gauuacaggcgugagccacc

SEQ ID NO: 1821099 - RNA, 19 nt, Homo sapiens
gucacccaacucaaggaca

SEQ ID NO: 1821100 - RNA, 17 nt, Homo sapiens
cuucauaaguaguauua

SEQ ID NO: 1821101 - RNA, 19 nt, Homo sapiens
uuaccgaggacagccugcc

SEQ ID NO: 1821102 - RNA, 14 nt, Homo sapiens
caaacuucaagggu

SEQ ID NO: 1821103 - RNA, 21 nt, Homo sapiens
acaccaaacgagguuccuggu

SEQ ID NO: 1821104 - RNA, 19 nt, Homo sapiens
gcacaugugccacuguuca

SEQ ID NO: 1821105 - RNA, 17 nt, Homo sapiens
uaaugaagacccagugu

SEQ ID NO: 1821106 - RNA, 15 nt, Homo sapiens
uuagaucuucugggu

SEQ ID NO: 1821107 - RNA, 18 nt, Homo sapiens
ucuuugauuuguaccauu

SEQ ID NO: 1821108 - RNA, 14 nt, Homo sapiens
guaacuagugaaau

SEQ ID NO: 1821109 - RNA, 21 nt, Homo sapiens
ucucccauuucuugcuagcua

SEQ ID NO: 1821110 - RNA, 17 nt, Homo sapiens
caucggucuagaaccac

SEQ ID NO: 1821111 - RNA, 15 nt, Homo sapiens
auaacaacacugugu

SEQ ID NO: 1821112 - RNA, 19 nt, Homo sapiens
auaacuggcacccagagaa

SEQ ID NO: 1821113 - RNA, 11 nt, Homo sapiens
ucaaccagaga

SEQ ID NO: 1821114 - RNA, 14 nt, Homo sapiens
gccaauuagcaauu

SEQ ID NO: 1821115 - RNA, 22 nt, Homo sapiens
gauuauucugggggcugcaguu

SEQ ID NO: 1821116 - RNA, 21 nt, Homo sapiens
ugcaauggcaccaucuuggcu

SEQ ID NO: 1821117 - RNA, 20 nt, Homo sapiens
uaugugggugggaccacaga

SEQ ID NO: 1821118 - RNA, 21 nt, Homo sapiens
uaaccuuucacuuaaguauug

SEQ ID NO: 1821119 - RNA, 20 nt, Homo sapiens
uuccaccaagacagugcuga

SEQ ID NO: 1821120 - RNA, 18 nt, Homo sapiens
agcucuuguuccgugcca

SEQ ID NO: 1821121 - RNA, 14 nt, Homo sapiens
gaugcccacuuccc

SEQ ID NO: 1821122 - RNA, 14 nt, Homo sapiens
aaagugaaaucaga

SEQ ID NO: 1821123 - RNA, 12 nt, Homo sapiens
gaucacuccugg

SEQ ID NO: 1821124 - RNA, 15 nt, Homo sapiens
gugcauuucugucuc

SEQ ID NO: 1821125 - RNA, 15 nt, Homo sapiens
cugagaaaguacaaa

SEQ ID NO: 1821126 - RNA, 15 nt, Homo sapiens
uaaagucacuaguga

SEQ ID NO: 1821127 - RNA, 15 nt, Homo sapiens
aucuuggaacugcau

SEQ ID NO: 1821128 - RNA, 16 nt, Homo sapiens
cagccacgacugccau

SEQ ID NO: 1821129 - RNA, 19 nt, Homo sapiens
aaguguaaaaaaugucuca

SEQ ID NO: 1821130 - RNA, 20 nt, Homo sapiens
uauuuguaauuuuacacaaa

SEQ ID NO: 1821131 - RNA, 19 nt, Homo sapiens
gacuauguaauuguaacua

SEQ ID NO: 1821132 - RNA, 17 nt, Homo sapiens
agcgaggcgaggcugcc

SEQ ID NO: 1821133 - RNA, 19 nt, Homo sapiens
auucuuaagccuuauauaa

SEQ ID NO: 1821134 - RNA, 23 nt, Homo sapiens
ccugggccacguaucaacaaucu

SEQ ID NO: 1821135 - RNA, 23 nt, Homo sapiens
ggcuguggaccauggaguggcag

SEQ ID NO: 1821136 - RNA, 21 nt, Homo sapiens
cacuuuggguuuuuaacucau

SEQ ID NO: 1821137 - RNA, 10 nt, Homo sapiens
cuacaaggac

SEQ ID NO: 1821138 - RNA, 12 nt, Homo sapiens
cuagcacuuugg

SEQ ID NO: 1821139 - RNA, 21 nt, Homo sapiens
ugcgugcgcgcgcuucuggga

SEQ ID NO: 1821140 - RNA, 13 nt, Homo sapiens
aaaaccacuguac

SEQ ID NO: 1821141 - RNA, 22 nt, Homo sapiens
ccaggcuggagagcacugccag

SEQ ID NO: 1821142 - RNA, 14 nt, Homo sapiens
aaagcuacuugaag

SEQ ID NO: 1821143 - RNA, 20 nt, Homo sapiens
cuuguuugguaguuagccau

SEQ ID NO: 1821144 - RNA, 17 nt, Homo sapiens
aagaaugagacugaacu

SEQ ID NO: 1821145 - RNA, 17 nt, Homo sapiens
cuucaccgcauuccagg

SEQ ID NO: 1821146 - RNA, 14 nt, Homo sapiens
caauugacugcccu

SEQ ID NO: 1821147 - RNA, 18 nt, Homo sapiens
auuucaauaaaaguaaag

SEQ ID NO: 1821148 - RNA, 20 nt, Homo sapiens
aaaaugaaccugcaagccuu

SEQ ID NO: 1821149 - RNA, 14 nt, Homo sapiens
ggccugugugugaa

SEQ ID NO: 1821150 - RNA, 15 nt, Homo sapiens
ccuaccaucagggac

SEQ ID NO: 1821151 - RNA, 13 nt, Homo sapiens
aacaaggacucag

SEQ ID NO: 1821152 - RNA, 18 nt, Homo sapiens
gcucuuauaaaaucaaua

SEQ ID NO: 1821153 - RNA, 21 nt, Homo sapiens
aucuauucuguguugcauuau

SEQ ID NO: 1821154 - RNA, 14 nt, Homo sapiens
uagacagugcccuu

SEQ ID NO: 1821155 - RNA, 20 nt, Homo sapiens
auuuauuuacaacucaaaaa

SEQ ID NO: 1821156 - RNA, 22 nt, Homo sapiens
caguuuaaugaacuaccaucug

SEQ ID NO: 1821157 - RNA, 18 nt, Homo sapiens
ucaaaggagcuuucucaa

SEQ ID NO: 1821158 - RNA, 17 nt, Homo sapiens
gucuaguuucucaaaac

SEQ ID NO: 1821159 - RNA, 22 nt, Homo sapiens
agcagugucuuccauaauguau

SEQ ID NO: 1821160 - RNA, 18 nt, Homo sapiens
ugugauagcacuuucuac

SEQ ID NO: 1821161 - RNA, 14 nt, Homo sapiens
cuaggcuaccucaa

SEQ ID NO: 1821162 - RNA, 21 nt, Homo sapiens
cccuagagagaauaaauugga

SEQ ID NO: 1821163 - RNA, 15 nt, Homo sapiens
uaaugaaaaugucag

SEQ ID NO: 1821164 - RNA, 18 nt, Homo sapiens
caaguauauaauauguca

SEQ ID NO: 1821165 - RNA, 12 nt, Homo sapiens
ugcagaacagug

SEQ ID NO: 1821166 - RNA, 16 nt, Homo sapiens
acuaucauucucucac

SEQ ID NO: 1821167 - RNA, 15 nt, Homo sapiens
uggaaguugcaguga

SEQ ID NO: 1821168 - RNA, 22 nt, Homo sapiens
ggagcccugggguuuccacaca

SEQ ID NO: 1821169 - RNA, 16 nt, Homo sapiens
cauucaugaugaacuc

SEQ ID NO: 1821170 - RNA, 11 nt, Homo sapiens
accacuggcag

SEQ ID NO: 1821171 - RNA, 15 nt, Homo sapiens
aauguuacauuauua

SEQ ID NO: 1821172 - RNA, 19 nt, Homo sapiens
auugaaguuuugacaucaa

SEQ ID NO: 1821173 - RNA, 15 nt, Homo sapiens
uuaacaaaauuagcu

SEQ ID NO: 1821174 - RNA, 18 nt, Homo sapiens
uauggagugcaccaaaga

SEQ ID NO: 1821175 - RNA, 21 nt, Homo sapiens
uggcuuugaaacuugcaacuu

SEQ ID NO: 1821176 - RNA, 17 nt, Homo sapiens
gaugaagaagccuuugu

SEQ ID NO: 1821177 - RNA, 18 nt, Homo sapiens
aucucugauuaaauuuaa

SEQ ID NO: 1821178 - RNA, 22 nt, Homo sapiens
augaagcugaggcugcugccag

SEQ ID NO: 1821179 - RNA, 16 nt, Homo sapiens
ugucaagaaauucugc

SEQ ID NO: 1821180 - RNA, 19 nt, Homo sapiens
ugcaguacaggacauauau

SEQ ID NO: 1821181 - RNA, 9 nt, Homo sapiens
ugugcucca

SEQ ID NO: 1821182 - RNA, 15 nt, Homo sapiens
uaaaccuuacaugug

SEQ ID NO: 1821183 - RNA, 15 nt, Homo sapiens
cuuugguuaaucucu

SEQ ID NO: 1821184 - RNA, 22 nt, Homo sapiens
aaucuuguuaauuucauuccaa

SEQ ID NO: 1821185 - RNA, 22 nt, Homo sapiens
cuggaaaguuuucuccacugga

SEQ ID NO: 1821186 - RNA, 22 nt, Homo sapiens
cuggggaggugagagugcagaa

SEQ ID NO: 1821187 - RNA, 22 nt, Homo sapiens
ggaacagcccugcacgcccagg

SEQ ID NO: 1821188 - RNA, 22 nt, Homo sapiens
uuaauucaccccacacuagaaa

SEQ ID NO: 1821189 - RNA, 12 nt, Homo sapiens
auaaaacauagc

SEQ ID NO: 1821190 - RNA, 17 nt, Homo sapiens
uuauuuguagccaaaga

SEQ ID NO: 1821191 - RNA, 21 nt, Homo sapiens
ggugugaccauguucauuaua

SEQ ID NO: 1821192 - RNA, 22 nt, Homo sapiens
caugucuuuacuggaccugaaa

SEQ ID NO: 1821193 - RNA, 18 nt, Homo sapiens
uaucuuaccuaguguuua

SEQ ID NO: 1821194 - RNA, 16 nt, Homo sapiens
aaagacuguuauuuca

SEQ ID NO: 1821195 - RNA, 20 nt, Homo sapiens
aauaauauauccacaucuaa

SEQ ID NO: 1821196 - RNA, 15 nt, Homo sapiens
ucuuuuagugauacu

SEQ ID NO: 1821197 - RNA, 15 nt, Homo sapiens
gcugccugcacugga

SEQ ID NO: 1821198 - RNA, 20 nt, Homo sapiens
uuuaugagaaaugccagugu

SEQ ID NO: 1821199 - RNA, 16 nt, Homo sapiens
uucauucuaaaccaaa

SEQ ID NO: 1821200 - RNA, 14 nt, Homo sapiens
aacaauaaaauguc

SEQ ID NO: 1821201 - RNA, 19 nt, Homo sapiens
cuacugggagacugggaca

SEQ ID NO: 1821202 - RNA, 20 nt, Homo sapiens
uggaauuugccugcugggau

SEQ ID NO: 1821203 - RNA, 22 nt, Homo sapiens
cacauuuacuguuucuguuaua

SEQ ID NO: 1821204 - RNA, 19 nt, Homo sapiens
ccucuccaagggcuucugc

SEQ ID NO: 1821205 - RNA, 18 nt, Homo sapiens
uguaauagugaacauaug

SEQ ID NO: 1821206 - RNA, 12 nt, Homo sapiens
cuggaauggugu

SEQ ID NO: 1821207 - RNA, 18 nt, Homo sapiens
ucaggcagaaauauuuag

SEQ ID NO: 1821208 - RNA, 13 nt, Homo sapiens
agucaccaggaau

SEQ ID NO: 1821209 - RNA, 17 nt, Homo sapiens
cauucacaacacaauca

SEQ ID NO: 1821210 - RNA, 21 nt, Homo sapiens
acuaugauaaaguuguaaaua

SEQ ID NO: 1821211 - RNA, 19 nt, Homo sapiens
aacuuaagaugaauacaug

SEQ ID NO: 1821212 - RNA, 19 nt, Homo sapiens
agaaguuuuuguacuguaa

SEQ ID NO: 1821213 - RNA, 17 nt, Homo sapiens
uauuuuaugaacauugu

SEQ ID NO: 1821214 - RNA, 17 nt, Homo sapiens
ccagucaccuucugggc

SEQ ID NO: 1821215 - RNA, 16 nt, Homo sapiens
aguuccuugccuuaau

SEQ ID NO: 1821216 - RNA, 23 nt, Homo sapiens
cugccgguaaacacgccugcaaa

SEQ ID NO: 1821217 - RNA, 23 nt, Homo sapiens
ccccaccuugcagcuaaauguga

SEQ ID NO: 1821218 - RNA, 16 nt, Homo sapiens
cuuaccugaacaggaa

SEQ ID NO: 1821219 - RNA, 21 nt, Homo sapiens
auaaugguaauuuaguguaua

SEQ ID NO: 1821220 - RNA, 16 nt, Homo sapiens
ugucagccacugugau

SEQ ID NO: 1821221 - RNA, 14 nt, Homo sapiens
agguaucugaugau

SEQ ID NO: 1821222 - RNA, 14 nt, Homo sapiens
cuagauccacacuu

SEQ ID NO: 1821223 - RNA, 13 nt, Homo sapiens
ugucugugugcaa

SEQ ID NO: 1821224 - RNA, 23 nt, Homo sapiens
aaugucauuuguugagcaagagu

SEQ ID NO: 1821225 - RNA, 18 nt, Homo sapiens
uacagagaagauucuugu

SEQ ID NO: 1821226 - RNA, 10 nt, Homo sapiens
gggucugugu

SEQ ID NO: 1821227 - RNA, 17 nt, Homo sapiens
aauacagauuuguaaca

SEQ ID NO: 1821228 - RNA, 12 nt, Homo sapiens
ggccuuuccugg

SEQ ID NO: 1821229 - RNA, 17 nt, Homo sapiens
uaauaaauugacauaac

SEQ ID NO: 1821230 - RNA, 14 nt, Homo sapiens
acucgggggugcug

SEQ ID NO: 1821231 - RNA, 20 nt, Homo sapiens
aacccuguggggccugaugg

SEQ ID NO: 1821232 - RNA, 14 nt, Homo sapiens
cuugcucagugcaa

SEQ ID NO: 1821233 - RNA, 23 nt, Homo sapiens
gaugauuuuaaagaaagccacac

SEQ ID NO: 1821234 - RNA, 16 nt, Homo sapiens
uaguaauaccuacuug

SEQ ID NO: 1821235 - RNA, 18 nt, Homo sapiens
cguggcacacacugacca

SEQ ID NO: 1821236 - RNA, 18 nt, Homo sapiens
gcauguggugauuggcca

SEQ ID NO: 1821237 - RNA, 12 nt, Homo sapiens
aaccuuauucca

SEQ ID NO: 1821238 - RNA, 20 nt, Homo sapiens
gcccucauuacugggccuua

SEQ ID NO: 1821239 - RNA, 20 nt, Homo sapiens
caacugggggaaucaaauca

SEQ ID NO: 1821240 - RNA, 16 nt, Homo sapiens
caauccugucauauaa

SEQ ID NO: 1821241 - RNA, 19 nt, Homo sapiens
acagcuauuucgcacugua

SEQ ID NO: 1821242 - RNA, 19 nt, Homo sapiens
cccugcugauaccaccaga

SEQ ID NO: 1821243 - RNA, 23 nt, Homo sapiens
auuuuucacuucaaaacaguauu

SEQ ID NO: 1821244 - RNA, 16 nt, Homo sapiens
uuuuuccuuccugaga

SEQ ID NO: 1821245 - RNA, 22 nt, Homo sapiens
ucauguacuuaauaacacuuca

SEQ ID NO: 1821246 - RNA, 18 nt, Homo sapiens
gggccgcucgaugccuuu

SEQ ID NO: 1821247 - RNA, 19 nt, Homo sapiens
caaaacaagugacaugaag

SEQ ID NO: 1821248 - RNA, 16 nt, Homo sapiens
ucccacuaaaacugca

SEQ ID NO: 1821249 - RNA, 15 nt, Homo sapiens
agugcuuaaaaauac

SEQ ID NO: 1821250 - RNA, 21 nt, Homo sapiens
gugucuucaaugucaacagau

SEQ ID NO: 1821251 - RNA, 21 nt, Homo sapiens
agguuucaccucccaaaccca

SEQ ID NO: 1821252 - RNA, 15 nt, Homo sapiens
uugcaaaaacuacaa

SEQ ID NO: 1821253 - RNA, 18 nt, Homo sapiens
gccccuauugagaaguuu

SEQ ID NO: 1821254 - RNA, 23 nt, Homo sapiens
acaggugguuuuugguuacaugg

SEQ ID NO: 1821255 - RNA, 12 nt, Homo sapiens
ccauaauaugau

SEQ ID NO: 1821256 - RNA, 22 nt, Homo sapiens
gaaaccgaaacugacuugcuca

SEQ ID NO: 1821257 - RNA, 18 nt, Homo sapiens
gcagagcaaagugcggug

SEQ ID NO: 1821258 - RNA, 21 nt, Homo sapiens
ugcagcauaccaauuacccau

SEQ ID NO: 1821259 - RNA, 16 nt, Homo sapiens
aucccugaaacauugc

SEQ ID NO: 1821260 - RNA, 13 nt, Homo sapiens
uaaugaaugcaua

SEQ ID NO: 1821261 - RNA, 20 nt, Homo sapiens
uugguauacuuuugcuucag

SEQ ID NO: 1821262 - RNA, 19 nt, Homo sapiens
auuuuuggugggaauccaa

SEQ ID NO: 1821263 - RNA, 13 nt, Homo sapiens
cuucuguuccaca

SEQ ID NO: 1821264 - RNA, 23 nt, Homo sapiens
acacccuaauaaguccacaucuu

SEQ ID NO: 1821265 - RNA, 20 nt, Homo sapiens
cugcuucuaccaacuggaag

SEQ ID NO: 1821266 - RNA, 16 nt, Homo sapiens
aacagccuuucaauuc

SEQ ID NO: 1821267 - RNA, 16 nt, Homo sapiens
guacucacacaugcca

SEQ ID NO: 1821268 - RNA, 14 nt, Homo sapiens
aucagaaauuccag

SEQ ID NO: 1821269 - RNA, 21 nt, Homo sapiens
cugcucccacacuugugccag

SEQ ID NO: 1821270 - RNA, 16 nt, Homo sapiens
ugggaugcucucuggu

SEQ ID NO: 1821271 - RNA, 11 nt, Homo sapiens
cuguagacuua

SEQ ID NO: 1821272 - RNA, 19 nt, Homo sapiens
cugaaauaaaaugauaaac

SEQ ID NO: 1821273 - RNA, 19 nt, Homo sapiens
ugaaucccauaucuaccca

SEQ ID NO: 1821274 - RNA, 18 nt, Homo sapiens
caccaggaggcggcagug

SEQ ID NO: 1821275 - RNA, 23 nt, Homo sapiens
cugcuccgugcuuguuugcucac

SEQ ID NO: 1821276 - RNA, 11 nt, Homo sapiens
caggugggcac

SEQ ID NO: 1821277 - RNA, 22 nt, Homo sapiens
gaaggucaucaauaaaggggaa

SEQ ID NO: 1821278 - RNA, 14 nt, Homo sapiens
gcccaaugcacuuu

SEQ ID NO: 1821279 - RNA, 17 nt, Homo sapiens
uagccaucaagcacuuc

SEQ ID NO: 1821280 - RNA, 16 nt, Homo sapiens
cugacuaugugccgag

SEQ ID NO: 1821281 - RNA, 16 nt, Homo sapiens
uaacuuauugcauaac

SEQ ID NO: 1821282 - RNA, 14 nt, Homo sapiens
uucucuauuuuacu

SEQ ID NO: 1821283 - RNA, 15 nt, Homo sapiens
ucccaccggugccaa

SEQ ID NO: 1821284 - RNA, 15 nt, Homo sapiens
ucccaugcacaagau

SEQ ID NO: 1821285 - RNA, 16 nt, Homo sapiens
cuauguaugcaucuau

SEQ ID NO: 1821286 - RNA, 17 nt, Homo sapiens
cccacacucuccuguga

SEQ ID NO: 1821287 - RNA, 13 nt, Homo sapiens
acacugugucauu

SEQ ID NO: 1821288 - RNA, 13 nt, Homo sapiens
uucuugugauccu

SEQ ID NO: 1821289 - RNA, 16 nt, Homo sapiens
ucuaucuuugagcgcc

SEQ ID NO: 1821290 - RNA, 20 nt, Homo sapiens
aauguuaauugggcagguga

SEQ ID NO: 1821291 - RNA, 20 nt, Homo sapiens
ugguguuucagcauacauaa

SEQ ID NO: 1821292 - RNA, 18 nt, Homo sapiens
cauccugcaggcagcuuu

SEQ ID NO: 1821293 - RNA, 20 nt, Homo sapiens
aaacacuucugcuuucacuu

SEQ ID NO: 1821294 - RNA, 13 nt, Homo sapiens
cucaggucagggu

SEQ ID NO: 1821295 - RNA, 12 nt, Homo sapiens
acuaaaugcuca

SEQ ID NO: 1821296 - RNA, 20 nt, Homo sapiens
uuaacauaggcuuauacaaa

SEQ ID NO: 1821297 - RNA, 13 nt, Homo sapiens
gcuuuggacagaa

SEQ ID NO: 1821298 - RNA, 20 nt, Homo sapiens
gcucccaccaggcagcucca

SEQ ID NO: 1821299 - RNA, 18 nt, Homo sapiens
gcuuucuuucugcaugac

SEQ ID NO: 1821300 - RNA, 15 nt, Homo sapiens
gggcaguggugcccu

SEQ ID NO: 1821301 - RNA, 18 nt, Homo sapiens
aggguuugauagcacuua

SEQ ID NO: 1821302 - RNA, 15 nt, Homo sapiens
aaugcccacugccug

SEQ ID NO: 1821303 - RNA, 21 nt, Homo sapiens
caacugcucuuuuauacugua

SEQ ID NO: 1821304 - RNA, 20 nt, Homo sapiens
gaagccgucugacuccagag

SEQ ID NO: 1821305 - RNA, 14 nt, Homo sapiens
aaaaucuguucuaa

SEQ ID NO: 1821306 - RNA, 19 nt, Homo sapiens
cagauauauuuaagccuua

SEQ ID NO: 1821307 - RNA, 19 nt, Homo sapiens
cagcacauauuugcauggg

SEQ ID NO: 1821308 - RNA, 16 nt, Homo sapiens
aaccauaacacuugau

SEQ ID NO: 1821309 - RNA, 19 nt, Homo sapiens
acaucuuuuucacugacuu

SEQ ID NO: 1821310 - RNA, 22 nt, Homo sapiens
ucacagcaaggauggagcugaa

SEQ ID NO: 1821311 - RNA, 20 nt, Homo sapiens
cuguucugggcucuuuccuc

SEQ ID NO: 1821312 - RNA, 19 nt, Homo sapiens
uuuaacugccaauccuuaa

SEQ ID NO: 1821313 - RNA, 19 nt, Homo sapiens
cauuggcucccaagucaca

SEQ ID NO: 1821314 - RNA, 17 nt, Homo sapiens
caagaagcccuccuugc

SEQ ID NO: 1821315 - RNA, 16 nt, Homo sapiens
caaggccugugcugca

SEQ ID NO: 1821316 - RNA, 20 nt, Homo sapiens
caucugacugccaagccaga

SEQ ID NO: 1821317 - RNA, 16 nt, Homo sapiens
ucccugacuguaaaug

SEQ ID NO: 1821318 - RNA, 17 nt, Homo sapiens
ccuccuuccacauguac

SEQ ID NO: 1821319 - RNA, 20 nt, Homo sapiens
agucacccagggacacucca

SEQ ID NO: 1821320 - RNA, 20 nt, Homo sapiens
ugaccuuggaggaaugacaa

SEQ ID NO: 1821321 - RNA, 22 nt, Homo sapiens
caugauacaccuacuacucaau

SEQ ID NO: 1821322 - RNA, 23 nt, Homo sapiens
ucuucuggagauggaagcuuguu

SEQ ID NO: 1821323 - RNA, 19 nt, Homo sapiens
ucucuuaauuuucaggaag

SEQ ID NO: 1821324 - RNA, 15 nt, Homo sapiens
cagugugguuugcau

SEQ ID NO: 1821325 - RNA, 16 nt, Homo sapiens
cauuauuauuacuuuu

SEQ ID NO: 1821326 - RNA, 12 nt, Homo sapiens
uacuuccaucug

SEQ ID NO: 1821327 - RNA, 16 nt, Homo sapiens
cuaugugggucuguga

SEQ ID NO: 1821328 - RNA, 13 nt, Homo sapiens
uauuggugcuaga

SEQ ID NO: 1821329 - RNA, 22 nt, Homo sapiens
aacaauugggagauuaucuuuc

SEQ ID NO: 1821330 - RNA, 17 nt, Homo sapiens
ucacucuuuauagugca

SEQ ID NO: 1821331 - RNA, 16 nt, Homo sapiens
aagaaccugucccagg

SEQ ID NO: 1821332 - RNA, 14 nt, Homo sapiens
ggaggcaccauuca

SEQ ID NO: 1821333 - RNA, 18 nt, Homo sapiens
caauaggugcugagugua

SEQ ID NO: 1821334 - RNA, 13 nt, Homo sapiens
cccaggucuucca

SEQ ID NO: 1821335 - RNA, 22 nt, Homo sapiens
cacgugcaauacggaacacugu

SEQ ID NO: 1821336 - RNA, 20 nt, Homo sapiens
gaauguauugaacuuggaaa

SEQ ID NO: 1821337 - RNA, 19 nt, Homo sapiens
uuucuaacgccagcacacu

SEQ ID NO: 1821338 - RNA, 19 nt, Homo sapiens
ugucuccaucucugucuca

SEQ ID NO: 1821339 - RNA, 16 nt, Homo sapiens
gucucaugaccaguca

SEQ ID NO: 1821340 - RNA, 16 nt, Homo sapiens
uaucauuggaacaacu

SEQ ID NO: 1821341 - RNA, 15 nt, Homo sapiens
gccugucucauucgc

SEQ ID NO: 1821342 - RNA, 14 nt, Homo sapiens
acaaccauguucuu

SEQ ID NO: 1821343 - RNA, 17 nt, Homo sapiens
caccacucugggcacaa

SEQ ID NO: 1821344 - RNA, 12 nt, Homo sapiens
ucuguguggcag

SEQ ID NO: 1821345 - RNA, 14 nt, Homo sapiens
cuucuaugcugcuu

SEQ ID NO: 1821346 - RNA, 13 nt, Homo sapiens
auuaaagccuuaa

SEQ ID NO: 1821347 - RNA, 13 nt, Homo sapiens
gcauauacuuuaa

SEQ ID NO: 1821348 - RNA, 18 nt, Homo sapiens
gucaagguuuguguuacc

SEQ ID NO: 1821349 - RNA, 22 nt, Homo sapiens
ucagcauuagagaaaugaauua

SEQ ID NO: 1821350 - RNA, 21 nt, Homo sapiens
ugcuuuguugugugccucuag

SEQ ID NO: 1821351 - RNA, 21 nt, Homo sapiens
aagaaccacucauaauucuuc

SEQ ID NO: 1821352 - RNA, 17 nt, Homo sapiens
aggugaaauaugugaug

SEQ ID NO: 1821353 - RNA, 20 nt, Homo sapiens
ccaguucauugcacuuugau

SEQ ID NO: 1821354 - RNA, 17 nt, Homo sapiens
uccccagcugaucaugu

SEQ ID NO: 1821355 - RNA, 20 nt, Homo sapiens
acucucagaaauaaaucaca

SEQ ID NO: 1821356 - RNA, 17 nt, Homo sapiens
ggcagcauuuagcacau

SEQ ID NO: 1821357 - RNA, 14 nt, Homo sapiens
ucuaggauaagcac

SEQ ID NO: 1821358 - RNA, 10 nt, Homo sapiens
aggcugugcu

SEQ ID NO: 1821359 - RNA, 14 nt, Homo sapiens
ugaaggucugcaag

SEQ ID NO: 1821360 - RNA, 12 nt, Homo sapiens
acugaacuccau

SEQ ID NO: 1821361 - RNA, 22 nt, Homo sapiens
aggagggcccggagaaacugag

SEQ ID NO: 1821362 - RNA, 19 nt, Homo sapiens
caagguagaaaugucuaug

SEQ ID NO: 1821363 - RNA, 20 nt, Homo sapiens
cuugccaagggucccugugu

SEQ ID NO: 1821364 - RNA, 14 nt, Homo sapiens
agacuguaaugugu

SEQ ID NO: 1821365 - RNA, 15 nt, Homo sapiens
cauauucccacagca

SEQ ID NO: 1821366 - RNA, 16 nt, Homo sapiens
ccuggcuggcugaggg

SEQ ID NO: 1821367 - RNA, 20 nt, Homo sapiens
aauauuagcauugccaauau

SEQ ID NO: 1821368 - RNA, 20 nt, Homo sapiens
guaccaaaacauccacuuaa

SEQ ID NO: 1821369 - RNA, 22 nt, Homo sapiens
gcuggggaccagcagucugccu

SEQ ID NO: 1821370 - RNA, 20 nt, Homo sapiens
cucuagaagugccaucucaa

SEQ ID NO: 1821371 - RNA, 23 nt, Homo sapiens
gucacauggccuaugcacauaug

SEQ ID NO: 1821372 - RNA, 14 nt, Homo sapiens
aggaaauguguauu

SEQ ID NO: 1821373 - RNA, 22 nt, Homo sapiens
uggacugaguuuauacucaccu

SEQ ID NO: 1821374 - RNA, 17 nt, Homo sapiens
agagcuucucugggcug

SEQ ID NO: 1821375 - RNA, 13 nt, Homo sapiens
acuagaagcacag

SEQ ID NO: 1821376 - RNA, 17 nt, Homo sapiens
caauaaagauauuucca

SEQ ID NO: 1821377 - RNA, 16 nt, Homo sapiens
caaaguuuaagcaauu

SEQ ID NO: 1821378 - RNA, 16 nt, Homo sapiens
gaaacuauaaguaauu

SEQ ID NO: 1821379 - RNA, 16 nt, Homo sapiens
aacuuuuuauugauuu

SEQ ID NO: 1821380 - RNA, 17 nt, Homo sapiens
uccagcuccccccaaga

SEQ ID NO: 1821381 - RNA, 15 nt, Homo sapiens
agaauagaacuauug

SEQ ID NO: 1821382 - RNA, 14 nt, Homo sapiens
aaagacuggccuga

SEQ ID NO: 1821383 - RNA, 22 nt, Homo sapiens
gcuuaccauuaaaguucucaau

SEQ ID NO: 1821384 - RNA, 20 nt, Homo sapiens
aaaaaggaugcauucccuac

SEQ ID NO: 1821385 - RNA, 15 nt, Homo sapiens
ggccgcuguggccuu

SEQ ID NO: 1821386 - RNA, 16 nt, Homo sapiens
acccuguaaugguugg

SEQ ID NO: 1821387 - RNA, 21 nt, Homo sapiens
acuucacagagacucuguccu

SEQ ID NO: 1821388 - RNA, 16 nt, Homo sapiens
agcugauuugauacca

SEQ ID NO: 1821389 - RNA, 17 nt, Homo sapiens
gccuucucaccacagag

SEQ ID NO: 1821390 - RNA, 19 nt, Homo sapiens
auuuucccuacuugcagcg

SEQ ID NO: 1821391 - RNA, 16 nt, Homo sapiens
cuaagcccuuugccau

SEQ ID NO: 1821392 - RNA, 16 nt, Homo sapiens
uaucacacuugcaaau

SEQ ID NO: 1821393 - RNA, 21 nt, Homo sapiens
acaauaaaacuaaauguguac

SEQ ID NO: 1821394 - RNA, 15 nt, Homo sapiens
agggagaggccauga

SEQ ID NO: 1821395 - RNA, 15 nt, Homo sapiens
ggugauuccugggaa

SEQ ID NO: 1821396 - RNA, 20 nt, Homo sapiens
guagaauuguuuggcaaugc

SEQ ID NO: 1821397 - RNA, 17 nt, Homo sapiens
uuccauauguuauauca

SEQ ID NO: 1821398 - RNA, 14 nt, Homo sapiens
ugggaccgugacua

SEQ ID NO: 1821399 - RNA, 17 nt, Homo sapiens
aagugauaugcauuucc

SEQ ID NO: 1821400 - RNA, 18 nt, Homo sapiens
cucuaauuagucuaucaa

SEQ ID NO: 1821401 - RNA, 14 nt, Homo sapiens
aagaaauauuccuu

SEQ ID NO: 1821402 - RNA, 14 nt, Homo sapiens
ugcuccgcaagagc

SEQ ID NO: 1821403 - RNA, 15 nt, Homo sapiens
ugaaaaaucauccaa

SEQ ID NO: 1821404 - RNA, 20 nt, Homo sapiens
cauugaagauccgaguguga

SEQ ID NO: 1821405 - RNA, 21 nt, Homo sapiens
ccaugguguauucagagcuga

SEQ ID NO: 1821406 - RNA, 20 nt, Homo sapiens
ucuacagauaaugucuauau

SEQ ID NO: 1821407 - RNA, 23 nt, Homo sapiens
ucgagauguucgcucgugcagua

SEQ ID NO: 1821408 - RNA, 20 nt, Homo sapiens
uuuauuuaacugugcaguga

SEQ ID NO: 1821409 - RNA, 21 nt, Homo sapiens
cuguccccugaaaaacugauc

SEQ ID NO: 1821410 - RNA, 19 nt, Homo sapiens
uuauuaaaaauguauauga

SEQ ID NO: 1821411 - RNA, 14 nt, Homo sapiens
agacccucucaggc

SEQ ID NO: 1821412 - RNA, 23 nt, Homo sapiens
ggcuuugugauucccuccaguga

SEQ ID NO: 1821413 - RNA, 19 nt, Homo sapiens
ucuaaggaauaugagcuuu

SEQ ID NO: 1821414 - RNA, 21 nt, Homo sapiens
uccaaaguuggagcuucuauu

SEQ ID NO: 1821415 - RNA, 17 nt, Homo sapiens
gccucuguguaucucag

SEQ ID NO: 1821416 - RNA, 19 nt, Homo sapiens
ccgcaccuguacaguggaa

SEQ ID NO: 1821417 - RNA, 23 nt, Homo sapiens
uaacccgugcagaaccagcacua

SEQ ID NO: 1821418 - RNA, 22 nt, Homo sapiens
ccaggcaggauauuccaagggc

SEQ ID NO: 1821419 - RNA, 15 nt, Homo sapiens
uaaaauggauagaaa

SEQ ID NO: 1821420 - RNA, 17 nt, Homo sapiens
cauacucccuauuuuca

SEQ ID NO: 1821421 - RNA, 15 nt, Homo sapiens
aguuccaucccagga

SEQ ID NO: 1821422 - RNA, 22 nt, Homo sapiens
cacuuuggacauggcucacaaa

SEQ ID NO: 1821423 - RNA, 18 nt, Homo sapiens
gaugagacagacauucac

SEQ ID NO: 1821424 - RNA, 20 nt, Homo sapiens
accccacgugcgacagagag

SEQ ID NO: 1821425 - RNA, 14 nt, Homo sapiens
cccaguggccucaa

SEQ ID NO: 1821426 - RNA, 18 nt, Homo sapiens
ucacucucuuccuuucau

SEQ ID NO: 1821427 - RNA, 16 nt, Homo sapiens
gaagaaaaacacugag

SEQ ID NO: 1821428 - RNA, 15 nt, Homo sapiens
augaaggucuaccug

SEQ ID NO: 1821429 - RNA, 17 nt, Homo sapiens
cauagauuaauggcacu

SEQ ID NO: 1821430 - RNA, 19 nt, Homo sapiens
aaggguggaggguaaucuc

SEQ ID NO: 1821431 - RNA, 21 nt, Homo sapiens
ccucucccgcgggccuggaca

SEQ ID NO: 1821432 - RNA, 23 nt, Homo sapiens
cucuaauucuagagucucuguua

SEQ ID NO: 1821433 - RNA, 14 nt, Homo sapiens
caggcucggagcca

SEQ ID NO: 1821434 - RNA, 22 nt, Homo sapiens
aacuauuugaaacacacaguga

SEQ ID NO: 1821435 - RNA, 15 nt, Homo sapiens
ugucagucuacaggc

SEQ ID NO: 1821436 - RNA, 13 nt, Homo sapiens
aaggagauuccac

SEQ ID NO: 1821437 - RNA, 17 nt, Homo sapiens
agccugggggcuccuca

SEQ ID NO: 1821438 - RNA, 14 nt, Homo sapiens
caugcagcuaccca

SEQ ID NO: 1821439 - RNA, 21 nt, Homo sapiens
uuccacacagggugcauguga

SEQ ID NO: 1821440 - RNA, 23 nt, Homo sapiens
gaacaggcucagaucucauggga

SEQ ID NO: 1821441 - RNA, 13 nt, Homo sapiens
aguccucacacac

SEQ ID NO: 1821442 - RNA, 17 nt, Homo sapiens
cugcuggaaaucucaaa

SEQ ID NO: 1821443 - RNA, 19 nt, Homo sapiens
gauguguuaggaaugucaa

SEQ ID NO: 1821444 - RNA, 15 nt, Homo sapiens
cauuaguuguuauua

SEQ ID NO: 1821445 - RNA, 16 nt, Homo sapiens
gagcaaacugcucagc

SEQ ID NO: 1821446 - RNA, 24 nt, Homo sapiens
uacauuugagcuucuagcauugau

SEQ ID NO: 1821447 - RNA, 16 nt, Homo sapiens
uggcgaccaccaaagu

SEQ ID NO: 1821448 - RNA, 15 nt, Homo sapiens
uguacuuccugugua

SEQ ID NO: 1821449 - RNA, 17 nt, Homo sapiens
caaguacaaguauauaa

SEQ ID NO: 1821450 - RNA, 22 nt, Homo sapiens
aggguaguucaaagagucuguc

SEQ ID NO: 1821451 - RNA, 15 nt, Homo sapiens
ugcaacuucuguccc

SEQ ID NO: 1821452 - RNA, 20 nt, Homo sapiens
uuaaaaaaaacaauuccaca

SEQ ID NO: 1821453 - RNA, 20 nt, Homo sapiens
uaugaugggcuucuguucuc

SEQ ID NO: 1821454 - RNA, 21 nt, Homo sapiens
gaucuuaauauaaauucacuu

SEQ ID NO: 1821455 - RNA, 13 nt, Homo sapiens
ugcccuaagugau

SEQ ID NO: 1821456 - RNA, 22 nt, Homo sapiens
agcuugcuuuuaagagcaaugu

SEQ ID NO: 1821457 - RNA, 19 nt, Homo sapiens
ugugucagggaacauauuu

SEQ ID NO: 1821458 - RNA, 14 nt, Homo sapiens
cuauucaaaaccuc

SEQ ID NO: 1821459 - RNA, 16 nt, Homo sapiens
caauuaguaacauuca

SEQ ID NO: 1821460 - RNA, 15 nt, Homo sapiens
uuaacugaacuguga

SEQ ID NO: 1821461 - RNA, 20 nt, Homo sapiens
ccaaacucuucccucucuca

SEQ ID NO: 1821462 - RNA, 13 nt, Homo sapiens
uucaucauuucag

SEQ ID NO: 1821463 - RNA, 16 nt, Homo sapiens
uaaacaauguauuugu

SEQ ID NO: 1821464 - RNA, 19 nt, Homo sapiens
cucagcaguucacuuccua

SEQ ID NO: 1821465 - RNA, 16 nt, Homo sapiens
aauacacaacacacac

SEQ ID NO: 1821466 - RNA, 23 nt, Homo sapiens
ccugcacuggggagcccgucuca

SEQ ID NO: 1821467 - RNA, 15 nt, Homo sapiens
ccuccuuccauggaa

SEQ ID NO: 1821468 - RNA, 19 nt, Homo sapiens
guuaaccucagugucauuu

SEQ ID NO: 1821469 - RNA, 13 nt, Homo sapiens
uugcacgugcaau

SEQ ID NO: 1821470 - RNA, 22 nt, Homo sapiens
acuccacuacucucuuccucca

SEQ ID NO: 1821471 - RNA, 16 nt, Homo sapiens
caauaaaacauuccug

SEQ ID NO: 1821472 - RNA, 18 nt, Homo sapiens
auuguccccuaaaccaaa

SEQ ID NO: 1821473 - RNA, 20 nt, Homo sapiens
ccacgagccugcuguuucca

SEQ ID NO: 1821474 - RNA, 21 nt, Homo sapiens
guuucccaagcuagacugugu

SEQ ID NO: 1821475 - RNA, 17 nt, Homo sapiens
caaggcaggcauaucaa

SEQ ID NO: 1821476 - RNA, 18 nt, Homo sapiens
aagagaucuacacauguu

SEQ ID NO: 1821477 - RNA, 21 nt, Homo sapiens
uaaccacaaagcacaguuuga

SEQ ID NO: 1821478 - RNA, 18 nt, Homo sapiens
acagccacaaaauacaca

SEQ ID NO: 1821479 - RNA, 15 nt, Homo sapiens
gagcuggaacacaau

SEQ ID NO: 1821480 - RNA, 12 nt, Homo sapiens
ucagccuuuuau

SEQ ID NO: 1821481 - RNA, 12 nt, Homo sapiens
cuauccuuccag

SEQ ID NO: 1821482 - RNA, 17 nt, Homo sapiens
auuauuugucaagcaaa

SEQ ID NO: 1821483 - RNA, 15 nt, Homo sapiens
uuuaaaaccaugcag

SEQ ID NO: 1821484 - RNA, 21 nt, Homo sapiens
gagugcuuccgcugcggugau

SEQ ID NO: 1821485 - RNA, 15 nt, Homo sapiens
uagcgaggcucuaac

SEQ ID NO: 1821486 - RNA, 13 nt, Homo sapiens
accacaccacagg

SEQ ID NO: 1821487 - RNA, 13 nt, Homo sapiens
uugcugaaaccau

SEQ ID NO: 1821488 - RNA, 19 nt, Homo sapiens
ucaaauuggugaacagugu

SEQ ID NO: 1821489 - RNA, 12 nt, Homo sapiens
uacuguccuguu

SEQ ID NO: 1821490 - RNA, 14 nt, Homo sapiens
ucauacaugacuca

SEQ ID NO: 1821491 - RNA, 21 nt, Homo sapiens
guauguuugggagacugcuga

SEQ ID NO: 1821492 - RNA, 13 nt, Homo sapiens
ugaaaacuaugca

SEQ ID NO: 1821493 - RNA, 10 nt, Homo sapiens
aacaccagaa

SEQ ID NO: 1821494 - RNA, 20 nt, Homo sapiens
cgccagagggcuugugaaca

SEQ ID NO: 1821495 - RNA, 20 nt, Homo sapiens
ugacgcuugugacagugccu

SEQ ID NO: 1821496 - RNA, 17 nt, Homo sapiens
aguggucgagugacaca

SEQ ID NO: 1821497 - RNA, 14 nt, Homo sapiens
uaacaauguuaaau

SEQ ID NO: 1821498 - RNA, 14 nt, Homo sapiens
uauaaauguuucau

SEQ ID NO: 1821499 - RNA, 19 nt, Homo sapiens
ugaauagcuuauguacaaa

SEQ ID NO: 1821500 - RNA, 21 nt, Homo sapiens
ugccuggugggccacguguuc

SEQ ID NO: 1821501 - RNA, 15 nt, Homo sapiens
aucgucuucuaagag

SEQ ID NO: 1821502 - RNA, 15 nt, Homo sapiens
ucaugauuggcuuaa

SEQ ID NO: 1821503 - RNA, 19 nt, Homo sapiens
aaacuuuucagcagcauuu

SEQ ID NO: 1821504 - RNA, 11 nt, Homo sapiens
auaguccuaua

SEQ ID NO: 1821505 - RNA, 13 nt, Homo sapiens
cagaggagccaug

SEQ ID NO: 1821506 - RNA, 15 nt, Homo sapiens
cuccgucuuccugug

SEQ ID NO: 1821507 - RNA, 17 nt, Homo sapiens
cccaggcaccugcauuu

SEQ ID NO: 1821508 - RNA, 17 nt, Homo sapiens
caagccauucugccuca

SEQ ID NO: 1821509 - RNA, 22 nt, Homo sapiens
gaagcucccucccucacugugg

SEQ ID NO: 1821510 - RNA, 16 nt, Homo sapiens
acaugaaaaacaggug

SEQ ID NO: 1821511 - RNA, 20 nt, Homo sapiens
uaguauuaauuuauguaucu

SEQ ID NO: 1821512 - RNA, 19 nt, Homo sapiens
cuccucaugaggccaugca

SEQ ID NO: 1821513 - RNA, 15 nt, Homo sapiens
ccuccgcuacuucca

SEQ ID NO: 1821514 - RNA, 12 nt, Homo sapiens
gcagcuucaggg

SEQ ID NO: 1821515 - RNA, 13 nt, Homo sapiens
cuguaaaaugcac

SEQ ID NO: 1821516 - RNA, 20 nt, Homo sapiens
agguccccugaggucaugca

SEQ ID NO: 1821517 - RNA, 19 nt, Homo sapiens
aauaggcuauuaaaaaagu

SEQ ID NO: 1821518 - RNA, 11 nt, Homo sapiens
ggcacccaaga

SEQ ID NO: 1821519 - RNA, 20 nt, Homo sapiens
aggcauccuuccucacacca

SEQ ID NO: 1821520 - RNA, 16 nt, Homo sapiens
cagggagcuugccaca

SEQ ID NO: 1821521 - RNA, 15 nt, Homo sapiens
gaaagacauccauaa

SEQ ID NO: 1821522 - RNA, 21 nt, Homo sapiens
cagagauggucacaugaccca

SEQ ID NO: 1821523 - RNA, 18 nt, Homo sapiens
gucccggggccagcacuu

SEQ ID NO: 1821524 - RNA, 16 nt, Homo sapiens
agcaauacuguuucca

SEQ ID NO: 1821525 - RNA, 17 nt, Homo sapiens
ucuuauuuaauuuuugc

SEQ ID NO: 1821526 - RNA, 19 nt, Homo sapiens
aaguggcagaacacuggau

SEQ ID NO: 1821527 - RNA, 17 nt, Homo sapiens
aaaggaauccucugugu

SEQ ID NO: 1821528 - RNA, 14 nt, Homo sapiens
uaaguucuauugaa

SEQ ID NO: 1821529 - RNA, 14 nt, Homo sapiens
ucccaacucuagcc

SEQ ID NO: 1821530 - RNA, 15 nt, Homo sapiens
aagauaacugagaau

SEQ ID NO: 1821531 - RNA, 22 nt, Homo sapiens
caccgcauccucacugggcuca

SEQ ID NO: 1821532 - RNA, 11 nt, Homo sapiens
uucuguaaaau

SEQ ID NO: 1821533 - RNA, 18 nt, Homo sapiens
acugucccaggagcaaau

SEQ ID NO: 1821534 - RNA, 14 nt, Homo sapiens
acucuccaccacac

SEQ ID NO: 1821535 - RNA, 19 nt, Homo sapiens
auacucacguuugcuuaaa

SEQ ID NO: 1821536 - RNA, 23 nt, Homo sapiens
guuaaaauacauaacuucagugc

SEQ ID NO: 1821537 - RNA, 21 nt, Homo sapiens
gcuccugcccaggccacagag

SEQ ID NO: 1821538 - RNA, 19 nt, Homo sapiens
ccuggugggacaacaaaga

SEQ ID NO: 1821539 - RNA, 20 nt, Homo sapiens
ggcucccaagucacacccac

SEQ ID NO: 1821540 - RNA, 16 nt, Homo sapiens
uugggaccaucacuga

SEQ ID NO: 1821541 - RNA, 20 nt, Homo sapiens
cucaggacagaaccacugag

SEQ ID NO: 1821542 - RNA, 18 nt, Homo sapiens
aagugcuggcaaccacua

SEQ ID NO: 1821543 - RNA, 20 nt, Homo sapiens
ucacaaucuuggggcugaug

SEQ ID NO: 1821544 - RNA, 17 nt, Homo sapiens
auagauuucuacacuga

SEQ ID NO: 1821545 - RNA, 13 nt, Homo sapiens
gguaauuugccac

SEQ ID NO: 1821546 - RNA, 21 nt, Homo sapiens
acuaaaacuuuccugacuuac

SEQ ID NO: 1821547 - RNA, 18 nt, Homo sapiens
cuuuaugcugaaacagaa

SEQ ID NO: 1821548 - RNA, 21 nt, Homo sapiens
guacucugaaauuggucacuu

SEQ ID NO: 1821549 - RNA, 19 nt, Homo sapiens
uauacauuauuucuguaua

SEQ ID NO: 1821550 - RNA, 15 nt, Homo sapiens
aucaagcuggaguac

SEQ ID NO: 1821551 - RNA, 15 nt, Homo sapiens
uggcaguacuguugc

SEQ ID NO: 1821552 - RNA, 17 nt, Homo sapiens
gccagccgugaugcuca

SEQ ID NO: 1821553 - RNA, 23 nt, Homo sapiens
uguaccucucucugcuccucacc

SEQ ID NO: 1821554 - RNA, 18 nt, Homo sapiens
gaaccaaaagagaucaca

SEQ ID NO: 1821555 - RNA, 18 nt, Homo sapiens
gauaacuaggaaauccau

SEQ ID NO: 1821556 - RNA, 15 nt, Homo sapiens
aucugacauauacuc

SEQ ID NO: 1821557 - RNA, 18 nt, Homo sapiens
acuugugucaaccacuaa

SEQ ID NO: 1821558 - RNA, 20 nt, Homo sapiens
agcauggucacaagcacaaa

SEQ ID NO: 1821559 - RNA, 20 nt, Homo sapiens
auguccagcaccuugugccu

SEQ ID NO: 1821560 - RNA, 14 nt, Homo sapiens
auuaccaaaacacu

SEQ ID NO: 1821561 - RNA, 21 nt, Homo sapiens
gcuuggcaucugugugcgugg

SEQ ID NO: 1821562 - RNA, 20 nt, Homo sapiens
gaaauaccagugaaccaaag

SEQ ID NO: 1821563 - RNA, 19 nt, Homo sapiens
auucauuguuuugcaaaag

SEQ ID NO: 1821564 - RNA, 13 nt, Homo sapiens
accaaucaucuua

SEQ ID NO: 1821565 - RNA, 20 nt, Homo sapiens
uuuagacuaacuuccauggu

SEQ ID NO: 1821566 - RNA, 13 nt, Homo sapiens
acauugguauauu

SEQ ID NO: 1821567 - RNA, 13 nt, Homo sapiens
auuuugguacuuu

SEQ ID NO: 1821568 - RNA, 16 nt, Homo sapiens
aagaccaccaccucag

SEQ ID NO: 1821569 - RNA, 22 nt, Homo sapiens
uacugcaugaucuuacacgaag

SEQ ID NO: 1821570 - RNA, 16 nt, Homo sapiens
auccaacucuaaaccc

SEQ ID NO: 1821571 - RNA, 19 nt, Homo sapiens
aaaaguagguuuacauuca

SEQ ID NO: 1821572 - RNA, 15 nt, Homo sapiens
acgucugccuucuuu

SEQ ID NO: 1821573 - RNA, 19 nt, Homo sapiens
cuuaacuuugaaccauaaa

SEQ ID NO: 1821574 - RNA, 15 nt, Homo sapiens
auuacuagauauuaa

SEQ ID NO: 1821575 - RNA, 22 nt, Homo sapiens
cucucuggccucccaccaggaa

SEQ ID NO: 1821576 - RNA, 16 nt, Homo sapiens
cucagagaaugaucac

SEQ ID NO: 1821577 - RNA, 12 nt, Homo sapiens
ccagcacccaga

SEQ ID NO: 1821578 - RNA, 20 nt, Homo sapiens
cuuccauccugucaccauga

SEQ ID NO: 1821579 - RNA, 13 nt, Homo sapiens
agaguccagucaa

SEQ ID NO: 1821580 - RNA, 21 nt, Homo sapiens
ugggggugccgcucucucuga

SEQ ID NO: 1821581 - RNA, 22 nt, Homo sapiens
ucauagaggaaaagcacagauu

SEQ ID NO: 1821582 - RNA, 22 nt, Homo sapiens
aaaaaugcaaaaaagaaacaau

SEQ ID NO: 1821583 - RNA, 14 nt, Homo sapiens
acuucacgcuuuca

SEQ ID NO: 1821584 - RNA, 19 nt, Homo sapiens
agucacucuuaugcuguac

SEQ ID NO: 1821585 - RNA, 19 nt, Homo sapiens
cuuuuuccagguuccugag

SEQ ID NO: 1821586 - RNA, 21 nt, Homo sapiens
uuguauaacccauauacucuu

SEQ ID NO: 1821587 - RNA, 17 nt, Homo sapiens
aggauguucugggacac

SEQ ID NO: 1821588 - RNA, 14 nt, Homo sapiens
uguacuaaagccaa

SEQ ID NO: 1821589 - RNA, 24 nt, Homo sapiens
uugaauacgcuaauaagugacaaa

SEQ ID NO: 1821590 - RNA, 23 nt, Homo sapiens
aggacuugcuaaagcacuuugca

SEQ ID NO: 1821591 - RNA, 20 nt, Homo sapiens
gccuugugugaacucaccaa

SEQ ID NO: 1821592 - RNA, 19 nt, Homo sapiens
agacuacacuaguccauaa

SEQ ID NO: 1821593 - RNA, 19 nt, Homo sapiens
uuccaccaaaugugcuuug

SEQ ID NO: 1821594 - RNA, 16 nt, Homo sapiens
ucugagccaguucagu

SEQ ID NO: 1821595 - RNA, 14 nt, Homo sapiens
cagcuucuacggug

SEQ ID NO: 1821596 - RNA, 13 nt, Homo sapiens
ucgguguguuugc

SEQ ID NO: 1821597 - RNA, 13 nt, Homo sapiens
ucguguucacuca

SEQ ID NO: 1821598 - RNA, 18 nt, Homo sapiens
ucagaaucugauaccaaa

SEQ ID NO: 1821599 - RNA, 15 nt, Homo sapiens
agucccuuugugacu

SEQ ID NO: 1821600 - RNA, 14 nt, Homo sapiens
gcacauagagccag

SEQ ID NO: 1821601 - RNA, 16 nt, Homo sapiens
gaagcccuccuugcca

SEQ ID NO: 1821602 - RNA, 16 nt, Homo sapiens
ccauccaagauggcau

SEQ ID NO: 1821603 - RNA, 20 nt, Homo sapiens
cucaccuuccaacacuccau

SEQ ID NO: 1821604 - RNA, 20 nt, Homo sapiens
caccagagcauuuccaacac

SEQ ID NO: 1821605 - RNA, 14 nt, Homo sapiens
auagcaacaugcuu

SEQ ID NO: 1821606 - RNA, 17 nt, Homo sapiens
cacuguaugauuuauaa

SEQ ID NO: 1821607 - RNA, 20 nt, Homo sapiens
ucuagguccccauacuccua

SEQ ID NO: 1821608 - RNA, 22 nt, Homo sapiens
ugccagugagucugaaugucac

SEQ ID NO: 1821609 - RNA, 14 nt, Homo sapiens
uuauuuacaaugca

SEQ ID NO: 1821610 - RNA, 13 nt, Homo sapiens
cguacuguaacug

SEQ ID NO: 1821611 - RNA, 19 nt, Homo sapiens
ucaagacacagacaaaguc

SEQ ID NO: 1821612 - RNA, 20 nt, Homo sapiens
guuuguggcuuuaguggcca

SEQ ID NO: 1821613 - RNA, 16 nt, Homo sapiens
aggaaccaaccaacaa

SEQ ID NO: 1821614 - RNA, 15 nt, Homo sapiens
ccagaaggcaaaaag

SEQ ID NO: 1821615 - RNA, 21 nt, Homo sapiens
aguguugugcacuucauguca

SEQ ID NO: 1821616 - RNA, 15 nt, Homo sapiens
aaugauuugggaaaa

SEQ ID NO: 1821617 - RNA, 16 nt, Homo sapiens
agacucagcucugaca

SEQ ID NO: 1821618 - RNA, 17 nt, Homo sapiens
agggauccguacauuca

SEQ ID NO: 1821619 - RNA, 12 nt, Homo sapiens
ccuucaugcuuu

SEQ ID NO: 1821620 - RNA, 15 nt, Homo sapiens
gagcacuggccagag

SEQ ID NO: 1821621 - RNA, 23 nt, Homo sapiens
agaauaaggcuuuuucuucccuu

SEQ ID NO: 1821622 - RNA, 19 nt, Homo sapiens
cccagaugugguugcauaa

SEQ ID NO: 1821623 - RNA, 22 nt, Homo sapiens
accacuaggccugaaaugacau

SEQ ID NO: 1821624 - RNA, 15 nt, Homo sapiens
gagaauuucaaggca

SEQ ID NO: 1821625 - RNA, 14 nt, Homo sapiens
gaagccaugugauu

SEQ ID NO: 1821626 - RNA, 22 nt, Homo sapiens
agaaucaucuuuugaagcuuuc

SEQ ID NO: 1821627 - RNA, 21 nt, Homo sapiens
cagcauauguuguugcuugua

SEQ ID NO: 1821628 - RNA, 19 nt, Homo sapiens
accgcaggccuuacagucu

SEQ ID NO: 1821629 - RNA, 18 nt, Homo sapiens
auggaguucuugugccau

SEQ ID NO: 1821630 - RNA, 17 nt, Homo sapiens
uccuggugccaccucag

SEQ ID NO: 1821631 - RNA, 15 nt, Homo sapiens
cugggagcacaggca

SEQ ID NO: 1821632 - RNA, 20 nt, Homo sapiens
uguuuggauacaucugcugu

SEQ ID NO: 1821633 - RNA, 21 nt, Homo sapiens
cuaaaaugugucuugcuguca

SEQ ID NO: 1821634 - RNA, 20 nt, Homo sapiens
uauaagaggacuguaguuua

SEQ ID NO: 1821635 - RNA, 14 nt, Homo sapiens
ugcuucuccaccuc

SEQ ID NO: 1821636 - RNA, 14 nt, Homo sapiens
cacccaucugcuca

SEQ ID NO: 1821637 - RNA, 18 nt, Homo sapiens
uguacccugcuguauaau

SEQ ID NO: 1821638 - RNA, 14 nt, Homo sapiens
gguaagagcaaaag

SEQ ID NO: 1821639 - RNA, 17 nt, Homo sapiens
cccugugccucuuccca

SEQ ID NO: 1821640 - RNA, 14 nt, Homo sapiens
aauacuccuaagac

SEQ ID NO: 1821641 - RNA, 18 nt, Homo sapiens
aacagcguggaugucgau

SEQ ID NO: 1821642 - RNA, 23 nt, Homo sapiens
aaagaauuuuuuaagaacuguau

SEQ ID NO: 1821643 - RNA, 14 nt, Homo sapiens
agcucacugcugau

SEQ ID NO: 1821644 - RNA, 22 nt, Homo sapiens
gauuacuguccagcuuauaguc

SEQ ID NO: 1821645 - RNA, 20 nt, Homo sapiens
uugguacacacuugaccuuc

SEQ ID NO: 1821646 - RNA, 15 nt, Homo sapiens
uguaaguggauucag

SEQ ID NO: 1821647 - RNA, 13 nt, Homo sapiens
gugagggcaagag

SEQ ID NO: 1821648 - RNA, 22 nt, Homo sapiens
gauucauuuuccuguucaguga

SEQ ID NO: 1821649 - RNA, 16 nt, Homo sapiens
uaggcaauguacucuu

SEQ ID NO: 1821650 - RNA, 16 nt, Homo sapiens
uugcgagaauuuucaa

SEQ ID NO: 1821651 - RNA, 20 nt, Homo sapiens
cucccaaggugcuaggauua

SEQ ID NO: 1821652 - RNA, 15 nt, Homo sapiens
aggacaagggaaaug

SEQ ID NO: 1821653 - RNA, 20 nt, Homo sapiens
gacuugguccuaagcaccug

SEQ ID NO: 1821654 - RNA, 12 nt, Homo sapiens
aagucccggcuu

SEQ ID NO: 1821655 - RNA, 20 nt, Homo sapiens
aaaugagcaccagugguacu

SEQ ID NO: 1821656 - RNA, 19 nt, Homo sapiens
cuuuugugccauguucaaa

SEQ ID NO: 1821657 - RNA, 14 nt, Homo sapiens
uuaauagacuucuc

SEQ ID NO: 1821658 - RNA, 22 nt, Homo sapiens
acaugcuagugauaucuagaaa

SEQ ID NO: 1821659 - RNA, 15 nt, Homo sapiens
ugcagaccugggacu

SEQ ID NO: 1821660 - RNA, 16 nt, Homo sapiens
cuccuuugcagugucu

SEQ ID NO: 1821661 - RNA, 23 nt, Homo sapiens
ccacucaccgaagccacuuucua

SEQ ID NO: 1821662 - RNA, 14 nt, Homo sapiens
acugcgacugugac

SEQ ID NO: 1821663 - RNA, 19 nt, Homo sapiens
ggacuuccaucugugccau

SEQ ID NO: 1821664 - RNA, 22 nt, Homo sapiens
agagacuguuugaaucuugucu

SEQ ID NO: 1821665 - RNA, 20 nt, Homo sapiens
cacugaaaaaauacuaccua

SEQ ID NO: 1821666 - RNA, 16 nt, Homo sapiens
caggcccaauccugaa

SEQ ID NO: 1821667 - RNA, 22 nt, Homo sapiens
agagacucauuucacagccuuu

SEQ ID NO: 1821668 - RNA, 14 nt, Homo sapiens
ucugggucaaucca

SEQ ID NO: 1821669 - RNA, 22 nt, Homo sapiens
ccgaaacauacaagacaaaaaa

SEQ ID NO: 1821670 - RNA, 17 nt, Homo sapiens
cugugauuagaucacau

SEQ ID NO: 1821671 - RNA, 22 nt, Homo sapiens
auuacacauguagagcauaucu

SEQ ID NO: 1821672 - RNA, 22 nt, Homo sapiens
caagugcccucucugaaccuca

SEQ ID NO: 1821673 - RNA, 17 nt, Homo sapiens
aguccuuugauuccauu

SEQ ID NO: 1821674 - RNA, 23 nt, Homo sapiens
aaucugccugauaggacccauau

SEQ ID NO: 1821675 - RNA, 19 nt, Homo sapiens
uucagauacacugugauaa

SEQ ID NO: 1821676 - RNA, 19 nt, Homo sapiens
gcuauggaaugccccaugg

SEQ ID NO: 1821677 - RNA, 20 nt, Homo sapiens
acugcagucaccccugucug

SEQ ID NO: 1821678 - RNA, 13 nt, Homo sapiens
agguggcacacug

SEQ ID NO: 1821679 - RNA, 20 nt, Homo sapiens
uuaauaaaaacuucagaaaa

SEQ ID NO: 1821680 - RNA, 13 nt, Homo sapiens
cauaaguaucaug

SEQ ID NO: 1821681 - RNA, 12 nt, Homo sapiens
caaucacuugag

SEQ ID NO: 1821682 - RNA, 13 nt, Homo sapiens
uuucugucucucu

SEQ ID NO: 1821683 - RNA, 19 nt, Homo sapiens
auuaaaaggaagcuuacau

SEQ ID NO: 1821684 - RNA, 15 nt, Homo sapiens
ggaacaggagaccca

SEQ ID NO: 1821685 - RNA, 20 nt, Homo sapiens
ccugggguguccuacaguga

SEQ ID NO: 1821686 - RNA, 21 nt, Homo sapiens
uaccaguaugaaugacaauuu

SEQ ID NO: 1821687 - RNA, 14 nt, Homo sapiens
ugucaggcacuggg

SEQ ID NO: 1821688 - RNA, 21 nt, Homo sapiens
aguaugcaaugcuaucacugu

SEQ ID NO: 1821689 - RNA, 16 nt, Homo sapiens
gaagccucuggcuaga

SEQ ID NO: 1821690 - RNA, 16 nt, Homo sapiens
auguuaauaaacugca

SEQ ID NO: 1821691 - RNA, 11 nt, Homo sapiens
ugucuaccuga

SEQ ID NO: 1821692 - RNA, 22 nt, Homo sapiens
uguaaacuuugcuucuccaaau

SEQ ID NO: 1821693 - RNA, 16 nt, Homo sapiens
cucacuuaguccuuua

SEQ ID NO: 1821694 - RNA, 21 nt, Homo sapiens
ggaagggccccacucagggau

SEQ ID NO: 1821695 - RNA, 12 nt, Homo sapiens
ugaauauacaga

SEQ ID NO: 1821696 - RNA, 21 nt, Homo sapiens
ccugcauuguaaauagguucu

SEQ ID NO: 1821697 - RNA, 15 nt, Homo sapiens
aaaugacauuucacu

SEQ ID NO: 1821698 - RNA, 16 nt, Homo sapiens
cuugugcccaggguuu

SEQ ID NO: 1821699 - RNA, 21 nt, Homo sapiens
ucuuuacaccucgcuguuguc

SEQ ID NO: 1821700 - RNA, 19 nt, Homo sapiens
agaaggcucacagauuuaa

SEQ ID NO: 1821701 - RNA, 15 nt, Homo sapiens
cauagacccucucaa

SEQ ID NO: 1821702 - RNA, 19 nt, Homo sapiens
acuaggaaaaucaugugcu

SEQ ID NO: 1821703 - RNA, 14 nt, Homo sapiens
agaugaagucuugu

SEQ ID NO: 1821704 - RNA, 19 nt, Homo sapiens
aggaagaccccagcacaga

SEQ ID NO: 1821705 - RNA, 14 nt, Homo sapiens
uucucuuuacuuga

SEQ ID NO: 1821706 - RNA, 23 nt, Homo sapiens
ugccauuauuuaauaaaugacaa

SEQ ID NO: 1821707 - RNA, 14 nt, Homo sapiens
cacugccaugccuc

SEQ ID NO: 1821708 - RNA, 12 nt, Homo sapiens
agucacaaagga

SEQ ID NO: 1821709 - RNA, 14 nt, Homo sapiens
ucgaucuccugacc

SEQ ID NO: 1821710 - RNA, 23 nt, Homo sapiens
ucugaacugaccuugaaucuuuu

SEQ ID NO: 1821711 - RNA, 23 nt, Homo sapiens
cccaccaaugggccuccagagac

SEQ ID NO: 1821712 - RNA, 21 nt, Homo sapiens
ugaauaaaguuaguguguugu

SEQ ID NO: 1821713 - RNA, 19 nt, Homo sapiens
caaguccauguuauucucu

SEQ ID NO: 1821714 - RNA, 14 nt, Homo sapiens
cuaaaaaguaccag

SEQ ID NO: 1821715 - RNA, 14 nt, Homo sapiens
ccucucaaccaccu

SEQ ID NO: 1821716 - RNA, 21 nt, Homo sapiens
cuaguacuuuauuaguuuaaa

SEQ ID NO: 1821717 - RNA, 19 nt, Homo sapiens
uggagggaagaccugaaag

SEQ ID NO: 1821718 - RNA, 19 nt, Homo sapiens
gacaaaggccacaggcagu

SEQ ID NO: 1821719 - RNA, 21 nt, Homo sapiens
guggucauuuccuaugcaaau

SEQ ID NO: 1821720 - RNA, 19 nt, Homo sapiens
auaaccuucaugaugaauu

SEQ ID NO: 1821721 - RNA, 15 nt, Homo sapiens
ccacauucagggaaa

SEQ ID NO: 1821722 - RNA, 16 nt, Homo sapiens
cagugcugucugggau

SEQ ID NO: 1821723 - RNA, 22 nt, Homo sapiens
ccugugucagagccuaccuuca

SEQ ID NO: 1821724 - RNA, 19 nt, Homo sapiens
auucauauauugcauuucu

SEQ ID NO: 1821725 - RNA, 20 nt, Homo sapiens
auuccauuuuacuuccauga

SEQ ID NO: 1821726 - RNA, 18 nt, Homo sapiens
uaagauuuuacaaaagag

SEQ ID NO: 1821727 - RNA, 16 nt, Homo sapiens
cucuuggacccuggga

SEQ ID NO: 1821728 - RNA, 16 nt, Homo sapiens
cuccuugcugcauuga

SEQ ID NO: 1821729 - RNA, 22 nt, Homo sapiens
agcgccuuucccaacucuagcu

SEQ ID NO: 1821730 - RNA, 15 nt, Homo sapiens
ugauuagccauuuga

SEQ ID NO: 1821731 - RNA, 13 nt, Homo sapiens
ccuaaguacugua

SEQ ID NO: 1821732 - RNA, 14 nt, Homo sapiens
auaggaccugcauc

SEQ ID NO: 1821733 - RNA, 15 nt, Homo sapiens
caggcuucugagcac

SEQ ID NO: 1821734 - RNA, 19 nt, Homo sapiens
uuucuaauggaaugugaga

SEQ ID NO: 1821735 - RNA, 21 nt, Homo sapiens
cugugguuucagaugugcaau

SEQ ID NO: 1821736 - RNA, 21 nt, Homo sapiens
gaccacucuuccugaguucag

SEQ ID NO: 1821737 - RNA, 17 nt, Homo sapiens
auucaggcuuccauuga

SEQ ID NO: 1821738 - RNA, 16 nt, Homo sapiens
guuaagaaagcacuua

SEQ ID NO: 1821739 - RNA, 18 nt, Homo sapiens
caaucugcaguuuaacaa

SEQ ID NO: 1821740 - RNA, 20 nt, Homo sapiens
ugguaccuguguauuuggaa

SEQ ID NO: 1821741 - RNA, 17 nt, Homo sapiens
caaaucaagaaauauga

SEQ ID NO: 1821742 - RNA, 22 nt, Homo sapiens
agaaaccagacccuguaugaca

SEQ ID NO: 1821743 - RNA, 22 nt, Homo sapiens
uugaaaaacuaaaacagaaaaa

SEQ ID NO: 1821744 - RNA, 14 nt, Homo sapiens
uaggcuuggauguu

SEQ ID NO: 1821745 - RNA, 23 nt, Homo sapiens
agccccugaccccugucuguccc

SEQ ID NO: 1821746 - RNA, 18 nt, Homo sapiens
aagggaaagugaacauga

SEQ ID NO: 1821747 - RNA, 23 nt, Homo sapiens
ucccuagaaagccaugugcagcc

SEQ ID NO: 1821748 - RNA, 17 nt, Homo sapiens
gucauugcaccuaucuc

SEQ ID NO: 1821749 - RNA, 16 nt, Homo sapiens
ugcuuuugcuucuaga

SEQ ID NO: 1821750 - RNA, 12 nt, Homo sapiens
gcuuugccaaaa

SEQ ID NO: 1821751 - RNA, 23 nt, Homo sapiens
augggagggggcuugaagccaaa

SEQ ID NO: 1821752 - RNA, 17 nt, Homo sapiens
gcuccugccuggaagaa

SEQ ID NO: 1821753 - RNA, 15 nt, Homo sapiens
ccaagacaugacauu

SEQ ID NO: 1821754 - RNA, 22 nt, Homo sapiens
cuagcccaaagccuucauuuua

SEQ ID NO: 1821755 - RNA, 18 nt, Homo sapiens
cugucauauaauuuugaa

SEQ ID NO: 1821756 - RNA, 22 nt, Homo sapiens
aaucaacccaauaauucuguau

SEQ ID NO: 1821757 - RNA, 12 nt, Homo sapiens
uauuaagcacau

SEQ ID NO: 1821758 - RNA, 14 nt, Homo sapiens
uguacuaaucugag

SEQ ID NO: 1821759 - RNA, 21 nt, Homo sapiens
uuaugugccaauuuaguggaa

SEQ ID NO: 1821760 - RNA, 19 nt, Homo sapiens
cccuuucaugauuugcaac

SEQ ID NO: 1821761 - RNA, 16 nt, Homo sapiens
cuuuugagugccuuac

SEQ ID NO: 1821762 - RNA, 18 nt, Homo sapiens
cuaaauguuuggcaugua

SEQ ID NO: 1821763 - RNA, 17 nt, Homo sapiens
accauguuagccaggau

SEQ ID NO: 1821764 - RNA, 16 nt, Homo sapiens
cuuauuucucauauca

SEQ ID NO: 1821765 - RNA, 14 nt, Homo sapiens
agggugggggugcu

SEQ ID NO: 1821766 - RNA, 23 nt, Homo sapiens
aauuucagugaaaugguguauag

SEQ ID NO: 1821767 - RNA, 17 nt, Homo sapiens
cacugccagcagcuguu

SEQ ID NO: 1821768 - RNA, 15 nt, Homo sapiens
cucuuuccuccucau

SEQ ID NO: 1821769 - RNA, 19 nt, Homo sapiens
ugcauuacaaaguuaauau

SEQ ID NO: 1821770 - RNA, 22 nt, Homo sapiens
gcuucaggcagcagacugacca

SEQ ID NO: 1821771 - RNA, 20 nt, Homo sapiens
ccccagcccuacucugugua

SEQ ID NO: 1821772 - RNA, 19 nt, Homo sapiens
uuugccuaucuuuaaacau

SEQ ID NO: 1821773 - RNA, 20 nt, Homo sapiens
ggcucagcuagacauugcaa

SEQ ID NO: 1821774 - RNA, 17 nt, Homo sapiens
aaaugcuugauggaauu

SEQ ID NO: 1821775 - RNA, 20 nt, Homo sapiens
gugugguacagagaagccag

SEQ ID NO: 1821776 - RNA, 16 nt, Homo sapiens
uacccucaggacaaug

SEQ ID NO: 1821777 - RNA, 18 nt, Homo sapiens
gcgucauuucagcucuug

SEQ ID NO: 1821778 - RNA, 16 nt, Homo sapiens
aaagguacacugguau

SEQ ID NO: 1821779 - RNA, 16 nt, Homo sapiens
cugggcuagggagaau

SEQ ID NO: 1821780 - RNA, 23 nt, Homo sapiens
aaggcacccgcccuuuccuugcc

SEQ ID NO: 1821781 - RNA, 20 nt, Homo sapiens
acaugcagaagauguuuaaa

SEQ ID NO: 1821782 - RNA, 14 nt, Homo sapiens
uuuauaaacuacca

SEQ ID NO: 1821783 - RNA, 17 nt, Homo sapiens
gccuugugucacuggcu

SEQ ID NO: 1821784 - RNA, 18 nt, Homo sapiens
ugugacuuucaaggacau

SEQ ID NO: 1821785 - RNA, 13 nt, Homo sapiens
gauggauguuggg

SEQ ID NO: 1821786 - RNA, 23 nt, Homo sapiens
uuuuccccccaauugcugccaau

SEQ ID NO: 1821787 - RNA, 16 nt, Homo sapiens
uccagaguuguucucu

SEQ ID NO: 1821788 - RNA, 20 nt, Homo sapiens
aggcagcagaauugcuugaa

SEQ ID NO: 1821789 - RNA, 22 nt, Homo sapiens
ugcugcauacuuugacaaggaa

SEQ ID NO: 1821790 - RNA, 16 nt, Homo sapiens
uaauucaaaagaucaa

SEQ ID NO: 1821791 - RNA, 19 nt, Homo sapiens
augacugcaccaacaucau

SEQ ID NO: 1821792 - RNA, 17 nt, Homo sapiens
cgggcaagcgugcugcc

SEQ ID NO: 1821793 - RNA, 12 nt, Homo sapiens
ggcacauugugu

SEQ ID NO: 1821794 - RNA, 13 nt, Homo sapiens
uacgcaguuacug

SEQ ID NO: 1821795 - RNA, 15 nt, Homo sapiens
aaagagguuacuuua

SEQ ID NO: 1821796 - RNA, 14 nt, Homo sapiens
augcauguccucaa

SEQ ID NO: 1821797 - RNA, 13 nt, Homo sapiens
cuacaguauauaa

SEQ ID NO: 1821798 - RNA, 22 nt, Homo sapiens
ucccuucgacauugagccuucg

SEQ ID NO: 1821799 - RNA, 18 nt, Homo sapiens
cuugguuuccaaaggcau

SEQ ID NO: 1821800 - RNA, 19 nt, Homo sapiens
uggugucagccccacagga

SEQ ID NO: 1821801 - RNA, 22 nt, Homo sapiens
ccccaucgccagcugaugacuc

SEQ ID NO: 1821802 - RNA, 17 nt, Homo sapiens
uguuucuaaguggccug

SEQ ID NO: 1821803 - RNA, 23 nt, Homo sapiens
caauauuugauugguauucuguu

SEQ ID NO: 1821804 - RNA, 23 nt, Homo sapiens
gcuacccuccucuagaaggcuga

SEQ ID NO: 1821805 - RNA, 15 nt, Homo sapiens
uccagggagaccuag

SEQ ID NO: 1821806 - RNA, 16 nt, Homo sapiens
agaccugccagccacu

SEQ ID NO: 1821807 - RNA, 18 nt, Homo sapiens
aauguuuagcagauuuaa

SEQ ID NO: 1821808 - RNA, 10 nt, Homo sapiens
gccaccagag

SEQ ID NO: 1821809 - RNA, 21 nt, Homo sapiens
cauuggaccuuuccugaggaa

SEQ ID NO: 1821810 - RNA, 17 nt, Homo sapiens
ccuccuaaaacaauccu

SEQ ID NO: 1821811 - RNA, 14 nt, Homo sapiens
gcagugagcuugua

SEQ ID NO: 1821812 - RNA, 12 nt, Homo sapiens
ccuccacuggaa

SEQ ID NO: 1821813 - RNA, 12 nt, Homo sapiens
ugagcugugcag

SEQ ID NO: 1821814 - RNA, 13 nt, Homo sapiens
agcagauaauggu

SEQ ID NO: 1821815 - RNA, 17 nt, Homo sapiens
uuugcauggaguauuau

SEQ ID NO: 1821816 - RNA, 17 nt, Homo sapiens
agccucccccugcugcu

SEQ ID NO: 1821817 - RNA, 17 nt, Homo sapiens
cccuuagccucccugaa

SEQ ID NO: 1821818 - RNA, 22 nt, Homo sapiens
ccucaacaucacacaguauacu

SEQ ID NO: 1821819 - RNA, 22 nt, Homo sapiens
caaggacguggaugacccuccc

SEQ ID NO: 1821820 - RNA, 18 nt, Homo sapiens
ggugccugccauagccag

SEQ ID NO: 1821821 - RNA, 16 nt, Homo sapiens
cacaguuugcaaucuu

SEQ ID NO: 1821822 - RNA, 19 nt, Homo sapiens
cuacucccuggaccacgag

SEQ ID NO: 1821823 - RNA, 15 nt, Homo sapiens
aauuuucaguauaau

SEQ ID NO: 1821824 - RNA, 14 nt, Homo sapiens
uagagcugccugug

SEQ ID NO: 1821825 - RNA, 11 nt, Homo sapiens
uucuggugcua

SEQ ID NO: 1821826 - RNA, 13 nt, Homo sapiens
cacaaaacccaga

SEQ ID NO: 1821827 - RNA, 14 nt, Homo sapiens
ugaccucccaguga

SEQ ID NO: 1821828 - RNA, 14 nt, Homo sapiens
agacacuaccccau

SEQ ID NO: 1821829 - RNA, 22 nt, Homo sapiens
acauucaugcucaguagcuuaa

SEQ ID NO: 1821830 - RNA, 15 nt, Homo sapiens
cuaugugcacugaua

SEQ ID NO: 1821831 - RNA, 13 nt, Homo sapiens
cuuaaauaaucuc

SEQ ID NO: 1821832 - RNA, 15 nt, Homo sapiens
guuuggacacacugg

SEQ ID NO: 1821833 - RNA, 13 nt, Homo sapiens
ucaucaggaugaa

SEQ ID NO: 1821834 - RNA, 23 nt, Homo sapiens
auaaacuuucucaaauuauuaaa

SEQ ID NO: 1821835 - RNA, 12 nt, Homo sapiens
aggcugcugcug

SEQ ID NO: 1821836 - RNA, 17 nt, Homo sapiens
gaaacucagauguccaa

SEQ ID NO: 1821837 - RNA, 22 nt, Homo sapiens
auccgagauaggguggcacauc

SEQ ID NO: 1821838 - RNA, 15 nt, Homo sapiens
auauuuaacuaugaa

SEQ ID NO: 1821839 - RNA, 15 nt, Homo sapiens
cuugguaaauuguaa

SEQ ID NO: 1821840 - RNA, 21 nt, Homo sapiens
aaaugaucaccauguuagccu

SEQ ID NO: 1821841 - RNA, 18 nt, Homo sapiens
ggagacacuggucucaga

SEQ ID NO: 1821842 - RNA, 23 nt, Homo sapiens
aauauggcaaccauuauaaccuu

SEQ ID NO: 1821843 - RNA, 23 nt, Homo sapiens
gcccuccuccuccuuaacccugc

SEQ ID NO: 1821844 - RNA, 14 nt, Homo sapiens
uucauguuacucau

SEQ ID NO: 1821845 - RNA, 17 nt, Homo sapiens
auuauauugagacaaaa

SEQ ID NO: 1821846 - RNA, 21 nt, Homo sapiens
auagaaaacacgcaugagaua

SEQ ID NO: 1821847 - RNA, 14 nt, Homo sapiens
cucagcucuuggcu

SEQ ID NO: 1821848 - RNA, 17 nt, Homo sapiens
cugaagugguugcauuc

SEQ ID NO: 1821849 - RNA, 14 nt, Homo sapiens
uacucuguccaggc

SEQ ID NO: 1821850 - RNA, 22 nt, Homo sapiens
uaacucaggaagccucuggguu

SEQ ID NO: 1821851 - RNA, 13 nt, Homo sapiens
acugagauuacag

SEQ ID NO: 1821852 - RNA, 21 nt, Homo sapiens
aggcccuguccuaagcacuuu

SEQ ID NO: 1821853 - RNA, 22 nt, Homo sapiens
auuaaugauuuagcucccucca

SEQ ID NO: 1821854 - RNA, 18 nt, Homo sapiens
cugaacauccuuccuucc

SEQ ID NO: 1821855 - RNA, 18 nt, Homo sapiens
aacuuggcacacucucca

SEQ ID NO: 1821856 - RNA, 17 nt, Homo sapiens
cuuuguaagaaaaccaa

SEQ ID NO: 1821857 - RNA, 17 nt, Homo sapiens
aaagugauuaguacuau

SEQ ID NO: 1821858 - RNA, 17 nt, Homo sapiens
uugaugauaagauuuac

SEQ ID NO: 1821859 - RNA, 16 nt, Homo sapiens
gagccuccugugccug

SEQ ID NO: 1821860 - RNA, 16 nt, Homo sapiens
gauuguauaacccaua

SEQ ID NO: 1821861 - RNA, 20 nt, Homo sapiens
ccuaccacugucuucuucag

SEQ ID NO: 1821862 - RNA, 19 nt, Homo sapiens
ccagguucaauguccuccg

SEQ ID NO: 1821863 - RNA, 19 nt, Homo sapiens
cuaauuaauaaauuauuua

SEQ ID NO: 1821864 - RNA, 16 nt, Homo sapiens
uuucacaacauaucag

SEQ ID NO: 1821865 - RNA, 15 nt, Homo sapiens
uguuuuggcuuuaug

SEQ ID NO: 1821866 - RNA, 18 nt, Homo sapiens
ugauuauuuguauuuaca

SEQ ID NO: 1821867 - RNA, 19 nt, Homo sapiens
cacagauccccccacaaag

SEQ ID NO: 1821868 - RNA, 16 nt, Homo sapiens
uuggcccaagcucuug

SEQ ID NO: 1821869 - RNA, 13 nt, Homo sapiens
aaaacauccagca

SEQ ID NO: 1821870 - RNA, 17 nt, Homo sapiens
ucaagcuucacauuugc

SEQ ID NO: 1821871 - RNA, 16 nt, Homo sapiens
gcuugcaagauuccaa

SEQ ID NO: 1821872 - RNA, 18 nt, Homo sapiens
uccaggaacuuuccagca

SEQ ID NO: 1821873 - RNA, 15 nt, Homo sapiens
uagccaucucaagca

SEQ ID NO: 1821874 - RNA, 20 nt, Homo sapiens
uacauuucugcagaucuucc

SEQ ID NO: 1821875 - RNA, 18 nt, Homo sapiens
cccucaccagaagcagau

SEQ ID NO: 1821876 - RNA, 20 nt, Homo sapiens
cucuagcuuugucauaguua

SEQ ID NO: 1821877 - RNA, 17 nt, Homo sapiens
gaugucucuuguagaag

SEQ ID NO: 1821878 - RNA, 16 nt, Homo sapiens
ucuauuuugugaugau

SEQ ID NO: 1821879 - RNA, 20 nt, Homo sapiens
aucucagcuaacauuccaug

SEQ ID NO: 1821880 - RNA, 19 nt, Homo sapiens
ugagcagacugcaaaucug

SEQ ID NO: 1821881 - RNA, 12 nt, Homo sapiens
acaugcucuuuu

SEQ ID NO: 1821882 - RNA, 14 nt, Homo sapiens
caugccucagugaa

SEQ ID NO: 1821883 - RNA, 22 nt, Homo sapiens
acagauccagggacugaagcca

SEQ ID NO: 1821884 - RNA, 15 nt, Homo sapiens
gaaucacaguacuuu

SEQ ID NO: 1821885 - RNA, 16 nt, Homo sapiens
uagguuuuuaaagacu

SEQ ID NO: 1821886 - RNA, 14 nt, Homo sapiens
auuacuacuguaca

SEQ ID NO: 1821887 - RNA, 15 nt, Homo sapiens
agaauuaaugcucua

SEQ ID NO: 1821888 - RNA, 19 nt, Homo sapiens
aaauaguaaucuguaagca

SEQ ID NO: 1821889 - RNA, 15 nt, Homo sapiens
uguguacaacacugg

SEQ ID NO: 1821890 - RNA, 18 nt, Homo sapiens
accauguggccauuaaca

SEQ ID NO: 1821891 - RNA, 23 nt, Homo sapiens
uucuaacccaagacaugacauuc

SEQ ID NO: 1821892 - RNA, 23 nt, Homo sapiens
cuaaauuauuuacugcaaaaaga

SEQ ID NO: 1821893 - RNA, 17 nt, Homo sapiens
gugaucccagcuacuca

SEQ ID NO: 1821894 - RNA, 20 nt, Homo sapiens
auguaaacauaauucuugua

SEQ ID NO: 1821895 - RNA, 20 nt, Homo sapiens
uuauuuuugcuuguuucuga

SEQ ID NO: 1821896 - RNA, 15 nt, Homo sapiens
ucauuauccacccca

SEQ ID NO: 1821897 - RNA, 18 nt, Homo sapiens
uuauuauuguucuuuaag

SEQ ID NO: 1821898 - RNA, 13 nt, Homo sapiens
gcgccuggugcug

SEQ ID NO: 1821899 - RNA, 14 nt, Homo sapiens
auacacaacauuua

SEQ ID NO: 1821900 - RNA, 18 nt, Homo sapiens
aaaaacuaacacccaguc

SEQ ID NO: 1821901 - RNA, 21 nt, Homo sapiens
aggccucccuagccagcacuu

SEQ ID NO: 1821902 - RNA, 17 nt, Homo sapiens
acgugaagccacaggag

SEQ ID NO: 1821903 - RNA, 23 nt, Homo sapiens
cccagauccaggaacacaugcac

SEQ ID NO: 1821904 - RNA, 18 nt, Homo sapiens
ucccuggaaaccuuccac

SEQ ID NO: 1821905 - RNA, 14 nt, Homo sapiens
guugugucuaggcu

SEQ ID NO: 1821906 - RNA, 14 nt, Homo sapiens
auauaugcaauaua

SEQ ID NO: 1821907 - RNA, 14 nt, Homo sapiens
aaauuugcauuaaa

SEQ ID NO: 1821908 - RNA, 14 nt, Homo sapiens
aagggcagugagaa

SEQ ID NO: 1821909 - RNA, 20 nt, Homo sapiens
acgcccuauuucuaugucau

SEQ ID NO: 1821910 - RNA, 23 nt, Homo sapiens
uacaugucuuucuccagggacau

SEQ ID NO: 1821911 - RNA, 19 nt, Homo sapiens
ucccgccggaggccagcua

SEQ ID NO: 1821912 - RNA, 17 nt, Homo sapiens
aaaucauccucaugucc

SEQ ID NO: 1821913 - RNA, 16 nt, Homo sapiens
uauaguuuauugacaa

SEQ ID NO: 1821914 - RNA, 18 nt, Homo sapiens
aauauguaaaauuacacu

SEQ ID NO: 1821915 - RNA, 17 nt, Homo sapiens
ugcacagcaggcugcca

SEQ ID NO: 1821916 - RNA, 20 nt, Homo sapiens
aggccgggcacaguggcuca

SEQ ID NO: 1821917 - RNA, 19 nt, Homo sapiens
agagggccuugcuucucuu

SEQ ID NO: 1821918 - RNA, 23 nt, Homo sapiens
ucauuggccacugucuccacuca

SEQ ID NO: 1821919 - RNA, 22 nt, Homo sapiens
acugucuugaagacaauggcuu

SEQ ID NO: 1821920 - RNA, 17 nt, Homo sapiens
ugcuccagacagggaau

SEQ ID NO: 1821921 - RNA, 12 nt, Homo sapiens
agagugcaaugg

SEQ ID NO: 1821922 - RNA, 12 nt, Homo sapiens
ggagugcagugg

SEQ ID NO: 1821923 - RNA, 17 nt, Homo sapiens
uauaucacaaucucugu

SEQ ID NO: 1821924 - RNA, 14 nt, Homo sapiens
aacuuugaggauaa

SEQ ID NO: 1821925 - RNA, 17 nt, Homo sapiens
agaugcuuagugugaag

SEQ ID NO: 1821926 - RNA, 22 nt, Homo sapiens
auagucuguacuucaguucuca

SEQ ID NO: 1821927 - RNA, 19 nt, Homo sapiens
uuucccuccaccagugugc

SEQ ID NO: 1821928 - RNA, 23 nt, Homo sapiens
uguacacacggaccaugugguau

SEQ ID NO: 1821929 - RNA, 23 nt, Homo sapiens
aaaucaggacagguggugcaaau

SEQ ID NO: 1821930 - RNA, 13 nt, Homo sapiens
auuuacuacuuau

SEQ ID NO: 1821931 - RNA, 18 nt, Homo sapiens
gaucuuaacaaagccuuu

SEQ ID NO: 1821932 - RNA, 13 nt, Homo sapiens
aaucaaacugcuu

SEQ ID NO: 1821933 - RNA, 19 nt, Homo sapiens
ucacgcaacuugaaauuau

SEQ ID NO: 1821934 - RNA, 17 nt, Homo sapiens
cacuaagucucuagccu

SEQ ID NO: 1821935 - RNA, 13 nt, Homo sapiens
uacagacugugag

SEQ ID NO: 1821936 - RNA, 14 nt, Homo sapiens
caagaaacacuuuc

SEQ ID NO: 1821937 - RNA, 14 nt, Homo sapiens
caccucuuugucac

SEQ ID NO: 1821938 - RNA, 20 nt, Homo sapiens
ccaucguauuaaaaaacaau

SEQ ID NO: 1821939 - RNA, 14 nt, Homo sapiens
aaagggauacacag

SEQ ID NO: 1821940 - RNA, 22 nt, Homo sapiens
ugaucaucgaggagcuagaaca

SEQ ID NO: 1821941 - RNA, 20 nt, Homo sapiens
ucaaauauuaccaaaaaagu

SEQ ID NO: 1821942 - RNA, 21 nt, Homo sapiens
cugagcacauuugacuccacu

SEQ ID NO: 1821943 - RNA, 22 nt, Homo sapiens
aaguagcuuuccacauuuguca

SEQ ID NO: 1821944 - RNA, 12 nt, Homo sapiens
gcuacugccaag

SEQ ID NO: 1821945 - RNA, 19 nt, Homo sapiens
gcgcccaguccuuccaccu

SEQ ID NO: 1821946 - RNA, 19 nt, Homo sapiens
aucagccccgcuccucccc

SEQ ID NO: 1821947 - RNA, 14 nt, Homo sapiens
cauuuaugacaagc

SEQ ID NO: 1821948 - RNA, 15 nt, Homo sapiens
gaacugguucuugcc

SEQ ID NO: 1821949 - RNA, 22 nt, Homo sapiens
agaaaaugccucaauucacaua

SEQ ID NO: 1821950 - RNA, 16 nt, Homo sapiens
uguaggguaaggugcc

SEQ ID NO: 1821951 - RNA, 22 nt, Homo sapiens
gauggcgaggccucucucagga

SEQ ID NO: 1821952 - RNA, 19 nt, Homo sapiens
cuaaaguugcuccauacaa

SEQ ID NO: 1821953 - RNA, 21 nt, Homo sapiens
gagcauguggugauuggccac

SEQ ID NO: 1821954 - RNA, 21 nt, Homo sapiens
gcccauccccaggcaccucac

SEQ ID NO: 1821955 - RNA, 20 nt, Homo sapiens
uagaguuauuauaguuauuc

SEQ ID NO: 1821956 - RNA, 16 nt, Homo sapiens
ugaguugaaauguucu

SEQ ID NO: 1821957 - RNA, 16 nt, Homo sapiens
uguuuguggaacaaaa

SEQ ID NO: 1821958 - RNA, 21 nt, Homo sapiens
ucaaauauauuucaagcuaua

SEQ ID NO: 1821959 - RNA, 18 nt, Homo sapiens
cuuuuucuggacucugga

SEQ ID NO: 1821960 - RNA, 16 nt, Homo sapiens
aauguuucaggucugg

SEQ ID NO: 1821961 - RNA, 16 nt, Homo sapiens
uucuucaagacucuga

SEQ ID NO: 1821962 - RNA, 23 nt, Homo sapiens
aaaguuaugguacuauguuagcc

SEQ ID NO: 1821963 - RNA, 19 nt, Homo sapiens
uaggccuuccagugcagga

SEQ ID NO: 1821964 - RNA, 19 nt, Homo sapiens
agguaggggcccacuucac

SEQ ID NO: 1821965 - RNA, 15 nt, Homo sapiens
gauguuucugucaca

SEQ ID NO: 1821966 - RNA, 14 nt, Homo sapiens
cacuagagucuuca

SEQ ID NO: 1821967 - RNA, 15 nt, Homo sapiens
gugggaaugcagugg

SEQ ID NO: 1821968 - RNA, 13 nt, Homo sapiens
gcaguacauguua

SEQ ID NO: 1821969 - RNA, 23 nt, Homo sapiens
ugcugucauuguccaugccuaca

SEQ ID NO: 1821970 - RNA, 13 nt, Homo sapiens
accucaccaaaac

SEQ ID NO: 1821971 - RNA, 17 nt, Homo sapiens
ucuaaguaaugaugucg

SEQ ID NO: 1821972 - RNA, 17 nt, Homo sapiens
uaccucaagggggacug

SEQ ID NO: 1821973 - RNA, 18 nt, Homo sapiens
gccuuggaggacccagca

SEQ ID NO: 1821974 - RNA, 14 nt, Homo sapiens
ucaccucauggaau

SEQ ID NO: 1821975 - RNA, 20 nt, Homo sapiens
ucaauugugcuuuguaucag

SEQ ID NO: 1821976 - RNA, 17 nt, Homo sapiens
ucaguaaaucagugcag

SEQ ID NO: 1821977 - RNA, 17 nt, Homo sapiens
auagucuauauuuuaac

SEQ ID NO: 1821978 - RNA, 16 nt, Homo sapiens
aaaaaugcucaaucuc

SEQ ID NO: 1821979 - RNA, 22 nt, Homo sapiens
agcuggccaaccccgagaacca

SEQ ID NO: 1821980 - RNA, 23 nt, Homo sapiens
gcacaccccuggggcugagucuc

SEQ ID NO: 1821981 - RNA, 23 nt, Homo sapiens
agucaggugggguggagucccag

SEQ ID NO: 1821982 - RNA, 19 nt, Homo sapiens
uuuguagccuuccuccaca

SEQ ID NO: 1821983 - RNA, 16 nt, Homo sapiens
cucagugaagguggug

SEQ ID NO: 1821984 - RNA, 23 nt, Homo sapiens
cuucucaauagaguguuguugcu

SEQ ID NO: 1821985 - RNA, 22 nt, Homo sapiens
aauguuuaugaauaguuuccaa

SEQ ID NO: 1821986 - RNA, 19 nt, Homo sapiens
caagaagguggaaggcagu

SEQ ID NO: 1821987 - RNA, 17 nt, Homo sapiens
uaaagccgaacugguac

SEQ ID NO: 1821988 - RNA, 20 nt, Homo sapiens
augaaauugagucauuuuau

SEQ ID NO: 1821989 - RNA, 19 nt, Homo sapiens
ccuaauagucauacuagua

SEQ ID NO: 1821990 - RNA, 19 nt, Homo sapiens
gcccucagcccaccugggg

SEQ ID NO: 1821991 - RNA, 22 nt, Homo sapiens
uguauaacauuuaaaaauguua

SEQ ID NO: 1821992 - RNA, 21 nt, Homo sapiens
aggaggagugggacagacagc

SEQ ID NO: 1821993 - RNA, 16 nt, Homo sapiens
cagcuuauaugugaca

SEQ ID NO: 1821994 - RNA, 12 nt, Homo sapiens
ugacaaagccau

SEQ ID NO: 1821995 - RNA, 21 nt, Homo sapiens
acaccuacaugaaaagcagaa

SEQ ID NO: 1821996 - RNA, 17 nt, Homo sapiens
uauguucugucuuccca

SEQ ID NO: 1821997 - RNA, 21 nt, Homo sapiens
uugaguuauuccacaaacaca

SEQ ID NO: 1821998 - RNA, 19 nt, Homo sapiens
agaacuccuuucuaaggag

SEQ ID NO: 1821999 - RNA, 19 nt, Homo sapiens
cgcauugagccaguggugc

SEQ ID NO: 1822000 - RNA, 15 nt, Homo sapiens
cuggugcuacgacca

SEQ ID NO: 1822001 - RNA, 19 nt, Homo sapiens
gcuagcuucuuuugauacu

SEQ ID NO: 1822002 - RNA, 18 nt, Homo sapiens
agggcauaaugaguuccu

SEQ ID NO: 1822003 - RNA, 19 nt, Homo sapiens
uugaaaauauuuuguugcc

SEQ ID NO: 1822004 - RNA, 13 nt, Homo sapiens
uagccugggacca

SEQ ID NO: 1822005 - RNA, 19 nt, Homo sapiens
aaaaugaaagcaugucuca

SEQ ID NO: 1822006 - RNA, 15 nt, Homo sapiens
uaaugguagcauucu

SEQ ID NO: 1822007 - RNA, 15 nt, Homo sapiens
uauacaccauaugcc

SEQ ID NO: 1822008 - RNA, 14 nt, Homo sapiens
aaacaaugcaguac

SEQ ID NO: 1822009 - RNA, 22 nt, Homo sapiens
augccaguaacgcgucuuccug

SEQ ID NO: 1822010 - RNA, 13 nt, Homo sapiens
accagagcacugu

SEQ ID NO: 1822011 - RNA, 13 nt, Homo sapiens
ucaaauccagugg

SEQ ID NO: 1822012 - RNA, 19 nt, Homo sapiens
ggcaaguugccacuuguca

SEQ ID NO: 1822013 - RNA, 12 nt, Homo sapiens
uuaggaacagcu

SEQ ID NO: 1822014 - RNA, 15 nt, Homo sapiens
cguucucuaccuuca

SEQ ID NO: 1822015 - RNA, 22 nt, Homo sapiens
aagaguggguuucacaagugaa

SEQ ID NO: 1822016 - RNA, 17 nt, Homo sapiens
ugaauaaagugcugcgg

SEQ ID NO: 1822017 - RNA, 15 nt, Homo sapiens
aagauuauuugcacg

SEQ ID NO: 1822018 - RNA, 14 nt, Homo sapiens
ggaguaacaaaaca

SEQ ID NO: 1822019 - RNA, 22 nt, Homo sapiens
ccuggugggccuccucugucca

SEQ ID NO: 1822020 - RNA, 21 nt, Homo sapiens
uauuucuauacaguagcuuga

SEQ ID NO: 1822021 - RNA, 18 nt, Homo sapiens
caacauuuuugcaaaucu

SEQ ID NO: 1822022 - RNA, 23 nt, Homo sapiens
cuucuagaauccccacagggaaa

SEQ ID NO: 1822023 - RNA, 15 nt, Homo sapiens
cuuucugaauggaaa

SEQ ID NO: 1822024 - RNA, 14 nt, Homo sapiens
caugaaaacuggga

SEQ ID NO: 1822025 - RNA, 19 nt, Homo sapiens
cacccagguuggagugcag

SEQ ID NO: 1822026 - RNA, 20 nt, Homo sapiens
agacgugcacuuggugcugc

SEQ ID NO: 1822027 - RNA, 12 nt, Homo sapiens
guggacaggugu

SEQ ID NO: 1822028 - RNA, 17 nt, Homo sapiens
aaauaacagacugucug

SEQ ID NO: 1822029 - RNA, 18 nt, Homo sapiens
cuucuugaugaugguggu

SEQ ID NO: 1822030 - RNA, 13 nt, Homo sapiens
ucuucuuaucaca

SEQ ID NO: 1822031 - RNA, 11 nt, Homo sapiens
aauuacaauac

SEQ ID NO: 1822032 - RNA, 15 nt, Homo sapiens
acauaaaagcacaaa

SEQ ID NO: 1822033 - RNA, 20 nt, Homo sapiens
ggagaaguaauccuagggaa

SEQ ID NO: 1822034 - RNA, 12 nt, Homo sapiens
uaaccaguacuu

SEQ ID NO: 1822035 - RNA, 14 nt, Homo sapiens
uuuaguaucuaguc

SEQ ID NO: 1822036 - RNA, 21 nt, Homo sapiens
cuguaccucucucugcuccuc

SEQ ID NO: 1822037 - RNA, 14 nt, Homo sapiens
ugucaccagcaaca

SEQ ID NO: 1822038 - RNA, 19 nt, Homo sapiens
cucaaccaccuaggcaaug

SEQ ID NO: 1822039 - RNA, 14 nt, Homo sapiens
cuuuuuacauuaca

SEQ ID NO: 1822040 - RNA, 13 nt, Homo sapiens
cccacuucuggca

SEQ ID NO: 1822041 - RNA, 14 nt, Homo sapiens
cauuuuauuaucac

SEQ ID NO: 1822042 - RNA, 13 nt, Homo sapiens
gcaaggccaccuc

SEQ ID NO: 1822043 - RNA, 21 nt, Homo sapiens
ucccucggccugggauuucag

SEQ ID NO: 1822044 - RNA, 16 nt, Homo sapiens
acaacaauaauaaaga

SEQ ID NO: 1822045 - RNA, 19 nt, Homo sapiens
auauggacacuggugccau

SEQ ID NO: 1822046 - RNA, 19 nt, Homo sapiens
accaaauguguaauggaga

SEQ ID NO: 1822047 - RNA, 14 nt, Homo sapiens
uguccuuucuugca

SEQ ID NO: 1822048 - RNA, 24 nt, Homo sapiens
gaaucacgauuuucuacaccuguc

SEQ ID NO: 1822049 - RNA, 20 nt, Homo sapiens
agcaacucagaaugcucuac

SEQ ID NO: 1822050 - RNA, 20 nt, Homo sapiens
gguauggacaaaauugcaga

SEQ ID NO: 1822051 - RNA, 13 nt, Homo sapiens
gcuucaaacuaac

SEQ ID NO: 1822052 - RNA, 23 nt, Homo sapiens
cuaggccuugccccaccuccauc

SEQ ID NO: 1822053 - RNA, 14 nt, Homo sapiens
agcuuccaccucau

SEQ ID NO: 1822054 - RNA, 16 nt, Homo sapiens
gccagcauacauuuuc

SEQ ID NO: 1822055 - RNA, 13 nt, Homo sapiens
caaccugcacuuc

SEQ ID NO: 1822056 - RNA, 18 nt, Homo sapiens
ugacuaaucuuugcugaa

SEQ ID NO: 1822057 - RNA, 14 nt, Homo sapiens
agacaauuccucca

SEQ ID NO: 1822058 - RNA, 15 nt, Homo sapiens
cauguuaacaugaca

SEQ ID NO: 1822059 - RNA, 13 nt, Homo sapiens
aguuugccuguac

SEQ ID NO: 1822060 - RNA, 23 nt, Homo sapiens
gagcccugugaggcuggguccaa

SEQ ID NO: 1822061 - RNA, 14 nt, Homo sapiens
acagugcaucucag

SEQ ID NO: 1822062 - RNA, 14 nt, Homo sapiens
uguguccaagacac

SEQ ID NO: 1822063 - RNA, 19 nt, Homo sapiens
cagacucgcuagcacucaa

SEQ ID NO: 1822064 - RNA, 13 nt, Homo sapiens
uaugugugccuuu

SEQ ID NO: 1822065 - RNA, 16 nt, Homo sapiens
ccaggaaggacugugc

SEQ ID NO: 1822066 - RNA, 22 nt, Homo sapiens
gauacugcugcgucauuacagg

SEQ ID NO: 1822067 - RNA, 19 nt, Homo sapiens
aauucugccuugguucugg

SEQ ID NO: 1822068 - RNA, 21 nt, Homo sapiens
uuuugcuauuccaaucuacaa

SEQ ID NO: 1822069 - RNA, 17 nt, Homo sapiens
augccacugcuuuccag

SEQ ID NO: 1822070 - RNA, 16 nt, Homo sapiens
uaguaucacauagaag

SEQ ID NO: 1822071 - RNA, 22 nt, Homo sapiens
cuuguagcucucugaccuccuc

SEQ ID NO: 1822072 - RNA, 16 nt, Homo sapiens
gaagugagaaaccagc

SEQ ID NO: 1822073 - RNA, 18 nt, Homo sapiens
aaaaccagagaagaucca

SEQ ID NO: 1822074 - RNA, 14 nt, Homo sapiens
uacauuugcaauua

SEQ ID NO: 1822075 - RNA, 14 nt, Homo sapiens
augggggcccaaag

SEQ ID NO: 1822076 - RNA, 15 nt, Homo sapiens
auaaaaacuacugaa

SEQ ID NO: 1822077 - RNA, 20 nt, Homo sapiens
uaccacucuuuaccuuuauu

SEQ ID NO: 1822078 - RNA, 21 nt, Homo sapiens
augacgucaucaucacauuca

SEQ ID NO: 1822079 - RNA, 12 nt, Homo sapiens
auagcaucuccu

SEQ ID NO: 1822080 - RNA, 13 nt, Homo sapiens
ugcagagcuuuca

SEQ ID NO: 1822081 - RNA, 13 nt, Homo sapiens
agcagagcauuca

SEQ ID NO: 1822082 - RNA, 20 nt, Homo sapiens
agaaaggggcuagcacugga

SEQ ID NO: 1822083 - RNA, 19 nt, Homo sapiens
aaauguuauagcugcauuu

SEQ ID NO: 1822084 - RNA, 16 nt, Homo sapiens
aagugccuuauucuca

SEQ ID NO: 1822085 - RNA, 17 nt, Homo sapiens
ugcaccuuugaaaugca

SEQ ID NO: 1822086 - RNA, 16 nt, Homo sapiens
guaaaacuauauucuc

SEQ ID NO: 1822087 - RNA, 16 nt, Homo sapiens
aguuuauugauauuca

SEQ ID NO: 1822088 - RNA, 15 nt, Homo sapiens
agaacaaauacacuu

SEQ ID NO: 1822089 - RNA, 21 nt, Homo sapiens
aacaucaucaaggcacugccu

SEQ ID NO: 1822090 - RNA, 21 nt, Homo sapiens
ucugugccgcaccauugaacu

SEQ ID NO: 1822091 - RNA, 20 nt, Homo sapiens
aucaugggccacaaggcaca

SEQ ID NO: 1822092 - RNA, 16 nt, Homo sapiens
uaaauaguuuacuuca

SEQ ID NO: 1822093 - RNA, 15 nt, Homo sapiens
aaagucauugcugac

SEQ ID NO: 1822094 - RNA, 21 nt, Homo sapiens
accgagguguugccagugcua

SEQ ID NO: 1822095 - RNA, 17 nt, Homo sapiens
uauaguaugaaugcagu

SEQ ID NO: 1822096 - RNA, 13 nt, Homo sapiens
gacauagcacuug

SEQ ID NO: 1822097 - RNA, 18 nt, Homo sapiens
ugaucagcaucugugaug

SEQ ID NO: 1822098 - RNA, 13 nt, Homo sapiens
cucuauauuacaa

SEQ ID NO: 1822099 - RNA, 13 nt, Homo sapiens
uaugaucucaggu

SEQ ID NO: 1822100 - RNA, 23 nt, Homo sapiens
auauuucauacugaagacacaga

SEQ ID NO: 1822101 - RNA, 15 nt, Homo sapiens
augaguccauguccu

SEQ ID NO: 1822102 - RNA, 17 nt, Homo sapiens
ggcacuugaugugaugu

SEQ ID NO: 1822103 - RNA, 16 nt, Homo sapiens
gcaaauuaguugguuu

SEQ ID NO: 1822104 - RNA, 20 nt, Homo sapiens
agagguggaacuuaauuacc

SEQ ID NO: 1822105 - RNA, 18 nt, Homo sapiens
uuaugugagccccuucag

SEQ ID NO: 1822106 - RNA, 13 nt, Homo sapiens
uaaaaaagcauac

SEQ ID NO: 1822107 - RNA, 13 nt, Homo sapiens
uauuaaagcaauc

SEQ ID NO: 1822108 - RNA, 14 nt, Homo sapiens
aacaagaacuuuaa

SEQ ID NO: 1822109 - RNA, 14 nt, Homo sapiens
auuaagaacacuaa

SEQ ID NO: 1822110 - RNA, 20 nt, Homo sapiens
guauuuuuauuuuugcacaa

SEQ ID NO: 1822111 - RNA, 14 nt, Homo sapiens
gguggaugaucuca

SEQ ID NO: 1822112 - RNA, 12 nt, Homo sapiens
uuccucacuaug

SEQ ID NO: 1822113 - RNA, 19 nt, Homo sapiens
aguccuguuugcagggaag

SEQ ID NO: 1822114 - RNA, 17 nt, Homo sapiens
caaacuucuuucacuca

SEQ ID NO: 1822115 - RNA, 20 nt, Homo sapiens
acugugaacaaucagauuag

SEQ ID NO: 1822116 - RNA, 12 nt, Homo sapiens
ccuaugggccag

SEQ ID NO: 1822117 - RNA, 11 nt, Homo sapiens
agaaagccaca

SEQ ID NO: 1822118 - RNA, 13 nt, Homo sapiens
ucaccuaucugga

SEQ ID NO: 1822119 - RNA, 17 nt, Homo sapiens
cauuaagacaacuacag

SEQ ID NO: 1822120 - RNA, 18 nt, Homo sapiens
guucauuugugugcucau

SEQ ID NO: 1822121 - RNA, 14 nt, Homo sapiens
uugcauguauccau

SEQ ID NO: 1822122 - RNA, 13 nt, Homo sapiens
aucaaugcaagag

SEQ ID NO: 1822123 - RNA, 20 nt, Homo sapiens
cuggcuagguuaaaggccag

SEQ ID NO: 1822124 - RNA, 17 nt, Homo sapiens
uccauucacaccagcua

SEQ ID NO: 1822125 - RNA, 18 nt, Homo sapiens
gucuacccagacucagag

SEQ ID NO: 1822126 - RNA, 15 nt, Homo sapiens
gcuugagcccaggag

SEQ ID NO: 1822127 - RNA, 17 nt, Homo sapiens
agaaccuucccgucuga

SEQ ID NO: 1822128 - RNA, 18 nt, Homo sapiens
uggcaaggacacagauga

SEQ ID NO: 1822129 - RNA, 12 nt, Homo sapiens
aaacccuucuug

SEQ ID NO: 1822130 - RNA, 21 nt, Homo sapiens
aagauugcgccauugcacucc

SEQ ID NO: 1822131 - RNA, 17 nt, Homo sapiens
gguaagaugacucugag

SEQ ID NO: 1822132 - RNA, 19 nt, Homo sapiens
uguggacgugcacugacag

SEQ ID NO: 1822133 - RNA, 12 nt, Homo sapiens
cuggaugcgugc

SEQ ID NO: 1822134 - RNA, 14 nt, Homo sapiens
ucaaugaacuucca

SEQ ID NO: 1822135 - RNA, 20 nt, Homo sapiens
gucacuacacacuaaaacuu

SEQ ID NO: 1822136 - RNA, 18 nt, Homo sapiens
caaauaaaugagcccaca

SEQ ID NO: 1822137 - RNA, 22 nt, Homo sapiens
uuuguauccaacugcauccagg

SEQ ID NO: 1822138 - RNA, 23 nt, Homo sapiens
auuuuuuuucuuccaacauguga

SEQ ID NO: 1822139 - RNA, 17 nt, Homo sapiens
auauucuuuccucaaaa

SEQ ID NO: 1822140 - RNA, 20 nt, Homo sapiens
gggacggcugugggaccagg

SEQ ID NO: 1822141 - RNA, 23 nt, Homo sapiens
gcagcugggccuccugggugcca

SEQ ID NO: 1822142 - RNA, 22 nt, Homo sapiens
cucugcacagggaugaccugga

SEQ ID NO: 1822143 - RNA, 23 nt, Homo sapiens
uuuuucacccauuuacacauauc

SEQ ID NO: 1822144 - RNA, 18 nt, Homo sapiens
uuaagaaauuuugccuuu

SEQ ID NO: 1822145 - RNA, 21 nt, Homo sapiens
gcgacuuaaaaugauugaaaa

SEQ ID NO: 1822146 - RNA, 19 nt, Homo sapiens
cuuugcuaaugcuaugcaa

SEQ ID NO: 1822147 - RNA, 11 nt, Homo sapiens
agguccauuua

SEQ ID NO: 1822148 - RNA, 17 nt, Homo sapiens
cugaacuccugccauag

SEQ ID NO: 1822149 - RNA, 18 nt, Homo sapiens
aacagcaggguaccugaa

SEQ ID NO: 1822150 - RNA, 16 nt, Homo sapiens
uuacucuuaugaucaa

SEQ ID NO: 1822151 - RNA, 16 nt, Homo sapiens
aaaauuaauagcuuuu

SEQ ID NO: 1822152 - RNA, 21 nt, Homo sapiens
gagcaggccauuggcuacuga

SEQ ID NO: 1822153 - RNA, 16 nt, Homo sapiens
cuugggccuugcugcu

SEQ ID NO: 1822154 - RNA, 16 nt, Homo sapiens
aauuccucauccucag

SEQ ID NO: 1822155 - RNA, 15 nt, Homo sapiens
aggacagaaaggaga

SEQ ID NO: 1822156 - RNA, 20 nt, Homo sapiens
uucccaacuagacauuacca

SEQ ID NO: 1822157 - RNA, 16 nt, Homo sapiens
aagggaucuuccuugg

SEQ ID NO: 1822158 - RNA, 18 nt, Homo sapiens
auauaucagugcuccagu

SEQ ID NO: 1822159 - RNA, 21 nt, Homo sapiens
uaucuuuuuuuuauuccacau

SEQ ID NO: 1822160 - RNA, 18 nt, Homo sapiens
aaguuauacuguggcuau

SEQ ID NO: 1822161 - RNA, 12 nt, Homo sapiens
auaaccacuuaa

SEQ ID NO: 1822162 - RNA, 14 nt, Homo sapiens
uuauauucuaauag

SEQ ID NO: 1822163 - RNA, 22 nt, Homo sapiens
guuuugccaguucaagaauuua

SEQ ID NO: 1822164 - RNA, 14 nt, Homo sapiens
gguuacuauuucuu

SEQ ID NO: 1822165 - RNA, 19 nt, Homo sapiens
auaaaacuucacauuuaug

SEQ ID NO: 1822166 - RNA, 21 nt, Homo sapiens
auauuucacacuggagugaau

SEQ ID NO: 1822167 - RNA, 21 nt, Homo sapiens
acgggaguggccaucuggaaa

SEQ ID NO: 1822168 - RNA, 11 nt, Homo sapiens
aguguggcucc

SEQ ID NO: 1822169 - RNA, 21 nt, Homo sapiens
gauuucaucugcucuccuucc

SEQ ID NO: 1822170 - RNA, 19 nt, Homo sapiens
gucuggccucaggugggcc

SEQ ID NO: 1822171 - RNA, 23 nt, Homo sapiens
cuuccuuuuauuccucacucggg

SEQ ID NO: 1822172 - RNA, 14 nt, Homo sapiens
uugacaucaaugau

SEQ ID NO: 1822173 - RNA, 19 nt, Homo sapiens
ccucaacccugugaucuau

SEQ ID NO: 1822174 - RNA, 16 nt, Homo sapiens
auugcuuacacggaug

SEQ ID NO: 1822175 - RNA, 19 nt, Homo sapiens
cugucuuaaauaauggugc

SEQ ID NO: 1822176 - RNA, 14 nt, Homo sapiens
aaaacgucuugcuu

SEQ ID NO: 1822177 - RNA, 21 nt, Homo sapiens
aauccgaaaacuuccauugua

SEQ ID NO: 1822178 - RNA, 13 nt, Homo sapiens
uguucacacuccu

SEQ ID NO: 1822179 - RNA, 13 nt, Homo sapiens
ccaauguauuuau

SEQ ID NO: 1822180 - RNA, 12 nt, Homo sapiens
aaaauaucacuu

SEQ ID NO: 1822181 - RNA, 13 nt, Homo sapiens
caucauguauaua

SEQ ID NO: 1822182 - RNA, 22 nt, Homo sapiens
ucuuguuucaauuccaccugca

SEQ ID NO: 1822183 - RNA, 13 nt, Homo sapiens
gcccaagcucacc

SEQ ID NO: 1822184 - RNA, 23 nt, Homo sapiens
ggcuagucuucccuuaccucaaa

SEQ ID NO: 1822185 - RNA, 23 nt, Homo sapiens
ccuuccggugcgugugaagccac

SEQ ID NO: 1822186 - RNA, 18 nt, Homo sapiens
ugugccccaucagcagcu

SEQ ID NO: 1822187 - RNA, 20 nt, Homo sapiens
ccacugggcacacgcacaaa

SEQ ID NO: 1822188 - RNA, 18 nt, Homo sapiens
gcacaugccuacugcugc

SEQ ID NO: 1822189 - RNA, 21 nt, Homo sapiens
aaaauacggcuuuuccaauga

SEQ ID NO: 1822190 - RNA, 18 nt, Homo sapiens
cugaguuaugauguaauc

SEQ ID NO: 1822191 - RNA, 21 nt, Homo sapiens
uuuuuaaagucuaaacuguua

SEQ ID NO: 1822192 - RNA, 13 nt, Homo sapiens
aguccuguugaag

SEQ ID NO: 1822193 - RNA, 17 nt, Homo sapiens
gcuugggacauggcaca

SEQ ID NO: 1822194 - RNA, 21 nt, Homo sapiens
guuggaacugcauucuuuuaa

SEQ ID NO: 1822195 - RNA, 20 nt, Homo sapiens
agagcugcagagagcaccug

SEQ ID NO: 1822196 - RNA, 13 nt, Homo sapiens
gcggccugcugga

SEQ ID NO: 1822197 - RNA, 17 nt, Homo sapiens
gccaggcccccaccaca

SEQ ID NO: 1822198 - RNA, 19 nt, Homo sapiens
uuuaaucucuaacagugga

SEQ ID NO: 1822199 - RNA, 22 nt, Homo sapiens
gccuaaaaaguaucauuacaua

SEQ ID NO: 1822200 - RNA, 12 nt, Homo sapiens
cagccucccacc

SEQ ID NO: 1822201 - RNA, 15 nt, Homo sapiens
ucugaauaagcacuu

SEQ ID NO: 1822202 - RNA, 16 nt, Homo sapiens
acccaaaacucaagca

SEQ ID NO: 1822203 - RNA, 21 nt, Homo sapiens
caagauugcgccauugcacuc

SEQ ID NO: 1822204 - RNA, 15 nt, Homo sapiens
gacuuugucacuuau

SEQ ID NO: 1822205 - RNA, 19 nt, Homo sapiens
cuggaugguccucuuacca

SEQ ID NO: 1822206 - RNA, 14 nt, Homo sapiens
acccaacaaugagu

SEQ ID NO: 1822207 - RNA, 18 nt, Homo sapiens
uuauaauaugugccuuaa

SEQ ID NO: 1822208 - RNA, 16 nt, Homo sapiens
cauguggaagcacuuu

SEQ ID NO: 1822209 - RNA, 20 nt, Homo sapiens
cuuugacguggagcugcuca

SEQ ID NO: 1822210 - RNA, 16 nt, Homo sapiens
ucuaaaguuacuacug

SEQ ID NO: 1822211 - RNA, 14 nt, Homo sapiens
aauuucauguguau

SEQ ID NO: 1822212 - RNA, 14 nt, Homo sapiens
aacaaauauugcca

SEQ ID NO: 1822213 - RNA, 16 nt, Homo sapiens
agugucacuuggugca

SEQ ID NO: 1822214 - RNA, 18 nt, Homo sapiens
acaauggcgugaucucag

SEQ ID NO: 1822215 - RNA, 23 nt, Homo sapiens
caggaacacagacccaaaccaua

SEQ ID NO: 1822216 - RNA, 23 nt, Homo sapiens
auggccuguggaucaaauccagc

SEQ ID NO: 1822217 - RNA, 15 nt, Homo sapiens
ucacuaugguaugcu

SEQ ID NO: 1822218 - RNA, 21 nt, Homo sapiens
augagucuuuauuuuuuguua

SEQ ID NO: 1822219 - RNA, 16 nt, Homo sapiens
uaauauguacuuugag

SEQ ID NO: 1822220 - RNA, 18 nt, Homo sapiens
uucaaggaaaaaugcugc

SEQ ID NO: 1822221 - RNA, 16 nt, Homo sapiens
aggguaggacccucau

SEQ ID NO: 1822222 - RNA, 13 nt, Homo sapiens
caaacccaaagau

SEQ ID NO: 1822223 - RNA, 13 nt, Homo sapiens
uaacugauagaac

SEQ ID NO: 1822224 - RNA, 15 nt, Homo sapiens
agaggaaaaggcugg

SEQ ID NO: 1822225 - RNA, 22 nt, Homo sapiens
agguuuuuggcugaguacugga

SEQ ID NO: 1822226 - RNA, 14 nt, Homo sapiens
caaggcacugagac

SEQ ID NO: 1822227 - RNA, 14 nt, Homo sapiens
cagggaacugggaa

SEQ ID NO: 1822228 - RNA, 13 nt, Homo sapiens
uggcaauuggcau

SEQ ID NO: 1822229 - RNA, 23 nt, Homo sapiens
ccucacaaaccugaauggucuga

SEQ ID NO: 1822230 - RNA, 19 nt, Homo sapiens
uuuuaacaacugugcuuuu

SEQ ID NO: 1822231 - RNA, 16 nt, Homo sapiens
gaauuaucucaaguaa

SEQ ID NO: 1822232 - RNA, 19 nt, Homo sapiens
auguuuauguucuuauaga

SEQ ID NO: 1822233 - RNA, 22 nt, Homo sapiens
cagccuuucuaaaaguugcaug

SEQ ID NO: 1822234 - RNA, 15 nt, Homo sapiens
ugagaagaacacauc

SEQ ID NO: 1822235 - RNA, 20 nt, Homo sapiens
uacccccugaaagugacaga

SEQ ID NO: 1822236 - RNA, 19 nt, Homo sapiens
agaggcauccugccugggu

SEQ ID NO: 1822237 - RNA, 20 nt, Homo sapiens
aaauagagaucuuaugucaa

SEQ ID NO: 1822238 - RNA, 13 nt, Homo sapiens
gggggacguuucu

SEQ ID NO: 1822239 - RNA, 14 nt, Homo sapiens
aauggacuuuggaa

SEQ ID NO: 1822240 - RNA, 21 nt, Homo sapiens
ccagacuggaaugcagugaca

SEQ ID NO: 1822241 - RNA, 22 nt, Homo sapiens
cuaagcaccugccucagcaauu

SEQ ID NO: 1822242 - RNA, 20 nt, Homo sapiens
cugaccacccugccugugga

SEQ ID NO: 1822243 - RNA, 14 nt, Homo sapiens
uccccucagauucc

SEQ ID NO: 1822244 - RNA, 14 nt, Homo sapiens
guugucaccaagcu

SEQ ID NO: 1822245 - RNA, 17 nt, Homo sapiens
ucuaggcuaagcacuuu

SEQ ID NO: 1822246 - RNA, 16 nt, Homo sapiens
auugcugcaaaccaca

SEQ ID NO: 1822247 - RNA, 16 nt, Homo sapiens
aacuuaggcaugcaca

SEQ ID NO: 1822248 - RNA, 20 nt, Homo sapiens
cauuguuaaauacacauuau

SEQ ID NO: 1822249 - RNA, 13 nt, Homo sapiens
acuguucucuuac

SEQ ID NO: 1822250 - RNA, 15 nt, Homo sapiens
cacagaaacuauaug

SEQ ID NO: 1822251 - RNA, 18 nt, Homo sapiens
ccucugccucccaaagug

SEQ ID NO: 1822252 - RNA, 17 nt, Homo sapiens
ucugccacuugcacugu

SEQ ID NO: 1822253 - RNA, 17 nt, Homo sapiens
cuugcuuccuucucauc

SEQ ID NO: 1822254 - RNA, 15 nt, Homo sapiens
cacauaugucuuacu

SEQ ID NO: 1822255 - RNA, 20 nt, Homo sapiens
guuguaaaaagaaaaaccac

SEQ ID NO: 1822256 - RNA, 12 nt, Homo sapiens
cuacugcuaaau

SEQ ID NO: 1822257 - RNA, 18 nt, Homo sapiens
aaauucuguggcaguuuu

SEQ ID NO: 1822258 - RNA, 20 nt, Homo sapiens
ccuccagcacaaacacaagg

SEQ ID NO: 1822259 - RNA, 17 nt, Homo sapiens
ucuaagaguauacuuga

SEQ ID NO: 1822260 - RNA, 21 nt, Homo sapiens
uacuuucuuauaaauuuggau

SEQ ID NO: 1822261 - RNA, 14 nt, Homo sapiens
uaauguacuuucac

SEQ ID NO: 1822262 - RNA, 17 nt, Homo sapiens
uaucacucacugccaaa

SEQ ID NO: 1822263 - RNA, 17 nt, Homo sapiens
ccauuaaaaacuaccac

SEQ ID NO: 1822264 - RNA, 23 nt, Homo sapiens
uuaucaacugucaaauauguucu

SEQ ID NO: 1822265 - RNA, 15 nt, Homo sapiens
gcuguggacuguccu

SEQ ID NO: 1822266 - RNA, 14 nt, Homo sapiens
accuccaagccacu

SEQ ID NO: 1822267 - RNA, 14 nt, Homo sapiens
ugcauacccgggca

SEQ ID NO: 1822268 - RNA, 15 nt, Homo sapiens
augcaaggucuugca

SEQ ID NO: 1822269 - RNA, 15 nt, Homo sapiens
cuuuagcuaagcaca

SEQ ID NO: 1822270 - RNA, 21 nt, Homo sapiens
acagguuuucuucuaaucaua

SEQ ID NO: 1822271 - RNA, 19 nt, Homo sapiens
agacaggucuagacuuucu

SEQ ID NO: 1822272 - RNA, 14 nt, Homo sapiens
gaugucuaagacag

SEQ ID NO: 1822273 - RNA, 18 nt, Homo sapiens
cccuguauucucagcacu

SEQ ID NO: 1822274 - RNA, 21 nt, Homo sapiens
gugcuaagaaagcaagccaau

SEQ ID NO: 1822275 - RNA, 16 nt, Homo sapiens
guccaggaacaagcua

SEQ ID NO: 1822276 - RNA, 18 nt, Homo sapiens
gcuagcaaaaaaacucuu

SEQ ID NO: 1822277 - RNA, 21 nt, Homo sapiens
aauguggcuugaauguaggua

SEQ ID NO: 1822278 - RNA, 20 nt, Homo sapiens
caucgaaauguauucaccuu

SEQ ID NO: 1822279 - RNA, 15 nt, Homo sapiens
uuccugauacugggu

SEQ ID NO: 1822280 - RNA, 19 nt, Homo sapiens
aaugcucagaccagcucuu

SEQ ID NO: 1822281 - RNA, 22 nt, Homo sapiens
auugcugccccaucagugcucc

SEQ ID NO: 1822282 - RNA, 14 nt, Homo sapiens
aacagaugucuucu

SEQ ID NO: 1822283 - RNA, 22 nt, Homo sapiens
agucucucucuuccucacaguc

SEQ ID NO: 1822284 - RNA, 18 nt, Homo sapiens
cugaaaugacauuucacu

SEQ ID NO: 1822285 - RNA, 18 nt, Homo sapiens
uugcaaucuuauguugau

SEQ ID NO: 1822286 - RNA, 22 nt, Homo sapiens
uaagaacaauagguaaagcuau

SEQ ID NO: 1822287 - RNA, 21 nt, Homo sapiens
ccauucuacauacuauggaau

SEQ ID NO: 1822288 - RNA, 15 nt, Homo sapiens
cauauaaauucugau

SEQ ID NO: 1822289 - RNA, 15 nt, Homo sapiens
ccacauccuguguca

SEQ ID NO: 1822290 - RNA, 18 nt, Homo sapiens
aagcagggacugugaaca

SEQ ID NO: 1822291 - RNA, 17 nt, Homo sapiens
ccaucccggaguucucc

SEQ ID NO: 1822292 - RNA, 17 nt, Homo sapiens
gugaguugcacagcuau

SEQ ID NO: 1822293 - RNA, 22 nt, Homo sapiens
ucucucagagaucuugcauuuc

SEQ ID NO: 1822294 - RNA, 15 nt, Homo sapiens
gcagcuaaaaaugca

SEQ ID NO: 1822295 - RNA, 19 nt, Homo sapiens
gccuuugaccccagcagcu

SEQ ID NO: 1822296 - RNA, 18 nt, Homo sapiens
ucuucauggugauaugca

SEQ ID NO: 1822297 - RNA, 21 nt, Homo sapiens
ugauucaaccugauacauuua

SEQ ID NO: 1822298 - RNA, 22 nt, Homo sapiens
cugcuccaaucugucacauaaa

SEQ ID NO: 1822299 - RNA, 10 nt, Homo sapiens
ucccaagaag

SEQ ID NO: 1822300 - RNA, 18 nt, Homo sapiens
auaacuuguccuauguca

SEQ ID NO: 1822301 - RNA, 13 nt, Homo sapiens
cucacugccuagg

SEQ ID NO: 1822302 - RNA, 19 nt, Homo sapiens
acugcagcgcgcuccugac

SEQ ID NO: 1822303 - RNA, 19 nt, Homo sapiens
accuggucugguugggcag

SEQ ID NO: 1822304 - RNA, 12 nt, Homo sapiens
ucagucugucca

SEQ ID NO: 1822305 - RNA, 22 nt, Homo sapiens
aauucuuaaccuggaacuggag

SEQ ID NO: 1822306 - RNA, 20 nt, Homo sapiens
uagccagcacacagggcagu

SEQ ID NO: 1822307 - RNA, 15 nt, Homo sapiens
aggaaaaugaugaua

SEQ ID NO: 1822308 - RNA, 21 nt, Homo sapiens
cugcuaauguugaucagcaaa

SEQ ID NO: 1822309 - RNA, 20 nt, Homo sapiens
accgccauugggcuacugua

SEQ ID NO: 1822310 - RNA, 19 nt, Homo sapiens
uuggaauaaagucaaccuu

SEQ ID NO: 1822311 - RNA, 13 nt, Homo sapiens
agucaccaaaauu

SEQ ID NO: 1822312 - RNA, 13 nt, Homo sapiens
uaucuccaugaua

SEQ ID NO: 1822313 - RNA, 16 nt, Homo sapiens
ccuuauucuucauuuc

SEQ ID NO: 1822314 - RNA, 15 nt, Homo sapiens
aucacugugucucau

SEQ ID NO: 1822315 - RNA, 23 nt, Homo sapiens
uucucuaguucaaguucaccaga

SEQ ID NO: 1822316 - RNA, 15 nt, Homo sapiens
ugauuuagguagccu

SEQ ID NO: 1822317 - RNA, 16 nt, Homo sapiens
cagagacgcaagggag

SEQ ID NO: 1822318 - RNA, 16 nt, Homo sapiens
cuugauccacuucucu

SEQ ID NO: 1822319 - RNA, 18 nt, Homo sapiens
guuugguucauggugaag

SEQ ID NO: 1822320 - RNA, 15 nt, Homo sapiens
aaugucuccugccac

SEQ ID NO: 1822321 - RNA, 14 nt, Homo sapiens
agucuucuccucca

SEQ ID NO: 1822322 - RNA, 20 nt, Homo sapiens
aggaaaacugaggcccuugg

SEQ ID NO: 1822323 - RNA, 22 nt, Homo sapiens
uccuccuuuaccuuucagugca

SEQ ID NO: 1822324 - RNA, 15 nt, Homo sapiens
cuguuauauaucucu

SEQ ID NO: 1822325 - RNA, 11 nt, Homo sapiens
gacuggcucaa

SEQ ID NO: 1822326 - RNA, 16 nt, Homo sapiens
aaacuugcaucacuua

SEQ ID NO: 1822327 - RNA, 13 nt, Homo sapiens
uccuugacucuua

SEQ ID NO: 1822328 - RNA, 19 nt, Homo sapiens
aaggauuuuaugcuuuaaa

SEQ ID NO: 1822329 - RNA, 17 nt, Homo sapiens
aaguuauuaacuuuaau

SEQ ID NO: 1822330 - RNA, 18 nt, Homo sapiens
caaaucucuugcuuucuu

SEQ ID NO: 1822331 - RNA, 23 nt, Homo sapiens
auugaauuacggaaaaugccugu

SEQ ID NO: 1822332 - RNA, 17 nt, Homo sapiens
uaauaaacucacaacuc

SEQ ID NO: 1822333 - RNA, 18 nt, Homo sapiens
caugagaccacuguuauc

SEQ ID NO: 1822334 - RNA, 16 nt, Homo sapiens
guuuuuuguaacuaau

SEQ ID NO: 1822335 - RNA, 14 nt, Homo sapiens
cacugcggagucca

SEQ ID NO: 1822336 - RNA, 16 nt, Homo sapiens
cugaggucucuugagg

SEQ ID NO: 1822337 - RNA, 17 nt, Homo sapiens
augaaauaucaugcucc

SEQ ID NO: 1822338 - RNA, 22 nt, Homo sapiens
ucagcuggcacugucucugcug

SEQ ID NO: 1822339 - RNA, 17 nt, Homo sapiens
agcgguuuaaccacauu

SEQ ID NO: 1822340 - RNA, 14 nt, Homo sapiens
ccucugcugaucuc

SEQ ID NO: 1822341 - RNA, 12 nt, Homo sapiens
aucagccaguga

SEQ ID NO: 1822342 - RNA, 17 nt, Homo sapiens
cagaauuggaaucacau

SEQ ID NO: 1822343 - RNA, 19 nt, Homo sapiens
ugccaaggaugacacugcc

SEQ ID NO: 1822344 - RNA, 20 nt, Homo sapiens
auuucaguacuucagcaaga

SEQ ID NO: 1822345 - RNA, 12 nt, Homo sapiens
agcccagggugg

SEQ ID NO: 1822346 - RNA, 14 nt, Homo sapiens
uauacuucaaguaa

SEQ ID NO: 1822347 - RNA, 20 nt, Homo sapiens
cagccuccgaaguagcuggg

SEQ ID NO: 1822348 - RNA, 22 nt, Homo sapiens
acccccucccccccagcacaac

SEQ ID NO: 1822349 - RNA, 20 nt, Homo sapiens
ucaguccugcuccagaauuu

SEQ ID NO: 1822350 - RNA, 22 nt, Homo sapiens
aacuugauuguugagacgccuu

SEQ ID NO: 1822351 - RNA, 22 nt, Homo sapiens
cuacuccuuuuccucuacccua

SEQ ID NO: 1822352 - RNA, 22 nt, Homo sapiens
accacuccccaaccccucucca

SEQ ID NO: 1822353 - RNA, 17 nt, Homo sapiens
cgagacugagaggcaga

SEQ ID NO: 1822354 - RNA, 17 nt, Homo sapiens
cucugcucaucuacaca

SEQ ID NO: 1822355 - RNA, 23 nt, Homo sapiens
cacagcccucaugaucauucuca

SEQ ID NO: 1822356 - RNA, 16 nt, Homo sapiens
uugcugacacugugac

SEQ ID NO: 1822357 - RNA, 22 nt, Homo sapiens
aauaugaaaaucuccaucucaa

SEQ ID NO: 1822358 - RNA, 12 nt, Homo sapiens
aaacugagucac

SEQ ID NO: 1822359 - RNA, 15 nt, Homo sapiens
agacucugucucagu

SEQ ID NO: 1822360 - RNA, 17 nt, Homo sapiens
uaaaacagcagaagauu

SEQ ID NO: 1822361 - RNA, 20 nt, Homo sapiens
gaagauaggauggaacguga

SEQ ID NO: 1822362 - RNA, 22 nt, Homo sapiens
ucuccaagcuuucagacaagaa

SEQ ID NO: 1822363 - RNA, 12 nt, Homo sapiens
uuaauaacaggu

SEQ ID NO: 1822364 - RNA, 14 nt, Homo sapiens
uggaaucaucacuu

SEQ ID NO: 1822365 - RNA, 17 nt, Homo sapiens
guucagaggcagcacca

SEQ ID NO: 1822366 - RNA, 18 nt, Homo sapiens
gcugcagggccacuggaa

SEQ ID NO: 1822367 - RNA, 14 nt, Homo sapiens
auugaacuguuuau

SEQ ID NO: 1822368 - RNA, 23 nt, Homo sapiens
ucgcucagaagagggaacuaagc

SEQ ID NO: 1822369 - RNA, 22 nt, Homo sapiens
aggugggggcuauuucuaugca

SEQ ID NO: 1822370 - RNA, 13 nt, Homo sapiens
ccaaaauuugaug

SEQ ID NO: 1822371 - RNA, 22 nt, Homo sapiens
aaccaagggggaugacauguga

SEQ ID NO: 1822372 - RNA, 22 nt, Homo sapiens
acccuaugugggugggaccaca

SEQ ID NO: 1822373 - RNA, 15 nt, Homo sapiens
acucggccacugugu

SEQ ID NO: 1822374 - RNA, 20 nt, Homo sapiens
gccuguaaucccagaacuuu

SEQ ID NO: 1822375 - RNA, 14 nt, Homo sapiens
gucacuuuccucuu

SEQ ID NO: 1822376 - RNA, 14 nt, Homo sapiens
uccaggagccucau

SEQ ID NO: 1822377 - RNA, 16 nt, Homo sapiens
cugacagcauaccuca

SEQ ID NO: 1822378 - RNA, 13 nt, Homo sapiens
cagacuccaaaag

SEQ ID NO: 1822379 - RNA, 12 nt, Homo sapiens
acugaugguuca

SEQ ID NO: 1822380 - RNA, 16 nt, Homo sapiens
cagauguaacagaaca

SEQ ID NO: 1822381 - RNA, 20 nt, Homo sapiens
ccucucuuuguucucagcuc

SEQ ID NO: 1822382 - RNA, 22 nt, Homo sapiens
uaaucuuagagacaaaccuuaa

SEQ ID NO: 1822383 - RNA, 15 nt, Homo sapiens
aacucaaaaccaucu

SEQ ID NO: 1822384 - RNA, 22 nt, Homo sapiens
uagagacgggguuucaccaugu

SEQ ID NO: 1822385 - RNA, 23 nt, Homo sapiens
cagaggcucuugaugguggacua

SEQ ID NO: 1822386 - RNA, 16 nt, Homo sapiens
aguauaaagcuaugua

SEQ ID NO: 1822387 - RNA, 12 nt, Homo sapiens
acaaacauggau

SEQ ID NO: 1822388 - RNA, 23 nt, Homo sapiens
ugagaagaaaaucagagagggaa

SEQ ID NO: 1822389 - RNA, 22 nt, Homo sapiens
uucgccagcugaaguugcugag

SEQ ID NO: 1822390 - RNA, 15 nt, Homo sapiens
auggugacagucucc

SEQ ID NO: 1822391 - RNA, 20 nt, Homo sapiens
uuauaaauucagaacaagca

SEQ ID NO: 1822392 - RNA, 20 nt, Homo sapiens
ggaccuucagagcaucccag

SEQ ID NO: 1822393 - RNA, 16 nt, Homo sapiens
cuaggcaucugcugua

SEQ ID NO: 1822394 - RNA, 14 nt, Homo sapiens
uugacaacccaaac

SEQ ID NO: 1822395 - RNA, 12 nt, Homo sapiens
agaaggugcuga

SEQ ID NO: 1822396 - RNA, 14 nt, Homo sapiens
ugaauuuuguugcu

SEQ ID NO: 1822397 - RNA, 17 nt, Homo sapiens
ugggucaaaccaagaag

SEQ ID NO: 1822398 - RNA, 17 nt, Homo sapiens
uacuugaucauucucag

SEQ ID NO: 1822399 - RNA, 23 nt, Homo sapiens
agagggucugggggcacaagacu

SEQ ID NO: 1822400 - RNA, 13 nt, Homo sapiens
ucuuuauacuuaa

SEQ ID NO: 1822401 - RNA, 23 nt, Homo sapiens
augaggucuguuuaaaguggcaa

SEQ ID NO: 1822402 - RNA, 15 nt, Homo sapiens
aggaauuuucuugaa

SEQ ID NO: 1822403 - RNA, 20 nt, Homo sapiens
aagaacugacuagugagaug

SEQ ID NO: 1822404 - RNA, 21 nt, Homo sapiens
cugggccugcuagucugucag

SEQ ID NO: 1822405 - RNA, 15 nt, Homo sapiens
cagccacaaaguagu

SEQ ID NO: 1822406 - RNA, 14 nt, Homo sapiens
agggugcaggagag

SEQ ID NO: 1822407 - RNA, 16 nt, Homo sapiens
aguuuacuuugccaac

SEQ ID NO: 1822408 - RNA, 15 nt, Homo sapiens
ucacaccacuuguga

SEQ ID NO: 1822409 - RNA, 21 nt, Homo sapiens
cagaucgcuuuacuccaggaa

SEQ ID NO: 1822410 - RNA, 16 nt, Homo sapiens
gaaggugggaggaugu

SEQ ID NO: 1822411 - RNA, 23 nt, Homo sapiens
uccugagaaggccagaauacugg

SEQ ID NO: 1822412 - RNA, 13 nt, Homo sapiens
acaguccacaggg

SEQ ID NO: 1822413 - RNA, 20 nt, Homo sapiens
augcaugcacaggaagauau

SEQ ID NO: 1822414 - RNA, 22 nt, Homo sapiens
cuaaggcuguccacguacuuaa

SEQ ID NO: 1822415 - RNA, 15 nt, Homo sapiens
auuucccagaaggga

SEQ ID NO: 1822416 - RNA, 16 nt, Homo sapiens
cuagcagacacugccu

SEQ ID NO: 1822417 - RNA, 23 nt, Homo sapiens
auccuaggcugacaccuaacucu

SEQ ID NO: 1822418 - RNA, 12 nt, Homo sapiens
gugggcugugag

SEQ ID NO: 1822419 - RNA, 17 nt, Homo sapiens
uacuucugacauuccau

SEQ ID NO: 1822420 - RNA, 15 nt, Homo sapiens
ggcaaaagacuugaa

SEQ ID NO: 1822421 - RNA, 23 nt, Homo sapiens
cugcugagaucuucucuguuauu

SEQ ID NO: 1822422 - RNA, 22 nt, Homo sapiens
acugcccccacgccuccugcca

SEQ ID NO: 1822423 - RNA, 17 nt, Homo sapiens
cacagaucacagcuuca

SEQ ID NO: 1822424 - RNA, 14 nt, Homo sapiens
caugauuuaaucca

SEQ ID NO: 1822425 - RNA, 13 nt, Homo sapiens
aaggguucuuucc

SEQ ID NO: 1822426 - RNA, 22 nt, Homo sapiens
augcucuuauuucaucauucac

SEQ ID NO: 1822427 - RNA, 22 nt, Homo sapiens
auugcuauuacuaguacuauua

SEQ ID NO: 1822428 - RNA, 22 nt, Homo sapiens
uaagaaaaaauucuuucacuug

SEQ ID NO: 1822429 - RNA, 20 nt, Homo sapiens
cauaggcaccuuuuacugug

SEQ ID NO: 1822430 - RNA, 21 nt, Homo sapiens
agucacuggcaucucacuuua

SEQ ID NO: 1822431 - RNA, 21 nt, Homo sapiens
uuuggcacuugccauuccaaa

SEQ ID NO: 1822432 - RNA, 23 nt, Homo sapiens
cugaagcuccuacacaggucacu

SEQ ID NO: 1822433 - RNA, 23 nt, Homo sapiens
accagcuucauguggcuucccuu

SEQ ID NO: 1822434 - RNA, 16 nt, Homo sapiens
ucucaaaaacaaagag

SEQ ID NO: 1822435 - RNA, 17 nt, Homo sapiens
aaccuuuucccaaccau

SEQ ID NO: 1822436 - RNA, 16 nt, Homo sapiens
ucaaacauuauucuca

SEQ ID NO: 1822437 - RNA, 22 nt, Homo sapiens
uggauugcacguggccucuuga

SEQ ID NO: 1822438 - RNA, 13 nt, Homo sapiens
gaauagacacuuc

SEQ ID NO: 1822439 - RNA, 20 nt, Homo sapiens
uacccagagaauauauacau

SEQ ID NO: 1822440 - RNA, 22 nt, Homo sapiens
cacuuggccaccaggacuccuu

SEQ ID NO: 1822441 - RNA, 16 nt, Homo sapiens
acauucgaguguuuca

SEQ ID NO: 1822442 - RNA, 13 nt, Homo sapiens
auuucaaggcagg

SEQ ID NO: 1822443 - RNA, 11 nt, Homo sapiens
gguuucacucc

SEQ ID NO: 1822444 - RNA, 13 nt, Homo sapiens
uauccaccaagaa

SEQ ID NO: 1822445 - RNA, 21 nt, Homo sapiens
uauccaacaugugcucaggga

SEQ ID NO: 1822446 - RNA, 15 nt, Homo sapiens
augaaaugcacugua

SEQ ID NO: 1822447 - RNA, 19 nt, Homo sapiens
gaaauuaguuuaccucauc

SEQ ID NO: 1822448 - RNA, 14 nt, Homo sapiens
gucuaaauguuugu

SEQ ID NO: 1822449 - RNA, 18 nt, Homo sapiens
aaggucacuacugcauuu

SEQ ID NO: 1822450 - RNA, 21 nt, Homo sapiens
aauauuuuuaaaaguauacau

SEQ ID NO: 1822451 - RNA, 16 nt, Homo sapiens
aaccugguccuaaccc

SEQ ID NO: 1822452 - RNA, 15 nt, Homo sapiens
ccaaauuaacaucag

SEQ ID NO: 1822453 - RNA, 23 nt, Homo sapiens
agccuccaauguacaacuuccgc

SEQ ID NO: 1822454 - RNA, 15 nt, Homo sapiens
ugaagaaaauccuaa

SEQ ID NO: 1822455 - RNA, 20 nt, Homo sapiens
cuauggagagcccugggacc

SEQ ID NO: 1822456 - RNA, 23 nt, Homo sapiens
agaaaugauucaaauugcugcuu

SEQ ID NO: 1822457 - RNA, 23 nt, Homo sapiens
uaaaaguuuaggguuuucucuug

SEQ ID NO: 1822458 - RNA, 16 nt, Homo sapiens
ccccugauguggcaua

SEQ ID NO: 1822459 - RNA, 15 nt, Homo sapiens
cugagguuggauuug

SEQ ID NO: 1822460 - RNA, 20 nt, Homo sapiens
ggcugccgagugcugugcac

SEQ ID NO: 1822461 - RNA, 18 nt, Homo sapiens
caacaccuccuccugcug

SEQ ID NO: 1822462 - RNA, 20 nt, Homo sapiens
aucaugggauuuuacuagaa

SEQ ID NO: 1822463 - RNA, 17 nt, Homo sapiens
ucagaagaaaggagcug

SEQ ID NO: 1822464 - RNA, 19 nt, Homo sapiens
cguaaguacagagaagcca

SEQ ID NO: 1822465 - RNA, 17 nt, Homo sapiens
cagucuguuaugcacug

SEQ ID NO: 1822466 - RNA, 17 nt, Homo sapiens
ccugcaaaaggacucuc

SEQ ID NO: 1822467 - RNA, 21 nt, Homo sapiens
aaauguuggaacucugugcag

SEQ ID NO: 1822468 - RNA, 13 nt, Homo sapiens
gcaccccaugcca

SEQ ID NO: 1822469 - RNA, 13 nt, Homo sapiens
ggcccccaucaca

SEQ ID NO: 1822470 - RNA, 18 nt, Homo sapiens
ucucacacaugagcauca

SEQ ID NO: 1822471 - RNA, 20 nt, Homo sapiens
cacgagagagggcuuucuca

SEQ ID NO: 1822472 - RNA, 17 nt, Homo sapiens
ccacauaagaaggcaau

SEQ ID NO: 1822473 - RNA, 15 nt, Homo sapiens
gaugcuuuggcaaug

SEQ ID NO: 1822474 - RNA, 11 nt, Homo sapiens
ggaaaacuguu

SEQ ID NO: 1822475 - RNA, 13 nt, Homo sapiens
cagguugugaaau

SEQ ID NO: 1822476 - RNA, 18 nt, Homo sapiens
cuuugcagggagaccagg

SEQ ID NO: 1822477 - RNA, 18 nt, Homo sapiens
cagugaaacaaauuuaca

SEQ ID NO: 1822478 - RNA, 17 nt, Homo sapiens
uuuucguauuucaaaua

SEQ ID NO: 1822479 - RNA, 24 nt, Homo sapiens
uuaaaucagccguguaaccaugga

SEQ ID NO: 1822480 - RNA, 22 nt, Homo sapiens
uccuccauaaauuauggcauuu

SEQ ID NO: 1822481 - RNA, 15 nt, Homo sapiens
acuuugggagaccaa

SEQ ID NO: 1822482 - RNA, 22 nt, Homo sapiens
gagggauaguggggucagggcu

SEQ ID NO: 1822483 - RNA, 13 nt, Homo sapiens
gaggcacugcuga

SEQ ID NO: 1822484 - RNA, 16 nt, Homo sapiens
gaacuuuaugcuguaa

SEQ ID NO: 1822485 - RNA, 17 nt, Homo sapiens
acaauuagucaaaccac

SEQ ID NO: 1822486 - RNA, 17 nt, Homo sapiens
gaacacaggagauucca

SEQ ID NO: 1822487 - RNA, 22 nt, Homo sapiens
gcuguucucgaacuccugaccu

SEQ ID NO: 1822488 - RNA, 16 nt, Homo sapiens
cagaaugaagaauuca

SEQ ID NO: 1822489 - RNA, 23 nt, Homo sapiens
auuucaugauuagacaaugugga

SEQ ID NO: 1822490 - RNA, 15 nt, Homo sapiens
accucugccccagau

SEQ ID NO: 1822491 - RNA, 13 nt, Homo sapiens
aggaaucacccca

SEQ ID NO: 1822492 - RNA, 21 nt, Homo sapiens
auacuaaugaugagcauuuag

SEQ ID NO: 1822493 - RNA, 18 nt, Homo sapiens
uggcaacaacaaagccaa

SEQ ID NO: 1822494 - RNA, 15 nt, Homo sapiens
ucagagaccauugca

SEQ ID NO: 1822495 - RNA, 19 nt, Homo sapiens
gagacugccauacauaaua

SEQ ID NO: 1822496 - RNA, 22 nt, Homo sapiens
ugaaugagaccuggaacaaauc

SEQ ID NO: 1822497 - RNA, 22 nt, Homo sapiens
ccuuuccaaaugcccagcuuaa

SEQ ID NO: 1822498 - RNA, 18 nt, Homo sapiens
gacauucaaaacgugaug

SEQ ID NO: 1822499 - RNA, 15 nt, Homo sapiens
cuuaagaaagugucu

SEQ ID NO: 1822500 - RNA, 22 nt, Homo sapiens
uuaugaguauaauacauuacau

SEQ ID NO: 1822501 - RNA, 14 nt, Homo sapiens
aagaaaaaugccug

SEQ ID NO: 1822502 - RNA, 11 nt, Homo sapiens
gguggggaccu

SEQ ID NO: 1822503 - RNA, 14 nt, Homo sapiens
cugcugacugccaa

SEQ ID NO: 1822504 - RNA, 17 nt, Homo sapiens
uuuguacauagcaaaua

SEQ ID NO: 1822505 - RNA, 14 nt, Homo sapiens
cuaaucaccaaagg

SEQ ID NO: 1822506 - RNA, 17 nt, Homo sapiens
ccucaaaugcaguauuu

SEQ ID NO: 1822507 - RNA, 17 nt, Homo sapiens
uugaguggaaacuugau

SEQ ID NO: 1822508 - RNA, 23 nt, Homo sapiens
gauccaagaaggccuucauggcc

SEQ ID NO: 1822509 - RNA, 16 nt, Homo sapiens
gauuaacuuuuccuaa

SEQ ID NO: 1822510 - RNA, 11 nt, Homo sapiens
aaacucuucag

SEQ ID NO: 1822511 - RNA, 14 nt, Homo sapiens
gucauggaggccaa

SEQ ID NO: 1822512 - RNA, 22 nt, Homo sapiens
cuggcccccaucagcccugcua

SEQ ID NO: 1822513 - RNA, 14 nt, Homo sapiens
cuaucaaagcacau

SEQ ID NO: 1822514 - RNA, 14 nt, Homo sapiens
aacaacaaauaauu

SEQ ID NO: 1822515 - RNA, 19 nt, Homo sapiens
acagagauaugcacacacc

SEQ ID NO: 1822516 - RNA, 18 nt, Homo sapiens
ucuucacaacagauuauu

SEQ ID NO: 1822517 - RNA, 19 nt, Homo sapiens
aaucccaggaaagaggcau

SEQ ID NO: 1822518 - RNA, 12 nt, Homo sapiens
uuuucauuugag

SEQ ID NO: 1822519 - RNA, 20 nt, Homo sapiens
aaggaguuagaaccacagca

SEQ ID NO: 1822520 - RNA, 13 nt, Homo sapiens
cugcuucuuucca

SEQ ID NO: 1822521 - RNA, 22 nt, Homo sapiens
agccauauucuaaauucacugu

SEQ ID NO: 1822522 - RNA, 19 nt, Homo sapiens
acuguggcccuucugucca

SEQ ID NO: 1822523 - RNA, 18 nt, Homo sapiens
aaccuuuugagugccuua

SEQ ID NO: 1822524 - RNA, 19 nt, Homo sapiens
augacauauccuuauaaga

SEQ ID NO: 1822525 - RNA, 23 nt, Homo sapiens
guuucucuagaagcuccagugau

SEQ ID NO: 1822526 - RNA, 18 nt, Homo sapiens
gugaggacugguugucuc

SEQ ID NO: 1822527 - RNA, 21 nt, Homo sapiens
aucuguuguucuguggucaca

SEQ ID NO: 1822528 - RNA, 13 nt, Homo sapiens
uggcuaccuugug

SEQ ID NO: 1822529 - RNA, 15 nt, Homo sapiens
ccagagggagaguuu

SEQ ID NO: 1822530 - RNA, 22 nt, Homo sapiens
acccauuugggugggaguguug

SEQ ID NO: 1822531 - RNA, 20 nt, Homo sapiens
ccauccaugagaguuucaaa

SEQ ID NO: 1822532 - RNA, 20 nt, Homo sapiens
cgagauaccauggugccauc

SEQ ID NO: 1822533 - RNA, 9 nt, Homo sapiens
guugagauu

SEQ ID NO: 1822534 - RNA, 21 nt, Homo sapiens
uggaaguauuuuccuccaaag

SEQ ID NO: 1822535 - RNA, 21 nt, Homo sapiens
uuaagaacaucaaaacuaacc

SEQ ID NO: 1822536 - RNA, 20 nt, Homo sapiens
ucccaaagugcuaggauuac

SEQ ID NO: 1822537 - RNA, 21 nt, Homo sapiens
cacuuacccugggcuggagag

SEQ ID NO: 1822538 - RNA, 15 nt, Homo sapiens
uggagucucagagca

SEQ ID NO: 1822539 - RNA, 14 nt, Homo sapiens
gcuuccuucagaga

SEQ ID NO: 1822540 - RNA, 16 nt, Homo sapiens
cugcuguauacuguac

SEQ ID NO: 1822541 - RNA, 19 nt, Homo sapiens
agcccaagugccaucccac

SEQ ID NO: 1822542 - RNA, 18 nt, Homo sapiens
auaaggaguuagaaccac

SEQ ID NO: 1822543 - RNA, 14 nt, Homo sapiens
uucaguuuuuacug

SEQ ID NO: 1822544 - RNA, 18 nt, Homo sapiens
uuuaucuguuuuguacuu

SEQ ID NO: 1822545 - RNA, 23 nt, Homo sapiens
auuagcccuuccuugccagugag

SEQ ID NO: 1822546 - RNA, 18 nt, Homo sapiens
ugcucugagugcuagcua

SEQ ID NO: 1822547 - RNA, 15 nt, Homo sapiens
uugauucuacucuua

SEQ ID NO: 1822548 - RNA, 20 nt, Homo sapiens
ugucuuccuguguaccucua

SEQ ID NO: 1822549 - RNA, 20 nt, Homo sapiens
uuuuuccaauuuuguugcau

SEQ ID NO: 1822550 - RNA, 14 nt, Homo sapiens
caguagacugcagu

SEQ ID NO: 1822551 - RNA, 15 nt, Homo sapiens
ccccagcugggcugu

SEQ ID NO: 1822552 - RNA, 12 nt, Homo sapiens
ccugaaauccag

SEQ ID NO: 1822553 - RNA, 19 nt, Homo sapiens
agacaauagcccaaagcca

SEQ ID NO: 1822554 - RNA, 22 nt, Homo sapiens
acuggaguaucauucuuuacau

SEQ ID NO: 1822555 - RNA, 22 nt, Homo sapiens
aucccacugaccuacucuugcc

SEQ ID NO: 1822556 - RNA, 12 nt, Homo sapiens
uggcccagguga

SEQ ID NO: 1822557 - RNA, 12 nt, Homo sapiens
aauuaagugcaa

SEQ ID NO: 1822558 - RNA, 12 nt, Homo sapiens
gauuaaguacaa

SEQ ID NO: 1822559 - RNA, 13 nt, Homo sapiens
cacccacauguga

SEQ ID NO: 1822560 - RNA, 21 nt, Homo sapiens
augguuacuaaaaaguaccag

SEQ ID NO: 1822561 - RNA, 23 nt, Homo sapiens
aaucagcaacuucuagcauauag

SEQ ID NO: 1822562 - RNA, 14 nt, Homo sapiens
uuuuuaaaguaugu

SEQ ID NO: 1822563 - RNA, 14 nt, Homo sapiens
uagagaugcaguuu

SEQ ID NO: 1822564 - RNA, 14 nt, Homo sapiens
caucaacuuuaugu

SEQ ID NO: 1822565 - RNA, 19 nt, Homo sapiens
uggccugggaucuggcaca

SEQ ID NO: 1822566 - RNA, 15 nt, Homo sapiens
cucacguuugcuuaa

SEQ ID NO: 1822567 - RNA, 14 nt, Homo sapiens
cucccacacugaaa

SEQ ID NO: 1822568 - RNA, 17 nt, Homo sapiens
ccuuuuauagaugguca

SEQ ID NO: 1822569 - RNA, 21 nt, Homo sapiens
uuaaggagaggagaaacugag

SEQ ID NO: 1822570 - RNA, 23 nt, Homo sapiens
ugaaauaccuuuucucacaaaaa

SEQ ID NO: 1822571 - RNA, 18 nt, Homo sapiens
auggcuuggggagcagag

SEQ ID NO: 1822572 - RNA, 22 nt, Homo sapiens
aaauacugcuuagcauuuugca

SEQ ID NO: 1822573 - RNA, 16 nt, Homo sapiens
caaaagaaaaaaaacu

SEQ ID NO: 1822574 - RNA, 16 nt, Homo sapiens
cuagaaauauagagca

SEQ ID NO: 1822575 - RNA, 13 nt, Homo sapiens
cuuuuuccaucuc

SEQ ID NO: 1822576 - RNA, 22 nt, Homo sapiens
guguauccagaagaagagauca

SEQ ID NO: 1822577 - RNA, 20 nt, Homo sapiens
uucaauacuuacauaucuga

SEQ ID NO: 1822578 - RNA, 19 nt, Homo sapiens
agagcugggcagacaggug

SEQ ID NO: 1822579 - RNA, 21 nt, Homo sapiens
cuauaguucacugacacagua

SEQ ID NO: 1822580 - RNA, 19 nt, Homo sapiens
gccccagggaguccagggu

SEQ ID NO: 1822581 - RNA, 15 nt, Homo sapiens
ugacuuuuccauuga

SEQ ID NO: 1822582 - RNA, 15 nt, Homo sapiens
aaaaugcuucacugu

SEQ ID NO: 1822583 - RNA, 13 nt, Homo sapiens
cuugggugaaaag

SEQ ID NO: 1822584 - RNA, 15 nt, Homo sapiens
guauccaauuaugug

SEQ ID NO: 1822585 - RNA, 18 nt, Homo sapiens
uaauaagcaacuguaaaa

SEQ ID NO: 1822586 - RNA, 22 nt, Homo sapiens
cuuucauuggacccugacugua

SEQ ID NO: 1822587 - RNA, 23 nt, Homo sapiens
auuaaggucauuacucucaacca

SEQ ID NO: 1822588 - RNA, 17 nt, Homo sapiens
guauuuacugacugcuu

SEQ ID NO: 1822589 - RNA, 20 nt, Homo sapiens
gaaaccuuauuguaccucuc

SEQ ID NO: 1822590 - RNA, 11 nt, Homo sapiens
cccacuccuuu

SEQ ID NO: 1822591 - RNA, 17 nt, Homo sapiens
ccgucgaggggcucuca

SEQ ID NO: 1822592 - RNA, 22 nt, Homo sapiens
uccugcuacaacuucagcagua

SEQ ID NO: 1822593 - RNA, 16 nt, Homo sapiens
guuggaaccacggaga

SEQ ID NO: 1822594 - RNA, 15 nt, Homo sapiens
auggccacugaagca

SEQ ID NO: 1822595 - RNA, 15 nt, Homo sapiens
cuuccuggccucuuc

SEQ ID NO: 1822596 - RNA, 22 nt, Homo sapiens
aggucacuauggacuuacccua

SEQ ID NO: 1822597 - RNA, 21 nt, Homo sapiens
cauuuguaaaugucuuuucaa

SEQ ID NO: 1822598 - RNA, 19 nt, Homo sapiens
aucuugaccaagcaggaag

SEQ ID NO: 1822599 - RNA, 17 nt, Homo sapiens
auuccccucgugugacu

SEQ ID NO: 1822600 - RNA, 14 nt, Homo sapiens
acuauuuuugcaca

SEQ ID NO: 1822601 - RNA, 19 nt, Homo sapiens
ggugcugagugcuaugugu

SEQ ID NO: 1822602 - RNA, 13 nt, Homo sapiens
aagcacagugccu

SEQ ID NO: 1822603 - RNA, 18 nt, Homo sapiens
ugauuucacaacagauca

SEQ ID NO: 1822604 - RNA, 17 nt, Homo sapiens
agaacaaauacaauuca

SEQ ID NO: 1822605 - RNA, 17 nt, Homo sapiens
gcauaaaaaucacuggg

SEQ ID NO: 1822606 - RNA, 20 nt, Homo sapiens
uaagaauuucacaagcuauu

SEQ ID NO: 1822607 - RNA, 19 nt, Homo sapiens
gauugugaccuccagaggu

SEQ ID NO: 1822608 - RNA, 15 nt, Homo sapiens
ggagggagcggcaug

SEQ ID NO: 1822609 - RNA, 23 nt, Homo sapiens
gccaucccggcagcgaggcuggg

SEQ ID NO: 1822610 - RNA, 18 nt, Homo sapiens
uauguacauuucucaggc

SEQ ID NO: 1822611 - RNA, 19 nt, Homo sapiens
gaauggggaucacagagac

SEQ ID NO: 1822612 - RNA, 14 nt, Homo sapiens
ccuuauuguaccuc

SEQ ID NO: 1822613 - RNA, 22 nt, Homo sapiens
ccuuuuuucaaaauccaaaaag

SEQ ID NO: 1822614 - RNA, 22 nt, Homo sapiens
auacugcauguaagccaaguca

SEQ ID NO: 1822615 - RNA, 17 nt, Homo sapiens
auuagcauaaagcacua

SEQ ID NO: 1822616 - RNA, 13 nt, Homo sapiens
cuaugagggugag

SEQ ID NO: 1822617 - RNA, 13 nt, Homo sapiens
ccagggcacagcu

SEQ ID NO: 1822618 - RNA, 14 nt, Homo sapiens
auaaauugauuugu

SEQ ID NO: 1822619 - RNA, 17 nt, Homo sapiens
gaaugcagaggucucca

SEQ ID NO: 1822620 - RNA, 16 nt, Homo sapiens
ccaacuuuuuguuaca

SEQ ID NO: 1822621 - RNA, 22 nt, Homo sapiens
guccccagggcugucaucugaa

SEQ ID NO: 1822622 - RNA, 13 nt, Homo sapiens
uuaacagauuuau

SEQ ID NO: 1822623 - RNA, 18 nt, Homo sapiens
uacagcccucacuaacaa

SEQ ID NO: 1822624 - RNA, 17 nt, Homo sapiens
uacuguuucuugcacug

SEQ ID NO: 1822625 - RNA, 20 nt, Homo sapiens
cacuuaacuccuuuuccacu

SEQ ID NO: 1822626 - RNA, 22 nt, Homo sapiens
uucuuggagggcccacuuguau

SEQ ID NO: 1822627 - RNA, 17 nt, Homo sapiens
gccacccuguguugaca

SEQ ID NO: 1822628 - RNA, 19 nt, Homo sapiens
cuuguucuaaucuugucaa

SEQ ID NO: 1822629 - RNA, 15 nt, Homo sapiens
auaaaaggauaucau

SEQ ID NO: 1822630 - RNA, 12 nt, Homo sapiens
ucccaccacagc

SEQ ID NO: 1822631 - RNA, 14 nt, Homo sapiens
accguacuguggaa

SEQ ID NO: 1822632 - RNA, 22 nt, Homo sapiens
aacagguuuucaccauagccua

SEQ ID NO: 1822633 - RNA, 21 nt, Homo sapiens
uuaacuuccaauuuacauacu

SEQ ID NO: 1822634 - RNA, 21 nt, Homo sapiens
cugcugucuacaaaaugccaa

SEQ ID NO: 1822635 - RNA, 16 nt, Homo sapiens
uaaaagacugucuuaa

SEQ ID NO: 1822636 - RNA, 20 nt, Homo sapiens
gaccucaagugauccaccca

SEQ ID NO: 1822637 - RNA, 17 nt, Homo sapiens
augauccagaacagugg

SEQ ID NO: 1822638 - RNA, 13 nt, Homo sapiens
ugcgaaugugcag

SEQ ID NO: 1822639 - RNA, 20 nt, Homo sapiens
cgcagaugaggggccacuga

SEQ ID NO: 1822640 - RNA, 16 nt, Homo sapiens
auggggaaaaaacugu

SEQ ID NO: 1822641 - RNA, 21 nt, Homo sapiens
cccagggucccagccuggcca

SEQ ID NO: 1822642 - RNA, 12 nt, Homo sapiens
aucccugccucu

SEQ ID NO: 1822643 - RNA, 19 nt, Homo sapiens
uaacgaaaauaguauuuca

SEQ ID NO: 1822644 - RNA, 16 nt, Homo sapiens
aucagaacuguuggca

SEQ ID NO: 1822645 - RNA, 14 nt, Homo sapiens
caaaauccaaggca

SEQ ID NO: 1822646 - RNA, 14 nt, Homo sapiens
cagaaaccaaagcu

SEQ ID NO: 1822647 - RNA, 20 nt, Homo sapiens
aucuguaaaauagucucauu

SEQ ID NO: 1822648 - RNA, 17 nt, Homo sapiens
aucaccuccaccauacu

SEQ ID NO: 1822649 - RNA, 14 nt, Homo sapiens
auagauuagaucaa

SEQ ID NO: 1822650 - RNA, 16 nt, Homo sapiens
ccaccucacugcagua

SEQ ID NO: 1822651 - RNA, 16 nt, Homo sapiens
cagagcauuauucuua

SEQ ID NO: 1822652 - RNA, 22 nt, Homo sapiens
cgccucccuaguuagcauccag

SEQ ID NO: 1822653 - RNA, 13 nt, Homo sapiens
gaauuuuaguccu

SEQ ID NO: 1822654 - RNA, 19 nt, Homo sapiens
cucugcuugauuuuugccu

SEQ ID NO: 1822655 - RNA, 12 nt, Homo sapiens
ugcacacaaaac

SEQ ID NO: 1822656 - RNA, 20 nt, Homo sapiens
auaaauguuauagcugcauu

SEQ ID NO: 1822657 - RNA, 18 nt, Homo sapiens
gcuagaggacuucuggca

SEQ ID NO: 1822658 - RNA, 19 nt, Homo sapiens
ccaggagcagcgugcagga

SEQ ID NO: 1822659 - RNA, 16 nt, Homo sapiens
caccauucaggucuuu

SEQ ID NO: 1822660 - RNA, 19 nt, Homo sapiens
aagugagacccugucucaa

SEQ ID NO: 1822661 - RNA, 19 nt, Homo sapiens
ucuggacacagccccaugu

SEQ ID NO: 1822662 - RNA, 21 nt, Homo sapiens
uggccuuaaaaggggcccaag

SEQ ID NO: 1822663 - RNA, 19 nt, Homo sapiens
agauaaggcaacaaaaugg

SEQ ID NO: 1822664 - RNA, 15 nt, Homo sapiens
gcaaucucauuacug

SEQ ID NO: 1822665 - RNA, 17 nt, Homo sapiens
auuuuuauaaagauaua

SEQ ID NO: 1822666 - RNA, 20 nt, Homo sapiens
uaauguaucuuaaaggacau

SEQ ID NO: 1822667 - RNA, 18 nt, Homo sapiens
acuaaauuugauacuuau

SEQ ID NO: 1822668 - RNA, 17 nt, Homo sapiens
cacauauauuuuuuaca

SEQ ID NO: 1822669 - RNA, 18 nt, Homo sapiens
uaaaacuaaaaagcauuu

SEQ ID NO: 1822670 - RNA, 14 nt, Homo sapiens
aaacucccauauca

SEQ ID NO: 1822671 - RNA, 22 nt, Homo sapiens
gaaagcuguuggauuucaguga

SEQ ID NO: 1822672 - RNA, 17 nt, Homo sapiens
caccugguacugaccca

SEQ ID NO: 1822673 - RNA, 11 nt, Homo sapiens
agagggggccu

SEQ ID NO: 1822674 - RNA, 20 nt, Homo sapiens
uucaccauguuggcuaggau

SEQ ID NO: 1822675 - RNA, 15 nt, Homo sapiens
ggcauuuucuguucc

SEQ ID NO: 1822676 - RNA, 20 nt, Homo sapiens
uaugcuuucccugaggaaug

SEQ ID NO: 1822677 - RNA, 14 nt, Homo sapiens
acaaacugccaguu

SEQ ID NO: 1822678 - RNA, 13 nt, Homo sapiens
gugugugcaguga

SEQ ID NO: 1822679 - RNA, 15 nt, Homo sapiens
cugcacagcaaaaga

SEQ ID NO: 1822680 - RNA, 17 nt, Homo sapiens
cccaucuaaaacucaua

SEQ ID NO: 1822681 - RNA, 16 nt, Homo sapiens
uguauuguauugccca

SEQ ID NO: 1822682 - RNA, 13 nt, Homo sapiens
uuucuuaccaugc

SEQ ID NO: 1822683 - RNA, 14 nt, Homo sapiens
aaauccgccagugu

SEQ ID NO: 1822684 - RNA, 18 nt, Homo sapiens
aagagggcacacacugug

SEQ ID NO: 1822685 - RNA, 15 nt, Homo sapiens
ucagcagcaggguuu

SEQ ID NO: 1822686 - RNA, 23 nt, Homo sapiens
cauuacgcucggaacacauucuc

SEQ ID NO: 1822687 - RNA, 19 nt, Homo sapiens
ugguaucuuauuaaugagu

SEQ ID NO: 1822688 - RNA, 21 nt, Homo sapiens
uccuccuuuagaguugcauga

SEQ ID NO: 1822689 - RNA, 15 nt, Homo sapiens
ggagcaaaccaaaga

SEQ ID NO: 1822690 - RNA, 15 nt, Homo sapiens
uguaguuacuguggu

SEQ ID NO: 1822691 - RNA, 12 nt, Homo sapiens
uucuuuguccau

SEQ ID NO: 1822692 - RNA, 12 nt, Homo sapiens
ccaauuguuuca

SEQ ID NO: 1822693 - RNA, 17 nt, Homo sapiens
gccagugaugugcggug

SEQ ID NO: 1822694 - RNA, 18 nt, Homo sapiens
ccauauucuaaauucacu

SEQ ID NO: 1822695 - RNA, 15 nt, Homo sapiens
ucagaccaguacugg

SEQ ID NO: 1822696 - RNA, 14 nt, Homo sapiens
uaaacuaaauuacu

SEQ ID NO: 1822697 - RNA, 16 nt, Homo sapiens
gcccgaggaggagcuc

SEQ ID NO: 1822698 - RNA, 11 nt, Homo sapiens
aguuacucagg

SEQ ID NO: 1822699 - RNA, 23 nt, Homo sapiens
aaaagucacccagggacacucca

SEQ ID NO: 1822700 - RNA, 14 nt, Homo sapiens
aaggugacaaaagg

SEQ ID NO: 1822701 - RNA, 12 nt, Homo sapiens
aagaaccuggaa

SEQ ID NO: 1822702 - RNA, 16 nt, Homo sapiens
uaggucagauggaggu

SEQ ID NO: 1822703 - RNA, 21 nt, Homo sapiens
ccaccacugugucccaguguc

SEQ ID NO: 1822704 - RNA, 22 nt, Homo sapiens
uguuucuaaauuuugugauucu

SEQ ID NO: 1822705 - RNA, 23 nt, Homo sapiens
cuuuuugguuugcagaugacaaa

SEQ ID NO: 1822706 - RNA, 22 nt, Homo sapiens
ccacagacagcuuagaagccau

SEQ ID NO: 1822707 - RNA, 20 nt, Homo sapiens
ucucccuugauuccacuugu

SEQ ID NO: 1822708 - RNA, 20 nt, Homo sapiens
caggauggucucgaucucuu

SEQ ID NO: 1822709 - RNA, 10 nt, Homo sapiens
auucagugac

SEQ ID NO: 1822710 - RNA, 19 nt, Homo sapiens
agccuggccauguccucaa

SEQ ID NO: 1822711 - RNA, 15 nt, Homo sapiens
uguucucuaguuuuc

SEQ ID NO: 1822712 - RNA, 12 nt, Homo sapiens
uggugucugucc

SEQ ID NO: 1822713 - RNA, 14 nt, Homo sapiens
ggcugguugggagc

SEQ ID NO: 1822714 - RNA, 16 nt, Homo sapiens
uuagguaagacauaua

SEQ ID NO: 1822715 - RNA, 19 nt, Homo sapiens
gacaagacccccagcacuu

SEQ ID NO: 1822716 - RNA, 17 nt, Homo sapiens
aggcaaauggcacugca

SEQ ID NO: 1822717 - RNA, 16 nt, Homo sapiens
ucaggccgcauccuga

SEQ ID NO: 1822718 - RNA, 20 nt, Homo sapiens
ucacauacaaaucauccauc

SEQ ID NO: 1822719 - RNA, 16 nt, Homo sapiens
acuucaccuuuccucu

SEQ ID NO: 1822720 - RNA, 14 nt, Homo sapiens
uauaauaacugaac

SEQ ID NO: 1822721 - RNA, 15 nt, Homo sapiens
accaagcucacccuu

SEQ ID NO: 1822722 - RNA, 17 nt, Homo sapiens
uucaccucuuugcuccc

SEQ ID NO: 1822723 - RNA, 17 nt, Homo sapiens
gcaauggacaaggaagg

SEQ ID NO: 1822724 - RNA, 22 nt, Homo sapiens
cacacaggaacucugugugaga

SEQ ID NO: 1822725 - RNA, 16 nt, Homo sapiens
cuuggacuugcauucc

SEQ ID NO: 1822726 - RNA, 17 nt, Homo sapiens
augcugagacaucccuc

SEQ ID NO: 1822727 - RNA, 21 nt, Homo sapiens
uaacuguauuuuugaagacua

SEQ ID NO: 1822728 - RNA, 23 nt, Homo sapiens
cacuuucccuagaaagccauauu

SEQ ID NO: 1822729 - RNA, 17 nt, Homo sapiens
uugucaaugcaguuguc

SEQ ID NO: 1822730 - RNA, 14 nt, Homo sapiens
ucgaugugcucagc

SEQ ID NO: 1822731 - RNA, 17 nt, Homo sapiens
uaaauagaguuccaaau

SEQ ID NO: 1822732 - RNA, 23 nt, Homo sapiens
ugcuguacuuuauuuguauuugc

SEQ ID NO: 1822733 - RNA, 13 nt, Homo sapiens
aaguaugccuuaa

SEQ ID NO: 1822734 - RNA, 13 nt, Homo sapiens
aaauaacuaucag

SEQ ID NO: 1822735 - RNA, 12 nt, Homo sapiens
aucaagacuauc

SEQ ID NO: 1822736 - RNA, 23 nt, Homo sapiens
cgcuacaaaauaaagcuguucuc

SEQ ID NO: 1822737 - RNA, 17 nt, Homo sapiens
acuucccuuuccuccac

SEQ ID NO: 1822738 - RNA, 22 nt, Homo sapiens
gaggaguagcaugaacgccaag

SEQ ID NO: 1822739 - RNA, 16 nt, Homo sapiens
gcucauuuugacaaag

SEQ ID NO: 1822740 - RNA, 11 nt, Homo sapiens
auauaaggaau

SEQ ID NO: 1822741 - RNA, 15 nt, Homo sapiens
agguagaacucaguc

SEQ ID NO: 1822742 - RNA, 17 nt, Homo sapiens
uaaggcguggcuucugc

SEQ ID NO: 1822743 - RNA, 18 nt, Homo sapiens
aucauuguaacuaaaaaa

SEQ ID NO: 1822744 - RNA, 14 nt, Homo sapiens
uaggauaagcacua

SEQ ID NO: 1822745 - RNA, 19 nt, Homo sapiens
ccacgucagaggaaggacu

SEQ ID NO: 1822746 - RNA, 16 nt, Homo sapiens
guugcuauaauaaaga

SEQ ID NO: 1822747 - RNA, 15 nt, Homo sapiens
auuagagagucucaa

SEQ ID NO: 1822748 - RNA, 20 nt, Homo sapiens
cacuuaaucuucucucuuga

SEQ ID NO: 1822749 - RNA, 23 nt, Homo sapiens
agaauccacaaagccgugccuuu

SEQ ID NO: 1822750 - RNA, 21 nt, Homo sapiens
ggcugccuaccaggggccuuc

SEQ ID NO: 1822751 - RNA, 18 nt, Homo sapiens
cuauuuacggaacucaaa

SEQ ID NO: 1822752 - RNA, 23 nt, Homo sapiens
gaccagccagggcaacacaguga

SEQ ID NO: 1822753 - RNA, 20 nt, Homo sapiens
augauagcaaauggccucau

SEQ ID NO: 1822754 - RNA, 14 nt, Homo sapiens
agagauucuucuag

SEQ ID NO: 1822755 - RNA, 20 nt, Homo sapiens
gaggcaaccuguugaauuua

SEQ ID NO: 1822756 - RNA, 14 nt, Homo sapiens
cugcuuugcaaauu

SEQ ID NO: 1822757 - RNA, 14 nt, Homo sapiens
uaacuauguugaua

SEQ ID NO: 1822758 - RNA, 19 nt, Homo sapiens
ugugcauacgccucuuguu

SEQ ID NO: 1822759 - RNA, 16 nt, Homo sapiens
uacuuuuucuuugaau

SEQ ID NO: 1822760 - RNA, 16 nt, Homo sapiens
uuuuuauacacuguaa

SEQ ID NO: 1822761 - RNA, 16 nt, Homo sapiens
gaugcugccauuuaac

SEQ ID NO: 1822762 - RNA, 23 nt, Homo sapiens
ucauuuguuguuguuuuuccuca

SEQ ID NO: 1822763 - RNA, 20 nt, Homo sapiens
ggacuagugagucagcaccu

SEQ ID NO: 1822764 - RNA, 23 nt, Homo sapiens
uaucuagauagcugacucauucu

SEQ ID NO: 1822765 - RNA, 14 nt, Homo sapiens
uggcaagugauauc

SEQ ID NO: 1822766 - RNA, 16 nt, Homo sapiens
cacagaaaauaaggca

SEQ ID NO: 1822767 - RNA, 21 nt, Homo sapiens
cuuuguuuuuacgucauuaca

SEQ ID NO: 1822768 - RNA, 18 nt, Homo sapiens
gcccagaaaacugucauu

SEQ ID NO: 1822769 - RNA, 16 nt, Homo sapiens
aacuugaaauauccug

SEQ ID NO: 1822770 - RNA, 17 nt, Homo sapiens
ucaguucaucaaaucau

SEQ ID NO: 1822771 - RNA, 20 nt, Homo sapiens
uaaagggcagggcccacgug

SEQ ID NO: 1822772 - RNA, 15 nt, Homo sapiens
aguaauugaggaaaa

SEQ ID NO: 1822773 - RNA, 18 nt, Homo sapiens
gccacaucccucucugcu

SEQ ID NO: 1822774 - RNA, 18 nt, Homo sapiens
uggccauggugacauugu

SEQ ID NO: 1822775 - RNA, 21 nt, Homo sapiens
gguacuauuuagauauaacac

SEQ ID NO: 1822776 - RNA, 22 nt, Homo sapiens
ccuccaagggaucugcuugaua

SEQ ID NO: 1822777 - RNA, 16 nt, Homo sapiens
acuugccugugcuaca

SEQ ID NO: 1822778 - RNA, 18 nt, Homo sapiens
ugagauuucccaguuuag

SEQ ID NO: 1822779 - RNA, 19 nt, Homo sapiens
cuuuugcucuucauaauaa

SEQ ID NO: 1822780 - RNA, 22 nt, Homo sapiens
ggaggaagcccacauauucuau

SEQ ID NO: 1822781 - RNA, 19 nt, Homo sapiens
caggguauaaaaugacauc

SEQ ID NO: 1822782 - RNA, 14 nt, Homo sapiens
ugacaaagaugcau

SEQ ID NO: 1822783 - RNA, 23 nt, Homo sapiens
uugacaaacucucccuucacucc

SEQ ID NO: 1822784 - RNA, 13 nt, Homo sapiens
ugccgcaccagcc

SEQ ID NO: 1822785 - RNA, 21 nt, Homo sapiens
cauuggaugcauuucuaucaa

SEQ ID NO: 1822786 - RNA, 15 nt, Homo sapiens
cagguuuuuggucug

SEQ ID NO: 1822787 - RNA, 20 nt, Homo sapiens
acugcucuccuccaccucaa

SEQ ID NO: 1822788 - RNA, 23 nt, Homo sapiens
acccagucagaguugugcacaug

SEQ ID NO: 1822789 - RNA, 19 nt, Homo sapiens
ggauggacagauggaccaa

SEQ ID NO: 1822790 - RNA, 18 nt, Homo sapiens
cggugaaaccccaucucu

SEQ ID NO: 1822791 - RNA, 14 nt, Homo sapiens
gaggaaacuuugau

SEQ ID NO: 1822792 - RNA, 13 nt, Homo sapiens
uaauuugcaauuu

SEQ ID NO: 1822793 - RNA, 12 nt, Homo sapiens
gaauuacuugug

SEQ ID NO: 1822794 - RNA, 19 nt, Homo sapiens
acaugccaugaccuuccuc

SEQ ID NO: 1822795 - RNA, 19 nt, Homo sapiens
caugucuuuucuugcauga

SEQ ID NO: 1822796 - RNA, 11 nt, Homo sapiens
aaacuuuccaa

SEQ ID NO: 1822797 - RNA, 17 nt, Homo sapiens
auuuauuacuguaagaa

SEQ ID NO: 1822798 - RNA, 18 nt, Homo sapiens
cucaaaacacccaaaaau

SEQ ID NO: 1822799 - RNA, 22 nt, Homo sapiens
cgggaugucagcagacacacau

SEQ ID NO: 1822800 - RNA, 15 nt, Homo sapiens
caacaggaggacaau

SEQ ID NO: 1822801 - RNA, 21 nt, Homo sapiens
cuacagaugugggccaccaug

SEQ ID NO: 1822802 - RNA, 15 nt, Homo sapiens
auucucccuuuauga

SEQ ID NO: 1822803 - RNA, 11 nt, Homo sapiens
uuaaaguauuu

SEQ ID NO: 1822804 - RNA, 20 nt, Homo sapiens
aaggggacagcgccaccucu

SEQ ID NO: 1822805 - RNA, 21 nt, Homo sapiens
aguucaaaugaugaagaccaa

SEQ ID NO: 1822806 - RNA, 21 nt, Homo sapiens
aagacuaaucgaaugaacaaa

SEQ ID NO: 1822807 - RNA, 15 nt, Homo sapiens
cagucuugcuuacaa

SEQ ID NO: 1822808 - RNA, 15 nt, Homo sapiens
auuugaagaagaguu

SEQ ID NO: 1822809 - RNA, 13 nt, Homo sapiens
acugucuuaguca

SEQ ID NO: 1822810 - RNA, 13 nt, Homo sapiens
ggcgucuugccca

SEQ ID NO: 1822811 - RNA, 19 nt, Homo sapiens
auaaaagauuuuccuauuc

SEQ ID NO: 1822812 - RNA, 20 nt, Homo sapiens
cagagcuaaaagguaccuuu

SEQ ID NO: 1822813 - RNA, 16 nt, Homo sapiens
ccacucagcucaccuc

SEQ ID NO: 1822814 - RNA, 20 nt, Homo sapiens
aguguuggaaaaugugcaau

SEQ ID NO: 1822815 - RNA, 17 nt, Homo sapiens
gcagcuccagucagugu

SEQ ID NO: 1822816 - RNA, 21 nt, Homo sapiens
uuugauuaacaaauaugcuaa

SEQ ID NO: 1822817 - RNA, 14 nt, Homo sapiens
gguuucaccuuccc

SEQ ID NO: 1822818 - RNA, 18 nt, Homo sapiens
guguugugaaacuguaaa

SEQ ID NO: 1822819 - RNA, 13 nt, Homo sapiens
uguaaacguuaaa

SEQ ID NO: 1822820 - RNA, 18 nt, Homo sapiens
uuuaaaggcccuaucugu

SEQ ID NO: 1822821 - RNA, 23 nt, Homo sapiens
uucuaagacucaaauguucuaag

SEQ ID NO: 1822822 - RNA, 18 nt, Homo sapiens
ccugaagucccagcauug

SEQ ID NO: 1822823 - RNA, 14 nt, Homo sapiens
ugcuggcugccuua

SEQ ID NO: 1822824 - RNA, 16 nt, Homo sapiens
ugucaacuucaguuga

SEQ ID NO: 1822825 - RNA, 16 nt, Homo sapiens
aaguuauuuaugcuau

SEQ ID NO: 1822826 - RNA, 23 nt, Homo sapiens
auguaauauauuguacaaaugua

SEQ ID NO: 1822827 - RNA, 19 nt, Homo sapiens
ggugagcagaaguggagcu

SEQ ID NO: 1822828 - RNA, 22 nt, Homo sapiens
gagagaucuccaacucucucug

SEQ ID NO: 1822829 - RNA, 22 nt, Homo sapiens
ggcaucaguagcaucuguaaca

SEQ ID NO: 1822830 - RNA, 17 nt, Homo sapiens
cgccauuccaagucaac

SEQ ID NO: 1822831 - RNA, 21 nt, Homo sapiens
uccaguugcccauaagcacau

SEQ ID NO: 1822832 - RNA, 17 nt, Homo sapiens
auccagcacuggugaac

SEQ ID NO: 1822833 - RNA, 15 nt, Homo sapiens
ucacagguugaccaa

SEQ ID NO: 1822834 - RNA, 15 nt, Homo sapiens
aucuauucuguguug

SEQ ID NO: 1822835 - RNA, 21 nt, Homo sapiens
ccaggaaggaaaaugugaaca

SEQ ID NO: 1822836 - RNA, 20 nt, Homo sapiens
caucaagcgaugaaacugga

SEQ ID NO: 1822837 - RNA, 21 nt, Homo sapiens
aagaauguagucagacugaca

SEQ ID NO: 1822838 - RNA, 21 nt, Homo sapiens
aaacaagguccaguaauagca

SEQ ID NO: 1822839 - RNA, 23 nt, Homo sapiens
agauaagacuuguuucuuucugu

SEQ ID NO: 1822840 - RNA, 13 nt, Homo sapiens
uggaaacaucuga

SEQ ID NO: 1822841 - RNA, 14 nt, Homo sapiens
cuucaguuaauucu

SEQ ID NO: 1822842 - RNA, 19 nt, Homo sapiens
auaagcaaaaucagaagua

SEQ ID NO: 1822843 - RNA, 16 nt, Homo sapiens
agggaaguuuagauga

SEQ ID NO: 1822844 - RNA, 18 nt, Homo sapiens
acaauaaacgaaacacag

SEQ ID NO: 1822845 - RNA, 20 nt, Homo sapiens
acaagccacaagucuuccag

SEQ ID NO: 1822846 - RNA, 16 nt, Homo sapiens
gagugagcaaccagcu

SEQ ID NO: 1822847 - RNA, 16 nt, Homo sapiens
aauaugaaucugcuca

SEQ ID NO: 1822848 - RNA, 22 nt, Homo sapiens
ccuaaaguaacaucagccauuu

SEQ ID NO: 1822849 - RNA, 13 nt, Homo sapiens
uaucccaucccau

SEQ ID NO: 1822850 - RNA, 16 nt, Homo sapiens
uggcuucuacacuggg

SEQ ID NO: 1822851 - RNA, 16 nt, Homo sapiens
acaggcagcucugagc

SEQ ID NO: 1822852 - RNA, 12 nt, Homo sapiens
gaggcuuggaaa

SEQ ID NO: 1822853 - RNA, 21 nt, Homo sapiens
cucauggcagcuaagccacau

SEQ ID NO: 1822854 - RNA, 14 nt, Homo sapiens
aggugagcccucau

SEQ ID NO: 1822855 - RNA, 20 nt, Homo sapiens
auuaaaaaaaucauacauuc

SEQ ID NO: 1822856 - RNA, 14 nt, Homo sapiens
ucaacugcuuguaa

SEQ ID NO: 1822857 - RNA, 21 nt, Homo sapiens
auggagcagccuggagaccca

SEQ ID NO: 1822858 - RNA, 21 nt, Homo sapiens
agcacaagguaaauauucauu

SEQ ID NO: 1822859 - RNA, 20 nt, Homo sapiens
gagauggaaguugcagugag

SEQ ID NO: 1822860 - RNA, 18 nt, Homo sapiens
uacucauuuuaaugauug

SEQ ID NO: 1822861 - RNA, 11 nt, Homo sapiens
ugcgcugcuaa

SEQ ID NO: 1822862 - RNA, 12 nt, Homo sapiens
uuucuuugccuc

SEQ ID NO: 1822863 - RNA, 18 nt, Homo sapiens
uucauauccauagauagu

SEQ ID NO: 1822864 - RNA, 14 nt, Homo sapiens
aagucccuuuuugu

SEQ ID NO: 1822865 - RNA, 19 nt, Homo sapiens
cuugaaaauaagauuccag

SEQ ID NO: 1822866 - RNA, 23 nt, Homo sapiens
uugccaaucuuguuuuaagcaaa

SEQ ID NO: 1822867 - RNA, 22 nt, Homo sapiens
acuacauuuuauuuuuguaucu

SEQ ID NO: 1822868 - RNA, 19 nt, Homo sapiens
uauccacagaaccuuuguc

SEQ ID NO: 1822869 - RNA, 11 nt, Homo sapiens
uucaaaugcau

SEQ ID NO: 1822870 - RNA, 15 nt, Homo sapiens
gucuaggacugcagu

SEQ ID NO: 1822871 - RNA, 18 nt, Homo sapiens
uugaaaagcucacuucaa

SEQ ID NO: 1822872 - RNA, 19 nt, Homo sapiens
uaaagaaugcaauacugua

SEQ ID NO: 1822873 - RNA, 17 nt, Homo sapiens
ggaagucugucucagga

SEQ ID NO: 1822874 - RNA, 15 nt, Homo sapiens
aaacuuuggaaguuu

SEQ ID NO: 1822875 - RNA, 15 nt, Homo sapiens
cuaccaagcagcuca

SEQ ID NO: 1822876 - RNA, 21 nt, Homo sapiens
ggucagcagaugccagugaag

SEQ ID NO: 1822877 - RNA, 14 nt, Homo sapiens
auaaacugcagaga

SEQ ID NO: 1822878 - RNA, 15 nt, Homo sapiens
uggcaugauuuauau

SEQ ID NO: 1822879 - RNA, 19 nt, Homo sapiens
cuuuuucucugcuuccagu

SEQ ID NO: 1822880 - RNA, 14 nt, Homo sapiens
gacaguuugauaau

SEQ ID NO: 1822881 - RNA, 18 nt, Homo sapiens
aggaaaaaaagauuucca

SEQ ID NO: 1822882 - RNA, 15 nt, Homo sapiens
caucagucaaugaau

SEQ ID NO: 1822883 - RNA, 15 nt, Homo sapiens
caggaggcaagcaag

SEQ ID NO: 1822884 - RNA, 19 nt, Homo sapiens
cccugugcaggagcuaguu

SEQ ID NO: 1822885 - RNA, 21 nt, Homo sapiens
ugcagcauuaaaaaaaaucaa

SEQ ID NO: 1822886 - RNA, 14 nt, Homo sapiens
cauaaguuaucaug

SEQ ID NO: 1822887 - RNA, 21 nt, Homo sapiens
ccuuuccaaauaagugcauuu

SEQ ID NO: 1822888 - RNA, 15 nt, Homo sapiens
cauggauauguugua

SEQ ID NO: 1822889 - RNA, 16 nt, Homo sapiens
uaauucuuuaucacau

SEQ ID NO: 1822890 - RNA, 17 nt, Homo sapiens
gcuucaaggauggagau

SEQ ID NO: 1822891 - RNA, 22 nt, Homo sapiens
uaacuaguccuuuacuaaucca

SEQ ID NO: 1822892 - RNA, 13 nt, Homo sapiens
cugucccagagag

SEQ ID NO: 1822893 - RNA, 19 nt, Homo sapiens
aaaguuuaaaaagcucaca

SEQ ID NO: 1822894 - RNA, 16 nt, Homo sapiens
cugucuugccagauua

SEQ ID NO: 1822895 - RNA, 14 nt, Homo sapiens
ucaucaaaaccaag

SEQ ID NO: 1822896 - RNA, 14 nt, Homo sapiens
acagucaucauuua

SEQ ID NO: 1822897 - RNA, 18 nt, Homo sapiens
ucuccaccucccccaaac

SEQ ID NO: 1822898 - RNA, 21 nt, Homo sapiens
agccgccucccuuaugcagga

SEQ ID NO: 1822899 - RNA, 13 nt, Homo sapiens
caaggugugaugg

SEQ ID NO: 1822900 - RNA, 14 nt, Homo sapiens
acaguuacuuccuu

SEQ ID NO: 1822901 - RNA, 22 nt, Homo sapiens
cauguuacuuuauucagagcua

SEQ ID NO: 1822902 - RNA, 16 nt, Homo sapiens
agcucaauaaaagaau

SEQ ID NO: 1822903 - RNA, 19 nt, Homo sapiens
cuuaccuucauaugcagua

SEQ ID NO: 1822904 - RNA, 13 nt, Homo sapiens
uaugucaacuuaa

SEQ ID NO: 1822905 - RNA, 15 nt, Homo sapiens
uuagcauuuugcuaa

SEQ ID NO: 1822906 - RNA, 20 nt, Homo sapiens
acccuugaucuuaacaaagc

SEQ ID NO: 1822907 - RNA, 13 nt, Homo sapiens
auaaacaucacag

SEQ ID NO: 1822908 - RNA, 22 nt, Homo sapiens
cuuugcugccccaccaucuugc

SEQ ID NO: 1822909 - RNA, 16 nt, Homo sapiens
aggagcagcugugcug

SEQ ID NO: 1822910 - RNA, 20 nt, Homo sapiens
cuuucuugaaaagaagcaag

SEQ ID NO: 1822911 - RNA, 14 nt, Homo sapiens
aaacccacaaucca

SEQ ID NO: 1822912 - RNA, 18 nt, Homo sapiens
gguccccuccuucccaag

SEQ ID NO: 1822913 - RNA, 10 nt, Homo sapiens
ggacucagga

SEQ ID NO: 1822914 - RNA, 20 nt, Homo sapiens
ccaguuuuacaaaccuuuaa

SEQ ID NO: 1822915 - RNA, 20 nt, Homo sapiens
aggugggcgggcagcacagc

SEQ ID NO: 1822916 - RNA, 15 nt, Homo sapiens
uugaacucaaugaua

SEQ ID NO: 1822917 - RNA, 20 nt, Homo sapiens
aguaaucugaucguucuuuc

SEQ ID NO: 1822918 - RNA, 12 nt, Homo sapiens
ugaacauuccua

SEQ ID NO: 1822919 - RNA, 19 nt, Homo sapiens
caaucaugagcaagugaac

SEQ ID NO: 1822920 - RNA, 16 nt, Homo sapiens
caaaagaugccauuca

SEQ ID NO: 1822921 - RNA, 21 nt, Homo sapiens
ucgggccccgaaugucacugg

SEQ ID NO: 1822922 - RNA, 14 nt, Homo sapiens
auacaucacuguau

SEQ ID NO: 1822923 - RNA, 23 nt, Homo sapiens
gaaagcuugagucucaagggugg

SEQ ID NO: 1822924 - RNA, 22 nt, Homo sapiens
agccaaauucauccucuuacca

SEQ ID NO: 1822925 - RNA, 18 nt, Homo sapiens
ccagacacagacuggcaa

SEQ ID NO: 1822926 - RNA, 15 nt, Homo sapiens
uccucagagcuccau

SEQ ID NO: 1822927 - RNA, 16 nt, Homo sapiens
ccauauuguagcucaa

SEQ ID NO: 1822928 - RNA, 21 nt, Homo sapiens
gugaaauuauuuuggagauua

SEQ ID NO: 1822929 - RNA, 19 nt, Homo sapiens
cacuguauauaaacauauc

SEQ ID NO: 1822930 - RNA, 16 nt, Homo sapiens
aauccuggagucucac

SEQ ID NO: 1822931 - RNA, 21 nt, Homo sapiens
guacaugugcuugccaugugu

SEQ ID NO: 1822932 - RNA, 14 nt, Homo sapiens
ucccaaaguguccu

SEQ ID NO: 1822933 - RNA, 16 nt, Homo sapiens
caccuugucugcuaaa

SEQ ID NO: 1822934 - RNA, 19 nt, Homo sapiens
auaucacauuggagucacu

SEQ ID NO: 1822935 - RNA, 19 nt, Homo sapiens
caagugaacucagcacucu

SEQ ID NO: 1822936 - RNA, 14 nt, Homo sapiens
gaaaauaucuugcu

SEQ ID NO: 1822937 - RNA, 14 nt, Homo sapiens
uacuacgaaguaua

SEQ ID NO: 1822938 - RNA, 14 nt, Homo sapiens
aauaggaugcauuc

SEQ ID NO: 1822939 - RNA, 15 nt, Homo sapiens
ugugagaugauuugu

SEQ ID NO: 1822940 - RNA, 15 nt, Homo sapiens
cagcacuccucauca

SEQ ID NO: 1822941 - RNA, 17 nt, Homo sapiens
uacaggccucgcuacaa

SEQ ID NO: 1822942 - RNA, 14 nt, Homo sapiens
uggacaaaggaauc

SEQ ID NO: 1822943 - RNA, 18 nt, Homo sapiens
agcuucuugcugaucaga

SEQ ID NO: 1822944 - RNA, 20 nt, Homo sapiens
uggggcccuaauucagccau

SEQ ID NO: 1822945 - RNA, 12 nt, Homo sapiens
cacguccuccac

SEQ ID NO: 1822946 - RNA, 14 nt, Homo sapiens
cagaagcauuucac

SEQ ID NO: 1822947 - RNA, 23 nt, Homo sapiens
uuaccuguguuucaagcuaccuu

SEQ ID NO: 1822948 - RNA, 16 nt, Homo sapiens
aguugcuuuucagcug

SEQ ID NO: 1822949 - RNA, 21 nt, Homo sapiens
agugucaugaagugcacagga

SEQ ID NO: 1822950 - RNA, 14 nt, Homo sapiens
gucauguaauacug

SEQ ID NO: 1822951 - RNA, 16 nt, Homo sapiens
aucauaacauugauuu

SEQ ID NO: 1822952 - RNA, 16 nt, Homo sapiens
agucaccuucugggca

SEQ ID NO: 1822953 - RNA, 22 nt, Homo sapiens
ccuauguccuaaggacacacua

SEQ ID NO: 1822954 - RNA, 16 nt, Homo sapiens
guacacagcaccagaa

SEQ ID NO: 1822955 - RNA, 19 nt, Homo sapiens
agugauccacccaccucag

SEQ ID NO: 1822956 - RNA, 14 nt, Homo sapiens
gaauugguugccau

SEQ ID NO: 1822957 - RNA, 13 nt, Homo sapiens
gagugccugccuc

SEQ ID NO: 1822958 - RNA, 14 nt, Homo sapiens
cucuuuuucugugu

SEQ ID NO: 1822959 - RNA, 16 nt, Homo sapiens
aucuaucccagaguac

SEQ ID NO: 1822960 - RNA, 19 nt, Homo sapiens
gugcuuauuuuguuucaau

SEQ ID NO: 1822961 - RNA, 22 nt, Homo sapiens
caugauugauugaaucauugcc

SEQ ID NO: 1822962 - RNA, 19 nt, Homo sapiens
uaaacgguuaacaauauua

SEQ ID NO: 1822963 - RNA, 12 nt, Homo sapiens
ccugacuggcaa

SEQ ID NO: 1822964 - RNA, 16 nt, Homo sapiens
agaaaauacauuuuau

SEQ ID NO: 1822965 - RNA, 21 nt, Homo sapiens
uacauccuguccacacugcug

SEQ ID NO: 1822966 - RNA, 13 nt, Homo sapiens
uuugccauucaag

SEQ ID NO: 1822967 - RNA, 13 nt, Homo sapiens
auuguacacuauc

SEQ ID NO: 1822968 - RNA, 23 nt, Homo sapiens
gccggcauggugccugggcugcc

SEQ ID NO: 1822969 - RNA, 22 nt, Homo sapiens
uuucacuuaaacuuugucacuu

SEQ ID NO: 1822970 - RNA, 19 nt, Homo sapiens
ccagcgcccgcugggcuga

SEQ ID NO: 1822971 - RNA, 12 nt, Homo sapiens
acuaucauucuc

SEQ ID NO: 1822972 - RNA, 22 nt, Homo sapiens
aggaggaucauuugagcucaug

SEQ ID NO: 1822973 - RNA, 23 nt, Homo sapiens
auuacaaauuuucacugcugcuc

SEQ ID NO: 1822974 - RNA, 15 nt, Homo sapiens
uucccacucugggca

SEQ ID NO: 1822975 - RNA, 23 nt, Homo sapiens
gacgaugccuucaaaaugcugcu

SEQ ID NO: 1822976 - RNA, 21 nt, Homo sapiens
auccuuggggagcacuugucc

SEQ ID NO: 1822977 - RNA, 18 nt, Homo sapiens
uccuuuuagguagaauuu

SEQ ID NO: 1822978 - RNA, 17 nt, Homo sapiens
aaaaguuacauugugcu

SEQ ID NO: 1822979 - RNA, 18 nt, Homo sapiens
uguggaauugacugccua

SEQ ID NO: 1822980 - RNA, 19 nt, Homo sapiens
cugucucuuuccacuuugu

SEQ ID NO: 1822981 - RNA, 13 nt, Homo sapiens
ccugaaacacgaa

SEQ ID NO: 1822982 - RNA, 16 nt, Homo sapiens
cuuuaaguuauuuuac

SEQ ID NO: 1822983 - RNA, 14 nt, Homo sapiens
caacuugcuucuaa

SEQ ID NO: 1822984 - RNA, 21 nt, Homo sapiens
caaauacuuagagcagugaag

SEQ ID NO: 1822985 - RNA, 19 nt, Homo sapiens
ugugcccgacugacuggag

SEQ ID NO: 1822986 - RNA, 18 nt, Homo sapiens
uaaaacuaaauagcaugu

SEQ ID NO: 1822987 - RNA, 22 nt, Homo sapiens
gcaagugauugaaaauaguaaa

SEQ ID NO: 1822988 - RNA, 18 nt, Homo sapiens
ugaccuugggguacaauu

SEQ ID NO: 1822989 - RNA, 12 nt, Homo sapiens
ccgcagugcaua

SEQ ID NO: 1822990 - RNA, 19 nt, Homo sapiens
agauagaugcacuuaugca

SEQ ID NO: 1822991 - RNA, 20 nt, Homo sapiens
cacugggaugccucuugcag

SEQ ID NO: 1822992 - RNA, 19 nt, Homo sapiens
agcccuucugucugucagg

SEQ ID NO: 1822993 - RNA, 15 nt, Homo sapiens
cuuacgcuauuucug

SEQ ID NO: 1822994 - RNA, 19 nt, Homo sapiens
gaggugggcagcagcucag

SEQ ID NO: 1822995 - RNA, 17 nt, Homo sapiens
cuuaaaagaugccuuaa

SEQ ID NO: 1822996 - RNA, 19 nt, Homo sapiens
ggagcccuagcccugcucc

SEQ ID NO: 1822997 - RNA, 22 nt, Homo sapiens
ccgcucagugucagcgggugac

SEQ ID NO: 1822998 - RNA, 23 nt, Homo sapiens
acugcagggaaaauuauuugcau

SEQ ID NO: 1822999 - RNA, 22 nt, Homo sapiens
acugcccacaugggaccuggcc

SEQ ID NO: 1823000 - RNA, 17 nt, Homo sapiens
aaccagggcucuucuca

SEQ ID NO: 1823001 - RNA, 15 nt, Homo sapiens
gugugucaaugccac

SEQ ID NO: 1823002 - RNA, 14 nt, Homo sapiens
auugucugucucua

SEQ ID NO: 1823003 - RNA, 19 nt, Homo sapiens
agcccuuccucccauuucc

SEQ ID NO: 1823004 - RNA, 20 nt, Homo sapiens
ugaaaauauuuuguugccuu

SEQ ID NO: 1823005 - RNA, 17 nt, Homo sapiens
cucccagcuagacugua

SEQ ID NO: 1823006 - RNA, 22 nt, Homo sapiens
ugcacucuaaaagguucaggga

SEQ ID NO: 1823007 - RNA, 21 nt, Homo sapiens
uaaaauguauuuuucacaaag

SEQ ID NO: 1823008 - RNA, 20 nt, Homo sapiens
cauuggcccugacaaaaagg

SEQ ID NO: 1823009 - RNA, 14 nt, Homo sapiens
agucuucaagcaga

SEQ ID NO: 1823010 - RNA, 14 nt, Homo sapiens
ugucugugccaugg

SEQ ID NO: 1823011 - RNA, 19 nt, Homo sapiens
gguaaagggcgcaaagggc

SEQ ID NO: 1823012 - RNA, 19 nt, Homo sapiens
ccagaagcagcauccucca

SEQ ID NO: 1823013 - RNA, 14 nt, Homo sapiens
cucauuuugcaauu

SEQ ID NO: 1823014 - RNA, 21 nt, Homo sapiens
gcaaggagccccccaaagaca

SEQ ID NO: 1823015 - RNA, 19 nt, Homo sapiens
agaagugucguuuucauaa

SEQ ID NO: 1823016 - RNA, 16 nt, Homo sapiens
aaaaucauggaaagac

SEQ ID NO: 1823017 - RNA, 13 nt, Homo sapiens
aucaaaugugcau

SEQ ID NO: 1823018 - RNA, 20 nt, Homo sapiens
uguauagacucagugcacau

SEQ ID NO: 1823019 - RNA, 21 nt, Homo sapiens
cuugcaaagaccuaccuccag

SEQ ID NO: 1823020 - RNA, 18 nt, Homo sapiens
gcacagaagguugcuaua

SEQ ID NO: 1823021 - RNA, 16 nt, Homo sapiens
ugccccugcugcuuaa

SEQ ID NO: 1823022 - RNA, 12 nt, Homo sapiens
acuauacuugau

SEQ ID NO: 1823023 - RNA, 21 nt, Homo sapiens
cagguccguuuccuuacacau

SEQ ID NO: 1823024 - RNA, 16 nt, Homo sapiens
ccugccuugaugaagc

SEQ ID NO: 1823025 - RNA, 18 nt, Homo sapiens
ugaguauaaugaacacuc

SEQ ID NO: 1823026 - RNA, 13 nt, Homo sapiens
gagacuguuauca

SEQ ID NO: 1823027 - RNA, 13 nt, Homo sapiens
ucuaauguacaau

SEQ ID NO: 1823028 - RNA, 13 nt, Homo sapiens
uuaaauguauuau

SEQ ID NO: 1823029 - RNA, 13 nt, Homo sapiens
auuuauguuuauu

SEQ ID NO: 1823030 - RNA, 17 nt, Homo sapiens
gcgaccccucagugcuc

SEQ ID NO: 1823031 - RNA, 23 nt, Homo sapiens
cagaggcagcauuuuugcacugg

SEQ ID NO: 1823032 - RNA, 19 nt, Homo sapiens
agccagugacuccaggaga

SEQ ID NO: 1823033 - RNA, 17 nt, Homo sapiens
uucugcuaagagaucac

SEQ ID NO: 1823034 - RNA, 21 nt, Homo sapiens
cucugauguagcuuauacaaa

SEQ ID NO: 1823035 - RNA, 15 nt, Homo sapiens
auaaagaaguauuuc

SEQ ID NO: 1823036 - RNA, 18 nt, Homo sapiens
gagcuggggcugagggau

SEQ ID NO: 1823037 - RNA, 17 nt, Homo sapiens
cccagaaaaggacagaa

SEQ ID NO: 1823038 - RNA, 13 nt, Homo sapiens
auuugcauauuca

SEQ ID NO: 1823039 - RNA, 13 nt, Homo sapiens
ucaugcauucaca

SEQ ID NO: 1823040 - RNA, 13 nt, Homo sapiens
guguuccugugau

SEQ ID NO: 1823041 - RNA, 20 nt, Homo sapiens
ggacucugccuuuuuucaca

SEQ ID NO: 1823042 - RNA, 20 nt, Homo sapiens
ccucaacaacaaaccaaaac

SEQ ID NO: 1823043 - RNA, 19 nt, Homo sapiens
agugaagaauuuaucucuu

SEQ ID NO: 1823044 - RNA, 12 nt, Homo sapiens
gacuuaucaaca

SEQ ID NO: 1823045 - RNA, 18 nt, Homo sapiens
gauuuaguuuuguaacuu

SEQ ID NO: 1823046 - RNA, 21 nt, Homo sapiens
cugcccccguuccagcugaca

SEQ ID NO: 1823047 - RNA, 17 nt, Homo sapiens
gaccugacuuuuagcca

SEQ ID NO: 1823048 - RNA, 14 nt, Homo sapiens
aaauugccaagaaa

SEQ ID NO: 1823049 - RNA, 15 nt, Homo sapiens
cauucugccaaagua

SEQ ID NO: 1823050 - RNA, 17 nt, Homo sapiens
cacaccauucgucauca

SEQ ID NO: 1823051 - RNA, 14 nt, Homo sapiens
gaacuuuuguacug

SEQ ID NO: 1823052 - RNA, 13 nt, Homo sapiens
uggcccacugcau

SEQ ID NO: 1823053 - RNA, 20 nt, Homo sapiens
augauaauggaaagcagcag

SEQ ID NO: 1823054 - RNA, 13 nt, Homo sapiens
cagaucaccaccc

SEQ ID NO: 1823055 - RNA, 13 nt, Homo sapiens
gugaagaacaucc

SEQ ID NO: 1823056 - RNA, 16 nt, Homo sapiens
gaccagaaauucccuu

SEQ ID NO: 1823057 - RNA, 14 nt, Homo sapiens
gaggaggaggacag

SEQ ID NO: 1823058 - RNA, 19 nt, Homo sapiens
aacaguuagcauggcuuca

SEQ ID NO: 1823059 - RNA, 18 nt, Homo sapiens
gcaggucaaaaaggccaa

SEQ ID NO: 1823060 - RNA, 18 nt, Homo sapiens
aaaccuuggccucugcua

SEQ ID NO: 1823061 - RNA, 17 nt, Homo sapiens
gucaauaggcaaagggg

SEQ ID NO: 1823062 - RNA, 19 nt, Homo sapiens
aauuuucuacaguacauga

SEQ ID NO: 1823063 - RNA, 16 nt, Homo sapiens
guucauuauguaugaa

SEQ ID NO: 1823064 - RNA, 19 nt, Homo sapiens
gcacuuuuccccaauucau

SEQ ID NO: 1823065 - RNA, 15 nt, Homo sapiens
aguuucccuggugcc

SEQ ID NO: 1823066 - RNA, 13 nt, Homo sapiens
uuauuaugauuag

SEQ ID NO: 1823067 - RNA, 13 nt, Homo sapiens
aggccuugcuuuu

SEQ ID NO: 1823068 - RNA, 19 nt, Homo sapiens
uguuacagaggacauacca

SEQ ID NO: 1823069 - RNA, 20 nt, Homo sapiens
acaucugcuucaccaaggag

SEQ ID NO: 1823070 - RNA, 18 nt, Homo sapiens
cuagcccucucacauuua

SEQ ID NO: 1823071 - RNA, 17 nt, Homo sapiens
aucugcaugucuacuca

SEQ ID NO: 1823072 - RNA, 17 nt, Homo sapiens
cugugaacuauccccug

SEQ ID NO: 1823073 - RNA, 18 nt, Homo sapiens
cucucaagugaaagacuu

SEQ ID NO: 1823074 - RNA, 17 nt, Homo sapiens
aggcagcucgugugccu

SEQ ID NO: 1823075 - RNA, 23 nt, Homo sapiens
cuauuaagucaucaucuccaaac

SEQ ID NO: 1823076 - RNA, 17 nt, Homo sapiens
cauccagggguucauuu

SEQ ID NO: 1823077 - RNA, 22 nt, Homo sapiens
gcaguggcaucaucucagcuca

SEQ ID NO: 1823078 - RNA, 20 nt, Homo sapiens
aguaauucuucugccucagc

SEQ ID NO: 1823079 - RNA, 22 nt, Homo sapiens
ggaaagacguuuuugugcugug

SEQ ID NO: 1823080 - RNA, 19 nt, Homo sapiens
uccaagugaaugaguuucc

SEQ ID NO: 1823081 - RNA, 15 nt, Homo sapiens
gaugaaagugcuuca

SEQ ID NO: 1823082 - RNA, 15 nt, Homo sapiens
gaccugauccuggag

SEQ ID NO: 1823083 - RNA, 19 nt, Homo sapiens
uucacuagaguucuuugaa

SEQ ID NO: 1823084 - RNA, 19 nt, Homo sapiens
aaagccucuuuuaguccau

SEQ ID NO: 1823085 - RNA, 19 nt, Homo sapiens
aguuuuggaaacguauuca

SEQ ID NO: 1823086 - RNA, 21 nt, Homo sapiens
aaaucugugcuacacuggaua

SEQ ID NO: 1823087 - RNA, 13 nt, Homo sapiens
aucagaauaucac

SEQ ID NO: 1823088 - RNA, 22 nt, Homo sapiens
uuggaaaccuggaacacaaaac

SEQ ID NO: 1823089 - RNA, 19 nt, Homo sapiens
gcaguccgcagucuggccu

SEQ ID NO: 1823090 - RNA, 14 nt, Homo sapiens
auauuuuauuuccu

SEQ ID NO: 1823091 - RNA, 17 nt, Homo sapiens
caaggcaggugccucca

SEQ ID NO: 1823092 - RNA, 18 nt, Homo sapiens
aacugcgaggacaucaaa

SEQ ID NO: 1823093 - RNA, 20 nt, Homo sapiens
ggaugaugagggaagcaaua

SEQ ID NO: 1823094 - RNA, 16 nt, Homo sapiens
ucugguuuauaaucuc

SEQ ID NO: 1823095 - RNA, 12 nt, Homo sapiens
acuugaccaaua

SEQ ID NO: 1823096 - RNA, 14 nt, Homo sapiens
augggaccagggau

SEQ ID NO: 1823097 - RNA, 22 nt, Homo sapiens
gagacaacuucccaaagcacaa

SEQ ID NO: 1823098 - RNA, 18 nt, Homo sapiens
ugagaucuauauggagcu

SEQ ID NO: 1823099 - RNA, 14 nt, Homo sapiens
uaccuuuggaauug

SEQ ID NO: 1823100 - RNA, 15 nt, Homo sapiens
ugcaccacgggcuuu

SEQ ID NO: 1823101 - RNA, 19 nt, Homo sapiens
acuucuaaaauuacagaca

SEQ ID NO: 1823102 - RNA, 11 nt, Homo sapiens
uuaacugccaa

SEQ ID NO: 1823103 - RNA, 11 nt, Homo sapiens
cugacugcuag

SEQ ID NO: 1823104 - RNA, 14 nt, Homo sapiens
agcuaaaugugauc

SEQ ID NO: 1823105 - RNA, 16 nt, Homo sapiens
ugguuaaaauguaggc

SEQ ID NO: 1823106 - RNA, 21 nt, Homo sapiens
gcaccaucauuuaaugugaca

SEQ ID NO: 1823107 - RNA, 18 nt, Homo sapiens
caccucgcccuucagccc

SEQ ID NO: 1823108 - RNA, 15 nt, Homo sapiens
ucucacuccaggaca

SEQ ID NO: 1823109 - RNA, 17 nt, Homo sapiens
gaccugcauagcuacgu

SEQ ID NO: 1823110 - RNA, 20 nt, Homo sapiens
cacgaggcuuggaccugcug

SEQ ID NO: 1823111 - RNA, 14 nt, Homo sapiens
acugccuaagcccu

SEQ ID NO: 1823112 - RNA, 20 nt, Homo sapiens
gacaaaauuaauacauucua

SEQ ID NO: 1823113 - RNA, 18 nt, Homo sapiens
auaaaagaaaugcacaau

SEQ ID NO: 1823114 - RNA, 17 nt, Homo sapiens
acauggugaaacuccau

SEQ ID NO: 1823115 - RNA, 21 nt, Homo sapiens
aacugucagggaggucuuucc

SEQ ID NO: 1823116 - RNA, 18 nt, Homo sapiens
ggugccuaggauugugcc

SEQ ID NO: 1823117 - RNA, 15 nt, Homo sapiens
gaucaaauauuucaa

SEQ ID NO: 1823118 - RNA, 13 nt, Homo sapiens
gccagguccuugc

SEQ ID NO: 1823119 - RNA, 16 nt, Homo sapiens
cuuuuucauguaugua

SEQ ID NO: 1823120 - RNA, 19 nt, Homo sapiens
aauguccugauuacaaugc

SEQ ID NO: 1823121 - RNA, 16 nt, Homo sapiens
acgugcugcucaagga

SEQ ID NO: 1823122 - RNA, 20 nt, Homo sapiens
uggguggggcugcuccucca

SEQ ID NO: 1823123 - RNA, 14 nt, Homo sapiens
gagcugccauguca

SEQ ID NO: 1823124 - RNA, 16 nt, Homo sapiens
ucuguuuucuaccucc

SEQ ID NO: 1823125 - RNA, 15 nt, Homo sapiens
cucucaggccagcuc

SEQ ID NO: 1823126 - RNA, 23 nt, Homo sapiens
gugacagugacgugacucagagc

SEQ ID NO: 1823127 - RNA, 21 nt, Homo sapiens
ccaacugcaggaaugcugaca

SEQ ID NO: 1823128 - RNA, 17 nt, Homo sapiens
caguguuacaaggguau

SEQ ID NO: 1823129 - RNA, 15 nt, Homo sapiens
gaaauugugugugca

SEQ ID NO: 1823130 - RNA, 14 nt, Homo sapiens
ccuaucaagcacua

SEQ ID NO: 1823131 - RNA, 23 nt, Homo sapiens
auggcucuguuaugcaagcacaa

SEQ ID NO: 1823132 - RNA, 14 nt, Homo sapiens
ugucccaucugccc

SEQ ID NO: 1823133 - RNA, 15 nt, Homo sapiens
gcacuuuagaucacu

SEQ ID NO: 1823134 - RNA, 23 nt, Homo sapiens
ugaggaaguggcugucccugugg

SEQ ID NO: 1823135 - RNA, 21 nt, Homo sapiens
uaaaaaaauuagugaguauaa

SEQ ID NO: 1823136 - RNA, 17 nt, Homo sapiens
gcagagccaauggugca

SEQ ID NO: 1823137 - RNA, 20 nt, Homo sapiens
gcucauaagcaauaccagca

SEQ ID NO: 1823138 - RNA, 19 nt, Homo sapiens
uauaauaaagaaguguucu

SEQ ID NO: 1823139 - RNA, 23 nt, Homo sapiens
agaaaaccuaguacauuacuaaa

SEQ ID NO: 1823140 - RNA, 13 nt, Homo sapiens
cgucuacugcaag

SEQ ID NO: 1823141 - RNA, 19 nt, Homo sapiens
aucaguguauuagucauaa

SEQ ID NO: 1823142 - RNA, 16 nt, Homo sapiens
gcugugggcugcauac

SEQ ID NO: 1823143 - RNA, 17 nt, Homo sapiens
auacauaucuuuauuaa

SEQ ID NO: 1823144 - RNA, 18 nt, Homo sapiens
auugggcugacaccuacc

SEQ ID NO: 1823145 - RNA, 19 nt, Homo sapiens
uagucagaagcagguucuu

SEQ ID NO: 1823146 - RNA, 15 nt, Homo sapiens
uggauuuacugagag

SEQ ID NO: 1823147 - RNA, 12 nt, Homo sapiens
uucaaucaaagc

SEQ ID NO: 1823148 - RNA, 21 nt, Homo sapiens
acuuccaguguuggcugugug

SEQ ID NO: 1823149 - RNA, 20 nt, Homo sapiens
ccuuccccaaaggaugguca

SEQ ID NO: 1823150 - RNA, 14 nt, Homo sapiens
cuucagagagcagu

SEQ ID NO: 1823151 - RNA, 16 nt, Homo sapiens
augcucugcauguuac

SEQ ID NO: 1823152 - RNA, 15 nt, Homo sapiens
cuucugugugaccau

SEQ ID NO: 1823153 - RNA, 17 nt, Homo sapiens
cucaugucggucccuga

SEQ ID NO: 1823154 - RNA, 20 nt, Homo sapiens
uuucaaaagaagaguuuuag

SEQ ID NO: 1823155 - RNA, 16 nt, Homo sapiens
cugcucucccagguga

SEQ ID NO: 1823156 - RNA, 16 nt, Homo sapiens
agaacaaaaggcuuug

SEQ ID NO: 1823157 - RNA, 17 nt, Homo sapiens
acguuugacuagccauc

SEQ ID NO: 1823158 - RNA, 22 nt, Homo sapiens
auguuccuuuaagguacugaag

SEQ ID NO: 1823159 - RNA, 21 nt, Homo sapiens
uaaaaagaugacuuaagguga

SEQ ID NO: 1823160 - RNA, 17 nt, Homo sapiens
gggaccucacccuggag

SEQ ID NO: 1823161 - RNA, 20 nt, Homo sapiens
cuguccugacucucuccuga

SEQ ID NO: 1823162 - RNA, 20 nt, Homo sapiens
cucaaaaccucuuaaaucau

SEQ ID NO: 1823163 - RNA, 12 nt, Homo sapiens
accacaccagcc

SEQ ID NO: 1823164 - RNA, 15 nt, Homo sapiens
cauuuuuuguucugu

SEQ ID NO: 1823165 - RNA, 19 nt, Homo sapiens
caguuguuuguuuuugcuu

SEQ ID NO: 1823166 - RNA, 18 nt, Homo sapiens
auuuauugagcaucuagu

SEQ ID NO: 1823167 - RNA, 23 nt, Homo sapiens
uuaucccccgcaaagacaucaaa

SEQ ID NO: 1823168 - RNA, 13 nt, Homo sapiens
cauuuuugccagu

SEQ ID NO: 1823169 - RNA, 22 nt, Homo sapiens
ugaccagaaauggugagaugua

SEQ ID NO: 1823170 - RNA, 13 nt, Homo sapiens
uauauaagccagu

SEQ ID NO: 1823171 - RNA, 20 nt, Homo sapiens
ggucuuggccgacucaggga

SEQ ID NO: 1823172 - RNA, 16 nt, Homo sapiens
aggagaucgagaccau

SEQ ID NO: 1823173 - RNA, 23 nt, Homo sapiens
ucauauucacuauagaaugauau

SEQ ID NO: 1823174 - RNA, 14 nt, Homo sapiens
ggagacccaugugc

SEQ ID NO: 1823175 - RNA, 18 nt, Homo sapiens
gucuguuuggacugcaga

SEQ ID NO: 1823176 - RNA, 14 nt, Homo sapiens
caaaggaagcacau

SEQ ID NO: 1823177 - RNA, 17 nt, Homo sapiens
cugaguggugucugcuu

SEQ ID NO: 1823178 - RNA, 15 nt, Homo sapiens
cccagccacauuuca

SEQ ID NO: 1823179 - RNA, 17 nt, Homo sapiens
uuagguggggacagagg

SEQ ID NO: 1823180 - RNA, 11 nt, Homo sapiens
acucagcacug

SEQ ID NO: 1823181 - RNA, 15 nt, Homo sapiens
aagacauucuuccaa

SEQ ID NO: 1823182 - RNA, 16 nt, Homo sapiens
ccugucuaaaaauuca

SEQ ID NO: 1823183 - RNA, 21 nt, Homo sapiens
caguuugccugcuguauuuau

SEQ ID NO: 1823184 - RNA, 22 nt, Homo sapiens
cugagcaaacuauuugcgacuc

SEQ ID NO: 1823185 - RNA, 19 nt, Homo sapiens
gcuuacaaugugcacugaa

SEQ ID NO: 1823186 - RNA, 13 nt, Homo sapiens
uaguauuuaugaa

SEQ ID NO: 1823187 - RNA, 15 nt, Homo sapiens
accaauaggugcaaa

SEQ ID NO: 1823188 - RNA, 20 nt, Homo sapiens
acauagaaaguucauggaac

SEQ ID NO: 1823189 - RNA, 22 nt, Homo sapiens
cauuuuaucccauggaaccacu

SEQ ID NO: 1823190 - RNA, 16 nt, Homo sapiens
acccagacguggugcu

SEQ ID NO: 1823191 - RNA, 19 nt, Homo sapiens
ccagggggcccucugccuc

SEQ ID NO: 1823192 - RNA, 16 nt, Homo sapiens
cacuagacaagccaga

SEQ ID NO: 1823193 - RNA, 15 nt, Homo sapiens
auuuuguaacugccu

SEQ ID NO: 1823194 - RNA, 17 nt, Homo sapiens
ugcugauaccauaugaa

SEQ ID NO: 1823195 - RNA, 19 nt, Homo sapiens
cccccauagcagcagugca

SEQ ID NO: 1823196 - RNA, 18 nt, Homo sapiens
gucacagcggcagcagcu

SEQ ID NO: 1823197 - RNA, 17 nt, Homo sapiens
agagccgggaaggggaa

SEQ ID NO: 1823198 - RNA, 15 nt, Homo sapiens
gacaagauaccaagg

SEQ ID NO: 1823199 - RNA, 13 nt, Homo sapiens
ugaaaacacuguu

SEQ ID NO: 1823200 - RNA, 15 nt, Homo sapiens
uagacuuacuuuccu

SEQ ID NO: 1823201 - RNA, 14 nt, Homo sapiens
aguugaugacuguu

SEQ ID NO: 1823202 - RNA, 22 nt, Homo sapiens
cuugauuuugcccccugaggga

SEQ ID NO: 1823203 - RNA, 14 nt, Homo sapiens
uugcggaagccaua

SEQ ID NO: 1823204 - RNA, 15 nt, Homo sapiens
uguaauauuuagcug

SEQ ID NO: 1823205 - RNA, 13 nt, Homo sapiens
uaaaaaaacagac

SEQ ID NO: 1823206 - RNA, 17 nt, Homo sapiens
acugaaaaccagucuuc

SEQ ID NO: 1823207 - RNA, 16 nt, Homo sapiens
caaauaauuggcuuug

SEQ ID NO: 1823208 - RNA, 21 nt, Homo sapiens
caaauauuuuuugaguguaug

SEQ ID NO: 1823209 - RNA, 21 nt, Homo sapiens
ccccauagguggcugagcauc

SEQ ID NO: 1823210 - RNA, 13 nt, Homo sapiens
ucccacaucaggg

SEQ ID NO: 1823211 - RNA, 21 nt, Homo sapiens
ucacaaaugugaaguuaugca

SEQ ID NO: 1823212 - RNA, 21 nt, Homo sapiens
aaagaagguuggugaauuuca

SEQ ID NO: 1823213 - RNA, 17 nt, Homo sapiens
gaaauuauaucuguggu

SEQ ID NO: 1823214 - RNA, 23 nt, Homo sapiens
gugccuucagccaagaccaucuc

SEQ ID NO: 1823215 - RNA, 16 nt, Homo sapiens
augaucgucaucauca

SEQ ID NO: 1823216 - RNA, 17 nt, Homo sapiens
acaggcaguuucagaga

SEQ ID NO: 1823217 - RNA, 16 nt, Homo sapiens
gaaaggcucauuuaaa

SEQ ID NO: 1823218 - RNA, 16 nt, Homo sapiens
augugcuauagacauu

SEQ ID NO: 1823219 - RNA, 19 nt, Homo sapiens
cuaucacccaggaaucuca

SEQ ID NO: 1823220 - RNA, 23 nt, Homo sapiens
cacgccacaacuccaguguuccc

SEQ ID NO: 1823221 - RNA, 22 nt, Homo sapiens
ucgaauacgucagauuggacca

SEQ ID NO: 1823222 - RNA, 18 nt, Homo sapiens
gcagagucagcugcugac

SEQ ID NO: 1823223 - RNA, 14 nt, Homo sapiens
ugaccgacaugaac

SEQ ID NO: 1823224 - RNA, 21 nt, Homo sapiens
auucagaccacgacaacuaug

SEQ ID NO: 1823225 - RNA, 17 nt, Homo sapiens
ucccaccaggaaucucc

SEQ ID NO: 1823226 - RNA, 16 nt, Homo sapiens
agaaaauguguccuau

SEQ ID NO: 1823227 - RNA, 23 nt, Homo sapiens
auuagccacauguacacuacauu

SEQ ID NO: 1823228 - RNA, 20 nt, Homo sapiens
aacuauugcauuuauaugua

SEQ ID NO: 1823229 - RNA, 15 nt, Homo sapiens
cuugucccucuguau

SEQ ID NO: 1823230 - RNA, 17 nt, Homo sapiens
agggcauggccaggugg

SEQ ID NO: 1823231 - RNA, 21 nt, Homo sapiens
gcaucucccacacaagaccca

SEQ ID NO: 1823232 - RNA, 16 nt, Homo sapiens
auauugaggcauucaa

SEQ ID NO: 1823233 - RNA, 16 nt, Homo sapiens
uccccagcagggucuu

SEQ ID NO: 1823234 - RNA, 14 nt, Homo sapiens
ucacuucgaugacu

SEQ ID NO: 1823235 - RNA, 17 nt, Homo sapiens
cucagaauguuggcaaa

SEQ ID NO: 1823236 - RNA, 21 nt, Homo sapiens
aucugaaagcaauaagcucuu

SEQ ID NO: 1823237 - RNA, 12 nt, Homo sapiens
gcagcucaaaau

SEQ ID NO: 1823238 - RNA, 14 nt, Homo sapiens
ucgugcauuucaac

SEQ ID NO: 1823239 - RNA, 18 nt, Homo sapiens
ucccucauccuuucaggu

SEQ ID NO: 1823240 - RNA, 19 nt, Homo sapiens
guggcugaccaggcccugc

SEQ ID NO: 1823241 - RNA, 16 nt, Homo sapiens
aacuugcauugugauu

SEQ ID NO: 1823242 - RNA, 20 nt, Homo sapiens
cuaaugguauauauuguagg

SEQ ID NO: 1823243 - RNA, 16 nt, Homo sapiens
auagaucaaaugcccu

SEQ ID NO: 1823244 - RNA, 16 nt, Homo sapiens
cuggaccaagcacaaa

SEQ ID NO: 1823245 - RNA, 15 nt, Homo sapiens
acagagggcugcauu

SEQ ID NO: 1823246 - RNA, 13 nt, Homo sapiens
aagagcaauguuu

SEQ ID NO: 1823247 - RNA, 18 nt, Homo sapiens
gugugaugggaucuguaa

SEQ ID NO: 1823248 - RNA, 13 nt, Homo sapiens
aguagaagggaaa

SEQ ID NO: 1823249 - RNA, 16 nt, Homo sapiens
gauuaaugaccugaau

SEQ ID NO: 1823250 - RNA, 18 nt, Homo sapiens
uuuauaaggcugauguca

SEQ ID NO: 1823251 - RNA, 17 nt, Homo sapiens
ucauggcaccaaagcca

SEQ ID NO: 1823252 - RNA, 11 nt, Homo sapiens
ggaucaucucu

SEQ ID NO: 1823253 - RNA, 20 nt, Homo sapiens
augccaauaaaguuugccca

SEQ ID NO: 1823254 - RNA, 22 nt, Homo sapiens
cuacagggagaaaauccagguc

SEQ ID NO: 1823255 - RNA, 17 nt, Homo sapiens
agaugaaauucaagccu

SEQ ID NO: 1823256 - RNA, 17 nt, Homo sapiens
gcccagugcacugaaag

SEQ ID NO: 1823257 - RNA, 17 nt, Homo sapiens
cacccccacuucaugcc

SEQ ID NO: 1823258 - RNA, 14 nt, Homo sapiens
uguggucauccugc

SEQ ID NO: 1823259 - RNA, 12 nt, Homo sapiens
acugagcuguca

SEQ ID NO: 1823260 - RNA, 12 nt, Homo sapiens
uggcucagggau

SEQ ID NO: 1823261 - RNA, 19 nt, Homo sapiens
aacucuggauuuugaauua

SEQ ID NO: 1823262 - RNA, 13 nt, Homo sapiens
cuccuuugcuuag

SEQ ID NO: 1823263 - RNA, 13 nt, Homo sapiens
aauaguugaaccu

SEQ ID NO: 1823264 - RNA, 14 nt, Homo sapiens
auuuuccucuuguc

SEQ ID NO: 1823265 - RNA, 14 nt, Homo sapiens
aucguucucucuuu

SEQ ID NO: 1823266 - RNA, 14 nt, Homo sapiens
guaggaucaccuga

SEQ ID NO: 1823267 - RNA, 15 nt, Homo sapiens
aaauuaaaaccaauu

SEQ ID NO: 1823268 - RNA, 14 nt, Homo sapiens
agucucuguugcug

SEQ ID NO: 1823269 - RNA, 13 nt, Homo sapiens
ccaaugacuucca

SEQ ID NO: 1823270 - RNA, 19 nt, Homo sapiens
ccauaauccuuucugccga

SEQ ID NO: 1823271 - RNA, 23 nt, Homo sapiens
uccugauacuuucuguucuccag

SEQ ID NO: 1823272 - RNA, 22 nt, Homo sapiens
aacaugcugucuuagaucagga

SEQ ID NO: 1823273 - RNA, 17 nt, Homo sapiens
cccuauuuauugacuuu

SEQ ID NO: 1823274 - RNA, 21 nt, Homo sapiens
acaaugauacaguugcauguu

SEQ ID NO: 1823275 - RNA, 22 nt, Homo sapiens
cucacaguaacccaaaccucaa

SEQ ID NO: 1823276 - RNA, 15 nt, Homo sapiens
ugaaauaaagcacau

SEQ ID NO: 1823277 - RNA, 13 nt, Homo sapiens
ucaaucacuguau

SEQ ID NO: 1823278 - RNA, 13 nt, Homo sapiens
agugacacacaga

SEQ ID NO: 1823279 - RNA, 18 nt, Homo sapiens
ugauaagcaagaaagauu

SEQ ID NO: 1823280 - RNA, 22 nt, Homo sapiens
agguaugaauuaaaagucuaca

SEQ ID NO: 1823281 - RNA, 14 nt, Homo sapiens
auuguguagagugu

SEQ ID NO: 1823282 - RNA, 22 nt, Homo sapiens
aaacccuauacaaguuguucua

SEQ ID NO: 1823283 - RNA, 19 nt, Homo sapiens
ccaugccagacccacugaa

SEQ ID NO: 1823284 - RNA, 12 nt, Homo sapiens
uuauucugccuu

SEQ ID NO: 1823285 - RNA, 15 nt, Homo sapiens
aucccaguuacucag

SEQ ID NO: 1823286 - RNA, 13 nt, Homo sapiens
cccaucucuacaa

SEQ ID NO: 1823287 - RNA, 13 nt, Homo sapiens
aagaccaauguga

SEQ ID NO: 1823288 - RNA, 18 nt, Homo sapiens
ggcacucagggagcauuu

SEQ ID NO: 1823289 - RNA, 17 nt, Homo sapiens
ucugcaccacaccuggc

SEQ ID NO: 1823290 - RNA, 20 nt, Homo sapiens
cgaacuagagaugugcaauu

SEQ ID NO: 1823291 - RNA, 18 nt, Homo sapiens
uuauucauccagcagugu

SEQ ID NO: 1823292 - RNA, 16 nt, Homo sapiens
ucucccagcucagggc

SEQ ID NO: 1823293 - RNA, 14 nt, Homo sapiens
caggaagccaaaga

SEQ ID NO: 1823294 - RNA, 14 nt, Homo sapiens
ugaggagcuggaaa

SEQ ID NO: 1823295 - RNA, 16 nt, Homo sapiens
uggcuguuucuguaua

SEQ ID NO: 1823296 - RNA, 14 nt, Homo sapiens
aucaucaacacaau

SEQ ID NO: 1823297 - RNA, 15 nt, Homo sapiens
uauaaacuaccaaau

SEQ ID NO: 1823298 - RNA, 22 nt, Homo sapiens
acccgugucuagaggcagguag

SEQ ID NO: 1823299 - RNA, 20 nt, Homo sapiens
caacaaugguugaaugaaua

SEQ ID NO: 1823300 - RNA, 15 nt, Homo sapiens
agaucuguuaccaau

SEQ ID NO: 1823301 - RNA, 17 nt, Homo sapiens
cagaaucuguuaccaga

SEQ ID NO: 1823302 - RNA, 12 nt, Homo sapiens
cugcauaugaua

SEQ ID NO: 1823303 - RNA, 20 nt, Homo sapiens
agugagggccugaggucugg

SEQ ID NO: 1823304 - RNA, 11 nt, Homo sapiens
gaagggccaga

SEQ ID NO: 1823305 - RNA, 15 nt, Homo sapiens
gaaaaggaaaacaau

SEQ ID NO: 1823306 - RNA, 21 nt, Homo sapiens
uucaaccuguccuuucaggga

SEQ ID NO: 1823307 - RNA, 15 nt, Homo sapiens
gaggugaaugcacag

SEQ ID NO: 1823308 - RNA, 22 nt, Homo sapiens
uaguucaauauuuguuacuguu

SEQ ID NO: 1823309 - RNA, 17 nt, Homo sapiens
aagaagcccagugguga

SEQ ID NO: 1823310 - RNA, 15 nt, Homo sapiens
ucuguucuuccauca

SEQ ID NO: 1823311 - RNA, 17 nt, Homo sapiens
cuucaaagcaaagcucu

SEQ ID NO: 1823312 - RNA, 19 nt, Homo sapiens
gguuugccaugcuggccag

SEQ ID NO: 1823313 - RNA, 21 nt, Homo sapiens
ccccaccuuugggaucagccu

SEQ ID NO: 1823314 - RNA, 13 nt, Homo sapiens
acuuugcacuuaa

SEQ ID NO: 1823315 - RNA, 21 nt, Homo sapiens
ccacccccucccccaucauau

SEQ ID NO: 1823316 - RNA, 14 nt, Homo sapiens
aagagcugugggca

SEQ ID NO: 1823317 - RNA, 15 nt, Homo sapiens
aagcagaagcacaua

SEQ ID NO: 1823318 - RNA, 21 nt, Homo sapiens
gugagcacacccgugugcaca

SEQ ID NO: 1823319 - RNA, 19 nt, Homo sapiens
accucccagagagugaaua

SEQ ID NO: 1823320 - RNA, 19 nt, Homo sapiens
aucacuaagggauggggca

SEQ ID NO: 1823321 - RNA, 15 nt, Homo sapiens
cagccuccaccuccu

SEQ ID NO: 1823322 - RNA, 15 nt, Homo sapiens
aauuugcacuuucag

SEQ ID NO: 1823323 - RNA, 22 nt, Homo sapiens
cacuugugggccccccuugccu

SEQ ID NO: 1823324 - RNA, 14 nt, Homo sapiens
agugugaauacugc

SEQ ID NO: 1823325 - RNA, 14 nt, Homo sapiens
ugugucaaaacugg

SEQ ID NO: 1823326 - RNA, 17 nt, Homo sapiens
uuccuuuccccuucccu

SEQ ID NO: 1823327 - RNA, 19 nt, Homo sapiens
augcaggucagcccaugga

SEQ ID NO: 1823328 - RNA, 22 nt, Homo sapiens
guugucuuuuaaaaagugugcu

SEQ ID NO: 1823329 - RNA, 15 nt, Homo sapiens
caggccucagccuca

SEQ ID NO: 1823330 - RNA, 16 nt, Homo sapiens
aggggcccuaccuggg

SEQ ID NO: 1823331 - RNA, 19 nt, Homo sapiens
cuguagcuucucuugcucu

SEQ ID NO: 1823332 - RNA, 19 nt, Homo sapiens
auaaauaaacuguugcucg

SEQ ID NO: 1823333 - RNA, 21 nt, Homo sapiens
accuagaccaguuugcaugau

SEQ ID NO: 1823334 - RNA, 23 nt, Homo sapiens
auauuuguccaacaacugucaga

SEQ ID NO: 1823335 - RNA, 21 nt, Homo sapiens
uacuuauuguuuaagguuucc

SEQ ID NO: 1823336 - RNA, 20 nt, Homo sapiens
aaaagggcagggcaucuccu

SEQ ID NO: 1823337 - RNA, 15 nt, Homo sapiens
ucuucauuaccucag

SEQ ID NO: 1823338 - RNA, 15 nt, Homo sapiens
uguggggaggcugca

SEQ ID NO: 1823339 - RNA, 18 nt, Homo sapiens
caccuuaauaugcugcaa

SEQ ID NO: 1823340 - RNA, 12 nt, Homo sapiens
aagcagugcagu

SEQ ID NO: 1823341 - RNA, 19 nt, Homo sapiens
cugguucccaccauucccu

SEQ ID NO: 1823342 - RNA, 15 nt, Homo sapiens
cucugcauucuagua

SEQ ID NO: 1823343 - RNA, 23 nt, Homo sapiens
uagccagccggggcgaguggcac

SEQ ID NO: 1823344 - RNA, 13 nt, Homo sapiens
aaugcuacuuuau

SEQ ID NO: 1823345 - RNA, 12 nt, Homo sapiens
uuuaaggcagca

SEQ ID NO: 1823346 - RNA, 11 nt, Homo sapiens
augcuuaccuu

SEQ ID NO: 1823347 - RNA, 17 nt, Homo sapiens
auguaaucaacauucca

SEQ ID NO: 1823348 - RNA, 18 nt, Homo sapiens
ugucuuauuacagcauuu

SEQ ID NO: 1823349 - RNA, 19 nt, Homo sapiens
acaaaccugggcaaugugg

SEQ ID NO: 1823350 - RNA, 17 nt, Homo sapiens
cucuuuaaauggcuuua

SEQ ID NO: 1823351 - RNA, 17 nt, Homo sapiens
uguagucaggugcucaa

SEQ ID NO: 1823352 - RNA, 13 nt, Homo sapiens
cagagagaaaaag

SEQ ID NO: 1823353 - RNA, 17 nt, Homo sapiens
cuugaauguaguauuca

SEQ ID NO: 1823354 - RNA, 21 nt, Homo sapiens
gaaguagcucuggugaccuug

SEQ ID NO: 1823355 - RNA, 19 nt, Homo sapiens
cucgggaggcugaggcaca

SEQ ID NO: 1823356 - RNA, 19 nt, Homo sapiens
guauuuuuucuaaugugca

SEQ ID NO: 1823357 - RNA, 20 nt, Homo sapiens
uugaauacuugaaccauaaa

SEQ ID NO: 1823358 - RNA, 17 nt, Homo sapiens
caguuauagaaaaucua

SEQ ID NO: 1823359 - RNA, 21 nt, Homo sapiens
ucugcuucucuuucacaacuu

SEQ ID NO: 1823360 - RNA, 21 nt, Homo sapiens
ugucagaaacacugaagccau

SEQ ID NO: 1823361 - RNA, 15 nt, Homo sapiens
agcagucccugcuua

SEQ ID NO: 1823362 - RNA, 17 nt, Homo sapiens
ggcagauguggcugaac

SEQ ID NO: 1823363 - RNA, 18 nt, Homo sapiens
cagagaagccccuaggca

SEQ ID NO: 1823364 - RNA, 22 nt, Homo sapiens
cgagcauaagaaauaaaaucua

SEQ ID NO: 1823365 - RNA, 20 nt, Homo sapiens
ucccuccagaauggaacuca

SEQ ID NO: 1823366 - RNA, 18 nt, Homo sapiens
ugcauuucaccugugaca

SEQ ID NO: 1823367 - RNA, 22 nt, Homo sapiens
uggccacaccugggucuuuaug

SEQ ID NO: 1823368 - RNA, 11 nt, Homo sapiens
uuugcuuuaau

SEQ ID NO: 1823369 - RNA, 21 nt, Homo sapiens
caauagcaugcaaaaaaugcu

SEQ ID NO: 1823370 - RNA, 13 nt, Homo sapiens
acagugucugugu

SEQ ID NO: 1823371 - RNA, 15 nt, Homo sapiens
aaaacuugaaaugag

SEQ ID NO: 1823372 - RNA, 15 nt, Homo sapiens
uggauugucaaagag

SEQ ID NO: 1823373 - RNA, 16 nt, Homo sapiens
agucugucuacugugg

SEQ ID NO: 1823374 - RNA, 17 nt, Homo sapiens
gcaguggcgugaucuca

SEQ ID NO: 1823375 - RNA, 23 nt, Homo sapiens
aggugcucauuguaaccauuucu

SEQ ID NO: 1823376 - RNA, 19 nt, Homo sapiens
ccugggcgagacacagcua

SEQ ID NO: 1823377 - RNA, 19 nt, Homo sapiens
ccaagggggugacuggaag

SEQ ID NO: 1823378 - RNA, 18 nt, Homo sapiens
acuugaaagcauccaugu

SEQ ID NO: 1823379 - RNA, 16 nt, Homo sapiens
guagcucucccuaggc

SEQ ID NO: 1823380 - RNA, 21 nt, Homo sapiens
cuuucauccacuagugcaaau

SEQ ID NO: 1823381 - RNA, 20 nt, Homo sapiens
auuugccuuucugggagcag

SEQ ID NO: 1823382 - RNA, 17 nt, Homo sapiens
uucccagaaucucugag

SEQ ID NO: 1823383 - RNA, 17 nt, Homo sapiens
uaacuauggaauuuuga

SEQ ID NO: 1823384 - RNA, 17 nt, Homo sapiens
aucaagguacaggaaaa

SEQ ID NO: 1823385 - RNA, 18 nt, Homo sapiens
uguugauaaaccauaaau

SEQ ID NO: 1823386 - RNA, 15 nt, Homo sapiens
ggcagcggguggcau

SEQ ID NO: 1823387 - RNA, 22 nt, Homo sapiens
ugaccaggcauccuccacaaua

SEQ ID NO: 1823388 - RNA, 20 nt, Homo sapiens
gaaagaugguagggagcauu

SEQ ID NO: 1823389 - RNA, 22 nt, Homo sapiens
uuucccuuugccuucauucugc

SEQ ID NO: 1823390 - RNA, 14 nt, Homo sapiens
gaaaaacaucugaa

SEQ ID NO: 1823391 - RNA, 14 nt, Homo sapiens
caugguggggccaa

SEQ ID NO: 1823392 - RNA, 16 nt, Homo sapiens
uuuauuaccgauaaau

SEQ ID NO: 1823393 - RNA, 19 nt, Homo sapiens
uuacauuuuaaacacauua

SEQ ID NO: 1823394 - RNA, 15 nt, Homo sapiens
uuucucagcauauau

SEQ ID NO: 1823395 - RNA, 23 nt, Homo sapiens
gcucaggccaguaaucccaguga

SEQ ID NO: 1823396 - RNA, 14 nt, Homo sapiens
ucauaaccauuccc

SEQ ID NO: 1823397 - RNA, 16 nt, Homo sapiens
uggaauauugugauuc

SEQ ID NO: 1823398 - RNA, 20 nt, Homo sapiens
auuacccccuuuccucuugg

SEQ ID NO: 1823399 - RNA, 17 nt, Homo sapiens
uuuuggggcucuugauc

SEQ ID NO: 1823400 - RNA, 22 nt, Homo sapiens
agaaacuuguaauggucucuga

SEQ ID NO: 1823401 - RNA, 21 nt, Homo sapiens
cagcaggcuuuuguguucucu

SEQ ID NO: 1823402 - RNA, 19 nt, Homo sapiens
aucugucucggcucugcau

SEQ ID NO: 1823403 - RNA, 15 nt, Homo sapiens
ugucagcaaguccua

SEQ ID NO: 1823404 - RNA, 21 nt, Homo sapiens
guaaaucauucuacuuuugca

SEQ ID NO: 1823405 - RNA, 16 nt, Homo sapiens
ggccaugcuucuugcc

SEQ ID NO: 1823406 - RNA, 21 nt, Homo sapiens
aaacauuaaaagaagacugga

SEQ ID NO: 1823407 - RNA, 16 nt, Homo sapiens
augagccucuccuugc

SEQ ID NO: 1823408 - RNA, 19 nt, Homo sapiens
agagccagcagcaaaaacu

SEQ ID NO: 1823409 - RNA, 17 nt, Homo sapiens
aucauggcucacugcag

SEQ ID NO: 1823410 - RNA, 15 nt, Homo sapiens
cuuuuccacuuuaaa

SEQ ID NO: 1823411 - RNA, 21 nt, Homo sapiens
aggucuuauucuugugcacuu

SEQ ID NO: 1823412 - RNA, 15 nt, Homo sapiens
uaaaugucccaaaua

SEQ ID NO: 1823413 - RNA, 20 nt, Homo sapiens
ccaaccccaguggauucuca

SEQ ID NO: 1823414 - RNA, 20 nt, Homo sapiens
cagguuuucuguuucugugu

SEQ ID NO: 1823415 - RNA, 22 nt, Homo sapiens
auucaauuacggacucuggaua

SEQ ID NO: 1823416 - RNA, 18 nt, Homo sapiens
uuguaagguggucacugu

SEQ ID NO: 1823417 - RNA, 18 nt, Homo sapiens
agggaggagggcuuugaa

SEQ ID NO: 1823418 - RNA, 15 nt, Homo sapiens
caucuguaggucacu

SEQ ID NO: 1823419 - RNA, 19 nt, Homo sapiens
cccgguacaaguggcucau

SEQ ID NO: 1823420 - RNA, 13 nt, Homo sapiens
ugccacugcacac

SEQ ID NO: 1823421 - RNA, 23 nt, Homo sapiens
ucggacucuuccagguucacuga

SEQ ID NO: 1823422 - RNA, 13 nt, Homo sapiens
uccuaacugagaa

SEQ ID NO: 1823423 - RNA, 21 nt, Homo sapiens
agucaaccuuguuucuacugu

SEQ ID NO: 1823424 - RNA, 12 nt, Homo sapiens
ccaccacuugau

SEQ ID NO: 1823425 - RNA, 19 nt, Homo sapiens
uguguuuuaaaaaaacuga

SEQ ID NO: 1823426 - RNA, 22 nt, Homo sapiens
uugcauuaaaaaugcauauacu

SEQ ID NO: 1823427 - RNA, 15 nt, Homo sapiens
agcuccagccugaca

SEQ ID NO: 1823428 - RNA, 14 nt, Homo sapiens
ccaggagccucacu

SEQ ID NO: 1823429 - RNA, 19 nt, Homo sapiens
ccuaacaggauuagacagu

SEQ ID NO: 1823430 - RNA, 19 nt, Homo sapiens
uucuaaggguuuucuuuga

SEQ ID NO: 1823431 - RNA, 18 nt, Homo sapiens
aggugccccucucuccau

SEQ ID NO: 1823432 - RNA, 16 nt, Homo sapiens
guagccuggucugugc

SEQ ID NO: 1823433 - RNA, 13 nt, Homo sapiens
gacaaaugcaaca

SEQ ID NO: 1823434 - RNA, 16 nt, Homo sapiens
ugccuuuaaaguauga

SEQ ID NO: 1823435 - RNA, 20 nt, Homo sapiens
caaugaaucaaugugcuccu

SEQ ID NO: 1823436 - RNA, 19 nt, Homo sapiens
auucuucuucuuuuaugua

SEQ ID NO: 1823437 - RNA, 22 nt, Homo sapiens
cugcaaucccagcuacuuggaa

SEQ ID NO: 1823438 - RNA, 15 nt, Homo sapiens
gcaauguuccaggaa

SEQ ID NO: 1823439 - RNA, 14 nt, Homo sapiens
caacaagccucaaa

SEQ ID NO: 1823440 - RNA, 16 nt, Homo sapiens
gacugcaaucaugugc

SEQ ID NO: 1823441 - RNA, 19 nt, Homo sapiens
guauacugugugggauacu

SEQ ID NO: 1823442 - RNA, 13 nt, Homo sapiens
caguggcuccuau

SEQ ID NO: 1823443 - RNA, 16 nt, Homo sapiens
cuugccugaauccauc

SEQ ID NO: 1823444 - RNA, 13 nt, Homo sapiens
aaucuaaacauaa

SEQ ID NO: 1823445 - RNA, 18 nt, Homo sapiens
cacauucccaucugucac

SEQ ID NO: 1823446 - RNA, 13 nt, Homo sapiens
gagaccccaggaa

SEQ ID NO: 1823447 - RNA, 13 nt, Homo sapiens
agagagaccccac

SEQ ID NO: 1823448 - RNA, 19 nt, Homo sapiens
cauuuccauggugcaaaaa

SEQ ID NO: 1823449 - RNA, 21 nt, Homo sapiens
uguuuuguaagugcugcuaua

SEQ ID NO: 1823450 - RNA, 17 nt, Homo sapiens
ucaugguguucaugaca

SEQ ID NO: 1823451 - RNA, 21 nt, Homo sapiens
gccucuggagggggcagaaga

SEQ ID NO: 1823452 - RNA, 21 nt, Homo sapiens
caaugaucuagguuuaacuca

SEQ ID NO: 1823453 - RNA, 18 nt, Homo sapiens
gcacugaacuuugcaaag

SEQ ID NO: 1823454 - RNA, 17 nt, Homo sapiens
auuucagugcugcugaa

SEQ ID NO: 1823455 - RNA, 19 nt, Homo sapiens
uuuggggagcaggaggcca

SEQ ID NO: 1823456 - RNA, 16 nt, Homo sapiens
acguggagagggauga

SEQ ID NO: 1823457 - RNA, 21 nt, Homo sapiens
cagaggaugcugaaguacagu

SEQ ID NO: 1823458 - RNA, 17 nt, Homo sapiens
ccagggcacaaccagaa

SEQ ID NO: 1823459 - RNA, 15 nt, Homo sapiens
gauugcacagaauuu

SEQ ID NO: 1823460 - RNA, 16 nt, Homo sapiens
gucggcacgucccaug

SEQ ID NO: 1823461 - RNA, 15 nt, Homo sapiens
caggagaugcugcag

SEQ ID NO: 1823462 - RNA, 14 nt, Homo sapiens
gcagggccugagga

SEQ ID NO: 1823463 - RNA, 23 nt, Homo sapiens
uacacguaaaucuguucaaggaa

SEQ ID NO: 1823464 - RNA, 22 nt, Homo sapiens
uuaggcaauggugaacugucau

SEQ ID NO: 1823465 - RNA, 14 nt, Homo sapiens
aggagaaagagccu

SEQ ID NO: 1823466 - RNA, 16 nt, Homo sapiens
gugggugugaagggau

SEQ ID NO: 1823467 - RNA, 17 nt, Homo sapiens
caugugccaucucuaca

SEQ ID NO: 1823468 - RNA, 17 nt, Homo sapiens
agggccuagaaacucac

SEQ ID NO: 1823469 - RNA, 22 nt, Homo sapiens
ucucuuuugagcuaaucuucau

SEQ ID NO: 1823470 - RNA, 14 nt, Homo sapiens
acuaugauggacca

SEQ ID NO: 1823471 - RNA, 19 nt, Homo sapiens
aggaaacuguacuacaucu

SEQ ID NO: 1823472 - RNA, 18 nt, Homo sapiens
caaaacagagaugugaua

SEQ ID NO: 1823473 - RNA, 18 nt, Homo sapiens
ugcaggcaugcaugugcu

SEQ ID NO: 1823474 - RNA, 18 nt, Homo sapiens
gucugugugugugugugc

SEQ ID NO: 1823475 - RNA, 13 nt, Homo sapiens
uccccucccagau

SEQ ID NO: 1823476 - RNA, 17 nt, Homo sapiens
caaggugacauuuccau

SEQ ID NO: 1823477 - RNA, 14 nt, Homo sapiens
aaagaauccauaaa

SEQ ID NO: 1823478 - RNA, 19 nt, Homo sapiens
uacauucuaaaucacuuua

SEQ ID NO: 1823479 - RNA, 15 nt, Homo sapiens
ggagcuugauccaga

SEQ ID NO: 1823480 - RNA, 16 nt, Homo sapiens
cuucauucuaaaccaa

SEQ ID NO: 1823481 - RNA, 13 nt, Homo sapiens
ggauuacaggugc

SEQ ID NO: 1823482 - RNA, 15 nt, Homo sapiens
agggcaggccuguuc

SEQ ID NO: 1823483 - RNA, 17 nt, Homo sapiens
uaguguucuuugcauuu

SEQ ID NO: 1823484 - RNA, 19 nt, Homo sapiens
ugacagauauuuuaucuau

SEQ ID NO: 1823485 - RNA, 16 nt, Homo sapiens
ugcaggccccagccaa

SEQ ID NO: 1823486 - RNA, 10 nt, Homo sapiens
uuggcuugac

SEQ ID NO: 1823487 - RNA, 22 nt, Homo sapiens
ucccuguucuggacauuucaua

SEQ ID NO: 1823488 - RNA, 17 nt, Homo sapiens
ggagcagggacagauca

SEQ ID NO: 1823489 - RNA, 22 nt, Homo sapiens
acaauucguuuuuucauuugaa

SEQ ID NO: 1823490 - RNA, 16 nt, Homo sapiens
gcaugcccaccuguug

SEQ ID NO: 1823491 - RNA, 13 nt, Homo sapiens
cuccucacugcca

SEQ ID NO: 1823492 - RNA, 15 nt, Homo sapiens
caguaaauauacacu

SEQ ID NO: 1823493 - RNA, 21 nt, Homo sapiens
auuccuugaggacagaccuua

SEQ ID NO: 1823494 - RNA, 21 nt, Homo sapiens
gccccaauaccccauggacca

SEQ ID NO: 1823495 - RNA, 21 nt, Homo sapiens
uugaaccagugauccaugucc

SEQ ID NO: 1823496 - RNA, 15 nt, Homo sapiens
aggaaucugccuucc

SEQ ID NO: 1823497 - RNA, 22 nt, Homo sapiens
gguagaaggggaggacacuggu

SEQ ID NO: 1823498 - RNA, 16 nt, Homo sapiens
aaccauccucucccuu

SEQ ID NO: 1823499 - RNA, 20 nt, Homo sapiens
ccucccuguuccccagagaa

SEQ ID NO: 1823500 - RNA, 23 nt, Homo sapiens
ugagauuugggcaggaacacaga

SEQ ID NO: 1823501 - RNA, 11 nt, Homo sapiens
agugcugugcu

SEQ ID NO: 1823502 - RNA, 21 nt, Homo sapiens
aaaacuuaauaaaaauuauua

SEQ ID NO: 1823503 - RNA, 14 nt, Homo sapiens
ggaguguucccgug

SEQ ID NO: 1823504 - RNA, 20 nt, Homo sapiens
uucuuaaguaaugauacugu

SEQ ID NO: 1823505 - RNA, 21 nt, Homo sapiens
cuuacacuacauuagaacacu

SEQ ID NO: 1823506 - RNA, 22 nt, Homo sapiens
aggaaauguugacuggccaaaa

SEQ ID NO: 1823507 - RNA, 21 nt, Homo sapiens
ucaggacccagggaaugccag

SEQ ID NO: 1823508 - RNA, 21 nt, Homo sapiens
uuuccucuggggcauuaucca

SEQ ID NO: 1823509 - RNA, 20 nt, Homo sapiens
aggccgggcgcaguggcuca

SEQ ID NO: 1823510 - RNA, 16 nt, Homo sapiens
uuuauaaaugauauca

SEQ ID NO: 1823511 - RNA, 23 nt, Homo sapiens
accauaugcacaauuccaugaau

SEQ ID NO: 1823512 - RNA, 14 nt, Homo sapiens
uucagguauaccuc

SEQ ID NO: 1823513 - RNA, 15 nt, Homo sapiens
ucccuuucacuaaaa

SEQ ID NO: 1823514 - RNA, 16 nt, Homo sapiens
caccugacugcaauga

SEQ ID NO: 1823515 - RNA, 12 nt, Homo sapiens
auacaguauuau

SEQ ID NO: 1823516 - RNA, 14 nt, Homo sapiens
aggcaguucuagaa

SEQ ID NO: 1823517 - RNA, 21 nt, Homo sapiens
acuaucuucacaaguguguaa

SEQ ID NO: 1823518 - RNA, 22 nt, Homo sapiens
uaauguuguaauucaugccagg

SEQ ID NO: 1823519 - RNA, 13 nt, Homo sapiens
aauguagucaaua

SEQ ID NO: 1823520 - RNA, 14 nt, Homo sapiens
aagauaaucucuca

SEQ ID NO: 1823521 - RNA, 14 nt, Homo sapiens
cacuauaucuguau

SEQ ID NO: 1823522 - RNA, 19 nt, Homo sapiens
agagggcuagcccugagcc

SEQ ID NO: 1823523 - RNA, 18 nt, Homo sapiens
ugagagcaaagugaccug

SEQ ID NO: 1823524 - RNA, 23 nt, Homo sapiens
cagauuccccccaucuccauugc

SEQ ID NO: 1823525 - RNA, 23 nt, Homo sapiens
cauuucucauaccuuccccacau

SEQ ID NO: 1823526 - RNA, 19 nt, Homo sapiens
guguucauccagcuacuua

SEQ ID NO: 1823527 - RNA, 18 nt, Homo sapiens
uacaaaguagagaaguau

SEQ ID NO: 1823528 - RNA, 16 nt, Homo sapiens
cuugcccagcuuucaa

SEQ ID NO: 1823529 - RNA, 17 nt, Homo sapiens
cuguauauagcucuaca

SEQ ID NO: 1823530 - RNA, 12 nt, Homo sapiens
uauacacauaca

SEQ ID NO: 1823531 - RNA, 22 nt, Homo sapiens
cagcaguggacucaaaacccau

SEQ ID NO: 1823532 - RNA, 15 nt, Homo sapiens
guuauagcugcauuu

SEQ ID NO: 1823533 - RNA, 21 nt, Homo sapiens
cgccaaggcuggagugcagug

SEQ ID NO: 1823534 - RNA, 22 nt, Homo sapiens
cuugcauaauuauauacuccuu

SEQ ID NO: 1823535 - RNA, 17 nt, Homo sapiens
cauugacccauagcaca

SEQ ID NO: 1823536 - RNA, 17 nt, Homo sapiens
aaaagcaaaaaugacaa

SEQ ID NO: 1823537 - RNA, 14 nt, Homo sapiens
ccauaaacauuugc

SEQ ID NO: 1823538 - RNA, 18 nt, Homo sapiens
guggcuuuuuaacaugaa

SEQ ID NO: 1823539 - RNA, 19 nt, Homo sapiens
uauauuaugguguaaugca

SEQ ID NO: 1823540 - RNA, 16 nt, Homo sapiens
cuuguauagcaguuuc

SEQ ID NO: 1823541 - RNA, 21 nt, Homo sapiens
aaauuuuuacaaaacugccaa

SEQ ID NO: 1823542 - RNA, 19 nt, Homo sapiens
cccugugagcaaaaaugcc

SEQ ID NO: 1823543 - RNA, 16 nt, Homo sapiens
uaucaguugacagugu

SEQ ID NO: 1823544 - RNA, 17 nt, Homo sapiens
ugggagaggagguccuu

SEQ ID NO: 1823545 - RNA, 20 nt, Homo sapiens
cuccuuucccuuuuccauca

SEQ ID NO: 1823546 - RNA, 20 nt, Homo sapiens
aauagcucuacugcccuccc

SEQ ID NO: 1823547 - RNA, 15 nt, Homo sapiens
uaagcacuguggauc

SEQ ID NO: 1823548 - RNA, 14 nt, Homo sapiens
uacacacagcagua

SEQ ID NO: 1823549 - RNA, 15 nt, Homo sapiens
cggagugccuggagu

SEQ ID NO: 1823550 - RNA, 17 nt, Homo sapiens
cauaggaugguaccaag

SEQ ID NO: 1823551 - RNA, 17 nt, Homo sapiens
acaagagcaaaacucag

SEQ ID NO: 1823552 - RNA, 21 nt, Homo sapiens
gccaugacuugagaaacaaau

SEQ ID NO: 1823553 - RNA, 18 nt, Homo sapiens
uacuugaaaacuucucau

SEQ ID NO: 1823554 - RNA, 15 nt, Homo sapiens
augauacacuaugaa

SEQ ID NO: 1823555 - RNA, 24 nt, Homo sapiens
gccacugcgcccagcuauacugua

SEQ ID NO: 1823556 - RNA, 23 nt, Homo sapiens
uucuaaacuaaaggaaacaaagc

SEQ ID NO: 1823557 - RNA, 20 nt, Homo sapiens
caccucccugcucagugcuu

SEQ ID NO: 1823558 - RNA, 15 nt, Homo sapiens
aggucucaugaccag

SEQ ID NO: 1823559 - RNA, 14 nt, Homo sapiens
aguaauagggcccu

SEQ ID NO: 1823560 - RNA, 14 nt, Homo sapiens
ccucuccuucccac

SEQ ID NO: 1823561 - RNA, 18 nt, Homo sapiens
cagugucuggcacuuggg

SEQ ID NO: 1823562 - RNA, 15 nt, Homo sapiens
uagagguccucaugg

SEQ ID NO: 1823563 - RNA, 13 nt, Homo sapiens
gauacaaauaagg

SEQ ID NO: 1823564 - RNA, 14 nt, Homo sapiens
cuugguguuuguga

SEQ ID NO: 1823565 - RNA, 16 nt, Homo sapiens
gccaugauggccuuac

SEQ ID NO: 1823566 - RNA, 14 nt, Homo sapiens
cauuugaaugcuua

SEQ ID NO: 1823567 - RNA, 20 nt, Homo sapiens
ccucucgcuccucaaccccu

SEQ ID NO: 1823568 - RNA, 17 nt, Homo sapiens
acuuugaaacuaucuca

SEQ ID NO: 1823569 - RNA, 22 nt, Homo sapiens
cugauuccagcacaaccuucaa

SEQ ID NO: 1823570 - RNA, 18 nt, Homo sapiens
uucuugcuacccaugacu

SEQ ID NO: 1823571 - RNA, 10 nt, Homo sapiens
cugugccugg

SEQ ID NO: 1823572 - RNA, 15 nt, Homo sapiens
gaauugcaugccauc

SEQ ID NO: 1823573 - RNA, 18 nt, Homo sapiens
uacuugaauacucucaca

SEQ ID NO: 1823574 - RNA, 16 nt, Homo sapiens
uaaagaaauaaucucu

SEQ ID NO: 1823575 - RNA, 17 nt, Homo sapiens
gucugaagcccaaagcc

SEQ ID NO: 1823576 - RNA, 17 nt, Homo sapiens
acccuaauaagacccca

SEQ ID NO: 1823577 - RNA, 16 nt, Homo sapiens
guugcccuaucgugau

SEQ ID NO: 1823578 - RNA, 16 nt, Homo sapiens
ccgaccucaggugauc

SEQ ID NO: 1823579 - RNA, 13 nt, Homo sapiens
caaauagcaaaga

SEQ ID NO: 1823580 - RNA, 17 nt, Homo sapiens
cacuuaguagagugauu

SEQ ID NO: 1823581 - RNA, 23 nt, Homo sapiens
cccaugccuccagcuacaaaaca

SEQ ID NO: 1823582 - RNA, 22 nt, Homo sapiens
ugccuggaucucacaagcacuu

SEQ ID NO: 1823583 - RNA, 12 nt, Homo sapiens
uacagcaaaaag

SEQ ID NO: 1823584 - RNA, 20 nt, Homo sapiens
aauacuauacagccauaaaa

SEQ ID NO: 1823585 - RNA, 18 nt, Homo sapiens
auuacaauuuucuguaag

SEQ ID NO: 1823586 - RNA, 15 nt, Homo sapiens
ugacaaagauuugca

SEQ ID NO: 1823587 - RNA, 15 nt, Homo sapiens
uaacguucugcugcu

SEQ ID NO: 1823588 - RNA, 19 nt, Homo sapiens
acaguuggaccuuacuuug

SEQ ID NO: 1823589 - RNA, 14 nt, Homo sapiens
caauacauguaucu

SEQ ID NO: 1823590 - RNA, 22 nt, Homo sapiens
uaauguuacugaucaugcauug

SEQ ID NO: 1823591 - RNA, 21 nt, Homo sapiens
cugauaugucuagggugugau

SEQ ID NO: 1823592 - RNA, 17 nt, Homo sapiens
ccaggcaugguggcuca

SEQ ID NO: 1823593 - RNA, 17 nt, Homo sapiens
cagugggggcagagcca

SEQ ID NO: 1823594 - RNA, 22 nt, Homo sapiens
aaacaugaccacucuuggcuau

SEQ ID NO: 1823595 - RNA, 19 nt, Homo sapiens
caaaacaucaaaaugaaua

SEQ ID NO: 1823596 - RNA, 16 nt, Homo sapiens
gcagaccgggggccag

SEQ ID NO: 1823597 - RNA, 14 nt, Homo sapiens
gagaacacugugaa

SEQ ID NO: 1823598 - RNA, 19 nt, Homo sapiens
cugugagcccagcuggguc

SEQ ID NO: 1823599 - RNA, 16 nt, Homo sapiens
gcacuuuccacuucca

SEQ ID NO: 1823600 - RNA, 21 nt, Homo sapiens
ggcauaaagcugggaggccaa

SEQ ID NO: 1823601 - RNA, 14 nt, Homo sapiens
aaacaucauuucaa

SEQ ID NO: 1823602 - RNA, 18 nt, Homo sapiens
ugccacucagagacuuca

SEQ ID NO: 1823603 - RNA, 20 nt, Homo sapiens
cauugucuacauagugacau

SEQ ID NO: 1823604 - RNA, 22 nt, Homo sapiens
uggggcgagccaggaccacaga

SEQ ID NO: 1823605 - RNA, 15 nt, Homo sapiens
aggugagaacccugu

SEQ ID NO: 1823606 - RNA, 15 nt, Homo sapiens
cuaguagccaaaagg

SEQ ID NO: 1823607 - RNA, 15 nt, Homo sapiens
caaaugaccuagaaa

SEQ ID NO: 1823608 - RNA, 21 nt, Homo sapiens
accauuuaaagaaagaaugca

SEQ ID NO: 1823609 - RNA, 20 nt, Homo sapiens
ggaagagcugcuguauuuga

SEQ ID NO: 1823610 - RNA, 21 nt, Homo sapiens
cuuguauuuucuuaauauaca

SEQ ID NO: 1823611 - RNA, 19 nt, Homo sapiens
gccaggcuccagcacuuca

SEQ ID NO: 1823612 - RNA, 21 nt, Homo sapiens
agcacccaaacacauggcacu

SEQ ID NO: 1823613 - RNA, 21 nt, Homo sapiens
acacauuguacaugguacgaa

SEQ ID NO: 1823614 - RNA, 19 nt, Homo sapiens
cugagaagucaaacauuuc

SEQ ID NO: 1823615 - RNA, 17 nt, Homo sapiens
cuuuaaucaaugugaca

SEQ ID NO: 1823616 - RNA, 20 nt, Homo sapiens
aggcgggaggauugcuugag

SEQ ID NO: 1823617 - RNA, 20 nt, Homo sapiens
aauuauagaguaucacuccc

SEQ ID NO: 1823618 - RNA, 21 nt, Homo sapiens
guuuacuuccugcagugaauu

SEQ ID NO: 1823619 - RNA, 13 nt, Homo sapiens
uacagagaagauu

SEQ ID NO: 1823620 - RNA, 17 nt, Homo sapiens
uuaacaugguucaggua

SEQ ID NO: 1823621 - RNA, 14 nt, Homo sapiens
acaaaaugauggca

SEQ ID NO: 1823622 - RNA, 23 nt, Homo sapiens
gagcaaacagaggaggccagccu

SEQ ID NO: 1823623 - RNA, 23 nt, Homo sapiens
uagcuguuuacugacauggugcu

SEQ ID NO: 1823624 - RNA, 22 nt, Homo sapiens
cauuuaaaaacaggcagcucau

SEQ ID NO: 1823625 - RNA, 14 nt, Homo sapiens
guugucauugcugu

SEQ ID NO: 1823626 - RNA, 17 nt, Homo sapiens
auaaacugucacucuag

SEQ ID NO: 1823627 - RNA, 20 nt, Homo sapiens
ggagucacucuuaugcugua

SEQ ID NO: 1823628 - RNA, 18 nt, Homo sapiens
aucugucuuucacuggaa

SEQ ID NO: 1823629 - RNA, 17 nt, Homo sapiens
cugguccucccauuucu

SEQ ID NO: 1823630 - RNA, 21 nt, Homo sapiens
aaagcaacaaagauugagaag

SEQ ID NO: 1823631 - RNA, 14 nt, Homo sapiens
uguagauaacacug

SEQ ID NO: 1823632 - RNA, 21 nt, Homo sapiens
auauugcucuauauguaauau

SEQ ID NO: 1823633 - RNA, 21 nt, Homo sapiens
gggccccacccucggggaugu

SEQ ID NO: 1823634 - RNA, 13 nt, Homo sapiens
ccgcgcuccgggc

SEQ ID NO: 1823635 - RNA, 22 nt, Homo sapiens
aaauuagauauuguuuugugac

SEQ ID NO: 1823636 - RNA, 20 nt, Homo sapiens
ucuuggcguauuuauacuca

SEQ ID NO: 1823637 - RNA, 23 nt, Homo sapiens
agcaauuuagacaaagccuuaag

SEQ ID NO: 1823638 - RNA, 18 nt, Homo sapiens
uaaaacauuuucacacaa

SEQ ID NO: 1823639 - RNA, 16 nt, Homo sapiens
cacugaacaaaaccua

SEQ ID NO: 1823640 - RNA, 21 nt, Homo sapiens
uggcugauuucaaaugcaguc

SEQ ID NO: 1823641 - RNA, 17 nt, Homo sapiens
aguaauuuuuaugaaau

SEQ ID NO: 1823642 - RNA, 23 nt, Homo sapiens
ucccucggcguuagucccuagcc

SEQ ID NO: 1823643 - RNA, 21 nt, Homo sapiens
ugugagcauccugcaagguga

SEQ ID NO: 1823644 - RNA, 16 nt, Homo sapiens
agcccggagaggaccc

SEQ ID NO: 1823645 - RNA, 14 nt, Homo sapiens
agacuaagccagac

SEQ ID NO: 1823646 - RNA, 22 nt, Homo sapiens
guguaugcaguauucuugcacu

SEQ ID NO: 1823647 - RNA, 14 nt, Homo sapiens
cuuuccuugcucaa

SEQ ID NO: 1823648 - RNA, 19 nt, Homo sapiens
agcgccuuuccugccaugu

SEQ ID NO: 1823649 - RNA, 13 nt, Homo sapiens
ugugagaugcuag

SEQ ID NO: 1823650 - RNA, 23 nt, Homo sapiens
uugaguuccuauaacacugugaa

SEQ ID NO: 1823651 - RNA, 21 nt, Homo sapiens
caucccaugggggugcugcag

SEQ ID NO: 1823652 - RNA, 19 nt, Homo sapiens
cacaguaaugcaagcaaag

SEQ ID NO: 1823653 - RNA, 12 nt, Homo sapiens
uuuaguuucaug

SEQ ID NO: 1823654 - RNA, 22 nt, Homo sapiens
auauccuccuucuccuguucca

SEQ ID NO: 1823655 - RNA, 23 nt, Homo sapiens
aguuuauagaccagaaccagagc

SEQ ID NO: 1823656 - RNA, 20 nt, Homo sapiens
guuguuuuuagagacagggu

SEQ ID NO: 1823657 - RNA, 18 nt, Homo sapiens
gacccaugggcaggagac

SEQ ID NO: 1823658 - RNA, 17 nt, Homo sapiens
ugggcacacacacccgc

SEQ ID NO: 1823659 - RNA, 19 nt, Homo sapiens
gaagaacaguaacugccau

SEQ ID NO: 1823660 - RNA, 14 nt, Homo sapiens
augcaacgcuguaa

SEQ ID NO: 1823661 - RNA, 14 nt, Homo sapiens
cccaaauguauucu

SEQ ID NO: 1823662 - RNA, 20 nt, Homo sapiens
ccaguggaacagucuuccca

SEQ ID NO: 1823663 - RNA, 16 nt, Homo sapiens
uagaauauaggucucu

SEQ ID NO: 1823664 - RNA, 14 nt, Homo sapiens
agggaauccauauc

SEQ ID NO: 1823665 - RNA, 16 nt, Homo sapiens
cccacuuccauccucu

SEQ ID NO: 1823666 - RNA, 21 nt, Homo sapiens
uuacuugggcuucaacagcca

SEQ ID NO: 1823667 - RNA, 19 nt, Homo sapiens
aggggaacagaccagugac

SEQ ID NO: 1823668 - RNA, 17 nt, Homo sapiens
uagaauugacauugaaa

SEQ ID NO: 1823669 - RNA, 19 nt, Homo sapiens
ggagguuguggggccucag

SEQ ID NO: 1823670 - RNA, 16 nt, Homo sapiens
acguaagacuguguaa

SEQ ID NO: 1823671 - RNA, 24 nt, Homo sapiens
aauccauucuuaaaguacuuguua

SEQ ID NO: 1823672 - RNA, 18 nt, Homo sapiens
uaagacacuaguagagca

SEQ ID NO: 1823673 - RNA, 13 nt, Homo sapiens
auaugugccaaag

SEQ ID NO: 1823674 - RNA, 17 nt, Homo sapiens
gaagggagucucucuuc

SEQ ID NO: 1823675 - RNA, 23 nt, Homo sapiens
acacuggucugcuguuccagugg

SEQ ID NO: 1823676 - RNA, 11 nt, Homo sapiens
caccuguaauc

SEQ ID NO: 1823677 - RNA, 20 nt, Homo sapiens
gcuaauuguacuaaucugag

SEQ ID NO: 1823678 - RNA, 13 nt, Homo sapiens
uugcaaggcauuu

SEQ ID NO: 1823679 - RNA, 16 nt, Homo sapiens
ugaagcccagugaauu

SEQ ID NO: 1823680 - RNA, 15 nt, Homo sapiens
aaauucaaaccauuu

SEQ ID NO: 1823681 - RNA, 16 nt, Homo sapiens
ccauggucacagagaa

SEQ ID NO: 1823682 - RNA, 17 nt, Homo sapiens
uccaggcuccagcacau

SEQ ID NO: 1823683 - RNA, 14 nt, Homo sapiens
aacugcaugcugcu

SEQ ID NO: 1823684 - RNA, 18 nt, Homo sapiens
gcagggaaggacaggacc

SEQ ID NO: 1823685 - RNA, 22 nt, Homo sapiens
gcaauggcacgaucucagcuca

SEQ ID NO: 1823686 - RNA, 22 nt, Homo sapiens
uuacagacaugaaccaccacgc

SEQ ID NO: 1823687 - RNA, 21 nt, Homo sapiens
uuauaucucccccacuccacu

SEQ ID NO: 1823688 - RNA, 17 nt, Homo sapiens
uugccaguauuaugcau

SEQ ID NO: 1823689 - RNA, 18 nt, Homo sapiens
gcccugaaacuacuguau

SEQ ID NO: 1823690 - RNA, 14 nt, Homo sapiens
uaaugcuaaucuug

SEQ ID NO: 1823691 - RNA, 18 nt, Homo sapiens
caccuguaaaacuuuauu

SEQ ID NO: 1823692 - RNA, 14 nt, Homo sapiens
ccacucaugacugc

SEQ ID NO: 1823693 - RNA, 14 nt, Homo sapiens
agcagauacuugag

SEQ ID NO: 1823694 - RNA, 14 nt, Homo sapiens
uaauuuucuuucac

SEQ ID NO: 1823695 - RNA, 22 nt, Homo sapiens
ggccugggaucuggcacacucc

SEQ ID NO: 1823696 - RNA, 22 nt, Homo sapiens
uucagcaguaacaggaaaccac

SEQ ID NO: 1823697 - RNA, 18 nt, Homo sapiens
augaaguauugcuaauau

SEQ ID NO: 1823698 - RNA, 18 nt, Homo sapiens
gccccuggagccucagaa

SEQ ID NO: 1823699 - RNA, 17 nt, Homo sapiens
acgccaacuucucccac

SEQ ID NO: 1823700 - RNA, 16 nt, Homo sapiens
caugccuccucaggag

SEQ ID NO: 1823701 - RNA, 17 nt, Homo sapiens
uaaaacuauauucucag

SEQ ID NO: 1823702 - RNA, 11 nt, Homo sapiens
ucagauuuauu

SEQ ID NO: 1823703 - RNA, 18 nt, Homo sapiens
auggaccagugguuucca

SEQ ID NO: 1823704 - RNA, 21 nt, Homo sapiens
aaaucaaagauaagguuauag

SEQ ID NO: 1823705 - RNA, 19 nt, Homo sapiens
uaguucuuagagcacuuuu

SEQ ID NO: 1823706 - RNA, 18 nt, Homo sapiens
cacaauggcaccucugcc

SEQ ID NO: 1823707 - RNA, 15 nt, Homo sapiens
ugaaugggcugagaa

SEQ ID NO: 1823708 - RNA, 20 nt, Homo sapiens
cuuucccgggcuguccacua

SEQ ID NO: 1823709 - RNA, 16 nt, Homo sapiens
ugggaggucuugcuag

SEQ ID NO: 1823710 - RNA, 23 nt, Homo sapiens
cauucaucaagcuguacauuugg

SEQ ID NO: 1823711 - RNA, 23 nt, Homo sapiens
auuuccuuaaacuguguggacug

SEQ ID NO: 1823712 - RNA, 22 nt, Homo sapiens
cuugguucuuaaaagcauucug

SEQ ID NO: 1823713 - RNA, 13 nt, Homo sapiens
ugaagcaauaacu

SEQ ID NO: 1823714 - RNA, 15 nt, Homo sapiens
ucauggggucccugc

SEQ ID NO: 1823715 - RNA, 20 nt, Homo sapiens
aucuccaguauucuugucaa

SEQ ID NO: 1823716 - RNA, 15 nt, Homo sapiens
gcaguccauuuccua

SEQ ID NO: 1823717 - RNA, 17 nt, Homo sapiens
cuggcugcuuuguucaa

SEQ ID NO: 1823718 - RNA, 18 nt, Homo sapiens
uaaguccuaauaaacuua

SEQ ID NO: 1823719 - RNA, 13 nt, Homo sapiens
cuaaacugcgguc

SEQ ID NO: 1823720 - RNA, 14 nt, Homo sapiens
cuuuugaugucuuu

SEQ ID NO: 1823721 - RNA, 14 nt, Homo sapiens
caacagucagccag

SEQ ID NO: 1823722 - RNA, 22 nt, Homo sapiens
uuuguaaugauuuuggaacugu

SEQ ID NO: 1823723 - RNA, 16 nt, Homo sapiens
uggaaccugcaaaaaa

SEQ ID NO: 1823724 - RNA, 16 nt, Homo sapiens
caggagcaguuugcca

SEQ ID NO: 1823725 - RNA, 12 nt, Homo sapiens
uccucugaucuc

SEQ ID NO: 1823726 - RNA, 13 nt, Homo sapiens
uccuaugcaauaa

SEQ ID NO: 1823727 - RNA, 16 nt, Homo sapiens
acgacgauuucagcua

SEQ ID NO: 1823728 - RNA, 14 nt, Homo sapiens
cugaggaccucuca

SEQ ID NO: 1823729 - RNA, 15 nt, Homo sapiens
uauauuuuugugcac

SEQ ID NO: 1823730 - RNA, 17 nt, Homo sapiens
guugucauugacuucaa

SEQ ID NO: 1823731 - RNA, 20 nt, Homo sapiens
guugcuaaugccaggccagu

SEQ ID NO: 1823732 - RNA, 16 nt, Homo sapiens
ccauuauuuucuguca

SEQ ID NO: 1823733 - RNA, 19 nt, Homo sapiens
acagucacugacucaagac

SEQ ID NO: 1823734 - RNA, 16 nt, Homo sapiens
cuguggggccugaugg

SEQ ID NO: 1823735 - RNA, 17 nt, Homo sapiens
uacacucuugauucuac

SEQ ID NO: 1823736 - RNA, 21 nt, Homo sapiens
uaucugcaccuagaaccuccc

SEQ ID NO: 1823737 - RNA, 15 nt, Homo sapiens
guucaugugccucug

SEQ ID NO: 1823738 - RNA, 20 nt, Homo sapiens
ggcggcuccuggugcuaaca

SEQ ID NO: 1823739 - RNA, 19 nt, Homo sapiens
gaggcaagugugggccacu

SEQ ID NO: 1823740 - RNA, 23 nt, Homo sapiens
aacacaaugccucaucuucccug

SEQ ID NO: 1823741 - RNA, 14 nt, Homo sapiens
agaaacuuaaacaa

SEQ ID NO: 1823742 - RNA, 20 nt, Homo sapiens
ucaccaagcuaggugcuauu

SEQ ID NO: 1823743 - RNA, 22 nt, Homo sapiens
cugaauaugcugcucaucccca

SEQ ID NO: 1823744 - RNA, 15 nt, Homo sapiens
auuguacaaccugug

SEQ ID NO: 1823745 - RNA, 22 nt, Homo sapiens
cagugcccuggggcugaucuca

SEQ ID NO: 1823746 - RNA, 15 nt, Homo sapiens
uaagcauaaaagauc

SEQ ID NO: 1823747 - RNA, 16 nt, Homo sapiens
ggauaaaguugguaaa

SEQ ID NO: 1823748 - RNA, 20 nt, Homo sapiens
ugccagaguagugaagcuaa

SEQ ID NO: 1823749 - RNA, 19 nt, Homo sapiens
aaggauuaauauucuucaa

SEQ ID NO: 1823750 - RNA, 14 nt, Homo sapiens
uaauauaguagauu

SEQ ID NO: 1823751 - RNA, 21 nt, Homo sapiens
aacaugugacaacaugcaaga

SEQ ID NO: 1823752 - RNA, 20 nt, Homo sapiens
ucucugcuuaguacauuuga

SEQ ID NO: 1823753 - RNA, 20 nt, Homo sapiens
uggccucagcugaaugccuc

SEQ ID NO: 1823754 - RNA, 20 nt, Homo sapiens
cccaagcccuggugaccaga

SEQ ID NO: 1823755 - RNA, 12 nt, Homo sapiens
aacuguauugau

SEQ ID NO: 1823756 - RNA, 19 nt, Homo sapiens
cuucacugugcuguuguua

SEQ ID NO: 1823757 - RNA, 20 nt, Homo sapiens
ugaugacuuaguacaaaguu

SEQ ID NO: 1823758 - RNA, 13 nt, Homo sapiens
ugacauuaagaca

SEQ ID NO: 1823759 - RNA, 15 nt, Homo sapiens
ucacagcuaccaaag

SEQ ID NO: 1823760 - RNA, 22 nt, Homo sapiens
uccuaauuuggacaagauuauu

SEQ ID NO: 1823761 - RNA, 19 nt, Homo sapiens
agugauuccaguauuucau

SEQ ID NO: 1823762 - RNA, 14 nt, Homo sapiens
aucacacuugucug

SEQ ID NO: 1823763 - RNA, 18 nt, Homo sapiens
uauggaucgaucuacguc

SEQ ID NO: 1823764 - RNA, 14 nt, Homo sapiens
uuuaaaucaaggaa

SEQ ID NO: 1823765 - RNA, 19 nt, Homo sapiens
ggcccaugugcccacuguc

SEQ ID NO: 1823766 - RNA, 18 nt, Homo sapiens
uagaacuccaauacucac

SEQ ID NO: 1823767 - RNA, 16 nt, Homo sapiens
ugaaaguuaauccacu

SEQ ID NO: 1823768 - RNA, 21 nt, Homo sapiens
uucucauuuagcauugaaaua

SEQ ID NO: 1823769 - RNA, 17 nt, Homo sapiens
uuuggauugacucugca

SEQ ID NO: 1823770 - RNA, 14 nt, Homo sapiens
cugccagaccugca

SEQ ID NO: 1823771 - RNA, 16 nt, Homo sapiens
aaaacaugugguuaca

SEQ ID NO: 1823772 - RNA, 16 nt, Homo sapiens
acugggcgucugacuc

SEQ ID NO: 1823773 - RNA, 14 nt, Homo sapiens
caggugagcaauua

SEQ ID NO: 1823774 - RNA, 21 nt, Homo sapiens
ucuuaugcacaggaacuaaag

SEQ ID NO: 1823775 - RNA, 17 nt, Homo sapiens
auuugguacacaugugu

SEQ ID NO: 1823776 - RNA, 12 nt, Homo sapiens
ugccuuccucau

SEQ ID NO: 1823777 - RNA, 17 nt, Homo sapiens
auggaagguuagguuug

SEQ ID NO: 1823778 - RNA, 20 nt, Homo sapiens
agauuuaaccccuccacugc

SEQ ID NO: 1823779 - RNA, 17 nt, Homo sapiens
aagaaugaauaauaauu

SEQ ID NO: 1823780 - RNA, 15 nt, Homo sapiens
uccuccccuugaaua

SEQ ID NO: 1823781 - RNA, 19 nt, Homo sapiens
gaaaauaguggugugauuu

SEQ ID NO: 1823782 - RNA, 14 nt, Homo sapiens
acacuccuugcauc

SEQ ID NO: 1823783 - RNA, 16 nt, Homo sapiens
gacaugggauggggga

SEQ ID NO: 1823784 - RNA, 17 nt, Homo sapiens
uauauccccugcuaccc

SEQ ID NO: 1823785 - RNA, 18 nt, Homo sapiens
cagcaggacacugaucca

SEQ ID NO: 1823786 - RNA, 15 nt, Homo sapiens
uauaaugguuuacug

SEQ ID NO: 1823787 - RNA, 19 nt, Homo sapiens
cuggagggaggggugagau

SEQ ID NO: 1823788 - RNA, 18 nt, Homo sapiens
ugagcuccagucccugcu

SEQ ID NO: 1823789 - RNA, 15 nt, Homo sapiens
caacaccacuaggaa

SEQ ID NO: 1823790 - RNA, 20 nt, Homo sapiens
ugccaagccauacuuauuaa

SEQ ID NO: 1823791 - RNA, 13 nt, Homo sapiens
cuuacaugcauua

SEQ ID NO: 1823792 - RNA, 13 nt, Homo sapiens
cagaaaugcuguc

SEQ ID NO: 1823793 - RNA, 18 nt, Homo sapiens
caauaaugagagcucaga

SEQ ID NO: 1823794 - RNA, 19 nt, Homo sapiens
cuccugggauuuucauuag

SEQ ID NO: 1823795 - RNA, 20 nt, Homo sapiens
gacaauggcuuacuccagga

SEQ ID NO: 1823796 - RNA, 13 nt, Homo sapiens
cucuuccugccaa

SEQ ID NO: 1823797 - RNA, 17 nt, Homo sapiens
ugcaccacuucaaguga

SEQ ID NO: 1823798 - RNA, 16 nt, Homo sapiens
uagaggaagaaaacca

SEQ ID NO: 1823799 - RNA, 22 nt, Homo sapiens
acuuuggaauguacucuguuca

SEQ ID NO: 1823800 - RNA, 22 nt, Homo sapiens
aauguuuagcaaauacauauuu

SEQ ID NO: 1823801 - RNA, 17 nt, Homo sapiens
uuaacaaaugugcugcu

SEQ ID NO: 1823802 - RNA, 19 nt, Homo sapiens
aauuuuguuaagaauuuca

SEQ ID NO: 1823803 - RNA, 20 nt, Homo sapiens
caguuacuuuuuuacacuga

SEQ ID NO: 1823804 - RNA, 17 nt, Homo sapiens
caggagucagugucugg

SEQ ID NO: 1823805 - RNA, 20 nt, Homo sapiens
aagauguuaguaguuucuca

SEQ ID NO: 1823806 - RNA, 17 nt, Homo sapiens
cuaaugaggcauuacaa

SEQ ID NO: 1823807 - RNA, 19 nt, Homo sapiens
cuugaacccaggaggcaga

SEQ ID NO: 1823808 - RNA, 22 nt, Homo sapiens
aauaaauuggaacaccuccuca

SEQ ID NO: 1823809 - RNA, 16 nt, Homo sapiens
aaugucuguuaacuua

SEQ ID NO: 1823810 - RNA, 22 nt, Homo sapiens
ucuguccacucugaauaccaag

SEQ ID NO: 1823811 - RNA, 14 nt, Homo sapiens
ggccaaaccucuaa

SEQ ID NO: 1823812 - RNA, 20 nt, Homo sapiens
aucgcucccuuggcuuugag

SEQ ID NO: 1823813 - RNA, 13 nt, Homo sapiens
aguucuaugcaga

SEQ ID NO: 1823814 - RNA, 20 nt, Homo sapiens
uguaaaaugugaagugaaug

SEQ ID NO: 1823815 - RNA, 15 nt, Homo sapiens
uccugaaauauccag

SEQ ID NO: 1823816 - RNA, 20 nt, Homo sapiens
uucgcgugcccucgcugcuu

SEQ ID NO: 1823817 - RNA, 15 nt, Homo sapiens
ucauagcgaguuuuc

SEQ ID NO: 1823818 - RNA, 16 nt, Homo sapiens
gucucuccagugaaau

SEQ ID NO: 1823819 - RNA, 22 nt, Homo sapiens
ucuaugcaaagucucucauuuc

SEQ ID NO: 1823820 - RNA, 19 nt, Homo sapiens
cagaaguuaguuuguauau

SEQ ID NO: 1823821 - RNA, 18 nt, Homo sapiens
accagucuuucaacucau

SEQ ID NO: 1823822 - RNA, 15 nt, Homo sapiens
gucccaccugcacac

SEQ ID NO: 1823823 - RNA, 21 nt, Homo sapiens
gggaacuggccaagcugaggu

SEQ ID NO: 1823824 - RNA, 13 nt, Homo sapiens
ugcuggacucugg

SEQ ID NO: 1823825 - RNA, 14 nt, Homo sapiens
aaauauacaaguaa

SEQ ID NO: 1823826 - RNA, 20 nt, Homo sapiens
ggcaaucaugagcaagugaa

SEQ ID NO: 1823827 - RNA, 15 nt, Homo sapiens
uguaagaggaugugg

SEQ ID NO: 1823828 - RNA, 14 nt, Homo sapiens
aaguuuuugccauu

SEQ ID NO: 1823829 - RNA, 19 nt, Homo sapiens
gaacagacaaucacagcaa

SEQ ID NO: 1823830 - RNA, 16 nt, Homo sapiens
agacggauuaucuaga

SEQ ID NO: 1823831 - RNA, 15 nt, Homo sapiens
cagaaucucaaauaa

SEQ ID NO: 1823832 - RNA, 18 nt, Homo sapiens
cugucgccugacagcaua

SEQ ID NO: 1823833 - RNA, 20 nt, Homo sapiens
uucacuggggcaugagauuu

SEQ ID NO: 1823834 - RNA, 17 nt, Homo sapiens
uccuuuugaccaaauaa

SEQ ID NO: 1823835 - RNA, 17 nt, Homo sapiens
aacuaacguacauucaa

SEQ ID NO: 1823836 - RNA, 17 nt, Homo sapiens
uuucaccagcagcauag

SEQ ID NO: 1823837 - RNA, 12 nt, Homo sapiens
gagauuugccac

SEQ ID NO: 1823838 - RNA, 14 nt, Homo sapiens
acaguaacugccau

SEQ ID NO: 1823839 - RNA, 18 nt, Homo sapiens
uagugggggaaaugccag

SEQ ID NO: 1823840 - RNA, 18 nt, Homo sapiens
uccuggacucaaaguauc

SEQ ID NO: 1823841 - RNA, 14 nt, Homo sapiens
ucaguuacuuuccc

SEQ ID NO: 1823842 - RNA, 13 nt, Homo sapiens
uuaaauaucagua

SEQ ID NO: 1823843 - RNA, 16 nt, Homo sapiens
uggggcaaacagucua

SEQ ID NO: 1823844 - RNA, 15 nt, Homo sapiens
caacuaggaccucau

SEQ ID NO: 1823845 - RNA, 16 nt, Homo sapiens
uccucuccacugccuu

SEQ ID NO: 1823846 - RNA, 23 nt, Homo sapiens
cuaauauaauagaugacaguggc

SEQ ID NO: 1823847 - RNA, 22 nt, Homo sapiens
cacuuaaaagcuggcuuucauc

SEQ ID NO: 1823848 - RNA, 13 nt, Homo sapiens
ccuccagccacca

SEQ ID NO: 1823849 - RNA, 16 nt, Homo sapiens
cuuccuggacuggccc

SEQ ID NO: 1823850 - RNA, 14 nt, Homo sapiens
cuuugaaugugagg

SEQ ID NO: 1823851 - RNA, 22 nt, Homo sapiens
cuauucucuccucagacugcuc

SEQ ID NO: 1823852 - RNA, 14 nt, Homo sapiens
uacugauucacugc

SEQ ID NO: 1823853 - RNA, 14 nt, Homo sapiens
ccucuauuucucuc

SEQ ID NO: 1823854 - RNA, 16 nt, Homo sapiens
cuccccacuagcauuu

SEQ ID NO: 1823855 - RNA, 20 nt, Homo sapiens
gccucugcucccaugcucau

SEQ ID NO: 1823856 - RNA, 21 nt, Homo sapiens
guucugcugggaccuuggaga

SEQ ID NO: 1823857 - RNA, 20 nt, Homo sapiens
uccauaaauuuggacugucu

SEQ ID NO: 1823858 - RNA, 14 nt, Homo sapiens
gaaaauguacaaua

SEQ ID NO: 1823859 - RNA, 15 nt, Homo sapiens
aggaaagcauguauu

SEQ ID NO: 1823860 - RNA, 23 nt, Homo sapiens
aaucauguuggauagucagcugu

SEQ ID NO: 1823861 - RNA, 14 nt, Homo sapiens
uuauuggacuucca

SEQ ID NO: 1823862 - RNA, 16 nt, Homo sapiens
cucauuuuuuccugag

SEQ ID NO: 1823863 - RNA, 12 nt, Homo sapiens
ccugcagguccu

SEQ ID NO: 1823864 - RNA, 18 nt, Homo sapiens
caguguuuagaagagccu

SEQ ID NO: 1823865 - RNA, 18 nt, Homo sapiens
augcaccccugagccagc

SEQ ID NO: 1823866 - RNA, 19 nt, Homo sapiens
ccuguguguauagcugugu

SEQ ID NO: 1823867 - RNA, 22 nt, Homo sapiens
auauuuguucuaaaauaaguca

SEQ ID NO: 1823868 - RNA, 22 nt, Homo sapiens
aaacugccacaagcacaauuga

SEQ ID NO: 1823869 - RNA, 17 nt, Homo sapiens
uuccauguucaccaaga

SEQ ID NO: 1823870 - RNA, 21 nt, Homo sapiens
aucuguauguguucuauucag

SEQ ID NO: 1823871 - RNA, 18 nt, Homo sapiens
auagaagugcauucuccu

SEQ ID NO: 1823872 - RNA, 23 nt, Homo sapiens
ccauuucucucuuguuugagaga

SEQ ID NO: 1823873 - RNA, 15 nt, Homo sapiens
ucaauauuucuagua

SEQ ID NO: 1823874 - RNA, 12 nt, Homo sapiens
caaccucaucca

SEQ ID NO: 1823875 - RNA, 15 nt, Homo sapiens
cucacucugguuguu

SEQ ID NO: 1823876 - RNA, 22 nt, Homo sapiens
aaagauauuuaugauguuaaca

SEQ ID NO: 1823877 - RNA, 22 nt, Homo sapiens
aucaagaauuagaagucuuuca

SEQ ID NO: 1823878 - RNA, 13 nt, Homo sapiens
uaaacaguucuug

SEQ ID NO: 1823879 - RNA, 17 nt, Homo sapiens
agccuugcugggccagg

SEQ ID NO: 1823880 - RNA, 13 nt, Homo sapiens
cguccacagggca

SEQ ID NO: 1823881 - RNA, 20 nt, Homo sapiens
gcuuuucaugcaaacucuuu

SEQ ID NO: 1823882 - RNA, 15 nt, Homo sapiens
cugaagccaaaugaa

SEQ ID NO: 1823883 - RNA, 21 nt, Homo sapiens
guauuguuaggaaaugucauc

SEQ ID NO: 1823884 - RNA, 14 nt, Homo sapiens
cuuucaauccacag

SEQ ID NO: 1823885 - RNA, 18 nt, Homo sapiens
gugcccaggguuuugccc

SEQ ID NO: 1823886 - RNA, 14 nt, Homo sapiens
uuaaggccugaauc

SEQ ID NO: 1823887 - RNA, 18 nt, Homo sapiens
cucacccgccucuugccc

SEQ ID NO: 1823888 - RNA, 21 nt, Homo sapiens
gcacagacaugguuucaggua

SEQ ID NO: 1823889 - RNA, 14 nt, Homo sapiens
acaauugcaguuuu

SEQ ID NO: 1823890 - RNA, 19 nt, Homo sapiens
ugaaauaguuacuauuuca

SEQ ID NO: 1823891 - RNA, 21 nt, Homo sapiens
acuuaauggacgaagcaacaa

SEQ ID NO: 1823892 - RNA, 15 nt, Homo sapiens
caaccacacaccuca

SEQ ID NO: 1823893 - RNA, 23 nt, Homo sapiens
cuuucuggaccagauccuacucu

SEQ ID NO: 1823894 - RNA, 12 nt, Homo sapiens
ccauccagguuc

SEQ ID NO: 1823895 - RNA, 23 nt, Homo sapiens
accuuuucauguacagcauuaaa

SEQ ID NO: 1823896 - RNA, 15 nt, Homo sapiens
uagaauuaucucuca

SEQ ID NO: 1823897 - RNA, 16 nt, Homo sapiens
cugaaauauacacaca

SEQ ID NO: 1823898 - RNA, 15 nt, Homo sapiens
acuauucaugagaau

SEQ ID NO: 1823899 - RNA, 21 nt, Homo sapiens
aggugaacaagcaaacccaga

SEQ ID NO: 1823900 - RNA, 13 nt, Homo sapiens
cuuucccaaauaa

SEQ ID NO: 1823901 - RNA, 14 nt, Homo sapiens
auagcuggacaucc

SEQ ID NO: 1823902 - RNA, 17 nt, Homo sapiens
ccgcaggugcugguccc

SEQ ID NO: 1823903 - RNA, 17 nt, Homo sapiens
uaaaaauaaccaaaaaa

SEQ ID NO: 1823904 - RNA, 20 nt, Homo sapiens
uauuuaucuggccauugcac

SEQ ID NO: 1823905 - RNA, 17 nt, Homo sapiens
acuacuaaugacuuugu

SEQ ID NO: 1823906 - RNA, 19 nt, Homo sapiens
aauucucuuuggucauuga

SEQ ID NO: 1823907 - RNA, 20 nt, Homo sapiens
caauaaagaugcccacugag

SEQ ID NO: 1823908 - RNA, 21 nt, Homo sapiens
ugggcucaucagccuuccuga

SEQ ID NO: 1823909 - RNA, 21 nt, Homo sapiens
aaauuagcuuuuaguuuuaaa

SEQ ID NO: 1823910 - RNA, 16 nt, Homo sapiens
gagagucgcaucucag

SEQ ID NO: 1823911 - RNA, 21 nt, Homo sapiens
auucauuucauagccaaacag

SEQ ID NO: 1823912 - RNA, 14 nt, Homo sapiens
agaaaggccuuuaa

SEQ ID NO: 1823913 - RNA, 15 nt, Homo sapiens
gcaaaguguauguga

SEQ ID NO: 1823914 - RNA, 13 nt, Homo sapiens
cgguggaggcaga

SEQ ID NO: 1823915 - RNA, 16 nt, Homo sapiens
uuuucaauucaaaaau

SEQ ID NO: 1823916 - RNA, 23 nt, Homo sapiens
uaaaugcacuguaauauguacac

SEQ ID NO: 1823917 - RNA, 15 nt, Homo sapiens
ucuccaggcccuugu

SEQ ID NO: 1823918 - RNA, 13 nt, Homo sapiens
cugagaaagccaa

SEQ ID NO: 1823919 - RNA, 14 nt, Homo sapiens
cugaguuggcauca

SEQ ID NO: 1823920 - RNA, 14 nt, Homo sapiens
cucccucugacucu

SEQ ID NO: 1823921 - RNA, 18 nt, Homo sapiens
aaggaggccacgugaugu

SEQ ID NO: 1823922 - RNA, 17 nt, Homo sapiens
acugaaucagaaaugua

SEQ ID NO: 1823923 - RNA, 14 nt, Homo sapiens
gcuggcucugagaa

SEQ ID NO: 1823924 - RNA, 20 nt, Homo sapiens
gcaguggagaagacauucug

SEQ ID NO: 1823925 - RNA, 21 nt, Homo sapiens
ugcuuuaauucagcuuuagaa

SEQ ID NO: 1823926 - RNA, 23 nt, Homo sapiens
agugaucgccuccaacagcauca

SEQ ID NO: 1823927 - RNA, 17 nt, Homo sapiens
acauauccuuagcccau

SEQ ID NO: 1823928 - RNA, 13 nt, Homo sapiens
gcagaauggacuu

SEQ ID NO: 1823929 - RNA, 13 nt, Homo sapiens
accugagacuuuc

SEQ ID NO: 1823930 - RNA, 14 nt, Homo sapiens
gccagcccuucagg

SEQ ID NO: 1823931 - RNA, 21 nt, Homo sapiens
acccuauuuagaaauggauuu

SEQ ID NO: 1823932 - RNA, 20 nt, Homo sapiens
gaagccauagggggcugcac

SEQ ID NO: 1823933 - RNA, 18 nt, Homo sapiens
agcuucugccacuuccca

SEQ ID NO: 1823934 - RNA, 20 nt, Homo sapiens
ugcaaugacucaggacaucc

SEQ ID NO: 1823935 - RNA, 13 nt, Homo sapiens
uuugcccagaaag

SEQ ID NO: 1823936 - RNA, 14 nt, Homo sapiens
uagaauacuuuuaa

SEQ ID NO: 1823937 - RNA, 14 nt, Homo sapiens
aagacaacauuucu

SEQ ID NO: 1823938 - RNA, 11 nt, Homo sapiens
uucccuguggc

SEQ ID NO: 1823939 - RNA, 17 nt, Homo sapiens
agaaacaggcucugaga

SEQ ID NO: 1823940 - RNA, 19 nt, Homo sapiens
accaaagagaagcaaaauc

SEQ ID NO: 1823941 - RNA, 19 nt, Homo sapiens
gaauuucacaagcuauuuu

SEQ ID NO: 1823942 - RNA, 16 nt, Homo sapiens
ugcaaaaggacucuca

SEQ ID NO: 1823943 - RNA, 19 nt, Homo sapiens
ugaagaauacacugugacu

SEQ ID NO: 1823944 - RNA, 19 nt, Homo sapiens
ccuuuuugagauacuauuu

SEQ ID NO: 1823945 - RNA, 20 nt, Homo sapiens
caaacagcaaaccaagagau

SEQ ID NO: 1823946 - RNA, 17 nt, Homo sapiens
gagauguggaaaagcca

SEQ ID NO: 1823947 - RNA, 18 nt, Homo sapiens
cggcccgccaccugugac

SEQ ID NO: 1823948 - RNA, 21 nt, Homo sapiens
ugauggcaacagaaaccaaga

SEQ ID NO: 1823949 - RNA, 13 nt, Homo sapiens
gcccuauucugcc

SEQ ID NO: 1823950 - RNA, 12 nt, Homo sapiens
cggacugugaau

SEQ ID NO: 1823951 - RNA, 19 nt, Homo sapiens
uccacaaauagucggggga

SEQ ID NO: 1823952 - RNA, 15 nt, Homo sapiens
agaaggcuaugggga

SEQ ID NO: 1823953 - RNA, 23 nt, Homo sapiens
cugccauuggacuauggagugca

SEQ ID NO: 1823954 - RNA, 22 nt, Homo sapiens
cuuccuucccagaauguuacug

SEQ ID NO: 1823955 - RNA, 12 nt, Homo sapiens
aaagaauaucuu

SEQ ID NO: 1823956 - RNA, 20 nt, Homo sapiens
gaaggcaaagccccuggaaa

SEQ ID NO: 1823957 - RNA, 14 nt, Homo sapiens
ugcugggacuuuuu

SEQ ID NO: 1823958 - RNA, 15 nt, Homo sapiens
gggugggaaccuggg

SEQ ID NO: 1823959 - RNA, 15 nt, Homo sapiens
ucuacccuggcacua

SEQ ID NO: 1823960 - RNA, 18 nt, Homo sapiens
cagacauccucuaugcca

SEQ ID NO: 1823961 - RNA, 21 nt, Homo sapiens
aauccauuuacagcauacuua

SEQ ID NO: 1823962 - RNA, 16 nt, Homo sapiens
gaaauauuauuggugu

SEQ ID NO: 1823963 - RNA, 15 nt, Homo sapiens
aguaauucuucugcc

SEQ ID NO: 1823964 - RNA, 20 nt, Homo sapiens
ugccuggccaggcagaucug

SEQ ID NO: 1823965 - RNA, 17 nt, Homo sapiens
gacuaacaacugggaaa

SEQ ID NO: 1823966 - RNA, 18 nt, Homo sapiens
gacaagaugguuaaguca

SEQ ID NO: 1823967 - RNA, 16 nt, Homo sapiens
gagcguucucuguccu

SEQ ID NO: 1823968 - RNA, 22 nt, Homo sapiens
ucaaaauagucauuuuuagcac

SEQ ID NO: 1823969 - RNA, 15 nt, Homo sapiens
ggcugagcaccucag

SEQ ID NO: 1823970 - RNA, 13 nt, Homo sapiens
agaaaaugaauuu

SEQ ID NO: 1823971 - RNA, 13 nt, Homo sapiens
uauaaaugugauu

SEQ ID NO: 1823972 - RNA, 20 nt, Homo sapiens
agagcuggugccagaugugg

SEQ ID NO: 1823973 - RNA, 15 nt, Homo sapiens
aauuacaacagugag

SEQ ID NO: 1823974 - RNA, 15 nt, Homo sapiens
cagugagaaauuaca

SEQ ID NO: 1823975 - RNA, 19 nt, Homo sapiens
gcaucccaugggggugcug

SEQ ID NO: 1823976 - RNA, 16 nt, Homo sapiens
uaaagucucucugacu

SEQ ID NO: 1823977 - RNA, 21 nt, Homo sapiens
uguuauaaagacacaugcacg

SEQ ID NO: 1823978 - RNA, 17 nt, Homo sapiens
aauacuucaccuuuccu

SEQ ID NO: 1823979 - RNA, 18 nt, Homo sapiens
gccauaaaaguaaaggau

SEQ ID NO: 1823980 - RNA, 22 nt, Homo sapiens
uucauuugugcaccaauuauca

SEQ ID NO: 1823981 - RNA, 11 nt, Homo sapiens
uuccagccaca

SEQ ID NO: 1823982 - RNA, 23 nt, Homo sapiens
gugaacugcagcgaguacuuccc

SEQ ID NO: 1823983 - RNA, 20 nt, Homo sapiens
caggugugagccacggugcc

SEQ ID NO: 1823984 - RNA, 13 nt, Homo sapiens
cccucaucuugaa

SEQ ID NO: 1823985 - RNA, 15 nt, Homo sapiens
ugcaaacacagcucu

SEQ ID NO: 1823986 - RNA, 20 nt, Homo sapiens
auagugggcaccccacugca

SEQ ID NO: 1823987 - RNA, 18 nt, Homo sapiens
gaaggaaggaugccacuu

SEQ ID NO: 1823988 - RNA, 13 nt, Homo sapiens
cagggcugcaaug

SEQ ID NO: 1823989 - RNA, 22 nt, Homo sapiens
caauauuugcuaaacauuugcu

SEQ ID NO: 1823990 - RNA, 19 nt, Homo sapiens
caauaaagcagcguuucua

SEQ ID NO: 1823991 - RNA, 19 nt, Homo sapiens
gaaugagccuacgcugaag

SEQ ID NO: 1823992 - RNA, 18 nt, Homo sapiens
cugugggugcagcuguca

SEQ ID NO: 1823993 - RNA, 20 nt, Homo sapiens
cuccagccaaccucauugca

SEQ ID NO: 1823994 - RNA, 16 nt, Homo sapiens
ugagguuacaauuaga

SEQ ID NO: 1823995 - RNA, 20 nt, Homo sapiens
cuuugcuacaaauuuaugca

SEQ ID NO: 1823996 - RNA, 15 nt, Homo sapiens
caagugagacaauca

SEQ ID NO: 1823997 - RNA, 13 nt, Homo sapiens
auccuagcacuug

SEQ ID NO: 1823998 - RNA, 16 nt, Homo sapiens
acagaggagaugccac

SEQ ID NO: 1823999 - RNA, 19 nt, Homo sapiens
ucaaacagggcaaaguguu

SEQ ID NO: 1824000 - RNA, 15 nt, Homo sapiens
aguguguauccagaa

SEQ ID NO: 1824001 - RNA, 15 nt, Homo sapiens
ugugggucaaaccaa

SEQ ID NO: 1824002 - RNA, 16 nt, Homo sapiens
caauggaaacaaucuu

SEQ ID NO: 1824003 - RNA, 16 nt, Homo sapiens
ugccccuccuguacau

SEQ ID NO: 1824004 - RNA, 21 nt, Homo sapiens
cauucauggaccacuguuucu

SEQ ID NO: 1824005 - RNA, 16 nt, Homo sapiens
aaaaaguauguucuaa

SEQ ID NO: 1824006 - RNA, 18 nt, Homo sapiens
uauuugagagacugccau

SEQ ID NO: 1824007 - RNA, 23 nt, Homo sapiens
gacuucacuaaaaugaccaggau

SEQ ID NO: 1824008 - RNA, 19 nt, Homo sapiens
caugcaaguuacugcaguu

SEQ ID NO: 1824009 - RNA, 21 nt, Homo sapiens
uuaacaaacaggauauccaag

SEQ ID NO: 1824010 - RNA, 15 nt, Homo sapiens
ccguuccacauccac

SEQ ID NO: 1824011 - RNA, 23 nt, Homo sapiens
ugauccugcaaggggacauucca

SEQ ID NO: 1824012 - RNA, 17 nt, Homo sapiens
gccacugaauuaugcca

SEQ ID NO: 1824013 - RNA, 19 nt, Homo sapiens
ucuagucaggggaaaagac

SEQ ID NO: 1824014 - RNA, 20 nt, Homo sapiens
caguaguuugaucaguugaa

SEQ ID NO: 1824015 - RNA, 22 nt, Homo sapiens
uccacuggcuggacaaacugca

SEQ ID NO: 1824016 - RNA, 19 nt, Homo sapiens
acaacuucuaauugccaug

SEQ ID NO: 1824017 - RNA, 23 nt, Homo sapiens
ucuggaaaaaaacaaaaacagaa

SEQ ID NO: 1824018 - RNA, 22 nt, Homo sapiens
augguuuguuuucuacauugau

SEQ ID NO: 1824019 - RNA, 21 nt, Homo sapiens
aaggaucuaggagaagggucu

SEQ ID NO: 1824020 - RNA, 13 nt, Homo sapiens
aaauugucccauu

SEQ ID NO: 1824021 - RNA, 12 nt, Homo sapiens
cucucacuccag

SEQ ID NO: 1824022 - RNA, 17 nt, Homo sapiens
aauuuagaaaacauuca

SEQ ID NO: 1824023 - RNA, 22 nt, Homo sapiens
cagauagucccagcagccuccc

SEQ ID NO: 1824024 - RNA, 13 nt, Homo sapiens
auggcugugacac

SEQ ID NO: 1824025 - RNA, 22 nt, Homo sapiens
caugaagggagggucccugugu

SEQ ID NO: 1824026 - RNA, 17 nt, Homo sapiens
cccgagaagcacuugag

SEQ ID NO: 1824027 - RNA, 13 nt, Homo sapiens
aaccacucggggc

SEQ ID NO: 1824028 - RNA, 14 nt, Homo sapiens
aaaguauaugugca

SEQ ID NO: 1824029 - RNA, 18 nt, Homo sapiens
ucccggggccagcacuuc

SEQ ID NO: 1824030 - RNA, 19 nt, Homo sapiens
ucuuggguguuuauccuau

SEQ ID NO: 1824031 - RNA, 14 nt, Homo sapiens
auguaaaaagaucu

SEQ ID NO: 1824032 - RNA, 13 nt, Homo sapiens
acaauucugauga

SEQ ID NO: 1824033 - RNA, 13 nt, Homo sapiens
accaugcacugua

SEQ ID NO: 1824034 - RNA, 15 nt, Homo sapiens
cuuucaccaguuucu

SEQ ID NO: 1824035 - RNA, 12 nt, Homo sapiens
ccaaaaccaaac

SEQ ID NO: 1824036 - RNA, 23 nt, Homo sapiens
uguagcuuugcucuuugguagaa

SEQ ID NO: 1824037 - RNA, 17 nt, Homo sapiens
agcccaauguaaugcau

SEQ ID NO: 1824038 - RNA, 15 nt, Homo sapiens
uccucugccaccucc

SEQ ID NO: 1824039 - RNA, 20 nt, Homo sapiens
uaagcuucuugucauucuuc

SEQ ID NO: 1824040 - RNA, 21 nt, Homo sapiens
gcucucugacgcuugugacag

SEQ ID NO: 1824041 - RNA, 19 nt, Homo sapiens
ucuauugagccaagaccaa

SEQ ID NO: 1824042 - RNA, 17 nt, Homo sapiens
uaguuucaccaggaucu

SEQ ID NO: 1824043 - RNA, 15 nt, Homo sapiens
uucacauaugacaau

SEQ ID NO: 1824044 - RNA, 21 nt, Homo sapiens
uuuaacuagaauuuauucaau

SEQ ID NO: 1824045 - RNA, 20 nt, Homo sapiens
cucaaccucaccauugugaa

SEQ ID NO: 1824046 - RNA, 16 nt, Homo sapiens
ugcaaagccaccaaca

SEQ ID NO: 1824047 - RNA, 16 nt, Homo sapiens
uggacagacagccacc

SEQ ID NO: 1824048 - RNA, 21 nt, Homo sapiens
gcuggcgucaugcaaagucau

SEQ ID NO: 1824049 - RNA, 21 nt, Homo sapiens
ggcucgccauguuucugguga

SEQ ID NO: 1824050 - RNA, 14 nt, Homo sapiens
gaaauaauuacuuu

SEQ ID NO: 1824051 - RNA, 17 nt, Homo sapiens
cuuaauuuucccaauga

SEQ ID NO: 1824052 - RNA, 15 nt, Homo sapiens
uguaaaaagugcagu

SEQ ID NO: 1824053 - RNA, 15 nt, Homo sapiens
cagcuuggagugcca

SEQ ID NO: 1824054 - RNA, 15 nt, Homo sapiens
ugaugcacccaccuc

SEQ ID NO: 1824055 - RNA, 21 nt, Homo sapiens
aacugggaaauaagcaaaaaa

SEQ ID NO: 1824056 - RNA, 21 nt, Homo sapiens
ucuucauauucuaaaaccauu

SEQ ID NO: 1824057 - RNA, 19 nt, Homo sapiens
agcuagguggaaaagccug

SEQ ID NO: 1824058 - RNA, 18 nt, Homo sapiens
caagaauagcaucuguac

SEQ ID NO: 1824059 - RNA, 19 nt, Homo sapiens
cuggcuacaauuacuuuga

SEQ ID NO: 1824060 - RNA, 18 nt, Homo sapiens
accaaaugaugccacuuc

SEQ ID NO: 1824061 - RNA, 17 nt, Homo sapiens
acagcuaacaaguagca

SEQ ID NO: 1824062 - RNA, 16 nt, Homo sapiens
uccaacacugcaacau

SEQ ID NO: 1824063 - RNA, 21 nt, Homo sapiens
gggcaguguggccucuuggcu

SEQ ID NO: 1824064 - RNA, 20 nt, Homo sapiens
aauugaagaaagucagcucu

SEQ ID NO: 1824065 - RNA, 21 nt, Homo sapiens
cuagacuggcugaaaaaccua

SEQ ID NO: 1824066 - RNA, 21 nt, Homo sapiens
auaugcacaauagcaguugaa

SEQ ID NO: 1824067 - RNA, 21 nt, Homo sapiens
cuucgcagccuagauaugaag

SEQ ID NO: 1824068 - RNA, 18 nt, Homo sapiens
acuagacaucugcuguua

SEQ ID NO: 1824069 - RNA, 19 nt, Homo sapiens
cuggaucuugggaccucca

SEQ ID NO: 1824070 - RNA, 16 nt, Homo sapiens
ugccccaaccacaaac

SEQ ID NO: 1824071 - RNA, 12 nt, Homo sapiens
uugucaguucuu

SEQ ID NO: 1824072 - RNA, 14 nt, Homo sapiens
gggacuccaugcug

SEQ ID NO: 1824073 - RNA, 23 nt, Homo sapiens
aaaaccaacaaaaagaacaaauc

SEQ ID NO: 1824074 - RNA, 14 nt, Homo sapiens
uaaguaaaaccaca

SEQ ID NO: 1824075 - RNA, 13 nt, Homo sapiens
aauacucuccuaa

SEQ ID NO: 1824076 - RNA, 15 nt, Homo sapiens
acugcaagcacugca

SEQ ID NO: 1824077 - RNA, 19 nt, Homo sapiens
uaguccuugggcaguucuc

SEQ ID NO: 1824078 - RNA, 15 nt, Homo sapiens
cuuuuuauacuauua

SEQ ID NO: 1824079 - RNA, 14 nt, Homo sapiens
cugccucuauucaa

SEQ ID NO: 1824080 - RNA, 13 nt, Homo sapiens
cgcuccccugaga

SEQ ID NO: 1824081 - RNA, 16 nt, Homo sapiens
ugcccccauucuccca

SEQ ID NO: 1824082 - RNA, 16 nt, Homo sapiens
aguuccagauucccag

SEQ ID NO: 1824083 - RNA, 16 nt, Homo sapiens
cucuguagauacaggg

SEQ ID NO: 1824084 - RNA, 15 nt, Homo sapiens
acuacaacagaauuu

SEQ ID NO: 1824085 - RNA, 18 nt, Homo sapiens
uguauuaucuguccaaaa

SEQ ID NO: 1824086 - RNA, 17 nt, Homo sapiens
gaaccgcacagcucagg

SEQ ID NO: 1824087 - RNA, 17 nt, Homo sapiens
cagcuaggcugagaugc

SEQ ID NO: 1824088 - RNA, 13 nt, Homo sapiens
uagaaaaacuugg

SEQ ID NO: 1824089 - RNA, 17 nt, Homo sapiens
aaacaagucaauucugu

SEQ ID NO: 1824090 - RNA, 21 nt, Homo sapiens
ugcuucuucaauggcaccuuc

SEQ ID NO: 1824091 - RNA, 16 nt, Homo sapiens
cuuuuugaaagaacau

SEQ ID NO: 1824092 - RNA, 18 nt, Homo sapiens
gaccuugaaugaugccau

SEQ ID NO: 1824093 - RNA, 20 nt, Homo sapiens
agugccauauucugugauca

SEQ ID NO: 1824094 - RNA, 14 nt, Homo sapiens
ugacaggauaugag

SEQ ID NO: 1824095 - RNA, 16 nt, Homo sapiens
aguaucuugguuguga

SEQ ID NO: 1824096 - RNA, 11 nt, Homo sapiens
aggagcucaac

SEQ ID NO: 1824097 - RNA, 23 nt, Homo sapiens
caugguuauuccccccuacuuga

SEQ ID NO: 1824098 - RNA, 15 nt, Homo sapiens
ugaccgaacacugca

SEQ ID NO: 1824099 - RNA, 16 nt, Homo sapiens
agaguagagaugcugg

SEQ ID NO: 1824100 - RNA, 12 nt, Homo sapiens
uaaaaaguaaug

SEQ ID NO: 1824101 - RNA, 15 nt, Homo sapiens
acgcgugcaugcaca

SEQ ID NO: 1824102 - RNA, 14 nt, Homo sapiens
agaaaugaacauuc

SEQ ID NO: 1824103 - RNA, 16 nt, Homo sapiens
ugaaaaugaauaucua

SEQ ID NO: 1824104 - RNA, 19 nt, Homo sapiens
gagucuuugguucuaagga

SEQ ID NO: 1824105 - RNA, 14 nt, Homo sapiens
agacugccagggag

SEQ ID NO: 1824106 - RNA, 14 nt, Homo sapiens
auauguacacugga

SEQ ID NO: 1824107 - RNA, 13 nt, Homo sapiens
cuucuaaaagcua

SEQ ID NO: 1824108 - RNA, 22 nt, Homo sapiens
cacuucucuccaggcuguuucu

SEQ ID NO: 1824109 - RNA, 16 nt, Homo sapiens
gcucgcuuugagugac

SEQ ID NO: 1824110 - RNA, 16 nt, Homo sapiens
aaccuuuugcuccuau

SEQ ID NO: 1824111 - RNA, 14 nt, Homo sapiens
augagagaacugga

SEQ ID NO: 1824112 - RNA, 23 nt, Homo sapiens
ccugggaagagggaaggugcacg

SEQ ID NO: 1824113 - RNA, 24 nt, Homo sapiens
acuauccaaguguuauaccaacua

SEQ ID NO: 1824114 - RNA, 23 nt, Homo sapiens
aguauuugggaagugaagacugg

SEQ ID NO: 1824115 - RNA, 17 nt, Homo sapiens
aagauguauccuuccaa

SEQ ID NO: 1824116 - RNA, 17 nt, Homo sapiens
cacauacaccacaaaaa

SEQ ID NO: 1824117 - RNA, 17 nt, Homo sapiens
acaaagaugaccugcug

SEQ ID NO: 1824118 - RNA, 20 nt, Homo sapiens
aaaagugcuuugcuggaguc

SEQ ID NO: 1824119 - RNA, 12 nt, Homo sapiens
guccuccagaca

SEQ ID NO: 1824120 - RNA, 17 nt, Homo sapiens
aagcuuggucaaacuuu

SEQ ID NO: 1824121 - RNA, 15 nt, Homo sapiens
guuacaugcauucua

SEQ ID NO: 1824122 - RNA, 16 nt, Homo sapiens
cuagaggcaagccugg

SEQ ID NO: 1824123 - RNA, 19 nt, Homo sapiens
cacugccggcccagugaca

SEQ ID NO: 1824124 - RNA, 14 nt, Homo sapiens
auuuuaaaauugca

SEQ ID NO: 1824125 - RNA, 21 nt, Homo sapiens
gaugaucuggauccaccaaga

SEQ ID NO: 1824126 - RNA, 16 nt, Homo sapiens
augauaaauguaucaa

SEQ ID NO: 1824127 - RNA, 14 nt, Homo sapiens
uaaauuuuagcaag

SEQ ID NO: 1824128 - RNA, 12 nt, Homo sapiens
ggccaucacuca

SEQ ID NO: 1824129 - RNA, 16 nt, Homo sapiens
ccuuggcugucugugg

SEQ ID NO: 1824130 - RNA, 12 nt, Homo sapiens
caggaccaccuc

SEQ ID NO: 1824131 - RNA, 15 nt, Homo sapiens
ggagcuaaaacuggc

SEQ ID NO: 1824132 - RNA, 13 nt, Homo sapiens
cugucuccaugcu

SEQ ID NO: 1824133 - RNA, 13 nt, Homo sapiens
gcuuagaccucag

SEQ ID NO: 1824134 - RNA, 22 nt, Homo sapiens
gagcacuguccaguauucuacc

SEQ ID NO: 1824135 - RNA, 22 nt, Homo sapiens
aacuauaacaccugccaccacu

SEQ ID NO: 1824136 - RNA, 17 nt, Homo sapiens
agcguagcuaagugaaa

SEQ ID NO: 1824137 - RNA, 22 nt, Homo sapiens
agccccauucugccugcccagg

SEQ ID NO: 1824138 - RNA, 23 nt, Homo sapiens
gaggccugugaagccaaacaaua

SEQ ID NO: 1824139 - RNA, 17 nt, Homo sapiens
cucccccagaccuccac

SEQ ID NO: 1824140 - RNA, 14 nt, Homo sapiens
ucauguaaacauac

SEQ ID NO: 1824141 - RNA, 15 nt, Homo sapiens
gcauacagagacaga

SEQ ID NO: 1824142 - RNA, 14 nt, Homo sapiens
ggauuuccagggau

SEQ ID NO: 1824143 - RNA, 17 nt, Homo sapiens
ugcuugcccccaugugg

SEQ ID NO: 1824144 - RNA, 23 nt, Homo sapiens
uagcugguucacacugaccaaga

SEQ ID NO: 1824145 - RNA, 17 nt, Homo sapiens
cuugucuuaaggucaua

SEQ ID NO: 1824146 - RNA, 17 nt, Homo sapiens
caucucuccugcucacc

SEQ ID NO: 1824147 - RNA, 15 nt, Homo sapiens
caccauggugacugc

SEQ ID NO: 1824148 - RNA, 21 nt, Homo sapiens
gagaccuuugauuuuugccca

SEQ ID NO: 1824149 - RNA, 18 nt, Homo sapiens
acgcucauuacuacccuc

SEQ ID NO: 1824150 - RNA, 13 nt, Homo sapiens
gugugaguguaug

SEQ ID NO: 1824151 - RNA, 14 nt, Homo sapiens
gccaagagucacuu

SEQ ID NO: 1824152 - RNA, 22 nt, Homo sapiens
aaaaaugcuugcuucaacccca

SEQ ID NO: 1824153 - RNA, 19 nt, Homo sapiens
aucuaugggaaaaaucuaa

SEQ ID NO: 1824154 - RNA, 16 nt, Homo sapiens
accuacucacacaggc

SEQ ID NO: 1824155 - RNA, 13 nt, Homo sapiens
cuuagagcucuca

SEQ ID NO: 1824156 - RNA, 22 nt, Homo sapiens
aaaaauuacuguuuaauugaca

SEQ ID NO: 1824157 - RNA, 19 nt, Homo sapiens
ugaggguggggugccccag

SEQ ID NO: 1824158 - RNA, 17 nt, Homo sapiens
aagguaccuuugucugc

SEQ ID NO: 1824159 - RNA, 14 nt, Homo sapiens
guguggggccaugc

SEQ ID NO: 1824160 - RNA, 22 nt, Homo sapiens
cuuccaaccauuuaucuugaag

SEQ ID NO: 1824161 - RNA, 19 nt, Homo sapiens
aaucagguaaaauagucau

SEQ ID NO: 1824162 - RNA, 14 nt, Homo sapiens
ccuaacauugugau

SEQ ID NO: 1824163 - RNA, 19 nt, Homo sapiens
uauguaugugugaguguau

SEQ ID NO: 1824164 - RNA, 21 nt, Homo sapiens
uuuauuaacauugauuggcau

SEQ ID NO: 1824165 - RNA, 16 nt, Homo sapiens
uaaaacuucaguuuca

SEQ ID NO: 1824166 - RNA, 16 nt, Homo sapiens
uagcccaggacccauc

SEQ ID NO: 1824167 - RNA, 19 nt, Homo sapiens
ggccugcagugauucagca

SEQ ID NO: 1824168 - RNA, 22 nt, Homo sapiens
gugguguuuucagggcacugug

SEQ ID NO: 1824169 - RNA, 19 nt, Homo sapiens
cuuuccaaagccaauguga

SEQ ID NO: 1824170 - RNA, 16 nt, Homo sapiens
cuugaaguacuuaaca

SEQ ID NO: 1824171 - RNA, 17 nt, Homo sapiens
auaaagggacacuuuua

SEQ ID NO: 1824172 - RNA, 15 nt, Homo sapiens
aagagucugucucaa

SEQ ID NO: 1824173 - RNA, 14 nt, Homo sapiens
auuuuaaguucucu

SEQ ID NO: 1824174 - RNA, 23 nt, Homo sapiens
gaaaugcugauguauccuuucau

SEQ ID NO: 1824175 - RNA, 22 nt, Homo sapiens
ccccaccaaugggccuccagag

SEQ ID NO: 1824176 - RNA, 12 nt, Homo sapiens
ugaccugcacac

SEQ ID NO: 1824177 - RNA, 15 nt, Homo sapiens
uaagaaauaaggcua

SEQ ID NO: 1824178 - RNA, 21 nt, Homo sapiens
ugcaacuaggaagagacacac

SEQ ID NO: 1824179 - RNA, 17 nt, Homo sapiens
gcagaaggcaaggcccu

SEQ ID NO: 1824180 - RNA, 21 nt, Homo sapiens
uaucauggaaauauuaugcaa

SEQ ID NO: 1824181 - RNA, 14 nt, Homo sapiens
gacgcacagcacug

SEQ ID NO: 1824182 - RNA, 20 nt, Homo sapiens
agccuguccucaccgucucg

SEQ ID NO: 1824183 - RNA, 19 nt, Homo sapiens
uccuaagucucuuacaaaa

SEQ ID NO: 1824184 - RNA, 19 nt, Homo sapiens
ccaggccagcgcugcaacc

SEQ ID NO: 1824185 - RNA, 16 nt, Homo sapiens
ugauaaugcagacuuc

SEQ ID NO: 1824186 - RNA, 17 nt, Homo sapiens
gaaagaugaugcucagu

SEQ ID NO: 1824187 - RNA, 17 nt, Homo sapiens
ugcaacuuaaguauauu

SEQ ID NO: 1824188 - RNA, 16 nt, Homo sapiens
cauucaucaagcugua

SEQ ID NO: 1824189 - RNA, 22 nt, Homo sapiens
accccgcaagcaccauccccuc

SEQ ID NO: 1824190 - RNA, 19 nt, Homo sapiens
agaaguacuuuaccugaaa

SEQ ID NO: 1824191 - RNA, 19 nt, Homo sapiens
gcucccccuccagccagag

SEQ ID NO: 1824192 - RNA, 21 nt, Homo sapiens
agcugcugaaacaacaaauag

SEQ ID NO: 1824193 - RNA, 14 nt, Homo sapiens
ugggagaaggcagu

SEQ ID NO: 1824194 - RNA, 15 nt, Homo sapiens
gaaacccuauggaga

SEQ ID NO: 1824195 - RNA, 21 nt, Homo sapiens
cauuuguaugucaaagcuuug

SEQ ID NO: 1824196 - RNA, 17 nt, Homo sapiens
accaucagggacaggau

SEQ ID NO: 1824197 - RNA, 18 nt, Homo sapiens
cagggccucugggagccu

SEQ ID NO: 1824198 - RNA, 21 nt, Homo sapiens
auggugggagagacugugagg

SEQ ID NO: 1824199 - RNA, 16 nt, Homo sapiens
augugucuugcaauga

SEQ ID NO: 1824200 - RNA, 20 nt, Homo sapiens
gcaaacucuaaaagaagaaa

SEQ ID NO: 1824201 - RNA, 21 nt, Homo sapiens
ggagaguaccuguguguuucg

SEQ ID NO: 1824202 - RNA, 15 nt, Homo sapiens
aggggaucuaaaaaa

SEQ ID NO: 1824203 - RNA, 11 nt, Homo sapiens
uucuauacugu

SEQ ID NO: 1824204 - RNA, 17 nt, Homo sapiens
auuuccccaguugcccu

SEQ ID NO: 1824205 - RNA, 13 nt, Homo sapiens
caccaacuugcca

SEQ ID NO: 1824206 - RNA, 22 nt, Homo sapiens
accucgucaagagcaugcacau

SEQ ID NO: 1824207 - RNA, 17 nt, Homo sapiens
cucagucccaucagaga

SEQ ID NO: 1824208 - RNA, 13 nt, Homo sapiens
uagguuuguagua

SEQ ID NO: 1824209 - RNA, 15 nt, Homo sapiens
augguuccauucucu

SEQ ID NO: 1824210 - RNA, 15 nt, Homo sapiens
cuucuucccuggucu

SEQ ID NO: 1824211 - RNA, 15 nt, Homo sapiens
cucuuagcacacuca

SEQ ID NO: 1824212 - RNA, 20 nt, Homo sapiens
uuuccauuggaaauaacugg

SEQ ID NO: 1824213 - RNA, 15 nt, Homo sapiens
uguccuccaccugcc

SEQ ID NO: 1824214 - RNA, 15 nt, Homo sapiens
aaguacccugagaua

SEQ ID NO: 1824215 - RNA, 20 nt, Homo sapiens
aaaagacugguuuguuugcu

SEQ ID NO: 1824216 - RNA, 21 nt, Homo sapiens
acuucuuacuucccuaaugaa

SEQ ID NO: 1824217 - RNA, 17 nt, Homo sapiens
caguuccuuugaucucg

SEQ ID NO: 1824218 - RNA, 22 nt, Homo sapiens
ggaagaucuaccugcaacacaa

SEQ ID NO: 1824219 - RNA, 19 nt, Homo sapiens
uauguaccauguacaugaa

SEQ ID NO: 1824220 - RNA, 18 nt, Homo sapiens
cauagcuguauauuugaa

SEQ ID NO: 1824221 - RNA, 18 nt, Homo sapiens
aucagauguuuuggucaa

SEQ ID NO: 1824222 - RNA, 23 nt, Homo sapiens
aauguuuuuauuuucucuaucaa

SEQ ID NO: 1824223 - RNA, 19 nt, Homo sapiens
acccucucaaguccaucaa

SEQ ID NO: 1824224 - RNA, 22 nt, Homo sapiens
uguguuuuuaagauuaguugaa

SEQ ID NO: 1824225 - RNA, 14 nt, Homo sapiens
gaaguguauuuuau

SEQ ID NO: 1824226 - RNA, 13 nt, Homo sapiens
auuuccuuuaugu

SEQ ID NO: 1824227 - RNA, 18 nt, Homo sapiens
gauacuccaccagugaaa

SEQ ID NO: 1824228 - RNA, 15 nt, Homo sapiens
ugcacuugaacacug

SEQ ID NO: 1824229 - RNA, 14 nt, Homo sapiens
caaauuuacuuuaa

SEQ ID NO: 1824230 - RNA, 22 nt, Homo sapiens
aaggggcccaagccccaucuca

SEQ ID NO: 1824231 - RNA, 21 nt, Homo sapiens
guaacaggguagugugguauu

SEQ ID NO: 1824232 - RNA, 21 nt, Homo sapiens
uauggaaacagagcaaaagaa

SEQ ID NO: 1824233 - RNA, 15 nt, Homo sapiens
ugccauuuagcaaua

SEQ ID NO: 1824234 - RNA, 17 nt, Homo sapiens
uccccacacagggcacu

SEQ ID NO: 1824235 - RNA, 16 nt, Homo sapiens
cuucugugcaccuggg

SEQ ID NO: 1824236 - RNA, 21 nt, Homo sapiens
gacucucucugggaggccaua

SEQ ID NO: 1824237 - RNA, 18 nt, Homo sapiens
cucguucaaaacauucca

SEQ ID NO: 1824238 - RNA, 19 nt, Homo sapiens
ccucuaacagcacagggaa

SEQ ID NO: 1824239 - RNA, 20 nt, Homo sapiens
acuugggcuggcacccacug

SEQ ID NO: 1824240 - RNA, 22 nt, Homo sapiens
augugcgcgcgugcaugugugc

SEQ ID NO: 1824241 - RNA, 23 nt, Homo sapiens
accuauaccuguguuucuugccu

SEQ ID NO: 1824242 - RNA, 22 nt, Homo sapiens
ccauuacucaaaaugcaggaca

SEQ ID NO: 1824243 - RNA, 19 nt, Homo sapiens
acccuacacccagacccca

SEQ ID NO: 1824244 - RNA, 21 nt, Homo sapiens
aagcugagugacuguaggcag

SEQ ID NO: 1824245 - RNA, 20 nt, Homo sapiens
ugcaaacucuuuggucguuu

SEQ ID NO: 1824246 - RNA, 22 nt, Homo sapiens
accucuccuuucugugcauuca

SEQ ID NO: 1824247 - RNA, 17 nt, Homo sapiens
ucacccccaaacaguga

SEQ ID NO: 1824248 - RNA, 14 nt, Homo sapiens
ccuccugugcuauu

SEQ ID NO: 1824249 - RNA, 19 nt, Homo sapiens
agaucacgccauugcacuc

SEQ ID NO: 1824250 - RNA, 22 nt, Homo sapiens
uggcccauguauggccaggaag

SEQ ID NO: 1824251 - RNA, 17 nt, Homo sapiens
cccagugcccccacuga

SEQ ID NO: 1824252 - RNA, 18 nt, Homo sapiens
uguuaacuuuguggucua

SEQ ID NO: 1824253 - RNA, 19 nt, Homo sapiens
gcauucccucccaucaugc

SEQ ID NO: 1824254 - RNA, 18 nt, Homo sapiens
cugguguauguuuaucaa

SEQ ID NO: 1824255 - RNA, 12 nt, Homo sapiens
cccagcacccag

SEQ ID NO: 1824256 - RNA, 12 nt, Homo sapiens
auaacuguuuau

SEQ ID NO: 1824257 - RNA, 12 nt, Homo sapiens
aacucuguuaca

SEQ ID NO: 1824258 - RNA, 21 nt, Homo sapiens
uuccuccuuugcagugucuua

SEQ ID NO: 1824259 - RNA, 17 nt, Homo sapiens
gguccacucagggcugc

SEQ ID NO: 1824260 - RNA, 17 nt, Homo sapiens
gacugaaggacaucuga

SEQ ID NO: 1824261 - RNA, 15 nt, Homo sapiens
aggaaaugaaccaca

SEQ ID NO: 1824262 - RNA, 11 nt, Homo sapiens
aggaaaaccag

SEQ ID NO: 1824263 - RNA, 16 nt, Homo sapiens
ccugccacuuugcaug

SEQ ID NO: 1824264 - RNA, 16 nt, Homo sapiens
auaucaccagucuuac

SEQ ID NO: 1824265 - RNA, 15 nt, Homo sapiens
aacacaaugccucau

SEQ ID NO: 1824266 - RNA, 15 nt, Homo sapiens
aauaucuugcuuuca

SEQ ID NO: 1824267 - RNA, 23 nt, Homo sapiens
ucucagauguugaaacuuugaau

SEQ ID NO: 1824268 - RNA, 19 nt, Homo sapiens
aauugucugccauuacacc

SEQ ID NO: 1824269 - RNA, 16 nt, Homo sapiens
gacauucucugaccua

SEQ ID NO: 1824270 - RNA, 17 nt, Homo sapiens
aaguuugcacucuuuga

SEQ ID NO: 1824271 - RNA, 21 nt, Homo sapiens
acaggcccuggagaagcagcu

SEQ ID NO: 1824272 - RNA, 14 nt, Homo sapiens
uaaggccaaugggc

SEQ ID NO: 1824273 - RNA, 13 nt, Homo sapiens
aauguguauucau

SEQ ID NO: 1824274 - RNA, 19 nt, Homo sapiens
ucuguuaacaucuagccua

SEQ ID NO: 1824275 - RNA, 15 nt, Homo sapiens
ccuucccaaucuucu

SEQ ID NO: 1824276 - RNA, 13 nt, Homo sapiens
guucgaagcuccg

SEQ ID NO: 1824277 - RNA, 23 nt, Homo sapiens
uuuugugauucaaaauguacuau

SEQ ID NO: 1824278 - RNA, 17 nt, Homo sapiens
gaaguggauuuaacuaa

SEQ ID NO: 1824279 - RNA, 23 nt, Homo sapiens
aaaaaccauaaacauuugcacca

SEQ ID NO: 1824280 - RNA, 23 nt, Homo sapiens
cuguaaucccagcuaccugggag

SEQ ID NO: 1824281 - RNA, 13 nt, Homo sapiens
ccggcuuugccau

SEQ ID NO: 1824282 - RNA, 19 nt, Homo sapiens
aguaccugaaaaaaugcca

SEQ ID NO: 1824283 - RNA, 22 nt, Homo sapiens
ccagggacugaagccaaaguua

SEQ ID NO: 1824284 - RNA, 19 nt, Homo sapiens
auucucucaucuaacugau

SEQ ID NO: 1824285 - RNA, 15 nt, Homo sapiens
cuguuucaagcccuc

SEQ ID NO: 1824286 - RNA, 19 nt, Homo sapiens
agaaccucagcauuuccuu

SEQ ID NO: 1824287 - RNA, 16 nt, Homo sapiens
auaaaauuaugccaua

SEQ ID NO: 1824288 - RNA, 14 nt, Homo sapiens
ccaacccacuggcc

SEQ ID NO: 1824289 - RNA, 21 nt, Homo sapiens
acauaccaggcaaccucccau

SEQ ID NO: 1824290 - RNA, 21 nt, Homo sapiens
aauauagauguuagcccaaga

SEQ ID NO: 1824291 - RNA, 11 nt, Homo sapiens
ugaaacagggc

SEQ ID NO: 1824292 - RNA, 21 nt, Homo sapiens
gcaacuccuccauuuuccucc

SEQ ID NO: 1824293 - RNA, 14 nt, Homo sapiens
acgcaguucuuucc

SEQ ID NO: 1824294 - RNA, 12 nt, Homo sapiens
cuguuacugugu

SEQ ID NO: 1824295 - RNA, 12 nt, Homo sapiens
ccauuacugcau

SEQ ID NO: 1824296 - RNA, 23 nt, Homo sapiens
acuguauaacuauuuacuauuca

SEQ ID NO: 1824297 - RNA, 22 nt, Homo sapiens
gacucaccaacuuuuaauggga

SEQ ID NO: 1824298 - RNA, 22 nt, Homo sapiens
uucugcuguugccucucuuuga

SEQ ID NO: 1824299 - RNA, 15 nt, Homo sapiens
gcacgcccaugugug

SEQ ID NO: 1824300 - RNA, 20 nt, Homo sapiens
ggcaagugauauugucuuca

SEQ ID NO: 1824301 - RNA, 17 nt, Homo sapiens
cucuaucccaaccucuc

SEQ ID NO: 1824302 - RNA, 13 nt, Homo sapiens
caccaggugucaa

SEQ ID NO: 1824303 - RNA, 11 nt, Homo sapiens
uuugcauaaag

SEQ ID NO: 1824304 - RNA, 22 nt, Homo sapiens
acauagggacauaaguucauuc

SEQ ID NO: 1824305 - RNA, 18 nt, Homo sapiens
cugaacuuucucuagcaa

SEQ ID NO: 1824306 - RNA, 21 nt, Homo sapiens
gacaaaucaacagaagcauuu

SEQ ID NO: 1824307 - RNA, 19 nt, Homo sapiens
uaaagcuuugucuuuuugu

SEQ ID NO: 1824308 - RNA, 22 nt, Homo sapiens
gaauaugggguugguguucuca

SEQ ID NO: 1824309 - RNA, 15 nt, Homo sapiens
ggaaguagcugucag

SEQ ID NO: 1824310 - RNA, 13 nt, Homo sapiens
gacugacaguuua

SEQ ID NO: 1824311 - RNA, 13 nt, Homo sapiens
aauguacuacauu

SEQ ID NO: 1824312 - RNA, 17 nt, Homo sapiens
uauaaaauuaacauaaa

SEQ ID NO: 1824313 - RNA, 14 nt, Homo sapiens
agcaugagacuuuc

SEQ ID NO: 1824314 - RNA, 16 nt, Homo sapiens
acuaaaagugauguga

SEQ ID NO: 1824315 - RNA, 21 nt, Homo sapiens
guguugaagaagaguuugcaa

SEQ ID NO: 1824316 - RNA, 14 nt, Homo sapiens
agagaccaucuccu

SEQ ID NO: 1824317 - RNA, 23 nt, Homo sapiens
uuugucugagacagaaucucagu

SEQ ID NO: 1824318 - RNA, 20 nt, Homo sapiens
uggcccagcuccccaagaaa

SEQ ID NO: 1824319 - RNA, 21 nt, Homo sapiens
aaucuguuucuauguccaaac

SEQ ID NO: 1824320 - RNA, 19 nt, Homo sapiens
uaauucuuaggguacucau

SEQ ID NO: 1824321 - RNA, 12 nt, Homo sapiens
cugaaggugcug

SEQ ID NO: 1824322 - RNA, 16 nt, Homo sapiens
ucagacauaaagccau

SEQ ID NO: 1824323 - RNA, 15 nt, Homo sapiens
guaauugcuugacaa

SEQ ID NO: 1824324 - RNA, 18 nt, Homo sapiens
ccuccugcucuaccagga

SEQ ID NO: 1824325 - RNA, 17 nt, Homo sapiens
gcccagucgauaucuca

SEQ ID NO: 1824326 - RNA, 23 nt, Homo sapiens
ugagcacaaaauuaugcaaauau

SEQ ID NO: 1824327 - RNA, 21 nt, Homo sapiens
cuuuguaagcgggacauuuag

SEQ ID NO: 1824328 - RNA, 15 nt, Homo sapiens
acucauuucuagcag

SEQ ID NO: 1824329 - RNA, 19 nt, Homo sapiens
ucuuagugcaaaaaacaua

SEQ ID NO: 1824330 - RNA, 19 nt, Homo sapiens
ccuucugccaguucccucc

SEQ ID NO: 1824331 - RNA, 15 nt, Homo sapiens
ucauuauuugcagag

SEQ ID NO: 1824332 - RNA, 14 nt, Homo sapiens
ucaucucacugccc

SEQ ID NO: 1824333 - RNA, 11 nt, Homo sapiens
aggaccacuga

SEQ ID NO: 1824334 - RNA, 18 nt, Homo sapiens
ucccacccugcaaaggga

SEQ ID NO: 1824335 - RNA, 15 nt, Homo sapiens
augcauaaaauguua

SEQ ID NO: 1824336 - RNA, 21 nt, Homo sapiens
ccuggaaccaggcuugccugg

SEQ ID NO: 1824337 - RNA, 20 nt, Homo sapiens
caucugccagaccuuaauaa

SEQ ID NO: 1824338 - RNA, 18 nt, Homo sapiens
cuugcugccaaaagccuu

SEQ ID NO: 1824339 - RNA, 19 nt, Homo sapiens
ugcuuaaacaaaacuggaa

SEQ ID NO: 1824340 - RNA, 17 nt, Homo sapiens
ucuaaaaagaaaugaag

SEQ ID NO: 1824341 - RNA, 17 nt, Homo sapiens
aaugaaugucaguguga

SEQ ID NO: 1824342 - RNA, 16 nt, Homo sapiens
cagguaguacugggaa

SEQ ID NO: 1824343 - RNA, 17 nt, Homo sapiens
cccacuguggcugauuu

SEQ ID NO: 1824344 - RNA, 16 nt, Homo sapiens
agaagggauaacccua

SEQ ID NO: 1824345 - RNA, 13 nt, Homo sapiens
ccauuaugccugg

SEQ ID NO: 1824346 - RNA, 19 nt, Homo sapiens
ucuuucuguaaacagaaua

SEQ ID NO: 1824347 - RNA, 18 nt, Homo sapiens
ucucaacaauauaugucc

SEQ ID NO: 1824348 - RNA, 18 nt, Homo sapiens
uuugauauaauuguacug

SEQ ID NO: 1824349 - RNA, 20 nt, Homo sapiens
ugaugcugccggcacagcug

SEQ ID NO: 1824350 - RNA, 14 nt, Homo sapiens
aaacccccacucca

SEQ ID NO: 1824351 - RNA, 22 nt, Homo sapiens
agugauccuccugccucagucu

SEQ ID NO: 1824352 - RNA, 14 nt, Homo sapiens
uuauacaauacaga

SEQ ID NO: 1824353 - RNA, 22 nt, Homo sapiens
guaugcauaugauuguccguga

SEQ ID NO: 1824354 - RNA, 20 nt, Homo sapiens
cccaaaccagcccagagcag

SEQ ID NO: 1824355 - RNA, 21 nt, Homo sapiens
auuugcauugaggaaauauua

SEQ ID NO: 1824356 - RNA, 19 nt, Homo sapiens
cuaaguaaagcacaguccc

SEQ ID NO: 1824357 - RNA, 16 nt, Homo sapiens
uucagccgagguccaa

SEQ ID NO: 1824358 - RNA, 19 nt, Homo sapiens
uuaccauauaauguaaaaa

SEQ ID NO: 1824359 - RNA, 22 nt, Homo sapiens
auauauuuauuuaagcuuaugu

SEQ ID NO: 1824360 - RNA, 19 nt, Homo sapiens
acgucacaaagaccuugcu

SEQ ID NO: 1824361 - RNA, 20 nt, Homo sapiens
aacgugaugcuaugcauguc

SEQ ID NO: 1824362 - RNA, 23 nt, Homo sapiens
ugaaguuagggaugacugugauu

SEQ ID NO: 1824363 - RNA, 13 nt, Homo sapiens
uccccagggggca

SEQ ID NO: 1824364 - RNA, 17 nt, Homo sapiens
uacuauaaaagcuuucu

SEQ ID NO: 1824365 - RNA, 22 nt, Homo sapiens
cgccuguaaucccagcacuuug

SEQ ID NO: 1824366 - RNA, 15 nt, Homo sapiens
gccaagcaggacagu

SEQ ID NO: 1824367 - RNA, 15 nt, Homo sapiens
agagaugaaagaggg

SEQ ID NO: 1824368 - RNA, 21 nt, Homo sapiens
gccuguggaggaacuuuucaa

SEQ ID NO: 1824369 - RNA, 14 nt, Homo sapiens
cgaaaucaaaccac

SEQ ID NO: 1824370 - RNA, 15 nt, Homo sapiens
aacacgccacagccu

SEQ ID NO: 1824371 - RNA, 13 nt, Homo sapiens
aggaacagcacug

SEQ ID NO: 1824372 - RNA, 18 nt, Homo sapiens
cuggaggccggaaucuca

SEQ ID NO: 1824373 - RNA, 18 nt, Homo sapiens
gaugucguuugaaucaca

SEQ ID NO: 1824374 - RNA, 16 nt, Homo sapiens
cuguggcggugcagug

SEQ ID NO: 1824375 - RNA, 23 nt, Homo sapiens
gcuuaaugauagucuuacuaaau

SEQ ID NO: 1824376 - RNA, 12 nt, Homo sapiens
cacagaaguagc

SEQ ID NO: 1824377 - RNA, 23 nt, Homo sapiens
aauagauaaaaaucccagacuac

SEQ ID NO: 1824378 - RNA, 17 nt, Homo sapiens
agagguggagugucaca

SEQ ID NO: 1824379 - RNA, 13 nt, Homo sapiens
aaaugacuuugaa

SEQ ID NO: 1824380 - RNA, 17 nt, Homo sapiens
ccuugccuauuugcuga

SEQ ID NO: 1824381 - RNA, 16 nt, Homo sapiens
augggucucucuugcc

SEQ ID NO: 1824382 - RNA, 20 nt, Homo sapiens
cucagcacuguuuucaucac

SEQ ID NO: 1824383 - RNA, 20 nt, Homo sapiens
ggauuacaggcuccugccac

SEQ ID NO: 1824384 - RNA, 12 nt, Homo sapiens
aacuucugccuc

SEQ ID NO: 1824385 - RNA, 15 nt, Homo sapiens
uaaagcaaacaugca

SEQ ID NO: 1824386 - RNA, 13 nt, Homo sapiens
uagauugcucaaa

SEQ ID NO: 1824387 - RNA, 12 nt, Homo sapiens
agccagugcuag

SEQ ID NO: 1824388 - RNA, 13 nt, Homo sapiens
cuguuucaccuuu

SEQ ID NO: 1824389 - RNA, 15 nt, Homo sapiens
aguaaugauauuuau

SEQ ID NO: 1824390 - RNA, 23 nt, Homo sapiens
cuuucauuauagcagagaguuuu

SEQ ID NO: 1824391 - RNA, 16 nt, Homo sapiens
cccugcaggcaggcag

SEQ ID NO: 1824392 - RNA, 17 nt, Homo sapiens
agauuuaagccuuacaa

SEQ ID NO: 1824393 - RNA, 13 nt, Homo sapiens
cagaagaaagggc

SEQ ID NO: 1824394 - RNA, 16 nt, Homo sapiens
auccagaaauaaugaa

SEQ ID NO: 1824395 - RNA, 18 nt, Homo sapiens
cccuggcucaagcgaucc

SEQ ID NO: 1824396 - RNA, 19 nt, Homo sapiens
ucagaagcaguauauucua

SEQ ID NO: 1824397 - RNA, 22 nt, Homo sapiens
cagagauggcagagccauccac

SEQ ID NO: 1824398 - RNA, 11 nt, Homo sapiens
ccauagcuauu

SEQ ID NO: 1824399 - RNA, 18 nt, Homo sapiens
ugaaggggcuucuaauga

SEQ ID NO: 1824400 - RNA, 20 nt, Homo sapiens
cuccauccugaaagccaaga

SEQ ID NO: 1824401 - RNA, 17 nt, Homo sapiens
cacgagaucaacacaca

SEQ ID NO: 1824402 - RNA, 18 nt, Homo sapiens
aacuuaaguuacugggua

SEQ ID NO: 1824403 - RNA, 18 nt, Homo sapiens
aaaauuuuguauguuaaa

SEQ ID NO: 1824404 - RNA, 15 nt, Homo sapiens
ccucugauuuucucc

SEQ ID NO: 1824405 - RNA, 21 nt, Homo sapiens
ggcucuaugccugcacuggga

SEQ ID NO: 1824406 - RNA, 20 nt, Homo sapiens
auugugccaaagauagcaga

SEQ ID NO: 1824407 - RNA, 17 nt, Homo sapiens
gacagggccagugcagu

SEQ ID NO: 1824408 - RNA, 20 nt, Homo sapiens
uaaguuuuguuuagcaaugu

SEQ ID NO: 1824409 - RNA, 14 nt, Homo sapiens
agucuucacuaaaa

SEQ ID NO: 1824410 - RNA, 19 nt, Homo sapiens
uuucaccccacucuguaca

SEQ ID NO: 1824411 - RNA, 12 nt, Homo sapiens
gaagaccccagg

SEQ ID NO: 1824412 - RNA, 21 nt, Homo sapiens
gaaaagaaaaauuucuggcaa

SEQ ID NO: 1824413 - RNA, 17 nt, Homo sapiens
guaccuuguuuugccau

SEQ ID NO: 1824414 - RNA, 16 nt, Homo sapiens
acaacugcauaaccuu

SEQ ID NO: 1824415 - RNA, 19 nt, Homo sapiens
aucuauaccuuacugcaau

SEQ ID NO: 1824416 - RNA, 16 nt, Homo sapiens
auugcgcucucaagac

SEQ ID NO: 1824417 - RNA, 22 nt, Homo sapiens
ucaugacuuuuccauguaucua

SEQ ID NO: 1824418 - RNA, 20 nt, Homo sapiens
gagcacauuuaccaguauag

SEQ ID NO: 1824419 - RNA, 13 nt, Homo sapiens
uucaacaauuuca

SEQ ID NO: 1824420 - RNA, 13 nt, Homo sapiens
auccgcacuguaa

SEQ ID NO: 1824421 - RNA, 17 nt, Homo sapiens
auuggagaaaagcacuu

SEQ ID NO: 1824422 - RNA, 14 nt, Homo sapiens
ccauguuucucaca

SEQ ID NO: 1824423 - RNA, 23 nt, Homo sapiens
agaaguuuguuauagauuuagcu

SEQ ID NO: 1824424 - RNA, 14 nt, Homo sapiens
acccagaguggcuu

SEQ ID NO: 1824425 - RNA, 16 nt, Homo sapiens
uagagcucgccacgaa

SEQ ID NO: 1824426 - RNA, 16 nt, Homo sapiens
auuugucucuguuauc

SEQ ID NO: 1824427 - RNA, 17 nt, Homo sapiens
ugcagggccacuggaag

SEQ ID NO: 1824428 - RNA, 14 nt, Homo sapiens
gacagugaacauuc

SEQ ID NO: 1824429 - RNA, 19 nt, Homo sapiens
acagauggauagucugucc

SEQ ID NO: 1824430 - RNA, 14 nt, Homo sapiens
ucaccaacuugcca

SEQ ID NO: 1824431 - RNA, 14 nt, Homo sapiens
agacuguggagcuc

SEQ ID NO: 1824432 - RNA, 23 nt, Homo sapiens
aucgccguguuacuguugcacug

SEQ ID NO: 1824433 - RNA, 16 nt, Homo sapiens
ccacugcccacuggcc

SEQ ID NO: 1824434 - RNA, 23 nt, Homo sapiens
uaagaaugacaggcuuuuacuuc

SEQ ID NO: 1824435 - RNA, 16 nt, Homo sapiens
cuacgaaauacuaaga

SEQ ID NO: 1824436 - RNA, 17 nt, Homo sapiens
ccauagcuccuucucuc

SEQ ID NO: 1824437 - RNA, 21 nt, Homo sapiens
acaguucugacgcugacaaua

SEQ ID NO: 1824438 - RNA, 19 nt, Homo sapiens
gaugugaauuauugacacu

SEQ ID NO: 1824439 - RNA, 19 nt, Homo sapiens
auuaauguaauaaagugaa

SEQ ID NO: 1824440 - RNA, 19 nt, Homo sapiens
ugaaaaguugaaaugugua

SEQ ID NO: 1824441 - RNA, 14 nt, Homo sapiens
caaaagcagcuuuu

SEQ ID NO: 1824442 - RNA, 15 nt, Homo sapiens
cuauuuauuuacaaa

SEQ ID NO: 1824443 - RNA, 15 nt, Homo sapiens
cacccugaaagcccu

SEQ ID NO: 1824444 - RNA, 19 nt, Homo sapiens
gcccacccccaacaggaau

SEQ ID NO: 1824445 - RNA, 15 nt, Homo sapiens
gguacuaggggcccg

SEQ ID NO: 1824446 - RNA, 23 nt, Homo sapiens
ggacugggcaaagaugauguuuc

SEQ ID NO: 1824447 - RNA, 16 nt, Homo sapiens
guaauccgagcacuuu

SEQ ID NO: 1824448 - RNA, 14 nt, Homo sapiens
ucuuguccugugau

SEQ ID NO: 1824449 - RNA, 12 nt, Homo sapiens
ugcaaaugcacu

SEQ ID NO: 1824450 - RNA, 14 nt, Homo sapiens
auuaaaugugagca

SEQ ID NO: 1824451 - RNA, 16 nt, Homo sapiens
caaacccagugagaca

SEQ ID NO: 1824452 - RNA, 21 nt, Homo sapiens
cuucauggaacucagcugucu

SEQ ID NO: 1824453 - RNA, 21 nt, Homo sapiens
cgccagcagcgcgcaggccug

SEQ ID NO: 1824454 - RNA, 21 nt, Homo sapiens
agcagguguuuuccuucacaa

SEQ ID NO: 1824455 - RNA, 20 nt, Homo sapiens
cucccucucugcaccugucu

SEQ ID NO: 1824456 - RNA, 17 nt, Homo sapiens
uuaauguuauaucauau

SEQ ID NO: 1824457 - RNA, 13 nt, Homo sapiens
uucuuaaggggau

SEQ ID NO: 1824458 - RNA, 21 nt, Homo sapiens
ucccccacggccgucccugac

SEQ ID NO: 1824459 - RNA, 22 nt, Homo sapiens
agcuacaaggaggacuugcagg

SEQ ID NO: 1824460 - RNA, 20 nt, Homo sapiens
uaauuucuacucugucuuaa

SEQ ID NO: 1824461 - RNA, 17 nt, Homo sapiens
cacagaaauacaugaaa

SEQ ID NO: 1824462 - RNA, 11 nt, Homo sapiens
ugggggucccu

SEQ ID NO: 1824463 - RNA, 15 nt, Homo sapiens
cugcaaauuaaugua

SEQ ID NO: 1824464 - RNA, 20 nt, Homo sapiens
agaacacuucagccugugca

SEQ ID NO: 1824465 - RNA, 17 nt, Homo sapiens
ccccucccagaacacac

SEQ ID NO: 1824466 - RNA, 15 nt, Homo sapiens
ucacaaaacauuaaa

SEQ ID NO: 1824467 - RNA, 22 nt, Homo sapiens
uuaaacuucauauguaaucucu

SEQ ID NO: 1824468 - RNA, 15 nt, Homo sapiens
cucuauuaugaaugu

SEQ ID NO: 1824469 - RNA, 12 nt, Homo sapiens
aucacacagugu

SEQ ID NO: 1824470 - RNA, 12 nt, Homo sapiens
augacacagucu

SEQ ID NO: 1824471 - RNA, 22 nt, Homo sapiens
aacuuuccucgccugacaacca

SEQ ID NO: 1824472 - RNA, 14 nt, Homo sapiens
uuacaggaaaugca

SEQ ID NO: 1824473 - RNA, 22 nt, Homo sapiens
cagaacuucugagcauccucuc

SEQ ID NO: 1824474 - RNA, 20 nt, Homo sapiens
gcacaauuuaaaacaauccu

SEQ ID NO: 1824475 - RNA, 13 nt, Homo sapiens
aaaauauuuuaca

SEQ ID NO: 1824476 - RNA, 13 nt, Homo sapiens
auaaaauuuaacu

SEQ ID NO: 1824477 - RNA, 18 nt, Homo sapiens
aaacccccacuccagcuc

SEQ ID NO: 1824478 - RNA, 22 nt, Homo sapiens
acuuuguauagacaucugcccu

SEQ ID NO: 1824479 - RNA, 14 nt, Homo sapiens
ccuguguccugaag

SEQ ID NO: 1824480 - RNA, 17 nt, Homo sapiens
uaaaccuuccauaaaaa

SEQ ID NO: 1824481 - RNA, 16 nt, Homo sapiens
ucaaaaggcugccuaa

SEQ ID NO: 1824482 - RNA, 18 nt, Homo sapiens
gcagguuccagugccuga

SEQ ID NO: 1824483 - RNA, 23 nt, Homo sapiens
ccguguaaauaauuuauuacaag

SEQ ID NO: 1824484 - RNA, 21 nt, Homo sapiens
gacagcuggacccauuugcca

SEQ ID NO: 1824485 - RNA, 13 nt, Homo sapiens
aucaggaggccag

SEQ ID NO: 1824486 - RNA, 21 nt, Homo sapiens
cuauagaaauagaacacugcc

SEQ ID NO: 1824487 - RNA, 19 nt, Homo sapiens
cagccuuacccaguccuau

SEQ ID NO: 1824488 - RNA, 17 nt, Homo sapiens
aauguggccaagccuau

SEQ ID NO: 1824489 - RNA, 15 nt, Homo sapiens
ggcuggaacacugua

SEQ ID NO: 1824490 - RNA, 15 nt, Homo sapiens
ggcugggacacugug

SEQ ID NO: 1824491 - RNA, 19 nt, Homo sapiens
gcuuuuucuccccuccucu

SEQ ID NO: 1824492 - RNA, 16 nt, Homo sapiens
ccaaguccagauuuac

SEQ ID NO: 1824493 - RNA, 18 nt, Homo sapiens
uucagcauggacagcauc

SEQ ID NO: 1824494 - RNA, 21 nt, Homo sapiens
caaagcaggaguggaagguga

SEQ ID NO: 1824495 - RNA, 21 nt, Homo sapiens
ugcaaaaucuccaauccacac

SEQ ID NO: 1824496 - RNA, 21 nt, Homo sapiens
cugguuuucagucuugcugag

SEQ ID NO: 1824497 - RNA, 16 nt, Homo sapiens
cuagacugugucugaa

SEQ ID NO: 1824498 - RNA, 16 nt, Homo sapiens
guggcacucucaggug

SEQ ID NO: 1824499 - RNA, 16 nt, Homo sapiens
uuaugcauaaagucag

SEQ ID NO: 1824500 - RNA, 17 nt, Homo sapiens
gagauucccaucugaua

SEQ ID NO: 1824501 - RNA, 23 nt, Homo sapiens
gcagcuggcagagagcacaguga

SEQ ID NO: 1824502 - RNA, 23 nt, Homo sapiens
ugagguuuccgggggaugaauga

SEQ ID NO: 1824503 - RNA, 15 nt, Homo sapiens
ucuggaccucugggu

SEQ ID NO: 1824504 - RNA, 17 nt, Homo sapiens
gccuuuuggguuugccu

SEQ ID NO: 1824505 - RNA, 16 nt, Homo sapiens
aucugguuuugcuauu

SEQ ID NO: 1824506 - RNA, 18 nt, Homo sapiens
uuaaucuccucagacagu

SEQ ID NO: 1824507 - RNA, 21 nt, Homo sapiens
gcacaugaacauauguccauc

SEQ ID NO: 1824508 - RNA, 18 nt, Homo sapiens
uucugagccaaauucuaa

SEQ ID NO: 1824509 - RNA, 22 nt, Homo sapiens
uguucugagcuauaacauuugc

SEQ ID NO: 1824510 - RNA, 14 nt, Homo sapiens
ucaguuggagaaaa

SEQ ID NO: 1824511 - RNA, 21 nt, Homo sapiens
ugauuguuuaauuguagguca

SEQ ID NO: 1824512 - RNA, 16 nt, Homo sapiens
ugaaugccgaauuugg

SEQ ID NO: 1824513 - RNA, 22 nt, Homo sapiens
uggaagaaaaaaaccacacaaa

SEQ ID NO: 1824514 - RNA, 17 nt, Homo sapiens
ccaccaaugggccucca

SEQ ID NO: 1824515 - RNA, 17 nt, Homo sapiens
aguuccagcacaccauu

SEQ ID NO: 1824516 - RNA, 18 nt, Homo sapiens
cugcccaaagcagcacuu

SEQ ID NO: 1824517 - RNA, 19 nt, Homo sapiens
gggggaaaaaaaaaaaaga

SEQ ID NO: 1824518 - RNA, 14 nt, Homo sapiens
gcugccuggcacag

SEQ ID NO: 1824519 - RNA, 22 nt, Homo sapiens
gacugccaaaguuaggagcccu

SEQ ID NO: 1824520 - RNA, 20 nt, Homo sapiens
cucuagccugggccacaggg

SEQ ID NO: 1824521 - RNA, 21 nt, Homo sapiens
uuuggggagacgguguugcag

SEQ ID NO: 1824522 - RNA, 13 nt, Homo sapiens
uccagagccagaa

SEQ ID NO: 1824523 - RNA, 15 nt, Homo sapiens
gaaaacuacuuuuug

SEQ ID NO: 1824524 - RNA, 13 nt, Homo sapiens
uaugugacaccaa

SEQ ID NO: 1824525 - RNA, 23 nt, Homo sapiens
acuacuccuguaauuccuaccuc

SEQ ID NO: 1824526 - RNA, 21 nt, Homo sapiens
caacaucuucauagaugaaug

SEQ ID NO: 1824527 - RNA, 23 nt, Homo sapiens
aacagccgacuuugagcauuguu

SEQ ID NO: 1824528 - RNA, 17 nt, Homo sapiens
uggccagauuuccucac

SEQ ID NO: 1824529 - RNA, 19 nt, Homo sapiens
augagccguugugcuccag

SEQ ID NO: 1824530 - RNA, 16 nt, Homo sapiens
aaagagccuggagaag

SEQ ID NO: 1824531 - RNA, 20 nt, Homo sapiens
agacagauguuggugcaaua

SEQ ID NO: 1824532 - RNA, 19 nt, Homo sapiens
cuagacugggcuggcugcc

SEQ ID NO: 1824533 - RNA, 14 nt, Homo sapiens
cacucuuucuuuca

SEQ ID NO: 1824534 - RNA, 20 nt, Homo sapiens
augguauggaacucucucca

SEQ ID NO: 1824535 - RNA, 13 nt, Homo sapiens
aaaguucuggucc

SEQ ID NO: 1824536 - RNA, 20 nt, Homo sapiens
augucuucucguuaaggaga

SEQ ID NO: 1824537 - RNA, 14 nt, Homo sapiens
ugucccccuugugg

SEQ ID NO: 1824538 - RNA, 19 nt, Homo sapiens
cuucaccuacauuaucuca

SEQ ID NO: 1824539 - RNA, 22 nt, Homo sapiens
gucaaucauauuuaaagggaau

SEQ ID NO: 1824540 - RNA, 19 nt, Homo sapiens
ucgugcggaggauccugua

SEQ ID NO: 1824541 - RNA, 15 nt, Homo sapiens
aaggcucacaccuca

SEQ ID NO: 1824542 - RNA, 18 nt, Homo sapiens
ccugaggcaagccaugga

SEQ ID NO: 1824543 - RNA, 22 nt, Homo sapiens
uaaaauucaagugagaaguaaa

SEQ ID NO: 1824544 - RNA, 15 nt, Homo sapiens
ccaaacagcaugugc

SEQ ID NO: 1824545 - RNA, 21 nt, Homo sapiens
acuuacagauggcagcaguga

SEQ ID NO: 1824546 - RNA, 19 nt, Homo sapiens
aaugaggaaaaaacccagc

SEQ ID NO: 1824547 - RNA, 13 nt, Homo sapiens
ucugccccagaua

SEQ ID NO: 1824548 - RNA, 13 nt, Homo sapiens
ucuuccccagaga

SEQ ID NO: 1824549 - RNA, 19 nt, Homo sapiens
acuacacacuaaaacuuuc

SEQ ID NO: 1824550 - RNA, 22 nt, Homo sapiens
augugacuugcgcuuaauccaa

SEQ ID NO: 1824551 - RNA, 12 nt, Homo sapiens
acaaacaugugu

SEQ ID NO: 1824552 - RNA, 16 nt, Homo sapiens
acuggaguuagaucuc

SEQ ID NO: 1824553 - RNA, 17 nt, Homo sapiens
cuuuuuaaccugcaaaa

SEQ ID NO: 1824554 - RNA, 19 nt, Homo sapiens
ucugaacucaaacugagga

SEQ ID NO: 1824555 - RNA, 20 nt, Homo sapiens
cugaggaggaggacacagca

SEQ ID NO: 1824556 - RNA, 22 nt, Homo sapiens
ucacucugggcggcuccccaua

SEQ ID NO: 1824557 - RNA, 16 nt, Homo sapiens
aagacaccauuuaucu

SEQ ID NO: 1824558 - RNA, 21 nt, Homo sapiens
cugcuucaguccacaguacau

SEQ ID NO: 1824559 - RNA, 20 nt, Homo sapiens
gccuggagugcccacccugg

SEQ ID NO: 1824560 - RNA, 18 nt, Homo sapiens
aauucuucucgacuucag

SEQ ID NO: 1824561 - RNA, 19 nt, Homo sapiens
uggcaucuuuggaggaauu

SEQ ID NO: 1824562 - RNA, 19 nt, Homo sapiens
gaggaaggcccaggggugg

SEQ ID NO: 1824563 - RNA, 19 nt, Homo sapiens
gaauaagagaccuguuuua

SEQ ID NO: 1824564 - RNA, 14 nt, Homo sapiens
agguuuuaugagac

SEQ ID NO: 1824565 - RNA, 22 nt, Homo sapiens
caaaucaguccuuugauuccau

SEQ ID NO: 1824566 - RNA, 20 nt, Homo sapiens
aggucacuuuaccucugugg

SEQ ID NO: 1824567 - RNA, 12 nt, Homo sapiens
uuuuaacucugu

SEQ ID NO: 1824568 - RNA, 12 nt, Homo sapiens
guuuuuugccau

SEQ ID NO: 1824569 - RNA, 19 nt, Homo sapiens
guaauuuaagugacacaga

SEQ ID NO: 1824570 - RNA, 19 nt, Homo sapiens
agaaacuuuggaagcacuu

SEQ ID NO: 1824571 - RNA, 20 nt, Homo sapiens
gguggucacaggcugugccu

SEQ ID NO: 1824572 - RNA, 14 nt, Homo sapiens
ugacccccagcucc

SEQ ID NO: 1824573 - RNA, 20 nt, Homo sapiens
cucccacccaaccaacuuuc

SEQ ID NO: 1824574 - RNA, 17 nt, Homo sapiens
uaaaggugagcccucau

SEQ ID NO: 1824575 - RNA, 13 nt, Homo sapiens
gaaucacuggaac

SEQ ID NO: 1824576 - RNA, 20 nt, Homo sapiens
cagcggcacaaaugcaccuc

SEQ ID NO: 1824577 - RNA, 20 nt, Homo sapiens
cgaacaccaaaaaugaugcg

SEQ ID NO: 1824578 - RNA, 23 nt, Homo sapiens
cacuguccugggcgcccuggaag

SEQ ID NO: 1824579 - RNA, 15 nt, Homo sapiens
cacaccuggccuuaa

SEQ ID NO: 1824580 - RNA, 19 nt, Homo sapiens
agcugaacccuccugauga

SEQ ID NO: 1824581 - RNA, 22 nt, Homo sapiens
auguauuugaaaauuacauguu

SEQ ID NO: 1824582 - RNA, 18 nt, Homo sapiens
acagagucaggaucucac

SEQ ID NO: 1824583 - RNA, 14 nt, Homo sapiens
aaaagccuugugua

SEQ ID NO: 1824584 - RNA, 23 nt, Homo sapiens
acuuuuucugucuuuauguaaga

SEQ ID NO: 1824585 - RNA, 17 nt, Homo sapiens
uaucuuuuggcucugaa

SEQ ID NO: 1824586 - RNA, 17 nt, Homo sapiens
caccagccccagcaaga

SEQ ID NO: 1824587 - RNA, 18 nt, Homo sapiens
gaauuccauaguggacca

SEQ ID NO: 1824588 - RNA, 21 nt, Homo sapiens
cgucagucuuuuucuguugua

SEQ ID NO: 1824589 - RNA, 12 nt, Homo sapiens
ccuauuaauucu

SEQ ID NO: 1824590 - RNA, 11 nt, Homo sapiens
acccaaaacac

SEQ ID NO: 1824591 - RNA, 21 nt, Homo sapiens
guuccgugccaggcauucaau

SEQ ID NO: 1824592 - RNA, 18 nt, Homo sapiens
ggacuuucugaagccuca

SEQ ID NO: 1824593 - RNA, 19 nt, Homo sapiens
ucuuuaaacuuuagaauuc

SEQ ID NO: 1824594 - RNA, 16 nt, Homo sapiens
uccugaaaauugcaau

SEQ ID NO: 1824595 - RNA, 14 nt, Homo sapiens
uccuagccacccac

SEQ ID NO: 1824596 - RNA, 17 nt, Homo sapiens
auugauaugcuuauaca

SEQ ID NO: 1824597 - RNA, 16 nt, Homo sapiens
uuccagccacucgaga

SEQ ID NO: 1824598 - RNA, 10 nt, Homo sapiens
aguucagugg

SEQ ID NO: 1824599 - RNA, 21 nt, Homo sapiens
uggagugcaguggugccauca

SEQ ID NO: 1824600 - RNA, 15 nt, Homo sapiens
ucucauacaagccau

SEQ ID NO: 1824601 - RNA, 14 nt, Homo sapiens
acaguucugaagaa

SEQ ID NO: 1824602 - RNA, 15 nt, Homo sapiens
aacuugagcuuuaaa

SEQ ID NO: 1824603 - RNA, 19 nt, Homo sapiens
uaaaaaucaaauaagcuaa

SEQ ID NO: 1824604 - RNA, 21 nt, Homo sapiens
ugaacucgaagcccacaaucc

SEQ ID NO: 1824605 - RNA, 14 nt, Homo sapiens
auuccacacuacca

SEQ ID NO: 1824606 - RNA, 15 nt, Homo sapiens
ggcugguuaauucca

SEQ ID NO: 1824607 - RNA, 18 nt, Homo sapiens
auucuguuuauucuucca

SEQ ID NO: 1824608 - RNA, 15 nt, Homo sapiens
gaagacuugccugcu

SEQ ID NO: 1824609 - RNA, 16 nt, Homo sapiens
ugaaguauuacaugau

SEQ ID NO: 1824610 - RNA, 17 nt, Homo sapiens
gaauucagugccuucaa

SEQ ID NO: 1824611 - RNA, 16 nt, Homo sapiens
ugaguggcagccaugc

SEQ ID NO: 1824612 - RNA, 19 nt, Homo sapiens
caaggacaaaaaaccucag

SEQ ID NO: 1824613 - RNA, 23 nt, Homo sapiens
gucuaguucuuuucauuuggaau

SEQ ID NO: 1824614 - RNA, 23 nt, Homo sapiens
ccaaggcccccaccucugugacc

SEQ ID NO: 1824615 - RNA, 20 nt, Homo sapiens
guugaacaucucacuuugcc

SEQ ID NO: 1824616 - RNA, 17 nt, Homo sapiens
gugaaauaaacagucua

SEQ ID NO: 1824617 - RNA, 16 nt, Homo sapiens
uguuuccugugcaagu

SEQ ID NO: 1824618 - RNA, 23 nt, Homo sapiens
gcagucuccccuuccuggcacau

SEQ ID NO: 1824619 - RNA, 16 nt, Homo sapiens
aaaccaacaggcuacc

SEQ ID NO: 1824620 - RNA, 13 nt, Homo sapiens
cacauauggacuc

SEQ ID NO: 1824621 - RNA, 15 nt, Homo sapiens
uuauuaccagcauuu

SEQ ID NO: 1824622 - RNA, 20 nt, Homo sapiens
aagaaccccucugucuucaa

SEQ ID NO: 1824623 - RNA, 21 nt, Homo sapiens
uuacguguaaaggaaaauaau

SEQ ID NO: 1824624 - RNA, 20 nt, Homo sapiens
agggaaguaguccuuggcau

SEQ ID NO: 1824625 - RNA, 18 nt, Homo sapiens
gcagagugcuuuaccaau

SEQ ID NO: 1824626 - RNA, 13 nt, Homo sapiens
gaggccacacgca

SEQ ID NO: 1824627 - RNA, 20 nt, Homo sapiens
gaacuuuggagagugagcua

SEQ ID NO: 1824628 - RNA, 18 nt, Homo sapiens
cuuuccuccccauacaca

SEQ ID NO: 1824629 - RNA, 17 nt, Homo sapiens
cacccugccccuugcca

SEQ ID NO: 1824630 - RNA, 18 nt, Homo sapiens
caucgggaauacaaagau

SEQ ID NO: 1824631 - RNA, 21 nt, Homo sapiens
caaugagguggcucaugccug

SEQ ID NO: 1824632 - RNA, 19 nt, Homo sapiens
auagugaaaccccaucucu

SEQ ID NO: 1824633 - RNA, 15 nt, Homo sapiens
cugcaugaccuacca

SEQ ID NO: 1824634 - RNA, 23 nt, Homo sapiens
gugcugcauggagugagcaguag

SEQ ID NO: 1824635 - RNA, 14 nt, Homo sapiens
agggagcagacuuu

SEQ ID NO: 1824636 - RNA, 14 nt, Homo sapiens
gcuggaacccagcu

SEQ ID NO: 1824637 - RNA, 18 nt, Homo sapiens
aaggagaacuauccaaaa

SEQ ID NO: 1824638 - RNA, 19 nt, Homo sapiens
cccuccacgucagugccau

SEQ ID NO: 1824639 - RNA, 18 nt, Homo sapiens
acagugccgacagcucuc

SEQ ID NO: 1824640 - RNA, 21 nt, Homo sapiens
caggaagccagcaggcucuca

SEQ ID NO: 1824641 - RNA, 16 nt, Homo sapiens
uugggaaaaauuauuu

SEQ ID NO: 1824642 - RNA, 15 nt, Homo sapiens
cuggguuuucuaacu

SEQ ID NO: 1824643 - RNA, 14 nt, Homo sapiens
guaugugcuguaau

SEQ ID NO: 1824644 - RNA, 20 nt, Homo sapiens
uccaaauguccuuucucaga

SEQ ID NO: 1824645 - RNA, 19 nt, Homo sapiens
ggacaacagagaugccaug

SEQ ID NO: 1824646 - RNA, 23 nt, Homo sapiens
aaguacaagagcuuaacagugug

SEQ ID NO: 1824647 - RNA, 16 nt, Homo sapiens
acuuuauaaauaucaa

SEQ ID NO: 1824648 - RNA, 18 nt, Homo sapiens
agugaggaccugacacaa

SEQ ID NO: 1824649 - RNA, 10 nt, Homo sapiens
ugcuguccaa

SEQ ID NO: 1824650 - RNA, 20 nt, Homo sapiens
uagccuagaagauacaauaa

SEQ ID NO: 1824651 - RNA, 12 nt, Homo sapiens
ucucacaaauca

SEQ ID NO: 1824652 - RNA, 20 nt, Homo sapiens
aaauguauuggcacagugcu

SEQ ID NO: 1824653 - RNA, 17 nt, Homo sapiens
uucaagucugacucucc

SEQ ID NO: 1824654 - RNA, 21 nt, Homo sapiens
gacuuauucauuccucacaau

SEQ ID NO: 1824655 - RNA, 23 nt, Homo sapiens
cuuucauuacccuacagacagcu

SEQ ID NO: 1824656 - RNA, 18 nt, Homo sapiens
auuuaucuuuaguuuguu

SEQ ID NO: 1824657 - RNA, 12 nt, Homo sapiens
uauauaaucuau

SEQ ID NO: 1824658 - RNA, 15 nt, Homo sapiens
auuuccgccacaucc

SEQ ID NO: 1824659 - RNA, 17 nt, Homo sapiens
auuacaggcgugagcca

SEQ ID NO: 1824660 - RNA, 16 nt, Homo sapiens
gugauaccccaucucu

SEQ ID NO: 1824661 - RNA, 21 nt, Homo sapiens
ccuccuugcugauuugcacac

SEQ ID NO: 1824662 - RNA, 14 nt, Homo sapiens
ugugggggaaaaau

SEQ ID NO: 1824663 - RNA, 19 nt, Homo sapiens
gagcagccugcugcucuca

SEQ ID NO: 1824664 - RNA, 13 nt, Homo sapiens
aauuggaagggaa

SEQ ID NO: 1824665 - RNA, 15 nt, Homo sapiens
gggcuggagaccaga

SEQ ID NO: 1824666 - RNA, 22 nt, Homo sapiens
auaaugugaaugcuauguucug

SEQ ID NO: 1824667 - RNA, 15 nt, Homo sapiens
gauuuuuauuugaaa

SEQ ID NO: 1824668 - RNA, 13 nt, Homo sapiens
cauuuuuacuguu

SEQ ID NO: 1824669 - RNA, 20 nt, Homo sapiens
caggaaaagaaagagcugaa

SEQ ID NO: 1824670 - RNA, 13 nt, Homo sapiens
uguuaacacugcu

SEQ ID NO: 1824671 - RNA, 16 nt, Homo sapiens
uggugaccccauacau

SEQ ID NO: 1824672 - RNA, 21 nt, Homo sapiens
cuugaagcauuucaaagcccu

SEQ ID NO: 1824673 - RNA, 19 nt, Homo sapiens
auaaaauauuauugaacua

SEQ ID NO: 1824674 - RNA, 20 nt, Homo sapiens
aacaucaacaggacuuaaca

SEQ ID NO: 1824675 - RNA, 18 nt, Homo sapiens
cucucuccacauuccaaa

SEQ ID NO: 1824676 - RNA, 21 nt, Homo sapiens
acagaaggaaaaaaacaugaa

SEQ ID NO: 1824677 - RNA, 17 nt, Homo sapiens
guaacuugagauucaag

SEQ ID NO: 1824678 - RNA, 19 nt, Homo sapiens
uaagugccauuaaauugaa

SEQ ID NO: 1824679 - RNA, 19 nt, Homo sapiens
gcaaggggaugagaccgca

SEQ ID NO: 1824680 - RNA, 22 nt, Homo sapiens
uuaaggagugaaaauagagugu

SEQ ID NO: 1824681 - RNA, 12 nt, Homo sapiens
auguuccagaca

SEQ ID NO: 1824682 - RNA, 18 nt, Homo sapiens
gaauaauacaguaucuca

SEQ ID NO: 1824683 - RNA, 19 nt, Homo sapiens
auauuucuaguagcacaac

SEQ ID NO: 1824684 - RNA, 21 nt, Homo sapiens
gucuggcccgcaauacuguag

SEQ ID NO: 1824685 - RNA, 13 nt, Homo sapiens
gaauaguuuccaa

SEQ ID NO: 1824686 - RNA, 21 nt, Homo sapiens
guacuguauggaaacacugau

SEQ ID NO: 1824687 - RNA, 16 nt, Homo sapiens
acacaagagcuggagc

SEQ ID NO: 1824688 - RNA, 22 nt, Homo sapiens
ucauggccugagaugcagguga

SEQ ID NO: 1824689 - RNA, 16 nt, Homo sapiens
caaauaaagugcaguu

SEQ ID NO: 1824690 - RNA, 18 nt, Homo sapiens
ccccuggguaacugucaa

SEQ ID NO: 1824691 - RNA, 20 nt, Homo sapiens
agcuugaccgugaggccaga

SEQ ID NO: 1824692 - RNA, 15 nt, Homo sapiens
uaacuaacagcaucc

SEQ ID NO: 1824693 - RNA, 18 nt, Homo sapiens
ugugaacuuaucaaaaau

SEQ ID NO: 1824694 - RNA, 18 nt, Homo sapiens
cuguauuccgauacaaag

SEQ ID NO: 1824695 - RNA, 19 nt, Homo sapiens
ccacauggccgcugcccac

SEQ ID NO: 1824696 - RNA, 20 nt, Homo sapiens
cucuaucggagaacaugaau

SEQ ID NO: 1824697 - RNA, 11 nt, Homo sapiens
ugaaaaugcca

SEQ ID NO: 1824698 - RNA, 16 nt, Homo sapiens
caaaacuucuugucag

SEQ ID NO: 1824699 - RNA, 16 nt, Homo sapiens
gacucuuuuccaaaca

SEQ ID NO: 1824700 - RNA, 16 nt, Homo sapiens
cagcagcccucagggc

SEQ ID NO: 1824701 - RNA, 16 nt, Homo sapiens
cacaggcacugcagga

SEQ ID NO: 1824702 - RNA, 23 nt, Homo sapiens
auccugaauuccagcaaaagagc

SEQ ID NO: 1824703 - RNA, 19 nt, Homo sapiens
uaaaugacaaauguauuaa

SEQ ID NO: 1824704 - RNA, 15 nt, Homo sapiens
agcagaccuacagca

SEQ ID NO: 1824705 - RNA, 21 nt, Homo sapiens
agugcccugagccagggucuc

SEQ ID NO: 1824706 - RNA, 16 nt, Homo sapiens
gugccaucagcuccuu

SEQ ID NO: 1824707 - RNA, 15 nt, Homo sapiens
cugaccuuaaaugca

SEQ ID NO: 1824708 - RNA, 18 nt, Homo sapiens
aucucauucagguguucu

SEQ ID NO: 1824709 - RNA, 23 nt, Homo sapiens
uuggcagcucuacucuggagguu

SEQ ID NO: 1824710 - RNA, 15 nt, Homo sapiens
guuuagcagauuuaa

SEQ ID NO: 1824711 - RNA, 19 nt, Homo sapiens
guauucuauuugguuagaa

SEQ ID NO: 1824712 - RNA, 22 nt, Homo sapiens
ucuaacuuacaaacugguuuga

SEQ ID NO: 1824713 - RNA, 15 nt, Homo sapiens
uauaauacauuacau

SEQ ID NO: 1824714 - RNA, 12 nt, Homo sapiens
caagugagcaaa

SEQ ID NO: 1824715 - RNA, 13 nt, Homo sapiens
agaccauggauuu

SEQ ID NO: 1824716 - RNA, 13 nt, Homo sapiens
ucuugucuuuauu

SEQ ID NO: 1824717 - RNA, 15 nt, Homo sapiens
uaaaguaauucauac

SEQ ID NO: 1824718 - RNA, 16 nt, Homo sapiens
acuguagaacugcaau

SEQ ID NO: 1824719 - RNA, 12 nt, Homo sapiens
cucuuaacaaga

SEQ ID NO: 1824720 - RNA, 14 nt, Homo sapiens
agcaaaucuaugag

SEQ ID NO: 1824721 - RNA, 16 nt, Homo sapiens
gcggggagcaugaaga

SEQ ID NO: 1824722 - RNA, 19 nt, Homo sapiens
agggugcaguaucaugccc

SEQ ID NO: 1824723 - RNA, 11 nt, Homo sapiens
ccccuccgggc

SEQ ID NO: 1824724 - RNA, 22 nt, Homo sapiens
gccucacucuggccacagguga

SEQ ID NO: 1824725 - RNA, 14 nt, Homo sapiens
uagcugagcucaca

SEQ ID NO: 1824726 - RNA, 23 nt, Homo sapiens
cauaauguaaugaggugguacua

SEQ ID NO: 1824727 - RNA, 15 nt, Homo sapiens
uaccuaauuguggau

SEQ ID NO: 1824728 - RNA, 21 nt, Homo sapiens
uacaccuccacucagcacucu

SEQ ID NO: 1824729 - RNA, 21 nt, Homo sapiens
agcauugacucuguggcuuug

SEQ ID NO: 1824730 - RNA, 14 nt, Homo sapiens
gcuagguagugggg

SEQ ID NO: 1824731 - RNA, 21 nt, Homo sapiens
uccagugguuugagacacugg

SEQ ID NO: 1824732 - RNA, 21 nt, Homo sapiens
auuuaagccuugacacacugu

SEQ ID NO: 1824733 - RNA, 21 nt, Homo sapiens
aagcuauuuuuuuaagcuauc

SEQ ID NO: 1824734 - RNA, 14 nt, Homo sapiens
aacaaucacuggcu

SEQ ID NO: 1824735 - RNA, 20 nt, Homo sapiens
cagugugcauaauuuugcca

SEQ ID NO: 1824736 - RNA, 21 nt, Homo sapiens
ccagccuaugagcauccugag

SEQ ID NO: 1824737 - RNA, 22 nt, Homo sapiens
guccugcuugaacugcugccaa

SEQ ID NO: 1824738 - RNA, 14 nt, Homo sapiens
gaaacacuuugccu

SEQ ID NO: 1824739 - RNA, 17 nt, Homo sapiens
ugcuguuauccaugggg

SEQ ID NO: 1824740 - RNA, 14 nt, Homo sapiens
acccaagcauuugu

SEQ ID NO: 1824741 - RNA, 16 nt, Homo sapiens
cuuaagagacuacaga

SEQ ID NO: 1824742 - RNA, 13 nt, Homo sapiens
caagucacagaaa

SEQ ID NO: 1824743 - RNA, 19 nt, Homo sapiens
ugaauaaaguugaagcuaa

SEQ ID NO: 1824744 - RNA, 18 nt, Homo sapiens
caugcgaugacacuugua

SEQ ID NO: 1824745 - RNA, 19 nt, Homo sapiens
aggacaccuguacuggaga

SEQ ID NO: 1824746 - RNA, 14 nt, Homo sapiens
cagauucccagcuu

SEQ ID NO: 1824747 - RNA, 14 nt, Homo sapiens
aggcaaccaggaaa

SEQ ID NO: 1824748 - RNA, 13 nt, Homo sapiens
uuuuaagaccaag

SEQ ID NO: 1824749 - RNA, 15 nt, Homo sapiens
cuuugggaucagccu

SEQ ID NO: 1824750 - RNA, 13 nt, Homo sapiens
agacuuggcuuug

SEQ ID NO: 1824751 - RNA, 18 nt, Homo sapiens
aagaaggaagaagccaga

SEQ ID NO: 1824752 - RNA, 16 nt, Homo sapiens
ugcuauaguauuugau

SEQ ID NO: 1824753 - RNA, 13 nt, Homo sapiens
auuaaucauucca

SEQ ID NO: 1824754 - RNA, 15 nt, Homo sapiens
uaauuauaaacagca

SEQ ID NO: 1824755 - RNA, 19 nt, Homo sapiens
aagagccaaagaauauucc

SEQ ID NO: 1824756 - RNA, 20 nt, Homo sapiens
cagagcgagacuccaucuca

SEQ ID NO: 1824757 - RNA, 20 nt, Homo sapiens
cagagcaagacuccgucuca

SEQ ID NO: 1824758 - RNA, 14 nt, Homo sapiens
agcucuugugucau

SEQ ID NO: 1824759 - RNA, 15 nt, Homo sapiens
aggaaggaaccagaa

SEQ ID NO: 1824760 - RNA, 15 nt, Homo sapiens
cgaguggccauggca

SEQ ID NO: 1824761 - RNA, 19 nt, Homo sapiens
gcuaacuguguguacauau

SEQ ID NO: 1824762 - RNA, 18 nt, Homo sapiens
aaaaagcaucuaucucau

SEQ ID NO: 1824763 - RNA, 16 nt, Homo sapiens
aaaccaaauauuccag

SEQ ID NO: 1824764 - RNA, 16 nt, Homo sapiens
cuuggcuuuucuagcc

SEQ ID NO: 1824765 - RNA, 19 nt, Homo sapiens
uaaaaugaaauuacuacaa

SEQ ID NO: 1824766 - RNA, 15 nt, Homo sapiens
cugagggcaguucug

SEQ ID NO: 1824767 - RNA, 16 nt, Homo sapiens
uguuugaagauugccu

SEQ ID NO: 1824768 - RNA, 11 nt, Homo sapiens
gccaacagcua

SEQ ID NO: 1824769 - RNA, 17 nt, Homo sapiens
cauuuuaacaagaagau

SEQ ID NO: 1824770 - RNA, 12 nt, Homo sapiens
caugaacccugc

SEQ ID NO: 1824771 - RNA, 17 nt, Homo sapiens
auaccauauacagcuca

SEQ ID NO: 1824772 - RNA, 14 nt, Homo sapiens
aaagccacuuuccu

SEQ ID NO: 1824773 - RNA, 13 nt, Homo sapiens
aaugacugaccca

SEQ ID NO: 1824774 - RNA, 13 nt, Homo sapiens
ucccacuguauga

SEQ ID NO: 1824775 - RNA, 22 nt, Homo sapiens
auauggcaaauagccacaauua

SEQ ID NO: 1824776 - RNA, 13 nt, Homo sapiens
cacacacacuggc

SEQ ID NO: 1824777 - RNA, 13 nt, Homo sapiens
auggcacaaacac

SEQ ID NO: 1824778 - RNA, 15 nt, Homo sapiens
uggagcugaauuuga

SEQ ID NO: 1824779 - RNA, 17 nt, Homo sapiens
ucaauuguuaguuauaa

SEQ ID NO: 1824780 - RNA, 14 nt, Homo sapiens
ugcugaagaauauu

SEQ ID NO: 1824781 - RNA, 19 nt, Homo sapiens
aagagcuguggguaaauua

SEQ ID NO: 1824782 - RNA, 21 nt, Homo sapiens
uuacagacagaauauacauau

SEQ ID NO: 1824783 - RNA, 21 nt, Homo sapiens
guacuccagcccggcacucca

SEQ ID NO: 1824784 - RNA, 18 nt, Homo sapiens
cuuuccccccuaggucag

SEQ ID NO: 1824785 - RNA, 18 nt, Homo sapiens
ggagcugugggagugauu

SEQ ID NO: 1824786 - RNA, 18 nt, Homo sapiens
acuaucugugaaguuaca

SEQ ID NO: 1824787 - RNA, 19 nt, Homo sapiens
cauuuacuguggcuucuua

SEQ ID NO: 1824788 - RNA, 17 nt, Homo sapiens
ucugccuggcaacaucu

SEQ ID NO: 1824789 - RNA, 12 nt, Homo sapiens
cugcuuacuguu

SEQ ID NO: 1824790 - RNA, 19 nt, Homo sapiens
cuuaauagcuguaguuuuc

SEQ ID NO: 1824791 - RNA, 20 nt, Homo sapiens
gcuucucacagcaaaccucu

SEQ ID NO: 1824792 - RNA, 15 nt, Homo sapiens
uacagaaaugcaaaa

SEQ ID NO: 1824793 - RNA, 17 nt, Homo sapiens
gcuacuacugcagucuu

SEQ ID NO: 1824794 - RNA, 15 nt, Homo sapiens
uucccugaacacuca

SEQ ID NO: 1824795 - RNA, 23 nt, Homo sapiens
uuccagggcauccgcagcccagg

SEQ ID NO: 1824796 - RNA, 22 nt, Homo sapiens
ggaugccaaccggucacccagg

SEQ ID NO: 1824797 - RNA, 13 nt, Homo sapiens
ccauuuacagucu

SEQ ID NO: 1824798 - RNA, 18 nt, Homo sapiens
caggaaaauggacaucaa

SEQ ID NO: 1824799 - RNA, 13 nt, Homo sapiens
acacggagugugc

SEQ ID NO: 1824800 - RNA, 13 nt, Homo sapiens
gauucugcagcug

SEQ ID NO: 1824801 - RNA, 23 nt, Homo sapiens
agaagucucuuaauucugaugcu

SEQ ID NO: 1824802 - RNA, 14 nt, Homo sapiens
gccuguaaucccag

SEQ ID NO: 1824803 - RNA, 15 nt, Homo sapiens
auccuacagugaaau

SEQ ID NO: 1824804 - RNA, 22 nt, Homo sapiens
auccagcuccccuucugaauca

SEQ ID NO: 1824805 - RNA, 15 nt, Homo sapiens
acuguggaacugcca

SEQ ID NO: 1824806 - RNA, 12 nt, Homo sapiens
auuaaacacugu

SEQ ID NO: 1824807 - RNA, 13 nt, Homo sapiens
ggccuugcugagu

SEQ ID NO: 1824808 - RNA, 12 nt, Homo sapiens
ugugaacaaguc

SEQ ID NO: 1824809 - RNA, 17 nt, Homo sapiens
uggaaucuacaagccaa

SEQ ID NO: 1824810 - RNA, 20 nt, Homo sapiens
cccuggccucccccacuuuc

SEQ ID NO: 1824811 - RNA, 16 nt, Homo sapiens
guuuguaauggugcuu

SEQ ID NO: 1824812 - RNA, 23 nt, Homo sapiens
ucagacuuggaguaaaacuguau

SEQ ID NO: 1824813 - RNA, 17 nt, Homo sapiens
ggaagauuugcccauuu

SEQ ID NO: 1824814 - RNA, 19 nt, Homo sapiens
agaaaaggccuucuuccca

SEQ ID NO: 1824815 - RNA, 20 nt, Homo sapiens
cccagaugccugggugcaaa

SEQ ID NO: 1824816 - RNA, 21 nt, Homo sapiens
ccaugacgcacugcucaagaa

SEQ ID NO: 1824817 - RNA, 18 nt, Homo sapiens
uagauucccuugcacugu

SEQ ID NO: 1824818 - RNA, 19 nt, Homo sapiens
uggcauacugagaauauac

SEQ ID NO: 1824819 - RNA, 17 nt, Homo sapiens
cacggcggggucuguag

SEQ ID NO: 1824820 - RNA, 19 nt, Homo sapiens
aagagauuuucacccaucc

SEQ ID NO: 1824821 - RNA, 19 nt, Homo sapiens
cccagccaugcaaugccaa

SEQ ID NO: 1824822 - RNA, 16 nt, Homo sapiens
uaucagacaagcacua

SEQ ID NO: 1824823 - RNA, 14 nt, Homo sapiens
cuaauaauagcauu

SEQ ID NO: 1824824 - RNA, 16 nt, Homo sapiens
uggggguggggcuccu

SEQ ID NO: 1824825 - RNA, 13 nt, Homo sapiens
aaugagaacaauc

SEQ ID NO: 1824826 - RNA, 21 nt, Homo sapiens
uggcuggugugguacagagaa

SEQ ID NO: 1824827 - RNA, 13 nt, Homo sapiens
ucuuuugccauua

SEQ ID NO: 1824828 - RNA, 13 nt, Homo sapiens
ucuuaugccauuu

SEQ ID NO: 1824829 - RNA, 13 nt, Homo sapiens
caccuugcuccca

SEQ ID NO: 1824830 - RNA, 15 nt, Homo sapiens
cacuuccauauguca

SEQ ID NO: 1824831 - RNA, 19 nt, Homo sapiens
agcagcuauuuuaagccau

SEQ ID NO: 1824832 - RNA, 19 nt, Homo sapiens
agccccauugcuccauuca

SEQ ID NO: 1824833 - RNA, 16 nt, Homo sapiens
ugccaccaaaagugcu

SEQ ID NO: 1824834 - RNA, 15 nt, Homo sapiens
ucugagcuuaaacau

SEQ ID NO: 1824835 - RNA, 19 nt, Homo sapiens
uaauaguuguugaguauuc

SEQ ID NO: 1824836 - RNA, 14 nt, Homo sapiens
aagauuaaugcuau

SEQ ID NO: 1824837 - RNA, 21 nt, Homo sapiens
gauaagcaagaaagauuucau

SEQ ID NO: 1824838 - RNA, 17 nt, Homo sapiens
ugaucgugcagcugcug

SEQ ID NO: 1824839 - RNA, 20 nt, Homo sapiens
aggagcccuuaucugugcuc

SEQ ID NO: 1824840 - RNA, 21 nt, Homo sapiens
aguaauacaauacaguacuca

SEQ ID NO: 1824841 - RNA, 14 nt, Homo sapiens
cucaaacugugauu

SEQ ID NO: 1824842 - RNA, 17 nt, Homo sapiens
acucauggguacccaga

SEQ ID NO: 1824843 - RNA, 17 nt, Homo sapiens
ugaagguccccuggcag

SEQ ID NO: 1824844 - RNA, 19 nt, Homo sapiens
uaaaaacaaacagaacaaa

SEQ ID NO: 1824845 - RNA, 22 nt, Homo sapiens
agaggaacuccuuggccuagcc

SEQ ID NO: 1824846 - RNA, 19 nt, Homo sapiens
uaaauugucugccauuaca

SEQ ID NO: 1824847 - RNA, 16 nt, Homo sapiens
acuaauuuuaaaguaa

SEQ ID NO: 1824848 - RNA, 14 nt, Homo sapiens
auugaaccgccguc

SEQ ID NO: 1824849 - RNA, 15 nt, Homo sapiens
cuccuucccauuucu

SEQ ID NO: 1824850 - RNA, 20 nt, Homo sapiens
agcaaugucucuuugugcuc

SEQ ID NO: 1824851 - RNA, 16 nt, Homo sapiens
aaaucucagcaaugau

SEQ ID NO: 1824852 - RNA, 23 nt, Homo sapiens
uguauuuuauuacaucuuucaca

SEQ ID NO: 1824853 - RNA, 16 nt, Homo sapiens
gccucccugcacuuca

SEQ ID NO: 1824854 - RNA, 13 nt, Homo sapiens
uuggcaugugcag

SEQ ID NO: 1824855 - RNA, 18 nt, Homo sapiens
gauugaucagagcauugu

SEQ ID NO: 1824856 - RNA, 15 nt, Homo sapiens
cucccuacauucccc

SEQ ID NO: 1824857 - RNA, 15 nt, Homo sapiens
cacaucacaauauuc

SEQ ID NO: 1824858 - RNA, 16 nt, Homo sapiens
guuucuggaagacugc

SEQ ID NO: 1824859 - RNA, 13 nt, Homo sapiens
uuaagaagacaua

SEQ ID NO: 1824860 - RNA, 13 nt, Homo sapiens
uggauccagcacu

SEQ ID NO: 1824861 - RNA, 18 nt, Homo sapiens
cacuauguugcccaggcu

SEQ ID NO: 1824862 - RNA, 15 nt, Homo sapiens
caucacuugccaaug

SEQ ID NO: 1824863 - RNA, 23 nt, Homo sapiens
cagcuuguaaugguucuuuacac

SEQ ID NO: 1824864 - RNA, 17 nt, Homo sapiens
caagugccuugagcugc

SEQ ID NO: 1824865 - RNA, 17 nt, Homo sapiens
cagcucagacccagacc

SEQ ID NO: 1824866 - RNA, 18 nt, Homo sapiens
acaaugcugagguuauga

SEQ ID NO: 1824867 - RNA, 14 nt, Homo sapiens
gguuccaacuguau

SEQ ID NO: 1824868 - RNA, 18 nt, Homo sapiens
guccaugccaugaaugag

SEQ ID NO: 1824869 - RNA, 23 nt, Homo sapiens
acaauguaugugaaaguguaaaa

SEQ ID NO: 1824870 - RNA, 19 nt, Homo sapiens
agacuguggaaccaaagcu

SEQ ID NO: 1824871 - RNA, 20 nt, Homo sapiens
cucuggacaggcacuaucug

SEQ ID NO: 1824872 - RNA, 19 nt, Homo sapiens
uguccacuuggagcuaaaa

SEQ ID NO: 1824873 - RNA, 11 nt, Homo sapiens
caaaacaacca

SEQ ID NO: 1824874 - RNA, 16 nt, Homo sapiens
aucuaucucacacugc

SEQ ID NO: 1824875 - RNA, 21 nt, Homo sapiens
gucguuuuuuucuugugcuga

SEQ ID NO: 1824876 - RNA, 23 nt, Homo sapiens
auccaccuuggcucugccagugg

SEQ ID NO: 1824877 - RNA, 16 nt, Homo sapiens
aaaauaauugggugac

SEQ ID NO: 1824878 - RNA, 18 nt, Homo sapiens
aaggagucaagaacaauu

SEQ ID NO: 1824879 - RNA, 21 nt, Homo sapiens
uaaauugggcuucaaucacug

SEQ ID NO: 1824880 - RNA, 18 nt, Homo sapiens
gacccucucaagugcccu

SEQ ID NO: 1824881 - RNA, 18 nt, Homo sapiens
gaugggcuuagagcucuc

SEQ ID NO: 1824882 - RNA, 13 nt, Homo sapiens
cagagcagagccu

SEQ ID NO: 1824883 - RNA, 20 nt, Homo sapiens
cugcccaacccuucccucac

SEQ ID NO: 1824884 - RNA, 21 nt, Homo sapiens
gaaaugggagaagagagacag

SEQ ID NO: 1824885 - RNA, 22 nt, Homo sapiens
cacagggcgagacuccgucuca

SEQ ID NO: 1824886 - RNA, 14 nt, Homo sapiens
auuuuaaagaggaa

SEQ ID NO: 1824887 - RNA, 23 nt, Homo sapiens
ugcuuaguagagcuuuuugcaug

SEQ ID NO: 1824888 - RNA, 16 nt, Homo sapiens
aagagauucugccuca

SEQ ID NO: 1824889 - RNA, 22 nt, Homo sapiens
ccugcgccaccucacugcagua

SEQ ID NO: 1824890 - RNA, 12 nt, Homo sapiens
caugggagaccc

SEQ ID NO: 1824891 - RNA, 16 nt, Homo sapiens
ugagggcccagagcag

SEQ ID NO: 1824892 - RNA, 14 nt, Homo sapiens
uuacuaaaugcaga

SEQ ID NO: 1824893 - RNA, 18 nt, Homo sapiens
uaugugggaguacucuca

SEQ ID NO: 1824894 - RNA, 19 nt, Homo sapiens
gacagugcauuugccuugu

SEQ ID NO: 1824895 - RNA, 22 nt, Homo sapiens
cuuuguugcuaucaauccaaga

SEQ ID NO: 1824896 - RNA, 18 nt, Homo sapiens
gagugugguuaugaacuu

SEQ ID NO: 1824897 - RNA, 19 nt, Homo sapiens
uuuccgagccuccagucca

SEQ ID NO: 1824898 - RNA, 20 nt, Homo sapiens
auuuuguaauaaacucucua

SEQ ID NO: 1824899 - RNA, 18 nt, Homo sapiens
auucaucugggaggcaga

SEQ ID NO: 1824900 - RNA, 18 nt, Homo sapiens
aguggcauucacaucuca

SEQ ID NO: 1824901 - RNA, 12 nt, Homo sapiens
aaacaggccagg

SEQ ID NO: 1824902 - RNA, 15 nt, Homo sapiens
aagcagcacugugag

SEQ ID NO: 1824903 - RNA, 20 nt, Homo sapiens
aagaucuguuuugaaggcaa

SEQ ID NO: 1824904 - RNA, 20 nt, Homo sapiens
ccugaggaggaggacacagc

SEQ ID NO: 1824905 - RNA, 22 nt, Homo sapiens
ugugcucucgggugcccugcau

SEQ ID NO: 1824906 - RNA, 22 nt, Homo sapiens
cuaucuuuugguauacuugugu

SEQ ID NO: 1824907 - RNA, 11 nt, Homo sapiens
agacaugaacu

SEQ ID NO: 1824908 - RNA, 22 nt, Homo sapiens
uccuugggaggccccacugggg

SEQ ID NO: 1824909 - RNA, 15 nt, Homo sapiens
cacaguuggcacuuc

SEQ ID NO: 1824910 - RNA, 20 nt, Homo sapiens
uauuuagaaauagaacuaca

SEQ ID NO: 1824911 - RNA, 18 nt, Homo sapiens
cugagacaugacuaggaa

SEQ ID NO: 1824912 - RNA, 16 nt, Homo sapiens
auuuucaccuauuacc

SEQ ID NO: 1824913 - RNA, 21 nt, Homo sapiens
aagcucagguucccugccaca

SEQ ID NO: 1824914 - RNA, 18 nt, Homo sapiens
aacaacucuccagugccu

SEQ ID NO: 1824915 - RNA, 20 nt, Homo sapiens
agcuguaacuuaacuauuaa

SEQ ID NO: 1824916 - RNA, 20 nt, Homo sapiens
ccuuuucucuggacacuggg

SEQ ID NO: 1824917 - RNA, 17 nt, Homo sapiens
caccugacagcuuuauc

SEQ ID NO: 1824918 - RNA, 18 nt, Homo sapiens
cagagcuggccaggccac

SEQ ID NO: 1824919 - RNA, 22 nt, Homo sapiens
acugaccccaucaccuacucac

SEQ ID NO: 1824920 - RNA, 12 nt, Homo sapiens
ucauaggcagua

SEQ ID NO: 1824921 - RNA, 15 nt, Homo sapiens
gagcuuugacucagg

SEQ ID NO: 1824922 - RNA, 23 nt, Homo sapiens
gcauucuccuccuauugccucca

SEQ ID NO: 1824923 - RNA, 13 nt, Homo sapiens
cccaggaggugca

SEQ ID NO: 1824924 - RNA, 16 nt, Homo sapiens
gaauccccuaaacaaa

SEQ ID NO: 1824925 - RNA, 17 nt, Homo sapiens
uauuugacucagcacug

SEQ ID NO: 1824926 - RNA, 17 nt, Homo sapiens
uguaagaaaagcuucca

SEQ ID NO: 1824927 - RNA, 22 nt, Homo sapiens
auuccaugaagccccagaggua

SEQ ID NO: 1824928 - RNA, 16 nt, Homo sapiens
uccaucugugccauac

SEQ ID NO: 1824929 - RNA, 14 nt, Homo sapiens
aaaaucaauauuuc

SEQ ID NO: 1824930 - RNA, 20 nt, Homo sapiens
accuggucccugcucucagu

SEQ ID NO: 1824931 - RNA, 15 nt, Homo sapiens
ccucauuguucugua

SEQ ID NO: 1824932 - RNA, 11 nt, Homo sapiens
uauacagcuca

SEQ ID NO: 1824933 - RNA, 19 nt, Homo sapiens
gccaggccagagggcagug

SEQ ID NO: 1824934 - RNA, 16 nt, Homo sapiens
gaccaucgcaaccagg

SEQ ID NO: 1824935 - RNA, 20 nt, Homo sapiens
acaaucuggcuuagugccac

SEQ ID NO: 1824936 - RNA, 19 nt, Homo sapiens
uaaaaugagucacuuacuu

SEQ ID NO: 1824937 - RNA, 16 nt, Homo sapiens
ucagggugucuggggc

SEQ ID NO: 1824938 - RNA, 20 nt, Homo sapiens
aacagggguucuuagucuca

SEQ ID NO: 1824939 - RNA, 20 nt, Homo sapiens
aacacuuauguuauacaaua

SEQ ID NO: 1824940 - RNA, 22 nt, Homo sapiens
uuccuggcacugcuuccaguga

SEQ ID NO: 1824941 - RNA, 22 nt, Homo sapiens
auaaaucgcuuuugauaaucaa

SEQ ID NO: 1824942 - RNA, 13 nt, Homo sapiens
uuccaaaaaccau

SEQ ID NO: 1824943 - RNA, 19 nt, Homo sapiens
uagugcaacaucucugaau

SEQ ID NO: 1824944 - RNA, 10 nt, Homo sapiens
aaaagugcaa

SEQ ID NO: 1824945 - RNA, 16 nt, Homo sapiens
accuugcaguguagga

SEQ ID NO: 1824946 - RNA, 17 nt, Homo sapiens
guuauaucauauguaua

SEQ ID NO: 1824947 - RNA, 23 nt, Homo sapiens
gacuuucuugaaaagaagcaagg

SEQ ID NO: 1824948 - RNA, 13 nt, Homo sapiens
guucuucuaucca

SEQ ID NO: 1824949 - RNA, 15 nt, Homo sapiens
acugauagaugucua

SEQ ID NO: 1824950 - RNA, 12 nt, Homo sapiens
aagcagcagcua

SEQ ID NO: 1824951 - RNA, 22 nt, Homo sapiens
cccgcgugauuguggcauuuaa

SEQ ID NO: 1824952 - RNA, 18 nt, Homo sapiens
ggcuaaagugcauuuuua

SEQ ID NO: 1824953 - RNA, 18 nt, Homo sapiens
ugcuggcagccauggcca

SEQ ID NO: 1824954 - RNA, 18 nt, Homo sapiens
ugcacuccagucuggcaa

SEQ ID NO: 1824955 - RNA, 18 nt, Homo sapiens
uaaggacaugaugcuuuu

SEQ ID NO: 1824956 - RNA, 20 nt, Homo sapiens
uguaccaccaacuacuaccu

SEQ ID NO: 1824957 - RNA, 20 nt, Homo sapiens
aagcucugccucccggguuc

SEQ ID NO: 1824958 - RNA, 19 nt, Homo sapiens
gaaauaccacaagccugag

SEQ ID NO: 1824959 - RNA, 18 nt, Homo sapiens
caucucuccccaacccua

SEQ ID NO: 1824960 - RNA, 21 nt, Homo sapiens
cauuacugcaugcacuucuua

SEQ ID NO: 1824961 - RNA, 15 nt, Homo sapiens
uggaugaagcagaga

SEQ ID NO: 1824962 - RNA, 13 nt, Homo sapiens
uccuaagcaccug

SEQ ID NO: 1824963 - RNA, 21 nt, Homo sapiens
ugagcaaaaugcugcuuucug

SEQ ID NO: 1824964 - RNA, 20 nt, Homo sapiens
cauaugugaauauggacuca

SEQ ID NO: 1824965 - RNA, 22 nt, Homo sapiens
cagugaaagcugacaucuguaa

SEQ ID NO: 1824966 - RNA, 13 nt, Homo sapiens
cugggcucugcca

SEQ ID NO: 1824967 - RNA, 22 nt, Homo sapiens
aacagucuaguguaauggauca

SEQ ID NO: 1824968 - RNA, 22 nt, Homo sapiens
cuguagucccagcuacucagga

SEQ ID NO: 1824969 - RNA, 15 nt, Homo sapiens
acuucacuaggcauu

SEQ ID NO: 1824970 - RNA, 12 nt, Homo sapiens
uccuucacuuac

SEQ ID NO: 1824971 - RNA, 22 nt, Homo sapiens
uaccauaagcuuuuucucugaa

SEQ ID NO: 1824972 - RNA, 16 nt, Homo sapiens
uguaaucccagcacuu

SEQ ID NO: 1824973 - RNA, 15 nt, Homo sapiens
gugagcacuagaaua

SEQ ID NO: 1824974 - RNA, 16 nt, Homo sapiens
ccauccuugagucaaa

SEQ ID NO: 1824975 - RNA, 20 nt, Homo sapiens
gaacauggucacccccacuc

SEQ ID NO: 1824976 - RNA, 16 nt, Homo sapiens
gcucaucuaacucugu

SEQ ID NO: 1824977 - RNA, 22 nt, Homo sapiens
ccugaauucuuuccccaaagac

SEQ ID NO: 1824978 - RNA, 22 nt, Homo sapiens
ugaaugugagguguugcuaaau

SEQ ID NO: 1824979 - RNA, 15 nt, Homo sapiens
uucagaaaagacacu

SEQ ID NO: 1824980 - RNA, 23 nt, Homo sapiens
aaggagauauggcuaguggcaau

SEQ ID NO: 1824981 - RNA, 19 nt, Homo sapiens
aagcagauuuauuuuugaa

SEQ ID NO: 1824982 - RNA, 19 nt, Homo sapiens
gucuggugccccuuugccc

SEQ ID NO: 1824983 - RNA, 16 nt, Homo sapiens
aauuacauacuauucu

SEQ ID NO: 1824984 - RNA, 13 nt, Homo sapiens
aacacugugcaaa

SEQ ID NO: 1824985 - RNA, 22 nt, Homo sapiens
acaggauucuuuaaucauggag

SEQ ID NO: 1824986 - RNA, 14 nt, Homo sapiens
aacuucuugucaga

SEQ ID NO: 1824987 - RNA, 14 nt, Homo sapiens
uugaauacaacauu

SEQ ID NO: 1824988 - RNA, 21 nt, Homo sapiens
aaagcuguucucauuccuguu

SEQ ID NO: 1824989 - RNA, 19 nt, Homo sapiens
caaugacuuaaccauauaa

SEQ ID NO: 1824990 - RNA, 11 nt, Homo sapiens
aguucugauga

SEQ ID NO: 1824991 - RNA, 20 nt, Homo sapiens
cuccucuuuuuuuaaaaaua

SEQ ID NO: 1824992 - RNA, 15 nt, Homo sapiens
augacucagcauacc

SEQ ID NO: 1824993 - RNA, 14 nt, Homo sapiens
guggggaaggggug

SEQ ID NO: 1824994 - RNA, 14 nt, Homo sapiens
caacucgugacagc

SEQ ID NO: 1824995 - RNA, 23 nt, Homo sapiens
uguaagaaauaacacugugaaug

SEQ ID NO: 1824996 - RNA, 15 nt, Homo sapiens
agcaaccuuucccuu

SEQ ID NO: 1824997 - RNA, 22 nt, Homo sapiens
guguauaaaaaccaugcuggua

SEQ ID NO: 1824998 - RNA, 23 nt, Homo sapiens
ucgcggcgcagccccuggagcuc

SEQ ID NO: 1824999 - RNA, 22 nt, Homo sapiens
uauaauucuguacauagccuau

SEQ ID NO: 1825000 - RNA, 16 nt, Homo sapiens
caaugguagcaaaaca

SEQ ID NO: 1825001 - RNA, 16 nt, Homo sapiens
ggaauuuucucuccau

SEQ ID NO: 1825002 - RNA, 22 nt, Homo sapiens
agagaaacgcaagcagacugga

SEQ ID NO: 1825003 - RNA, 17 nt, Homo sapiens
augccuguaaucccagc

SEQ ID NO: 1825004 - RNA, 21 nt, Homo sapiens
cucagcuagacauugcaauuu

SEQ ID NO: 1825005 - RNA, 15 nt, Homo sapiens
agcagaacacacucu

SEQ ID NO: 1825006 - RNA, 12 nt, Homo sapiens
gugaguucucac

SEQ ID NO: 1825007 - RNA, 21 nt, Homo sapiens
ugaggcuggacuccagaucug

SEQ ID NO: 1825008 - RNA, 18 nt, Homo sapiens
aagcaguuaggcuguaca

SEQ ID NO: 1825009 - RNA, 18 nt, Homo sapiens
cucauucccuccccagaa

SEQ ID NO: 1825010 - RNA, 14 nt, Homo sapiens
ggaagaggagcaac

SEQ ID NO: 1825011 - RNA, 13 nt, Homo sapiens
cacucuguggcca

SEQ ID NO: 1825012 - RNA, 18 nt, Homo sapiens
acaacucuagucagcaca

SEQ ID NO: 1825013 - RNA, 21 nt, Homo sapiens
caauucaaucaaagcuaccuu

SEQ ID NO: 1825014 - RNA, 12 nt, Homo sapiens
cauuauuccucc

SEQ ID NO: 1825015 - RNA, 15 nt, Homo sapiens
ucuacaguuguccug

SEQ ID NO: 1825016 - RNA, 21 nt, Homo sapiens
uggcugucaaugggaccugug

SEQ ID NO: 1825017 - RNA, 20 nt, Homo sapiens
ucaaugccucacgagauuug

SEQ ID NO: 1825018 - RNA, 18 nt, Homo sapiens
gcugacaucuguguuuca

SEQ ID NO: 1825019 - RNA, 16 nt, Homo sapiens
caugaaaggggaaaua

SEQ ID NO: 1825020 - RNA, 15 nt, Homo sapiens
caagauuuugaagga

SEQ ID NO: 1825021 - RNA, 15 nt, Homo sapiens
uaauuaaagccuuaa

SEQ ID NO: 1825022 - RNA, 14 nt, Homo sapiens
cacaauuugcagua

SEQ ID NO: 1825023 - RNA, 14 nt, Homo sapiens
ugucauaugacuga

SEQ ID NO: 1825024 - RNA, 20 nt, Homo sapiens
aacguuuuuggacacugugc

SEQ ID NO: 1825025 - RNA, 19 nt, Homo sapiens
cagcccuauggaagucuca

SEQ ID NO: 1825026 - RNA, 19 nt, Homo sapiens
gaggggacucaaacagucu

SEQ ID NO: 1825027 - RNA, 23 nt, Homo sapiens
cauaaagagguaaaaaacuguca

SEQ ID NO: 1825028 - RNA, 15 nt, Homo sapiens
uugcuuauuacauau

SEQ ID NO: 1825029 - RNA, 20 nt, Homo sapiens
gagacaacagcccugucuca

SEQ ID NO: 1825030 - RNA, 17 nt, Homo sapiens
ugcaggcaucacagcua

SEQ ID NO: 1825031 - RNA, 15 nt, Homo sapiens
caauauuucuucaca

SEQ ID NO: 1825032 - RNA, 23 nt, Homo sapiens
cuguauagaaugguaaaauacca

SEQ ID NO: 1825033 - RNA, 18 nt, Homo sapiens
cugagggcagugcccuuu

SEQ ID NO: 1825034 - RNA, 19 nt, Homo sapiens
aguugacucugcucuugca

SEQ ID NO: 1825035 - RNA, 14 nt, Homo sapiens
uuuggaaauccaaa

SEQ ID NO: 1825036 - RNA, 17 nt, Homo sapiens
aacauauucuugcuuuc

SEQ ID NO: 1825037 - RNA, 12 nt, Homo sapiens
caaauaugcuuu

SEQ ID NO: 1825038 - RNA, 14 nt, Homo sapiens
gucuggcauuacaa

SEQ ID NO: 1825039 - RNA, 21 nt, Homo sapiens
aaaaugacauuaaaugcaaua

SEQ ID NO: 1825040 - RNA, 10 nt, Homo sapiens
uaauuuuccu

SEQ ID NO: 1825041 - RNA, 19 nt, Homo sapiens
ggaaauuccuaacuuugcc

SEQ ID NO: 1825042 - RNA, 15 nt, Homo sapiens
guccauuucuaccaa

SEQ ID NO: 1825043 - RNA, 16 nt, Homo sapiens
uguggaggauugcuau

SEQ ID NO: 1825044 - RNA, 16 nt, Homo sapiens
cuucaaccccaugaga

SEQ ID NO: 1825045 - RNA, 22 nt, Homo sapiens
uggcaaccugcuuucaagaccc

SEQ ID NO: 1825046 - RNA, 14 nt, Homo sapiens
guuccugcacucca

SEQ ID NO: 1825047 - RNA, 19 nt, Homo sapiens
cagaaagaccgugugugaa

SEQ ID NO: 1825048 - RNA, 16 nt, Homo sapiens
acgcuguuuguuucau

SEQ ID NO: 1825049 - RNA, 21 nt, Homo sapiens
gaauucuaggcagcaccuuag

SEQ ID NO: 1825050 - RNA, 20 nt, Homo sapiens
ucaaaaugaugcaaccaaaa

SEQ ID NO: 1825051 - RNA, 23 nt, Homo sapiens
ggcagccccaccucacagccaga

SEQ ID NO: 1825052 - RNA, 18 nt, Homo sapiens
caaaccuccaaauguccu

SEQ ID NO: 1825053 - RNA, 15 nt, Homo sapiens
acgcugacugcaaaa

SEQ ID NO: 1825054 - RNA, 12 nt, Homo sapiens
agugaccuuccu

SEQ ID NO: 1825055 - RNA, 16 nt, Homo sapiens
acucaggagucugcca

SEQ ID NO: 1825056 - RNA, 17 nt, Homo sapiens
ucuugcugaaagccaag

SEQ ID NO: 1825057 - RNA, 12 nt, Homo sapiens
aggagccaaaca

SEQ ID NO: 1825058 - RNA, 14 nt, Homo sapiens
augggcuagagggu

SEQ ID NO: 1825059 - RNA, 21 nt, Homo sapiens
gcucacccaaggucaccaaac

SEQ ID NO: 1825060 - RNA, 15 nt, Homo sapiens
auaauaauagcagug

SEQ ID NO: 1825061 - RNA, 15 nt, Homo sapiens
agaaaggucauccaa

SEQ ID NO: 1825062 - RNA, 15 nt, Homo sapiens
aguuuuuguuucaca

SEQ ID NO: 1825063 - RNA, 19 nt, Homo sapiens
caucuagaggcuuccuuca

SEQ ID NO: 1825064 - RNA, 17 nt, Homo sapiens
auaaaauugaugugcau

SEQ ID NO: 1825065 - RNA, 16 nt, Homo sapiens
ucaaggauauacugca

SEQ ID NO: 1825066 - RNA, 16 nt, Homo sapiens
ugagaagacuggcuag

SEQ ID NO: 1825067 - RNA, 16 nt, Homo sapiens
cugccugcuacuugag

SEQ ID NO: 1825068 - RNA, 15 nt, Homo sapiens
agucgaacaauucau

SEQ ID NO: 1825069 - RNA, 21 nt, Homo sapiens
accucccccuguguggcccug

SEQ ID NO: 1825070 - RNA, 15 nt, Homo sapiens
cucaguggaucuuca

SEQ ID NO: 1825071 - RNA, 22 nt, Homo sapiens
acaaucuuuccuugucucucau

SEQ ID NO: 1825072 - RNA, 17 nt, Homo sapiens
aacgaaucgauucugca

SEQ ID NO: 1825073 - RNA, 13 nt, Homo sapiens
uuagacuugcucc

SEQ ID NO: 1825074 - RNA, 16 nt, Homo sapiens
uauuuugaaaacacuu

SEQ ID NO: 1825075 - RNA, 17 nt, Homo sapiens
aggaaagagagacccca

SEQ ID NO: 1825076 - RNA, 22 nt, Homo sapiens
aacaucaucaggcuuggaauga

SEQ ID NO: 1825077 - RNA, 14 nt, Homo sapiens
uuugaaggcuuuag

SEQ ID NO: 1825078 - RNA, 18 nt, Homo sapiens
ucagagggccucaucuca

SEQ ID NO: 1825079 - RNA, 19 nt, Homo sapiens
gagauaacagccucuugcc

SEQ ID NO: 1825080 - RNA, 21 nt, Homo sapiens
gccaugguggagggcacuuca

SEQ ID NO: 1825081 - RNA, 22 nt, Homo sapiens
uucugagaagaaacuuguccuu

SEQ ID NO: 1825082 - RNA, 16 nt, Homo sapiens
guauucucagcacuuu

SEQ ID NO: 1825083 - RNA, 18 nt, Homo sapiens
cuuugacaugacugcaau

SEQ ID NO: 1825084 - RNA, 20 nt, Homo sapiens
gaggaucguaguguguuuaa

SEQ ID NO: 1825085 - RNA, 18 nt, Homo sapiens
aggguaacuuaacagagu

SEQ ID NO: 1825086 - RNA, 17 nt, Homo sapiens
gcuuugccgccauggga

SEQ ID NO: 1825087 - RNA, 13 nt, Homo sapiens
cagggauggcccc

SEQ ID NO: 1825088 - RNA, 14 nt, Homo sapiens
cugauucuaggaua

SEQ ID NO: 1825089 - RNA, 20 nt, Homo sapiens
uagucccagcuacuugagag

SEQ ID NO: 1825090 - RNA, 21 nt, Homo sapiens
gcagucaccacccagcccuuc

SEQ ID NO: 1825091 - RNA, 15 nt, Homo sapiens
acacguguccuguag

SEQ ID NO: 1825092 - RNA, 11 nt, Homo sapiens
gauugcuaaau

SEQ ID NO: 1825093 - RNA, 18 nt, Homo sapiens
cccuggcccuccaugaca

SEQ ID NO: 1825094 - RNA, 16 nt, Homo sapiens
ccacuucuaaauagca

SEQ ID NO: 1825095 - RNA, 16 nt, Homo sapiens
aaucaucuccuuugca

SEQ ID NO: 1825096 - RNA, 14 nt, Homo sapiens
acauuugaugucua

SEQ ID NO: 1825097 - RNA, 14 nt, Homo sapiens
uguugacagugcca

SEQ ID NO: 1825098 - RNA, 19 nt, Homo sapiens
cagggagguggcuggguuu

SEQ ID NO: 1825099 - RNA, 13 nt, Homo sapiens
acucgcaauuuca

SEQ ID NO: 1825100 - RNA, 19 nt, Homo sapiens
cugccugcggaccagauga

SEQ ID NO: 1825101 - RNA, 13 nt, Homo sapiens
acguuugucauuc

SEQ ID NO: 1825102 - RNA, 14 nt, Homo sapiens
uagggcugagcucu

SEQ ID NO: 1825103 - RNA, 20 nt, Homo sapiens
caaagaaacagccuuacacu

SEQ ID NO: 1825104 - RNA, 13 nt, Homo sapiens
uauucaacuaaua

SEQ ID NO: 1825105 - RNA, 13 nt, Homo sapiens
cguccuacuguau

SEQ ID NO: 1825106 - RNA, 13 nt, Homo sapiens
uccauaucagcuc

SEQ ID NO: 1825107 - RNA, 21 nt, Homo sapiens
cauccauccuggagccucaug

SEQ ID NO: 1825108 - RNA, 17 nt, Homo sapiens
caauccuccauuugcug

SEQ ID NO: 1825109 - RNA, 13 nt, Homo sapiens
cucugccacugac

SEQ ID NO: 1825110 - RNA, 17 nt, Homo sapiens
aggacacgaacuggaag

SEQ ID NO: 1825111 - RNA, 19 nt, Homo sapiens
ccuaggagaagcagccucc

SEQ ID NO: 1825112 - RNA, 17 nt, Homo sapiens
aauccagcaucuauacg

SEQ ID NO: 1825113 - RNA, 15 nt, Homo sapiens
uaucaaaucauucaa

SEQ ID NO: 1825114 - RNA, 16 nt, Homo sapiens
gugacauuugggagac

SEQ ID NO: 1825115 - RNA, 20 nt, Homo sapiens
cauggaaagggagacagcca

SEQ ID NO: 1825116 - RNA, 19 nt, Homo sapiens
aaaucuaaucucuuauucu

SEQ ID NO: 1825117 - RNA, 13 nt, Homo sapiens
cuguucauuucac

SEQ ID NO: 1825118 - RNA, 23 nt, Homo sapiens
uuagcauuccuauugacaacucu

SEQ ID NO: 1825119 - RNA, 21 nt, Homo sapiens
ucucaaaccugugcugaccaa

SEQ ID NO: 1825120 - RNA, 15 nt, Homo sapiens
ugagcagacaggaca

SEQ ID NO: 1825121 - RNA, 16 nt, Homo sapiens
uguacagaauuuccac

SEQ ID NO: 1825122 - RNA, 14 nt, Homo sapiens
uacaauguacaauu

SEQ ID NO: 1825123 - RNA, 18 nt, Homo sapiens
gaauccucucagagucau

SEQ ID NO: 1825124 - RNA, 22 nt, Homo sapiens
cuuucuuuguaacaugacacau

SEQ ID NO: 1825125 - RNA, 12 nt, Homo sapiens
cagcacugcccc

SEQ ID NO: 1825126 - RNA, 13 nt, Homo sapiens
cacagauuuccaa

SEQ ID NO: 1825127 - RNA, 13 nt, Homo sapiens
ucuagauucauaa

SEQ ID NO: 1825128 - RNA, 18 nt, Homo sapiens
auaggaggccaacccaaa

SEQ ID NO: 1825129 - RNA, 21 nt, Homo sapiens
uuauuucaggaaggucuucaa

SEQ ID NO: 1825130 - RNA, 22 nt, Homo sapiens
uagaauugugcuggucauacau

SEQ ID NO: 1825131 - RNA, 14 nt, Homo sapiens
uuuaacagcucucu

SEQ ID NO: 1825132 - RNA, 17 nt, Homo sapiens
cucuuggacaacagcuc

SEQ ID NO: 1825133 - RNA, 18 nt, Homo sapiens
gaagucagccacacuggg

SEQ ID NO: 1825134 - RNA, 21 nt, Homo sapiens
agcacugccaggagggacaaa

SEQ ID NO: 1825135 - RNA, 15 nt, Homo sapiens
ugggcagcagcucag

SEQ ID NO: 1825136 - RNA, 22 nt, Homo sapiens
cagagcuccaguuugcauuugg

SEQ ID NO: 1825137 - RNA, 20 nt, Homo sapiens
ggcaaaaucgagagaagcug

SEQ ID NO: 1825138 - RNA, 23 nt, Homo sapiens
cauuagggggaacucuagccaaa

SEQ ID NO: 1825139 - RNA, 15 nt, Homo sapiens
ucugggcuacugcca

SEQ ID NO: 1825140 - RNA, 15 nt, Homo sapiens
gaguuuaacaugugu

SEQ ID NO: 1825141 - RNA, 17 nt, Homo sapiens
gaggucuccaaacugau

SEQ ID NO: 1825142 - RNA, 17 nt, Homo sapiens
gcauuuauuuaugugca

SEQ ID NO: 1825143 - RNA, 15 nt, Homo sapiens
caugccuuaccuaag

SEQ ID NO: 1825144 - RNA, 15 nt, Homo sapiens
gagccuccucagggg

SEQ ID NO: 1825145 - RNA, 18 nt, Homo sapiens
auuuaugaagaaaauacu

SEQ ID NO: 1825146 - RNA, 14 nt, Homo sapiens
aaagcccuugaacc

SEQ ID NO: 1825147 - RNA, 22 nt, Homo sapiens
cccaaccgcgggggcugugagc

SEQ ID NO: 1825148 - RNA, 18 nt, Homo sapiens
ucccuuaauaaaaauaua

SEQ ID NO: 1825149 - RNA, 16 nt, Homo sapiens
aagagauaacuguaaa

SEQ ID NO: 1825150 - RNA, 22 nt, Homo sapiens
gugauggcauuacucugcacua

SEQ ID NO: 1825151 - RNA, 15 nt, Homo sapiens
ugcaaaaauaaccaa

SEQ ID NO: 1825152 - RNA, 18 nt, Homo sapiens
auucuaagucaauccaag

SEQ ID NO: 1825153 - RNA, 13 nt, Homo sapiens
caggccucugagg

SEQ ID NO: 1825154 - RNA, 12 nt, Homo sapiens
ggagaguguaua

SEQ ID NO: 1825155 - RNA, 19 nt, Homo sapiens
ugucacccuccaccgagcc

SEQ ID NO: 1825156 - RNA, 23 nt, Homo sapiens
aguauuccaugggauguuaagca

SEQ ID NO: 1825157 - RNA, 13 nt, Homo sapiens
ucuuuuugcugcc

SEQ ID NO: 1825158 - RNA, 23 nt, Homo sapiens
cgugggugugugugggcacgugu

SEQ ID NO: 1825159 - RNA, 22 nt, Homo sapiens
aaagcuguuucuaaacaguuga

SEQ ID NO: 1825160 - RNA, 18 nt, Homo sapiens
aaggcugacagacucacu

SEQ ID NO: 1825161 - RNA, 19 nt, Homo sapiens
aguagugaguuaaagcuac

SEQ ID NO: 1825162 - RNA, 17 nt, Homo sapiens
ugaggcaggagaauggc

SEQ ID NO: 1825163 - RNA, 17 nt, Homo sapiens
ccuggacaguuuucugc

SEQ ID NO: 1825164 - RNA, 21 nt, Homo sapiens
aaggaaugauauauucuugaa

SEQ ID NO: 1825165 - RNA, 12 nt, Homo sapiens
gacugugccugg

SEQ ID NO: 1825166 - RNA, 17 nt, Homo sapiens
ccaaaaagggcuucaag

SEQ ID NO: 1825167 - RNA, 18 nt, Homo sapiens
ucuuacuccuggcuuuaa

SEQ ID NO: 1825168 - RNA, 13 nt, Homo sapiens
ucagacccaggag

SEQ ID NO: 1825169 - RNA, 17 nt, Homo sapiens
uugguucaguaccacau

SEQ ID NO: 1825170 - RNA, 18 nt, Homo sapiens
ucugccucuauucaauuu

SEQ ID NO: 1825171 - RNA, 20 nt, Homo sapiens
acagccugcacacaccugcc

SEQ ID NO: 1825172 - RNA, 23 nt, Homo sapiens
uuaguuguaaaccaagugaucaa

SEQ ID NO: 1825173 - RNA, 18 nt, Homo sapiens
aggagaugucaucaagcu

SEQ ID NO: 1825174 - RNA, 13 nt, Homo sapiens
aaauuaugacugc

SEQ ID NO: 1825175 - RNA, 17 nt, Homo sapiens
cuguccuccagcugucu

SEQ ID NO: 1825176 - RNA, 21 nt, Homo sapiens
ccuguuuggggagcaaguguu

SEQ ID NO: 1825177 - RNA, 12 nt, Homo sapiens
guacuguucaca

SEQ ID NO: 1825178 - RNA, 18 nt, Homo sapiens
aaccauagaggauggucu

SEQ ID NO: 1825179 - RNA, 16 nt, Homo sapiens
aguauguaaguaucac

SEQ ID NO: 1825180 - RNA, 11 nt, Homo sapiens
acaccaaccag

SEQ ID NO: 1825181 - RNA, 17 nt, Homo sapiens
aucuggguuuguuuaca

SEQ ID NO: 1825182 - RNA, 22 nt, Homo sapiens
gaagucugaucccugccaaaaa

SEQ ID NO: 1825183 - RNA, 13 nt, Homo sapiens
uaaauguauauac

SEQ ID NO: 1825184 - RNA, 20 nt, Homo sapiens
ccagagcacugcuccagugg

SEQ ID NO: 1825185 - RNA, 18 nt, Homo sapiens
uggcacgugccugugauc

SEQ ID NO: 1825186 - RNA, 23 nt, Homo sapiens
aggcuagguggguugaaagccaa

SEQ ID NO: 1825187 - RNA, 15 nt, Homo sapiens
aaaugagugcuuaaa

SEQ ID NO: 1825188 - RNA, 15 nt, Homo sapiens
ggauggcaguggcug

SEQ ID NO: 1825189 - RNA, 14 nt, Homo sapiens
aguagacugugauu

SEQ ID NO: 1825190 - RNA, 18 nt, Homo sapiens
gucaacuuauucuuugag

SEQ ID NO: 1825191 - RNA, 22 nt, Homo sapiens
agaagauaugugaagaaaaaug

SEQ ID NO: 1825192 - RNA, 20 nt, Homo sapiens
caagcccgcucccugcucag

SEQ ID NO: 1825193 - RNA, 18 nt, Homo sapiens
auugguuauucaaguauu

SEQ ID NO: 1825194 - RNA, 23 nt, Homo sapiens
ggaggacccagggcucuguaagu

SEQ ID NO: 1825195 - RNA, 20 nt, Homo sapiens
gaucguauuaauuaucugau

SEQ ID NO: 1825196 - RNA, 16 nt, Homo sapiens
cuuccccaucuucuaa

SEQ ID NO: 1825197 - RNA, 18 nt, Homo sapiens
gucauaagcauuacuuua

SEQ ID NO: 1825198 - RNA, 14 nt, Homo sapiens
guacacauuuugua

SEQ ID NO: 1825199 - RNA, 18 nt, Homo sapiens
uaauaacugucuucugga

SEQ ID NO: 1825200 - RNA, 21 nt, Homo sapiens
agcgugcccugccccucuggc

SEQ ID NO: 1825201 - RNA, 14 nt, Homo sapiens
agcacaaagcacug

SEQ ID NO: 1825202 - RNA, 22 nt, Homo sapiens
aucucgccaaccccucucucau

SEQ ID NO: 1825203 - RNA, 14 nt, Homo sapiens
uaaagcagggaaua

SEQ ID NO: 1825204 - RNA, 18 nt, Homo sapiens
gcuuuugaaaaacaaaca

SEQ ID NO: 1825205 - RNA, 19 nt, Homo sapiens
cuggaucaggguuguucug

SEQ ID NO: 1825206 - RNA, 21 nt, Homo sapiens
uuuccaagacagagucuugcu

SEQ ID NO: 1825207 - RNA, 14 nt, Homo sapiens
gggacaagaaucaa

SEQ ID NO: 1825208 - RNA, 20 nt, Homo sapiens
agaggcucuaauguacaaua

SEQ ID NO: 1825209 - RNA, 19 nt, Homo sapiens
ucauaugacugauuacuca

SEQ ID NO: 1825210 - RNA, 15 nt, Homo sapiens
acccccuuaacugua

SEQ ID NO: 1825211 - RNA, 18 nt, Homo sapiens
cuuuguuaugacagugaa

SEQ ID NO: 1825212 - RNA, 16 nt, Homo sapiens
uggacgugugugaaug

SEQ ID NO: 1825213 - RNA, 16 nt, Homo sapiens
uucccuggaggucucu

SEQ ID NO: 1825214 - RNA, 14 nt, Homo sapiens
ccugauuucucuga

SEQ ID NO: 1825215 - RNA, 14 nt, Homo sapiens
cucuguuuccugaa

SEQ ID NO: 1825216 - RNA, 12 nt, Homo sapiens
gugugcaagugu

SEQ ID NO: 1825217 - RNA, 13 nt, Homo sapiens
gcuuuaugcaaau

SEQ ID NO: 1825218 - RNA, 24 nt, Homo sapiens
gaacuuauaacaggaauaagcaaa

SEQ ID NO: 1825219 - RNA, 12 nt, Homo sapiens
caagguuguuca

SEQ ID NO: 1825220 - RNA, 19 nt, Homo sapiens
cuauuuuuaaaaaguacca

SEQ ID NO: 1825221 - RNA, 21 nt, Homo sapiens
gaauuuugggacuucuaccca

SEQ ID NO: 1825222 - RNA, 12 nt, Homo sapiens
ugucaaugcagg

SEQ ID NO: 1825223 - RNA, 21 nt, Homo sapiens
acucuggaguucaucagaguu

SEQ ID NO: 1825224 - RNA, 21 nt, Homo sapiens
gggagucagucuucacuugca

SEQ ID NO: 1825225 - RNA, 22 nt, Homo sapiens
uuuuacuaaaauggcagcuuaa

SEQ ID NO: 1825226 - RNA, 17 nt, Homo sapiens
caguguccucaucugua

SEQ ID NO: 1825227 - RNA, 19 nt, Homo sapiens
accuuaacuggagaccaga

SEQ ID NO: 1825228 - RNA, 21 nt, Homo sapiens
ggacuccucaaaccacuugcc

SEQ ID NO: 1825229 - RNA, 22 nt, Homo sapiens
uaagacagauucuucacugugu

SEQ ID NO: 1825230 - RNA, 13 nt, Homo sapiens
uuaaugauaauau

SEQ ID NO: 1825231 - RNA, 15 nt, Homo sapiens
gauaaauaauaaagg

SEQ ID NO: 1825232 - RNA, 23 nt, Homo sapiens
agcuguacccuugagaccuggaa

SEQ ID NO: 1825233 - RNA, 19 nt, Homo sapiens
auuacaguggauugcucau

SEQ ID NO: 1825234 - RNA, 17 nt, Homo sapiens
guuaggccaacugccuc

SEQ ID NO: 1825235 - RNA, 11 nt, Homo sapiens
cauuagcugaa

SEQ ID NO: 1825236 - RNA, 21 nt, Homo sapiens
aaagcugccugugccaugccc

SEQ ID NO: 1825237 - RNA, 13 nt, Homo sapiens
cuggagcucugcc

SEQ ID NO: 1825238 - RNA, 14 nt, Homo sapiens
uuaauaaagcauuc

SEQ ID NO: 1825239 - RNA, 14 nt, Homo sapiens
gaucagaauaucac

SEQ ID NO: 1825240 - RNA, 19 nt, Homo sapiens
cacacuuuuccacauucca

SEQ ID NO: 1825241 - RNA, 22 nt, Homo sapiens
uucuaugacccagcauggguua

SEQ ID NO: 1825242 - RNA, 14 nt, Homo sapiens
uguuguauugauca

SEQ ID NO: 1825243 - RNA, 12 nt, Homo sapiens
ucuccugcugau

SEQ ID NO: 1825244 - RNA, 22 nt, Homo sapiens
uuguuuccucuuccaaaguaaa

SEQ ID NO: 1825245 - RNA, 18 nt, Homo sapiens
uuuuacuaaaacacugaa

SEQ ID NO: 1825246 - RNA, 19 nt, Homo sapiens
gcaauaaauccgcuucucc

SEQ ID NO: 1825247 - RNA, 17 nt, Homo sapiens
gugaugcugacaccagc

SEQ ID NO: 1825248 - RNA, 16 nt, Homo sapiens
ucacaggagucuuugu

SEQ ID NO: 1825249 - RNA, 18 nt, Homo sapiens
aaauauuuuugcuguaga

SEQ ID NO: 1825250 - RNA, 21 nt, Homo sapiens
ucccaaauccgccaguguuuc

SEQ ID NO: 1825251 - RNA, 23 nt, Homo sapiens
uuugaaauugagcuggaccucac

SEQ ID NO: 1825252 - RNA, 22 nt, Homo sapiens
ggaauauuugcaagacauagaa

SEQ ID NO: 1825253 - RNA, 14 nt, Homo sapiens
uaggaaaaaaacug

SEQ ID NO: 1825254 - RNA, 12 nt, Homo sapiens
cuccuugcacuu

SEQ ID NO: 1825255 - RNA, 17 nt, Homo sapiens
aggagggagaaaggaga

SEQ ID NO: 1825256 - RNA, 20 nt, Homo sapiens
cugugcccacggucugagcu

SEQ ID NO: 1825257 - RNA, 19 nt, Homo sapiens
ucaagagacaguauugcua

SEQ ID NO: 1825258 - RNA, 18 nt, Homo sapiens
agcccccacuucucucca

SEQ ID NO: 1825259 - RNA, 14 nt, Homo sapiens
acucuuacauguau

SEQ ID NO: 1825260 - RNA, 21 nt, Homo sapiens
uuugucccccgggcccaccac

SEQ ID NO: 1825261 - RNA, 15 nt, Homo sapiens
uguagcaucuaauga

SEQ ID NO: 1825262 - RNA, 12 nt, Homo sapiens
aagguuuccuca

SEQ ID NO: 1825263 - RNA, 12 nt, Homo sapiens
aagaaaaaccac

SEQ ID NO: 1825264 - RNA, 22 nt, Homo sapiens
cagauuagguuugucccaguca

SEQ ID NO: 1825265 - RNA, 15 nt, Homo sapiens
uaugaaaacacucaa

SEQ ID NO: 1825266 - RNA, 17 nt, Homo sapiens
caucccauuuucauccu

SEQ ID NO: 1825267 - RNA, 18 nt, Homo sapiens
ggccuggaagagcugaga

SEQ ID NO: 1825268 - RNA, 14 nt, Homo sapiens
gauuccuuuggaaa

SEQ ID NO: 1825269 - RNA, 18 nt, Homo sapiens
cuuguuuggggcacagua

SEQ ID NO: 1825270 - RNA, 19 nt, Homo sapiens
uuagccugcaaacaacauu

SEQ ID NO: 1825271 - RNA, 13 nt, Homo sapiens
gacuagaucucug

SEQ ID NO: 1825272 - RNA, 20 nt, Homo sapiens
ugcuggugcacaugacauuu

SEQ ID NO: 1825273 - RNA, 22 nt, Homo sapiens
uuugacuacauauagcaagagu

SEQ ID NO: 1825274 - RNA, 12 nt, Homo sapiens
aaacaacauauu

SEQ ID NO: 1825275 - RNA, 15 nt, Homo sapiens
auuaaugaacuguga

SEQ ID NO: 1825276 - RNA, 14 nt, Homo sapiens
aucaauacaaucuu

SEQ ID NO: 1825277 - RNA, 13 nt, Homo sapiens
acccagaucucau

SEQ ID NO: 1825278 - RNA, 14 nt, Homo sapiens
uagauucauuuuac

SEQ ID NO: 1825279 - RNA, 18 nt, Homo sapiens
cugauguuuaaaagucca

SEQ ID NO: 1825280 - RNA, 21 nt, Homo sapiens
acugccuucgcuucuugccuc

SEQ ID NO: 1825281 - RNA, 17 nt, Homo sapiens
acuuguaguccauuuaa

SEQ ID NO: 1825282 - RNA, 21 nt, Homo sapiens
acugguaaagccucauuugaa

SEQ ID NO: 1825283 - RNA, 22 nt, Homo sapiens
uguauaaaauguaacacugaug

SEQ ID NO: 1825284 - RNA, 17 nt, Homo sapiens
cuuaauucuguuacaca

SEQ ID NO: 1825285 - RNA, 15 nt, Homo sapiens
cagguuaaugcugaa

SEQ ID NO: 1825286 - RNA, 21 nt, Homo sapiens
aguugguuaccuauugcugua

SEQ ID NO: 1825287 - RNA, 14 nt, Homo sapiens
aggcuuugccauug

SEQ ID NO: 1825288 - RNA, 19 nt, Homo sapiens
ccugagaaacccaccagcc

SEQ ID NO: 1825289 - RNA, 15 nt, Homo sapiens
uucuaauuaaccuua

SEQ ID NO: 1825290 - RNA, 14 nt, Homo sapiens
ugccgcaugacaac

SEQ ID NO: 1825291 - RNA, 16 nt, Homo sapiens
cgggauggguggacca

SEQ ID NO: 1825292 - RNA, 23 nt, Homo sapiens
acuacucagccuagcacaggcug

SEQ ID NO: 1825293 - RNA, 12 nt, Homo sapiens
uaugagggaaaa

SEQ ID NO: 1825294 - RNA, 14 nt, Homo sapiens
uggugccaaacaaa

SEQ ID NO: 1825295 - RNA, 15 nt, Homo sapiens
uaugggagcugucaa

SEQ ID NO: 1825296 - RNA, 15 nt, Homo sapiens
gacuucaagaugccu

SEQ ID NO: 1825297 - RNA, 22 nt, Homo sapiens
acauggcuguuaacccacugca

SEQ ID NO: 1825298 - RNA, 13 nt, Homo sapiens
ccagacauggugg

SEQ ID NO: 1825299 - RNA, 20 nt, Homo sapiens
gugugacagucuugcauucu

SEQ ID NO: 1825300 - RNA, 13 nt, Homo sapiens
uuagcuaccucac

SEQ ID NO: 1825301 - RNA, 22 nt, Homo sapiens
aaggguuuaugcuuacgucucu

SEQ ID NO: 1825302 - RNA, 19 nt, Homo sapiens
cuaccuuacagugagggcu

SEQ ID NO: 1825303 - RNA, 22 nt, Homo sapiens
acagaggaauuuauaccucaaa

SEQ ID NO: 1825304 - RNA, 23 nt, Homo sapiens
uugugcaggguguguacugcaca

SEQ ID NO: 1825305 - RNA, 21 nt, Homo sapiens
uacacuuuugagacuuuuugg

SEQ ID NO: 1825306 - RNA, 15 nt, Homo sapiens
ucuguugaaucacag

SEQ ID NO: 1825307 - RNA, 16 nt, Homo sapiens
agcuccaaaccuucac

SEQ ID NO: 1825308 - RNA, 18 nt, Homo sapiens
acuagaugccaaugacau

SEQ ID NO: 1825309 - RNA, 20 nt, Homo sapiens
auaaaaucucgguguucuau

SEQ ID NO: 1825310 - RNA, 12 nt, Homo sapiens
cuacauguucuu

SEQ ID NO: 1825311 - RNA, 21 nt, Homo sapiens
uugcuuuugaaggaauacaau

SEQ ID NO: 1825312 - RNA, 17 nt, Homo sapiens
agaaaaacuaugugaug

SEQ ID NO: 1825313 - RNA, 13 nt, Homo sapiens
ucuugcagaucaa

SEQ ID NO: 1825314 - RNA, 16 nt, Homo sapiens
ccuuguuacccaugaa

SEQ ID NO: 1825315 - RNA, 18 nt, Homo sapiens
agcaguuagcucauuuga

SEQ ID NO: 1825316 - RNA, 21 nt, Homo sapiens
ccugaaagagaagauggccau

SEQ ID NO: 1825317 - RNA, 22 nt, Homo sapiens
cagacccacugaaaugaccaag

SEQ ID NO: 1825318 - RNA, 21 nt, Homo sapiens
ugauuugcugggcaguuuuuc

SEQ ID NO: 1825319 - RNA, 16 nt, Homo sapiens
agucugccgauuuugu

SEQ ID NO: 1825320 - RNA, 19 nt, Homo sapiens
aguagaaacgggguuucac

SEQ ID NO: 1825321 - RNA, 19 nt, Homo sapiens
uuaagcugggauaaucaca

SEQ ID NO: 1825322 - RNA, 16 nt, Homo sapiens
ccccaccuccugugga

SEQ ID NO: 1825323 - RNA, 12 nt, Homo sapiens
ugguuacaagaa

SEQ ID NO: 1825324 - RNA, 18 nt, Homo sapiens
caccuccuucaauuccau

SEQ ID NO: 1825325 - RNA, 15 nt, Homo sapiens
uagagcuguucaaca

SEQ ID NO: 1825326 - RNA, 21 nt, Homo sapiens
aggacuacaaccaauuuacac

SEQ ID NO: 1825327 - RNA, 15 nt, Homo sapiens
gaacauucgaggugu

SEQ ID NO: 1825328 - RNA, 16 nt, Homo sapiens
agagagcuguauuaag

SEQ ID NO: 1825329 - RNA, 14 nt, Homo sapiens
cuuccccaguguca

SEQ ID NO: 1825330 - RNA, 18 nt, Homo sapiens
acccacuuaggcuuugua

SEQ ID NO: 1825331 - RNA, 14 nt, Homo sapiens
cauaaucuguacaa

SEQ ID NO: 1825332 - RNA, 21 nt, Homo sapiens
aucacgucacugcacuccagc

SEQ ID NO: 1825333 - RNA, 23 nt, Homo sapiens
ugaaaaggcagcauuugaauacu

SEQ ID NO: 1825334 - RNA, 20 nt, Homo sapiens
gaugcuuggcuggagucacc

SEQ ID NO: 1825335 - RNA, 14 nt, Homo sapiens
gagaaauggccaaa

SEQ ID NO: 1825336 - RNA, 14 nt, Homo sapiens
cugggcuggacugg

SEQ ID NO: 1825337 - RNA, 11 nt, Homo sapiens
cuaaaugucaa

SEQ ID NO: 1825338 - RNA, 11 nt, Homo sapiens
gugaaugugag

SEQ ID NO: 1825339 - RNA, 21 nt, Homo sapiens
gaauguuuugcuagagcuaac

SEQ ID NO: 1825340 - RNA, 15 nt, Homo sapiens
cgugcagaaccagca

SEQ ID NO: 1825341 - RNA, 17 nt, Homo sapiens
caaauacacauuugcua

SEQ ID NO: 1825342 - RNA, 23 nt, Homo sapiens
uugcuacccauuuacaaauaaga

SEQ ID NO: 1825343 - RNA, 24 nt, Homo sapiens
aauccaguauuauccacaauuauu

SEQ ID NO: 1825344 - RNA, 23 nt, Homo sapiens
guucccacaccccaacacuucca

SEQ ID NO: 1825345 - RNA, 15 nt, Homo sapiens
aggugugacauguua

SEQ ID NO: 1825346 - RNA, 15 nt, Homo sapiens
agagggcccaucagg

SEQ ID NO: 1825347 - RNA, 18 nt, Homo sapiens
cuucuuugcaguucccau

SEQ ID NO: 1825348 - RNA, 17 nt, Homo sapiens
uuaauucucaugugauc

SEQ ID NO: 1825349 - RNA, 17 nt, Homo sapiens
uuugagaagaaaaucag

SEQ ID NO: 1825350 - RNA, 19 nt, Homo sapiens
cguuucugcccagcccucu

SEQ ID NO: 1825351 - RNA, 15 nt, Homo sapiens
augacauuacuguau

SEQ ID NO: 1825352 - RNA, 14 nt, Homo sapiens
cugcaaguggccau

SEQ ID NO: 1825353 - RNA, 18 nt, Homo sapiens
acaugcuaccugauccca

SEQ ID NO: 1825354 - RNA, 20 nt, Homo sapiens
agggauuuaaagggacaccc

SEQ ID NO: 1825355 - RNA, 12 nt, Homo sapiens
ucccccacugau

SEQ ID NO: 1825356 - RNA, 11 nt, Homo sapiens
uguuccagagc

SEQ ID NO: 1825357 - RNA, 22 nt, Homo sapiens
ucuccggaggagacacaguuac

SEQ ID NO: 1825358 - RNA, 15 nt, Homo sapiens
aacagacaacagaag

SEQ ID NO: 1825359 - RNA, 22 nt, Homo sapiens
ccuaaaucugccuuuucaucua

SEQ ID NO: 1825360 - RNA, 13 nt, Homo sapiens
acaaccaugccag

SEQ ID NO: 1825361 - RNA, 14 nt, Homo sapiens
uaaugcacaucugc

SEQ ID NO: 1825362 - RNA, 21 nt, Homo sapiens
agaucuaauauugacugccuc

SEQ ID NO: 1825363 - RNA, 19 nt, Homo sapiens
gugcacacguguguaugag

SEQ ID NO: 1825364 - RNA, 14 nt, Homo sapiens
ggcuugcagugcgc

SEQ ID NO: 1825365 - RNA, 20 nt, Homo sapiens
cucacucccucccuuucuau

SEQ ID NO: 1825366 - RNA, 16 nt, Homo sapiens
gauauaccuagauucc

SEQ ID NO: 1825367 - RNA, 13 nt, Homo sapiens
aauucacuccacu

SEQ ID NO: 1825368 - RNA, 14 nt, Homo sapiens
gcuuucaacacaca

SEQ ID NO: 1825369 - RNA, 23 nt, Homo sapiens
auggagcuguauaacugugcaga

SEQ ID NO: 1825370 - RNA, 12 nt, Homo sapiens
ucccacaggugg

SEQ ID NO: 1825371 - RNA, 16 nt, Homo sapiens
agaggagagaggcuca

SEQ ID NO: 1825372 - RNA, 12 nt, Homo sapiens
guuaacaguaaa

SEQ ID NO: 1825373 - RNA, 12 nt, Homo sapiens
aaauguagcaau

SEQ ID NO: 1825374 - RNA, 15 nt, Homo sapiens
aauuaaaugcauguc

SEQ ID NO: 1825375 - RNA, 19 nt, Homo sapiens
cuaaagugcugcacucaaa

SEQ ID NO: 1825376 - RNA, 20 nt, Homo sapiens
cucuccuccccccaagcuca

SEQ ID NO: 1825377 - RNA, 15 nt, Homo sapiens
cuuugagcugagugc

SEQ ID NO: 1825378 - RNA, 14 nt, Homo sapiens
uaguguacuuggag

SEQ ID NO: 1825379 - RNA, 15 nt, Homo sapiens
cucgacucacugcaa

SEQ ID NO: 1825380 - RNA, 16 nt, Homo sapiens
cagccaacgagacaca

SEQ ID NO: 1825381 - RNA, 11 nt, Homo sapiens
guucauuccac

SEQ ID NO: 1825382 - RNA, 16 nt, Homo sapiens
aguaacccaaaccuca

SEQ ID NO: 1825383 - RNA, 22 nt, Homo sapiens
ccacauauuucaaaaacaugcu

SEQ ID NO: 1825384 - RNA, 13 nt, Homo sapiens
ggcuuuugaacug

SEQ ID NO: 1825385 - RNA, 22 nt, Homo sapiens
gcaaagggccugcccagacaag

SEQ ID NO: 1825386 - RNA, 19 nt, Homo sapiens
uccucuagcccacucccug

SEQ ID NO: 1825387 - RNA, 22 nt, Homo sapiens
gucugagcuucaguauaaaaga

SEQ ID NO: 1825388 - RNA, 20 nt, Homo sapiens
uggaggaggcuuugggacca

SEQ ID NO: 1825389 - RNA, 15 nt, Homo sapiens
uacaaguagcuaauu

SEQ ID NO: 1825390 - RNA, 22 nt, Homo sapiens
ugcauucaaaguaauauaucaa

SEQ ID NO: 1825391 - RNA, 19 nt, Homo sapiens
agcugaaggugaggggaug

SEQ ID NO: 1825392 - RNA, 22 nt, Homo sapiens
gaagcugguccuguccagacac

SEQ ID NO: 1825393 - RNA, 19 nt, Homo sapiens
gcuccuccagggagucuca

SEQ ID NO: 1825394 - RNA, 22 nt, Homo sapiens
acuuauuggaacucugcuugau

SEQ ID NO: 1825395 - RNA, 19 nt, Homo sapiens
cggacugaggugccugcuc

SEQ ID NO: 1825396 - RNA, 17 nt, Homo sapiens
caugaagggaugcugca

SEQ ID NO: 1825397 - RNA, 22 nt, Homo sapiens
caaggacuaauccaauaccucu

SEQ ID NO: 1825398 - RNA, 18 nt, Homo sapiens
ugccaucguuuccaugac

SEQ ID NO: 1825399 - RNA, 20 nt, Homo sapiens
gaaacauccauauugcacaa

SEQ ID NO: 1825400 - RNA, 13 nt, Homo sapiens
uggaaggagcaca

SEQ ID NO: 1825401 - RNA, 23 nt, Homo sapiens
agaucuucucuguuauuccugau

SEQ ID NO: 1825402 - RNA, 19 nt, Homo sapiens
uucuugaguugucuuuugc

SEQ ID NO: 1825403 - RNA, 16 nt, Homo sapiens
uauggacagcuuuauu

SEQ ID NO: 1825404 - RNA, 12 nt, Homo sapiens
uccucauguugc

SEQ ID NO: 1825405 - RNA, 22 nt, Homo sapiens
gagugcugaaauaaaaugauaa

SEQ ID NO: 1825406 - RNA, 17 nt, Homo sapiens
gaauaaaauugccucuc

SEQ ID NO: 1825407 - RNA, 15 nt, Homo sapiens
accauggugggcuug

SEQ ID NO: 1825408 - RNA, 15 nt, Homo sapiens
ugaaccgucugugga

SEQ ID NO: 1825409 - RNA, 22 nt, Homo sapiens
uguuaguuucugaguuuuacca

SEQ ID NO: 1825410 - RNA, 23 nt, Homo sapiens
cauauuuccuauuguucacuuua

SEQ ID NO: 1825411 - RNA, 18 nt, Homo sapiens
ucguaugaucaguacuga

SEQ ID NO: 1825412 - RNA, 16 nt, Homo sapiens
ucucugaagcgacucu

SEQ ID NO: 1825413 - RNA, 12 nt, Homo sapiens
gcacugcucaau

SEQ ID NO: 1825414 - RNA, 15 nt, Homo sapiens
gccccaaauuccugu

SEQ ID NO: 1825415 - RNA, 21 nt, Homo sapiens
gucacgagcguucaaacugcu

SEQ ID NO: 1825416 - RNA, 19 nt, Homo sapiens
auguguugcuuuggauaca

SEQ ID NO: 1825417 - RNA, 17 nt, Homo sapiens
ugggcauagccauggaa

SEQ ID NO: 1825418 - RNA, 22 nt, Homo sapiens
ggaguaaucaggcagccuucau

SEQ ID NO: 1825419 - RNA, 22 nt, Homo sapiens
uccugagaccagccaaccuggg

SEQ ID NO: 1825420 - RNA, 23 nt, Homo sapiens
cuggaauguaaguaagugacaau

SEQ ID NO: 1825421 - RNA, 14 nt, Homo sapiens
ucccggacugcaag

SEQ ID NO: 1825422 - RNA, 20 nt, Homo sapiens
cuccuagaggugggcagcug

SEQ ID NO: 1825423 - RNA, 18 nt, Homo sapiens
ccauauccgggugcucaa

SEQ ID NO: 1825424 - RNA, 20 nt, Homo sapiens
ugagaaggggcagauguucc

SEQ ID NO: 1825425 - RNA, 15 nt, Homo sapiens
uuuuugccagacucu

SEQ ID NO: 1825426 - RNA, 15 nt, Homo sapiens
gagccugcagggaag

SEQ ID NO: 1825427 - RNA, 22 nt, Homo sapiens
auccuacaagacacagugacca

SEQ ID NO: 1825428 - RNA, 19 nt, Homo sapiens
auuuauuguuuaagcagaa

SEQ ID NO: 1825429 - RNA, 18 nt, Homo sapiens
uugaaauuccaguugcaa

SEQ ID NO: 1825430 - RNA, 21 nt, Homo sapiens
ggucccauuucucacugagaa

SEQ ID NO: 1825431 - RNA, 14 nt, Homo sapiens
caaaaacauggccu

SEQ ID NO: 1825432 - RNA, 22 nt, Homo sapiens
caggcugugacucuucucucaa

SEQ ID NO: 1825433 - RNA, 20 nt, Homo sapiens
aauuuccggccaacaguuaa

SEQ ID NO: 1825434 - RNA, 17 nt, Homo sapiens
aguguggcgggaagggu

SEQ ID NO: 1825435 - RNA, 23 nt, Homo sapiens
cacaucaugagcugagugacugc

SEQ ID NO: 1825436 - RNA, 21 nt, Homo sapiens
uggggcccgcugcgugccauc

SEQ ID NO: 1825437 - RNA, 17 nt, Homo sapiens
aguguuuuuauugcucg

SEQ ID NO: 1825438 - RNA, 21 nt, Homo sapiens
accugugcacguuggaacuuu

SEQ ID NO: 1825439 - RNA, 17 nt, Homo sapiens
aaccaaauuacaaguau

SEQ ID NO: 1825440 - RNA, 15 nt, Homo sapiens
ucaauaaaguuugau

SEQ ID NO: 1825441 - RNA, 19 nt, Homo sapiens
acccaccccccguggcacu

SEQ ID NO: 1825442 - RNA, 19 nt, Homo sapiens
guucagagccaagccuuaa

SEQ ID NO: 1825443 - RNA, 16 nt, Homo sapiens
uauuagauuacuaagu

SEQ ID NO: 1825444 - RNA, 13 nt, Homo sapiens
uuuaugccuuuau

SEQ ID NO: 1825445 - RNA, 17 nt, Homo sapiens
acuccccuaaacuccag

SEQ ID NO: 1825446 - RNA, 17 nt, Homo sapiens
aaaacuaugcuauuaaa

SEQ ID NO: 1825447 - RNA, 11 nt, Homo sapiens
uugaacaaagu

SEQ ID NO: 1825448 - RNA, 19 nt, Homo sapiens
acuuguguuauauagccaa

SEQ ID NO: 1825449 - RNA, 21 nt, Homo sapiens
agagcagggccaaagcacagc

SEQ ID NO: 1825450 - RNA, 17 nt, Homo sapiens
uagcuagccagcugugu

SEQ ID NO: 1825451 - RNA, 17 nt, Homo sapiens
aaacuaaagcaauagaa

SEQ ID NO: 1825452 - RNA, 22 nt, Homo sapiens
cacaugucuuguacauguguag

SEQ ID NO: 1825453 - RNA, 13 nt, Homo sapiens
ucccucuacugug

SEQ ID NO: 1825454 - RNA, 17 nt, Homo sapiens
cagccuguuuucacuca

SEQ ID NO: 1825455 - RNA, 17 nt, Homo sapiens
gaaaauccauggauauc

SEQ ID NO: 1825456 - RNA, 23 nt, Homo sapiens
gcccagcaagaugaaacagggca

SEQ ID NO: 1825457 - RNA, 17 nt, Homo sapiens
uggcuguauguugcaug

SEQ ID NO: 1825458 - RNA, 16 nt, Homo sapiens
uagguugacagauacu

SEQ ID NO: 1825459 - RNA, 16 nt, Homo sapiens
ucugcaguccuacuca

SEQ ID NO: 1825460 - RNA, 15 nt, Homo sapiens
ccauaaucucauuca

SEQ ID NO: 1825461 - RNA, 21 nt, Homo sapiens
ccucugucucugcucuugccu

SEQ ID NO: 1825462 - RNA, 17 nt, Homo sapiens
acucgcacaaccaugac

SEQ ID NO: 1825463 - RNA, 12 nt, Homo sapiens
cagcuuaucucu

SEQ ID NO: 1825464 - RNA, 12 nt, Homo sapiens
aaggaagcucca

SEQ ID NO: 1825465 - RNA, 15 nt, Homo sapiens
gauauuaaaauaagc

SEQ ID NO: 1825466 - RNA, 17 nt, Homo sapiens
acuccaguccaagucuc

SEQ ID NO: 1825467 - RNA, 14 nt, Homo sapiens
ucacucaccaucug

SEQ ID NO: 1825468 - RNA, 19 nt, Homo sapiens
cacugagugccuacucuuu

SEQ ID NO: 1825469 - RNA, 16 nt, Homo sapiens
gaagccggucaucacc

SEQ ID NO: 1825470 - RNA, 17 nt, Homo sapiens
ggcgaaucacgagguca

SEQ ID NO: 1825471 - RNA, 14 nt, Homo sapiens
gccacccuagccaa

SEQ ID NO: 1825472 - RNA, 12 nt, Homo sapiens
aucucuugucau

SEQ ID NO: 1825473 - RNA, 16 nt, Homo sapiens
auguauuuuucacaaa

SEQ ID NO: 1825474 - RNA, 19 nt, Homo sapiens
ggcuggccagccaccacug

SEQ ID NO: 1825475 - RNA, 21 nt, Homo sapiens
gaagcugaggcugcugccagg

SEQ ID NO: 1825476 - RNA, 19 nt, Homo sapiens
gaauaugcauugucugcaa

SEQ ID NO: 1825477 - RNA, 18 nt, Homo sapiens
acaccuccuccugcugcu

SEQ ID NO: 1825478 - RNA, 21 nt, Homo sapiens
ugcacacacacacacaugcac

SEQ ID NO: 1825479 - RNA, 16 nt, Homo sapiens
agucuccccuauguaa

SEQ ID NO: 1825480 - RNA, 22 nt, Homo sapiens
gguguagcuguccucucagaac

SEQ ID NO: 1825481 - RNA, 14 nt, Homo sapiens
ucuaaauacugaga

SEQ ID NO: 1825482 - RNA, 16 nt, Homo sapiens
agguauuggggaacag

SEQ ID NO: 1825483 - RNA, 18 nt, Homo sapiens
cuccugccagcucaggau

SEQ ID NO: 1825484 - RNA, 12 nt, Homo sapiens
caagcucugcag

SEQ ID NO: 1825485 - RNA, 15 nt, Homo sapiens
uacauuuugugcagu

SEQ ID NO: 1825486 - RNA, 23 nt, Homo sapiens
ccugaugcagugcuccauccaaa

SEQ ID NO: 1825487 - RNA, 22 nt, Homo sapiens
accuccuuucaagguaacugua

SEQ ID NO: 1825488 - RNA, 18 nt, Homo sapiens
ugaccaauacuacuguaa

SEQ ID NO: 1825489 - RNA, 23 nt, Homo sapiens
aaccauguauaugagcuuauaaa

SEQ ID NO: 1825490 - RNA, 13 nt, Homo sapiens
ugcuugugcacug

SEQ ID NO: 1825491 - RNA, 16 nt, Homo sapiens
cauauauacacacaca

SEQ ID NO: 1825492 - RNA, 19 nt, Homo sapiens
ugaucaaaaccugugccag

SEQ ID NO: 1825493 - RNA, 14 nt, Homo sapiens
cacuggcuccauga

SEQ ID NO: 1825494 - RNA, 20 nt, Homo sapiens
aauucacuuuauuguagaaa

SEQ ID NO: 1825495 - RNA, 22 nt, Homo sapiens
gggcggggcguguagccagcca

SEQ ID NO: 1825496 - RNA, 16 nt, Homo sapiens
ucgccugcccuccucu

SEQ ID NO: 1825497 - RNA, 22 nt, Homo sapiens
cccaugauuuggggugauuucu

SEQ ID NO: 1825498 - RNA, 14 nt, Homo sapiens
uaucuaguaugaaa

SEQ ID NO: 1825499 - RNA, 20 nt, Homo sapiens
accccgagccuggcuccaaa

SEQ ID NO: 1825500 - RNA, 21 nt, Homo sapiens
cauaauaaccaaacauaacau

SEQ ID NO: 1825501 - RNA, 18 nt, Homo sapiens
agcaucacuuaaaacacg

SEQ ID NO: 1825502 - RNA, 21 nt, Homo sapiens
aagaaucagaaacaggugcau

SEQ ID NO: 1825503 - RNA, 20 nt, Homo sapiens
uuccacucaaaauaugucaa

SEQ ID NO: 1825504 - RNA, 12 nt, Homo sapiens
aacaaagcaccu

SEQ ID NO: 1825505 - RNA, 12 nt, Homo sapiens
accuaagcaaca

SEQ ID NO: 1825506 - RNA, 18 nt, Homo sapiens
auggcaguuugaagucaa

SEQ ID NO: 1825507 - RNA, 19 nt, Homo sapiens
ugaagcaaauacaauucac

SEQ ID NO: 1825508 - RNA, 16 nt, Homo sapiens
aaauugcagauaccau

SEQ ID NO: 1825509 - RNA, 21 nt, Homo sapiens
ccaccucugaggacucuggac

SEQ ID NO: 1825510 - RNA, 13 nt, Homo sapiens
ccacauugcacuu

SEQ ID NO: 1825511 - RNA, 20 nt, Homo sapiens
aucauugugaaauuauucau

SEQ ID NO: 1825512 - RNA, 15 nt, Homo sapiens
gaacucacgagccuu

SEQ ID NO: 1825513 - RNA, 20 nt, Homo sapiens
gguuaucacuuuucuguaac

SEQ ID NO: 1825514 - RNA, 20 nt, Homo sapiens
cccugcaaacagaacagggu

SEQ ID NO: 1825515 - RNA, 15 nt, Homo sapiens
uccuuucuugcagau

SEQ ID NO: 1825516 - RNA, 20 nt, Homo sapiens
cucuuccuggucugaacucc

SEQ ID NO: 1825517 - RNA, 16 nt, Homo sapiens
ugcuucuuaugguggu

SEQ ID NO: 1825518 - RNA, 17 nt, Homo sapiens
guggcccagcuccucac

SEQ ID NO: 1825519 - RNA, 17 nt, Homo sapiens
caacaauucucccggga

SEQ ID NO: 1825520 - RNA, 16 nt, Homo sapiens
gccuaugcacauaugg

SEQ ID NO: 1825521 - RNA, 18 nt, Homo sapiens
cggacggaaaaggggugg

SEQ ID NO: 1825522 - RNA, 17 nt, Homo sapiens
agauaauucuagcuuug

SEQ ID NO: 1825523 - RNA, 22 nt, Homo sapiens
auacauuguacuuauacaccuu

SEQ ID NO: 1825524 - RNA, 22 nt, Homo sapiens
uuaugaaaaacagaagcacaaa

SEQ ID NO: 1825525 - RNA, 18 nt, Homo sapiens
gggcuucacugcugugac

SEQ ID NO: 1825526 - RNA, 18 nt, Homo sapiens
ugcauuagaaaccaugaa

SEQ ID NO: 1825527 - RNA, 16 nt, Homo sapiens
agccagcuggucuuca

SEQ ID NO: 1825528 - RNA, 22 nt, Homo sapiens
ccuuuugaaacucugcaugguc

SEQ ID NO: 1825529 - RNA, 14 nt, Homo sapiens
cacauggacaugug

SEQ ID NO: 1825530 - RNA, 15 nt, Homo sapiens
cagugaccacaccaa

SEQ ID NO: 1825531 - RNA, 21 nt, Homo sapiens
uuccagagucaucuaccugag

SEQ ID NO: 1825532 - RNA, 23 nt, Homo sapiens
aggugagccugggcagcuucugu

SEQ ID NO: 1825533 - RNA, 14 nt, Homo sapiens
cauagauuucauag

SEQ ID NO: 1825534 - RNA, 15 nt, Homo sapiens
cagacuccugugcaa

SEQ ID NO: 1825535 - RNA, 12 nt, Homo sapiens
aucugaggaauu

SEQ ID NO: 1825536 - RNA, 16 nt, Homo sapiens
ugagaaucacugcucc

SEQ ID NO: 1825537 - RNA, 11 nt, Homo sapiens
agccagaguuc

SEQ ID NO: 1825538 - RNA, 16 nt, Homo sapiens
aagcaugaaacauuuc

SEQ ID NO: 1825539 - RNA, 17 nt, Homo sapiens
ucugcuuuucccauugc

SEQ ID NO: 1825540 - RNA, 15 nt, Homo sapiens
agccucacuccucag

SEQ ID NO: 1825541 - RNA, 20 nt, Homo sapiens
cugaauuaaagucuacacug

SEQ ID NO: 1825542 - RNA, 18 nt, Homo sapiens
acauucguucucuaacca

SEQ ID NO: 1825543 - RNA, 14 nt, Homo sapiens
accacugaagggaa

SEQ ID NO: 1825544 - RNA, 19 nt, Homo sapiens
uuccuguucccuuggaaua

SEQ ID NO: 1825545 - RNA, 12 nt, Homo sapiens
ugaucaugucag

SEQ ID NO: 1825546 - RNA, 18 nt, Homo sapiens
uuccucaccaagcucaac

SEQ ID NO: 1825547 - RNA, 15 nt, Homo sapiens
gcauaucugccuccc

SEQ ID NO: 1825548 - RNA, 16 nt, Homo sapiens
aagugugggagaccga

SEQ ID NO: 1825549 - RNA, 21 nt, Homo sapiens
uugaagauugccucuucuaca

SEQ ID NO: 1825550 - RNA, 23 nt, Homo sapiens
cucuuugugauaauucucaguag

SEQ ID NO: 1825551 - RNA, 11 nt, Homo sapiens
aaaugcaacuu

SEQ ID NO: 1825552 - RNA, 23 nt, Homo sapiens
uaaaaugaauaauuuauuauuaa

SEQ ID NO: 1825553 - RNA, 15 nt, Homo sapiens
gaacaguuguccagg

SEQ ID NO: 1825554 - RNA, 17 nt, Homo sapiens
agucguucccagugugg

SEQ ID NO: 1825555 - RNA, 22 nt, Homo sapiens
aaaauuuuaacacuaaccaaac

SEQ ID NO: 1825556 - RNA, 13 nt, Homo sapiens
ggaaacuugucac

SEQ ID NO: 1825557 - RNA, 21 nt, Homo sapiens
cugugaaaaauaaagucauca

SEQ ID NO: 1825558 - RNA, 15 nt, Homo sapiens
auggugaaggaaaca

SEQ ID NO: 1825559 - RNA, 20 nt, Homo sapiens
gugacugcgcacugaguaca

SEQ ID NO: 1825560 - RNA, 17 nt, Homo sapiens
uuugcuuuacagcacug

SEQ ID NO: 1825561 - RNA, 14 nt, Homo sapiens
caauaaacuuguag

SEQ ID NO: 1825562 - RNA, 15 nt, Homo sapiens
aggcccaugccaagg

SEQ ID NO: 1825563 - RNA, 11 nt, Homo sapiens
caauuaacugc

SEQ ID NO: 1825564 - RNA, 20 nt, Homo sapiens
aaaccagcaucugcaccuaa

SEQ ID NO: 1825565 - RNA, 20 nt, Homo sapiens
aaaguuacuagguaacuuca

SEQ ID NO: 1825566 - RNA, 19 nt, Homo sapiens
uugcauucagaacauaaau

SEQ ID NO: 1825567 - RNA, 16 nt, Homo sapiens
uccccaccaccaauug

SEQ ID NO: 1825568 - RNA, 11 nt, Homo sapiens
cagacaccagu

SEQ ID NO: 1825569 - RNA, 22 nt, Homo sapiens
uucucuccaacucccucuggga

SEQ ID NO: 1825570 - RNA, 17 nt, Homo sapiens
ccaucaucucugccuuu

SEQ ID NO: 1825571 - RNA, 21 nt, Homo sapiens
caauuaccugccaaaugcuau

SEQ ID NO: 1825572 - RNA, 23 nt, Homo sapiens
aucucagccagccuccagcaccu

SEQ ID NO: 1825573 - RNA, 22 nt, Homo sapiens
agugggccccgggcuggagaaa

SEQ ID NO: 1825574 - RNA, 13 nt, Homo sapiens
auccaaacaauuu

SEQ ID NO: 1825575 - RNA, 13 nt, Homo sapiens
aacuuaacauuca

SEQ ID NO: 1825576 - RNA, 14 nt, Homo sapiens
auucaaacauauuc

SEQ ID NO: 1825577 - RNA, 17 nt, Homo sapiens
uaaauugcacgugcaau

SEQ ID NO: 1825578 - RNA, 19 nt, Homo sapiens
uauggaagaaaugggagaa

SEQ ID NO: 1825579 - RNA, 23 nt, Homo sapiens
ugagcaaguaacacuaacuuuga

SEQ ID NO: 1825580 - RNA, 14 nt, Homo sapiens
aacgucaucucagg

SEQ ID NO: 1825581 - RNA, 14 nt, Homo sapiens
cuaaagugcucuau

SEQ ID NO: 1825582 - RNA, 16 nt, Homo sapiens
gucuagaggcagguag

SEQ ID NO: 1825583 - RNA, 19 nt, Homo sapiens
aaagccaauaaaugaacug

SEQ ID NO: 1825584 - RNA, 19 nt, Homo sapiens
ugccaauuuucuuugaaaa

SEQ ID NO: 1825585 - RNA, 23 nt, Homo sapiens
aauuguguugucuucagcaguca

SEQ ID NO: 1825586 - RNA, 15 nt, Homo sapiens
uauagcauguaauau

SEQ ID NO: 1825587 - RNA, 20 nt, Homo sapiens
gagaugagccccacguggag

SEQ ID NO: 1825588 - RNA, 15 nt, Homo sapiens
ucugcccaugggaag

SEQ ID NO: 1825589 - RNA, 17 nt, Homo sapiens
uauguuuggcugcuaga

SEQ ID NO: 1825590 - RNA, 22 nt, Homo sapiens
aggagcaggcccugggccucca

SEQ ID NO: 1825591 - RNA, 13 nt, Homo sapiens
gagaaaagccaga

SEQ ID NO: 1825592 - RNA, 13 nt, Homo sapiens
gaaaguacuuugg

SEQ ID NO: 1825593 - RNA, 20 nt, Homo sapiens
aaccuaccucgccgagcugu

SEQ ID NO: 1825594 - RNA, 21 nt, Homo sapiens
uuagcuugguaugagacagau

SEQ ID NO: 1825595 - RNA, 18 nt, Homo sapiens
acugucacuguuucucug

SEQ ID NO: 1825596 - RNA, 16 nt, Homo sapiens
cccucaacugaagggg

SEQ ID NO: 1825597 - RNA, 20 nt, Homo sapiens
gucuguguuuaaagugaauu

SEQ ID NO: 1825598 - RNA, 19 nt, Homo sapiens
gugaacauguguguguguu

SEQ ID NO: 1825599 - RNA, 17 nt, Homo sapiens
cgggcaccaggggccaa

SEQ ID NO: 1825600 - RNA, 21 nt, Homo sapiens
ggaaauaucagccuugggcaa

SEQ ID NO: 1825601 - RNA, 14 nt, Homo sapiens
uaaauagaugacaa

SEQ ID NO: 1825602 - RNA, 12 nt, Homo sapiens
uacuugucauau

SEQ ID NO: 1825603 - RNA, 20 nt, Homo sapiens
auugaguuauuaacuguauu

SEQ ID NO: 1825604 - RNA, 14 nt, Homo sapiens
caucaacauuccug

SEQ ID NO: 1825605 - RNA, 19 nt, Homo sapiens
gucuggaaggucacgcuga

SEQ ID NO: 1825606 - RNA, 19 nt, Homo sapiens
ucuauucuuggaaccacga

SEQ ID NO: 1825607 - RNA, 19 nt, Homo sapiens
guuggacaccaucuucuaa

SEQ ID NO: 1825608 - RNA, 12 nt, Homo sapiens
uucagaguauau

SEQ ID NO: 1825609 - RNA, 15 nt, Homo sapiens
aucuauguguaugca

SEQ ID NO: 1825610 - RNA, 15 nt, Homo sapiens
gaauuucaauaucaa

SEQ ID NO: 1825611 - RNA, 21 nt, Homo sapiens
ccagauuaaaugaauauacug

SEQ ID NO: 1825612 - RNA, 18 nt, Homo sapiens
ccgggcaugguagcucaa

SEQ ID NO: 1825613 - RNA, 16 nt, Homo sapiens
ucagaaaagugacagu

SEQ ID NO: 1825614 - RNA, 22 nt, Homo sapiens
uaaauuuaaagauauuguucaa

SEQ ID NO: 1825615 - RNA, 21 nt, Homo sapiens
ucuuccuggaaugcauucacu

SEQ ID NO: 1825616 - RNA, 18 nt, Homo sapiens
acaaucuacacugccuua

SEQ ID NO: 1825617 - RNA, 13 nt, Homo sapiens
ucuucaacagcuc

SEQ ID NO: 1825618 - RNA, 14 nt, Homo sapiens
acaguaaaauccac

SEQ ID NO: 1825619 - RNA, 14 nt, Homo sapiens
acuacacacuaaaa

SEQ ID NO: 1825620 - RNA, 22 nt, Homo sapiens
caagcucuguccaaucagguag

SEQ ID NO: 1825621 - RNA, 18 nt, Homo sapiens
uggcaguacagagugcag

SEQ ID NO: 1825622 - RNA, 21 nt, Homo sapiens
uccaauugcauuuauuuauca

SEQ ID NO: 1825623 - RNA, 13 nt, Homo sapiens
acugccauugucu

SEQ ID NO: 1825624 - RNA, 13 nt, Homo sapiens
cauguuuuaggga

SEQ ID NO: 1825625 - RNA, 19 nt, Homo sapiens
cugacuacggaacugcaca

SEQ ID NO: 1825626 - RNA, 13 nt, Homo sapiens
accuguccuugca

SEQ ID NO: 1825627 - RNA, 21 nt, Homo sapiens
cagguguugggaccugcugcu

SEQ ID NO: 1825628 - RNA, 12 nt, Homo sapiens
gacacugucacu

SEQ ID NO: 1825629 - RNA, 12 nt, Homo sapiens
gacucugucaca

SEQ ID NO: 1825630 - RNA, 16 nt, Homo sapiens
aauaaauguaucugaa

SEQ ID NO: 1825631 - RNA, 15 nt, Homo sapiens
gacaaagugccucau

SEQ ID NO: 1825632 - RNA, 15 nt, Homo sapiens
cccagcauguacaaa

SEQ ID NO: 1825633 - RNA, 17 nt, Homo sapiens
cagacgccacagucucc

SEQ ID NO: 1825634 - RNA, 21 nt, Homo sapiens
caacuuuuuguuacagauuaa

SEQ ID NO: 1825635 - RNA, 15 nt, Homo sapiens
caaauuccaaauucu

SEQ ID NO: 1825636 - RNA, 15 nt, Homo sapiens
cacacuguuugugua

SEQ ID NO: 1825637 - RNA, 17 nt, Homo sapiens
uaacugaaccauuccaa

SEQ ID NO: 1825638 - RNA, 16 nt, Homo sapiens
gucaaacagugccaaa

SEQ ID NO: 1825639 - RNA, 16 nt, Homo sapiens
ccaaaauguguuucau

SEQ ID NO: 1825640 - RNA, 16 nt, Homo sapiens
caggcagcgccaagug

SEQ ID NO: 1825641 - RNA, 22 nt, Homo sapiens
ccucugccgcugccaugcuuug

SEQ ID NO: 1825642 - RNA, 17 nt, Homo sapiens
ccuuggggucacuccuu

SEQ ID NO: 1825643 - RNA, 14 nt, Homo sapiens
cuucaaaccuaaaa

SEQ ID NO: 1825644 - RNA, 17 nt, Homo sapiens
aggaaguucaacuucca

SEQ ID NO: 1825645 - RNA, 21 nt, Homo sapiens
acucuguccacgauucacuca

SEQ ID NO: 1825646 - RNA, 13 nt, Homo sapiens
aauggacuugcuu

SEQ ID NO: 1825647 - RNA, 17 nt, Homo sapiens
aucugccaagcuccuca

SEQ ID NO: 1825648 - RNA, 15 nt, Homo sapiens
aguagaagugucaca

SEQ ID NO: 1825649 - RNA, 23 nt, Homo sapiens
ccauaugaaaaggcuaagcuuca

SEQ ID NO: 1825650 - RNA, 16 nt, Homo sapiens
ucagaccuuugucuga

SEQ ID NO: 1825651 - RNA, 12 nt, Homo sapiens
uuagaagacauu

SEQ ID NO: 1825652 - RNA, 17 nt, Homo sapiens
uaaauuuugaguucuac

SEQ ID NO: 1825653 - RNA, 20 nt, Homo sapiens
uugcuguuuuucugguuuaa

SEQ ID NO: 1825654 - RNA, 20 nt, Homo sapiens
ucugagccaagacugaggua

SEQ ID NO: 1825655 - RNA, 17 nt, Homo sapiens
cauauggaaugccaaaa

SEQ ID NO: 1825656 - RNA, 14 nt, Homo sapiens
gcucagcacuuugg

SEQ ID NO: 1825657 - RNA, 15 nt, Homo sapiens
gcaaagggagcagaa

SEQ ID NO: 1825658 - RNA, 22 nt, Homo sapiens
cauguggcacguaaggucucau

SEQ ID NO: 1825659 - RNA, 22 nt, Homo sapiens
ccaaagcaucaauacaaccagc

SEQ ID NO: 1825660 - RNA, 17 nt, Homo sapiens
ugacagcaggugggaaa

SEQ ID NO: 1825661 - RNA, 17 nt, Homo sapiens
cagguagggccagcuca

SEQ ID NO: 1825662 - RNA, 20 nt, Homo sapiens
aaaacuaaauggugcuuuau

SEQ ID NO: 1825663 - RNA, 22 nt, Homo sapiens
ccagugacacgucucgccaagc

SEQ ID NO: 1825664 - RNA, 13 nt, Homo sapiens
ugcucauaaucug

SEQ ID NO: 1825665 - RNA, 12 nt, Homo sapiens
accacacagcac

SEQ ID NO: 1825666 - RNA, 15 nt, Homo sapiens
aauaauauuagcuua

SEQ ID NO: 1825667 - RNA, 16 nt, Homo sapiens
caguaacgcaggggaa

SEQ ID NO: 1825668 - RNA, 17 nt, Homo sapiens
ucuugacaaucaucucc

SEQ ID NO: 1825669 - RNA, 13 nt, Homo sapiens
ugaucauagcuca

SEQ ID NO: 1825670 - RNA, 21 nt, Homo sapiens
acuggaaaacagaacacuuau

SEQ ID NO: 1825671 - RNA, 20 nt, Homo sapiens
uguuucucauccuuugccag

SEQ ID NO: 1825672 - RNA, 14 nt, Homo sapiens
aagcgugugaguga

SEQ ID NO: 1825673 - RNA, 23 nt, Homo sapiens
cuuaaaaaagcccuuugcuaaaa

SEQ ID NO: 1825674 - RNA, 12 nt, Homo sapiens
agggagugcaug

SEQ ID NO: 1825675 - RNA, 22 nt, Homo sapiens
gagcagccucuugaaugcuuaa

SEQ ID NO: 1825676 - RNA, 21 nt, Homo sapiens
cagaaauggggaauucucuaa

SEQ ID NO: 1825677 - RNA, 23 nt, Homo sapiens
gauuuucuuuuuaacuuuaccaa

SEQ ID NO: 1825678 - RNA, 13 nt, Homo sapiens
uaucuuaugccac

SEQ ID NO: 1825679 - RNA, 13 nt, Homo sapiens
ugaaaaagaacug

SEQ ID NO: 1825680 - RNA, 20 nt, Homo sapiens
gucaaagauacacaaucuga

SEQ ID NO: 1825681 - RNA, 18 nt, Homo sapiens
cacuguguacaccucaaa

SEQ ID NO: 1825682 - RNA, 17 nt, Homo sapiens
cccugcauuucugaguu

SEQ ID NO: 1825683 - RNA, 19 nt, Homo sapiens
uaaucccagcuacucggga

SEQ ID NO: 1825684 - RNA, 17 nt, Homo sapiens
aggaggaauaaggggaa

SEQ ID NO: 1825685 - RNA, 15 nt, Homo sapiens
agcauggacagugug

SEQ ID NO: 1825686 - RNA, 15 nt, Homo sapiens
auguacuauaacaua

SEQ ID NO: 1825687 - RNA, 15 nt, Homo sapiens
ggaaacgagcugugu

SEQ ID NO: 1825688 - RNA, 23 nt, Homo sapiens
uggagaaacccuugaaaagacau

SEQ ID NO: 1825689 - RNA, 17 nt, Homo sapiens
cugaaucuauggcuuua

SEQ ID NO: 1825690 - RNA, 16 nt, Homo sapiens
gaaacauuacaguuca

SEQ ID NO: 1825691 - RNA, 12 nt, Homo sapiens
uuagcuuuacaa

SEQ ID NO: 1825692 - RNA, 23 nt, Homo sapiens
cuugguaaaaacugcagugucuu

SEQ ID NO: 1825693 - RNA, 15 nt, Homo sapiens
aguuccuugccuuaa

SEQ ID NO: 1825694 - RNA, 15 nt, Homo sapiens
gccaagaacuugcaa

SEQ ID NO: 1825695 - RNA, 21 nt, Homo sapiens
aagcacucgugugcaacagac

SEQ ID NO: 1825696 - RNA, 23 nt, Homo sapiens
cuguuggucugccuucugcugaa

SEQ ID NO: 1825697 - RNA, 17 nt, Homo sapiens
caggagcugcucaggcu

SEQ ID NO: 1825698 - RNA, 21 nt, Homo sapiens
cagaggauucugucuuccagg

SEQ ID NO: 1825699 - RNA, 21 nt, Homo sapiens
uuaaauaggcggggcuugccu

SEQ ID NO: 1825700 - RNA, 15 nt, Homo sapiens
uacgcugucucugac

SEQ ID NO: 1825701 - RNA, 18 nt, Homo sapiens
cugguugaugccugugaa

SEQ ID NO: 1825702 - RNA, 13 nt, Homo sapiens
cauggagcuauaa

SEQ ID NO: 1825703 - RNA, 13 nt, Homo sapiens
agcucgagaucau

SEQ ID NO: 1825704 - RNA, 16 nt, Homo sapiens
gaagaaagacuccuuu

SEQ ID NO: 1825705 - RNA, 22 nt, Homo sapiens
uccagccugggugacagagcaa

SEQ ID NO: 1825706 - RNA, 17 nt, Homo sapiens
uucugcagagacuucua

SEQ ID NO: 1825707 - RNA, 19 nt, Homo sapiens
ggaagagugugcuugucau

SEQ ID NO: 1825708 - RNA, 17 nt, Homo sapiens
cugugaauaaagccaca

SEQ ID NO: 1825709 - RNA, 23 nt, Homo sapiens
uuccaacucgaaucugugugaaa

SEQ ID NO: 1825710 - RNA, 17 nt, Homo sapiens
agagccuucacaugaaa

SEQ ID NO: 1825711 - RNA, 18 nt, Homo sapiens
ggagacugugugugcccu

SEQ ID NO: 1825712 - RNA, 18 nt, Homo sapiens
aauuaugucaaauggaug

SEQ ID NO: 1825713 - RNA, 20 nt, Homo sapiens
guccugaggcagaaccuggu

SEQ ID NO: 1825714 - RNA, 11 nt, Homo sapiens
uacgugcauuu

SEQ ID NO: 1825715 - RNA, 19 nt, Homo sapiens
uggaaagagguuuucacaa

SEQ ID NO: 1825716 - RNA, 15 nt, Homo sapiens
cuuguauauacauau

SEQ ID NO: 1825717 - RNA, 17 nt, Homo sapiens
uagacacuuuaccucuu

SEQ ID NO: 1825718 - RNA, 16 nt, Homo sapiens
aggagccccaguggug

SEQ ID NO: 1825719 - RNA, 20 nt, Homo sapiens
uauucaggaccccaucugcu

SEQ ID NO: 1825720 - RNA, 21 nt, Homo sapiens
uagcacuuugaaauaccucau

SEQ ID NO: 1825721 - RNA, 22 nt, Homo sapiens
ucaagcgauucucaugccucag

SEQ ID NO: 1825722 - RNA, 22 nt, Homo sapiens
ucaagagauucuccugccucag

SEQ ID NO: 1825723 - RNA, 13 nt, Homo sapiens
caugcucucucac

SEQ ID NO: 1825724 - RNA, 13 nt, Homo sapiens
caucaggcuuucu

SEQ ID NO: 1825725 - RNA, 15 nt, Homo sapiens
ccuugccauuuucaa

SEQ ID NO: 1825726 - RNA, 14 nt, Homo sapiens
uaauagcacugcca

SEQ ID NO: 1825727 - RNA, 20 nt, Homo sapiens
gcaguguuuaagucagcaaa

SEQ ID NO: 1825728 - RNA, 14 nt, Homo sapiens
uaaaauaaaacaca

SEQ ID NO: 1825729 - RNA, 15 nt, Homo sapiens
acaaucaaagcacuu

SEQ ID NO: 1825730 - RNA, 16 nt, Homo sapiens
auuuuuaacaccaugg

SEQ ID NO: 1825731 - RNA, 16 nt, Homo sapiens
auaucuugcuuucaaa

SEQ ID NO: 1825732 - RNA, 15 nt, Homo sapiens
aauauuccuaacuua

SEQ ID NO: 1825733 - RNA, 22 nt, Homo sapiens
agggugggggagggagguuccu

SEQ ID NO: 1825734 - RNA, 14 nt, Homo sapiens
uugggcuucauccu

SEQ ID NO: 1825735 - RNA, 22 nt, Homo sapiens
guuggagguuucacuugcacau

SEQ ID NO: 1825736 - RNA, 21 nt, Homo sapiens
cagauggacuccagccugccu

SEQ ID NO: 1825737 - RNA, 15 nt, Homo sapiens
gaacgagaccugugu

SEQ ID NO: 1825738 - RNA, 19 nt, Homo sapiens
ugucuaauagcccauaaag

SEQ ID NO: 1825739 - RNA, 15 nt, Homo sapiens
ugcaagccagggaug

SEQ ID NO: 1825740 - RNA, 18 nt, Homo sapiens
gucaccagcuaucuguca

SEQ ID NO: 1825741 - RNA, 22 nt, Homo sapiens
uucucauuaaaguuguuuccca

SEQ ID NO: 1825742 - RNA, 20 nt, Homo sapiens
agacaggagaaacacuugaa

SEQ ID NO: 1825743 - RNA, 13 nt, Homo sapiens
cagaauguaacug

SEQ ID NO: 1825744 - RNA, 21 nt, Homo sapiens
gaaauaaagaaaauucucuca

SEQ ID NO: 1825745 - RNA, 12 nt, Homo sapiens
uuaauauguuca

SEQ ID NO: 1825746 - RNA, 15 nt, Homo sapiens
uugcuucuugccauc

SEQ ID NO: 1825747 - RNA, 18 nt, Homo sapiens
aguggugacaaaucaaga

SEQ ID NO: 1825748 - RNA, 12 nt, Homo sapiens
ucuagacaacua

SEQ ID NO: 1825749 - RNA, 15 nt, Homo sapiens
guuuacacugucaaa

SEQ ID NO: 1825750 - RNA, 23 nt, Homo sapiens
ucccccuccaccugcucugugcc

SEQ ID NO: 1825751 - RNA, 22 nt, Homo sapiens
caucuaagaaaauuuacuguaa

SEQ ID NO: 1825752 - RNA, 17 nt, Homo sapiens
aacuugucacuugcaug

SEQ ID NO: 1825753 - RNA, 16 nt, Homo sapiens
cugugaaauaccacaa

SEQ ID NO: 1825754 - RNA, 16 nt, Homo sapiens
cccagagcuacaggcc

SEQ ID NO: 1825755 - RNA, 17 nt, Homo sapiens
uaguaauaagauggcug

SEQ ID NO: 1825756 - RNA, 23 nt, Homo sapiens
ucauguguguccacgacugucuc

SEQ ID NO: 1825757 - RNA, 22 nt, Homo sapiens
guguccauuuugcaaacccaac

SEQ ID NO: 1825758 - RNA, 15 nt, Homo sapiens
uggguacuucuugaa

SEQ ID NO: 1825759 - RNA, 15 nt, Homo sapiens
cagugaccuuuuaca

SEQ ID NO: 1825760 - RNA, 16 nt, Homo sapiens
caucugccucuauuca

SEQ ID NO: 1825761 - RNA, 13 nt, Homo sapiens
uucuuugcacuuu

SEQ ID NO: 1825762 - RNA, 21 nt, Homo sapiens
auuguaauccuagcacuuugg

SEQ ID NO: 1825763 - RNA, 22 nt, Homo sapiens
agcagagaagguaaggugugaa

SEQ ID NO: 1825764 - RNA, 13 nt, Homo sapiens
caucauaguacag

SEQ ID NO: 1825765 - RNA, 16 nt, Homo sapiens
ccacuccagcucugag

SEQ ID NO: 1825766 - RNA, 16 nt, Homo sapiens
gaacugagcaucucca

SEQ ID NO: 1825767 - RNA, 11 nt, Homo sapiens
gaguuugccac

SEQ ID NO: 1825768 - RNA, 15 nt, Homo sapiens
aagugugugaucugu

SEQ ID NO: 1825769 - RNA, 16 nt, Homo sapiens
gauaucaggaaauauc

SEQ ID NO: 1825770 - RNA, 24 nt, Homo sapiens
ccugcaccgagagagauggaauaa

SEQ ID NO: 1825771 - RNA, 17 nt, Homo sapiens
cuccccaacaccccacu

SEQ ID NO: 1825772 - RNA, 15 nt, Homo sapiens
aagacuaugaucuca

SEQ ID NO: 1825773 - RNA, 22 nt, Homo sapiens
gaagcuccggauggaggccagc

SEQ ID NO: 1825774 - RNA, 19 nt, Homo sapiens
auagcaugcaucuguuuau

SEQ ID NO: 1825775 - RNA, 23 nt, Homo sapiens
cuaagacaggaggaucacaagag

SEQ ID NO: 1825776 - RNA, 15 nt, Homo sapiens
ccauucccuuugcau

SEQ ID NO: 1825777 - RNA, 12 nt, Homo sapiens
gauguugcucag

SEQ ID NO: 1825778 - RNA, 17 nt, Homo sapiens
ugcgucgucaccaaauc

SEQ ID NO: 1825779 - RNA, 13 nt, Homo sapiens
cauuucuuugaau

SEQ ID NO: 1825780 - RNA, 22 nt, Homo sapiens
cauguucagaaaagaagugaag

SEQ ID NO: 1825781 - RNA, 14 nt, Homo sapiens
gauaugcacuugaa

SEQ ID NO: 1825782 - RNA, 13 nt, Homo sapiens
augaauacaauua

SEQ ID NO: 1825783 - RNA, 13 nt, Homo sapiens
uacaagacacagu

SEQ ID NO: 1825784 - RNA, 20 nt, Homo sapiens
cugagagccacaggugccug

SEQ ID NO: 1825785 - RNA, 15 nt, Homo sapiens
ggcacaaacaccuua

SEQ ID NO: 1825786 - RNA, 15 nt, Homo sapiens
aaguuugucuucaug

SEQ ID NO: 1825787 - RNA, 18 nt, Homo sapiens
ccuagccagaggcucuaa

SEQ ID NO: 1825788 - RNA, 15 nt, Homo sapiens
cucuucuuacuguau

SEQ ID NO: 1825789 - RNA, 15 nt, Homo sapiens
auuucugucuacuaa

SEQ ID NO: 1825790 - RNA, 19 nt, Homo sapiens
agggacaaaacacuguguc

SEQ ID NO: 1825791 - RNA, 16 nt, Homo sapiens
cuacauuaaaaugaca

SEQ ID NO: 1825792 - RNA, 20 nt, Homo sapiens
guuaaucuauaacuacauau

SEQ ID NO: 1825793 - RNA, 12 nt, Homo sapiens
cuuuuuucugcc

SEQ ID NO: 1825794 - RNA, 17 nt, Homo sapiens
acgauagccuagcuuuc

SEQ ID NO: 1825795 - RNA, 15 nt, Homo sapiens
gcuccucuuagcuca

SEQ ID NO: 1825796 - RNA, 19 nt, Homo sapiens
cacaauuucugggugauga

SEQ ID NO: 1825797 - RNA, 19 nt, Homo sapiens
gucaucucagugcuguaaa

SEQ ID NO: 1825798 - RNA, 17 nt, Homo sapiens
ucugagcuccaccucug

SEQ ID NO: 1825799 - RNA, 12 nt, Homo sapiens
agagccacugcc

SEQ ID NO: 1825800 - RNA, 19 nt, Homo sapiens
uaggcaccaccucugucac

SEQ ID NO: 1825801 - RNA, 18 nt, Homo sapiens
ucuguccauuaucuauau

SEQ ID NO: 1825802 - RNA, 23 nt, Homo sapiens
ucagcuuuuugauccucuacugu

SEQ ID NO: 1825803 - RNA, 15 nt, Homo sapiens
ccagcuagugccaaa

SEQ ID NO: 1825804 - RNA, 12 nt, Homo sapiens
ccaaguagcuag

SEQ ID NO: 1825805 - RNA, 14 nt, Homo sapiens
gguggaguggugcu

SEQ ID NO: 1825806 - RNA, 19 nt, Homo sapiens
ugcucucgaggcagcagug

SEQ ID NO: 1825807 - RNA, 17 nt, Homo sapiens
agaaaaagcuagcacua

SEQ ID NO: 1825808 - RNA, 20 nt, Homo sapiens
aauaugcauugucugcaaug

SEQ ID NO: 1825809 - RNA, 15 nt, Homo sapiens
gaagugagaccuucc

SEQ ID NO: 1825810 - RNA, 16 nt, Homo sapiens
aguaguauuaccaccc

SEQ ID NO: 1825811 - RNA, 13 nt, Homo sapiens
acaggacucugca

SEQ ID NO: 1825812 - RNA, 22 nt, Homo sapiens
cucacaagaacagaaccugcaa

SEQ ID NO: 1825813 - RNA, 17 nt, Homo sapiens
aagcaaugguugaugau

SEQ ID NO: 1825814 - RNA, 15 nt, Homo sapiens
agaaccucagaucag

SEQ ID NO: 1825815 - RNA, 15 nt, Homo sapiens
gcccaggccaggugc

SEQ ID NO: 1825816 - RNA, 22 nt, Homo sapiens
auccuuaaugguguucucucuc

SEQ ID NO: 1825817 - RNA, 16 nt, Homo sapiens
caggauuaacuaaaga

SEQ ID NO: 1825818 - RNA, 19 nt, Homo sapiens
ggugguuuucccaucucag

SEQ ID NO: 1825819 - RNA, 23 nt, Homo sapiens
ccagccaccuuccugacugggaa

SEQ ID NO: 1825820 - RNA, 16 nt, Homo sapiens
uuccaguuauaaauau

SEQ ID NO: 1825821 - RNA, 13 nt, Homo sapiens
ugcccagacaaga

SEQ ID NO: 1825822 - RNA, 22 nt, Homo sapiens
cacuccucaucaucacucaucu

SEQ ID NO: 1825823 - RNA, 16 nt, Homo sapiens
aagaaacagcuuucaa

SEQ ID NO: 1825824 - RNA, 16 nt, Homo sapiens
acaacacuuaauagca

SEQ ID NO: 1825825 - RNA, 14 nt, Homo sapiens
aggcccacucuguu

SEQ ID NO: 1825826 - RNA, 14 nt, Homo sapiens
cccucuacucuuac

SEQ ID NO: 1825827 - RNA, 23 nt, Homo sapiens
gagacugugcugggaacauguac

SEQ ID NO: 1825828 - RNA, 16 nt, Homo sapiens
uagugcaguucaccau

SEQ ID NO: 1825829 - RNA, 14 nt, Homo sapiens
acagugacacugga

SEQ ID NO: 1825830 - RNA, 21 nt, Homo sapiens
ggcuccuuggauguagucagu

SEQ ID NO: 1825831 - RNA, 13 nt, Homo sapiens
acacgucucgcca

SEQ ID NO: 1825832 - RNA, 14 nt, Homo sapiens
auuuuugaaaccaa

SEQ ID NO: 1825833 - RNA, 12 nt, Homo sapiens
ccacugucugcc

SEQ ID NO: 1825834 - RNA, 15 nt, Homo sapiens
aaauacucuuccaaa

SEQ ID NO: 1825835 - RNA, 14 nt, Homo sapiens
ugaaaaugaaucuu

SEQ ID NO: 1825836 - RNA, 12 nt, Homo sapiens
aacaaaccacac

SEQ ID NO: 1825837 - RNA, 21 nt, Homo sapiens
auaaaauggaauaacauauca

SEQ ID NO: 1825838 - RNA, 17 nt, Homo sapiens
uguacagauucuuucag

SEQ ID NO: 1825839 - RNA, 21 nt, Homo sapiens
guuuguauagaguucauccca

SEQ ID NO: 1825840 - RNA, 16 nt, Homo sapiens
gcuugaagccaaagaa

SEQ ID NO: 1825841 - RNA, 15 nt, Homo sapiens
aucucuuugauguca

SEQ ID NO: 1825842 - RNA, 15 nt, Homo sapiens
aggaauccuuacuga

SEQ ID NO: 1825843 - RNA, 13 nt, Homo sapiens
cuaggucacuuga

SEQ ID NO: 1825844 - RNA, 18 nt, Homo sapiens
ugaaucuguuucuauguc

SEQ ID NO: 1825845 - RNA, 22 nt, Homo sapiens
ggacuuucccccacacccagau

SEQ ID NO: 1825846 - RNA, 14 nt, Homo sapiens
aaugucuugagcuc

SEQ ID NO: 1825847 - RNA, 20 nt, Homo sapiens
aacugguauuuuaucuuuga

SEQ ID NO: 1825848 - RNA, 23 nt, Homo sapiens
aaacugccuguuaagucugagaa

SEQ ID NO: 1825849 - RNA, 18 nt, Homo sapiens
ugcucccgucugucuguc

SEQ ID NO: 1825850 - RNA, 13 nt, Homo sapiens
auacucagguuaa

SEQ ID NO: 1825851 - RNA, 14 nt, Homo sapiens
aaagucugaaucuc

SEQ ID NO: 1825852 - RNA, 19 nt, Homo sapiens
aguggcauuuccuggucag

SEQ ID NO: 1825853 - RNA, 20 nt, Homo sapiens
acauuacuguauauacuuug

SEQ ID NO: 1825854 - RNA, 15 nt, Homo sapiens
ucgcuuugccuauug

SEQ ID NO: 1825855 - RNA, 13 nt, Homo sapiens
ucugggaagccaa

SEQ ID NO: 1825856 - RNA, 19 nt, Homo sapiens
cuuuauuguucacacaaag

SEQ ID NO: 1825857 - RNA, 19 nt, Homo sapiens
uaaccaguguuguggauuu

SEQ ID NO: 1825858 - RNA, 20 nt, Homo sapiens
aagaauggugugugcccguu

SEQ ID NO: 1825859 - RNA, 21 nt, Homo sapiens
gccaucaauuuuaacauuuga

SEQ ID NO: 1825860 - RNA, 15 nt, Homo sapiens
uauucaguuccaaua

SEQ ID NO: 1825861 - RNA, 20 nt, Homo sapiens
cuaccucagaauuaaaacuu

SEQ ID NO: 1825862 - RNA, 11 nt, Homo sapiens
uaauguuacua

SEQ ID NO: 1825863 - RNA, 14 nt, Homo sapiens
uuacacuguauauu

SEQ ID NO: 1825864 - RNA, 15 nt, Homo sapiens
caaauaauacaucuu

SEQ ID NO: 1825865 - RNA, 18 nt, Homo sapiens
ucacagaaauguuaaacu

SEQ ID NO: 1825866 - RNA, 21 nt, Homo sapiens
acacagcgcgguuuuuuccac

SEQ ID NO: 1825867 - RNA, 15 nt, Homo sapiens
ccccaggcauugcca

SEQ ID NO: 1825868 - RNA, 20 nt, Homo sapiens
cuucacaguagagccagcuu

SEQ ID NO: 1825869 - RNA, 22 nt, Homo sapiens
cagggaagcaucugucuuguca

SEQ ID NO: 1825870 - RNA, 23 nt, Homo sapiens
ggcucuaucuuuuccuucaguga

SEQ ID NO: 1825871 - RNA, 13 nt, Homo sapiens
ugugucauguaua

SEQ ID NO: 1825872 - RNA, 16 nt, Homo sapiens
cuuuuccauguaucua

SEQ ID NO: 1825873 - RNA, 23 nt, Homo sapiens
auauagcaaaugcagaaccacaa

SEQ ID NO: 1825874 - RNA, 16 nt, Homo sapiens
cuucccaauccagugg

SEQ ID NO: 1825875 - RNA, 21 nt, Homo sapiens
gccauauuuaguauaccagag

SEQ ID NO: 1825876 - RNA, 19 nt, Homo sapiens
cugccccaggccugaaaga

SEQ ID NO: 1825877 - RNA, 23 nt, Homo sapiens
cccuggguuccgguuguugauau

SEQ ID NO: 1825878 - RNA, 14 nt, Homo sapiens
agaucaacauucca

SEQ ID NO: 1825879 - RNA, 19 nt, Homo sapiens
cagaucacugccacacucu

SEQ ID NO: 1825880 - RNA, 17 nt, Homo sapiens
aauaacuuauaucauca

SEQ ID NO: 1825881 - RNA, 16 nt, Homo sapiens
gcugcagcuugggaga

SEQ ID NO: 1825882 - RNA, 17 nt, Homo sapiens
cacagaguuacugccac

SEQ ID NO: 1825883 - RNA, 17 nt, Homo sapiens
ugcaggauguucaggga

SEQ ID NO: 1825884 - RNA, 14 nt, Homo sapiens
cauguaaaugcuca

SEQ ID NO: 1825885 - RNA, 17 nt, Homo sapiens
ugcuaugucucuaucca

SEQ ID NO: 1825886 - RNA, 22 nt, Homo sapiens
ugggucaaagugcggcugccau

SEQ ID NO: 1825887 - RNA, 23 nt, Homo sapiens
auuccaccccagcaggacaguga

SEQ ID NO: 1825888 - RNA, 20 nt, Homo sapiens
gaauaguaguaacuguuuca

SEQ ID NO: 1825889 - RNA, 22 nt, Homo sapiens
gucauugauagaacuacuuuga

SEQ ID NO: 1825890 - RNA, 22 nt, Homo sapiens
gcuaagauacugaugacagugu

SEQ ID NO: 1825891 - RNA, 15 nt, Homo sapiens
uucagcaugugcuuu

SEQ ID NO: 1825892 - RNA, 19 nt, Homo sapiens
gacccggagcuaacacugg

SEQ ID NO: 1825893 - RNA, 13 nt, Homo sapiens
ugagagacacugg

SEQ ID NO: 1825894 - RNA, 19 nt, Homo sapiens
gcugggcaguuuuucugua

SEQ ID NO: 1825895 - RNA, 11 nt, Homo sapiens
cucugcuccag

SEQ ID NO: 1825896 - RNA, 17 nt, Homo sapiens
ggacaggacuaacacuc

SEQ ID NO: 1825897 - RNA, 19 nt, Homo sapiens
gaaauuugauaaacugaau

SEQ ID NO: 1825898 - RNA, 19 nt, Homo sapiens
auaaaacgugacagggaaa

SEQ ID NO: 1825899 - RNA, 14 nt, Homo sapiens
agaugggacaauua

SEQ ID NO: 1825900 - RNA, 19 nt, Homo sapiens
gcugaauacgcuaagccug

SEQ ID NO: 1825901 - RNA, 15 nt, Homo sapiens
ccccacucuaccucc

SEQ ID NO: 1825902 - RNA, 12 nt, Homo sapiens
agagaucuguca

SEQ ID NO: 1825903 - RNA, 19 nt, Homo sapiens
aggagggccgaggugggcu

SEQ ID NO: 1825904 - RNA, 14 nt, Homo sapiens
guggguggcacuga

SEQ ID NO: 1825905 - RNA, 14 nt, Homo sapiens
aggugacaaccauu

SEQ ID NO: 1825906 - RNA, 22 nt, Homo sapiens
ugcuggcauuugcaccuaccuc

SEQ ID NO: 1825907 - RNA, 19 nt, Homo sapiens
auuccaccuagagcuagau

SEQ ID NO: 1825908 - RNA, 17 nt, Homo sapiens
augacaucugucuagga

SEQ ID NO: 1825909 - RNA, 12 nt, Homo sapiens
agugaaauuacu

SEQ ID NO: 1825910 - RNA, 15 nt, Homo sapiens
augacugugcuacug

SEQ ID NO: 1825911 - RNA, 15 nt, Homo sapiens
augcaaaugcucaaa

SEQ ID NO: 1825912 - RNA, 21 nt, Homo sapiens
gcuaaagagcuuugugauaua

SEQ ID NO: 1825913 - RNA, 22 nt, Homo sapiens
agggcaggucuggcggcuccau

SEQ ID NO: 1825914 - RNA, 19 nt, Homo sapiens
agccgcagagacccucuca

SEQ ID NO: 1825915 - RNA, 16 nt, Homo sapiens
uguguaauuagugcca

SEQ ID NO: 1825916 - RNA, 22 nt, Homo sapiens
ucaaaauaaaaaugagguacuc

SEQ ID NO: 1825917 - RNA, 17 nt, Homo sapiens
guugcuaggaacaugug

SEQ ID NO: 1825918 - RNA, 16 nt, Homo sapiens
aguucugaugucuuag

SEQ ID NO: 1825919 - RNA, 14 nt, Homo sapiens
cauaauaaaguguu

SEQ ID NO: 1825920 - RNA, 21 nt, Homo sapiens
aaaacucuuauggccaaauuc

SEQ ID NO: 1825921 - RNA, 15 nt, Homo sapiens
uaaacgggcugcguu

SEQ ID NO: 1825922 - RNA, 21 nt, Homo sapiens
uaaaggaguagaauaccaaau

SEQ ID NO: 1825923 - RNA, 13 nt, Homo sapiens
cauuccauuugaa

SEQ ID NO: 1825924 - RNA, 17 nt, Homo sapiens
uguuuaaguaauugcca

SEQ ID NO: 1825925 - RNA, 15 nt, Homo sapiens
uguauuuauaauuua

SEQ ID NO: 1825926 - RNA, 14 nt, Homo sapiens
ugucauauguagcc

SEQ ID NO: 1825927 - RNA, 15 nt, Homo sapiens
uuaccacuugcacua

SEQ ID NO: 1825928 - RNA, 18 nt, Homo sapiens
cuuccucuccuucccaca

SEQ ID NO: 1825929 - RNA, 12 nt, Homo sapiens
auucuggaagau

SEQ ID NO: 1825930 - RNA, 13 nt, Homo sapiens
auauaucuugucu

SEQ ID NO: 1825931 - RNA, 19 nt, Homo sapiens
ccccuaagaggcagugaga

SEQ ID NO: 1825932 - RNA, 13 nt, Homo sapiens
uuuuuaugugcag

SEQ ID NO: 1825933 - RNA, 18 nt, Homo sapiens
aucaguagauuucuggca

SEQ ID NO: 1825934 - RNA, 12 nt, Homo sapiens
uccagugcaguc

SEQ ID NO: 1825935 - RNA, 21 nt, Homo sapiens
guuccacagacggaaggguaa

SEQ ID NO: 1825936 - RNA, 16 nt, Homo sapiens
guuggccaauuucacc

SEQ ID NO: 1825937 - RNA, 21 nt, Homo sapiens
gggugaccaccgauuccagcu

SEQ ID NO: 1825938 - RNA, 19 nt, Homo sapiens
uucagguggaacaggagga

SEQ ID NO: 1825939 - RNA, 16 nt, Homo sapiens
uggcccuucacugucc

SEQ ID NO: 1825940 - RNA, 16 nt, Homo sapiens
guucauccccugugaa

SEQ ID NO: 1825941 - RNA, 11 nt, Homo sapiens
aaccccagugg

SEQ ID NO: 1825942 - RNA, 17 nt, Homo sapiens
acccagggacacuccaa

SEQ ID NO: 1825943 - RNA, 15 nt, Homo sapiens
cuagugaaccacagg

SEQ ID NO: 1825944 - RNA, 18 nt, Homo sapiens
ucaucuguccgacaaguu

SEQ ID NO: 1825945 - RNA, 13 nt, Homo sapiens
caagcucacccuu

SEQ ID NO: 1825946 - RNA, 19 nt, Homo sapiens
gccuuguuucaccuuccau

SEQ ID NO: 1825947 - RNA, 16 nt, Homo sapiens
aaugaucgggauauaa

SEQ ID NO: 1825948 - RNA, 21 nt, Homo sapiens
guguugugccccuucacucau

SEQ ID NO: 1825949 - RNA, 18 nt, Homo sapiens
cagaguacuggcugaugg

SEQ ID NO: 1825950 - RNA, 15 nt, Homo sapiens
gaaauccaaacuacu

SEQ ID NO: 1825951 - RNA, 16 nt, Homo sapiens
gacacauucacacugg

SEQ ID NO: 1825952 - RNA, 12 nt, Homo sapiens
cuccaaggagca

SEQ ID NO: 1825953 - RNA, 14 nt, Homo sapiens
agaacugcacuuuu

SEQ ID NO: 1825954 - RNA, 15 nt, Homo sapiens
aucuaaaaaauaucu

SEQ ID NO: 1825955 - RNA, 15 nt, Homo sapiens
gccccauuuacccaa

SEQ ID NO: 1825956 - RNA, 15 nt, Homo sapiens
uauuucuugcuuuca

SEQ ID NO: 1825957 - RNA, 15 nt, Homo sapiens
uaaauuaugcaauuu

SEQ ID NO: 1825958 - RNA, 20 nt, Homo sapiens
auugauauugaaugauguga

SEQ ID NO: 1825959 - RNA, 22 nt, Homo sapiens
ucucuuccugucuuuguugucu

SEQ ID NO: 1825960 - RNA, 16 nt, Homo sapiens
auauaauaugucuuca

SEQ ID NO: 1825961 - RNA, 13 nt, Homo sapiens
ggagagcccaguc

SEQ ID NO: 1825962 - RNA, 18 nt, Homo sapiens
cuuuggcaaucagugcuc

SEQ ID NO: 1825963 - RNA, 18 nt, Homo sapiens
ugcuggggguuucuguag

SEQ ID NO: 1825964 - RNA, 13 nt, Homo sapiens
caaacagcucagg

SEQ ID NO: 1825965 - RNA, 20 nt, Homo sapiens
aaguagcaucccaucccaac

SEQ ID NO: 1825966 - RNA, 20 nt, Homo sapiens
ugcaugaaacauguucucaa

SEQ ID NO: 1825967 - RNA, 22 nt, Homo sapiens
aaauuuauuugaaaaugcauca

SEQ ID NO: 1825968 - RNA, 11 nt, Homo sapiens
aagaaaaccaa

SEQ ID NO: 1825969 - RNA, 18 nt, Homo sapiens
gaaagacuauucaaacag

SEQ ID NO: 1825970 - RNA, 19 nt, Homo sapiens
cuuaaucauuauccuucua

SEQ ID NO: 1825971 - RNA, 21 nt, Homo sapiens
ucaagauaauccuagagucuu

SEQ ID NO: 1825972 - RNA, 15 nt, Homo sapiens
gagucuuugcagaga

SEQ ID NO: 1825973 - RNA, 13 nt, Homo sapiens
gauggagcuggag

SEQ ID NO: 1825974 - RNA, 14 nt, Homo sapiens
acuuguggacacag

SEQ ID NO: 1825975 - RNA, 23 nt, Homo sapiens
acuccuuaggaggagugagacag

SEQ ID NO: 1825976 - RNA, 14 nt, Homo sapiens
gcaauauuccagua

SEQ ID NO: 1825977 - RNA, 13 nt, Homo sapiens
auuugcugucaca

SEQ ID NO: 1825978 - RNA, 22 nt, Homo sapiens
cuacagccucccuggcuacaug

SEQ ID NO: 1825979 - RNA, 23 nt, Homo sapiens
gccaaaaauacagccuauaguaa

SEQ ID NO: 1825980 - RNA, 13 nt, Homo sapiens
cccuaccagacac

SEQ ID NO: 1825981 - RNA, 15 nt, Homo sapiens
aaaagcuagacagau

SEQ ID NO: 1825982 - RNA, 15 nt, Homo sapiens
augaaaauagcaaua

SEQ ID NO: 1825983 - RNA, 13 nt, Homo sapiens
uguagaaggagcc

SEQ ID NO: 1825984 - RNA, 15 nt, Homo sapiens
auaaaaaguaaaaac

SEQ ID NO: 1825985 - RNA, 19 nt, Homo sapiens
gccccggccacucccugcc

SEQ ID NO: 1825986 - RNA, 17 nt, Homo sapiens
gggcaagccugaguggu

SEQ ID NO: 1825987 - RNA, 17 nt, Homo sapiens
uauaauaaaugggcaca

SEQ ID NO: 1825988 - RNA, 15 nt, Homo sapiens
aacagcaucauguca

SEQ ID NO: 1825989 - RNA, 16 nt, Homo sapiens
uuacauuuucuuucau

SEQ ID NO: 1825990 - RNA, 19 nt, Homo sapiens
guccauguaauauucccau

SEQ ID NO: 1825991 - RNA, 19 nt, Homo sapiens
caggcuacacugacacugg

SEQ ID NO: 1825992 - RNA, 16 nt, Homo sapiens
uacuggacuucuauca

SEQ ID NO: 1825993 - RNA, 18 nt, Homo sapiens
augccagcauauacugaa

SEQ ID NO: 1825994 - RNA, 21 nt, Homo sapiens
aggcugcuggaaacacaguca

SEQ ID NO: 1825995 - RNA, 23 nt, Homo sapiens
augcaaauacaaucagcccagug

SEQ ID NO: 1825996 - RNA, 19 nt, Homo sapiens
ucccggagcgcaccugcuu

SEQ ID NO: 1825997 - RNA, 20 nt, Homo sapiens
aaagcucuauuaagauuucc

SEQ ID NO: 1825998 - RNA, 22 nt, Homo sapiens
guauugaaucuaaaaccaaaua

SEQ ID NO: 1825999 - RNA, 16 nt, Homo sapiens
uguaucaaaugugaca

SEQ ID NO: 1826000 - RNA, 19 nt, Homo sapiens
cuggaggaaccacauauaa

SEQ ID NO: 1826001 - RNA, 23 nt, Homo sapiens
ugccauccuaggcuuaaaugcaa

SEQ ID NO: 1826002 - RNA, 17 nt, Homo sapiens
gcaagucuuccaugacc

SEQ ID NO: 1826003 - RNA, 18 nt, Homo sapiens
accagguuugaugccugu

SEQ ID NO: 1826004 - RNA, 17 nt, Homo sapiens
gcacuuuuuuguuugaa

SEQ ID NO: 1826005 - RNA, 22 nt, Homo sapiens
cuucagaggccuggcaucuucu

SEQ ID NO: 1826006 - RNA, 24 nt, Homo sapiens
ucaguaccccugguaaaccaagcc

SEQ ID NO: 1826007 - RNA, 19 nt, Homo sapiens
acccccaaaaaacaauuau

SEQ ID NO: 1826008 - RNA, 19 nt, Homo sapiens
ccccacugcagacaugacc

SEQ ID NO: 1826009 - RNA, 17 nt, Homo sapiens
ccagccuggacaccucu

SEQ ID NO: 1826010 - RNA, 18 nt, Homo sapiens
augcugcaggacuugaga

SEQ ID NO: 1826011 - RNA, 11 nt, Homo sapiens
accccaucucu

SEQ ID NO: 1826012 - RNA, 23 nt, Homo sapiens
ucaguaacacaauacaguacuca

SEQ ID NO: 1826013 - RNA, 20 nt, Homo sapiens
cccagcccagauggcacuca

SEQ ID NO: 1826014 - RNA, 17 nt, Homo sapiens
ggccucaucuccuuuau

SEQ ID NO: 1826015 - RNA, 14 nt, Homo sapiens
cucacucacucuga

SEQ ID NO: 1826016 - RNA, 15 nt, Homo sapiens
aaauagaggcuaaau

SEQ ID NO: 1826017 - RNA, 14 nt, Homo sapiens
auggaggacuccag

SEQ ID NO: 1826018 - RNA, 15 nt, Homo sapiens
gaauaaugcuguuuu

SEQ ID NO: 1826019 - RNA, 21 nt, Homo sapiens
ucaggacacuaauacaccagg

SEQ ID NO: 1826020 - RNA, 18 nt, Homo sapiens
ggcugcucggggugcaca

SEQ ID NO: 1826021 - RNA, 14 nt, Homo sapiens
augaccagagcaaa

SEQ ID NO: 1826022 - RNA, 16 nt, Homo sapiens
aaccucucugugccau

SEQ ID NO: 1826023 - RNA, 21 nt, Homo sapiens
cugcagccccuccuccucggg

SEQ ID NO: 1826024 - RNA, 14 nt, Homo sapiens
uugcaaccucgcug

SEQ ID NO: 1826025 - RNA, 22 nt, Homo sapiens
acaacauuucucaaaugcacau

SEQ ID NO: 1826026 - RNA, 14 nt, Homo sapiens
gauauccaugccac

SEQ ID NO: 1826027 - RNA, 21 nt, Homo sapiens
caaguauacuagggagccauu

SEQ ID NO: 1826028 - RNA, 14 nt, Homo sapiens
aauacaaguucuuu

SEQ ID NO: 1826029 - RNA, 19 nt, Homo sapiens
uguuacagguuacaugaga

SEQ ID NO: 1826030 - RNA, 19 nt, Homo sapiens
aguggcagcccagccagcg

SEQ ID NO: 1826031 - RNA, 23 nt, Homo sapiens
aagagaugcuggauucagauaua

SEQ ID NO: 1826032 - RNA, 17 nt, Homo sapiens
uccuguacgaaccccuc

SEQ ID NO: 1826033 - RNA, 16 nt, Homo sapiens
ucagagacuaucugau

SEQ ID NO: 1826034 - RNA, 15 nt, Homo sapiens
agaaaaacaaugaaa

SEQ ID NO: 1826035 - RNA, 19 nt, Homo sapiens
auaccagagaccugaggca

SEQ ID NO: 1826036 - RNA, 19 nt, Homo sapiens
cuuuugguuacagcacaaa

SEQ ID NO: 1826037 - RNA, 20 nt, Homo sapiens
aaggaaagaugaugcucagu

SEQ ID NO: 1826038 - RNA, 20 nt, Homo sapiens
uuuaaguuacucagcucuau

SEQ ID NO: 1826039 - RNA, 14 nt, Homo sapiens
accuuuuacaaaag

SEQ ID NO: 1826040 - RNA, 22 nt, Homo sapiens
agaaaucuagaauuuuuacuua

SEQ ID NO: 1826041 - RNA, 15 nt, Homo sapiens
ggcugagcucuuauc

SEQ ID NO: 1826042 - RNA, 19 nt, Homo sapiens
ucuauggguuggacaaccu

SEQ ID NO: 1826043 - RNA, 12 nt, Homo sapiens
aacaguaaauau

SEQ ID NO: 1826044 - RNA, 13 nt, Homo sapiens
uaauggcacugau

SEQ ID NO: 1826045 - RNA, 18 nt, Homo sapiens
agugucucagggugcaga

SEQ ID NO: 1826046 - RNA, 19 nt, Homo sapiens
cagagucaggcuguugcgc

SEQ ID NO: 1826047 - RNA, 14 nt, Homo sapiens
guauugugugagug

SEQ ID NO: 1826048 - RNA, 21 nt, Homo sapiens
uaaaaaacaaagccuuaucca

SEQ ID NO: 1826049 - RNA, 20 nt, Homo sapiens
aggguaagcugcucugaggu

SEQ ID NO: 1826050 - RNA, 20 nt, Homo sapiens
ucuugaagcugggcugucuc

SEQ ID NO: 1826051 - RNA, 21 nt, Homo sapiens
uuuucuaccuauaacacucua

SEQ ID NO: 1826052 - RNA, 14 nt, Homo sapiens
aaaggagacauauc

SEQ ID NO: 1826053 - RNA, 16 nt, Homo sapiens
augauaauuacaauac

SEQ ID NO: 1826054 - RNA, 17 nt, Homo sapiens
uguugaaucaggggcaa

SEQ ID NO: 1826055 - RNA, 14 nt, Homo sapiens
guucagacauguga

SEQ ID NO: 1826056 - RNA, 20 nt, Homo sapiens
aaaugugcauauuccaugac

SEQ ID NO: 1826057 - RNA, 15 nt, Homo sapiens
ucagaucauggcauc

SEQ ID NO: 1826058 - RNA, 13 nt, Homo sapiens
ugugcagacugug

SEQ ID NO: 1826059 - RNA, 13 nt, Homo sapiens
uuucuguaaacuc

SEQ ID NO: 1826060 - RNA, 15 nt, Homo sapiens
uucucaagaagaaca

SEQ ID NO: 1826061 - RNA, 15 nt, Homo sapiens
gacuucuugaaauca

SEQ ID NO: 1826062 - RNA, 18 nt, Homo sapiens
uaaucuaagaaaagggga

SEQ ID NO: 1826063 - RNA, 21 nt, Homo sapiens
ucucagccuuagcacuaugga

SEQ ID NO: 1826064 - RNA, 17 nt, Homo sapiens
cuggagcaaaagucauu

SEQ ID NO: 1826065 - RNA, 14 nt, Homo sapiens
ggaacacggccaca

SEQ ID NO: 1826066 - RNA, 22 nt, Homo sapiens
acucugagugaauacuuugaug

SEQ ID NO: 1826067 - RNA, 20 nt, Homo sapiens
ugaaagcuggagucugucaa

SEQ ID NO: 1826068 - RNA, 22 nt, Homo sapiens
ucgugaauaaguugauucuguc

SEQ ID NO: 1826069 - RNA, 20 nt, Homo sapiens
auacaaauacuaucucugua

SEQ ID NO: 1826070 - RNA, 22 nt, Homo sapiens
ugcaguuuacuauugcuaucuu

SEQ ID NO: 1826071 - RNA, 18 nt, Homo sapiens
aaggauguaguaucucau

SEQ ID NO: 1826072 - RNA, 14 nt, Homo sapiens
uugccccacaguug

SEQ ID NO: 1826073 - RNA, 18 nt, Homo sapiens
uucauauauuuguaugau

SEQ ID NO: 1826074 - RNA, 18 nt, Homo sapiens
cuccccuucccagacccc

SEQ ID NO: 1826075 - RNA, 16 nt, Homo sapiens
uaaaagacuguuuuca

SEQ ID NO: 1826076 - RNA, 15 nt, Homo sapiens
ugccugaacauggca

SEQ ID NO: 1826077 - RNA, 14 nt, Homo sapiens
aauaacuaccuccu

SEQ ID NO: 1826078 - RNA, 15 nt, Homo sapiens
agacgggcacagaca

SEQ ID NO: 1826079 - RNA, 14 nt, Homo sapiens
ugagauuguacugu

SEQ ID NO: 1826080 - RNA, 20 nt, Homo sapiens
aaauggauaugggcuggaua

SEQ ID NO: 1826081 - RNA, 21 nt, Homo sapiens
uucccaccaggcugcucaggg

SEQ ID NO: 1826082 - RNA, 15 nt, Homo sapiens
accuucacaccacuu

SEQ ID NO: 1826083 - RNA, 19 nt, Homo sapiens
acuauggagccuggcacag

SEQ ID NO: 1826084 - RNA, 19 nt, Homo sapiens
uagagaaauuugccaauuu

SEQ ID NO: 1826085 - RNA, 22 nt, Homo sapiens
uccuggggagcuucacaaacau

SEQ ID NO: 1826086 - RNA, 15 nt, Homo sapiens
aagaaagggccagga

SEQ ID NO: 1826087 - RNA, 16 nt, Homo sapiens
uaauaaaaaucuccca

SEQ ID NO: 1826088 - RNA, 20 nt, Homo sapiens
agauuuuuacacauguaucu

SEQ ID NO: 1826089 - RNA, 15 nt, Homo sapiens
cagggccgugagcau

SEQ ID NO: 1826090 - RNA, 15 nt, Homo sapiens
acuacugacaugugg

SEQ ID NO: 1826091 - RNA, 16 nt, Homo sapiens
agaaguauaaagugau

SEQ ID NO: 1826092 - RNA, 16 nt, Homo sapiens
ugugugccuauagucc

SEQ ID NO: 1826093 - RNA, 17 nt, Homo sapiens
acaauguugcacugaaa

SEQ ID NO: 1826094 - RNA, 18 nt, Homo sapiens
gugaggugggccuuugag

SEQ ID NO: 1826095 - RNA, 21 nt, Homo sapiens
acuuugaaacuaucucaugcc

SEQ ID NO: 1826096 - RNA, 14 nt, Homo sapiens
uuagcaucucaggu

SEQ ID NO: 1826097 - RNA, 21 nt, Homo sapiens
cuagcaaagacuugugugaug

SEQ ID NO: 1826098 - RNA, 18 nt, Homo sapiens
ugcagucaucuugaccaa

SEQ ID NO: 1826099 - RNA, 19 nt, Homo sapiens
augacacaggcugacucau

SEQ ID NO: 1826100 - RNA, 14 nt, Homo sapiens
uauaaugguugacu

SEQ ID NO: 1826101 - RNA, 14 nt, Homo sapiens
caucuaagacauuc

SEQ ID NO: 1826102 - RNA, 19 nt, Homo sapiens
ugagggguggccaucuccu

SEQ ID NO: 1826103 - RNA, 19 nt, Homo sapiens
ugaacaauccccuaacaca

SEQ ID NO: 1826104 - RNA, 16 nt, Homo sapiens
acaaaacccugcaccu

SEQ ID NO: 1826105 - RNA, 18 nt, Homo sapiens
agacuggagcaucugacu

SEQ ID NO: 1826106 - RNA, 21 nt, Homo sapiens
uacauccagcuccucuagggg

SEQ ID NO: 1826107 - RNA, 20 nt, Homo sapiens
uagcaagacugcaagagaug

SEQ ID NO: 1826108 - RNA, 15 nt, Homo sapiens
uccuaaacccaauga

SEQ ID NO: 1826109 - RNA, 16 nt, Homo sapiens
aauuugagccauuuaa

SEQ ID NO: 1826110 - RNA, 14 nt, Homo sapiens
ucaaucuucuacuu

SEQ ID NO: 1826111 - RNA, 19 nt, Homo sapiens
cagagaccugaagugugca

SEQ ID NO: 1826112 - RNA, 20 nt, Homo sapiens
ccuugaggaaaaauguccaa

SEQ ID NO: 1826113 - RNA, 13 nt, Homo sapiens
ccgcggcccagac

SEQ ID NO: 1826114 - RNA, 22 nt, Homo sapiens
ggaggagggucuagaggccuga

SEQ ID NO: 1826115 - RNA, 13 nt, Homo sapiens
ugucguagccaag

SEQ ID NO: 1826116 - RNA, 22 nt, Homo sapiens
acugagugaaauauuacucugc

SEQ ID NO: 1826117 - RNA, 14 nt, Homo sapiens
aaggcccucaguga

SEQ ID NO: 1826118 - RNA, 15 nt, Homo sapiens
cuacacauacagaaa

SEQ ID NO: 1826119 - RNA, 22 nt, Homo sapiens
ccaagauuaugugacuugcaau

SEQ ID NO: 1826120 - RNA, 16 nt, Homo sapiens
agaagagggaaugagc

SEQ ID NO: 1826121 - RNA, 15 nt, Homo sapiens
ugaggguuaaugaaa

SEQ ID NO: 1826122 - RNA, 18 nt, Homo sapiens
ucucacuugugcaguguu

SEQ ID NO: 1826123 - RNA, 15 nt, Homo sapiens
caucuuccucugcag

SEQ ID NO: 1826124 - RNA, 21 nt, Homo sapiens
cuuuccuucaucucccacgaa

SEQ ID NO: 1826125 - RNA, 22 nt, Homo sapiens
uaauuacaauaaugaguucacu

SEQ ID NO: 1826126 - RNA, 18 nt, Homo sapiens
accucugagaagacacaa

SEQ ID NO: 1826127 - RNA, 23 nt, Homo sapiens
ugcucaccaagcuguuccacuuc

SEQ ID NO: 1826128 - RNA, 18 nt, Homo sapiens
uauguaaaccacauugua

SEQ ID NO: 1826129 - RNA, 18 nt, Homo sapiens
uggaguacagugguguga

SEQ ID NO: 1826130 - RNA, 16 nt, Homo sapiens
gcacgcgccuguaauc

SEQ ID NO: 1826131 - RNA, 18 nt, Homo sapiens
cugagaagugcacuuuaa

SEQ ID NO: 1826132 - RNA, 22 nt, Homo sapiens
auaaaccccaccuuuauuccuu

SEQ ID NO: 1826133 - RNA, 16 nt, Homo sapiens
ucauguagguugucua

SEQ ID NO: 1826134 - RNA, 13 nt, Homo sapiens
guuccucuuugca

SEQ ID NO: 1826135 - RNA, 17 nt, Homo sapiens
cagcguggggguggcca

SEQ ID NO: 1826136 - RNA, 19 nt, Homo sapiens
caaaauuguuuaccauaga

SEQ ID NO: 1826137 - RNA, 15 nt, Homo sapiens
gccccguuucuugcc

SEQ ID NO: 1826138 - RNA, 18 nt, Homo sapiens
agucaugugugaacacau

SEQ ID NO: 1826139 - RNA, 19 nt, Homo sapiens
uuuggguucucuacaugca

SEQ ID NO: 1826140 - RNA, 21 nt, Homo sapiens
aagcuaaaauauauaauauac

SEQ ID NO: 1826141 - RNA, 15 nt, Homo sapiens
aaggacacagaugaa

SEQ ID NO: 1826142 - RNA, 16 nt, Homo sapiens
agaauaauaggccagg

SEQ ID NO: 1826143 - RNA, 9 nt, Homo sapiens
ugucucaug

SEQ ID NO: 1826144 - RNA, 18 nt, Homo sapiens
aucaucuccugccuuccu

SEQ ID NO: 1826145 - RNA, 14 nt, Homo sapiens
aaauccauccugcu

SEQ ID NO: 1826146 - RNA, 14 nt, Homo sapiens
guuccaguaccgcc

SEQ ID NO: 1826147 - RNA, 16 nt, Homo sapiens
aagagguaacugaggu

SEQ ID NO: 1826148 - RNA, 18 nt, Homo sapiens
augugauuccaucuugcc

SEQ ID NO: 1826149 - RNA, 15 nt, Homo sapiens
uaaagaauguauuua

SEQ ID NO: 1826150 - RNA, 14 nt, Homo sapiens
cuugccagauuacc

SEQ ID NO: 1826151 - RNA, 17 nt, Homo sapiens
uuuugccauuagccaag

SEQ ID NO: 1826152 - RNA, 23 nt, Homo sapiens
uucucaugauagauuuguaugau

SEQ ID NO: 1826153 - RNA, 19 nt, Homo sapiens
cuuagcuuucuaggccacu

SEQ ID NO: 1826154 - RNA, 15 nt, Homo sapiens
cgcaaguucagggaa

SEQ ID NO: 1826155 - RNA, 14 nt, Homo sapiens
aaacugcacugcca

SEQ ID NO: 1826156 - RNA, 23 nt, Homo sapiens
uauuguggaaagaugaaugcaau

SEQ ID NO: 1826157 - RNA, 19 nt, Homo sapiens
gccucccacccccaucucu

SEQ ID NO: 1826158 - RNA, 17 nt, Homo sapiens
cugccccaggacuguca

SEQ ID NO: 1826159 - RNA, 11 nt, Homo sapiens
agcacuuucca

SEQ ID NO: 1826160 - RNA, 18 nt, Homo sapiens
ccacucucccuuguccuc

SEQ ID NO: 1826161 - RNA, 19 nt, Homo sapiens
ccaaaggcauccaggccag

SEQ ID NO: 1826162 - RNA, 19 nt, Homo sapiens
acccacacagguggccauc

SEQ ID NO: 1826163 - RNA, 12 nt, Homo sapiens
cugaguagaaag

SEQ ID NO: 1826164 - RNA, 23 nt, Homo sapiens
agagcacuugagaaccagucucc

SEQ ID NO: 1826165 - RNA, 21 nt, Homo sapiens
auauggcacuaaaugcacaaa

SEQ ID NO: 1826166 - RNA, 14 nt, Homo sapiens
uuaaaauagucaua

SEQ ID NO: 1826167 - RNA, 21 nt, Homo sapiens
gagaaagggagugcaugugcg

SEQ ID NO: 1826168 - RNA, 20 nt, Homo sapiens
ggaggcagagguugcaguga

SEQ ID NO: 1826169 - RNA, 19 nt, Homo sapiens
accggcugguggagcugcu

SEQ ID NO: 1826170 - RNA, 20 nt, Homo sapiens
aagccgguugcagagaaucu

SEQ ID NO: 1826171 - RNA, 17 nt, Homo sapiens
auaacaaaucguccaaa

SEQ ID NO: 1826172 - RNA, 16 nt, Homo sapiens
uggggacauugcucuc

SEQ ID NO: 1826173 - RNA, 14 nt, Homo sapiens
ucauuguguucucu

SEQ ID NO: 1826174 - RNA, 13 nt, Homo sapiens
gcagugcugaggg

SEQ ID NO: 1826175 - RNA, 14 nt, Homo sapiens
aagaguuacuuaau

SEQ ID NO: 1826176 - RNA, 15 nt, Homo sapiens
cacaucccucucugc

SEQ ID NO: 1826177 - RNA, 16 nt, Homo sapiens
ggcagacacauuguca

SEQ ID NO: 1826178 - RNA, 21 nt, Homo sapiens
aaauccuugagauguggguau

SEQ ID NO: 1826179 - RNA, 24 nt, Homo sapiens
guccucacaucuuucacacuucca

SEQ ID NO: 1826180 - RNA, 17 nt, Homo sapiens
auucuauuaccuuguga

SEQ ID NO: 1826181 - RNA, 11 nt, Homo sapiens
caucaucccag

SEQ ID NO: 1826182 - RNA, 19 nt, Homo sapiens
ccaccccccacucagugcc

SEQ ID NO: 1826183 - RNA, 21 nt, Homo sapiens
cauuuagaacuugcagcugau

SEQ ID NO: 1826184 - RNA, 21 nt, Homo sapiens
caugcaagacuucacugcagc

SEQ ID NO: 1826185 - RNA, 14 nt, Homo sapiens
uuuauuuacuucgu

SEQ ID NO: 1826186 - RNA, 13 nt, Homo sapiens
ucuggcugcagag

SEQ ID NO: 1826187 - RNA, 22 nt, Homo sapiens
cagucuuggcucacuacagccu

SEQ ID NO: 1826188 - RNA, 21 nt, Homo sapiens
uaaauaaugaauaaacugaau

SEQ ID NO: 1826189 - RNA, 15 nt, Homo sapiens
gcgaaagcaguggcu

SEQ ID NO: 1826190 - RNA, 15 nt, Homo sapiens
cucagaauauaccca

SEQ ID NO: 1826191 - RNA, 13 nt, Homo sapiens
agccuacuuuuca

SEQ ID NO: 1826192 - RNA, 15 nt, Homo sapiens
gcagcuaacaauguc

SEQ ID NO: 1826193 - RNA, 12 nt, Homo sapiens
ccaagugaagca

SEQ ID NO: 1826194 - RNA, 18 nt, Homo sapiens
uugcaugaugucuaccuc

SEQ ID NO: 1826195 - RNA, 13 nt, Homo sapiens
caauaugcaaugu

SEQ ID NO: 1826196 - RNA, 12 nt, Homo sapiens
aucauacuucca

SEQ ID NO: 1826197 - RNA, 17 nt, Homo sapiens
acaaauaaucacauuga

SEQ ID NO: 1826198 - RNA, 17 nt, Homo sapiens
ccuaagacuuauguauu

SEQ ID NO: 1826199 - RNA, 21 nt, Homo sapiens
uccaucacuagccaugauaac

SEQ ID NO: 1826200 - RNA, 16 nt, Homo sapiens
gaauaauaugaugcca

SEQ ID NO: 1826201 - RNA, 19 nt, Homo sapiens
cccaggugcgugugucucu

SEQ ID NO: 1826202 - RNA, 18 nt, Homo sapiens
ugggccucugauguucuu

SEQ ID NO: 1826203 - RNA, 21 nt, Homo sapiens
acagauuucaaaaaaaaaccc

SEQ ID NO: 1826204 - RNA, 13 nt, Homo sapiens
uccuggacaacaa

SEQ ID NO: 1826205 - RNA, 24 nt, Homo sapiens
ggauaucaucuuuucuaaucucuu

SEQ ID NO: 1826206 - RNA, 17 nt, Homo sapiens
agaaaaaccugugauuc

SEQ ID NO: 1826207 - RNA, 16 nt, Homo sapiens
cuucccucacaccgcg

SEQ ID NO: 1826208 - RNA, 11 nt, Homo sapiens
cugccauuucc

SEQ ID NO: 1826209 - RNA, 14 nt, Homo sapiens
aucuguuuguaauc

SEQ ID NO: 1826210 - RNA, 19 nt, Homo sapiens
aaaaauuccuuaaacagug

SEQ ID NO: 1826211 - RNA, 20 nt, Homo sapiens
aaaacaauuguaauaaugcu

SEQ ID NO: 1826212 - RNA, 16 nt, Homo sapiens
gagggagacugcaaau

SEQ ID NO: 1826213 - RNA, 14 nt, Homo sapiens
ugauccaguggaca

SEQ ID NO: 1826214 - RNA, 14 nt, Homo sapiens
aauaucaaagucau

SEQ ID NO: 1826215 - RNA, 20 nt, Homo sapiens
gaauuuuucuuccucuccac

SEQ ID NO: 1826216 - RNA, 17 nt, Homo sapiens
uguagcuacauuuucag

SEQ ID NO: 1826217 - RNA, 17 nt, Homo sapiens
gacgacaagugcugaac

SEQ ID NO: 1826218 - RNA, 22 nt, Homo sapiens
gcucuucagaugccacuucuaa

SEQ ID NO: 1826219 - RNA, 13 nt, Homo sapiens
ggcugagugcagc

SEQ ID NO: 1826220 - RNA, 18 nt, Homo sapiens
uuuagaaaucacaacaaa

SEQ ID NO: 1826221 - RNA, 13 nt, Homo sapiens
gaucauugccauc

SEQ ID NO: 1826222 - RNA, 16 nt, Homo sapiens
caaaacugugcuuuua

SEQ ID NO: 1826223 - RNA, 17 nt, Homo sapiens
gccuuucucucuuucuc

SEQ ID NO: 1826224 - RNA, 17 nt, Homo sapiens
auauuuuagcauuuuaa

SEQ ID NO: 1826225 - RNA, 14 nt, Homo sapiens
guuuuauuacacau

SEQ ID NO: 1826226 - RNA, 12 nt, Homo sapiens
cucuccaccuca

SEQ ID NO: 1826227 - RNA, 16 nt, Homo sapiens
accauguuagccuuag

SEQ ID NO: 1826228 - RNA, 14 nt, Homo sapiens
cuacugauaacgua

SEQ ID NO: 1826229 - RNA, 22 nt, Homo sapiens
ucuccugcgugugcccacugaa

SEQ ID NO: 1826230 - RNA, 19 nt, Homo sapiens
gacugcuugugagaccauu

SEQ ID NO: 1826231 - RNA, 14 nt, Homo sapiens
aggaaggggugcug

SEQ ID NO: 1826232 - RNA, 23 nt, Homo sapiens
uuuaagggggaaaacuguucucu

SEQ ID NO: 1826233 - RNA, 16 nt, Homo sapiens
ugccuugcacacaggu

SEQ ID NO: 1826234 - RNA, 21 nt, Homo sapiens
augaccacauagaacaugugu

SEQ ID NO: 1826235 - RNA, 23 nt, Homo sapiens
caggcuucugucaauuucauuau

SEQ ID NO: 1826236 - RNA, 19 nt, Homo sapiens
ugugcacaucuacaugcca

SEQ ID NO: 1826237 - RNA, 22 nt, Homo sapiens
gguagccagcacacagggcagu

SEQ ID NO: 1826238 - RNA, 20 nt, Homo sapiens
gcacaagaagugguccaucu

SEQ ID NO: 1826239 - RNA, 16 nt, Homo sapiens
uccuuucauuuacugu

SEQ ID NO: 1826240 - RNA, 14 nt, Homo sapiens
guauagauguugcu

SEQ ID NO: 1826241 - RNA, 19 nt, Homo sapiens
auauaggccagaguugcaa

SEQ ID NO: 1826242 - RNA, 16 nt, Homo sapiens
guuggcaugcauccca

SEQ ID NO: 1826243 - RNA, 16 nt, Homo sapiens
auaauucauagugaua

SEQ ID NO: 1826244 - RNA, 17 nt, Homo sapiens
cuuuugagaauguuuga

SEQ ID NO: 1826245 - RNA, 11 nt, Homo sapiens
uauaucuguaa

SEQ ID NO: 1826246 - RNA, 12 nt, Homo sapiens
accaucucaggc

SEQ ID NO: 1826247 - RNA, 12 nt, Homo sapiens
uccaucucuggc

SEQ ID NO: 1826248 - RNA, 19 nt, Homo sapiens
aggcacccaccaccaugcc

SEQ ID NO: 1826249 - RNA, 12 nt, Homo sapiens
ugugcugugagu

SEQ ID NO: 1826250 - RNA, 18 nt, Homo sapiens
caauaaauguugcaaugc

SEQ ID NO: 1826251 - RNA, 18 nt, Homo sapiens
ucauccugcuugacugua

SEQ ID NO: 1826252 - RNA, 16 nt, Homo sapiens
ucuauaccaccuucaa

SEQ ID NO: 1826253 - RNA, 11 nt, Homo sapiens
gaaaauuacac

SEQ ID NO: 1826254 - RNA, 17 nt, Homo sapiens
uucucagugaaauaacu

SEQ ID NO: 1826255 - RNA, 11 nt, Homo sapiens
uuccuaaacau

SEQ ID NO: 1826256 - RNA, 15 nt, Homo sapiens
cuguggaugcugcug

SEQ ID NO: 1826257 - RNA, 20 nt, Homo sapiens
gagcuguugagguaccucca

SEQ ID NO: 1826258 - RNA, 12 nt, Homo sapiens
gcagcuggagau

SEQ ID NO: 1826259 - RNA, 19 nt, Homo sapiens
cagaaggcucgccucuccc

SEQ ID NO: 1826260 - RNA, 20 nt, Homo sapiens
agacuguggcuagugacaaa

SEQ ID NO: 1826261 - RNA, 20 nt, Homo sapiens
gagcaacucccucucagcua

SEQ ID NO: 1826262 - RNA, 17 nt, Homo sapiens
uagaacuuauaugaauu

SEQ ID NO: 1826263 - RNA, 19 nt, Homo sapiens
uugcauaacagcaggguac

SEQ ID NO: 1826264 - RNA, 16 nt, Homo sapiens
cugcucacugcucaca

SEQ ID NO: 1826265 - RNA, 19 nt, Homo sapiens
caaucuggcuuagugccac

SEQ ID NO: 1826266 - RNA, 16 nt, Homo sapiens
uuccaacugggcauuu

SEQ ID NO: 1826267 - RNA, 18 nt, Homo sapiens
caaaguccuuuuuuucca

SEQ ID NO: 1826268 - RNA, 16 nt, Homo sapiens
aaauuuugaaaacugu

SEQ ID NO: 1826269 - RNA, 23 nt, Homo sapiens
gcugaagcuguguccucaugagg

SEQ ID NO: 1826270 - RNA, 10 nt, Homo sapiens
gccagucuca

SEQ ID NO: 1826271 - RNA, 16 nt, Homo sapiens
aggaaagaaacuugca

SEQ ID NO: 1826272 - RNA, 23 nt, Homo sapiens
gguucugaaaguggcucuucuaa

SEQ ID NO: 1826273 - RNA, 16 nt, Homo sapiens
caguaacauagcugug

SEQ ID NO: 1826274 - RNA, 16 nt, Homo sapiens
uaaauguuuauacugu

SEQ ID NO: 1826275 - RNA, 22 nt, Homo sapiens
acuggucacaggcaaaguccag

SEQ ID NO: 1826276 - RNA, 13 nt, Homo sapiens
ugcuagcaguaaa

SEQ ID NO: 1826277 - RNA, 15 nt, Homo sapiens
ucaaauuucagacca

SEQ ID NO: 1826278 - RNA, 18 nt, Homo sapiens
uaaacaugucacaauaca

SEQ ID NO: 1826279 - RNA, 14 nt, Homo sapiens
acccucccaaaaca

SEQ ID NO: 1826280 - RNA, 24 nt, Homo sapiens
ccuagcuuagugaaaagauagcca

SEQ ID NO: 1826281 - RNA, 22 nt, Homo sapiens
cuacauugacgagcaugagcug

SEQ ID NO: 1826282 - RNA, 16 nt, Homo sapiens
ucgucuucagcugcau

SEQ ID NO: 1826283 - RNA, 19 nt, Homo sapiens
uguugauaauuucagggaa

SEQ ID NO: 1826284 - RNA, 16 nt, Homo sapiens
cuggagggguguugua

SEQ ID NO: 1826285 - RNA, 18 nt, Homo sapiens
uggcaggacccugucagg

SEQ ID NO: 1826286 - RNA, 20 nt, Homo sapiens
ccuugcugggguccagggcu

SEQ ID NO: 1826287 - RNA, 21 nt, Homo sapiens
ggcugaagcgagcccucagga

SEQ ID NO: 1826288 - RNA, 17 nt, Homo sapiens
aucuugaguugcagcuc

SEQ ID NO: 1826289 - RNA, 11 nt, Homo sapiens
accugaugcug

SEQ ID NO: 1826290 - RNA, 13 nt, Homo sapiens
uaaagucucugcu

SEQ ID NO: 1826291 - RNA, 13 nt, Homo sapiens
uaacuucucugag

SEQ ID NO: 1826292 - RNA, 21 nt, Homo sapiens
uacauccauuuugauauacca

SEQ ID NO: 1826293 - RNA, 18 nt, Homo sapiens
gacacuuuuuggacucaa

SEQ ID NO: 1826294 - RNA, 22 nt, Homo sapiens
ugccauggaacuguuuccuuca

SEQ ID NO: 1826295 - RNA, 21 nt, Homo sapiens
aggucauaaguuucugagaug

SEQ ID NO: 1826296 - RNA, 19 nt, Homo sapiens
uuguauaaggaaagccaaa

SEQ ID NO: 1826297 - RNA, 21 nt, Homo sapiens
ucuucugacauuuaucaggca

SEQ ID NO: 1826298 - RNA, 14 nt, Homo sapiens
uuguaauaaacucu

SEQ ID NO: 1826299 - RNA, 21 nt, Homo sapiens
acaucagaaguuugcaucucg

SEQ ID NO: 1826300 - RNA, 16 nt, Homo sapiens
ugagcccccauuccac

SEQ ID NO: 1826301 - RNA, 18 nt, Homo sapiens
guuuaaagauucuaugcc

SEQ ID NO: 1826302 - RNA, 13 nt, Homo sapiens
ucucaucacugaa

SEQ ID NO: 1826303 - RNA, 15 nt, Homo sapiens
ugcauguggcacuua

SEQ ID NO: 1826304 - RNA, 22 nt, Homo sapiens
caugugcgcgcgugcaugugug

SEQ ID NO: 1826305 - RNA, 12 nt, Homo sapiens
gcccugcaccug

SEQ ID NO: 1826306 - RNA, 19 nt, Homo sapiens
auuaguuuggguucucuac

SEQ ID NO: 1826307 - RNA, 16 nt, Homo sapiens
auuggaagcugucaua

SEQ ID NO: 1826308 - RNA, 11 nt, Homo sapiens
gaucugaugaa

SEQ ID NO: 1826309 - RNA, 19 nt, Homo sapiens
gacuuccgagcuaugucag

SEQ ID NO: 1826310 - RNA, 21 nt, Homo sapiens
cauaauuuucuucaugcaaug

SEQ ID NO: 1826311 - RNA, 16 nt, Homo sapiens
auugguugcauccagg

SEQ ID NO: 1826312 - RNA, 16 nt, Homo sapiens
gcucuagggaaucugg

SEQ ID NO: 1826313 - RNA, 21 nt, Homo sapiens
agggccaggccucucccuccu

SEQ ID NO: 1826314 - RNA, 18 nt, Homo sapiens
cauaauaaauaucuguac

SEQ ID NO: 1826315 - RNA, 20 nt, Homo sapiens
uguuaucuuauacuguacaa

SEQ ID NO: 1826316 - RNA, 19 nt, Homo sapiens
cuguaauuccagcuacuca

SEQ ID NO: 1826317 - RNA, 17 nt, Homo sapiens
uugaagacauaucaugu

SEQ ID NO: 1826318 - RNA, 14 nt, Homo sapiens
acgacuucugccca

SEQ ID NO: 1826319 - RNA, 15 nt, Homo sapiens
ggccucagggaccaa

SEQ ID NO: 1826320 - RNA, 19 nt, Homo sapiens
gggcuggcucccagggugg

SEQ ID NO: 1826321 - RNA, 12 nt, Homo sapiens
ccccagagccac

SEQ ID NO: 1826322 - RNA, 22 nt, Homo sapiens
ccagacugcagguuggacccca

SEQ ID NO: 1826323 - RNA, 18 nt, Homo sapiens
cauggccauuucugugga

SEQ ID NO: 1826324 - RNA, 21 nt, Homo sapiens
guuuaauuaacuaugugaugu

SEQ ID NO: 1826325 - RNA, 20 nt, Homo sapiens
acugaacaaaaccuacacac

SEQ ID NO: 1826326 - RNA, 17 nt, Homo sapiens
uaugaagaaucugcucu

SEQ ID NO: 1826327 - RNA, 19 nt, Homo sapiens
aaucuuauuccucagugag

SEQ ID NO: 1826328 - RNA, 18 nt, Homo sapiens
gaagagacucucuuaggg

SEQ ID NO: 1826329 - RNA, 21 nt, Homo sapiens
augcaaaugcacucaucacaa

SEQ ID NO: 1826330 - RNA, 19 nt, Homo sapiens
ugggccgggguguggaauc

SEQ ID NO: 1826331 - RNA, 20 nt, Homo sapiens
uuuuaaguuucucugcagaa

SEQ ID NO: 1826332 - RNA, 21 nt, Homo sapiens
ggucccuccucucaccucucc

SEQ ID NO: 1826333 - RNA, 15 nt, Homo sapiens
ccuuccuugccagug

SEQ ID NO: 1826334 - RNA, 23 nt, Homo sapiens
cuggugaggguccucuuccucaa

SEQ ID NO: 1826335 - RNA, 18 nt, Homo sapiens
aauuuaaaaaaagcaaaa

SEQ ID NO: 1826336 - RNA, 14 nt, Homo sapiens
uacuuaaacuucca

SEQ ID NO: 1826337 - RNA, 14 nt, Homo sapiens
aaucaaagcacuug

SEQ ID NO: 1826338 - RNA, 20 nt, Homo sapiens
uccaaagaagguguuuuccu

SEQ ID NO: 1826339 - RNA, 22 nt, Homo sapiens
cugugccucggcuuuucucagc

SEQ ID NO: 1826340 - RNA, 19 nt, Homo sapiens
cuguaaaacuaaacauaca

SEQ ID NO: 1826341 - RNA, 15 nt, Homo sapiens
ggccugccaaugcca

SEQ ID NO: 1826342 - RNA, 20 nt, Homo sapiens
uccgccuugcugagacuuac

SEQ ID NO: 1826343 - RNA, 16 nt, Homo sapiens
accuucguccuuuuaa

SEQ ID NO: 1826344 - RNA, 21 nt, Homo sapiens
guuuccuauuugcaguuacuu

SEQ ID NO: 1826345 - RNA, 13 nt, Homo sapiens
cugaccccagugc

SEQ ID NO: 1826346 - RNA, 20 nt, Homo sapiens
caagugugugugcaauguuc

SEQ ID NO: 1826347 - RNA, 15 nt, Homo sapiens
gcccggggccagcuu

SEQ ID NO: 1826348 - RNA, 22 nt, Homo sapiens
cauccuuucuuuuaaugaugcc

SEQ ID NO: 1826349 - RNA, 22 nt, Homo sapiens
gcucuuucucugagaaccaaaa

SEQ ID NO: 1826350 - RNA, 13 nt, Homo sapiens
gacucuccauuua

SEQ ID NO: 1826351 - RNA, 21 nt, Homo sapiens
uacaucugcaauaugaauuca

SEQ ID NO: 1826352 - RNA, 16 nt, Homo sapiens
aacauggccagcaaau

SEQ ID NO: 1826353 - RNA, 22 nt, Homo sapiens
ugcuggaaagaaaacacacucc

SEQ ID NO: 1826354 - RNA, 22 nt, Homo sapiens
cugugugcaagugugugcacau

SEQ ID NO: 1826355 - RNA, 21 nt, Homo sapiens
ccaaauaaaacuugagcccac

SEQ ID NO: 1826356 - RNA, 14 nt, Homo sapiens
ugaagugauguugu

SEQ ID NO: 1826357 - RNA, 16 nt, Homo sapiens
caaaucucacuguauu

SEQ ID NO: 1826358 - RNA, 23 nt, Homo sapiens
ugaccuuuuaagugaaaaucuga

SEQ ID NO: 1826359 - RNA, 15 nt, Homo sapiens
gcuggugcacaugac

SEQ ID NO: 1826360 - RNA, 20 nt, Homo sapiens
gcuccggaggggacccagcu

SEQ ID NO: 1826361 - RNA, 15 nt, Homo sapiens
cuuuggaacuuuaau

SEQ ID NO: 1826362 - RNA, 12 nt, Homo sapiens
aucaaccuucaa

SEQ ID NO: 1826363 - RNA, 23 nt, Homo sapiens
gaucaucuuugccaccaccuggg

SEQ ID NO: 1826364 - RNA, 13 nt, Homo sapiens
aguugcugucagu

SEQ ID NO: 1826365 - RNA, 13 nt, Homo sapiens
gugaggcacugug

SEQ ID NO: 1826366 - RNA, 20 nt, Homo sapiens
cauaaucucuuugaagguuu

SEQ ID NO: 1826367 - RNA, 13 nt, Homo sapiens
uuaaauaagcaaa

SEQ ID NO: 1826368 - RNA, 14 nt, Homo sapiens
aaguaucacucuaa

SEQ ID NO: 1826369 - RNA, 15 nt, Homo sapiens
acaucacagcuuauu

SEQ ID NO: 1826370 - RNA, 13 nt, Homo sapiens
cuucauagguaga

SEQ ID NO: 1826371 - RNA, 19 nt, Homo sapiens
ggaacauguaguuuuacuu

SEQ ID NO: 1826372 - RNA, 20 nt, Homo sapiens
cagugaugcuggaugcuccu

SEQ ID NO: 1826373 - RNA, 13 nt, Homo sapiens
caucaacuuaaaa

SEQ ID NO: 1826374 - RNA, 17 nt, Homo sapiens
cacagcuacagcuuucu

SEQ ID NO: 1826375 - RNA, 21 nt, Homo sapiens
ucugauuuuccuggacaguuu

SEQ ID NO: 1826376 - RNA, 21 nt, Homo sapiens
caaaguauaaauuuguguaau

SEQ ID NO: 1826377 - RNA, 18 nt, Homo sapiens
cuuuuucauauuucuacc

SEQ ID NO: 1826378 - RNA, 13 nt, Homo sapiens
cuuauuaaaugga

SEQ ID NO: 1826379 - RNA, 14 nt, Homo sapiens
ccucacuguguugg

SEQ ID NO: 1826380 - RNA, 17 nt, Homo sapiens
uggggcuugaauuugca

SEQ ID NO: 1826381 - RNA, 21 nt, Homo sapiens
ucuguggaaguagcuuugaac

SEQ ID NO: 1826382 - RNA, 22 nt, Homo sapiens
caaaaagggauccguacauuca

SEQ ID NO: 1826383 - RNA, 21 nt, Homo sapiens
gauucauucucauaauuccua

SEQ ID NO: 1826384 - RNA, 15 nt, Homo sapiens
uagucuguuugcaaa

SEQ ID NO: 1826385 - RNA, 21 nt, Homo sapiens
agacauagccgauucucugcc

SEQ ID NO: 1826386 - RNA, 22 nt, Homo sapiens
auaguuauuguuuuauguucua

SEQ ID NO: 1826387 - RNA, 20 nt, Homo sapiens
caggaacagcaaaugcaaaa

SEQ ID NO: 1826388 - RNA, 20 nt, Homo sapiens
accaucuggaauuccagucu

SEQ ID NO: 1826389 - RNA, 17 nt, Homo sapiens
auucaggaaauguucac

SEQ ID NO: 1826390 - RNA, 23 nt, Homo sapiens
gacuuuauguuguaugauuccaa

SEQ ID NO: 1826391 - RNA, 22 nt, Homo sapiens
agccaaguuauauugaauauau

SEQ ID NO: 1826392 - RNA, 22 nt, Homo sapiens
caaccugcugaagggcagaggu

SEQ ID NO: 1826393 - RNA, 16 nt, Homo sapiens
cuuucagucccaaagc

SEQ ID NO: 1826394 - RNA, 20 nt, Homo sapiens
gccccucugcacccuuauca

SEQ ID NO: 1826395 - RNA, 21 nt, Homo sapiens
ugccucaccucucaccuccca

SEQ ID NO: 1826396 - RNA, 13 nt, Homo sapiens
ucaagucuggauc

SEQ ID NO: 1826397 - RNA, 21 nt, Homo sapiens
gaacuggccacuccccagugc

SEQ ID NO: 1826398 - RNA, 20 nt, Homo sapiens
augauggccuuacacugaaa

SEQ ID NO: 1826399 - RNA, 15 nt, Homo sapiens
agccuuuccaaguca

SEQ ID NO: 1826400 - RNA, 15 nt, Homo sapiens
agcucuuuacuguaa

SEQ ID NO: 1826401 - RNA, 19 nt, Homo sapiens
aagaagccucacacguaaa

SEQ ID NO: 1826402 - RNA, 20 nt, Homo sapiens
ugucauuaucaaaagugauc

SEQ ID NO: 1826403 - RNA, 23 nt, Homo sapiens
uggucuauuuucugcagaaauuu

SEQ ID NO: 1826404 - RNA, 18 nt, Homo sapiens
cauugccuucuggagcug

SEQ ID NO: 1826405 - RNA, 19 nt, Homo sapiens
acaugaguucaaauacuuu

SEQ ID NO: 1826406 - RNA, 14 nt, Homo sapiens
cuggccacgcagcc

SEQ ID NO: 1826407 - RNA, 22 nt, Homo sapiens
ggagcuguguaccaaucgucuc

SEQ ID NO: 1826408 - RNA, 19 nt, Homo sapiens
guggggcacggagggcagu

SEQ ID NO: 1826409 - RNA, 13 nt, Homo sapiens
aggcagggaccua

SEQ ID NO: 1826410 - RNA, 18 nt, Homo sapiens
ggccaggggacacuguau

SEQ ID NO: 1826411 - RNA, 16 nt, Homo sapiens
aucucuguaaaccacu

SEQ ID NO: 1826412 - RNA, 18 nt, Homo sapiens
aaucuauauuugucuucc

SEQ ID NO: 1826413 - RNA, 23 nt, Homo sapiens
ucaaugcaagagugauugcagcu

SEQ ID NO: 1826414 - RNA, 11 nt, Homo sapiens
ugcaagcuuuu

SEQ ID NO: 1826415 - RNA, 19 nt, Homo sapiens
uuucaaauauugaaugccu

SEQ ID NO: 1826416 - RNA, 12 nt, Homo sapiens
ugcuguggguuc

SEQ ID NO: 1826417 - RNA, 20 nt, Homo sapiens
agaacuuagggaggaccauu

SEQ ID NO: 1826418 - RNA, 16 nt, Homo sapiens
uacuuuggacuaaaga

SEQ ID NO: 1826419 - RNA, 18 nt, Homo sapiens
aaauguauaccaaggcaa

SEQ ID NO: 1826420 - RNA, 15 nt, Homo sapiens
uuagacucaaagaau

SEQ ID NO: 1826421 - RNA, 14 nt, Homo sapiens
gaaggcagagccau

SEQ ID NO: 1826422 - RNA, 23 nt, Homo sapiens
cuauuguggguuuuuuugaaugu

SEQ ID NO: 1826423 - RNA, 12 nt, Homo sapiens
acaggacuuuua

SEQ ID NO: 1826424 - RNA, 15 nt, Homo sapiens
aaauguuggagugga

SEQ ID NO: 1826425 - RNA, 13 nt, Homo sapiens
ugagauucuucag

SEQ ID NO: 1826426 - RNA, 17 nt, Homo sapiens
uuuccucaaaacuggag

SEQ ID NO: 1826427 - RNA, 22 nt, Homo sapiens
acaggcuaguucuaauucccua

SEQ ID NO: 1826428 - RNA, 17 nt, Homo sapiens
ccuugguaaaaacugca

SEQ ID NO: 1826429 - RNA, 16 nt, Homo sapiens
cacaccaaaccagaca

SEQ ID NO: 1826430 - RNA, 17 nt, Homo sapiens
uaagugcuaagugcuua

SEQ ID NO: 1826431 - RNA, 15 nt, Homo sapiens
uggaccuaacauucg

SEQ ID NO: 1826432 - RNA, 15 nt, Homo sapiens
cucaauucugucuca

SEQ ID NO: 1826433 - RNA, 23 nt, Homo sapiens
ucuuugacugaagccgugccugu

SEQ ID NO: 1826434 - RNA, 18 nt, Homo sapiens
aaaacccacaauugaacu

SEQ ID NO: 1826435 - RNA, 20 nt, Homo sapiens
ugaaaugcucuuuugcacaa

SEQ ID NO: 1826436 - RNA, 21 nt, Homo sapiens
aagagggucuuccuaagaaga

SEQ ID NO: 1826437 - RNA, 22 nt, Homo sapiens
aaacacuauauggcagugucuu

SEQ ID NO: 1826438 - RNA, 16 nt, Homo sapiens
ucucuucggaagaccu

SEQ ID NO: 1826439 - RNA, 11 nt, Homo sapiens
uaagacacaaa

SEQ ID NO: 1826440 - RNA, 18 nt, Homo sapiens
ucuauaaaagaauugcac

SEQ ID NO: 1826441 - RNA, 18 nt, Homo sapiens
uccuccugauccugacac

SEQ ID NO: 1826442 - RNA, 16 nt, Homo sapiens
ugaacucaccauagag

SEQ ID NO: 1826443 - RNA, 23 nt, Homo sapiens
ccgaggaguccaguuugugcaag

SEQ ID NO: 1826444 - RNA, 13 nt, Homo sapiens
ucauucaucauga

SEQ ID NO: 1826445 - RNA, 19 nt, Homo sapiens
cauuugaaccagugaucca

SEQ ID NO: 1826446 - RNA, 18 nt, Homo sapiens
ugcauguuuuaugugcac

SEQ ID NO: 1826447 - RNA, 18 nt, Homo sapiens
cucuuuccaugacaucaa

SEQ ID NO: 1826448 - RNA, 15 nt, Homo sapiens
acaggagaccuggca

SEQ ID NO: 1826449 - RNA, 14 nt, Homo sapiens
accuguacucuucc

SEQ ID NO: 1826450 - RNA, 21 nt, Homo sapiens
auugcucagcccgcuuggcca

SEQ ID NO: 1826451 - RNA, 13 nt, Homo sapiens
gcugaaaauggag

SEQ ID NO: 1826452 - RNA, 16 nt, Homo sapiens
augaggcucuguaacc

SEQ ID NO: 1826453 - RNA, 19 nt, Homo sapiens
aagugaccuauaccugugu

SEQ ID NO: 1826454 - RNA, 24 nt, Homo sapiens
ucccccagcccugucaugugccuu

SEQ ID NO: 1826455 - RNA, 17 nt, Homo sapiens
gguaauucuagccuuuu

SEQ ID NO: 1826456 - RNA, 19 nt, Homo sapiens
guucugaauaugcugcuca

SEQ ID NO: 1826457 - RNA, 13 nt, Homo sapiens
aggcagccacuuc

SEQ ID NO: 1826458 - RNA, 21 nt, Homo sapiens
caagaaucagucuauccacag

SEQ ID NO: 1826459 - RNA, 14 nt, Homo sapiens
aucgggccaucuca

SEQ ID NO: 1826460 - RNA, 14 nt, Homo sapiens
aaauggccaaagca

SEQ ID NO: 1826461 - RNA, 12 nt, Homo sapiens
ugcuagagccag

SEQ ID NO: 1826462 - RNA, 15 nt, Homo sapiens
cauaaugacagagag

SEQ ID NO: 1826463 - RNA, 15 nt, Homo sapiens
aaaucuccaagaccu

SEQ ID NO: 1826464 - RNA, 12 nt, Homo sapiens
uccacuuuuugu

SEQ ID NO: 1826465 - RNA, 16 nt, Homo sapiens
uauuuuuuauauauac

SEQ ID NO: 1826466 - RNA, 23 nt, Homo sapiens
gagaaaacagauaaugauagugu

SEQ ID NO: 1826467 - RNA, 17 nt, Homo sapiens
guaccccccuaccacac

SEQ ID NO: 1826468 - RNA, 19 nt, Homo sapiens
guaaaagcaccauugugaa

SEQ ID NO: 1826469 - RNA, 16 nt, Homo sapiens
acugguauuaacuuua

SEQ ID NO: 1826470 - RNA, 14 nt, Homo sapiens
auaugucaaaggcu

SEQ ID NO: 1826471 - RNA, 23 nt, Homo sapiens
uccacacugaagaacauguccua

SEQ ID NO: 1826472 - RNA, 15 nt, Homo sapiens
uccugaugaugcugg

SEQ ID NO: 1826473 - RNA, 16 nt, Homo sapiens
ugcaaccaucaccaga

SEQ ID NO: 1826474 - RNA, 16 nt, Homo sapiens
guguuuagaagccuaa

SEQ ID NO: 1826475 - RNA, 18 nt, Homo sapiens
agcaggagagacugagca

SEQ ID NO: 1826476 - RNA, 14 nt, Homo sapiens
uuaugcacugccug

SEQ ID NO: 1826477 - RNA, 21 nt, Homo sapiens
cacagaggcgggucuauaaca

SEQ ID NO: 1826478 - RNA, 14 nt, Homo sapiens
cguauuacaagaga

SEQ ID NO: 1826479 - RNA, 18 nt, Homo sapiens
cucuaaugugucucucac

SEQ ID NO: 1826480 - RNA, 16 nt, Homo sapiens
caguucucugccaaag

SEQ ID NO: 1826481 - RNA, 13 nt, Homo sapiens
uaucuuugauucu

SEQ ID NO: 1826482 - RNA, 10 nt, Homo sapiens
cagcaucuga

SEQ ID NO: 1826483 - RNA, 20 nt, Homo sapiens
auggaagguuagguuuguca

SEQ ID NO: 1826484 - RNA, 13 nt, Homo sapiens
ugucacacucugu

SEQ ID NO: 1826485 - RNA, 14 nt, Homo sapiens
uggaaaccuuuuca

SEQ ID NO: 1826486 - RNA, 14 nt, Homo sapiens
ccgcugucucugag

SEQ ID NO: 1826487 - RNA, 18 nt, Homo sapiens
auaggcuaugccaugugc

SEQ ID NO: 1826488 - RNA, 15 nt, Homo sapiens
guucgcauggcagcc

SEQ ID NO: 1826489 - RNA, 21 nt, Homo sapiens
uuaagcuuccgccgucucaac

SEQ ID NO: 1826490 - RNA, 22 nt, Homo sapiens
cacuaaagggugcccacaaaau

SEQ ID NO: 1826491 - RNA, 16 nt, Homo sapiens
uggauuuaugacauua

SEQ ID NO: 1826492 - RNA, 20 nt, Homo sapiens
auucuuuaaauuucaucuca

SEQ ID NO: 1826493 - RNA, 22 nt, Homo sapiens
gauugaggguucaccucugccu

SEQ ID NO: 1826494 - RNA, 17 nt, Homo sapiens
gcaaggccugugcugca

SEQ ID NO: 1826495 - RNA, 16 nt, Homo sapiens
aaaagacauucuucca

SEQ ID NO: 1826496 - RNA, 17 nt, Homo sapiens
aaaaaauaacaaugaaa

SEQ ID NO: 1826497 - RNA, 15 nt, Homo sapiens
aauuaucugcauuua

SEQ ID NO: 1826498 - RNA, 15 nt, Homo sapiens
aaauaacugcuuuaa

SEQ ID NO: 1826499 - RNA, 19 nt, Homo sapiens
uggaugaggagacagaaua

SEQ ID NO: 1826500 - RNA, 22 nt, Homo sapiens
cccuagugggagcccagcacac

SEQ ID NO: 1826501 - RNA, 15 nt, Homo sapiens
ucacaguaauguguc

SEQ ID NO: 1826502 - RNA, 20 nt, Homo sapiens
agggaaagggggcuaguccc

SEQ ID NO: 1826503 - RNA, 14 nt, Homo sapiens
cuuucucaaagagg

SEQ ID NO: 1826504 - RNA, 21 nt, Homo sapiens
cuacccuuuuccuuugugguu

SEQ ID NO: 1826505 - RNA, 13 nt, Homo sapiens
agcuuucucucag

SEQ ID NO: 1826506 - RNA, 15 nt, Homo sapiens
cccgcaucaagguca

SEQ ID NO: 1826507 - RNA, 23 nt, Homo sapiens
uacguauuuuuucuaaugugcau

SEQ ID NO: 1826508 - RNA, 15 nt, Homo sapiens
gaccccuuguuacuc

SEQ ID NO: 1826509 - RNA, 15 nt, Homo sapiens
aaagaaaauauaguc

SEQ ID NO: 1826510 - RNA, 13 nt, Homo sapiens
gaauaaagagggu

SEQ ID NO: 1826511 - RNA, 23 nt, Homo sapiens
agcgguccaacgccgccuuggcc

SEQ ID NO: 1826512 - RNA, 17 nt, Homo sapiens
ccuuuugaagagcuuuu

SEQ ID NO: 1826513 - RNA, 12 nt, Homo sapiens
ccaucagacugu

SEQ ID NO: 1826514 - RNA, 16 nt, Homo sapiens
augggcagaaaaaugg

SEQ ID NO: 1826515 - RNA, 18 nt, Homo sapiens
ugggcagcuaagcagucu

SEQ ID NO: 1826516 - RNA, 14 nt, Homo sapiens
uucugagccauuca

SEQ ID NO: 1826517 - RNA, 22 nt, Homo sapiens
auuugucacaaauaaacauaau

SEQ ID NO: 1826518 - RNA, 16 nt, Homo sapiens
agaccccggcuuccuu

SEQ ID NO: 1826519 - RNA, 21 nt, Homo sapiens
ccugauguuuuucuguguuac

SEQ ID NO: 1826520 - RNA, 19 nt, Homo sapiens
guccuguuaugucauugug

SEQ ID NO: 1826521 - RNA, 22 nt, Homo sapiens
uuagaaacuccaaugaaagaca

SEQ ID NO: 1826522 - RNA, 19 nt, Homo sapiens
uaugaccauuugacuguuc

SEQ ID NO: 1826523 - RNA, 13 nt, Homo sapiens
cgccuccaugacu

SEQ ID NO: 1826524 - RNA, 14 nt, Homo sapiens
aggcuggcccugcc

SEQ ID NO: 1826525 - RNA, 22 nt, Homo sapiens
ugaccaaaaucaggaaccacag

SEQ ID NO: 1826526 - RNA, 19 nt, Homo sapiens
ggcuauugaagaugcugcc

SEQ ID NO: 1826527 - RNA, 23 nt, Homo sapiens
gcccugggcugggugcugggaag

SEQ ID NO: 1826528 - RNA, 16 nt, Homo sapiens
uuuggaugucuuugcu

SEQ ID NO: 1826529 - RNA, 12 nt, Homo sapiens
uacacuguauau

SEQ ID NO: 1826530 - RNA, 16 nt, Homo sapiens
aaccggucacccagga

SEQ ID NO: 1826531 - RNA, 22 nt, Homo sapiens
uaacaaugucuucuugaaauuu

SEQ ID NO: 1826532 - RNA, 15 nt, Homo sapiens
ucaaguugugcuugu

SEQ ID NO: 1826533 - RNA, 18 nt, Homo sapiens
guuucacaaacuacaaag

SEQ ID NO: 1826534 - RNA, 14 nt, Homo sapiens
ugguguguuacaca

SEQ ID NO: 1826535 - RNA, 13 nt, Homo sapiens
caccccagugugc

SEQ ID NO: 1826536 - RNA, 14 nt, Homo sapiens
cucaagcagucuac

SEQ ID NO: 1826537 - RNA, 23 nt, Homo sapiens
auuuuguucuuuuuucuuaccac

SEQ ID NO: 1826538 - RNA, 23 nt, Homo sapiens
gcaaucaaguccuacaagcuaaa

SEQ ID NO: 1826539 - RNA, 16 nt, Homo sapiens
uguccugaucugugau

SEQ ID NO: 1826540 - RNA, 15 nt, Homo sapiens
cuaggaggagggggu

SEQ ID NO: 1826541 - RNA, 15 nt, Homo sapiens
auuuauuaacaggau

SEQ ID NO: 1826542 - RNA, 20 nt, Homo sapiens
uucccuguaugauuccuuga

SEQ ID NO: 1826543 - RNA, 19 nt, Homo sapiens
gaaauaaagcguccucuca

SEQ ID NO: 1826544 - RNA, 21 nt, Homo sapiens
cccuccgguuaucaagcaaaa

SEQ ID NO: 1826545 - RNA, 17 nt, Homo sapiens
cuagaaacugacacaug

SEQ ID NO: 1826546 - RNA, 13 nt, Homo sapiens
aaugauacaguau

SEQ ID NO: 1826547 - RNA, 13 nt, Homo sapiens
aauauuacaguga

SEQ ID NO: 1826548 - RNA, 16 nt, Homo sapiens
cuaaaguauaacaugu

SEQ ID NO: 1826549 - RNA, 16 nt, Homo sapiens
uaaucauccccauccu

SEQ ID NO: 1826550 - RNA, 20 nt, Homo sapiens
ucagucaucuccaaaaacag

SEQ ID NO: 1826551 - RNA, 22 nt, Homo sapiens
agcauuauuuuuuguugaauag

SEQ ID NO: 1826552 - RNA, 12 nt, Homo sapiens
aguacuggcaca

SEQ ID NO: 1826553 - RNA, 19 nt, Homo sapiens
acaucucagaaaacucugg

SEQ ID NO: 1826554 - RNA, 17 nt, Homo sapiens
cugagccagcccuccuu

SEQ ID NO: 1826555 - RNA, 19 nt, Homo sapiens
uggaguguuauguauuucc

SEQ ID NO: 1826556 - RNA, 15 nt, Homo sapiens
aucugccucuauuca

SEQ ID NO: 1826557 - RNA, 14 nt, Homo sapiens
guauuccugucauu

SEQ ID NO: 1826558 - RNA, 11 nt, Homo sapiens
ccgaaacacca

SEQ ID NO: 1826559 - RNA, 15 nt, Homo sapiens
gaaaauuaacacugc

SEQ ID NO: 1826560 - RNA, 18 nt, Homo sapiens
aucucacuuaauacagau

SEQ ID NO: 1826561 - RNA, 15 nt, Homo sapiens
ccaggugagcucuga

SEQ ID NO: 1826562 - RNA, 22 nt, Homo sapiens
uuugucccaucgguagcuugaa

SEQ ID NO: 1826563 - RNA, 15 nt, Homo sapiens
aauugagaaagcuua

SEQ ID NO: 1826564 - RNA, 19 nt, Homo sapiens
ccuaacguuuucuacuuug

SEQ ID NO: 1826565 - RNA, 11 nt, Homo sapiens
caacauugugu

SEQ ID NO: 1826566 - RNA, 17 nt, Homo sapiens
uaugucagcagcucuga

SEQ ID NO: 1826567 - RNA, 15 nt, Homo sapiens
agccaagcucugcag

SEQ ID NO: 1826568 - RNA, 15 nt, Homo sapiens
accccaucugugaau

SEQ ID NO: 1826569 - RNA, 19 nt, Homo sapiens
gauacuugccaaaaugaga

SEQ ID NO: 1826570 - RNA, 20 nt, Homo sapiens
aagccuagcccuucucucau

SEQ ID NO: 1826571 - RNA, 13 nt, Homo sapiens
uggcuucacauuc

SEQ ID NO: 1826572 - RNA, 15 nt, Homo sapiens
uggguggagggugag

SEQ ID NO: 1826573 - RNA, 16 nt, Homo sapiens
accuccacccagugau

SEQ ID NO: 1826574 - RNA, 20 nt, Homo sapiens
ucagaaucacuucugagaac

SEQ ID NO: 1826575 - RNA, 17 nt, Homo sapiens
uauuguccgggcucaga

SEQ ID NO: 1826576 - RNA, 13 nt, Homo sapiens
cacguguccugua

SEQ ID NO: 1826577 - RNA, 19 nt, Homo sapiens
cuguaagauaauguugcuu

SEQ ID NO: 1826578 - RNA, 21 nt, Homo sapiens
ggccaggccauggccaagggg

SEQ ID NO: 1826579 - RNA, 22 nt, Homo sapiens
caggucuucucuccaacucuuc

SEQ ID NO: 1826580 - RNA, 21 nt, Homo sapiens
gcuuucauguaaacugugcac

SEQ ID NO: 1826581 - RNA, 20 nt, Homo sapiens
uagaaucagccuagggguca

SEQ ID NO: 1826582 - RNA, 23 nt, Homo sapiens
cuugaaauuuggcuaauaacaaa

SEQ ID NO: 1826583 - RNA, 17 nt, Homo sapiens
cugucuuugucaccacg

SEQ ID NO: 1826584 - RNA, 20 nt, Homo sapiens
cccuguucccuguccuacca

SEQ ID NO: 1826585 - RNA, 14 nt, Homo sapiens
gcacagauguuccc

SEQ ID NO: 1826586 - RNA, 13 nt, Homo sapiens
agaagaaacugac

SEQ ID NO: 1826587 - RNA, 12 nt, Homo sapiens
gcugaacacugg

SEQ ID NO: 1826588 - RNA, 18 nt, Homo sapiens
aauucugagccugauauu

SEQ ID NO: 1826589 - RNA, 13 nt, Homo sapiens
cucuuaucuauga

SEQ ID NO: 1826590 - RNA, 19 nt, Homo sapiens
uugggcaaggacaccauag

SEQ ID NO: 1826591 - RNA, 16 nt, Homo sapiens
ccucugacccuccuuc

SEQ ID NO: 1826592 - RNA, 14 nt, Homo sapiens
uguacuuguuugcu

SEQ ID NO: 1826593 - RNA, 21 nt, Homo sapiens
ggaguucacuucaucuucuca

SEQ ID NO: 1826594 - RNA, 22 nt, Homo sapiens
ggugggcccccaaugacaccca

SEQ ID NO: 1826595 - RNA, 12 nt, Homo sapiens
uauguugcaaga

SEQ ID NO: 1826596 - RNA, 14 nt, Homo sapiens
auuucacagugugu

SEQ ID NO: 1826597 - RNA, 16 nt, Homo sapiens
ucagaaacgaaaucua

SEQ ID NO: 1826598 - RNA, 15 nt, Homo sapiens
ucggugugcugccaa

SEQ ID NO: 1826599 - RNA, 17 nt, Homo sapiens
ccuuguuccuguuacaa

SEQ ID NO: 1826600 - RNA, 15 nt, Homo sapiens
cuugguucaucagug

SEQ ID NO: 1826601 - RNA, 14 nt, Homo sapiens
agacuugugugaug

SEQ ID NO: 1826602 - RNA, 16 nt, Homo sapiens
agccaggagaugcugg

SEQ ID NO: 1826603 - RNA, 21 nt, Homo sapiens
ugaacaaaauguaaagccagc

SEQ ID NO: 1826604 - RNA, 20 nt, Homo sapiens
cucuuguuucuuuucacaua

SEQ ID NO: 1826605 - RNA, 14 nt, Homo sapiens
aaucagcaggaugu

SEQ ID NO: 1826606 - RNA, 14 nt, Homo sapiens
aaacagcagguugu

SEQ ID NO: 1826607 - RNA, 13 nt, Homo sapiens
acagauaaugucu

SEQ ID NO: 1826608 - RNA, 12 nt, Homo sapiens
ugcuuccuccca

SEQ ID NO: 1826609 - RNA, 19 nt, Homo sapiens
ccacaauuauuggcaaagu

SEQ ID NO: 1826610 - RNA, 16 nt, Homo sapiens
gguuugggcugucuua

SEQ ID NO: 1826611 - RNA, 19 nt, Homo sapiens
caggaggggaacugaguca

SEQ ID NO: 1826612 - RNA, 11 nt, Homo sapiens
auccuauuuau

SEQ ID NO: 1826613 - RNA, 15 nt, Homo sapiens
gccuuccagccacau

SEQ ID NO: 1826614 - RNA, 16 nt, Homo sapiens
cuccuauaaucuguca

SEQ ID NO: 1826615 - RNA, 18 nt, Homo sapiens
ucuuccuuuucacugcug

SEQ ID NO: 1826616 - RNA, 23 nt, Homo sapiens
cacaacacagagcugcuauuaaa

SEQ ID NO: 1826617 - RNA, 14 nt, Homo sapiens
caguaggagaggau

SEQ ID NO: 1826618 - RNA, 17 nt, Homo sapiens
gacaacaauccaaaaaa

SEQ ID NO: 1826619 - RNA, 13 nt, Homo sapiens
cuaugaucuuggc

SEQ ID NO: 1826620 - RNA, 13 nt, Homo sapiens
cuggcugcugcug

SEQ ID NO: 1826621 - RNA, 15 nt, Homo sapiens
ccagccugggugaca

SEQ ID NO: 1826622 - RNA, 15 nt, Homo sapiens
auuuuccuuggcaau

SEQ ID NO: 1826623 - RNA, 23 nt, Homo sapiens
caaaguggaaggaaagaugcuca

SEQ ID NO: 1826624 - RNA, 15 nt, Homo sapiens
caucuggauuucauc

SEQ ID NO: 1826625 - RNA, 23 nt, Homo sapiens
cuauuuuuuaauaaaaguacuga

SEQ ID NO: 1826626 - RNA, 12 nt, Homo sapiens
ggaggcugagau

SEQ ID NO: 1826627 - RNA, 24 nt, Homo sapiens
ccauauggaggccucacacccaga

SEQ ID NO: 1826628 - RNA, 19 nt, Homo sapiens
aagcaccugcaugugcugu

SEQ ID NO: 1826629 - RNA, 16 nt, Homo sapiens
aauuuuugaguagcau

SEQ ID NO: 1826630 - RNA, 17 nt, Homo sapiens
uccaacaguugcuaaac

SEQ ID NO: 1826631 - RNA, 19 nt, Homo sapiens
ucaacaaacauuugcugaa

SEQ ID NO: 1826632 - RNA, 21 nt, Homo sapiens
cuguagggaaaaaaaugcuuc

SEQ ID NO: 1826633 - RNA, 15 nt, Homo sapiens
acugauuugauacca

SEQ ID NO: 1826634 - RNA, 12 nt, Homo sapiens
cugacacaggaa

SEQ ID NO: 1826635 - RNA, 12 nt, Homo sapiens
cuaucacagggu

SEQ ID NO: 1826636 - RNA, 15 nt, Homo sapiens
ccaguuacucaggag

SEQ ID NO: 1826637 - RNA, 16 nt, Homo sapiens
cugccccagcuuuauc

SEQ ID NO: 1826638 - RNA, 15 nt, Homo sapiens
caauugggagagaaa

SEQ ID NO: 1826639 - RNA, 22 nt, Homo sapiens
ucacaucucccuuccaccucac

SEQ ID NO: 1826640 - RNA, 22 nt, Homo sapiens
agcccgacuuagccagcccugg

SEQ ID NO: 1826641 - RNA, 15 nt, Homo sapiens
auguaaaaugcaaaa

SEQ ID NO: 1826642 - RNA, 19 nt, Homo sapiens
agugcugggauuacaggcg

SEQ ID NO: 1826643 - RNA, 21 nt, Homo sapiens
aaaaauagccugccucuucuc

SEQ ID NO: 1826644 - RNA, 16 nt, Homo sapiens
agacccauaccuuucc

SEQ ID NO: 1826645 - RNA, 22 nt, Homo sapiens
uucucugccuugguauagcaua

SEQ ID NO: 1826646 - RNA, 21 nt, Homo sapiens
cugaaacgagaagugcccuua

SEQ ID NO: 1826647 - RNA, 14 nt, Homo sapiens
uucacggagacagc

SEQ ID NO: 1826648 - RNA, 15 nt, Homo sapiens
uccauauuugccuug

SEQ ID NO: 1826649 - RNA, 23 nt, Homo sapiens
augcuggcauuugcaccuaccuc

SEQ ID NO: 1826650 - RNA, 23 nt, Homo sapiens
uagguuuuuuuccuucugaagug

SEQ ID NO: 1826651 - RNA, 12 nt, Homo sapiens
gcuggauuugua

SEQ ID NO: 1826652 - RNA, 15 nt, Homo sapiens
ugagccaaagccaga

SEQ ID NO: 1826653 - RNA, 19 nt, Homo sapiens
agucaaggacgaauuugca

SEQ ID NO: 1826654 - RNA, 21 nt, Homo sapiens
ccuucuggccgcugcagucag

SEQ ID NO: 1826655 - RNA, 14 nt, Homo sapiens
gacgaaccuugaaa

SEQ ID NO: 1826656 - RNA, 12 nt, Homo sapiens
gauuacaggugc

SEQ ID NO: 1826657 - RNA, 15 nt, Homo sapiens
cuaagaaagacauca

SEQ ID NO: 1826658 - RNA, 14 nt, Homo sapiens
acacugcuaaugaa

SEQ ID NO: 1826659 - RNA, 22 nt, Homo sapiens
ggaagguagcccagcacuguga

SEQ ID NO: 1826660 - RNA, 13 nt, Homo sapiens
uaaauugcagaug

SEQ ID NO: 1826661 - RNA, 13 nt, Homo sapiens
agcauugcuacug

SEQ ID NO: 1826662 - RNA, 12 nt, Homo sapiens
guaugcuuccag

SEQ ID NO: 1826663 - RNA, 16 nt, Homo sapiens
gcaauauggaagcaac

SEQ ID NO: 1826664 - RNA, 14 nt, Homo sapiens
acccugcccugggc

SEQ ID NO: 1826665 - RNA, 15 nt, Homo sapiens
cuggaugcccaggaa

SEQ ID NO: 1826666 - RNA, 17 nt, Homo sapiens
uccuaugccugucuuua

SEQ ID NO: 1826667 - RNA, 17 nt, Homo sapiens
uuuaaguaguaagaaua

SEQ ID NO: 1826668 - RNA, 14 nt, Homo sapiens
ccauuuaccuggaa

SEQ ID NO: 1826669 - RNA, 19 nt, Homo sapiens
gcccccacagcuccuugca

SEQ ID NO: 1826670 - RNA, 21 nt, Homo sapiens
cuuuagcaguuuccucaguga

SEQ ID NO: 1826671 - RNA, 22 nt, Homo sapiens
ggcugcagcgcccggugcucug

SEQ ID NO: 1826672 - RNA, 19 nt, Homo sapiens
cacgcuguuuguuucauau

SEQ ID NO: 1826673 - RNA, 22 nt, Homo sapiens
caagacaccuuuuguauuuaaa

SEQ ID NO: 1826674 - RNA, 13 nt, Homo sapiens
ucucucugagcug

SEQ ID NO: 1826675 - RNA, 16 nt, Homo sapiens
auaccuuuuuguguca

SEQ ID NO: 1826676 - RNA, 15 nt, Homo sapiens
ugucuggccaggccu

SEQ ID NO: 1826677 - RNA, 17 nt, Homo sapiens
ucuuuagagguaugauu

SEQ ID NO: 1826678 - RNA, 19 nt, Homo sapiens
ccccucgcuucauaggcag

SEQ ID NO: 1826679 - RNA, 14 nt, Homo sapiens
uggccugccagaca

SEQ ID NO: 1826680 - RNA, 18 nt, Homo sapiens
agagauggggaaggcuuu

SEQ ID NO: 1826681 - RNA, 14 nt, Homo sapiens
cucauuuugcucaa

SEQ ID NO: 1826682 - RNA, 18 nt, Homo sapiens
ccagucugauauucaccu

SEQ ID NO: 1826683 - RNA, 16 nt, Homo sapiens
cugcccccaauccaug

SEQ ID NO: 1826684 - RNA, 18 nt, Homo sapiens
ucaacacaaagacaugga

SEQ ID NO: 1826685 - RNA, 17 nt, Homo sapiens
ccucaagccccauuucc

SEQ ID NO: 1826686 - RNA, 13 nt, Homo sapiens
cucccaggaccaa

SEQ ID NO: 1826687 - RNA, 22 nt, Homo sapiens
uauuuguuaauaguuccugcua

SEQ ID NO: 1826688 - RNA, 15 nt, Homo sapiens
gcccagggcauccca

SEQ ID NO: 1826689 - RNA, 13 nt, Homo sapiens
uaucccucucuuc

SEQ ID NO: 1826690 - RNA, 18 nt, Homo sapiens
cugccucuuggcuucuca

SEQ ID NO: 1826691 - RNA, 13 nt, Homo sapiens
gaaugacacuguu

SEQ ID NO: 1826692 - RNA, 15 nt, Homo sapiens
uaaaccgaaaguguu

SEQ ID NO: 1826693 - RNA, 16 nt, Homo sapiens
aaggcagccaccagcg

SEQ ID NO: 1826694 - RNA, 20 nt, Homo sapiens
caccugggccgggcuguaga

SEQ ID NO: 1826695 - RNA, 21 nt, Homo sapiens
cauucuccucaugcuuagaaa

SEQ ID NO: 1826696 - RNA, 11 nt, Homo sapiens
cugcagucucu

SEQ ID NO: 1826697 - RNA, 14 nt, Homo sapiens
ucuauaaaaugagg

SEQ ID NO: 1826698 - RNA, 23 nt, Homo sapiens
gaauguagcccuuccaacaccug

SEQ ID NO: 1826699 - RNA, 14 nt, Homo sapiens
ucagguugugcauu

SEQ ID NO: 1826700 - RNA, 16 nt, Homo sapiens
ccagaccccguggcuc

SEQ ID NO: 1826701 - RNA, 15 nt, Homo sapiens
aaauacucuaauucu

SEQ ID NO: 1826702 - RNA, 14 nt, Homo sapiens
uauaacaacaauga

SEQ ID NO: 1826703 - RNA, 16 nt, Homo sapiens
cuaaugauuagcacuu

SEQ ID NO: 1826704 - RNA, 19 nt, Homo sapiens
ugcauccccuuggcuguga

SEQ ID NO: 1826705 - RNA, 17 nt, Homo sapiens
agaauuccugaagccag

SEQ ID NO: 1826706 - RNA, 20 nt, Homo sapiens
ucccuuggaaccuuuguacg

SEQ ID NO: 1826707 - RNA, 23 nt, Homo sapiens
ucaagcagacauagaagagccaa

SEQ ID NO: 1826708 - RNA, 14 nt, Homo sapiens
auaucuuauguuaa

SEQ ID NO: 1826709 - RNA, 15 nt, Homo sapiens
aacaccagaacugug

SEQ ID NO: 1826710 - RNA, 23 nt, Homo sapiens
cagaacuucacagugacacugga

SEQ ID NO: 1826711 - RNA, 19 nt, Homo sapiens
uugaaaacaaacaaaucaa

SEQ ID NO: 1826712 - RNA, 20 nt, Homo sapiens
cuuaaagaauaauacuuaga

SEQ ID NO: 1826713 - RNA, 17 nt, Homo sapiens
auuguuaugcacuuuuc

SEQ ID NO: 1826714 - RNA, 15 nt, Homo sapiens
gugccagcacaaagu

SEQ ID NO: 1826715 - RNA, 16 nt, Homo sapiens
ccuuuuguauacaucc

SEQ ID NO: 1826716 - RNA, 19 nt, Homo sapiens
uaaaagugaucuacaugag

SEQ ID NO: 1826717 - RNA, 19 nt, Homo sapiens
ugucauuauuccaucuucu

SEQ ID NO: 1826718 - RNA, 22 nt, Homo sapiens
gcuccuuauucccaguguucca

SEQ ID NO: 1826719 - RNA, 14 nt, Homo sapiens
ucaauaaagcacug

SEQ ID NO: 1826720 - RNA, 18 nt, Homo sapiens
gcaagccugucugagacu

SEQ ID NO: 1826721 - RNA, 18 nt, Homo sapiens
guccaucucaagugccau

SEQ ID NO: 1826722 - RNA, 23 nt, Homo sapiens
gauacuuugauaauuaaggccag

SEQ ID NO: 1826723 - RNA, 14 nt, Homo sapiens
uccagaggccaugu

SEQ ID NO: 1826724 - RNA, 21 nt, Homo sapiens
ccuguccccaaaaugugaugc

SEQ ID NO: 1826725 - RNA, 21 nt, Homo sapiens
uaugcuugcucuaagucaaau

SEQ ID NO: 1826726 - RNA, 19 nt, Homo sapiens
agccuccccaccuucuuca

SEQ ID NO: 1826727 - RNA, 19 nt, Homo sapiens
auucaagaggaauuccagc

SEQ ID NO: 1826728 - RNA, 17 nt, Homo sapiens
uucccuaggggacacuu

SEQ ID NO: 1826729 - RNA, 14 nt, Homo sapiens
acccccagcacuug

SEQ ID NO: 1826730 - RNA, 18 nt, Homo sapiens
guaucuuugcacuccaau

SEQ ID NO: 1826731 - RNA, 14 nt, Homo sapiens
cuuucaaagcauuu

SEQ ID NO: 1826732 - RNA, 19 nt, Homo sapiens
ugaacacuuauaagugaag

SEQ ID NO: 1826733 - RNA, 16 nt, Homo sapiens
gccugugccaggugag

SEQ ID NO: 1826734 - RNA, 15 nt, Homo sapiens
cuuucaggaacacuc

SEQ ID NO: 1826735 - RNA, 24 nt, Homo sapiens
agcaauuucccccuaaaccaacug

SEQ ID NO: 1826736 - RNA, 20 nt, Homo sapiens
gggcugcccacaaggcuugu

SEQ ID NO: 1826737 - RNA, 20 nt, Homo sapiens
ugcuagauaauaaaauugcu

SEQ ID NO: 1826738 - RNA, 16 nt, Homo sapiens
uuauauauguaucuaa

SEQ ID NO: 1826739 - RNA, 23 nt, Homo sapiens
uaccucauggaugcuuuggcaau

SEQ ID NO: 1826740 - RNA, 14 nt, Homo sapiens
gagcaguagcugga

SEQ ID NO: 1826741 - RNA, 13 nt, Homo sapiens
acagcuucagcca

SEQ ID NO: 1826742 - RNA, 15 nt, Homo sapiens
ugcccugacaugcac

SEQ ID NO: 1826743 - RNA, 21 nt, Homo sapiens
cuuuaagggcaugccuugugc

SEQ ID NO: 1826744 - RNA, 14 nt, Homo sapiens
uucaaguuugucac

SEQ ID NO: 1826745 - RNA, 14 nt, Homo sapiens
aacuguugccagga

SEQ ID NO: 1826746 - RNA, 23 nt, Homo sapiens
auauguguaugcacaguaaaaau

SEQ ID NO: 1826747 - RNA, 17 nt, Homo sapiens
caucaacagcagggugg

SEQ ID NO: 1826748 - RNA, 13 nt, Homo sapiens
cugaagaagacca

SEQ ID NO: 1826749 - RNA, 22 nt, Homo sapiens
cagauccagggacugaagccaa

SEQ ID NO: 1826750 - RNA, 21 nt, Homo sapiens
cugaucaccuguuagcauugc

SEQ ID NO: 1826751 - RNA, 11 nt, Homo sapiens
auaugcaauau

SEQ ID NO: 1826752 - RNA, 11 nt, Homo sapiens
uuuugcaaaaa

SEQ ID NO: 1826753 - RNA, 11 nt, Homo sapiens
cacagugucug

SEQ ID NO: 1826754 - RNA, 17 nt, Homo sapiens
uugauaguaaggcaauc

SEQ ID NO: 1826755 - RNA, 15 nt, Homo sapiens
cucuggacacagccc

SEQ ID NO: 1826756 - RNA, 20 nt, Homo sapiens
agauguucuuuucuauuuau

SEQ ID NO: 1826757 - RNA, 19 nt, Homo sapiens
aaaagcaguucaugucuga

SEQ ID NO: 1826758 - RNA, 15 nt, Homo sapiens
uacaacaaacacugu

SEQ ID NO: 1826759 - RNA, 20 nt, Homo sapiens
uauuuccuuuaugugaauuu

SEQ ID NO: 1826760 - RNA, 20 nt, Homo sapiens
cacagccacacacacagaaa

SEQ ID NO: 1826761 - RNA, 12 nt, Homo sapiens
aaugacuuccau

SEQ ID NO: 1826762 - RNA, 14 nt, Homo sapiens
caaguucuucaccu

SEQ ID NO: 1826763 - RNA, 22 nt, Homo sapiens
auagagugaccuuuuaaucaga

SEQ ID NO: 1826764 - RNA, 15 nt, Homo sapiens
cagacuuccuugaga

SEQ ID NO: 1826765 - RNA, 14 nt, Homo sapiens
gcaguucacuuccu

SEQ ID NO: 1826766 - RNA, 17 nt, Homo sapiens
uucuguauuaacugaau

SEQ ID NO: 1826767 - RNA, 17 nt, Homo sapiens
cacacagagauaugcac

SEQ ID NO: 1826768 - RNA, 15 nt, Homo sapiens
uaucugggauucuac

SEQ ID NO: 1826769 - RNA, 22 nt, Homo sapiens
cuauaauuaguuaugacagcca

SEQ ID NO: 1826770 - RNA, 16 nt, Homo sapiens
aagauuaauguaggau

SEQ ID NO: 1826771 - RNA, 19 nt, Homo sapiens
ccacccaacccuaucuccu

SEQ ID NO: 1826772 - RNA, 19 nt, Homo sapiens
cuuaaggggauggggguca

SEQ ID NO: 1826773 - RNA, 15 nt, Homo sapiens
ucgcagcuacuaggg

SEQ ID NO: 1826774 - RNA, 17 nt, Homo sapiens
cugagaugcucacuuua

SEQ ID NO: 1826775 - RNA, 18 nt, Homo sapiens
ccagguacaggagaggca

SEQ ID NO: 1826776 - RNA, 17 nt, Homo sapiens
aguggacuuccuauuaa

SEQ ID NO: 1826777 - RNA, 14 nt, Homo sapiens
auuuccccaaugac

SEQ ID NO: 1826778 - RNA, 16 nt, Homo sapiens
ugaguaccccugcuuu

SEQ ID NO: 1826779 - RNA, 12 nt, Homo sapiens
agcuguuccucc

SEQ ID NO: 1826780 - RNA, 16 nt, Homo sapiens
cccacggguguggcuc

SEQ ID NO: 1826781 - RNA, 11 nt, Homo sapiens
auucauaacaa

SEQ ID NO: 1826782 - RNA, 12 nt, Homo sapiens
ucuuuaaucucc

SEQ ID NO: 1826783 - RNA, 13 nt, Homo sapiens
ggaucuaccagca

SEQ ID NO: 1826784 - RNA, 22 nt, Homo sapiens
gcuucaaauuauagaaacaaua

SEQ ID NO: 1826785 - RNA, 16 nt, Homo sapiens
cacugugucucauggu

SEQ ID NO: 1826786 - RNA, 15 nt, Homo sapiens
uggcucuacuuucag

SEQ ID NO: 1826787 - RNA, 16 nt, Homo sapiens
cuaacagugugauuca

SEQ ID NO: 1826788 - RNA, 15 nt, Homo sapiens
gccccacauugcacu

SEQ ID NO: 1826789 - RNA, 13 nt, Homo sapiens
ccccuucuguguu

SEQ ID NO: 1826790 - RNA, 15 nt, Homo sapiens
caccagaagugccau

SEQ ID NO: 1826791 - RNA, 15 nt, Homo sapiens
aagagaugcuggauu

SEQ ID NO: 1826792 - RNA, 19 nt, Homo sapiens
caguuuugucaaugcaguu

SEQ ID NO: 1826793 - RNA, 16 nt, Homo sapiens
auagcuaaguagcauc

SEQ ID NO: 1826794 - RNA, 13 nt, Homo sapiens
caggcgugaucca

SEQ ID NO: 1826795 - RNA, 13 nt, Homo sapiens
gcuaaaccauuca

SEQ ID NO: 1826796 - RNA, 15 nt, Homo sapiens
uuucauuagaaguua

SEQ ID NO: 1826797 - RNA, 17 nt, Homo sapiens
gguguucugugauauaa

SEQ ID NO: 1826798 - RNA, 19 nt, Homo sapiens
ucuucaauaugaaucuaua

SEQ ID NO: 1826799 - RNA, 15 nt, Homo sapiens
aguccagauuuacac

SEQ ID NO: 1826800 - RNA, 17 nt, Homo sapiens
ucuauaccuuacugcaa

SEQ ID NO: 1826801 - RNA, 21 nt, Homo sapiens
cuuguaccagcccaggcaaua

SEQ ID NO: 1826802 - RNA, 18 nt, Homo sapiens
gaaauguauucaccuuuc

SEQ ID NO: 1826803 - RNA, 11 nt, Homo sapiens
caaagcacuug

SEQ ID NO: 1826804 - RNA, 19 nt, Homo sapiens
auaguaggacugcugacau

SEQ ID NO: 1826805 - RNA, 23 nt, Homo sapiens
augacauuuuuccucucugcaaa

SEQ ID NO: 1826806 - RNA, 14 nt, Homo sapiens
gucauuucauucca

SEQ ID NO: 1826807 - RNA, 15 nt, Homo sapiens
guaaagcacaguccc

SEQ ID NO: 1826808 - RNA, 20 nt, Homo sapiens
ccaagggguagaaguggcau

SEQ ID NO: 1826809 - RNA, 22 nt, Homo sapiens
ccgucaccucagagacauacac

SEQ ID NO: 1826810 - RNA, 19 nt, Homo sapiens
aaguauggcagugggagac

SEQ ID NO: 1826811 - RNA, 18 nt, Homo sapiens
guagacugaaaagccaug

SEQ ID NO: 1826812 - RNA, 16 nt, Homo sapiens
uguagaccuguuucau

SEQ ID NO: 1826813 - RNA, 22 nt, Homo sapiens
gaaauuaauaaaacuuaucuga

SEQ ID NO: 1826814 - RNA, 17 nt, Homo sapiens
aacaugauugaaccauu

SEQ ID NO: 1826815 - RNA, 14 nt, Homo sapiens
caacuucaaguaua

SEQ ID NO: 1826816 - RNA, 15 nt, Homo sapiens
caggaggcuccagga

SEQ ID NO: 1826817 - RNA, 15 nt, Homo sapiens
gacacacagccuuuc

SEQ ID NO: 1826818 - RNA, 16 nt, Homo sapiens
cauagaauaguauucu

SEQ ID NO: 1826819 - RNA, 23 nt, Homo sapiens
acaucaacauggcaauugcacuc

SEQ ID NO: 1826820 - RNA, 18 nt, Homo sapiens
ugacagaguucacuauaa

SEQ ID NO: 1826821 - RNA, 13 nt, Homo sapiens
accuucuaaucca

SEQ ID NO: 1826822 - RNA, 18 nt, Homo sapiens
ucuaugguugacauugua

SEQ ID NO: 1826823 - RNA, 16 nt, Homo sapiens
auauuuuucugagauu

SEQ ID NO: 1826824 - RNA, 15 nt, Homo sapiens
uacuuugccauuaag

SEQ ID NO: 1826825 - RNA, 14 nt, Homo sapiens
cucucacagacaua

SEQ ID NO: 1826826 - RNA, 18 nt, Homo sapiens
gaggaagugauaguuucu

SEQ ID NO: 1826827 - RNA, 22 nt, Homo sapiens
ucauuuuuguaggaagcauuuu

SEQ ID NO: 1826828 - RNA, 21 nt, Homo sapiens
agacagugucgcuaagugcau

SEQ ID NO: 1826829 - RNA, 21 nt, Homo sapiens
acuuaaauaauaaacagugga

SEQ ID NO: 1826830 - RNA, 14 nt, Homo sapiens
agagucacuggaac

SEQ ID NO: 1826831 - RNA, 15 nt, Homo sapiens
accaacuacagaaag

SEQ ID NO: 1826832 - RNA, 16 nt, Homo sapiens
ggaaacuauucaugaa

SEQ ID NO: 1826833 - RNA, 20 nt, Homo sapiens
aguucucuugcuuucacauu

SEQ ID NO: 1826834 - RNA, 21 nt, Homo sapiens
uucugggaguucccugaacau

SEQ ID NO: 1826835 - RNA, 18 nt, Homo sapiens
gcuugauuccuguugaau

SEQ ID NO: 1826836 - RNA, 15 nt, Homo sapiens
aaacauuccugugaa

SEQ ID NO: 1826837 - RNA, 16 nt, Homo sapiens
cugcucccgucugucu

SEQ ID NO: 1826838 - RNA, 17 nt, Homo sapiens
cagguuaccacucuggc

SEQ ID NO: 1826839 - RNA, 21 nt, Homo sapiens
ggcaacuggaaaauacauguc

SEQ ID NO: 1826840 - RNA, 16 nt, Homo sapiens
gaccaaacuacuucau

SEQ ID NO: 1826841 - RNA, 22 nt, Homo sapiens
cugccuccuucccucggggcca

SEQ ID NO: 1826842 - RNA, 16 nt, Homo sapiens
uuugagguuuccuuca

SEQ ID NO: 1826843 - RNA, 18 nt, Homo sapiens
cauucugcaagcacaucu

SEQ ID NO: 1826844 - RNA, 23 nt, Homo sapiens
ucaggaaagagagcaccacguga

SEQ ID NO: 1826845 - RNA, 20 nt, Homo sapiens
acugcuaauucuguauuuau

SEQ ID NO: 1826846 - RNA, 16 nt, Homo sapiens
agaagccaacuaugau

SEQ ID NO: 1826847 - RNA, 21 nt, Homo sapiens
auagaguguuuuucauggaaa

SEQ ID NO: 1826848 - RNA, 18 nt, Homo sapiens
ccaaauguaacuauguuu

SEQ ID NO: 1826849 - RNA, 15 nt, Homo sapiens
ggcaugcaccagugc

SEQ ID NO: 1826850 - RNA, 19 nt, Homo sapiens
ggcucugucuacccagugc

SEQ ID NO: 1826851 - RNA, 17 nt, Homo sapiens
agacuccucaguucuug

SEQ ID NO: 1826852 - RNA, 13 nt, Homo sapiens
ucuguaaagucua

SEQ ID NO: 1826853 - RNA, 14 nt, Homo sapiens
uuggccguuugcuu

SEQ ID NO: 1826854 - RNA, 14 nt, Homo sapiens
auuacuguuuaauu

SEQ ID NO: 1826855 - RNA, 16 nt, Homo sapiens
cagacucaaaugcuca

SEQ ID NO: 1826856 - RNA, 16 nt, Homo sapiens
auuaaaaucuggaaau

SEQ ID NO: 1826857 - RNA, 23 nt, Homo sapiens
gcaucgggagcacccagagcacc

SEQ ID NO: 1826858 - RNA, 19 nt, Homo sapiens
aauguggcauuugugauca

SEQ ID NO: 1826859 - RNA, 16 nt, Homo sapiens
aaguauccaugcaugu

SEQ ID NO: 1826860 - RNA, 14 nt, Homo sapiens
gcacauuucuuugc

SEQ ID NO: 1826861 - RNA, 19 nt, Homo sapiens
uaagugaugugcugaauuu

SEQ ID NO: 1826862 - RNA, 17 nt, Homo sapiens
uugcuuauguaaucuca

SEQ ID NO: 1826863 - RNA, 19 nt, Homo sapiens
ugccaagggcaggaccaau

SEQ ID NO: 1826864 - RNA, 22 nt, Homo sapiens
ugacuguauuuuccaacuuguu

SEQ ID NO: 1826865 - RNA, 18 nt, Homo sapiens
accacggucacaccucac

SEQ ID NO: 1826866 - RNA, 22 nt, Homo sapiens
caucaugcggugggugcugcca

SEQ ID NO: 1826867 - RNA, 22 nt, Homo sapiens
uagaaaaugaggaaaugccaca

SEQ ID NO: 1826868 - RNA, 18 nt, Homo sapiens
gaacucucaagugucuua

SEQ ID NO: 1826869 - RNA, 16 nt, Homo sapiens
uuccuucagcaucuca

SEQ ID NO: 1826870 - RNA, 18 nt, Homo sapiens
caggaggggcuguccaau

SEQ ID NO: 1826871 - RNA, 14 nt, Homo sapiens
aacucaagguucua

SEQ ID NO: 1826872 - RNA, 14 nt, Homo sapiens
gcugguggcaauaa

SEQ ID NO: 1826873 - RNA, 14 nt, Homo sapiens
agcugcuacaagaa

SEQ ID NO: 1826874 - RNA, 15 nt, Homo sapiens
cauccccagccagaa

SEQ ID NO: 1826875 - RNA, 20 nt, Homo sapiens
agacuuagaaaaauccuaca

SEQ ID NO: 1826876 - RNA, 17 nt, Homo sapiens
aagucagguucuuuaca

SEQ ID NO: 1826877 - RNA, 12 nt, Homo sapiens
augcugcuuuaa

SEQ ID NO: 1826878 - RNA, 19 nt, Homo sapiens
cucuauaaaaaauauguau

SEQ ID NO: 1826879 - RNA, 18 nt, Homo sapiens
agauucuggguuugccca

SEQ ID NO: 1826880 - RNA, 15 nt, Homo sapiens
uguguaauacuucau

SEQ ID NO: 1826881 - RNA, 15 nt, Homo sapiens
aguguauuucuucaa

SEQ ID NO: 1826882 - RNA, 15 nt, Homo sapiens
uuacagugggccauu

SEQ ID NO: 1826883 - RNA, 20 nt, Homo sapiens
auugaucuguuuuacaggaa

SEQ ID NO: 1826884 - RNA, 17 nt, Homo sapiens
cugugugucuguccuga

SEQ ID NO: 1826885 - RNA, 23 nt, Homo sapiens
caucaggacuuucccugacagcu

SEQ ID NO: 1826886 - RNA, 18 nt, Homo sapiens
ccugacgacacugaagaa

SEQ ID NO: 1826887 - RNA, 12 nt, Homo sapiens
auagaccaaaga

SEQ ID NO: 1826888 - RNA, 11 nt, Homo sapiens
aauccccagac

SEQ ID NO: 1826889 - RNA, 13 nt, Homo sapiens
aacauugccugau

SEQ ID NO: 1826890 - RNA, 22 nt, Homo sapiens
cagguccucuacuuaaugagau

SEQ ID NO: 1826891 - RNA, 19 nt, Homo sapiens
ucauaugaauuagccaaaa

SEQ ID NO: 1826892 - RNA, 23 nt, Homo sapiens
ccccacccaacagccaccaagcc

SEQ ID NO: 1826893 - RNA, 17 nt, Homo sapiens
guucuacacucaucuua

SEQ ID NO: 1826894 - RNA, 16 nt, Homo sapiens
caccuagacuguaaac

SEQ ID NO: 1826895 - RNA, 19 nt, Homo sapiens
uugugggacacaacacaga

SEQ ID NO: 1826896 - RNA, 21 nt, Homo sapiens
ugcuuuguuuccauucuuguc

SEQ ID NO: 1826897 - RNA, 16 nt, Homo sapiens
cacauuucacauugaa

SEQ ID NO: 1826898 - RNA, 17 nt, Homo sapiens
cagacaugcugcccacc

SEQ ID NO: 1826899 - RNA, 16 nt, Homo sapiens
uucuaacugcuguuaa

SEQ ID NO: 1826900 - RNA, 17 nt, Homo sapiens
gcccagucgacgucagc

SEQ ID NO: 1826901 - RNA, 15 nt, Homo sapiens
ggaacacccccauga

SEQ ID NO: 1826902 - RNA, 16 nt, Homo sapiens
acgcuguccugagaug

SEQ ID NO: 1826903 - RNA, 22 nt, Homo sapiens
cuuuguggcaugugccuguaau

SEQ ID NO: 1826904 - RNA, 23 nt, Homo sapiens
ucuuccuccucgcugccagauga

SEQ ID NO: 1826905 - RNA, 20 nt, Homo sapiens
uucuugcucgggucccuuca

SEQ ID NO: 1826906 - RNA, 19 nt, Homo sapiens
cugagaaauuucugugcuu

SEQ ID NO: 1826907 - RNA, 23 nt, Homo sapiens
aggcuggaaggcagcaggcauuu

SEQ ID NO: 1826908 - RNA, 16 nt, Homo sapiens
acaaaacguaacuugc

SEQ ID NO: 1826909 - RNA, 20 nt, Homo sapiens
augaggccuuuccccagugu

SEQ ID NO: 1826910 - RNA, 21 nt, Homo sapiens
aauuauccauuacgugcauuu

SEQ ID NO: 1826911 - RNA, 21 nt, Homo sapiens
ucaccaggaggcggcagugca

SEQ ID NO: 1826912 - RNA, 20 nt, Homo sapiens
gaaauccguucuauuuugug

SEQ ID NO: 1826913 - RNA, 19 nt, Homo sapiens
caugugacuggcaguauua

SEQ ID NO: 1826914 - RNA, 19 nt, Homo sapiens
gaacauaaaaacuacugaa

SEQ ID NO: 1826915 - RNA, 18 nt, Homo sapiens
cuuuuuaaaaaaugcugg

SEQ ID NO: 1826916 - RNA, 13 nt, Homo sapiens
ugggauuacaggg

SEQ ID NO: 1826917 - RNA, 21 nt, Homo sapiens
guacaggacauguacugagac

SEQ ID NO: 1826918 - RNA, 22 nt, Homo sapiens
ccugguugagcuucugcuaaaa

SEQ ID NO: 1826919 - RNA, 19 nt, Homo sapiens
ucaccaagaaaacaugcaa

SEQ ID NO: 1826920 - RNA, 15 nt, Homo sapiens
cuccagauggugcua

SEQ ID NO: 1826921 - RNA, 11 nt, Homo sapiens
aaaugacaauu

SEQ ID NO: 1826922 - RNA, 18 nt, Homo sapiens
ccaacugaaggcuaaaaa

SEQ ID NO: 1826923 - RNA, 13 nt, Homo sapiens
guaauauaaugga

SEQ ID NO: 1826924 - RNA, 19 nt, Homo sapiens
guacuuucaaugaacauaa

SEQ ID NO: 1826925 - RNA, 19 nt, Homo sapiens
agucuugcaguuaucuuag

SEQ ID NO: 1826926 - RNA, 12 nt, Homo sapiens
ugugaaugaccu

SEQ ID NO: 1826927 - RNA, 20 nt, Homo sapiens
agcaauugacugucacuguu

SEQ ID NO: 1826928 - RNA, 18 nt, Homo sapiens
caugagugauucuugaca

SEQ ID NO: 1826929 - RNA, 17 nt, Homo sapiens
uugagaaauacuauaua

SEQ ID NO: 1826930 - RNA, 18 nt, Homo sapiens
agcaaacuggggcugugu

SEQ ID NO: 1826931 - RNA, 19 nt, Homo sapiens
cauugauucaguauuacaa

SEQ ID NO: 1826932 - RNA, 17 nt, Homo sapiens
uaccaacaucuggucuu

SEQ ID NO: 1826933 - RNA, 21 nt, Homo sapiens
ggcgcagacaggcggggccca

SEQ ID NO: 1826934 - RNA, 20 nt, Homo sapiens
acuuggugauuaccugaaag

SEQ ID NO: 1826935 - RNA, 16 nt, Homo sapiens
cauuuguuaaugcuuu

SEQ ID NO: 1826936 - RNA, 12 nt, Homo sapiens
agacaaugacuu

SEQ ID NO: 1826937 - RNA, 21 nt, Homo sapiens
augauuucaaaugcuguaacu

SEQ ID NO: 1826938 - RNA, 22 nt, Homo sapiens
ugagugggcgugguaccugcug

SEQ ID NO: 1826939 - RNA, 22 nt, Homo sapiens
uuguaagucagccacugggacc

SEQ ID NO: 1826940 - RNA, 19 nt, Homo sapiens
uguccagugagcaguguug

SEQ ID NO: 1826941 - RNA, 15 nt, Homo sapiens
uuccuggcaauagug

SEQ ID NO: 1826942 - RNA, 18 nt, Homo sapiens
aucccacuucacugugag

SEQ ID NO: 1826943 - RNA, 16 nt, Homo sapiens
auaaugcaccacuuuu

SEQ ID NO: 1826944 - RNA, 21 nt, Homo sapiens
auuccuuuucguuuagaauca

SEQ ID NO: 1826945 - RNA, 11 nt, Homo sapiens
cauucugccaa

SEQ ID NO: 1826946 - RNA, 23 nt, Homo sapiens
aacauccguuuucauuguucacu

SEQ ID NO: 1826947 - RNA, 21 nt, Homo sapiens
agaccuccagaaaucuauucc

SEQ ID NO: 1826948 - RNA, 20 nt, Homo sapiens
cccgggaggcagagguugua

SEQ ID NO: 1826949 - RNA, 20 nt, Homo sapiens
uucaguauguccccauaaga

SEQ ID NO: 1826950 - RNA, 16 nt, Homo sapiens
uacuccaggcuuccac

SEQ ID NO: 1826951 - RNA, 12 nt, Homo sapiens
auucuagcaccu

SEQ ID NO: 1826952 - RNA, 13 nt, Homo sapiens
cccucugcucuca

SEQ ID NO: 1826953 - RNA, 20 nt, Homo sapiens
ucccgaguagcugagauuau

SEQ ID NO: 1826954 - RNA, 12 nt, Homo sapiens
acaucauauguu

SEQ ID NO: 1826955 - RNA, 14 nt, Homo sapiens
auuccagugcagua

SEQ ID NO: 1826956 - RNA, 13 nt, Homo sapiens
caguuccaaaaga

SEQ ID NO: 1826957 - RNA, 16 nt, Homo sapiens
uacauuguaaucugcu

SEQ ID NO: 1826958 - RNA, 21 nt, Homo sapiens
aggagaaucacuugaacccag

SEQ ID NO: 1826959 - RNA, 20 nt, Homo sapiens
uagaaguacguuuuugcauu

SEQ ID NO: 1826960 - RNA, 21 nt, Homo sapiens
caugaugccgcucuucuguca

SEQ ID NO: 1826961 - RNA, 18 nt, Homo sapiens
gaggaagcaccucucagc

SEQ ID NO: 1826962 - RNA, 15 nt, Homo sapiens
uauuuauaaucacuu

SEQ ID NO: 1826963 - RNA, 12 nt, Homo sapiens
uuccauucuugg

SEQ ID NO: 1826964 - RNA, 21 nt, Homo sapiens
aauucucaagccgcaucccag

SEQ ID NO: 1826965 - RNA, 14 nt, Homo sapiens
ucaagaacugccau

SEQ ID NO: 1826966 - RNA, 19 nt, Homo sapiens
caaacagccucacuccuca

SEQ ID NO: 1826967 - RNA, 19 nt, Homo sapiens
acuacaguauuacucuuac

SEQ ID NO: 1826968 - RNA, 15 nt, Homo sapiens
auuuucuacacagcg

SEQ ID NO: 1826969 - RNA, 20 nt, Homo sapiens
gggaagcucccaccccacuc

SEQ ID NO: 1826970 - RNA, 23 nt, Homo sapiens
caccucccccuuucacacuggau

SEQ ID NO: 1826971 - RNA, 22 nt, Homo sapiens
uaccuauacaauguauguaauu

SEQ ID NO: 1826972 - RNA, 14 nt, Homo sapiens
aauauuuucuuccu

SEQ ID NO: 1826973 - RNA, 13 nt, Homo sapiens
gaguaaugcauga

SEQ ID NO: 1826974 - RNA, 15 nt, Homo sapiens
uaagaauaguucccu

SEQ ID NO: 1826975 - RNA, 17 nt, Homo sapiens
cacagcccugaaucaga

SEQ ID NO: 1826976 - RNA, 22 nt, Homo sapiens
aaugagugaaucaccuguggua

SEQ ID NO: 1826977 - RNA, 13 nt, Homo sapiens
gccaaugcagcua

SEQ ID NO: 1826978 - RNA, 15 nt, Homo sapiens
agucgguuagucauu

SEQ ID NO: 1826979 - RNA, 16 nt, Homo sapiens
aggaugugcauucucc

SEQ ID NO: 1826980 - RNA, 22 nt, Homo sapiens
uggcacagaugcccacguaugu

SEQ ID NO: 1826981 - RNA, 12 nt, Homo sapiens
uaguaacauuca

SEQ ID NO: 1826982 - RNA, 23 nt, Homo sapiens
gugaaggcagagaggagccagga

SEQ ID NO: 1826983 - RNA, 18 nt, Homo sapiens
uuugguucucuccaggaa

SEQ ID NO: 1826984 - RNA, 20 nt, Homo sapiens
uccuaaggaaacugcuuuau

SEQ ID NO: 1826985 - RNA, 19 nt, Homo sapiens
gaagugcuacagaaagcac

SEQ ID NO: 1826986 - RNA, 15 nt, Homo sapiens
aucuccucagcaccc

SEQ ID NO: 1826987 - RNA, 19 nt, Homo sapiens
agacgggguuucacugugu

SEQ ID NO: 1826988 - RNA, 14 nt, Homo sapiens
uggguacaaaaagu

SEQ ID NO: 1826989 - RNA, 22 nt, Homo sapiens
cuggagugcaguggcacgaucu

SEQ ID NO: 1826990 - RNA, 19 nt, Homo sapiens
ggaaaaagaaugaugcuau

SEQ ID NO: 1826991 - RNA, 14 nt, Homo sapiens
cacuguuccagucu

SEQ ID NO: 1826992 - RNA, 22 nt, Homo sapiens
gcauguuucaccacaacccugu

SEQ ID NO: 1826993 - RNA, 18 nt, Homo sapiens
augaaguaaggagaggga

SEQ ID NO: 1826994 - RNA, 17 nt, Homo sapiens
cccuucuggacacugag

SEQ ID NO: 1826995 - RNA, 14 nt, Homo sapiens
aggcuuucagcuua

SEQ ID NO: 1826996 - RNA, 12 nt, Homo sapiens
aguagcugcuac

SEQ ID NO: 1826997 - RNA, 16 nt, Homo sapiens
guuucuuagauaugau

SEQ ID NO: 1826998 - RNA, 22 nt, Homo sapiens
ccaugcuuguggccaaugcauc

SEQ ID NO: 1826999 - RNA, 13 nt, Homo sapiens
aaacuuaaaucuc

SEQ ID NO: 1827000 - RNA, 18 nt, Homo sapiens
aguuuaauagauguuacu

SEQ ID NO: 1827001 - RNA, 15 nt, Homo sapiens
aagcagagcuuccuc

SEQ ID NO: 1827002 - RNA, 19 nt, Homo sapiens
ggauaaucuguauucuugc

SEQ ID NO: 1827003 - RNA, 18 nt, Homo sapiens
uuagguauuauaaguaau

SEQ ID NO: 1827004 - RNA, 15 nt, Homo sapiens
cucagguaguacugg

SEQ ID NO: 1827005 - RNA, 16 nt, Homo sapiens
uccaguugcaauucau

SEQ ID NO: 1827006 - RNA, 11 nt, Homo sapiens
ucauacuguac

SEQ ID NO: 1827007 - RNA, 19 nt, Homo sapiens
ucuauguuguuugcccaau

SEQ ID NO: 1827008 - RNA, 20 nt, Homo sapiens
cuggccgcguuuagaccaag

SEQ ID NO: 1827009 - RNA, 19 nt, Homo sapiens
ugcaugacuuguagcauau

SEQ ID NO: 1827010 - RNA, 17 nt, Homo sapiens
ugaaauguaacaugaag

SEQ ID NO: 1827011 - RNA, 18 nt, Homo sapiens
agugggccugguagcaca

SEQ ID NO: 1827012 - RNA, 15 nt, Homo sapiens
gaaauaacauggccu

SEQ ID NO: 1827013 - RNA, 23 nt, Homo sapiens
aaacgugcauggauaugugccag

SEQ ID NO: 1827014 - RNA, 20 nt, Homo sapiens
aauuaguguugugcacuuca

SEQ ID NO: 1827015 - RNA, 16 nt, Homo sapiens
auuuuaaacagaggau

SEQ ID NO: 1827016 - RNA, 21 nt, Homo sapiens
uaguauugcagccaaagaaua

SEQ ID NO: 1827017 - RNA, 18 nt, Homo sapiens
auccauuaccuccaucca

SEQ ID NO: 1827018 - RNA, 24 nt, Homo sapiens
aaaccaccuggguucagccucucc

SEQ ID NO: 1827019 - RNA, 21 nt, Homo sapiens
aagacagauucuucacugugu

SEQ ID NO: 1827020 - RNA, 13 nt, Homo sapiens
ugaggcaggugag

SEQ ID NO: 1827021 - RNA, 15 nt, Homo sapiens
auauuucagugacag

SEQ ID NO: 1827022 - RNA, 22 nt, Homo sapiens
uaaauuauauuccucuugcauu

SEQ ID NO: 1827023 - RNA, 18 nt, Homo sapiens
uggacagaugaauaccuu

SEQ ID NO: 1827024 - RNA, 23 nt, Homo sapiens
uggagaacuugcucaagugcagg

SEQ ID NO: 1827025 - RNA, 13 nt, Homo sapiens
uaugggaagccau

SEQ ID NO: 1827026 - RNA, 14 nt, Homo sapiens
cacacagaaugcaa

SEQ ID NO: 1827027 - RNA, 17 nt, Homo sapiens
accagauugucagcucc

SEQ ID NO: 1827028 - RNA, 17 nt, Homo sapiens
cagcacguaguuugcau

SEQ ID NO: 1827029 - RNA, 14 nt, Homo sapiens
cgagaugaaauuaa

SEQ ID NO: 1827030 - RNA, 22 nt, Homo sapiens
auuuccuauuguucacuuuauu

SEQ ID NO: 1827031 - RNA, 22 nt, Homo sapiens
uccaggagaugaggcuggauag

SEQ ID NO: 1827032 - RNA, 20 nt, Homo sapiens
acuaugguggccaagggcag

SEQ ID NO: 1827033 - RNA, 16 nt, Homo sapiens
gcacuagaauauuuaa

SEQ ID NO: 1827034 - RNA, 23 nt, Homo sapiens
ggccucucucucucuccucagga

SEQ ID NO: 1827035 - RNA, 15 nt, Homo sapiens
acucaagcucaaaag

SEQ ID NO: 1827036 - RNA, 16 nt, Homo sapiens
gugcccagucuggcau

SEQ ID NO: 1827037 - RNA, 21 nt, Homo sapiens
augcuuccuugccugaugaca

SEQ ID NO: 1827038 - RNA, 17 nt, Homo sapiens
uucuagccuuagacaaa

SEQ ID NO: 1827039 - RNA, 13 nt, Homo sapiens
uagcaaauucaaa

SEQ ID NO: 1827040 - RNA, 13 nt, Homo sapiens
auggccuugucua

SEQ ID NO: 1827041 - RNA, 18 nt, Homo sapiens
uuaugauccuucacauuc

SEQ ID NO: 1827042 - RNA, 22 nt, Homo sapiens
gcaaucauggugcucagagcag

SEQ ID NO: 1827043 - RNA, 18 nt, Homo sapiens
ucccaacucgaugggcac

SEQ ID NO: 1827044 - RNA, 13 nt, Homo sapiens
uuauacuaauuca

SEQ ID NO: 1827045 - RNA, 15 nt, Homo sapiens
aggggaaaaucucag

SEQ ID NO: 1827046 - RNA, 22 nt, Homo sapiens
cucuuggaacugcaccaccgac

SEQ ID NO: 1827047 - RNA, 19 nt, Homo sapiens
ccucgccgggccauucuga

SEQ ID NO: 1827048 - RNA, 18 nt, Homo sapiens
ugacucagcauaccugcu

SEQ ID NO: 1827049 - RNA, 16 nt, Homo sapiens
ggcacugcacccuguu

SEQ ID NO: 1827050 - RNA, 14 nt, Homo sapiens
agaaagaucaaaga

SEQ ID NO: 1827051 - RNA, 19 nt, Homo sapiens
agagacacaaguggccuua

SEQ ID NO: 1827052 - RNA, 14 nt, Homo sapiens
gagcuuaaacagcu

SEQ ID NO: 1827053 - RNA, 20 nt, Homo sapiens
aaggaaaacucaccauuuca

SEQ ID NO: 1827054 - RNA, 11 nt, Homo sapiens
aggaccacaga

SEQ ID NO: 1827055 - RNA, 16 nt, Homo sapiens
aaccaaacuaguauca

SEQ ID NO: 1827056 - RNA, 19 nt, Homo sapiens
ugaaaaaauaacacuguac

SEQ ID NO: 1827057 - RNA, 13 nt, Homo sapiens
cuuccagcuccug

SEQ ID NO: 1827058 - RNA, 16 nt, Homo sapiens
gcagacaggugugcag

SEQ ID NO: 1827059 - RNA, 18 nt, Homo sapiens
cuccucccuaaugcucac

SEQ ID NO: 1827060 - RNA, 17 nt, Homo sapiens
gaaauaaaccuaugaau

SEQ ID NO: 1827061 - RNA, 14 nt, Homo sapiens
cucccuacauuccc

SEQ ID NO: 1827062 - RNA, 18 nt, Homo sapiens
ggagucccugcaggugaa

SEQ ID NO: 1827063 - RNA, 22 nt, Homo sapiens
ucagacacugccgacaucagca

SEQ ID NO: 1827064 - RNA, 21 nt, Homo sapiens
augcuguugguaaagcacaug

SEQ ID NO: 1827065 - RNA, 18 nt, Homo sapiens
ggucuaccucaucucuga

SEQ ID NO: 1827066 - RNA, 16 nt, Homo sapiens
aucagugacugaauuc

SEQ ID NO: 1827067 - RNA, 19 nt, Homo sapiens
guguagauuucaugcucga

SEQ ID NO: 1827068 - RNA, 15 nt, Homo sapiens
cuaugguuugccauu

SEQ ID NO: 1827069 - RNA, 16 nt, Homo sapiens
acuacauaucuaaagc

SEQ ID NO: 1827070 - RNA, 20 nt, Homo sapiens
gaaagauugguaagagccaa

SEQ ID NO: 1827071 - RNA, 19 nt, Homo sapiens
cuuggcagcccgggucauc

SEQ ID NO: 1827072 - RNA, 17 nt, Homo sapiens
gccuuugacccaggaac

SEQ ID NO: 1827073 - RNA, 20 nt, Homo sapiens
ggggcccugugcgucucagu

SEQ ID NO: 1827074 - RNA, 21 nt, Homo sapiens
uaugagacugggcaucucuga

SEQ ID NO: 1827075 - RNA, 22 nt, Homo sapiens
agacuaugaggaauauuugcaa

SEQ ID NO: 1827076 - RNA, 13 nt, Homo sapiens
aaaugaauuauua

SEQ ID NO: 1827077 - RNA, 16 nt, Homo sapiens
caaagccggcuugauu

SEQ ID NO: 1827078 - RNA, 19 nt, Homo sapiens
ccauagcuacuauaugcau

SEQ ID NO: 1827079 - RNA, 23 nt, Homo sapiens
uccccagccuccccgugccaaaa

SEQ ID NO: 1827080 - RNA, 12 nt, Homo sapiens
agcccccacuga

SEQ ID NO: 1827081 - RNA, 21 nt, Homo sapiens
acugucuauuuaagugcaauu

SEQ ID NO: 1827082 - RNA, 22 nt, Homo sapiens
guugucuacauuaaaucacuug

SEQ ID NO: 1827083 - RNA, 17 nt, Homo sapiens
caggugguccugagacc

SEQ ID NO: 1827084 - RNA, 22 nt, Homo sapiens
ucccuccauaccucgaacauca

SEQ ID NO: 1827085 - RNA, 22 nt, Homo sapiens
uuauaugcagaacacauuucaa

SEQ ID NO: 1827086 - RNA, 14 nt, Homo sapiens
uaagauuuaauuca

SEQ ID NO: 1827087 - RNA, 22 nt, Homo sapiens
ccauccuggcuaacacggugaa

SEQ ID NO: 1827088 - RNA, 12 nt, Homo sapiens
ccucugacucag

SEQ ID NO: 1827089 - RNA, 15 nt, Homo sapiens
aagauuuaugaugca

SEQ ID NO: 1827090 - RNA, 14 nt, Homo sapiens
uuugcguacacaga

SEQ ID NO: 1827091 - RNA, 15 nt, Homo sapiens
aguagacaagcaauu

SEQ ID NO: 1827092 - RNA, 18 nt, Homo sapiens
aguuaagaagcuguugua

SEQ ID NO: 1827093 - RNA, 20 nt, Homo sapiens
ucaaauaagcuaauauacag

SEQ ID NO: 1827094 - RNA, 18 nt, Homo sapiens
ugggauuauauaggcaug

SEQ ID NO: 1827095 - RNA, 21 nt, Homo sapiens
cauuuuuugaaaugcugaaaa

SEQ ID NO: 1827096 - RNA, 19 nt, Homo sapiens
ucagagacagauaccucca

SEQ ID NO: 1827097 - RNA, 15 nt, Homo sapiens
augcagucuguccag

SEQ ID NO: 1827098 - RNA, 15 nt, Homo sapiens
uuucacacagugaaa

SEQ ID NO: 1827099 - RNA, 19 nt, Homo sapiens
ugguguuggcggucccugu

SEQ ID NO: 1827100 - RNA, 14 nt, Homo sapiens
cuggcuuugccucu

SEQ ID NO: 1827101 - RNA, 15 nt, Homo sapiens
ggagucaccaugcaa

SEQ ID NO: 1827102 - RNA, 13 nt, Homo sapiens
auacaugcugcua

SEQ ID NO: 1827103 - RNA, 17 nt, Homo sapiens
caaaaggacaaccacag

SEQ ID NO: 1827104 - RNA, 16 nt, Homo sapiens
gcccugcuguggaaga

SEQ ID NO: 1827105 - RNA, 17 nt, Homo sapiens
uuacagcuuuucucuuu

SEQ ID NO: 1827106 - RNA, 21 nt, Homo sapiens
cucugcauccgacacccaccc

SEQ ID NO: 1827107 - RNA, 16 nt, Homo sapiens
gaaaugagaacauucc

SEQ ID NO: 1827108 - RNA, 15 nt, Homo sapiens
cacaagccacagaag

SEQ ID NO: 1827109 - RNA, 17 nt, Homo sapiens
acugccaaaacauuuau

SEQ ID NO: 1827110 - RNA, 23 nt, Homo sapiens
auuugauaguugguguucaaaaa

SEQ ID NO: 1827111 - RNA, 17 nt, Homo sapiens
agaguugcuuccagucc

SEQ ID NO: 1827112 - RNA, 21 nt, Homo sapiens
gaggaagaggaggaagguugg

SEQ ID NO: 1827113 - RNA, 11 nt, Homo sapiens
guaaacauacu

SEQ ID NO: 1827114 - RNA, 19 nt, Homo sapiens
gaauacacauuuuuugcca

SEQ ID NO: 1827115 - RNA, 19 nt, Homo sapiens
gaucccgagguauggcaga

SEQ ID NO: 1827116 - RNA, 18 nt, Homo sapiens
aggcuccaguugggcuga

SEQ ID NO: 1827117 - RNA, 14 nt, Homo sapiens
ccagcugccgcacc

SEQ ID NO: 1827118 - RNA, 11 nt, Homo sapiens
ucacgcugggg

SEQ ID NO: 1827119 - RNA, 14 nt, Homo sapiens
acuagaacucucca

SEQ ID NO: 1827120 - RNA, 14 nt, Homo sapiens
caaaccgcaggcaa

SEQ ID NO: 1827121 - RNA, 15 nt, Homo sapiens
accaggaccaguuca

SEQ ID NO: 1827122 - RNA, 13 nt, Homo sapiens
aacuugcugccuc

SEQ ID NO: 1827123 - RNA, 21 nt, Homo sapiens
aucuacaacuguuugcacuua

SEQ ID NO: 1827124 - RNA, 23 nt, Homo sapiens
uuucuuguaaggcauacugccuu

SEQ ID NO: 1827125 - RNA, 14 nt, Homo sapiens
ugaggcugcaccca

SEQ ID NO: 1827126 - RNA, 20 nt, Homo sapiens
uggcucuacguuuaggcacc

SEQ ID NO: 1827127 - RNA, 18 nt, Homo sapiens
auuaacaugauguacuaa

SEQ ID NO: 1827128 - RNA, 14 nt, Homo sapiens
aacuggaaugccuu

SEQ ID NO: 1827129 - RNA, 23 nt, Homo sapiens
ccgagcugggggccaugagcucc

SEQ ID NO: 1827130 - RNA, 20 nt, Homo sapiens
ucaucaauuuaaaaucauuc

SEQ ID NO: 1827131 - RNA, 21 nt, Homo sapiens
cucugucucauugaccuucag

SEQ ID NO: 1827132 - RNA, 19 nt, Homo sapiens
aauauaaaagaucuugcag

SEQ ID NO: 1827133 - RNA, 20 nt, Homo sapiens
ucuuaaugucugucagaaga

SEQ ID NO: 1827134 - RNA, 17 nt, Homo sapiens
cauuaaaaaugcauaua

SEQ ID NO: 1827135 - RNA, 23 nt, Homo sapiens
acugaauauuaaaaagauagacu

SEQ ID NO: 1827136 - RNA, 18 nt, Homo sapiens
gagcuugauuagaagcca

SEQ ID NO: 1827137 - RNA, 19 nt, Homo sapiens
aacucugauuaugaauaca

SEQ ID NO: 1827138 - RNA, 14 nt, Homo sapiens
uuacaaaccucuca

SEQ ID NO: 1827139 - RNA, 22 nt, Homo sapiens
ggaacuaacacgugaugugaua

SEQ ID NO: 1827140 - RNA, 14 nt, Homo sapiens
ggcugugggaccag

SEQ ID NO: 1827141 - RNA, 17 nt, Homo sapiens
gaaacuaagagcucuca

SEQ ID NO: 1827142 - RNA, 18 nt, Homo sapiens
uucuaccacccaccaguu

SEQ ID NO: 1827143 - RNA, 23 nt, Homo sapiens
ucucagguccagcuuuacugugg

SEQ ID NO: 1827144 - RNA, 23 nt, Homo sapiens
uauaauuguaucguauagcugua

SEQ ID NO: 1827145 - RNA, 13 nt, Homo sapiens
ugggcaagcagac

SEQ ID NO: 1827146 - RNA, 21 nt, Homo sapiens
acuuaucaccacaccacugcc

SEQ ID NO: 1827147 - RNA, 21 nt, Homo sapiens
aaaucaacuuuuuauugccuu

SEQ ID NO: 1827148 - RNA, 21 nt, Homo sapiens
cugccuccacuugccuuguga

SEQ ID NO: 1827149 - RNA, 18 nt, Homo sapiens
uucacugcaaccucugcc

SEQ ID NO: 1827150 - RNA, 16 nt, Homo sapiens
augucagucuacaggc

SEQ ID NO: 1827151 - RNA, 15 nt, Homo sapiens
cugcucugaccuucc

SEQ ID NO: 1827152 - RNA, 14 nt, Homo sapiens
acucauucauuacu

SEQ ID NO: 1827153 - RNA, 20 nt, Homo sapiens
cuggagcagagaacaucugg

SEQ ID NO: 1827154 - RNA, 19 nt, Homo sapiens
aagaaucuuagauaacuuc

SEQ ID NO: 1827155 - RNA, 20 nt, Homo sapiens
uuaugucccugacuguaaau

SEQ ID NO: 1827156 - RNA, 18 nt, Homo sapiens
ccaggcuggcgugcagug

SEQ ID NO: 1827157 - RNA, 14 nt, Homo sapiens
aauaauuugccauu

SEQ ID NO: 1827158 - RNA, 13 nt, Homo sapiens
ccaaaaccuuuca

SEQ ID NO: 1827159 - RNA, 14 nt, Homo sapiens
uaagugacuugccc

SEQ ID NO: 1827160 - RNA, 17 nt, Homo sapiens
cuuuaaaaaugcaauau

SEQ ID NO: 1827161 - RNA, 14 nt, Homo sapiens
acauuugugcuguu

SEQ ID NO: 1827162 - RNA, 20 nt, Homo sapiens
aaauaccucuuagcugagug

SEQ ID NO: 1827163 - RNA, 17 nt, Homo sapiens
gcaugagaaucacuuga

SEQ ID NO: 1827164 - RNA, 15 nt, Homo sapiens
aucuuccaccagcac

SEQ ID NO: 1827165 - RNA, 20 nt, Homo sapiens
auuuuaaaauguauaccaag

SEQ ID NO: 1827166 - RNA, 16 nt, Homo sapiens
auaucauuugugaaga

SEQ ID NO: 1827167 - RNA, 23 nt, Homo sapiens
uugcugacaaccauuaaagucag

SEQ ID NO: 1827168 - RNA, 20 nt, Homo sapiens
aggcaugagccacugugccu

SEQ ID NO: 1827169 - RNA, 21 nt, Homo sapiens
guaaaugguguacauaaugua

SEQ ID NO: 1827170 - RNA, 17 nt, Homo sapiens
gcuuaccuccucauggc

SEQ ID NO: 1827171 - RNA, 16 nt, Homo sapiens
agauuguggggugcag

SEQ ID NO: 1827172 - RNA, 22 nt, Homo sapiens
accgugggcccucaagcuuucc

SEQ ID NO: 1827173 - RNA, 13 nt, Homo sapiens
cugggaccaaaac

SEQ ID NO: 1827174 - RNA, 15 nt, Homo sapiens
ugacuuaagcacacu

SEQ ID NO: 1827175 - RNA, 15 nt, Homo sapiens
ugacacaagcacuuu

SEQ ID NO: 1827176 - RNA, 15 nt, Homo sapiens
gcaguuuaugagaca

SEQ ID NO: 1827177 - RNA, 14 nt, Homo sapiens
acaagaaccaagga

SEQ ID NO: 1827178 - RNA, 15 nt, Homo sapiens
agcaaccaugaacuc

SEQ ID NO: 1827179 - RNA, 20 nt, Homo sapiens
gacucuccuccuugagcccu

SEQ ID NO: 1827180 - RNA, 14 nt, Homo sapiens
cuuacuuuaacccu

SEQ ID NO: 1827181 - RNA, 17 nt, Homo sapiens
uggaacuacauuacugu

SEQ ID NO: 1827182 - RNA, 18 nt, Homo sapiens
agccaagugcccucucug

SEQ ID NO: 1827183 - RNA, 21 nt, Homo sapiens
ugcuggcgccaacaacuucuc

SEQ ID NO: 1827184 - RNA, 18 nt, Homo sapiens
aauuuucacagccaugau

SEQ ID NO: 1827185 - RNA, 17 nt, Homo sapiens
cugauaaacagaguaac

SEQ ID NO: 1827186 - RNA, 23 nt, Homo sapiens
uguuuucucuguauaacuuguga

SEQ ID NO: 1827187 - RNA, 22 nt, Homo sapiens
aaauacauucuccuuuuugccc

SEQ ID NO: 1827188 - RNA, 14 nt, Homo sapiens
uguccuccuuggcg

SEQ ID NO: 1827189 - RNA, 18 nt, Homo sapiens
uauuuaaaagacaaacac

SEQ ID NO: 1827190 - RNA, 17 nt, Homo sapiens
uagcaagcaccaaaaaa

SEQ ID NO: 1827191 - RNA, 13 nt, Homo sapiens
gaacuagacuccc

SEQ ID NO: 1827192 - RNA, 15 nt, Homo sapiens
uuuuuucugcaacuu

SEQ ID NO: 1827193 - RNA, 18 nt, Homo sapiens
cucaucugccaagcuccu

SEQ ID NO: 1827194 - RNA, 17 nt, Homo sapiens
cuuuagcaguacccuag

SEQ ID NO: 1827195 - RNA, 14 nt, Homo sapiens
gucagcccaugugc

SEQ ID NO: 1827196 - RNA, 18 nt, Homo sapiens
agccuggguggaaggcag

SEQ ID NO: 1827197 - RNA, 16 nt, Homo sapiens
auauagacauucucac

SEQ ID NO: 1827198 - RNA, 20 nt, Homo sapiens
auguucucaugaacuacccc

SEQ ID NO: 1827199 - RNA, 17 nt, Homo sapiens
uaaaacuacacaucccu

SEQ ID NO: 1827200 - RNA, 15 nt, Homo sapiens
ugugccucagccucc

SEQ ID NO: 1827201 - RNA, 18 nt, Homo sapiens
cuggugguggcaccaucu

SEQ ID NO: 1827202 - RNA, 15 nt, Homo sapiens
cuuuucagcugaggu

SEQ ID NO: 1827203 - RNA, 18 nt, Homo sapiens
uccagcacaaaguuuacu

SEQ ID NO: 1827204 - RNA, 19 nt, Homo sapiens
caauaaacccucagagccu

SEQ ID NO: 1827205 - RNA, 15 nt, Homo sapiens
ucugcucugugcacu

SEQ ID NO: 1827206 - RNA, 15 nt, Homo sapiens
aggacguguguaaau

SEQ ID NO: 1827207 - RNA, 21 nt, Homo sapiens
acauugucaccccaagccaua

SEQ ID NO: 1827208 - RNA, 22 nt, Homo sapiens
auuauccagagucaugggagag

SEQ ID NO: 1827209 - RNA, 21 nt, Homo sapiens
ucauaaacuggaaauacugau

SEQ ID NO: 1827210 - RNA, 13 nt, Homo sapiens
cugaguuuagugg

SEQ ID NO: 1827211 - RNA, 11 nt, Homo sapiens
uaaaaugcaag

SEQ ID NO: 1827212 - RNA, 13 nt, Homo sapiens
cuucaaccuaguc

SEQ ID NO: 1827213 - RNA, 18 nt, Homo sapiens
acacaugcacacaugugc

SEQ ID NO: 1827214 - RNA, 23 nt, Homo sapiens
ggggcgagaaacaagacaagcuc

SEQ ID NO: 1827215 - RNA, 14 nt, Homo sapiens
gcacccacccagca

SEQ ID NO: 1827216 - RNA, 14 nt, Homo sapiens
auaaugaaugucau

SEQ ID NO: 1827217 - RNA, 16 nt, Homo sapiens
ugagguuaugagaaaa

SEQ ID NO: 1827218 - RNA, 16 nt, Homo sapiens
auguauaaaugugaua

SEQ ID NO: 1827219 - RNA, 12 nt, Homo sapiens
gccugugccuuu

SEQ ID NO: 1827220 - RNA, 18 nt, Homo sapiens
uggacaggggcgugggau

SEQ ID NO: 1827221 - RNA, 19 nt, Homo sapiens
auggguuugccaagcccuu

SEQ ID NO: 1827222 - RNA, 23 nt, Homo sapiens
gcauggcuuuggcuuugcaaaau

SEQ ID NO: 1827223 - RNA, 16 nt, Homo sapiens
uuuggaaggaagaaca

SEQ ID NO: 1827224 - RNA, 19 nt, Homo sapiens
ucaccagccccacugccag

SEQ ID NO: 1827225 - RNA, 19 nt, Homo sapiens
aaaauaauaaaagaaucau

SEQ ID NO: 1827226 - RNA, 19 nt, Homo sapiens
gaaacccuaagccaagacc

SEQ ID NO: 1827227 - RNA, 15 nt, Homo sapiens
acuuaauggcuguau

SEQ ID NO: 1827228 - RNA, 17 nt, Homo sapiens
aucuccauuucugcuca

SEQ ID NO: 1827229 - RNA, 13 nt, Homo sapiens
agaaaaccaaaca

SEQ ID NO: 1827230 - RNA, 13 nt, Homo sapiens
aaaacaccagacc

SEQ ID NO: 1827231 - RNA, 17 nt, Homo sapiens
gacacagacuggcaaua

SEQ ID NO: 1827232 - RNA, 19 nt, Homo sapiens
augcaaaaaaugcuuuguu

SEQ ID NO: 1827233 - RNA, 18 nt, Homo sapiens
uacaccacacacaacagc

SEQ ID NO: 1827234 - RNA, 18 nt, Homo sapiens
ucccauuugggcaguaua

SEQ ID NO: 1827235 - RNA, 18 nt, Homo sapiens
ugaccaggcuggucucaa

SEQ ID NO: 1827236 - RNA, 19 nt, Homo sapiens
gauguccuccucugugaaa

SEQ ID NO: 1827237 - RNA, 14 nt, Homo sapiens
aaacacaauaucau

SEQ ID NO: 1827238 - RNA, 19 nt, Homo sapiens
ucugaguaagcccucagga

SEQ ID NO: 1827239 - RNA, 22 nt, Homo sapiens
ugccugggccguggcacagcug

SEQ ID NO: 1827240 - RNA, 22 nt, Homo sapiens
acuuccacauuauacauuugau

SEQ ID NO: 1827241 - RNA, 18 nt, Homo sapiens
aucauuuuauuauaaucc

SEQ ID NO: 1827242 - RNA, 17 nt, Homo sapiens
aguuggggcggcccacg

SEQ ID NO: 1827243 - RNA, 13 nt, Homo sapiens
auaagaaagaauu

SEQ ID NO: 1827244 - RNA, 11 nt, Homo sapiens
gagauuugcca

SEQ ID NO: 1827245 - RNA, 16 nt, Homo sapiens
uucacccuguguaaca

SEQ ID NO: 1827246 - RNA, 22 nt, Homo sapiens
acugauuuagaaaaacaaauga

SEQ ID NO: 1827247 - RNA, 14 nt, Homo sapiens
aaaauagucucauu

SEQ ID NO: 1827248 - RNA, 21 nt, Homo sapiens
agcccuuaauaauaaugccaa

SEQ ID NO: 1827249 - RNA, 16 nt, Homo sapiens
cggaugcacacacaga

SEQ ID NO: 1827250 - RNA, 20 nt, Homo sapiens
gcuugcuaccaaucugugag

SEQ ID NO: 1827251 - RNA, 12 nt, Homo sapiens
auuguacugugu

SEQ ID NO: 1827252 - RNA, 14 nt, Homo sapiens
gagggcaagcccug

SEQ ID NO: 1827253 - RNA, 20 nt, Homo sapiens
auaucuuugaccucaaugga

SEQ ID NO: 1827254 - RNA, 16 nt, Homo sapiens
gcccaggguuuugccc

SEQ ID NO: 1827255 - RNA, 13 nt, Homo sapiens
auuucuggcaaau

SEQ ID NO: 1827256 - RNA, 15 nt, Homo sapiens
ccaaucauacaaaua

SEQ ID NO: 1827257 - RNA, 21 nt, Homo sapiens
acgcuugugaggcccgaggca

SEQ ID NO: 1827258 - RNA, 15 nt, Homo sapiens
gaaaaacaacccagc

SEQ ID NO: 1827259 - RNA, 19 nt, Homo sapiens
ugggcaccagcucaugcca

SEQ ID NO: 1827260 - RNA, 16 nt, Homo sapiens
auguugaccauuccaa

SEQ ID NO: 1827261 - RNA, 11 nt, Homo sapiens
gacaagccauc

SEQ ID NO: 1827262 - RNA, 20 nt, Homo sapiens
uuauaucaucagcauaccuu

SEQ ID NO: 1827263 - RNA, 18 nt, Homo sapiens
gaaugugggucugcaccu

SEQ ID NO: 1827264 - RNA, 14 nt, Homo sapiens
aaaguacaaagcau

SEQ ID NO: 1827265 - RNA, 14 nt, Homo sapiens
aaaguucaaagcaa

SEQ ID NO: 1827266 - RNA, 12 nt, Homo sapiens
aucugcacuggg

SEQ ID NO: 1827267 - RNA, 14 nt, Homo sapiens
aaccgauaaugcau

SEQ ID NO: 1827268 - RNA, 15 nt, Homo sapiens
ugaaaauacagcagg

SEQ ID NO: 1827269 - RNA, 18 nt, Homo sapiens
gaaaugagaacaaucuca

SEQ ID NO: 1827270 - RNA, 17 nt, Homo sapiens
cuuuuguuguuucuuaa

SEQ ID NO: 1827271 - RNA, 22 nt, Homo sapiens
cuaccuugguucccccacugau

SEQ ID NO: 1827272 - RNA, 14 nt, Homo sapiens
gacuaugaaaagcu

SEQ ID NO: 1827273 - RNA, 14 nt, Homo sapiens
cuugcaucugcaca

SEQ ID NO: 1827274 - RNA, 18 nt, Homo sapiens
ccaaaugcuauacugugu

SEQ ID NO: 1827275 - RNA, 21 nt, Homo sapiens
augcccccuguggaugcugcu

SEQ ID NO: 1827276 - RNA, 21 nt, Homo sapiens
uuaccugacagcucuuaccaa

SEQ ID NO: 1827277 - RNA, 18 nt, Homo sapiens
ugugccugcucagcagcc

SEQ ID NO: 1827278 - RNA, 17 nt, Homo sapiens
ccuguccuccaacacca

SEQ ID NO: 1827279 - RNA, 12 nt, Homo sapiens
gcucagccacag

SEQ ID NO: 1827280 - RNA, 18 nt, Homo sapiens
aguuugggugucugcuaa

SEQ ID NO: 1827281 - RNA, 13 nt, Homo sapiens
uaggucaugaagg

SEQ ID NO: 1827282 - RNA, 14 nt, Homo sapiens
gcagacucugguca

SEQ ID NO: 1827283 - RNA, 17 nt, Homo sapiens
guaagcuuuaagcgcaa

SEQ ID NO: 1827284 - RNA, 23 nt, Homo sapiens
uuuaauguauuguucucauguaa

SEQ ID NO: 1827285 - RNA, 20 nt, Homo sapiens
cugccggucccccaugccac

SEQ ID NO: 1827286 - RNA, 17 nt, Homo sapiens
agagcacuuugcaacuc

SEQ ID NO: 1827287 - RNA, 16 nt, Homo sapiens
accuauguacuugaaa

SEQ ID NO: 1827288 - RNA, 18 nt, Homo sapiens
aagugguaaauacuguga

SEQ ID NO: 1827289 - RNA, 18 nt, Homo sapiens
auaguuucaccacuccuc

SEQ ID NO: 1827290 - RNA, 16 nt, Homo sapiens
uucuucauuaccucag

SEQ ID NO: 1827291 - RNA, 17 nt, Homo sapiens
aaacaugcuaaauaguu

SEQ ID NO: 1827292 - RNA, 18 nt, Homo sapiens
gauggaacaugcccacaa

SEQ ID NO: 1827293 - RNA, 20 nt, Homo sapiens
ugcauacuggccgagcugcu

SEQ ID NO: 1827294 - RNA, 16 nt, Homo sapiens
cccccaaccauuuccu

SEQ ID NO: 1827295 - RNA, 16 nt, Homo sapiens
caugaucccaccuccc

SEQ ID NO: 1827296 - RNA, 17 nt, Homo sapiens
gaacugguccaggccag

SEQ ID NO: 1827297 - RNA, 19 nt, Homo sapiens
aagggugggugcucagaau

SEQ ID NO: 1827298 - RNA, 13 nt, Homo sapiens
agauaaaugcaca

SEQ ID NO: 1827299 - RNA, 15 nt, Homo sapiens
cauguaaauugcaaa

SEQ ID NO: 1827300 - RNA, 14 nt, Homo sapiens
uggcacagaagcuc

SEQ ID NO: 1827301 - RNA, 15 nt, Homo sapiens
aauagagccuugugg

SEQ ID NO: 1827302 - RNA, 18 nt, Homo sapiens
gcuagagcugacagcuuu

SEQ ID NO: 1827303 - RNA, 12 nt, Homo sapiens
uaacacuuguca

SEQ ID NO: 1827304 - RNA, 19 nt, Homo sapiens
ucaucacagggauuuagac

SEQ ID NO: 1827305 - RNA, 17 nt, Homo sapiens
guaaaagugcuuuccau

SEQ ID NO: 1827306 - RNA, 18 nt, Homo sapiens
cuuggcacucaggugcug

SEQ ID NO: 1827307 - RNA, 19 nt, Homo sapiens
cuuuuccacuccuauggaa

SEQ ID NO: 1827308 - RNA, 16 nt, Homo sapiens
uuuauuucugaucuau

SEQ ID NO: 1827309 - RNA, 18 nt, Homo sapiens
gcacccaaaucacaucuc

SEQ ID NO: 1827310 - RNA, 22 nt, Homo sapiens
cuguaggaacaagcaugaucuu

SEQ ID NO: 1827311 - RNA, 18 nt, Homo sapiens
gcccccuccacaccagug

SEQ ID NO: 1827312 - RNA, 15 nt, Homo sapiens
cugacugucagggag

SEQ ID NO: 1827313 - RNA, 13 nt, Homo sapiens
gagaacuaaauaa

SEQ ID NO: 1827314 - RNA, 13 nt, Homo sapiens
guuaucuaaugau

SEQ ID NO: 1827315 - RNA, 15 nt, Homo sapiens
acugucagauuaaau

SEQ ID NO: 1827316 - RNA, 20 nt, Homo sapiens
uuuucaggauuuuugguaua

SEQ ID NO: 1827317 - RNA, 17 nt, Homo sapiens
gcaaaaaacuaauguga

SEQ ID NO: 1827318 - RNA, 16 nt, Homo sapiens
auccuuuuccauccca

SEQ ID NO: 1827319 - RNA, 20 nt, Homo sapiens
guuugaaaaagcagacagaa

SEQ ID NO: 1827320 - RNA, 17 nt, Homo sapiens
auuuggacugcauuuaa

SEQ ID NO: 1827321 - RNA, 22 nt, Homo sapiens
cugugugggauacuuaguggua

SEQ ID NO: 1827322 - RNA, 18 nt, Homo sapiens
auguccugacuuugcccc

SEQ ID NO: 1827323 - RNA, 20 nt, Homo sapiens
ccucccuucuacugcuucua

SEQ ID NO: 1827324 - RNA, 22 nt, Homo sapiens
uuuauuacuguuguaucuaugu

SEQ ID NO: 1827325 - RNA, 16 nt, Homo sapiens
cugggugcaucaaaca

SEQ ID NO: 1827326 - RNA, 18 nt, Homo sapiens
ucguugacccucacagga

SEQ ID NO: 1827327 - RNA, 17 nt, Homo sapiens
uaggaacccagcucuca

SEQ ID NO: 1827328 - RNA, 22 nt, Homo sapiens
gcuaaguggccggaaaacaagc

SEQ ID NO: 1827329 - RNA, 18 nt, Homo sapiens
cugcaauacaaguuucau

SEQ ID NO: 1827330 - RNA, 16 nt, Homo sapiens
caguugcugaucccug

SEQ ID NO: 1827331 - RNA, 16 nt, Homo sapiens
agacuuguguccugac

SEQ ID NO: 1827332 - RNA, 15 nt, Homo sapiens
cagccagguggcacc

SEQ ID NO: 1827333 - RNA, 15 nt, Homo sapiens
acaugaacuacagac

SEQ ID NO: 1827334 - RNA, 23 nt, Homo sapiens
uccacucuuguucaaguaucuaa

SEQ ID NO: 1827335 - RNA, 23 nt, Homo sapiens
uaguuguuggucuguagcaagcu

SEQ ID NO: 1827336 - RNA, 22 nt, Homo sapiens
aucuuucuuaauagaaagucag

SEQ ID NO: 1827337 - RNA, 15 nt, Homo sapiens
agucagugcucucag

SEQ ID NO: 1827338 - RNA, 22 nt, Homo sapiens
ucaguucauggcaucacaucuu

SEQ ID NO: 1827339 - RNA, 23 nt, Homo sapiens
aagcuuacucaauaaaacuuuaa

SEQ ID NO: 1827340 - RNA, 15 nt, Homo sapiens
gugaaauaauuccuc

SEQ ID NO: 1827341 - RNA, 16 nt, Homo sapiens
ccugaacuggccacuc

SEQ ID NO: 1827342 - RNA, 18 nt, Homo sapiens
acgcacacaucuuaccuc

SEQ ID NO: 1827343 - RNA, 22 nt, Homo sapiens
agacaaauacuuagacaguaug

SEQ ID NO: 1827344 - RNA, 21 nt, Homo sapiens
guuuucacucuucuaaugcaa

SEQ ID NO: 1827345 - RNA, 23 nt, Homo sapiens
uguguuccccauguguguguaca

SEQ ID NO: 1827346 - RNA, 17 nt, Homo sapiens
agcuguuagcacguuag

SEQ ID NO: 1827347 - RNA, 21 nt, Homo sapiens
agagcaguaccagcgcucuaa

SEQ ID NO: 1827348 - RNA, 15 nt, Homo sapiens
ugcuggaaaccaagu

SEQ ID NO: 1827349 - RNA, 16 nt, Homo sapiens
cauugugcagagaagc

SEQ ID NO: 1827350 - RNA, 18 nt, Homo sapiens
uuagugaccucagcuuug

SEQ ID NO: 1827351 - RNA, 21 nt, Homo sapiens
uaauugugugacuuuuucaga

SEQ ID NO: 1827352 - RNA, 14 nt, Homo sapiens
aaauuguugugcuu

SEQ ID NO: 1827353 - RNA, 13 nt, Homo sapiens
aauuuucuucaca

SEQ ID NO: 1827354 - RNA, 13 nt, Homo sapiens
uauuuucuacaca

SEQ ID NO: 1827355 - RNA, 12 nt, Homo sapiens
agggcaucucaa

SEQ ID NO: 1827356 - RNA, 20 nt, Homo sapiens
aaucuuuuucuuuaccucca

SEQ ID NO: 1827357 - RNA, 16 nt, Homo sapiens
uuuaaucccacuugcc

SEQ ID NO: 1827358 - RNA, 21 nt, Homo sapiens
ucacuuaauaaucaaccuggg

SEQ ID NO: 1827359 - RNA, 20 nt, Homo sapiens
ugaaugcugcuuccauuuga

SEQ ID NO: 1827360 - RNA, 19 nt, Homo sapiens
guuguucgccgcguggaau

SEQ ID NO: 1827361 - RNA, 17 nt, Homo sapiens
acacugccuuugcugcc

SEQ ID NO: 1827362 - RNA, 15 nt, Homo sapiens
aggacaagagggaca

SEQ ID NO: 1827363 - RNA, 20 nt, Homo sapiens
auacaccacugcaaaauguc

SEQ ID NO: 1827364 - RNA, 18 nt, Homo sapiens
cccucauccuuuacauuu

SEQ ID NO: 1827365 - RNA, 15 nt, Homo sapiens
ccuguuuuuuugcuu

SEQ ID NO: 1827366 - RNA, 23 nt, Homo sapiens
cuaaucuugucaaccagugcaag

SEQ ID NO: 1827367 - RNA, 20 nt, Homo sapiens
uucaugagucuuguaauuaa

SEQ ID NO: 1827368 - RNA, 20 nt, Homo sapiens
gcccagggccacucugccuc

SEQ ID NO: 1827369 - RNA, 22 nt, Homo sapiens
auaguugauguaacauuguaga

SEQ ID NO: 1827370 - RNA, 19 nt, Homo sapiens
ggaagagcugcaacggaau

SEQ ID NO: 1827371 - RNA, 14 nt, Homo sapiens
ucggcccuggggua

SEQ ID NO: 1827372 - RNA, 14 nt, Homo sapiens
auugguucaugccu

SEQ ID NO: 1827373 - RNA, 19 nt, Homo sapiens
aaauuuuuaaauauucaca

SEQ ID NO: 1827374 - RNA, 19 nt, Homo sapiens
uaggcacuucuuaacagac

SEQ ID NO: 1827375 - RNA, 19 nt, Homo sapiens
gagacaauguuuucuucaa

SEQ ID NO: 1827376 - RNA, 20 nt, Homo sapiens
gugauuacccucugggucuc

SEQ ID NO: 1827377 - RNA, 23 nt, Homo sapiens
uaaugaguuaagcugaagaguuu

SEQ ID NO: 1827378 - RNA, 16 nt, Homo sapiens
caaauugucaccugcu

SEQ ID NO: 1827379 - RNA, 20 nt, Homo sapiens
gaauuaaagucuacacugcc

SEQ ID NO: 1827380 - RNA, 12 nt, Homo sapiens
auggacuuaccc

SEQ ID NO: 1827381 - RNA, 22 nt, Homo sapiens
uuuuguggugucuagcauuaac

SEQ ID NO: 1827382 - RNA, 21 nt, Homo sapiens
cgaacgcugcuccaugcacag

SEQ ID NO: 1827383 - RNA, 16 nt, Homo sapiens
ugcccaguacauuuaa

SEQ ID NO: 1827384 - RNA, 18 nt, Homo sapiens
gccauguaucaauauuca

SEQ ID NO: 1827385 - RNA, 19 nt, Homo sapiens
uagagcucuacugccucaa

SEQ ID NO: 1827386 - RNA, 21 nt, Homo sapiens
aucagcuguuaaccauuugca

SEQ ID NO: 1827387 - RNA, 12 nt, Homo sapiens
uuacagccuuau

SEQ ID NO: 1827388 - RNA, 19 nt, Homo sapiens
guaacuugguuauacauga

SEQ ID NO: 1827389 - RNA, 13 nt, Homo sapiens
uucagcugcugaa

SEQ ID NO: 1827390 - RNA, 18 nt, Homo sapiens
gucaccaugccaaugaag

SEQ ID NO: 1827391 - RNA, 21 nt, Homo sapiens
aaugacccaaaucucuuccac

SEQ ID NO: 1827392 - RNA, 17 nt, Homo sapiens
ccugggggcuuuugcca

SEQ ID NO: 1827393 - RNA, 19 nt, Homo sapiens
caaccccugcccuuccucu

SEQ ID NO: 1827394 - RNA, 13 nt, Homo sapiens
uuaauccuagcug

SEQ ID NO: 1827395 - RNA, 22 nt, Homo sapiens
cauaugaggaggaugucccugg

SEQ ID NO: 1827396 - RNA, 20 nt, Homo sapiens
auaacaacuggaugcaucaa

SEQ ID NO: 1827397 - RNA, 13 nt, Homo sapiens
ccuucucugcucc

SEQ ID NO: 1827398 - RNA, 19 nt, Homo sapiens
ccagccuguccaacagagg

SEQ ID NO: 1827399 - RNA, 13 nt, Homo sapiens
uucaguauguguc

SEQ ID NO: 1827400 - RNA, 13 nt, Homo sapiens
gcccaaacacccu

SEQ ID NO: 1827401 - RNA, 12 nt, Homo sapiens
cugcucuaagaa

SEQ ID NO: 1827402 - RNA, 15 nt, Homo sapiens
gaaaagauuccuguc

SEQ ID NO: 1827403 - RNA, 15 nt, Homo sapiens
ugagacagauucucu

SEQ ID NO: 1827404 - RNA, 22 nt, Homo sapiens
augcauacuguugauacaaacc

SEQ ID NO: 1827405 - RNA, 16 nt, Homo sapiens
ccaguuugcuuugccc

SEQ ID NO: 1827406 - RNA, 20 nt, Homo sapiens
gugcacccaugggcucugac

SEQ ID NO: 1827407 - RNA, 23 nt, Homo sapiens
cagagcugaaugggcaguguaau

SEQ ID NO: 1827408 - RNA, 18 nt, Homo sapiens
ugaugaaggcaucugaug

SEQ ID NO: 1827409 - RNA, 18 nt, Homo sapiens
gauugagaagggacaagc

SEQ ID NO: 1827410 - RNA, 20 nt, Homo sapiens
uagguuugucaacacaaaga

SEQ ID NO: 1827411 - RNA, 17 nt, Homo sapiens
uaaucucauaccucuga

SEQ ID NO: 1827412 - RNA, 20 nt, Homo sapiens
uguucuuuaguagcaacuaa

SEQ ID NO: 1827413 - RNA, 14 nt, Homo sapiens
ugggagagugucaa

SEQ ID NO: 1827414 - RNA, 13 nt, Homo sapiens
auugugaacauga

SEQ ID NO: 1827415 - RNA, 21 nt, Homo sapiens
uaaagcuuucagguguuacag

SEQ ID NO: 1827416 - RNA, 14 nt, Homo sapiens
cuagaagaauuuca

SEQ ID NO: 1827417 - RNA, 15 nt, Homo sapiens
uucaagugccaaaca

SEQ ID NO: 1827418 - RNA, 14 nt, Homo sapiens
cccaccucaggcug

SEQ ID NO: 1827419 - RNA, 21 nt, Homo sapiens
cugcuggaugucaccaagaag

SEQ ID NO: 1827420 - RNA, 22 nt, Homo sapiens
cauguaucugucuacuuucucu

SEQ ID NO: 1827421 - RNA, 14 nt, Homo sapiens
gcauuguguucacu

SEQ ID NO: 1827422 - RNA, 20 nt, Homo sapiens
auauacaaugccucccagcu

SEQ ID NO: 1827423 - RNA, 13 nt, Homo sapiens
gugcacuccagac

SEQ ID NO: 1827424 - RNA, 12 nt, Homo sapiens
ucauuggcucca

SEQ ID NO: 1827425 - RNA, 15 nt, Homo sapiens
uuaaccagaugguug

SEQ ID NO: 1827426 - RNA, 19 nt, Homo sapiens
cuggggccugugcacuguu

SEQ ID NO: 1827427 - RNA, 17 nt, Homo sapiens
uggugggccacguguuc

SEQ ID NO: 1827428 - RNA, 19 nt, Homo sapiens
uaaaagacaugaaauugag

SEQ ID NO: 1827429 - RNA, 13 nt, Homo sapiens
caucuuuuccauc

SEQ ID NO: 1827430 - RNA, 20 nt, Homo sapiens
agguacgaaaagaggggaag

SEQ ID NO: 1827431 - RNA, 19 nt, Homo sapiens
gugggccgaggugacugca

SEQ ID NO: 1827432 - RNA, 20 nt, Homo sapiens
uguaaacuuuuugugcugaa

SEQ ID NO: 1827433 - RNA, 15 nt, Homo sapiens
ccucacuuaaacuuu

SEQ ID NO: 1827434 - RNA, 21 nt, Homo sapiens
gaccaugccagacccacugaa

SEQ ID NO: 1827435 - RNA, 20 nt, Homo sapiens
agcccccccaacacugugcc

SEQ ID NO: 1827436 - RNA, 16 nt, Homo sapiens
gugucaggcaugaaga

SEQ ID NO: 1827437 - RNA, 22 nt, Homo sapiens
uucuaaaaacaguuaagacaac

SEQ ID NO: 1827438 - RNA, 13 nt, Homo sapiens
accaccagggcau

SEQ ID NO: 1827439 - RNA, 22 nt, Homo sapiens
accugcaaagaucuguccucag

SEQ ID NO: 1827440 - RNA, 20 nt, Homo sapiens
aucucaacaggccucagggc

SEQ ID NO: 1827441 - RNA, 11 nt, Homo sapiens
aaggugauaua

SEQ ID NO: 1827442 - RNA, 21 nt, Homo sapiens
augaagauucuccugugcuag

SEQ ID NO: 1827443 - RNA, 20 nt, Homo sapiens
gaggccccgccugcucuuuc

SEQ ID NO: 1827444 - RNA, 19 nt, Homo sapiens
uucucacacacauacauac

SEQ ID NO: 1827445 - RNA, 15 nt, Homo sapiens
acucaucaaaaacac

SEQ ID NO: 1827446 - RNA, 23 nt, Homo sapiens
ugcucccagccccuaccuugaga

SEQ ID NO: 1827447 - RNA, 20 nt, Homo sapiens
gcaucguggccuugaccucc

SEQ ID NO: 1827448 - RNA, 16 nt, Homo sapiens
gcucaggugguugugg

SEQ ID NO: 1827449 - RNA, 13 nt, Homo sapiens
uagaggugagaaa

SEQ ID NO: 1827450 - RNA, 19 nt, Homo sapiens
aagaaauguuuuccuugcc

SEQ ID NO: 1827451 - RNA, 22 nt, Homo sapiens
aacacuauuuccaaaagcacau

SEQ ID NO: 1827452 - RNA, 20 nt, Homo sapiens
aacagaacuucacagugaca

SEQ ID NO: 1827453 - RNA, 18 nt, Homo sapiens
uuuauuuuguaauuauga

SEQ ID NO: 1827454 - RNA, 14 nt, Homo sapiens
agaugaagacauca

SEQ ID NO: 1827455 - RNA, 19 nt, Homo sapiens
ucaguaaauagugucauau

SEQ ID NO: 1827456 - RNA, 18 nt, Homo sapiens
cccagcccugaggggugg

SEQ ID NO: 1827457 - RNA, 18 nt, Homo sapiens
ucugggaaaggugcucaa

SEQ ID NO: 1827458 - RNA, 16 nt, Homo sapiens
uuaacuuccacuguua

SEQ ID NO: 1827459 - RNA, 22 nt, Homo sapiens
caaacacaagugcgccuugcaa

SEQ ID NO: 1827460 - RNA, 19 nt, Homo sapiens
caacaggcaggggcccacu

SEQ ID NO: 1827461 - RNA, 17 nt, Homo sapiens
cugaucuggcagacuca

SEQ ID NO: 1827462 - RNA, 15 nt, Homo sapiens
uguccagcauggaug

SEQ ID NO: 1827463 - RNA, 16 nt, Homo sapiens
cugaguggguguugca

SEQ ID NO: 1827464 - RNA, 17 nt, Homo sapiens
cccaggcuggagugcaa

SEQ ID NO: 1827465 - RNA, 17 nt, Homo sapiens
cccaggcuagagugcag

SEQ ID NO: 1827466 - RNA, 21 nt, Homo sapiens
guauauaauacuaaagugucu

SEQ ID NO: 1827467 - RNA, 16 nt, Homo sapiens
caaggaaaauggacau

SEQ ID NO: 1827468 - RNA, 23 nt, Homo sapiens
uuuaggaagcuagacuagcugua

SEQ ID NO: 1827469 - RNA, 14 nt, Homo sapiens
ggaggccaggcccu

SEQ ID NO: 1827470 - RNA, 14 nt, Homo sapiens
uugcaaagauuucu

SEQ ID NO: 1827471 - RNA, 23 nt, Homo sapiens
acauggcuccggccucugccuuu

SEQ ID NO: 1827472 - RNA, 22 nt, Homo sapiens
cacuccacaguuaggccaagaa

SEQ ID NO: 1827473 - RNA, 22 nt, Homo sapiens
cagccuccaaaguggagcuggg

SEQ ID NO: 1827474 - RNA, 14 nt, Homo sapiens
ugagagaaaccucu

SEQ ID NO: 1827475 - RNA, 18 nt, Homo sapiens
aaagaaaaagaccuauga

SEQ ID NO: 1827476 - RNA, 18 nt, Homo sapiens
agccguuccgucccaaac

SEQ ID NO: 1827477 - RNA, 20 nt, Homo sapiens
ggaaacccuagaccauguca

SEQ ID NO: 1827478 - RNA, 17 nt, Homo sapiens
gugccaguccaucucaa

SEQ ID NO: 1827479 - RNA, 13 nt, Homo sapiens
acugagccaaaaa

SEQ ID NO: 1827480 - RNA, 17 nt, Homo sapiens
cuuguguugugugaucu

SEQ ID NO: 1827481 - RNA, 23 nt, Homo sapiens
uuauugccucugaaaugccucuu

SEQ ID NO: 1827482 - RNA, 18 nt, Homo sapiens
acagcaugagguguugug

SEQ ID NO: 1827483 - RNA, 18 nt, Homo sapiens
gauggcaggccugaccca

SEQ ID NO: 1827484 - RNA, 13 nt, Homo sapiens
aauacagcuauga

SEQ ID NO: 1827485 - RNA, 12 nt, Homo sapiens
uuauuaugcucu

SEQ ID NO: 1827486 - RNA, 17 nt, Homo sapiens
accuggggacuccucaa

SEQ ID NO: 1827487 - RNA, 17 nt, Homo sapiens
uacaguauucuguacca

SEQ ID NO: 1827488 - RNA, 16 nt, Homo sapiens
ccuuuuggccuuugua

SEQ ID NO: 1827489 - RNA, 21 nt, Homo sapiens
aaaugugacucaagacuucca

SEQ ID NO: 1827490 - RNA, 20 nt, Homo sapiens
aguagagaugggguuucacc

SEQ ID NO: 1827491 - RNA, 23 nt, Homo sapiens
aaacacuuuuucucgaguccaaa

SEQ ID NO: 1827492 - RNA, 17 nt, Homo sapiens
caguaaauagugucaua

SEQ ID NO: 1827493 - RNA, 14 nt, Homo sapiens
cacuccccucaaaa

SEQ ID NO: 1827494 - RNA, 19 nt, Homo sapiens
gagacaagggcaucaucua

SEQ ID NO: 1827495 - RNA, 17 nt, Homo sapiens
uacauuccucagcugcc

SEQ ID NO: 1827496 - RNA, 17 nt, Homo sapiens
ugcacugggguaccaca

SEQ ID NO: 1827497 - RNA, 13 nt, Homo sapiens
agccgcagcugua

SEQ ID NO: 1827498 - RNA, 20 nt, Homo sapiens
cugaacugaaaacaagccau

SEQ ID NO: 1827499 - RNA, 15 nt, Homo sapiens
uaauaacagguuuaa

SEQ ID NO: 1827500 - RNA, 19 nt, Homo sapiens
ugaugguaacugcacacau

SEQ ID NO: 1827501 - RNA, 21 nt, Homo sapiens
ccuagucuucacaacuuugac

SEQ ID NO: 1827502 - RNA, 19 nt, Homo sapiens
agacaaaaucuuaaaugcc

SEQ ID NO: 1827503 - RNA, 11 nt, Homo sapiens
gaaggggccau

SEQ ID NO: 1827504 - RNA, 19 nt, Homo sapiens
cugcaguggacagucccca

SEQ ID NO: 1827505 - RNA, 16 nt, Homo sapiens
caggacagaugccaca

SEQ ID NO: 1827506 - RNA, 21 nt, Homo sapiens
aggacugggucugaccuggug

SEQ ID NO: 1827507 - RNA, 21 nt, Homo sapiens
guugacugugauuagaucaca

SEQ ID NO: 1827508 - RNA, 20 nt, Homo sapiens
gcuguuuuaaaaacaaagaa

SEQ ID NO: 1827509 - RNA, 20 nt, Homo sapiens
ccagugggaacugugcaaag

SEQ ID NO: 1827510 - RNA, 15 nt, Homo sapiens
cuggcaagaaugugu

SEQ ID NO: 1827511 - RNA, 22 nt, Homo sapiens
ugaauuaaagucuacacugccu

SEQ ID NO: 1827512 - RNA, 17 nt, Homo sapiens
uaugaguaguguggaau

SEQ ID NO: 1827513 - RNA, 21 nt, Homo sapiens
aaugucuguaucacucugugu

SEQ ID NO: 1827514 - RNA, 15 nt, Homo sapiens
ggacucaagggucca

SEQ ID NO: 1827515 - RNA, 15 nt, Homo sapiens
uuauuuuauugccuu

SEQ ID NO: 1827516 - RNA, 11 nt, Homo sapiens
uucccuggaag

SEQ ID NO: 1827517 - RNA, 18 nt, Homo sapiens
aagugauuucagcacauu

SEQ ID NO: 1827518 - RNA, 12 nt, Homo sapiens
caaauagauuaa

SEQ ID NO: 1827519 - RNA, 22 nt, Homo sapiens
aucacaaaggcugacauucacu

SEQ ID NO: 1827520 - RNA, 18 nt, Homo sapiens
guccuucuguagugccau

SEQ ID NO: 1827521 - RNA, 22 nt, Homo sapiens
ccugacaugugacaucuaccuc

SEQ ID NO: 1827522 - RNA, 15 nt, Homo sapiens
guauuuaacaaaaag

SEQ ID NO: 1827523 - RNA, 16 nt, Homo sapiens
auacacacacaaacca

SEQ ID NO: 1827524 - RNA, 19 nt, Homo sapiens
ucagcucccauuucuacuc

SEQ ID NO: 1827525 - RNA, 18 nt, Homo sapiens
acuuuuggcuccucuagu

SEQ ID NO: 1827526 - RNA, 12 nt, Homo sapiens
uauaacaguguu

SEQ ID NO: 1827527 - RNA, 23 nt, Homo sapiens
uuuaaaaaaugagcuuccauuaa

SEQ ID NO: 1827528 - RNA, 18 nt, Homo sapiens
uuuccccaccccagcuca

SEQ ID NO: 1827529 - RNA, 16 nt, Homo sapiens
agcagaugccagugaa

SEQ ID NO: 1827530 - RNA, 13 nt, Homo sapiens
gcgaucucagcuc

SEQ ID NO: 1827531 - RNA, 17 nt, Homo sapiens
cucccagauaaugugaa

SEQ ID NO: 1827532 - RNA, 13 nt, Homo sapiens
caucuguaaaaua

SEQ ID NO: 1827533 - RNA, 13 nt, Homo sapiens
uagugcuacagaa

SEQ ID NO: 1827534 - RNA, 22 nt, Homo sapiens
aaacuuccucuuuuucaugaag

SEQ ID NO: 1827535 - RNA, 19 nt, Homo sapiens
uggcacaguuuucugagaa

SEQ ID NO: 1827536 - RNA, 23 nt, Homo sapiens
aacuacuuuuguaccagugugaa

SEQ ID NO: 1827537 - RNA, 19 nt, Homo sapiens
guugaucuggaacccagac

SEQ ID NO: 1827538 - RNA, 17 nt, Homo sapiens
agcuauuuucugaccaa

SEQ ID NO: 1827539 - RNA, 22 nt, Homo sapiens
ccacacccuggaggauuucauc

SEQ ID NO: 1827540 - RNA, 21 nt, Homo sapiens
aaggauaugguagcauuuuau

SEQ ID NO: 1827541 - RNA, 18 nt, Homo sapiens
cuuuuccauccuagugag

SEQ ID NO: 1827542 - RNA, 15 nt, Homo sapiens
uaaugacaacaaaag

SEQ ID NO: 1827543 - RNA, 18 nt, Homo sapiens
aaucugauuuacacuguu

SEQ ID NO: 1827544 - RNA, 13 nt, Homo sapiens
gacacagacucau

SEQ ID NO: 1827545 - RNA, 12 nt, Homo sapiens
aaacuucaucuu

SEQ ID NO: 1827546 - RNA, 12 nt, Homo sapiens
aaauuucaucuc

SEQ ID NO: 1827547 - RNA, 14 nt, Homo sapiens
aaacucacaacucu

SEQ ID NO: 1827548 - RNA, 16 nt, Homo sapiens
agaaaugggaaucaug

SEQ ID NO: 1827549 - RNA, 21 nt, Homo sapiens
ucccuguccuccucggaucac

SEQ ID NO: 1827550 - RNA, 14 nt, Homo sapiens
auuauuugcacaga

SEQ ID NO: 1827551 - RNA, 18 nt, Homo sapiens
caaacauuugccaaguga

SEQ ID NO: 1827552 - RNA, 16 nt, Homo sapiens
cucuaacccuguggaa

SEQ ID NO: 1827553 - RNA, 22 nt, Homo sapiens
aucauuugagcucaugagggcc

SEQ ID NO: 1827554 - RNA, 18 nt, Homo sapiens
ugcagaugguugcaauug

SEQ ID NO: 1827555 - RNA, 22 nt, Homo sapiens
auuaauuugugaauuugcaaca

SEQ ID NO: 1827556 - RNA, 19 nt, Homo sapiens
uagauugggguagagggaa

SEQ ID NO: 1827557 - RNA, 18 nt, Homo sapiens
gcaggaaagggagggaau

SEQ ID NO: 1827558 - RNA, 20 nt, Homo sapiens
acugcaaagcucggugcucc

SEQ ID NO: 1827559 - RNA, 21 nt, Homo sapiens
uuuuaggaugucauucuuugc

SEQ ID NO: 1827560 - RNA, 20 nt, Homo sapiens
acucagggcuccucccagcu

SEQ ID NO: 1827561 - RNA, 17 nt, Homo sapiens
caaucgagacugcaaug

SEQ ID NO: 1827562 - RNA, 22 nt, Homo sapiens
agcuuuucuugauaggccuagu

SEQ ID NO: 1827563 - RNA, 22 nt, Homo sapiens
guccagccuaaucaagucaaau

SEQ ID NO: 1827564 - RNA, 21 nt, Homo sapiens
accuaaugggaaucauuccac

SEQ ID NO: 1827565 - RNA, 16 nt, Homo sapiens
cucccccuccccggca

SEQ ID NO: 1827566 - RNA, 14 nt, Homo sapiens
cuaguucuuaggaa

SEQ ID NO: 1827567 - RNA, 20 nt, Homo sapiens
uuacucaucgggcccaggga

SEQ ID NO: 1827568 - RNA, 19 nt, Homo sapiens
ggagaugcggaaagcccug

SEQ ID NO: 1827569 - RNA, 23 nt, Homo sapiens
cuagugucuuuuuuuucuucacc

SEQ ID NO: 1827570 - RNA, 22 nt, Homo sapiens
ugccaacagcuggccaguaauu

SEQ ID NO: 1827571 - RNA, 21 nt, Homo sapiens
augcucucucaccugcuccca

SEQ ID NO: 1827572 - RNA, 22 nt, Homo sapiens
aguacuagaugcaucacugggu

SEQ ID NO: 1827573 - RNA, 18 nt, Homo sapiens
aaaauuauuagaacauuc

SEQ ID NO: 1827574 - RNA, 15 nt, Homo sapiens
cucagucagugcacu

SEQ ID NO: 1827575 - RNA, 16 nt, Homo sapiens
ccuagaccugggcucc

SEQ ID NO: 1827576 - RNA, 16 nt, Homo sapiens
cagucuuuugugucag

SEQ ID NO: 1827577 - RNA, 16 nt, Homo sapiens
augagggagaugccau

SEQ ID NO: 1827578 - RNA, 17 nt, Homo sapiens
auuuuuguauccaagga

SEQ ID NO: 1827579 - RNA, 14 nt, Homo sapiens
uauggauucacuuc

SEQ ID NO: 1827580 - RNA, 16 nt, Homo sapiens
cucagcaaguguacag

SEQ ID NO: 1827581 - RNA, 15 nt, Homo sapiens
ugccucuugcagggu

SEQ ID NO: 1827582 - RNA, 21 nt, Homo sapiens
agagggcugcgagcauuuccc

SEQ ID NO: 1827583 - RNA, 13 nt, Homo sapiens
ucccacagcacaa

SEQ ID NO: 1827584 - RNA, 13 nt, Homo sapiens
cauaucagucucu

SEQ ID NO: 1827585 - RNA, 17 nt, Homo sapiens
auuuauaaucacuuuuu

SEQ ID NO: 1827586 - RNA, 20 nt, Homo sapiens
gagcugcuaaacucuuucau

SEQ ID NO: 1827587 - RNA, 23 nt, Homo sapiens
acuuaaaucuauauacaaagccu

SEQ ID NO: 1827588 - RNA, 14 nt, Homo sapiens
cgggagacucugaa

SEQ ID NO: 1827589 - RNA, 16 nt, Homo sapiens
ccaugaaaauagccaa

SEQ ID NO: 1827590 - RNA, 21 nt, Homo sapiens
gcaccggucuuugauccgcag

SEQ ID NO: 1827591 - RNA, 22 nt, Homo sapiens
ucccaucuaaaacucauacaau

SEQ ID NO: 1827592 - RNA, 15 nt, Homo sapiens
acccagccauguguu

SEQ ID NO: 1827593 - RNA, 18 nt, Homo sapiens
gaaacacagcaacaauga

SEQ ID NO: 1827594 - RNA, 17 nt, Homo sapiens
cuuaugccugucuuuac

SEQ ID NO: 1827595 - RNA, 15 nt, Homo sapiens
ccaguggaaccaaaa

SEQ ID NO: 1827596 - RNA, 11 nt, Homo sapiens
uaugugacuug

SEQ ID NO: 1827597 - RNA, 23 nt, Homo sapiens
cacauuaaauugauaacauggaa

SEQ ID NO: 1827598 - RNA, 19 nt, Homo sapiens
uccaggccgagaugugcaa

SEQ ID NO: 1827599 - RNA, 23 nt, Homo sapiens
ccucacagagugcauugugaggg

SEQ ID NO: 1827600 - RNA, 16 nt, Homo sapiens
accacaaaucugaaug

SEQ ID NO: 1827601 - RNA, 15 nt, Homo sapiens
uuugaggucuagaga

SEQ ID NO: 1827602 - RNA, 11 nt, Homo sapiens
guggucauuuc

SEQ ID NO: 1827603 - RNA, 21 nt, Homo sapiens
uuuuuguauuuuggcagagau

SEQ ID NO: 1827604 - RNA, 20 nt, Homo sapiens
ucuaucuaaugacaugccua

SEQ ID NO: 1827605 - RNA, 18 nt, Homo sapiens
acacccagugccaggggc

SEQ ID NO: 1827606 - RNA, 14 nt, Homo sapiens
gaagaaacuuugcc

SEQ ID NO: 1827607 - RNA, 17 nt, Homo sapiens
ucugugggauaucacau

SEQ ID NO: 1827608 - RNA, 17 nt, Homo sapiens
uuuguaugacagugaag

SEQ ID NO: 1827609 - RNA, 15 nt, Homo sapiens
acagccaaaccacug

SEQ ID NO: 1827610 - RNA, 21 nt, Homo sapiens
acuugagaaccagucuccuca

SEQ ID NO: 1827611 - RNA, 14 nt, Homo sapiens
gaggccccggcugg

SEQ ID NO: 1827612 - RNA, 17 nt, Homo sapiens
ggcacuacuucuauuca

SEQ ID NO: 1827613 - RNA, 13 nt, Homo sapiens
agcuccuugacuc

SEQ ID NO: 1827614 - RNA, 16 nt, Homo sapiens
ccccugcugcugucac

SEQ ID NO: 1827615 - RNA, 19 nt, Homo sapiens
acgcacauagagauaugca

SEQ ID NO: 1827616 - RNA, 18 nt, Homo sapiens
agaguucgugaagaggga

SEQ ID NO: 1827617 - RNA, 22 nt, Homo sapiens
augugaaguguauaugauucuc

SEQ ID NO: 1827618 - RNA, 18 nt, Homo sapiens
ugauuaugaaaugccaga

SEQ ID NO: 1827619 - RNA, 16 nt, Homo sapiens
ugaggcuggacuccag

SEQ ID NO: 1827620 - RNA, 11 nt, Homo sapiens
gcaauaaucuu

SEQ ID NO: 1827621 - RNA, 19 nt, Homo sapiens
caaaugacuucauuucuga

SEQ ID NO: 1827622 - RNA, 16 nt, Homo sapiens
guccccagacucagcu

SEQ ID NO: 1827623 - RNA, 19 nt, Homo sapiens
uauaaaugagcaaauggaa

SEQ ID NO: 1827624 - RNA, 12 nt, Homo sapiens
ccuucgggguga

SEQ ID NO: 1827625 - RNA, 12 nt, Homo sapiens
gcuaccaggaaa

SEQ ID NO: 1827626 - RNA, 15 nt, Homo sapiens
aacuacacuaauaaa

SEQ ID NO: 1827627 - RNA, 15 nt, Homo sapiens
gauuauuuuaaucua

SEQ ID NO: 1827628 - RNA, 15 nt, Homo sapiens
uccuuaacacauuca

SEQ ID NO: 1827629 - RNA, 15 nt, Homo sapiens
caaagcugucacuca

SEQ ID NO: 1827630 - RNA, 11 nt, Homo sapiens
auggguucauc

SEQ ID NO: 1827631 - RNA, 18 nt, Homo sapiens
cagcaggcauggauccag

SEQ ID NO: 1827632 - RNA, 13 nt, Homo sapiens
uauucaucugauu

SEQ ID NO: 1827633 - RNA, 18 nt, Homo sapiens
cuuugcuaaagacaugaa

SEQ ID NO: 1827634 - RNA, 18 nt, Homo sapiens
agcuauuucgcacuguau

SEQ ID NO: 1827635 - RNA, 22 nt, Homo sapiens
auuagucuuggaaaaaaaccac

SEQ ID NO: 1827636 - RNA, 17 nt, Homo sapiens
gagucagaaaacagaga

SEQ ID NO: 1827637 - RNA, 13 nt, Homo sapiens
gcaaacccaguga

SEQ ID NO: 1827638 - RNA, 17 nt, Homo sapiens
uaaucacucagugauug

SEQ ID NO: 1827639 - RNA, 17 nt, Homo sapiens
uucacuuucaauugcuu

SEQ ID NO: 1827640 - RNA, 18 nt, Homo sapiens
aggugagaacuaaugccu

SEQ ID NO: 1827641 - RNA, 19 nt, Homo sapiens
ggcagaaaacuggcagugc

SEQ ID NO: 1827642 - RNA, 15 nt, Homo sapiens
gaaugcgguucaggg

SEQ ID NO: 1827643 - RNA, 15 nt, Homo sapiens
ccgcucugauuucag

SEQ ID NO: 1827644 - RNA, 16 nt, Homo sapiens
ucuucuaccauuugaa

SEQ ID NO: 1827645 - RNA, 19 nt, Homo sapiens
agcuuuagagaagccauaa

SEQ ID NO: 1827646 - RNA, 19 nt, Homo sapiens
caaauaaacggacucagug

SEQ ID NO: 1827647 - RNA, 18 nt, Homo sapiens
uuuaacuauucauaagau

SEQ ID NO: 1827648 - RNA, 16 nt, Homo sapiens
uuacagagaaucugaa

SEQ ID NO: 1827649 - RNA, 14 nt, Homo sapiens
ggagugagacugac

SEQ ID NO: 1827650 - RNA, 18 nt, Homo sapiens
caccagccccacugccag

SEQ ID NO: 1827651 - RNA, 16 nt, Homo sapiens
cucggugaugccuucc

SEQ ID NO: 1827652 - RNA, 23 nt, Homo sapiens
cucacugcaggcaugcugaacaa

SEQ ID NO: 1827653 - RNA, 11 nt, Homo sapiens
augccaaagga

SEQ ID NO: 1827654 - RNA, 17 nt, Homo sapiens
auuuaacugcauauaga

SEQ ID NO: 1827655 - RNA, 20 nt, Homo sapiens
cuagaggauguaucucacaa

SEQ ID NO: 1827656 - RNA, 22 nt, Homo sapiens
gaaaaguuucaaaccuacuaau

SEQ ID NO: 1827657 - RNA, 14 nt, Homo sapiens
ggacacacaucaaa

SEQ ID NO: 1827658 - RNA, 19 nt, Homo sapiens
ucuggcaaacaugugcaac

SEQ ID NO: 1827659 - RNA, 17 nt, Homo sapiens
uccuuuuugacacugaa

SEQ ID NO: 1827660 - RNA, 18 nt, Homo sapiens
uuuuaucauuaccauuaa

SEQ ID NO: 1827661 - RNA, 20 nt, Homo sapiens
aguacuuaauaaacuguggu

SEQ ID NO: 1827662 - RNA, 13 nt, Homo sapiens
uacagaugaacuc

SEQ ID NO: 1827663 - RNA, 13 nt, Homo sapiens
agcacaugugcug

SEQ ID NO: 1827664 - RNA, 13 nt, Homo sapiens
aggagaugugguc

SEQ ID NO: 1827665 - RNA, 13 nt, Homo sapiens
uacagagaagcca

SEQ ID NO: 1827666 - RNA, 20 nt, Homo sapiens
ggagccugggcauccucagg

SEQ ID NO: 1827667 - RNA, 15 nt, Homo sapiens
ccuuuugcauucucc

SEQ ID NO: 1827668 - RNA, 12 nt, Homo sapiens
cucuguugacug

SEQ ID NO: 1827669 - RNA, 21 nt, Homo sapiens
gccucaccugcuguccugcaa

SEQ ID NO: 1827670 - RNA, 20 nt, Homo sapiens
cuugugaaggaaaaacaugc

SEQ ID NO: 1827671 - RNA, 14 nt, Homo sapiens
cugauaccauucua

SEQ ID NO: 1827672 - RNA, 14 nt, Homo sapiens
gagcaggcuacugu

SEQ ID NO: 1827673 - RNA, 18 nt, Homo sapiens
accuggucuggucaggca

SEQ ID NO: 1827674 - RNA, 16 nt, Homo sapiens
uuguacauuccugaua

SEQ ID NO: 1827675 - RNA, 23 nt, Homo sapiens
ccgguacaaguggcucaucauca

SEQ ID NO: 1827676 - RNA, 20 nt, Homo sapiens
aucacuuaaaggcacaaaua

SEQ ID NO: 1827677 - RNA, 14 nt, Homo sapiens
cggcuucccaugcc

SEQ ID NO: 1827678 - RNA, 18 nt, Homo sapiens
gaugaaacaucauuucaa

SEQ ID NO: 1827679 - RNA, 20 nt, Homo sapiens
aggguuuugccauguugccc

SEQ ID NO: 1827680 - RNA, 15 nt, Homo sapiens
acuagaugaccucau

SEQ ID NO: 1827681 - RNA, 22 nt, Homo sapiens
auccauucccaagaugccugau

SEQ ID NO: 1827682 - RNA, 18 nt, Homo sapiens
uaaaaccugggugucaga

SEQ ID NO: 1827683 - RNA, 15 nt, Homo sapiens
aagguggacuuccag

SEQ ID NO: 1827684 - RNA, 22 nt, Homo sapiens
guacacacccacacacaucuau

SEQ ID NO: 1827685 - RNA, 17 nt, Homo sapiens
cccaguggcagggcaca

SEQ ID NO: 1827686 - RNA, 18 nt, Homo sapiens
uuuaaugugcuguguaaa

SEQ ID NO: 1827687 - RNA, 18 nt, Homo sapiens
ugcucuccagccugggag

SEQ ID NO: 1827688 - RNA, 18 nt, Homo sapiens
acucaaauuggugaacag

SEQ ID NO: 1827689 - RNA, 19 nt, Homo sapiens
aaguugauuagaaagacca

SEQ ID NO: 1827690 - RNA, 23 nt, Homo sapiens
ggagcagugcuuuucacuacuuu

SEQ ID NO: 1827691 - RNA, 21 nt, Homo sapiens
gccaagauacuugaacacugu

SEQ ID NO: 1827692 - RNA, 19 nt, Homo sapiens
ugaaauuucccacacccca

SEQ ID NO: 1827693 - RNA, 19 nt, Homo sapiens
ugcaauaaaagugcuuuau

SEQ ID NO: 1827694 - RNA, 17 nt, Homo sapiens
cacuggcguuacugcuu

SEQ ID NO: 1827695 - RNA, 14 nt, Homo sapiens
gagaaaccugccaa

SEQ ID NO: 1827696 - RNA, 18 nt, Homo sapiens
gucacaccucacugucau

SEQ ID NO: 1827697 - RNA, 19 nt, Homo sapiens
uucccuggagagaaagugu

SEQ ID NO: 1827698 - RNA, 23 nt, Homo sapiens
cugccuaguaagggaacuaugga

SEQ ID NO: 1827699 - RNA, 12 nt, Homo sapiens
aagcaugguccg

SEQ ID NO: 1827700 - RNA, 21 nt, Homo sapiens
cccucgucuagagcagaccca

SEQ ID NO: 1827701 - RNA, 15 nt, Homo sapiens
cacauucggacccug

SEQ ID NO: 1827702 - RNA, 21 nt, Homo sapiens
aaauacaauaaacuuacuaua

SEQ ID NO: 1827703 - RNA, 22 nt, Homo sapiens
cuuucguucugcugaccaaaug

SEQ ID NO: 1827704 - RNA, 21 nt, Homo sapiens
uaaacucaucaaugugccuuu

SEQ ID NO: 1827705 - RNA, 14 nt, Homo sapiens
ucccuccccagugu

SEQ ID NO: 1827706 - RNA, 23 nt, Homo sapiens
agguggucaacaacauuccucaa

SEQ ID NO: 1827707 - RNA, 15 nt, Homo sapiens
ccaugugugugcaag

SEQ ID NO: 1827708 - RNA, 13 nt, Homo sapiens
ccaacucuugcag

SEQ ID NO: 1827709 - RNA, 22 nt, Homo sapiens
agcccugcgccaccucacugca

SEQ ID NO: 1827710 - RNA, 14 nt, Homo sapiens
cuaauuguguacau

SEQ ID NO: 1827711 - RNA, 13 nt, Homo sapiens
auucuuaaugaca

SEQ ID NO: 1827712 - RNA, 15 nt, Homo sapiens
acauguaauuugaug

SEQ ID NO: 1827713 - RNA, 21 nt, Homo sapiens
uauuuuuuuaagcuguaaaaa

SEQ ID NO: 1827714 - RNA, 20 nt, Homo sapiens
gcccagaggcggagggcagu

SEQ ID NO: 1827715 - RNA, 17 nt, Homo sapiens
auagccuauuguguaug

SEQ ID NO: 1827716 - RNA, 21 nt, Homo sapiens
aaaaauugaaacuugcauuuu

SEQ ID NO: 1827717 - RNA, 13 nt, Homo sapiens
ccauguuauguga

SEQ ID NO: 1827718 - RNA, 20 nt, Homo sapiens
cccuacucccucuucacugu

SEQ ID NO: 1827719 - RNA, 13 nt, Homo sapiens
ucauccugcaggc

SEQ ID NO: 1827720 - RNA, 12 nt, Homo sapiens
cccuucacccca

SEQ ID NO: 1827721 - RNA, 22 nt, Homo sapiens
acuccggccugggugacagagu

SEQ ID NO: 1827722 - RNA, 21 nt, Homo sapiens
aucuuauuacugagagugcaa

SEQ ID NO: 1827723 - RNA, 14 nt, Homo sapiens
ugcaccacugcucu

SEQ ID NO: 1827724 - RNA, 21 nt, Homo sapiens
cuuaaugaagagccagcccaa

SEQ ID NO: 1827725 - RNA, 17 nt, Homo sapiens
aagucuugaaaacagug

SEQ ID NO: 1827726 - RNA, 20 nt, Homo sapiens
auaauuuuuaccuaaucucc

SEQ ID NO: 1827727 - RNA, 13 nt, Homo sapiens
caaagggugcuag

SEQ ID NO: 1827728 - RNA, 14 nt, Homo sapiens
gccuacaggccuca

SEQ ID NO: 1827729 - RNA, 23 nt, Homo sapiens
caaaugucuucaugaccuacuuc

SEQ ID NO: 1827730 - RNA, 12 nt, Homo sapiens
caccuaugugcc

SEQ ID NO: 1827731 - RNA, 15 nt, Homo sapiens
ugccuucugcugaaa

SEQ ID NO: 1827732 - RNA, 20 nt, Homo sapiens
aauuaaagccuuaagcacaa

SEQ ID NO: 1827733 - RNA, 19 nt, Homo sapiens
gaauaaggcuuuuucuucc

SEQ ID NO: 1827734 - RNA, 17 nt, Homo sapiens
gaaugcagcacugcugc

SEQ ID NO: 1827735 - RNA, 16 nt, Homo sapiens
aauaaugccaaugaac

SEQ ID NO: 1827736 - RNA, 15 nt, Homo sapiens
gaauacauaaaguau

SEQ ID NO: 1827737 - RNA, 22 nt, Homo sapiens
aacacaagaagacccauccuga

SEQ ID NO: 1827738 - RNA, 21 nt, Homo sapiens
aguccagcucaucugccaaaa

SEQ ID NO: 1827739 - RNA, 17 nt, Homo sapiens
gaaauaaagaguucucc

SEQ ID NO: 1827740 - RNA, 18 nt, Homo sapiens
gcuuuuuguucagaauua

SEQ ID NO: 1827741 - RNA, 16 nt, Homo sapiens
aacauccucuuccaua

SEQ ID NO: 1827742 - RNA, 19 nt, Homo sapiens
gauuuuuuuguaaauauga

SEQ ID NO: 1827743 - RNA, 18 nt, Homo sapiens
ggggcgagcacugugagc

SEQ ID NO: 1827744 - RNA, 20 nt, Homo sapiens
ccgguccgcccgcuucccuc

SEQ ID NO: 1827745 - RNA, 19 nt, Homo sapiens
uggaaaacaguauuuucca

SEQ ID NO: 1827746 - RNA, 17 nt, Homo sapiens
uggaauccaucugucuc

SEQ ID NO: 1827747 - RNA, 16 nt, Homo sapiens
cuuucggucuccuuaa

SEQ ID NO: 1827748 - RNA, 18 nt, Homo sapiens
acucagucucucuucucu

SEQ ID NO: 1827749 - RNA, 18 nt, Homo sapiens
gguguacacggaggucuc

SEQ ID NO: 1827750 - RNA, 13 nt, Homo sapiens
cuuauuccaugac

SEQ ID NO: 1827751 - RNA, 22 nt, Homo sapiens
uccagccaccacccacaaucac

SEQ ID NO: 1827752 - RNA, 20 nt, Homo sapiens
cagccucccaaguagcugag

SEQ ID NO: 1827753 - RNA, 21 nt, Homo sapiens
gagauaacagccucuugcccg

SEQ ID NO: 1827754 - RNA, 18 nt, Homo sapiens
uagagggauuucuuugcu

SEQ ID NO: 1827755 - RNA, 14 nt, Homo sapiens
ccagaggcugcaga

SEQ ID NO: 1827756 - RNA, 18 nt, Homo sapiens
ugggguuugaagcugacu

SEQ ID NO: 1827757 - RNA, 20 nt, Homo sapiens
aaccaaauggagugacuuag

SEQ ID NO: 1827758 - RNA, 14 nt, Homo sapiens
uucacaauauccaa

SEQ ID NO: 1827759 - RNA, 13 nt, Homo sapiens
ugauauaaauucu

SEQ ID NO: 1827760 - RNA, 17 nt, Homo sapiens
gcuguaguaccccaaga

SEQ ID NO: 1827761 - RNA, 20 nt, Homo sapiens
ucaacagugugagcauuugu

SEQ ID NO: 1827762 - RNA, 22 nt, Homo sapiens
aguuucauuuccuuguccugcu

SEQ ID NO: 1827763 - RNA, 13 nt, Homo sapiens
agcaagaugaaac

SEQ ID NO: 1827764 - RNA, 20 nt, Homo sapiens
cauguauuucuuacguacac

SEQ ID NO: 1827765 - RNA, 15 nt, Homo sapiens
ggcauggaacuuuuu

SEQ ID NO: 1827766 - RNA, 11 nt, Homo sapiens
cccucagcacu

SEQ ID NO: 1827767 - RNA, 16 nt, Homo sapiens
ugccuccugccugccc

SEQ ID NO: 1827768 - RNA, 14 nt, Homo sapiens
cugagucgugaccu

SEQ ID NO: 1827769 - RNA, 22 nt, Homo sapiens
auuuucaagagucuaauagucu

SEQ ID NO: 1827770 - RNA, 13 nt, Homo sapiens
cagucccuuucag

SEQ ID NO: 1827771 - RNA, 18 nt, Homo sapiens
uugauaccauggcacuga

SEQ ID NO: 1827772 - RNA, 19 nt, Homo sapiens
agaggugcaagaccuaguc

SEQ ID NO: 1827773 - RNA, 17 nt, Homo sapiens
uucauuaaaacaagaga

SEQ ID NO: 1827774 - RNA, 20 nt, Homo sapiens
aucccuuaaucuaugugcac

SEQ ID NO: 1827775 - RNA, 17 nt, Homo sapiens
accagguccaaugagcu

SEQ ID NO: 1827776 - RNA, 21 nt, Homo sapiens
aaaagucauuuaauguagaau

SEQ ID NO: 1827777 - RNA, 17 nt, Homo sapiens
aaagauuguuggaugaa

SEQ ID NO: 1827778 - RNA, 21 nt, Homo sapiens
aauggugauacauucuagccu

SEQ ID NO: 1827779 - RNA, 20 nt, Homo sapiens
cauguggaaaacucacagau

SEQ ID NO: 1827780 - RNA, 14 nt, Homo sapiens
auagcuugagcuau

SEQ ID NO: 1827781 - RNA, 15 nt, Homo sapiens
caauaaaauguaucu

SEQ ID NO: 1827782 - RNA, 19 nt, Homo sapiens
ggcagaaaugccgggcaca

SEQ ID NO: 1827783 - RNA, 17 nt, Homo sapiens
cuucaacguagucaucc

SEQ ID NO: 1827784 - RNA, 18 nt, Homo sapiens
uggacucagcugccagca

SEQ ID NO: 1827785 - RNA, 21 nt, Homo sapiens
agaaggugggaggaugugaau

SEQ ID NO: 1827786 - RNA, 20 nt, Homo sapiens
aggcauacugccuuguuuaa

SEQ ID NO: 1827787 - RNA, 15 nt, Homo sapiens
auucaacaauuucaa

SEQ ID NO: 1827788 - RNA, 18 nt, Homo sapiens
agcacaaccggucccuuc

SEQ ID NO: 1827789 - RNA, 23 nt, Homo sapiens
uagauauuuuccauauauuggca

SEQ ID NO: 1827790 - RNA, 17 nt, Homo sapiens
aacuccuuucagccaca

SEQ ID NO: 1827791 - RNA, 18 nt, Homo sapiens
cuuuccaaugccacagac

SEQ ID NO: 1827792 - RNA, 21 nt, Homo sapiens
uccaguuuuuugccacugcaa

SEQ ID NO: 1827793 - RNA, 22 nt, Homo sapiens
aaaccagcaacuaauaaaaccu

SEQ ID NO: 1827794 - RNA, 15 nt, Homo sapiens
ugcaaaacauuucau

SEQ ID NO: 1827795 - RNA, 19 nt, Homo sapiens
cuucaaggaagugauaaca

SEQ ID NO: 1827796 - RNA, 18 nt, Homo sapiens
uguacauuaugaagaaua

SEQ ID NO: 1827797 - RNA, 16 nt, Homo sapiens
aaauuaaacuuccuuc

SEQ ID NO: 1827798 - RNA, 20 nt, Homo sapiens
gagcccuuagccuugcugua

SEQ ID NO: 1827799 - RNA, 22 nt, Homo sapiens
uguaauuccucuagcuaccauu

SEQ ID NO: 1827800 - RNA, 22 nt, Homo sapiens
caucucagcaaucacaagccaa

SEQ ID NO: 1827801 - RNA, 23 nt, Homo sapiens
ugacugcucaugguuaaugcagg

SEQ ID NO: 1827802 - RNA, 19 nt, Homo sapiens
uagagaucugaaaacucau

SEQ ID NO: 1827803 - RNA, 17 nt, Homo sapiens
cacaccuagcaucucau

SEQ ID NO: 1827804 - RNA, 19 nt, Homo sapiens
uacauccuaagguucuugc

SEQ ID NO: 1827805 - RNA, 16 nt, Homo sapiens
gcugcauuugugucau

SEQ ID NO: 1827806 - RNA, 20 nt, Homo sapiens
acauuguauuaauaccaaag

SEQ ID NO: 1827807 - RNA, 20 nt, Homo sapiens
aaugucaauaugagauauua

SEQ ID NO: 1827808 - RNA, 19 nt, Homo sapiens
ccuggccucaagugaucug

SEQ ID NO: 1827809 - RNA, 18 nt, Homo sapiens
gaggcuagccccagggug

SEQ ID NO: 1827810 - RNA, 15 nt, Homo sapiens
ucaaaaugguuuauu

SEQ ID NO: 1827811 - RNA, 14 nt, Homo sapiens
aauacagcuaugaa

SEQ ID NO: 1827812 - RNA, 20 nt, Homo sapiens
gaccucacuguccugugaag

SEQ ID NO: 1827813 - RNA, 14 nt, Homo sapiens
caguugaacagagg

SEQ ID NO: 1827814 - RNA, 14 nt, Homo sapiens
agcugaaaagcaua

SEQ ID NO: 1827815 - RNA, 11 nt, Homo sapiens
cauuguucucc

SEQ ID NO: 1827816 - RNA, 20 nt, Homo sapiens
ugccaagggcagguugauca

SEQ ID NO: 1827817 - RNA, 17 nt, Homo sapiens
aguaguuuuguucauga

SEQ ID NO: 1827818 - RNA, 16 nt, Homo sapiens
acaggucggggaccaa

SEQ ID NO: 1827819 - RNA, 14 nt, Homo sapiens
ucuggggcauuauc

SEQ ID NO: 1827820 - RNA, 13 nt, Homo sapiens
acauagugaaaau

SEQ ID NO: 1827821 - RNA, 19 nt, Homo sapiens
agcagauuucuaugguacc

SEQ ID NO: 1827822 - RNA, 16 nt, Homo sapiens
cccuggacaagccaca

SEQ ID NO: 1827823 - RNA, 21 nt, Homo sapiens
gcccucaucaucaacgucuca

SEQ ID NO: 1827824 - RNA, 23 nt, Homo sapiens
cugacuaauuuuuguauuuuuag

SEQ ID NO: 1827825 - RNA, 18 nt, Homo sapiens
aggauuuuacagaaacgu

SEQ ID NO: 1827826 - RNA, 19 nt, Homo sapiens
ucccaccccuaccucuagu

SEQ ID NO: 1827827 - RNA, 12 nt, Homo sapiens
uuuagucuuguc

SEQ ID NO: 1827828 - RNA, 19 nt, Homo sapiens
agaucuggaaccucagccu

SEQ ID NO: 1827829 - RNA, 20 nt, Homo sapiens
ucugcuuuuccugucuguau

SEQ ID NO: 1827830 - RNA, 17 nt, Homo sapiens
agagcucuggugauaag

SEQ ID NO: 1827831 - RNA, 18 nt, Homo sapiens
cuuaguguuucugugcau

SEQ ID NO: 1827832 - RNA, 21 nt, Homo sapiens
cauaagugaaaaucuuacaac

SEQ ID NO: 1827833 - RNA, 19 nt, Homo sapiens
gcuuacauuugaacuugau

SEQ ID NO: 1827834 - RNA, 21 nt, Homo sapiens
gugcugcggguggguauccca

SEQ ID NO: 1827835 - RNA, 20 nt, Homo sapiens
cgagacuugguuucaaaaaa

SEQ ID NO: 1827836 - RNA, 13 nt, Homo sapiens
cccucagagccuc

SEQ ID NO: 1827837 - RNA, 13 nt, Homo sapiens
cccugagagccug

SEQ ID NO: 1827838 - RNA, 13 nt, Homo sapiens
aguaucuauuucu

SEQ ID NO: 1827839 - RNA, 14 nt, Homo sapiens
ugagggcaggguuc

SEQ ID NO: 1827840 - RNA, 16 nt, Homo sapiens
uccaaauggcugcuuu

SEQ ID NO: 1827841 - RNA, 22 nt, Homo sapiens
ccaggaggcggagguugcagua

SEQ ID NO: 1827842 - RNA, 13 nt, Homo sapiens
aaaagucauucaa

SEQ ID NO: 1827843 - RNA, 15 nt, Homo sapiens
aaaugaugagucuau

SEQ ID NO: 1827844 - RNA, 14 nt, Homo sapiens
aagucuuccaugac

SEQ ID NO: 1827845 - RNA, 21 nt, Homo sapiens
ugaucaggcuauguauggaau

SEQ ID NO: 1827846 - RNA, 18 nt, Homo sapiens
ccagaacugcacucuuca

SEQ ID NO: 1827847 - RNA, 16 nt, Homo sapiens
cccuucccucugggca

SEQ ID NO: 1827848 - RNA, 19 nt, Homo sapiens
uuauuuaucccucauucau

SEQ ID NO: 1827849 - RNA, 21 nt, Homo sapiens
aaacaacuuguguucuauuaa

SEQ ID NO: 1827850 - RNA, 20 nt, Homo sapiens
ucuucaucucccggugccuu

SEQ ID NO: 1827851 - RNA, 16 nt, Homo sapiens
cucaaaccacuugccu

SEQ ID NO: 1827852 - RNA, 13 nt, Homo sapiens
auuuuuauuaaau

SEQ ID NO: 1827853 - RNA, 11 nt, Homo sapiens
uaggauuuaua

SEQ ID NO: 1827854 - RNA, 19 nt, Homo sapiens
aagugcuucacagguuuua

SEQ ID NO: 1827855 - RNA, 16 nt, Homo sapiens
gugauuacucuuugcu

SEQ ID NO: 1827856 - RNA, 16 nt, Homo sapiens
cccgucauguuccuca

SEQ ID NO: 1827857 - RNA, 14 nt, Homo sapiens
gcugagagacccaa

SEQ ID NO: 1827858 - RNA, 14 nt, Homo sapiens
gcccagagacugaa

SEQ ID NO: 1827859 - RNA, 16 nt, Homo sapiens
uggcccccugugccag

SEQ ID NO: 1827860 - RNA, 19 nt, Homo sapiens
cguggugugagaagaucau

SEQ ID NO: 1827861 - RNA, 15 nt, Homo sapiens
cugcuccuccaguac

SEQ ID NO: 1827862 - RNA, 19 nt, Homo sapiens
uccccuugcagccugguca

SEQ ID NO: 1827863 - RNA, 19 nt, Homo sapiens
cacgaggucaggaguucaa

SEQ ID NO: 1827864 - RNA, 21 nt, Homo sapiens
uaccuguacuaaaccaccuca

SEQ ID NO: 1827865 - RNA, 15 nt, Homo sapiens
uauccaauugcucuu

SEQ ID NO: 1827866 - RNA, 14 nt, Homo sapiens
ucuaaacuuucccu

SEQ ID NO: 1827867 - RNA, 22 nt, Homo sapiens
gaguuccuagcaaguugacuaa

SEQ ID NO: 1827868 - RNA, 18 nt, Homo sapiens
agccugugccacacuucg

SEQ ID NO: 1827869 - RNA, 15 nt, Homo sapiens
ccuggguuagacugc

SEQ ID NO: 1827870 - RNA, 14 nt, Homo sapiens
gagaaaugugucau

SEQ ID NO: 1827871 - RNA, 15 nt, Homo sapiens
aaaguauucucaaag

SEQ ID NO: 1827872 - RNA, 12 nt, Homo sapiens
cacacauucacg

SEQ ID NO: 1827873 - RNA, 13 nt, Homo sapiens
gccuguggcauuc

SEQ ID NO: 1827874 - RNA, 19 nt, Homo sapiens
uguaauuccagccacucga

SEQ ID NO: 1827875 - RNA, 13 nt, Homo sapiens
ccuugaaggguuc

SEQ ID NO: 1827876 - RNA, 24 nt, Homo sapiens
uucuuuucaaugcaaugcaucuga

SEQ ID NO: 1827877 - RNA, 14 nt, Homo sapiens
acuggugcucucuu

SEQ ID NO: 1827878 - RNA, 13 nt, Homo sapiens
uacccccucauuu

SEQ ID NO: 1827879 - RNA, 17 nt, Homo sapiens
gaaacugccauugugau

SEQ ID NO: 1827880 - RNA, 18 nt, Homo sapiens
ucagaguugagaccuuug

SEQ ID NO: 1827881 - RNA, 16 nt, Homo sapiens
guccugccuugaugaa

SEQ ID NO: 1827882 - RNA, 13 nt, Homo sapiens
cuggagcugccag

SEQ ID NO: 1827883 - RNA, 21 nt, Homo sapiens
cuguugucacaucucagggaa

SEQ ID NO: 1827884 - RNA, 16 nt, Homo sapiens
gugagcaaagggcuca

SEQ ID NO: 1827885 - RNA, 15 nt, Homo sapiens
cuccgugugucucau

SEQ ID NO: 1827886 - RNA, 17 nt, Homo sapiens
aaauauaagaacuugau

SEQ ID NO: 1827887 - RNA, 23 nt, Homo sapiens
ucccaaguauugcgaaugugcag

SEQ ID NO: 1827888 - RNA, 13 nt, Homo sapiens
ucaaaauguggac

SEQ ID NO: 1827889 - RNA, 17 nt, Homo sapiens
uguaaucccccaggaga

SEQ ID NO: 1827890 - RNA, 21 nt, Homo sapiens
augaccucagucaggcacugg

SEQ ID NO: 1827891 - RNA, 19 nt, Homo sapiens
agaccccaaggcccagaca

SEQ ID NO: 1827892 - RNA, 22 nt, Homo sapiens
auuaaccuuaucauaaauucaa

SEQ ID NO: 1827893 - RNA, 18 nt, Homo sapiens
ugggguucccccagacag

SEQ ID NO: 1827894 - RNA, 22 nt, Homo sapiens
ccaaggaaacuuugccaaauau

SEQ ID NO: 1827895 - RNA, 18 nt, Homo sapiens
aaagcuuuauacaguuga

SEQ ID NO: 1827896 - RNA, 18 nt, Homo sapiens
cugauggugucaucugcu

SEQ ID NO: 1827897 - RNA, 12 nt, Homo sapiens
caauaaaacuga

SEQ ID NO: 1827898 - RNA, 13 nt, Homo sapiens
uugucaacaaagu

SEQ ID NO: 1827899 - RNA, 17 nt, Homo sapiens
uuccccuguccugugaa

SEQ ID NO: 1827900 - RNA, 22 nt, Homo sapiens
gacauagauuucauaguauuuu

SEQ ID NO: 1827901 - RNA, 16 nt, Homo sapiens
gaaagagcugaaaaug

SEQ ID NO: 1827902 - RNA, 13 nt, Homo sapiens
aacauucccacug

SEQ ID NO: 1827903 - RNA, 16 nt, Homo sapiens
auuuccagaacuacca

SEQ ID NO: 1827904 - RNA, 22 nt, Homo sapiens
gacauguccccauggcuguggg

SEQ ID NO: 1827905 - RNA, 13 nt, Homo sapiens
cuuccuggccuaa

SEQ ID NO: 1827906 - RNA, 19 nt, Homo sapiens
gaagauucuuaccaagagu

SEQ ID NO: 1827907 - RNA, 15 nt, Homo sapiens
ucagaaucuuuucaa

SEQ ID NO: 1827908 - RNA, 13 nt, Homo sapiens
uguaaacuaguac

SEQ ID NO: 1827909 - RNA, 16 nt, Homo sapiens
gacaaaucaacagaag

SEQ ID NO: 1827910 - RNA, 23 nt, Homo sapiens
acaaguuucugauaccacugcac

SEQ ID NO: 1827911 - RNA, 17 nt, Homo sapiens
cucuugcccauccugac

SEQ ID NO: 1827912 - RNA, 15 nt, Homo sapiens
ugcccgccagugcac

SEQ ID NO: 1827913 - RNA, 13 nt, Homo sapiens
uggaugcauuucu

SEQ ID NO: 1827914 - RNA, 14 nt, Homo sapiens
ucacacaaaggcau

SEQ ID NO: 1827915 - RNA, 11 nt, Homo sapiens
cacacauggau

SEQ ID NO: 1827916 - RNA, 11 nt, Homo sapiens
auugcacuaaa

SEQ ID NO: 1827917 - RNA, 14 nt, Homo sapiens
uuacccuccuguaa

SEQ ID NO: 1827918 - RNA, 22 nt, Homo sapiens
cugcauuuucugaaacuaauga

SEQ ID NO: 1827919 - RNA, 13 nt, Homo sapiens
auauguacauaca

SEQ ID NO: 1827920 - RNA, 20 nt, Homo sapiens
gaucucggcucagugcaacc

SEQ ID NO: 1827921 - RNA, 18 nt, Homo sapiens
uuacagagaggauacauu

SEQ ID NO: 1827922 - RNA, 12 nt, Homo sapiens
caggcgaagggu

SEQ ID NO: 1827923 - RNA, 13 nt, Homo sapiens
caagcagccaagg

SEQ ID NO: 1827924 - RNA, 19 nt, Homo sapiens
gagguggcggccugcugcu

SEQ ID NO: 1827925 - RNA, 22 nt, Homo sapiens
acuauaaauacaaaucuguaua

SEQ ID NO: 1827926 - RNA, 13 nt, Homo sapiens
cuugaauguucuc

SEQ ID NO: 1827927 - RNA, 21 nt, Homo sapiens
ucagcacugucccuugccuca

SEQ ID NO: 1827928 - RNA, 19 nt, Homo sapiens
cagucgaugcguucacucc

SEQ ID NO: 1827929 - RNA, 20 nt, Homo sapiens
cuccucaggcccagcugcuc

SEQ ID NO: 1827930 - RNA, 19 nt, Homo sapiens
acauccacaugauaccucu

SEQ ID NO: 1827931 - RNA, 18 nt, Homo sapiens
ugaccaggacuaaugcau

SEQ ID NO: 1827932 - RNA, 13 nt, Homo sapiens
ggacugauuugug

SEQ ID NO: 1827933 - RNA, 13 nt, Homo sapiens
guucaaacugcuc

SEQ ID NO: 1827934 - RNA, 20 nt, Homo sapiens
aagcugagcaccaggggaug

SEQ ID NO: 1827935 - RNA, 22 nt, Homo sapiens
ccauccuaaggugcuuaccuca

SEQ ID NO: 1827936 - RNA, 13 nt, Homo sapiens
gaggacaaagugu

SEQ ID NO: 1827937 - RNA, 16 nt, Homo sapiens
uuaaaaguuaagcaaa

SEQ ID NO: 1827938 - RNA, 14 nt, Homo sapiens
ugcccuuuggccag

SEQ ID NO: 1827939 - RNA, 19 nt, Homo sapiens
cuguagacaggaaagccag

SEQ ID NO: 1827940 - RNA, 21 nt, Homo sapiens
aauucaaagaaucaccuaauu

SEQ ID NO: 1827941 - RNA, 23 nt, Homo sapiens
uccuggcaaagaugaucaguaug

SEQ ID NO: 1827942 - RNA, 22 nt, Homo sapiens
aagcugugaaagaaccaaaaga

SEQ ID NO: 1827943 - RNA, 15 nt, Homo sapiens
caacuuucauuugaa

SEQ ID NO: 1827944 - RNA, 19 nt, Homo sapiens
aaaugcucuuuugcacaag

SEQ ID NO: 1827945 - RNA, 14 nt, Homo sapiens
gcuccaccaagggg

SEQ ID NO: 1827946 - RNA, 13 nt, Homo sapiens
acugaacuuugcu

SEQ ID NO: 1827947 - RNA, 13 nt, Homo sapiens
uauaaccuggcaa

SEQ ID NO: 1827948 - RNA, 13 nt, Homo sapiens
ucuccauacuuug

SEQ ID NO: 1827949 - RNA, 18 nt, Homo sapiens
acgugcgugcgagcacac

SEQ ID NO: 1827950 - RNA, 16 nt, Homo sapiens
aguuagcaacaaaucc

SEQ ID NO: 1827951 - RNA, 15 nt, Homo sapiens
agugcugaccagaca

SEQ ID NO: 1827952 - RNA, 18 nt, Homo sapiens
uguccaaaacugccucag

SEQ ID NO: 1827953 - RNA, 18 nt, Homo sapiens
acagauaucagugucucc

SEQ ID NO: 1827954 - RNA, 19 nt, Homo sapiens
gagacaagaaauccuagug

SEQ ID NO: 1827955 - RNA, 20 nt, Homo sapiens
cgugcuuccucaguuacaca

SEQ ID NO: 1827956 - RNA, 19 nt, Homo sapiens
gcccuccucucccgucucg

SEQ ID NO: 1827957 - RNA, 18 nt, Homo sapiens
gagacccccgugccaaau

SEQ ID NO: 1827958 - RNA, 19 nt, Homo sapiens
ugcuggcucccagggccau

SEQ ID NO: 1827959 - RNA, 16 nt, Homo sapiens
aggggaagagacuugg

SEQ ID NO: 1827960 - RNA, 18 nt, Homo sapiens
guggaaugccgcugucuc

SEQ ID NO: 1827961 - RNA, 16 nt, Homo sapiens
cugagaaaaggcaaaa

SEQ ID NO: 1827962 - RNA, 19 nt, Homo sapiens
aagaaaaugucuguuuucc

SEQ ID NO: 1827963 - RNA, 12 nt, Homo sapiens
acucccacuucc

SEQ ID NO: 1827964 - RNA, 12 nt, Homo sapiens
ugagaaagccuu

SEQ ID NO: 1827965 - RNA, 21 nt, Homo sapiens
auagucucauucugucaccca

SEQ ID NO: 1827966 - RNA, 20 nt, Homo sapiens
cugcaggugggaugagggag

SEQ ID NO: 1827967 - RNA, 19 nt, Homo sapiens
cccggaugugaauggcaug

SEQ ID NO: 1827968 - RNA, 19 nt, Homo sapiens
cacugagcaaagcauugag

SEQ ID NO: 1827969 - RNA, 20 nt, Homo sapiens
ucaccaacugaaguggcuaa

SEQ ID NO: 1827970 - RNA, 14 nt, Homo sapiens
aggagacagccuca

SEQ ID NO: 1827971 - RNA, 16 nt, Homo sapiens
auuagcagcugacuuu

SEQ ID NO: 1827972 - RNA, 20 nt, Homo sapiens
guacauucuuccaucaucac

SEQ ID NO: 1827973 - RNA, 23 nt, Homo sapiens
auuacaggcaugagccacugcgc

SEQ ID NO: 1827974 - RNA, 20 nt, Homo sapiens
agccauguacuauaauguga

SEQ ID NO: 1827975 - RNA, 20 nt, Homo sapiens
cugacacuguguaagaagcu

SEQ ID NO: 1827976 - RNA, 16 nt, Homo sapiens
augaaauuauuuguca

SEQ ID NO: 1827977 - RNA, 23 nt, Homo sapiens
cuguagcuuauauuugacauucu

SEQ ID NO: 1827978 - RNA, 20 nt, Homo sapiens
uaugaccaaaacuauuccau

SEQ ID NO: 1827979 - RNA, 15 nt, Homo sapiens
cugcaucuuaguuua

SEQ ID NO: 1827980 - RNA, 21 nt, Homo sapiens
cuugcaucuaaugaaaaacaa

SEQ ID NO: 1827981 - RNA, 14 nt, Homo sapiens
aggucuacucccuc

SEQ ID NO: 1827982 - RNA, 19 nt, Homo sapiens
gacuuugaauaaugugaua

SEQ ID NO: 1827983 - RNA, 18 nt, Homo sapiens
guuuaaaagucacauaaa

SEQ ID NO: 1827984 - RNA, 14 nt, Homo sapiens
ucuauucagcauug

SEQ ID NO: 1827985 - RNA, 15 nt, Homo sapiens
uauuguccauuccaa

SEQ ID NO: 1827986 - RNA, 14 nt, Homo sapiens
uuuauagucucaaa

SEQ ID NO: 1827987 - RNA, 23 nt, Homo sapiens
ccccaaaaccuuuccccagacac

SEQ ID NO: 1827988 - RNA, 14 nt, Homo sapiens
agcuucgaugaugu

SEQ ID NO: 1827989 - RNA, 13 nt, Homo sapiens
ggauuggacaaaa

SEQ ID NO: 1827990 - RNA, 19 nt, Homo sapiens
gaaucuguuucucugcugu

SEQ ID NO: 1827991 - RNA, 13 nt, Homo sapiens
aucugacccagug

SEQ ID NO: 1827992 - RNA, 20 nt, Homo sapiens
cauuucuuaccaugcauuuc

SEQ ID NO: 1827993 - RNA, 20 nt, Homo sapiens
acaaacucucaccaugaugu

SEQ ID NO: 1827994 - RNA, 21 nt, Homo sapiens
uuccccaaagacgaccagcau

SEQ ID NO: 1827995 - RNA, 17 nt, Homo sapiens
uggcugcguacuccacu

SEQ ID NO: 1827996 - RNA, 14 nt, Homo sapiens
uuuuuggcagggag

SEQ ID NO: 1827997 - RNA, 21 nt, Homo sapiens
gugcagaauuggggcacuuaa

SEQ ID NO: 1827998 - RNA, 15 nt, Homo sapiens
cacaauauccaauga

SEQ ID NO: 1827999 - RNA, 16 nt, Homo sapiens
cauucacugauuggaa

SEQ ID NO: 1828000 - RNA, 16 nt, Homo sapiens
cuguuucuuuccagca

SEQ ID NO: 1828001 - RNA, 18 nt, Homo sapiens
ugcuauagucaauuuagu

SEQ ID NO: 1828002 - RNA, 15 nt, Homo sapiens
auccaggguaugacc

SEQ ID NO: 1828003 - RNA, 19 nt, Homo sapiens
ucuuagugcuucagaguuu

SEQ ID NO: 1828004 - RNA, 22 nt, Homo sapiens
caggcccuacuacccauuguuc

SEQ ID NO: 1828005 - RNA, 22 nt, Homo sapiens
cugccuggggccucaccugcug

SEQ ID NO: 1828006 - RNA, 20 nt, Homo sapiens
cccuuuuaagcaugugaugu

SEQ ID NO: 1828007 - RNA, 22 nt, Homo sapiens
uccauccuccucuccaugcaag

SEQ ID NO: 1828008 - RNA, 18 nt, Homo sapiens
gcacauaccuucaugugg

SEQ ID NO: 1828009 - RNA, 16 nt, Homo sapiens
uugugcuuuugcaaaa

SEQ ID NO: 1828010 - RNA, 15 nt, Homo sapiens
cucuuccaaguccuu

SEQ ID NO: 1828011 - RNA, 20 nt, Homo sapiens
auauaauauuauacugcuau

SEQ ID NO: 1828012 - RNA, 15 nt, Homo sapiens
ccaggcuaugccauc

SEQ ID NO: 1828013 - RNA, 20 nt, Homo sapiens
caacuucccaaagcacaaag

SEQ ID NO: 1828014 - RNA, 15 nt, Homo sapiens
acaagccaagaaaga

SEQ ID NO: 1828015 - RNA, 15 nt, Homo sapiens
gccugcuccaucuca

SEQ ID NO: 1828016 - RNA, 12 nt, Homo sapiens
aaauggccuagc

SEQ ID NO: 1828017 - RNA, 15 nt, Homo sapiens
uuuaucaacacuaau

SEQ ID NO: 1828018 - RNA, 18 nt, Homo sapiens
augccccacccaccccuc

SEQ ID NO: 1828019 - RNA, 20 nt, Homo sapiens
aacugugacaaagaagacca

SEQ ID NO: 1828020 - RNA, 22 nt, Homo sapiens
uguugagaugugcuuugcugca

SEQ ID NO: 1828021 - RNA, 21 nt, Homo sapiens
cauauucaggaagcucagggc

SEQ ID NO: 1828022 - RNA, 19 nt, Homo sapiens
aaccuaaaaaucaaucacu

SEQ ID NO: 1828023 - RNA, 16 nt, Homo sapiens
uaauucagguauguaa

SEQ ID NO: 1828024 - RNA, 11 nt, Homo sapiens
ugccuguguau

SEQ ID NO: 1828025 - RNA, 23 nt, Homo sapiens
caugaugcgggccagugcuccag

SEQ ID NO: 1828026 - RNA, 18 nt, Homo sapiens
agggcacagcaucuguag

SEQ ID NO: 1828027 - RNA, 21 nt, Homo sapiens
accuuuuguuaccacagaguu

SEQ ID NO: 1828028 - RNA, 13 nt, Homo sapiens
gccuuuuuugcca

SEQ ID NO: 1828029 - RNA, 23 nt, Homo sapiens
aguuccucauuuuugaauacagg

SEQ ID NO: 1828030 - RNA, 13 nt, Homo sapiens
gagacacaugggu

SEQ ID NO: 1828031 - RNA, 18 nt, Homo sapiens
cauauguccccacuggca

SEQ ID NO: 1828032 - RNA, 15 nt, Homo sapiens
aguauggaaucagcu

SEQ ID NO: 1828033 - RNA, 12 nt, Homo sapiens
uggaacuggagg

SEQ ID NO: 1828034 - RNA, 20 nt, Homo sapiens
gugcaugaauagauucucuc

SEQ ID NO: 1828035 - RNA, 15 nt, Homo sapiens
accuuuggagcaaag

SEQ ID NO: 1828036 - RNA, 18 nt, Homo sapiens
gugaauaugugguuucua

SEQ ID NO: 1828037 - RNA, 18 nt, Homo sapiens
ggauuucauuuguaacuu

SEQ ID NO: 1828038 - RNA, 14 nt, Homo sapiens
gcccugacccugug

SEQ ID NO: 1828039 - RNA, 15 nt, Homo sapiens
agguuugcccugccu

SEQ ID NO: 1828040 - RNA, 17 nt, Homo sapiens
aguccaauuuuuacuca

SEQ ID NO: 1828041 - RNA, 20 nt, Homo sapiens
uccaauugaacuuucacaua

SEQ ID NO: 1828042 - RNA, 22 nt, Homo sapiens
agucaggaaagagaacuuccag

SEQ ID NO: 1828043 - RNA, 21 nt, Homo sapiens
uauacuuuaguagacauuuau

SEQ ID NO: 1828044 - RNA, 20 nt, Homo sapiens
uaaagugacccugcucucac

SEQ ID NO: 1828045 - RNA, 22 nt, Homo sapiens
acacguccauguuuauccaugu

SEQ ID NO: 1828046 - RNA, 13 nt, Homo sapiens
aagcaccaaucau

SEQ ID NO: 1828047 - RNA, 13 nt, Homo sapiens
ccuggcaugucag

SEQ ID NO: 1828048 - RNA, 16 nt, Homo sapiens
augacugguuguucaa

SEQ ID NO: 1828049 - RNA, 19 nt, Homo sapiens
gcacagauucccaggccag

SEQ ID NO: 1828050 - RNA, 21 nt, Homo sapiens
gaaaauauagaccuaugauaa

SEQ ID NO: 1828051 - RNA, 20 nt, Homo sapiens
gcugauacuucuacaacuuu

SEQ ID NO: 1828052 - RNA, 18 nt, Homo sapiens
uaauaaaauucauuccau

SEQ ID NO: 1828053 - RNA, 17 nt, Homo sapiens
agacaccauccugagcc

SEQ ID NO: 1828054 - RNA, 22 nt, Homo sapiens
auuaaaaugucggauuuaucuu

SEQ ID NO: 1828055 - RNA, 17 nt, Homo sapiens
guacaaauguaagcaaa

SEQ ID NO: 1828056 - RNA, 17 nt, Homo sapiens
accagccuucccaacau

SEQ ID NO: 1828057 - RNA, 23 nt, Homo sapiens
cagcucuccccucagagugcaag

SEQ ID NO: 1828058 - RNA, 16 nt, Homo sapiens
gcucugccuguggagu

SEQ ID NO: 1828059 - RNA, 23 nt, Homo sapiens
cuucagcaccugccccggcagug

SEQ ID NO: 1828060 - RNA, 12 nt, Homo sapiens
cauacacauaau

SEQ ID NO: 1828061 - RNA, 18 nt, Homo sapiens
gugauggauggcacaaug

SEQ ID NO: 1828062 - RNA, 23 nt, Homo sapiens
aacucagauccagggacagaggc

SEQ ID NO: 1828063 - RNA, 22 nt, Homo sapiens
ggucuucgcagccuagauauga

SEQ ID NO: 1828064 - RNA, 22 nt, Homo sapiens
gcaccaggcaggagaugcugca

SEQ ID NO: 1828065 - RNA, 16 nt, Homo sapiens
gaacacgaauugcuca

SEQ ID NO: 1828066 - RNA, 13 nt, Homo sapiens
ccauugucuuucc

SEQ ID NO: 1828067 - RNA, 22 nt, Homo sapiens
ccauagaaacaugacacugacc

SEQ ID NO: 1828068 - RNA, 13 nt, Homo sapiens
uaugcccucaagu

SEQ ID NO: 1828069 - RNA, 22 nt, Homo sapiens
cuucuccagggacagaagcagg

SEQ ID NO: 1828070 - RNA, 14 nt, Homo sapiens
uaauuuaguuccac

SEQ ID NO: 1828071 - RNA, 19 nt, Homo sapiens
agauguguugcaaagguag

SEQ ID NO: 1828072 - RNA, 16 nt, Homo sapiens
aggggaaccccggggu

SEQ ID NO: 1828073 - RNA, 16 nt, Homo sapiens
agaagcaagugguggg

SEQ ID NO: 1828074 - RNA, 19 nt, Homo sapiens
ugagaggagagagacucca

SEQ ID NO: 1828075 - RNA, 12 nt, Homo sapiens
augacacugacc

SEQ ID NO: 1828076 - RNA, 14 nt, Homo sapiens
aaauaucacaaagu

SEQ ID NO: 1828077 - RNA, 19 nt, Homo sapiens
aaaguuuggaagcacugau

SEQ ID NO: 1828078 - RNA, 20 nt, Homo sapiens
ucugcccacugugaaaccac

SEQ ID NO: 1828079 - RNA, 19 nt, Homo sapiens
acaucucguauaauauuca

SEQ ID NO: 1828080 - RNA, 20 nt, Homo sapiens
gggaggccagugagccacuc

SEQ ID NO: 1828081 - RNA, 17 nt, Homo sapiens
aagauguucugccuuau

SEQ ID NO: 1828082 - RNA, 20 nt, Homo sapiens
ccucauggaagaugcaagua

SEQ ID NO: 1828083 - RNA, 12 nt, Homo sapiens
ucaaucucugca

SEQ ID NO: 1828084 - RNA, 12 nt, Homo sapiens
agauucucaccu

SEQ ID NO: 1828085 - RNA, 22 nt, Homo sapiens
cuugaggcugcaaucacacuga

SEQ ID NO: 1828086 - RNA, 17 nt, Homo sapiens
ccuuuuacguccaucuc

SEQ ID NO: 1828087 - RNA, 14 nt, Homo sapiens
ugcagcccaugccc

SEQ ID NO: 1828088 - RNA, 22 nt, Homo sapiens
augaauaccaggauagcuuuau

SEQ ID NO: 1828089 - RNA, 15 nt, Homo sapiens
agccaaacucugcca

SEQ ID NO: 1828090 - RNA, 23 nt, Homo sapiens
uuguguuuuuuuuuuaaauagac

SEQ ID NO: 1828091 - RNA, 13 nt, Homo sapiens
cugugucauuuca

SEQ ID NO: 1828092 - RNA, 17 nt, Homo sapiens
uccagccgccauugcca

SEQ ID NO: 1828093 - RNA, 22 nt, Homo sapiens
cuugcaaauaccuccucccuaa

SEQ ID NO: 1828094 - RNA, 14 nt, Homo sapiens
cuaaaaggaugucu

SEQ ID NO: 1828095 - RNA, 11 nt, Homo sapiens
cccugugcaua

SEQ ID NO: 1828096 - RNA, 17 nt, Homo sapiens
agacuuaauucugauua

SEQ ID NO: 1828097 - RNA, 16 nt, Homo sapiens
cacuggaacauuccag

SEQ ID NO: 1828098 - RNA, 14 nt, Homo sapiens
ucuagcaagggagg

SEQ ID NO: 1828099 - RNA, 15 nt, Homo sapiens
ugccucagccuucca

SEQ ID NO: 1828100 - RNA, 18 nt, Homo sapiens
aaccuuuucaugccuuua

SEQ ID NO: 1828101 - RNA, 16 nt, Homo sapiens
cuuuuguuuugcuuac

SEQ ID NO: 1828102 - RNA, 22 nt, Homo sapiens
ccccaacuacuguguuaugcaa

SEQ ID NO: 1828103 - RNA, 21 nt, Homo sapiens
ccuuugauuuuugcccagaaa

SEQ ID NO: 1828104 - RNA, 16 nt, Homo sapiens
gccacuuuacccaccu

SEQ ID NO: 1828105 - RNA, 16 nt, Homo sapiens
uaugcucugugacaag

SEQ ID NO: 1828106 - RNA, 17 nt, Homo sapiens
caaaaccaaguaucaca

SEQ ID NO: 1828107 - RNA, 16 nt, Homo sapiens
aaugugucucaggaaa

SEQ ID NO: 1828108 - RNA, 13 nt, Homo sapiens
caauuuauugcac

SEQ ID NO: 1828109 - RNA, 19 nt, Homo sapiens
cugacacgugauggaccaa

SEQ ID NO: 1828110 - RNA, 18 nt, Homo sapiens
aauguauuuucuucaccu

SEQ ID NO: 1828111 - RNA, 21 nt, Homo sapiens
cuguauauaacuuauuugccc

SEQ ID NO: 1828112 - RNA, 21 nt, Homo sapiens
gucuguuucaagauuucugca

SEQ ID NO: 1828113 - RNA, 18 nt, Homo sapiens
accugauuuccauuugca

SEQ ID NO: 1828114 - RNA, 18 nt, Homo sapiens
aacuuaaagaucauaaac

SEQ ID NO: 1828115 - RNA, 14 nt, Homo sapiens
ucagagguccaggc

SEQ ID NO: 1828116 - RNA, 20 nt, Homo sapiens
uuggguuuccugguuccacu

SEQ ID NO: 1828117 - RNA, 20 nt, Homo sapiens
cucaagauuaucaacugugu

SEQ ID NO: 1828118 - RNA, 13 nt, Homo sapiens
cugagcucaaggu

SEQ ID NO: 1828119 - RNA, 14 nt, Homo sapiens
cagagauaacaucc

SEQ ID NO: 1828120 - RNA, 23 nt, Homo sapiens
uuccagcaggagggacagucuca

SEQ ID NO: 1828121 - RNA, 22 nt, Homo sapiens
cucuucuuccccagguccuucc

SEQ ID NO: 1828122 - RNA, 22 nt, Homo sapiens
ccugcagaagaagcuggugccc

SEQ ID NO: 1828123 - RNA, 15 nt, Homo sapiens
uacagaucauauaag

SEQ ID NO: 1828124 - RNA, 15 nt, Homo sapiens
ccucuauuuugccac

SEQ ID NO: 1828125 - RNA, 13 nt, Homo sapiens
gaauucuuaccau

SEQ ID NO: 1828126 - RNA, 18 nt, Homo sapiens
gaaaguaaaaagaacaac

SEQ ID NO: 1828127 - RNA, 16 nt, Homo sapiens
ugggacugcugugaac

SEQ ID NO: 1828128 - RNA, 13 nt, Homo sapiens
auaucgaucucuu

SEQ ID NO: 1828129 - RNA, 17 nt, Homo sapiens
ggaggaaggagccuaug

SEQ ID NO: 1828130 - RNA, 16 nt, Homo sapiens
gaaguuauucuugaca

SEQ ID NO: 1828131 - RNA, 18 nt, Homo sapiens
cuguguacacgugacaga

SEQ ID NO: 1828132 - RNA, 21 nt, Homo sapiens
aaaaacaggcagguacaggua

SEQ ID NO: 1828133 - RNA, 14 nt, Homo sapiens
gaaacaugacacug

SEQ ID NO: 1828134 - RNA, 20 nt, Homo sapiens
cuucccuugcuucuuggacu

SEQ ID NO: 1828135 - RNA, 19 nt, Homo sapiens
uacauuuuuuucucuuucc

SEQ ID NO: 1828136 - RNA, 12 nt, Homo sapiens
acuuacacugua

SEQ ID NO: 1828137 - RNA, 18 nt, Homo sapiens
aucuuuguauauaugugu

SEQ ID NO: 1828138 - RNA, 13 nt, Homo sapiens
ggcccuccuugcc

SEQ ID NO: 1828139 - RNA, 19 nt, Homo sapiens
gccccacagucuccggccu

SEQ ID NO: 1828140 - RNA, 23 nt, Homo sapiens
accuugcgauucugcagccacaa

SEQ ID NO: 1828141 - RNA, 23 nt, Homo sapiens
guuuuagacgaggccacagcugc

SEQ ID NO: 1828142 - RNA, 16 nt, Homo sapiens
cuguguugaagcacug

SEQ ID NO: 1828143 - RNA, 16 nt, Homo sapiens
aaccaccucucugucu

SEQ ID NO: 1828144 - RNA, 23 nt, Homo sapiens
auauaauuuugaaaaguaaaaau

SEQ ID NO: 1828145 - RNA, 11 nt, Homo sapiens
gcuucauaucu

SEQ ID NO: 1828146 - RNA, 15 nt, Homo sapiens
uauauaaaucuucaa

SEQ ID NO: 1828147 - RNA, 13 nt, Homo sapiens
cuuccaugcccca

SEQ ID NO: 1828148 - RNA, 17 nt, Homo sapiens
uaaacugucgugucaua

SEQ ID NO: 1828149 - RNA, 15 nt, Homo sapiens
auucucuugccucaa

SEQ ID NO: 1828150 - RNA, 19 nt, Homo sapiens
aauaugcaaaccaggauuu

SEQ ID NO: 1828151 - RNA, 16 nt, Homo sapiens
aacaauaaaguuugcu

SEQ ID NO: 1828152 - RNA, 20 nt, Homo sapiens
uaaugguagucagauuucau

SEQ ID NO: 1828153 - RNA, 17 nt, Homo sapiens
ggacaggauguguuugc

SEQ ID NO: 1828154 - RNA, 15 nt, Homo sapiens
ugcuguauacuguac

SEQ ID NO: 1828155 - RNA, 22 nt, Homo sapiens
auuaaaacaagagaccacuucc

SEQ ID NO: 1828156 - RNA, 13 nt, Homo sapiens
gaggcaguggcag

SEQ ID NO: 1828157 - RNA, 13 nt, Homo sapiens
ugcccucucugaa

SEQ ID NO: 1828158 - RNA, 19 nt, Homo sapiens
caugaaaguggacaaggag

SEQ ID NO: 1828159 - RNA, 22 nt, Homo sapiens
uuuaaagucuucuuucauguaa

SEQ ID NO: 1828160 - RNA, 19 nt, Homo sapiens
cuuacagaauggaucaugu

SEQ ID NO: 1828161 - RNA, 14 nt, Homo sapiens
ggccagagugcagu

SEQ ID NO: 1828162 - RNA, 18 nt, Homo sapiens
gcagucacuuuuccugug

SEQ ID NO: 1828163 - RNA, 19 nt, Homo sapiens
aaaccuuuccccagacaca

SEQ ID NO: 1828164 - RNA, 17 nt, Homo sapiens
gaaaagcuauuagccag

SEQ ID NO: 1828165 - RNA, 13 nt, Homo sapiens
cagacaugugcac

SEQ ID NO: 1828166 - RNA, 18 nt, Homo sapiens
uacaauaaagcaaugugg

SEQ ID NO: 1828167 - RNA, 15 nt, Homo sapiens
aaugucagucuacag

SEQ ID NO: 1828168 - RNA, 22 nt, Homo sapiens
aucucuaauauauccacacauu

SEQ ID NO: 1828169 - RNA, 14 nt, Homo sapiens
gucuccccaaagcu

SEQ ID NO: 1828170 - RNA, 22 nt, Homo sapiens
ugucuauuauuaugaagaauug

SEQ ID NO: 1828171 - RNA, 16 nt, Homo sapiens
aaaauugaacuacuug

SEQ ID NO: 1828172 - RNA, 20 nt, Homo sapiens
caaauuuaugcauuucauuc

SEQ ID NO: 1828173 - RNA, 13 nt, Homo sapiens
gaccaacagugag

SEQ ID NO: 1828174 - RNA, 15 nt, Homo sapiens
caacaggauuuucaa

SEQ ID NO: 1828175 - RNA, 17 nt, Homo sapiens
aucuugcuuuuuuucac

SEQ ID NO: 1828176 - RNA, 23 nt, Homo sapiens
gcauauuuucuccgaaaggcaaa

SEQ ID NO: 1828177 - RNA, 13 nt, Homo sapiens
auuaauaauaccu

SEQ ID NO: 1828178 - RNA, 20 nt, Homo sapiens
guuugucuucauguacugua

SEQ ID NO: 1828179 - RNA, 21 nt, Homo sapiens
cuauauuccuuuuucuaugaa

SEQ ID NO: 1828180 - RNA, 17 nt, Homo sapiens
cacggcuucacugacca

SEQ ID NO: 1828181 - RNA, 19 nt, Homo sapiens
cuuauuaagacuggcuuua

SEQ ID NO: 1828182 - RNA, 20 nt, Homo sapiens
ccuguuaggggaaaauagua

SEQ ID NO: 1828183 - RNA, 13 nt, Homo sapiens
caggcuguucucc

SEQ ID NO: 1828184 - RNA, 18 nt, Homo sapiens
cacaauuauaagagacuu

SEQ ID NO: 1828185 - RNA, 16 nt, Homo sapiens
cugcaaauuaauguau

SEQ ID NO: 1828186 - RNA, 22 nt, Homo sapiens
aguagcugagacuacaggugag

SEQ ID NO: 1828187 - RNA, 23 nt, Homo sapiens
aauguagcagcagccuacugagu

SEQ ID NO: 1828188 - RNA, 20 nt, Homo sapiens
gcuuaagugccuaugggaau

SEQ ID NO: 1828189 - RNA, 13 nt, Homo sapiens
aaugcuucaauca

SEQ ID NO: 1828190 - RNA, 17 nt, Homo sapiens
gcagacucacuguggga

SEQ ID NO: 1828191 - RNA, 18 nt, Homo sapiens
ugcuugccaccaccagau

SEQ ID NO: 1828192 - RNA, 16 nt, Homo sapiens
ucacucuuaggcacuu

SEQ ID NO: 1828193 - RNA, 12 nt, Homo sapiens
uagagacaguga

SEQ ID NO: 1828194 - RNA, 21 nt, Homo sapiens
gcagcugaugccugaauguau

SEQ ID NO: 1828195 - RNA, 13 nt, Homo sapiens
aguaccagugugc

SEQ ID NO: 1828196 - RNA, 12 nt, Homo sapiens
uuuuaaagucag

SEQ ID NO: 1828197 - RNA, 20 nt, Homo sapiens
gaaaggcaugaaucuucccu

SEQ ID NO: 1828198 - RNA, 16 nt, Homo sapiens
uccuaacguuugucau

SEQ ID NO: 1828199 - RNA, 13 nt, Homo sapiens
augguucugccuc

SEQ ID NO: 1828200 - RNA, 14 nt, Homo sapiens
cuugcggaagccau

SEQ ID NO: 1828201 - RNA, 15 nt, Homo sapiens
agccacgucaaugca

SEQ ID NO: 1828202 - RNA, 18 nt, Homo sapiens
auuauauuuuuacauaua

SEQ ID NO: 1828203 - RNA, 15 nt, Homo sapiens
cagucugcuuagaaa

SEQ ID NO: 1828204 - RNA, 16 nt, Homo sapiens
cuuggauucucuaacc

SEQ ID NO: 1828205 - RNA, 20 nt, Homo sapiens
cuuuauuuguauuugccauu

SEQ ID NO: 1828206 - RNA, 11 nt, Homo sapiens
gcaagccauaa

SEQ ID NO: 1828207 - RNA, 23 nt, Homo sapiens
ucccaggaguacaccccaacagc

SEQ ID NO: 1828208 - RNA, 23 nt, Homo sapiens
auucgcccacccgaguaccucca

SEQ ID NO: 1828209 - RNA, 15 nt, Homo sapiens
caggggggugguuuu

SEQ ID NO: 1828210 - RNA, 17 nt, Homo sapiens
agccucucaaguaauau

SEQ ID NO: 1828211 - RNA, 12 nt, Homo sapiens
uacaauuucaaa

SEQ ID NO: 1828212 - RNA, 14 nt, Homo sapiens
aaugauaaaacacc

SEQ ID NO: 1828213 - RNA, 21 nt, Homo sapiens
ucuaaaagggggcuauucccu

SEQ ID NO: 1828214 - RNA, 17 nt, Homo sapiens
cucagaacaauccgauu

SEQ ID NO: 1828215 - RNA, 12 nt, Homo sapiens
uggaugaucucc

SEQ ID NO: 1828216 - RNA, 16 nt, Homo sapiens
uucauaaaaacacuca

SEQ ID NO: 1828217 - RNA, 11 nt, Homo sapiens
cuuacauggcc

SEQ ID NO: 1828218 - RNA, 21 nt, Homo sapiens
agauuccaggcgaugugcaag

SEQ ID NO: 1828219 - RNA, 15 nt, Homo sapiens
ugcaaggugugaugg

SEQ ID NO: 1828220 - RNA, 16 nt, Homo sapiens
gcagccggagaucuga

SEQ ID NO: 1828221 - RNA, 14 nt, Homo sapiens
aguauuuaucuccu

SEQ ID NO: 1828222 - RNA, 21 nt, Homo sapiens
ucuucaaggcuucagucucau

SEQ ID NO: 1828223 - RNA, 19 nt, Homo sapiens
accagcccagaagugcaga

SEQ ID NO: 1828224 - RNA, 17 nt, Homo sapiens
acuuucugccagcaucu

SEQ ID NO: 1828225 - RNA, 14 nt, Homo sapiens
guauauacccaaag

SEQ ID NO: 1828226 - RNA, 18 nt, Homo sapiens
agcacugucccuugccuc

SEQ ID NO: 1828227 - RNA, 16 nt, Homo sapiens
aucagacuagugacaa

SEQ ID NO: 1828228 - RNA, 16 nt, Homo sapiens
aaguaauacaaacuaa

SEQ ID NO: 1828229 - RNA, 11 nt, Homo sapiens
uaagugcauuu

SEQ ID NO: 1828230 - RNA, 11 nt, Homo sapiens
aaugugcaaua

SEQ ID NO: 1828231 - RNA, 11 nt, Homo sapiens
uaugugcauua

SEQ ID NO: 1828232 - RNA, 15 nt, Homo sapiens
aaagccaaauuucca

SEQ ID NO: 1828233 - RNA, 14 nt, Homo sapiens
acacugaacuuaau

SEQ ID NO: 1828234 - RNA, 15 nt, Homo sapiens
ucaagggccagucag

SEQ ID NO: 1828235 - RNA, 23 nt, Homo sapiens
cuaaaugcagacaacaccuuccu

SEQ ID NO: 1828236 - RNA, 18 nt, Homo sapiens
uacuacccucagucuaca

SEQ ID NO: 1828237 - RNA, 22 nt, Homo sapiens
caaauagagcuguucaacauca

SEQ ID NO: 1828238 - RNA, 21 nt, Homo sapiens
guucugccacuugcacugugc

SEQ ID NO: 1828239 - RNA, 20 nt, Homo sapiens
uuccuggagaaggcauucca

SEQ ID NO: 1828240 - RNA, 17 nt, Homo sapiens
caguugcugucacaaag

SEQ ID NO: 1828241 - RNA, 14 nt, Homo sapiens
gcauaaaagacuuu

SEQ ID NO: 1828242 - RNA, 15 nt, Homo sapiens
caauggggcugguuu

SEQ ID NO: 1828243 - RNA, 22 nt, Homo sapiens
cuuuacaaaagaaauaccuuga

SEQ ID NO: 1828244 - RNA, 19 nt, Homo sapiens
caugaugacucaaggccaa

SEQ ID NO: 1828245 - RNA, 21 nt, Homo sapiens
gcacuuuacagaugagauucc

SEQ ID NO: 1828246 - RNA, 19 nt, Homo sapiens
gagucacucuuaugcugua

SEQ ID NO: 1828247 - RNA, 15 nt, Homo sapiens
uuguaaucaagccuu

SEQ ID NO: 1828248 - RNA, 15 nt, Homo sapiens
uauucaucauucauu

SEQ ID NO: 1828249 - RNA, 17 nt, Homo sapiens
agaacuggugcucucuu

SEQ ID NO: 1828250 - RNA, 15 nt, Homo sapiens
auaaagccacuuucc

SEQ ID NO: 1828251 - RNA, 18 nt, Homo sapiens
ggcaugaaaagugguccu

SEQ ID NO: 1828252 - RNA, 15 nt, Homo sapiens
ugugaaguagguaua

SEQ ID NO: 1828253 - RNA, 22 nt, Homo sapiens
aaucccgauucacccuguccaa

SEQ ID NO: 1828254 - RNA, 13 nt, Homo sapiens
ucugaggcucagc

SEQ ID NO: 1828255 - RNA, 20 nt, Homo sapiens
ccccagauggccgggacaug

SEQ ID NO: 1828256 - RNA, 16 nt, Homo sapiens
uauuaaaauaucccaa

SEQ ID NO: 1828257 - RNA, 18 nt, Homo sapiens
uauuuuuuaaacauacga

SEQ ID NO: 1828258 - RNA, 13 nt, Homo sapiens
gaagccacagagu

SEQ ID NO: 1828259 - RNA, 19 nt, Homo sapiens
acuggauauguuguuaaac

SEQ ID NO: 1828260 - RNA, 16 nt, Homo sapiens
uugaaugcuaagaaug

SEQ ID NO: 1828261 - RNA, 23 nt, Homo sapiens
ugagucaaugcgcaaaaugcagc

SEQ ID NO: 1828262 - RNA, 13 nt, Homo sapiens
acauaauugugac

SEQ ID NO: 1828263 - RNA, 21 nt, Homo sapiens
aaagauugcuauaauguauaa

SEQ ID NO: 1828264 - RNA, 19 nt, Homo sapiens
uuucuaaagcugaauguca

SEQ ID NO: 1828265 - RNA, 19 nt, Homo sapiens
caauaauuuuccugugaca

SEQ ID NO: 1828266 - RNA, 15 nt, Homo sapiens
auuugcagacuagaa

SEQ ID NO: 1828267 - RNA, 20 nt, Homo sapiens
ccuucuuugauaauguuaaa

SEQ ID NO: 1828268 - RNA, 14 nt, Homo sapiens
aauugcacuucuug

SEQ ID NO: 1828269 - RNA, 16 nt, Homo sapiens
ugggacugucuugaga

SEQ ID NO: 1828270 - RNA, 20 nt, Homo sapiens
cuauuaauaucaacucugaa

SEQ ID NO: 1828271 - RNA, 18 nt, Homo sapiens
uggggccaggaccauggc

SEQ ID NO: 1828272 - RNA, 16 nt, Homo sapiens
gcgcugcugguguucu

SEQ ID NO: 1828273 - RNA, 13 nt, Homo sapiens
ucccagccaaguc

SEQ ID NO: 1828274 - RNA, 12 nt, Homo sapiens
gaacacauuuca

SEQ ID NO: 1828275 - RNA, 12 nt, Homo sapiens
uuacacaugaca

SEQ ID NO: 1828276 - RNA, 15 nt, Homo sapiens
gagcagccugcugcu

SEQ ID NO: 1828277 - RNA, 19 nt, Homo sapiens
ugaacucacagacugcugu

SEQ ID NO: 1828278 - RNA, 17 nt, Homo sapiens
aggcauacuuuuaauca

SEQ ID NO: 1828279 - RNA, 17 nt, Homo sapiens
cacuauggucaaaaagu

SEQ ID NO: 1828280 - RNA, 21 nt, Homo sapiens
ucagcacaggccugggaccuc

SEQ ID NO: 1828281 - RNA, 17 nt, Homo sapiens
gauggcgaccaccaaag

SEQ ID NO: 1828282 - RNA, 20 nt, Homo sapiens
auccuacaaggcuggcagug

SEQ ID NO: 1828283 - RNA, 13 nt, Homo sapiens
gcauaaagccaaa

SEQ ID NO: 1828284 - RNA, 13 nt, Homo sapiens
gcugucaugccca

SEQ ID NO: 1828285 - RNA, 15 nt, Homo sapiens
uccauuagaaugcua

SEQ ID NO: 1828286 - RNA, 15 nt, Homo sapiens
cuuugacacuuuuca

SEQ ID NO: 1828287 - RNA, 15 nt, Homo sapiens
aaaagacaaaaauca

SEQ ID NO: 1828288 - RNA, 16 nt, Homo sapiens
cgagcgccuggugcug

SEQ ID NO: 1828289 - RNA, 15 nt, Homo sapiens
guaaauuccaaagau

SEQ ID NO: 1828290 - RNA, 16 nt, Homo sapiens
uacaaucucaaauucu

SEQ ID NO: 1828291 - RNA, 16 nt, Homo sapiens
uccauccuccaaaccu

SEQ ID NO: 1828292 - RNA, 18 nt, Homo sapiens
cuuuaagcgcaacauuuc

SEQ ID NO: 1828293 - RNA, 19 nt, Homo sapiens
uugggaggugauguuccca

SEQ ID NO: 1828294 - RNA, 20 nt, Homo sapiens
agcugugcacaaaguggcau

SEQ ID NO: 1828295 - RNA, 18 nt, Homo sapiens
auaucuaauauauaugaa

SEQ ID NO: 1828296 - RNA, 17 nt, Homo sapiens
uggaaaugaccaggcca

SEQ ID NO: 1828297 - RNA, 21 nt, Homo sapiens
agauugagcuuagauugccuc

SEQ ID NO: 1828298 - RNA, 18 nt, Homo sapiens
acugaaacgccuugcacg

SEQ ID NO: 1828299 - RNA, 16 nt, Homo sapiens
auuccucacaaugagg

SEQ ID NO: 1828300 - RNA, 11 nt, Homo sapiens
ccagugccagg

SEQ ID NO: 1828301 - RNA, 12 nt, Homo sapiens
gaaacacauuua

SEQ ID NO: 1828302 - RNA, 22 nt, Homo sapiens
ucuuguccugguccuggccaca

SEQ ID NO: 1828303 - RNA, 17 nt, Homo sapiens
aaugacuguagaacuua

SEQ ID NO: 1828304 - RNA, 17 nt, Homo sapiens
accaagcagagcucaca

SEQ ID NO: 1828305 - RNA, 14 nt, Homo sapiens
auucugugacauuu

SEQ ID NO: 1828306 - RNA, 21 nt, Homo sapiens
cuugugacuaaguugcaagau

SEQ ID NO: 1828307 - RNA, 18 nt, Homo sapiens
ugaauuucacaagcuauu

SEQ ID NO: 1828308 - RNA, 19 nt, Homo sapiens
cuggccagccuacaauggg

SEQ ID NO: 1828309 - RNA, 21 nt, Homo sapiens
cucugccaaaggaugugauau

SEQ ID NO: 1828310 - RNA, 13 nt, Homo sapiens
aaaaaaaugaugc

SEQ ID NO: 1828311 - RNA, 21 nt, Homo sapiens
guaccacucaggccaacaagc

SEQ ID NO: 1828312 - RNA, 21 nt, Homo sapiens
cucuccaaggguggugaccaa

SEQ ID NO: 1828313 - RNA, 14 nt, Homo sapiens
cuuuucaaccacaa

SEQ ID NO: 1828314 - RNA, 13 nt, Homo sapiens
caauaauauuuca

SEQ ID NO: 1828315 - RNA, 16 nt, Homo sapiens
acaguaucccacaucc

SEQ ID NO: 1828316 - RNA, 16 nt, Homo sapiens
gccuccccuccauggg

SEQ ID NO: 1828317 - RNA, 20 nt, Homo sapiens
caaaaauuauugauugcuuu

SEQ ID NO: 1828318 - RNA, 21 nt, Homo sapiens
uauuugaacuuauuuacacau

SEQ ID NO: 1828319 - RNA, 19 nt, Homo sapiens
aucugcuccucccauuccc

SEQ ID NO: 1828320 - RNA, 17 nt, Homo sapiens
augucucaagugcaaug

SEQ ID NO: 1828321 - RNA, 17 nt, Homo sapiens
aagaguuggagugagau

SEQ ID NO: 1828322 - RNA, 19 nt, Homo sapiens
cucucauuuggacuugcug

SEQ ID NO: 1828323 - RNA, 17 nt, Homo sapiens
agguaccuccaaggacc

SEQ ID NO: 1828324 - RNA, 14 nt, Homo sapiens
cuaagcuggucuca

SEQ ID NO: 1828325 - RNA, 21 nt, Homo sapiens
agucuaaggaugcuaaaccuu

SEQ ID NO: 1828326 - RNA, 20 nt, Homo sapiens
ugcccccacgccuccugcca

SEQ ID NO: 1828327 - RNA, 12 nt, Homo sapiens
gaacuaucuuca

SEQ ID NO: 1828328 - RNA, 18 nt, Homo sapiens
acaaugaagaugaugcua

SEQ ID NO: 1828329 - RNA, 15 nt, Homo sapiens
gaaggucuugccuga

SEQ ID NO: 1828330 - RNA, 17 nt, Homo sapiens
ggcuaauucagugucac

SEQ ID NO: 1828331 - RNA, 22 nt, Homo sapiens
ccauccuauuuaacuggcuuca

SEQ ID NO: 1828332 - RNA, 18 nt, Homo sapiens
augauugccaacaguggc

SEQ ID NO: 1828333 - RNA, 16 nt, Homo sapiens
ggaccaggagccaggu

SEQ ID NO: 1828334 - RNA, 19 nt, Homo sapiens
cauuaucgagcagcauuuu

SEQ ID NO: 1828335 - RNA, 21 nt, Homo sapiens
caaauccccggcugcuuccuu

SEQ ID NO: 1828336 - RNA, 14 nt, Homo sapiens
ccaacaaaccaaga

SEQ ID NO: 1828337 - RNA, 14 nt, Homo sapiens
augucaaaauguga

SEQ ID NO: 1828338 - RNA, 18 nt, Homo sapiens
uauuaagggauuaguauu

SEQ ID NO: 1828339 - RNA, 20 nt, Homo sapiens
ucgacucuuugcaacagcac

SEQ ID NO: 1828340 - RNA, 20 nt, Homo sapiens
ugggcuuucacaaaaggcau

SEQ ID NO: 1828341 - RNA, 21 nt, Homo sapiens
uaguuucuguaaaugacacuu

SEQ ID NO: 1828342 - RNA, 20 nt, Homo sapiens
guccuccaccacaagagcuc

SEQ ID NO: 1828343 - RNA, 19 nt, Homo sapiens
gcuggacacccucuuccca

SEQ ID NO: 1828344 - RNA, 14 nt, Homo sapiens
gggucucuugccca

SEQ ID NO: 1828345 - RNA, 15 nt, Homo sapiens
cugagacagggugcu

SEQ ID NO: 1828346 - RNA, 16 nt, Homo sapiens
auaggcaaaagacaug

SEQ ID NO: 1828347 - RNA, 15 nt, Homo sapiens
uuucucaaaagcauu

SEQ ID NO: 1828348 - RNA, 15 nt, Homo sapiens
cagcaucaccugccu

SEQ ID NO: 1828349 - RNA, 19 nt, Homo sapiens
acauggccuaugcacauau

SEQ ID NO: 1828350 - RNA, 23 nt, Homo sapiens
cagaaaagugcuuagaaaguuau

SEQ ID NO: 1828351 - RNA, 15 nt, Homo sapiens
aggugagaccaccuc

SEQ ID NO: 1828352 - RNA, 18 nt, Homo sapiens
agguaauuguagcacauu

SEQ ID NO: 1828353 - RNA, 17 nt, Homo sapiens
uauuaccuuuacauauu

SEQ ID NO: 1828354 - RNA, 16 nt, Homo sapiens
ucaaauguuuccuuaa

SEQ ID NO: 1828355 - RNA, 23 nt, Homo sapiens
uugggauugucuuacuguugcau

SEQ ID NO: 1828356 - RNA, 20 nt, Homo sapiens
gaaguugcaccauugcacuc

SEQ ID NO: 1828357 - RNA, 11 nt, Homo sapiens
gugaccagcac

SEQ ID NO: 1828358 - RNA, 14 nt, Homo sapiens
uaaugaauaccuua

SEQ ID NO: 1828359 - RNA, 18 nt, Homo sapiens
acccuggaauucagcacc

SEQ ID NO: 1828360 - RNA, 14 nt, Homo sapiens
aauaggaguucucc

SEQ ID NO: 1828361 - RNA, 18 nt, Homo sapiens
aguugaagcuaagauuua

SEQ ID NO: 1828362 - RNA, 15 nt, Homo sapiens
ucuaaaaucaugaaa

SEQ ID NO: 1828363 - RNA, 14 nt, Homo sapiens
aggcagcugaucca

SEQ ID NO: 1828364 - RNA, 17 nt, Homo sapiens
caaagauguacugagag

SEQ ID NO: 1828365 - RNA, 20 nt, Homo sapiens
aguaacccugucuaaugaaa

SEQ ID NO: 1828366 - RNA, 17 nt, Homo sapiens
aagauuccuuuccacuc

SEQ ID NO: 1828367 - RNA, 19 nt, Homo sapiens
gugagaaguccccuuccau

SEQ ID NO: 1828368 - RNA, 21 nt, Homo sapiens
ccuuacaacgccgagugcacu

SEQ ID NO: 1828369 - RNA, 19 nt, Homo sapiens
ucaccuugaugacuuccua

SEQ ID NO: 1828370 - RNA, 13 nt, Homo sapiens
agcugucaggcag

SEQ ID NO: 1828371 - RNA, 23 nt, Homo sapiens
aaacuagguaaaaucuacaguac

SEQ ID NO: 1828372 - RNA, 14 nt, Homo sapiens
uaagacuuucccca

SEQ ID NO: 1828373 - RNA, 19 nt, Homo sapiens
gcaaaggaaacuuugcaga

SEQ ID NO: 1828374 - RNA, 14 nt, Homo sapiens
cauaucucuugccc

SEQ ID NO: 1828375 - RNA, 13 nt, Homo sapiens
uuauagaucauuu

SEQ ID NO: 1828376 - RNA, 19 nt, Homo sapiens
gcaguccuccgguugcaua

SEQ ID NO: 1828377 - RNA, 20 nt, Homo sapiens
gauaaguaaguuugauuuca

SEQ ID NO: 1828378 - RNA, 17 nt, Homo sapiens
cccugaaccucugaugc

SEQ ID NO: 1828379 - RNA, 18 nt, Homo sapiens
auggcaggugucauauga

SEQ ID NO: 1828380 - RNA, 12 nt, Homo sapiens
uaagauuuaccc

SEQ ID NO: 1828381 - RNA, 18 nt, Homo sapiens
gacaaucauguguguuaa

SEQ ID NO: 1828382 - RNA, 12 nt, Homo sapiens
cuguacuuugau

SEQ ID NO: 1828383 - RNA, 18 nt, Homo sapiens
cacaguuagguagcuuua

SEQ ID NO: 1828384 - RNA, 15 nt, Homo sapiens
agcccauucucaugu

SEQ ID NO: 1828385 - RNA, 17 nt, Homo sapiens
gugggucccacuucccc

SEQ ID NO: 1828386 - RNA, 12 nt, Homo sapiens
gacucaguucca

SEQ ID NO: 1828387 - RNA, 18 nt, Homo sapiens
agucucgcucuguugccc

SEQ ID NO: 1828388 - RNA, 19 nt, Homo sapiens
ccacaaaacuucagugugg

SEQ ID NO: 1828389 - RNA, 21 nt, Homo sapiens
gagacugucucaagagggcac

SEQ ID NO: 1828390 - RNA, 16 nt, Homo sapiens
aggaaaauaaugacau

SEQ ID NO: 1828391 - RNA, 21 nt, Homo sapiens
ucuauaaauccccaguuuucc

SEQ ID NO: 1828392 - RNA, 19 nt, Homo sapiens
aaaacaaagcaacaaauua

SEQ ID NO: 1828393 - RNA, 12 nt, Homo sapiens
cccuuuuccucu

SEQ ID NO: 1828394 - RNA, 19 nt, Homo sapiens
aacauguuagucaaggacu

SEQ ID NO: 1828395 - RNA, 18 nt, Homo sapiens
uuauguaauugaaaacca

SEQ ID NO: 1828396 - RNA, 16 nt, Homo sapiens
ggccugugcacuguug

SEQ ID NO: 1828397 - RNA, 14 nt, Homo sapiens
ccuggccuaaagaa

SEQ ID NO: 1828398 - RNA, 23 nt, Homo sapiens
cuggcuuucuuuucucuaugaaa

SEQ ID NO: 1828399 - RNA, 12 nt, Homo sapiens
caaauagcacau

SEQ ID NO: 1828400 - RNA, 19 nt, Homo sapiens
cagccaagcccacccuggg

SEQ ID NO: 1828401 - RNA, 12 nt, Homo sapiens
ggaaaaugagua

SEQ ID NO: 1828402 - RNA, 14 nt, Homo sapiens
gccagcaucugcag

SEQ ID NO: 1828403 - RNA, 18 nt, Homo sapiens
aagcuccaagaggcuccu

SEQ ID NO: 1828404 - RNA, 21 nt, Homo sapiens
agcaucuccuuacagucacua

SEQ ID NO: 1828405 - RNA, 15 nt, Homo sapiens
ugaacgcuucugcuu

SEQ ID NO: 1828406 - RNA, 16 nt, Homo sapiens
ggauucacagccuuug

SEQ ID NO: 1828407 - RNA, 23 nt, Homo sapiens
agagaacugcagaccucacuguc

SEQ ID NO: 1828408 - RNA, 16 nt, Homo sapiens
uccaguuggaugaaca

SEQ ID NO: 1828409 - RNA, 16 nt, Homo sapiens
agggcacagcccuccg

SEQ ID NO: 1828410 - RNA, 19 nt, Homo sapiens
augcuacagagagugaaua

SEQ ID NO: 1828411 - RNA, 13 nt, Homo sapiens
aguguuaucauau

SEQ ID NO: 1828412 - RNA, 22 nt, Homo sapiens
ugggaugagagggcccagaaga

SEQ ID NO: 1828413 - RNA, 19 nt, Homo sapiens
ccuacagaacuucagaaag

SEQ ID NO: 1828414 - RNA, 19 nt, Homo sapiens
cuguuaaaaaaauaaaaua

SEQ ID NO: 1828415 - RNA, 15 nt, Homo sapiens
agaaaugcacauuga

SEQ ID NO: 1828416 - RNA, 17 nt, Homo sapiens
auguaaauaaaacauca

SEQ ID NO: 1828417 - RNA, 15 nt, Homo sapiens
aggcugccucagacc

SEQ ID NO: 1828418 - RNA, 23 nt, Homo sapiens
ucagugaugaaaauuugccuuug

SEQ ID NO: 1828419 - RNA, 13 nt, Homo sapiens
gcauaugaguaag

SEQ ID NO: 1828420 - RNA, 21 nt, Homo sapiens
ccugagcacccagaacuccau

SEQ ID NO: 1828421 - RNA, 14 nt, Homo sapiens
uggcugacuguugc

SEQ ID NO: 1828422 - RNA, 14 nt, Homo sapiens
cuguggaaugugca

SEQ ID NO: 1828423 - RNA, 14 nt, Homo sapiens
auaaaacuguuuau

SEQ ID NO: 1828424 - RNA, 17 nt, Homo sapiens
cauuauuaaguaacuua

SEQ ID NO: 1828425 - RNA, 18 nt, Homo sapiens
acagaacuauguacuuua

SEQ ID NO: 1828426 - RNA, 21 nt, Homo sapiens
aguuccacuuagagaacaaag

SEQ ID NO: 1828427 - RNA, 18 nt, Homo sapiens
aagcggagguugcaggga

SEQ ID NO: 1828428 - RNA, 15 nt, Homo sapiens
agcugagccaggcua

SEQ ID NO: 1828429 - RNA, 24 nt, Homo sapiens
ucacagcauguagggugaugagca

SEQ ID NO: 1828430 - RNA, 13 nt, Homo sapiens
ggacauuccagua

SEQ ID NO: 1828431 - RNA, 12 nt, Homo sapiens
aucugaccaucu

SEQ ID NO: 1828432 - RNA, 14 nt, Homo sapiens
aacagaucugaauu

SEQ ID NO: 1828433 - RNA, 16 nt, Homo sapiens
aucaaaugcucaagcc

SEQ ID NO: 1828434 - RNA, 20 nt, Homo sapiens
ccagguuaccucacuuuuaa

SEQ ID NO: 1828435 - RNA, 21 nt, Homo sapiens
cuguaguuaauuucagugccu

SEQ ID NO: 1828436 - RNA, 18 nt, Homo sapiens
ucccagcaccuggcacac

SEQ ID NO: 1828437 - RNA, 22 nt, Homo sapiens
cuccagcuucccgaguaccagu

SEQ ID NO: 1828438 - RNA, 13 nt, Homo sapiens
uuguuuuacauaa

SEQ ID NO: 1828439 - RNA, 17 nt, Homo sapiens
auaguucuaaacuauca

SEQ ID NO: 1828440 - RNA, 18 nt, Homo sapiens
uagaaauuggcuggaugu

SEQ ID NO: 1828441 - RNA, 16 nt, Homo sapiens
ccagaaucaacagcuc

SEQ ID NO: 1828442 - RNA, 13 nt, Homo sapiens
uauauacaaggug

SEQ ID NO: 1828443 - RNA, 16 nt, Homo sapiens
acagaaacuucucagu

SEQ ID NO: 1828444 - RNA, 12 nt, Homo sapiens
uccuauccugua

SEQ ID NO: 1828445 - RNA, 20 nt, Homo sapiens
uggcccagcugaucuaagga

SEQ ID NO: 1828446 - RNA, 20 nt, Homo sapiens
gcugaaauacugucuaucuc

SEQ ID NO: 1828447 - RNA, 23 nt, Homo sapiens
ggauguuauucuuccuucccaac

SEQ ID NO: 1828448 - RNA, 17 nt, Homo sapiens
acuauuuaugaaggcaa

SEQ ID NO: 1828449 - RNA, 12 nt, Homo sapiens
uggcaucugugc

SEQ ID NO: 1828450 - RNA, 13 nt, Homo sapiens
ugcaggacacugg

SEQ ID NO: 1828451 - RNA, 13 nt, Homo sapiens
agaagcccagaau

SEQ ID NO: 1828452 - RNA, 23 nt, Homo sapiens
ugucaccaacugaaguggcuaaa

SEQ ID NO: 1828453 - RNA, 16 nt, Homo sapiens
aagucagaacagccag

SEQ ID NO: 1828454 - RNA, 14 nt, Homo sapiens
agucaugauccuug

SEQ ID NO: 1828455 - RNA, 19 nt, Homo sapiens
gauucaccugagcaggacc

SEQ ID NO: 1828456 - RNA, 23 nt, Homo sapiens
cccacgauuccgaucgacugcca

SEQ ID NO: 1828457 - RNA, 11 nt, Homo sapiens
cuauguucccu

SEQ ID NO: 1828458 - RNA, 21 nt, Homo sapiens
ccaaacauguuguacauuuca

SEQ ID NO: 1828459 - RNA, 22 nt, Homo sapiens
cugacacaagaauggucuuucu

SEQ ID NO: 1828460 - RNA, 21 nt, Homo sapiens
ccauuagcauuugucaacaaa

SEQ ID NO: 1828461 - RNA, 16 nt, Homo sapiens
aagacucuauucucaa

SEQ ID NO: 1828462 - RNA, 17 nt, Homo sapiens
guuauuuaugcacugug

SEQ ID NO: 1828463 - RNA, 16 nt, Homo sapiens
accauuuuaguuuuaa

SEQ ID NO: 1828464 - RNA, 16 nt, Homo sapiens
caaagaaacaccacuu

SEQ ID NO: 1828465 - RNA, 14 nt, Homo sapiens
aaaagccacauaga

SEQ ID NO: 1828466 - RNA, 21 nt, Homo sapiens
ugggaggcagagguugcagug

SEQ ID NO: 1828467 - RNA, 13 nt, Homo sapiens
agauaacucuccu

SEQ ID NO: 1828468 - RNA, 22 nt, Homo sapiens
acuuuuguuauuaugcucuuaa

SEQ ID NO: 1828469 - RNA, 14 nt, Homo sapiens
augugauugcagcu

SEQ ID NO: 1828470 - RNA, 19 nt, Homo sapiens
cacaacugacacaggaaac

SEQ ID NO: 1828471 - RNA, 12 nt, Homo sapiens
ucucuugauuca

SEQ ID NO: 1828472 - RNA, 17 nt, Homo sapiens
aggaaaaacaaacucua

SEQ ID NO: 1828473 - RNA, 14 nt, Homo sapiens
gagugccaauccaa

SEQ ID NO: 1828474 - RNA, 14 nt, Homo sapiens
cagucucuuagaau

SEQ ID NO: 1828475 - RNA, 20 nt, Homo sapiens
uaaaaugggaagacugagcu

SEQ ID NO: 1828476 - RNA, 17 nt, Homo sapiens
auaauuuuccugugaca

SEQ ID NO: 1828477 - RNA, 14 nt, Homo sapiens
gcauguugccauga

SEQ ID NO: 1828478 - RNA, 16 nt, Homo sapiens
aaggccaauaguuuua

SEQ ID NO: 1828479 - RNA, 13 nt, Homo sapiens
cucaaaacaguaa

SEQ ID NO: 1828480 - RNA, 11 nt, Homo sapiens
ugaaaacuggg

SEQ ID NO: 1828481 - RNA, 19 nt, Homo sapiens
ucaacaccuuaauaugcug

SEQ ID NO: 1828482 - RNA, 14 nt, Homo sapiens
cuaacagccagcuu

SEQ ID NO: 1828483 - RNA, 15 nt, Homo sapiens
ccaaauaaaugcuca

SEQ ID NO: 1828484 - RNA, 18 nt, Homo sapiens
cucugccuccauuuaauu

SEQ ID NO: 1828485 - RNA, 22 nt, Homo sapiens
gcuuuaccuuuuuguaugugaa

SEQ ID NO: 1828486 - RNA, 14 nt, Homo sapiens
uuucaccagccaca

SEQ ID NO: 1828487 - RNA, 13 nt, Homo sapiens
uucaagcaauucu

SEQ ID NO: 1828488 - RNA, 22 nt, Homo sapiens
uuggaaaauaauauccaugcgu

SEQ ID NO: 1828489 - RNA, 14 nt, Homo sapiens
uuuaaaacuaucca

SEQ ID NO: 1828490 - RNA, 19 nt, Homo sapiens
uguagaaacucagcagaag

SEQ ID NO: 1828491 - RNA, 23 nt, Homo sapiens
cccgcugggauuucuucgcugcu

SEQ ID NO: 1828492 - RNA, 20 nt, Homo sapiens
gucuacaaacugaacacugc

SEQ ID NO: 1828493 - RNA, 19 nt, Homo sapiens
ucccuuggaaaucugccau

SEQ ID NO: 1828494 - RNA, 20 nt, Homo sapiens
cauauacuuguggucccaga

SEQ ID NO: 1828495 - RNA, 18 nt, Homo sapiens
aggagcucuacccugcuc

SEQ ID NO: 1828496 - RNA, 22 nt, Homo sapiens
acagacccccagggcauugugu

SEQ ID NO: 1828497 - RNA, 19 nt, Homo sapiens
caaauuauuuuuaucuuuc

SEQ ID NO: 1828498 - RNA, 17 nt, Homo sapiens
gucaguggaagaagcag

SEQ ID NO: 1828499 - RNA, 20 nt, Homo sapiens
cagcuggaggaauacauuuu

SEQ ID NO: 1828500 - RNA, 20 nt, Homo sapiens
uccggaaagccuuccucaag

SEQ ID NO: 1828501 - RNA, 17 nt, Homo sapiens
uaauugaccuacuuugg

SEQ ID NO: 1828502 - RNA, 16 nt, Homo sapiens
cuggugcaaauucaga

SEQ ID NO: 1828503 - RNA, 17 nt, Homo sapiens
ugucgaguuuacuucau

SEQ ID NO: 1828504 - RNA, 20 nt, Homo sapiens
agucuuccacuucaaugcac

SEQ ID NO: 1828505 - RNA, 16 nt, Homo sapiens
acuugccucugcacac

SEQ ID NO: 1828506 - RNA, 14 nt, Homo sapiens
augauccagaacag

SEQ ID NO: 1828507 - RNA, 16 nt, Homo sapiens
ucugcuuugcuguuau

SEQ ID NO: 1828508 - RNA, 16 nt, Homo sapiens
aguuaugaguauaaua

SEQ ID NO: 1828509 - RNA, 17 nt, Homo sapiens
caagugauccgcccauc

SEQ ID NO: 1828510 - RNA, 21 nt, Homo sapiens
aauacucugcuauuucucuug

SEQ ID NO: 1828511 - RNA, 20 nt, Homo sapiens
auuuacuuaauucagucuca

SEQ ID NO: 1828512 - RNA, 17 nt, Homo sapiens
ucaggcagggugcagua

SEQ ID NO: 1828513 - RNA, 13 nt, Homo sapiens
acuaacgccaucc

SEQ ID NO: 1828514 - RNA, 14 nt, Homo sapiens
caaagaacaagauc

SEQ ID NO: 1828515 - RNA, 13 nt, Homo sapiens
acucgugugcaac

SEQ ID NO: 1828516 - RNA, 22 nt, Homo sapiens
cugagccuuggggaguccacag

SEQ ID NO: 1828517 - RNA, 16 nt, Homo sapiens
uccaaaaauagucaaa

SEQ ID NO: 1828518 - RNA, 17 nt, Homo sapiens
auucugauguccauuug

SEQ ID NO: 1828519 - RNA, 15 nt, Homo sapiens
uguuuggcuguccag

SEQ ID NO: 1828520 - RNA, 17 nt, Homo sapiens
ugaaaaugccaccaucc

SEQ ID NO: 1828521 - RNA, 14 nt, Homo sapiens
aacuuaaaguauaa

SEQ ID NO: 1828522 - RNA, 20 nt, Homo sapiens
ccgugacaguuuacaaauga

SEQ ID NO: 1828523 - RNA, 19 nt, Homo sapiens
uaaucaucuucucuuuuuc

SEQ ID NO: 1828524 - RNA, 14 nt, Homo sapiens
ccugccugccgucu

SEQ ID NO: 1828525 - RNA, 14 nt, Homo sapiens
auugauugauguac

SEQ ID NO: 1828526 - RNA, 14 nt, Homo sapiens
ucaagaaagccagu

SEQ ID NO: 1828527 - RNA, 16 nt, Homo sapiens
aauagaaccacuauga

SEQ ID NO: 1828528 - RNA, 13 nt, Homo sapiens
ugcugaagggagg

SEQ ID NO: 1828529 - RNA, 23 nt, Homo sapiens
agggagggcgugaggucuugcag

SEQ ID NO: 1828530 - RNA, 15 nt, Homo sapiens
aauuuucccacugca

SEQ ID NO: 1828531 - RNA, 16 nt, Homo sapiens
aaggacuagagcucag

SEQ ID NO: 1828532 - RNA, 16 nt, Homo sapiens
auguuuagugugauug

SEQ ID NO: 1828533 - RNA, 14 nt, Homo sapiens
cagccacaacugca

SEQ ID NO: 1828534 - RNA, 19 nt, Homo sapiens
auugccuuauuugucugua

SEQ ID NO: 1828535 - RNA, 12 nt, Homo sapiens
guaugcauucau

SEQ ID NO: 1828536 - RNA, 23 nt, Homo sapiens
guggauaauagcguucagcagca

SEQ ID NO: 1828537 - RNA, 13 nt, Homo sapiens
cucagugggacaa

SEQ ID NO: 1828538 - RNA, 21 nt, Homo sapiens
aguggacccuggaccauucca

SEQ ID NO: 1828539 - RNA, 16 nt, Homo sapiens
gccuuuagccuggacc

SEQ ID NO: 1828540 - RNA, 15 nt, Homo sapiens
uuaugcagugcugcu

SEQ ID NO: 1828541 - RNA, 19 nt, Homo sapiens
auacugcacuuauuuguca

SEQ ID NO: 1828542 - RNA, 19 nt, Homo sapiens
auaucauuguugguguuaa

SEQ ID NO: 1828543 - RNA, 13 nt, Homo sapiens
acguggcaaaauc

SEQ ID NO: 1828544 - RNA, 17 nt, Homo sapiens
uccccaccagcuuuauu

SEQ ID NO: 1828545 - RNA, 13 nt, Homo sapiens
cagauuuaccaua

SEQ ID NO: 1828546 - RNA, 14 nt, Homo sapiens
gcaucugucagcca

SEQ ID NO: 1828547 - RNA, 15 nt, Homo sapiens
guucuuggaccaguu

SEQ ID NO: 1828548 - RNA, 17 nt, Homo sapiens
cccacgaggauggccug

SEQ ID NO: 1828549 - RNA, 19 nt, Homo sapiens
gugcugggauuacagggau

SEQ ID NO: 1828550 - RNA, 14 nt, Homo sapiens
agguagaacaaaga

SEQ ID NO: 1828551 - RNA, 22 nt, Homo sapiens
cauucauuuggauaaguuguga

SEQ ID NO: 1828552 - RNA, 17 nt, Homo sapiens
auuaaacaaauuccuuc

SEQ ID NO: 1828553 - RNA, 18 nt, Homo sapiens
ccccugcuccaccagcag

SEQ ID NO: 1828554 - RNA, 16 nt, Homo sapiens
cuaugauuaaacuggg

SEQ ID NO: 1828555 - RNA, 21 nt, Homo sapiens
cagaugaaaccaggucacugg

SEQ ID NO: 1828556 - RNA, 15 nt, Homo sapiens
guucugggacacagu

SEQ ID NO: 1828557 - RNA, 19 nt, Homo sapiens
ucugggaaaaagugcacgu

SEQ ID NO: 1828558 - RNA, 19 nt, Homo sapiens
aguuagcuuuaagcacccu

SEQ ID NO: 1828559 - RNA, 14 nt, Homo sapiens
ggagugucuggaau

SEQ ID NO: 1828560 - RNA, 23 nt, Homo sapiens
ugucuacaccaaugcccaacugc

SEQ ID NO: 1828561 - RNA, 16 nt, Homo sapiens
gaaucuagaaaaucag

SEQ ID NO: 1828562 - RNA, 18 nt, Homo sapiens
gcugacagagcucugggu

SEQ ID NO: 1828563 - RNA, 12 nt, Homo sapiens
gauuacaaugcu

SEQ ID NO: 1828564 - RNA, 20 nt, Homo sapiens
ccaagucucucuaagacaaa

SEQ ID NO: 1828565 - RNA, 13 nt, Homo sapiens
uccagacaccagu

SEQ ID NO: 1828566 - RNA, 18 nt, Homo sapiens
guauaaguauucaaguau

SEQ ID NO: 1828567 - RNA, 19 nt, Homo sapiens
cuguguugucagcacugua

SEQ ID NO: 1828568 - RNA, 20 nt, Homo sapiens
ccgugggaauuuuaucuuuu

SEQ ID NO: 1828569 - RNA, 23 nt, Homo sapiens
uaacauuuguguaauaugaaaua

SEQ ID NO: 1828570 - RNA, 13 nt, Homo sapiens
aggcaaugcccug

SEQ ID NO: 1828571 - RNA, 16 nt, Homo sapiens
cuuaauaauugcauau

SEQ ID NO: 1828572 - RNA, 19 nt, Homo sapiens
cccuuuccccauucaguga

SEQ ID NO: 1828573 - RNA, 16 nt, Homo sapiens
gucugggcacaagugu

SEQ ID NO: 1828574 - RNA, 16 nt, Homo sapiens
uccuaugcuauugaca

SEQ ID NO: 1828575 - RNA, 19 nt, Homo sapiens
auugugaagcaccuacuau

SEQ ID NO: 1828576 - RNA, 19 nt, Homo sapiens
uuuugucauguagcuguuu

SEQ ID NO: 1828577 - RNA, 20 nt, Homo sapiens
gagccacagaaauugcauaa

SEQ ID NO: 1828578 - RNA, 16 nt, Homo sapiens
cucgacguugccuuua

SEQ ID NO: 1828579 - RNA, 21 nt, Homo sapiens
cuccucaucucuaacagcuca

SEQ ID NO: 1828580 - RNA, 14 nt, Homo sapiens
agauaacauuucaa

SEQ ID NO: 1828581 - RNA, 21 nt, Homo sapiens
ccaucggguaagaugcuccug

SEQ ID NO: 1828582 - RNA, 16 nt, Homo sapiens
ugacaauuugccauag

SEQ ID NO: 1828583 - RNA, 16 nt, Homo sapiens
cuacaguacaaucagc

SEQ ID NO: 1828584 - RNA, 14 nt, Homo sapiens
uaccuaguuugcac

SEQ ID NO: 1828585 - RNA, 14 nt, Homo sapiens
cauacggcacugaa

SEQ ID NO: 1828586 - RNA, 17 nt, Homo sapiens
gaaagacuggacucuaa

SEQ ID NO: 1828587 - RNA, 21 nt, Homo sapiens
cucuggggugcugagugagcu

SEQ ID NO: 1828588 - RNA, 19 nt, Homo sapiens
uuccgugagagucaucuca

SEQ ID NO: 1828589 - RNA, 14 nt, Homo sapiens
uccugccuggccag

SEQ ID NO: 1828590 - RNA, 18 nt, Homo sapiens
agggaugcuaguccguga

SEQ ID NO: 1828591 - RNA, 18 nt, Homo sapiens
ccuucugaggacauucca

SEQ ID NO: 1828592 - RNA, 17 nt, Homo sapiens
agugaagugaagagagg

SEQ ID NO: 1828593 - RNA, 11 nt, Homo sapiens
uguuugcacuu

SEQ ID NO: 1828594 - RNA, 13 nt, Homo sapiens
cccaucucaaaaa

SEQ ID NO: 1828595 - RNA, 18 nt, Homo sapiens
uaaagcguccucucagua

SEQ ID NO: 1828596 - RNA, 20 nt, Homo sapiens
aaucuguguucgauggcuca

SEQ ID NO: 1828597 - RNA, 15 nt, Homo sapiens
cacugaguucuauca

SEQ ID NO: 1828598 - RNA, 12 nt, Homo sapiens
uacucaucagag

SEQ ID NO: 1828599 - RNA, 17 nt, Homo sapiens
aaacaaaauuugacuaa

SEQ ID NO: 1828600 - RNA, 13 nt, Homo sapiens
aucaucacuguaa

SEQ ID NO: 1828601 - RNA, 21 nt, Homo sapiens
cccucacuaauugguacuuuu

SEQ ID NO: 1828602 - RNA, 15 nt, Homo sapiens
uaaaauuaugccaua

SEQ ID NO: 1828603 - RNA, 15 nt, Homo sapiens
uacagacaugaacug

SEQ ID NO: 1828604 - RNA, 16 nt, Homo sapiens
guucguugcacagcug

SEQ ID NO: 1828605 - RNA, 15 nt, Homo sapiens
ucuuuuagcauguga

SEQ ID NO: 1828606 - RNA, 19 nt, Homo sapiens
aacucauggcuucucucuc

SEQ ID NO: 1828607 - RNA, 18 nt, Homo sapiens
gggggagaagaagccgag

SEQ ID NO: 1828608 - RNA, 20 nt, Homo sapiens
gcauccuggccaacauggug

SEQ ID NO: 1828609 - RNA, 17 nt, Homo sapiens
ucucagacugccaaaga

SEQ ID NO: 1828610 - RNA, 16 nt, Homo sapiens
cauaugauacugaugc

SEQ ID NO: 1828611 - RNA, 20 nt, Homo sapiens
aucacuuuggacagaauuag

SEQ ID NO: 1828612 - RNA, 19 nt, Homo sapiens
uaaguucuuugaagacuua

SEQ ID NO: 1828613 - RNA, 15 nt, Homo sapiens
cuccuucaagcugcu

SEQ ID NO: 1828614 - RNA, 20 nt, Homo sapiens
uuaaaauaugcucuaaacau

SEQ ID NO: 1828615 - RNA, 21 nt, Homo sapiens
caaagccucggaucagccuug

SEQ ID NO: 1828616 - RNA, 17 nt, Homo sapiens
cuguaaucucagcacuu

SEQ ID NO: 1828617 - RNA, 15 nt, Homo sapiens
uuaaucccagcacuu

SEQ ID NO: 1828618 - RNA, 22 nt, Homo sapiens
uuccuagcaccgcuuauccccu

SEQ ID NO: 1828619 - RNA, 22 nt, Homo sapiens
acccacuaauacuacugcacag

SEQ ID NO: 1828620 - RNA, 15 nt, Homo sapiens
cacauuuaacgacag

SEQ ID NO: 1828621 - RNA, 21 nt, Homo sapiens
aaaccugaccccugcucagua

SEQ ID NO: 1828622 - RNA, 15 nt, Homo sapiens
cagacaacacuggga

SEQ ID NO: 1828623 - RNA, 12 nt, Homo sapiens
uuguacauauug

SEQ ID NO: 1828624 - RNA, 12 nt, Homo sapiens
auugacauuugu

SEQ ID NO: 1828625 - RNA, 17 nt, Homo sapiens
uguuagcugcucacuua

SEQ ID NO: 1828626 - RNA, 21 nt, Homo sapiens
uccucuggcuuucccaggaga

SEQ ID NO: 1828627 - RNA, 19 nt, Homo sapiens
ccccucggccccagcacau

SEQ ID NO: 1828628 - RNA, 13 nt, Homo sapiens
uuuacuugcaccu

SEQ ID NO: 1828629 - RNA, 18 nt, Homo sapiens
gaugauccuugcacagac

SEQ ID NO: 1828630 - RNA, 23 nt, Homo sapiens
gaacuuuaagaagcaguguuuua

SEQ ID NO: 1828631 - RNA, 18 nt, Homo sapiens
acaccagcagcacuggaa

SEQ ID NO: 1828632 - RNA, 19 nt, Homo sapiens
caagaucagccugggcaac

SEQ ID NO: 1828633 - RNA, 13 nt, Homo sapiens
cauugcacuggaa

SEQ ID NO: 1828634 - RNA, 14 nt, Homo sapiens
gucuucuuuaccuc

SEQ ID NO: 1828635 - RNA, 17 nt, Homo sapiens
uuagagugucuuuccac

SEQ ID NO: 1828636 - RNA, 20 nt, Homo sapiens
acacauaggaggcucauucu

SEQ ID NO: 1828637 - RNA, 19 nt, Homo sapiens
ucuagauuuuucugugaaa

SEQ ID NO: 1828638 - RNA, 14 nt, Homo sapiens
auacuuuugcugau

SEQ ID NO: 1828639 - RNA, 19 nt, Homo sapiens
uggugcagugugugaaaau

SEQ ID NO: 1828640 - RNA, 13 nt, Homo sapiens
agucaccugccca

SEQ ID NO: 1828641 - RNA, 14 nt, Homo sapiens
acauuucuuuggaa

SEQ ID NO: 1828642 - RNA, 16 nt, Homo sapiens
cagagcacuguauacc

SEQ ID NO: 1828643 - RNA, 18 nt, Homo sapiens
acaggagaccccuuugca

SEQ ID NO: 1828644 - RNA, 12 nt, Homo sapiens
aauccuggacca

SEQ ID NO: 1828645 - RNA, 14 nt, Homo sapiens
cucauggcaucauc

SEQ ID NO: 1828646 - RNA, 21 nt, Homo sapiens
auuucauacccaugucagauu

SEQ ID NO: 1828647 - RNA, 23 nt, Homo sapiens
auuaagguauuucgaaacugcca

SEQ ID NO: 1828648 - RNA, 15 nt, Homo sapiens
cucucggacucccua

SEQ ID NO: 1828649 - RNA, 17 nt, Homo sapiens
acaaucagcccagugca

SEQ ID NO: 1828650 - RNA, 16 nt, Homo sapiens
auuuauuuuguguugu

SEQ ID NO: 1828651 - RNA, 23 nt, Homo sapiens
aucuaagauauuuugaacuaagc

SEQ ID NO: 1828652 - RNA, 14 nt, Homo sapiens
agaauaucuaaaca

SEQ ID NO: 1828653 - RNA, 13 nt, Homo sapiens
guuuuacagcugc

SEQ ID NO: 1828654 - RNA, 11 nt, Homo sapiens
ccacccaguuc

SEQ ID NO: 1828655 - RNA, 14 nt, Homo sapiens
caauccaugagaua

SEQ ID NO: 1828656 - RNA, 14 nt, Homo sapiens
cuaaccauguguua

SEQ ID NO: 1828657 - RNA, 19 nt, Homo sapiens
ugauaccuucuggcugugc

SEQ ID NO: 1828658 - RNA, 22 nt, Homo sapiens
aaacagagacaggcccaagaga

SEQ ID NO: 1828659 - RNA, 23 nt, Homo sapiens
aauggguaucuaauaaauacuua

SEQ ID NO: 1828660 - RNA, 16 nt, Homo sapiens
gggucugcccugccca

SEQ ID NO: 1828661 - RNA, 21 nt, Homo sapiens
agguuccuguuugaacccagg

SEQ ID NO: 1828662 - RNA, 19 nt, Homo sapiens
uggaaucaaggaauccuga

SEQ ID NO: 1828663 - RNA, 23 nt, Homo sapiens
guuugucuauaugucuagcucau

SEQ ID NO: 1828664 - RNA, 13 nt, Homo sapiens
cggagcacugcac

SEQ ID NO: 1828665 - RNA, 14 nt, Homo sapiens
cgagucaugcacuc

SEQ ID NO: 1828666 - RNA, 22 nt, Homo sapiens
ucccuucuuuuuguucuucauc

SEQ ID NO: 1828667 - RNA, 18 nt, Homo sapiens
aagacuauucccuucuaa

SEQ ID NO: 1828668 - RNA, 15 nt, Homo sapiens
ucacauccaaugcau

SEQ ID NO: 1828669 - RNA, 22 nt, Homo sapiens
acugauggcaauauuaagacag

SEQ ID NO: 1828670 - RNA, 15 nt, Homo sapiens
cccgacugccugucu

SEQ ID NO: 1828671 - RNA, 22 nt, Homo sapiens
caguaaaguguaacauaugcaa

SEQ ID NO: 1828672 - RNA, 19 nt, Homo sapiens
aaagcaacagacuucucaa

SEQ ID NO: 1828673 - RNA, 18 nt, Homo sapiens
auggaauuuugcaaagau

SEQ ID NO: 1828674 - RNA, 21 nt, Homo sapiens
aaguacuaucuuuguguugca

SEQ ID NO: 1828675 - RNA, 13 nt, Homo sapiens
aaaacaauaauuu

SEQ ID NO: 1828676 - RNA, 19 nt, Homo sapiens
agacgccuuucuccuccaa

SEQ ID NO: 1828677 - RNA, 20 nt, Homo sapiens
uaggugcuaauuaauaaaga

SEQ ID NO: 1828678 - RNA, 21 nt, Homo sapiens
acacugaguucuaucaguuau

SEQ ID NO: 1828679 - RNA, 12 nt, Homo sapiens
acacaguggaga

SEQ ID NO: 1828680 - RNA, 13 nt, Homo sapiens
acauugaguuuaa

SEQ ID NO: 1828681 - RNA, 17 nt, Homo sapiens
uggagccgggaaagcug

SEQ ID NO: 1828682 - RNA, 16 nt, Homo sapiens
gaaagaaaaauaccau

SEQ ID NO: 1828683 - RNA, 15 nt, Homo sapiens
gcccaggagccucac

SEQ ID NO: 1828684 - RNA, 15 nt, Homo sapiens
uucaagugguucucc

SEQ ID NO: 1828685 - RNA, 15 nt, Homo sapiens
uucccuucaaugcaa

SEQ ID NO: 1828686 - RNA, 18 nt, Homo sapiens
uggugcagccuacacuau

SEQ ID NO: 1828687 - RNA, 21 nt, Homo sapiens
auguaucuaauucuccugacu

SEQ ID NO: 1828688 - RNA, 10 nt, Homo sapiens
gucauagaaa

SEQ ID NO: 1828689 - RNA, 23 nt, Homo sapiens
uaacuaugaucaucuugaugucu

SEQ ID NO: 1828690 - RNA, 15 nt, Homo sapiens
aguaaguauuuccau

SEQ ID NO: 1828691 - RNA, 19 nt, Homo sapiens
guuuuuuacuuccacagaa

SEQ ID NO: 1828692 - RNA, 18 nt, Homo sapiens
uuuaaaaaauuauggaau

SEQ ID NO: 1828693 - RNA, 11 nt, Homo sapiens
gacacugugcu

SEQ ID NO: 1828694 - RNA, 17 nt, Homo sapiens
ggccccggguccaggag

SEQ ID NO: 1828695 - RNA, 15 nt, Homo sapiens
agcagauguggugau

SEQ ID NO: 1828696 - RNA, 22 nt, Homo sapiens
uucaaggacuguuucaguguga

SEQ ID NO: 1828697 - RNA, 13 nt, Homo sapiens
ucaauuugcugaa

SEQ ID NO: 1828698 - RNA, 14 nt, Homo sapiens
ucuuuuaacagccu

SEQ ID NO: 1828699 - RNA, 20 nt, Homo sapiens
ggaucacaaggucacuagau

SEQ ID NO: 1828700 - RNA, 15 nt, Homo sapiens
aaaauccuacaguga

SEQ ID NO: 1828701 - RNA, 17 nt, Homo sapiens
guauaagguacauauuu

SEQ ID NO: 1828702 - RNA, 22 nt, Homo sapiens
uaguauaagucugggcacugga

SEQ ID NO: 1828703 - RNA, 19 nt, Homo sapiens
acuggggucuguguggugc

SEQ ID NO: 1828704 - RNA, 15 nt, Homo sapiens
ucuucauggccucag

SEQ ID NO: 1828705 - RNA, 21 nt, Homo sapiens
ucuaggugggagagagugcau

SEQ ID NO: 1828706 - RNA, 18 nt, Homo sapiens
uguccugaaccgacugac

SEQ ID NO: 1828707 - RNA, 20 nt, Homo sapiens
ucacuuuuuccccugcaaug

SEQ ID NO: 1828708 - RNA, 18 nt, Homo sapiens
aguuugugagaaacaucu

SEQ ID NO: 1828709 - RNA, 11 nt, Homo sapiens
cucuccagaag

SEQ ID NO: 1828710 - RNA, 20 nt, Homo sapiens
aaguucaggcagcacaucaa

SEQ ID NO: 1828711 - RNA, 20 nt, Homo sapiens
gaccugaggcuccugugcua

SEQ ID NO: 1828712 - RNA, 16 nt, Homo sapiens
agcauccuucuaagac

SEQ ID NO: 1828713 - RNA, 13 nt, Homo sapiens
cauugucuuuaau

SEQ ID NO: 1828714 - RNA, 12 nt, Homo sapiens
gaugcugcuaug

SEQ ID NO: 1828715 - RNA, 16 nt, Homo sapiens
auaaguggccuugaca

SEQ ID NO: 1828716 - RNA, 21 nt, Homo sapiens
ccaagcugggccccagcccac

SEQ ID NO: 1828717 - RNA, 18 nt, Homo sapiens
uaucguuaagcacaagac

SEQ ID NO: 1828718 - RNA, 16 nt, Homo sapiens
cauuucugauacuuuc

SEQ ID NO: 1828719 - RNA, 14 nt, Homo sapiens
ugaauaguuuccaa

SEQ ID NO: 1828720 - RNA, 18 nt, Homo sapiens
aucugugcccagagaugg

SEQ ID NO: 1828721 - RNA, 18 nt, Homo sapiens
uuaaccugccaacauacu

SEQ ID NO: 1828722 - RNA, 15 nt, Homo sapiens
acagcagcacuguuc

SEQ ID NO: 1828723 - RNA, 22 nt, Homo sapiens
guguggacuuugagcacacuuu

SEQ ID NO: 1828724 - RNA, 18 nt, Homo sapiens
uccucuuuuucuguguga

SEQ ID NO: 1828725 - RNA, 20 nt, Homo sapiens
aagcagucuucucuucugcc

SEQ ID NO: 1828726 - RNA, 19 nt, Homo sapiens
cuugagauguauuaugcaa

SEQ ID NO: 1828727 - RNA, 16 nt, Homo sapiens
uauuuacauuagcuga

SEQ ID NO: 1828728 - RNA, 16 nt, Homo sapiens
acggcugugggaccag

SEQ ID NO: 1828729 - RNA, 17 nt, Homo sapiens
aaagcguggacaggugu

SEQ ID NO: 1828730 - RNA, 21 nt, Homo sapiens
ccuggaccugaaggcaucuga

SEQ ID NO: 1828731 - RNA, 13 nt, Homo sapiens
aggcauagaggga

SEQ ID NO: 1828732 - RNA, 12 nt, Homo sapiens
uccccugucuac

SEQ ID NO: 1828733 - RNA, 12 nt, Homo sapiens
cucccuguucac

SEQ ID NO: 1828734 - RNA, 19 nt, Homo sapiens
uuacagucauaauguguug

SEQ ID NO: 1828735 - RNA, 21 nt, Homo sapiens
cagcccuacaacaaccugaag

SEQ ID NO: 1828736 - RNA, 21 nt, Homo sapiens
caaacguacgggaaugugcuu

SEQ ID NO: 1828737 - RNA, 20 nt, Homo sapiens
uaacauagauuuauguaaug

SEQ ID NO: 1828738 - RNA, 16 nt, Homo sapiens
acuguguguugacacu

SEQ ID NO: 1828739 - RNA, 17 nt, Homo sapiens
cacgggguuacacuguu

SEQ ID NO: 1828740 - RNA, 22 nt, Homo sapiens
augccuaguuauucauuguuaa

SEQ ID NO: 1828741 - RNA, 16 nt, Homo sapiens
cuuuacuuucccaaau

SEQ ID NO: 1828742 - RNA, 12 nt, Homo sapiens
aaauauuaucuu

SEQ ID NO: 1828743 - RNA, 16 nt, Homo sapiens
acaagcugcacuguga

SEQ ID NO: 1828744 - RNA, 21 nt, Homo sapiens
cauuauuucuguauauagaug

SEQ ID NO: 1828745 - RNA, 20 nt, Homo sapiens
uccuuaaaugaacuacugcu

SEQ ID NO: 1828746 - RNA, 14 nt, Homo sapiens
ccuccccaccagag

SEQ ID NO: 1828747 - RNA, 20 nt, Homo sapiens
aguccagcacccagguaaaa

SEQ ID NO: 1828748 - RNA, 20 nt, Homo sapiens
uggagaaaccuucacuccag

SEQ ID NO: 1828749 - RNA, 15 nt, Homo sapiens
cagauaucugaaugg

SEQ ID NO: 1828750 - RNA, 14 nt, Homo sapiens
aacuuauaucauca

SEQ ID NO: 1828751 - RNA, 20 nt, Homo sapiens
ucuaucccaaacuaagcuau

SEQ ID NO: 1828752 - RNA, 15 nt, Homo sapiens
caucaaaguggcaaa

SEQ ID NO: 1828753 - RNA, 18 nt, Homo sapiens
aguucacuaaaacccugg

SEQ ID NO: 1828754 - RNA, 20 nt, Homo sapiens
gugacaaaaaauuaaagcau

SEQ ID NO: 1828755 - RNA, 15 nt, Homo sapiens
auacuuuugugaaca

SEQ ID NO: 1828756 - RNA, 22 nt, Homo sapiens
uugaaacagcagucccaguauu

SEQ ID NO: 1828757 - RNA, 14 nt, Homo sapiens
accucagcuugcac

SEQ ID NO: 1828758 - RNA, 19 nt, Homo sapiens
aucuuuucuacagcaaauu

SEQ ID NO: 1828759 - RNA, 15 nt, Homo sapiens
uaaggaacaaaucuc

SEQ ID NO: 1828760 - RNA, 15 nt, Homo sapiens
cauugggcuacugua

SEQ ID NO: 1828761 - RNA, 15 nt, Homo sapiens
aggcuucuggggcuu

SEQ ID NO: 1828762 - RNA, 17 nt, Homo sapiens
cuuucugaaauagucaa

SEQ ID NO: 1828763 - RNA, 21 nt, Homo sapiens
uacagaggauucugucuucca

SEQ ID NO: 1828764 - RNA, 15 nt, Homo sapiens
cuucuguccuacucu

SEQ ID NO: 1828765 - RNA, 14 nt, Homo sapiens
acacuaugugcaaa

SEQ ID NO: 1828766 - RNA, 23 nt, Homo sapiens
uacuuuucucuuucuucucugcu

SEQ ID NO: 1828767 - RNA, 19 nt, Homo sapiens
cucugguccuucugacccc

SEQ ID NO: 1828768 - RNA, 15 nt, Homo sapiens
gccacuuaguauuuu

SEQ ID NO: 1828769 - RNA, 15 nt, Homo sapiens
aggcagaccauccac

SEQ ID NO: 1828770 - RNA, 12 nt, Homo sapiens
ucccaucuccuu

SEQ ID NO: 1828771 - RNA, 18 nt, Homo sapiens
ugacuccagguguaguua

SEQ ID NO: 1828772 - RNA, 20 nt, Homo sapiens
cugaaguucagcugcauaca

SEQ ID NO: 1828773 - RNA, 15 nt, Homo sapiens
aaucacauccacaaa

SEQ ID NO: 1828774 - RNA, 21 nt, Homo sapiens
guuaacguauuaguugccaau

SEQ ID NO: 1828775 - RNA, 17 nt, Homo sapiens
cuggaagcuaauuugca

SEQ ID NO: 1828776 - RNA, 16 nt, Homo sapiens
ccaaccuccaguguca

SEQ ID NO: 1828777 - RNA, 14 nt, Homo sapiens
uggaaaauaaauca

SEQ ID NO: 1828778 - RNA, 24 nt, Homo sapiens
agcagagcuggcacccugucauca

SEQ ID NO: 1828779 - RNA, 22 nt, Homo sapiens
acagauucacuuuguuuaugca

SEQ ID NO: 1828780 - RNA, 21 nt, Homo sapiens
aagugcuaauuuugaaaaacu

SEQ ID NO: 1828781 - RNA, 19 nt, Homo sapiens
uacaaaaauuagcugggca

SEQ ID NO: 1828782 - RNA, 13 nt, Homo sapiens
cuugucauauucg

SEQ ID NO: 1828783 - RNA, 14 nt, Homo sapiens
gcuuucucuucuaa

SEQ ID NO: 1828784 - RNA, 19 nt, Homo sapiens
ggcgcacuucagaaucaga

SEQ ID NO: 1828785 - RNA, 23 nt, Homo sapiens
uacauauauauauacacauacau

SEQ ID NO: 1828786 - RNA, 23 nt, Homo sapiens
ugcacacacacacacaugcacac

SEQ ID NO: 1828787 - RNA, 17 nt, Homo sapiens
gaaacugaaacuacugc

SEQ ID NO: 1828788 - RNA, 17 nt, Homo sapiens
uuucuuggccaggguag

SEQ ID NO: 1828789 - RNA, 15 nt, Homo sapiens
aacagagccuucaca

SEQ ID NO: 1828790 - RNA, 21 nt, Homo sapiens
ucagcauugugacuuggagau

SEQ ID NO: 1828791 - RNA, 21 nt, Homo sapiens
aguuauuucaaccagcacauu

SEQ ID NO: 1828792 - RNA, 18 nt, Homo sapiens
ccucucccaaguccacac

SEQ ID NO: 1828793 - RNA, 12 nt, Homo sapiens
uacuguaucuga

SEQ ID NO: 1828794 - RNA, 20 nt, Homo sapiens
ucuugcuggauuugugcuuu

SEQ ID NO: 1828795 - RNA, 11 nt, Homo sapiens
ccccaaagugg

SEQ ID NO: 1828796 - RNA, 14 nt, Homo sapiens
cugaacucccaguc

SEQ ID NO: 1828797 - RNA, 18 nt, Homo sapiens
caucgcagggcucaugau

SEQ ID NO: 1828798 - RNA, 14 nt, Homo sapiens
auuucuaggccagu

SEQ ID NO: 1828799 - RNA, 16 nt, Homo sapiens
ugcccuugucugagau

SEQ ID NO: 1828800 - RNA, 20 nt, Homo sapiens
ccaaaaagagacugaucauc

SEQ ID NO: 1828801 - RNA, 13 nt, Homo sapiens
gagcccgcacugu

SEQ ID NO: 1828802 - RNA, 21 nt, Homo sapiens
cugggcagcaccucuggucag

SEQ ID NO: 1828803 - RNA, 21 nt, Homo sapiens
aggcccgcuugcuggguaccu

SEQ ID NO: 1828804 - RNA, 22 nt, Homo sapiens
guguguuaaaugggacuggagu

SEQ ID NO: 1828805 - RNA, 22 nt, Homo sapiens
aaggcagucccgggagaaaaga

SEQ ID NO: 1828806 - RNA, 18 nt, Homo sapiens
uuggcaccgaagcccaga

SEQ ID NO: 1828807 - RNA, 19 nt, Homo sapiens
acuuaggcuuggauacuca

SEQ ID NO: 1828808 - RNA, 13 nt, Homo sapiens
aauuacacaugua

SEQ ID NO: 1828809 - RNA, 13 nt, Homo sapiens
aauaauauugcau

SEQ ID NO: 1828810 - RNA, 20 nt, Homo sapiens
gagaugggugauuccuucaa

SEQ ID NO: 1828811 - RNA, 14 nt, Homo sapiens
cucucaggaccaga

SEQ ID NO: 1828812 - RNA, 17 nt, Homo sapiens
aaagugcgaguccucca

SEQ ID NO: 1828813 - RNA, 18 nt, Homo sapiens
cauuuaucuaaauaugga

SEQ ID NO: 1828814 - RNA, 23 nt, Homo sapiens
aaauuuuccuuuuagucuagccu

SEQ ID NO: 1828815 - RNA, 21 nt, Homo sapiens
ggcccuaccagacacugcugc

SEQ ID NO: 1828816 - RNA, 19 nt, Homo sapiens
cccaggaucagauugcaug

SEQ ID NO: 1828817 - RNA, 16 nt, Homo sapiens
gccucagcaagccaug

SEQ ID NO: 1828818 - RNA, 17 nt, Homo sapiens
ugaauacucuucccaca

SEQ ID NO: 1828819 - RNA, 21 nt, Homo sapiens
gaauccuuggggagcacuugu

SEQ ID NO: 1828820 - RNA, 16 nt, Homo sapiens
gucuuggccucccaaa

SEQ ID NO: 1828821 - RNA, 18 nt, Homo sapiens
cuguagcauuacaguggg

SEQ ID NO: 1828822 - RNA, 18 nt, Homo sapiens
cagcucugugccaccucc

SEQ ID NO: 1828823 - RNA, 16 nt, Homo sapiens
ucccaucucauuucca

SEQ ID NO: 1828824 - RNA, 17 nt, Homo sapiens
gaggccccugccuccaa

SEQ ID NO: 1828825 - RNA, 19 nt, Homo sapiens
ggcuugggcaccagcucau

SEQ ID NO: 1828826 - RNA, 19 nt, Homo sapiens
ccccucucucacacaucac

SEQ ID NO: 1828827 - RNA, 13 nt, Homo sapiens
auggcauccugca

SEQ ID NO: 1828828 - RNA, 19 nt, Homo sapiens
cagguaccucuuucagggu

SEQ ID NO: 1828829 - RNA, 14 nt, Homo sapiens
ggaagggaggucuc

SEQ ID NO: 1828830 - RNA, 14 nt, Homo sapiens
cuugggaccguguu

SEQ ID NO: 1828831 - RNA, 15 nt, Homo sapiens
auuugacuccacuuu

SEQ ID NO: 1828832 - RNA, 14 nt, Homo sapiens
caacaauuuaccuu

SEQ ID NO: 1828833 - RNA, 22 nt, Homo sapiens
cuggccuugucaggacccaggc

SEQ ID NO: 1828834 - RNA, 11 nt, Homo sapiens
gccugccauag

SEQ ID NO: 1828835 - RNA, 16 nt, Homo sapiens
agacaucagauccugg

SEQ ID NO: 1828836 - RNA, 18 nt, Homo sapiens
uuuggcuugcuguuuacu

SEQ ID NO: 1828837 - RNA, 22 nt, Homo sapiens
guaaacagaggaguacagguga

SEQ ID NO: 1828838 - RNA, 19 nt, Homo sapiens
aagcuucugccuucuggaa

SEQ ID NO: 1828839 - RNA, 21 nt, Homo sapiens
agggacuugugucacaucucu

SEQ ID NO: 1828840 - RNA, 18 nt, Homo sapiens
auggcagcuguuucucau

SEQ ID NO: 1828841 - RNA, 15 nt, Homo sapiens
acugugaguccugau

SEQ ID NO: 1828842 - RNA, 15 nt, Homo sapiens
uccuucauuucaggu

SEQ ID NO: 1828843 - RNA, 15 nt, Homo sapiens
aacagacuucucaau

SEQ ID NO: 1828844 - RNA, 15 nt, Homo sapiens
auaaaccacugugcg

SEQ ID NO: 1828845 - RNA, 20 nt, Homo sapiens
cauagagauaugcacacaca

SEQ ID NO: 1828846 - RNA, 14 nt, Homo sapiens
cugcugacaguguu

SEQ ID NO: 1828847 - RNA, 22 nt, Homo sapiens
cuuuuugaagacuucuagcaga

SEQ ID NO: 1828848 - RNA, 22 nt, Homo sapiens
gggccagccccacccccagcca

SEQ ID NO: 1828849 - RNA, 19 nt, Homo sapiens
cacaguuguguucaugcug

SEQ ID NO: 1828850 - RNA, 18 nt, Homo sapiens
ccuccagagaccccagga

SEQ ID NO: 1828851 - RNA, 20 nt, Homo sapiens
caaggcccuuuccuuuggaa

SEQ ID NO: 1828852 - RNA, 23 nt, Homo sapiens
uuguuggagucaaaaagaaccac

SEQ ID NO: 1828853 - RNA, 14 nt, Homo sapiens
uccaccagucauuu

SEQ ID NO: 1828854 - RNA, 15 nt, Homo sapiens
aagaggucuccauca

SEQ ID NO: 1828855 - RNA, 20 nt, Homo sapiens
acaacagugugaucauuggu

SEQ ID NO: 1828856 - RNA, 17 nt, Homo sapiens
ugccaugcccaccaucg

SEQ ID NO: 1828857 - RNA, 21 nt, Homo sapiens
aagagaaaaagcccucuucaa

SEQ ID NO: 1828858 - RNA, 22 nt, Homo sapiens
cuggguuuuguauucucugagc

SEQ ID NO: 1828859 - RNA, 13 nt, Homo sapiens
aaggaagucuuca

SEQ ID NO: 1828860 - RNA, 19 nt, Homo sapiens
uacauugauucaugucuca

SEQ ID NO: 1828861 - RNA, 17 nt, Homo sapiens
cuguuaacgucaucuca

SEQ ID NO: 1828862 - RNA, 20 nt, Homo sapiens
uuucugaggugcacugggag

SEQ ID NO: 1828863 - RNA, 13 nt, Homo sapiens
ggagaaugcacag

SEQ ID NO: 1828864 - RNA, 24 nt, Homo sapiens
uuucaaguuauucaaauuuguaca

SEQ ID NO: 1828865 - RNA, 16 nt, Homo sapiens
aaugucucaagugcaa

SEQ ID NO: 1828866 - RNA, 18 nt, Homo sapiens
uggaaagaguaggaagac

SEQ ID NO: 1828867 - RNA, 22 nt, Homo sapiens
gcacugaccccccccauuagaa

SEQ ID NO: 1828868 - RNA, 16 nt, Homo sapiens
cucugccuacagccag

SEQ ID NO: 1828869 - RNA, 17 nt, Homo sapiens
gguaauuccaagugaau

SEQ ID NO: 1828870 - RNA, 14 nt, Homo sapiens
uguagaaagugauc

SEQ ID NO: 1828871 - RNA, 15 nt, Homo sapiens
agucuugucucaaga

SEQ ID NO: 1828872 - RNA, 18 nt, Homo sapiens
auucggugugcugccaac

SEQ ID NO: 1828873 - RNA, 14 nt, Homo sapiens
gucucuauaccaau

SEQ ID NO: 1828874 - RNA, 17 nt, Homo sapiens
uuuaaaaagugugcuua

SEQ ID NO: 1828875 - RNA, 14 nt, Homo sapiens
cucucucgaccuuc

SEQ ID NO: 1828876 - RNA, 18 nt, Homo sapiens
ugaccgacaaaauuccag

SEQ ID NO: 1828877 - RNA, 16 nt, Homo sapiens
cacuuccguuuaccuu

SEQ ID NO: 1828878 - RNA, 12 nt, Homo sapiens
gguucugcccug

SEQ ID NO: 1828879 - RNA, 18 nt, Homo sapiens
aacuuuccugacuuacaa

SEQ ID NO: 1828880 - RNA, 22 nt, Homo sapiens
caucuccagggagcaagacaga

SEQ ID NO: 1828881 - RNA, 18 nt, Homo sapiens
gcaagcggggaugucccu

SEQ ID NO: 1828882 - RNA, 19 nt, Homo sapiens
gggauggagaaacaagaca

SEQ ID NO: 1828883 - RNA, 16 nt, Homo sapiens
aucucauggcagcuaa

SEQ ID NO: 1828884 - RNA, 22 nt, Homo sapiens
uccaccuggccccuucuccagc

SEQ ID NO: 1828885 - RNA, 21 nt, Homo sapiens
ccaacuuaauacaaaacugug

SEQ ID NO: 1828886 - RNA, 15 nt, Homo sapiens
uuuccuuugaccucu

SEQ ID NO: 1828887 - RNA, 22 nt, Homo sapiens
gaaagagaaaccugagugacga

SEQ ID NO: 1828888 - RNA, 17 nt, Homo sapiens
uugccugugccagguga

SEQ ID NO: 1828889 - RNA, 19 nt, Homo sapiens
accaucaaguugugccaaa

SEQ ID NO: 1828890 - RNA, 21 nt, Homo sapiens
cauauuccugguguagcacuu

SEQ ID NO: 1828891 - RNA, 19 nt, Homo sapiens
cagauggaaaaacugaggc

SEQ ID NO: 1828892 - RNA, 14 nt, Homo sapiens
uggaagaaauggga

SEQ ID NO: 1828893 - RNA, 21 nt, Homo sapiens
agucacauuugcaucauagac

SEQ ID NO: 1828894 - RNA, 17 nt, Homo sapiens
ugacaaaguaugugguu

SEQ ID NO: 1828895 - RNA, 22 nt, Homo sapiens
ccagacaucuggacacugggca

SEQ ID NO: 1828896 - RNA, 17 nt, Homo sapiens
ucaauaauauuagcuua

SEQ ID NO: 1828897 - RNA, 12 nt, Homo sapiens
aacaucaccagu

SEQ ID NO: 1828898 - RNA, 13 nt, Homo sapiens
cuuccacuggugg

SEQ ID NO: 1828899 - RNA, 22 nt, Homo sapiens
gugcgcucacaguugagcugcu

SEQ ID NO: 1828900 - RNA, 21 nt, Homo sapiens
agcucuucaggccucccucuc

SEQ ID NO: 1828901 - RNA, 13 nt, Homo sapiens
uuuccuccaccuc

SEQ ID NO: 1828902 - RNA, 9 nt, Homo sapiens
aauagucau

SEQ ID NO: 1828903 - RNA, 24 nt, Homo sapiens
uaaaauuaauuugugcaucagaaa

SEQ ID NO: 1828904 - RNA, 23 nt, Homo sapiens
uaucaccuuaagaaagugucucu

SEQ ID NO: 1828905 - RNA, 19 nt, Homo sapiens
ugcggaggaaagcaagugu

SEQ ID NO: 1828906 - RNA, 14 nt, Homo sapiens
uaaaaaugcaacuu

SEQ ID NO: 1828907 - RNA, 14 nt, Homo sapiens
aagaguaguaauag

SEQ ID NO: 1828908 - RNA, 19 nt, Homo sapiens
ccccagcugauuagugucu

SEQ ID NO: 1828909 - RNA, 13 nt, Homo sapiens
uaagugacuuccu

SEQ ID NO: 1828910 - RNA, 11 nt, Homo sapiens
cuuguaaaaag

SEQ ID NO: 1828911 - RNA, 22 nt, Homo sapiens
gcuucuggagcagaacuuucca

SEQ ID NO: 1828912 - RNA, 20 nt, Homo sapiens
ccaugcucuuguucuguucc

SEQ ID NO: 1828913 - RNA, 18 nt, Homo sapiens
ugucugccuaugcacuga

SEQ ID NO: 1828914 - RNA, 13 nt, Homo sapiens
cagcaagccaugc

SEQ ID NO: 1828915 - RNA, 22 nt, Homo sapiens
cggacccuucuggguccaggga

SEQ ID NO: 1828916 - RNA, 12 nt, Homo sapiens
cauuuuggcaac

SEQ ID NO: 1828917 - RNA, 21 nt, Homo sapiens
uauuguugcuuuuuuuccaau

SEQ ID NO: 1828918 - RNA, 17 nt, Homo sapiens
aagcuguuccacuucuc

SEQ ID NO: 1828919 - RNA, 11 nt, Homo sapiens
auccagcaguc

SEQ ID NO: 1828920 - RNA, 17 nt, Homo sapiens
uaggccagcaccaucuc

SEQ ID NO: 1828921 - RNA, 14 nt, Homo sapiens
aagcaaauggaugg

SEQ ID NO: 1828922 - RNA, 23 nt, Homo sapiens
gcuguauauaggggucaauguga

SEQ ID NO: 1828923 - RNA, 12 nt, Homo sapiens
ugcuuggaugua

SEQ ID NO: 1828924 - RNA, 13 nt, Homo sapiens
agauaauuugcau

SEQ ID NO: 1828925 - RNA, 16 nt, Homo sapiens
ugugugcgugcgcauc

SEQ ID NO: 1828926 - RNA, 19 nt, Homo sapiens
acagcaaaacuccaucuca

SEQ ID NO: 1828927 - RNA, 19 nt, Homo sapiens
auuaugacgguaucacugu

SEQ ID NO: 1828928 - RNA, 23 nt, Homo sapiens
agggcaagaaauggcgucugcuc

SEQ ID NO: 1828929 - RNA, 14 nt, Homo sapiens
ccaucuacaccagu

SEQ ID NO: 1828930 - RNA, 17 nt, Homo sapiens
accucguugacaugcac

SEQ ID NO: 1828931 - RNA, 16 nt, Homo sapiens
auucugacauccacau

SEQ ID NO: 1828932 - RNA, 13 nt, Homo sapiens
auugaugauccau

SEQ ID NO: 1828933 - RNA, 13 nt, Homo sapiens
uucaaugaacugu

SEQ ID NO: 1828934 - RNA, 20 nt, Homo sapiens
uugaaaggauaggauugaca

SEQ ID NO: 1828935 - RNA, 17 nt, Homo sapiens
uucccucagauuuccau

SEQ ID NO: 1828936 - RNA, 20 nt, Homo sapiens
cguuguuaacacgugacacu

SEQ ID NO: 1828937 - RNA, 21 nt, Homo sapiens
cccugguuaauucagcuugag

SEQ ID NO: 1828938 - RNA, 17 nt, Homo sapiens
ucucaaagaccccaugg

SEQ ID NO: 1828939 - RNA, 21 nt, Homo sapiens
ugagaaucaccccucucagug

SEQ ID NO: 1828940 - RNA, 23 nt, Homo sapiens
aucuuuagcaguacccuagccuc

SEQ ID NO: 1828941 - RNA, 18 nt, Homo sapiens
gcugggcagaaggccaag

SEQ ID NO: 1828942 - RNA, 14 nt, Homo sapiens
aauaaaaacugacu

SEQ ID NO: 1828943 - RNA, 16 nt, Homo sapiens
caaaugaggauaucau

SEQ ID NO: 1828944 - RNA, 16 nt, Homo sapiens
cuggggacaccucagg

SEQ ID NO: 1828945 - RNA, 21 nt, Homo sapiens
acauuauccauccucugagau

SEQ ID NO: 1828946 - RNA, 17 nt, Homo sapiens
cucucguacucucucuc

SEQ ID NO: 1828947 - RNA, 21 nt, Homo sapiens
uugguaauauuaauuuccacu

SEQ ID NO: 1828948 - RNA, 18 nt, Homo sapiens
ugaaacaaacuacugugu

SEQ ID NO: 1828949 - RNA, 19 nt, Homo sapiens
uucacagacugauuggaau

SEQ ID NO: 1828950 - RNA, 11 nt, Homo sapiens
ggcacugaccg

SEQ ID NO: 1828951 - RNA, 23 nt, Homo sapiens
aguccccuucuuuuggcccuccg

SEQ ID NO: 1828952 - RNA, 21 nt, Homo sapiens
uuaccugauuugaugauacau

SEQ ID NO: 1828953 - RNA, 21 nt, Homo sapiens
uccagauugaaaaguguccuc

SEQ ID NO: 1828954 - RNA, 13 nt, Homo sapiens
auugagaccugag

SEQ ID NO: 1828955 - RNA, 16 nt, Homo sapiens
uuggguucacagugca

SEQ ID NO: 1828956 - RNA, 19 nt, Homo sapiens
uuucugaaaaagaacugua

SEQ ID NO: 1828957 - RNA, 13 nt, Homo sapiens
uaccuacagcuaa

SEQ ID NO: 1828958 - RNA, 15 nt, Homo sapiens
uugguccuugucugc

SEQ ID NO: 1828959 - RNA, 13 nt, Homo sapiens
acaaaaaccaaaa

SEQ ID NO: 1828960 - RNA, 13 nt, Homo sapiens
acagaaaccaaga

SEQ ID NO: 1828961 - RNA, 18 nt, Homo sapiens
auucaugaacacaauaca

SEQ ID NO: 1828962 - RNA, 19 nt, Homo sapiens
ggugucuuuaacugucauu

SEQ ID NO: 1828963 - RNA, 19 nt, Homo sapiens
ccuuucucuaaaacugccu

SEQ ID NO: 1828964 - RNA, 23 nt, Homo sapiens
agugcacacggaugcacagagau

SEQ ID NO: 1828965 - RNA, 14 nt, Homo sapiens
cacaggaccaccuc

SEQ ID NO: 1828966 - RNA, 13 nt, Homo sapiens
acacuguuuccau

SEQ ID NO: 1828967 - RNA, 19 nt, Homo sapiens
cucaaaagcuucgugccaa

SEQ ID NO: 1828968 - RNA, 16 nt, Homo sapiens
auuuaauauacugcau

SEQ ID NO: 1828969 - RNA, 14 nt, Homo sapiens
acccuuucauaaag

SEQ ID NO: 1828970 - RNA, 14 nt, Homo sapiens
uagauaaagcacug

SEQ ID NO: 1828971 - RNA, 23 nt, Homo sapiens
caccccugugcuccgugccucca

SEQ ID NO: 1828972 - RNA, 16 nt, Homo sapiens
gucacagccauaguca

SEQ ID NO: 1828973 - RNA, 21 nt, Homo sapiens
ucugaauuugcaaaguacugu

SEQ ID NO: 1828974 - RNA, 14 nt, Homo sapiens
ggaaaccacagcug

SEQ ID NO: 1828975 - RNA, 19 nt, Homo sapiens
agguuuucuucacugccag

SEQ ID NO: 1828976 - RNA, 18 nt, Homo sapiens
aaggaauuguuuuuauaa

SEQ ID NO: 1828977 - RNA, 17 nt, Homo sapiens
auggaucuuaaagcauu

SEQ ID NO: 1828978 - RNA, 19 nt, Homo sapiens
acccaccuuugccacaaag

SEQ ID NO: 1828979 - RNA, 21 nt, Homo sapiens
uccuccccuguaggguuugga

SEQ ID NO: 1828980 - RNA, 18 nt, Homo sapiens
auuucauccuguuggcug

SEQ ID NO: 1828981 - RNA, 16 nt, Homo sapiens
ccuagauagcuauuaa

SEQ ID NO: 1828982 - RNA, 22 nt, Homo sapiens
gauagagaauguuccagacauu

SEQ ID NO: 1828983 - RNA, 17 nt, Homo sapiens
uccaggauagacuuuuc

SEQ ID NO: 1828984 - RNA, 15 nt, Homo sapiens
uacgauccugcaggg

SEQ ID NO: 1828985 - RNA, 11 nt, Homo sapiens
aggcaggugag

SEQ ID NO: 1828986 - RNA, 13 nt, Homo sapiens
ucacaucugucac

SEQ ID NO: 1828987 - RNA, 18 nt, Homo sapiens
gcauagagcccuggccag

SEQ ID NO: 1828988 - RNA, 15 nt, Homo sapiens
gauuuaauacaguuu

SEQ ID NO: 1828989 - RNA, 13 nt, Homo sapiens
uuauagauucuaa

SEQ ID NO: 1828990 - RNA, 22 nt, Homo sapiens
uagacaaugaugugaguaccca

SEQ ID NO: 1828991 - RNA, 15 nt, Homo sapiens
gggauggagaagcac

SEQ ID NO: 1828992 - RNA, 21 nt, Homo sapiens
cuuuauaaauguaccagagag

SEQ ID NO: 1828993 - RNA, 14 nt, Homo sapiens
cucaaugagcaugu

SEQ ID NO: 1828994 - RNA, 20 nt, Homo sapiens
ucccaaaauuagggagcucu

SEQ ID NO: 1828995 - RNA, 21 nt, Homo sapiens
uuaggauaacuaaaauucugg

SEQ ID NO: 1828996 - RNA, 16 nt, Homo sapiens
gagguggagcaaagug

SEQ ID NO: 1828997 - RNA, 17 nt, Homo sapiens
cuguccucuacauacca

SEQ ID NO: 1828998 - RNA, 22 nt, Homo sapiens
ucacaggacauuaaggaccaau

SEQ ID NO: 1828999 - RNA, 16 nt, Homo sapiens
caagaguugugacaac

SEQ ID NO: 1829000 - RNA, 22 nt, Homo sapiens
uguaacucacauucucuuccca

SEQ ID NO: 1829001 - RNA, 21 nt, Homo sapiens
ugcuuagagcauguucuugga

SEQ ID NO: 1829002 - RNA, 19 nt, Homo sapiens
aagauuuggaagcucuucu

SEQ ID NO: 1829003 - RNA, 13 nt, Homo sapiens
aaugucuguuuca

SEQ ID NO: 1829004 - RNA, 17 nt, Homo sapiens
cuacaggaggaaugcac

SEQ ID NO: 1829005 - RNA, 18 nt, Homo sapiens
uaauuuuguaauguauca

SEQ ID NO: 1829006 - RNA, 19 nt, Homo sapiens
auaauuuuacucacucacu

SEQ ID NO: 1829007 - RNA, 15 nt, Homo sapiens
ucuuguuucacucca

SEQ ID NO: 1829008 - RNA, 22 nt, Homo sapiens
cugcaaccucggggagugccac

SEQ ID NO: 1829009 - RNA, 15 nt, Homo sapiens
uccagcugacagcca

SEQ ID NO: 1829010 - RNA, 23 nt, Homo sapiens
gccugcucucgaggcagcagugg

SEQ ID NO: 1829011 - RNA, 23 nt, Homo sapiens
caugauaccuggauccagccauu

SEQ ID NO: 1829012 - RNA, 16 nt, Homo sapiens
gcaccagcucaugcca

SEQ ID NO: 1829013 - RNA, 19 nt, Homo sapiens
accaauaaagugacccugu

SEQ ID NO: 1829014 - RNA, 19 nt, Homo sapiens
ugcuugggacccuagcuau

SEQ ID NO: 1829015 - RNA, 16 nt, Homo sapiens
acccugccaacuuucc

SEQ ID NO: 1829016 - RNA, 20 nt, Homo sapiens
gaggcagagcuugcagugag

SEQ ID NO: 1829017 - RNA, 21 nt, Homo sapiens
guuugucaggauggaauccua

SEQ ID NO: 1829018 - RNA, 16 nt, Homo sapiens
acucucaaauccaaaa

SEQ ID NO: 1829019 - RNA, 15 nt, Homo sapiens
accucccaguuugcu

SEQ ID NO: 1829020 - RNA, 16 nt, Homo sapiens
uaagaaagaaaugcua

SEQ ID NO: 1829021 - RNA, 20 nt, Homo sapiens
cucugcagcccucagauuau

SEQ ID NO: 1829022 - RNA, 14 nt, Homo sapiens
gagacagaccacuu

SEQ ID NO: 1829023 - RNA, 18 nt, Homo sapiens
uguauaacuaggcuguua

SEQ ID NO: 1829024 - RNA, 23 nt, Homo sapiens
cuugagcccaggaaguccagaac

SEQ ID NO: 1829025 - RNA, 18 nt, Homo sapiens
auauuuuguaacuauuac

SEQ ID NO: 1829026 - RNA, 14 nt, Homo sapiens
ccaggcuagaggca

SEQ ID NO: 1829027 - RNA, 22 nt, Homo sapiens
gcaggaaggagcugccuggacc

SEQ ID NO: 1829028 - RNA, 13 nt, Homo sapiens
auucacaaauggg

SEQ ID NO: 1829029 - RNA, 17 nt, Homo sapiens
uugguauuacacaguca

SEQ ID NO: 1829030 - RNA, 21 nt, Homo sapiens
agcuuucuccugagcuccagu

SEQ ID NO: 1829031 - RNA, 14 nt, Homo sapiens
ucuuucccaaaauu

SEQ ID NO: 1829032 - RNA, 16 nt, Homo sapiens
uagcuuacugauuaac

SEQ ID NO: 1829033 - RNA, 15 nt, Homo sapiens
ugaccucacuggccu

SEQ ID NO: 1829034 - RNA, 18 nt, Homo sapiens
acuugaguuuuggcaagg

SEQ ID NO: 1829035 - RNA, 21 nt, Homo sapiens
ucagacagaaggguaaugcgu

SEQ ID NO: 1829036 - RNA, 16 nt, Homo sapiens
auaugaaauuauaaug

SEQ ID NO: 1829037 - RNA, 16 nt, Homo sapiens
uccaaauacugauggu

SEQ ID NO: 1829038 - RNA, 23 nt, Homo sapiens
cacaaaucaaagcaagggcucca

SEQ ID NO: 1829039 - RNA, 16 nt, Homo sapiens
uuuaaaauauuacaca

SEQ ID NO: 1829040 - RNA, 17 nt, Homo sapiens
uuccugccuagucucac

SEQ ID NO: 1829041 - RNA, 18 nt, Homo sapiens
cuccuuugcacuguuuau

SEQ ID NO: 1829042 - RNA, 14 nt, Homo sapiens
aaaagcugcauuua

SEQ ID NO: 1829043 - RNA, 15 nt, Homo sapiens
aaacucuauggguau

SEQ ID NO: 1829044 - RNA, 18 nt, Homo sapiens
uuauaguaacaucaaaga

SEQ ID NO: 1829045 - RNA, 15 nt, Homo sapiens
ccucaggucagcuca

SEQ ID NO: 1829046 - RNA, 12 nt, Homo sapiens
cagcagaacucc

SEQ ID NO: 1829047 - RNA, 18 nt, Homo sapiens
uauacauguauagugagu

SEQ ID NO: 1829048 - RNA, 22 nt, Homo sapiens
caccguacaucugcaauaugaa

SEQ ID NO: 1829049 - RNA, 15 nt, Homo sapiens
agaacccugcaaaug

SEQ ID NO: 1829050 - RNA, 21 nt, Homo sapiens
cauguuucaggaucagaucaa

SEQ ID NO: 1829051 - RNA, 20 nt, Homo sapiens
cagaacuuaaggauggagcc

SEQ ID NO: 1829052 - RNA, 15 nt, Homo sapiens
gaaaagagcugggau

SEQ ID NO: 1829053 - RNA, 16 nt, Homo sapiens
gcagacugauuggccu

SEQ ID NO: 1829054 - RNA, 18 nt, Homo sapiens
cacaagaagugguccauc

SEQ ID NO: 1829055 - RNA, 17 nt, Homo sapiens
uuuaaguauauaguaua

SEQ ID NO: 1829056 - RNA, 18 nt, Homo sapiens
cacauccgacaccuccca

SEQ ID NO: 1829057 - RNA, 19 nt, Homo sapiens
gacccagaacaggacucca

SEQ ID NO: 1829058 - RNA, 23 nt, Homo sapiens
guuuugauauuuauuuuuugcca

SEQ ID NO: 1829059 - RNA, 12 nt, Homo sapiens
cggagcacuuuc

SEQ ID NO: 1829060 - RNA, 23 nt, Homo sapiens
uucaacauggucuaauuauuuac

SEQ ID NO: 1829061 - RNA, 15 nt, Homo sapiens
aauaauaauaccucc

SEQ ID NO: 1829062 - RNA, 19 nt, Homo sapiens
gacauuucucaagggccau

SEQ ID NO: 1829063 - RNA, 11 nt, Homo sapiens
uugauacaugc

SEQ ID NO: 1829064 - RNA, 22 nt, Homo sapiens
aacaucuuuuuuuuuuuugaca

SEQ ID NO: 1829065 - RNA, 13 nt, Homo sapiens
agaaaucuggccc

SEQ ID NO: 1829066 - RNA, 21 nt, Homo sapiens
gcacuugucuuugacuugugu

SEQ ID NO: 1829067 - RNA, 19 nt, Homo sapiens
aaccucaaacuaggaggaa

SEQ ID NO: 1829068 - RNA, 19 nt, Homo sapiens
gaaauauggaacuguaaua

SEQ ID NO: 1829069 - RNA, 18 nt, Homo sapiens
aagucguacuguucacac

SEQ ID NO: 1829070 - RNA, 15 nt, Homo sapiens
cagaugaacuaucca

SEQ ID NO: 1829071 - RNA, 18 nt, Homo sapiens
ucccuucuuucaggaaua

SEQ ID NO: 1829072 - RNA, 20 nt, Homo sapiens
gcuuucuuuucucuaugaaa

SEQ ID NO: 1829073 - RNA, 22 nt, Homo sapiens
ggugaaaccccaucucuaugaa

SEQ ID NO: 1829074 - RNA, 20 nt, Homo sapiens
aauaaagucucuuuuucuca

SEQ ID NO: 1829075 - RNA, 13 nt, Homo sapiens
uuggaugucugua

SEQ ID NO: 1829076 - RNA, 14 nt, Homo sapiens
aaugccacagugaa

SEQ ID NO: 1829077 - RNA, 14 nt, Homo sapiens
uacaccacugcaaa

SEQ ID NO: 1829078 - RNA, 13 nt, Homo sapiens
uggaaacucaugg

SEQ ID NO: 1829079 - RNA, 20 nt, Homo sapiens
aucuagccagagcccuucac

SEQ ID NO: 1829080 - RNA, 14 nt, Homo sapiens
augugaaagucaaa

SEQ ID NO: 1829081 - RNA, 23 nt, Homo sapiens
cuccggccccaccucgugaacac

SEQ ID NO: 1829082 - RNA, 22 nt, Homo sapiens
ucuagggacaggccgggcagug

SEQ ID NO: 1829083 - RNA, 22 nt, Homo sapiens
agcuauuucauuugcuguucau

SEQ ID NO: 1829084 - RNA, 16 nt, Homo sapiens
acugaucuuacucuac

SEQ ID NO: 1829085 - RNA, 14 nt, Homo sapiens
gaagcaacugugaa

SEQ ID NO: 1829086 - RNA, 21 nt, Homo sapiens
guaagccuguuggauaaagac

SEQ ID NO: 1829087 - RNA, 19 nt, Homo sapiens
uccucauccaugcagauaa

SEQ ID NO: 1829088 - RNA, 20 nt, Homo sapiens
aacauacccgccuagcugcu

SEQ ID NO: 1829089 - RNA, 22 nt, Homo sapiens
gguauauaaauuggggugauga

SEQ ID NO: 1829090 - RNA, 13 nt, Homo sapiens
agaagaugaucag

SEQ ID NO: 1829091 - RNA, 13 nt, Homo sapiens
ugaugauguucug

SEQ ID NO: 1829092 - RNA, 23 nt, Homo sapiens
caugagauguguggacuguggca

SEQ ID NO: 1829093 - RNA, 21 nt, Homo sapiens
caccaggagacagacagagaa

SEQ ID NO: 1829094 - RNA, 13 nt, Homo sapiens
gggacaacaaaga

SEQ ID NO: 1829095 - RNA, 23 nt, Homo sapiens
aucuccaguagaaagcauaacaa

SEQ ID NO: 1829096 - RNA, 22 nt, Homo sapiens
uaauuuagucuaacacaguuga

SEQ ID NO: 1829097 - RNA, 13 nt, Homo sapiens
ucuauaacaguuu

SEQ ID NO: 1829098 - RNA, 23 nt, Homo sapiens
aaagcauaugcagccaaccaaga

SEQ ID NO: 1829099 - RNA, 18 nt, Homo sapiens
cauccuccagauagugua

SEQ ID NO: 1829100 - RNA, 19 nt, Homo sapiens
cuaucugggcugugggcaa

SEQ ID NO: 1829101 - RNA, 15 nt, Homo sapiens
caaccaaacaaagaa

SEQ ID NO: 1829102 - RNA, 17 nt, Homo sapiens
ggggcacccuccaaaca

SEQ ID NO: 1829103 - RNA, 21 nt, Homo sapiens
cacuccccagagcugugccag

SEQ ID NO: 1829104 - RNA, 17 nt, Homo sapiens
cgggagacucaaaggga

SEQ ID NO: 1829105 - RNA, 12 nt, Homo sapiens
cucugcuuacuu

SEQ ID NO: 1829106 - RNA, 16 nt, Homo sapiens
cucaugcuucuucuca

SEQ ID NO: 1829107 - RNA, 13 nt, Homo sapiens
uagugacauuuaa

SEQ ID NO: 1829108 - RNA, 17 nt, Homo sapiens
accaaaccauuauucau

SEQ ID NO: 1829109 - RNA, 22 nt, Homo sapiens
gauucguggagcccuacucaca

SEQ ID NO: 1829110 - RNA, 23 nt, Homo sapiens
uagacccgaggaaacucagaguc

SEQ ID NO: 1829111 - RNA, 20 nt, Homo sapiens
augccugcggggugucugua

SEQ ID NO: 1829112 - RNA, 18 nt, Homo sapiens
acauguuuuuucauuugu

SEQ ID NO: 1829113 - RNA, 15 nt, Homo sapiens
gaaacugaauucugg

SEQ ID NO: 1829114 - RNA, 14 nt, Homo sapiens
guauaaauggaccu

SEQ ID NO: 1829115 - RNA, 14 nt, Homo sapiens
aucuaaauagcccu

SEQ ID NO: 1829116 - RNA, 15 nt, Homo sapiens
cuuauuuugcauucc

SEQ ID NO: 1829117 - RNA, 21 nt, Homo sapiens
ccucauugcuaccacagacuu

SEQ ID NO: 1829118 - RNA, 13 nt, Homo sapiens
augugaucagcuu

SEQ ID NO: 1829119 - RNA, 15 nt, Homo sapiens
caagguccacucccu

SEQ ID NO: 1829120 - RNA, 18 nt, Homo sapiens
ugaccuuuagugccaacu

SEQ ID NO: 1829121 - RNA, 17 nt, Homo sapiens
agcuggccuguggcaca

SEQ ID NO: 1829122 - RNA, 18 nt, Homo sapiens
cugucauaacauccagag

SEQ ID NO: 1829123 - RNA, 19 nt, Homo sapiens
cuucuugguggggaugaga

SEQ ID NO: 1829124 - RNA, 20 nt, Homo sapiens
ggcaagugugggggguccuu

SEQ ID NO: 1829125 - RNA, 15 nt, Homo sapiens
auauuuuucugagau

SEQ ID NO: 1829126 - RNA, 21 nt, Homo sapiens
caggagauuccagucuacuug

SEQ ID NO: 1829127 - RNA, 15 nt, Homo sapiens
uuguuaccaguaaaa

SEQ ID NO: 1829128 - RNA, 21 nt, Homo sapiens
aucucuccagccccugacccc

SEQ ID NO: 1829129 - RNA, 17 nt, Homo sapiens
uguaaaaguuauacuca

SEQ ID NO: 1829130 - RNA, 15 nt, Homo sapiens
aggaagugacuugaa

SEQ ID NO: 1829131 - RNA, 19 nt, Homo sapiens
uucaaggguuguuggaaaa

SEQ ID NO: 1829132 - RNA, 22 nt, Homo sapiens
cauuucccauuaaagagccagu

SEQ ID NO: 1829133 - RNA, 17 nt, Homo sapiens
auaaaauaaauauacua

SEQ ID NO: 1829134 - RNA, 23 nt, Homo sapiens
cuaaaaugacaagccuucuuaaa

SEQ ID NO: 1829135 - RNA, 14 nt, Homo sapiens
gaugaccauaugca

SEQ ID NO: 1829136 - RNA, 22 nt, Homo sapiens
acuccagcuugggcaacagagc

SEQ ID NO: 1829137 - RNA, 22 nt, Homo sapiens
gcacaaaauauaaagcaucuaa

SEQ ID NO: 1829138 - RNA, 14 nt, Homo sapiens
auuucauacuguaa

SEQ ID NO: 1829139 - RNA, 18 nt, Homo sapiens
auggacgaccuccagcuc

SEQ ID NO: 1829140 - RNA, 22 nt, Homo sapiens
uacuuagauuuggcaucuacuu

SEQ ID NO: 1829141 - RNA, 23 nt, Homo sapiens
uuuaacuuuuuguuuuuauuucu

SEQ ID NO: 1829142 - RNA, 17 nt, Homo sapiens
gugccgcugucucugag

SEQ ID NO: 1829143 - RNA, 20 nt, Homo sapiens
uugaaaagaagcaaggaaau

SEQ ID NO: 1829144 - RNA, 23 nt, Homo sapiens
uaggugacagggccgugagcaug

SEQ ID NO: 1829145 - RNA, 14 nt, Homo sapiens
agaagcagaccuca

SEQ ID NO: 1829146 - RNA, 19 nt, Homo sapiens
ucagccaggugcugugaca

SEQ ID NO: 1829147 - RNA, 13 nt, Homo sapiens
ugaucacucccag

SEQ ID NO: 1829148 - RNA, 22 nt, Homo sapiens
ugaacugcagcgaguacuuccc

SEQ ID NO: 1829149 - RNA, 23 nt, Homo sapiens
cucagcuaacauuccauguuuca

SEQ ID NO: 1829150 - RNA, 21 nt, Homo sapiens
ccagccuggccaacaugguga

SEQ ID NO: 1829151 - RNA, 22 nt, Homo sapiens
aauaaucauaaacuauauucug

SEQ ID NO: 1829152 - RNA, 13 nt, Homo sapiens
agacacugcacag

SEQ ID NO: 1829153 - RNA, 17 nt, Homo sapiens
agccucuccccugauua

SEQ ID NO: 1829154 - RNA, 15 nt, Homo sapiens
ccucuuuaacagcuu

SEQ ID NO: 1829155 - RNA, 18 nt, Homo sapiens
ggacaacagagaugccau

SEQ ID NO: 1829156 - RNA, 12 nt, Homo sapiens
gagcugucaugu

SEQ ID NO: 1829157 - RNA, 20 nt, Homo sapiens
gcucacccgccucuugcccc

SEQ ID NO: 1829158 - RNA, 16 nt, Homo sapiens
caaccuaauuaccugu

SEQ ID NO: 1829159 - RNA, 14 nt, Homo sapiens
uauagagcacaaua

SEQ ID NO: 1829160 - RNA, 19 nt, Homo sapiens
acguacccaggucugggug

SEQ ID NO: 1829161 - RNA, 16 nt, Homo sapiens
gccuuaacuguucagu

SEQ ID NO: 1829162 - RNA, 20 nt, Homo sapiens
uugagaauuacccuuuugcc

SEQ ID NO: 1829163 - RNA, 21 nt, Homo sapiens
uguagauucagguaauacaaa

SEQ ID NO: 1829164 - RNA, 18 nt, Homo sapiens
ucccacccccaaugcaca

SEQ ID NO: 1829165 - RNA, 13 nt, Homo sapiens
uaaauguacagua

SEQ ID NO: 1829166 - RNA, 13 nt, Homo sapiens
uaaaaguacaguu

SEQ ID NO: 1829167 - RNA, 18 nt, Homo sapiens
agaaaugcauagcauuau

SEQ ID NO: 1829168 - RNA, 19 nt, Homo sapiens
cugucacccagacuggagu

SEQ ID NO: 1829169 - RNA, 19 nt, Homo sapiens
ucuugucauaaaaugcaua

SEQ ID NO: 1829170 - RNA, 15 nt, Homo sapiens
ugcgucccacugagu

SEQ ID NO: 1829171 - RNA, 20 nt, Homo sapiens
uucuagaaccugggcugugc

SEQ ID NO: 1829172 - RNA, 21 nt, Homo sapiens
ggccuaguacaaucuugggaa

SEQ ID NO: 1829173 - RNA, 19 nt, Homo sapiens
gccagaccuuaagcucuau

SEQ ID NO: 1829174 - RNA, 14 nt, Homo sapiens
ucauuuuuuacuug

SEQ ID NO: 1829175 - RNA, 22 nt, Homo sapiens
aaugauagcaccuaaacuuaca

SEQ ID NO: 1829176 - RNA, 16 nt, Homo sapiens
gcacaguacuguuuca

SEQ ID NO: 1829177 - RNA, 18 nt, Homo sapiens
acaguguaacagguccuu

SEQ ID NO: 1829178 - RNA, 16 nt, Homo sapiens
caguucaaagcaggau

SEQ ID NO: 1829179 - RNA, 18 nt, Homo sapiens
acagauucugacauuuau

SEQ ID NO: 1829180 - RNA, 20 nt, Homo sapiens
ugaccccacuuaugcugcug

SEQ ID NO: 1829181 - RNA, 17 nt, Homo sapiens
cacgaaaauacccagcg

SEQ ID NO: 1829182 - RNA, 12 nt, Homo sapiens
agaccacugucc

SEQ ID NO: 1829183 - RNA, 13 nt, Homo sapiens
cuccccuugccug

SEQ ID NO: 1829184 - RNA, 11 nt, Homo sapiens
agggugcuagu

SEQ ID NO: 1829185 - RNA, 13 nt, Homo sapiens
uggagcugcucaa

SEQ ID NO: 1829186 - RNA, 9 nt, Homo sapiens
agggagcag

SEQ ID NO: 1829187 - RNA, 16 nt, Homo sapiens
uaauauugccuugaug

SEQ ID NO: 1829188 - RNA, 14 nt, Homo sapiens
cucgcccaccagug

SEQ ID NO: 1829189 - RNA, 21 nt, Homo sapiens
gcgcaggccugcgugcgcugg

SEQ ID NO: 1829190 - RNA, 20 nt, Homo sapiens
auguuucucccccuuuccaa

SEQ ID NO: 1829191 - RNA, 22 nt, Homo sapiens
aguaacaugaggggacauuuug

SEQ ID NO: 1829192 - RNA, 20 nt, Homo sapiens
uuuugaagcuuuaagcaaau

SEQ ID NO: 1829193 - RNA, 21 nt, Homo sapiens
caucagugcacacggaugcac

SEQ ID NO: 1829194 - RNA, 20 nt, Homo sapiens
gguuggggccgggcacauug

SEQ ID NO: 1829195 - RNA, 14 nt, Homo sapiens
gaacacaucagcuu

SEQ ID NO: 1829196 - RNA, 16 nt, Homo sapiens
uuauaauaauguucuc

SEQ ID NO: 1829197 - RNA, 19 nt, Homo sapiens
caaggaaggcauuuggacc

SEQ ID NO: 1829198 - RNA, 21 nt, Homo sapiens
augauaugugcuuguguguau

SEQ ID NO: 1829199 - RNA, 21 nt, Homo sapiens
agaagaccccugacucaucau

SEQ ID NO: 1829200 - RNA, 20 nt, Homo sapiens
aggcuccccagaacuggcug

SEQ ID NO: 1829201 - RNA, 14 nt, Homo sapiens
gcccucugcugcuu

SEQ ID NO: 1829202 - RNA, 21 nt, Homo sapiens
ugguuccaugccugcucucga

SEQ ID NO: 1829203 - RNA, 14 nt, Homo sapiens
uaacagugcaguac

SEQ ID NO: 1829204 - RNA, 14 nt, Homo sapiens
cuccccccacugca

SEQ ID NO: 1829205 - RNA, 16 nt, Homo sapiens
cccaucagccauuugc

SEQ ID NO: 1829206 - RNA, 21 nt, Homo sapiens
cacccaccuggcuucauacag

SEQ ID NO: 1829207 - RNA, 18 nt, Homo sapiens
uaggagggugacaugggg

SEQ ID NO: 1829208 - RNA, 20 nt, Homo sapiens
ccuaaaacaccugguaggag

SEQ ID NO: 1829209 - RNA, 16 nt, Homo sapiens
uuccauuaugauucuu

SEQ ID NO: 1829210 - RNA, 16 nt, Homo sapiens
auacauucuucaagau

SEQ ID NO: 1829211 - RNA, 19 nt, Homo sapiens
ggaaaucuuugguggccaa

SEQ ID NO: 1829212 - RNA, 20 nt, Homo sapiens
uuucagggaaaaauacuuua

SEQ ID NO: 1829213 - RNA, 15 nt, Homo sapiens
gaaaccaaacaaaua

SEQ ID NO: 1829214 - RNA, 22 nt, Homo sapiens
ugaacuggauucuuaaccaaga

SEQ ID NO: 1829215 - RNA, 16 nt, Homo sapiens
aucucccacacaagac

SEQ ID NO: 1829216 - RNA, 14 nt, Homo sapiens
caucuucuuugcag

SEQ ID NO: 1829217 - RNA, 11 nt, Homo sapiens
uucaccaaaau

SEQ ID NO: 1829218 - RNA, 22 nt, Homo sapiens
cagagggagaauccaaggguug

SEQ ID NO: 1829219 - RNA, 17 nt, Homo sapiens
aacgcuccaaagucaua

SEQ ID NO: 1829220 - RNA, 16 nt, Homo sapiens
gagccgggagccugac

SEQ ID NO: 1829221 - RNA, 22 nt, Homo sapiens
gaauuacuaaauuacaaaugca

SEQ ID NO: 1829222 - RNA, 14 nt, Homo sapiens
ucccacccugagau

SEQ ID NO: 1829223 - RNA, 12 nt, Homo sapiens
aguucugaugag

SEQ ID NO: 1829224 - RNA, 22 nt, Homo sapiens
ugcucucuucuccccacugugc

SEQ ID NO: 1829225 - RNA, 16 nt, Homo sapiens
cauuauguacaauaca

SEQ ID NO: 1829226 - RNA, 17 nt, Homo sapiens
acuuuuuguuacauaga

SEQ ID NO: 1829227 - RNA, 20 nt, Homo sapiens
ucacccaguucagguguaua

SEQ ID NO: 1829228 - RNA, 13 nt, Homo sapiens
cacacacccagcu

SEQ ID NO: 1829229 - RNA, 14 nt, Homo sapiens
gucaggacccaggc

SEQ ID NO: 1829230 - RNA, 11 nt, Homo sapiens
ccuuggcuuua

SEQ ID NO: 1829231 - RNA, 20 nt, Homo sapiens
ucaagcuggaagaagugagc

SEQ ID NO: 1829232 - RNA, 23 nt, Homo sapiens
aaccagggccccggggccuguua

SEQ ID NO: 1829233 - RNA, 19 nt, Homo sapiens
aaaggugaaaaaagcuuuu

SEQ ID NO: 1829234 - RNA, 19 nt, Homo sapiens
aacagagaguaagcacuua

SEQ ID NO: 1829235 - RNA, 19 nt, Homo sapiens
ugcuaacuguguguacaua

SEQ ID NO: 1829236 - RNA, 16 nt, Homo sapiens
cagaguggcccaagac

SEQ ID NO: 1829237 - RNA, 14 nt, Homo sapiens
cucucucccaugga

SEQ ID NO: 1829238 - RNA, 20 nt, Homo sapiens
ugugacaaaacaucuuuuca

SEQ ID NO: 1829239 - RNA, 22 nt, Homo sapiens
uccuucccucggggccauacuu

SEQ ID NO: 1829240 - RNA, 18 nt, Homo sapiens
gcucccagggucccugcc

SEQ ID NO: 1829241 - RNA, 23 nt, Homo sapiens
guucaauucucauuugucacaca

SEQ ID NO: 1829242 - RNA, 14 nt, Homo sapiens
aaggacucuuccac

SEQ ID NO: 1829243 - RNA, 13 nt, Homo sapiens
gauucccagagac

SEQ ID NO: 1829244 - RNA, 20 nt, Homo sapiens
agauagaaccuggagccacu

SEQ ID NO: 1829245 - RNA, 14 nt, Homo sapiens
uagagagccuuaac

SEQ ID NO: 1829246 - RNA, 14 nt, Homo sapiens
agugccuggggugu

SEQ ID NO: 1829247 - RNA, 23 nt, Homo sapiens
acauguaucacgggucacuugaa

SEQ ID NO: 1829248 - RNA, 21 nt, Homo sapiens
uuugguccucugauuucacau

SEQ ID NO: 1829249 - RNA, 14 nt, Homo sapiens
aauaaaccaaugaa

SEQ ID NO: 1829250 - RNA, 20 nt, Homo sapiens
aacacaaacgggcucagcaa

SEQ ID NO: 1829251 - RNA, 23 nt, Homo sapiens
acccaugugcacaagugugcaca

SEQ ID NO: 1829252 - RNA, 15 nt, Homo sapiens
uaaucaccucucugu

SEQ ID NO: 1829253 - RNA, 13 nt, Homo sapiens
agcuccacuguca

SEQ ID NO: 1829254 - RNA, 15 nt, Homo sapiens
cuugaaaagauugca

SEQ ID NO: 1829255 - RNA, 13 nt, Homo sapiens
cuggaagccucua

SEQ ID NO: 1829256 - RNA, 23 nt, Homo sapiens
uuacuauagcaaaguaguacuuc

SEQ ID NO: 1829257 - RNA, 19 nt, Homo sapiens
uuugugaagauuuaaucuc

SEQ ID NO: 1829258 - RNA, 22 nt, Homo sapiens
gaccuucaucagaccacucccu

SEQ ID NO: 1829259 - RNA, 22 nt, Homo sapiens
cucuagccugggugacagagcg

SEQ ID NO: 1829260 - RNA, 22 nt, Homo sapiens
gacccuucagguguuacuagaa

SEQ ID NO: 1829261 - RNA, 19 nt, Homo sapiens
guguuacccacugccaugc

SEQ ID NO: 1829262 - RNA, 20 nt, Homo sapiens
uagcaugcuuguugcaauug

SEQ ID NO: 1829263 - RNA, 21 nt, Homo sapiens
ugcuaccaaguuucauaccaa

SEQ ID NO: 1829264 - RNA, 16 nt, Homo sapiens
ugucauccacuuuaug

SEQ ID NO: 1829265 - RNA, 23 nt, Homo sapiens
cagacaccucccccuacccauau

SEQ ID NO: 1829266 - RNA, 19 nt, Homo sapiens
acccuucugucuguaagau

SEQ ID NO: 1829267 - RNA, 20 nt, Homo sapiens
augugauggucaggaucuca

SEQ ID NO: 1829268 - RNA, 22 nt, Homo sapiens
cuuaaaaaauuuuggaaauuca

SEQ ID NO: 1829269 - RNA, 11 nt, Homo sapiens
ccuuaccugaa

SEQ ID NO: 1829270 - RNA, 18 nt, Homo sapiens
cuugccagggcagggucu

SEQ ID NO: 1829271 - RNA, 15 nt, Homo sapiens
ugccccacacucccc

SEQ ID NO: 1829272 - RNA, 20 nt, Homo sapiens
ugcagcuuaaaacaagcaaa

SEQ ID NO: 1829273 - RNA, 15 nt, Homo sapiens
ugagagacaggacua

SEQ ID NO: 1829274 - RNA, 15 nt, Homo sapiens
uuaguuuuuuccaca

SEQ ID NO: 1829275 - RNA, 16 nt, Homo sapiens
ugcaucauguugaaua

SEQ ID NO: 1829276 - RNA, 18 nt, Homo sapiens
acauugaacacauuuccu

SEQ ID NO: 1829277 - RNA, 18 nt, Homo sapiens
cuacaguuuggagcccac

SEQ ID NO: 1829278 - RNA, 18 nt, Homo sapiens
aaauuuuacugacagaaa

SEQ ID NO: 1829279 - RNA, 20 nt, Homo sapiens
gagagauggagaagcuagaa

SEQ ID NO: 1829280 - RNA, 23 nt, Homo sapiens
aaaauagggaccuagaagcuuaa

SEQ ID NO: 1829281 - RNA, 14 nt, Homo sapiens
uuaaugaaauacca

SEQ ID NO: 1829282 - RNA, 18 nt, Homo sapiens
cuaguuaggccacgcucc

SEQ ID NO: 1829283 - RNA, 17 nt, Homo sapiens
aaugccuaucugaccaa

SEQ ID NO: 1829284 - RNA, 24 nt, Homo sapiens
ucaucugaguugagcacuggucac

SEQ ID NO: 1829285 - RNA, 18 nt, Homo sapiens
agaggcgagaugagccca

SEQ ID NO: 1829286 - RNA, 22 nt, Homo sapiens
ugcaggacauuuggcugugaug

SEQ ID NO: 1829287 - RNA, 17 nt, Homo sapiens
agaccaguucuuggccu

SEQ ID NO: 1829288 - RNA, 18 nt, Homo sapiens
ucuguguaccacugggau

SEQ ID NO: 1829289 - RNA, 20 nt, Homo sapiens
cagugagcuguguucuugcc

SEQ ID NO: 1829290 - RNA, 19 nt, Homo sapiens
acugccccagacacagugc

SEQ ID NO: 1829291 - RNA, 15 nt, Homo sapiens
aguggguagugucau

SEQ ID NO: 1829292 - RNA, 21 nt, Homo sapiens
aaguuacagccauaugcagga

SEQ ID NO: 1829293 - RNA, 18 nt, Homo sapiens
acucaucgggcccaggga

SEQ ID NO: 1829294 - RNA, 20 nt, Homo sapiens
uaaaugcaauugucuuguac

SEQ ID NO: 1829295 - RNA, 22 nt, Homo sapiens
gaagaacugaaaucauacuucu

SEQ ID NO: 1829296 - RNA, 22 nt, Homo sapiens
uggugucacccuggauaggcaa

SEQ ID NO: 1829297 - RNA, 18 nt, Homo sapiens
agaaguaaaaaauguaag

SEQ ID NO: 1829298 - RNA, 14 nt, Homo sapiens
cccaccugccacca

SEQ ID NO: 1829299 - RNA, 18 nt, Homo sapiens
cuauacguuucuguggag

SEQ ID NO: 1829300 - RNA, 17 nt, Homo sapiens
gaagagccuuucuucca

SEQ ID NO: 1829301 - RNA, 16 nt, Homo sapiens
aaagcuaaaauaaaga

SEQ ID NO: 1829302 - RNA, 15 nt, Homo sapiens
agggagcgcucucuu

SEQ ID NO: 1829303 - RNA, 21 nt, Homo sapiens
gaguccaggguggaugaucuc

SEQ ID NO: 1829304 - RNA, 17 nt, Homo sapiens
gucucuaccuaaggaca

SEQ ID NO: 1829305 - RNA, 14 nt, Homo sapiens
cagggaaauaugaa

SEQ ID NO: 1829306 - RNA, 14 nt, Homo sapiens
uuuagaaacugaaa

SEQ ID NO: 1829307 - RNA, 11 nt, Homo sapiens
auaguuuccaa

SEQ ID NO: 1829308 - RNA, 18 nt, Homo sapiens
caagcgccagaaagagcu

SEQ ID NO: 1829309 - RNA, 15 nt, Homo sapiens
ggguccccaccuggg

SEQ ID NO: 1829310 - RNA, 22 nt, Homo sapiens
ccacauauaaauguacuuuucc

SEQ ID NO: 1829311 - RNA, 23 nt, Homo sapiens
gugccucccacccuucucaggga

SEQ ID NO: 1829312 - RNA, 22 nt, Homo sapiens
uaaaaagucaaacuuucaccuc

SEQ ID NO: 1829313 - RNA, 14 nt, Homo sapiens
cuaucaagcacuaa

SEQ ID NO: 1829314 - RNA, 14 nt, Homo sapiens
gaauauaggucucu

SEQ ID NO: 1829315 - RNA, 21 nt, Homo sapiens
auuaugcagacaaccucauca

SEQ ID NO: 1829316 - RNA, 12 nt, Homo sapiens
auuguguucacu

SEQ ID NO: 1829317 - RNA, 19 nt, Homo sapiens
ugcaaagaguuauaugacu

SEQ ID NO: 1829318 - RNA, 16 nt, Homo sapiens
agacuaugguccugca

SEQ ID NO: 1829319 - RNA, 15 nt, Homo sapiens
ggguacagaugugcu

SEQ ID NO: 1829320 - RNA, 23 nt, Homo sapiens
ucauguaauuugcauuacucugg

SEQ ID NO: 1829321 - RNA, 22 nt, Homo sapiens
uggaccaucaagggucauggca

SEQ ID NO: 1829322 - RNA, 22 nt, Homo sapiens
cuuucaauugcagaugccaaaa

SEQ ID NO: 1829323 - RNA, 14 nt, Homo sapiens
aauuuuggaacaaa

SEQ ID NO: 1829324 - RNA, 24 nt, Homo sapiens
gcuucaugugcugccugcaagcuu

SEQ ID NO: 1829325 - RNA, 21 nt, Homo sapiens
cuggccuguggcuaauggagg

SEQ ID NO: 1829326 - RNA, 22 nt, Homo sapiens
aggagugccuucauacacugua

SEQ ID NO: 1829327 - RNA, 13 nt, Homo sapiens
auuuuaaaguauc

SEQ ID NO: 1829328 - RNA, 18 nt, Homo sapiens
cauguauguauauaauca

SEQ ID NO: 1829329 - RNA, 15 nt, Homo sapiens
cuaacuccagugaag

SEQ ID NO: 1829330 - RNA, 15 nt, Homo sapiens
acaagggcugaccug

SEQ ID NO: 1829331 - RNA, 19 nt, Homo sapiens
agagcucuucagagaucau

SEQ ID NO: 1829332 - RNA, 19 nt, Homo sapiens
uggaauaguaaacuaaagu

SEQ ID NO: 1829333 - RNA, 21 nt, Homo sapiens
ccccaauugggaaugcaauau

SEQ ID NO: 1829334 - RNA, 11 nt, Homo sapiens
ucauguuauau

SEQ ID NO: 1829335 - RNA, 16 nt, Homo sapiens
cugagcgaugacucaa

SEQ ID NO: 1829336 - RNA, 22 nt, Homo sapiens
gguugaaugagcgucagcaucc

SEQ ID NO: 1829337 - RNA, 17 nt, Homo sapiens
cucuaagcccaggaucu

SEQ ID NO: 1829338 - RNA, 17 nt, Homo sapiens
guguuaauuuaugcacu

SEQ ID NO: 1829339 - RNA, 16 nt, Homo sapiens
cagauacccaguggaa

SEQ ID NO: 1829340 - RNA, 18 nt, Homo sapiens
aaugaggaggaugcuaaa

SEQ ID NO: 1829341 - RNA, 17 nt, Homo sapiens
cacccaaguauuuuaaa

SEQ ID NO: 1829342 - RNA, 21 nt, Homo sapiens
cugucacuggcagagcacagc

SEQ ID NO: 1829343 - RNA, 17 nt, Homo sapiens
acaggagacccagagag

SEQ ID NO: 1829344 - RNA, 16 nt, Homo sapiens
guucucuuuaagccag

SEQ ID NO: 1829345 - RNA, 18 nt, Homo sapiens
uguaauacacauaucuaa

SEQ ID NO: 1829346 - RNA, 21 nt, Homo sapiens
ccccuuaguuauaauucugug

SEQ ID NO: 1829347 - RNA, 17 nt, Homo sapiens
caccuccacucagcacu

SEQ ID NO: 1829348 - RNA, 20 nt, Homo sapiens
cuauuuuaguaguaaacuga

SEQ ID NO: 1829349 - RNA, 22 nt, Homo sapiens
auugcuugaguuauauguucac

SEQ ID NO: 1829350 - RNA, 13 nt, Homo sapiens
acccacucugcac

SEQ ID NO: 1829351 - RNA, 23 nt, Homo sapiens
agcuguauuuugaugauugcuau

SEQ ID NO: 1829352 - RNA, 17 nt, Homo sapiens
cauuggcaaagugacaa

SEQ ID NO: 1829353 - RNA, 17 nt, Homo sapiens
aagcuacccaucugcca

SEQ ID NO: 1829354 - RNA, 21 nt, Homo sapiens
cuuucccuccuuuucccaaag

SEQ ID NO: 1829355 - RNA, 20 nt, Homo sapiens
aagaugauucuggcugaaaa

SEQ ID NO: 1829356 - RNA, 20 nt, Homo sapiens
cccagcccacuucugccaua

SEQ ID NO: 1829357 - RNA, 16 nt, Homo sapiens
acucuagaauguccau

SEQ ID NO: 1829358 - RNA, 19 nt, Homo sapiens
uuccaucccuagccauucu

SEQ ID NO: 1829359 - RNA, 13 nt, Homo sapiens
guguaugcacgug

SEQ ID NO: 1829360 - RNA, 14 nt, Homo sapiens
cucuucuuacuggu

SEQ ID NO: 1829361 - RNA, 23 nt, Homo sapiens
acacauaauuucuuaauuuucac

SEQ ID NO: 1829362 - RNA, 14 nt, Homo sapiens
cuggucugaaaaug

SEQ ID NO: 1829363 - RNA, 16 nt, Homo sapiens
ugugcuccccugccac

SEQ ID NO: 1829364 - RNA, 23 nt, Homo sapiens
agcucauuuugucugguccugau

SEQ ID NO: 1829365 - RNA, 20 nt, Homo sapiens
accuuggaggaaugacaaua

SEQ ID NO: 1829366 - RNA, 16 nt, Homo sapiens
acugcaaacacaccuu

SEQ ID NO: 1829367 - RNA, 23 nt, Homo sapiens
cucaguaaaucagugcaguacuc

SEQ ID NO: 1829368 - RNA, 14 nt, Homo sapiens
uaucacaucacuua

SEQ ID NO: 1829369 - RNA, 14 nt, Homo sapiens
ccuggccagcccuu

SEQ ID NO: 1829370 - RNA, 17 nt, Homo sapiens
uaaagagcaauccugga

SEQ ID NO: 1829371 - RNA, 19 nt, Homo sapiens
gaggaagcagaggucuuca

SEQ ID NO: 1829372 - RNA, 21 nt, Homo sapiens
gccucuuuuaaugucaucucu

SEQ ID NO: 1829373 - RNA, 21 nt, Homo sapiens
gaguccagaaugguacacaau

SEQ ID NO: 1829374 - RNA, 19 nt, Homo sapiens
auuuuuacaugcagaguau

SEQ ID NO: 1829375 - RNA, 18 nt, Homo sapiens
auuuuagaaugucaauaa

SEQ ID NO: 1829376 - RNA, 15 nt, Homo sapiens
ggugggugugggaca

SEQ ID NO: 1829377 - RNA, 22 nt, Homo sapiens
uaccgauguuaauuauuuugac

SEQ ID NO: 1829378 - RNA, 16 nt, Homo sapiens
cucacauauaacaugc

SEQ ID NO: 1829379 - RNA, 21 nt, Homo sapiens
ugaaacaugaacccaaaaaga

SEQ ID NO: 1829380 - RNA, 19 nt, Homo sapiens
uugcucucgacaguaucca

SEQ ID NO: 1829381 - RNA, 15 nt, Homo sapiens
gugaggcggcagcug

SEQ ID NO: 1829382 - RNA, 11 nt, Homo sapiens
uaaacugccaa

SEQ ID NO: 1829383 - RNA, 15 nt, Homo sapiens
uggaugacacaaucc

SEQ ID NO: 1829384 - RNA, 14 nt, Homo sapiens
acugaggcagacag

SEQ ID NO: 1829385 - RNA, 19 nt, Homo sapiens
uucuugggguacucuugau

SEQ ID NO: 1829386 - RNA, 17 nt, Homo sapiens
uguaugugaaccaccca

SEQ ID NO: 1829387 - RNA, 13 nt, Homo sapiens
aauaauucaucaa

SEQ ID NO: 1829388 - RNA, 22 nt, Homo sapiens
uccacaguaacacgcugaaggg

SEQ ID NO: 1829389 - RNA, 20 nt, Homo sapiens
accugggagggugggaccaa

SEQ ID NO: 1829390 - RNA, 20 nt, Homo sapiens
ucuccaucccucuaaugaga

SEQ ID NO: 1829391 - RNA, 17 nt, Homo sapiens
ccccacucuaccuccuu

SEQ ID NO: 1829392 - RNA, 12 nt, Homo sapiens
uguuugcaucug

SEQ ID NO: 1829393 - RNA, 24 nt, Homo sapiens
guuuaccuagaagaagcuauguca

SEQ ID NO: 1829394 - RNA, 16 nt, Homo sapiens
aaggcauauacuuugu

SEQ ID NO: 1829395 - RNA, 22 nt, Homo sapiens
gcgugggauugaauuaaaacag

SEQ ID NO: 1829396 - RNA, 20 nt, Homo sapiens
aauguaaggagccuuuccag

SEQ ID NO: 1829397 - RNA, 12 nt, Homo sapiens
acagauggcuca

SEQ ID NO: 1829398 - RNA, 18 nt, Homo sapiens
auuaacuuugaccagagu

SEQ ID NO: 1829399 - RNA, 12 nt, Homo sapiens
agagcacuuuua

SEQ ID NO: 1829400 - RNA, 18 nt, Homo sapiens
ucuuauucucacuccacc

SEQ ID NO: 1829401 - RNA, 18 nt, Homo sapiens
uccccacuccacccuguu

SEQ ID NO: 1829402 - RNA, 14 nt, Homo sapiens
ugaaaaugaaugcu

SEQ ID NO: 1829403 - RNA, 16 nt, Homo sapiens
cuucucugcacuuaua

SEQ ID NO: 1829404 - RNA, 16 nt, Homo sapiens
uucuuaaguaucucaa

SEQ ID NO: 1829405 - RNA, 23 nt, Homo sapiens
acuuccaagcuggcuuuucccau

SEQ ID NO: 1829406 - RNA, 23 nt, Homo sapiens
gauacacagauauauacacacag

SEQ ID NO: 1829407 - RNA, 17 nt, Homo sapiens
auacgcucaccuuacag

SEQ ID NO: 1829408 - RNA, 18 nt, Homo sapiens
cagcuguuaccugagaua

SEQ ID NO: 1829409 - RNA, 15 nt, Homo sapiens
ugcagacccugccag

SEQ ID NO: 1829410 - RNA, 22 nt, Homo sapiens
cuacuuuauuuugaaacauuug

SEQ ID NO: 1829411 - RNA, 16 nt, Homo sapiens
caugucucuuugccaa

SEQ ID NO: 1829412 - RNA, 23 nt, Homo sapiens
cuccuuauagacacuugcuccca

SEQ ID NO: 1829413 - RNA, 16 nt, Homo sapiens
acaccacuguugccuu

SEQ ID NO: 1829414 - RNA, 18 nt, Homo sapiens
uagccagcacacagggca

SEQ ID NO: 1829415 - RNA, 18 nt, Homo sapiens
gaaugugccucucucuug

SEQ ID NO: 1829416 - RNA, 11 nt, Homo sapiens
ggcauuugccu

SEQ ID NO: 1829417 - RNA, 14 nt, Homo sapiens
auggucacaguaaa

SEQ ID NO: 1829418 - RNA, 12 nt, Homo sapiens
uguaaauguguu

SEQ ID NO: 1829419 - RNA, 22 nt, Homo sapiens
ucacaguccuguccucuggauc

SEQ ID NO: 1829420 - RNA, 13 nt, Homo sapiens
uuccgcacugggc

SEQ ID NO: 1829421 - RNA, 17 nt, Homo sapiens
aucacgcagaucacuaa

SEQ ID NO: 1829422 - RNA, 17 nt, Homo sapiens
ccauggcccagcagcuu

SEQ ID NO: 1829423 - RNA, 20 nt, Homo sapiens
gccuuuuaaaaguucuuuaa

SEQ ID NO: 1829424 - RNA, 14 nt, Homo sapiens
acucugaaagagca

SEQ ID NO: 1829425 - RNA, 13 nt, Homo sapiens
gaaaaggcuuuca

SEQ ID NO: 1829426 - RNA, 21 nt, Homo sapiens
ccccucucugggcagucagaa

SEQ ID NO: 1829427 - RNA, 20 nt, Homo sapiens
ccaugacugcucaggccuca

SEQ ID NO: 1829428 - RNA, 12 nt, Homo sapiens
ccaauucaucuu

SEQ ID NO: 1829429 - RNA, 21 nt, Homo sapiens
gcacaauuuaauauauucaag

SEQ ID NO: 1829430 - RNA, 17 nt, Homo sapiens
cauagcagcugcuacua

SEQ ID NO: 1829431 - RNA, 19 nt, Homo sapiens
acaaacucucccuucacuc

SEQ ID NO: 1829432 - RNA, 16 nt, Homo sapiens
ugacccuccaugccaa

SEQ ID NO: 1829433 - RNA, 13 nt, Homo sapiens
agaguggcccaag

SEQ ID NO: 1829434 - RNA, 14 nt, Homo sapiens
caguaucucuugcu

SEQ ID NO: 1829435 - RNA, 19 nt, Homo sapiens
cucuccccuccagccuuug

SEQ ID NO: 1829436 - RNA, 22 nt, Homo sapiens
auucauaccuguuguacacuug

SEQ ID NO: 1829437 - RNA, 16 nt, Homo sapiens
accaugacuuccucac

SEQ ID NO: 1829438 - RNA, 16 nt, Homo sapiens
auaccguguggcccaa

SEQ ID NO: 1829439 - RNA, 14 nt, Homo sapiens
gcuccugccagcuc

SEQ ID NO: 1829440 - RNA, 22 nt, Homo sapiens
aagcacaacugaaaccaguagc

SEQ ID NO: 1829441 - RNA, 16 nt, Homo sapiens
acccauuucaaugugu

SEQ ID NO: 1829442 - RNA, 12 nt, Homo sapiens
aucuuuguauau

SEQ ID NO: 1829443 - RNA, 12 nt, Homo sapiens
ggacucagagaa

SEQ ID NO: 1829444 - RNA, 16 nt, Homo sapiens
agcccugggggccagc

SEQ ID NO: 1829445 - RNA, 16 nt, Homo sapiens
ugcaaaaauaaaaugg

SEQ ID NO: 1829446 - RNA, 17 nt, Homo sapiens
aaaguguaauaauauga

SEQ ID NO: 1829447 - RNA, 16 nt, Homo sapiens
agacaggaaagccagg

SEQ ID NO: 1829448 - RNA, 15 nt, Homo sapiens
gagagggaugcagug

SEQ ID NO: 1829449 - RNA, 22 nt, Homo sapiens
agguaaguggcaggacccuguc

SEQ ID NO: 1829450 - RNA, 23 nt, Homo sapiens
agauuuugggagaguaaagcuaa

SEQ ID NO: 1829451 - RNA, 18 nt, Homo sapiens
aagacaaaauuuaauugu

SEQ ID NO: 1829452 - RNA, 14 nt, Homo sapiens
ucuagaugacauaa

SEQ ID NO: 1829453 - RNA, 15 nt, Homo sapiens
auuggucuccucuca

SEQ ID NO: 1829454 - RNA, 17 nt, Homo sapiens
ccagcccauaaccagua

SEQ ID NO: 1829455 - RNA, 21 nt, Homo sapiens
cuugagcaagaugauguaaug

SEQ ID NO: 1829456 - RNA, 13 nt, Homo sapiens
caaaacacugugg

SEQ ID NO: 1829457 - RNA, 18 nt, Homo sapiens
acuucucugccaccauca

SEQ ID NO: 1829458 - RNA, 23 nt, Homo sapiens
ucccuuuuaguuugaucagacag

SEQ ID NO: 1829459 - RNA, 13 nt, Homo sapiens
ccuuaguacucuu

SEQ ID NO: 1829460 - RNA, 19 nt, Homo sapiens
cggguucaccauguugccc

SEQ ID NO: 1829461 - RNA, 18 nt, Homo sapiens
aucugcugccagaauuaa

SEQ ID NO: 1829462 - RNA, 22 nt, Homo sapiens
cuaaugugcagggauauugccu

SEQ ID NO: 1829463 - RNA, 14 nt, Homo sapiens
uauaauuugcauac

SEQ ID NO: 1829464 - RNA, 15 nt, Homo sapiens
cuaaagucacauaua

SEQ ID NO: 1829465 - RNA, 17 nt, Homo sapiens
cuuaggggaacccuguc

SEQ ID NO: 1829466 - RNA, 23 nt, Homo sapiens
gcuggagugcaguaaguggcaca

SEQ ID NO: 1829467 - RNA, 20 nt, Homo sapiens
cuaguucagagccaagccuu

SEQ ID NO: 1829468 - RNA, 22 nt, Homo sapiens
uaguagaauauggacuuggaaa

SEQ ID NO: 1829469 - RNA, 14 nt, Homo sapiens
cacuuauuugucaa

SEQ ID NO: 1829470 - RNA, 14 nt, Homo sapiens
gucccagcuucucc

SEQ ID NO: 1829471 - RNA, 14 nt, Homo sapiens
aaguuccuucccag

SEQ ID NO: 1829472 - RNA, 12 nt, Homo sapiens
uuucuccauugu

SEQ ID NO: 1829473 - RNA, 12 nt, Homo sapiens
uugcuccauuuu

SEQ ID NO: 1829474 - RNA, 12 nt, Homo sapiens
guucuccagugu

SEQ ID NO: 1829475 - RNA, 18 nt, Homo sapiens
gugcacuagccugugauu

SEQ ID NO: 1829476 - RNA, 12 nt, Homo sapiens
cguacauucaau

SEQ ID NO: 1829477 - RNA, 12 nt, Homo sapiens
uauacauuugau

SEQ ID NO: 1829478 - RNA, 16 nt, Homo sapiens
ugucauaaauuacaca

SEQ ID NO: 1829479 - RNA, 14 nt, Homo sapiens
aguuaagaaccuga

SEQ ID NO: 1829480 - RNA, 19 nt, Homo sapiens
uuaaauucaaguccaggcu

SEQ ID NO: 1829481 - RNA, 22 nt, Homo sapiens
ugagcaagucuuagacaucaua

SEQ ID NO: 1829482 - RNA, 18 nt, Homo sapiens
caauugacauaggcaaua

SEQ ID NO: 1829483 - RNA, 17 nt, Homo sapiens
ugguaguccucccaagc

SEQ ID NO: 1829484 - RNA, 13 nt, Homo sapiens
ccaugauaucacu

SEQ ID NO: 1829485 - RNA, 11 nt, Homo sapiens
auuucaucacu

SEQ ID NO: 1829486 - RNA, 11 nt, Homo sapiens
uucucaucucc

SEQ ID NO: 1829487 - RNA, 14 nt, Homo sapiens
aauuauaguuucaa

SEQ ID NO: 1829488 - RNA, 19 nt, Homo sapiens
acacuauaaagguugacaa

SEQ ID NO: 1829489 - RNA, 21 nt, Homo sapiens
auucuuggguguuuauccuau

SEQ ID NO: 1829490 - RNA, 16 nt, Homo sapiens
uggggagagacagaga

SEQ ID NO: 1829491 - RNA, 21 nt, Homo sapiens
ucauaagucuuugguacaagu

SEQ ID NO: 1829492 - RNA, 20 nt, Homo sapiens
gugguuuuauuucaaaggga

SEQ ID NO: 1829493 - RNA, 23 nt, Homo sapiens
uccugcaccgagagagauggaau

SEQ ID NO: 1829494 - RNA, 18 nt, Homo sapiens
ugacauuccuugcugaaa

SEQ ID NO: 1829495 - RNA, 19 nt, Homo sapiens
gcacacaauaagcauucaa

SEQ ID NO: 1829496 - RNA, 21 nt, Homo sapiens
ucagcacaggaauucucaaga

SEQ ID NO: 1829497 - RNA, 19 nt, Homo sapiens
ccuuuguauauuauuucua

SEQ ID NO: 1829498 - RNA, 23 nt, Homo sapiens
ccagcggaaacagguguguguga

SEQ ID NO: 1829499 - RNA, 23 nt, Homo sapiens
uucauccaggccugccaagguga

SEQ ID NO: 1829500 - RNA, 18 nt, Homo sapiens
agaaacacagcaugcauu

SEQ ID NO: 1829501 - RNA, 22 nt, Homo sapiens
uccucuaguaagaugcacugaa

SEQ ID NO: 1829502 - RNA, 20 nt, Homo sapiens
ggguauaguucaugucugcu

SEQ ID NO: 1829503 - RNA, 17 nt, Homo sapiens
acguauauuucauugaa

SEQ ID NO: 1829504 - RNA, 15 nt, Homo sapiens
accauguaaagucau

SEQ ID NO: 1829505 - RNA, 21 nt, Homo sapiens
gacuuaacgugcucaugggcu

SEQ ID NO: 1829506 - RNA, 18 nt, Homo sapiens
auaaguucauucaugcca

SEQ ID NO: 1829507 - RNA, 15 nt, Homo sapiens
acaguuugaugucau

SEQ ID NO: 1829508 - RNA, 16 nt, Homo sapiens
caacucacugugcucc

SEQ ID NO: 1829509 - RNA, 17 nt, Homo sapiens
gcaaugggagggggcuc

SEQ ID NO: 1829510 - RNA, 22 nt, Homo sapiens
augucuauguuuucuacuccaa

SEQ ID NO: 1829511 - RNA, 20 nt, Homo sapiens
agaaguacaggucaucugcu

SEQ ID NO: 1829512 - RNA, 18 nt, Homo sapiens
gacacaugggcuugugac

SEQ ID NO: 1829513 - RNA, 17 nt, Homo sapiens
ucccaaacccagccucu

SEQ ID NO: 1829514 - RNA, 17 nt, Homo sapiens
caggacagcauggugca

SEQ ID NO: 1829515 - RNA, 17 nt, Homo sapiens
cagggagcuggcaaugc

SEQ ID NO: 1829516 - RNA, 18 nt, Homo sapiens
cccggcucaagugauccu

SEQ ID NO: 1829517 - RNA, 16 nt, Homo sapiens
auacuugaccuugcau

SEQ ID NO: 1829518 - RNA, 23 nt, Homo sapiens
agccaggccugggggcagccucu

SEQ ID NO: 1829519 - RNA, 12 nt, Homo sapiens
uuguguguucua

SEQ ID NO: 1829520 - RNA, 13 nt, Homo sapiens
acaauuuaugaau

SEQ ID NO: 1829521 - RNA, 16 nt, Homo sapiens
ccauggugugaucguc

SEQ ID NO: 1829522 - RNA, 19 nt, Homo sapiens
acaccucacucugcuaccu

SEQ ID NO: 1829523 - RNA, 20 nt, Homo sapiens
gacgcaacuuaagcugggau

SEQ ID NO: 1829524 - RNA, 14 nt, Homo sapiens
gaagcaaggcacaa

SEQ ID NO: 1829525 - RNA, 16 nt, Homo sapiens
uagccaugcuuuaugu

SEQ ID NO: 1829526 - RNA, 22 nt, Homo sapiens
agcuuaacacuaccaauuuccc

SEQ ID NO: 1829527 - RNA, 21 nt, Homo sapiens
ucgguauccccccaucuugcu

SEQ ID NO: 1829528 - RNA, 19 nt, Homo sapiens
cagcugucugucaucugcu

SEQ ID NO: 1829529 - RNA, 22 nt, Homo sapiens
accagggggaagcaccagccuc

SEQ ID NO: 1829530 - RNA, 21 nt, Homo sapiens
gaggcagauaagaaggugcga

SEQ ID NO: 1829531 - RNA, 14 nt, Homo sapiens
gcuuuuucagugau

SEQ ID NO: 1829532 - RNA, 20 nt, Homo sapiens
uuauuuacaaugcagaauuu

SEQ ID NO: 1829533 - RNA, 20 nt, Homo sapiens
uccagcuuauagucuuccag

SEQ ID NO: 1829534 - RNA, 15 nt, Homo sapiens
ugagcaauaugccuc

SEQ ID NO: 1829535 - RNA, 17 nt, Homo sapiens
cuauauaagccagugag

SEQ ID NO: 1829536 - RNA, 20 nt, Homo sapiens
gugaauguggauucuuccca

SEQ ID NO: 1829537 - RNA, 22 nt, Homo sapiens
gccagugcaagaccgagauuga

SEQ ID NO: 1829538 - RNA, 18 nt, Homo sapiens
aucuggaccugguacaaa

SEQ ID NO: 1829539 - RNA, 23 nt, Homo sapiens
cugugacccacuucucaucacac

SEQ ID NO: 1829540 - RNA, 17 nt, Homo sapiens
agcauuacuuuauagcu

SEQ ID NO: 1829541 - RNA, 23 nt, Homo sapiens
cugcgggcaccagaaugcuaaag

SEQ ID NO: 1829542 - RNA, 23 nt, Homo sapiens
cagcuccuccccacuagcauuuu

SEQ ID NO: 1829543 - RNA, 20 nt, Homo sapiens
agcugggcagagcucuggga

SEQ ID NO: 1829544 - RNA, 14 nt, Homo sapiens
agcuuaugucagac

SEQ ID NO: 1829545 - RNA, 22 nt, Homo sapiens
gggcuccugcuuccccaucccg

SEQ ID NO: 1829546 - RNA, 20 nt, Homo sapiens
uugccugggggcuuuugcca

SEQ ID NO: 1829547 - RNA, 14 nt, Homo sapiens
uucuugaagacauc

SEQ ID NO: 1829548 - RNA, 14 nt, Homo sapiens
aggggacaacaaua

SEQ ID NO: 1829549 - RNA, 18 nt, Homo sapiens
ccuguuuacgguacuugg

SEQ ID NO: 1829550 - RNA, 17 nt, Homo sapiens
cacuacaccacacacaa

SEQ ID NO: 1829551 - RNA, 14 nt, Homo sapiens
aaauuugcuucacu

SEQ ID NO: 1829552 - RNA, 20 nt, Homo sapiens
gcuggucucaaacuccugac

SEQ ID NO: 1829553 - RNA, 16 nt, Homo sapiens
caaggaggccacguga

SEQ ID NO: 1829554 - RNA, 16 nt, Homo sapiens
acaccgaugugcgcac

SEQ ID NO: 1829555 - RNA, 18 nt, Homo sapiens
agagccggguguccccaa

SEQ ID NO: 1829556 - RNA, 15 nt, Homo sapiens
aagacaugcagcuuu

SEQ ID NO: 1829557 - RNA, 15 nt, Homo sapiens
agccgccaggacaca

SEQ ID NO: 1829558 - RNA, 16 nt, Homo sapiens
ucucagcucacuguga

SEQ ID NO: 1829559 - RNA, 12 nt, Homo sapiens
aaccucaucucu

SEQ ID NO: 1829560 - RNA, 15 nt, Homo sapiens
cugcaaacacaccuu

SEQ ID NO: 1829561 - RNA, 21 nt, Homo sapiens
auuucaaaccacaauauccag

SEQ ID NO: 1829562 - RNA, 23 nt, Homo sapiens
ucagucacucuaggacucugcac

SEQ ID NO: 1829563 - RNA, 22 nt, Homo sapiens
guagaaaaacccaaacugagac

SEQ ID NO: 1829564 - RNA, 13 nt, Homo sapiens
aguaaacuugaaa

SEQ ID NO: 1829565 - RNA, 22 nt, Homo sapiens
gaggacauucuggaaaagcaaa

SEQ ID NO: 1829566 - RNA, 15 nt, Homo sapiens
cuuagaaauacuugu

SEQ ID NO: 1829567 - RNA, 14 nt, Homo sapiens
cuguugcuuuacag

SEQ ID NO: 1829568 - RNA, 16 nt, Homo sapiens
ugaauuuggucucucc

SEQ ID NO: 1829569 - RNA, 17 nt, Homo sapiens
agaugguacgaugcauc

SEQ ID NO: 1829570 - RNA, 15 nt, Homo sapiens
uuuauacaggucaua

SEQ ID NO: 1829571 - RNA, 19 nt, Homo sapiens
gcaugcacagcugcuuguc

SEQ ID NO: 1829572 - RNA, 21 nt, Homo sapiens
ccuaaucaagucaaauggaga

SEQ ID NO: 1829573 - RNA, 17 nt, Homo sapiens
ucaagaucaacauucca

SEQ ID NO: 1829574 - RNA, 13 nt, Homo sapiens
acugacaguuuuu

SEQ ID NO: 1829575 - RNA, 19 nt, Homo sapiens
gauauuuauuuuuugccau

SEQ ID NO: 1829576 - RNA, 16 nt, Homo sapiens
cagugcagguauuuca

SEQ ID NO: 1829577 - RNA, 24 nt, Homo sapiens
cuucauuugaugcuaaauaggaga

SEQ ID NO: 1829578 - RNA, 19 nt, Homo sapiens
cuaauuggaagaaauuccu

SEQ ID NO: 1829579 - RNA, 20 nt, Homo sapiens
gcaaucucggcucacugcaa

SEQ ID NO: 1829580 - RNA, 17 nt, Homo sapiens
acucaggggcuuggccc

SEQ ID NO: 1829581 - RNA, 13 nt, Homo sapiens
uguuugcucuugc

SEQ ID NO: 1829582 - RNA, 17 nt, Homo sapiens
ugagucauugucagaau

SEQ ID NO: 1829583 - RNA, 18 nt, Homo sapiens
uaaagaugaacucugaac

SEQ ID NO: 1829584 - RNA, 14 nt, Homo sapiens
acccuuucauucag

SEQ ID NO: 1829585 - RNA, 19 nt, Homo sapiens
gcugaagacauguuucaag

SEQ ID NO: 1829586 - RNA, 23 nt, Homo sapiens
aaagaugcaucaucucuuccuca

SEQ ID NO: 1829587 - RNA, 17 nt, Homo sapiens
uguacuaaaccaccuca

SEQ ID NO: 1829588 - RNA, 14 nt, Homo sapiens
cgucugugcuuccu

SEQ ID NO: 1829589 - RNA, 17 nt, Homo sapiens
uuggaaugagucuccuu

SEQ ID NO: 1829590 - RNA, 21 nt, Homo sapiens
cucacuggucaaaaccuacac

SEQ ID NO: 1829591 - RNA, 17 nt, Homo sapiens
ugguuuuguaacuuguu

SEQ ID NO: 1829592 - RNA, 18 nt, Homo sapiens
gcacaagucaccaugccu

SEQ ID NO: 1829593 - RNA, 20 nt, Homo sapiens
agccugggcgacagagccag

SEQ ID NO: 1829594 - RNA, 22 nt, Homo sapiens
acaaggcaggaggagcugauaa

SEQ ID NO: 1829595 - RNA, 14 nt, Homo sapiens
ucuuugcugcugcu

SEQ ID NO: 1829596 - RNA, 21 nt, Homo sapiens
auaguauaaaaauguuaggau

SEQ ID NO: 1829597 - RNA, 19 nt, Homo sapiens
uaggaguuaacuacccuac

SEQ ID NO: 1829598 - RNA, 21 nt, Homo sapiens
cacaaucugaaacagcuucau

SEQ ID NO: 1829599 - RNA, 13 nt, Homo sapiens
uuauacacugugu

SEQ ID NO: 1829600 - RNA, 13 nt, Homo sapiens
augacacugaccu

SEQ ID NO: 1829601 - RNA, 19 nt, Homo sapiens
agacuggaaugcagugaca

SEQ ID NO: 1829602 - RNA, 23 nt, Homo sapiens
gcucaccuuuuuaugaucugcca

SEQ ID NO: 1829603 - RNA, 16 nt, Homo sapiens
uguacuugucaacccc

SEQ ID NO: 1829604 - RNA, 19 nt, Homo sapiens
auaaaaugagggugcccag

SEQ ID NO: 1829605 - RNA, 9 nt, Homo sapiens
uguuugaug

SEQ ID NO: 1829606 - RNA, 13 nt, Homo sapiens
ugcugcaacaagc

SEQ ID NO: 1829607 - RNA, 20 nt, Homo sapiens
gagcuguggagaggggaccc

SEQ ID NO: 1829608 - RNA, 23 nt, Homo sapiens
cuucuagugauugugagugccuu

SEQ ID NO: 1829609 - RNA, 14 nt, Homo sapiens
accgguuugcuaca

SEQ ID NO: 1829610 - RNA, 21 nt, Homo sapiens
gaaacauccuguuuugcaaau

SEQ ID NO: 1829611 - RNA, 18 nt, Homo sapiens
auccucccuccaccucaa

SEQ ID NO: 1829612 - RNA, 18 nt, Homo sapiens
caccaugcuugccugaag

SEQ ID NO: 1829613 - RNA, 17 nt, Homo sapiens
uccugaguagcagugau

SEQ ID NO: 1829614 - RNA, 13 nt, Homo sapiens
augaucauugcug

SEQ ID NO: 1829615 - RNA, 11 nt, Homo sapiens
gcccucaggaa

SEQ ID NO: 1829616 - RNA, 13 nt, Homo sapiens
aucuaccaagaac

SEQ ID NO: 1829617 - RNA, 16 nt, Homo sapiens
aagaauuuaauggacu

SEQ ID NO: 1829618 - RNA, 15 nt, Homo sapiens
cugaaaaacauucca

SEQ ID NO: 1829619 - RNA, 18 nt, Homo sapiens
cauccuggccuggcacau

SEQ ID NO: 1829620 - RNA, 22 nt, Homo sapiens
ugcccacuaaaagaauugugac

SEQ ID NO: 1829621 - RNA, 19 nt, Homo sapiens
uauauggcauuugcagauu

SEQ ID NO: 1829622 - RNA, 12 nt, Homo sapiens
uuauccaccucc

SEQ ID NO: 1829623 - RNA, 18 nt, Homo sapiens
ucagauaccgacuggggc

SEQ ID NO: 1829624 - RNA, 16 nt, Homo sapiens
gaguggaaagucaccu

SEQ ID NO: 1829625 - RNA, 18 nt, Homo sapiens
auauucuauuaacuuuaa

SEQ ID NO: 1829626 - RNA, 22 nt, Homo sapiens
caaacggaguacagacgucuca

SEQ ID NO: 1829627 - RNA, 21 nt, Homo sapiens
gauacacaaucugaaacagcu

SEQ ID NO: 1829628 - RNA, 18 nt, Homo sapiens
uguccuccucugugaaac

SEQ ID NO: 1829629 - RNA, 23 nt, Homo sapiens
gccacuugacauuccuugucacc

SEQ ID NO: 1829630 - RNA, 18 nt, Homo sapiens
agaaaucuagaagacugu

SEQ ID NO: 1829631 - RNA, 23 nt, Homo sapiens
aguucugcaaaaaugaccuauaa

SEQ ID NO: 1829632 - RNA, 11 nt, Homo sapiens
uggucacaggg

SEQ ID NO: 1829633 - RNA, 19 nt, Homo sapiens
agguacuggugagggcaag

SEQ ID NO: 1829634 - RNA, 17 nt, Homo sapiens
cacaguacuuuauugua

SEQ ID NO: 1829635 - RNA, 16 nt, Homo sapiens
acauaauugugaccaa

SEQ ID NO: 1829636 - RNA, 20 nt, Homo sapiens
cucugcuucaguccacagua

SEQ ID NO: 1829637 - RNA, 17 nt, Homo sapiens
uugaaaugaacuuuguc

SEQ ID NO: 1829638 - RNA, 15 nt, Homo sapiens
ucauaacucacuuua

SEQ ID NO: 1829639 - RNA, 17 nt, Homo sapiens
agagcggcggagacaag

SEQ ID NO: 1829640 - RNA, 21 nt, Homo sapiens
guuaaucauccaucacuuccc

SEQ ID NO: 1829641 - RNA, 15 nt, Homo sapiens
auaaauuucccaguu

SEQ ID NO: 1829642 - RNA, 13 nt, Homo sapiens
gagauaccauuca

SEQ ID NO: 1829643 - RNA, 15 nt, Homo sapiens
gaccuuaguguuucu

SEQ ID NO: 1829644 - RNA, 18 nt, Homo sapiens
auuuaagugacacagaca

SEQ ID NO: 1829645 - RNA, 22 nt, Homo sapiens
acaaauuuaugcauuucauuca

SEQ ID NO: 1829646 - RNA, 14 nt, Homo sapiens
cccuagacauggac

SEQ ID NO: 1829647 - RNA, 14 nt, Homo sapiens
cuggggacaccugc

SEQ ID NO: 1829648 - RNA, 15 nt, Homo sapiens
uauguuucacccugu

SEQ ID NO: 1829649 - RNA, 23 nt, Homo sapiens
cccagcaucucagaguccaguca

SEQ ID NO: 1829650 - RNA, 15 nt, Homo sapiens
uccuuucucaccagc

SEQ ID NO: 1829651 - RNA, 15 nt, Homo sapiens
ccagagcauuuccaa

SEQ ID NO: 1829652 - RNA, 14 nt, Homo sapiens
gaugaucagggauc

SEQ ID NO: 1829653 - RNA, 21 nt, Homo sapiens
cugagccugcuuguugggaaa

SEQ ID NO: 1829654 - RNA, 18 nt, Homo sapiens
uuucugcaucaguucacu

SEQ ID NO: 1829655 - RNA, 12 nt, Homo sapiens
aaaccauugugg

SEQ ID NO: 1829656 - RNA, 18 nt, Homo sapiens
augcugcaaauaaauuca

SEQ ID NO: 1829657 - RNA, 20 nt, Homo sapiens
uguguauauaaauacaugca

SEQ ID NO: 1829658 - RNA, 13 nt, Homo sapiens
agugagaagccag

SEQ ID NO: 1829659 - RNA, 16 nt, Homo sapiens
cggugcaugaugcugc

SEQ ID NO: 1829660 - RNA, 16 nt, Homo sapiens
cuucucaucuugugaa

SEQ ID NO: 1829661 - RNA, 16 nt, Homo sapiens
uguaagaaacugccaa

SEQ ID NO: 1829662 - RNA, 21 nt, Homo sapiens
caucgguucaggaggagacag

SEQ ID NO: 1829663 - RNA, 22 nt, Homo sapiens
cagggcucagcuagacauugca

SEQ ID NO: 1829664 - RNA, 19 nt, Homo sapiens
gaccaggggaccagaggga

SEQ ID NO: 1829665 - RNA, 14 nt, Homo sapiens
aaccgugaagcucu

SEQ ID NO: 1829666 - RNA, 17 nt, Homo sapiens
gaaauugcaaagaaaau

SEQ ID NO: 1829667 - RNA, 14 nt, Homo sapiens
caagcacugugguc

SEQ ID NO: 1829668 - RNA, 21 nt, Homo sapiens
uugugaaguugcccaccaaaa

SEQ ID NO: 1829669 - RNA, 22 nt, Homo sapiens
ucaaggagaauguacuggcgau

SEQ ID NO: 1829670 - RNA, 20 nt, Homo sapiens
gaguccucguagccaucucu

SEQ ID NO: 1829671 - RNA, 23 nt, Homo sapiens
ucauuaugaggggcacauucuua

SEQ ID NO: 1829672 - RNA, 21 nt, Homo sapiens
ggagugccuucauacacugua

SEQ ID NO: 1829673 - RNA, 23 nt, Homo sapiens
aaccacuguuauuaacagaugua

SEQ ID NO: 1829674 - RNA, 21 nt, Homo sapiens
ccagaagaauauucaggacuu

SEQ ID NO: 1829675 - RNA, 12 nt, Homo sapiens
ugcagggccauc

SEQ ID NO: 1829676 - RNA, 21 nt, Homo sapiens
aaaguaccacauuccaugacg

SEQ ID NO: 1829677 - RNA, 12 nt, Homo sapiens
uccauacuuuga

SEQ ID NO: 1829678 - RNA, 21 nt, Homo sapiens
uucccugagucccaccauagc

SEQ ID NO: 1829679 - RNA, 14 nt, Homo sapiens
cacuugccuuguga

SEQ ID NO: 1829680 - RNA, 14 nt, Homo sapiens
gaaauguaaaagca

SEQ ID NO: 1829681 - RNA, 19 nt, Homo sapiens
aguagcucaaaaauacucu

SEQ ID NO: 1829682 - RNA, 22 nt, Homo sapiens
uacaggugcucaauaaacacuu

SEQ ID NO: 1829683 - RNA, 23 nt, Homo sapiens
aaaugcccagcuuaaaggggcua

SEQ ID NO: 1829684 - RNA, 20 nt, Homo sapiens
ucagacaucagucaauggaa

SEQ ID NO: 1829685 - RNA, 17 nt, Homo sapiens
ugcuuuaaaaaaauaca

SEQ ID NO: 1829686 - RNA, 15 nt, Homo sapiens
gagcauggaacacuu

SEQ ID NO: 1829687 - RNA, 13 nt, Homo sapiens
acuccacugcaag

SEQ ID NO: 1829688 - RNA, 14 nt, Homo sapiens
guuucuugcaaggg

SEQ ID NO: 1829689 - RNA, 16 nt, Homo sapiens
gaugaggguucaucau

SEQ ID NO: 1829690 - RNA, 22 nt, Homo sapiens
cuuucuaggagggagacacugg

SEQ ID NO: 1829691 - RNA, 15 nt, Homo sapiens
ucuuuugaagcuuuc

SEQ ID NO: 1829692 - RNA, 17 nt, Homo sapiens
aaguugcuucucaugga

SEQ ID NO: 1829693 - RNA, 20 nt, Homo sapiens
gucuagcauuaacuuauugu

SEQ ID NO: 1829694 - RNA, 13 nt, Homo sapiens
ugccuuugugauc

SEQ ID NO: 1829695 - RNA, 20 nt, Homo sapiens
agugaauaaaaggauaucau

SEQ ID NO: 1829696 - RNA, 14 nt, Homo sapiens
acacagcacucucu

SEQ ID NO: 1829697 - RNA, 20 nt, Homo sapiens
uguugauugccaaauugaca

SEQ ID NO: 1829698 - RNA, 12 nt, Homo sapiens
caucuugcugcu

SEQ ID NO: 1829699 - RNA, 20 nt, Homo sapiens
uuaacuaguguuucugcaga

SEQ ID NO: 1829700 - RNA, 16 nt, Homo sapiens
aauuucugauuucacu

SEQ ID NO: 1829701 - RNA, 13 nt, Homo sapiens
ugcaauggcucaa

SEQ ID NO: 1829702 - RNA, 23 nt, Homo sapiens
gccucauuauuuuucacugcccc

SEQ ID NO: 1829703 - RNA, 14 nt, Homo sapiens
uuugaaaacaccag

SEQ ID NO: 1829704 - RNA, 20 nt, Homo sapiens
gggacuacaggcacaaguca

SEQ ID NO: 1829705 - RNA, 23 nt, Homo sapiens
caugaauauuuaguguucauaaa

SEQ ID NO: 1829706 - RNA, 12 nt, Homo sapiens
aaaucuauucca

SEQ ID NO: 1829707 - RNA, 14 nt, Homo sapiens
ugacuuaguucuuc

SEQ ID NO: 1829708 - RNA, 18 nt, Homo sapiens
uaaagaauacuugaacuu

SEQ ID NO: 1829709 - RNA, 18 nt, Homo sapiens
cauucucugaguguuguu

SEQ ID NO: 1829710 - RNA, 12 nt, Homo sapiens
guauuuuugccg

SEQ ID NO: 1829711 - RNA, 19 nt, Homo sapiens
gcauguaugacgugacugg

SEQ ID NO: 1829712 - RNA, 14 nt, Homo sapiens
auauucugugauca

SEQ ID NO: 1829713 - RNA, 13 nt, Homo sapiens
uccccacucccuu

SEQ ID NO: 1829714 - RNA, 15 nt, Homo sapiens
gccgcuaccuggacu

SEQ ID NO: 1829715 - RNA, 16 nt, Homo sapiens
gguccaccccauguca

SEQ ID NO: 1829716 - RNA, 20 nt, Homo sapiens
ucgaacuccugacaucaggu

SEQ ID NO: 1829717 - RNA, 13 nt, Homo sapiens
aucuucaacagac

SEQ ID NO: 1829718 - RNA, 14 nt, Homo sapiens
ucuggaacaacuug

SEQ ID NO: 1829719 - RNA, 23 nt, Homo sapiens
caggguacaaaaaauucagugau

SEQ ID NO: 1829720 - RNA, 23 nt, Homo sapiens
cuggggaucccacucuucuugca

SEQ ID NO: 1829721 - RNA, 12 nt, Homo sapiens
ucuguguacaaa

SEQ ID NO: 1829722 - RNA, 13 nt, Homo sapiens
cgauaaccacagg

SEQ ID NO: 1829723 - RNA, 18 nt, Homo sapiens
ccugacaacagccugaga

SEQ ID NO: 1829724 - RNA, 14 nt, Homo sapiens
gcucaagcccugaa

SEQ ID NO: 1829725 - RNA, 20 nt, Homo sapiens
cuucuaguucugccaggaga

SEQ ID NO: 1829726 - RNA, 14 nt, Homo sapiens
cuaugcaaagcacu

SEQ ID NO: 1829727 - RNA, 19 nt, Homo sapiens
uaaugacagaaguauuuau

SEQ ID NO: 1829728 - RNA, 14 nt, Homo sapiens
cuugguagcacuuu

SEQ ID NO: 1829729 - RNA, 16 nt, Homo sapiens
gaauccagacccggcu

SEQ ID NO: 1829730 - RNA, 15 nt, Homo sapiens
uaaaaaaugugaacu

SEQ ID NO: 1829731 - RNA, 23 nt, Homo sapiens
aucucauucccagagucagagga

SEQ ID NO: 1829732 - RNA, 12 nt, Homo sapiens
uggccuugcuac

SEQ ID NO: 1829733 - RNA, 18 nt, Homo sapiens
acuugggaauaaaucaua

SEQ ID NO: 1829734 - RNA, 20 nt, Homo sapiens
ugcugaaugcauucagggga

SEQ ID NO: 1829735 - RNA, 14 nt, Homo sapiens
ucuguccucuuggc

SEQ ID NO: 1829736 - RNA, 15 nt, Homo sapiens
aaauaaaauguguac

SEQ ID NO: 1829737 - RNA, 14 nt, Homo sapiens
ucaucaaaaagccu

SEQ ID NO: 1829738 - RNA, 21 nt, Homo sapiens
uuaagggcauuuuuauacuca

SEQ ID NO: 1829739 - RNA, 18 nt, Homo sapiens
aggaaccaauaccuucaa

SEQ ID NO: 1829740 - RNA, 21 nt, Homo sapiens
ugcccugggccaaaaccaaug

SEQ ID NO: 1829741 - RNA, 16 nt, Homo sapiens
uggcugggacugggaa

SEQ ID NO: 1829742 - RNA, 14 nt, Homo sapiens
acugucccacaaaa

SEQ ID NO: 1829743 - RNA, 14 nt, Homo sapiens
agcccgcugcucac

SEQ ID NO: 1829744 - RNA, 14 nt, Homo sapiens
acuucucugugaac

SEQ ID NO: 1829745 - RNA, 20 nt, Homo sapiens
accugccccggaccuaccuc

SEQ ID NO: 1829746 - RNA, 18 nt, Homo sapiens
auggaccacacuuugaga

SEQ ID NO: 1829747 - RNA, 18 nt, Homo sapiens
uaaaauaaacuucuuaac

SEQ ID NO: 1829748 - RNA, 22 nt, Homo sapiens
ccagaugggaugggcuuucuca

SEQ ID NO: 1829749 - RNA, 20 nt, Homo sapiens
gcaggccugccuucucaggg

SEQ ID NO: 1829750 - RNA, 16 nt, Homo sapiens
cuugugauucugggau

SEQ ID NO: 1829751 - RNA, 12 nt, Homo sapiens
uauaccaaagac

SEQ ID NO: 1829752 - RNA, 17 nt, Homo sapiens
uggagacugucuggccc

SEQ ID NO: 1829753 - RNA, 15 nt, Homo sapiens
uaagcagaagcacau

SEQ ID NO: 1829754 - RNA, 13 nt, Homo sapiens
ugccacacugaau

SEQ ID NO: 1829755 - RNA, 13 nt, Homo sapiens
ugagcaaccagcu

SEQ ID NO: 1829756 - RNA, 21 nt, Homo sapiens
auuuacugaaguuauuuauua

SEQ ID NO: 1829757 - RNA, 18 nt, Homo sapiens
cuccuuggcugucugugg

SEQ ID NO: 1829758 - RNA, 14 nt, Homo sapiens
gcugaaacccaaug

SEQ ID NO: 1829759 - RNA, 16 nt, Homo sapiens
auuccuugcuuagaca

SEQ ID NO: 1829760 - RNA, 16 nt, Homo sapiens
caccagaggcugcaau

SEQ ID NO: 1829761 - RNA, 22 nt, Homo sapiens
aacacugugauuuaucuuucaa

SEQ ID NO: 1829762 - RNA, 13 nt, Homo sapiens
agagccagggucu

SEQ ID NO: 1829763 - RNA, 13 nt, Homo sapiens
cuccaggcaccgc

SEQ ID NO: 1829764 - RNA, 15 nt, Homo sapiens
cuaaguauuaaaaca

SEQ ID NO: 1829765 - RNA, 15 nt, Homo sapiens
uugacuuaccaugga

SEQ ID NO: 1829766 - RNA, 19 nt, Homo sapiens
aucgugaaaccccaucucu

SEQ ID NO: 1829767 - RNA, 18 nt, Homo sapiens
aaccagugaagugccaca

SEQ ID NO: 1829768 - RNA, 17 nt, Homo sapiens
cugccaaaccuguguag

SEQ ID NO: 1829769 - RNA, 23 nt, Homo sapiens
cacucggcuuuggagacuuucuu

SEQ ID NO: 1829770 - RNA, 24 nt, Homo sapiens
uggcugggaacaacuucaguccaa

SEQ ID NO: 1829771 - RNA, 21 nt, Homo sapiens
ccugggagugagggugggugu

SEQ ID NO: 1829772 - RNA, 12 nt, Homo sapiens
ucuaaaagacuu

SEQ ID NO: 1829773 - RNA, 22 nt, Homo sapiens
aggacauuugugggcaagcaga

SEQ ID NO: 1829774 - RNA, 13 nt, Homo sapiens
cuaaagcuauauu

SEQ ID NO: 1829775 - RNA, 20 nt, Homo sapiens
cugcgcuguguacaauguga

SEQ ID NO: 1829776 - RNA, 12 nt, Homo sapiens
gcuuuucacaaa

SEQ ID NO: 1829777 - RNA, 22 nt, Homo sapiens
aggcugccugggccuguucacg

SEQ ID NO: 1829778 - RNA, 12 nt, Homo sapiens
aagaaccaaaaa

SEQ ID NO: 1829779 - RNA, 12 nt, Homo sapiens
cagaaccacaaa

SEQ ID NO: 1829780 - RNA, 15 nt, Homo sapiens
uaaguaacauaacua

SEQ ID NO: 1829781 - RNA, 16 nt, Homo sapiens
uagcaaacacuggggg

SEQ ID NO: 1829782 - RNA, 19 nt, Homo sapiens
cagccagcgccucccucca

SEQ ID NO: 1829783 - RNA, 12 nt, Homo sapiens
ugugucuucaau

SEQ ID NO: 1829784 - RNA, 14 nt, Homo sapiens
aaauccaaguagau

SEQ ID NO: 1829785 - RNA, 17 nt, Homo sapiens
auuuuuaagcugcaaau

SEQ ID NO: 1829786 - RNA, 14 nt, Homo sapiens
uaacugaagcucua

SEQ ID NO: 1829787 - RNA, 20 nt, Homo sapiens
ucuuguucuaaucuugucaa

SEQ ID NO: 1829788 - RNA, 20 nt, Homo sapiens
uuccucucuuccuccaggga

SEQ ID NO: 1829789 - RNA, 15 nt, Homo sapiens
cuuguuacucaggaa

SEQ ID NO: 1829790 - RNA, 23 nt, Homo sapiens
aguauugcugaacucuuaggcac

SEQ ID NO: 1829791 - RNA, 14 nt, Homo sapiens
ucuaaguguuucau

SEQ ID NO: 1829792 - RNA, 15 nt, Homo sapiens
ucuaacccacccuca

SEQ ID NO: 1829793 - RNA, 21 nt, Homo sapiens
cauguuggccaggcugcucuu

SEQ ID NO: 1829794 - RNA, 17 nt, Homo sapiens
uuugggaucuugaagaa

SEQ ID NO: 1829795 - RNA, 19 nt, Homo sapiens
uggaggcuggaugugcauu

SEQ ID NO: 1829796 - RNA, 13 nt, Homo sapiens
aaauuccacucaa

SEQ ID NO: 1829797 - RNA, 14 nt, Homo sapiens
guuucuuccuguua

SEQ ID NO: 1829798 - RNA, 13 nt, Homo sapiens
accagcaaugaga

SEQ ID NO: 1829799 - RNA, 13 nt, Homo sapiens
cagcccauugcug

SEQ ID NO: 1829800 - RNA, 16 nt, Homo sapiens
acugucaugcccagcu

SEQ ID NO: 1829801 - RNA, 22 nt, Homo sapiens
agacuugcuaggaggccuuagc

SEQ ID NO: 1829802 - RNA, 20 nt, Homo sapiens
uucgacguuugacuagccau

SEQ ID NO: 1829803 - RNA, 20 nt, Homo sapiens
acucagaucaaaaaugggca

SEQ ID NO: 1829804 - RNA, 18 nt, Homo sapiens
uuaaugaagaaaguggaa

SEQ ID NO: 1829805 - RNA, 18 nt, Homo sapiens
ugaacaagauuaaauucc

SEQ ID NO: 1829806 - RNA, 16 nt, Homo sapiens
auauauggggggccaa

SEQ ID NO: 1829807 - RNA, 14 nt, Homo sapiens
ccuguguguaggcu

SEQ ID NO: 1829808 - RNA, 23 nt, Homo sapiens
ucggcaccuuccccugaggaccu

SEQ ID NO: 1829809 - RNA, 16 nt, Homo sapiens
gcaguuucauugugau

SEQ ID NO: 1829810 - RNA, 16 nt, Homo sapiens
uuguaauaaaccacgc

SEQ ID NO: 1829811 - RNA, 20 nt, Homo sapiens
agaggugaauuaauggacag

SEQ ID NO: 1829812 - RNA, 17 nt, Homo sapiens
auuuaaagcaucaucug

SEQ ID NO: 1829813 - RNA, 17 nt, Homo sapiens
gaauggauuuaucagaa

SEQ ID NO: 1829814 - RNA, 16 nt, Homo sapiens
gagguggcuaaggggg

SEQ ID NO: 1829815 - RNA, 22 nt, Homo sapiens
agcuggguuggaaaacaguauu

SEQ ID NO: 1829816 - RNA, 12 nt, Homo sapiens
gggaggcccaaa

SEQ ID NO: 1829817 - RNA, 18 nt, Homo sapiens
accccugaccucacugug

SEQ ID NO: 1829818 - RNA, 15 nt, Homo sapiens
aucaagaacauguca

SEQ ID NO: 1829819 - RNA, 19 nt, Homo sapiens
gaagcaugcuuugcugcua

SEQ ID NO: 1829820 - RNA, 20 nt, Homo sapiens
gaaaauuuuccacauaggaa

SEQ ID NO: 1829821 - RNA, 23 nt, Homo sapiens
gcagcuccggaaggacacaguca

SEQ ID NO: 1829822 - RNA, 19 nt, Homo sapiens
ccuugggagguuuuauucu

SEQ ID NO: 1829823 - RNA, 22 nt, Homo sapiens
aacacccuguagguucuugaua

SEQ ID NO: 1829824 - RNA, 24 nt, Homo sapiens
uagaaggauggcaucuccauguag

SEQ ID NO: 1829825 - RNA, 13 nt, Homo sapiens
cgugcacugugaa

SEQ ID NO: 1829826 - RNA, 21 nt, Homo sapiens
uauuuuuaaaaguauacaugu

SEQ ID NO: 1829827 - RNA, 23 nt, Homo sapiens
agaaagcaaaugugaccuguguc

SEQ ID NO: 1829828 - RNA, 14 nt, Homo sapiens
ccuauagacuguaa

SEQ ID NO: 1829829 - RNA, 23 nt, Homo sapiens
aauacccugcccuugacaucugg

SEQ ID NO: 1829830 - RNA, 18 nt, Homo sapiens
guccagccuuccaggugg

SEQ ID NO: 1829831 - RNA, 18 nt, Homo sapiens
ggcaaacuuuucuuucuu

SEQ ID NO: 1829832 - RNA, 21 nt, Homo sapiens
uucaacaacaaaacauuugcu

SEQ ID NO: 1829833 - RNA, 18 nt, Homo sapiens
guuuuuaugcauguuugu

SEQ ID NO: 1829834 - RNA, 12 nt, Homo sapiens
aagaaacauaac

SEQ ID NO: 1829835 - RNA, 23 nt, Homo sapiens
caguauuguucuuguaaaacugu

SEQ ID NO: 1829836 - RNA, 22 nt, Homo sapiens
auugcuaugaaugauacccuga

SEQ ID NO: 1829837 - RNA, 19 nt, Homo sapiens
uacuuaagagugcugugua

SEQ ID NO: 1829838 - RNA, 20 nt, Homo sapiens
gaaaugcucuuuugcacaag

SEQ ID NO: 1829839 - RNA, 21 nt, Homo sapiens
aagcaggaagaacauugauuu

SEQ ID NO: 1829840 - RNA, 22 nt, Homo sapiens
auuauuuauuugagaguuaaua

SEQ ID NO: 1829841 - RNA, 17 nt, Homo sapiens
auuuccuaauacuguca

SEQ ID NO: 1829842 - RNA, 19 nt, Homo sapiens
uucaaguauucauuguuga

SEQ ID NO: 1829843 - RNA, 17 nt, Homo sapiens
agcuugucucuugccug

SEQ ID NO: 1829844 - RNA, 21 nt, Homo sapiens
aucaaccauaugaauuuacua

SEQ ID NO: 1829845 - RNA, 20 nt, Homo sapiens
ugauuucggaccgaagguga

SEQ ID NO: 1829846 - RNA, 20 nt, Homo sapiens
aaugucuucaguggaacaca

SEQ ID NO: 1829847 - RNA, 13 nt, Homo sapiens
cuccacugugcac

SEQ ID NO: 1829848 - RNA, 17 nt, Homo sapiens
gccaggacacugccuug

SEQ ID NO: 1829849 - RNA, 22 nt, Homo sapiens
uuguaagcacugacugggacca

SEQ ID NO: 1829850 - RNA, 22 nt, Homo sapiens
uuuacacugggagaggugccag

SEQ ID NO: 1829851 - RNA, 20 nt, Homo sapiens
uagcaaaauacaugacauuu

SEQ ID NO: 1829852 - RNA, 16 nt, Homo sapiens
aaaauguaucauucag

SEQ ID NO: 1829853 - RNA, 12 nt, Homo sapiens
cccaaagagccu

SEQ ID NO: 1829854 - RNA, 12 nt, Homo sapiens
aaccaagcuaua

SEQ ID NO: 1829855 - RNA, 21 nt, Homo sapiens
ugucccucuuugccuguguga

SEQ ID NO: 1829856 - RNA, 20 nt, Homo sapiens
gccccgugggcugugccaag

SEQ ID NO: 1829857 - RNA, 15 nt, Homo sapiens
ucuccagaagccaau

SEQ ID NO: 1829858 - RNA, 16 nt, Homo sapiens
agguccagcucugugg

SEQ ID NO: 1829859 - RNA, 22 nt, Homo sapiens
cuccagcuccucuccagacaca

SEQ ID NO: 1829860 - RNA, 19 nt, Homo sapiens
ccuacuuccugcacugacc

SEQ ID NO: 1829861 - RNA, 16 nt, Homo sapiens
uggugccccucgccag

SEQ ID NO: 1829862 - RNA, 22 nt, Homo sapiens
ccucagacccaggaguccagcc

SEQ ID NO: 1829863 - RNA, 17 nt, Homo sapiens
uaauuuucuacaaccua

SEQ ID NO: 1829864 - RNA, 17 nt, Homo sapiens
cuuaauccauuucuuga

SEQ ID NO: 1829865 - RNA, 20 nt, Homo sapiens
uccaucauacauuagugcca

SEQ ID NO: 1829866 - RNA, 24 nt, Homo sapiens
guggaugggcccugcaagacacag

SEQ ID NO: 1829867 - RNA, 13 nt, Homo sapiens
uuacagaaaucaa

SEQ ID NO: 1829868 - RNA, 22 nt, Homo sapiens
ccuuucggcuuugggcuuuuau

SEQ ID NO: 1829869 - RNA, 13 nt, Homo sapiens
caugggaucucau

SEQ ID NO: 1829870 - RNA, 18 nt, Homo sapiens
aggaauaagaauggagca

SEQ ID NO: 1829871 - RNA, 19 nt, Homo sapiens
cuguaagguggacuuccag

SEQ ID NO: 1829872 - RNA, 12 nt, Homo sapiens
aaaguaugcuac

SEQ ID NO: 1829873 - RNA, 16 nt, Homo sapiens
aagcccagugaccuga

SEQ ID NO: 1829874 - RNA, 20 nt, Homo sapiens
ucaggaauucagugccuuca

SEQ ID NO: 1829875 - RNA, 22 nt, Homo sapiens
caguaagagguguuauuuggaa

SEQ ID NO: 1829876 - RNA, 16 nt, Homo sapiens
cuuaauacuaccuuga

SEQ ID NO: 1829877 - RNA, 19 nt, Homo sapiens
auuucucagggaaguaaga

SEQ ID NO: 1829878 - RNA, 19 nt, Homo sapiens
agccaggcaccguggcuca

SEQ ID NO: 1829879 - RNA, 23 nt, Homo sapiens
caauaaaacugauguuacuagcc

SEQ ID NO: 1829880 - RNA, 13 nt, Homo sapiens
caucugcuuacaa

SEQ ID NO: 1829881 - RNA, 20 nt, Homo sapiens
acccccaccccuugcucuca

SEQ ID NO: 1829882 - RNA, 14 nt, Homo sapiens
auggcgacaaaagu

SEQ ID NO: 1829883 - RNA, 15 nt, Homo sapiens
gaagcuuuaagcaaa

SEQ ID NO: 1829884 - RNA, 21 nt, Homo sapiens
ucuaauuuugugcucuuuccu

SEQ ID NO: 1829885 - RNA, 14 nt, Homo sapiens
gucagauggcaaug

SEQ ID NO: 1829886 - RNA, 21 nt, Homo sapiens
gcuaucugcauuuauaaaugu

SEQ ID NO: 1829887 - RNA, 16 nt, Homo sapiens
uauauaguauaccaua

SEQ ID NO: 1829888 - RNA, 15 nt, Homo sapiens
gcugaagugucacag

SEQ ID NO: 1829889 - RNA, 17 nt, Homo sapiens
caaaauuaaauacauaa

SEQ ID NO: 1829890 - RNA, 20 nt, Homo sapiens
ucuauuuauggauaucacac

SEQ ID NO: 1829891 - RNA, 15 nt, Homo sapiens
aaauauauauaaaga

SEQ ID NO: 1829892 - RNA, 14 nt, Homo sapiens
ucagucuugcugag

SEQ ID NO: 1829893 - RNA, 13 nt, Homo sapiens
uuaugugagauac

SEQ ID NO: 1829894 - RNA, 23 nt, Homo sapiens
cacuagcauuuucucuaccuuca

SEQ ID NO: 1829895 - RNA, 13 nt, Homo sapiens
uucauuucaggaa

SEQ ID NO: 1829896 - RNA, 20 nt, Homo sapiens
gcagagaaaucggugucuga

SEQ ID NO: 1829897 - RNA, 15 nt, Homo sapiens
ggugugacacuuuug

SEQ ID NO: 1829898 - RNA, 15 nt, Homo sapiens
cugauaaaacucaaa

SEQ ID NO: 1829899 - RNA, 21 nt, Homo sapiens
aacagggcugccuucuggccu

SEQ ID NO: 1829900 - RNA, 18 nt, Homo sapiens
guagagacaggguuucac

SEQ ID NO: 1829901 - RNA, 21 nt, Homo sapiens
auuccucaaaaaauugcacau

SEQ ID NO: 1829902 - RNA, 14 nt, Homo sapiens
gagcugagcuggaa

SEQ ID NO: 1829903 - RNA, 19 nt, Homo sapiens
ccgacagcccaucaccucu

SEQ ID NO: 1829904 - RNA, 17 nt, Homo sapiens
cagugagucauaucuua

SEQ ID NO: 1829905 - RNA, 17 nt, Homo sapiens
gaggagauauggaguga

SEQ ID NO: 1829906 - RNA, 13 nt, Homo sapiens
uauaauaugucac

SEQ ID NO: 1829907 - RNA, 19 nt, Homo sapiens
aaggucaauuucaguguau

SEQ ID NO: 1829908 - RNA, 22 nt, Homo sapiens
acugucuucacaaccuccgugc

SEQ ID NO: 1829909 - RNA, 15 nt, Homo sapiens
uguggaugucuuccu

SEQ ID NO: 1829910 - RNA, 16 nt, Homo sapiens
uuccuguuuccagggu

SEQ ID NO: 1829911 - RNA, 11 nt, Homo sapiens
ucaucuuugag

SEQ ID NO: 1829912 - RNA, 23 nt, Homo sapiens
ugaugcuacccgagguuugcaaa

SEQ ID NO: 1829913 - RNA, 12 nt, Homo sapiens
uauuugccagcu

SEQ ID NO: 1829914 - RNA, 16 nt, Homo sapiens
gaacaugcaguuugaa

SEQ ID NO: 1829915 - RNA, 20 nt, Homo sapiens
accccuugccggugaaggau

SEQ ID NO: 1829916 - RNA, 22 nt, Homo sapiens
ucauucccucucaucucaggua

SEQ ID NO: 1829917 - RNA, 15 nt, Homo sapiens
cuuuaacugaacucu

SEQ ID NO: 1829918 - RNA, 19 nt, Homo sapiens
auuuuauuuugacagaagc

SEQ ID NO: 1829919 - RNA, 23 nt, Homo sapiens
uuaacuguauuuucuuucacuuu

SEQ ID NO: 1829920 - RNA, 17 nt, Homo sapiens
gauauuuccacuaagaa

SEQ ID NO: 1829921 - RNA, 15 nt, Homo sapiens
cccuucuccuuccaa

SEQ ID NO: 1829922 - RNA, 22 nt, Homo sapiens
cagucucuucugauuaaagaga

SEQ ID NO: 1829923 - RNA, 18 nt, Homo sapiens
cugucucucuugucacau

SEQ ID NO: 1829924 - RNA, 15 nt, Homo sapiens
gaagcugggagcuac

SEQ ID NO: 1829925 - RNA, 16 nt, Homo sapiens
ugccugaggcucaaga

SEQ ID NO: 1829926 - RNA, 19 nt, Homo sapiens
auuguuuugguuugcuacu

SEQ ID NO: 1829927 - RNA, 18 nt, Homo sapiens
uguuauuucacuugccaa

SEQ ID NO: 1829928 - RNA, 14 nt, Homo sapiens
acugucaucugcca

SEQ ID NO: 1829929 - RNA, 21 nt, Homo sapiens
auugagcccaaaaacaagcaa

SEQ ID NO: 1829930 - RNA, 20 nt, Homo sapiens
uaaccugucuauacuacagu

SEQ ID NO: 1829931 - RNA, 17 nt, Homo sapiens
caaaggugauugugcca

SEQ ID NO: 1829932 - RNA, 15 nt, Homo sapiens
ugcacaguuugcaau

SEQ ID NO: 1829933 - RNA, 15 nt, Homo sapiens
cagccaauacaauua

SEQ ID NO: 1829934 - RNA, 13 nt, Homo sapiens
ugaggcaguucca

SEQ ID NO: 1829935 - RNA, 23 nt, Homo sapiens
gccguuuccccuccuuggcuuua

SEQ ID NO: 1829936 - RNA, 17 nt, Homo sapiens
ccggcggcuacucugga

SEQ ID NO: 1829937 - RNA, 17 nt, Homo sapiens
ucaccuugguguuucuc

SEQ ID NO: 1829938 - RNA, 17 nt, Homo sapiens
auuuucuauuuuaguua

SEQ ID NO: 1829939 - RNA, 15 nt, Homo sapiens
cauuaacugcacaaa

SEQ ID NO: 1829940 - RNA, 16 nt, Homo sapiens
aagcagcuuagaguug

SEQ ID NO: 1829941 - RNA, 21 nt, Homo sapiens
aauuuuguugcaucauguuga

SEQ ID NO: 1829942 - RNA, 18 nt, Homo sapiens
cuuaacuuuacuaaguaa

SEQ ID NO: 1829943 - RNA, 16 nt, Homo sapiens
gaaugaagcugaaggu

SEQ ID NO: 1829944 - RNA, 13 nt, Homo sapiens
cgggacucaggug

SEQ ID NO: 1829945 - RNA, 22 nt, Homo sapiens
cccacaaucuggcuuagugcca

SEQ ID NO: 1829946 - RNA, 20 nt, Homo sapiens
guaagaaaccuacugcccag

SEQ ID NO: 1829947 - RNA, 17 nt, Homo sapiens
ugcacucuuuaacacau

SEQ ID NO: 1829948 - RNA, 20 nt, Homo sapiens
augaauagaugugaucacug

SEQ ID NO: 1829949 - RNA, 14 nt, Homo sapiens
aggccccuuaccug

SEQ ID NO: 1829950 - RNA, 11 nt, Homo sapiens
agaugaccuca

SEQ ID NO: 1829951 - RNA, 24 nt, Homo sapiens
ccuccugggggcauaucucaguca

SEQ ID NO: 1829952 - RNA, 21 nt, Homo sapiens
gauaauggcaucaaaugucag

SEQ ID NO: 1829953 - RNA, 17 nt, Homo sapiens
uaccccagucccaggga

SEQ ID NO: 1829954 - RNA, 15 nt, Homo sapiens
cccagagcacccaga

SEQ ID NO: 1829955 - RNA, 16 nt, Homo sapiens
aagaauagcauuguaa

SEQ ID NO: 1829956 - RNA, 22 nt, Homo sapiens
uuaccagacgguucaccagccu

SEQ ID NO: 1829957 - RNA, 21 nt, Homo sapiens
cugagcuaucuccuaacuuug

SEQ ID NO: 1829958 - RNA, 15 nt, Homo sapiens
guuccucuuugcccu

SEQ ID NO: 1829959 - RNA, 14 nt, Homo sapiens
ugccucaucacugc

SEQ ID NO: 1829960 - RNA, 13 nt, Homo sapiens
caaugggagcuga

SEQ ID NO: 1829961 - RNA, 10 nt, Homo sapiens
ccuccagacc

SEQ ID NO: 1829962 - RNA, 18 nt, Homo sapiens
gaacaaagccacugacug

SEQ ID NO: 1829963 - RNA, 17 nt, Homo sapiens
uaguguaacuugcuuaa

SEQ ID NO: 1829964 - RNA, 15 nt, Homo sapiens
cccaagaagaugaaa

SEQ ID NO: 1829965 - RNA, 14 nt, Homo sapiens
agcugcaccagcag

SEQ ID NO: 1829966 - RNA, 17 nt, Homo sapiens
uuuccgccagaccucaa

SEQ ID NO: 1829967 - RNA, 16 nt, Homo sapiens
ccgacucugcacucuc

SEQ ID NO: 1829968 - RNA, 18 nt, Homo sapiens
aaucccauuccugggcua

SEQ ID NO: 1829969 - RNA, 15 nt, Homo sapiens
cagugacauaaaaag

SEQ ID NO: 1829970 - RNA, 20 nt, Homo sapiens
cucaccuugugcuggggaca

SEQ ID NO: 1829971 - RNA, 14 nt, Homo sapiens
ugugauugugauuc

SEQ ID NO: 1829972 - RNA, 19 nt, Homo sapiens
aacccuaaauuaauaaaag

SEQ ID NO: 1829973 - RNA, 18 nt, Homo sapiens
acuauuuaugaauauuaa

SEQ ID NO: 1829974 - RNA, 23 nt, Homo sapiens
aguugagcacaggcaacauuaca

SEQ ID NO: 1829975 - RNA, 19 nt, Homo sapiens
uucauaguaagaauucugg

SEQ ID NO: 1829976 - RNA, 11 nt, Homo sapiens
ugcuauggaag

SEQ ID NO: 1829977 - RNA, 18 nt, Homo sapiens
guuuuagcacccccaugg

SEQ ID NO: 1829978 - RNA, 12 nt, Homo sapiens
ccacgugcacag

SEQ ID NO: 1829979 - RNA, 23 nt, Homo sapiens
cccccacugcagacaugacccga

SEQ ID NO: 1829980 - RNA, 14 nt, Homo sapiens
cacagauauuucca

SEQ ID NO: 1829981 - RNA, 18 nt, Homo sapiens
ugaggcaaaaacugcuua

SEQ ID NO: 1829982 - RNA, 21 nt, Homo sapiens
ugauaacaacacuguguuaua

SEQ ID NO: 1829983 - RNA, 16 nt, Homo sapiens
uguucaggaagcuggu

SEQ ID NO: 1829984 - RNA, 16 nt, Homo sapiens
aucagcacagcucucc

SEQ ID NO: 1829985 - RNA, 15 nt, Homo sapiens
uaucccuacaucuaa

SEQ ID NO: 1829986 - RNA, 16 nt, Homo sapiens
acagugaccaucgcaa

SEQ ID NO: 1829987 - RNA, 21 nt, Homo sapiens
uacaggugugagccacagugc

SEQ ID NO: 1829988 - RNA, 19 nt, Homo sapiens
uacaucuguguucuaugca

SEQ ID NO: 1829989 - RNA, 16 nt, Homo sapiens
aauaaucaucuaagac

SEQ ID NO: 1829990 - RNA, 19 nt, Homo sapiens
ggguguuaaggcagugacu

SEQ ID NO: 1829991 - RNA, 13 nt, Homo sapiens
uugucugagacag

SEQ ID NO: 1829992 - RNA, 12 nt, Homo sapiens
uguuacauacac

SEQ ID NO: 1829993 - RNA, 12 nt, Homo sapiens
cuuugcgcucuc

SEQ ID NO: 1829994 - RNA, 22 nt, Homo sapiens
aauucacaugaugcacuucaaa

SEQ ID NO: 1829995 - RNA, 16 nt, Homo sapiens
guccccuacucccucu

SEQ ID NO: 1829996 - RNA, 15 nt, Homo sapiens
agaaagucaccugcc

SEQ ID NO: 1829997 - RNA, 22 nt, Homo sapiens
gugagcuggauagacuugggau

SEQ ID NO: 1829998 - RNA, 15 nt, Homo sapiens
uccuccggggcucag

SEQ ID NO: 1829999 - RNA, 17 nt, Homo sapiens
gcaauuuuuccaaaagc

SEQ ID NO: 1830000 - RNA, 15 nt, Homo sapiens
caaccaugucauuuc

SEQ ID NO: 1830001 - RNA, 15 nt, Homo sapiens
caacagcacgugcag

SEQ ID NO: 1830002 - RNA, 16 nt, Homo sapiens
ucuuaaagcauuucag

SEQ ID NO: 1830003 - RNA, 15 nt, Homo sapiens
aacagaaacaugcca

SEQ ID NO: 1830004 - RNA, 20 nt, Homo sapiens
cucuuacauggccacaaagg

SEQ ID NO: 1830005 - RNA, 17 nt, Homo sapiens
cagcaguuuucuuuuaa

SEQ ID NO: 1830006 - RNA, 20 nt, Homo sapiens
accaauugugcugccauuug

SEQ ID NO: 1830007 - RNA, 23 nt, Homo sapiens
gugcauuaccacacucagcuaau

SEQ ID NO: 1830008 - RNA, 12 nt, Homo sapiens
aaauauuuugcu

SEQ ID NO: 1830009 - RNA, 16 nt, Homo sapiens
uugggugaccagccac

SEQ ID NO: 1830010 - RNA, 20 nt, Homo sapiens
aucugaguugacuugacaga

SEQ ID NO: 1830011 - RNA, 23 nt, Homo sapiens
uuuauaaccaacauuuuguugcu

SEQ ID NO: 1830012 - RNA, 16 nt, Homo sapiens
agaccagaaaccuucc

SEQ ID NO: 1830013 - RNA, 21 nt, Homo sapiens
cgagccucugguuuuccucug

SEQ ID NO: 1830014 - RNA, 16 nt, Homo sapiens
auagcuauugcaugua

SEQ ID NO: 1830015 - RNA, 23 nt, Homo sapiens
guccagaaauugugugugcaaga

SEQ ID NO: 1830016 - RNA, 22 nt, Homo sapiens
gccagccggguaccucaguuuc

SEQ ID NO: 1830017 - RNA, 13 nt, Homo sapiens
ugagcaccuguaa

SEQ ID NO: 1830018 - RNA, 12 nt, Homo sapiens
augaugaugaug

SEQ ID NO: 1830019 - RNA, 17 nt, Homo sapiens
ccucuucgcugaccucg

SEQ ID NO: 1830020 - RNA, 21 nt, Homo sapiens
uuuacaauccuaaucauauug

SEQ ID NO: 1830021 - RNA, 19 nt, Homo sapiens
aacauacucuagugaaugu

SEQ ID NO: 1830022 - RNA, 18 nt, Homo sapiens
guauauauuuagugcugc

SEQ ID NO: 1830023 - RNA, 13 nt, Homo sapiens
uacauuugaucuu

SEQ ID NO: 1830024 - RNA, 16 nt, Homo sapiens
uagcaacccugugaua

SEQ ID NO: 1830025 - RNA, 15 nt, Homo sapiens
acccaggaguccaga

SEQ ID NO: 1830026 - RNA, 14 nt, Homo sapiens
aguaaaagugcuuu

SEQ ID NO: 1830027 - RNA, 17 nt, Homo sapiens
cccaggccuccagccuc

SEQ ID NO: 1830028 - RNA, 14 nt, Homo sapiens
aauaucuuccacag

SEQ ID NO: 1830029 - RNA, 19 nt, Homo sapiens
ugaauaucaggcuauuauu

SEQ ID NO: 1830030 - RNA, 16 nt, Homo sapiens
uaacaaauugcauuug

SEQ ID NO: 1830031 - RNA, 18 nt, Homo sapiens
aguaugauuuguuccuuu

SEQ ID NO: 1830032 - RNA, 22 nt, Homo sapiens
ucucugucccuugcuguaugcu

SEQ ID NO: 1830033 - RNA, 23 nt, Homo sapiens
auugaugccaagcuuuuuugcca

SEQ ID NO: 1830034 - RNA, 17 nt, Homo sapiens
aaaugcuuuccaugagu

SEQ ID NO: 1830035 - RNA, 18 nt, Homo sapiens
uacaggugcaagccacua

SEQ ID NO: 1830036 - RNA, 13 nt, Homo sapiens
gauaaacaucaca

SEQ ID NO: 1830037 - RNA, 20 nt, Homo sapiens
cugggggguggggacgccug

SEQ ID NO: 1830038 - RNA, 16 nt, Homo sapiens
agauagccccacagga

SEQ ID NO: 1830039 - RNA, 13 nt, Homo sapiens
uugugguacuguc

SEQ ID NO: 1830040 - RNA, 16 nt, Homo sapiens
cggcugcccgacucag

SEQ ID NO: 1830041 - RNA, 15 nt, Homo sapiens
uagacggaacagugu

SEQ ID NO: 1830042 - RNA, 15 nt, Homo sapiens
ucaaaauccuuccaa

SEQ ID NO: 1830043 - RNA, 18 nt, Homo sapiens
cagccaagagccaucuga

SEQ ID NO: 1830044 - RNA, 21 nt, Homo sapiens
ggcaacgugcgugucucugcc

SEQ ID NO: 1830045 - RNA, 20 nt, Homo sapiens
uauuugcauauguaugacuc

SEQ ID NO: 1830046 - RNA, 22 nt, Homo sapiens
uauuuacaacacuuuaaugggu

SEQ ID NO: 1830047 - RNA, 11 nt, Homo sapiens
cagaacagagg

SEQ ID NO: 1830048 - RNA, 14 nt, Homo sapiens
ugcuggcaguacug

SEQ ID NO: 1830049 - RNA, 18 nt, Homo sapiens
ucucaccuuaccugguga

SEQ ID NO: 1830050 - RNA, 18 nt, Homo sapiens
uagcaauuccccuacauc

SEQ ID NO: 1830051 - RNA, 16 nt, Homo sapiens
uagcuagaaugcacac

SEQ ID NO: 1830052 - RNA, 15 nt, Homo sapiens
cugccagugucuuag

SEQ ID NO: 1830053 - RNA, 23 nt, Homo sapiens
aaagggccuugacaucaguuccu

SEQ ID NO: 1830054 - RNA, 18 nt, Homo sapiens
guauaaguaauacuucag

SEQ ID NO: 1830055 - RNA, 20 nt, Homo sapiens
aguggugcuaucuuggcuca

SEQ ID NO: 1830056 - RNA, 22 nt, Homo sapiens
ccuugcugaccucccagccuuu

SEQ ID NO: 1830057 - RNA, 12 nt, Homo sapiens
auuguacuuuga

SEQ ID NO: 1830058 - RNA, 23 nt, Homo sapiens
ucuucccuacccuuccugccaag

SEQ ID NO: 1830059 - RNA, 16 nt, Homo sapiens
cagggcaugcuuuauu

SEQ ID NO: 1830060 - RNA, 17 nt, Homo sapiens
gaauacugggugcuguc

SEQ ID NO: 1830061 - RNA, 16 nt, Homo sapiens
acacuaaaaaaaugca

SEQ ID NO: 1830062 - RNA, 17 nt, Homo sapiens
agagccccacucucaga

SEQ ID NO: 1830063 - RNA, 17 nt, Homo sapiens
accaaccccgcggccca

SEQ ID NO: 1830064 - RNA, 22 nt, Homo sapiens
ccagccuggccaagagaccagc

SEQ ID NO: 1830065 - RNA, 15 nt, Homo sapiens
ugaugcuaguucuua

SEQ ID NO: 1830066 - RNA, 16 nt, Homo sapiens
uucagauuauuuccag

SEQ ID NO: 1830067 - RNA, 19 nt, Homo sapiens
cagcaaaauuguggcauuu

SEQ ID NO: 1830068 - RNA, 16 nt, Homo sapiens
ugugucuccaugcaca

SEQ ID NO: 1830069 - RNA, 18 nt, Homo sapiens
uaauauuguaaauacugg

SEQ ID NO: 1830070 - RNA, 12 nt, Homo sapiens
acuuuuccccau

SEQ ID NO: 1830071 - RNA, 14 nt, Homo sapiens
cuugcacacuuccc

SEQ ID NO: 1830072 - RNA, 14 nt, Homo sapiens
caaccccacaagca

SEQ ID NO: 1830073 - RNA, 18 nt, Homo sapiens
aauggccagugcugcuuc

SEQ ID NO: 1830074 - RNA, 14 nt, Homo sapiens
uuagacuccccuga

SEQ ID NO: 1830075 - RNA, 13 nt, Homo sapiens
aguguggucagag

SEQ ID NO: 1830076 - RNA, 15 nt, Homo sapiens
cuccagcaacugccc

SEQ ID NO: 1830077 - RNA, 19 nt, Homo sapiens
aaccgcaggaagcugcucc

SEQ ID NO: 1830078 - RNA, 17 nt, Homo sapiens
aacauucaaaagcacaa

SEQ ID NO: 1830079 - RNA, 17 nt, Homo sapiens
auaagugagaacaugca

SEQ ID NO: 1830080 - RNA, 12 nt, Homo sapiens
ucuacuaauucc

SEQ ID NO: 1830081 - RNA, 14 nt, Homo sapiens
uaaccucuacaggc

SEQ ID NO: 1830082 - RNA, 20 nt, Homo sapiens
aaacagugcaaggaagggca

SEQ ID NO: 1830083 - RNA, 18 nt, Homo sapiens
agguucuucagggccagu

SEQ ID NO: 1830084 - RNA, 17 nt, Homo sapiens
ugggauuauucuuugaa

SEQ ID NO: 1830085 - RNA, 11 nt, Homo sapiens
accaucuccua

SEQ ID NO: 1830086 - RNA, 14 nt, Homo sapiens
cccugaaagacuga

SEQ ID NO: 1830087 - RNA, 15 nt, Homo sapiens
cucacaggacuuccc

SEQ ID NO: 1830088 - RNA, 18 nt, Homo sapiens
uucaaugaaauaaaagca

SEQ ID NO: 1830089 - RNA, 17 nt, Homo sapiens
cacuggccaccaggcug

SEQ ID NO: 1830090 - RNA, 20 nt, Homo sapiens
ugacgagcaugagcuggaug

SEQ ID NO: 1830091 - RNA, 16 nt, Homo sapiens
ggccucccugccagua

SEQ ID NO: 1830092 - RNA, 21 nt, Homo sapiens
cuaaaauguagaaauucuaac

SEQ ID NO: 1830093 - RNA, 14 nt, Homo sapiens
ucuugaaaagccuu

SEQ ID NO: 1830094 - RNA, 20 nt, Homo sapiens
auggacugggaaaaacauca

SEQ ID NO: 1830095 - RNA, 12 nt, Homo sapiens
agggaaaacugc

SEQ ID NO: 1830096 - RNA, 16 nt, Homo sapiens
accuuauuagcuaaaa

SEQ ID NO: 1830097 - RNA, 20 nt, Homo sapiens
cuaacagaucagaacaugaa

SEQ ID NO: 1830098 - RNA, 14 nt, Homo sapiens
cauugccuuccuac

SEQ ID NO: 1830099 - RNA, 13 nt, Homo sapiens
uuuaggaagcaag

SEQ ID NO: 1830100 - RNA, 13 nt, Homo sapiens
gcagaccccaggu

SEQ ID NO: 1830101 - RNA, 13 nt, Homo sapiens
gucuuaucuacca

SEQ ID NO: 1830102 - RNA, 18 nt, Homo sapiens
uuauuagcauugaucuga

SEQ ID NO: 1830103 - RNA, 16 nt, Homo sapiens
auggagugcaccaaag

SEQ ID NO: 1830104 - RNA, 15 nt, Homo sapiens
agcuuucccagagac

SEQ ID NO: 1830105 - RNA, 23 nt, Homo sapiens
ggacucugucuuguucacugcag

SEQ ID NO: 1830106 - RNA, 19 nt, Homo sapiens
cagccacggggacucagcc

SEQ ID NO: 1830107 - RNA, 19 nt, Homo sapiens
agcuauauuauacaaauac

SEQ ID NO: 1830108 - RNA, 14 nt, Homo sapiens
gcacagauuuacuc

SEQ ID NO: 1830109 - RNA, 20 nt, Homo sapiens
ucccagccccggcaagccac

SEQ ID NO: 1830110 - RNA, 15 nt, Homo sapiens
aaggcagcuagacac

SEQ ID NO: 1830111 - RNA, 14 nt, Homo sapiens
gacugaaccagucc

SEQ ID NO: 1830112 - RNA, 20 nt, Homo sapiens
uugccccugagacaaaugga

SEQ ID NO: 1830113 - RNA, 20 nt, Homo sapiens
auauguacuuguuugcuaug

SEQ ID NO: 1830114 - RNA, 15 nt, Homo sapiens
ugguuugcaugacuu

SEQ ID NO: 1830115 - RNA, 23 nt, Homo sapiens
cauugucacaacaauuaaauaua

SEQ ID NO: 1830116 - RNA, 14 nt, Homo sapiens
cgcagacacaugug

SEQ ID NO: 1830117 - RNA, 17 nt, Homo sapiens
caguaauuccuguuacu

SEQ ID NO: 1830118 - RNA, 20 nt, Homo sapiens
uuaacagacucaaaccacau

SEQ ID NO: 1830119 - RNA, 22 nt, Homo sapiens
gcugcccuccuuguccacccac

SEQ ID NO: 1830120 - RNA, 14 nt, Homo sapiens
agacagaaucucag

SEQ ID NO: 1830121 - RNA, 14 nt, Homo sapiens
ugacacaaacucac

SEQ ID NO: 1830122 - RNA, 15 nt, Homo sapiens
augaucucaguauuu

SEQ ID NO: 1830123 - RNA, 15 nt, Homo sapiens
aggguuucauugucu

SEQ ID NO: 1830124 - RNA, 15 nt, Homo sapiens
agagaauuggcucaa

SEQ ID NO: 1830125 - RNA, 18 nt, Homo sapiens
uaggaagggaucugagaa

SEQ ID NO: 1830126 - RNA, 11 nt, Homo sapiens
acaacuuccug

SEQ ID NO: 1830127 - RNA, 22 nt, Homo sapiens
gcauguaccccagguacaucca

SEQ ID NO: 1830128 - RNA, 23 nt, Homo sapiens
cugacaaugggcacugauuugau

SEQ ID NO: 1830129 - RNA, 17 nt, Homo sapiens
caugugauguguugcuc

SEQ ID NO: 1830130 - RNA, 17 nt, Homo sapiens
cuuagcaggaauuuaau

SEQ ID NO: 1830131 - RNA, 18 nt, Homo sapiens
cgaguacagaguggcccu

SEQ ID NO: 1830132 - RNA, 18 nt, Homo sapiens
caggccugcuagucacug

SEQ ID NO: 1830133 - RNA, 20 nt, Homo sapiens
acuguaaaggcaagccagca

SEQ ID NO: 1830134 - RNA, 15 nt, Homo sapiens
cagauggcagguuug

SEQ ID NO: 1830135 - RNA, 14 nt, Homo sapiens
uuauuggauucaca

SEQ ID NO: 1830136 - RNA, 20 nt, Homo sapiens
aaguagcugggaccacaagu

SEQ ID NO: 1830137 - RNA, 16 nt, Homo sapiens
cuuaauaaacauguca

SEQ ID NO: 1830138 - RNA, 15 nt, Homo sapiens
gacuggaguggagca

SEQ ID NO: 1830139 - RNA, 17 nt, Homo sapiens
caccuccucugugauuu

SEQ ID NO: 1830140 - RNA, 17 nt, Homo sapiens
aucagggccugagugac

SEQ ID NO: 1830141 - RNA, 17 nt, Homo sapiens
cagauucacacaugcca

SEQ ID NO: 1830142 - RNA, 15 nt, Homo sapiens
auccaauugcugcuu

SEQ ID NO: 1830143 - RNA, 14 nt, Homo sapiens
agcugcauggcaca

SEQ ID NO: 1830144 - RNA, 16 nt, Homo sapiens
gcccugcuuugcaaac

SEQ ID NO: 1830145 - RNA, 15 nt, Homo sapiens
cuguaggaagucauc

SEQ ID NO: 1830146 - RNA, 20 nt, Homo sapiens
ucagaaauaugacaauuaau

SEQ ID NO: 1830147 - RNA, 12 nt, Homo sapiens
aagaaaacugau

SEQ ID NO: 1830148 - RNA, 19 nt, Homo sapiens
ucuuucugucugcuuuaaa

SEQ ID NO: 1830149 - RNA, 16 nt, Homo sapiens
ucuccagaaagcucau

SEQ ID NO: 1830150 - RNA, 15 nt, Homo sapiens
ugcccaaaugugauu

SEQ ID NO: 1830151 - RNA, 15 nt, Homo sapiens
accaauuaauguagc

SEQ ID NO: 1830152 - RNA, 22 nt, Homo sapiens
uuagggagcagaugacugagaa

SEQ ID NO: 1830153 - RNA, 15 nt, Homo sapiens
guggccacacaggca

SEQ ID NO: 1830154 - RNA, 14 nt, Homo sapiens
acuauucaaugcaa

SEQ ID NO: 1830155 - RNA, 16 nt, Homo sapiens
cugugcugggugagcu

SEQ ID NO: 1830156 - RNA, 16 nt, Homo sapiens
cugcuuacuaaugugc

SEQ ID NO: 1830157 - RNA, 13 nt, Homo sapiens
ugaggaauggagg

SEQ ID NO: 1830158 - RNA, 20 nt, Homo sapiens
ugcugaguuugugcuggugu

SEQ ID NO: 1830159 - RNA, 17 nt, Homo sapiens
caaagaguaguuaaaag

SEQ ID NO: 1830160 - RNA, 14 nt, Homo sapiens
uguucaguacucua

SEQ ID NO: 1830161 - RNA, 12 nt, Homo sapiens
uuguuccucuuu

SEQ ID NO: 1830162 - RNA, 20 nt, Homo sapiens
uauuuucauuauacaugaaa

SEQ ID NO: 1830163 - RNA, 17 nt, Homo sapiens
aaauauuagaugugauu

SEQ ID NO: 1830164 - RNA, 18 nt, Homo sapiens
uccaaggauuaaaucugg

SEQ ID NO: 1830165 - RNA, 15 nt, Homo sapiens
uaaauguaacuuauu

SEQ ID NO: 1830166 - RNA, 20 nt, Homo sapiens
caucccagacacauucacac

SEQ ID NO: 1830167 - RNA, 20 nt, Homo sapiens
uugugguuuauugaauguga

SEQ ID NO: 1830168 - RNA, 14 nt, Homo sapiens
uauucugggggccc

SEQ ID NO: 1830169 - RNA, 14 nt, Homo sapiens
ucuuuccccaccuc

SEQ ID NO: 1830170 - RNA, 14 nt, Homo sapiens
gggcagcaaccccu

SEQ ID NO: 1830171 - RNA, 18 nt, Homo sapiens
ucaaaaggagaacugugc

SEQ ID NO: 1830172 - RNA, 23 nt, Homo sapiens
ucugcagggggugugucugcuca

SEQ ID NO: 1830173 - RNA, 16 nt, Homo sapiens
gcauuuuuagcuccuu

SEQ ID NO: 1830174 - RNA, 13 nt, Homo sapiens
caguuuuccagga

SEQ ID NO: 1830175 - RNA, 13 nt, Homo sapiens
cauuuuuccauga

SEQ ID NO: 1830176 - RNA, 14 nt, Homo sapiens
uugucauauggaau

SEQ ID NO: 1830177 - RNA, 13 nt, Homo sapiens
agcagcuggugcu

SEQ ID NO: 1830178 - RNA, 13 nt, Homo sapiens
ggccgucuucacu

SEQ ID NO: 1830179 - RNA, 11 nt, Homo sapiens
ggccuccagaa

SEQ ID NO: 1830180 - RNA, 23 nt, Homo sapiens
auuuuaguauucauucugcauug

SEQ ID NO: 1830181 - RNA, 16 nt, Homo sapiens
aaagaaaaggugucau

SEQ ID NO: 1830182 - RNA, 18 nt, Homo sapiens
cccugugccagaccucaa

SEQ ID NO: 1830183 - RNA, 14 nt, Homo sapiens
gaggcagaggacag

SEQ ID NO: 1830184 - RNA, 15 nt, Homo sapiens
uuuauucccccaaag

SEQ ID NO: 1830185 - RNA, 22 nt, Homo sapiens
agcagcaucuacucuaggcaua

SEQ ID NO: 1830186 - RNA, 14 nt, Homo sapiens
gggacuguuccaaa

SEQ ID NO: 1830187 - RNA, 14 nt, Homo sapiens
uggaaugugccaca

SEQ ID NO: 1830188 - RNA, 16 nt, Homo sapiens
uugaugaugcaguuuu

SEQ ID NO: 1830189 - RNA, 20 nt, Homo sapiens
gcagucucucucugccaugg

SEQ ID NO: 1830190 - RNA, 14 nt, Homo sapiens
uccaaacagugugu

SEQ ID NO: 1830191 - RNA, 23 nt, Homo sapiens
aacacauuuaaacaucaguauua

SEQ ID NO: 1830192 - RNA, 19 nt, Homo sapiens
uaggcauucuaagucacag

SEQ ID NO: 1830193 - RNA, 12 nt, Homo sapiens
cuccauucauag

SEQ ID NO: 1830194 - RNA, 16 nt, Homo sapiens
ucuuaaaaugcaauau

SEQ ID NO: 1830195 - RNA, 15 nt, Homo sapiens
uuuauauuacuuuug

SEQ ID NO: 1830196 - RNA, 18 nt, Homo sapiens
cacacacaugaguguaga

SEQ ID NO: 1830197 - RNA, 21 nt, Homo sapiens
caaguugugcaugcaaccaga

SEQ ID NO: 1830198 - RNA, 15 nt, Homo sapiens
aauuuccucugacau

SEQ ID NO: 1830199 - RNA, 18 nt, Homo sapiens
cacaaacagaaaacaugu

SEQ ID NO: 1830200 - RNA, 11 nt, Homo sapiens
uccucacuccc

SEQ ID NO: 1830201 - RNA, 19 nt, Homo sapiens
ucugauuaacuauuccuau

SEQ ID NO: 1830202 - RNA, 15 nt, Homo sapiens
agccacaggaccacc

SEQ ID NO: 1830203 - RNA, 21 nt, Homo sapiens
auuuguuguuuuuaacaacua

SEQ ID NO: 1830204 - RNA, 22 nt, Homo sapiens
uucuguccugugagguuuccca

SEQ ID NO: 1830205 - RNA, 16 nt, Homo sapiens
acaguguuuccugagu

SEQ ID NO: 1830206 - RNA, 22 nt, Homo sapiens
uuuucugaagcuacuuucuuaa

SEQ ID NO: 1830207 - RNA, 19 nt, Homo sapiens
ccugcaggcgugaccugac

SEQ ID NO: 1830208 - RNA, 23 nt, Homo sapiens
ucagaggucuaauuuaguagaaa

SEQ ID NO: 1830209 - RNA, 22 nt, Homo sapiens
ugcacagcaggaccugugcuuu

SEQ ID NO: 1830210 - RNA, 23 nt, Homo sapiens
auaacuggaaaacagaacacuua

SEQ ID NO: 1830211 - RNA, 14 nt, Homo sapiens
aucuaaggacaagg

SEQ ID NO: 1830212 - RNA, 14 nt, Homo sapiens
uugcuggaugcauu

SEQ ID NO: 1830213 - RNA, 14 nt, Homo sapiens
acuaaacaguaaga

SEQ ID NO: 1830214 - RNA, 12 nt, Homo sapiens
gaauauuugcca

SEQ ID NO: 1830215 - RNA, 17 nt, Homo sapiens
ccuagguauuuacccaa

SEQ ID NO: 1830216 - RNA, 17 nt, Homo sapiens
ucaagguucuaacccua

SEQ ID NO: 1830217 - RNA, 22 nt, Homo sapiens
cuccagcuguacuagugccauu

SEQ ID NO: 1830218 - RNA, 23 nt, Homo sapiens
gaaaccccaucucuacuaaaaau

SEQ ID NO: 1830219 - RNA, 15 nt, Homo sapiens
cagagccucaaauga

SEQ ID NO: 1830220 - RNA, 23 nt, Homo sapiens
aauaaaaauguucuuacacaagg

SEQ ID NO: 1830221 - RNA, 19 nt, Homo sapiens
gcgugugacagucuugcau

SEQ ID NO: 1830222 - RNA, 15 nt, Homo sapiens
agaacuaaaucauag

SEQ ID NO: 1830223 - RNA, 20 nt, Homo sapiens
auuucagugaauuugcacug

SEQ ID NO: 1830224 - RNA, 15 nt, Homo sapiens
caugaaagcagcaca

SEQ ID NO: 1830225 - RNA, 17 nt, Homo sapiens
agccaauaccagccgcc

SEQ ID NO: 1830226 - RNA, 15 nt, Homo sapiens
guccccucauaggau

SEQ ID NO: 1830227 - RNA, 15 nt, Homo sapiens
caauucccaccacua

SEQ ID NO: 1830228 - RNA, 17 nt, Homo sapiens
cccuuggcuucugugau

SEQ ID NO: 1830229 - RNA, 20 nt, Homo sapiens
aauauguuucacccuguccc

SEQ ID NO: 1830230 - RNA, 19 nt, Homo sapiens
gacucaaauguucuaaguu

SEQ ID NO: 1830231 - RNA, 21 nt, Homo sapiens
ccuuguuauuuuauugccuuu

SEQ ID NO: 1830232 - RNA, 23 nt, Homo sapiens
aaacuuugccaaauauaaucuca

SEQ ID NO: 1830233 - RNA, 16 nt, Homo sapiens
ccccgcccagugcagu

SEQ ID NO: 1830234 - RNA, 13 nt, Homo sapiens
cucacaagcacuu

SEQ ID NO: 1830235 - RNA, 22 nt, Homo sapiens
acuauccucacucccauaagcu

SEQ ID NO: 1830236 - RNA, 15 nt, Homo sapiens
aaaguuuaaccuaaa

SEQ ID NO: 1830237 - RNA, 15 nt, Homo sapiens
ugagaccucaaugaa

SEQ ID NO: 1830238 - RNA, 16 nt, Homo sapiens
gcaguuaauucuugcc

SEQ ID NO: 1830239 - RNA, 12 nt, Homo sapiens
aaaaugagacaa

SEQ ID NO: 1830240 - RNA, 13 nt, Homo sapiens
gcacggcuuccca

SEQ ID NO: 1830241 - RNA, 13 nt, Homo sapiens
uggauaaucugag

SEQ ID NO: 1830242 - RNA, 17 nt, Homo sapiens
uauuaaucauagauuau

SEQ ID NO: 1830243 - RNA, 15 nt, Homo sapiens
acucaacauuacauu

SEQ ID NO: 1830244 - RNA, 15 nt, Homo sapiens
aaauuauagcucuaa

SEQ ID NO: 1830245 - RNA, 14 nt, Homo sapiens
caaacaggaacacu

SEQ ID NO: 1830246 - RNA, 18 nt, Homo sapiens
gaacucugggcacuuuug

SEQ ID NO: 1830247 - RNA, 18 nt, Homo sapiens
cauccagagaccaaauaa

SEQ ID NO: 1830248 - RNA, 13 nt, Homo sapiens
cucuuacagcuuu

SEQ ID NO: 1830249 - RNA, 17 nt, Homo sapiens
aggagauaauuguuuca

SEQ ID NO: 1830250 - RNA, 18 nt, Homo sapiens
agggcugcgagcauuucc

SEQ ID NO: 1830251 - RNA, 21 nt, Homo sapiens
agucccugacuaacagccuca

SEQ ID NO: 1830252 - RNA, 16 nt, Homo sapiens
agaauggaugugcuca

SEQ ID NO: 1830253 - RNA, 13 nt, Homo sapiens
uucagaagcugau

SEQ ID NO: 1830254 - RNA, 16 nt, Homo sapiens
uguucaugcacacuug

SEQ ID NO: 1830255 - RNA, 14 nt, Homo sapiens
uuuucugccaggga

SEQ ID NO: 1830256 - RNA, 17 nt, Homo sapiens
agauguucccggagcag

SEQ ID NO: 1830257 - RNA, 23 nt, Homo sapiens
acaugucuuuucuuccacugccu

SEQ ID NO: 1830258 - RNA, 20 nt, Homo sapiens
gaugugucccaucuagggaa

SEQ ID NO: 1830259 - RNA, 13 nt, Homo sapiens
uuucauaguucug

SEQ ID NO: 1830260 - RNA, 19 nt, Homo sapiens
gaaauacccaacgcacaaa

SEQ ID NO: 1830261 - RNA, 20 nt, Homo sapiens
gcagagcccgaauuccugac

SEQ ID NO: 1830262 - RNA, 17 nt, Homo sapiens
agaacagcauggcccga

SEQ ID NO: 1830263 - RNA, 19 nt, Homo sapiens
cugguuaccaccagccuuu

SEQ ID NO: 1830264 - RNA, 20 nt, Homo sapiens
caguuaauaaaccuuugcaa

SEQ ID NO: 1830265 - RNA, 14 nt, Homo sapiens
uuuaacugcauaau

SEQ ID NO: 1830266 - RNA, 22 nt, Homo sapiens
cauuuguggguuuuuauuuccu

SEQ ID NO: 1830267 - RNA, 21 nt, Homo sapiens
ccagccucuagaacagccaga

SEQ ID NO: 1830268 - RNA, 14 nt, Homo sapiens
ggcaagaagaucac

SEQ ID NO: 1830269 - RNA, 22 nt, Homo sapiens
uuuauaccagcuuaugagcuca

SEQ ID NO: 1830270 - RNA, 22 nt, Homo sapiens
acauacauugauucaugucuca

SEQ ID NO: 1830271 - RNA, 15 nt, Homo sapiens
ugggaacacagugcc

SEQ ID NO: 1830272 - RNA, 15 nt, Homo sapiens
acuuggucugugaga

SEQ ID NO: 1830273 - RNA, 15 nt, Homo sapiens
gcaucaagaugugac

SEQ ID NO: 1830274 - RNA, 22 nt, Homo sapiens
ucaaccaacaacaauguguugu

SEQ ID NO: 1830275 - RNA, 17 nt, Homo sapiens
auugucacaacacugaa

SEQ ID NO: 1830276 - RNA, 20 nt, Homo sapiens
cugggaccccagcugcucua

SEQ ID NO: 1830277 - RNA, 19 nt, Homo sapiens
cuuuagaccuauuuuugaa

SEQ ID NO: 1830278 - RNA, 12 nt, Homo sapiens
ugcuuauaucau

SEQ ID NO: 1830279 - RNA, 20 nt, Homo sapiens
aauggcaggugucauaugac

SEQ ID NO: 1830280 - RNA, 18 nt, Homo sapiens
cugcacagaaacuugaac

SEQ ID NO: 1830281 - RNA, 19 nt, Homo sapiens
acaagggguggaagggcag

SEQ ID NO: 1830282 - RNA, 18 nt, Homo sapiens
ccugggugugugaagcug

SEQ ID NO: 1830283 - RNA, 23 nt, Homo sapiens
aaacuguucucuauuagacuuua

SEQ ID NO: 1830284 - RNA, 18 nt, Homo sapiens
accuucaagaaccaggca

SEQ ID NO: 1830285 - RNA, 18 nt, Homo sapiens
ggccccggccuugggaga

SEQ ID NO: 1830286 - RNA, 21 nt, Homo sapiens
augagguuucuuugacuucaa

SEQ ID NO: 1830287 - RNA, 21 nt, Homo sapiens
ugauacgcuuaagguggaaag

SEQ ID NO: 1830288 - RNA, 16 nt, Homo sapiens
acugaaggcauaugca

SEQ ID NO: 1830289 - RNA, 13 nt, Homo sapiens
ccucuacugccuu

SEQ ID NO: 1830290 - RNA, 15 nt, Homo sapiens
caggagcacugcaug

SEQ ID NO: 1830291 - RNA, 16 nt, Homo sapiens
aacauuacauugccau

SEQ ID NO: 1830292 - RNA, 12 nt, Homo sapiens
gauaaccaggcu

SEQ ID NO: 1830293 - RNA, 12 nt, Homo sapiens
ggcaaccagauu

SEQ ID NO: 1830294 - RNA, 21 nt, Homo sapiens
ccagcuucaaacuauacuaca

SEQ ID NO: 1830295 - RNA, 12 nt, Homo sapiens
uucagauauuau

SEQ ID NO: 1830296 - RNA, 14 nt, Homo sapiens
acgucugacaggca

SEQ ID NO: 1830297 - RNA, 17 nt, Homo sapiens
ccuugcuuuugcuucua

SEQ ID NO: 1830298 - RNA, 13 nt, Homo sapiens
cauuaaaaagccu

SEQ ID NO: 1830299 - RNA, 13 nt, Homo sapiens
gagacugcaaugu

SEQ ID NO: 1830300 - RNA, 22 nt, Homo sapiens
uuuaugucucagaccacuauuc

SEQ ID NO: 1830301 - RNA, 13 nt, Homo sapiens
ucggccucuccac

SEQ ID NO: 1830302 - RNA, 15 nt, Homo sapiens
auggcacccacacag

SEQ ID NO: 1830303 - RNA, 20 nt, Homo sapiens
cuggcacauuggaaagcaca

SEQ ID NO: 1830304 - RNA, 22 nt, Homo sapiens
guucagaacucguuaaagcaaa

SEQ ID NO: 1830305 - RNA, 18 nt, Homo sapiens
uggagugcaguggcauga

SEQ ID NO: 1830306 - RNA, 20 nt, Homo sapiens
auaacaaccugggcauuccu

SEQ ID NO: 1830307 - RNA, 16 nt, Homo sapiens
uuagcuaacaaaagau

SEQ ID NO: 1830308 - RNA, 17 nt, Homo sapiens
aauauucauuuuacuca

SEQ ID NO: 1830309 - RNA, 15 nt, Homo sapiens
ccugcgccaccucac

SEQ ID NO: 1830310 - RNA, 15 nt, Homo sapiens
cacuugccaauguac

SEQ ID NO: 1830311 - RNA, 13 nt, Homo sapiens
cuaaguagaguau

SEQ ID NO: 1830312 - RNA, 22 nt, Homo sapiens
caugauaaaaagaaaugugauu

SEQ ID NO: 1830313 - RNA, 16 nt, Homo sapiens
acuucauauaacugag

SEQ ID NO: 1830314 - RNA, 21 nt, Homo sapiens
cugguuuuacuagugugcaag

SEQ ID NO: 1830315 - RNA, 15 nt, Homo sapiens
uucaugcccacugcc

SEQ ID NO: 1830316 - RNA, 23 nt, Homo sapiens
ugaucaggaccuccaagccacug

SEQ ID NO: 1830317 - RNA, 12 nt, Homo sapiens
uaauugguucuu

SEQ ID NO: 1830318 - RNA, 20 nt, Homo sapiens
gauucaggggucugaugaca

SEQ ID NO: 1830319 - RNA, 19 nt, Homo sapiens
ugaauucucugcucaguga

SEQ ID NO: 1830320 - RNA, 13 nt, Homo sapiens
agaccacaaauag

SEQ ID NO: 1830321 - RNA, 16 nt, Homo sapiens
ucuuuccugaaccaug

SEQ ID NO: 1830322 - RNA, 19 nt, Homo sapiens
agacucagacauuggcacc

SEQ ID NO: 1830323 - RNA, 18 nt, Homo sapiens
guaucuauucuucugacc

SEQ ID NO: 1830324 - RNA, 15 nt, Homo sapiens
agaacuuuucuuacu

SEQ ID NO: 1830325 - RNA, 24 nt, Homo sapiens
cucugagagggaaaggucuguccu

SEQ ID NO: 1830326 - RNA, 19 nt, Homo sapiens
gaauagcuuugaauguggc

SEQ ID NO: 1830327 - RNA, 18 nt, Homo sapiens
gaacaaaaauugagacau

SEQ ID NO: 1830328 - RNA, 12 nt, Homo sapiens
agaaccaaagca

SEQ ID NO: 1830329 - RNA, 19 nt, Homo sapiens
uccugcagaaguacuccua

SEQ ID NO: 1830330 - RNA, 22 nt, Homo sapiens
gugaaaaaaacaaccuacagaa

SEQ ID NO: 1830331 - RNA, 21 nt, Homo sapiens
caggauugccauaugugcaaa

SEQ ID NO: 1830332 - RNA, 19 nt, Homo sapiens
uauccauguaauaagcacu

SEQ ID NO: 1830333 - RNA, 13 nt, Homo sapiens
ucacuaaaagugu

SEQ ID NO: 1830334 - RNA, 12 nt, Homo sapiens
gggggcugugag

SEQ ID NO: 1830335 - RNA, 13 nt, Homo sapiens
gaugcacauuucu

SEQ ID NO: 1830336 - RNA, 14 nt, Homo sapiens
auugugcagauauu

SEQ ID NO: 1830337 - RNA, 14 nt, Homo sapiens
aacuccugccugag

SEQ ID NO: 1830338 - RNA, 17 nt, Homo sapiens
ggcucagacauguuuuc

SEQ ID NO: 1830339 - RNA, 21 nt, Homo sapiens
acucauuugcugacacaucag

SEQ ID NO: 1830340 - RNA, 18 nt, Homo sapiens
uucuaaucccagcacuuu

SEQ ID NO: 1830341 - RNA, 11 nt, Homo sapiens
auggcacugag

SEQ ID NO: 1830342 - RNA, 18 nt, Homo sapiens
cuauuaagauacuuagau

SEQ ID NO: 1830343 - RNA, 20 nt, Homo sapiens
uacucauaaaggacacugga

SEQ ID NO: 1830344 - RNA, 13 nt, Homo sapiens
caaucacguggaa

SEQ ID NO: 1830345 - RNA, 21 nt, Homo sapiens
augaagggacccuuugggggu

SEQ ID NO: 1830346 - RNA, 24 nt, Homo sapiens
aggcaaaucagguaaaauagucau

SEQ ID NO: 1830347 - RNA, 17 nt, Homo sapiens
gauauauaccacuuucc

SEQ ID NO: 1830348 - RNA, 23 nt, Homo sapiens
uuauuugcuaccacagcaacuau

SEQ ID NO: 1830349 - RNA, 23 nt, Homo sapiens
uaugacucagagaaccagugcag

SEQ ID NO: 1830350 - RNA, 12 nt, Homo sapiens
uuuuccuauaau

SEQ ID NO: 1830351 - RNA, 20 nt, Homo sapiens
ccaagcccuccacauuuuca

SEQ ID NO: 1830352 - RNA, 20 nt, Homo sapiens
cacccaggcugcagugcaau

SEQ ID NO: 1830353 - RNA, 22 nt, Homo sapiens
uugguguaaaccauucuuggga

SEQ ID NO: 1830354 - RNA, 17 nt, Homo sapiens
cuuacauguguaaaggu

SEQ ID NO: 1830355 - RNA, 14 nt, Homo sapiens
guaccaagcauuua

SEQ ID NO: 1830356 - RNA, 14 nt, Homo sapiens
gcuuccuucaggac

SEQ ID NO: 1830357 - RNA, 16 nt, Homo sapiens
cagucuccccacucca

SEQ ID NO: 1830358 - RNA, 14 nt, Homo sapiens
uggacugugccugg

SEQ ID NO: 1830359 - RNA, 17 nt, Homo sapiens
uuuccaagggucuuccu

SEQ ID NO: 1830360 - RNA, 19 nt, Homo sapiens
aaaaaacaccaggauuuaa

SEQ ID NO: 1830361 - RNA, 18 nt, Homo sapiens
ucacggcugcgcacugug

SEQ ID NO: 1830362 - RNA, 20 nt, Homo sapiens
ccagaagccugaugugagug

SEQ ID NO: 1830363 - RNA, 18 nt, Homo sapiens
guauucgaaaccugugau

SEQ ID NO: 1830364 - RNA, 16 nt, Homo sapiens
cugauaacaacaggga

SEQ ID NO: 1830365 - RNA, 22 nt, Homo sapiens
gcccagucuuuggagagcucag

SEQ ID NO: 1830366 - RNA, 20 nt, Homo sapiens
aagacuuggguugaucucuu

SEQ ID NO: 1830367 - RNA, 14 nt, Homo sapiens
cacuuuucauauca

SEQ ID NO: 1830368 - RNA, 13 nt, Homo sapiens
aucugaacucuca

SEQ ID NO: 1830369 - RNA, 21 nt, Homo sapiens
ccauguacuucccucuugaaa

SEQ ID NO: 1830370 - RNA, 16 nt, Homo sapiens
acugaaucuaccugcc

SEQ ID NO: 1830371 - RNA, 14 nt, Homo sapiens
cugcaacaaaaagu

SEQ ID NO: 1830372 - RNA, 13 nt, Homo sapiens
aagaagcauuucu

SEQ ID NO: 1830373 - RNA, 20 nt, Homo sapiens
aaccacaccuacccagggcu

SEQ ID NO: 1830374 - RNA, 19 nt, Homo sapiens
acuucuggcacugugacua

SEQ ID NO: 1830375 - RNA, 20 nt, Homo sapiens
agguagaccaggugcucagc

SEQ ID NO: 1830376 - RNA, 23 nt, Homo sapiens
ucuuuccuaagaaagacaucaca

SEQ ID NO: 1830377 - RNA, 16 nt, Homo sapiens
cagaaaacauaugcau

SEQ ID NO: 1830378 - RNA, 22 nt, Homo sapiens
ugccaggcccucuccugccaca

SEQ ID NO: 1830379 - RNA, 18 nt, Homo sapiens
ggcucucuuaggcaugua

SEQ ID NO: 1830380 - RNA, 15 nt, Homo sapiens
cugcacacugcacau

SEQ ID NO: 1830381 - RNA, 23 nt, Homo sapiens
cauaacauaaauuuaucaucucg

SEQ ID NO: 1830382 - RNA, 13 nt, Homo sapiens
cuccccacuccac

SEQ ID NO: 1830383 - RNA, 18 nt, Homo sapiens
auacgaccgggaggucca

SEQ ID NO: 1830384 - RNA, 20 nt, Homo sapiens
cgauucaucuacccugcuga

SEQ ID NO: 1830385 - RNA, 23 nt, Homo sapiens
caacccugugaucuauaccaccu

SEQ ID NO: 1830386 - RNA, 21 nt, Homo sapiens
agcuccgugaacuugugagaa

SEQ ID NO: 1830387 - RNA, 22 nt, Homo sapiens
ccuuugggaggcagcaucaggg

SEQ ID NO: 1830388 - RNA, 19 nt, Homo sapiens
cucuggggacccuccagag

SEQ ID NO: 1830389 - RNA, 14 nt, Homo sapiens
cacaauaaccuuau

SEQ ID NO: 1830390 - RNA, 19 nt, Homo sapiens
auuugcauaacaauuccuc

SEQ ID NO: 1830391 - RNA, 21 nt, Homo sapiens
acauccugaccuccuggacug

SEQ ID NO: 1830392 - RNA, 18 nt, Homo sapiens
cuuggagcuaaaacuggc

SEQ ID NO: 1830393 - RNA, 13 nt, Homo sapiens
aucaccaccacac

SEQ ID NO: 1830394 - RNA, 13 nt, Homo sapiens
cagcacacaugca

SEQ ID NO: 1830395 - RNA, 17 nt, Homo sapiens
cagauccugcagucaau

SEQ ID NO: 1830396 - RNA, 17 nt, Homo sapiens
aaacuuuggcuuauaaa

SEQ ID NO: 1830397 - RNA, 20 nt, Homo sapiens
auuuugggacuucuacccag

SEQ ID NO: 1830398 - RNA, 23 nt, Homo sapiens
cauggagcuugacuucaugccag

SEQ ID NO: 1830399 - RNA, 19 nt, Homo sapiens
uauggcauguguaguuaau

SEQ ID NO: 1830400 - RNA, 22 nt, Homo sapiens
uuggguucacagaagcacagca

SEQ ID NO: 1830401 - RNA, 15 nt, Homo sapiens
aguuccuucugcucc

SEQ ID NO: 1830402 - RNA, 13 nt, Homo sapiens
accauuuccucag

SEQ ID NO: 1830403 - RNA, 16 nt, Homo sapiens
gauauuaucuaccugu

SEQ ID NO: 1830404 - RNA, 16 nt, Homo sapiens
cacuuuguuuaugcau

SEQ ID NO: 1830405 - RNA, 13 nt, Homo sapiens
caauuugccuuuu

SEQ ID NO: 1830406 - RNA, 19 nt, Homo sapiens
cuccuuuguguguguguca

SEQ ID NO: 1830407 - RNA, 17 nt, Homo sapiens
accugaaucagcuggac

SEQ ID NO: 1830408 - RNA, 13 nt, Homo sapiens
caggagugacuca

SEQ ID NO: 1830409 - RNA, 14 nt, Homo sapiens
aaaagaauuaccaa

SEQ ID NO: 1830410 - RNA, 15 nt, Homo sapiens
aguggcacucugugu

SEQ ID NO: 1830411 - RNA, 19 nt, Homo sapiens
gacagcaggaagccauaga

SEQ ID NO: 1830412 - RNA, 15 nt, Homo sapiens
ucacuacaguacagu

SEQ ID NO: 1830413 - RNA, 16 nt, Homo sapiens
agaaauuuuaucucuu

SEQ ID NO: 1830414 - RNA, 15 nt, Homo sapiens
uuaaagaaccaucag

SEQ ID NO: 1830415 - RNA, 22 nt, Homo sapiens
uaaggccagcuagagcuuccac

SEQ ID NO: 1830416 - RNA, 20 nt, Homo sapiens
gcauugggguuccucuguac

SEQ ID NO: 1830417 - RNA, 19 nt, Homo sapiens
accaauggauuguggaaaa

SEQ ID NO: 1830418 - RNA, 23 nt, Homo sapiens
ugcuccagucauugcacaaggca

SEQ ID NO: 1830419 - RNA, 22 nt, Homo sapiens
uugaaagcagaagaagacagac

SEQ ID NO: 1830420 - RNA, 21 nt, Homo sapiens
caguugaauaaaagugcacac

SEQ ID NO: 1830421 - RNA, 19 nt, Homo sapiens
ucccgaagccugagcucau

SEQ ID NO: 1830422 - RNA, 19 nt, Homo sapiens
cagcaggacacugauccag

SEQ ID NO: 1830423 - RNA, 17 nt, Homo sapiens
ugcauuuaauuuauuga

SEQ ID NO: 1830424 - RNA, 17 nt, Homo sapiens
gucacugacacaaagga

SEQ ID NO: 1830425 - RNA, 14 nt, Homo sapiens
uggcugcugcugug

SEQ ID NO: 1830426 - RNA, 17 nt, Homo sapiens
cacggcccguggcuguu

SEQ ID NO: 1830427 - RNA, 19 nt, Homo sapiens
cugaccaaugugugaagua

SEQ ID NO: 1830428 - RNA, 16 nt, Homo sapiens
caugacauugcauuug

SEQ ID NO: 1830429 - RNA, 20 nt, Homo sapiens
aagcagugaauaguaacaau

SEQ ID NO: 1830430 - RNA, 14 nt, Homo sapiens
augacaacuggaau

SEQ ID NO: 1830431 - RNA, 18 nt, Homo sapiens
cuaugauaagauugaaau

SEQ ID NO: 1830432 - RNA, 20 nt, Homo sapiens
aaaugguggcuucagcucca

SEQ ID NO: 1830433 - RNA, 13 nt, Homo sapiens
uugacugcugcuc

SEQ ID NO: 1830434 - RNA, 22 nt, Homo sapiens
ugagagcuggcccagggguccc

SEQ ID NO: 1830435 - RNA, 20 nt, Homo sapiens
ccuuucagcaauccaugaga

SEQ ID NO: 1830436 - RNA, 20 nt, Homo sapiens
cauguucaaagugugacauu

SEQ ID NO: 1830437 - RNA, 19 nt, Homo sapiens
agaucugcacucaccucac

SEQ ID NO: 1830438 - RNA, 16 nt, Homo sapiens
ccaaaagcugcucagg

SEQ ID NO: 1830439 - RNA, 22 nt, Homo sapiens
aucaaauugugcaguacuuugu

SEQ ID NO: 1830440 - RNA, 12 nt, Homo sapiens
aaugacagaucu

SEQ ID NO: 1830441 - RNA, 22 nt, Homo sapiens
agagaagcugugucuuuagaca

SEQ ID NO: 1830442 - RNA, 22 nt, Homo sapiens
gaggacagccugccucugccac

SEQ ID NO: 1830443 - RNA, 18 nt, Homo sapiens
agcugugaagacuugccu

SEQ ID NO: 1830444 - RNA, 14 nt, Homo sapiens
guguuuguuggcaa

SEQ ID NO: 1830445 - RNA, 16 nt, Homo sapiens
ggcucaugaccuggaa

SEQ ID NO: 1830446 - RNA, 16 nt, Homo sapiens
ugccuucuuauugcuu

SEQ ID NO: 1830447 - RNA, 21 nt, Homo sapiens
aggggaccacaccucccugaa

SEQ ID NO: 1830448 - RNA, 21 nt, Homo sapiens
agucaggcuacuaaaauauua

SEQ ID NO: 1830449 - RNA, 16 nt, Homo sapiens
gccugaugagacucca

SEQ ID NO: 1830450 - RNA, 15 nt, Homo sapiens
cacucaaccaugacc

SEQ ID NO: 1830451 - RNA, 13 nt, Homo sapiens
guugcccugccau

SEQ ID NO: 1830452 - RNA, 19 nt, Homo sapiens
cuuaaacuaauacgugcca

SEQ ID NO: 1830453 - RNA, 20 nt, Homo sapiens
aauuugaaaugguugucacc

SEQ ID NO: 1830454 - RNA, 22 nt, Homo sapiens
gcaccuccucaccuuaauuuau

SEQ ID NO: 1830455 - RNA, 21 nt, Homo sapiens
uguaacaagaaaguggucugu

SEQ ID NO: 1830456 - RNA, 18 nt, Homo sapiens
cuguagcucaaguuuaaa

SEQ ID NO: 1830457 - RNA, 13 nt, Homo sapiens
ggcuaaauggaag

SEQ ID NO: 1830458 - RNA, 20 nt, Homo sapiens
aggaagaaaaccagcgcaag

SEQ ID NO: 1830459 - RNA, 12 nt, Homo sapiens
ccagaaccugga

SEQ ID NO: 1830460 - RNA, 19 nt, Homo sapiens
gagauggucacaugaccca

SEQ ID NO: 1830461 - RNA, 16 nt, Homo sapiens
cuuaugaaacuugaaa

SEQ ID NO: 1830462 - RNA, 22 nt, Homo sapiens
uguaacaagaaaggagagucuu

SEQ ID NO: 1830463 - RNA, 21 nt, Homo sapiens
ccgauacuaguuugcuuugcu

SEQ ID NO: 1830464 - RNA, 21 nt, Homo sapiens
cauuauguaaaauguuuuagc

SEQ ID NO: 1830465 - RNA, 14 nt, Homo sapiens
agcugaguguagug

SEQ ID NO: 1830466 - RNA, 22 nt, Homo sapiens
gaggcuggcauccuggcuggcu

SEQ ID NO: 1830467 - RNA, 12 nt, Homo sapiens
uuaauagacuga

SEQ ID NO: 1830468 - RNA, 19 nt, Homo sapiens
caucauugugcuagcugau

SEQ ID NO: 1830469 - RNA, 15 nt, Homo sapiens
auauuaucuaccugu

SEQ ID NO: 1830470 - RNA, 17 nt, Homo sapiens
uugccgugagcaugcac

SEQ ID NO: 1830471 - RNA, 19 nt, Homo sapiens
caacugaagcuucaaaaag

SEQ ID NO: 1830472 - RNA, 19 nt, Homo sapiens
ggcuucacauuuaaaccag

SEQ ID NO: 1830473 - RNA, 23 nt, Homo sapiens
gccagcucugaggggaggcaccu

SEQ ID NO: 1830474 - RNA, 13 nt, Homo sapiens
aguagcagggaau

SEQ ID NO: 1830475 - RNA, 16 nt, Homo sapiens
cgcuccucugccuugg

SEQ ID NO: 1830476 - RNA, 14 nt, Homo sapiens
ucugggcacaagca

SEQ ID NO: 1830477 - RNA, 20 nt, Homo sapiens
cgcuuaaauaagacaacaga

SEQ ID NO: 1830478 - RNA, 20 nt, Homo sapiens
caagccuuggaccaaaugga

SEQ ID NO: 1830479 - RNA, 22 nt, Homo sapiens
aggcugccucagccaguggcac

SEQ ID NO: 1830480 - RNA, 12 nt, Homo sapiens
ugucacagggac

SEQ ID NO: 1830481 - RNA, 21 nt, Homo sapiens
agguaacugagguaaaauguu

SEQ ID NO: 1830482 - RNA, 20 nt, Homo sapiens
ucaggugccgggcgcaggaa

SEQ ID NO: 1830483 - RNA, 22 nt, Homo sapiens
cugaauccccggccucugucac

SEQ ID NO: 1830484 - RNA, 21 nt, Homo sapiens
uauucuguuugcguacuugua

SEQ ID NO: 1830485 - RNA, 18 nt, Homo sapiens
accaaauucugaauuugu

SEQ ID NO: 1830486 - RNA, 20 nt, Homo sapiens
ccucucccaguccauuucca

SEQ ID NO: 1830487 - RNA, 21 nt, Homo sapiens
uugcucuggaagccugcugau

SEQ ID NO: 1830488 - RNA, 16 nt, Homo sapiens
aagugguuacuuugug

SEQ ID NO: 1830489 - RNA, 18 nt, Homo sapiens
ggaaaaaggcuucuccac

SEQ ID NO: 1830490 - RNA, 19 nt, Homo sapiens
cucuaauucggauuugcca

SEQ ID NO: 1830491 - RNA, 14 nt, Homo sapiens
guaugguucucgga

SEQ ID NO: 1830492 - RNA, 15 nt, Homo sapiens
uggacugcaggggag

SEQ ID NO: 1830493 - RNA, 14 nt, Homo sapiens
gacuuaaaacaugg

SEQ ID NO: 1830494 - RNA, 21 nt, Homo sapiens
gcaggcuaugaaguugcaaug

SEQ ID NO: 1830495 - RNA, 22 nt, Homo sapiens
aaggcugaggcaggaggaucac

SEQ ID NO: 1830496 - RNA, 18 nt, Homo sapiens
uagaugcauguacccuaa

SEQ ID NO: 1830497 - RNA, 16 nt, Homo sapiens
uggcagacuuacaaag

SEQ ID NO: 1830498 - RNA, 15 nt, Homo sapiens
ugaaauuuucaggua

SEQ ID NO: 1830499 - RNA, 23 nt, Homo sapiens
gcucccucuguuagguccauuuu

SEQ ID NO: 1830500 - RNA, 17 nt, Homo sapiens
uucaguuugcagaguag

SEQ ID NO: 1830501 - RNA, 13 nt, Homo sapiens
gaaccagccacga

SEQ ID NO: 1830502 - RNA, 15 nt, Homo sapiens
uauccaugcaugugc

SEQ ID NO: 1830503 - RNA, 22 nt, Homo sapiens
guaaaauuuguguaaauuugua

SEQ ID NO: 1830504 - RNA, 22 nt, Homo sapiens
caguaauagcaagucuuaguac

SEQ ID NO: 1830505 - RNA, 16 nt, Homo sapiens
auggugauuucuugcu

SEQ ID NO: 1830506 - RNA, 13 nt, Homo sapiens
cuggaagagccaa

SEQ ID NO: 1830507 - RNA, 20 nt, Homo sapiens
auaacuuuacagauaaccua

SEQ ID NO: 1830508 - RNA, 15 nt, Homo sapiens
aggugauagcauugc

SEQ ID NO: 1830509 - RNA, 18 nt, Homo sapiens
ccucuauauauacaucau

SEQ ID NO: 1830510 - RNA, 18 nt, Homo sapiens
aaaccaaccgcacaugca

SEQ ID NO: 1830511 - RNA, 20 nt, Homo sapiens
auguucaguccaacaaacca

SEQ ID NO: 1830512 - RNA, 22 nt, Homo sapiens
auaggcuggagaagcucaccca

SEQ ID NO: 1830513 - RNA, 19 nt, Homo sapiens
augcagcaaauaugggcug

SEQ ID NO: 1830514 - RNA, 19 nt, Homo sapiens
agcuguuuggccaaugugc

SEQ ID NO: 1830515 - RNA, 19 nt, Homo sapiens
aucucccccacuccacuac

SEQ ID NO: 1830516 - RNA, 20 nt, Homo sapiens
auaccauauggaaugccaaa

SEQ ID NO: 1830517 - RNA, 18 nt, Homo sapiens
uggccccgggcucuggcc

SEQ ID NO: 1830518 - RNA, 14 nt, Homo sapiens
cgggcccaugaaga

SEQ ID NO: 1830519 - RNA, 15 nt, Homo sapiens
caucuguaugcuggu

SEQ ID NO: 1830520 - RNA, 19 nt, Homo sapiens
gggccucccauagugcugg

SEQ ID NO: 1830521 - RNA, 18 nt, Homo sapiens
caggaggaauacugaaca

SEQ ID NO: 1830522 - RNA, 10 nt, Homo sapiens
cuaccucagc

SEQ ID NO: 1830523 - RNA, 20 nt, Homo sapiens
uaccuucaugcauagguuua

SEQ ID NO: 1830524 - RNA, 17 nt, Homo sapiens
agcucuuccaggagcca

SEQ ID NO: 1830525 - RNA, 16 nt, Homo sapiens
caccaaucagcacucu

SEQ ID NO: 1830526 - RNA, 20 nt, Homo sapiens
guuguacuuuuuauucaauu

SEQ ID NO: 1830527 - RNA, 14 nt, Homo sapiens
uugacagcauauag

SEQ ID NO: 1830528 - RNA, 15 nt, Homo sapiens
cagugcagcucguga

SEQ ID NO: 1830529 - RNA, 15 nt, Homo sapiens
uuuauacuuugcaau

SEQ ID NO: 1830530 - RNA, 15 nt, Homo sapiens
agugagagaguggcu

SEQ ID NO: 1830531 - RNA, 16 nt, Homo sapiens
auccgugaagucacau

SEQ ID NO: 1830532 - RNA, 15 nt, Homo sapiens
ucuggcgaagcucag

SEQ ID NO: 1830533 - RNA, 22 nt, Homo sapiens
ccaauaaagugacccugcucuc

SEQ ID NO: 1830534 - RNA, 20 nt, Homo sapiens
aggcgggagcaucucuugag

SEQ ID NO: 1830535 - RNA, 20 nt, Homo sapiens
gagcuuuugguaugugacau

SEQ ID NO: 1830536 - RNA, 17 nt, Homo sapiens
agagaggaggggaccaa

SEQ ID NO: 1830537 - RNA, 16 nt, Homo sapiens
gucaaucaagaugggu

SEQ ID NO: 1830538 - RNA, 15 nt, Homo sapiens
caucugccugcagug

SEQ ID NO: 1830539 - RNA, 22 nt, Homo sapiens
acaaaacugacaguaaaucuca

SEQ ID NO: 1830540 - RNA, 15 nt, Homo sapiens
gaaccacauucaggg

SEQ ID NO: 1830541 - RNA, 13 nt, Homo sapiens
ugaaaccuguaca

SEQ ID NO: 1830542 - RNA, 16 nt, Homo sapiens
acugccauuacccagu

SEQ ID NO: 1830543 - RNA, 15 nt, Homo sapiens
acuuuccucuuccac

SEQ ID NO: 1830544 - RNA, 17 nt, Homo sapiens
cuguggccagccuggca

SEQ ID NO: 1830545 - RNA, 14 nt, Homo sapiens
ugcuguaguaacug

SEQ ID NO: 1830546 - RNA, 15 nt, Homo sapiens
cuaaguucacuaaaa

SEQ ID NO: 1830547 - RNA, 14 nt, Homo sapiens
gaacguugccacac

SEQ ID NO: 1830548 - RNA, 14 nt, Homo sapiens
caucacugguugca

SEQ ID NO: 1830549 - RNA, 20 nt, Homo sapiens
ccucggggcaggaagucccu

SEQ ID NO: 1830550 - RNA, 16 nt, Homo sapiens
cugggauccaguguau

SEQ ID NO: 1830551 - RNA, 14 nt, Homo sapiens
acagaaagcacuca

SEQ ID NO: 1830552 - RNA, 14 nt, Homo sapiens
gaggaagaaaacca

SEQ ID NO: 1830553 - RNA, 17 nt, Homo sapiens
gacacuuuaauuaccaa

SEQ ID NO: 1830554 - RNA, 23 nt, Homo sapiens
ugacaagguguuucucuguaaaa

SEQ ID NO: 1830555 - RNA, 21 nt, Homo sapiens
aacagauuuggaaagacugga

SEQ ID NO: 1830556 - RNA, 15 nt, Homo sapiens
uucccucugcauuga

SEQ ID NO: 1830557 - RNA, 13 nt, Homo sapiens
ucagaaagcaaua

SEQ ID NO: 1830558 - RNA, 20 nt, Homo sapiens
gaucugacauccccacucac

SEQ ID NO: 1830559 - RNA, 23 nt, Homo sapiens
aacauggugaaaaccccaucucu

SEQ ID NO: 1830560 - RNA, 16 nt, Homo sapiens
cuugaaagugaacaau

SEQ ID NO: 1830561 - RNA, 15 nt, Homo sapiens
ugcuuuuacuaagca

SEQ ID NO: 1830562 - RNA, 18 nt, Homo sapiens
aagauuguugaaagccau

SEQ ID NO: 1830563 - RNA, 17 nt, Homo sapiens
acuacaggugcaagcca

SEQ ID NO: 1830564 - RNA, 14 nt, Homo sapiens
acaagaaggccagc

SEQ ID NO: 1830565 - RNA, 15 nt, Homo sapiens
uuuuggagguauuca

SEQ ID NO: 1830566 - RNA, 14 nt, Homo sapiens
ggagaugggaugcu

SEQ ID NO: 1830567 - RNA, 16 nt, Homo sapiens
aguagcagugucugua

SEQ ID NO: 1830568 - RNA, 12 nt, Homo sapiens
ccuggaaaccac

SEQ ID NO: 1830569 - RNA, 20 nt, Homo sapiens
gaggaagcaguuggggcccu

SEQ ID NO: 1830570 - RNA, 19 nt, Homo sapiens
uggagcuccgauuuaacug

SEQ ID NO: 1830571 - RNA, 20 nt, Homo sapiens
cagacagacaacacugggaa

SEQ ID NO: 1830572 - RNA, 23 nt, Homo sapiens
gcuagaaggcaaagugcacauga

SEQ ID NO: 1830573 - RNA, 20 nt, Homo sapiens
uauuuaaaaaaaaagucaga

SEQ ID NO: 1830574 - RNA, 20 nt, Homo sapiens
gugagaccaaauugagcuag

SEQ ID NO: 1830575 - RNA, 14 nt, Homo sapiens
uggaggccuaccuc

SEQ ID NO: 1830576 - RNA, 14 nt, Homo sapiens
cacaggcccggcuc

SEQ ID NO: 1830577 - RNA, 22 nt, Homo sapiens
agacaagcuguauaaacagaac

SEQ ID NO: 1830578 - RNA, 23 nt, Homo sapiens
ucaugucuguaaucccagcacuu

SEQ ID NO: 1830579 - RNA, 19 nt, Homo sapiens
agggaugggaccugaugac

SEQ ID NO: 1830580 - RNA, 14 nt, Homo sapiens
uacuauauauguga

SEQ ID NO: 1830581 - RNA, 19 nt, Homo sapiens
aacugcccuuccagguggg

SEQ ID NO: 1830582 - RNA, 17 nt, Homo sapiens
aggcaaagauuucauga

SEQ ID NO: 1830583 - RNA, 17 nt, Homo sapiens
uggaggaaauguguauu

SEQ ID NO: 1830584 - RNA, 20 nt, Homo sapiens
ucaucuugaccaagcaggaa

SEQ ID NO: 1830585 - RNA, 19 nt, Homo sapiens
gaaggaauccugguggaag

SEQ ID NO: 1830586 - RNA, 20 nt, Homo sapiens
agcccaaauggcucugugaa

SEQ ID NO: 1830587 - RNA, 17 nt, Homo sapiens
cucccagggacugacac

SEQ ID NO: 1830588 - RNA, 19 nt, Homo sapiens
ucagaaauaauaaccuguu

SEQ ID NO: 1830589 - RNA, 24 nt, Homo sapiens
cuuaaauuuuaagcuugaagauua

SEQ ID NO: 1830590 - RNA, 15 nt, Homo sapiens
gcucuggagugugca

SEQ ID NO: 1830591 - RNA, 14 nt, Homo sapiens
agcaaaagcaucca

SEQ ID NO: 1830592 - RNA, 15 nt, Homo sapiens
cagugcuccauccaa

SEQ ID NO: 1830593 - RNA, 19 nt, Homo sapiens
auacaguguaggcauuuaa

SEQ ID NO: 1830594 - RNA, 22 nt, Homo sapiens
auucucuccucagacugcucaa

SEQ ID NO: 1830595 - RNA, 18 nt, Homo sapiens
aggcagggccugauuuau

SEQ ID NO: 1830596 - RNA, 23 nt, Homo sapiens
guggagauucucuggcacucuga

SEQ ID NO: 1830597 - RNA, 15 nt, Homo sapiens
aaccacaugugcaac

SEQ ID NO: 1830598 - RNA, 19 nt, Homo sapiens
auauuuauggggggagaac

SEQ ID NO: 1830599 - RNA, 19 nt, Homo sapiens
agaaauccuaguaugccaa

SEQ ID NO: 1830600 - RNA, 18 nt, Homo sapiens
auucacuuuccugcagcc

SEQ ID NO: 1830601 - RNA, 15 nt, Homo sapiens
uggaaauagaugugc

SEQ ID NO: 1830602 - RNA, 23 nt, Homo sapiens
auauaacuacauuaaaagcuuua

SEQ ID NO: 1830603 - RNA, 14 nt, Homo sapiens
ugagaaggcaaaag

SEQ ID NO: 1830604 - RNA, 19 nt, Homo sapiens
gcuuuuccauucugggugu

SEQ ID NO: 1830605 - RNA, 17 nt, Homo sapiens
cagcacccccaccaaac

SEQ ID NO: 1830606 - RNA, 22 nt, Homo sapiens
cagucccuuuaaagaaacaugg

SEQ ID NO: 1830607 - RNA, 17 nt, Homo sapiens
uuuauacucagaacugu

SEQ ID NO: 1830608 - RNA, 20 nt, Homo sapiens
agagcagcacuaaaugacac

SEQ ID NO: 1830609 - RNA, 18 nt, Homo sapiens
gaaguaagggagucauug

SEQ ID NO: 1830610 - RNA, 15 nt, Homo sapiens
aauugaauaguaaga

SEQ ID NO: 1830611 - RNA, 20 nt, Homo sapiens
uuaauugaaauaccuauuca

SEQ ID NO: 1830612 - RNA, 13 nt, Homo sapiens
uuauuaucuauua

SEQ ID NO: 1830613 - RNA, 23 nt, Homo sapiens
acaagaucacaagucagcacuac

SEQ ID NO: 1830614 - RNA, 19 nt, Homo sapiens
ccaugaagaagugcuuccg

SEQ ID NO: 1830615 - RNA, 14 nt, Homo sapiens
auggccuggaaccc

SEQ ID NO: 1830616 - RNA, 14 nt, Homo sapiens
cuuccucuucuuca

SEQ ID NO: 1830617 - RNA, 22 nt, Homo sapiens
uguacagugaacaaaugucuua

SEQ ID NO: 1830618 - RNA, 17 nt, Homo sapiens
cacaauccuccugggga

SEQ ID NO: 1830619 - RNA, 21 nt, Homo sapiens
cuuugaguaaacuuacuacaa

SEQ ID NO: 1830620 - RNA, 22 nt, Homo sapiens
ugccucccuggcagcacaggaa

SEQ ID NO: 1830621 - RNA, 14 nt, Homo sapiens
auccauccuuccaa

SEQ ID NO: 1830622 - RNA, 12 nt, Homo sapiens
ccccugcugauc

SEQ ID NO: 1830623 - RNA, 12 nt, Homo sapiens
ccugugcugacg

SEQ ID NO: 1830624 - RNA, 12 nt, Homo sapiens
accccaucucau

SEQ ID NO: 1830625 - RNA, 20 nt, Homo sapiens
acuccaccgaccaacugccc

SEQ ID NO: 1830626 - RNA, 14 nt, Homo sapiens
gaagaaaaugaucu

SEQ ID NO: 1830627 - RNA, 23 nt, Homo sapiens
agcagccaccagggaguggccau

SEQ ID NO: 1830628 - RNA, 18 nt, Homo sapiens
ccacacgcacuggugcca

SEQ ID NO: 1830629 - RNA, 16 nt, Homo sapiens
uaaauagggaauauga

SEQ ID NO: 1830630 - RNA, 14 nt, Homo sapiens
aaaggaauccacuc

SEQ ID NO: 1830631 - RNA, 22 nt, Homo sapiens
agggcagaauaaauaagcaaaa

SEQ ID NO: 1830632 - RNA, 13 nt, Homo sapiens
uuccauauugaug

SEQ ID NO: 1830633 - RNA, 14 nt, Homo sapiens
ccuaauuaccugua

SEQ ID NO: 1830634 - RNA, 21 nt, Homo sapiens
gggcugccgggaaccucaucu

SEQ ID NO: 1830635 - RNA, 22 nt, Homo sapiens
acagugaaaauguaagcuguuu

SEQ ID NO: 1830636 - RNA, 11 nt, Homo sapiens
uuuccuuugaa

SEQ ID NO: 1830637 - RNA, 17 nt, Homo sapiens
cagucaccuaugugguc

SEQ ID NO: 1830638 - RNA, 17 nt, Homo sapiens
ccaaaaagagcagcaca

SEQ ID NO: 1830639 - RNA, 23 nt, Homo sapiens
accaagugucuagagucauguga

SEQ ID NO: 1830640 - RNA, 20 nt, Homo sapiens
accuguugagacugauucag

SEQ ID NO: 1830641 - RNA, 22 nt, Homo sapiens
cugaacuugccuuaaacacuca

SEQ ID NO: 1830642 - RNA, 19 nt, Homo sapiens
cuuuuccacacgcauuaau

SEQ ID NO: 1830643 - RNA, 17 nt, Homo sapiens
ggcucuaauguacaaua

SEQ ID NO: 1830644 - RNA, 22 nt, Homo sapiens
acucuugaaggccacaugugaa

SEQ ID NO: 1830645 - RNA, 15 nt, Homo sapiens
caguaaggcagugaa

SEQ ID NO: 1830646 - RNA, 15 nt, Homo sapiens
cauaaggcauauaca

SEQ ID NO: 1830647 - RNA, 14 nt, Homo sapiens
accuauugcugaua

SEQ ID NO: 1830648 - RNA, 14 nt, Homo sapiens
ucccuuuccuccac

SEQ ID NO: 1830649 - RNA, 20 nt, Homo sapiens
cucguugacccucacaggag

SEQ ID NO: 1830650 - RNA, 20 nt, Homo sapiens
ccugagaggagcguguccua

SEQ ID NO: 1830651 - RNA, 17 nt, Homo sapiens
gaggaauaaagcuucuc

SEQ ID NO: 1830652 - RNA, 16 nt, Homo sapiens
uguaguccgugcugac

SEQ ID NO: 1830653 - RNA, 17 nt, Homo sapiens
guuaagggaagcugaua

SEQ ID NO: 1830654 - RNA, 14 nt, Homo sapiens
cauggccacagcca

SEQ ID NO: 1830655 - RNA, 17 nt, Homo sapiens
ggaaaaggccuggggug

SEQ ID NO: 1830656 - RNA, 13 nt, Homo sapiens
agcaccaaaggga

SEQ ID NO: 1830657 - RNA, 20 nt, Homo sapiens
uccuguaaaggucaacaaua

SEQ ID NO: 1830658 - RNA, 17 nt, Homo sapiens
uuaauaaaacucacuca

SEQ ID NO: 1830659 - RNA, 15 nt, Homo sapiens
uuaacagauuuaucu

SEQ ID NO: 1830660 - RNA, 18 nt, Homo sapiens
cuuuauuuguauuugcca

SEQ ID NO: 1830661 - RNA, 17 nt, Homo sapiens
ccucauaugcaugcccu

SEQ ID NO: 1830662 - RNA, 18 nt, Homo sapiens
aaauucagucuuuucucu

SEQ ID NO: 1830663 - RNA, 12 nt, Homo sapiens
ugccaaccaguu

SEQ ID NO: 1830664 - RNA, 20 nt, Homo sapiens
aggaggcagagguugcaaug

SEQ ID NO: 1830665 - RNA, 22 nt, Homo sapiens
aauaucugagaaguguauauag

SEQ ID NO: 1830666 - RNA, 21 nt, Homo sapiens
uagaacuaucugcauuaucua

SEQ ID NO: 1830667 - RNA, 16 nt, Homo sapiens
aaacuaacacccaguc

SEQ ID NO: 1830668 - RNA, 16 nt, Homo sapiens
acccagcuaugguucu

SEQ ID NO: 1830669 - RNA, 13 nt, Homo sapiens
ucucaacuaccuc

SEQ ID NO: 1830670 - RNA, 12 nt, Homo sapiens
acacugcugcuc

SEQ ID NO: 1830671 - RNA, 23 nt, Homo sapiens
cagugcaccucccuccccagcuc

SEQ ID NO: 1830672 - RNA, 12 nt, Homo sapiens
gaggcuggccaa

SEQ ID NO: 1830673 - RNA, 21 nt, Homo sapiens
uauuguaaaaggaaagucauu

SEQ ID NO: 1830674 - RNA, 15 nt, Homo sapiens
cugucugugcaccga

SEQ ID NO: 1830675 - RNA, 19 nt, Homo sapiens
uuauaccagguuaccucac

SEQ ID NO: 1830676 - RNA, 19 nt, Homo sapiens
ucauacucaccucacccca

SEQ ID NO: 1830677 - RNA, 12 nt, Homo sapiens
uaauugccaugu

SEQ ID NO: 1830678 - RNA, 21 nt, Homo sapiens
acuugacauguagcuucuucu

SEQ ID NO: 1830679 - RNA, 23 nt, Homo sapiens
aggcucugugccuuggucucucc

SEQ ID NO: 1830680 - RNA, 12 nt, Homo sapiens
uauuguaucugu

SEQ ID NO: 1830681 - RNA, 14 nt, Homo sapiens
gaauggcagcugcc

SEQ ID NO: 1830682 - RNA, 16 nt, Homo sapiens
cacagcccauaauuca

SEQ ID NO: 1830683 - RNA, 18 nt, Homo sapiens
gggccuuggaucgcuaag

SEQ ID NO: 1830684 - RNA, 20 nt, Homo sapiens
uaacuuacgaucucuugaca

SEQ ID NO: 1830685 - RNA, 22 nt, Homo sapiens
ucucuugaauuugguaucuuau

SEQ ID NO: 1830686 - RNA, 20 nt, Homo sapiens
aacgagcauaguccaaaaag

SEQ ID NO: 1830687 - RNA, 19 nt, Homo sapiens
ucuuuguuggcucagaaaa

SEQ ID NO: 1830688 - RNA, 14 nt, Homo sapiens
uuucccaacacaaa

SEQ ID NO: 1830689 - RNA, 11 nt, Homo sapiens
auugcuucaau

SEQ ID NO: 1830690 - RNA, 22 nt, Homo sapiens
cuuguaaaaacuuuuaagccau

SEQ ID NO: 1830691 - RNA, 12 nt, Homo sapiens
aaucacugugcu

SEQ ID NO: 1830692 - RNA, 21 nt, Homo sapiens
ucacuaggcccccacuugccu

SEQ ID NO: 1830693 - RNA, 19 nt, Homo sapiens
cagaguccacuguggcacu

SEQ ID NO: 1830694 - RNA, 19 nt, Homo sapiens
ugggcugccgggaaccuca

SEQ ID NO: 1830695 - RNA, 21 nt, Homo sapiens
cccaggcuggagagcacugcc

SEQ ID NO: 1830696 - RNA, 20 nt, Homo sapiens
caggaguucgagaccagccu

SEQ ID NO: 1830697 - RNA, 14 nt, Homo sapiens
cucggccuucacaa

SEQ ID NO: 1830698 - RNA, 13 nt, Homo sapiens
aaauauucacucu

SEQ ID NO: 1830699 - RNA, 15 nt, Homo sapiens
aucuguuacuccaaa

SEQ ID NO: 1830700 - RNA, 19 nt, Homo sapiens
cauuuaggagaauagcaga

SEQ ID NO: 1830701 - RNA, 20 nt, Homo sapiens
ccaaauaggcaucaucaaua

SEQ ID NO: 1830702 - RNA, 17 nt, Homo sapiens
ugcuugggaucuucaau

SEQ ID NO: 1830703 - RNA, 13 nt, Homo sapiens
uuuaaacauuuca

SEQ ID NO: 1830704 - RNA, 13 nt, Homo sapiens
uauaaacauauca

SEQ ID NO: 1830705 - RNA, 19 nt, Homo sapiens
aagcccuccaaaagcacuu

SEQ ID NO: 1830706 - RNA, 22 nt, Homo sapiens
caucauuuuacucuuaugauca

SEQ ID NO: 1830707 - RNA, 22 nt, Homo sapiens
cauuaucucaaaacugcacugu

SEQ ID NO: 1830708 - RNA, 23 nt, Homo sapiens
ccuuugagcccacaaagccuuau

SEQ ID NO: 1830709 - RNA, 12 nt, Homo sapiens
cuccacagggca

SEQ ID NO: 1830710 - RNA, 22 nt, Homo sapiens
ggcccuuucaccccucuuccca

SEQ ID NO: 1830711 - RNA, 13 nt, Homo sapiens
accaaaugcuguc

SEQ ID NO: 1830712 - RNA, 22 nt, Homo sapiens
aguauuuauugcaggauggugu

SEQ ID NO: 1830713 - RNA, 21 nt, Homo sapiens
gacacaacuauuuuuccaaaa

SEQ ID NO: 1830714 - RNA, 18 nt, Homo sapiens
uugaaaaccucuuuccaa

SEQ ID NO: 1830715 - RNA, 19 nt, Homo sapiens
accucacucagcaccacuc

SEQ ID NO: 1830716 - RNA, 11 nt, Homo sapiens
gcacaccucau

SEQ ID NO: 1830717 - RNA, 20 nt, Homo sapiens
uuauguuuuaaacacaugcc

SEQ ID NO: 1830718 - RNA, 13 nt, Homo sapiens
gaauagcuuuaau

SEQ ID NO: 1830719 - RNA, 16 nt, Homo sapiens
agugaaguccagugac

SEQ ID NO: 1830720 - RNA, 21 nt, Homo sapiens
uacaguuauuaaucuggacau

SEQ ID NO: 1830721 - RNA, 21 nt, Homo sapiens
guauauuaggaaacugggaug

SEQ ID NO: 1830722 - RNA, 22 nt, Homo sapiens
aggagaccuggcacuggaugca

SEQ ID NO: 1830723 - RNA, 16 nt, Homo sapiens
gagaugauacauccaa

SEQ ID NO: 1830724 - RNA, 18 nt, Homo sapiens
aaggcucuucuuccucac

SEQ ID NO: 1830725 - RNA, 19 nt, Homo sapiens
auuaaagucuacacugccu

SEQ ID NO: 1830726 - RNA, 15 nt, Homo sapiens
cuuuguguguauuca

SEQ ID NO: 1830727 - RNA, 16 nt, Homo sapiens
caaaccacuguacaua

SEQ ID NO: 1830728 - RNA, 16 nt, Homo sapiens
ccuggaucuaccagca

SEQ ID NO: 1830729 - RNA, 22 nt, Homo sapiens
cccagucuuucuucacucuggc

SEQ ID NO: 1830730 - RNA, 19 nt, Homo sapiens
cgcccuccucccugucaua

SEQ ID NO: 1830731 - RNA, 16 nt, Homo sapiens
ggcagcuuugcaaaau

SEQ ID NO: 1830732 - RNA, 13 nt, Homo sapiens
caaccucuuugcu

SEQ ID NO: 1830733 - RNA, 14 nt, Homo sapiens
uccaucugauucca

SEQ ID NO: 1830734 - RNA, 15 nt, Homo sapiens
ugcaccacccuuuga

SEQ ID NO: 1830735 - RNA, 14 nt, Homo sapiens
gccaggcaccacag

SEQ ID NO: 1830736 - RNA, 16 nt, Homo sapiens
cauuucuauagccaaa

SEQ ID NO: 1830737 - RNA, 16 nt, Homo sapiens
cugcaaugccaggugg

SEQ ID NO: 1830738 - RNA, 14 nt, Homo sapiens
agaaccucccaaau

SEQ ID NO: 1830739 - RNA, 22 nt, Homo sapiens
agaaugacucuggaaccauccu

SEQ ID NO: 1830740 - RNA, 16 nt, Homo sapiens
gcacuguuagugacag

SEQ ID NO: 1830741 - RNA, 19 nt, Homo sapiens
uuccacuucaggguucuaa

SEQ ID NO: 1830742 - RNA, 17 nt, Homo sapiens
cagugcccggcugaggg

SEQ ID NO: 1830743 - RNA, 12 nt, Homo sapiens
cuccaacaauaa

SEQ ID NO: 1830744 - RNA, 21 nt, Homo sapiens
cugguugauuuguaacacagu

SEQ ID NO: 1830745 - RNA, 18 nt, Homo sapiens
ggaccuggggaagcaaaa

SEQ ID NO: 1830746 - RNA, 18 nt, Homo sapiens
uauaugaucaguguuacu

SEQ ID NO: 1830747 - RNA, 14 nt, Homo sapiens
caauuuucuauuua

SEQ ID NO: 1830748 - RNA, 21 nt, Homo sapiens
uuacuaacuaaauaccauuca

SEQ ID NO: 1830749 - RNA, 16 nt, Homo sapiens
ugauuacuuccacuga

SEQ ID NO: 1830750 - RNA, 23 nt, Homo sapiens
uguggcccucuggauccagccau

SEQ ID NO: 1830751 - RNA, 21 nt, Homo sapiens
cacucaauaaauugcaacaua

SEQ ID NO: 1830752 - RNA, 13 nt, Homo sapiens
cauacaccagcau

SEQ ID NO: 1830753 - RNA, 16 nt, Homo sapiens
uguagauuaccaaaac

SEQ ID NO: 1830754 - RNA, 20 nt, Homo sapiens
uaacaucccaauaaaguccu

SEQ ID NO: 1830755 - RNA, 19 nt, Homo sapiens
agcuagaggacuucuggca

SEQ ID NO: 1830756 - RNA, 21 nt, Homo sapiens
cgagaucgcgccacugcacuc

SEQ ID NO: 1830757 - RNA, 14 nt, Homo sapiens
auuaugcacguguc

SEQ ID NO: 1830758 - RNA, 14 nt, Homo sapiens
uguucacacuuugc

SEQ ID NO: 1830759 - RNA, 14 nt, Homo sapiens
gaaugggagccaga

SEQ ID NO: 1830760 - RNA, 16 nt, Homo sapiens
auuuaauuguguaacu

SEQ ID NO: 1830761 - RNA, 17 nt, Homo sapiens
cauacauaguacauaca

SEQ ID NO: 1830762 - RNA, 23 nt, Homo sapiens
gggauuacagacaugaaccacca

SEQ ID NO: 1830763 - RNA, 16 nt, Homo sapiens
ggagcagaugcaauga

SEQ ID NO: 1830764 - RNA, 23 nt, Homo sapiens
ugacuuccugaacucccagucau

SEQ ID NO: 1830765 - RNA, 15 nt, Homo sapiens
aagaauggcuuucaa

SEQ ID NO: 1830766 - RNA, 17 nt, Homo sapiens
uaaacagauggcacuuu

SEQ ID NO: 1830767 - RNA, 17 nt, Homo sapiens
uacuuagcaugcacaaa

SEQ ID NO: 1830768 - RNA, 17 nt, Homo sapiens
ugauuucuguacaguca

SEQ ID NO: 1830769 - RNA, 15 nt, Homo sapiens
gagagguuugucaac

SEQ ID NO: 1830770 - RNA, 21 nt, Homo sapiens
ccagaagcugauuuucaugaa

SEQ ID NO: 1830771 - RNA, 19 nt, Homo sapiens
caguaucucuucagucucu

SEQ ID NO: 1830772 - RNA, 17 nt, Homo sapiens
ucaugauccaacuaaug

SEQ ID NO: 1830773 - RNA, 20 nt, Homo sapiens
cuuucugagaguuggcucag

SEQ ID NO: 1830774 - RNA, 14 nt, Homo sapiens
uaauaauuugcacu

SEQ ID NO: 1830775 - RNA, 13 nt, Homo sapiens
cccccuucacaaa

SEQ ID NO: 1830776 - RNA, 16 nt, Homo sapiens
caaacaaacaaugcau

SEQ ID NO: 1830777 - RNA, 22 nt, Homo sapiens
acauguaauugcagauaacuuu

SEQ ID NO: 1830778 - RNA, 21 nt, Homo sapiens
uaaauuuguaaacaaucuaau

SEQ ID NO: 1830779 - RNA, 13 nt, Homo sapiens
cccacacugugaa

SEQ ID NO: 1830780 - RNA, 19 nt, Homo sapiens
uaaccaaagucacaaauca

SEQ ID NO: 1830781 - RNA, 17 nt, Homo sapiens
uccagauccagacugua

SEQ ID NO: 1830782 - RNA, 16 nt, Homo sapiens
cugucauuuugcacug

SEQ ID NO: 1830783 - RNA, 15 nt, Homo sapiens
gaaucucaccugcug

SEQ ID NO: 1830784 - RNA, 17 nt, Homo sapiens
cugugccuggcucccug

SEQ ID NO: 1830785 - RNA, 19 nt, Homo sapiens
ccagagagacgcugugauu

SEQ ID NO: 1830786 - RNA, 16 nt, Homo sapiens
auuuucaauucaaaaa

SEQ ID NO: 1830787 - RNA, 18 nt, Homo sapiens
uccaacucugacuguaaa

SEQ ID NO: 1830788 - RNA, 15 nt, Homo sapiens
gagaccugcucaggc

SEQ ID NO: 1830789 - RNA, 16 nt, Homo sapiens
auaacuagacguucaa

SEQ ID NO: 1830790 - RNA, 18 nt, Homo sapiens
auacaaaaauuagcugga

SEQ ID NO: 1830791 - RNA, 15 nt, Homo sapiens
uguuauaucagggaa

SEQ ID NO: 1830792 - RNA, 19 nt, Homo sapiens
uccaaugugguuggucaaa

SEQ ID NO: 1830793 - RNA, 24 nt, Homo sapiens
aagcaguugggacuacaggcguga

SEQ ID NO: 1830794 - RNA, 18 nt, Homo sapiens
ccaagaugcaagaaggag

SEQ ID NO: 1830795 - RNA, 11 nt, Homo sapiens
augaugaucuc

SEQ ID NO: 1830796 - RNA, 13 nt, Homo sapiens
ucuauuaucugua

SEQ ID NO: 1830797 - RNA, 16 nt, Homo sapiens
caucacguauguuaua

SEQ ID NO: 1830798 - RNA, 17 nt, Homo sapiens
cgaguuguggaaagccu

SEQ ID NO: 1830799 - RNA, 16 nt, Homo sapiens
cuccugacaugucuca

SEQ ID NO: 1830800 - RNA, 17 nt, Homo sapiens
gcuuggaaaggaccagu

SEQ ID NO: 1830801 - RNA, 16 nt, Homo sapiens
aaugugaccaggggug

SEQ ID NO: 1830802 - RNA, 21 nt, Homo sapiens
ugagaaagcugauggccuugu

SEQ ID NO: 1830803 - RNA, 20 nt, Homo sapiens
cuguuuccccaauuccucug

SEQ ID NO: 1830804 - RNA, 17 nt, Homo sapiens
aacuuuuuaauauguaa

SEQ ID NO: 1830805 - RNA, 21 nt, Homo sapiens
cucugcuugagucagguuuga

SEQ ID NO: 1830806 - RNA, 18 nt, Homo sapiens
agccucuugucuacauau

SEQ ID NO: 1830807 - RNA, 16 nt, Homo sapiens
aagauaauuguugaaa

SEQ ID NO: 1830808 - RNA, 13 nt, Homo sapiens
cucugucuucuuu

SEQ ID NO: 1830809 - RNA, 15 nt, Homo sapiens
cccuuggaugugaug

SEQ ID NO: 1830810 - RNA, 15 nt, Homo sapiens
uuuauuuacacuccu

SEQ ID NO: 1830811 - RNA, 15 nt, Homo sapiens
cuauaacuuuggcca

SEQ ID NO: 1830812 - RNA, 20 nt, Homo sapiens
aggugauccacccgccucag

SEQ ID NO: 1830813 - RNA, 15 nt, Homo sapiens
gaaggaaaagcaaga

SEQ ID NO: 1830814 - RNA, 22 nt, Homo sapiens
aggaacccuucuccauacccac

SEQ ID NO: 1830815 - RNA, 17 nt, Homo sapiens
cagagcacccccugcuc

SEQ ID NO: 1830816 - RNA, 19 nt, Homo sapiens
uccacuuguuugcacugug

SEQ ID NO: 1830817 - RNA, 17 nt, Homo sapiens
cuaugaauuuucaagua

SEQ ID NO: 1830818 - RNA, 22 nt, Homo sapiens
uauguaccguugauguugauaa

SEQ ID NO: 1830819 - RNA, 22 nt, Homo sapiens
ugacacuggaccagguccugcu

SEQ ID NO: 1830820 - RNA, 17 nt, Homo sapiens
cuuucuaagagaccuga

SEQ ID NO: 1830821 - RNA, 15 nt, Homo sapiens
auuugcaagacauag

SEQ ID NO: 1830822 - RNA, 21 nt, Homo sapiens
cauuaaaauugugaugcuccu

SEQ ID NO: 1830823 - RNA, 17 nt, Homo sapiens
ucuuuccugauauauca

SEQ ID NO: 1830824 - RNA, 15 nt, Homo sapiens
uccaucugugccaua

SEQ ID NO: 1830825 - RNA, 19 nt, Homo sapiens
uuccagacuuccuugagac

SEQ ID NO: 1830826 - RNA, 18 nt, Homo sapiens
gaugucacaugucagaga

SEQ ID NO: 1830827 - RNA, 10 nt, Homo sapiens
uuuugcucau

SEQ ID NO: 1830828 - RNA, 22 nt, Homo sapiens
cugccccacggagacagaggaa

SEQ ID NO: 1830829 - RNA, 17 nt, Homo sapiens
gaacaucccaagccaga

SEQ ID NO: 1830830 - RNA, 22 nt, Homo sapiens
cacguuugcaguugaugugucu

SEQ ID NO: 1830831 - RNA, 17 nt, Homo sapiens
uaauccaucacuagcca

SEQ ID NO: 1830832 - RNA, 12 nt, Homo sapiens
gcuuacaggaag

SEQ ID NO: 1830833 - RNA, 17 nt, Homo sapiens
cacgugcaaaaauguau

SEQ ID NO: 1830834 - RNA, 23 nt, Homo sapiens
cucuguguuacccaguaacucau

SEQ ID NO: 1830835 - RNA, 20 nt, Homo sapiens
aaggugugccuggcagccau

SEQ ID NO: 1830836 - RNA, 15 nt, Homo sapiens
uccaaggggcuuugu

SEQ ID NO: 1830837 - RNA, 22 nt, Homo sapiens
gagagcagcuuuaaacucaggg

SEQ ID NO: 1830838 - RNA, 21 nt, Homo sapiens
aaaacuuuucauuucagauuu

SEQ ID NO: 1830839 - RNA, 16 nt, Homo sapiens
gacucuccagccaccc

SEQ ID NO: 1830840 - RNA, 17 nt, Homo sapiens
ccucuagguagcacuug

SEQ ID NO: 1830841 - RNA, 18 nt, Homo sapiens
auucauaccuucugauga

SEQ ID NO: 1830842 - RNA, 17 nt, Homo sapiens
uuaccaaaaccauccau

SEQ ID NO: 1830843 - RNA, 18 nt, Homo sapiens
accaauuccaauuucaaa

SEQ ID NO: 1830844 - RNA, 12 nt, Homo sapiens
caaauauuuccc

SEQ ID NO: 1830845 - RNA, 20 nt, Homo sapiens
cauuguuccugcgcugcaaa

SEQ ID NO: 1830846 - RNA, 15 nt, Homo sapiens
cuuccauuaggugaa

SEQ ID NO: 1830847 - RNA, 22 nt, Homo sapiens
cgugauggcuaugccuugcaca

SEQ ID NO: 1830848 - RNA, 22 nt, Homo sapiens
cacagggaggcugcaguucccu

SEQ ID NO: 1830849 - RNA, 15 nt, Homo sapiens
agaggaggggaccaa

SEQ ID NO: 1830850 - RNA, 12 nt, Homo sapiens
cuguacccagug

SEQ ID NO: 1830851 - RNA, 21 nt, Homo sapiens
acuccagccugggcaacacag

SEQ ID NO: 1830852 - RNA, 19 nt, Homo sapiens
cacauuggguggggcuccu

SEQ ID NO: 1830853 - RNA, 17 nt, Homo sapiens
ccagguuuaaacaucac

SEQ ID NO: 1830854 - RNA, 14 nt, Homo sapiens
accaaugccaaaaa

SEQ ID NO: 1830855 - RNA, 15 nt, Homo sapiens
ugcccugcugagcac

SEQ ID NO: 1830856 - RNA, 18 nt, Homo sapiens
agguucugucugugccaa

SEQ ID NO: 1830857 - RNA, 23 nt, Homo sapiens
caaaggcuugccccaaaucucaa

SEQ ID NO: 1830858 - RNA, 17 nt, Homo sapiens
uacuugaaguaacuaua

SEQ ID NO: 1830859 - RNA, 22 nt, Homo sapiens
accaacuuuuaaugggauuuca

SEQ ID NO: 1830860 - RNA, 15 nt, Homo sapiens
acgucagacuuggcu

SEQ ID NO: 1830861 - RNA, 15 nt, Homo sapiens
gcugacaucuguaaa

SEQ ID NO: 1830862 - RNA, 21 nt, Homo sapiens
uggagggaccuugucucccag

SEQ ID NO: 1830863 - RNA, 14 nt, Homo sapiens
gacacagacuggca

SEQ ID NO: 1830864 - RNA, 13 nt, Homo sapiens
uuccuucauuuca

SEQ ID NO: 1830865 - RNA, 16 nt, Homo sapiens
auuaauugacaaugac

SEQ ID NO: 1830866 - RNA, 21 nt, Homo sapiens
ugcuauuacuaguacuauuac

SEQ ID NO: 1830867 - RNA, 20 nt, Homo sapiens
aacaacacuuuuuuucaugc

SEQ ID NO: 1830868 - RNA, 15 nt, Homo sapiens
aaacaugcaguacuu

SEQ ID NO: 1830869 - RNA, 15 nt, Homo sapiens
uucacuguggucuca

SEQ ID NO: 1830870 - RNA, 16 nt, Homo sapiens
ucaaauguuguucucu

SEQ ID NO: 1830871 - RNA, 18 nt, Homo sapiens
cuugcaauggaucagcca

SEQ ID NO: 1830872 - RNA, 21 nt, Homo sapiens
acuguauuuuauaucacuuau

SEQ ID NO: 1830873 - RNA, 13 nt, Homo sapiens
gcaaucacacuga

SEQ ID NO: 1830874 - RNA, 20 nt, Homo sapiens
guccucauccuuuccugcca

SEQ ID NO: 1830875 - RNA, 21 nt, Homo sapiens
uugggaugcggggcagagcca

SEQ ID NO: 1830876 - RNA, 17 nt, Homo sapiens
ggaaaguaaauauuuca

SEQ ID NO: 1830877 - RNA, 15 nt, Homo sapiens
ucuagagaacaugcc

SEQ ID NO: 1830878 - RNA, 21 nt, Homo sapiens
gcaugcagggcccccacagga

SEQ ID NO: 1830879 - RNA, 14 nt, Homo sapiens
guaauuaaggaaua

SEQ ID NO: 1830880 - RNA, 17 nt, Homo sapiens
cuucuccccuccagacc

SEQ ID NO: 1830881 - RNA, 14 nt, Homo sapiens
caagcaccugcuca

SEQ ID NO: 1830882 - RNA, 22 nt, Homo sapiens
acugggaugagccgcugugagc

SEQ ID NO: 1830883 - RNA, 14 nt, Homo sapiens
auuuauuguauuag

SEQ ID NO: 1830884 - RNA, 19 nt, Homo sapiens
aaggaagaggcugacaaua

SEQ ID NO: 1830885 - RNA, 19 nt, Homo sapiens
agaaaaaggaaaaccauuc

SEQ ID NO: 1830886 - RNA, 18 nt, Homo sapiens
ccaaacuaaauacuguaa

SEQ ID NO: 1830887 - RNA, 17 nt, Homo sapiens
agcccucuuucucucug

SEQ ID NO: 1830888 - RNA, 23 nt, Homo sapiens
aaacucccagccacagcauuuau

SEQ ID NO: 1830889 - RNA, 23 nt, Homo sapiens
ccauccccuucuagccuuuccua

SEQ ID NO: 1830890 - RNA, 23 nt, Homo sapiens
ccccacccccaaauccuguucca

SEQ ID NO: 1830891 - RNA, 22 nt, Homo sapiens
ucaauuuaaaaucagacucuuu

SEQ ID NO: 1830892 - RNA, 17 nt, Homo sapiens
ugcccuuaaacauugga

SEQ ID NO: 1830893 - RNA, 13 nt, Homo sapiens
cucaaacuccuga

SEQ ID NO: 1830894 - RNA, 11 nt, Homo sapiens
accaauuccaa

SEQ ID NO: 1830895 - RNA, 11 nt, Homo sapiens
acaaauuccac

SEQ ID NO: 1830896 - RNA, 14 nt, Homo sapiens
ugcuuaaucuugcu

SEQ ID NO: 1830897 - RNA, 13 nt, Homo sapiens
gggccgggcucca

SEQ ID NO: 1830898 - RNA, 18 nt, Homo sapiens
uaaacucagucaaaugua

SEQ ID NO: 1830899 - RNA, 20 nt, Homo sapiens
uggagaguauuuuagaaacu

SEQ ID NO: 1830900 - RNA, 23 nt, Homo sapiens
cucagcacauucgggaccaauau

SEQ ID NO: 1830901 - RNA, 18 nt, Homo sapiens
augacaauuaaugauuaa

SEQ ID NO: 1830902 - RNA, 19 nt, Homo sapiens
caggauaccauauacagcu

SEQ ID NO: 1830903 - RNA, 17 nt, Homo sapiens
agggaagcaccaugaau

SEQ ID NO: 1830904 - RNA, 15 nt, Homo sapiens
accaauugaagcaug

SEQ ID NO: 1830905 - RNA, 19 nt, Homo sapiens
gacuuaaggacagcauguc

SEQ ID NO: 1830906 - RNA, 22 nt, Homo sapiens
augaaucaaucaauucauaucu

SEQ ID NO: 1830907 - RNA, 15 nt, Homo sapiens
cgcuuuguugcccag

SEQ ID NO: 1830908 - RNA, 17 nt, Homo sapiens
aauuuuaaauguucaca

SEQ ID NO: 1830909 - RNA, 17 nt, Homo sapiens
gacucucccccuuucaa

SEQ ID NO: 1830910 - RNA, 21 nt, Homo sapiens
cauaaacgguuccuggugacu

SEQ ID NO: 1830911 - RNA, 20 nt, Homo sapiens
ucaaaauaaaaaccaagaag

SEQ ID NO: 1830912 - RNA, 20 nt, Homo sapiens
ccccagaggugcuccaugga

SEQ ID NO: 1830913 - RNA, 18 nt, Homo sapiens
acaucucgggaguccucu

SEQ ID NO: 1830914 - RNA, 23 nt, Homo sapiens
gaggcagaaagggaaaguauuag

SEQ ID NO: 1830915 - RNA, 12 nt, Homo sapiens
ucuuuaugaucu

SEQ ID NO: 1830916 - RNA, 21 nt, Homo sapiens
auccaugugcugcuguggcau

SEQ ID NO: 1830917 - RNA, 21 nt, Homo sapiens
ugacggcccucaucuaugagg

SEQ ID NO: 1830918 - RNA, 21 nt, Homo sapiens
guacucuggggugcugccuga

SEQ ID NO: 1830919 - RNA, 17 nt, Homo sapiens
acaaacagcccuuccuu

SEQ ID NO: 1830920 - RNA, 20 nt, Homo sapiens
cuugaucauuauaucauugg

SEQ ID NO: 1830921 - RNA, 19 nt, Homo sapiens
agaccugacaagcacugcu

SEQ ID NO: 1830922 - RNA, 13 nt, Homo sapiens
cuggacucagggu

SEQ ID NO: 1830923 - RNA, 15 nt, Homo sapiens
cagguucuucagggc

SEQ ID NO: 1830924 - RNA, 16 nt, Homo sapiens
ucuacuucuugugcuu

SEQ ID NO: 1830925 - RNA, 18 nt, Homo sapiens
ccugaaugaccugcaguc

SEQ ID NO: 1830926 - RNA, 19 nt, Homo sapiens
cuccuuaagaacacaaagc

SEQ ID NO: 1830927 - RNA, 19 nt, Homo sapiens
agaaucuuguuaauuucau

SEQ ID NO: 1830928 - RNA, 21 nt, Homo sapiens
cacagacuggcaauaaacucc

SEQ ID NO: 1830929 - RNA, 15 nt, Homo sapiens
aaaugcaaaugcacu

SEQ ID NO: 1830930 - RNA, 14 nt, Homo sapiens
cugcuuuagacuug

SEQ ID NO: 1830931 - RNA, 13 nt, Homo sapiens
gugcuacacugga

SEQ ID NO: 1830932 - RNA, 17 nt, Homo sapiens
accaagaacauaagaau

SEQ ID NO: 1830933 - RNA, 17 nt, Homo sapiens
cauuauucuccuauuca

SEQ ID NO: 1830934 - RNA, 17 nt, Homo sapiens
ccuuguguaacuguguu

SEQ ID NO: 1830935 - RNA, 14 nt, Homo sapiens
gccacuuggccuca

SEQ ID NO: 1830936 - RNA, 14 nt, Homo sapiens
guguaccacuacuu

SEQ ID NO: 1830937 - RNA, 22 nt, Homo sapiens
uaauacuugcaacuaaggacaa

SEQ ID NO: 1830938 - RNA, 16 nt, Homo sapiens
uuagauuccuuuccug

SEQ ID NO: 1830939 - RNA, 12 nt, Homo sapiens
gguaaagugcaa

SEQ ID NO: 1830940 - RNA, 12 nt, Homo sapiens
gucagugucuua

SEQ ID NO: 1830941 - RNA, 19 nt, Homo sapiens
ggagcaucagccagugaau

SEQ ID NO: 1830942 - RNA, 22 nt, Homo sapiens
cagacaggaggaaucaugucag

SEQ ID NO: 1830943 - RNA, 19 nt, Homo sapiens
gaugacaaugggagccuca

SEQ ID NO: 1830944 - RNA, 16 nt, Homo sapiens
ucucaccagcugcaaa

SEQ ID NO: 1830945 - RNA, 17 nt, Homo sapiens
cuuacagucagcacaga

SEQ ID NO: 1830946 - RNA, 19 nt, Homo sapiens
agguucaauaugaaccaag

SEQ ID NO: 1830947 - RNA, 15 nt, Homo sapiens
ugauauagccagaaa

SEQ ID NO: 1830948 - RNA, 17 nt, Homo sapiens
gugaggugcccagcuag

SEQ ID NO: 1830949 - RNA, 19 nt, Homo sapiens
caaguucuggaaaccacgu

SEQ ID NO: 1830950 - RNA, 18 nt, Homo sapiens
uuucuaauggacuuucag

SEQ ID NO: 1830951 - RNA, 17 nt, Homo sapiens
uaagaagaaaauugcug

SEQ ID NO: 1830952 - RNA, 23 nt, Homo sapiens
cuuauguguaggugaacagucac

SEQ ID NO: 1830953 - RNA, 18 nt, Homo sapiens
aucaaguuugaccagugc

SEQ ID NO: 1830954 - RNA, 16 nt, Homo sapiens
cgccgcacgcuccauc

SEQ ID NO: 1830955 - RNA, 20 nt, Homo sapiens
uaauaaacugcaaaugugca

SEQ ID NO: 1830956 - RNA, 22 nt, Homo sapiens
cuauauuuucccuuauuacugc

SEQ ID NO: 1830957 - RNA, 18 nt, Homo sapiens
ugcaccccuccccauuca

SEQ ID NO: 1830958 - RNA, 20 nt, Homo sapiens
aaguacaaccacacccacac

SEQ ID NO: 1830959 - RNA, 15 nt, Homo sapiens
ucucuauguacagau

SEQ ID NO: 1830960 - RNA, 19 nt, Homo sapiens
auuguuuuuuuaauaacua

SEQ ID NO: 1830961 - RNA, 14 nt, Homo sapiens
caggcaugcaugug

SEQ ID NO: 1830962 - RNA, 16 nt, Homo sapiens
ucagcaguccacaaag

SEQ ID NO: 1830963 - RNA, 20 nt, Homo sapiens
acagacugaugccagacaaa

SEQ ID NO: 1830964 - RNA, 19 nt, Homo sapiens
ugcacguuaugguguuucu

SEQ ID NO: 1830965 - RNA, 14 nt, Homo sapiens
aauauaaacuauaa

SEQ ID NO: 1830966 - RNA, 16 nt, Homo sapiens
auaauggugcauuuau

SEQ ID NO: 1830967 - RNA, 16 nt, Homo sapiens
auaaaggagcauauaa

SEQ ID NO: 1830968 - RNA, 14 nt, Homo sapiens
acgcgggcgcugcc

SEQ ID NO: 1830969 - RNA, 17 nt, Homo sapiens
auaccugaccucacaga

SEQ ID NO: 1830970 - RNA, 13 nt, Homo sapiens
aggacuuucucuu

SEQ ID NO: 1830971 - RNA, 18 nt, Homo sapiens
accccaaggagggagaug

SEQ ID NO: 1830972 - RNA, 19 nt, Homo sapiens
uugggccuaaaacaguauu

SEQ ID NO: 1830973 - RNA, 23 nt, Homo sapiens
ccugugcuuuuggagcugagauc

SEQ ID NO: 1830974 - RNA, 19 nt, Homo sapiens
uccugccuaagguugucua

SEQ ID NO: 1830975 - RNA, 15 nt, Homo sapiens
auggcagaaccaaag

SEQ ID NO: 1830976 - RNA, 21 nt, Homo sapiens
cacagcaccuccauguggacu

SEQ ID NO: 1830977 - RNA, 14 nt, Homo sapiens
ucugcagucucuau

SEQ ID NO: 1830978 - RNA, 13 nt, Homo sapiens
ccacaggaucuga

SEQ ID NO: 1830979 - RNA, 12 nt, Homo sapiens
cccuccaaagag

SEQ ID NO: 1830980 - RNA, 22 nt, Homo sapiens
acagcuguaguaccccaagaag

SEQ ID NO: 1830981 - RNA, 20 nt, Homo sapiens
uacucaucgggcccagggac

SEQ ID NO: 1830982 - RNA, 17 nt, Homo sapiens
acuggcgagcagccacu

SEQ ID NO: 1830983 - RNA, 19 nt, Homo sapiens
cgauuaugcuuucuuuggc

SEQ ID NO: 1830984 - RNA, 23 nt, Homo sapiens
agcugaagaacuuggcacacucu

SEQ ID NO: 1830985 - RNA, 22 nt, Homo sapiens
ccuagagugacucuaccugcaa

SEQ ID NO: 1830986 - RNA, 14 nt, Homo sapiens
gguuugaagcugac

SEQ ID NO: 1830987 - RNA, 20 nt, Homo sapiens
gaagccuguggaugaucaau

SEQ ID NO: 1830988 - RNA, 13 nt, Homo sapiens
caaaguacaugua

SEQ ID NO: 1830989 - RNA, 22 nt, Homo sapiens
auucgcaauagacaaagugaag

SEQ ID NO: 1830990 - RNA, 18 nt, Homo sapiens
gucccucccaucucuacc

SEQ ID NO: 1830991 - RNA, 22 nt, Homo sapiens
gauuauuaaaauuagugcugua

SEQ ID NO: 1830992 - RNA, 13 nt, Homo sapiens
uaugcuauggaau

SEQ ID NO: 1830993 - RNA, 18 nt, Homo sapiens
uguuccugauaaacagag

SEQ ID NO: 1830994 - RNA, 12 nt, Homo sapiens
acgagacuccac

SEQ ID NO: 1830995 - RNA, 19 nt, Homo sapiens
ugcaugccccugaguguga

SEQ ID NO: 1830996 - RNA, 17 nt, Homo sapiens
acaaauuagcuaggcau

SEQ ID NO: 1830997 - RNA, 18 nt, Homo sapiens
cacugcagaacagcauca

SEQ ID NO: 1830998 - RNA, 22 nt, Homo sapiens
ccugucuggcagucuggagcaa

SEQ ID NO: 1830999 - RNA, 19 nt, Homo sapiens
auaauggcauguauuccaa

SEQ ID NO: 1831000 - RNA, 16 nt, Homo sapiens
uuccauucuuucuucc

SEQ ID NO: 1831001 - RNA, 16 nt, Homo sapiens
cuccuccucuucacuu

SEQ ID NO: 1831002 - RNA, 23 nt, Homo sapiens
caauaucuaauauauaugaauaa

SEQ ID NO: 1831003 - RNA, 18 nt, Homo sapiens
caguugugucagcuacug

SEQ ID NO: 1831004 - RNA, 16 nt, Homo sapiens
accauuuccccagggc

SEQ ID NO: 1831005 - RNA, 16 nt, Homo sapiens
gucuggagcucaccca

SEQ ID NO: 1831006 - RNA, 22 nt, Homo sapiens
agcuuccucuucuaccauuucc

SEQ ID NO: 1831007 - RNA, 14 nt, Homo sapiens
uguggcagccacac

SEQ ID NO: 1831008 - RNA, 21 nt, Homo sapiens
uuguuucuuccaagacuccag

SEQ ID NO: 1831009 - RNA, 15 nt, Homo sapiens
ggugcacuccagacu

SEQ ID NO: 1831010 - RNA, 21 nt, Homo sapiens
auguccucaguguaccacuac

SEQ ID NO: 1831011 - RNA, 20 nt, Homo sapiens
aggcuggagugcaauggugu

SEQ ID NO: 1831012 - RNA, 19 nt, Homo sapiens
uaccacaucugcucuaggg

SEQ ID NO: 1831013 - RNA, 16 nt, Homo sapiens
acccuuggagcucuga

SEQ ID NO: 1831014 - RNA, 17 nt, Homo sapiens
gacucaggccugccaau

SEQ ID NO: 1831015 - RNA, 13 nt, Homo sapiens
gagucaaauccag

SEQ ID NO: 1831016 - RNA, 22 nt, Homo sapiens
uagauguaugcacacacauaua

SEQ ID NO: 1831017 - RNA, 17 nt, Homo sapiens
ccucugugccauggaug

SEQ ID NO: 1831018 - RNA, 14 nt, Homo sapiens
uugccuggugaaug

SEQ ID NO: 1831019 - RNA, 19 nt, Homo sapiens
auuucagauacuugaagaa

SEQ ID NO: 1831020 - RNA, 13 nt, Homo sapiens
aauagacuaucua

SEQ ID NO: 1831021 - RNA, 12 nt, Homo sapiens
ugugccauguca

SEQ ID NO: 1831022 - RNA, 23 nt, Homo sapiens
aaagauuacccccaguccucccu

SEQ ID NO: 1831023 - RNA, 19 nt, Homo sapiens
caauauuugugugcuaaac

SEQ ID NO: 1831024 - RNA, 22 nt, Homo sapiens
uuaucucuaaaugugacaugca

SEQ ID NO: 1831025 - RNA, 16 nt, Homo sapiens
auguagaaaucucauc

SEQ ID NO: 1831026 - RNA, 17 nt, Homo sapiens
aauggagaaaaccagag

SEQ ID NO: 1831027 - RNA, 15 nt, Homo sapiens
aguccagccuagucu

SEQ ID NO: 1831028 - RNA, 15 nt, Homo sapiens
auuggcugaguccau

SEQ ID NO: 1831029 - RNA, 14 nt, Homo sapiens
ucacauccuguguu

SEQ ID NO: 1831030 - RNA, 20 nt, Homo sapiens
aauuuauucacauauaucaa

SEQ ID NO: 1831031 - RNA, 14 nt, Homo sapiens
cagguucagguguu

SEQ ID NO: 1831032 - RNA, 19 nt, Homo sapiens
aacccucccuguucauccc

SEQ ID NO: 1831033 - RNA, 19 nt, Homo sapiens
aauuaaauccaacuuucac

SEQ ID NO: 1831034 - RNA, 21 nt, Homo sapiens
gaaggcccaggucaacaucua

SEQ ID NO: 1831035 - RNA, 20 nt, Homo sapiens
aauccuuugugucgauuuca

SEQ ID NO: 1831036 - RNA, 14 nt, Homo sapiens
uguaggaacaagca

SEQ ID NO: 1831037 - RNA, 23 nt, Homo sapiens
ugucccuucucccaucagggucc

SEQ ID NO: 1831038 - RNA, 20 nt, Homo sapiens
ccuggggagcccacugaggg

SEQ ID NO: 1831039 - RNA, 13 nt, Homo sapiens
ccuugcaagccau

SEQ ID NO: 1831040 - RNA, 13 nt, Homo sapiens
cauuucaagacag

SEQ ID NO: 1831041 - RNA, 13 nt, Homo sapiens
ugacuucccaagc

SEQ ID NO: 1831042 - RNA, 13 nt, Homo sapiens
cagccuccugggu

SEQ ID NO: 1831043 - RNA, 13 nt, Homo sapiens
caaccaccauuca

SEQ ID NO: 1831044 - RNA, 21 nt, Homo sapiens
aacaauuguccauggucucaa

SEQ ID NO: 1831045 - RNA, 15 nt, Homo sapiens
auauuuaaugcauua

SEQ ID NO: 1831046 - RNA, 21 nt, Homo sapiens
cagagagcugcccuucagcga

SEQ ID NO: 1831047 - RNA, 16 nt, Homo sapiens
gccucaacacccuggg

SEQ ID NO: 1831048 - RNA, 16 nt, Homo sapiens
ugagaaauuucuguga

SEQ ID NO: 1831049 - RNA, 18 nt, Homo sapiens
cccccaauugcugccaau

SEQ ID NO: 1831050 - RNA, 18 nt, Homo sapiens
cagagaacugucuuucau

SEQ ID NO: 1831051 - RNA, 15 nt, Homo sapiens
gaacuauaacauuca

SEQ ID NO: 1831052 - RNA, 17 nt, Homo sapiens
uguaaaauuucacuuaa

SEQ ID NO: 1831053 - RNA, 15 nt, Homo sapiens
cuuuauuauuuugcu

SEQ ID NO: 1831054 - RNA, 16 nt, Homo sapiens
cgggugcaagcacucg

SEQ ID NO: 1831055 - RNA, 15 nt, Homo sapiens
agccccaagcugggc

SEQ ID NO: 1831056 - RNA, 14 nt, Homo sapiens
gcuuugguacuaau

SEQ ID NO: 1831057 - RNA, 15 nt, Homo sapiens
guacugcacaaggac

SEQ ID NO: 1831058 - RNA, 15 nt, Homo sapiens
cuucugaagauggaa

SEQ ID NO: 1831059 - RNA, 19 nt, Homo sapiens
gccugaccucaagcaacca

SEQ ID NO: 1831060 - RNA, 19 nt, Homo sapiens
cugaggucaugcauuguaa

SEQ ID NO: 1831061 - RNA, 14 nt, Homo sapiens
aauucaucagauaa

SEQ ID NO: 1831062 - RNA, 16 nt, Homo sapiens
gaaucccuuaaacuca

SEQ ID NO: 1831063 - RNA, 12 nt, Homo sapiens
ggggauuuugcu

SEQ ID NO: 1831064 - RNA, 13 nt, Homo sapiens
cugcuuacuaaug

SEQ ID NO: 1831065 - RNA, 16 nt, Homo sapiens
uccccauaggccauuu

SEQ ID NO: 1831066 - RNA, 16 nt, Homo sapiens
gccaaauaugcacuuu

SEQ ID NO: 1831067 - RNA, 18 nt, Homo sapiens
cacgucccggaccugugg

SEQ ID NO: 1831068 - RNA, 21 nt, Homo sapiens
uuugcuauaguuauacaucaa

SEQ ID NO: 1831069 - RNA, 21 nt, Homo sapiens
caacauggugaaacuccaucu

SEQ ID NO: 1831070 - RNA, 17 nt, Homo sapiens
ugcccaggaaaauaaca

SEQ ID NO: 1831071 - RNA, 13 nt, Homo sapiens
agagucuaaagau

SEQ ID NO: 1831072 - RNA, 17 nt, Homo sapiens
aguauaaagucacuucc

SEQ ID NO: 1831073 - RNA, 20 nt, Homo sapiens
acccuuucugccagggaugg

SEQ ID NO: 1831074 - RNA, 17 nt, Homo sapiens
auagcgaaucaucucaa

SEQ ID NO: 1831075 - RNA, 20 nt, Homo sapiens
cauggcuccagaaaugucua

SEQ ID NO: 1831076 - RNA, 17 nt, Homo sapiens
auccccuggacugggag

SEQ ID NO: 1831077 - RNA, 16 nt, Homo sapiens
uggcaauaaacuccua

SEQ ID NO: 1831078 - RNA, 17 nt, Homo sapiens
aaguauuaagcaguuca

SEQ ID NO: 1831079 - RNA, 18 nt, Homo sapiens
acaaaccugcaugguguu

SEQ ID NO: 1831080 - RNA, 17 nt, Homo sapiens
uaagaagagccauagcu

SEQ ID NO: 1831081 - RNA, 20 nt, Homo sapiens
cuggcccuccccacaaugcc

SEQ ID NO: 1831082 - RNA, 21 nt, Homo sapiens
gcucugugcacucacgcucag

SEQ ID NO: 1831083 - RNA, 22 nt, Homo sapiens
cugagcgaagcuauaggcucuu

SEQ ID NO: 1831084 - RNA, 17 nt, Homo sapiens
caaugucugguuaguua

SEQ ID NO: 1831085 - RNA, 22 nt, Homo sapiens
cgcugcacacagacggccuagg

SEQ ID NO: 1831086 - RNA, 20 nt, Homo sapiens
gaaacuaauauuuuauguga

SEQ ID NO: 1831087 - RNA, 10 nt, Homo sapiens
agaacacagg

SEQ ID NO: 1831088 - RNA, 14 nt, Homo sapiens
aacaaauaugcaaa

SEQ ID NO: 1831089 - RNA, 16 nt, Homo sapiens
uucugcucauucuaau

SEQ ID NO: 1831090 - RNA, 19 nt, Homo sapiens
uuugcauuaaauucacaaa

SEQ ID NO: 1831091 - RNA, 22 nt, Homo sapiens
aguuuugaaaggcuuuccucag

SEQ ID NO: 1831092 - RNA, 18 nt, Homo sapiens
ucuuugcauguaagcucu

SEQ ID NO: 1831093 - RNA, 14 nt, Homo sapiens
ggaagauaugccac

SEQ ID NO: 1831094 - RNA, 11 nt, Homo sapiens
acucacuccag

SEQ ID NO: 1831095 - RNA, 17 nt, Homo sapiens
ccucugcagauacacug

SEQ ID NO: 1831096 - RNA, 15 nt, Homo sapiens
aacaaagcaugcuca

SEQ ID NO: 1831097 - RNA, 19 nt, Homo sapiens
acuguauggaaacacugau

SEQ ID NO: 1831098 - RNA, 21 nt, Homo sapiens
gucaccacccacccuaccugc

SEQ ID NO: 1831099 - RNA, 21 nt, Homo sapiens
uacuccucacacuuacuguaa

SEQ ID NO: 1831100 - RNA, 22 nt, Homo sapiens
gugcaugccuggcacaacauca

SEQ ID NO: 1831101 - RNA, 13 nt, Homo sapiens
uggggaucugcau

SEQ ID NO: 1831102 - RNA, 16 nt, Homo sapiens
cccuguccugaugguc

SEQ ID NO: 1831103 - RNA, 16 nt, Homo sapiens
ugcuuuucccauugcc

SEQ ID NO: 1831104 - RNA, 23 nt, Homo sapiens
cuucaggggcacuucauugagag

SEQ ID NO: 1831105 - RNA, 22 nt, Homo sapiens
caaagaauuccugaagccagau

SEQ ID NO: 1831106 - RNA, 20 nt, Homo sapiens
agaaagccaacauguggcuc

SEQ ID NO: 1831107 - RNA, 17 nt, Homo sapiens
cuuugaaccugugcaau

SEQ ID NO: 1831108 - RNA, 14 nt, Homo sapiens
caauaguuugcaua

SEQ ID NO: 1831109 - RNA, 21 nt, Homo sapiens
gaguucccucaguacuauucc

SEQ ID NO: 1831110 - RNA, 14 nt, Homo sapiens
uugcuggacuguca

SEQ ID NO: 1831111 - RNA, 17 nt, Homo sapiens
ggaagaggagaugacag

SEQ ID NO: 1831112 - RNA, 14 nt, Homo sapiens
ugggcugggucccc

SEQ ID NO: 1831113 - RNA, 14 nt, Homo sapiens
uaccugccagauaa

SEQ ID NO: 1831114 - RNA, 18 nt, Homo sapiens
caauuugccauuguuucu

SEQ ID NO: 1831115 - RNA, 13 nt, Homo sapiens
acauuuaucacug

SEQ ID NO: 1831116 - RNA, 22 nt, Homo sapiens
uaaagggagauaacaaucugua

SEQ ID NO: 1831117 - RNA, 23 nt, Homo sapiens
uucauguggcucagugccuuccu

SEQ ID NO: 1831118 - RNA, 15 nt, Homo sapiens
auuguccccagggac

SEQ ID NO: 1831119 - RNA, 22 nt, Homo sapiens
aaaucuaaaugauuaucuugaa

SEQ ID NO: 1831120 - RNA, 18 nt, Homo sapiens
cacgcuaguuccauccac

SEQ ID NO: 1831121 - RNA, 17 nt, Homo sapiens
ugguugaaaaccacagu

SEQ ID NO: 1831122 - RNA, 14 nt, Homo sapiens
cuuaaauaugugaa

SEQ ID NO: 1831123 - RNA, 16 nt, Homo sapiens
gcauucgcacuggggg

SEQ ID NO: 1831124 - RNA, 22 nt, Homo sapiens
aguugggggccagcacagcuga

SEQ ID NO: 1831125 - RNA, 21 nt, Homo sapiens
agacuaaugcuuucuguggac

SEQ ID NO: 1831126 - RNA, 20 nt, Homo sapiens
gaaaauacgaaaaucccaug

SEQ ID NO: 1831127 - RNA, 15 nt, Homo sapiens
agcuucggcauuuga

SEQ ID NO: 1831128 - RNA, 15 nt, Homo sapiens
acucaaaauauguca

SEQ ID NO: 1831129 - RNA, 20 nt, Homo sapiens
gcauucuuaacaaacucuuc

SEQ ID NO: 1831130 - RNA, 20 nt, Homo sapiens
aauaauuagguuaacauugu

SEQ ID NO: 1831131 - RNA, 19 nt, Homo sapiens
agccuuauuuaugauguau

SEQ ID NO: 1831132 - RNA, 15 nt, Homo sapiens
uauauugggcucaga

SEQ ID NO: 1831133 - RNA, 23 nt, Homo sapiens
gauaaaauuacaggauaucacau

SEQ ID NO: 1831134 - RNA, 18 nt, Homo sapiens
aagcuucccuccaucccc

SEQ ID NO: 1831135 - RNA, 15 nt, Homo sapiens
ucguguacugcaaag

SEQ ID NO: 1831136 - RNA, 23 nt, Homo sapiens
aauacuacccauagaaaacuuga

SEQ ID NO: 1831137 - RNA, 12 nt, Homo sapiens
uugaucaguaua

SEQ ID NO: 1831138 - RNA, 15 nt, Homo sapiens
ccuaugggaaguagu

SEQ ID NO: 1831139 - RNA, 12 nt, Homo sapiens
agagguccaggu

SEQ ID NO: 1831140 - RNA, 19 nt, Homo sapiens
augcuauuugcaauuccug

SEQ ID NO: 1831141 - RNA, 19 nt, Homo sapiens
caagugucaccuccuuccc

SEQ ID NO: 1831142 - RNA, 12 nt, Homo sapiens
aacccaaacuuc

SEQ ID NO: 1831143 - RNA, 17 nt, Homo sapiens
ccugucuuagacuuuga

SEQ ID NO: 1831144 - RNA, 14 nt, Homo sapiens
caauagcaccccua

SEQ ID NO: 1831145 - RNA, 14 nt, Homo sapiens
cacguggagccuag

SEQ ID NO: 1831146 - RNA, 18 nt, Homo sapiens
cuauuccugaacuauaac

SEQ ID NO: 1831147 - RNA, 23 nt, Homo sapiens
cagaugcccacguaugugaaaca

SEQ ID NO: 1831148 - RNA, 18 nt, Homo sapiens
ucccuggaugacauuaaa

SEQ ID NO: 1831149 - RNA, 17 nt, Homo sapiens
auauugcucucauuuca

SEQ ID NO: 1831150 - RNA, 14 nt, Homo sapiens
cugucugugcacau

SEQ ID NO: 1831151 - RNA, 17 nt, Homo sapiens
caggccaccaguuaaau

SEQ ID NO: 1831152 - RNA, 21 nt, Homo sapiens
ccauggcccuuccuggacugg

SEQ ID NO: 1831153 - RNA, 19 nt, Homo sapiens
ggccaguuugaagacuaca

SEQ ID NO: 1831154 - RNA, 19 nt, Homo sapiens
uaaagaaaaaaauguauuu

SEQ ID NO: 1831155 - RNA, 19 nt, Homo sapiens
uuaguacacagcaccagaa

SEQ ID NO: 1831156 - RNA, 16 nt, Homo sapiens
gcagauggggcacuga

SEQ ID NO: 1831157 - RNA, 18 nt, Homo sapiens
uugccaugucuuguucag

SEQ ID NO: 1831158 - RNA, 17 nt, Homo sapiens
guccauuucaugugauc

SEQ ID NO: 1831159 - RNA, 19 nt, Homo sapiens
ggcuccuugcccucaagca

SEQ ID NO: 1831160 - RNA, 19 nt, Homo sapiens
uguggaaggugaucuggcu

SEQ ID NO: 1831161 - RNA, 18 nt, Homo sapiens
cacuucagaauuccauau

SEQ ID NO: 1831162 - RNA, 21 nt, Homo sapiens
aaguccuugcaagaauggaga

SEQ ID NO: 1831163 - RNA, 18 nt, Homo sapiens
cccugccgugguggcagc

SEQ ID NO: 1831164 - RNA, 14 nt, Homo sapiens
aacugcccuuccag

SEQ ID NO: 1831165 - RNA, 15 nt, Homo sapiens
caagaucugccagac

SEQ ID NO: 1831166 - RNA, 13 nt, Homo sapiens
acaacucugaaag

SEQ ID NO: 1831167 - RNA, 23 nt, Homo sapiens
agacacagcccccacggacaaaa

SEQ ID NO: 1831168 - RNA, 23 nt, Homo sapiens
cacgagcuagcuucugcaauguu

SEQ ID NO: 1831169 - RNA, 20 nt, Homo sapiens
acuucaguacucaaauucaa

SEQ ID NO: 1831170 - RNA, 15 nt, Homo sapiens
cguguauaugugcuu

SEQ ID NO: 1831171 - RNA, 17 nt, Homo sapiens
acacuagccugugcacg

SEQ ID NO: 1831172 - RNA, 23 nt, Homo sapiens
ugcaguuuaagaugacacuuuua

SEQ ID NO: 1831173 - RNA, 16 nt, Homo sapiens
cagaaaauguucuguu

SEQ ID NO: 1831174 - RNA, 22 nt, Homo sapiens
accacagguucucacuagauga

SEQ ID NO: 1831175 - RNA, 15 nt, Homo sapiens
uuuagugugccuucc

SEQ ID NO: 1831176 - RNA, 18 nt, Homo sapiens
ucuuaaucuuuucacaaa

SEQ ID NO: 1831177 - RNA, 19 nt, Homo sapiens
ggcaauuauuccccuaggc

SEQ ID NO: 1831178 - RNA, 12 nt, Homo sapiens
auggagcuuugu

SEQ ID NO: 1831179 - RNA, 15 nt, Homo sapiens
ccccaggacuguggg

SEQ ID NO: 1831180 - RNA, 12 nt, Homo sapiens
uucaaugugacu

SEQ ID NO: 1831181 - RNA, 19 nt, Homo sapiens
uguuugauaugaaguguua

SEQ ID NO: 1831182 - RNA, 17 nt, Homo sapiens
cucuguauaacuuguga

SEQ ID NO: 1831183 - RNA, 17 nt, Homo sapiens
ccugcuuucugguauaa

SEQ ID NO: 1831184 - RNA, 15 nt, Homo sapiens
ggucaccuugcacuc

SEQ ID NO: 1831185 - RNA, 23 nt, Homo sapiens
ugucucucuaguugaacccuggg

SEQ ID NO: 1831186 - RNA, 19 nt, Homo sapiens
uaugcaacugcaguucauc

SEQ ID NO: 1831187 - RNA, 16 nt, Homo sapiens
ucaagaaaacuggaaa

SEQ ID NO: 1831188 - RNA, 12 nt, Homo sapiens
uuuuuccugcau

SEQ ID NO: 1831189 - RNA, 14 nt, Homo sapiens
cugccucuuaaaua

SEQ ID NO: 1831190 - RNA, 21 nt, Homo sapiens
uguugaauucuuuugccaagg

SEQ ID NO: 1831191 - RNA, 17 nt, Homo sapiens
ugacugaacugcacguu

SEQ ID NO: 1831192 - RNA, 18 nt, Homo sapiens
uccaucaauggugagcac

SEQ ID NO: 1831193 - RNA, 23 nt, Homo sapiens
cuuuaccaaacagcaaaccaaga

SEQ ID NO: 1831194 - RNA, 15 nt, Homo sapiens
caagacaaauucaaa

SEQ ID NO: 1831195 - RNA, 17 nt, Homo sapiens
aaucccaaucuuucuau

SEQ ID NO: 1831196 - RNA, 15 nt, Homo sapiens
ucuugaacuccugac

SEQ ID NO: 1831197 - RNA, 23 nt, Homo sapiens
cauguuuugccacccccugugag

SEQ ID NO: 1831198 - RNA, 21 nt, Homo sapiens
acccagagaguccugugcuga

SEQ ID NO: 1831199 - RNA, 23 nt, Homo sapiens
acccaacgcggugcgcaccaacu

SEQ ID NO: 1831200 - RNA, 22 nt, Homo sapiens
aggacaccuuuuaacucaccuc

SEQ ID NO: 1831201 - RNA, 21 nt, Homo sapiens
cuuccagggggaaggccaagg

SEQ ID NO: 1831202 - RNA, 21 nt, Homo sapiens
aucuuuccucccuccucccac

SEQ ID NO: 1831203 - RNA, 14 nt, Homo sapiens
gacuuaaaacaaac

SEQ ID NO: 1831204 - RNA, 22 nt, Homo sapiens
cccauacuagacucauacucaa

SEQ ID NO: 1831205 - RNA, 16 nt, Homo sapiens
gccaggaaguagcaca

SEQ ID NO: 1831206 - RNA, 17 nt, Homo sapiens
acuguaaaaugugggau

SEQ ID NO: 1831207 - RNA, 16 nt, Homo sapiens
uggucaaaaccuacac

SEQ ID NO: 1831208 - RNA, 23 nt, Homo sapiens
aucucuaaaaugcuguucucaau

SEQ ID NO: 1831209 - RNA, 14 nt, Homo sapiens
cauucaguguaaau

SEQ ID NO: 1831210 - RNA, 14 nt, Homo sapiens
caaaauguguuuca

SEQ ID NO: 1831211 - RNA, 23 nt, Homo sapiens
ugaggugggaaaaucacuugaac

SEQ ID NO: 1831212 - RNA, 18 nt, Homo sapiens
ucuggaauacauauucca

SEQ ID NO: 1831213 - RNA, 13 nt, Homo sapiens
uaugaacuugucu

SEQ ID NO: 1831214 - RNA, 14 nt, Homo sapiens
cugaaacccaauga

SEQ ID NO: 1831215 - RNA, 13 nt, Homo sapiens
gucaccugcagcc

SEQ ID NO: 1831216 - RNA, 20 nt, Homo sapiens
auuuccaucagcccaucuca

SEQ ID NO: 1831217 - RNA, 22 nt, Homo sapiens
gucacccgagcuagagugcagu

SEQ ID NO: 1831218 - RNA, 20 nt, Homo sapiens
aaucucccgugggcaucuca

SEQ ID NO: 1831219 - RNA, 13 nt, Homo sapiens
gcaccagccaccc

SEQ ID NO: 1831220 - RNA, 15 nt, Homo sapiens
ccuuuuaacugccaa

SEQ ID NO: 1831221 - RNA, 15 nt, Homo sapiens
auugguuuugcagaa

SEQ ID NO: 1831222 - RNA, 12 nt, Homo sapiens
aauaaaccgugu

SEQ ID NO: 1831223 - RNA, 16 nt, Homo sapiens
agaauuuuaugucaua

SEQ ID NO: 1831224 - RNA, 23 nt, Homo sapiens
cugaaaaucacuauaaccaucag

SEQ ID NO: 1831225 - RNA, 21 nt, Homo sapiens
cuugaggaccuccaccuggga

SEQ ID NO: 1831226 - RNA, 22 nt, Homo sapiens
accuuguuccuguaaaauccau

SEQ ID NO: 1831227 - RNA, 21 nt, Homo sapiens
uauuugcaguucaccugcacu

SEQ ID NO: 1831228 - RNA, 21 nt, Homo sapiens
uuuuucacauaucuaguauga

SEQ ID NO: 1831229 - RNA, 14 nt, Homo sapiens
aauugaccuuguga

SEQ ID NO: 1831230 - RNA, 15 nt, Homo sapiens
cacuuucgccuccuc

SEQ ID NO: 1831231 - RNA, 21 nt, Homo sapiens
ucaacucacuagaugccaaug

SEQ ID NO: 1831232 - RNA, 16 nt, Homo sapiens
uuucuaauuugcugcu

SEQ ID NO: 1831233 - RNA, 17 nt, Homo sapiens
caaauggacuauacaua

SEQ ID NO: 1831234 - RNA, 22 nt, Homo sapiens
uggaaugagacuggcuugcccu

SEQ ID NO: 1831235 - RNA, 20 nt, Homo sapiens
aagcgauucucaugccucag

SEQ ID NO: 1831236 - RNA, 21 nt, Homo sapiens
aaaagccauguauuucaggga

SEQ ID NO: 1831237 - RNA, 19 nt, Homo sapiens
cuaccuggcucuccugucu

SEQ ID NO: 1831238 - RNA, 18 nt, Homo sapiens
aggacgugggcagcaaaa

SEQ ID NO: 1831239 - RNA, 18 nt, Homo sapiens
aagagaacauuuuacugu

SEQ ID NO: 1831240 - RNA, 22 nt, Homo sapiens
aagaucuaccugcaacacaaca

SEQ ID NO: 1831241 - RNA, 18 nt, Homo sapiens
agacucuccuucaggguu

SEQ ID NO: 1831242 - RNA, 15 nt, Homo sapiens
caugagauaacucaa

SEQ ID NO: 1831243 - RNA, 14 nt, Homo sapiens
uucaccaacaacag

SEQ ID NO: 1831244 - RNA, 16 nt, Homo sapiens
uggguccuucaaacaa

SEQ ID NO: 1831245 - RNA, 17 nt, Homo sapiens
agugauauuguggguaa

SEQ ID NO: 1831246 - RNA, 14 nt, Homo sapiens
cuccgcuacuucca

SEQ ID NO: 1831247 - RNA, 20 nt, Homo sapiens
gcccacuguaacaauacugg

SEQ ID NO: 1831248 - RNA, 14 nt, Homo sapiens
gagccuugcaugua

SEQ ID NO: 1831249 - RNA, 15 nt, Homo sapiens
auacacaugugcaca

SEQ ID NO: 1831250 - RNA, 18 nt, Homo sapiens
cuggggaauaaacuccag

SEQ ID NO: 1831251 - RNA, 15 nt, Homo sapiens
cacagccucagaaua

SEQ ID NO: 1831252 - RNA, 16 nt, Homo sapiens
aaacaucauuacuaua

SEQ ID NO: 1831253 - RNA, 15 nt, Homo sapiens
caacuggagcacuga

SEQ ID NO: 1831254 - RNA, 15 nt, Homo sapiens
guguggcaaacauuu

SEQ ID NO: 1831255 - RNA, 15 nt, Homo sapiens
augucccccuuaugu

SEQ ID NO: 1831256 - RNA, 15 nt, Homo sapiens
gcauccuaaggacga

SEQ ID NO: 1831257 - RNA, 17 nt, Homo sapiens
augggcuuagagcucuc

SEQ ID NO: 1831258 - RNA, 14 nt, Homo sapiens
ucucuuucaaaaag

SEQ ID NO: 1831259 - RNA, 18 nt, Homo sapiens
cuugcuaauuuucucaaa

SEQ ID NO: 1831260 - RNA, 13 nt, Homo sapiens
ucagcgagcauaa

SEQ ID NO: 1831261 - RNA, 15 nt, Homo sapiens
agacuuauugccaaa

SEQ ID NO: 1831262 - RNA, 17 nt, Homo sapiens
gucguuuuuagcuuugu

SEQ ID NO: 1831263 - RNA, 19 nt, Homo sapiens
gauuuaaauagaacuugau

SEQ ID NO: 1831264 - RNA, 15 nt, Homo sapiens
cacacuggugacugc

SEQ ID NO: 1831265 - RNA, 13 nt, Homo sapiens
agaagaguggcag

SEQ ID NO: 1831266 - RNA, 14 nt, Homo sapiens
cgucuggacugcua

SEQ ID NO: 1831267 - RNA, 18 nt, Homo sapiens
cccuuaaggaucacccca

SEQ ID NO: 1831268 - RNA, 15 nt, Homo sapiens
acagcaauagugaau

SEQ ID NO: 1831269 - RNA, 17 nt, Homo sapiens
acagcugcauggcacau

SEQ ID NO: 1831270 - RNA, 13 nt, Homo sapiens
ucuagaacacuca

SEQ ID NO: 1831271 - RNA, 13 nt, Homo sapiens
uucuguaauuuga

SEQ ID NO: 1831272 - RNA, 15 nt, Homo sapiens
ggcucuaccaagaca

SEQ ID NO: 1831273 - RNA, 20 nt, Homo sapiens
uugaaucuacauucacuuuu

SEQ ID NO: 1831274 - RNA, 15 nt, Homo sapiens
gcuggcaggagacac

SEQ ID NO: 1831275 - RNA, 16 nt, Homo sapiens
aagaaagccacacaga

SEQ ID NO: 1831276 - RNA, 23 nt, Homo sapiens
ccugucauugcgaccauuucuca

SEQ ID NO: 1831277 - RNA, 17 nt, Homo sapiens
agcagaaaaucuaccaa

SEQ ID NO: 1831278 - RNA, 15 nt, Homo sapiens
agaccaaguuaucau

SEQ ID NO: 1831279 - RNA, 20 nt, Homo sapiens
guaccuuucuucacugcaga

SEQ ID NO: 1831280 - RNA, 15 nt, Homo sapiens
gauggaaaauaccag

SEQ ID NO: 1831281 - RNA, 22 nt, Homo sapiens
uccccgggguauuagcaccucu

SEQ ID NO: 1831282 - RNA, 21 nt, Homo sapiens
guacuucaaguuaaagugaau

SEQ ID NO: 1831283 - RNA, 23 nt, Homo sapiens
acuuuuucucgaguccaaaauca

SEQ ID NO: 1831284 - RNA, 18 nt, Homo sapiens
gcuaauuuugaaugcccu

SEQ ID NO: 1831285 - RNA, 23 nt, Homo sapiens
ugacaaaaguaagagagcacagu

SEQ ID NO: 1831286 - RNA, 11 nt, Homo sapiens
cucagccagcc

SEQ ID NO: 1831287 - RNA, 20 nt, Homo sapiens
uuucuauuaaaagacucauc

SEQ ID NO: 1831288 - RNA, 21 nt, Homo sapiens
auuuauccuauaagaugacaa

SEQ ID NO: 1831289 - RNA, 23 nt, Homo sapiens
gaccauacauaauaaccaaacau

SEQ ID NO: 1831290 - RNA, 18 nt, Homo sapiens
gccacugccucucccucu

SEQ ID NO: 1831291 - RNA, 21 nt, Homo sapiens
augagcuccugcucauugugg

SEQ ID NO: 1831292 - RNA, 15 nt, Homo sapiens
ugggucacauccauc

SEQ ID NO: 1831293 - RNA, 13 nt, Homo sapiens
uaacagugcaaaa

SEQ ID NO: 1831294 - RNA, 17 nt, Homo sapiens
gcuggauacuggacaca

SEQ ID NO: 1831295 - RNA, 18 nt, Homo sapiens
cagcuguccagcugcaaa

SEQ ID NO: 1831296 - RNA, 22 nt, Homo sapiens
uauuguuaggaaaugucaucaa

SEQ ID NO: 1831297 - RNA, 18 nt, Homo sapiens
cugaccuuggguccugaa

SEQ ID NO: 1831298 - RNA, 15 nt, Homo sapiens
guugaaaaccacagu

SEQ ID NO: 1831299 - RNA, 18 nt, Homo sapiens
uucauuuuaaauauuguc

SEQ ID NO: 1831300 - RNA, 15 nt, Homo sapiens
ggaggaauacauuuu

SEQ ID NO: 1831301 - RNA, 21 nt, Homo sapiens
aggaaagaaguucacaucaga

SEQ ID NO: 1831302 - RNA, 17 nt, Homo sapiens
cuuacuuuugugagucu

SEQ ID NO: 1831303 - RNA, 24 nt, Homo sapiens
agaaaagcugaugaggcuggugac

SEQ ID NO: 1831304 - RNA, 18 nt, Homo sapiens
acgggcaugggcacuccc

SEQ ID NO: 1831305 - RNA, 15 nt, Homo sapiens
cagucauacaaguca

SEQ ID NO: 1831306 - RNA, 16 nt, Homo sapiens
acuggauauguuguua

SEQ ID NO: 1831307 - RNA, 21 nt, Homo sapiens
ugggcaacauugcuggcugga

SEQ ID NO: 1831308 - RNA, 22 nt, Homo sapiens
ccuauugggagaggucauaaaa

SEQ ID NO: 1831309 - RNA, 17 nt, Homo sapiens
uaugccauauacaaaaa

SEQ ID NO: 1831310 - RNA, 23 nt, Homo sapiens
ggacuguuccaggcccuccagug

SEQ ID NO: 1831311 - RNA, 19 nt, Homo sapiens
uaugugagugaaaguacuu

SEQ ID NO: 1831312 - RNA, 14 nt, Homo sapiens
gcacagguauuuca

SEQ ID NO: 1831313 - RNA, 14 nt, Homo sapiens
ggaaaacagcuauu

SEQ ID NO: 1831314 - RNA, 19 nt, Homo sapiens
aggccaggaguucccaaau

SEQ ID NO: 1831315 - RNA, 20 nt, Homo sapiens
cucaguuaggcagugcagua

SEQ ID NO: 1831316 - RNA, 20 nt, Homo sapiens
ccuccaucauuaaugugaag

SEQ ID NO: 1831317 - RNA, 13 nt, Homo sapiens
caguuucuugcaa

SEQ ID NO: 1831318 - RNA, 19 nt, Homo sapiens
agaaaucaauaguugaauu

SEQ ID NO: 1831319 - RNA, 18 nt, Homo sapiens
agcugagcacagcagggg

SEQ ID NO: 1831320 - RNA, 14 nt, Homo sapiens
ggaaagugggacag

SEQ ID NO: 1831321 - RNA, 16 nt, Homo sapiens
cuugccauccugaugg

SEQ ID NO: 1831322 - RNA, 19 nt, Homo sapiens
cgucccgugucuccagggg

SEQ ID NO: 1831323 - RNA, 15 nt, Homo sapiens
augggaaacuuccaa

SEQ ID NO: 1831324 - RNA, 23 nt, Homo sapiens
acagaagacaaaauuguaagcca

SEQ ID NO: 1831325 - RNA, 22 nt, Homo sapiens
ugaggcaggagggcaugugcag

SEQ ID NO: 1831326 - RNA, 14 nt, Homo sapiens
cagccccuuuccaa

SEQ ID NO: 1831327 - RNA, 17 nt, Homo sapiens
ccagggcagugcuagug

SEQ ID NO: 1831328 - RNA, 19 nt, Homo sapiens
auucaguauuagcaaugga

SEQ ID NO: 1831329 - RNA, 19 nt, Homo sapiens
agagcaguuucuguccugc

SEQ ID NO: 1831330 - RNA, 22 nt, Homo sapiens
ucaggaaaucaaauaugcaaag

SEQ ID NO: 1831331 - RNA, 15 nt, Homo sapiens
ccacucugacuggca

SEQ ID NO: 1831332 - RNA, 16 nt, Homo sapiens
agucccuauaguauau

SEQ ID NO: 1831333 - RNA, 21 nt, Homo sapiens
gcaagguuggcgacugucaug

SEQ ID NO: 1831334 - RNA, 14 nt, Homo sapiens
ucaagccaggagac

SEQ ID NO: 1831335 - RNA, 18 nt, Homo sapiens
uguucauauuuauugauu

SEQ ID NO: 1831336 - RNA, 15 nt, Homo sapiens
ugcuccagacaggga

SEQ ID NO: 1831337 - RNA, 12 nt, Homo sapiens
ucagaacagaca

SEQ ID NO: 1831338 - RNA, 18 nt, Homo sapiens
ucugcuuuuaaagauaug

SEQ ID NO: 1831339 - RNA, 19 nt, Homo sapiens
aauccuguugaaaagccau

SEQ ID NO: 1831340 - RNA, 21 nt, Homo sapiens
cuugagcaagucccaucucac

SEQ ID NO: 1831341 - RNA, 18 nt, Homo sapiens
ccagggucugaaaggggu

SEQ ID NO: 1831342 - RNA, 17 nt, Homo sapiens
aucccauccaucagcuc

SEQ ID NO: 1831343 - RNA, 22 nt, Homo sapiens
gcacucagaaaagaaaaccauu

SEQ ID NO: 1831344 - RNA, 16 nt, Homo sapiens
cccucagauuugauga

SEQ ID NO: 1831345 - RNA, 18 nt, Homo sapiens
acuuaaaaaaagcacaug

SEQ ID NO: 1831346 - RNA, 17 nt, Homo sapiens
agagaacuaacacuauu

SEQ ID NO: 1831347 - RNA, 23 nt, Homo sapiens
uucaagugcuucuccagccucag

SEQ ID NO: 1831348 - RNA, 16 nt, Homo sapiens
auaacugaaccaaauu

SEQ ID NO: 1831349 - RNA, 20 nt, Homo sapiens
ugaauuauuuccugcuuauu

SEQ ID NO: 1831350 - RNA, 19 nt, Homo sapiens
ucaaagucuaacauauuca

SEQ ID NO: 1831351 - RNA, 10 nt, Homo sapiens
uuuugccaac

SEQ ID NO: 1831352 - RNA, 18 nt, Homo sapiens
aaagguuuaugaaaaaga

SEQ ID NO: 1831353 - RNA, 15 nt, Homo sapiens
guaacuuucugcuga

SEQ ID NO: 1831354 - RNA, 20 nt, Homo sapiens
auguuuaaggaaaugugcag

SEQ ID NO: 1831355 - RNA, 17 nt, Homo sapiens
acaaggcccugagcuuu

SEQ ID NO: 1831356 - RNA, 21 nt, Homo sapiens
uugaaaaagggaagccauucc

SEQ ID NO: 1831357 - RNA, 15 nt, Homo sapiens
aucaggaaccacaga

SEQ ID NO: 1831358 - RNA, 16 nt, Homo sapiens
agcaagcccugaccca

SEQ ID NO: 1831359 - RNA, 16 nt, Homo sapiens
aaaaugcucaaucuca

SEQ ID NO: 1831360 - RNA, 16 nt, Homo sapiens
gggcgggccagggugg

SEQ ID NO: 1831361 - RNA, 16 nt, Homo sapiens
gggcuuaccaggugag

SEQ ID NO: 1831362 - RNA, 15 nt, Homo sapiens
uccugcagucccaca

SEQ ID NO: 1831363 - RNA, 22 nt, Homo sapiens
ccuuaaucugccauaaagccau

SEQ ID NO: 1831364 - RNA, 18 nt, Homo sapiens
uaguacuaguacuaugac

SEQ ID NO: 1831365 - RNA, 18 nt, Homo sapiens
aacacugggcucugagga

SEQ ID NO: 1831366 - RNA, 15 nt, Homo sapiens
caaacccuggugcuu

SEQ ID NO: 1831367 - RNA, 12 nt, Homo sapiens
aauggaaccagg

SEQ ID NO: 1831368 - RNA, 15 nt, Homo sapiens
cagggcagggcucau

SEQ ID NO: 1831369 - RNA, 21 nt, Homo sapiens
uugcaugaucugucaaaguga

SEQ ID NO: 1831370 - RNA, 13 nt, Homo sapiens
ugugcacauuuau

SEQ ID NO: 1831371 - RNA, 18 nt, Homo sapiens
aaucagguccucagagaa

SEQ ID NO: 1831372 - RNA, 17 nt, Homo sapiens
auggacacuacacuggg

SEQ ID NO: 1831373 - RNA, 18 nt, Homo sapiens
acaagggcugcaaugccc

SEQ ID NO: 1831374 - RNA, 19 nt, Homo sapiens
uuaaaauucagugagauau

SEQ ID NO: 1831375 - RNA, 20 nt, Homo sapiens
uacaaaaauaaaaggcuucc

SEQ ID NO: 1831376 - RNA, 19 nt, Homo sapiens
aaauaaaaacaaaaccaca

SEQ ID NO: 1831377 - RNA, 19 nt, Homo sapiens
acagaauguaucugugaag

SEQ ID NO: 1831378 - RNA, 15 nt, Homo sapiens
aggaaacuaauuucc

SEQ ID NO: 1831379 - RNA, 12 nt, Homo sapiens
ccucucuuugac

SEQ ID NO: 1831380 - RNA, 20 nt, Homo sapiens
ugcacuagaggaacccuaca

SEQ ID NO: 1831381 - RNA, 19 nt, Homo sapiens
uuggaauauuuuauccugu

SEQ ID NO: 1831382 - RNA, 13 nt, Homo sapiens
uuccauuuguagg

SEQ ID NO: 1831383 - RNA, 20 nt, Homo sapiens
ccagcaagccgaauagcuga

SEQ ID NO: 1831384 - RNA, 20 nt, Homo sapiens
cuuaugacuaaaaauaucac

SEQ ID NO: 1831385 - RNA, 15 nt, Homo sapiens
uuuuaaaaauugauu

SEQ ID NO: 1831386 - RNA, 15 nt, Homo sapiens
uaugcuuaaauucaa

SEQ ID NO: 1831387 - RNA, 14 nt, Homo sapiens
uccaacucuucacg

SEQ ID NO: 1831388 - RNA, 15 nt, Homo sapiens
cuccaccccccggcc

SEQ ID NO: 1831389 - RNA, 17 nt, Homo sapiens
cccagacuagauguagu

SEQ ID NO: 1831390 - RNA, 22 nt, Homo sapiens
gagcaguuagaaauacauuaug

SEQ ID NO: 1831391 - RNA, 13 nt, Homo sapiens
uagaucuccugua

SEQ ID NO: 1831392 - RNA, 11 nt, Homo sapiens
uacauggguag

SEQ ID NO: 1831393 - RNA, 19 nt, Homo sapiens
guuacuggauuuguuguuc

SEQ ID NO: 1831394 - RNA, 24 nt, Homo sapiens
caaaggaagugagguagugccaau

SEQ ID NO: 1831395 - RNA, 17 nt, Homo sapiens
uccagggcugccaggag

SEQ ID NO: 1831396 - RNA, 12 nt, Homo sapiens
uaggaguacaag

SEQ ID NO: 1831397 - RNA, 13 nt, Homo sapiens
uuauaguacauga

SEQ ID NO: 1831398 - RNA, 22 nt, Homo sapiens
cagcagcuucucuccacugaaa

SEQ ID NO: 1831399 - RNA, 14 nt, Homo sapiens
uguacaggugucac

SEQ ID NO: 1831400 - RNA, 16 nt, Homo sapiens
aaguucauccuuugac

SEQ ID NO: 1831401 - RNA, 21 nt, Homo sapiens
uggugucaguaguuuuacuga

SEQ ID NO: 1831402 - RNA, 13 nt, Homo sapiens
uguucugcacuga

SEQ ID NO: 1831403 - RNA, 21 nt, Homo sapiens
ccugugcuuguguuugcugcu

SEQ ID NO: 1831404 - RNA, 11 nt, Homo sapiens
gacaucacugu

SEQ ID NO: 1831405 - RNA, 17 nt, Homo sapiens
ccagagcccacuccauc

SEQ ID NO: 1831406 - RNA, 22 nt, Homo sapiens
aucucaaccaggauccugaugu

SEQ ID NO: 1831407 - RNA, 15 nt, Homo sapiens
acaaauaaauguuca

SEQ ID NO: 1831408 - RNA, 18 nt, Homo sapiens
uucugacacuuucugcug

SEQ ID NO: 1831409 - RNA, 20 nt, Homo sapiens
gauauauuuaagccuuauaa

SEQ ID NO: 1831410 - RNA, 21 nt, Homo sapiens
agaaaauucuaccuggcuaca

SEQ ID NO: 1831411 - RNA, 14 nt, Homo sapiens
aacauaguuuucac

SEQ ID NO: 1831412 - RNA, 14 nt, Homo sapiens
cuguagaacugcaa

SEQ ID NO: 1831413 - RNA, 18 nt, Homo sapiens
cugaacauaaaucaguua

SEQ ID NO: 1831414 - RNA, 14 nt, Homo sapiens
ccuguaaauaguuu

SEQ ID NO: 1831415 - RNA, 17 nt, Homo sapiens
ugaaaaagauggcuacu

SEQ ID NO: 1831416 - RNA, 12 nt, Homo sapiens
accccaagucca

SEQ ID NO: 1831417 - RNA, 18 nt, Homo sapiens
acagaaagacugagcuca

SEQ ID NO: 1831418 - RNA, 14 nt, Homo sapiens
cuuuaucuaaagaa

SEQ ID NO: 1831419 - RNA, 16 nt, Homo sapiens
ucuaauucaguucuga

SEQ ID NO: 1831420 - RNA, 20 nt, Homo sapiens
gacguccucccugaucccac

SEQ ID NO: 1831421 - RNA, 19 nt, Homo sapiens
uaauuuuuuguacuuuuag

SEQ ID NO: 1831422 - RNA, 15 nt, Homo sapiens
ccaggcaaggcugac

SEQ ID NO: 1831423 - RNA, 13 nt, Homo sapiens
uugguggggccag

SEQ ID NO: 1831424 - RNA, 15 nt, Homo sapiens
acuggaaagcacaag

SEQ ID NO: 1831425 - RNA, 14 nt, Homo sapiens
accagcuacuugau

SEQ ID NO: 1831426 - RNA, 13 nt, Homo sapiens
aguccacucccag

SEQ ID NO: 1831427 - RNA, 21 nt, Homo sapiens
ggaagagauaaacgaccaaac

SEQ ID NO: 1831428 - RNA, 16 nt, Homo sapiens
aagagagagccaugaa

SEQ ID NO: 1831429 - RNA, 14 nt, Homo sapiens
agguccggaggggu

SEQ ID NO: 1831430 - RNA, 23 nt, Homo sapiens
uuccucagaacaaugaaaaaagu

SEQ ID NO: 1831431 - RNA, 14 nt, Homo sapiens
aggagucagggaga

SEQ ID NO: 1831432 - RNA, 14 nt, Homo sapiens
aaugaucagaugaa

SEQ ID NO: 1831433 - RNA, 18 nt, Homo sapiens
uuccauguggcugacuag

SEQ ID NO: 1831434 - RNA, 16 nt, Homo sapiens
ccuuugggacuaagcu

SEQ ID NO: 1831435 - RNA, 21 nt, Homo sapiens
agagcccuucacugccaugau

SEQ ID NO: 1831436 - RNA, 14 nt, Homo sapiens
uagcauaacuguag

SEQ ID NO: 1831437 - RNA, 16 nt, Homo sapiens
ucuggagaaaugcuua

SEQ ID NO: 1831438 - RNA, 13 nt, Homo sapiens
uaaguguugggaa

SEQ ID NO: 1831439 - RNA, 22 nt, Homo sapiens
cgugaacuuuaugcuguaaaua

SEQ ID NO: 1831440 - RNA, 21 nt, Homo sapiens
ccggguucaagugauucucau

SEQ ID NO: 1831441 - RNA, 19 nt, Homo sapiens
caaaauggauacauaaaga

SEQ ID NO: 1831442 - RNA, 22 nt, Homo sapiens
gaaucaacaauaguaacucuuu

SEQ ID NO: 1831443 - RNA, 22 nt, Homo sapiens
uccgaaugagaauuuauuguga

SEQ ID NO: 1831444 - RNA, 17 nt, Homo sapiens
uuguaacaauagcacaa

SEQ ID NO: 1831445 - RNA, 16 nt, Homo sapiens
uguguguuuaccuaaa

SEQ ID NO: 1831446 - RNA, 13 nt, Homo sapiens
aaugugcauuucu

SEQ ID NO: 1831447 - RNA, 18 nt, Homo sapiens
cuccaccuugcucuucuu

SEQ ID NO: 1831448 - RNA, 21 nt, Homo sapiens
agccauugcggccccaggagg

SEQ ID NO: 1831449 - RNA, 19 nt, Homo sapiens
gugacaugggugugccagg

SEQ ID NO: 1831450 - RNA, 14 nt, Homo sapiens
cuuucaaaagcaag

SEQ ID NO: 1831451 - RNA, 15 nt, Homo sapiens
uaaucugcaugaagg

SEQ ID NO: 1831452 - RNA, 18 nt, Homo sapiens
auuaucgugucugcauuu

SEQ ID NO: 1831453 - RNA, 13 nt, Homo sapiens
gaaagcccuucuc

SEQ ID NO: 1831454 - RNA, 16 nt, Homo sapiens
cuggcuucaggaauau

SEQ ID NO: 1831455 - RNA, 22 nt, Homo sapiens
uccauauagucuauucauuaag

SEQ ID NO: 1831456 - RNA, 21 nt, Homo sapiens
cuaaggucauuucuuugcuua

SEQ ID NO: 1831457 - RNA, 21 nt, Homo sapiens
gaaccccaaaucccacagggc

SEQ ID NO: 1831458 - RNA, 22 nt, Homo sapiens
gaacccaagcuuagaacuuuaa

SEQ ID NO: 1831459 - RNA, 21 nt, Homo sapiens
aaacaugcugaaaacuacaca

SEQ ID NO: 1831460 - RNA, 16 nt, Homo sapiens
gaugagaaacaacaga

SEQ ID NO: 1831461 - RNA, 14 nt, Homo sapiens
acuccagacuugua

SEQ ID NO: 1831462 - RNA, 20 nt, Homo sapiens
cuaaaugcagucagucacaa

SEQ ID NO: 1831463 - RNA, 14 nt, Homo sapiens
ugccacugccuucg

SEQ ID NO: 1831464 - RNA, 23 nt, Homo sapiens
cagcagcaacaacugucaguuca

SEQ ID NO: 1831465 - RNA, 22 nt, Homo sapiens
guguugcauagcauaagccaaa

SEQ ID NO: 1831466 - RNA, 14 nt, Homo sapiens
gccgcugcugacca

SEQ ID NO: 1831467 - RNA, 14 nt, Homo sapiens
acacgaugcauuua

SEQ ID NO: 1831468 - RNA, 14 nt, Homo sapiens
ccaauucugaaaua

SEQ ID NO: 1831469 - RNA, 13 nt, Homo sapiens
cguuugcuuaaug

SEQ ID NO: 1831470 - RNA, 14 nt, Homo sapiens
ucacugagaagauu

SEQ ID NO: 1831471 - RNA, 22 nt, Homo sapiens
ugggcaagggaccugcuucuau

SEQ ID NO: 1831472 - RNA, 17 nt, Homo sapiens
uacguuaaaauuacuuu

SEQ ID NO: 1831473 - RNA, 18 nt, Homo sapiens
ugccaggcuguaagcauu

SEQ ID NO: 1831474 - RNA, 13 nt, Homo sapiens
cagccucccugag

SEQ ID NO: 1831475 - RNA, 19 nt, Homo sapiens
cagcucuaccaguucucgu

SEQ ID NO: 1831476 - RNA, 15 nt, Homo sapiens
cgcccgcauagcacu

SEQ ID NO: 1831477 - RNA, 14 nt, Homo sapiens
cuguuuaauugaca

SEQ ID NO: 1831478 - RNA, 19 nt, Homo sapiens
uaagcuccuucaguuugaa

SEQ ID NO: 1831479 - RNA, 21 nt, Homo sapiens
aacacucaucuccucuguaau

SEQ ID NO: 1831480 - RNA, 21 nt, Homo sapiens
auugcuuaucaguaguaucaa

SEQ ID NO: 1831481 - RNA, 12 nt, Homo sapiens
aggggccugcag

SEQ ID NO: 1831482 - RNA, 21 nt, Homo sapiens
uauaugcuggacugcauucac

SEQ ID NO: 1831483 - RNA, 20 nt, Homo sapiens
cucugacaaagugugucuca

SEQ ID NO: 1831484 - RNA, 22 nt, Homo sapiens
ugaagaagaccagucacagcca

SEQ ID NO: 1831485 - RNA, 22 nt, Homo sapiens
agcaaagacuuaaucauaucaa

SEQ ID NO: 1831486 - RNA, 22 nt, Homo sapiens
auuccaacagcucaagucuucc

SEQ ID NO: 1831487 - RNA, 13 nt, Homo sapiens
ucugaaucagaaa

SEQ ID NO: 1831488 - RNA, 20 nt, Homo sapiens
caaaggaucuggaccaguuu

SEQ ID NO: 1831489 - RNA, 21 nt, Homo sapiens
uuuuaaagccagaagucacau

SEQ ID NO: 1831490 - RNA, 13 nt, Homo sapiens
aaucaucuucucc

SEQ ID NO: 1831491 - RNA, 16 nt, Homo sapiens
cuaagaauaauggacu

SEQ ID NO: 1831492 - RNA, 16 nt, Homo sapiens
caaaucccauugucac

SEQ ID NO: 1831493 - RNA, 10 nt, Homo sapiens
uuuguucccu

SEQ ID NO: 1831494 - RNA, 20 nt, Homo sapiens
ccuuccuugaacccuaauaa

SEQ ID NO: 1831495 - RNA, 12 nt, Homo sapiens
cuuggggggcca

SEQ ID NO: 1831496 - RNA, 19 nt, Homo sapiens
ggauuaaccugccagggag

SEQ ID NO: 1831497 - RNA, 14 nt, Homo sapiens
ugagcuggcccuuu

SEQ ID NO: 1831498 - RNA, 11 nt, Homo sapiens
agugaguucaa

SEQ ID NO: 1831499 - RNA, 17 nt, Homo sapiens
acucgucuuccuuguua

SEQ ID NO: 1831500 - RNA, 21 nt, Homo sapiens
gagaggaggcagcaggacugu

SEQ ID NO: 1831501 - RNA, 19 nt, Homo sapiens
agauggugcuaaaccauuc

SEQ ID NO: 1831502 - RNA, 14 nt, Homo sapiens
caucugaccagcag

SEQ ID NO: 1831503 - RNA, 19 nt, Homo sapiens
agauguucuggauaccauu

SEQ ID NO: 1831504 - RNA, 15 nt, Homo sapiens
gcaaauacacuccag

SEQ ID NO: 1831505 - RNA, 22 nt, Homo sapiens
cugggcccaagugauccuucca

SEQ ID NO: 1831506 - RNA, 14 nt, Homo sapiens
cuuauggcaucuca

SEQ ID NO: 1831507 - RNA, 21 nt, Homo sapiens
cauguaucacucacugccaaa

SEQ ID NO: 1831508 - RNA, 19 nt, Homo sapiens
cagcacccagcaacuccaa

SEQ ID NO: 1831509 - RNA, 17 nt, Homo sapiens
accccgcggugcucugg

SEQ ID NO: 1831510 - RNA, 15 nt, Homo sapiens
ccgacuccacuuuca

SEQ ID NO: 1831511 - RNA, 16 nt, Homo sapiens
gccagaggcaccucaa

SEQ ID NO: 1831512 - RNA, 21 nt, Homo sapiens
acauacaagcauaagcaaaac

SEQ ID NO: 1831513 - RNA, 16 nt, Homo sapiens
cuaaccugaacugaug

SEQ ID NO: 1831514 - RNA, 20 nt, Homo sapiens
auuugugaaaagaguaugua

SEQ ID NO: 1831515 - RNA, 19 nt, Homo sapiens
gucacuucaugcaggugaa

SEQ ID NO: 1831516 - RNA, 13 nt, Homo sapiens
uucugcacuugcg

SEQ ID NO: 1831517 - RNA, 18 nt, Homo sapiens
aauuauaaucucauuuca

SEQ ID NO: 1831518 - RNA, 15 nt, Homo sapiens
aacuaauacaauuca

SEQ ID NO: 1831519 - RNA, 19 nt, Homo sapiens
cagcuggaaucugaaggcg

SEQ ID NO: 1831520 - RNA, 15 nt, Homo sapiens
cagaacuauaacauu

SEQ ID NO: 1831521 - RNA, 18 nt, Homo sapiens
acaggcuggugcuaacau

SEQ ID NO: 1831522 - RNA, 14 nt, Homo sapiens
uccauuccauggaa

SEQ ID NO: 1831523 - RNA, 17 nt, Homo sapiens
aagacagggcuucucuc

SEQ ID NO: 1831524 - RNA, 18 nt, Homo sapiens
aacuguuacuguccuguu

SEQ ID NO: 1831525 - RNA, 19 nt, Homo sapiens
cagggucucacucugucgc

SEQ ID NO: 1831526 - RNA, 21 nt, Homo sapiens
ccuaacaugacaguauuccau

SEQ ID NO: 1831527 - RNA, 17 nt, Homo sapiens
auggagguuaagcacuu

SEQ ID NO: 1831528 - RNA, 14 nt, Homo sapiens
ugccccucucacca

SEQ ID NO: 1831529 - RNA, 15 nt, Homo sapiens
cuuuguuacugucca

SEQ ID NO: 1831530 - RNA, 15 nt, Homo sapiens
gucauuaaaccagau

SEQ ID NO: 1831531 - RNA, 11 nt, Homo sapiens
aauaaauucca

SEQ ID NO: 1831532 - RNA, 18 nt, Homo sapiens
uguauaguugcuugccug

SEQ ID NO: 1831533 - RNA, 21 nt, Homo sapiens
uacaucuaccuaaaggacuau

SEQ ID NO: 1831534 - RNA, 16 nt, Homo sapiens
gucacugcugucauca

SEQ ID NO: 1831535 - RNA, 19 nt, Homo sapiens
ccagaaaccacaagcaaaa

SEQ ID NO: 1831536 - RNA, 19 nt, Homo sapiens
cucuaggccuguugccucg

SEQ ID NO: 1831537 - RNA, 21 nt, Homo sapiens
aucagauccgugcgugaagua

SEQ ID NO: 1831538 - RNA, 14 nt, Homo sapiens
gcugggcacugcca

SEQ ID NO: 1831539 - RNA, 21 nt, Homo sapiens
gccacuguccggaaauucaug

SEQ ID NO: 1831540 - RNA, 16 nt, Homo sapiens
auccagaccucuacaa

SEQ ID NO: 1831541 - RNA, 16 nt, Homo sapiens
guccccuccucaguga

SEQ ID NO: 1831542 - RNA, 18 nt, Homo sapiens
acucugagugaauacuuu

SEQ ID NO: 1831543 - RNA, 17 nt, Homo sapiens
gcacaguaucugcuguu

SEQ ID NO: 1831544 - RNA, 19 nt, Homo sapiens
cuggccucugccuuugguu

SEQ ID NO: 1831545 - RNA, 19 nt, Homo sapiens
aaaguuuugcaacaauaaa

SEQ ID NO: 1831546 - RNA, 20 nt, Homo sapiens
cugaguaagaaaugcugccc

SEQ ID NO: 1831547 - RNA, 17 nt, Homo sapiens
uggaugugauugccuca

SEQ ID NO: 1831548 - RNA, 21 nt, Homo sapiens
ccuagcuggcucugugagggu

SEQ ID NO: 1831549 - RNA, 13 nt, Homo sapiens
accagcagcaauc

SEQ ID NO: 1831550 - RNA, 23 nt, Homo sapiens
guaggcccugguuccugcugucc

SEQ ID NO: 1831551 - RNA, 19 nt, Homo sapiens
ccaucucuuuguguaauag

SEQ ID NO: 1831552 - RNA, 18 nt, Homo sapiens
gaucuauuacucugacau

SEQ ID NO: 1831553 - RNA, 16 nt, Homo sapiens
uagguuuagcaguaua

SEQ ID NO: 1831554 - RNA, 21 nt, Homo sapiens
cauggagaccucaugccaugg

SEQ ID NO: 1831555 - RNA, 17 nt, Homo sapiens
ucaauguucauuguaau

SEQ ID NO: 1831556 - RNA, 13 nt, Homo sapiens
ucuuuccuacaca

SEQ ID NO: 1831557 - RNA, 18 nt, Homo sapiens
uaaaguucagugugcuga

SEQ ID NO: 1831558 - RNA, 16 nt, Homo sapiens
uauugguguacuguaa

SEQ ID NO: 1831559 - RNA, 14 nt, Homo sapiens
uccaggaguuugag

SEQ ID NO: 1831560 - RNA, 17 nt, Homo sapiens
cucugaacacacauugc

SEQ ID NO: 1831561 - RNA, 22 nt, Homo sapiens
aguuugaggcugcagugagcca

SEQ ID NO: 1831562 - RNA, 14 nt, Homo sapiens
uugguauucuguuc

SEQ ID NO: 1831563 - RNA, 16 nt, Homo sapiens
aaagaggacaggcuac

SEQ ID NO: 1831564 - RNA, 18 nt, Homo sapiens
agaaacaguuccauucaa

SEQ ID NO: 1831565 - RNA, 20 nt, Homo sapiens
uacugggucugcgaugcagc

SEQ ID NO: 1831566 - RNA, 21 nt, Homo sapiens
auaacauguaaaauccagggu

SEQ ID NO: 1831567 - RNA, 19 nt, Homo sapiens
cugcacgugaccucugaca

SEQ ID NO: 1831568 - RNA, 13 nt, Homo sapiens
gcugucucaggag

SEQ ID NO: 1831569 - RNA, 20 nt, Homo sapiens
acuguccuauuauauucauu

SEQ ID NO: 1831570 - RNA, 20 nt, Homo sapiens
gaggcaggagagucacuuga

SEQ ID NO: 1831571 - RNA, 18 nt, Homo sapiens
uaggaaacacugauuaac

SEQ ID NO: 1831572 - RNA, 20 nt, Homo sapiens
acacauuuccauucauggau

SEQ ID NO: 1831573 - RNA, 22 nt, Homo sapiens
cucccuagccagaggcucuaau

SEQ ID NO: 1831574 - RNA, 21 nt, Homo sapiens
gguauuggugcuuugugucua

SEQ ID NO: 1831575 - RNA, 14 nt, Homo sapiens
uuuauuuccaaaau

SEQ ID NO: 1831576 - RNA, 18 nt, Homo sapiens
aucguacacacucaguga

SEQ ID NO: 1831577 - RNA, 11 nt, Homo sapiens
auuagugccau

SEQ ID NO: 1831578 - RNA, 11 nt, Homo sapiens
cucagugcaac

SEQ ID NO: 1831579 - RNA, 23 nt, Homo sapiens
gcuuccuagaaaguucuguguaa

SEQ ID NO: 1831580 - RNA, 15 nt, Homo sapiens
cugugucuaagauuc

SEQ ID NO: 1831581 - RNA, 22 nt, Homo sapiens
gagggcgaccccgucacagccu

SEQ ID NO: 1831582 - RNA, 22 nt, Homo sapiens
gucuauaacuccuuguuucaga

SEQ ID NO: 1831583 - RNA, 22 nt, Homo sapiens
caacgauuguauuugugacuuu

SEQ ID NO: 1831584 - RNA, 18 nt, Homo sapiens
ccauuagagaaguauuua

SEQ ID NO: 1831585 - RNA, 15 nt, Homo sapiens
gggccuucauugucu

SEQ ID NO: 1831586 - RNA, 17 nt, Homo sapiens
auaaggaauaaagccuu

SEQ ID NO: 1831587 - RNA, 17 nt, Homo sapiens
cuugaguuaaccuugcu

SEQ ID NO: 1831588 - RNA, 13 nt, Homo sapiens
gcuaaugucacaa

SEQ ID NO: 1831589 - RNA, 15 nt, Homo sapiens
ccacuaauugccuua

SEQ ID NO: 1831590 - RNA, 18 nt, Homo sapiens
aucuacacccaccagagu

SEQ ID NO: 1831591 - RNA, 14 nt, Homo sapiens
ugcuaaaaauaacu

SEQ ID NO: 1831592 - RNA, 16 nt, Homo sapiens
aagaggugaccauaaa

SEQ ID NO: 1831593 - RNA, 14 nt, Homo sapiens
gacaucacagcagc

SEQ ID NO: 1831594 - RNA, 21 nt, Homo sapiens
caaauuuagaagaaaaaacca

SEQ ID NO: 1831595 - RNA, 17 nt, Homo sapiens
acuucugagaccuuguu

SEQ ID NO: 1831596 - RNA, 16 nt, Homo sapiens
acucacauccucacuu

SEQ ID NO: 1831597 - RNA, 17 nt, Homo sapiens
caaggccagaugcacau

SEQ ID NO: 1831598 - RNA, 21 nt, Homo sapiens
gacucuaagaaagaacacgcu

SEQ ID NO: 1831599 - RNA, 20 nt, Homo sapiens
acucucccuuguacagccuu

SEQ ID NO: 1831600 - RNA, 17 nt, Homo sapiens
aaaucuuguuaauguca

SEQ ID NO: 1831601 - RNA, 17 nt, Homo sapiens
uagagugaccuuuuaau

SEQ ID NO: 1831602 - RNA, 17 nt, Homo sapiens
cacugugaccugcuccu

SEQ ID NO: 1831603 - RNA, 16 nt, Homo sapiens
gcuaaguggcuuccca

SEQ ID NO: 1831604 - RNA, 23 nt, Homo sapiens
cuauuuauuuuuucuaagugugg

SEQ ID NO: 1831605 - RNA, 18 nt, Homo sapiens
cacugcauuaucuugcuc

SEQ ID NO: 1831606 - RNA, 13 nt, Homo sapiens
guuuucacuguau

SEQ ID NO: 1831607 - RNA, 20 nt, Homo sapiens
ucuggccuugaaaccaccuu

SEQ ID NO: 1831608 - RNA, 21 nt, Homo sapiens
cagggggccuccaggagaccc

SEQ ID NO: 1831609 - RNA, 16 nt, Homo sapiens
cacaauuucuuuaaaa

SEQ ID NO: 1831610 - RNA, 22 nt, Homo sapiens
ccugggguucgaaaucagugag

SEQ ID NO: 1831611 - RNA, 15 nt, Homo sapiens
gccagcccacugccu

SEQ ID NO: 1831612 - RNA, 15 nt, Homo sapiens
uagagaaugauuuca

SEQ ID NO: 1831613 - RNA, 15 nt, Homo sapiens
gauuuaccagcuuaa

SEQ ID NO: 1831614 - RNA, 17 nt, Homo sapiens
auaaauuguagggcuuu

SEQ ID NO: 1831615 - RNA, 19 nt, Homo sapiens
uaguuuaaaaagaaauuga

SEQ ID NO: 1831616 - RNA, 19 nt, Homo sapiens
auuguuaaacuuuguaaag

SEQ ID NO: 1831617 - RNA, 19 nt, Homo sapiens
agauggugcagaugccugc

SEQ ID NO: 1831618 - RNA, 14 nt, Homo sapiens
uccugucacugagc

SEQ ID NO: 1831619 - RNA, 18 nt, Homo sapiens
ugcuggggaucuagggaa

SEQ ID NO: 1831620 - RNA, 21 nt, Homo sapiens
auagugggguuccaugaguua

SEQ ID NO: 1831621 - RNA, 20 nt, Homo sapiens
gucacauaaugaaugcuauu

SEQ ID NO: 1831622 - RNA, 21 nt, Homo sapiens
uccuguuugaugugacaggaa

SEQ ID NO: 1831623 - RNA, 13 nt, Homo sapiens
aaagcucaucuca

SEQ ID NO: 1831624 - RNA, 16 nt, Homo sapiens
uguucaguguugacau

SEQ ID NO: 1831625 - RNA, 14 nt, Homo sapiens
cuauaaccuggauu

SEQ ID NO: 1831626 - RNA, 20 nt, Homo sapiens
caguacacaggggcuugacu

SEQ ID NO: 1831627 - RNA, 21 nt, Homo sapiens
uguuuauuaguucuguauaca

SEQ ID NO: 1831628 - RNA, 17 nt, Homo sapiens
aagccagaguuccaugu

SEQ ID NO: 1831629 - RNA, 22 nt, Homo sapiens
ccuggaggugggagacaaggaa

SEQ ID NO: 1831630 - RNA, 19 nt, Homo sapiens
guaaaauuuugucauauac

SEQ ID NO: 1831631 - RNA, 16 nt, Homo sapiens
ucaggguaccuggggc

SEQ ID NO: 1831632 - RNA, 12 nt, Homo sapiens
guaggaugucuc

SEQ ID NO: 1831633 - RNA, 15 nt, Homo sapiens
caaccuguucugcuu

SEQ ID NO: 1831634 - RNA, 23 nt, Homo sapiens
acccugguggaggcuucuugccc

SEQ ID NO: 1831635 - RNA, 16 nt, Homo sapiens
gcagauaccuggugag

SEQ ID NO: 1831636 - RNA, 18 nt, Homo sapiens
aauguagugaagggaugu

SEQ ID NO: 1831637 - RNA, 16 nt, Homo sapiens
acacacacacaccucu

SEQ ID NO: 1831638 - RNA, 16 nt, Homo sapiens
agaauggaagccugaa

SEQ ID NO: 1831639 - RNA, 21 nt, Homo sapiens
cuugucugagaacaaauacaa

SEQ ID NO: 1831640 - RNA, 19 nt, Homo sapiens
auauugaggcauucaagga

SEQ ID NO: 1831641 - RNA, 18 nt, Homo sapiens
agaauuaagauacaaauu

SEQ ID NO: 1831642 - RNA, 15 nt, Homo sapiens
accucacacgcuggg

SEQ ID NO: 1831643 - RNA, 13 nt, Homo sapiens
aaaugcuauaauu

SEQ ID NO: 1831644 - RNA, 21 nt, Homo sapiens
caguucuaugcagaacaguga

SEQ ID NO: 1831645 - RNA, 16 nt, Homo sapiens
auguaauaaugugaau

SEQ ID NO: 1831646 - RNA, 20 nt, Homo sapiens
cuuaauuguuagcuauuuau

SEQ ID NO: 1831647 - RNA, 11 nt, Homo sapiens
cugaagggaaa

SEQ ID NO: 1831648 - RNA, 21 nt, Homo sapiens
gcaaugggagggggcuccaug

SEQ ID NO: 1831649 - RNA, 13 nt, Homo sapiens
cuuucucugagaa

SEQ ID NO: 1831650 - RNA, 22 nt, Homo sapiens
uaugacuguuuuuguaguggua

SEQ ID NO: 1831651 - RNA, 11 nt, Homo sapiens
auguguugccc

SEQ ID NO: 1831652 - RNA, 17 nt, Homo sapiens
gaggcucagccacacag

SEQ ID NO: 1831653 - RNA, 17 nt, Homo sapiens
gcagcauuuuauuuacc

SEQ ID NO: 1831654 - RNA, 19 nt, Homo sapiens
uggggacuggggaagggga

SEQ ID NO: 1831655 - RNA, 17 nt, Homo sapiens
auacuuguaaucccagc

SEQ ID NO: 1831656 - RNA, 13 nt, Homo sapiens
caaucacugccaa

SEQ ID NO: 1831657 - RNA, 12 nt, Homo sapiens
cacguggagcuc

SEQ ID NO: 1831658 - RNA, 23 nt, Homo sapiens
ugacagccccuuauuugcacuuc

SEQ ID NO: 1831659 - RNA, 18 nt, Homo sapiens
gcuacuauguacugccuu

SEQ ID NO: 1831660 - RNA, 18 nt, Homo sapiens
aaugcuaagaaugcauua

SEQ ID NO: 1831661 - RNA, 15 nt, Homo sapiens
cucccuaugcuuuca

SEQ ID NO: 1831662 - RNA, 22 nt, Homo sapiens
uacauccuugauuacuuccacu

SEQ ID NO: 1831663 - RNA, 14 nt, Homo sapiens
ugagacuugccuuc

SEQ ID NO: 1831664 - RNA, 20 nt, Homo sapiens
ggcgacagagcgagacucca

SEQ ID NO: 1831665 - RNA, 20 nt, Homo sapiens
ggcaacagagcaagacucca

SEQ ID NO: 1831666 - RNA, 16 nt, Homo sapiens
agacagacuugagaac

SEQ ID NO: 1831667 - RNA, 13 nt, Homo sapiens
uugccuguucagu

SEQ ID NO: 1831668 - RNA, 21 nt, Homo sapiens
caaaaguuucuuacucaagga

SEQ ID NO: 1831669 - RNA, 15 nt, Homo sapiens
agacauggauuugau

SEQ ID NO: 1831670 - RNA, 21 nt, Homo sapiens
auauauuguguugacuuuaua

SEQ ID NO: 1831671 - RNA, 23 nt, Homo sapiens
gcucuauaagagcuggaugcaca

SEQ ID NO: 1831672 - RNA, 14 nt, Homo sapiens
cugguccuguggau

SEQ ID NO: 1831673 - RNA, 21 nt, Homo sapiens
guaauuguacuaaagccaaac

SEQ ID NO: 1831674 - RNA, 22 nt, Homo sapiens
ccuuucucgugguagaagccag

SEQ ID NO: 1831675 - RNA, 12 nt, Homo sapiens
aguagacagggu

SEQ ID NO: 1831676 - RNA, 16 nt, Homo sapiens
uaaauccaugcaccua

SEQ ID NO: 1831677 - RNA, 22 nt, Homo sapiens
ucccccuggggcacuugcugag

SEQ ID NO: 1831678 - RNA, 23 nt, Homo sapiens
cauauucuuaaugacauuucacu

SEQ ID NO: 1831679 - RNA, 23 nt, Homo sapiens
ugcucagguacuuguaaauuauu

SEQ ID NO: 1831680 - RNA, 20 nt, Homo sapiens
ugagauauuugguaccaugg

SEQ ID NO: 1831681 - RNA, 20 nt, Homo sapiens
cgcggcaggcuucucagucu

SEQ ID NO: 1831682 - RNA, 22 nt, Homo sapiens
uccagagcugcagagagcaccu

SEQ ID NO: 1831683 - RNA, 19 nt, Homo sapiens
uuaaauaagauuuaauuca

SEQ ID NO: 1831684 - RNA, 20 nt, Homo sapiens
aacuccuggaucccuuucac

SEQ ID NO: 1831685 - RNA, 20 nt, Homo sapiens
cagagcuugaacacagucuc

SEQ ID NO: 1831686 - RNA, 13 nt, Homo sapiens
cccuaaaauccau

SEQ ID NO: 1831687 - RNA, 12 nt, Homo sapiens
acagauugccau

SEQ ID NO: 1831688 - RNA, 22 nt, Homo sapiens
gaaccucagcaagaccuugaac

SEQ ID NO: 1831689 - RNA, 11 nt, Homo sapiens
caaaaccucca

SEQ ID NO: 1831690 - RNA, 22 nt, Homo sapiens
cuuucaaaagaagaguuuuaga

SEQ ID NO: 1831691 - RNA, 18 nt, Homo sapiens
cugauugcuuuauccaaa

SEQ ID NO: 1831692 - RNA, 14 nt, Homo sapiens
agcuauuaagauac

SEQ ID NO: 1831693 - RNA, 13 nt, Homo sapiens
ucaguaaggcagu

SEQ ID NO: 1831694 - RNA, 13 nt, Homo sapiens
gaacaaaguaaca

SEQ ID NO: 1831695 - RNA, 17 nt, Homo sapiens
uugggggagucaugguc

SEQ ID NO: 1831696 - RNA, 16 nt, Homo sapiens
uggauggcacaaugaa

SEQ ID NO: 1831697 - RNA, 20 nt, Homo sapiens
uuucagauggaggugccaua

SEQ ID NO: 1831698 - RNA, 22 nt, Homo sapiens
gcaaugggauguaugaauacag

SEQ ID NO: 1831699 - RNA, 20 nt, Homo sapiens
agcuuuuggcugcaaguaac

SEQ ID NO: 1831700 - RNA, 17 nt, Homo sapiens
cauccagugacaaacca

SEQ ID NO: 1831701 - RNA, 18 nt, Homo sapiens
ucaacacagguagcacag

SEQ ID NO: 1831702 - RNA, 22 nt, Homo sapiens
cuagacuaagaagauuuaguuu

SEQ ID NO: 1831703 - RNA, 15 nt, Homo sapiens
agacagacucugaau

SEQ ID NO: 1831704 - RNA, 15 nt, Homo sapiens
cugaguccaugaaaa

SEQ ID NO: 1831705 - RNA, 19 nt, Homo sapiens
accaauuguacauucccug

SEQ ID NO: 1831706 - RNA, 17 nt, Homo sapiens
ccugggggauaccagcu

SEQ ID NO: 1831707 - RNA, 19 nt, Homo sapiens
aauugggggagcugcaguc

SEQ ID NO: 1831708 - RNA, 23 nt, Homo sapiens
gaaaguauguaccaaaacauuga

SEQ ID NO: 1831709 - RNA, 22 nt, Homo sapiens
auugaaggcuuaauugacugaa

SEQ ID NO: 1831710 - RNA, 22 nt, Homo sapiens
gaagucuuuucugucaccaaau

SEQ ID NO: 1831711 - RNA, 19 nt, Homo sapiens
cuugucucuuccucugcag

SEQ ID NO: 1831712 - RNA, 23 nt, Homo sapiens
aaugugaaaaaaaaaaguaauua

SEQ ID NO: 1831713 - RNA, 18 nt, Homo sapiens
cccaguucuucauuugga

SEQ ID NO: 1831714 - RNA, 18 nt, Homo sapiens
agcaucggucaugugugu

SEQ ID NO: 1831715 - RNA, 18 nt, Homo sapiens
auccuuaaugcagagcua

SEQ ID NO: 1831716 - RNA, 15 nt, Homo sapiens
uugcagugagccaag

SEQ ID NO: 1831717 - RNA, 15 nt, Homo sapiens
uaccauguugcccag

SEQ ID NO: 1831718 - RNA, 23 nt, Homo sapiens
cuuuccccggaguaccuauugua

SEQ ID NO: 1831719 - RNA, 14 nt, Homo sapiens
guaacuacugcuaa

SEQ ID NO: 1831720 - RNA, 20 nt, Homo sapiens
uaagagaaucaacauuucuc

SEQ ID NO: 1831721 - RNA, 21 nt, Homo sapiens
guccugcuccgcugccuggaa

SEQ ID NO: 1831722 - RNA, 19 nt, Homo sapiens
ucaggaccccaucugcuga

SEQ ID NO: 1831723 - RNA, 16 nt, Homo sapiens
cuuuuauuugcaacau

SEQ ID NO: 1831724 - RNA, 17 nt, Homo sapiens
uacacauugcuaccuca

SEQ ID NO: 1831725 - RNA, 20 nt, Homo sapiens
caaggaaggguguugcagag

SEQ ID NO: 1831726 - RNA, 11 nt, Homo sapiens
aggagauucca

SEQ ID NO: 1831727 - RNA, 16 nt, Homo sapiens
cuccauccuaccacaa

SEQ ID NO: 1831728 - RNA, 14 nt, Homo sapiens
caagguguuuccau

SEQ ID NO: 1831729 - RNA, 18 nt, Homo sapiens
acaaggcaaaaacaaaga

SEQ ID NO: 1831730 - RNA, 16 nt, Homo sapiens
guacuauuacuauuac

SEQ ID NO: 1831731 - RNA, 18 nt, Homo sapiens
aagcuuuuuagugcauua

SEQ ID NO: 1831732 - RNA, 19 nt, Homo sapiens
ugaaagcugaauccuucca

SEQ ID NO: 1831733 - RNA, 16 nt, Homo sapiens
ugccaagacaugauua

SEQ ID NO: 1831734 - RNA, 20 nt, Homo sapiens
cagccauuccugaagcccac

SEQ ID NO: 1831735 - RNA, 16 nt, Homo sapiens
ggaaaaguuagucaau

SEQ ID NO: 1831736 - RNA, 12 nt, Homo sapiens
cuccccauuugc

SEQ ID NO: 1831737 - RNA, 12 nt, Homo sapiens
agaaauugauua

SEQ ID NO: 1831738 - RNA, 14 nt, Homo sapiens
agcaucgggagcac

SEQ ID NO: 1831739 - RNA, 19 nt, Homo sapiens
aaaaugcugaacauugcau

SEQ ID NO: 1831740 - RNA, 13 nt, Homo sapiens
aaaggcucugugc

SEQ ID NO: 1831741 - RNA, 19 nt, Homo sapiens
ugcacaggaugggggcaau

SEQ ID NO: 1831742 - RNA, 18 nt, Homo sapiens
auuuugugaauacuaugu

SEQ ID NO: 1831743 - RNA, 18 nt, Homo sapiens
augaaaauagccaaccag

SEQ ID NO: 1831744 - RNA, 14 nt, Homo sapiens
ugaccuuugucuca

SEQ ID NO: 1831745 - RNA, 15 nt, Homo sapiens
aucuggagucuuccu

SEQ ID NO: 1831746 - RNA, 21 nt, Homo sapiens
uacuaauuuuccauaagcuau

SEQ ID NO: 1831747 - RNA, 14 nt, Homo sapiens
acaugaacagacac

SEQ ID NO: 1831748 - RNA, 14 nt, Homo sapiens
caucugccaaaaug

SEQ ID NO: 1831749 - RNA, 20 nt, Homo sapiens
aggcaaaauugauauacuuu

SEQ ID NO: 1831750 - RNA, 21 nt, Homo sapiens
gaauacccuaaaguauaacau

SEQ ID NO: 1831751 - RNA, 21 nt, Homo sapiens
aacauuccguuuacauuuuag

SEQ ID NO: 1831752 - RNA, 14 nt, Homo sapiens
uauaaaugccagag

SEQ ID NO: 1831753 - RNA, 14 nt, Homo sapiens
uaucaagguggaaa

SEQ ID NO: 1831754 - RNA, 19 nt, Homo sapiens
aaagaauguucagcucaac

SEQ ID NO: 1831755 - RNA, 21 nt, Homo sapiens
guggugagccgagauugcacc

SEQ ID NO: 1831756 - RNA, 18 nt, Homo sapiens
aagcauccaggcacccaa

SEQ ID NO: 1831757 - RNA, 18 nt, Homo sapiens
agaggcugggagguuggg

SEQ ID NO: 1831758 - RNA, 14 nt, Homo sapiens
aaugaauguuuaca

SEQ ID NO: 1831759 - RNA, 20 nt, Homo sapiens
ugacagcuucaugaaacugu

SEQ ID NO: 1831760 - RNA, 20 nt, Homo sapiens
aagaagggaagccuuuugca

SEQ ID NO: 1831761 - RNA, 21 nt, Homo sapiens
cagaaucucucuucuuuucaa

SEQ ID NO: 1831762 - RNA, 20 nt, Homo sapiens
aaauaguccuccaaaacaca

SEQ ID NO: 1831763 - RNA, 13 nt, Homo sapiens
cagcgacauuucu

SEQ ID NO: 1831764 - RNA, 23 nt, Homo sapiens
uuaucugugcgugaaacacacca

SEQ ID NO: 1831765 - RNA, 17 nt, Homo sapiens
ccccucacaauccuugc

SEQ ID NO: 1831766 - RNA, 14 nt, Homo sapiens
ucacagaacugcag

SEQ ID NO: 1831767 - RNA, 17 nt, Homo sapiens
ucaacauuucucaauaa

SEQ ID NO: 1831768 - RNA, 19 nt, Homo sapiens
acacaugggcauauucuga

SEQ ID NO: 1831769 - RNA, 21 nt, Homo sapiens
ggagccuggcuccguccagga

SEQ ID NO: 1831770 - RNA, 20 nt, Homo sapiens
auuuuccugaauauuaaucc

SEQ ID NO: 1831771 - RNA, 21 nt, Homo sapiens
ucccggcgggugcucugaggc

SEQ ID NO: 1831772 - RNA, 19 nt, Homo sapiens
auuaguuugaagcauugac

SEQ ID NO: 1831773 - RNA, 13 nt, Homo sapiens
auugcacaacaga

SEQ ID NO: 1831774 - RNA, 20 nt, Homo sapiens
caagaggcugguuuuggcau

SEQ ID NO: 1831775 - RNA, 18 nt, Homo sapiens
aguauauugggggaggaa

SEQ ID NO: 1831776 - RNA, 13 nt, Homo sapiens
auaccgugggggu

SEQ ID NO: 1831777 - RNA, 21 nt, Homo sapiens
aaauaaauccaagacugucau

SEQ ID NO: 1831778 - RNA, 20 nt, Homo sapiens
gagguugugcauggaggcca

SEQ ID NO: 1831779 - RNA, 16 nt, Homo sapiens
guauaagcacugaaaa

SEQ ID NO: 1831780 - RNA, 20 nt, Homo sapiens
auaaaauauuugcuucacuu

SEQ ID NO: 1831781 - RNA, 20 nt, Homo sapiens
uuuucaauuaguaacauuca

SEQ ID NO: 1831782 - RNA, 23 nt, Homo sapiens
auacauggaaucgaaguguuuau

SEQ ID NO: 1831783 - RNA, 11 nt, Homo sapiens
ugaagaugucc

SEQ ID NO: 1831784 - RNA, 12 nt, Homo sapiens
gggagggugaga

SEQ ID NO: 1831785 - RNA, 14 nt, Homo sapiens
acuuauuuuaauuc

SEQ ID NO: 1831786 - RNA, 12 nt, Homo sapiens
ccuucacuuaaa

SEQ ID NO: 1831787 - RNA, 14 nt, Homo sapiens
uguuuggagcucua

SEQ ID NO: 1831788 - RNA, 20 nt, Homo sapiens
aaauauauacccccccaugc

SEQ ID NO: 1831789 - RNA, 14 nt, Homo sapiens
caaaucucuuccuu

SEQ ID NO: 1831790 - RNA, 18 nt, Homo sapiens
gacagucgagaagccagg

SEQ ID NO: 1831791 - RNA, 23 nt, Homo sapiens
aaggccuuuggaaagacuugaau

SEQ ID NO: 1831792 - RNA, 18 nt, Homo sapiens
guaucauguauggugaua

SEQ ID NO: 1831793 - RNA, 15 nt, Homo sapiens
acaggcugcugucca

SEQ ID NO: 1831794 - RNA, 14 nt, Homo sapiens
cagagugaacacuc

SEQ ID NO: 1831795 - RNA, 22 nt, Homo sapiens
cauuaugaucuaauaaacuuua

SEQ ID NO: 1831796 - RNA, 19 nt, Homo sapiens
cugguucugcaaugacugc

SEQ ID NO: 1831797 - RNA, 23 nt, Homo sapiens
uaaauaucuuuuuccuucuacuc

SEQ ID NO: 1831798 - RNA, 14 nt, Homo sapiens
aaagaugacuugaa

SEQ ID NO: 1831799 - RNA, 12 nt, Homo sapiens
ccucucucuaua

SEQ ID NO: 1831800 - RNA, 16 nt, Homo sapiens
acugcucauaugaugu

SEQ ID NO: 1831801 - RNA, 20 nt, Homo sapiens
guuuucuuuuucagauuuau

SEQ ID NO: 1831802 - RNA, 21 nt, Homo sapiens
ccagagcccaaggucagggag

SEQ ID NO: 1831803 - RNA, 19 nt, Homo sapiens
ucaucaaacauuugccaag

SEQ ID NO: 1831804 - RNA, 16 nt, Homo sapiens
agaggugccacacuga

SEQ ID NO: 1831805 - RNA, 21 nt, Homo sapiens
uguuccugaauacaagccuau

SEQ ID NO: 1831806 - RNA, 22 nt, Homo sapiens
aagaagcgcggcuaacuuauuc

SEQ ID NO: 1831807 - RNA, 16 nt, Homo sapiens
caaagaacucauuuga

SEQ ID NO: 1831808 - RNA, 20 nt, Homo sapiens
ggguggcacucaacucugag

SEQ ID NO: 1831809 - RNA, 23 nt, Homo sapiens
ucauugcccccagggcacuucac

SEQ ID NO: 1831810 - RNA, 17 nt, Homo sapiens
ucaguaggcuaauguca

SEQ ID NO: 1831811 - RNA, 17 nt, Homo sapiens
auccucaagcucagggc

SEQ ID NO: 1831812 - RNA, 19 nt, Homo sapiens
caacuaguuuuguuuauaa

SEQ ID NO: 1831813 - RNA, 21 nt, Homo sapiens
uuccaguucccuuugcuuguc

SEQ ID NO: 1831814 - RNA, 21 nt, Homo sapiens
aggaaauagacuuuguaugaa

SEQ ID NO: 1831815 - RNA, 17 nt, Homo sapiens
gucuuauaucccaggug

SEQ ID NO: 1831816 - RNA, 21 nt, Homo sapiens
caagagucuggggaccagcuu

SEQ ID NO: 1831817 - RNA, 19 nt, Homo sapiens
ucauuuaagaaaaaucaua

SEQ ID NO: 1831818 - RNA, 19 nt, Homo sapiens
agccacugcaccugaccug

SEQ ID NO: 1831819 - RNA, 22 nt, Homo sapiens
gagacacuuugucuaguguauu

SEQ ID NO: 1831820 - RNA, 17 nt, Homo sapiens
aacuguguggacuguga

SEQ ID NO: 1831821 - RNA, 13 nt, Homo sapiens
ucagggaccugcu

SEQ ID NO: 1831822 - RNA, 20 nt, Homo sapiens
ucauuucauguuagucuuac

SEQ ID NO: 1831823 - RNA, 14 nt, Homo sapiens
cuuuaaaacaugcu

SEQ ID NO: 1831824 - RNA, 15 nt, Homo sapiens
cucccauuucuacuc

SEQ ID NO: 1831825 - RNA, 18 nt, Homo sapiens
ucauagaaauucuuuaua

SEQ ID NO: 1831826 - RNA, 13 nt, Homo sapiens
uccaucuuucuac

SEQ ID NO: 1831827 - RNA, 22 nt, Homo sapiens
aacacugaaaaaauacuaccua

SEQ ID NO: 1831828 - RNA, 17 nt, Homo sapiens
uacaccuuagucuuucc

SEQ ID NO: 1831829 - RNA, 19 nt, Homo sapiens
acgugugcagacuguggcu

SEQ ID NO: 1831830 - RNA, 22 nt, Homo sapiens
guuaugagggucagggcaguau

SEQ ID NO: 1831831 - RNA, 13 nt, Homo sapiens
gcuuaaaagcaag

SEQ ID NO: 1831832 - RNA, 23 nt, Homo sapiens
ccucaaagaagucggaaugucau

SEQ ID NO: 1831833 - RNA, 15 nt, Homo sapiens
cauaucuauaaaaug

SEQ ID NO: 1831834 - RNA, 17 nt, Homo sapiens
uauagaaacaguuuuau

SEQ ID NO: 1831835 - RNA, 21 nt, Homo sapiens
gccccaccuccaccugugaga

SEQ ID NO: 1831836 - RNA, 21 nt, Homo sapiens
gucucucucucuuuuucuuuu

SEQ ID NO: 1831837 - RNA, 21 nt, Homo sapiens
uagcuuuccuggaagucaaau

SEQ ID NO: 1831838 - RNA, 13 nt, Homo sapiens
cccuuccagauca

SEQ ID NO: 1831839 - RNA, 24 nt, Homo sapiens
uuuuagauguaaccuacaauucag

SEQ ID NO: 1831840 - RNA, 20 nt, Homo sapiens
uaaauuuguaaguuucaggu

SEQ ID NO: 1831841 - RNA, 17 nt, Homo sapiens
cauuuauuuacauaaau

SEQ ID NO: 1831842 - RNA, 17 nt, Homo sapiens
cuuagcuuuucugcaau

SEQ ID NO: 1831843 - RNA, 22 nt, Homo sapiens
uugcucaguggaucacacacau

SEQ ID NO: 1831844 - RNA, 20 nt, Homo sapiens
caucucuccagcuagcaaaa

SEQ ID NO: 1831845 - RNA, 17 nt, Homo sapiens
gcucuuucccuuuauca

SEQ ID NO: 1831846 - RNA, 21 nt, Homo sapiens
gucuuucuuuuauacugacac

SEQ ID NO: 1831847 - RNA, 12 nt, Homo sapiens
uccucagugucc

SEQ ID NO: 1831848 - RNA, 23 nt, Homo sapiens
ggacauggugugccacaggcugc

SEQ ID NO: 1831849 - RNA, 21 nt, Homo sapiens
uuucaaggauuguuaacaugc

SEQ ID NO: 1831850 - RNA, 15 nt, Homo sapiens
agugaaguugugcaa

SEQ ID NO: 1831851 - RNA, 16 nt, Homo sapiens
guuuccucaagucuca

SEQ ID NO: 1831852 - RNA, 16 nt, Homo sapiens
uaaauccaauaucaug

SEQ ID NO: 1831853 - RNA, 13 nt, Homo sapiens
uacauuaucauuc

SEQ ID NO: 1831854 - RNA, 20 nt, Homo sapiens
aaagcccuuugugggacccg

SEQ ID NO: 1831855 - RNA, 19 nt, Homo sapiens
ucuaauggggacacagauc

SEQ ID NO: 1831856 - RNA, 20 nt, Homo sapiens
aaauggaggaucucuaaaga

SEQ ID NO: 1831857 - RNA, 13 nt, Homo sapiens
uguccuacaguga

SEQ ID NO: 1831858 - RNA, 15 nt, Homo sapiens
auaugaaggauuacu

SEQ ID NO: 1831859 - RNA, 16 nt, Homo sapiens
agucggggcaggccag

SEQ ID NO: 1831860 - RNA, 14 nt, Homo sapiens
gcugaggacacuca

SEQ ID NO: 1831861 - RNA, 17 nt, Homo sapiens
agucauaucaaagggua

SEQ ID NO: 1831862 - RNA, 12 nt, Homo sapiens
cagaauugcuca

SEQ ID NO: 1831863 - RNA, 18 nt, Homo sapiens
uuuaaaguaaaggcaaac

SEQ ID NO: 1831864 - RNA, 14 nt, Homo sapiens
agaccccaaaaaga

SEQ ID NO: 1831865 - RNA, 20 nt, Homo sapiens
uccaagcgcgguuacuaugg

SEQ ID NO: 1831866 - RNA, 12 nt, Homo sapiens
ucuccaaaacua

SEQ ID NO: 1831867 - RNA, 22 nt, Homo sapiens
gccccucugcaacuggagagaa

SEQ ID NO: 1831868 - RNA, 15 nt, Homo sapiens
gguccaggaaggcag

SEQ ID NO: 1831869 - RNA, 20 nt, Homo sapiens
ugaggaagaguuuauggcaa

SEQ ID NO: 1831870 - RNA, 14 nt, Homo sapiens
ugcugcacuuccug

SEQ ID NO: 1831871 - RNA, 15 nt, Homo sapiens
caguuccuucacuua

SEQ ID NO: 1831872 - RNA, 22 nt, Homo sapiens
uaucaauggagcaugugugcaa

SEQ ID NO: 1831873 - RNA, 20 nt, Homo sapiens
ucugcugucuaaccugugac

SEQ ID NO: 1831874 - RNA, 15 nt, Homo sapiens
gaaauaugcauguac

SEQ ID NO: 1831875 - RNA, 15 nt, Homo sapiens
cuuacuuaaccugaa

SEQ ID NO: 1831876 - RNA, 19 nt, Homo sapiens
auggucuucuccauccuca

SEQ ID NO: 1831877 - RNA, 20 nt, Homo sapiens
gagcacccagaacuccauac

SEQ ID NO: 1831878 - RNA, 18 nt, Homo sapiens
ccuucucccacacugcua

SEQ ID NO: 1831879 - RNA, 23 nt, Homo sapiens
cauucguccuuagaauacuguau

SEQ ID NO: 1831880 - RNA, 21 nt, Homo sapiens
ucagauccuccucauucacau

SEQ ID NO: 1831881 - RNA, 17 nt, Homo sapiens
ucuuguucgcacaaucu

SEQ ID NO: 1831882 - RNA, 16 nt, Homo sapiens
augaucccacucacca

SEQ ID NO: 1831883 - RNA, 15 nt, Homo sapiens
guaugugaaccaccc

SEQ ID NO: 1831884 - RNA, 21 nt, Homo sapiens
ugaugcagagcuuucaaggau

SEQ ID NO: 1831885 - RNA, 13 nt, Homo sapiens
auugaguuuagaa

SEQ ID NO: 1831886 - RNA, 19 nt, Homo sapiens
ucugcaaaggcaccugaau

SEQ ID NO: 1831887 - RNA, 20 nt, Homo sapiens
aauccaggcagauccaggac

SEQ ID NO: 1831888 - RNA, 15 nt, Homo sapiens
cugaauaaacaggaa

SEQ ID NO: 1831889 - RNA, 12 nt, Homo sapiens
uuaagugcuaug

SEQ ID NO: 1831890 - RNA, 22 nt, Homo sapiens
ucagaaaagacgcaccagccca

SEQ ID NO: 1831891 - RNA, 14 nt, Homo sapiens
gugaguuaauuuaa

SEQ ID NO: 1831892 - RNA, 20 nt, Homo sapiens
uaauacugaaggacacagca

SEQ ID NO: 1831893 - RNA, 12 nt, Homo sapiens
guaaaaacugca

SEQ ID NO: 1831894 - RNA, 17 nt, Homo sapiens
aacaguuaccugagaga

SEQ ID NO: 1831895 - RNA, 20 nt, Homo sapiens
cagguucucuuugagucaau

SEQ ID NO: 1831896 - RNA, 15 nt, Homo sapiens
uuuucugugcuuuga

SEQ ID NO: 1831897 - RNA, 13 nt, Homo sapiens
ucccucccagcgc

SEQ ID NO: 1831898 - RNA, 23 nt, Homo sapiens
gucugaauauuaaagcucuucau

SEQ ID NO: 1831899 - RNA, 18 nt, Homo sapiens
aacuuugauacuuacuca

SEQ ID NO: 1831900 - RNA, 21 nt, Homo sapiens
uccacugcguuguccacaaga

SEQ ID NO: 1831901 - RNA, 15 nt, Homo sapiens
uaucuucuuagcuca

SEQ ID NO: 1831902 - RNA, 19 nt, Homo sapiens
cagaaaauuguacaaccug

SEQ ID NO: 1831903 - RNA, 21 nt, Homo sapiens
aauuugaaacacuuugcauaa

SEQ ID NO: 1831904 - RNA, 12 nt, Homo sapiens
gagaagugccua

SEQ ID NO: 1831905 - RNA, 18 nt, Homo sapiens
cagccagugccauuccac

SEQ ID NO: 1831906 - RNA, 14 nt, Homo sapiens
uuaagagaaaugag

SEQ ID NO: 1831907 - RNA, 23 nt, Homo sapiens
gcagggcaaaugacaugcacuga

SEQ ID NO: 1831908 - RNA, 18 nt, Homo sapiens
uccuaucaccuauuucca

SEQ ID NO: 1831909 - RNA, 14 nt, Homo sapiens
cuuuguacugcuuu

SEQ ID NO: 1831910 - RNA, 18 nt, Homo sapiens
ccugcagacagaccucaa

SEQ ID NO: 1831911 - RNA, 22 nt, Homo sapiens
gccaugaguuccagaaaguaaa

SEQ ID NO: 1831912 - RNA, 12 nt, Homo sapiens
acacacaguacg

SEQ ID NO: 1831913 - RNA, 17 nt, Homo sapiens
caggaccacucaguuaa

SEQ ID NO: 1831914 - RNA, 16 nt, Homo sapiens
uggauuuauucugcca

SEQ ID NO: 1831915 - RNA, 14 nt, Homo sapiens
aggccuccagcuca

SEQ ID NO: 1831916 - RNA, 14 nt, Homo sapiens
gcguacagaucucu

SEQ ID NO: 1831917 - RNA, 15 nt, Homo sapiens
ugagagaaaccucuu

SEQ ID NO: 1831918 - RNA, 17 nt, Homo sapiens
gagcaaauggugcugaa

SEQ ID NO: 1831919 - RNA, 16 nt, Homo sapiens
gcauguuuuccagcuc

SEQ ID NO: 1831920 - RNA, 14 nt, Homo sapiens
gucuuggcccuguu

SEQ ID NO: 1831921 - RNA, 19 nt, Homo sapiens
cagaguauggaaguagcuc

SEQ ID NO: 1831922 - RNA, 22 nt, Homo sapiens
cacagcagguccuccaucccaa

SEQ ID NO: 1831923 - RNA, 13 nt, Homo sapiens
ugccgaaccagga

SEQ ID NO: 1831924 - RNA, 21 nt, Homo sapiens
uauccauguaauaagcacuug

SEQ ID NO: 1831925 - RNA, 17 nt, Homo sapiens
aaagucagauuuguaua

SEQ ID NO: 1831926 - RNA, 16 nt, Homo sapiens
caguaccuaaguaaga

SEQ ID NO: 1831927 - RNA, 18 nt, Homo sapiens
ucuggaagauggggacca

SEQ ID NO: 1831928 - RNA, 17 nt, Homo sapiens
ucccuggucucugccag

SEQ ID NO: 1831929 - RNA, 16 nt, Homo sapiens
cgacuccuagauccag

SEQ ID NO: 1831930 - RNA, 22 nt, Homo sapiens
agaagugacuaggguucagaga

SEQ ID NO: 1831931 - RNA, 21 nt, Homo sapiens
caguccuuuaaauuuugcacu

SEQ ID NO: 1831932 - RNA, 22 nt, Homo sapiens
auguaaaggucacuuuucacau

SEQ ID NO: 1831933 - RNA, 15 nt, Homo sapiens
ugauaaaauagccaa

SEQ ID NO: 1831934 - RNA, 19 nt, Homo sapiens
cuaaauguaacagucugau

SEQ ID NO: 1831935 - RNA, 20 nt, Homo sapiens
ucugcacccagaacaguggu

SEQ ID NO: 1831936 - RNA, 18 nt, Homo sapiens
acccuuccacguguaugc

SEQ ID NO: 1831937 - RNA, 19 nt, Homo sapiens
uaacuagaaaucugccaau

SEQ ID NO: 1831938 - RNA, 21 nt, Homo sapiens
uagaagaggguuuuagguaga

SEQ ID NO: 1831939 - RNA, 17 nt, Homo sapiens
ucacuaugacacugagc

SEQ ID NO: 1831940 - RNA, 9 nt, Homo sapiens
aucugggca

SEQ ID NO: 1831941 - RNA, 12 nt, Homo sapiens
uguuuucacuaa

SEQ ID NO: 1831942 - RNA, 23 nt, Homo sapiens
auucuugugccucggccucccua

SEQ ID NO: 1831943 - RNA, 15 nt, Homo sapiens
gccugacacauagaa

SEQ ID NO: 1831944 - RNA, 15 nt, Homo sapiens
gguggagguugcagu

SEQ ID NO: 1831945 - RNA, 15 nt, Homo sapiens
uagccaacuccuccu

SEQ ID NO: 1831946 - RNA, 21 nt, Homo sapiens
cugaagcuucaaaaagccacu

SEQ ID NO: 1831947 - RNA, 22 nt, Homo sapiens
auuugucgauauuuccaucauu

SEQ ID NO: 1831948 - RNA, 13 nt, Homo sapiens
gaaagcaacagcu

SEQ ID NO: 1831949 - RNA, 20 nt, Homo sapiens
ggggcaaaauggcaccuaag

SEQ ID NO: 1831950 - RNA, 15 nt, Homo sapiens
cuuuucaugauuuua

SEQ ID NO: 1831951 - RNA, 16 nt, Homo sapiens
aacaauggaagauuug

SEQ ID NO: 1831952 - RNA, 20 nt, Homo sapiens
gcuuaagggaauaugcauug

SEQ ID NO: 1831953 - RNA, 19 nt, Homo sapiens
ugaagagacuuuauugccu

SEQ ID NO: 1831954 - RNA, 14 nt, Homo sapiens
auacaguuauuaaa

SEQ ID NO: 1831955 - RNA, 20 nt, Homo sapiens
auucuuuuuuaauaaacuac

SEQ ID NO: 1831956 - RNA, 14 nt, Homo sapiens
cauaaaaucuguga

SEQ ID NO: 1831957 - RNA, 13 nt, Homo sapiens
ucccaggccaggc

SEQ ID NO: 1831958 - RNA, 14 nt, Homo sapiens
acaaaaaaugugcu

SEQ ID NO: 1831959 - RNA, 19 nt, Homo sapiens
caggcauuuuuacagcaca

SEQ ID NO: 1831960 - RNA, 20 nt, Homo sapiens
gagccugcaggguggugcug

SEQ ID NO: 1831961 - RNA, 21 nt, Homo sapiens
aaaggauuguuaauguuugca

SEQ ID NO: 1831962 - RNA, 15 nt, Homo sapiens
guccagcuguggaag

SEQ ID NO: 1831963 - RNA, 13 nt, Homo sapiens
ugcacacaugcac

SEQ ID NO: 1831964 - RNA, 13 nt, Homo sapiens
uauauacauauau

SEQ ID NO: 1831965 - RNA, 13 nt, Homo sapiens
uacauacauacau

SEQ ID NO: 1831966 - RNA, 13 nt, Homo sapiens
caagaacacaaga

SEQ ID NO: 1831967 - RNA, 13 nt, Homo sapiens
cuggcacacuggc

SEQ ID NO: 1831968 - RNA, 22 nt, Homo sapiens
auacaguauucuguaccauagc

SEQ ID NO: 1831969 - RNA, 20 nt, Homo sapiens
cucaugcccauaaucccagc

SEQ ID NO: 1831970 - RNA, 19 nt, Homo sapiens
caaggacauuucucaaggg

SEQ ID NO: 1831971 - RNA, 16 nt, Homo sapiens
acagauuuuauuugua

SEQ ID NO: 1831972 - RNA, 22 nt, Homo sapiens
cagcucggacuauacugcugag

SEQ ID NO: 1831973 - RNA, 14 nt, Homo sapiens
auagguaaaccaaa

SEQ ID NO: 1831974 - RNA, 13 nt, Homo sapiens
auuugcuggaaca

SEQ ID NO: 1831975 - RNA, 15 nt, Homo sapiens
ccagagcagaugcag

SEQ ID NO: 1831976 - RNA, 14 nt, Homo sapiens
aguggacgugucag

SEQ ID NO: 1831977 - RNA, 13 nt, Homo sapiens
aggacacagugau

SEQ ID NO: 1831978 - RNA, 18 nt, Homo sapiens
uagauugccuuuggcaau

SEQ ID NO: 1831979 - RNA, 12 nt, Homo sapiens
aacaaaagggag

SEQ ID NO: 1831980 - RNA, 20 nt, Homo sapiens
acagcuacuugcaauucaaa

SEQ ID NO: 1831981 - RNA, 15 nt, Homo sapiens
agugaagcaauuuca

SEQ ID NO: 1831982 - RNA, 18 nt, Homo sapiens
ccucaggacccagggaau

SEQ ID NO: 1831983 - RNA, 17 nt, Homo sapiens
agauuacauuguaguua

SEQ ID NO: 1831984 - RNA, 17 nt, Homo sapiens
gcaaucaaacgaagaca

SEQ ID NO: 1831985 - RNA, 21 nt, Homo sapiens
cauuugacugaagaugcagcu

SEQ ID NO: 1831986 - RNA, 15 nt, Homo sapiens
aggcacacacugugc

SEQ ID NO: 1831987 - RNA, 14 nt, Homo sapiens
cucaucccacccgc

SEQ ID NO: 1831988 - RNA, 17 nt, Homo sapiens
acccccaucucuacuaa

SEQ ID NO: 1831989 - RNA, 22 nt, Homo sapiens
cacccgcccgagggauggugcc

SEQ ID NO: 1831990 - RNA, 20 nt, Homo sapiens
aaauuaguuucaaauuuacc

SEQ ID NO: 1831991 - RNA, 17 nt, Homo sapiens
cagugcccauguguaug

SEQ ID NO: 1831992 - RNA, 19 nt, Homo sapiens
ggucucaccuucgccuuug

SEQ ID NO: 1831993 - RNA, 15 nt, Homo sapiens
uggucccauuauucu

SEQ ID NO: 1831994 - RNA, 21 nt, Homo sapiens
guauaaguggaggcacuuuag

SEQ ID NO: 1831995 - RNA, 14 nt, Homo sapiens
gaauaaagcuguga

SEQ ID NO: 1831996 - RNA, 22 nt, Homo sapiens
gccgagcggggagccaggaaag

SEQ ID NO: 1831997 - RNA, 19 nt, Homo sapiens
ugaaaagugggcugugacu

SEQ ID NO: 1831998 - RNA, 11 nt, Homo sapiens
ugaaaauugca

SEQ ID NO: 1831999 - RNA, 16 nt, Homo sapiens
ucaaugccuggagaca

SEQ ID NO: 1832000 - RNA, 16 nt, Homo sapiens
uggguaaaucagggac

SEQ ID NO: 1832001 - RNA, 20 nt, Homo sapiens
uugcagcuuauauucaucca

SEQ ID NO: 1832002 - RNA, 16 nt, Homo sapiens
guuugggccacugcca

SEQ ID NO: 1832003 - RNA, 21 nt, Homo sapiens
cggcgccacagaccccggguc

SEQ ID NO: 1832004 - RNA, 23 nt, Homo sapiens
cuggcuuccagguaucuccagga

SEQ ID NO: 1832005 - RNA, 11 nt, Homo sapiens
ggcuggcacug

SEQ ID NO: 1832006 - RNA, 18 nt, Homo sapiens
ccaauuagcauuccauca

SEQ ID NO: 1832007 - RNA, 18 nt, Homo sapiens
agaacggugucauccugg

SEQ ID NO: 1832008 - RNA, 18 nt, Homo sapiens
gccuuguuucaccuucca

SEQ ID NO: 1832009 - RNA, 15 nt, Homo sapiens
uguucccauuggaug

SEQ ID NO: 1832010 - RNA, 14 nt, Homo sapiens
cacagcccagccac

SEQ ID NO: 1832011 - RNA, 19 nt, Homo sapiens
agacaaauucggauguaug

SEQ ID NO: 1832012 - RNA, 13 nt, Homo sapiens
ucccucagugaag

SEQ ID NO: 1832013 - RNA, 16 nt, Homo sapiens
acuaauacagacuaug

SEQ ID NO: 1832014 - RNA, 14 nt, Homo sapiens
cuuuccuucauuca

SEQ ID NO: 1832015 - RNA, 23 nt, Homo sapiens
uugucuguaaaaaauguaugcua

SEQ ID NO: 1832016 - RNA, 17 nt, Homo sapiens
aucucauuuaagggaaa

SEQ ID NO: 1832017 - RNA, 17 nt, Homo sapiens
aucaaggggacuaaagu

SEQ ID NO: 1832018 - RNA, 16 nt, Homo sapiens
uguccaggguccucua

SEQ ID NO: 1832019 - RNA, 23 nt, Homo sapiens
ugacucuggccuuacaaccuucc

SEQ ID NO: 1832020 - RNA, 23 nt, Homo sapiens
auguagcaaauuccaauacauua

SEQ ID NO: 1832021 - RNA, 20 nt, Homo sapiens
auuauauucccaaaucucaa

SEQ ID NO: 1832022 - RNA, 14 nt, Homo sapiens
gaaacaacauuuaa

SEQ ID NO: 1832023 - RNA, 17 nt, Homo sapiens
cagcuacgugugccccu

SEQ ID NO: 1832024 - RNA, 15 nt, Homo sapiens
guuccuuugaucucg

SEQ ID NO: 1832025 - RNA, 18 nt, Homo sapiens
ugcaguaauuugcaauuu

SEQ ID NO: 1832026 - RNA, 15 nt, Homo sapiens
ucacaccauugcacu

SEQ ID NO: 1832027 - RNA, 16 nt, Homo sapiens
cuuccuaaacuuucaa

SEQ ID NO: 1832028 - RNA, 12 nt, Homo sapiens
acauccaaacau

SEQ ID NO: 1832029 - RNA, 21 nt, Homo sapiens
acugccuccucccuggcugca

SEQ ID NO: 1832030 - RNA, 22 nt, Homo sapiens
agauuuaauccuagagauuugg

SEQ ID NO: 1832031 - RNA, 22 nt, Homo sapiens
auuuauucaucugggaggcaga

SEQ ID NO: 1832032 - RNA, 19 nt, Homo sapiens
uauaaauacguauuacaaa

SEQ ID NO: 1832033 - RNA, 14 nt, Homo sapiens
auuuuggaaccuaa

SEQ ID NO: 1832034 - RNA, 14 nt, Homo sapiens
acuuuggaaucuaa

SEQ ID NO: 1832035 - RNA, 20 nt, Homo sapiens
ucauuaacucaaauucaaug

SEQ ID NO: 1832036 - RNA, 13 nt, Homo sapiens
uuucaggccaaau

SEQ ID NO: 1832037 - RNA, 18 nt, Homo sapiens
gaguaguauuaaaagcua

SEQ ID NO: 1832038 - RNA, 14 nt, Homo sapiens
caaaagugcauuca

SEQ ID NO: 1832039 - RNA, 21 nt, Homo sapiens
uuucucuuuagccuuccaaca

SEQ ID NO: 1832040 - RNA, 21 nt, Homo sapiens
accccucucuacuaaaaauac

SEQ ID NO: 1832041 - RNA, 23 nt, Homo sapiens
acagagaaaagucaggugcaguc

SEQ ID NO: 1832042 - RNA, 16 nt, Homo sapiens
ucaaaugcacaucuca

SEQ ID NO: 1832043 - RNA, 19 nt, Homo sapiens
cuggacuccggaggacuga

SEQ ID NO: 1832044 - RNA, 14 nt, Homo sapiens
agggagcaccagau

SEQ ID NO: 1832045 - RNA, 16 nt, Homo sapiens
cagugacaaagacucc

SEQ ID NO: 1832046 - RNA, 23 nt, Homo sapiens
auaaacauuuaacuuguuuccaa

SEQ ID NO: 1832047 - RNA, 19 nt, Homo sapiens
cuccgaaagucugaaucuc

SEQ ID NO: 1832048 - RNA, 20 nt, Homo sapiens
gccacacacaguuacagagu

SEQ ID NO: 1832049 - RNA, 17 nt, Homo sapiens
uggggccugugcacugu

SEQ ID NO: 1832050 - RNA, 15 nt, Homo sapiens
gaccagcacacuccc

SEQ ID NO: 1832051 - RNA, 12 nt, Homo sapiens
caugaagcacac

SEQ ID NO: 1832052 - RNA, 12 nt, Homo sapiens
caucaagcacag

SEQ ID NO: 1832053 - RNA, 17 nt, Homo sapiens
aggaaauaucaaagugu

SEQ ID NO: 1832054 - RNA, 22 nt, Homo sapiens
gaacucaugucuuucucagagg

SEQ ID NO: 1832055 - RNA, 15 nt, Homo sapiens
ucuuuaagcagagaa

SEQ ID NO: 1832056 - RNA, 21 nt, Homo sapiens
ugcucaccucuucuuuaccag

SEQ ID NO: 1832057 - RNA, 22 nt, Homo sapiens
uaauacauuaagccucuugucu

SEQ ID NO: 1832058 - RNA, 16 nt, Homo sapiens
aagcuuaacacuugac

SEQ ID NO: 1832059 - RNA, 23 nt, Homo sapiens
agccaagcucccuggagcccugu

SEQ ID NO: 1832060 - RNA, 19 nt, Homo sapiens
ccucaucaaaaacacucuc

SEQ ID NO: 1832061 - RNA, 22 nt, Homo sapiens
uagccaugugaaacucaucuca

SEQ ID NO: 1832062 - RNA, 15 nt, Homo sapiens
cacugacucaagaca

SEQ ID NO: 1832063 - RNA, 14 nt, Homo sapiens
gcuggccuggcaca

SEQ ID NO: 1832064 - RNA, 17 nt, Homo sapiens
ccucugcugcuuuccaa

SEQ ID NO: 1832065 - RNA, 21 nt, Homo sapiens
uggaauauuguccauugucca

SEQ ID NO: 1832066 - RNA, 16 nt, Homo sapiens
aggucccugcuuaccu

SEQ ID NO: 1832067 - RNA, 17 nt, Homo sapiens
ugaauuuuguaaguaua

SEQ ID NO: 1832068 - RNA, 18 nt, Homo sapiens
aaucacauuuuaagugcu

SEQ ID NO: 1832069 - RNA, 16 nt, Homo sapiens
ucauggcuaccucaga

SEQ ID NO: 1832070 - RNA, 21 nt, Homo sapiens
guaucaugauugauugaauca

SEQ ID NO: 1832071 - RNA, 21 nt, Homo sapiens
ggccccucucaggcugugcuu

SEQ ID NO: 1832072 - RNA, 22 nt, Homo sapiens
auuuaggucuuauugaaaugca

SEQ ID NO: 1832073 - RNA, 14 nt, Homo sapiens
cuucagggccaguc

SEQ ID NO: 1832074 - RNA, 14 nt, Homo sapiens
cagggccucaggca

SEQ ID NO: 1832075 - RNA, 15 nt, Homo sapiens
uuaaaccacuguaua

SEQ ID NO: 1832076 - RNA, 21 nt, Homo sapiens
agaaauuagugccacaaauaa

SEQ ID NO: 1832077 - RNA, 12 nt, Homo sapiens
ugccaaaauaca

SEQ ID NO: 1832078 - RNA, 21 nt, Homo sapiens
aucuccaagugcggcacugca

SEQ ID NO: 1832079 - RNA, 21 nt, Homo sapiens
uuaccuagauuuacagccuca

SEQ ID NO: 1832080 - RNA, 22 nt, Homo sapiens
gaaaagguagcuuaccugacac

SEQ ID NO: 1832081 - RNA, 15 nt, Homo sapiens
uaagaggaguaggcc

SEQ ID NO: 1832082 - RNA, 23 nt, Homo sapiens
guuucucguacuuucacaucucu

SEQ ID NO: 1832083 - RNA, 19 nt, Homo sapiens
uccccccuugaagcaauaa

SEQ ID NO: 1832084 - RNA, 21 nt, Homo sapiens
uguuccacggaaaaugcuauc

SEQ ID NO: 1832085 - RNA, 15 nt, Homo sapiens
ccauacuacccucau

SEQ ID NO: 1832086 - RNA, 19 nt, Homo sapiens
cacagaaaaaaauggugcc

SEQ ID NO: 1832087 - RNA, 15 nt, Homo sapiens
caugagucccagugg

SEQ ID NO: 1832088 - RNA, 19 nt, Homo sapiens
cgccagauucuuuccugag

SEQ ID NO: 1832089 - RNA, 22 nt, Homo sapiens
acuguccuggcugcucucaugc

SEQ ID NO: 1832090 - RNA, 22 nt, Homo sapiens
aggcugccccaggccggagccc

SEQ ID NO: 1832091 - RNA, 16 nt, Homo sapiens
cgcuguguagggacca

SEQ ID NO: 1832092 - RNA, 19 nt, Homo sapiens
ccagccuccccgugccaaa

SEQ ID NO: 1832093 - RNA, 18 nt, Homo sapiens
ggauggccaaacccaaga

SEQ ID NO: 1832094 - RNA, 23 nt, Homo sapiens
gcacucaaagucuggguauucau

SEQ ID NO: 1832095 - RNA, 20 nt, Homo sapiens
uccugcuugaacugcugcca

SEQ ID NO: 1832096 - RNA, 15 nt, Homo sapiens
auacagggacagggu

SEQ ID NO: 1832097 - RNA, 18 nt, Homo sapiens
aagcaccuaaaugaugcc

SEQ ID NO: 1832098 - RNA, 22 nt, Homo sapiens
ccugugcacgcgcgcgugcaca

SEQ ID NO: 1832099 - RNA, 22 nt, Homo sapiens
aacauuguucugaacacuuuag

SEQ ID NO: 1832100 - RNA, 21 nt, Homo sapiens
uggggacauuccaauuugcac

SEQ ID NO: 1832101 - RNA, 19 nt, Homo sapiens
aaagaacacgcucucucca

SEQ ID NO: 1832102 - RNA, 20 nt, Homo sapiens
uaccuggccuuccugccagg

SEQ ID NO: 1832103 - RNA, 16 nt, Homo sapiens
uauguauuugcaguuc

SEQ ID NO: 1832104 - RNA, 13 nt, Homo sapiens
cuuccuacuguag

SEQ ID NO: 1832105 - RNA, 21 nt, Homo sapiens
auaggaacaaucuuugcugua

SEQ ID NO: 1832106 - RNA, 21 nt, Homo sapiens
cuaacauuauauugcaaugaa

SEQ ID NO: 1832107 - RNA, 14 nt, Homo sapiens
uagcaaaacuggac

SEQ ID NO: 1832108 - RNA, 18 nt, Homo sapiens
uaaguuacaucuacaaac

SEQ ID NO: 1832109 - RNA, 16 nt, Homo sapiens
gagucugcacgggacc

SEQ ID NO: 1832110 - RNA, 22 nt, Homo sapiens
aucucuuaaaguggucauauua

SEQ ID NO: 1832111 - RNA, 18 nt, Homo sapiens
ccagcguggcaacaggcg

SEQ ID NO: 1832112 - RNA, 15 nt, Homo sapiens
ggagcuucggggccu

SEQ ID NO: 1832113 - RNA, 22 nt, Homo sapiens
aaguccuagccccucacuucca

SEQ ID NO: 1832114 - RNA, 18 nt, Homo sapiens
gcccacccugcaccucau

SEQ ID NO: 1832115 - RNA, 11 nt, Homo sapiens
uauaagacauu

SEQ ID NO: 1832116 - RNA, 22 nt, Homo sapiens
gucccuugcuugccugcagggc

SEQ ID NO: 1832117 - RNA, 23 nt, Homo sapiens
aaauauucgugguaucugugaac

SEQ ID NO: 1832118 - RNA, 20 nt, Homo sapiens
aaaggcauuucaaagucuca

SEQ ID NO: 1832119 - RNA, 22 nt, Homo sapiens
uguacaguuuuuauugcuuguu

SEQ ID NO: 1832120 - RNA, 20 nt, Homo sapiens
cuagugcagagagguuguga

SEQ ID NO: 1832121 - RNA, 16 nt, Homo sapiens
uacaagguuuggcaaa

SEQ ID NO: 1832122 - RNA, 13 nt, Homo sapiens
gcagcuacuggaa

SEQ ID NO: 1832123 - RNA, 14 nt, Homo sapiens
uuaacacaguaaaa

SEQ ID NO: 1832124 - RNA, 15 nt, Homo sapiens
cuguagucucaggac

SEQ ID NO: 1832125 - RNA, 15 nt, Homo sapiens
guccuccaccaugca

SEQ ID NO: 1832126 - RNA, 12 nt, Homo sapiens
agcacuguaaaa

SEQ ID NO: 1832127 - RNA, 14 nt, Homo sapiens
uacuccaugguucu

SEQ ID NO: 1832128 - RNA, 15 nt, Homo sapiens
cucuuucuucaauua

SEQ ID NO: 1832129 - RNA, 17 nt, Homo sapiens
aggauccugguauugua

SEQ ID NO: 1832130 - RNA, 18 nt, Homo sapiens
aauuugacaaaacccacu

SEQ ID NO: 1832131 - RNA, 17 nt, Homo sapiens
augucaggaaacauuca

SEQ ID NO: 1832132 - RNA, 14 nt, Homo sapiens
auuccauacaguga

SEQ ID NO: 1832133 - RNA, 16 nt, Homo sapiens
gauguugaacugguca

SEQ ID NO: 1832134 - RNA, 18 nt, Homo sapiens
cccagcuuggagugccac

SEQ ID NO: 1832135 - RNA, 23 nt, Homo sapiens
gguucugugcaaaacuaccacau

SEQ ID NO: 1832136 - RNA, 19 nt, Homo sapiens
ccauauauuggcacugcua

SEQ ID NO: 1832137 - RNA, 15 nt, Homo sapiens
ucucugagcagugaa

SEQ ID NO: 1832138 - RNA, 13 nt, Homo sapiens
aggugggugcugc

SEQ ID NO: 1832139 - RNA, 13 nt, Homo sapiens
ugggagcaaaaaa

SEQ ID NO: 1832140 - RNA, 20 nt, Homo sapiens
agauccuucgggugcuggaa

SEQ ID NO: 1832141 - RNA, 11 nt, Homo sapiens
uccaagaccaa

SEQ ID NO: 1832142 - RNA, 16 nt, Homo sapiens
uaucugggugccuuaa

SEQ ID NO: 1832143 - RNA, 22 nt, Homo sapiens
uuugaugaacaaaauuuccuaa

SEQ ID NO: 1832144 - RNA, 21 nt, Homo sapiens
cuaucggggucacuugcaauu

SEQ ID NO: 1832145 - RNA, 21 nt, Homo sapiens
uccaggcucugggcacagugc

SEQ ID NO: 1832146 - RNA, 14 nt, Homo sapiens
ugugaucugggaac

SEQ ID NO: 1832147 - RNA, 15 nt, Homo sapiens
acaugagugucaacu

SEQ ID NO: 1832148 - RNA, 13 nt, Homo sapiens
ugcuaccaaaaac

SEQ ID NO: 1832149 - RNA, 15 nt, Homo sapiens
cacaagaauuacacu

SEQ ID NO: 1832150 - RNA, 23 nt, Homo sapiens
gccacacucccaaacuccaagac

SEQ ID NO: 1832151 - RNA, 21 nt, Homo sapiens
gcugaaggcaguggcagggga

SEQ ID NO: 1832152 - RNA, 22 nt, Homo sapiens
agagugagcaagggggcccaaa

SEQ ID NO: 1832153 - RNA, 14 nt, Homo sapiens
gccaaaacauuuau

SEQ ID NO: 1832154 - RNA, 21 nt, Homo sapiens
agggucauggcagugccugaa

SEQ ID NO: 1832155 - RNA, 18 nt, Homo sapiens
aagcuucaaaaagccacu

SEQ ID NO: 1832156 - RNA, 18 nt, Homo sapiens
acacuuuuaugagcuucc

SEQ ID NO: 1832157 - RNA, 17 nt, Homo sapiens
acgcuaccaaaucucaa

SEQ ID NO: 1832158 - RNA, 20 nt, Homo sapiens
uuccaucccuagccauucug

SEQ ID NO: 1832159 - RNA, 15 nt, Homo sapiens
aauuaagguuugccc

SEQ ID NO: 1832160 - RNA, 16 nt, Homo sapiens
cuuguaguaugcuuaa

SEQ ID NO: 1832161 - RNA, 15 nt, Homo sapiens
uaucuucacuuuuau

SEQ ID NO: 1832162 - RNA, 16 nt, Homo sapiens
caagggcaggucuuca

SEQ ID NO: 1832163 - RNA, 21 nt, Homo sapiens
accagauacggacagagacca

SEQ ID NO: 1832164 - RNA, 18 nt, Homo sapiens
uucacucugacaguauua

SEQ ID NO: 1832165 - RNA, 18 nt, Homo sapiens
uuaagacauaaacaaaga

SEQ ID NO: 1832166 - RNA, 18 nt, Homo sapiens
uaacuaucaccagugcau

SEQ ID NO: 1832167 - RNA, 17 nt, Homo sapiens
aaguuaaaacaaaggaa

SEQ ID NO: 1832168 - RNA, 17 nt, Homo sapiens
ccuuaacccaaggagca

SEQ ID NO: 1832169 - RNA, 21 nt, Homo sapiens
cauaggguccugaauguuuca

SEQ ID NO: 1832170 - RNA, 16 nt, Homo sapiens
uccuuagcauucauaa

SEQ ID NO: 1832171 - RNA, 14 nt, Homo sapiens
caauugaacugcuu

SEQ ID NO: 1832172 - RNA, 17 nt, Homo sapiens
cuuauuguuccaagaca

SEQ ID NO: 1832173 - RNA, 19 nt, Homo sapiens
gggcccuugucgggcacag

SEQ ID NO: 1832174 - RNA, 21 nt, Homo sapiens
aagacauuaccaugaguaaua

SEQ ID NO: 1832175 - RNA, 15 nt, Homo sapiens
gcccagccugcauac

SEQ ID NO: 1832176 - RNA, 21 nt, Homo sapiens
cuggaauuuggacaagugcug

SEQ ID NO: 1832177 - RNA, 20 nt, Homo sapiens
cccguggucuccuugcacuu

SEQ ID NO: 1832178 - RNA, 12 nt, Homo sapiens
uuagauugugag

SEQ ID NO: 1832179 - RNA, 15 nt, Homo sapiens
ugcauuccauuuaau

SEQ ID NO: 1832180 - RNA, 20 nt, Homo sapiens
uacugcaaaaaguacauagu

SEQ ID NO: 1832181 - RNA, 13 nt, Homo sapiens
agaaauauauuau

SEQ ID NO: 1832182 - RNA, 21 nt, Homo sapiens
ccagagguaauguuaguaaau

SEQ ID NO: 1832183 - RNA, 13 nt, Homo sapiens
gcaaggacugccc

SEQ ID NO: 1832184 - RNA, 13 nt, Homo sapiens
aaagcacauacau

SEQ ID NO: 1832185 - RNA, 22 nt, Homo sapiens
gugugcaagagagggaugcaug

SEQ ID NO: 1832186 - RNA, 21 nt, Homo sapiens
aaaaugcuauuguugcaauau

SEQ ID NO: 1832187 - RNA, 20 nt, Homo sapiens
gaggcacgagaauugcuuga

SEQ ID NO: 1832188 - RNA, 21 nt, Homo sapiens
cagaaaaaaaaaaaaaagccu

SEQ ID NO: 1832189 - RNA, 19 nt, Homo sapiens
ugcuauuuuacugucuuaa

SEQ ID NO: 1832190 - RNA, 21 nt, Homo sapiens
ugagauucagaugucauuuag

SEQ ID NO: 1832191 - RNA, 22 nt, Homo sapiens
auaaagcaucauuaaugcacau

SEQ ID NO: 1832192 - RNA, 16 nt, Homo sapiens
ucuggaugcugugaag

SEQ ID NO: 1832193 - RNA, 21 nt, Homo sapiens
uaguuccccaaauuaauacuu

SEQ ID NO: 1832194 - RNA, 22 nt, Homo sapiens
ggccucagcaccccugucucua

SEQ ID NO: 1832195 - RNA, 19 nt, Homo sapiens
ccaggccaucaccacagcu

SEQ ID NO: 1832196 - RNA, 14 nt, Homo sapiens
uucugcaagcaauc

SEQ ID NO: 1832197 - RNA, 15 nt, Homo sapiens
gggcacugcacccug

SEQ ID NO: 1832198 - RNA, 12 nt, Homo sapiens
aaaaaaguucau

SEQ ID NO: 1832199 - RNA, 18 nt, Homo sapiens
cuccccuccagaccccua

SEQ ID NO: 1832200 - RNA, 17 nt, Homo sapiens
aucuguuuucuaccucc

SEQ ID NO: 1832201 - RNA, 12 nt, Homo sapiens
uugaacuuguca

SEQ ID NO: 1832202 - RNA, 12 nt, Homo sapiens
caguuaagugaa

SEQ ID NO: 1832203 - RNA, 17 nt, Homo sapiens
aagacauguacugauga

SEQ ID NO: 1832204 - RNA, 17 nt, Homo sapiens
uucaccacaugugcaca

SEQ ID NO: 1832205 - RNA, 11 nt, Homo sapiens
cuaaucccucc

SEQ ID NO: 1832206 - RNA, 15 nt, Homo sapiens
gucuuagauguauau

SEQ ID NO: 1832207 - RNA, 20 nt, Homo sapiens
cccugcuucaauacccaaau

SEQ ID NO: 1832208 - RNA, 18 nt, Homo sapiens
uucaauaugguuacguug

SEQ ID NO: 1832209 - RNA, 17 nt, Homo sapiens
caauaaaggcaccuccc

SEQ ID NO: 1832210 - RNA, 14 nt, Homo sapiens
cacaaggaaggcau

SEQ ID NO: 1832211 - RNA, 15 nt, Homo sapiens
auuggacugucuuua

SEQ ID NO: 1832212 - RNA, 13 nt, Homo sapiens
uguguauguguau

SEQ ID NO: 1832213 - RNA, 22 nt, Homo sapiens
aguuauucuugcaaagauuucu

SEQ ID NO: 1832214 - RNA, 14 nt, Homo sapiens
cuggugcacagggc

SEQ ID NO: 1832215 - RNA, 20 nt, Homo sapiens
cuggagugcaguggcgcaau

SEQ ID NO: 1832216 - RNA, 15 nt, Homo sapiens
ugccagaacccaaau

SEQ ID NO: 1832217 - RNA, 18 nt, Homo sapiens
auaacaacacuguguuau

SEQ ID NO: 1832218 - RNA, 13 nt, Homo sapiens
cuucaccuuuuga

SEQ ID NO: 1832219 - RNA, 22 nt, Homo sapiens
acagugcauuugccuugucacc

SEQ ID NO: 1832220 - RNA, 13 nt, Homo sapiens
acccugcucucac

SEQ ID NO: 1832221 - RNA, 11 nt, Homo sapiens
ccccugaaaua

SEQ ID NO: 1832222 - RNA, 21 nt, Homo sapiens
uugaaagaacuuaagucucga

SEQ ID NO: 1832223 - RNA, 14 nt, Homo sapiens
agacugggacaccu

SEQ ID NO: 1832224 - RNA, 21 nt, Homo sapiens
uccccugcggagcugcaugga

SEQ ID NO: 1832225 - RNA, 15 nt, Homo sapiens
augcgacccaagacc

SEQ ID NO: 1832226 - RNA, 21 nt, Homo sapiens
gacaucagaaguaacucccac

SEQ ID NO: 1832227 - RNA, 17 nt, Homo sapiens
guauguguucuauucag

SEQ ID NO: 1832228 - RNA, 16 nt, Homo sapiens
aauggccccuccauuu

SEQ ID NO: 1832229 - RNA, 20 nt, Homo sapiens
augcggaaggauugcaaugc

SEQ ID NO: 1832230 - RNA, 16 nt, Homo sapiens
uuggaaaguucagcca

SEQ ID NO: 1832231 - RNA, 17 nt, Homo sapiens
aaaguccucugcuccag

SEQ ID NO: 1832232 - RNA, 12 nt, Homo sapiens
uggagagccacc

SEQ ID NO: 1832233 - RNA, 14 nt, Homo sapiens
gagacccacagccc

SEQ ID NO: 1832234 - RNA, 15 nt, Homo sapiens
agaugaggugcucaa

SEQ ID NO: 1832235 - RNA, 18 nt, Homo sapiens
ugcuaaccucacugccuc

SEQ ID NO: 1832236 - RNA, 23 nt, Homo sapiens
uccucagaaugauuuguaaauag

SEQ ID NO: 1832237 - RNA, 19 nt, Homo sapiens
uguuggauaaagaccuucc

SEQ ID NO: 1832238 - RNA, 21 nt, Homo sapiens
gccaauaaaaaguucagaguu

SEQ ID NO: 1832239 - RNA, 16 nt, Homo sapiens
ggucagucuaacaguu

SEQ ID NO: 1832240 - RNA, 21 nt, Homo sapiens
aucauauuaguauuaauacua

SEQ ID NO: 1832241 - RNA, 16 nt, Homo sapiens
gaguguucaacuguga

SEQ ID NO: 1832242 - RNA, 14 nt, Homo sapiens
cagcaggacugugg

SEQ ID NO: 1832243 - RNA, 13 nt, Homo sapiens
ggaggcugcugug

SEQ ID NO: 1832244 - RNA, 16 nt, Homo sapiens
cugguccugacuuccc

SEQ ID NO: 1832245 - RNA, 15 nt, Homo sapiens
caaggcugcagugag

SEQ ID NO: 1832246 - RNA, 17 nt, Homo sapiens
ucuccaaggaugggaau

SEQ ID NO: 1832247 - RNA, 21 nt, Homo sapiens
uuugggcacggcccuccuucu

SEQ ID NO: 1832248 - RNA, 20 nt, Homo sapiens
aguguuuagaagagccugac

SEQ ID NO: 1832249 - RNA, 22 nt, Homo sapiens
aauauguuuaucaacucaagaa

SEQ ID NO: 1832250 - RNA, 21 nt, Homo sapiens
acagauauuuagcucugugga

SEQ ID NO: 1832251 - RNA, 18 nt, Homo sapiens
caguucccaccaucugau

SEQ ID NO: 1832252 - RNA, 16 nt, Homo sapiens
uccagaacgucucuca

SEQ ID NO: 1832253 - RNA, 19 nt, Homo sapiens
ugacucuaguacugugaau

SEQ ID NO: 1832254 - RNA, 16 nt, Homo sapiens
cucauagaacugccug

SEQ ID NO: 1832255 - RNA, 18 nt, Homo sapiens
cacacuggcuggcccucu

SEQ ID NO: 1832256 - RNA, 17 nt, Homo sapiens
uagcauaaaaaccacau

SEQ ID NO: 1832257 - RNA, 13 nt, Homo sapiens
ccagacaugccac

SEQ ID NO: 1832258 - RNA, 17 nt, Homo sapiens
caccgaugcaaacauug

SEQ ID NO: 1832259 - RNA, 19 nt, Homo sapiens
gggagcacuguucacauca

SEQ ID NO: 1832260 - RNA, 15 nt, Homo sapiens
ugagcugggcagcug

SEQ ID NO: 1832261 - RNA, 14 nt, Homo sapiens
agcccagugcugcc

SEQ ID NO: 1832262 - RNA, 20 nt, Homo sapiens
ggagugacggucccacacug

SEQ ID NO: 1832263 - RNA, 13 nt, Homo sapiens
ccugaacucagaa

SEQ ID NO: 1832264 - RNA, 13 nt, Homo sapiens
gcugaacugagaa

SEQ ID NO: 1832265 - RNA, 14 nt, Homo sapiens
ggcuucuucuuaua

SEQ ID NO: 1832266 - RNA, 18 nt, Homo sapiens
acugccugacaagugccu

SEQ ID NO: 1832267 - RNA, 21 nt, Homo sapiens
uugugguggcugcuccaugag

SEQ ID NO: 1832268 - RNA, 17 nt, Homo sapiens
uaucagccuugcuuugg

SEQ ID NO: 1832269 - RNA, 17 nt, Homo sapiens
gagcccagcagaucuca

SEQ ID NO: 1832270 - RNA, 12 nt, Homo sapiens
agcuguggugag

SEQ ID NO: 1832271 - RNA, 18 nt, Homo sapiens
auaagucaaaauaaucug

SEQ ID NO: 1832272 - RNA, 19 nt, Homo sapiens
cucagguuccuuuuucaaa

SEQ ID NO: 1832273 - RNA, 12 nt, Homo sapiens
ucauacugaaaa

SEQ ID NO: 1832274 - RNA, 12 nt, Homo sapiens
aaauacugucaa

SEQ ID NO: 1832275 - RNA, 13 nt, Homo sapiens
agcuagacugugu

SEQ ID NO: 1832276 - RNA, 12 nt, Homo sapiens
ucuccauuucac

SEQ ID NO: 1832277 - RNA, 12 nt, Homo sapiens
uauacauuuaaa

SEQ ID NO: 1832278 - RNA, 16 nt, Homo sapiens
caggaagucccucucc

SEQ ID NO: 1832279 - RNA, 19 nt, Homo sapiens
aggucuggguggggcccag

SEQ ID NO: 1832280 - RNA, 20 nt, Homo sapiens
gucauggccaaauguucaau

SEQ ID NO: 1832281 - RNA, 21 nt, Homo sapiens
guuuuguaaauguacugguaa

SEQ ID NO: 1832282 - RNA, 15 nt, Homo sapiens
gcuuccugcaggacu

SEQ ID NO: 1832283 - RNA, 17 nt, Homo sapiens
cagcacaagggcacauu

SEQ ID NO: 1832284 - RNA, 17 nt, Homo sapiens
auuuaacuuacacugau

SEQ ID NO: 1832285 - RNA, 13 nt, Homo sapiens
aguucaugcauug

SEQ ID NO: 1832286 - RNA, 22 nt, Homo sapiens
ugaauaaaguguaaguucacaa

SEQ ID NO: 1832287 - RNA, 15 nt, Homo sapiens
cccagaccuagggau

SEQ ID NO: 1832288 - RNA, 16 nt, Homo sapiens
uaguaauugauuugac

SEQ ID NO: 1832289 - RNA, 14 nt, Homo sapiens
ucgucugggcuccc

SEQ ID NO: 1832290 - RNA, 13 nt, Homo sapiens
guuucuugccuca

SEQ ID NO: 1832291 - RNA, 22 nt, Homo sapiens
gugguaaauauagaaccaugaa

SEQ ID NO: 1832292 - RNA, 15 nt, Homo sapiens
uaauaaugacucuaa

SEQ ID NO: 1832293 - RNA, 23 nt, Homo sapiens
cugacccucccacucccaucucc

SEQ ID NO: 1832294 - RNA, 18 nt, Homo sapiens
auaucucuuuuauuucac

SEQ ID NO: 1832295 - RNA, 14 nt, Homo sapiens
caucuuacuuggcu

SEQ ID NO: 1832296 - RNA, 17 nt, Homo sapiens
auggaagaaaugggaga

SEQ ID NO: 1832297 - RNA, 20 nt, Homo sapiens
aacagcagugaucucagggc

SEQ ID NO: 1832298 - RNA, 14 nt, Homo sapiens
cacaaucugaaaca

SEQ ID NO: 1832299 - RNA, 14 nt, Homo sapiens
acccuuaaccuaaa

SEQ ID NO: 1832300 - RNA, 21 nt, Homo sapiens
aaacuaauuuuuggugcugau

SEQ ID NO: 1832301 - RNA, 17 nt, Homo sapiens
gacaaaaacaagcaaug

SEQ ID NO: 1832302 - RNA, 21 nt, Homo sapiens
cuaaaguauagagaaaagugu

SEQ ID NO: 1832303 - RNA, 14 nt, Homo sapiens
gaacuuauuuacac

SEQ ID NO: 1832304 - RNA, 19 nt, Homo sapiens
aguauuaaaaugcuuacau

SEQ ID NO: 1832305 - RNA, 23 nt, Homo sapiens
ucaaacuuccauagcuucaucca

SEQ ID NO: 1832306 - RNA, 16 nt, Homo sapiens
cucaucuuucuccuuc

SEQ ID NO: 1832307 - RNA, 16 nt, Homo sapiens
guccuuuuugucaugc

SEQ ID NO: 1832308 - RNA, 19 nt, Homo sapiens
uucaauaaaucuuucaaaa

SEQ ID NO: 1832309 - RNA, 21 nt, Homo sapiens
ccaagaaaguccaguuuauga

SEQ ID NO: 1832310 - RNA, 17 nt, Homo sapiens
uaaagccuacccuauuc

SEQ ID NO: 1832311 - RNA, 18 nt, Homo sapiens
gguaccucuggcacccau

SEQ ID NO: 1832312 - RNA, 23 nt, Homo sapiens
uggaugggguggggaccuggaau

SEQ ID NO: 1832313 - RNA, 17 nt, Homo sapiens
caucagcgggucuccuc

SEQ ID NO: 1832314 - RNA, 22 nt, Homo sapiens
accccagcauucucaggcacca

SEQ ID NO: 1832315 - RNA, 14 nt, Homo sapiens
ucccagcucuacau

SEQ ID NO: 1832316 - RNA, 14 nt, Homo sapiens
cagccagcccagcu

SEQ ID NO: 1832317 - RNA, 20 nt, Homo sapiens
uaagcccagugcugcuguaa

SEQ ID NO: 1832318 - RNA, 15 nt, Homo sapiens
uccuauuaagacuua

SEQ ID NO: 1832319 - RNA, 19 nt, Homo sapiens
guagcugucuccucuucaa

SEQ ID NO: 1832320 - RNA, 18 nt, Homo sapiens
cuguccuaggucaugaag

SEQ ID NO: 1832321 - RNA, 19 nt, Homo sapiens
aggacaccagccuggugcc

SEQ ID NO: 1832322 - RNA, 15 nt, Homo sapiens
acugacaaugggcac

SEQ ID NO: 1832323 - RNA, 18 nt, Homo sapiens
gaguuuugccaguucaag

SEQ ID NO: 1832324 - RNA, 20 nt, Homo sapiens
aaggcucuaucugcugggcu

SEQ ID NO: 1832325 - RNA, 24 nt, Homo sapiens
acaucauuacugccaucuuuauca

SEQ ID NO: 1832326 - RNA, 14 nt, Homo sapiens
aacauagccaaaau

SEQ ID NO: 1832327 - RNA, 20 nt, Homo sapiens
uccaacugccagaacaugga

SEQ ID NO: 1832328 - RNA, 14 nt, Homo sapiens
ccaagccaugguga

SEQ ID NO: 1832329 - RNA, 13 nt, Homo sapiens
aacaaugacuuaa

SEQ ID NO: 1832330 - RNA, 17 nt, Homo sapiens
acuggacauggucugca

SEQ ID NO: 1832331 - RNA, 19 nt, Homo sapiens
cauaauugccuacauuuau

SEQ ID NO: 1832332 - RNA, 21 nt, Homo sapiens
aauuuucaaaaucaaauucca

SEQ ID NO: 1832333 - RNA, 15 nt, Homo sapiens
gucuuucuccauuau

SEQ ID NO: 1832334 - RNA, 14 nt, Homo sapiens
cuccugaagccaca

SEQ ID NO: 1832335 - RNA, 20 nt, Homo sapiens
uagagcaggcguucagcuca

SEQ ID NO: 1832336 - RNA, 13 nt, Homo sapiens
gugaaaacaauau

SEQ ID NO: 1832337 - RNA, 14 nt, Homo sapiens
auaaugaguuuuac

SEQ ID NO: 1832338 - RNA, 23 nt, Homo sapiens
uggagcccgugcccuaccacaca

SEQ ID NO: 1832339 - RNA, 22 nt, Homo sapiens
aaucuggcuccuuuacaaaaga

SEQ ID NO: 1832340 - RNA, 17 nt, Homo sapiens
ucagaauuggaaucaca

SEQ ID NO: 1832341 - RNA, 15 nt, Homo sapiens
uauugaaguucauga

SEQ ID NO: 1832342 - RNA, 23 nt, Homo sapiens
ugggguagaaggauccuccaaag

SEQ ID NO: 1832343 - RNA, 20 nt, Homo sapiens
agaaccuggacauuggccag

SEQ ID NO: 1832344 - RNA, 13 nt, Homo sapiens
ugacgugaccaau

SEQ ID NO: 1832345 - RNA, 13 nt, Homo sapiens
cagggacugucuu

SEQ ID NO: 1832346 - RNA, 24 nt, Homo sapiens
ggaaaauaaacugacacuuauuaa

SEQ ID NO: 1832347 - RNA, 14 nt, Homo sapiens
auacgguaugauau

SEQ ID NO: 1832348 - RNA, 22 nt, Homo sapiens
ugcaggccaggccagcuucccc

SEQ ID NO: 1832349 - RNA, 15 nt, Homo sapiens
ucccaaucugagaaa

SEQ ID NO: 1832350 - RNA, 14 nt, Homo sapiens
agacccagugcacu

SEQ ID NO: 1832351 - RNA, 15 nt, Homo sapiens
auuuauucugaagaa

SEQ ID NO: 1832352 - RNA, 13 nt, Homo sapiens
ugcccgggcuccc

SEQ ID NO: 1832353 - RNA, 15 nt, Homo sapiens
gcugaucuuugcccc

SEQ ID NO: 1832354 - RNA, 13 nt, Homo sapiens
acucaaacuugag

SEQ ID NO: 1832355 - RNA, 16 nt, Homo sapiens
agaguuuagcuggaaa

SEQ ID NO: 1832356 - RNA, 18 nt, Homo sapiens
gcucuuaaugauuuacag

SEQ ID NO: 1832357 - RNA, 20 nt, Homo sapiens
acuuaucaaaucauucaaaa

SEQ ID NO: 1832358 - RNA, 15 nt, Homo sapiens
ggugauagguaaauu

SEQ ID NO: 1832359 - RNA, 17 nt, Homo sapiens
aaggcuucuugcuuaca

SEQ ID NO: 1832360 - RNA, 17 nt, Homo sapiens
aaugcaaauuucuauaa

SEQ ID NO: 1832361 - RNA, 15 nt, Homo sapiens
cuauguagcugaaaa

SEQ ID NO: 1832362 - RNA, 20 nt, Homo sapiens
cuucuggagucuccaguggu

SEQ ID NO: 1832363 - RNA, 14 nt, Homo sapiens
cagcucagccagug

SEQ ID NO: 1832364 - RNA, 23 nt, Homo sapiens
gccucuuaauugcaucaguauuu

SEQ ID NO: 1832365 - RNA, 15 nt, Homo sapiens
ugcaccccacuucag

SEQ ID NO: 1832366 - RNA, 13 nt, Homo sapiens
aacuuacauaugu

SEQ ID NO: 1832367 - RNA, 14 nt, Homo sapiens
cucaucccaaaagc

SEQ ID NO: 1832368 - RNA, 16 nt, Homo sapiens
cuguaaaacuaagaaa

SEQ ID NO: 1832369 - RNA, 18 nt, Homo sapiens
caagauucagacuccagc

SEQ ID NO: 1832370 - RNA, 16 nt, Homo sapiens
ccaagaacuugcaaua

SEQ ID NO: 1832371 - RNA, 13 nt, Homo sapiens
acauaugacaaug

SEQ ID NO: 1832372 - RNA, 13 nt, Homo sapiens
cuucuguuuccau

SEQ ID NO: 1832373 - RNA, 20 nt, Homo sapiens
gcccaaccuccuauauauag

SEQ ID NO: 1832374 - RNA, 22 nt, Homo sapiens
ucuuguaaauaaugcuuaacau

SEQ ID NO: 1832375 - RNA, 14 nt, Homo sapiens
gugcacauauccuu

SEQ ID NO: 1832376 - RNA, 20 nt, Homo sapiens
ccuuccagcuagugacccac

SEQ ID NO: 1832377 - RNA, 20 nt, Homo sapiens
ugccccaccaucuugcugac

SEQ ID NO: 1832378 - RNA, 20 nt, Homo sapiens
aacuaaaauuaaguauauau

SEQ ID NO: 1832379 - RNA, 19 nt, Homo sapiens
cguuuuacaauguaacuau

SEQ ID NO: 1832380 - RNA, 15 nt, Homo sapiens
agaugaauaugagcu

SEQ ID NO: 1832381 - RNA, 21 nt, Homo sapiens
cuggaauuuucagucaucuca

SEQ ID NO: 1832382 - RNA, 13 nt, Homo sapiens
uacucuugccuuc

SEQ ID NO: 1832383 - RNA, 13 nt, Homo sapiens
caccauugucuca

SEQ ID NO: 1832384 - RNA, 22 nt, Homo sapiens
ugagcucuuguuccgugccagg

SEQ ID NO: 1832385 - RNA, 20 nt, Homo sapiens
cacuuugaaggggccucacc

SEQ ID NO: 1832386 - RNA, 15 nt, Homo sapiens
gaagcagugccuucc

SEQ ID NO: 1832387 - RNA, 15 nt, Homo sapiens
ccuguaccacacaua

SEQ ID NO: 1832388 - RNA, 16 nt, Homo sapiens
uccgaggcugaggcag

SEQ ID NO: 1832389 - RNA, 20 nt, Homo sapiens
ugggcaauuuuuguauccaa

SEQ ID NO: 1832390 - RNA, 18 nt, Homo sapiens
gcaaggggcuggggccag

SEQ ID NO: 1832391 - RNA, 15 nt, Homo sapiens
ugcagucgcuugcca

SEQ ID NO: 1832392 - RNA, 18 nt, Homo sapiens
aguuuauguuguacaaug

SEQ ID NO: 1832393 - RNA, 13 nt, Homo sapiens
aaaguaguuauuu

SEQ ID NO: 1832394 - RNA, 16 nt, Homo sapiens
gaggaaagaacacuuc

SEQ ID NO: 1832395 - RNA, 20 nt, Homo sapiens
ggaauaauagcacaugauuu

SEQ ID NO: 1832396 - RNA, 12 nt, Homo sapiens
augccacugacc

SEQ ID NO: 1832397 - RNA, 16 nt, Homo sapiens
accuguccuugcacac

SEQ ID NO: 1832398 - RNA, 16 nt, Homo sapiens
agagcuggaggcaccc

SEQ ID NO: 1832399 - RNA, 21 nt, Homo sapiens
aauagacauuuuuuuguucca

SEQ ID NO: 1832400 - RNA, 12 nt, Homo sapiens
guucuuacacau

SEQ ID NO: 1832401 - RNA, 16 nt, Homo sapiens
aggaucucacauuuca

SEQ ID NO: 1832402 - RNA, 20 nt, Homo sapiens
aucucuaauuagucuaucaa

SEQ ID NO: 1832403 - RNA, 17 nt, Homo sapiens
ccugguggucacaggcu

SEQ ID NO: 1832404 - RNA, 13 nt, Homo sapiens
gcuccacugggau

SEQ ID NO: 1832405 - RNA, 17 nt, Homo sapiens
ccaaagcuugccacuuu

SEQ ID NO: 1832406 - RNA, 23 nt, Homo sapiens
uuuccugaugugacgcacuguau

SEQ ID NO: 1832407 - RNA, 20 nt, Homo sapiens
uguuuccagagugcuuauaa

SEQ ID NO: 1832408 - RNA, 13 nt, Homo sapiens
gauagugguauga

SEQ ID NO: 1832409 - RNA, 13 nt, Homo sapiens
cagccuguaggga

SEQ ID NO: 1832410 - RNA, 12 nt, Homo sapiens
cauacagacugg

SEQ ID NO: 1832411 - RNA, 18 nt, Homo sapiens
aaggcuuauuaaagugga

SEQ ID NO: 1832412 - RNA, 17 nt, Homo sapiens
aauguaccauguugccc

SEQ ID NO: 1832413 - RNA, 15 nt, Homo sapiens
gccaccuuugaagaa

SEQ ID NO: 1832414 - RNA, 17 nt, Homo sapiens
acugcaaaaacugggua

SEQ ID NO: 1832415 - RNA, 13 nt, Homo sapiens
aagucaaaucaau

SEQ ID NO: 1832416 - RNA, 21 nt, Homo sapiens
caucaagucuuucacauuuaa

SEQ ID NO: 1832417 - RNA, 15 nt, Homo sapiens
ugauauaaucuuuca

SEQ ID NO: 1832418 - RNA, 22 nt, Homo sapiens
aguguuaucagucauaacuaaa

SEQ ID NO: 1832419 - RNA, 22 nt, Homo sapiens
aagaugaaugagcaaaaccaaa

SEQ ID NO: 1832420 - RNA, 14 nt, Homo sapiens
ugaacugcagugau

SEQ ID NO: 1832421 - RNA, 18 nt, Homo sapiens
agacagaauguaucugug

SEQ ID NO: 1832422 - RNA, 13 nt, Homo sapiens
aguuuguuuuaca

SEQ ID NO: 1832423 - RNA, 15 nt, Homo sapiens
gaggugcaugccuaa

SEQ ID NO: 1832424 - RNA, 17 nt, Homo sapiens
cuccuuucucugguaca

SEQ ID NO: 1832425 - RNA, 22 nt, Homo sapiens
acauaguccagagaacugacau

SEQ ID NO: 1832426 - RNA, 15 nt, Homo sapiens
aauaauuuucauuuc

SEQ ID NO: 1832427 - RNA, 21 nt, Homo sapiens
aauuaaagucuacacugccuu

SEQ ID NO: 1832428 - RNA, 20 nt, Homo sapiens
ccuaggguuuaugcuuaauu

SEQ ID NO: 1832429 - RNA, 22 nt, Homo sapiens
caaaucuaaaauuuaaaauuaa

SEQ ID NO: 1832430 - RNA, 21 nt, Homo sapiens
guagacucacgcugacugcag

SEQ ID NO: 1832431 - RNA, 22 nt, Homo sapiens
uggcauaaggaguuagaaccac

SEQ ID NO: 1832432 - RNA, 13 nt, Homo sapiens
gaaauaaccacug

SEQ ID NO: 1832433 - RNA, 20 nt, Homo sapiens
ucuagacccccgacuccgca

SEQ ID NO: 1832434 - RNA, 23 nt, Homo sapiens
gcaucccuagucucuacccagua

SEQ ID NO: 1832435 - RNA, 19 nt, Homo sapiens
ugcugcgcucggcccucaa

SEQ ID NO: 1832436 - RNA, 18 nt, Homo sapiens
uauuucaggcacaucauu

SEQ ID NO: 1832437 - RNA, 13 nt, Homo sapiens
caugcaauuccau

SEQ ID NO: 1832438 - RNA, 18 nt, Homo sapiens
ucauuucuuauuaaccaa

SEQ ID NO: 1832439 - RNA, 21 nt, Homo sapiens
auuuguucugggaguauaaag

SEQ ID NO: 1832440 - RNA, 17 nt, Homo sapiens
gaagcuucuaauuagau

SEQ ID NO: 1832441 - RNA, 16 nt, Homo sapiens
uaaaucugagaucucc

SEQ ID NO: 1832442 - RNA, 18 nt, Homo sapiens
ugugccuuggugugcugu

SEQ ID NO: 1832443 - RNA, 16 nt, Homo sapiens
uccugaauaauuucca

SEQ ID NO: 1832444 - RNA, 21 nt, Homo sapiens
aguaacauuugcuguuuuaaa

SEQ ID NO: 1832445 - RNA, 19 nt, Homo sapiens
uuccacuggaguucacuuu

SEQ ID NO: 1832446 - RNA, 19 nt, Homo sapiens
uaacaaacuacauguaauc

SEQ ID NO: 1832447 - RNA, 19 nt, Homo sapiens
uccugucccuguagcucag

SEQ ID NO: 1832448 - RNA, 19 nt, Homo sapiens
uauaaauauauguauacau

SEQ ID NO: 1832449 - RNA, 19 nt, Homo sapiens
caaguuucccaaauucccu

SEQ ID NO: 1832450 - RNA, 15 nt, Homo sapiens
uucuucuggggucag

SEQ ID NO: 1832451 - RNA, 14 nt, Homo sapiens
gaauaucagucacu

SEQ ID NO: 1832452 - RNA, 20 nt, Homo sapiens
uuccccuauccuguucuucc

SEQ ID NO: 1832453 - RNA, 12 nt, Homo sapiens
agcaaaccagcu

SEQ ID NO: 1832454 - RNA, 13 nt, Homo sapiens
ucuuccaucaccu

SEQ ID NO: 1832455 - RNA, 17 nt, Homo sapiens
agucccugccaucaugu

SEQ ID NO: 1832456 - RNA, 20 nt, Homo sapiens
aguuuuuggcaaaaaacaac

SEQ ID NO: 1832457 - RNA, 16 nt, Homo sapiens
agggugcugcuucccu

SEQ ID NO: 1832458 - RNA, 14 nt, Homo sapiens
cccacucauuccuu

SEQ ID NO: 1832459 - RNA, 24 nt, Homo sapiens
ccagcuccccucuuuuguaaguau

SEQ ID NO: 1832460 - RNA, 17 nt, Homo sapiens
ccuuaguuugcugccau

SEQ ID NO: 1832461 - RNA, 19 nt, Homo sapiens
ugccagcccaacugugaga

SEQ ID NO: 1832462 - RNA, 15 nt, Homo sapiens
aaacagccaugucca

SEQ ID NO: 1832463 - RNA, 22 nt, Homo sapiens
gcugcaggccccggggacccca

SEQ ID NO: 1832464 - RNA, 18 nt, Homo sapiens
auuuguuugagacagggu

SEQ ID NO: 1832465 - RNA, 23 nt, Homo sapiens
uaaagccacuguaugauucucuu

SEQ ID NO: 1832466 - RNA, 15 nt, Homo sapiens
ucuucauaguuuauu

SEQ ID NO: 1832467 - RNA, 19 nt, Homo sapiens
ccggccaggccaccuccag

SEQ ID NO: 1832468 - RNA, 22 nt, Homo sapiens
gcugaggcggguggaucacuug

SEQ ID NO: 1832469 - RNA, 15 nt, Homo sapiens
gcuguuccugagaaa

SEQ ID NO: 1832470 - RNA, 13 nt, Homo sapiens
cagucugagucau

SEQ ID NO: 1832471 - RNA, 19 nt, Homo sapiens
uugugcaacggccaggguu

SEQ ID NO: 1832472 - RNA, 16 nt, Homo sapiens
guaaauacaugcauau

SEQ ID NO: 1832473 - RNA, 15 nt, Homo sapiens
cacggugggagaccu

SEQ ID NO: 1832474 - RNA, 15 nt, Homo sapiens
agagaaaucacugaa

SEQ ID NO: 1832475 - RNA, 14 nt, Homo sapiens
ugauucuuguaaau

SEQ ID NO: 1832476 - RNA, 17 nt, Homo sapiens
uggucagaggggagcaa

SEQ ID NO: 1832477 - RNA, 15 nt, Homo sapiens
aagugcugggaauua

SEQ ID NO: 1832478 - RNA, 13 nt, Homo sapiens
aauaaugauaccu

SEQ ID NO: 1832479 - RNA, 15 nt, Homo sapiens
cuuguuccugaaaug

SEQ ID NO: 1832480 - RNA, 13 nt, Homo sapiens
ugagaucauguca

SEQ ID NO: 1832481 - RNA, 19 nt, Homo sapiens
uccaaaaccuaaagaggaa

SEQ ID NO: 1832482 - RNA, 12 nt, Homo sapiens
gcugcuuugaca

SEQ ID NO: 1832483 - RNA, 18 nt, Homo sapiens
gauucuaaugucuucauu

SEQ ID NO: 1832484 - RNA, 19 nt, Homo sapiens
uagcucuuuucuugggcau

SEQ ID NO: 1832485 - RNA, 14 nt, Homo sapiens
ugguccaggguuga

SEQ ID NO: 1832486 - RNA, 17 nt, Homo sapiens
ucugacauccccacuca

SEQ ID NO: 1832487 - RNA, 14 nt, Homo sapiens
uccagaccauucag

SEQ ID NO: 1832488 - RNA, 19 nt, Homo sapiens
accagagaccaaaugucac

SEQ ID NO: 1832489 - RNA, 16 nt, Homo sapiens
acugcacacucagugg

SEQ ID NO: 1832490 - RNA, 20 nt, Homo sapiens
cuuccagauccucucugggg

SEQ ID NO: 1832491 - RNA, 15 nt, Homo sapiens
gcgucuccagacucu

SEQ ID NO: 1832492 - RNA, 20 nt, Homo sapiens
guagcauuugggucugagau

SEQ ID NO: 1832493 - RNA, 12 nt, Homo sapiens
ugggacacaguu

SEQ ID NO: 1832494 - RNA, 15 nt, Homo sapiens
acugacagauuucca

SEQ ID NO: 1832495 - RNA, 12 nt, Homo sapiens
uauuaccacuga

SEQ ID NO: 1832496 - RNA, 13 nt, Homo sapiens
cuuguaggaucua

SEQ ID NO: 1832497 - RNA, 17 nt, Homo sapiens
uagcuuaaauaaauuca

SEQ ID NO: 1832498 - RNA, 21 nt, Homo sapiens
augacuugacuggcugcucuu

SEQ ID NO: 1832499 - RNA, 11 nt, Homo sapiens
ccaaugggcua

SEQ ID NO: 1832500 - RNA, 12 nt, Homo sapiens
aaaagaucuucu

SEQ ID NO: 1832501 - RNA, 21 nt, Homo sapiens
gagucauuuuuuaagugacuu

SEQ ID NO: 1832502 - RNA, 17 nt, Homo sapiens
cauucaugaugaacuca

SEQ ID NO: 1832503 - RNA, 22 nt, Homo sapiens
uggaguagccuggacuguuuca

SEQ ID NO: 1832504 - RNA, 17 nt, Homo sapiens
uagccagcauuccauau

SEQ ID NO: 1832505 - RNA, 19 nt, Homo sapiens
gagaucuaaggaugucaca

SEQ ID NO: 1832506 - RNA, 17 nt, Homo sapiens
ucagcuuauaaaaucaa

SEQ ID NO: 1832507 - RNA, 15 nt, Homo sapiens
uguuaauagacuuaa

SEQ ID NO: 1832508 - RNA, 23 nt, Homo sapiens
uuauuuaaagcaaugcugaugaa

SEQ ID NO: 1832509 - RNA, 16 nt, Homo sapiens
aaaacccuuacaguga

SEQ ID NO: 1832510 - RNA, 16 nt, Homo sapiens
augucaugucagcucc

SEQ ID NO: 1832511 - RNA, 22 nt, Homo sapiens
cuuccguauccaucgaagcaga

SEQ ID NO: 1832512 - RNA, 22 nt, Homo sapiens
ggccuggcuugucggagcaagu

SEQ ID NO: 1832513 - RNA, 22 nt, Homo sapiens
caauacuuuucaggcacuuuag

SEQ ID NO: 1832514 - RNA, 14 nt, Homo sapiens
uacacacacacucc

SEQ ID NO: 1832515 - RNA, 12 nt, Homo sapiens
uugaaucucaua

SEQ ID NO: 1832516 - RNA, 12 nt, Homo sapiens
uuguaucucauu

SEQ ID NO: 1832517 - RNA, 11 nt, Homo sapiens
accugaugcag

SEQ ID NO: 1832518 - RNA, 18 nt, Homo sapiens
ugaaaaaucuaagugaua

SEQ ID NO: 1832519 - RNA, 17 nt, Homo sapiens
cuugccaaauuuagauu

SEQ ID NO: 1832520 - RNA, 21 nt, Homo sapiens
aagauagggaacacucauccc

SEQ ID NO: 1832521 - RNA, 22 nt, Homo sapiens
acgaauauagaggguuuugcuc

SEQ ID NO: 1832522 - RNA, 20 nt, Homo sapiens
uccgaagaaugaagucuuuc

SEQ ID NO: 1832523 - RNA, 18 nt, Homo sapiens
caugcauuacugcaugca

SEQ ID NO: 1832524 - RNA, 12 nt, Homo sapiens
cuguaugauucc

SEQ ID NO: 1832525 - RNA, 21 nt, Homo sapiens
cccuacauuaguaaaaauaaa

SEQ ID NO: 1832526 - RNA, 21 nt, Homo sapiens
auuccuaagacugcugcugaa

SEQ ID NO: 1832527 - RNA, 16 nt, Homo sapiens
gaaaagguugccugaa

SEQ ID NO: 1832528 - RNA, 21 nt, Homo sapiens
ccuuagaaauguaaacugcca

SEQ ID NO: 1832529 - RNA, 23 nt, Homo sapiens
uugaaggccuuauucuacauuuc

SEQ ID NO: 1832530 - RNA, 15 nt, Homo sapiens
ugccacugacaggaa

SEQ ID NO: 1832531 - RNA, 13 nt, Homo sapiens
gaaaaugcaaaag

SEQ ID NO: 1832532 - RNA, 14 nt, Homo sapiens
gaauuuacauauag

SEQ ID NO: 1832533 - RNA, 17 nt, Homo sapiens
cccugaaccgcacccca

SEQ ID NO: 1832534 - RNA, 15 nt, Homo sapiens
aucuauuucacuuau

SEQ ID NO: 1832535 - RNA, 22 nt, Homo sapiens
cugagagaaguacuaagaccca

SEQ ID NO: 1832536 - RNA, 15 nt, Homo sapiens
ugaagaguaaaggaa

SEQ ID NO: 1832537 - RNA, 17 nt, Homo sapiens
uagugauuucauuacca

SEQ ID NO: 1832538 - RNA, 15 nt, Homo sapiens
uggguucaauuugcc

SEQ ID NO: 1832539 - RNA, 17 nt, Homo sapiens
gaggugagggaagccug

SEQ ID NO: 1832540 - RNA, 22 nt, Homo sapiens
cgcaccgggcccuccuugccug

SEQ ID NO: 1832541 - RNA, 17 nt, Homo sapiens
gaacauaaaaaggacau

SEQ ID NO: 1832542 - RNA, 15 nt, Homo sapiens
cccuugcaagccaua

SEQ ID NO: 1832543 - RNA, 13 nt, Homo sapiens
aucuccugaccuc

SEQ ID NO: 1832544 - RNA, 14 nt, Homo sapiens
aauaaaagaaucau

SEQ ID NO: 1832545 - RNA, 22 nt, Homo sapiens
cgaugccgugugucucgucucc

SEQ ID NO: 1832546 - RNA, 17 nt, Homo sapiens
uguggaugucccuauuc

SEQ ID NO: 1832547 - RNA, 14 nt, Homo sapiens
aucucucaugguga

SEQ ID NO: 1832548 - RNA, 15 nt, Homo sapiens
uuauaucagaguaug

SEQ ID NO: 1832549 - RNA, 16 nt, Homo sapiens
uagcaacccagaaugu

SEQ ID NO: 1832550 - RNA, 16 nt, Homo sapiens
auaaauaaaagcuaga

SEQ ID NO: 1832551 - RNA, 20 nt, Homo sapiens
auaaugccaaugaacaucuc

SEQ ID NO: 1832552 - RNA, 22 nt, Homo sapiens
agguuguggugagccaacauca

SEQ ID NO: 1832553 - RNA, 17 nt, Homo sapiens
ugucauuucuacuuuga

SEQ ID NO: 1832554 - RNA, 23 nt, Homo sapiens
cagggagauguuggacugugccu

SEQ ID NO: 1832555 - RNA, 18 nt, Homo sapiens
agcucaggcccuggugag

SEQ ID NO: 1832556 - RNA, 20 nt, Homo sapiens
gggucucgcucuguugccca

SEQ ID NO: 1832557 - RNA, 22 nt, Homo sapiens
caugucacuccagcagcacagg

SEQ ID NO: 1832558 - RNA, 12 nt, Homo sapiens
gcuggaacccga

SEQ ID NO: 1832559 - RNA, 23 nt, Homo sapiens
aacuaggcucagagaugugcacc

SEQ ID NO: 1832560 - RNA, 21 nt, Homo sapiens
accgcauggaacagugcagga

SEQ ID NO: 1832561 - RNA, 16 nt, Homo sapiens
agccaggaacugugug

SEQ ID NO: 1832562 - RNA, 15 nt, Homo sapiens
cugaaggcauaugca

SEQ ID NO: 1832563 - RNA, 18 nt, Homo sapiens
uaagccuuugagacuguu

SEQ ID NO: 1832564 - RNA, 21 nt, Homo sapiens
aaauguacucuugaacuucuu

SEQ ID NO: 1832565 - RNA, 22 nt, Homo sapiens
ugaacugucuuuuaauguguaa

SEQ ID NO: 1832566 - RNA, 14 nt, Homo sapiens
agccccacuugaag

SEQ ID NO: 1832567 - RNA, 21 nt, Homo sapiens
aauaaaagccaauuagcucua

SEQ ID NO: 1832568 - RNA, 17 nt, Homo sapiens
aacuuaauucuguuaca

SEQ ID NO: 1832569 - RNA, 13 nt, Homo sapiens
aggaggugucuca

SEQ ID NO: 1832570 - RNA, 16 nt, Homo sapiens
ccuggcucugcaaugg

SEQ ID NO: 1832571 - RNA, 12 nt, Homo sapiens
uagaauugggaa

SEQ ID NO: 1832572 - RNA, 14 nt, Homo sapiens
ucugacacacagcu

SEQ ID NO: 1832573 - RNA, 19 nt, Homo sapiens
auuaguuuauuguuaggau

SEQ ID NO: 1832574 - RNA, 20 nt, Homo sapiens
cauuggggauugaaaaucau

SEQ ID NO: 1832575 - RNA, 16 nt, Homo sapiens
augauguauuguugcu

SEQ ID NO: 1832576 - RNA, 14 nt, Homo sapiens
gaggccugugcuag

SEQ ID NO: 1832577 - RNA, 22 nt, Homo sapiens
ccauucugaaaauagcaggaca

SEQ ID NO: 1832578 - RNA, 16 nt, Homo sapiens
agugacuaguacaaau

SEQ ID NO: 1832579 - RNA, 22 nt, Homo sapiens
acauauguauacaugugccaug

SEQ ID NO: 1832580 - RNA, 14 nt, Homo sapiens
caaguauaugugaa

SEQ ID NO: 1832581 - RNA, 15 nt, Homo sapiens
uugugccucacugga

SEQ ID NO: 1832582 - RNA, 15 nt, Homo sapiens
cuccaugacuggcug

SEQ ID NO: 1832583 - RNA, 15 nt, Homo sapiens
ugccaugaugggcug

SEQ ID NO: 1832584 - RNA, 14 nt, Homo sapiens
ccaaauaugagaug

SEQ ID NO: 1832585 - RNA, 12 nt, Homo sapiens
cacaaugcccaa

SEQ ID NO: 1832586 - RNA, 13 nt, Homo sapiens
ucaagauacauag

SEQ ID NO: 1832587 - RNA, 13 nt, Homo sapiens
uaacuauaccucu

SEQ ID NO: 1832588 - RNA, 15 nt, Homo sapiens
acacacacaaaaaau

SEQ ID NO: 1832589 - RNA, 14 nt, Homo sapiens
aagccaagcacuuu

SEQ ID NO: 1832590 - RNA, 21 nt, Homo sapiens
cggagcagccuuuaucaagag

SEQ ID NO: 1832591 - RNA, 16 nt, Homo sapiens
uguuuggaauauucca

SEQ ID NO: 1832592 - RNA, 20 nt, Homo sapiens
caucauucagcaaaugccuu

SEQ ID NO: 1832593 - RNA, 21 nt, Homo sapiens
ggcuuuauucugcaagcaauc

SEQ ID NO: 1832594 - RNA, 14 nt, Homo sapiens
gaggcugcaugcuc

SEQ ID NO: 1832595 - RNA, 22 nt, Homo sapiens
cuugcuaucggggaagccagac

SEQ ID NO: 1832596 - RNA, 20 nt, Homo sapiens
ccaggaaacaugaagcauaa

SEQ ID NO: 1832597 - RNA, 22 nt, Homo sapiens
uauaaauacagcauacuucaaa

SEQ ID NO: 1832598 - RNA, 15 nt, Homo sapiens
uaaauguacucuuga

SEQ ID NO: 1832599 - RNA, 14 nt, Homo sapiens
aaggcuuccugaaa

SEQ ID NO: 1832600 - RNA, 16 nt, Homo sapiens
ugaacaggauauucuc

SEQ ID NO: 1832601 - RNA, 13 nt, Homo sapiens
cuacaguucugug

SEQ ID NO: 1832602 - RNA, 16 nt, Homo sapiens
aguuccgaauuccugc

SEQ ID NO: 1832603 - RNA, 15 nt, Homo sapiens
aauaaaaagccacca

SEQ ID NO: 1832604 - RNA, 12 nt, Homo sapiens
agauaccaaaug

SEQ ID NO: 1832605 - RNA, 23 nt, Homo sapiens
cgaguggucacugucagugggaa

SEQ ID NO: 1832606 - RNA, 17 nt, Homo sapiens
gaaauuugaauuuugug

SEQ ID NO: 1832607 - RNA, 12 nt, Homo sapiens
augagauggauc

SEQ ID NO: 1832608 - RNA, 19 nt, Homo sapiens
gaggugguucagacaagac

SEQ ID NO: 1832609 - RNA, 15 nt, Homo sapiens
caaggaccucucuca

SEQ ID NO: 1832610 - RNA, 17 nt, Homo sapiens
ugauuuugagaaguaua

SEQ ID NO: 1832611 - RNA, 18 nt, Homo sapiens
ugaaaacagugucuugag

SEQ ID NO: 1832612 - RNA, 11 nt, Homo sapiens
caggugcugcu

SEQ ID NO: 1832613 - RNA, 11 nt, Homo sapiens
gcugugcucag

SEQ ID NO: 1832614 - RNA, 16 nt, Homo sapiens
uuuagaaugacaggaa

SEQ ID NO: 1832615 - RNA, 23 nt, Homo sapiens
agcuucaccuuuuugucuuggcu

SEQ ID NO: 1832616 - RNA, 21 nt, Homo sapiens
auccuggcucuuuggagauca

SEQ ID NO: 1832617 - RNA, 13 nt, Homo sapiens
gucucucauucuc

SEQ ID NO: 1832618 - RNA, 13 nt, Homo sapiens
uuugaucaguuga

SEQ ID NO: 1832619 - RNA, 16 nt, Homo sapiens
agucaaaucugggcuc

SEQ ID NO: 1832620 - RNA, 13 nt, Homo sapiens
uuugcaacuuaau

SEQ ID NO: 1832621 - RNA, 22 nt, Homo sapiens
caauauacuuguauagcaguuu

SEQ ID NO: 1832622 - RNA, 16 nt, Homo sapiens
uauuacuuuucaucua

SEQ ID NO: 1832623 - RNA, 21 nt, Homo sapiens
cuugaauguccccauucuaua

SEQ ID NO: 1832624 - RNA, 19 nt, Homo sapiens
uguaaacacgccugcaaac

SEQ ID NO: 1832625 - RNA, 16 nt, Homo sapiens
uucccauauacaaucu

SEQ ID NO: 1832626 - RNA, 19 nt, Homo sapiens
accccagcaauuaugaaaa

SEQ ID NO: 1832627 - RNA, 15 nt, Homo sapiens
cagcccugcagugcc

SEQ ID NO: 1832628 - RNA, 13 nt, Homo sapiens
gcccuccaugugu

SEQ ID NO: 1832629 - RNA, 15 nt, Homo sapiens
cugucauuccuaaaa

SEQ ID NO: 1832630 - RNA, 17 nt, Homo sapiens
ugguuauaucauucugg

SEQ ID NO: 1832631 - RNA, 13 nt, Homo sapiens
auuaaccuaauca

SEQ ID NO: 1832632 - RNA, 22 nt, Homo sapiens
gagcuucuuccguuucuucccc

SEQ ID NO: 1832633 - RNA, 22 nt, Homo sapiens
acuuucuuaagcaacaauggau

SEQ ID NO: 1832634 - RNA, 23 nt, Homo sapiens
uguuuuuacccugccccugccuu

SEQ ID NO: 1832635 - RNA, 18 nt, Homo sapiens
gaaguuuuaugccauguu

SEQ ID NO: 1832636 - RNA, 19 nt, Homo sapiens
aaguuacaaauucaaggag

SEQ ID NO: 1832637 - RNA, 14 nt, Homo sapiens
caucucgaccacuu

SEQ ID NO: 1832638 - RNA, 18 nt, Homo sapiens
uuaguguguaaaauuaau

SEQ ID NO: 1832639 - RNA, 13 nt, Homo sapiens
auggcagcugcca

SEQ ID NO: 1832640 - RNA, 18 nt, Homo sapiens
ccucagccuugccagaga

SEQ ID NO: 1832641 - RNA, 19 nt, Homo sapiens
aaagucuaucuaaugacau

SEQ ID NO: 1832642 - RNA, 16 nt, Homo sapiens
acucugguucuuuuaa

SEQ ID NO: 1832643 - RNA, 16 nt, Homo sapiens
ucucagauacuuauga

SEQ ID NO: 1832644 - RNA, 23 nt, Homo sapiens
aucucucgagcugucuugcugag

SEQ ID NO: 1832645 - RNA, 18 nt, Homo sapiens
gaacugggaagaugcugg

SEQ ID NO: 1832646 - RNA, 13 nt, Homo sapiens
uuuaaugauuugc

SEQ ID NO: 1832647 - RNA, 15 nt, Homo sapiens
auucuuuccaugaca

SEQ ID NO: 1832648 - RNA, 19 nt, Homo sapiens
ccuccagcacaaacacaag

SEQ ID NO: 1832649 - RNA, 15 nt, Homo sapiens
ucauaccuacauuca

SEQ ID NO: 1832650 - RNA, 11 nt, Homo sapiens
ucacauucccu

SEQ ID NO: 1832651 - RNA, 11 nt, Homo sapiens
ucucauuccca

SEQ ID NO: 1832652 - RNA, 13 nt, Homo sapiens
uauccaccaccuc

SEQ ID NO: 1832653 - RNA, 15 nt, Homo sapiens
aacaucugauuugag

SEQ ID NO: 1832654 - RNA, 23 nt, Homo sapiens
aaugucccagugucaguauuuac

SEQ ID NO: 1832655 - RNA, 12 nt, Homo sapiens
acggacacucaa

SEQ ID NO: 1832656 - RNA, 14 nt, Homo sapiens
gcagcagcuuucag

SEQ ID NO: 1832657 - RNA, 23 nt, Homo sapiens
gcauacagacuggggacccugga

SEQ ID NO: 1832658 - RNA, 13 nt, Homo sapiens
uuaucuugggaua

SEQ ID NO: 1832659 - RNA, 22 nt, Homo sapiens
auuuuuauaaagauauaccaag

SEQ ID NO: 1832660 - RNA, 13 nt, Homo sapiens
uuccacugaaaau

SEQ ID NO: 1832661 - RNA, 23 nt, Homo sapiens
cacacuguauauaaacauaucaa

SEQ ID NO: 1832662 - RNA, 22 nt, Homo sapiens
uggaagagaauauuccuacuug

SEQ ID NO: 1832663 - RNA, 17 nt, Homo sapiens
auggccacacugugaca

SEQ ID NO: 1832664 - RNA, 13 nt, Homo sapiens
cugaaaauucugu

SEQ ID NO: 1832665 - RNA, 15 nt, Homo sapiens
ucaccaugacuuccu

SEQ ID NO: 1832666 - RNA, 16 nt, Homo sapiens
gugucgcgcacacagc

SEQ ID NO: 1832667 - RNA, 21 nt, Homo sapiens
cauuagagauguugagucuua

SEQ ID NO: 1832668 - RNA, 18 nt, Homo sapiens
cugugcaucuagccucaa

SEQ ID NO: 1832669 - RNA, 19 nt, Homo sapiens
ucuaucaggggugcauucu

SEQ ID NO: 1832670 - RNA, 21 nt, Homo sapiens
auuuuuguuuuuguaaugcac

SEQ ID NO: 1832671 - RNA, 14 nt, Homo sapiens
acagucagcaacau

SEQ ID NO: 1832672 - RNA, 22 nt, Homo sapiens
auaaucauucuuauuucaugaa

SEQ ID NO: 1832673 - RNA, 19 nt, Homo sapiens
gccuuggcaggcugcugga

SEQ ID NO: 1832674 - RNA, 19 nt, Homo sapiens
acucuguaaaaacacugaa

SEQ ID NO: 1832675 - RNA, 22 nt, Homo sapiens
agagagaaaaguaacuguuuug

SEQ ID NO: 1832676 - RNA, 21 nt, Homo sapiens
gccaggccacccugccucuac

SEQ ID NO: 1832677 - RNA, 21 nt, Homo sapiens
agcugguggcucugugugcuc

SEQ ID NO: 1832678 - RNA, 13 nt, Homo sapiens
cauauccuuucaa

SEQ ID NO: 1832679 - RNA, 21 nt, Homo sapiens
ccaaauuuaauuaaagccuua

SEQ ID NO: 1832680 - RNA, 20 nt, Homo sapiens
uaauuucuuuuuuccucuga

SEQ ID NO: 1832681 - RNA, 17 nt, Homo sapiens
aaaucauauagaccaau

SEQ ID NO: 1832682 - RNA, 20 nt, Homo sapiens
agcuucugaguuuacgugga

SEQ ID NO: 1832683 - RNA, 14 nt, Homo sapiens
auucugcugucuca

SEQ ID NO: 1832684 - RNA, 14 nt, Homo sapiens
aacuugcugaucca

SEQ ID NO: 1832685 - RNA, 15 nt, Homo sapiens
uccuggauucacuca

SEQ ID NO: 1832686 - RNA, 17 nt, Homo sapiens
acugguuugccaggcca

SEQ ID NO: 1832687 - RNA, 19 nt, Homo sapiens
ucccagacagcagugugag

SEQ ID NO: 1832688 - RNA, 12 nt, Homo sapiens
aaccuauuggga

SEQ ID NO: 1832689 - RNA, 23 nt, Homo sapiens
acacggccuggggcgagcacugu

SEQ ID NO: 1832690 - RNA, 16 nt, Homo sapiens
uaaaugugauucaccu

SEQ ID NO: 1832691 - RNA, 22 nt, Homo sapiens
ugccacugugugccuucugcca

SEQ ID NO: 1832692 - RNA, 17 nt, Homo sapiens
cagacauugcuuucaaa

SEQ ID NO: 1832693 - RNA, 23 nt, Homo sapiens
uaaaauauccacuggacacugug

SEQ ID NO: 1832694 - RNA, 12 nt, Homo sapiens
acccccagcugg

SEQ ID NO: 1832695 - RNA, 23 nt, Homo sapiens
gauuaucgacaucuuugaagcug

SEQ ID NO: 1832696 - RNA, 20 nt, Homo sapiens
gccugagugcaccacccuuu

SEQ ID NO: 1832697 - RNA, 18 nt, Homo sapiens
uaaaacauuccugugaaa

SEQ ID NO: 1832698 - RNA, 13 nt, Homo sapiens
aaagucaaaaaua

SEQ ID NO: 1832699 - RNA, 17 nt, Homo sapiens
cucuuguuuucucucuc

SEQ ID NO: 1832700 - RNA, 15 nt, Homo sapiens
augaauucuucucaa

SEQ ID NO: 1832701 - RNA, 15 nt, Homo sapiens
uggucuucagcaaaa

SEQ ID NO: 1832702 - RNA, 19 nt, Homo sapiens
ccugugcuuguguuugcug

SEQ ID NO: 1832703 - RNA, 19 nt, Homo sapiens
ccugcagaagaagcuggug

SEQ ID NO: 1832704 - RNA, 20 nt, Homo sapiens
cugagaugggacaggaucaa

SEQ ID NO: 1832705 - RNA, 19 nt, Homo sapiens
uucccuaaagaacauaccu

SEQ ID NO: 1832706 - RNA, 18 nt, Homo sapiens
cuuggaguaaaacuguau

SEQ ID NO: 1832707 - RNA, 22 nt, Homo sapiens
acgccauuuccuuuuccuucaa

SEQ ID NO: 1832708 - RNA, 13 nt, Homo sapiens
aaagugcaaucau

SEQ ID NO: 1832709 - RNA, 16 nt, Homo sapiens
aauauaggcacauuac

SEQ ID NO: 1832710 - RNA, 17 nt, Homo sapiens
acguaaucucacuuaau

SEQ ID NO: 1832711 - RNA, 15 nt, Homo sapiens
gacuuuaucaugugu

SEQ ID NO: 1832712 - RNA, 14 nt, Homo sapiens
ucccuccugcuuug

SEQ ID NO: 1832713 - RNA, 17 nt, Homo sapiens
guuccgcccgcccuccc

SEQ ID NO: 1832714 - RNA, 21 nt, Homo sapiens
aggucuaggaacauacuucag

SEQ ID NO: 1832715 - RNA, 14 nt, Homo sapiens
caaagccacuggaa

SEQ ID NO: 1832716 - RNA, 16 nt, Homo sapiens
gugccuaauguuccau

SEQ ID NO: 1832717 - RNA, 15 nt, Homo sapiens
ucuguguaccacugg

SEQ ID NO: 1832718 - RNA, 15 nt, Homo sapiens
uuucaagacuagaau

SEQ ID NO: 1832719 - RNA, 23 nt, Homo sapiens
gcuguguuugcagccugcucuag

SEQ ID NO: 1832720 - RNA, 13 nt, Homo sapiens
aaagcugccugua

SEQ ID NO: 1832721 - RNA, 12 nt, Homo sapiens
ucucagaaccuu

SEQ ID NO: 1832722 - RNA, 21 nt, Homo sapiens
aucaauaaauguugcaaugca

SEQ ID NO: 1832723 - RNA, 21 nt, Homo sapiens
cagacugcggugaacauuucc

SEQ ID NO: 1832724 - RNA, 23 nt, Homo sapiens
uuaggaagaaaugcccaaaagag

SEQ ID NO: 1832725 - RNA, 16 nt, Homo sapiens
aggcagcuaagacaua

SEQ ID NO: 1832726 - RNA, 22 nt, Homo sapiens
aguggggacggaaggcaaagag

SEQ ID NO: 1832727 - RNA, 18 nt, Homo sapiens
aaaauacagcacuuugac

SEQ ID NO: 1832728 - RNA, 22 nt, Homo sapiens
cacgccuguaaucccagcaauu

SEQ ID NO: 1832729 - RNA, 15 nt, Homo sapiens
gcuccagcuuuugca

SEQ ID NO: 1832730 - RNA, 21 nt, Homo sapiens
uaguguguaaaauuaauguaa

SEQ ID NO: 1832731 - RNA, 13 nt, Homo sapiens
cguagaugcugcc

SEQ ID NO: 1832732 - RNA, 19 nt, Homo sapiens
uguugcuaauuugccacag

SEQ ID NO: 1832733 - RNA, 23 nt, Homo sapiens
cagcggccacacuguacucugca

SEQ ID NO: 1832734 - RNA, 18 nt, Homo sapiens
agugcaacaucucugaau

SEQ ID NO: 1832735 - RNA, 20 nt, Homo sapiens
uaugcuacaguacuauguaa

SEQ ID NO: 1832736 - RNA, 11 nt, Homo sapiens
cgaguuacaga

SEQ ID NO: 1832737 - RNA, 22 nt, Homo sapiens
gaaacuuccuuugagaauugug

SEQ ID NO: 1832738 - RNA, 13 nt, Homo sapiens
uccccccaguggg

SEQ ID NO: 1832739 - RNA, 16 nt, Homo sapiens
agugcccucucugaac

SEQ ID NO: 1832740 - RNA, 22 nt, Homo sapiens
ucaugaagaaaacugauucucu

SEQ ID NO: 1832741 - RNA, 19 nt, Homo sapiens
uugaccagugaaacuauga

SEQ ID NO: 1832742 - RNA, 21 nt, Homo sapiens
ggaaugugccucggccuccaa

SEQ ID NO: 1832743 - RNA, 22 nt, Homo sapiens
cagacaaggcaggccugaggca

SEQ ID NO: 1832744 - RNA, 16 nt, Homo sapiens
cauguuagucaaggac

SEQ ID NO: 1832745 - RNA, 23 nt, Homo sapiens
gaauguuccuuucgaaagcaaug

SEQ ID NO: 1832746 - RNA, 17 nt, Homo sapiens
auaaaagcacaaagaca

SEQ ID NO: 1832747 - RNA, 19 nt, Homo sapiens
gacuacacaauacaguauu

SEQ ID NO: 1832748 - RNA, 13 nt, Homo sapiens
cagaaaacuagaa

SEQ ID NO: 1832749 - RNA, 14 nt, Homo sapiens
uggcccaaagcagu

SEQ ID NO: 1832750 - RNA, 17 nt, Homo sapiens
cacguuaugguguuucu

SEQ ID NO: 1832751 - RNA, 22 nt, Homo sapiens
augggaucuuucugacacacuu

SEQ ID NO: 1832752 - RNA, 20 nt, Homo sapiens
cacugcuuuaaacugcauuu

SEQ ID NO: 1832753 - RNA, 18 nt, Homo sapiens
ggggauucuguguuuuca

SEQ ID NO: 1832754 - RNA, 17 nt, Homo sapiens
cauuuuugugcuuuuau

SEQ ID NO: 1832755 - RNA, 15 nt, Homo sapiens
aguuuaagucucuga

SEQ ID NO: 1832756 - RNA, 17 nt, Homo sapiens
aaacccauggcucuauu

SEQ ID NO: 1832757 - RNA, 21 nt, Homo sapiens
gugccuucucuauggccuugc

SEQ ID NO: 1832758 - RNA, 22 nt, Homo sapiens
acgaguggccaguucauugugg

SEQ ID NO: 1832759 - RNA, 16 nt, Homo sapiens
uccauucacaccagcu

SEQ ID NO: 1832760 - RNA, 18 nt, Homo sapiens
caucuuuucuagagacac

SEQ ID NO: 1832761 - RNA, 17 nt, Homo sapiens
ugggcggaaguacuucc

SEQ ID NO: 1832762 - RNA, 19 nt, Homo sapiens
uuaaaacucaucacauaaa

SEQ ID NO: 1832763 - RNA, 16 nt, Homo sapiens
gucuccugaggguccu

SEQ ID NO: 1832764 - RNA, 13 nt, Homo sapiens
agacauugucagc

SEQ ID NO: 1832765 - RNA, 14 nt, Homo sapiens
caguagacugugau

SEQ ID NO: 1832766 - RNA, 22 nt, Homo sapiens
ucugccuagaguguagccuaaa

SEQ ID NO: 1832767 - RNA, 18 nt, Homo sapiens
uaaacaagggucaauuca

SEQ ID NO: 1832768 - RNA, 20 nt, Homo sapiens
gcccagucuggcaugcagcu

SEQ ID NO: 1832769 - RNA, 14 nt, Homo sapiens
cagacaagcacuau

SEQ ID NO: 1832770 - RNA, 21 nt, Homo sapiens
gacucauuuuaaaaaauggaa

SEQ ID NO: 1832771 - RNA, 18 nt, Homo sapiens
cagggcaaauguuuacau

SEQ ID NO: 1832772 - RNA, 12 nt, Homo sapiens
uaagagauguga

SEQ ID NO: 1832773 - RNA, 19 nt, Homo sapiens
uagauuuacagaacaaagu

SEQ ID NO: 1832774 - RNA, 22 nt, Homo sapiens
gaacguuuucuaauugcuuauu

SEQ ID NO: 1832775 - RNA, 18 nt, Homo sapiens
ccuccagaagcugcuccu

SEQ ID NO: 1832776 - RNA, 16 nt, Homo sapiens
cuugguuccuucugcc

SEQ ID NO: 1832777 - RNA, 20 nt, Homo sapiens
aggcucucccucucucucau

SEQ ID NO: 1832778 - RNA, 16 nt, Homo sapiens
gcauuacuugcuuuca

SEQ ID NO: 1832779 - RNA, 18 nt, Homo sapiens
uauuucuguauuuggcua

SEQ ID NO: 1832780 - RNA, 18 nt, Homo sapiens
cuugaacuccuggccuca

SEQ ID NO: 1832781 - RNA, 20 nt, Homo sapiens
aagauuuuuaauuacaauaa

SEQ ID NO: 1832782 - RNA, 18 nt, Homo sapiens
cagucuaauuacauuuca

SEQ ID NO: 1832783 - RNA, 21 nt, Homo sapiens
gaugguuacugaggaccaaag

SEQ ID NO: 1832784 - RNA, 18 nt, Homo sapiens
auaaaggcaguuuucuaa

SEQ ID NO: 1832785 - RNA, 13 nt, Homo sapiens
cgcgagacugaga

SEQ ID NO: 1832786 - RNA, 13 nt, Homo sapiens
aaagacaccauuu

SEQ ID NO: 1832787 - RNA, 16 nt, Homo sapiens
cugcaaugaaagucaa

SEQ ID NO: 1832788 - RNA, 11 nt, Homo sapiens
cauucucucau

SEQ ID NO: 1832789 - RNA, 11 nt, Homo sapiens
gacucucugac

SEQ ID NO: 1832790 - RNA, 17 nt, Homo sapiens
gcaguguucaaggccau

SEQ ID NO: 1832791 - RNA, 15 nt, Homo sapiens
ugcuccucacuggag

SEQ ID NO: 1832792 - RNA, 17 nt, Homo sapiens
caaauccucaccaucca

SEQ ID NO: 1832793 - RNA, 22 nt, Homo sapiens
acucugugugagcguguccaca

SEQ ID NO: 1832794 - RNA, 22 nt, Homo sapiens
cucuuguauagcugaaauucca

SEQ ID NO: 1832795 - RNA, 16 nt, Homo sapiens
accuaagcccugcccc

SEQ ID NO: 1832796 - RNA, 10 nt, Homo sapiens
ucauguugcc

SEQ ID NO: 1832797 - RNA, 17 nt, Homo sapiens
uaucuauaaacacuguu

SEQ ID NO: 1832798 - RNA, 15 nt, Homo sapiens
ugcaacugaaugacu

SEQ ID NO: 1832799 - RNA, 23 nt, Homo sapiens
ccccaccugcagggcugcccuga

SEQ ID NO: 1832800 - RNA, 22 nt, Homo sapiens
acucagccauuucuaagcagau

SEQ ID NO: 1832801 - RNA, 13 nt, Homo sapiens
gcagucacagcua

SEQ ID NO: 1832802 - RNA, 19 nt, Homo sapiens
cccucuguagccacuagua

SEQ ID NO: 1832803 - RNA, 13 nt, Homo sapiens
aguuuugaugaaa

SEQ ID NO: 1832804 - RNA, 12 nt, Homo sapiens
cuccucuacucu

SEQ ID NO: 1832805 - RNA, 23 nt, Homo sapiens
uacucugcccucuagagccuuca

SEQ ID NO: 1832806 - RNA, 15 nt, Homo sapiens
ucaacacuaacauga

SEQ ID NO: 1832807 - RNA, 15 nt, Homo sapiens
cuuuacauauauaug

SEQ ID NO: 1832808 - RNA, 16 nt, Homo sapiens
uuuauguggugguuuc

SEQ ID NO: 1832809 - RNA, 11 nt, Homo sapiens
uggggccacau

SEQ ID NO: 1832810 - RNA, 15 nt, Homo sapiens
caaacauugaugcug

SEQ ID NO: 1832811 - RNA, 21 nt, Homo sapiens
ugcuggggucucagguccagc

SEQ ID NO: 1832812 - RNA, 15 nt, Homo sapiens
ucaaggcccucagca

SEQ ID NO: 1832813 - RNA, 21 nt, Homo sapiens
caagaucacgccauugcacuc

SEQ ID NO: 1832814 - RNA, 16 nt, Homo sapiens
gaaaaguccacaguga

SEQ ID NO: 1832815 - RNA, 16 nt, Homo sapiens
caucuugguccuguca

SEQ ID NO: 1832816 - RNA, 14 nt, Homo sapiens
uaacaggcauuugu

SEQ ID NO: 1832817 - RNA, 18 nt, Homo sapiens
agccuaccucugucugag

SEQ ID NO: 1832818 - RNA, 18 nt, Homo sapiens
aggccaggaaucugccau

SEQ ID NO: 1832819 - RNA, 18 nt, Homo sapiens
gccuggaccgcuucccag

SEQ ID NO: 1832820 - RNA, 14 nt, Homo sapiens
caaaaucuuaauca

SEQ ID NO: 1832821 - RNA, 17 nt, Homo sapiens
cuacugcucaagauaug

SEQ ID NO: 1832822 - RNA, 16 nt, Homo sapiens
aaagugacaugcauuc

SEQ ID NO: 1832823 - RNA, 16 nt, Homo sapiens
aaagugauaugcauuu

SEQ ID NO: 1832824 - RNA, 16 nt, Homo sapiens
ugcucugaugcagugc

SEQ ID NO: 1832825 - RNA, 12 nt, Homo sapiens
gcauugucaaua

SEQ ID NO: 1832826 - RNA, 13 nt, Homo sapiens
uuuugugccauua

SEQ ID NO: 1832827 - RNA, 20 nt, Homo sapiens
agcuccuauuucaaggagaa

SEQ ID NO: 1832828 - RNA, 18 nt, Homo sapiens
acauaguucagccacaaa

SEQ ID NO: 1832829 - RNA, 22 nt, Homo sapiens
gaauugauauugaaugauguga

SEQ ID NO: 1832830 - RNA, 15 nt, Homo sapiens
ccaggcagcuggcua

SEQ ID NO: 1832831 - RNA, 12 nt, Homo sapiens
ucccaaccugau

SEQ ID NO: 1832832 - RNA, 22 nt, Homo sapiens
auggccucuuuguccauuauuc

SEQ ID NO: 1832833 - RNA, 19 nt, Homo sapiens
acauauaccuauaaugugu

SEQ ID NO: 1832834 - RNA, 20 nt, Homo sapiens
gucucccgccccccacacuu

SEQ ID NO: 1832835 - RNA, 19 nt, Homo sapiens
uggacguggguugcacugg

SEQ ID NO: 1832836 - RNA, 15 nt, Homo sapiens
cuauaccugcuucag

SEQ ID NO: 1832837 - RNA, 18 nt, Homo sapiens
uuccaugaauucuugauu

SEQ ID NO: 1832838 - RNA, 16 nt, Homo sapiens
aucgggcaaugggagg

SEQ ID NO: 1832839 - RNA, 22 nt, Homo sapiens
uucuuguuugucagcaucugac

SEQ ID NO: 1832840 - RNA, 22 nt, Homo sapiens
auagaacuaaaguaucugagau

SEQ ID NO: 1832841 - RNA, 10 nt, Homo sapiens
aguagcucuu

SEQ ID NO: 1832842 - RNA, 23 nt, Homo sapiens
ccugggagagaaguuugaagcac

SEQ ID NO: 1832843 - RNA, 20 nt, Homo sapiens
acucucacuaugcugcuaug

SEQ ID NO: 1832844 - RNA, 23 nt, Homo sapiens
ucaacuguuucagaaaacauaau

SEQ ID NO: 1832845 - RNA, 23 nt, Homo sapiens
ugcugacaggugaugcucuggcu

SEQ ID NO: 1832846 - RNA, 15 nt, Homo sapiens
cugggccaacuccag

SEQ ID NO: 1832847 - RNA, 16 nt, Homo sapiens
auuucuagagagucuc

SEQ ID NO: 1832848 - RNA, 16 nt, Homo sapiens
ggcgagucugcuuucu

SEQ ID NO: 1832849 - RNA, 20 nt, Homo sapiens
acguaugcaagucugugagu

SEQ ID NO: 1832850 - RNA, 21 nt, Homo sapiens
agccucuccaaggguuuucac

SEQ ID NO: 1832851 - RNA, 15 nt, Homo sapiens
guaugacucuccucu

SEQ ID NO: 1832852 - RNA, 13 nt, Homo sapiens
gaacucugagcag

SEQ ID NO: 1832853 - RNA, 15 nt, Homo sapiens
auauguacagaagau

SEQ ID NO: 1832854 - RNA, 16 nt, Homo sapiens
ggaguugacugcucau

SEQ ID NO: 1832855 - RNA, 18 nt, Homo sapiens
ugugauacgaugcuucaa

SEQ ID NO: 1832856 - RNA, 16 nt, Homo sapiens
acauuuuuuguuugcu

SEQ ID NO: 1832857 - RNA, 15 nt, Homo sapiens
acagaccuccagauu

SEQ ID NO: 1832858 - RNA, 13 nt, Homo sapiens
cuaaucuucaggg

SEQ ID NO: 1832859 - RNA, 18 nt, Homo sapiens
ggauucuguucugcaacu

SEQ ID NO: 1832860 - RNA, 16 nt, Homo sapiens
cagggccaggccucug

SEQ ID NO: 1832861 - RNA, 22 nt, Homo sapiens
auucaccaagagccaauaucua

SEQ ID NO: 1832862 - RNA, 17 nt, Homo sapiens
ggugaagaacaucccaa

SEQ ID NO: 1832863 - RNA, 14 nt, Homo sapiens
aguucaauggcugc

SEQ ID NO: 1832864 - RNA, 22 nt, Homo sapiens
gagcugggccgguuaguguaug

SEQ ID NO: 1832865 - RNA, 18 nt, Homo sapiens
auccagaugugugcaaug

SEQ ID NO: 1832866 - RNA, 21 nt, Homo sapiens
aauauuuuguaaugcugcaca

SEQ ID NO: 1832867 - RNA, 15 nt, Homo sapiens
ccugucaugugccuu

SEQ ID NO: 1832868 - RNA, 13 nt, Homo sapiens
gaugcaagcaaga

SEQ ID NO: 1832869 - RNA, 19 nt, Homo sapiens
cugggcacccaguccuuga

SEQ ID NO: 1832870 - RNA, 18 nt, Homo sapiens
uaaaauuagaugaacuca

SEQ ID NO: 1832871 - RNA, 17 nt, Homo sapiens
uaaagggaucugcuuaa

SEQ ID NO: 1832872 - RNA, 12 nt, Homo sapiens
aaacaccaaaga

SEQ ID NO: 1832873 - RNA, 17 nt, Homo sapiens
auuucaaugaguuauug

SEQ ID NO: 1832874 - RNA, 12 nt, Homo sapiens
acuggaccucag

SEQ ID NO: 1832875 - RNA, 18 nt, Homo sapiens
uaggaaacucacacuccc

SEQ ID NO: 1832876 - RNA, 23 nt, Homo sapiens
ugaggaccaggugucucugagaa

SEQ ID NO: 1832877 - RNA, 17 nt, Homo sapiens
gucucccagcucagggc

SEQ ID NO: 1832878 - RNA, 18 nt, Homo sapiens
ccccuaccucuaguaaau

SEQ ID NO: 1832879 - RNA, 18 nt, Homo sapiens
gagcuauucuugcugaug

SEQ ID NO: 1832880 - RNA, 17 nt, Homo sapiens
gagcaacuaacuaacca

SEQ ID NO: 1832881 - RNA, 14 nt, Homo sapiens
guucccuuggcaaa

SEQ ID NO: 1832882 - RNA, 22 nt, Homo sapiens
ggcagccacacuucucaggaca

SEQ ID NO: 1832883 - RNA, 18 nt, Homo sapiens
ggccuaaucucauaccuc

SEQ ID NO: 1832884 - RNA, 15 nt, Homo sapiens
ugauuugaaaaguau

SEQ ID NO: 1832885 - RNA, 20 nt, Homo sapiens
agggagacagccagguggca

SEQ ID NO: 1832886 - RNA, 15 nt, Homo sapiens
uaagcaaaauucaua

SEQ ID NO: 1832887 - RNA, 12 nt, Homo sapiens
aauauugcaguu

SEQ ID NO: 1832888 - RNA, 18 nt, Homo sapiens
ucacagcuaacaauugug

SEQ ID NO: 1832889 - RNA, 23 nt, Homo sapiens
augaauauguguggcagugaaga

SEQ ID NO: 1832890 - RNA, 15 nt, Homo sapiens
auaaagugcuuuaaa

SEQ ID NO: 1832891 - RNA, 19 nt, Homo sapiens
aucaaacacacuuccagcu

SEQ ID NO: 1832892 - RNA, 22 nt, Homo sapiens
agcugccccuccuggagcagaa

SEQ ID NO: 1832893 - RNA, 17 nt, Homo sapiens
uguacuuuguuaaaaac

SEQ ID NO: 1832894 - RNA, 19 nt, Homo sapiens
guucuauuugcuaucugaa

SEQ ID NO: 1832895 - RNA, 19 nt, Homo sapiens
aauauauauguugauuucu

SEQ ID NO: 1832896 - RNA, 22 nt, Homo sapiens
ucaaggauagaaguauaccuga

SEQ ID NO: 1832897 - RNA, 20 nt, Homo sapiens
acaguugugauaauagcauu

SEQ ID NO: 1832898 - RNA, 13 nt, Homo sapiens
ugacacauaugca

SEQ ID NO: 1832899 - RNA, 21 nt, Homo sapiens
gguuucacaugguuacauauc

SEQ ID NO: 1832900 - RNA, 22 nt, Homo sapiens
ugcaaaaggacucucaggacca

SEQ ID NO: 1832901 - RNA, 20 nt, Homo sapiens
acaccaaccagacagcacag

SEQ ID NO: 1832902 - RNA, 13 nt, Homo sapiens
uuccugcguagaa

SEQ ID NO: 1832903 - RNA, 17 nt, Homo sapiens
gagcuguguucuugcca

SEQ ID NO: 1832904 - RNA, 17 nt, Homo sapiens
ccaucaagacaauggga

SEQ ID NO: 1832905 - RNA, 20 nt, Homo sapiens
caaucucuuuucuacauaca

SEQ ID NO: 1832906 - RNA, 17 nt, Homo sapiens
aaaguacccucuuuuac

SEQ ID NO: 1832907 - RNA, 14 nt, Homo sapiens
cuauuaccuuguga

SEQ ID NO: 1832908 - RNA, 18 nt, Homo sapiens
uguuaucaaccaacugca

SEQ ID NO: 1832909 - RNA, 16 nt, Homo sapiens
accccuccucccucag

SEQ ID NO: 1832910 - RNA, 17 nt, Homo sapiens
aggcaggugacagugag

SEQ ID NO: 1832911 - RNA, 15 nt, Homo sapiens
auuucauuucagcca

SEQ ID NO: 1832912 - RNA, 19 nt, Homo sapiens
accugaaaacacugugcac

SEQ ID NO: 1832913 - RNA, 21 nt, Homo sapiens
guauccccagccccaaagaca

SEQ ID NO: 1832914 - RNA, 21 nt, Homo sapiens
agcuccaguguccugagcuca

SEQ ID NO: 1832915 - RNA, 14 nt, Homo sapiens
gaaugcuuugccau

SEQ ID NO: 1832916 - RNA, 23 nt, Homo sapiens
ccagcaaaauggaagcaaagaca

SEQ ID NO: 1832917 - RNA, 18 nt, Homo sapiens
agggauaucuacuguggu

SEQ ID NO: 1832918 - RNA, 21 nt, Homo sapiens
auucauuuuaacaucugagaa

SEQ ID NO: 1832919 - RNA, 16 nt, Homo sapiens
uaacuuuuuuggauaa

SEQ ID NO: 1832920 - RNA, 13 nt, Homo sapiens
aaauaaacaugag

SEQ ID NO: 1832921 - RNA, 20 nt, Homo sapiens
agucaaauuuggauuuucca

SEQ ID NO: 1832922 - RNA, 16 nt, Homo sapiens
aaugucuuuaaugcaa

SEQ ID NO: 1832923 - RNA, 19 nt, Homo sapiens
aacaucuuaagauccacaa

SEQ ID NO: 1832924 - RNA, 19 nt, Homo sapiens
agcccaagauaucagccca

SEQ ID NO: 1832925 - RNA, 20 nt, Homo sapiens
accuacacccuggcccagcu

SEQ ID NO: 1832926 - RNA, 16 nt, Homo sapiens
cauaacaugcuuuaga

SEQ ID NO: 1832927 - RNA, 15 nt, Homo sapiens
ugugcccucugggcu

SEQ ID NO: 1832928 - RNA, 18 nt, Homo sapiens
gauuucucauugaucaca

SEQ ID NO: 1832929 - RNA, 17 nt, Homo sapiens
uuugauccaggugccaa

SEQ ID NO: 1832930 - RNA, 14 nt, Homo sapiens
uuccuucucuuuaa

SEQ ID NO: 1832931 - RNA, 16 nt, Homo sapiens
acuaacaagauuugua

SEQ ID NO: 1832932 - RNA, 19 nt, Homo sapiens
ucccuucucuuaauuuaau

SEQ ID NO: 1832933 - RNA, 17 nt, Homo sapiens
uaagcaacuugcuucua

SEQ ID NO: 1832934 - RNA, 14 nt, Homo sapiens
aagaguucuaacca

SEQ ID NO: 1832935 - RNA, 18 nt, Homo sapiens
ugcuggaccuaaaauacu

SEQ ID NO: 1832936 - RNA, 20 nt, Homo sapiens
gcaucuaucuggugauuucu

SEQ ID NO: 1832937 - RNA, 18 nt, Homo sapiens
uaaauccucucuaucaca

SEQ ID NO: 1832938 - RNA, 15 nt, Homo sapiens
aaagugaaauuagua

SEQ ID NO: 1832939 - RNA, 13 nt, Homo sapiens
agucccggagccc

SEQ ID NO: 1832940 - RNA, 20 nt, Homo sapiens
ucuacuacaugugacuggca

SEQ ID NO: 1832941 - RNA, 22 nt, Homo sapiens
uagaugauuaaauaagauucua

SEQ ID NO: 1832942 - RNA, 14 nt, Homo sapiens
ugggcauugagauc

SEQ ID NO: 1832943 - RNA, 19 nt, Homo sapiens
uuggaaacaauaugcaaug

SEQ ID NO: 1832944 - RNA, 17 nt, Homo sapiens
ugcacaaagcccuucca

SEQ ID NO: 1832945 - RNA, 17 nt, Homo sapiens
cugagaccaaaguagau

SEQ ID NO: 1832946 - RNA, 23 nt, Homo sapiens
guguuucuguccuguaacuguua

SEQ ID NO: 1832947 - RNA, 17 nt, Homo sapiens
ugcaaauagcaaaacua

SEQ ID NO: 1832948 - RNA, 19 nt, Homo sapiens
cagggccacagagcuacau

SEQ ID NO: 1832949 - RNA, 23 nt, Homo sapiens
ggcagcagcucccgcagggcuga

SEQ ID NO: 1832950 - RNA, 18 nt, Homo sapiens
aaugacuucuaguguaga

SEQ ID NO: 1832951 - RNA, 11 nt, Homo sapiens
ccugugccugg

SEQ ID NO: 1832952 - RNA, 16 nt, Homo sapiens
uaucauuuuguggaua

SEQ ID NO: 1832953 - RNA, 14 nt, Homo sapiens
ccgucccucaguga

SEQ ID NO: 1832954 - RNA, 19 nt, Homo sapiens
cucugggagccugacagug

SEQ ID NO: 1832955 - RNA, 19 nt, Homo sapiens
cuguggccuuaugagcuca

SEQ ID NO: 1832956 - RNA, 18 nt, Homo sapiens
uuguccaucugucugugu

SEQ ID NO: 1832957 - RNA, 19 nt, Homo sapiens
cccagaaccacacuguuga

SEQ ID NO: 1832958 - RNA, 18 nt, Homo sapiens
agcugaugccugaaugua

SEQ ID NO: 1832959 - RNA, 18 nt, Homo sapiens
uuuuaagcagacucagcu

SEQ ID NO: 1832960 - RNA, 14 nt, Homo sapiens
aacaacuacuguga

SEQ ID NO: 1832961 - RNA, 18 nt, Homo sapiens
agcuuuugcaacaugguc

SEQ ID NO: 1832962 - RNA, 15 nt, Homo sapiens
uaggcaggacaugcu

SEQ ID NO: 1832963 - RNA, 19 nt, Homo sapiens
acagagaaagcagaaaauc

SEQ ID NO: 1832964 - RNA, 16 nt, Homo sapiens
uuggucccgugcagcu

SEQ ID NO: 1832965 - RNA, 17 nt, Homo sapiens
ugggguguggagacuug

SEQ ID NO: 1832966 - RNA, 17 nt, Homo sapiens
cacugccccacaugcau

SEQ ID NO: 1832967 - RNA, 15 nt, Homo sapiens
uagcugcacuguuua

SEQ ID NO: 1832968 - RNA, 22 nt, Homo sapiens
ucagagaagaccacaccaagga

SEQ ID NO: 1832969 - RNA, 14 nt, Homo sapiens
cuucucucuguucc

SEQ ID NO: 1832970 - RNA, 15 nt, Homo sapiens
ucaagguaacuguac

SEQ ID NO: 1832971 - RNA, 17 nt, Homo sapiens
gcaaugacaaugaccaa

SEQ ID NO: 1832972 - RNA, 15 nt, Homo sapiens
caccugcacacucca

SEQ ID NO: 1832973 - RNA, 23 nt, Homo sapiens
gaaacugcccuggcuccagugaa

SEQ ID NO: 1832974 - RNA, 16 nt, Homo sapiens
caaaccccugaccuca

SEQ ID NO: 1832975 - RNA, 12 nt, Homo sapiens
cucacaucuugg

SEQ ID NO: 1832976 - RNA, 17 nt, Homo sapiens
caaagucacauccacaa

SEQ ID NO: 1832977 - RNA, 16 nt, Homo sapiens
cauugucugacuguga

SEQ ID NO: 1832978 - RNA, 23 nt, Homo sapiens
aaagagaaauauauuugucacuu

SEQ ID NO: 1832979 - RNA, 23 nt, Homo sapiens
accagugccucucccugcugcuc

SEQ ID NO: 1832980 - RNA, 22 nt, Homo sapiens
acccaccuggcuucauacagaa

SEQ ID NO: 1832981 - RNA, 19 nt, Homo sapiens
ucuacuucucucucucuga

SEQ ID NO: 1832982 - RNA, 19 nt, Homo sapiens
gucucucuggcccacucau

SEQ ID NO: 1832983 - RNA, 14 nt, Homo sapiens
cacacagacucuag

SEQ ID NO: 1832984 - RNA, 23 nt, Homo sapiens
auugcaggccaaaccguacugua

SEQ ID NO: 1832985 - RNA, 18 nt, Homo sapiens
ucuuaauguacacauugc

SEQ ID NO: 1832986 - RNA, 19 nt, Homo sapiens
uuugcagcagugagucucu

SEQ ID NO: 1832987 - RNA, 23 nt, Homo sapiens
cuucuguccucuucugugaguca

SEQ ID NO: 1832988 - RNA, 12 nt, Homo sapiens
cagccagggccu

SEQ ID NO: 1832989 - RNA, 14 nt, Homo sapiens
gucauuguauucag

SEQ ID NO: 1832990 - RNA, 22 nt, Homo sapiens
guuucugaaccauuacuguaau

SEQ ID NO: 1832991 - RNA, 17 nt, Homo sapiens
uuaauuuuuugguacaa

SEQ ID NO: 1832992 - RNA, 16 nt, Homo sapiens
cuugagggacaaugcc

SEQ ID NO: 1832993 - RNA, 14 nt, Homo sapiens
guaaguacuuccac

SEQ ID NO: 1832994 - RNA, 18 nt, Homo sapiens
guugaaccauuauacuuu

SEQ ID NO: 1832995 - RNA, 23 nt, Homo sapiens
uuucccgcccagccucacuuccu

SEQ ID NO: 1832996 - RNA, 16 nt, Homo sapiens
cugaacucuuaggcac

SEQ ID NO: 1832997 - RNA, 16 nt, Homo sapiens
caggcuguaugggaag

SEQ ID NO: 1832998 - RNA, 15 nt, Homo sapiens
guagccuucuucccu

SEQ ID NO: 1832999 - RNA, 14 nt, Homo sapiens
aagagccaguuuau

SEQ ID NO: 1833000 - RNA, 15 nt, Homo sapiens
gcauggagcauggga

SEQ ID NO: 1833001 - RNA, 12 nt, Homo sapiens
cagucacagcca

SEQ ID NO: 1833002 - RNA, 17 nt, Homo sapiens
cuucugugugcugcuaa

SEQ ID NO: 1833003 - RNA, 14 nt, Homo sapiens
guguauauggacaa

SEQ ID NO: 1833004 - RNA, 13 nt, Homo sapiens
cuucucuuuggaa

SEQ ID NO: 1833005 - RNA, 16 nt, Homo sapiens
cuaaacucauuuauaa

SEQ ID NO: 1833006 - RNA, 16 nt, Homo sapiens
auuaagcccucuucca

SEQ ID NO: 1833007 - RNA, 12 nt, Homo sapiens
auaauaaaucac

SEQ ID NO: 1833008 - RNA, 19 nt, Homo sapiens
aagagggacaggcugaaga

SEQ ID NO: 1833009 - RNA, 18 nt, Homo sapiens
ccuaaaaggaaaucucac

SEQ ID NO: 1833010 - RNA, 15 nt, Homo sapiens
ucucuccagucuucc

SEQ ID NO: 1833011 - RNA, 15 nt, Homo sapiens
uugacaacugugacu

SEQ ID NO: 1833012 - RNA, 17 nt, Homo sapiens
aacaggcugcuuagauu

SEQ ID NO: 1833013 - RNA, 12 nt, Homo sapiens
ccuaaugaaguu

SEQ ID NO: 1833014 - RNA, 18 nt, Homo sapiens
cuugguuguauaaagcaa

SEQ ID NO: 1833015 - RNA, 22 nt, Homo sapiens
guaagaaauaacacugugaaug

SEQ ID NO: 1833016 - RNA, 14 nt, Homo sapiens
aucauguguguuaa

SEQ ID NO: 1833017 - RNA, 16 nt, Homo sapiens
gaaaaaaagcuuuuau

SEQ ID NO: 1833018 - RNA, 19 nt, Homo sapiens
agcuaggaauuguguuuau

SEQ ID NO: 1833019 - RNA, 20 nt, Homo sapiens
uucaacaaugacuaaugagu

SEQ ID NO: 1833020 - RNA, 12 nt, Homo sapiens
cuuuugcacaua

SEQ ID NO: 1833021 - RNA, 12 nt, Homo sapiens
aaaaugcaauau

SEQ ID NO: 1833022 - RNA, 12 nt, Homo sapiens
auauugcaaaaa

SEQ ID NO: 1833023 - RNA, 12 nt, Homo sapiens
auuuugcaaaua

SEQ ID NO: 1833024 - RNA, 21 nt, Homo sapiens
gccugaagucccagcauugau

SEQ ID NO: 1833025 - RNA, 13 nt, Homo sapiens
agagcuuuaccua

SEQ ID NO: 1833026 - RNA, 15 nt, Homo sapiens
ccaccuccuucucug

SEQ ID NO: 1833027 - RNA, 22 nt, Homo sapiens
uggcuggccacugcacagagcu

SEQ ID NO: 1833028 - RNA, 22 nt, Homo sapiens
cuuguauuaaacucuucacaaa

SEQ ID NO: 1833029 - RNA, 23 nt, Homo sapiens
acagccucuuugcccaaauguga

SEQ ID NO: 1833030 - RNA, 18 nt, Homo sapiens
cagucuaguguaauggau

SEQ ID NO: 1833031 - RNA, 22 nt, Homo sapiens
cgacuccccccuggccacagac

SEQ ID NO: 1833032 - RNA, 12 nt, Homo sapiens
aaccaccagcgu

SEQ ID NO: 1833033 - RNA, 16 nt, Homo sapiens
gcccucuguccugacu

SEQ ID NO: 1833034 - RNA, 21 nt, Homo sapiens
cagaaaaugcaccucauucca

SEQ ID NO: 1833035 - RNA, 20 nt, Homo sapiens
gucuguguagaguguuauac

SEQ ID NO: 1833036 - RNA, 11 nt, Homo sapiens
cuguaugcauc

SEQ ID NO: 1833037 - RNA, 18 nt, Homo sapiens
auuaccuggucauuucaa

SEQ ID NO: 1833038 - RNA, 13 nt, Homo sapiens
agcugaugugccc

SEQ ID NO: 1833039 - RNA, 21 nt, Homo sapiens
guugugaaaaucugucaugag

SEQ ID NO: 1833040 - RNA, 17 nt, Homo sapiens
aaaaguaaaacagauuu

SEQ ID NO: 1833041 - RNA, 13 nt, Homo sapiens
ccaauaaagccuu

SEQ ID NO: 1833042 - RNA, 13 nt, Homo sapiens
cuugcaagccaua

SEQ ID NO: 1833043 - RNA, 15 nt, Homo sapiens
auauguucccuccag

SEQ ID NO: 1833044 - RNA, 18 nt, Homo sapiens
uuugcuguggaacuacau

SEQ ID NO: 1833045 - RNA, 19 nt, Homo sapiens
cagauagucccagcagccu

SEQ ID NO: 1833046 - RNA, 15 nt, Homo sapiens
cacugcgaccacaag

SEQ ID NO: 1833047 - RNA, 13 nt, Homo sapiens
uaaauaaaaagcg

SEQ ID NO: 1833048 - RNA, 17 nt, Homo sapiens
gcagagugaaagaucaa

SEQ ID NO: 1833049 - RNA, 11 nt, Homo sapiens
aguacuugaaa

SEQ ID NO: 1833050 - RNA, 19 nt, Homo sapiens
acugauugcauaugcaucc

SEQ ID NO: 1833051 - RNA, 17 nt, Homo sapiens
ugaccucgugaucugcc

SEQ ID NO: 1833052 - RNA, 16 nt, Homo sapiens
gagaggcaggcauaga

SEQ ID NO: 1833053 - RNA, 18 nt, Homo sapiens
gagcuuagggucucaggg

SEQ ID NO: 1833054 - RNA, 16 nt, Homo sapiens
guuaugugacuaucuu

SEQ ID NO: 1833055 - RNA, 13 nt, Homo sapiens
uugcauaugucau

SEQ ID NO: 1833056 - RNA, 13 nt, Homo sapiens
uaagaaauacuca

SEQ ID NO: 1833057 - RNA, 13 nt, Homo sapiens
gugcuaaaccaca

SEQ ID NO: 1833058 - RNA, 14 nt, Homo sapiens
cugucacacacugg

SEQ ID NO: 1833059 - RNA, 16 nt, Homo sapiens
ucuucagcauuuucca

SEQ ID NO: 1833060 - RNA, 12 nt, Homo sapiens
gaugaagaccaa

SEQ ID NO: 1833061 - RNA, 17 nt, Homo sapiens
gucucacagauugcugc

SEQ ID NO: 1833062 - RNA, 17 nt, Homo sapiens
acgagauacagaauuuu

SEQ ID NO: 1833063 - RNA, 22 nt, Homo sapiens
accaacugaaguggcuaaagag

SEQ ID NO: 1833064 - RNA, 22 nt, Homo sapiens
cccuuugggcccagggacacca

SEQ ID NO: 1833065 - RNA, 11 nt, Homo sapiens
aaaccuaccuu

SEQ ID NO: 1833066 - RNA, 19 nt, Homo sapiens
gaagacacuugcugaguga

SEQ ID NO: 1833067 - RNA, 13 nt, Homo sapiens
aagaagguuucug

SEQ ID NO: 1833068 - RNA, 19 nt, Homo sapiens
cacugaagggcuagaguuu

SEQ ID NO: 1833069 - RNA, 19 nt, Homo sapiens
agggcgaguucagcaaaga

SEQ ID NO: 1833070 - RNA, 20 nt, Homo sapiens
ucacguccuuuuuuccuucc

SEQ ID NO: 1833071 - RNA, 14 nt, Homo sapiens
agcagaggggccag

SEQ ID NO: 1833072 - RNA, 18 nt, Homo sapiens
uuacaauuuacaaagugu

SEQ ID NO: 1833073 - RNA, 13 nt, Homo sapiens
aaaagguaugaaa

SEQ ID NO: 1833074 - RNA, 18 nt, Homo sapiens
cuaagggccacaucccac

SEQ ID NO: 1833075 - RNA, 14 nt, Homo sapiens
guauuaaaagcuaa

SEQ ID NO: 1833076 - RNA, 16 nt, Homo sapiens
ccccuuuccaaaaacu

SEQ ID NO: 1833077 - RNA, 21 nt, Homo sapiens
agcugagggagggagccaugg

SEQ ID NO: 1833078 - RNA, 12 nt, Homo sapiens
aaguaagccaug

SEQ ID NO: 1833079 - RNA, 13 nt, Homo sapiens
uaucagcaaaaaa

SEQ ID NO: 1833080 - RNA, 15 nt, Homo sapiens
cucaccacagccuuc

SEQ ID NO: 1833081 - RNA, 19 nt, Homo sapiens
cuccagucuggucggcaag

SEQ ID NO: 1833082 - RNA, 20 nt, Homo sapiens
agauuuuuuuaacgagaaaa

SEQ ID NO: 1833083 - RNA, 22 nt, Homo sapiens
cauucguccuuagaauacugua

SEQ ID NO: 1833084 - RNA, 13 nt, Homo sapiens
ugcugggaauuac

SEQ ID NO: 1833085 - RNA, 13 nt, Homo sapiens
cacauuagcuugu

SEQ ID NO: 1833086 - RNA, 15 nt, Homo sapiens
ucacuugcacugggg

SEQ ID NO: 1833087 - RNA, 18 nt, Homo sapiens
ccuguguguauagcugug

SEQ ID NO: 1833088 - RNA, 18 nt, Homo sapiens
caaaucccacagggccag

SEQ ID NO: 1833089 - RNA, 22 nt, Homo sapiens
ugcaggcucccaaacucaggcu

SEQ ID NO: 1833090 - RNA, 17 nt, Homo sapiens
ggaugagccaaaccagc

SEQ ID NO: 1833091 - RNA, 22 nt, Homo sapiens
gcugguauucucucuaugcaaa

SEQ ID NO: 1833092 - RNA, 22 nt, Homo sapiens
caguuacagagugaacacucua

SEQ ID NO: 1833093 - RNA, 20 nt, Homo sapiens
uguuuugcccuauauaccuc

SEQ ID NO: 1833094 - RNA, 12 nt, Homo sapiens
guacacaacaau

SEQ ID NO: 1833095 - RNA, 22 nt, Homo sapiens
cuucccuucucucucucucaaa

SEQ ID NO: 1833096 - RNA, 18 nt, Homo sapiens
uuguauaaauaagcacua

SEQ ID NO: 1833097 - RNA, 20 nt, Homo sapiens
caaggacuaaggccuccagc

SEQ ID NO: 1833098 - RNA, 14 nt, Homo sapiens
cuggacaacacuga

SEQ ID NO: 1833099 - RNA, 14 nt, Homo sapiens
aacugcaaauggaa

SEQ ID NO: 1833100 - RNA, 22 nt, Homo sapiens
ugcuuccacuaccaaaagacau

SEQ ID NO: 1833101 - RNA, 14 nt, Homo sapiens
aaauauauauuaaa

SEQ ID NO: 1833102 - RNA, 20 nt, Homo sapiens
auggugcaaauccuacugaa

SEQ ID NO: 1833103 - RNA, 19 nt, Homo sapiens
aacaaaugauuuacacuga

SEQ ID NO: 1833104 - RNA, 14 nt, Homo sapiens
cuugaccauucuca

SEQ ID NO: 1833105 - RNA, 16 nt, Homo sapiens
ucucacugccauggaa

SEQ ID NO: 1833106 - RNA, 21 nt, Homo sapiens
cugcauccauuugaacacauu

SEQ ID NO: 1833107 - RNA, 22 nt, Homo sapiens
ucccgcugcacacagacggccu

SEQ ID NO: 1833108 - RNA, 23 nt, Homo sapiens
cuccaggugugcacguggcaugu

SEQ ID NO: 1833109 - RNA, 13 nt, Homo sapiens
ugauacaugucag

SEQ ID NO: 1833110 - RNA, 16 nt, Homo sapiens
cccuggccgaguccaa

SEQ ID NO: 1833111 - RNA, 15 nt, Homo sapiens
guauaacagcacaau

SEQ ID NO: 1833112 - RNA, 16 nt, Homo sapiens
uuguuaacuaugagga

SEQ ID NO: 1833113 - RNA, 21 nt, Homo sapiens
uuaguucaguagcuuaucuca

SEQ ID NO: 1833114 - RNA, 22 nt, Homo sapiens
cccaguccgccaaacacuccac

SEQ ID NO: 1833115 - RNA, 13 nt, Homo sapiens
gauuauuaauauc

SEQ ID NO: 1833116 - RNA, 19 nt, Homo sapiens
aacuacauuaaaagcuuua

SEQ ID NO: 1833117 - RNA, 16 nt, Homo sapiens
guggggcagcacagag

SEQ ID NO: 1833118 - RNA, 22 nt, Homo sapiens
aggagggggucguggagagcua

SEQ ID NO: 1833119 - RNA, 23 nt, Homo sapiens
cugagugaauuacagacaaccua

SEQ ID NO: 1833120 - RNA, 20 nt, Homo sapiens
caaaugaugcaggugcaaau

SEQ ID NO: 1833121 - RNA, 19 nt, Homo sapiens
ccacuguggcacuggccac

SEQ ID NO: 1833122 - RNA, 15 nt, Homo sapiens
ucucccugcuucaua

SEQ ID NO: 1833123 - RNA, 15 nt, Homo sapiens
auucugaccuuguga

SEQ ID NO: 1833124 - RNA, 14 nt, Homo sapiens
aaaugagaacauga

SEQ ID NO: 1833125 - RNA, 17 nt, Homo sapiens
cagcaccugauucucac

SEQ ID NO: 1833126 - RNA, 22 nt, Homo sapiens
cuggguuuauagaugugagcca

SEQ ID NO: 1833127 - RNA, 18 nt, Homo sapiens
gccccagccuucuuugcu

SEQ ID NO: 1833128 - RNA, 20 nt, Homo sapiens
auuuaguaaaugcugaaaua

SEQ ID NO: 1833129 - RNA, 16 nt, Homo sapiens
caaugcacgaucucag

SEQ ID NO: 1833130 - RNA, 14 nt, Homo sapiens
agcaucauugaucu

SEQ ID NO: 1833131 - RNA, 14 nt, Homo sapiens
uaaguagauuugua

SEQ ID NO: 1833132 - RNA, 14 nt, Homo sapiens
aaccauuugcaaua

SEQ ID NO: 1833133 - RNA, 13 nt, Homo sapiens
uuucuaccaccgc

SEQ ID NO: 1833134 - RNA, 14 nt, Homo sapiens
cugagggcagugcc

SEQ ID NO: 1833135 - RNA, 19 nt, Homo sapiens
gcacaguguaauccagggg

SEQ ID NO: 1833136 - RNA, 16 nt, Homo sapiens
acauuucuucuaguga

SEQ ID NO: 1833137 - RNA, 20 nt, Homo sapiens
uuucacaaaaggcaucugaa

SEQ ID NO: 1833138 - RNA, 12 nt, Homo sapiens
cuaccuugucau

SEQ ID NO: 1833139 - RNA, 20 nt, Homo sapiens
gcugcggggcgggcacaccu

SEQ ID NO: 1833140 - RNA, 22 nt, Homo sapiens
ucaccuuuauauauguacuagc

SEQ ID NO: 1833141 - RNA, 21 nt, Homo sapiens
ugcuacaccucugauuacaau

SEQ ID NO: 1833142 - RNA, 22 nt, Homo sapiens
gaaagcguuuuguuaucuucua

SEQ ID NO: 1833143 - RNA, 17 nt, Homo sapiens
caagcacuagccuuccc

SEQ ID NO: 1833144 - RNA, 12 nt, Homo sapiens
ggccaguggcac

SEQ ID NO: 1833145 - RNA, 15 nt, Homo sapiens
cugaaagccauuugu

SEQ ID NO: 1833146 - RNA, 16 nt, Homo sapiens
gaggcaggaggaucau

SEQ ID NO: 1833147 - RNA, 22 nt, Homo sapiens
gcacuugcuugcggaacucuuc

SEQ ID NO: 1833148 - RNA, 22 nt, Homo sapiens
caacugucuuagacugcuagcu

SEQ ID NO: 1833149 - RNA, 22 nt, Homo sapiens
gaaagagcgucauguccuuggc

SEQ ID NO: 1833150 - RNA, 16 nt, Homo sapiens
cugugucaaacaccuc

SEQ ID NO: 1833151 - RNA, 19 nt, Homo sapiens
agcuagagugcaguggugc

SEQ ID NO: 1833152 - RNA, 20 nt, Homo sapiens
ggaaacauauuuaagaaaua

SEQ ID NO: 1833153 - RNA, 19 nt, Homo sapiens
uauccuagcacaugcuuca

SEQ ID NO: 1833154 - RNA, 20 nt, Homo sapiens
auagaugucuagguacuuca

SEQ ID NO: 1833155 - RNA, 21 nt, Homo sapiens
auccucuugccaaaucaaaag

SEQ ID NO: 1833156 - RNA, 19 nt, Homo sapiens
aaagaagucauggcccaaa

SEQ ID NO: 1833157 - RNA, 13 nt, Homo sapiens
ggcagcacaggaa

SEQ ID NO: 1833158 - RNA, 24 nt, Homo sapiens
uaagcagccagacccacaaggcca

SEQ ID NO: 1833159 - RNA, 16 nt, Homo sapiens
guuuucugggugucca

SEQ ID NO: 1833160 - RNA, 14 nt, Homo sapiens
aaagcaaccaccug

SEQ ID NO: 1833161 - RNA, 20 nt, Homo sapiens
gcugcuauacacaagcaaug

SEQ ID NO: 1833162 - RNA, 15 nt, Homo sapiens
uagcaugcacaaagu

SEQ ID NO: 1833163 - RNA, 18 nt, Homo sapiens
uccaacagccagugugug

SEQ ID NO: 1833164 - RNA, 17 nt, Homo sapiens
auaaauuggcuaaucag

SEQ ID NO: 1833165 - RNA, 16 nt, Homo sapiens
ucagguauguugccuu

SEQ ID NO: 1833166 - RNA, 20 nt, Homo sapiens
uaaucacacacacacuugcu

SEQ ID NO: 1833167 - RNA, 20 nt, Homo sapiens
cuccccuuugacccuauuca

SEQ ID NO: 1833168 - RNA, 20 nt, Homo sapiens
gacacagaggacggcuuccc

SEQ ID NO: 1833169 - RNA, 13 nt, Homo sapiens
ucuugcucaaaaa

SEQ ID NO: 1833170 - RNA, 22 nt, Homo sapiens
aagaccaauauucaaaugcgua

SEQ ID NO: 1833171 - RNA, 13 nt, Homo sapiens
aguaaauccucau

SEQ ID NO: 1833172 - RNA, 16 nt, Homo sapiens
ccccuccucugugcuc

SEQ ID NO: 1833173 - RNA, 19 nt, Homo sapiens
ucuauugucuguauuugcc

SEQ ID NO: 1833174 - RNA, 21 nt, Homo sapiens
acaaacaauuaacugagcaua

SEQ ID NO: 1833175 - RNA, 13 nt, Homo sapiens
gaucuauuuacau

SEQ ID NO: 1833176 - RNA, 15 nt, Homo sapiens
uacuuaauucagucu

SEQ ID NO: 1833177 - RNA, 19 nt, Homo sapiens
acugauuauugaguucuga

SEQ ID NO: 1833178 - RNA, 15 nt, Homo sapiens
aaaaugggaucucau

SEQ ID NO: 1833179 - RNA, 16 nt, Homo sapiens
uuuccaguguuuacaa

SEQ ID NO: 1833180 - RNA, 14 nt, Homo sapiens
ccucgaaaaccauc

SEQ ID NO: 1833181 - RNA, 17 nt, Homo sapiens
acugcugcuccagugca

SEQ ID NO: 1833182 - RNA, 14 nt, Homo sapiens
gagcucuuugcacu

SEQ ID NO: 1833183 - RNA, 18 nt, Homo sapiens
ugacaaaauaacauuuga

SEQ ID NO: 1833184 - RNA, 22 nt, Homo sapiens
gagugcugagaaccacggugaa

SEQ ID NO: 1833185 - RNA, 17 nt, Homo sapiens
aggugagaaaaccaugg

SEQ ID NO: 1833186 - RNA, 16 nt, Homo sapiens
uagaucugaauaaagu

SEQ ID NO: 1833187 - RNA, 15 nt, Homo sapiens
ggcacugacugagca

SEQ ID NO: 1833188 - RNA, 18 nt, Homo sapiens
gcuaauguaggacuguau

SEQ ID NO: 1833189 - RNA, 19 nt, Homo sapiens
gaagguucuucaugaucca

SEQ ID NO: 1833190 - RNA, 22 nt, Homo sapiens
uggaaagcaucaccucaggcca

SEQ ID NO: 1833191 - RNA, 21 nt, Homo sapiens
aucagcaaaaaaguacuuaaa

SEQ ID NO: 1833192 - RNA, 15 nt, Homo sapiens
uauuuaacuggugca

SEQ ID NO: 1833193 - RNA, 23 nt, Homo sapiens
caacucccagccaccaccacugu

SEQ ID NO: 1833194 - RNA, 16 nt, Homo sapiens
acuuccuguccagaga

SEQ ID NO: 1833195 - RNA, 14 nt, Homo sapiens
gccaaggacugacu

SEQ ID NO: 1833196 - RNA, 14 nt, Homo sapiens
cugccugagcccag

SEQ ID NO: 1833197 - RNA, 21 nt, Homo sapiens
aaauauauuuuaugauuuaaa

SEQ ID NO: 1833198 - RNA, 20 nt, Homo sapiens
aacaggaauuuuuaaaccaa

SEQ ID NO: 1833199 - RNA, 20 nt, Homo sapiens
uccaggcugggcugagccaa

SEQ ID NO: 1833200 - RNA, 23 nt, Homo sapiens
uaccuauaggaaagucugucagg

SEQ ID NO: 1833201 - RNA, 16 nt, Homo sapiens
cugcuguccagacagc

SEQ ID NO: 1833202 - RNA, 20 nt, Homo sapiens
cagcccuggcaaaugccuga

SEQ ID NO: 1833203 - RNA, 17 nt, Homo sapiens
aguaaauaacaggcauu

SEQ ID NO: 1833204 - RNA, 23 nt, Homo sapiens
gacaccagccaucaugugccugg

SEQ ID NO: 1833205 - RNA, 16 nt, Homo sapiens
cuaagcuauucaguaa

SEQ ID NO: 1833206 - RNA, 15 nt, Homo sapiens
cccacugaggggcca

SEQ ID NO: 1833207 - RNA, 20 nt, Homo sapiens
cauuugguucaggcauaaau

SEQ ID NO: 1833208 - RNA, 19 nt, Homo sapiens
caaugaugaaauauaauca

SEQ ID NO: 1833209 - RNA, 21 nt, Homo sapiens
cauugcuucauuaaaacaaga

SEQ ID NO: 1833210 - RNA, 18 nt, Homo sapiens
caucauuuugacagcauc

SEQ ID NO: 1833211 - RNA, 22 nt, Homo sapiens
ugcuguuaaaauuaauauauca

SEQ ID NO: 1833212 - RNA, 15 nt, Homo sapiens
auauauagugcuaua

SEQ ID NO: 1833213 - RNA, 20 nt, Homo sapiens
acgccaaagugcagcccuuc

SEQ ID NO: 1833214 - RNA, 19 nt, Homo sapiens
cauacaaacaaugcaacca

SEQ ID NO: 1833215 - RNA, 20 nt, Homo sapiens
gggaugacaauggaccucuc

SEQ ID NO: 1833216 - RNA, 14 nt, Homo sapiens
ugugcuucauagaa

SEQ ID NO: 1833217 - RNA, 19 nt, Homo sapiens
ccuccucggaucaccgaga

SEQ ID NO: 1833218 - RNA, 11 nt, Homo sapiens
agacaggugag

SEQ ID NO: 1833219 - RNA, 13 nt, Homo sapiens
agguuggauuugc

SEQ ID NO: 1833220 - RNA, 18 nt, Homo sapiens
gcuuauaagaaugguguu

SEQ ID NO: 1833221 - RNA, 14 nt, Homo sapiens
ccacccucuuccca

SEQ ID NO: 1833222 - RNA, 10 nt, Homo sapiens
ucucauuccc

SEQ ID NO: 1833223 - RNA, 16 nt, Homo sapiens
accagcauacccuuac

SEQ ID NO: 1833224 - RNA, 21 nt, Homo sapiens
acaaguaaaaggaaaugcucc

SEQ ID NO: 1833225 - RNA, 20 nt, Homo sapiens
cuccugucucgccagaagac

SEQ ID NO: 1833226 - RNA, 23 nt, Homo sapiens
caucucccuuggguaaaaugaag

SEQ ID NO: 1833227 - RNA, 14 nt, Homo sapiens
cgccaggcgcugca

SEQ ID NO: 1833228 - RNA, 24 nt, Homo sapiens
gggagccuucugugcugugagucc

SEQ ID NO: 1833229 - RNA, 18 nt, Homo sapiens
cauaugacaauaagccac

SEQ ID NO: 1833230 - RNA, 19 nt, Homo sapiens
cauccgcuacuacaucaag

SEQ ID NO: 1833231 - RNA, 15 nt, Homo sapiens
ugggucaaagccggu

SEQ ID NO: 1833232 - RNA, 15 nt, Homo sapiens
aagucauuccaugaa

SEQ ID NO: 1833233 - RNA, 15 nt, Homo sapiens
aaauuccagagcuau

SEQ ID NO: 1833234 - RNA, 17 nt, Homo sapiens
uuaauuuuaacugccaa

SEQ ID NO: 1833235 - RNA, 18 nt, Homo sapiens
acuugucacugacacaaa

SEQ ID NO: 1833236 - RNA, 22 nt, Homo sapiens
uuugagaacaauggagauauca

SEQ ID NO: 1833237 - RNA, 17 nt, Homo sapiens
ccaggacgcagacugac

SEQ ID NO: 1833238 - RNA, 16 nt, Homo sapiens
cgcauuguuuugcauc

SEQ ID NO: 1833239 - RNA, 14 nt, Homo sapiens
gaccugcaggccaa

SEQ ID NO: 1833240 - RNA, 21 nt, Homo sapiens
ccuacaagaugccaaggaggu

SEQ ID NO: 1833241 - RNA, 12 nt, Homo sapiens
gaaugugucuug

SEQ ID NO: 1833242 - RNA, 19 nt, Homo sapiens
ugcuccuccuccuguauuc

SEQ ID NO: 1833243 - RNA, 21 nt, Homo sapiens
acaauuccuuacauuuaccaa

SEQ ID NO: 1833244 - RNA, 23 nt, Homo sapiens
cacauuagggugggcgugcugcg

SEQ ID NO: 1833245 - RNA, 16 nt, Homo sapiens
uccagagcugccagug

SEQ ID NO: 1833246 - RNA, 17 nt, Homo sapiens
auuauaaaugacagauc

SEQ ID NO: 1833247 - RNA, 11 nt, Homo sapiens
cacacacugug

SEQ ID NO: 1833248 - RNA, 17 nt, Homo sapiens
ggagaaacgggugagcu

SEQ ID NO: 1833249 - RNA, 21 nt, Homo sapiens
uaucauuuuugagcaacuccc

SEQ ID NO: 1833250 - RNA, 15 nt, Homo sapiens
cucauucuucuuggc

SEQ ID NO: 1833251 - RNA, 18 nt, Homo sapiens
guacaagagaugggaugc

SEQ ID NO: 1833252 - RNA, 14 nt, Homo sapiens
ggcccugagccaga

SEQ ID NO: 1833253 - RNA, 13 nt, Homo sapiens
ccaagacccugug

SEQ ID NO: 1833254 - RNA, 22 nt, Homo sapiens
aauaagccacauaucuagauuu

SEQ ID NO: 1833255 - RNA, 17 nt, Homo sapiens
aucugaauccaagacag

SEQ ID NO: 1833256 - RNA, 15 nt, Homo sapiens
gucugccccacccuc

SEQ ID NO: 1833257 - RNA, 18 nt, Homo sapiens
aucucucccacucugcca

SEQ ID NO: 1833258 - RNA, 18 nt, Homo sapiens
aucagacauucagagauu

SEQ ID NO: 1833259 - RNA, 20 nt, Homo sapiens
uguaaaaagacaaaaaccaa

SEQ ID NO: 1833260 - RNA, 21 nt, Homo sapiens
ucuaaggccaaggccucagga

SEQ ID NO: 1833261 - RNA, 20 nt, Homo sapiens
acauccuccacugacuuccu

SEQ ID NO: 1833262 - RNA, 19 nt, Homo sapiens
gcacaagaaucacuugaac

SEQ ID NO: 1833263 - RNA, 16 nt, Homo sapiens
uaaucuaccuugcagu

SEQ ID NO: 1833264 - RNA, 13 nt, Homo sapiens
cuguucuuagcuc

SEQ ID NO: 1833265 - RNA, 16 nt, Homo sapiens
gacucucggcucuuca

SEQ ID NO: 1833266 - RNA, 22 nt, Homo sapiens
agaggguggagaugucagucug

SEQ ID NO: 1833267 - RNA, 14 nt, Homo sapiens
aaaacacauaauuu

SEQ ID NO: 1833268 - RNA, 16 nt, Homo sapiens
gaaauuaagaaggcaa

SEQ ID NO: 1833269 - RNA, 20 nt, Homo sapiens
uuuaaaacgcaugugcagcu

SEQ ID NO: 1833270 - RNA, 19 nt, Homo sapiens
cugggggagaggugaccua

SEQ ID NO: 1833271 - RNA, 15 nt, Homo sapiens
cagcccuuauggcca

SEQ ID NO: 1833272 - RNA, 16 nt, Homo sapiens
uugcuuuagucauuua

SEQ ID NO: 1833273 - RNA, 18 nt, Homo sapiens
ggauagcgaaugcacuca

SEQ ID NO: 1833274 - RNA, 16 nt, Homo sapiens
uaacaucuguuaucaa

SEQ ID NO: 1833275 - RNA, 16 nt, Homo sapiens
acccuuggaccucucc

SEQ ID NO: 1833276 - RNA, 17 nt, Homo sapiens
uuacauuugaaaucuau

SEQ ID NO: 1833277 - RNA, 18 nt, Homo sapiens
guguuuuucacauuugcg

SEQ ID NO: 1833278 - RNA, 20 nt, Homo sapiens
cuguugcccuacacugccuu

SEQ ID NO: 1833279 - RNA, 18 nt, Homo sapiens
uucaucaauuuucacuug

SEQ ID NO: 1833280 - RNA, 18 nt, Homo sapiens
ucugaauuugagauacaa

SEQ ID NO: 1833281 - RNA, 17 nt, Homo sapiens
ugaagauggacauuuua

SEQ ID NO: 1833282 - RNA, 18 nt, Homo sapiens
ucaacuuugcaaacaaca

SEQ ID NO: 1833283 - RNA, 14 nt, Homo sapiens
uccaguaucuccaa

SEQ ID NO: 1833284 - RNA, 15 nt, Homo sapiens
ucuuuuaggaucaga

SEQ ID NO: 1833285 - RNA, 22 nt, Homo sapiens
cagaaaccuuccagagaacaca

SEQ ID NO: 1833286 - RNA, 19 nt, Homo sapiens
cacgucaagcuuuggauaa

SEQ ID NO: 1833287 - RNA, 13 nt, Homo sapiens
uauuaccaaaaaa

SEQ ID NO: 1833288 - RNA, 16 nt, Homo sapiens
aucuguauauacaaua

SEQ ID NO: 1833289 - RNA, 22 nt, Homo sapiens
cacaugucagccacugugauag

SEQ ID NO: 1833290 - RNA, 15 nt, Homo sapiens
uccucucauuugcag

SEQ ID NO: 1833291 - RNA, 18 nt, Homo sapiens
uacauaguagacaugugu

SEQ ID NO: 1833292 - RNA, 15 nt, Homo sapiens
aaguuauucuugaca

SEQ ID NO: 1833293 - RNA, 13 nt, Homo sapiens
cucaagacucacc

SEQ ID NO: 1833294 - RNA, 21 nt, Homo sapiens
ugggaagauaggcucugcaca

SEQ ID NO: 1833295 - RNA, 17 nt, Homo sapiens
gaacagcugugagccau

SEQ ID NO: 1833296 - RNA, 20 nt, Homo sapiens
caagagaucagcaguggcag

SEQ ID NO: 1833297 - RNA, 23 nt, Homo sapiens
aguuaacugugaaauaccacaag

SEQ ID NO: 1833298 - RNA, 20 nt, Homo sapiens
uuaaaaauauuuucugaauu

SEQ ID NO: 1833299 - RNA, 17 nt, Homo sapiens
uuaaauaauuucuacuc

SEQ ID NO: 1833300 - RNA, 14 nt, Homo sapiens
gaaugcauucaggg

SEQ ID NO: 1833301 - RNA, 23 nt, Homo sapiens
guuccacugcuacugacccagag

SEQ ID NO: 1833302 - RNA, 14 nt, Homo sapiens
guuuaaacccaagu

SEQ ID NO: 1833303 - RNA, 21 nt, Homo sapiens
accuuaacuggagaccagaaa

SEQ ID NO: 1833304 - RNA, 19 nt, Homo sapiens
gggaccuccccagcccagg

SEQ ID NO: 1833305 - RNA, 16 nt, Homo sapiens
cugggcgccaacugcu

SEQ ID NO: 1833306 - RNA, 11 nt, Homo sapiens
agaaagagccu

SEQ ID NO: 1833307 - RNA, 18 nt, Homo sapiens
auucccguuuuacagaua

SEQ ID NO: 1833308 - RNA, 12 nt, Homo sapiens
ugcaagucaaaa

SEQ ID NO: 1833309 - RNA, 19 nt, Homo sapiens
uggugcugcuuucuuguug

SEQ ID NO: 1833310 - RNA, 16 nt, Homo sapiens
ccaggaugcugcugca

SEQ ID NO: 1833311 - RNA, 18 nt, Homo sapiens
uaguaaaauauaaaaaca

SEQ ID NO: 1833312 - RNA, 16 nt, Homo sapiens
uucaacagggaagaaa

SEQ ID NO: 1833313 - RNA, 18 nt, Homo sapiens
aucuuacauuagugauuc

SEQ ID NO: 1833314 - RNA, 15 nt, Homo sapiens
caaaaucguuuuuaa

SEQ ID NO: 1833315 - RNA, 16 nt, Homo sapiens
aacugauaaaccaaaa

SEQ ID NO: 1833316 - RNA, 16 nt, Homo sapiens
uccuguagucccauug

SEQ ID NO: 1833317 - RNA, 16 nt, Homo sapiens
gaugaagaccaaagac

SEQ ID NO: 1833318 - RNA, 18 nt, Homo sapiens
agucaucuuguaauuucc

SEQ ID NO: 1833319 - RNA, 14 nt, Homo sapiens
uggagucacuguag

SEQ ID NO: 1833320 - RNA, 22 nt, Homo sapiens
uggagggcagcuguggcuucua

SEQ ID NO: 1833321 - RNA, 18 nt, Homo sapiens
agugaggcaggagaagaa

SEQ ID NO: 1833322 - RNA, 13 nt, Homo sapiens
uucaaaauucuca

SEQ ID NO: 1833323 - RNA, 13 nt, Homo sapiens
accaaaauauuca

SEQ ID NO: 1833324 - RNA, 15 nt, Homo sapiens
gagccaccccaggaa

SEQ ID NO: 1833325 - RNA, 23 nt, Homo sapiens
guauauuuugacgucacugauau

SEQ ID NO: 1833326 - RNA, 13 nt, Homo sapiens
ccugcagaugcca

SEQ ID NO: 1833327 - RNA, 20 nt, Homo sapiens
guggagccaauccacuccuu

SEQ ID NO: 1833328 - RNA, 20 nt, Homo sapiens
cucccaggccaacaguagcc

SEQ ID NO: 1833329 - RNA, 12 nt, Homo sapiens
uuguucugauaa

SEQ ID NO: 1833330 - RNA, 14 nt, Homo sapiens
acugacccucaggc

SEQ ID NO: 1833331 - RNA, 20 nt, Homo sapiens
auaauuugaaaaaguuccau

SEQ ID NO: 1833332 - RNA, 21 nt, Homo sapiens
gccccugcccgagagcucuua

SEQ ID NO: 1833333 - RNA, 21 nt, Homo sapiens
caagaacagaaguguucacau

SEQ ID NO: 1833334 - RNA, 20 nt, Homo sapiens
gaagguucuacgccagggga

SEQ ID NO: 1833335 - RNA, 16 nt, Homo sapiens
caaucaguauucauau

SEQ ID NO: 1833336 - RNA, 16 nt, Homo sapiens
ucaggaugaacccagg

SEQ ID NO: 1833337 - RNA, 22 nt, Homo sapiens
ucuguucauuucacacagugaa

SEQ ID NO: 1833338 - RNA, 15 nt, Homo sapiens
auugcacaaauacaa

SEQ ID NO: 1833339 - RNA, 11 nt, Homo sapiens
aucacugccaa

SEQ ID NO: 1833340 - RNA, 11 nt, Homo sapiens
aaaacugccuc

SEQ ID NO: 1833341 - RNA, 16 nt, Homo sapiens
agagaugggacuggga

SEQ ID NO: 1833342 - RNA, 14 nt, Homo sapiens
aacagccucagcac

SEQ ID NO: 1833343 - RNA, 15 nt, Homo sapiens
cccaucccuauccau

SEQ ID NO: 1833344 - RNA, 20 nt, Homo sapiens
gcucuuacccacacuacgca

SEQ ID NO: 1833345 - RNA, 16 nt, Homo sapiens
ugucuuggacccaccu

SEQ ID NO: 1833346 - RNA, 18 nt, Homo sapiens
cuuuuaaaaaaaaauacu

SEQ ID NO: 1833347 - RNA, 16 nt, Homo sapiens
uaaaggcccacuggca

SEQ ID NO: 1833348 - RNA, 16 nt, Homo sapiens
cagagcccagcuccaa

SEQ ID NO: 1833349 - RNA, 17 nt, Homo sapiens
uuacuaucacacaugaa

SEQ ID NO: 1833350 - RNA, 14 nt, Homo sapiens
agcugcugcacagc

SEQ ID NO: 1833351 - RNA, 14 nt, Homo sapiens
agaaauugcaauau

SEQ ID NO: 1833352 - RNA, 19 nt, Homo sapiens
uaaguagcaacccugugau

SEQ ID NO: 1833353 - RNA, 21 nt, Homo sapiens
aacagcaccuccccgcuggga

SEQ ID NO: 1833354 - RNA, 12 nt, Homo sapiens
uaaaaugcuagg

SEQ ID NO: 1833355 - RNA, 20 nt, Homo sapiens
ccuaggcugcugcugugacc

SEQ ID NO: 1833356 - RNA, 20 nt, Homo sapiens
gucuucagggggccaggugc

SEQ ID NO: 1833357 - RNA, 18 nt, Homo sapiens
cuguagugagauagcauu

SEQ ID NO: 1833358 - RNA, 16 nt, Homo sapiens
cauuucuucugcacaa

SEQ ID NO: 1833359 - RNA, 17 nt, Homo sapiens
gcucauaaacugccaag

SEQ ID NO: 1833360 - RNA, 18 nt, Homo sapiens
gaagaaagauugcuauaa

SEQ ID NO: 1833361 - RNA, 18 nt, Homo sapiens
agauaagucuacauuaaa

SEQ ID NO: 1833362 - RNA, 15 nt, Homo sapiens
ugcuuugugccuuug

SEQ ID NO: 1833363 - RNA, 14 nt, Homo sapiens
auguuuuucaccua

SEQ ID NO: 1833364 - RNA, 22 nt, Homo sapiens
gccccguggugacauuucccaa

SEQ ID NO: 1833365 - RNA, 23 nt, Homo sapiens
cagaaaacaaaucuucaaggugu

SEQ ID NO: 1833366 - RNA, 21 nt, Homo sapiens
ggucauucauaucacuaugaa

SEQ ID NO: 1833367 - RNA, 14 nt, Homo sapiens
cucuuaagaucuga

SEQ ID NO: 1833368 - RNA, 21 nt, Homo sapiens
ggaacucuuccuggaaugcau

SEQ ID NO: 1833369 - RNA, 18 nt, Homo sapiens
gaaauaauaaaacuauua

SEQ ID NO: 1833370 - RNA, 23 nt, Homo sapiens
uacuucugugucugucaccacau

SEQ ID NO: 1833371 - RNA, 18 nt, Homo sapiens
cuuuggggauagucugga

SEQ ID NO: 1833372 - RNA, 21 nt, Homo sapiens
caggccaguaaucccagugac

SEQ ID NO: 1833373 - RNA, 16 nt, Homo sapiens
agagaaacuuuauaca

SEQ ID NO: 1833374 - RNA, 17 nt, Homo sapiens
uggucuuuuuccugaaa

SEQ ID NO: 1833375 - RNA, 14 nt, Homo sapiens
guaaacugugcacc

SEQ ID NO: 1833376 - RNA, 17 nt, Homo sapiens
ggcgggaaagccaguga

SEQ ID NO: 1833377 - RNA, 18 nt, Homo sapiens
gcacugacagauuuccau

SEQ ID NO: 1833378 - RNA, 17 nt, Homo sapiens
ugcagcccccucgggga

SEQ ID NO: 1833379 - RNA, 19 nt, Homo sapiens
aacuuggauguagccauga

SEQ ID NO: 1833380 - RNA, 13 nt, Homo sapiens
agugaaaucugug

SEQ ID NO: 1833381 - RNA, 14 nt, Homo sapiens
guagaaaucuguaa

SEQ ID NO: 1833382 - RNA, 17 nt, Homo sapiens
uaauaugguuacauuua

SEQ ID NO: 1833383 - RNA, 19 nt, Homo sapiens
gacccaugcaauauuuccu

SEQ ID NO: 1833384 - RNA, 16 nt, Homo sapiens
gaaccauuacuguaau

SEQ ID NO: 1833385 - RNA, 13 nt, Homo sapiens
uucuccaggugau

SEQ ID NO: 1833386 - RNA, 14 nt, Homo sapiens
ucaaagaggccuua

SEQ ID NO: 1833387 - RNA, 12 nt, Homo sapiens
ccugugugcacc

SEQ ID NO: 1833388 - RNA, 15 nt, Homo sapiens
guaggagacuugcca

SEQ ID NO: 1833389 - RNA, 17 nt, Homo sapiens
aaccacagggcugggcu

SEQ ID NO: 1833390 - RNA, 13 nt, Homo sapiens
guccccagggaca

SEQ ID NO: 1833391 - RNA, 14 nt, Homo sapiens
cuuacacacugucu

SEQ ID NO: 1833392 - RNA, 22 nt, Homo sapiens
agaaugaaagacugaaucuucc

SEQ ID NO: 1833393 - RNA, 19 nt, Homo sapiens
gauccucaugguucccaag

SEQ ID NO: 1833394 - RNA, 19 nt, Homo sapiens
aucccgccgauagagggac

SEQ ID NO: 1833395 - RNA, 20 nt, Homo sapiens
aacauugcaauaaauggcuu

SEQ ID NO: 1833396 - RNA, 15 nt, Homo sapiens
uggacugcucaggaa

SEQ ID NO: 1833397 - RNA, 23 nt, Homo sapiens
ugagcaauggaguggcugccaug

SEQ ID NO: 1833398 - RNA, 16 nt, Homo sapiens
aagguugagggcaaug

SEQ ID NO: 1833399 - RNA, 19 nt, Homo sapiens
aggcgaggucgauggaacu

SEQ ID NO: 1833400 - RNA, 15 nt, Homo sapiens
auuuauuggcaauac

SEQ ID NO: 1833401 - RNA, 18 nt, Homo sapiens
uggaggccccaacccugu

SEQ ID NO: 1833402 - RNA, 18 nt, Homo sapiens
gugcaacaaacucaaaau

SEQ ID NO: 1833403 - RNA, 22 nt, Homo sapiens
gccaacucuaacaggcacuuug

SEQ ID NO: 1833404 - RNA, 23 nt, Homo sapiens
uuuauguguuugacgggaaacaa

SEQ ID NO: 1833405 - RNA, 23 nt, Homo sapiens
agcucauuugagauaaagucaaa

SEQ ID NO: 1833406 - RNA, 21 nt, Homo sapiens
uuuccuccugcuucaugggaa

SEQ ID NO: 1833407 - RNA, 14 nt, Homo sapiens
ccuugcaaccucac

SEQ ID NO: 1833408 - RNA, 19 nt, Homo sapiens
uguuauguuugcacuuugu

SEQ ID NO: 1833409 - RNA, 19 nt, Homo sapiens
guaauuuuaaguaauuuca

SEQ ID NO: 1833410 - RNA, 17 nt, Homo sapiens
uuauucaagugccucuu

SEQ ID NO: 1833411 - RNA, 15 nt, Homo sapiens
auuccaccuagagcu

SEQ ID NO: 1833412 - RNA, 13 nt, Homo sapiens
agacccugccagg

SEQ ID NO: 1833413 - RNA, 22 nt, Homo sapiens
gcaacccaugagcguccaggug

SEQ ID NO: 1833414 - RNA, 19 nt, Homo sapiens
agauaugcacacacaugga

SEQ ID NO: 1833415 - RNA, 16 nt, Homo sapiens
uauucuuaacuauuca

SEQ ID NO: 1833416 - RNA, 19 nt, Homo sapiens
cccacaccccuccaaagcc

SEQ ID NO: 1833417 - RNA, 23 nt, Homo sapiens
gacauaaaacuuuaaaaggcaac

SEQ ID NO: 1833418 - RNA, 22 nt, Homo sapiens
guaugaucuuagggaacuuuga

SEQ ID NO: 1833419 - RNA, 20 nt, Homo sapiens
gcccaguuucacugccauau

SEQ ID NO: 1833420 - RNA, 20 nt, Homo sapiens
agggacccugggugggagca

SEQ ID NO: 1833421 - RNA, 13 nt, Homo sapiens
uguaaacuuuauc

SEQ ID NO: 1833422 - RNA, 21 nt, Homo sapiens
ucccucaaagcuuccauucca

SEQ ID NO: 1833423 - RNA, 20 nt, Homo sapiens
gguggaaggugggaacagag

SEQ ID NO: 1833424 - RNA, 17 nt, Homo sapiens
caagccacgaaugaaug

SEQ ID NO: 1833425 - RNA, 19 nt, Homo sapiens
ggcccaugaaauugaugaa

SEQ ID NO: 1833426 - RNA, 14 nt, Homo sapiens
cauauauauuacaa

SEQ ID NO: 1833427 - RNA, 16 nt, Homo sapiens
caaaucaucuguaaca

SEQ ID NO: 1833428 - RNA, 17 nt, Homo sapiens
uuaauaaagaauuaaca

SEQ ID NO: 1833429 - RNA, 14 nt, Homo sapiens
gggacggguggugg

SEQ ID NO: 1833430 - RNA, 16 nt, Homo sapiens
ccugcauuugcagaug

SEQ ID NO: 1833431 - RNA, 20 nt, Homo sapiens
ucacccggaucccuccucac

SEQ ID NO: 1833432 - RNA, 15 nt, Homo sapiens
cagcuauauuugauu

SEQ ID NO: 1833433 - RNA, 23 nt, Homo sapiens
uauuacaguguuuauccuuucau

SEQ ID NO: 1833434 - RNA, 19 nt, Homo sapiens
ugggagggagguaacgggu

SEQ ID NO: 1833435 - RNA, 17 nt, Homo sapiens
gaugguguccuucccug

SEQ ID NO: 1833436 - RNA, 18 nt, Homo sapiens
aguucauauguaccaugu

SEQ ID NO: 1833437 - RNA, 18 nt, Homo sapiens
uagagggguuggucccau

SEQ ID NO: 1833438 - RNA, 21 nt, Homo sapiens
ucagcaucugaccaucuguga

SEQ ID NO: 1833439 - RNA, 20 nt, Homo sapiens
gagcaagguggacaucuuca

SEQ ID NO: 1833440 - RNA, 16 nt, Homo sapiens
aaguccaucugacaaa

SEQ ID NO: 1833441 - RNA, 23 nt, Homo sapiens
uuggauuuuccaccaaauucuga

SEQ ID NO: 1833442 - RNA, 17 nt, Homo sapiens
ugaaaaauaucuuugca

SEQ ID NO: 1833443 - RNA, 20 nt, Homo sapiens
cagccaccauccuauugcaa

SEQ ID NO: 1833444 - RNA, 18 nt, Homo sapiens
agugaaauuauacagaua

SEQ ID NO: 1833445 - RNA, 17 nt, Homo sapiens
ucuugaucuuugagccc

SEQ ID NO: 1833446 - RNA, 20 nt, Homo sapiens
ucuccacugucauaaucucu

SEQ ID NO: 1833447 - RNA, 16 nt, Homo sapiens
aauauuauauaaccca

SEQ ID NO: 1833448 - RNA, 13 nt, Homo sapiens
ccuucagcacuuu

SEQ ID NO: 1833449 - RNA, 13 nt, Homo sapiens
auuacagccuuau

SEQ ID NO: 1833450 - RNA, 13 nt, Homo sapiens
uacugaucuuacu

SEQ ID NO: 1833451 - RNA, 23 nt, Homo sapiens
cugggccucagcaagccaugccc

SEQ ID NO: 1833452 - RNA, 22 nt, Homo sapiens
gacaaaucuaugccacucagaa

SEQ ID NO: 1833453 - RNA, 20 nt, Homo sapiens
agguugaggggcuccuggaa

SEQ ID NO: 1833454 - RNA, 15 nt, Homo sapiens
ugugggugaagguga

SEQ ID NO: 1833455 - RNA, 20 nt, Homo sapiens
ucucaaacucuugaccucag

SEQ ID NO: 1833456 - RNA, 21 nt, Homo sapiens
gccccucucagcuuuccaucc

SEQ ID NO: 1833457 - RNA, 21 nt, Homo sapiens
agaauaucaggaugccuuaaa

SEQ ID NO: 1833458 - RNA, 16 nt, Homo sapiens
auuucuaaaacauuaa

SEQ ID NO: 1833459 - RNA, 15 nt, Homo sapiens
uugaaagacaucaau

SEQ ID NO: 1833460 - RNA, 22 nt, Homo sapiens
caucaguguggcuucuaugagc

SEQ ID NO: 1833461 - RNA, 23 nt, Homo sapiens
ugcuucucuucuuuauugcacua

SEQ ID NO: 1833462 - RNA, 20 nt, Homo sapiens
aaagaauucuguacccugau

SEQ ID NO: 1833463 - RNA, 15 nt, Homo sapiens
auugaaaugcagauu

SEQ ID NO: 1833464 - RNA, 14 nt, Homo sapiens
augugguagccuca

SEQ ID NO: 1833465 - RNA, 19 nt, Homo sapiens
aguccugacacuauucauu

SEQ ID NO: 1833466 - RNA, 14 nt, Homo sapiens
gagagugugcucuc

SEQ ID NO: 1833467 - RNA, 17 nt, Homo sapiens
gagugaaacauugaacu

SEQ ID NO: 1833468 - RNA, 16 nt, Homo sapiens
agguggaucaccugag

SEQ ID NO: 1833469 - RNA, 16 nt, Homo sapiens
gaacugugugucucau

SEQ ID NO: 1833470 - RNA, 16 nt, Homo sapiens
uuugaaucacaguaua

SEQ ID NO: 1833471 - RNA, 16 nt, Homo sapiens
gugucucccgugcaug

SEQ ID NO: 1833472 - RNA, 19 nt, Homo sapiens
cuaugaauuaacccaaaga

SEQ ID NO: 1833473 - RNA, 22 nt, Homo sapiens
caggaggcagcuguugcaguga

SEQ ID NO: 1833474 - RNA, 23 nt, Homo sapiens
gugugacuccuuaucucuuucca

SEQ ID NO: 1833475 - RNA, 17 nt, Homo sapiens
uacgaagaccauacaua

SEQ ID NO: 1833476 - RNA, 19 nt, Homo sapiens
accagacuuuugcuuaccu

SEQ ID NO: 1833477 - RNA, 21 nt, Homo sapiens
cacaaaucauccuaguaauaa

SEQ ID NO: 1833478 - RNA, 15 nt, Homo sapiens
agucuuggugcuauc

SEQ ID NO: 1833479 - RNA, 14 nt, Homo sapiens
ccagaaccucagca

SEQ ID NO: 1833480 - RNA, 13 nt, Homo sapiens
uuguuuaugcugc

SEQ ID NO: 1833481 - RNA, 15 nt, Homo sapiens
ccugagcgcaccauc

SEQ ID NO: 1833482 - RNA, 13 nt, Homo sapiens
cuacccucuaguu

SEQ ID NO: 1833483 - RNA, 18 nt, Homo sapiens
ggacuucuggcagggaag

SEQ ID NO: 1833484 - RNA, 14 nt, Homo sapiens
uaccaguaucucca

SEQ ID NO: 1833485 - RNA, 17 nt, Homo sapiens
cauugauggagccugaa

SEQ ID NO: 1833486 - RNA, 20 nt, Homo sapiens
uguacuauccaaucugugau

SEQ ID NO: 1833487 - RNA, 15 nt, Homo sapiens
gcucaaugugcuguu

SEQ ID NO: 1833488 - RNA, 12 nt, Homo sapiens
uuuauuacaacu

SEQ ID NO: 1833489 - RNA, 14 nt, Homo sapiens
cucaagucuugaca

SEQ ID NO: 1833490 - RNA, 17 nt, Homo sapiens
cugguguagcuacagag

SEQ ID NO: 1833491 - RNA, 23 nt, Homo sapiens
uaauuccuguguagcuuuguuca

SEQ ID NO: 1833492 - RNA, 14 nt, Homo sapiens
cuucagucucuaua

SEQ ID NO: 1833493 - RNA, 18 nt, Homo sapiens
uuaacccugucugagaug

SEQ ID NO: 1833494 - RNA, 19 nt, Homo sapiens
gggacuggcgagucugcuu

SEQ ID NO: 1833495 - RNA, 19 nt, Homo sapiens
gcagggugaagcagcucau

SEQ ID NO: 1833496 - RNA, 17 nt, Homo sapiens
auguucacuguaugccu

SEQ ID NO: 1833497 - RNA, 17 nt, Homo sapiens
ccaaggagaaaggcaug

SEQ ID NO: 1833498 - RNA, 22 nt, Homo sapiens
uuuaaaagagacaaacuguaaa

SEQ ID NO: 1833499 - RNA, 20 nt, Homo sapiens
cuucuuuuuuuuugagaugg

SEQ ID NO: 1833500 - RNA, 19 nt, Homo sapiens
ugggaguguuugucccauc

SEQ ID NO: 1833501 - RNA, 23 nt, Homo sapiens
uagcccucccccucaaccucacc

SEQ ID NO: 1833502 - RNA, 13 nt, Homo sapiens
accagaauugcuu

SEQ ID NO: 1833503 - RNA, 21 nt, Homo sapiens
gagagacccugucucaaaaaa

SEQ ID NO: 1833504 - RNA, 17 nt, Homo sapiens
uucccaaaucucaaaag

SEQ ID NO: 1833505 - RNA, 19 nt, Homo sapiens
ugagcucccacaagccuga

SEQ ID NO: 1833506 - RNA, 13 nt, Homo sapiens
aaugauccugcca

SEQ ID NO: 1833507 - RNA, 16 nt, Homo sapiens
cccugacucaucauuu

SEQ ID NO: 1833508 - RNA, 14 nt, Homo sapiens
ccauugugaaccaa

SEQ ID NO: 1833509 - RNA, 17 nt, Homo sapiens
cagcagaucccagcuca

SEQ ID NO: 1833510 - RNA, 19 nt, Homo sapiens
aggcaagaaccaguguuua

SEQ ID NO: 1833511 - RNA, 18 nt, Homo sapiens
auugagugcacuaaacaa

SEQ ID NO: 1833512 - RNA, 17 nt, Homo sapiens
ucagaguggccaauccc

SEQ ID NO: 1833513 - RNA, 11 nt, Homo sapiens
agagggggcca

SEQ ID NO: 1833514 - RNA, 16 nt, Homo sapiens
caggacagaaccacug

SEQ ID NO: 1833515 - RNA, 17 nt, Homo sapiens
uuuguaaaucugccaca

SEQ ID NO: 1833516 - RNA, 17 nt, Homo sapiens
cucuucuacccucauca

SEQ ID NO: 1833517 - RNA, 19 nt, Homo sapiens
accuuucaggcuacaagag

SEQ ID NO: 1833518 - RNA, 16 nt, Homo sapiens
gaagucuaaaugaagu

SEQ ID NO: 1833519 - RNA, 22 nt, Homo sapiens
ggaggccugggagaugcagcug

SEQ ID NO: 1833520 - RNA, 21 nt, Homo sapiens
gcauugauucaguauuacaaa

SEQ ID NO: 1833521 - RNA, 12 nt, Homo sapiens
cuguauuccuag

SEQ ID NO: 1833522 - RNA, 23 nt, Homo sapiens
gaaggugcugauccuaagaauuu

SEQ ID NO: 1833523 - RNA, 20 nt, Homo sapiens
uagcaauagguuuguaaaau

SEQ ID NO: 1833524 - RNA, 22 nt, Homo sapiens
agcaucugcuccaucggggcag

SEQ ID NO: 1833525 - RNA, 15 nt, Homo sapiens
aaacgcaccaaucag

SEQ ID NO: 1833526 - RNA, 17 nt, Homo sapiens
uuccgagggcacuaccg

SEQ ID NO: 1833527 - RNA, 17 nt, Homo sapiens
agugcaguccauuuccu

SEQ ID NO: 1833528 - RNA, 15 nt, Homo sapiens
ucauugaaguauuuu

SEQ ID NO: 1833529 - RNA, 15 nt, Homo sapiens
aauggcacaugucau

SEQ ID NO: 1833530 - RNA, 16 nt, Homo sapiens
acuauaucacaaucuc

SEQ ID NO: 1833531 - RNA, 14 nt, Homo sapiens
gcauuagugcugau

SEQ ID NO: 1833532 - RNA, 20 nt, Homo sapiens
guguccccucacgcaagugc

SEQ ID NO: 1833533 - RNA, 17 nt, Homo sapiens
aggcgccgcacuuccuu

SEQ ID NO: 1833534 - RNA, 15 nt, Homo sapiens
cugaacacuuuaggu

SEQ ID NO: 1833535 - RNA, 15 nt, Homo sapiens
cugaggcucuccaaa

SEQ ID NO: 1833536 - RNA, 21 nt, Homo sapiens
aaauauuaaaauuuauuucac

SEQ ID NO: 1833537 - RNA, 16 nt, Homo sapiens
auuaggacuggcuuug

SEQ ID NO: 1833538 - RNA, 20 nt, Homo sapiens
uaguaauuguaaguaccccu

SEQ ID NO: 1833539 - RNA, 21 nt, Homo sapiens
aauuucuaucagccuugcuaa

SEQ ID NO: 1833540 - RNA, 21 nt, Homo sapiens
uuaauguauuuguuugcaauu

SEQ ID NO: 1833541 - RNA, 17 nt, Homo sapiens
aguaagagguuaugcca

SEQ ID NO: 1833542 - RNA, 21 nt, Homo sapiens
gcaccauggugacugccacau

SEQ ID NO: 1833543 - RNA, 13 nt, Homo sapiens
accauaaacauuu

SEQ ID NO: 1833544 - RNA, 21 nt, Homo sapiens
gucaaccugaauuaaagucua

SEQ ID NO: 1833545 - RNA, 12 nt, Homo sapiens
gcacgugcaaua

SEQ ID NO: 1833546 - RNA, 17 nt, Homo sapiens
auuucugaagugcuugu

SEQ ID NO: 1833547 - RNA, 22 nt, Homo sapiens
caguaaagaguacacucagcca

SEQ ID NO: 1833548 - RNA, 22 nt, Homo sapiens
auaugcuuagcauagauuugca

SEQ ID NO: 1833549 - RNA, 16 nt, Homo sapiens
gaaggauuuugcaguu

SEQ ID NO: 1833550 - RNA, 21 nt, Homo sapiens
ugcacuugcacgcccaugugu

SEQ ID NO: 1833551 - RNA, 19 nt, Homo sapiens
aaccaugggauaaaugcca

SEQ ID NO: 1833552 - RNA, 14 nt, Homo sapiens
uugcccccauuuca

SEQ ID NO: 1833553 - RNA, 23 nt, Homo sapiens
guuguaaaaagcccagcacuuga

SEQ ID NO: 1833554 - RNA, 16 nt, Homo sapiens
uacgcugcgugccaug

SEQ ID NO: 1833555 - RNA, 13 nt, Homo sapiens
guguggccucuuc

SEQ ID NO: 1833556 - RNA, 16 nt, Homo sapiens
cuaucugguauuaaau

SEQ ID NO: 1833557 - RNA, 23 nt, Homo sapiens
uuugaaaaagccucuaauggacu

SEQ ID NO: 1833558 - RNA, 12 nt, Homo sapiens
uuucaggaucua

SEQ ID NO: 1833559 - RNA, 17 nt, Homo sapiens
gcaucucccacacaaga

SEQ ID NO: 1833560 - RNA, 12 nt, Homo sapiens
agagacaggguc

SEQ ID NO: 1833561 - RNA, 20 nt, Homo sapiens
cauaucucuuaucuuacgaa

SEQ ID NO: 1833562 - RNA, 17 nt, Homo sapiens
cccacuuucaagacaga

SEQ ID NO: 1833563 - RNA, 21 nt, Homo sapiens
cguuugaauauauuuuaucuu

SEQ ID NO: 1833564 - RNA, 16 nt, Homo sapiens
accaguuucagagaaa

SEQ ID NO: 1833565 - RNA, 16 nt, Homo sapiens
augcaaauacaaucag

SEQ ID NO: 1833566 - RNA, 16 nt, Homo sapiens
gacccuggucugagga

SEQ ID NO: 1833567 - RNA, 22 nt, Homo sapiens
aaaaacacugcugaggcuucau

SEQ ID NO: 1833568 - RNA, 14 nt, Homo sapiens
ugaagggaaagggc

SEQ ID NO: 1833569 - RNA, 19 nt, Homo sapiens
accagcucugaacuuccaa

SEQ ID NO: 1833570 - RNA, 13 nt, Homo sapiens
gguccuggugccc

SEQ ID NO: 1833571 - RNA, 19 nt, Homo sapiens
ucucagacugcauguacca

SEQ ID NO: 1833572 - RNA, 19 nt, Homo sapiens
agguucaugaauauggugu

SEQ ID NO: 1833573 - RNA, 16 nt, Homo sapiens
caacaccccacugagc

SEQ ID NO: 1833574 - RNA, 13 nt, Homo sapiens
cuucaauguuaaa

SEQ ID NO: 1833575 - RNA, 13 nt, Homo sapiens
uaaauaugcaucu

SEQ ID NO: 1833576 - RNA, 16 nt, Homo sapiens
cugaaauaaugaucuu

SEQ ID NO: 1833577 - RNA, 22 nt, Homo sapiens
cacacauccccuuuguguagaa

SEQ ID NO: 1833578 - RNA, 17 nt, Homo sapiens
gaacauuaaauagcaaa

SEQ ID NO: 1833579 - RNA, 16 nt, Homo sapiens
aacguaagacugugua

SEQ ID NO: 1833580 - RNA, 16 nt, Homo sapiens
cagguaauacaaacua

SEQ ID NO: 1833581 - RNA, 23 nt, Homo sapiens
gagaaguuacuuuccauugcuau

SEQ ID NO: 1833582 - RNA, 13 nt, Homo sapiens
aaaugugauuucc

SEQ ID NO: 1833583 - RNA, 22 nt, Homo sapiens
auagcacugcagaaaccuuuaa

SEQ ID NO: 1833584 - RNA, 20 nt, Homo sapiens
augaauucuaaaccaaucaa

SEQ ID NO: 1833585 - RNA, 13 nt, Homo sapiens
uuuucuccaaaua

SEQ ID NO: 1833586 - RNA, 13 nt, Homo sapiens
aggcucuguggag

SEQ ID NO: 1833587 - RNA, 15 nt, Homo sapiens
uggcuuuuuccucug

SEQ ID NO: 1833588 - RNA, 13 nt, Homo sapiens
gccccagacucca

SEQ ID NO: 1833589 - RNA, 11 nt, Homo sapiens
acugcgcucuu

SEQ ID NO: 1833590 - RNA, 13 nt, Homo sapiens
uuuuuauaggcuu

SEQ ID NO: 1833591 - RNA, 14 nt, Homo sapiens
cagccagugccauu

SEQ ID NO: 1833592 - RNA, 20 nt, Homo sapiens
guuaacuuuucuaacagaaa

SEQ ID NO: 1833593 - RNA, 17 nt, Homo sapiens
ccacuagguuucaccuc

SEQ ID NO: 1833594 - RNA, 21 nt, Homo sapiens
accuguguuucaagcuaccuu

SEQ ID NO: 1833595 - RNA, 15 nt, Homo sapiens
ucuugcuauaugauu

SEQ ID NO: 1833596 - RNA, 16 nt, Homo sapiens
uacaaaacguauuuau

SEQ ID NO: 1833597 - RNA, 18 nt, Homo sapiens
aucaacauuuguuccaug

SEQ ID NO: 1833598 - RNA, 21 nt, Homo sapiens
cauacggcucuaacagauuag

SEQ ID NO: 1833599 - RNA, 21 nt, Homo sapiens
ggcucccagggacaccuggga

SEQ ID NO: 1833600 - RNA, 15 nt, Homo sapiens
cagcccaagugaaaa

SEQ ID NO: 1833601 - RNA, 19 nt, Homo sapiens
agacuuuguauauuuguua

SEQ ID NO: 1833602 - RNA, 22 nt, Homo sapiens
uuccgcacccucccuagcucug

SEQ ID NO: 1833603 - RNA, 18 nt, Homo sapiens
gccagacgugguggcuca

SEQ ID NO: 1833604 - RNA, 18 nt, Homo sapiens
gccaggcguggugacuca

SEQ ID NO: 1833605 - RNA, 20 nt, Homo sapiens
ccauucuuuagucauuccaa

SEQ ID NO: 1833606 - RNA, 20 nt, Homo sapiens
cucuuacaucuccuugauca

SEQ ID NO: 1833607 - RNA, 13 nt, Homo sapiens
aaggcaagcacca

SEQ ID NO: 1833608 - RNA, 16 nt, Homo sapiens
auggacugcuucaucu

SEQ ID NO: 1833609 - RNA, 16 nt, Homo sapiens
ucaauauuucuaguag

SEQ ID NO: 1833610 - RNA, 18 nt, Homo sapiens
aucucugcccucuucuca

SEQ ID NO: 1833611 - RNA, 19 nt, Homo sapiens
ccugaggaggaggacacag

SEQ ID NO: 1833612 - RNA, 14 nt, Homo sapiens
agcagggaugaagg

SEQ ID NO: 1833613 - RNA, 22 nt, Homo sapiens
agaauucaggcaaacguccaca

SEQ ID NO: 1833614 - RNA, 17 nt, Homo sapiens
caacucugccuuuauga

SEQ ID NO: 1833615 - RNA, 17 nt, Homo sapiens
acacuaccaauuuccca

SEQ ID NO: 1833616 - RNA, 21 nt, Homo sapiens
uaccauaugccccauucccaa

SEQ ID NO: 1833617 - RNA, 15 nt, Homo sapiens
cuaugaacuuggaua

SEQ ID NO: 1833618 - RNA, 20 nt, Homo sapiens
uuaucauauauauacauaca

SEQ ID NO: 1833619 - RNA, 20 nt, Homo sapiens
gcaauuaaaacuaugugcua

SEQ ID NO: 1833620 - RNA, 18 nt, Homo sapiens
aaaaagaguuacacugga

SEQ ID NO: 1833621 - RNA, 22 nt, Homo sapiens
agucuucauaauuucuucacuc

SEQ ID NO: 1833622 - RNA, 19 nt, Homo sapiens
auauguuguguuugguuca

SEQ ID NO: 1833623 - RNA, 19 nt, Homo sapiens
uccaauuugacaaaaccca

SEQ ID NO: 1833624 - RNA, 10 nt, Homo sapiens
uucugucacc

SEQ ID NO: 1833625 - RNA, 13 nt, Homo sapiens
gacuccacuggac

SEQ ID NO: 1833626 - RNA, 16 nt, Homo sapiens
aaggccugguguuucu

SEQ ID NO: 1833627 - RNA, 17 nt, Homo sapiens
aaccuuccaucucgcca

SEQ ID NO: 1833628 - RNA, 17 nt, Homo sapiens
uauguauaucauucuac

SEQ ID NO: 1833629 - RNA, 14 nt, Homo sapiens
uaauaaaguagcaa

SEQ ID NO: 1833630 - RNA, 16 nt, Homo sapiens
augacugcuuaacucc

SEQ ID NO: 1833631 - RNA, 13 nt, Homo sapiens
ugugccagcugug

SEQ ID NO: 1833632 - RNA, 19 nt, Homo sapiens
cagagugagacucgucuca

SEQ ID NO: 1833633 - RNA, 14 nt, Homo sapiens
cuggaaggacaucu

SEQ ID NO: 1833634 - RNA, 15 nt, Homo sapiens
aucaagaccaaagag

SEQ ID NO: 1833635 - RNA, 22 nt, Homo sapiens
aaauaauuuauaugcaugcaca

SEQ ID NO: 1833636 - RNA, 20 nt, Homo sapiens
gaccuggcugccccucaccu

SEQ ID NO: 1833637 - RNA, 13 nt, Homo sapiens
ggcaucccaagac

SEQ ID NO: 1833638 - RNA, 20 nt, Homo sapiens
aagcucccucccucacugug

SEQ ID NO: 1833639 - RNA, 22 nt, Homo sapiens
ugccugggagugugugguguua

SEQ ID NO: 1833640 - RNA, 12 nt, Homo sapiens
gaaaaauacuuu

SEQ ID NO: 1833641 - RNA, 15 nt, Homo sapiens
uaacaucaaagacuc

SEQ ID NO: 1833642 - RNA, 15 nt, Homo sapiens
uaaacuaaaagcaua

SEQ ID NO: 1833643 - RNA, 21 nt, Homo sapiens
ucuaacucuucuggaaaccaa

SEQ ID NO: 1833644 - RNA, 16 nt, Homo sapiens
cuucuggaugggacaa

SEQ ID NO: 1833645 - RNA, 17 nt, Homo sapiens
aggucuccuaaaacugg

SEQ ID NO: 1833646 - RNA, 15 nt, Homo sapiens
cuugagcuagaccaa

SEQ ID NO: 1833647 - RNA, 16 nt, Homo sapiens
ucggccuggcuccuac

SEQ ID NO: 1833648 - RNA, 17 nt, Homo sapiens
ucccauucgcaauaagu

SEQ ID NO: 1833649 - RNA, 18 nt, Homo sapiens
ugucaaaauuguuuacca

SEQ ID NO: 1833650 - RNA, 20 nt, Homo sapiens
uugcuuuucacuggcauaaa

SEQ ID NO: 1833651 - RNA, 21 nt, Homo sapiens
cauacaugacucagcauaccu

SEQ ID NO: 1833652 - RNA, 20 nt, Homo sapiens
acaaaacugcuuugugcaua

SEQ ID NO: 1833653 - RNA, 11 nt, Homo sapiens
auaagcauuua

SEQ ID NO: 1833654 - RNA, 11 nt, Homo sapiens
auuagcauuuu

SEQ ID NO: 1833655 - RNA, 21 nt, Homo sapiens
gaaucacuuuagaaagccagc

SEQ ID NO: 1833656 - RNA, 12 nt, Homo sapiens
uggcacauguca

SEQ ID NO: 1833657 - RNA, 14 nt, Homo sapiens
agaccaggugaccu

SEQ ID NO: 1833658 - RNA, 18 nt, Homo sapiens
aguaugaucucaguauuu

SEQ ID NO: 1833659 - RNA, 23 nt, Homo sapiens
ccaguaguggugacugugggcuc

SEQ ID NO: 1833660 - RNA, 17 nt, Homo sapiens
agaauguaucuccuccu

SEQ ID NO: 1833661 - RNA, 14 nt, Homo sapiens
acagacuggcaaua

SEQ ID NO: 1833662 - RNA, 13 nt, Homo sapiens
gcaguauugacaa

SEQ ID NO: 1833663 - RNA, 13 nt, Homo sapiens
auauuauucucau

SEQ ID NO: 1833664 - RNA, 13 nt, Homo sapiens
accucauuccaac

SEQ ID NO: 1833665 - RNA, 22 nt, Homo sapiens
gacauuuauccaagaccugaaa

SEQ ID NO: 1833666 - RNA, 19 nt, Homo sapiens
aacuacuguguuaugcaaa

SEQ ID NO: 1833667 - RNA, 14 nt, Homo sapiens
cauccuacaagaca

SEQ ID NO: 1833668 - RNA, 14 nt, Homo sapiens
ggaaaucuuuggug

SEQ ID NO: 1833669 - RNA, 16 nt, Homo sapiens
agauccuuucucucaa

SEQ ID NO: 1833670 - RNA, 13 nt, Homo sapiens
aggaaaugaauga

SEQ ID NO: 1833671 - RNA, 13 nt, Homo sapiens
cggggaugcauag

SEQ ID NO: 1833672 - RNA, 20 nt, Homo sapiens
cugcauguaccauuugcaug

SEQ ID NO: 1833673 - RNA, 17 nt, Homo sapiens
gaaaacugccauaacau

SEQ ID NO: 1833674 - RNA, 21 nt, Homo sapiens
aucucuaaaaugcuguucuca

SEQ ID NO: 1833675 - RNA, 23 nt, Homo sapiens
aacugucuuucauuuuugaaccc

SEQ ID NO: 1833676 - RNA, 19 nt, Homo sapiens
ucagcucggggagccuuag

SEQ ID NO: 1833677 - RNA, 20 nt, Homo sapiens
uuucaagaaaauagcuauaa

SEQ ID NO: 1833678 - RNA, 16 nt, Homo sapiens
gcagguucgugcccug

SEQ ID NO: 1833679 - RNA, 22 nt, Homo sapiens
uguuccaguuugaagaccaauc

SEQ ID NO: 1833680 - RNA, 14 nt, Homo sapiens
auccacuucucuca

SEQ ID NO: 1833681 - RNA, 14 nt, Homo sapiens
gagauggugcuaaa

SEQ ID NO: 1833682 - RNA, 15 nt, Homo sapiens
uuuccuuucauuuac

SEQ ID NO: 1833683 - RNA, 12 nt, Homo sapiens
ucucguacuuga

SEQ ID NO: 1833684 - RNA, 12 nt, Homo sapiens
agccuggcucuu

SEQ ID NO: 1833685 - RNA, 16 nt, Homo sapiens
ccagcaagguggagug

SEQ ID NO: 1833686 - RNA, 15 nt, Homo sapiens
uauuacagaaauucu

SEQ ID NO: 1833687 - RNA, 16 nt, Homo sapiens
uguaaacccucaaggg

SEQ ID NO: 1833688 - RNA, 16 nt, Homo sapiens
cacagcagcuguucaa

SEQ ID NO: 1833689 - RNA, 12 nt, Homo sapiens
ccauuuacacuu

SEQ ID NO: 1833690 - RNA, 20 nt, Homo sapiens
ucagcacaggccauggugca

SEQ ID NO: 1833691 - RNA, 23 nt, Homo sapiens
gcagucuugcaacagugccaugu

SEQ ID NO: 1833692 - RNA, 15 nt, Homo sapiens
cauuaaacugaauca

SEQ ID NO: 1833693 - RNA, 23 nt, Homo sapiens
cauuucuagacucaaaaccugga

SEQ ID NO: 1833694 - RNA, 20 nt, Homo sapiens
ucccagaggagccaccaguu

SEQ ID NO: 1833695 - RNA, 19 nt, Homo sapiens
agugccauugucuuuauau

SEQ ID NO: 1833696 - RNA, 14 nt, Homo sapiens
aaagcagauuuucc

SEQ ID NO: 1833697 - RNA, 17 nt, Homo sapiens
caugcauuggucuuaga

SEQ ID NO: 1833698 - RNA, 17 nt, Homo sapiens
gugggcuccuggcagaa

SEQ ID NO: 1833699 - RNA, 18 nt, Homo sapiens
ucaaacccuccacuucuc

SEQ ID NO: 1833700 - RNA, 18 nt, Homo sapiens
cuuaaaguuguguaucug

SEQ ID NO: 1833701 - RNA, 18 nt, Homo sapiens
ucaucccuuuuucugcua

SEQ ID NO: 1833702 - RNA, 21 nt, Homo sapiens
aacuaaucacuuucccaucuu

SEQ ID NO: 1833703 - RNA, 12 nt, Homo sapiens
uaauugcuuauu

SEQ ID NO: 1833704 - RNA, 12 nt, Homo sapiens
ccagugcuccug

SEQ ID NO: 1833705 - RNA, 19 nt, Homo sapiens
caacuagauaucaugaugu

SEQ ID NO: 1833706 - RNA, 15 nt, Homo sapiens
aaagggcaugggucg

SEQ ID NO: 1833707 - RNA, 18 nt, Homo sapiens
augugagauuacuuuguc

SEQ ID NO: 1833708 - RNA, 13 nt, Homo sapiens
gucugcuuaccaa

SEQ ID NO: 1833709 - RNA, 14 nt, Homo sapiens
aguuguugcauucc

SEQ ID NO: 1833710 - RNA, 15 nt, Homo sapiens
aguaaugguucucau

SEQ ID NO: 1833711 - RNA, 18 nt, Homo sapiens
uagauaucacuuacucag

SEQ ID NO: 1833712 - RNA, 21 nt, Homo sapiens
acaauggcgugaucucagcuc

SEQ ID NO: 1833713 - RNA, 21 nt, Homo sapiens
uucuauggguuggacaaccuc

SEQ ID NO: 1833714 - RNA, 14 nt, Homo sapiens
gcaugacagucaca

SEQ ID NO: 1833715 - RNA, 13 nt, Homo sapiens
uaacauagguuuu

SEQ ID NO: 1833716 - RNA, 20 nt, Homo sapiens
aucaauuuuucccaguauuu

SEQ ID NO: 1833717 - RNA, 12 nt, Homo sapiens
ugaagaaaggga

SEQ ID NO: 1833718 - RNA, 14 nt, Homo sapiens
uucaaguuaugauu

SEQ ID NO: 1833719 - RNA, 17 nt, Homo sapiens
ugcagagagacaacaga

SEQ ID NO: 1833720 - RNA, 21 nt, Homo sapiens
ucagaauaaauugauccuuug

SEQ ID NO: 1833721 - RNA, 14 nt, Homo sapiens
ucucccagccucuu

SEQ ID NO: 1833722 - RNA, 20 nt, Homo sapiens
aacugcuuuuccacaaggaa

SEQ ID NO: 1833723 - RNA, 17 nt, Homo sapiens
aaaaauaaaguaccaca

SEQ ID NO: 1833724 - RNA, 14 nt, Homo sapiens
uaaucagaguuuaa

SEQ ID NO: 1833725 - RNA, 20 nt, Homo sapiens
caaaauggacucaagagaga

SEQ ID NO: 1833726 - RNA, 21 nt, Homo sapiens
cugugcacggaaaagacaaga

SEQ ID NO: 1833727 - RNA, 21 nt, Homo sapiens
accugcgcucucagcugacca

SEQ ID NO: 1833728 - RNA, 17 nt, Homo sapiens
cuguuacugaauauuaa

SEQ ID NO: 1833729 - RNA, 15 nt, Homo sapiens
aauuuuuacugagaa

SEQ ID NO: 1833730 - RNA, 17 nt, Homo sapiens
uaucuagcaaucacaac

SEQ ID NO: 1833731 - RNA, 15 nt, Homo sapiens
agcugcacauuccug

SEQ ID NO: 1833732 - RNA, 11 nt, Homo sapiens
uccagaauuaa

SEQ ID NO: 1833733 - RNA, 14 nt, Homo sapiens
aucccaucugcauu

SEQ ID NO: 1833734 - RNA, 17 nt, Homo sapiens
acuggacaauguccaaa

SEQ ID NO: 1833735 - RNA, 15 nt, Homo sapiens
agguucccacucugg

SEQ ID NO: 1833736 - RNA, 19 nt, Homo sapiens
aaaguugggauuugcaaau

SEQ ID NO: 1833737 - RNA, 16 nt, Homo sapiens
aauauuuuuuacagau

SEQ ID NO: 1833738 - RNA, 16 nt, Homo sapiens
caguugcugcuucaau

SEQ ID NO: 1833739 - RNA, 12 nt, Homo sapiens
ucagccaugagg

SEQ ID NO: 1833740 - RNA, 14 nt, Homo sapiens
agggacuccaugcu

SEQ ID NO: 1833741 - RNA, 21 nt, Homo sapiens
ccagggagcaguggcugagua

SEQ ID NO: 1833742 - RNA, 21 nt, Homo sapiens
gcuauuaggaaauucugauga

SEQ ID NO: 1833743 - RNA, 18 nt, Homo sapiens
auguuuaagaaaugagaa

SEQ ID NO: 1833744 - RNA, 15 nt, Homo sapiens
aaugaucagccuugc

SEQ ID NO: 1833745 - RNA, 18 nt, Homo sapiens
guaacauaugcaaacaua

SEQ ID NO: 1833746 - RNA, 16 nt, Homo sapiens
ugccaaauauguccug

SEQ ID NO: 1833747 - RNA, 17 nt, Homo sapiens
cuuguaccuugaguuga

SEQ ID NO: 1833748 - RNA, 21 nt, Homo sapiens
uuuuaccaucacacauguuca

SEQ ID NO: 1833749 - RNA, 18 nt, Homo sapiens
aauguuuauuguucaaua

SEQ ID NO: 1833750 - RNA, 16 nt, Homo sapiens
ugacuugaaaugcucu

SEQ ID NO: 1833751 - RNA, 19 nt, Homo sapiens
acacaccucuaggacucca

SEQ ID NO: 1833752 - RNA, 17 nt, Homo sapiens
acccacuggagacuuug

SEQ ID NO: 1833753 - RNA, 15 nt, Homo sapiens
uuagcuuaguucucu

SEQ ID NO: 1833754 - RNA, 18 nt, Homo sapiens
ucgaaugaacaaagucca

SEQ ID NO: 1833755 - RNA, 17 nt, Homo sapiens
guaacauccaauaggaa

SEQ ID NO: 1833756 - RNA, 23 nt, Homo sapiens
ugcucuuuaugaaugaaaaaaca

SEQ ID NO: 1833757 - RNA, 23 nt, Homo sapiens
gagaauguuagaggaucccucuc

SEQ ID NO: 1833758 - RNA, 19 nt, Homo sapiens
aauccccacccugggcucu

SEQ ID NO: 1833759 - RNA, 21 nt, Homo sapiens
uucuaacuagaaaucugccaa

SEQ ID NO: 1833760 - RNA, 14 nt, Homo sapiens
uuuugcugcuuuau

SEQ ID NO: 1833761 - RNA, 13 nt, Homo sapiens
cuaaaaauccaga

SEQ ID NO: 1833762 - RNA, 23 nt, Homo sapiens
cugcaauaagggaaaaaugggaa

SEQ ID NO: 1833763 - RNA, 21 nt, Homo sapiens
ggaccccaccccucaucagga

SEQ ID NO: 1833764 - RNA, 17 nt, Homo sapiens
gguggauccacugugca

SEQ ID NO: 1833765 - RNA, 20 nt, Homo sapiens
aggaugauuguacagaauca

SEQ ID NO: 1833766 - RNA, 12 nt, Homo sapiens
uggacaaccaga

SEQ ID NO: 1833767 - RNA, 16 nt, Homo sapiens
ucccuuccacuaugag

SEQ ID NO: 1833768 - RNA, 15 nt, Homo sapiens
caaucauuucuauua

SEQ ID NO: 1833769 - RNA, 21 nt, Homo sapiens
ccugagcgaugggcaucacac

SEQ ID NO: 1833770 - RNA, 20 nt, Homo sapiens
ucugaguaagaaacagaauc

SEQ ID NO: 1833771 - RNA, 21 nt, Homo sapiens
uauaaaugaaucugguguugg

SEQ ID NO: 1833772 - RNA, 22 nt, Homo sapiens
aguuggaaccguguccagcaca

SEQ ID NO: 1833773 - RNA, 18 nt, Homo sapiens
ugcaaagcccagcuugaa

SEQ ID NO: 1833774 - RNA, 13 nt, Homo sapiens
acauauuugcacu

SEQ ID NO: 1833775 - RNA, 13 nt, Homo sapiens
auauuuuuguaca

SEQ ID NO: 1833776 - RNA, 19 nt, Homo sapiens
gcacugaccggugcuuuua

SEQ ID NO: 1833777 - RNA, 13 nt, Homo sapiens
cagaauugcucaa

SEQ ID NO: 1833778 - RNA, 23 nt, Homo sapiens
gaaaagcaaaucuguauaaaugu

SEQ ID NO: 1833779 - RNA, 19 nt, Homo sapiens
aggaccucucucaaugcca

SEQ ID NO: 1833780 - RNA, 13 nt, Homo sapiens
uacguaucugcuc

SEQ ID NO: 1833781 - RNA, 23 nt, Homo sapiens
aucaucuuauucagcaccaagca

SEQ ID NO: 1833782 - RNA, 17 nt, Homo sapiens
ucaaacccagacuugcu

SEQ ID NO: 1833783 - RNA, 20 nt, Homo sapiens
cacaccucacgcucuggaca

SEQ ID NO: 1833784 - RNA, 20 nt, Homo sapiens
uagacuguuagacaaaagug

SEQ ID NO: 1833785 - RNA, 22 nt, Homo sapiens
augucauauaucaaaucaucuc

SEQ ID NO: 1833786 - RNA, 15 nt, Homo sapiens
caugugucuugcaau

SEQ ID NO: 1833787 - RNA, 18 nt, Homo sapiens
gaccaacaccccucccac

SEQ ID NO: 1833788 - RNA, 21 nt, Homo sapiens
uccggagaugaauaugagcuc

SEQ ID NO: 1833789 - RNA, 20 nt, Homo sapiens
ucuaacauuugcaaaaugga

SEQ ID NO: 1833790 - RNA, 18 nt, Homo sapiens
gaaaagcacaaucaacuu

SEQ ID NO: 1833791 - RNA, 15 nt, Homo sapiens
ugccucccaucucaa

SEQ ID NO: 1833792 - RNA, 11 nt, Homo sapiens
ugauuugcaac

SEQ ID NO: 1833793 - RNA, 19 nt, Homo sapiens
uauuuugagaagcucugau

SEQ ID NO: 1833794 - RNA, 18 nt, Homo sapiens
agcuggccaccauggcac

SEQ ID NO: 1833795 - RNA, 20 nt, Homo sapiens
caccagcccagcucccgugu

SEQ ID NO: 1833796 - RNA, 14 nt, Homo sapiens
acuuuccugagcug

SEQ ID NO: 1833797 - RNA, 18 nt, Homo sapiens
aaacuaggggacaaagca

SEQ ID NO: 1833798 - RNA, 13 nt, Homo sapiens
agauacagcugcu

SEQ ID NO: 1833799 - RNA, 18 nt, Homo sapiens
ugcgaaaguaaaaacacu

SEQ ID NO: 1833800 - RNA, 22 nt, Homo sapiens
uguguagcuuuguucauugcau

SEQ ID NO: 1833801 - RNA, 12 nt, Homo sapiens
ccucuccugucc

SEQ ID NO: 1833802 - RNA, 18 nt, Homo sapiens
agaaagugacauuugcuu

SEQ ID NO: 1833803 - RNA, 23 nt, Homo sapiens
gccgagaacaccgagcacugaac

SEQ ID NO: 1833804 - RNA, 16 nt, Homo sapiens
agugacugccaaaaag

SEQ ID NO: 1833805 - RNA, 17 nt, Homo sapiens
aggcccccacuugccuc

SEQ ID NO: 1833806 - RNA, 12 nt, Homo sapiens
ugcaucugaccc

SEQ ID NO: 1833807 - RNA, 20 nt, Homo sapiens
uuaacugauuaaaaauaccu

SEQ ID NO: 1833808 - RNA, 13 nt, Homo sapiens
cauacuuguucug

SEQ ID NO: 1833809 - RNA, 17 nt, Homo sapiens
augcacaauuccaugaa

SEQ ID NO: 1833810 - RNA, 14 nt, Homo sapiens
uuuauuuugugcua

SEQ ID NO: 1833811 - RNA, 16 nt, Homo sapiens
aggggccgagccauuu

SEQ ID NO: 1833812 - RNA, 12 nt, Homo sapiens
aaauuccuuuca

SEQ ID NO: 1833813 - RNA, 13 nt, Homo sapiens
auguaugcagcua

SEQ ID NO: 1833814 - RNA, 19 nt, Homo sapiens
caaacugugaaaauagugu

SEQ ID NO: 1833815 - RNA, 11 nt, Homo sapiens
ggcucuugucc

SEQ ID NO: 1833816 - RNA, 13 nt, Homo sapiens
acccauuugauau

SEQ ID NO: 1833817 - RNA, 21 nt, Homo sapiens
uucuaagaugugauauucuaa

SEQ ID NO: 1833818 - RNA, 21 nt, Homo sapiens
aaauaccugucaauacuaugg

SEQ ID NO: 1833819 - RNA, 11 nt, Homo sapiens
guaacuacuuc

SEQ ID NO: 1833820 - RNA, 11 nt, Homo sapiens
aaagcacugac

SEQ ID NO: 1833821 - RNA, 17 nt, Homo sapiens
ugcauuuuuuaccacaa

SEQ ID NO: 1833822 - RNA, 20 nt, Homo sapiens
aggcaguguuccucaccaau

SEQ ID NO: 1833823 - RNA, 23 nt, Homo sapiens
ucacucuuugaagcgagcaguca

SEQ ID NO: 1833824 - RNA, 23 nt, Homo sapiens
auaacugaugagauacauuugau

SEQ ID NO: 1833825 - RNA, 15 nt, Homo sapiens
augauagugugauuu

SEQ ID NO: 1833826 - RNA, 18 nt, Homo sapiens
accaaggucucacacucc

SEQ ID NO: 1833827 - RNA, 20 nt, Homo sapiens
ugcagauagugccucugcaa

SEQ ID NO: 1833828 - RNA, 14 nt, Homo sapiens
aaugaaaggugaca

SEQ ID NO: 1833829 - RNA, 16 nt, Homo sapiens
ccuccagacucagcag

SEQ ID NO: 1833830 - RNA, 18 nt, Homo sapiens
cuuucaugaguuuuuccc

SEQ ID NO: 1833831 - RNA, 18 nt, Homo sapiens
uagacuguuagacaaaag

SEQ ID NO: 1833832 - RNA, 20 nt, Homo sapiens
ugagggagacaggaacggcu

SEQ ID NO: 1833833 - RNA, 12 nt, Homo sapiens
guccauaugcau

SEQ ID NO: 1833834 - RNA, 13 nt, Homo sapiens
cacagacuggcaa

SEQ ID NO: 1833835 - RNA, 14 nt, Homo sapiens
cagccugauggcca

SEQ ID NO: 1833836 - RNA, 14 nt, Homo sapiens
uguguuuuucacau

SEQ ID NO: 1833837 - RNA, 11 nt, Homo sapiens
cucccagugag

SEQ ID NO: 1833838 - RNA, 21 nt, Homo sapiens
uugagauuuagagcaaugcau

SEQ ID NO: 1833839 - RNA, 18 nt, Homo sapiens
caggcuuaaaaucagucc

SEQ ID NO: 1833840 - RNA, 16 nt, Homo sapiens
aaguucuuguugacuc

SEQ ID NO: 1833841 - RNA, 14 nt, Homo sapiens
uugaagucuucuaa

SEQ ID NO: 1833842 - RNA, 20 nt, Homo sapiens
cuuggaggacccagcacuga

SEQ ID NO: 1833843 - RNA, 13 nt, Homo sapiens
uuagaaaguaaua

SEQ ID NO: 1833844 - RNA, 16 nt, Homo sapiens
cuuugcccagacauuu

SEQ ID NO: 1833845 - RNA, 15 nt, Homo sapiens
acccaacacauggga

SEQ ID NO: 1833846 - RNA, 20 nt, Homo sapiens
cacaaucauuggaauuccuu

SEQ ID NO: 1833847 - RNA, 21 nt, Homo sapiens
ucucacgggcucuaugccugc

SEQ ID NO: 1833848 - RNA, 13 nt, Homo sapiens
uugaacacaggca

SEQ ID NO: 1833849 - RNA, 13 nt, Homo sapiens
aucagcacugccg

SEQ ID NO: 1833850 - RNA, 13 nt, Homo sapiens
auaaacacugaca

SEQ ID NO: 1833851 - RNA, 15 nt, Homo sapiens
uugaaaggaugguau

SEQ ID NO: 1833852 - RNA, 14 nt, Homo sapiens
uucuguuuggcacu

SEQ ID NO: 1833853 - RNA, 16 nt, Homo sapiens
aguaucacaaaaccac

SEQ ID NO: 1833854 - RNA, 21 nt, Homo sapiens
gagcuggugacuuuggggaca

SEQ ID NO: 1833855 - RNA, 16 nt, Homo sapiens
cugaaaggccagcagc

SEQ ID NO: 1833856 - RNA, 22 nt, Homo sapiens
cuacaguaaauguuugugaugu

SEQ ID NO: 1833857 - RNA, 15 nt, Homo sapiens
aacauuggcauuuga

SEQ ID NO: 1833858 - RNA, 15 nt, Homo sapiens
aucuagagcuuaaug

SEQ ID NO: 1833859 - RNA, 18 nt, Homo sapiens
ugccucccagguucaagu

SEQ ID NO: 1833860 - RNA, 15 nt, Homo sapiens
ucccagcaccugcca

SEQ ID NO: 1833861 - RNA, 20 nt, Homo sapiens
uagacugaagagaccacagc

SEQ ID NO: 1833862 - RNA, 23 nt, Homo sapiens
guaaaauugaaaggcauucucug

SEQ ID NO: 1833863 - RNA, 20 nt, Homo sapiens
aaacucacagaacuauguac

SEQ ID NO: 1833864 - RNA, 22 nt, Homo sapiens
gccuugacaucaguuccuuugu

SEQ ID NO: 1833865 - RNA, 18 nt, Homo sapiens
ucugaaaauauucuacug

SEQ ID NO: 1833866 - RNA, 14 nt, Homo sapiens
accagacuguguau

SEQ ID NO: 1833867 - RNA, 16 nt, Homo sapiens
ccauggaggcaugcca

SEQ ID NO: 1833868 - RNA, 20 nt, Homo sapiens
ugaaggggguggggaagaag

SEQ ID NO: 1833869 - RNA, 20 nt, Homo sapiens
ugcuaugccaagccaugucu

SEQ ID NO: 1833870 - RNA, 20 nt, Homo sapiens
ugccaucaagaaacauucag

SEQ ID NO: 1833871 - RNA, 18 nt, Homo sapiens
uuccaucagcccaucuca

SEQ ID NO: 1833872 - RNA, 18 nt, Homo sapiens
gauauuuauuuauuuucc

SEQ ID NO: 1833873 - RNA, 18 nt, Homo sapiens
cugucccauagucccugc

SEQ ID NO: 1833874 - RNA, 20 nt, Homo sapiens
guguguacaugugcacuccc

SEQ ID NO: 1833875 - RNA, 20 nt, Homo sapiens
agaccuuggcauccugugcu

SEQ ID NO: 1833876 - RNA, 19 nt, Homo sapiens
ucagaaaauuaaacuacag

SEQ ID NO: 1833877 - RNA, 11 nt, Homo sapiens
ugcacugugac

SEQ ID NO: 1833878 - RNA, 11 nt, Homo sapiens
ugaacugugaa

SEQ ID NO: 1833879 - RNA, 14 nt, Homo sapiens
gcuggcuccucugc

SEQ ID NO: 1833880 - RNA, 17 nt, Homo sapiens
cuaaagagugaaugcca

SEQ ID NO: 1833881 - RNA, 15 nt, Homo sapiens
aacagauugaaaaga

SEQ ID NO: 1833882 - RNA, 16 nt, Homo sapiens
aaauauuuccuuaaac

SEQ ID NO: 1833883 - RNA, 14 nt, Homo sapiens
acgugcaacugaca

SEQ ID NO: 1833884 - RNA, 21 nt, Homo sapiens
agauuauugugacuucacugu

SEQ ID NO: 1833885 - RNA, 17 nt, Homo sapiens
cucauuuggacuugcug

SEQ ID NO: 1833886 - RNA, 18 nt, Homo sapiens
gagccaaagcuuauguga

SEQ ID NO: 1833887 - RNA, 14 nt, Homo sapiens
ucuaguuugcaacu

SEQ ID NO: 1833888 - RNA, 16 nt, Homo sapiens
acucagugauugcaau

SEQ ID NO: 1833889 - RNA, 20 nt, Homo sapiens
cuggcccuucagucugcucc

SEQ ID NO: 1833890 - RNA, 22 nt, Homo sapiens
gagcagugauucucucuucucu

SEQ ID NO: 1833891 - RNA, 21 nt, Homo sapiens
uauaaauguuaguucuagcuc

SEQ ID NO: 1833892 - RNA, 14 nt, Homo sapiens
aagaucaucuccca

SEQ ID NO: 1833893 - RNA, 21 nt, Homo sapiens
cgccugccaguccuagcugca

SEQ ID NO: 1833894 - RNA, 17 nt, Homo sapiens
caaacguacaagucagu

SEQ ID NO: 1833895 - RNA, 22 nt, Homo sapiens
gucccagccccuccucccucag

SEQ ID NO: 1833896 - RNA, 16 nt, Homo sapiens
gaaacuaagaaucauc

SEQ ID NO: 1833897 - RNA, 15 nt, Homo sapiens
cucccucacuguggg

SEQ ID NO: 1833898 - RNA, 16 nt, Homo sapiens
uggagcuacugaugaa

SEQ ID NO: 1833899 - RNA, 14 nt, Homo sapiens
cugucucagccucc

SEQ ID NO: 1833900 - RNA, 24 nt, Homo sapiens
aguuuucaggaugagaugacagau

SEQ ID NO: 1833901 - RNA, 19 nt, Homo sapiens
ccuccacucuaguucuaga

SEQ ID NO: 1833902 - RNA, 17 nt, Homo sapiens
gcaacaauuuaugaauu

SEQ ID NO: 1833903 - RNA, 14 nt, Homo sapiens
ucuaagacauucac

SEQ ID NO: 1833904 - RNA, 14 nt, Homo sapiens
accaugacuuccuc

SEQ ID NO: 1833905 - RNA, 12 nt, Homo sapiens
cccugacacugu

SEQ ID NO: 1833906 - RNA, 23 nt, Homo sapiens
aaugaagcaauuuauaucuuuau

SEQ ID NO: 1833907 - RNA, 19 nt, Homo sapiens
acuaccuuuauagcucuca

SEQ ID NO: 1833908 - RNA, 13 nt, Homo sapiens
uuuaucugucaca

SEQ ID NO: 1833909 - RNA, 19 nt, Homo sapiens
ugcagccacuuucugccag

SEQ ID NO: 1833910 - RNA, 23 nt, Homo sapiens
aggacacacauagauaccuucaa

SEQ ID NO: 1833911 - RNA, 22 nt, Homo sapiens
auuuuucugggaaguccuagcc

SEQ ID NO: 1833912 - RNA, 19 nt, Homo sapiens
ggauguguuauucuugccc

SEQ ID NO: 1833913 - RNA, 14 nt, Homo sapiens
uuucagaacacaag

SEQ ID NO: 1833914 - RNA, 22 nt, Homo sapiens
gccuuggaggaaaugugcucaa

SEQ ID NO: 1833915 - RNA, 21 nt, Homo sapiens
guaucugauaucagcacugga

SEQ ID NO: 1833916 - RNA, 17 nt, Homo sapiens
uccagagagcagugugg

SEQ ID NO: 1833917 - RNA, 17 nt, Homo sapiens
uuaccaugucacugugg

SEQ ID NO: 1833918 - RNA, 14 nt, Homo sapiens
aaaauagcacauga

SEQ ID NO: 1833919 - RNA, 14 nt, Homo sapiens
cuucauacuuugaa

SEQ ID NO: 1833920 - RNA, 21 nt, Homo sapiens
ccaggcuguuggaaaauccag

SEQ ID NO: 1833921 - RNA, 17 nt, Homo sapiens
gauucacugccuaugaa

SEQ ID NO: 1833922 - RNA, 13 nt, Homo sapiens
cguccacugucaa

SEQ ID NO: 1833923 - RNA, 22 nt, Homo sapiens
aucauuuuauuaucaccaugca

SEQ ID NO: 1833924 - RNA, 14 nt, Homo sapiens
auaaggacacugaa

SEQ ID NO: 1833925 - RNA, 20 nt, Homo sapiens
gaacuucucguagaugcugc

SEQ ID NO: 1833926 - RNA, 22 nt, Homo sapiens
gugcucuuuguuuugugucucu

SEQ ID NO: 1833927 - RNA, 16 nt, Homo sapiens
cugccugcuccaagaa

SEQ ID NO: 1833928 - RNA, 17 nt, Homo sapiens
gaugauauuaagaacug

SEQ ID NO: 1833929 - RNA, 13 nt, Homo sapiens
gagguagugccaa

SEQ ID NO: 1833930 - RNA, 23 nt, Homo sapiens
auacauguaucugguuugucagg

SEQ ID NO: 1833931 - RNA, 20 nt, Homo sapiens
gcccucauacccaugcacag

SEQ ID NO: 1833932 - RNA, 23 nt, Homo sapiens
gauccccaaguggugaaugacac

SEQ ID NO: 1833933 - RNA, 21 nt, Homo sapiens
ggaauuacaggcacauaccac

SEQ ID NO: 1833934 - RNA, 15 nt, Homo sapiens
ccaucuucacuggcu

SEQ ID NO: 1833935 - RNA, 18 nt, Homo sapiens
uguacuuuguacaaagac

SEQ ID NO: 1833936 - RNA, 12 nt, Homo sapiens
uuucguguauau

SEQ ID NO: 1833937 - RNA, 18 nt, Homo sapiens
ggccagcccuugcucuac

SEQ ID NO: 1833938 - RNA, 17 nt, Homo sapiens
caucaauugcaugagua

SEQ ID NO: 1833939 - RNA, 18 nt, Homo sapiens
cacuggucuaauguuugu

SEQ ID NO: 1833940 - RNA, 21 nt, Homo sapiens
uacuuaggacuacauuuugcu

SEQ ID NO: 1833941 - RNA, 17 nt, Homo sapiens
aggccuuggguguucca

SEQ ID NO: 1833942 - RNA, 22 nt, Homo sapiens
acuucuaagaaaagccuaauca

SEQ ID NO: 1833943 - RNA, 16 nt, Homo sapiens
ucacucacucacucca

SEQ ID NO: 1833944 - RNA, 19 nt, Homo sapiens
ucagaaggugacaaguacu

SEQ ID NO: 1833945 - RNA, 14 nt, Homo sapiens
cagaccacuugcca

SEQ ID NO: 1833946 - RNA, 15 nt, Homo sapiens
gcaagagccacagua

SEQ ID NO: 1833947 - RNA, 21 nt, Homo sapiens
uaaagaaauaauuuuauucca

SEQ ID NO: 1833948 - RNA, 19 nt, Homo sapiens
agaaauuugccaauuuacu

SEQ ID NO: 1833949 - RNA, 20 nt, Homo sapiens
ccuaaauauaauuauccaaa

SEQ ID NO: 1833950 - RNA, 15 nt, Homo sapiens
auguaugcaccucaa

SEQ ID NO: 1833951 - RNA, 17 nt, Homo sapiens
cugcucaagauauggaa

SEQ ID NO: 1833952 - RNA, 20 nt, Homo sapiens
cuuaugaaaagaauuugaug

SEQ ID NO: 1833953 - RNA, 20 nt, Homo sapiens
acgugugugcacguacacac

SEQ ID NO: 1833954 - RNA, 16 nt, Homo sapiens
ccaauugcucuuucac

SEQ ID NO: 1833955 - RNA, 21 nt, Homo sapiens
cgugggcaagucauuguccuc

SEQ ID NO: 1833956 - RNA, 16 nt, Homo sapiens
augcucauuugccaau

SEQ ID NO: 1833957 - RNA, 12 nt, Homo sapiens
uguagauauugu

SEQ ID NO: 1833958 - RNA, 13 nt, Homo sapiens
guaacauauuuau

SEQ ID NO: 1833959 - RNA, 14 nt, Homo sapiens
cauaacccaugaag

SEQ ID NO: 1833960 - RNA, 22 nt, Homo sapiens
caggauagagugggacaguucc

SEQ ID NO: 1833961 - RNA, 17 nt, Homo sapiens
auauugguguacuguaa

SEQ ID NO: 1833962 - RNA, 14 nt, Homo sapiens
caugcaacuugauu

SEQ ID NO: 1833963 - RNA, 15 nt, Homo sapiens
guggccuaccuugug

SEQ ID NO: 1833964 - RNA, 19 nt, Homo sapiens
ucuuaacuucacuuccauu

SEQ ID NO: 1833965 - RNA, 16 nt, Homo sapiens
uccuuugcacuguuua

SEQ ID NO: 1833966 - RNA, 12 nt, Homo sapiens
gcucuugggagu

SEQ ID NO: 1833967 - RNA, 12 nt, Homo sapiens
agaaucaagucu

SEQ ID NO: 1833968 - RNA, 15 nt, Homo sapiens
gcaccaccaugccag

SEQ ID NO: 1833969 - RNA, 16 nt, Homo sapiens
ugaccagaaaauauga

SEQ ID NO: 1833970 - RNA, 14 nt, Homo sapiens
acgcacuaacccag

SEQ ID NO: 1833971 - RNA, 23 nt, Homo sapiens
gggcccccaccgccgggguccug

SEQ ID NO: 1833972 - RNA, 22 nt, Homo sapiens
gcaacgccugccuucugggcaa

SEQ ID NO: 1833973 - RNA, 18 nt, Homo sapiens
guuggccuaacacugggc

SEQ ID NO: 1833974 - RNA, 18 nt, Homo sapiens
uaacuauuaguauuauua

SEQ ID NO: 1833975 - RNA, 13 nt, Homo sapiens
ccuugcacacucc

SEQ ID NO: 1833976 - RNA, 14 nt, Homo sapiens
ccggcgucuugccc

SEQ ID NO: 1833977 - RNA, 14 nt, Homo sapiens
uaacaaauguggcu

SEQ ID NO: 1833978 - RNA, 23 nt, Homo sapiens
acugugccuuguuucaacaguuu

SEQ ID NO: 1833979 - RNA, 16 nt, Homo sapiens
ugggguuucaccauau

SEQ ID NO: 1833980 - RNA, 15 nt, Homo sapiens
cccucagagugcaag

SEQ ID NO: 1833981 - RNA, 15 nt, Homo sapiens
ugcccacucuaauau

SEQ ID NO: 1833982 - RNA, 16 nt, Homo sapiens
auagacucacauuuac

SEQ ID NO: 1833983 - RNA, 20 nt, Homo sapiens
ucugccugaaccuuccaucu

SEQ ID NO: 1833984 - RNA, 15 nt, Homo sapiens
gcuggagcccacagc

SEQ ID NO: 1833985 - RNA, 16 nt, Homo sapiens
aucauagguaacaguu

SEQ ID NO: 1833986 - RNA, 19 nt, Homo sapiens
uaaaauacuaaacuacauu

SEQ ID NO: 1833987 - RNA, 18 nt, Homo sapiens
gaaacaugccagaaggaa

SEQ ID NO: 1833988 - RNA, 14 nt, Homo sapiens
cccuccaggaagau

SEQ ID NO: 1833989 - RNA, 23 nt, Homo sapiens
acuuugccuucaaaaaugugcug

SEQ ID NO: 1833990 - RNA, 15 nt, Homo sapiens
ucuccacugacacaa

SEQ ID NO: 1833991 - RNA, 17 nt, Homo sapiens
uaaaauacacacucaaa

SEQ ID NO: 1833992 - RNA, 19 nt, Homo sapiens
acacucaauaaacagucac

SEQ ID NO: 1833993 - RNA, 16 nt, Homo sapiens
ccacucugggcacaag

SEQ ID NO: 1833994 - RNA, 21 nt, Homo sapiens
acauguuuguuucuguagaaa

SEQ ID NO: 1833995 - RNA, 12 nt, Homo sapiens
guacaugacugu

SEQ ID NO: 1833996 - RNA, 11 nt, Homo sapiens
cagcugcugaa

SEQ ID NO: 1833997 - RNA, 13 nt, Homo sapiens
cucaauggugcua

SEQ ID NO: 1833998 - RNA, 19 nt, Homo sapiens
ugcuuuaaaaugucugugu

SEQ ID NO: 1833999 - RNA, 15 nt, Homo sapiens
ugccagggaggccau

SEQ ID NO: 1834000 - RNA, 16 nt, Homo sapiens
cccucggcauucacac

SEQ ID NO: 1834001 - RNA, 17 nt, Homo sapiens
auuggccacacacugag

SEQ ID NO: 1834002 - RNA, 13 nt, Homo sapiens
auuaacaaacauc

SEQ ID NO: 1834003 - RNA, 15 nt, Homo sapiens
gaagauccacauccu

SEQ ID NO: 1834004 - RNA, 21 nt, Homo sapiens
cuggacuccacgaugccuuug

SEQ ID NO: 1834005 - RNA, 15 nt, Homo sapiens
ccaaaguaacugaau

SEQ ID NO: 1834006 - RNA, 12 nt, Homo sapiens
acauaaagccau

SEQ ID NO: 1834007 - RNA, 12 nt, Homo sapiens
aaugaaagcaug

SEQ ID NO: 1834008 - RNA, 18 nt, Homo sapiens
uucuagugauuucugggg

SEQ ID NO: 1834009 - RNA, 15 nt, Homo sapiens
uacuuauucauugug

SEQ ID NO: 1834010 - RNA, 23 nt, Homo sapiens
gaaacauagccucaccaagguga

SEQ ID NO: 1834011 - RNA, 19 nt, Homo sapiens
auguggagcucagcaacaa

SEQ ID NO: 1834012 - RNA, 15 nt, Homo sapiens
cugugccucagugag

SEQ ID NO: 1834013 - RNA, 22 nt, Homo sapiens
ggaucccaagcccugcauugua

SEQ ID NO: 1834014 - RNA, 16 nt, Homo sapiens
gagcuggaacacucuc

SEQ ID NO: 1834015 - RNA, 13 nt, Homo sapiens
uacuguacaugaa

SEQ ID NO: 1834016 - RNA, 17 nt, Homo sapiens
ggaggugagagugcaga

SEQ ID NO: 1834017 - RNA, 16 nt, Homo sapiens
uacaacauuaaggaau

SEQ ID NO: 1834018 - RNA, 11 nt, Homo sapiens
uagaaccucac

SEQ ID NO: 1834019 - RNA, 14 nt, Homo sapiens
cauagaguuuagua

SEQ ID NO: 1834020 - RNA, 16 nt, Homo sapiens
gaggaaaaacugacag

SEQ ID NO: 1834021 - RNA, 12 nt, Homo sapiens
cacuuuuuuaca

SEQ ID NO: 1834022 - RNA, 20 nt, Homo sapiens
uguuaucagucauaacuaaa

SEQ ID NO: 1834023 - RNA, 17 nt, Homo sapiens
cugagcaucacuaguga

SEQ ID NO: 1834024 - RNA, 18 nt, Homo sapiens
caugcacacccauucaca

SEQ ID NO: 1834025 - RNA, 22 nt, Homo sapiens
uaaaauaacaguaugugggaua

SEQ ID NO: 1834026 - RNA, 17 nt, Homo sapiens
ggcccagugcauaugca

SEQ ID NO: 1834027 - RNA, 23 nt, Homo sapiens
gccuuccacuuggcuacacaggg

SEQ ID NO: 1834028 - RNA, 20 nt, Homo sapiens
ugacuuccucgccucuccca

SEQ ID NO: 1834029 - RNA, 16 nt, Homo sapiens
cagcucccagccacau

SEQ ID NO: 1834030 - RNA, 21 nt, Homo sapiens
aauuggaguucauacugaugc

SEQ ID NO: 1834031 - RNA, 16 nt, Homo sapiens
cucuugaaaaaugcau

SEQ ID NO: 1834032 - RNA, 24 nt, Homo sapiens
aaauggcacuauccguguacgaau

SEQ ID NO: 1834033 - RNA, 20 nt, Homo sapiens
cuggaaaccacacuucuuga

SEQ ID NO: 1834034 - RNA, 19 nt, Homo sapiens
caugaaaauagcucuuuca

SEQ ID NO: 1834035 - RNA, 13 nt, Homo sapiens
caucacaguucac

SEQ ID NO: 1834036 - RNA, 19 nt, Homo sapiens
aguggcauuaaacauuuga

SEQ ID NO: 1834037 - RNA, 17 nt, Homo sapiens
gcaauuagacaagaacu

SEQ ID NO: 1834038 - RNA, 20 nt, Homo sapiens
aagcccuuccuaccucuggu

SEQ ID NO: 1834039 - RNA, 20 nt, Homo sapiens
uauuugucugugugcuacua

SEQ ID NO: 1834040 - RNA, 19 nt, Homo sapiens
agggucacaguaccuugaa

SEQ ID NO: 1834041 - RNA, 19 nt, Homo sapiens
gacuaugaggaauauuugc

SEQ ID NO: 1834042 - RNA, 17 nt, Homo sapiens
cauacuaauucuauguc

SEQ ID NO: 1834043 - RNA, 21 nt, Homo sapiens
acucgucuguucugaugccac

SEQ ID NO: 1834044 - RNA, 18 nt, Homo sapiens
ccuaguuuguuagugcau

SEQ ID NO: 1834045 - RNA, 21 nt, Homo sapiens
cuuuuuaaagaagugcaugaa

SEQ ID NO: 1834046 - RNA, 13 nt, Homo sapiens
uacuuucacaucu

SEQ ID NO: 1834047 - RNA, 13 nt, Homo sapiens
uaagucuaucugg

SEQ ID NO: 1834048 - RNA, 21 nt, Homo sapiens
cgcccacccacgcauacacac

SEQ ID NO: 1834049 - RNA, 15 nt, Homo sapiens
acaagggauuaucac

SEQ ID NO: 1834050 - RNA, 15 nt, Homo sapiens
acuguuaaucauggg

SEQ ID NO: 1834051 - RNA, 21 nt, Homo sapiens
cuuuucaccaggggugcucac

SEQ ID NO: 1834052 - RNA, 14 nt, Homo sapiens
ggcccgcacugggg

SEQ ID NO: 1834053 - RNA, 13 nt, Homo sapiens
agugauucuagag

SEQ ID NO: 1834054 - RNA, 15 nt, Homo sapiens
auucaaagcacuguu

SEQ ID NO: 1834055 - RNA, 14 nt, Homo sapiens
aaaacaauacauca

SEQ ID NO: 1834056 - RNA, 14 nt, Homo sapiens
ccaugaaucaaaga

SEQ ID NO: 1834057 - RNA, 14 nt, Homo sapiens
aaaaguauacaugu

SEQ ID NO: 1834058 - RNA, 22 nt, Homo sapiens
ugugauaauauauugcuaaaau

SEQ ID NO: 1834059 - RNA, 16 nt, Homo sapiens
cuuguggauaagggag

SEQ ID NO: 1834060 - RNA, 18 nt, Homo sapiens
uacagauuuaguuuacca

SEQ ID NO: 1834061 - RNA, 17 nt, Homo sapiens
uaaaaucagacucuuua

SEQ ID NO: 1834062 - RNA, 20 nt, Homo sapiens
acccccuccuccagcaauag

SEQ ID NO: 1834063 - RNA, 16 nt, Homo sapiens
cuccuccgcccagcuc

SEQ ID NO: 1834064 - RNA, 14 nt, Homo sapiens
agacugcccugggu

SEQ ID NO: 1834065 - RNA, 14 nt, Homo sapiens
gcggacaccauguu

SEQ ID NO: 1834066 - RNA, 11 nt, Homo sapiens
ugccaugucac

SEQ ID NO: 1834067 - RNA, 11 nt, Homo sapiens
uggcaugucag

SEQ ID NO: 1834068 - RNA, 14 nt, Homo sapiens
uggcaugccuucca

SEQ ID NO: 1834069 - RNA, 21 nt, Homo sapiens
ccuguuuuauaaugaacccau

SEQ ID NO: 1834070 - RNA, 18 nt, Homo sapiens
cugcuuucugauacaucu

SEQ ID NO: 1834071 - RNA, 20 nt, Homo sapiens
cauugggccaucaagccuuu

SEQ ID NO: 1834072 - RNA, 16 nt, Homo sapiens
acauuuuugugccauu

SEQ ID NO: 1834073 - RNA, 16 nt, Homo sapiens
gaagaaaagcugccau

SEQ ID NO: 1834074 - RNA, 18 nt, Homo sapiens
caaugucuucaagacuuu

SEQ ID NO: 1834075 - RNA, 15 nt, Homo sapiens
cgauggugcugcacc

SEQ ID NO: 1834076 - RNA, 11 nt, Homo sapiens
uucugacacag

SEQ ID NO: 1834077 - RNA, 22 nt, Homo sapiens
auagacuguaacuuccaaauaa

SEQ ID NO: 1834078 - RNA, 22 nt, Homo sapiens
auuuagauccugguuucauaac

SEQ ID NO: 1834079 - RNA, 16 nt, Homo sapiens
gaccuguucaaaaagg

SEQ ID NO: 1834080 - RNA, 17 nt, Homo sapiens
aaacuuaugaauguuuc

SEQ ID NO: 1834081 - RNA, 20 nt, Homo sapiens
cugagcugccuguaacuuga

SEQ ID NO: 1834082 - RNA, 21 nt, Homo sapiens
uaacuuggagccccagugcca

SEQ ID NO: 1834083 - RNA, 12 nt, Homo sapiens
ucaauagcauug

SEQ ID NO: 1834084 - RNA, 12 nt, Homo sapiens
ugaacauuucaa

SEQ ID NO: 1834085 - RNA, 18 nt, Homo sapiens
ugaaccauuacuguaauu

SEQ ID NO: 1834086 - RNA, 19 nt, Homo sapiens
caacauuccacagcugccc

SEQ ID NO: 1834087 - RNA, 20 nt, Homo sapiens
gccuuuuuuuauagcuggaa

SEQ ID NO: 1834088 - RNA, 16 nt, Homo sapiens
accaaauuccuuggca

SEQ ID NO: 1834089 - RNA, 20 nt, Homo sapiens
ucucaaacuccugagcucaa

SEQ ID NO: 1834090 - RNA, 23 nt, Homo sapiens
aucugagcaaaaugugaacuuca

SEQ ID NO: 1834091 - RNA, 16 nt, Homo sapiens
aguguuuauacaguac

SEQ ID NO: 1834092 - RNA, 18 nt, Homo sapiens
aagcugauuaaaugacac

SEQ ID NO: 1834093 - RNA, 18 nt, Homo sapiens
cuagagaaaauaaauucc

SEQ ID NO: 1834094 - RNA, 20 nt, Homo sapiens
aaguucaggcucugagacac

SEQ ID NO: 1834095 - RNA, 13 nt, Homo sapiens
cauggugcaugcc

SEQ ID NO: 1834096 - RNA, 14 nt, Homo sapiens
cuuagaaaccaaau

SEQ ID NO: 1834097 - RNA, 16 nt, Homo sapiens
uaagcacuagaucucc

SEQ ID NO: 1834098 - RNA, 21 nt, Homo sapiens
gcuacuucccagcuaaucucc

SEQ ID NO: 1834099 - RNA, 14 nt, Homo sapiens
ucugcaacagccug

SEQ ID NO: 1834100 - RNA, 19 nt, Homo sapiens
augaguuuuacauuacaaa

SEQ ID NO: 1834101 - RNA, 21 nt, Homo sapiens
uguugaaagcugaaaagcaua

SEQ ID NO: 1834102 - RNA, 23 nt, Homo sapiens
ucagaaaccaaagcuuuauuuca

SEQ ID NO: 1834103 - RNA, 22 nt, Homo sapiens
gugcuaauccaggacagcauua

SEQ ID NO: 1834104 - RNA, 18 nt, Homo sapiens
gaagcaacagcuucagaa

SEQ ID NO: 1834105 - RNA, 20 nt, Homo sapiens
auuuaacauagguuuugauu

SEQ ID NO: 1834106 - RNA, 21 nt, Homo sapiens
cagcccugaaggcaccuguca

SEQ ID NO: 1834107 - RNA, 13 nt, Homo sapiens
cagcccagagcca

SEQ ID NO: 1834108 - RNA, 19 nt, Homo sapiens
gaagaguaaaauggcuguu

SEQ ID NO: 1834109 - RNA, 16 nt, Homo sapiens
gaugcagagucagcag

SEQ ID NO: 1834110 - RNA, 18 nt, Homo sapiens
uucuugcuggcucugaga

SEQ ID NO: 1834111 - RNA, 16 nt, Homo sapiens
caaauaccacaugauu

SEQ ID NO: 1834112 - RNA, 16 nt, Homo sapiens
ugccccagagccuggg

SEQ ID NO: 1834113 - RNA, 22 nt, Homo sapiens
ugccagguggagaaaucacaga

SEQ ID NO: 1834114 - RNA, 23 nt, Homo sapiens
gccccagccguggcgugaacuga

SEQ ID NO: 1834115 - RNA, 22 nt, Homo sapiens
cacgccuguaaucccagcacuu

SEQ ID NO: 1834116 - RNA, 17 nt, Homo sapiens
ugauuugugcugagauc

SEQ ID NO: 1834117 - RNA, 20 nt, Homo sapiens
cacagcucccauaaccgcug

SEQ ID NO: 1834118 - RNA, 16 nt, Homo sapiens
cuggucgagagccaaa

SEQ ID NO: 1834119 - RNA, 18 nt, Homo sapiens
agagacgcagacaugugc

SEQ ID NO: 1834120 - RNA, 14 nt, Homo sapiens
guugaaaagcacac

SEQ ID NO: 1834121 - RNA, 16 nt, Homo sapiens
uacaccaauuaaugua

SEQ ID NO: 1834122 - RNA, 15 nt, Homo sapiens
uccugcuuccucaga

SEQ ID NO: 1834123 - RNA, 19 nt, Homo sapiens
cuuugccgugagcaugcac

SEQ ID NO: 1834124 - RNA, 22 nt, Homo sapiens
cauggaugcacgcacaugccaa

SEQ ID NO: 1834125 - RNA, 14 nt, Homo sapiens
uaaaaugacagauc

SEQ ID NO: 1834126 - RNA, 18 nt, Homo sapiens
gucgagauugcacugcug

SEQ ID NO: 1834127 - RNA, 23 nt, Homo sapiens
uacaugcuacaaaaaaguagcaa

SEQ ID NO: 1834128 - RNA, 15 nt, Homo sapiens
ugggacuuccuugcu

SEQ ID NO: 1834129 - RNA, 14 nt, Homo sapiens
uuugacacuaagaa

SEQ ID NO: 1834130 - RNA, 14 nt, Homo sapiens
uuuaacacuaaaaa

SEQ ID NO: 1834131 - RNA, 13 nt, Homo sapiens
uacauaaucuuua

SEQ ID NO: 1834132 - RNA, 15 nt, Homo sapiens
auguuugccaugagu

SEQ ID NO: 1834133 - RNA, 16 nt, Homo sapiens
acuaccucaaaggcca

SEQ ID NO: 1834134 - RNA, 15 nt, Homo sapiens
aacucuuccaccucu

SEQ ID NO: 1834135 - RNA, 20 nt, Homo sapiens
aacaugaaaaacacggcagc

SEQ ID NO: 1834136 - RNA, 14 nt, Homo sapiens
cagaggacacagag

SEQ ID NO: 1834137 - RNA, 15 nt, Homo sapiens
uggaauuuugcaaag

SEQ ID NO: 1834138 - RNA, 12 nt, Homo sapiens
gcaucagcaucc

SEQ ID NO: 1834139 - RNA, 19 nt, Homo sapiens
acaugaguggaaauacacu

SEQ ID NO: 1834140 - RNA, 18 nt, Homo sapiens
uacauuugugaacaaaaa

SEQ ID NO: 1834141 - RNA, 13 nt, Homo sapiens
guuuccaguggau

SEQ ID NO: 1834142 - RNA, 18 nt, Homo sapiens
ugaaauaaagucaaauca

SEQ ID NO: 1834143 - RNA, 15 nt, Homo sapiens
augcuggacacuaca

SEQ ID NO: 1834144 - RNA, 15 nt, Homo sapiens
ccauuucuacuguau

SEQ ID NO: 1834145 - RNA, 17 nt, Homo sapiens
uuaaagucaggauuuau

SEQ ID NO: 1834146 - RNA, 17 nt, Homo sapiens
aaccuuccugucuccca

SEQ ID NO: 1834147 - RNA, 19 nt, Homo sapiens
cauaguguuaacugucagu

SEQ ID NO: 1834148 - RNA, 13 nt, Homo sapiens
uuugaaaaacuaa

SEQ ID NO: 1834149 - RNA, 13 nt, Homo sapiens
aguccuuuaguca

SEQ ID NO: 1834150 - RNA, 13 nt, Homo sapiens
gcaccuuugcaca

SEQ ID NO: 1834151 - RNA, 17 nt, Homo sapiens
agcuggaaaaggccugu

SEQ ID NO: 1834152 - RNA, 12 nt, Homo sapiens
gcagagccuguc

SEQ ID NO: 1834153 - RNA, 19 nt, Homo sapiens
agaugucaugacaacacua

SEQ ID NO: 1834154 - RNA, 13 nt, Homo sapiens
uuagagaaacuga

SEQ ID NO: 1834155 - RNA, 14 nt, Homo sapiens
caucaccuuccuaa

SEQ ID NO: 1834156 - RNA, 20 nt, Homo sapiens
aaaauucagcggcagugugu

SEQ ID NO: 1834157 - RNA, 15 nt, Homo sapiens
augacauuucaucug

SEQ ID NO: 1834158 - RNA, 14 nt, Homo sapiens
cccagcaugcaggu

SEQ ID NO: 1834159 - RNA, 22 nt, Homo sapiens
gcaggcuguggggcagcugagc

SEQ ID NO: 1834160 - RNA, 23 nt, Homo sapiens
aaguguuggcaaacgagacuuuc

SEQ ID NO: 1834161 - RNA, 16 nt, Homo sapiens
cagacgagcagugacg

SEQ ID NO: 1834162 - RNA, 19 nt, Homo sapiens
uacacugcggaagccaaag

SEQ ID NO: 1834163 - RNA, 20 nt, Homo sapiens
aggggucccauagaggugag

SEQ ID NO: 1834164 - RNA, 15 nt, Homo sapiens
aguuuaugcuaccua

SEQ ID NO: 1834165 - RNA, 21 nt, Homo sapiens
ucagcaugccugaacuacaua

SEQ ID NO: 1834166 - RNA, 12 nt, Homo sapiens
aaugaagcuuua

SEQ ID NO: 1834167 - RNA, 15 nt, Homo sapiens
acaagcuauagcuaa

SEQ ID NO: 1834168 - RNA, 16 nt, Homo sapiens
uuauauacaagugaua

SEQ ID NO: 1834169 - RNA, 18 nt, Homo sapiens
cugggaaggggggccaua

SEQ ID NO: 1834170 - RNA, 17 nt, Homo sapiens
aggaauucuauugagug

SEQ ID NO: 1834171 - RNA, 18 nt, Homo sapiens
uauugacccucuaugaua

SEQ ID NO: 1834172 - RNA, 18 nt, Homo sapiens
accccuucccacauauaa

SEQ ID NO: 1834173 - RNA, 19 nt, Homo sapiens
auauggaaacagagcaaaa

SEQ ID NO: 1834174 - RNA, 19 nt, Homo sapiens
cuggaaacaagugacccca

SEQ ID NO: 1834175 - RNA, 13 nt, Homo sapiens
ugaauauccagaa

SEQ ID NO: 1834176 - RNA, 20 nt, Homo sapiens
cuguaaauaccauugacaca

SEQ ID NO: 1834177 - RNA, 17 nt, Homo sapiens
uaaaaugacaagcacua

SEQ ID NO: 1834178 - RNA, 23 nt, Homo sapiens
augaguguaugugccaguacuua

SEQ ID NO: 1834179 - RNA, 21 nt, Homo sapiens
ggcauuuagcacaguauuuaa

SEQ ID NO: 1834180 - RNA, 15 nt, Homo sapiens
ccuugaauguucucu

SEQ ID NO: 1834181 - RNA, 22 nt, Homo sapiens
cagaagaaaauagaauugacau

SEQ ID NO: 1834182 - RNA, 14 nt, Homo sapiens
ccuuuuuuaaggaa

SEQ ID NO: 1834183 - RNA, 18 nt, Homo sapiens
uagagcaagaacauucaa

SEQ ID NO: 1834184 - RNA, 15 nt, Homo sapiens
ggcucugcaggccac

SEQ ID NO: 1834185 - RNA, 16 nt, Homo sapiens
uguguuugguuuccca

SEQ ID NO: 1834186 - RNA, 20 nt, Homo sapiens
gcuccauagacaucaguauu

SEQ ID NO: 1834187 - RNA, 16 nt, Homo sapiens
ucuuugaaaacucaua

SEQ ID NO: 1834188 - RNA, 21 nt, Homo sapiens
cugugaacaguacaguauuua

SEQ ID NO: 1834189 - RNA, 18 nt, Homo sapiens
gaaaucagaagugcaaag

SEQ ID NO: 1834190 - RNA, 16 nt, Homo sapiens
ugacaauggaccucuc

SEQ ID NO: 1834191 - RNA, 23 nt, Homo sapiens
aaccucaguaauuuagaaaucau

SEQ ID NO: 1834192 - RNA, 19 nt, Homo sapiens
uuucagugcuuuuacuauc

SEQ ID NO: 1834193 - RNA, 17 nt, Homo sapiens
acuucugggcucugcca

SEQ ID NO: 1834194 - RNA, 13 nt, Homo sapiens
auuccccccaucu

SEQ ID NO: 1834195 - RNA, 20 nt, Homo sapiens
uauuguauuccucaugucau

SEQ ID NO: 1834196 - RNA, 23 nt, Homo sapiens
ggagucuaagccggcuuuccucu

SEQ ID NO: 1834197 - RNA, 17 nt, Homo sapiens
uccuccugcagacaccu

SEQ ID NO: 1834198 - RNA, 19 nt, Homo sapiens
aaaauauuuuuaugugcaa

SEQ ID NO: 1834199 - RNA, 21 nt, Homo sapiens
ucacacauauucuuaaugaca

SEQ ID NO: 1834200 - RNA, 13 nt, Homo sapiens
acaugacauccac

SEQ ID NO: 1834201 - RNA, 18 nt, Homo sapiens
acacuuacugcaaaggcu

SEQ ID NO: 1834202 - RNA, 20 nt, Homo sapiens
auuucagugggaaauaugcc

SEQ ID NO: 1834203 - RNA, 20 nt, Homo sapiens
ucagacaacauuaugaucua

SEQ ID NO: 1834204 - RNA, 12 nt, Homo sapiens
cccagcuccacu

SEQ ID NO: 1834205 - RNA, 17 nt, Homo sapiens
aauuagugaaccaaaaa

SEQ ID NO: 1834206 - RNA, 13 nt, Homo sapiens
cauuucuacugua

SEQ ID NO: 1834207 - RNA, 16 nt, Homo sapiens
guucugagaccagugu

SEQ ID NO: 1834208 - RNA, 14 nt, Homo sapiens
aggagaaggggaag

SEQ ID NO: 1834209 - RNA, 17 nt, Homo sapiens
gcuuuacucaagcagau

SEQ ID NO: 1834210 - RNA, 13 nt, Homo sapiens
cucagaugccacu

SEQ ID NO: 1834211 - RNA, 22 nt, Homo sapiens
gugguuuuauacugaaggaaaa

SEQ ID NO: 1834212 - RNA, 17 nt, Homo sapiens
uuuaauguuuacaacaa

SEQ ID NO: 1834213 - RNA, 17 nt, Homo sapiens
ucuagagaacacgucuu

SEQ ID NO: 1834214 - RNA, 20 nt, Homo sapiens
cuacaacaugcaucaugcuc

SEQ ID NO: 1834215 - RNA, 21 nt, Homo sapiens
gaacauacuuucuaaaugccu

SEQ ID NO: 1834216 - RNA, 15 nt, Homo sapiens
caaaggacccaaucc

SEQ ID NO: 1834217 - RNA, 14 nt, Homo sapiens
aggcucucugugaa

SEQ ID NO: 1834218 - RNA, 21 nt, Homo sapiens
uauuucucaacaaagcacagu

SEQ ID NO: 1834219 - RNA, 14 nt, Homo sapiens
augaaaaaggagag

SEQ ID NO: 1834220 - RNA, 13 nt, Homo sapiens
ucauucauccuga

SEQ ID NO: 1834221 - RNA, 23 nt, Homo sapiens
auugagcgccauaagcagaagau

SEQ ID NO: 1834222 - RNA, 15 nt, Homo sapiens
acauuuauaaacuag

SEQ ID NO: 1834223 - RNA, 18 nt, Homo sapiens
ggagacggccaagugaag

SEQ ID NO: 1834224 - RNA, 23 nt, Homo sapiens
acuaaaaaaauuuuugacacuuu

SEQ ID NO: 1834225 - RNA, 23 nt, Homo sapiens
cauguuuauaaaucuuaugcucu

SEQ ID NO: 1834226 - RNA, 14 nt, Homo sapiens
ggauccucccucau

SEQ ID NO: 1834227 - RNA, 19 nt, Homo sapiens
cuucugagcaguuuuccag

SEQ ID NO: 1834228 - RNA, 24 nt, Homo sapiens
cuuuguauccucugaccuacauac

SEQ ID NO: 1834229 - RNA, 17 nt, Homo sapiens
agaaagauuuggaaaau

SEQ ID NO: 1834230 - RNA, 19 nt, Homo sapiens
ucugcaucuccacuuggca

SEQ ID NO: 1834231 - RNA, 20 nt, Homo sapiens
uuaucuuuguauuauguguc

SEQ ID NO: 1834232 - RNA, 14 nt, Homo sapiens
aagcuaggucgugg

SEQ ID NO: 1834233 - RNA, 19 nt, Homo sapiens
cucgugauuugccugccug

SEQ ID NO: 1834234 - RNA, 22 nt, Homo sapiens
gguuuuucugauuagagugcaa

SEQ ID NO: 1834235 - RNA, 20 nt, Homo sapiens
auuuguuuugagaguucuuc

SEQ ID NO: 1834236 - RNA, 15 nt, Homo sapiens
cugcucacugcucac

SEQ ID NO: 1834237 - RNA, 17 nt, Homo sapiens
aaguaaucauauaucaa

SEQ ID NO: 1834238 - RNA, 20 nt, Homo sapiens
uucaaugccucuggcucuac

SEQ ID NO: 1834239 - RNA, 13 nt, Homo sapiens
cagaguaucagau

SEQ ID NO: 1834240 - RNA, 12 nt, Homo sapiens
ccuagagcucua

SEQ ID NO: 1834241 - RNA, 12 nt, Homo sapiens
uacagagccaca

SEQ ID NO: 1834242 - RNA, 16 nt, Homo sapiens
gggauagcgcuguuga

SEQ ID NO: 1834243 - RNA, 23 nt, Homo sapiens
augugugucuuuuuguaucucau

SEQ ID NO: 1834244 - RNA, 14 nt, Homo sapiens
uauuuuccucagag

SEQ ID NO: 1834245 - RNA, 15 nt, Homo sapiens
cuaaauacuugcucc

SEQ ID NO: 1834246 - RNA, 15 nt, Homo sapiens
ucaaaaggaaaccaa

SEQ ID NO: 1834247 - RNA, 20 nt, Homo sapiens
cagccacuuauuuccaugga

SEQ ID NO: 1834248 - RNA, 22 nt, Homo sapiens
cucugcauccauuugaacacau

SEQ ID NO: 1834249 - RNA, 22 nt, Homo sapiens
acagguauucugcugaugcuac

SEQ ID NO: 1834250 - RNA, 21 nt, Homo sapiens
ucaaugauuauuuucauuaca

SEQ ID NO: 1834251 - RNA, 21 nt, Homo sapiens
cugcccagaccccucuggcca

SEQ ID NO: 1834252 - RNA, 19 nt, Homo sapiens
uaaagaaauuuuaguaguu

SEQ ID NO: 1834253 - RNA, 13 nt, Homo sapiens
uuugcgcuaaaaa

SEQ ID NO: 1834254 - RNA, 12 nt, Homo sapiens
uggaacuggagu

SEQ ID NO: 1834255 - RNA, 13 nt, Homo sapiens
acucugagcucau

SEQ ID NO: 1834256 - RNA, 15 nt, Homo sapiens
uuguuuuccugugag

SEQ ID NO: 1834257 - RNA, 13 nt, Homo sapiens
auuauggcccagg

SEQ ID NO: 1834258 - RNA, 23 nt, Homo sapiens
ccugcgggugaacaaagcagcca

SEQ ID NO: 1834259 - RNA, 20 nt, Homo sapiens
ucuaaagcuaguaaacuucc

SEQ ID NO: 1834260 - RNA, 17 nt, Homo sapiens
uaauuacauuggcacaa

SEQ ID NO: 1834261 - RNA, 22 nt, Homo sapiens
aagucuaaacaaaauugcaauu

SEQ ID NO: 1834262 - RNA, 14 nt, Homo sapiens
auauauuuauagca

SEQ ID NO: 1834263 - RNA, 18 nt, Homo sapiens
cucagccuacuccgcuca

SEQ ID NO: 1834264 - RNA, 15 nt, Homo sapiens
gucucuccugcucuc

SEQ ID NO: 1834265 - RNA, 15 nt, Homo sapiens
guuucaucuguucau

SEQ ID NO: 1834266 - RNA, 23 nt, Homo sapiens
auucugagcaaaggcccugggua

SEQ ID NO: 1834267 - RNA, 18 nt, Homo sapiens
cccaguucaacucaugga

SEQ ID NO: 1834268 - RNA, 17 nt, Homo sapiens
ugaacggugagcauugu

SEQ ID NO: 1834269 - RNA, 14 nt, Homo sapiens
aaauauaucacuuu

SEQ ID NO: 1834270 - RNA, 17 nt, Homo sapiens
aaauuauauguuuauaa

SEQ ID NO: 1834271 - RNA, 17 nt, Homo sapiens
caugugugcgagugugu

SEQ ID NO: 1834272 - RNA, 22 nt, Homo sapiens
cauugucacagcuaccaaagug

SEQ ID NO: 1834273 - RNA, 18 nt, Homo sapiens
aaggggauggacuucauu

SEQ ID NO: 1834274 - RNA, 16 nt, Homo sapiens
caagcuguugaagucu

SEQ ID NO: 1834275 - RNA, 13 nt, Homo sapiens
gacagccuggcac

SEQ ID NO: 1834276 - RNA, 21 nt, Homo sapiens
gauuccucuaagaucuugccu

SEQ ID NO: 1834277 - RNA, 13 nt, Homo sapiens
cugugcacagcca

SEQ ID NO: 1834278 - RNA, 16 nt, Homo sapiens
ugccuggaacaccagc

SEQ ID NO: 1834279 - RNA, 12 nt, Homo sapiens
agugaaccaaaa

SEQ ID NO: 1834280 - RNA, 13 nt, Homo sapiens
ugcauuuaugauu

SEQ ID NO: 1834281 - RNA, 14 nt, Homo sapiens
uacauuuugcuugc

SEQ ID NO: 1834282 - RNA, 15 nt, Homo sapiens
cacacccaggaaggg

SEQ ID NO: 1834283 - RNA, 23 nt, Homo sapiens
uaucagaguaacgagaagacaaa

SEQ ID NO: 1834284 - RNA, 21 nt, Homo sapiens
uguucacaaacuaccucugga

SEQ ID NO: 1834285 - RNA, 14 nt, Homo sapiens
gugaggccauagca

SEQ ID NO: 1834286 - RNA, 18 nt, Homo sapiens
auuccugaauaauuucca

SEQ ID NO: 1834287 - RNA, 20 nt, Homo sapiens
cagagcccuucacugccaug

SEQ ID NO: 1834288 - RNA, 14 nt, Homo sapiens
cacuuuauggaaga

SEQ ID NO: 1834289 - RNA, 15 nt, Homo sapiens
guauuuugacacugg

SEQ ID NO: 1834290 - RNA, 16 nt, Homo sapiens
aucuguaaaucuacac

SEQ ID NO: 1834291 - RNA, 20 nt, Homo sapiens
aauucagcucuugagagcau

SEQ ID NO: 1834292 - RNA, 21 nt, Homo sapiens
uuuaauguuuauuauuuacau

SEQ ID NO: 1834293 - RNA, 18 nt, Homo sapiens
uccgaccucucuccucug

SEQ ID NO: 1834294 - RNA, 12 nt, Homo sapiens
gcugaguggacu

SEQ ID NO: 1834295 - RNA, 13 nt, Homo sapiens
uuaaaucugugaa

SEQ ID NO: 1834296 - RNA, 17 nt, Homo sapiens
agaaaggacagcucaga

SEQ ID NO: 1834297 - RNA, 15 nt, Homo sapiens
caugaaacacuucuc

SEQ ID NO: 1834298 - RNA, 12 nt, Homo sapiens
agucacuggcau

SEQ ID NO: 1834299 - RNA, 18 nt, Homo sapiens
ucugaaccccucccucca

SEQ ID NO: 1834300 - RNA, 19 nt, Homo sapiens
acauguaauuaaguacuau

SEQ ID NO: 1834301 - RNA, 15 nt, Homo sapiens
auacaauauauagcu

SEQ ID NO: 1834302 - RNA, 22 nt, Homo sapiens
uugaauuaauaucccuacaugu

SEQ ID NO: 1834303 - RNA, 14 nt, Homo sapiens
caggcugugcagcg

SEQ ID NO: 1834304 - RNA, 18 nt, Homo sapiens
ugcauugagguuuccaca

SEQ ID NO: 1834305 - RNA, 21 nt, Homo sapiens
ugguuaaauuaacauugcaua

SEQ ID NO: 1834306 - RNA, 18 nt, Homo sapiens
ugauggcccauacuugua

SEQ ID NO: 1834307 - RNA, 15 nt, Homo sapiens
cgaagggaucagccc

SEQ ID NO: 1834308 - RNA, 17 nt, Homo sapiens
aaguucauucaauucca

SEQ ID NO: 1834309 - RNA, 13 nt, Homo sapiens
aaagaagcaguuu

SEQ ID NO: 1834310 - RNA, 14 nt, Homo sapiens
gaacaaugcuauaa

SEQ ID NO: 1834311 - RNA, 14 nt, Homo sapiens
uaaaaauugucauu

SEQ ID NO: 1834312 - RNA, 13 nt, Homo sapiens
gaucccuccucca

SEQ ID NO: 1834313 - RNA, 22 nt, Homo sapiens
acaguuuugaccuaacauaccg

SEQ ID NO: 1834314 - RNA, 19 nt, Homo sapiens
gaauaaguaccuuuguguc

SEQ ID NO: 1834315 - RNA, 12 nt, Homo sapiens
uuucuguguuua

SEQ ID NO: 1834316 - RNA, 16 nt, Homo sapiens
gauaaaaaaacagcuu

SEQ ID NO: 1834317 - RNA, 23 nt, Homo sapiens
cuaugaagccaacugacaaagau

SEQ ID NO: 1834318 - RNA, 19 nt, Homo sapiens
aaauagaaaauucugccgu

SEQ ID NO: 1834319 - RNA, 19 nt, Homo sapiens
aauugggaguccaggcaca

SEQ ID NO: 1834320 - RNA, 15 nt, Homo sapiens
cauucaucuugcaag

SEQ ID NO: 1834321 - RNA, 23 nt, Homo sapiens
gugccacugcccgagcuggugca

SEQ ID NO: 1834322 - RNA, 16 nt, Homo sapiens
ucuaaugugcauuaaa

SEQ ID NO: 1834323 - RNA, 16 nt, Homo sapiens
ugguaaauuaguauuu

SEQ ID NO: 1834324 - RNA, 17 nt, Homo sapiens
aaagaaaugucugccau

SEQ ID NO: 1834325 - RNA, 17 nt, Homo sapiens
cuuucacccucaugaaa

SEQ ID NO: 1834326 - RNA, 22 nt, Homo sapiens
aaacuacaagacaauuguugaa

SEQ ID NO: 1834327 - RNA, 21 nt, Homo sapiens
aguuaaaagccuaccuaagca

SEQ ID NO: 1834328 - RNA, 16 nt, Homo sapiens
gaucccugcucucuga

SEQ ID NO: 1834329 - RNA, 22 nt, Homo sapiens
acuggcaaagcagaaugugaua

SEQ ID NO: 1834330 - RNA, 21 nt, Homo sapiens
cuccuacccuuccagugcccu

SEQ ID NO: 1834331 - RNA, 16 nt, Homo sapiens
uguauaacuaaacuaa

SEQ ID NO: 1834332 - RNA, 21 nt, Homo sapiens
auuuaagucuguccauuaucu

SEQ ID NO: 1834333 - RNA, 20 nt, Homo sapiens
gcuagaaagagaaaaagccc

SEQ ID NO: 1834334 - RNA, 22 nt, Homo sapiens
ugggcuugacaccugucuugaa

SEQ ID NO: 1834335 - RNA, 23 nt, Homo sapiens
ugcuuccccuuuugccaaucuca

SEQ ID NO: 1834336 - RNA, 19 nt, Homo sapiens
gccugugcccacgugugca

SEQ ID NO: 1834337 - RNA, 13 nt, Homo sapiens
gcccucuguggug

SEQ ID NO: 1834338 - RNA, 16 nt, Homo sapiens
aacuuaauaguauuua

SEQ ID NO: 1834339 - RNA, 22 nt, Homo sapiens
cauaugagcuuccuucugugaa

SEQ ID NO: 1834340 - RNA, 18 nt, Homo sapiens
uaaaguguuugaaagcuu

SEQ ID NO: 1834341 - RNA, 22 nt, Homo sapiens
agguagagcccacugcucauug

SEQ ID NO: 1834342 - RNA, 12 nt, Homo sapiens
cacgaugcauuu

SEQ ID NO: 1834343 - RNA, 24 nt, Homo sapiens
ucuugcuguaacucagacauucca

SEQ ID NO: 1834344 - RNA, 13 nt, Homo sapiens
agaaaaaaaagua

SEQ ID NO: 1834345 - RNA, 18 nt, Homo sapiens
uaauuccuguuacuuuac

SEQ ID NO: 1834346 - RNA, 19 nt, Homo sapiens
cuguaaauaaugugcacug

SEQ ID NO: 1834347 - RNA, 13 nt, Homo sapiens
aacauuugcacca

SEQ ID NO: 1834348 - RNA, 21 nt, Homo sapiens
uucauccaggcccaacuguga

SEQ ID NO: 1834349 - RNA, 15 nt, Homo sapiens
uggaauacacaugca

SEQ ID NO: 1834350 - RNA, 16 nt, Homo sapiens
uauauuuauacuguau

SEQ ID NO: 1834351 - RNA, 21 nt, Homo sapiens
gaccuguuuaugagaugcugg

SEQ ID NO: 1834352 - RNA, 19 nt, Homo sapiens
aaguguauuauaacagugu

SEQ ID NO: 1834353 - RNA, 15 nt, Homo sapiens
cguuaugguguuucu

SEQ ID NO: 1834354 - RNA, 21 nt, Homo sapiens
cuucuuuuguggugucuucca

SEQ ID NO: 1834355 - RNA, 13 nt, Homo sapiens
aauuguacaauaa

SEQ ID NO: 1834356 - RNA, 16 nt, Homo sapiens
uucucucuuugucccg

SEQ ID NO: 1834357 - RNA, 17 nt, Homo sapiens
cauuauguaauguccuu

SEQ ID NO: 1834358 - RNA, 19 nt, Homo sapiens
auuuuaccuagcauuucaa

SEQ ID NO: 1834359 - RNA, 15 nt, Homo sapiens
gaugauauucucacc

SEQ ID NO: 1834360 - RNA, 23 nt, Homo sapiens
ugaugacuuagcgucaagacauu

SEQ ID NO: 1834361 - RNA, 23 nt, Homo sapiens
caaagaaaaaguaaaucaaagau

SEQ ID NO: 1834362 - RNA, 11 nt, Homo sapiens
cacagucucau

SEQ ID NO: 1834363 - RNA, 21 nt, Homo sapiens
cagcaagcccgucaucuuccc

SEQ ID NO: 1834364 - RNA, 18 nt, Homo sapiens
aacauuuuacaugcagcu

SEQ ID NO: 1834365 - RNA, 22 nt, Homo sapiens
auaaaaaucuuuuuugauauga

SEQ ID NO: 1834366 - RNA, 14 nt, Homo sapiens
cugggccgggaccc

SEQ ID NO: 1834367 - RNA, 19 nt, Homo sapiens
guggguggggacagaccag

SEQ ID NO: 1834368 - RNA, 19 nt, Homo sapiens
gucagccugacucuucccu

SEQ ID NO: 1834369 - RNA, 15 nt, Homo sapiens
agacaacaccuuccu

SEQ ID NO: 1834370 - RNA, 16 nt, Homo sapiens
caauuuauugcacaaa

SEQ ID NO: 1834371 - RNA, 16 nt, Homo sapiens
ugauuuaucacacaaa

SEQ ID NO: 1834372 - RNA, 21 nt, Homo sapiens
caccccaagagaacucgcgcu

SEQ ID NO: 1834373 - RNA, 18 nt, Homo sapiens
aaucugccuauugcagcu

SEQ ID NO: 1834374 - RNA, 16 nt, Homo sapiens
augaauggggaccaug

SEQ ID NO: 1834375 - RNA, 18 nt, Homo sapiens
ccucacccgcugcccagc

SEQ ID NO: 1834376 - RNA, 17 nt, Homo sapiens
gacucccacucaguacu

SEQ ID NO: 1834377 - RNA, 12 nt, Homo sapiens
uuaaauagugug

SEQ ID NO: 1834378 - RNA, 15 nt, Homo sapiens
augaugagcauuuag

SEQ ID NO: 1834379 - RNA, 17 nt, Homo sapiens
aauugauuaaacuguau

SEQ ID NO: 1834380 - RNA, 17 nt, Homo sapiens
aacagaaauuaaucuua

SEQ ID NO: 1834381 - RNA, 14 nt, Homo sapiens
ucagcucuugucaa

SEQ ID NO: 1834382 - RNA, 23 nt, Homo sapiens
gaggauaccccaaaguccaggcu

SEQ ID NO: 1834383 - RNA, 20 nt, Homo sapiens
gauaacucaggaagccucug

SEQ ID NO: 1834384 - RNA, 14 nt, Homo sapiens
ucuucuaacacaaa

SEQ ID NO: 1834385 - RNA, 19 nt, Homo sapiens
acuaauuauacuacuuugu

SEQ ID NO: 1834386 - RNA, 18 nt, Homo sapiens
uggaaacuguaccauaca

SEQ ID NO: 1834387 - RNA, 14 nt, Homo sapiens
acuguagggccagg

SEQ ID NO: 1834388 - RNA, 18 nt, Homo sapiens
aacuuaagccaauuucaa

SEQ ID NO: 1834389 - RNA, 22 nt, Homo sapiens
cuggaaaagggucuugggaaau

SEQ ID NO: 1834390 - RNA, 20 nt, Homo sapiens
accacagagggcaggggaug

SEQ ID NO: 1834391 - RNA, 21 nt, Homo sapiens
gaaugcuccauucaggccuau

SEQ ID NO: 1834392 - RNA, 15 nt, Homo sapiens
ccagacucucaggug

SEQ ID NO: 1834393 - RNA, 15 nt, Homo sapiens
gugaaguucacuucc

SEQ ID NO: 1834394 - RNA, 21 nt, Homo sapiens
aguauuuuguguccuccagga

SEQ ID NO: 1834395 - RNA, 18 nt, Homo sapiens
cagagaucuauaaacaga

SEQ ID NO: 1834396 - RNA, 14 nt, Homo sapiens
acuuagaaugccau

SEQ ID NO: 1834397 - RNA, 17 nt, Homo sapiens
gggcaacacucacugcc

SEQ ID NO: 1834398 - RNA, 20 nt, Homo sapiens
uguaucuuccuuucuugucu

SEQ ID NO: 1834399 - RNA, 14 nt, Homo sapiens
caguuucuucaugc

SEQ ID NO: 1834400 - RNA, 19 nt, Homo sapiens
aauaugugaaaaugauuag

SEQ ID NO: 1834401 - RNA, 14 nt, Homo sapiens
aucugggaaaauac

SEQ ID NO: 1834402 - RNA, 22 nt, Homo sapiens
uugagcaguggcugguccaggg

SEQ ID NO: 1834403 - RNA, 19 nt, Homo sapiens
gacaacauuauaacuguau

SEQ ID NO: 1834404 - RNA, 21 nt, Homo sapiens
agccauuauucucugaugcac

SEQ ID NO: 1834405 - RNA, 21 nt, Homo sapiens
acucguguucacucagcacuu

SEQ ID NO: 1834406 - RNA, 20 nt, Homo sapiens
ccuggaggagcugugcugcc

SEQ ID NO: 1834407 - RNA, 20 nt, Homo sapiens
aauguuagucccuaaccacu

SEQ ID NO: 1834408 - RNA, 22 nt, Homo sapiens
agugcaaggcaggggcacggug

SEQ ID NO: 1834409 - RNA, 12 nt, Homo sapiens
uuaauguacaaa

SEQ ID NO: 1834410 - RNA, 17 nt, Homo sapiens
ucagacauuuucacugg

SEQ ID NO: 1834411 - RNA, 22 nt, Homo sapiens
uccaagggguagucugccuucc

SEQ ID NO: 1834412 - RNA, 14 nt, Homo sapiens
uagauauaugccuu

SEQ ID NO: 1834413 - RNA, 14 nt, Homo sapiens
ccacgcccccaugc

SEQ ID NO: 1834414 - RNA, 14 nt, Homo sapiens
auauauccauacau

SEQ ID NO: 1834415 - RNA, 19 nt, Homo sapiens
caggaaaucaaauaugcaa

SEQ ID NO: 1834416 - RNA, 14 nt, Homo sapiens
ucuuuaaacaguuu

SEQ ID NO: 1834417 - RNA, 18 nt, Homo sapiens
aaauuauggaauaucauc

SEQ ID NO: 1834418 - RNA, 16 nt, Homo sapiens
uguggacgugcacuga

SEQ ID NO: 1834419 - RNA, 16 nt, Homo sapiens
acgccuggcuaauaag

SEQ ID NO: 1834420 - RNA, 15 nt, Homo sapiens
auuccaggaacacau

SEQ ID NO: 1834421 - RNA, 23 nt, Homo sapiens
aaacuugaaguagguagcaacgu

SEQ ID NO: 1834422 - RNA, 13 nt, Homo sapiens
aggggcauugcug

SEQ ID NO: 1834423 - RNA, 16 nt, Homo sapiens
cuccugcacuguuuaa

SEQ ID NO: 1834424 - RNA, 19 nt, Homo sapiens
ggccaucucuaagauguca

SEQ ID NO: 1834425 - RNA, 18 nt, Homo sapiens
ugaccacagcacagccaa

SEQ ID NO: 1834426 - RNA, 21 nt, Homo sapiens
auccaaauugccugaacaugg

SEQ ID NO: 1834427 - RNA, 22 nt, Homo sapiens
uaaagagaaagcccgcuuuagu

SEQ ID NO: 1834428 - RNA, 21 nt, Homo sapiens
uggaaaacagcgaacagccuu

SEQ ID NO: 1834429 - RNA, 14 nt, Homo sapiens
cuugggccaagcca

SEQ ID NO: 1834430 - RNA, 21 nt, Homo sapiens
ggcagagcaauuccaggcuga

SEQ ID NO: 1834431 - RNA, 18 nt, Homo sapiens
uaaaacccaaaacaguaa

SEQ ID NO: 1834432 - RNA, 21 nt, Homo sapiens
ucacuagaaaagcugaucaua

SEQ ID NO: 1834433 - RNA, 23 nt, Homo sapiens
gcuuuguugaaugaagcagagaa

SEQ ID NO: 1834434 - RNA, 23 nt, Homo sapiens
agaaacuguguauagcuuaccug

SEQ ID NO: 1834435 - RNA, 18 nt, Homo sapiens
gaauugaacgacuaccca

SEQ ID NO: 1834436 - RNA, 14 nt, Homo sapiens
uaauuaaaaccauc

SEQ ID NO: 1834437 - RNA, 22 nt, Homo sapiens
agcuuugucucugucacaucag

SEQ ID NO: 1834438 - RNA, 21 nt, Homo sapiens
augcagcaggugcaaggcagc

SEQ ID NO: 1834439 - RNA, 22 nt, Homo sapiens
guuccaaaagaguccaugugga

SEQ ID NO: 1834440 - RNA, 22 nt, Homo sapiens
cuuugcccauggaagucucaaa

SEQ ID NO: 1834441 - RNA, 12 nt, Homo sapiens
aacuuuuaucua

SEQ ID NO: 1834442 - RNA, 13 nt, Homo sapiens
ugucaccauugug

SEQ ID NO: 1834443 - RNA, 11 nt, Homo sapiens
uagaaaugcca

SEQ ID NO: 1834444 - RNA, 15 nt, Homo sapiens
ugugucaugcaugaa

SEQ ID NO: 1834445 - RNA, 17 nt, Homo sapiens
ccacagcacagcucccu

SEQ ID NO: 1834446 - RNA, 18 nt, Homo sapiens
ggaggccguucagcugug

SEQ ID NO: 1834447 - RNA, 15 nt, Homo sapiens
augaaaugcucuccu

SEQ ID NO: 1834448 - RNA, 17 nt, Homo sapiens
cuacuagccauugggaa

SEQ ID NO: 1834449 - RNA, 13 nt, Homo sapiens
ggccaccucccac

SEQ ID NO: 1834450 - RNA, 20 nt, Homo sapiens
ucaaggaauguuaucaguau

SEQ ID NO: 1834451 - RNA, 22 nt, Homo sapiens
agcacuuuaacccucucuuccc

SEQ ID NO: 1834452 - RNA, 19 nt, Homo sapiens
uuaggaaagcagugcagua

SEQ ID NO: 1834453 - RNA, 15 nt, Homo sapiens
cuguugcccauugca

SEQ ID NO: 1834454 - RNA, 17 nt, Homo sapiens
ugccccagacacagugc

SEQ ID NO: 1834455 - RNA, 22 nt, Homo sapiens
cucccucagacccaggagucca

SEQ ID NO: 1834456 - RNA, 23 nt, Homo sapiens
uauuuuggaggugcuugaucuau

SEQ ID NO: 1834457 - RNA, 19 nt, Homo sapiens
ggacuauggccacauucaa

SEQ ID NO: 1834458 - RNA, 15 nt, Homo sapiens
ccucugggaucugcc

SEQ ID NO: 1834459 - RNA, 18 nt, Homo sapiens
gccuuuggaaagacuuga

SEQ ID NO: 1834460 - RNA, 22 nt, Homo sapiens
aauuugugugacagacuccgaa

SEQ ID NO: 1834461 - RNA, 16 nt, Homo sapiens
agccacuguaugauuc

SEQ ID NO: 1834462 - RNA, 20 nt, Homo sapiens
cagcuuugcucauauuuccc

SEQ ID NO: 1834463 - RNA, 21 nt, Homo sapiens
caagacagaggggagcagugg

SEQ ID NO: 1834464 - RNA, 14 nt, Homo sapiens
gaggccccaggugg

SEQ ID NO: 1834465 - RNA, 15 nt, Homo sapiens
uuaugaugaaaaccu

SEQ ID NO: 1834466 - RNA, 19 nt, Homo sapiens
acacugaucacuuccccaa

SEQ ID NO: 1834467 - RNA, 22 nt, Homo sapiens
aggcuggcagugacagaacuaa

SEQ ID NO: 1834468 - RNA, 13 nt, Homo sapiens
acacacuauggca

SEQ ID NO: 1834469 - RNA, 17 nt, Homo sapiens
acauacgugcacagggu

SEQ ID NO: 1834470 - RNA, 19 nt, Homo sapiens
uacauucuccuuuuugccc

SEQ ID NO: 1834471 - RNA, 19 nt, Homo sapiens
agacaggguuuugccaugu

SEQ ID NO: 1834472 - RNA, 23 nt, Homo sapiens
uugcaugccaucuccacccugag

SEQ ID NO: 1834473 - RNA, 18 nt, Homo sapiens
acaugagaagaagcacga

SEQ ID NO: 1834474 - RNA, 20 nt, Homo sapiens
uacccaguaaaaauccacua

SEQ ID NO: 1834475 - RNA, 14 nt, Homo sapiens
uauaaauaagcacu

SEQ ID NO: 1834476 - RNA, 15 nt, Homo sapiens
ugaccacucagagac

SEQ ID NO: 1834477 - RNA, 21 nt, Homo sapiens
uagaguaacacauaacauugu

SEQ ID NO: 1834478 - RNA, 13 nt, Homo sapiens
cuccccaauccag

SEQ ID NO: 1834479 - RNA, 21 nt, Homo sapiens
gggccuggggauguaaccaag

SEQ ID NO: 1834480 - RNA, 11 nt, Homo sapiens
cccagugcaaa

SEQ ID NO: 1834481 - RNA, 20 nt, Homo sapiens
agcaucccccaaaguucaca

SEQ ID NO: 1834482 - RNA, 20 nt, Homo sapiens
aguucuuaaacucagaauau

SEQ ID NO: 1834483 - RNA, 19 nt, Homo sapiens
gaauucuaagcuggugccc

SEQ ID NO: 1834484 - RNA, 15 nt, Homo sapiens
gcucaucauucucug

SEQ ID NO: 1834485 - RNA, 11 nt, Homo sapiens
uacaauuuugu

SEQ ID NO: 1834486 - RNA, 21 nt, Homo sapiens
augacauuucacugaugcuuc

SEQ ID NO: 1834487 - RNA, 14 nt, Homo sapiens
cgaaaccugugauu

SEQ ID NO: 1834488 - RNA, 15 nt, Homo sapiens
agcauggacucuggg

SEQ ID NO: 1834489 - RNA, 20 nt, Homo sapiens
uaccuugaacucuuagugau

SEQ ID NO: 1834490 - RNA, 23 nt, Homo sapiens
ccacaguugcucuaugcuuucca

SEQ ID NO: 1834491 - RNA, 14 nt, Homo sapiens
cugugccuuuugcc

SEQ ID NO: 1834492 - RNA, 14 nt, Homo sapiens
agccucagccuccc

SEQ ID NO: 1834493 - RNA, 17 nt, Homo sapiens
gauauuuucacacuggu

SEQ ID NO: 1834494 - RNA, 15 nt, Homo sapiens
uaccagcaucuccca

SEQ ID NO: 1834495 - RNA, 22 nt, Homo sapiens
caagcacuggacuacaagggca

SEQ ID NO: 1834496 - RNA, 16 nt, Homo sapiens
uuacagcaaauccuuu

SEQ ID NO: 1834497 - RNA, 16 nt, Homo sapiens
caggugucuagacugc

SEQ ID NO: 1834498 - RNA, 23 nt, Homo sapiens
uaguuaagagaauaaacuagauc

SEQ ID NO: 1834499 - RNA, 22 nt, Homo sapiens
guggcauucucucugcucagug

SEQ ID NO: 1834500 - RNA, 16 nt, Homo sapiens
ugauggaagcaccuaa

SEQ ID NO: 1834501 - RNA, 23 nt, Homo sapiens
guaaggauguauguggugaaaac

SEQ ID NO: 1834502 - RNA, 17 nt, Homo sapiens
cuaaacaaaauugcaau

SEQ ID NO: 1834503 - RNA, 16 nt, Homo sapiens
agcuaaacauugugau

SEQ ID NO: 1834504 - RNA, 11 nt, Homo sapiens
aaaaugcuuuc

SEQ ID NO: 1834505 - RNA, 13 nt, Homo sapiens
aauguuugcugag

SEQ ID NO: 1834506 - RNA, 14 nt, Homo sapiens
uuuucuaucaaaua

SEQ ID NO: 1834507 - RNA, 20 nt, Homo sapiens
ucccacaugaggccaucuca

SEQ ID NO: 1834508 - RNA, 14 nt, Homo sapiens
ggcaagauagcucc

SEQ ID NO: 1834509 - RNA, 16 nt, Homo sapiens
guccaaacugccuaag

SEQ ID NO: 1834510 - RNA, 21 nt, Homo sapiens
uuugcuauggggacauuccaa

SEQ ID NO: 1834511 - RNA, 20 nt, Homo sapiens
aaggguaggcucaaaacagg

SEQ ID NO: 1834512 - RNA, 17 nt, Homo sapiens
acuccaguacucuguaa

SEQ ID NO: 1834513 - RNA, 15 nt, Homo sapiens
gucuugcucugucac

SEQ ID NO: 1834514 - RNA, 13 nt, Homo sapiens
gcacuccaucacu

SEQ ID NO: 1834515 - RNA, 16 nt, Homo sapiens
acuuagagaaccuaua

SEQ ID NO: 1834516 - RNA, 20 nt, Homo sapiens
auacagcuuuuugcaguaug

SEQ ID NO: 1834517 - RNA, 20 nt, Homo sapiens
auucauuucaucuacuacag

SEQ ID NO: 1834518 - RNA, 18 nt, Homo sapiens
uuuuaucuagaacauuca

SEQ ID NO: 1834519 - RNA, 16 nt, Homo sapiens
auccauguccugaaaa

SEQ ID NO: 1834520 - RNA, 16 nt, Homo sapiens
ucaaaaugaugcaacc

SEQ ID NO: 1834521 - RNA, 13 nt, Homo sapiens
aaaaauuagcuua

SEQ ID NO: 1834522 - RNA, 19 nt, Homo sapiens
uaaagugacauaauuuaca

SEQ ID NO: 1834523 - RNA, 17 nt, Homo sapiens
uagaaacaauacuguuc

SEQ ID NO: 1834524 - RNA, 17 nt, Homo sapiens
aauagagaucaguuugu

SEQ ID NO: 1834525 - RNA, 19 nt, Homo sapiens
ggguuuccauggcuuccca

SEQ ID NO: 1834526 - RNA, 16 nt, Homo sapiens
cccacagccaaguaga

SEQ ID NO: 1834527 - RNA, 16 nt, Homo sapiens
aagugccauaaccaug

SEQ ID NO: 1834528 - RNA, 13 nt, Homo sapiens
acccagccucuag

SEQ ID NO: 1834529 - RNA, 20 nt, Homo sapiens
aguaaauugacguacuugca

SEQ ID NO: 1834530 - RNA, 18 nt, Homo sapiens
cgucaggaaaccaaauaa

SEQ ID NO: 1834531 - RNA, 15 nt, Homo sapiens
ugaagagauugcuga

SEQ ID NO: 1834532 - RNA, 15 nt, Homo sapiens
augacauaagugcua

SEQ ID NO: 1834533 - RNA, 14 nt, Homo sapiens
caggucaaaaguca

SEQ ID NO: 1834534 - RNA, 16 nt, Homo sapiens
uuugccuaauggcaaa

SEQ ID NO: 1834535 - RNA, 19 nt, Homo sapiens
cugugaauugccuguaaca

SEQ ID NO: 1834536 - RNA, 18 nt, Homo sapiens
uucacuuggccaguuuca

SEQ ID NO: 1834537 - RNA, 19 nt, Homo sapiens
cugacaaaaggcuccaguu

SEQ ID NO: 1834538 - RNA, 15 nt, Homo sapiens
uaccacauucacuac

SEQ ID NO: 1834539 - RNA, 20 nt, Homo sapiens
gaauuuuucuaaaggugcua

SEQ ID NO: 1834540 - RNA, 21 nt, Homo sapiens
aagauuuuauucuuauuucau

SEQ ID NO: 1834541 - RNA, 13 nt, Homo sapiens
gcccuuaccuguc

SEQ ID NO: 1834542 - RNA, 21 nt, Homo sapiens
uguaccucccccugccuucca

SEQ ID NO: 1834543 - RNA, 16 nt, Homo sapiens
gaucuacccucuaguu

SEQ ID NO: 1834544 - RNA, 16 nt, Homo sapiens
gcuucuccugugugau

SEQ ID NO: 1834545 - RNA, 14 nt, Homo sapiens
aaucuuuaaaccaa

SEQ ID NO: 1834546 - RNA, 19 nt, Homo sapiens
gaaaaacuaaacuacagaa

SEQ ID NO: 1834547 - RNA, 16 nt, Homo sapiens
ucaccaaaugcuuuuu

SEQ ID NO: 1834548 - RNA, 21 nt, Homo sapiens
agaaauuggaagaagcacuga

SEQ ID NO: 1834549 - RNA, 13 nt, Homo sapiens
aaagucacauaaa

SEQ ID NO: 1834550 - RNA, 13 nt, Homo sapiens
uaagucacuuaaa

SEQ ID NO: 1834551 - RNA, 16 nt, Homo sapiens
acccuuagccacuuca

SEQ ID NO: 1834552 - RNA, 18 nt, Homo sapiens
uuuacacucucuguacaa

SEQ ID NO: 1834553 - RNA, 21 nt, Homo sapiens
uaucaccuagcagccucaaaa

SEQ ID NO: 1834554 - RNA, 18 nt, Homo sapiens
aagggacugguccaggca

SEQ ID NO: 1834555 - RNA, 13 nt, Homo sapiens
ggucccucugugu

SEQ ID NO: 1834556 - RNA, 13 nt, Homo sapiens
ucucucucgcugc

SEQ ID NO: 1834557 - RNA, 16 nt, Homo sapiens
ggcagcaggguggccu

SEQ ID NO: 1834558 - RNA, 16 nt, Homo sapiens
uucucugugucuaaga

SEQ ID NO: 1834559 - RNA, 11 nt, Homo sapiens
acuucaucugg

SEQ ID NO: 1834560 - RNA, 15 nt, Homo sapiens
uuggaauuuugugcc

SEQ ID NO: 1834561 - RNA, 21 nt, Homo sapiens
caaguuauuaauuucuucaca

SEQ ID NO: 1834562 - RNA, 22 nt, Homo sapiens
aggagugggaaaacacugccau

SEQ ID NO: 1834563 - RNA, 20 nt, Homo sapiens
cugggcacugguaaucccaa

SEQ ID NO: 1834564 - RNA, 21 nt, Homo sapiens
uccugugcuuuccucucuuca

SEQ ID NO: 1834565 - RNA, 16 nt, Homo sapiens
cgcccgcauagcacuu

SEQ ID NO: 1834566 - RNA, 12 nt, Homo sapiens
cccucucugcac

SEQ ID NO: 1834567 - RNA, 13 nt, Homo sapiens
aaaggggcccaag

SEQ ID NO: 1834568 - RNA, 16 nt, Homo sapiens
ggguuuugacuugcca

SEQ ID NO: 1834569 - RNA, 14 nt, Homo sapiens
cuagucaaugacau

SEQ ID NO: 1834570 - RNA, 14 nt, Homo sapiens
cggagaguacagug

SEQ ID NO: 1834571 - RNA, 17 nt, Homo sapiens
cacucaguuuaugcugu

SEQ ID NO: 1834572 - RNA, 21 nt, Homo sapiens
aaagcccuuguccccaugaaa

SEQ ID NO: 1834573 - RNA, 21 nt, Homo sapiens
ugacugcugaauuaaugugau

SEQ ID NO: 1834574 - RNA, 14 nt, Homo sapiens
cagagauggccaug

SEQ ID NO: 1834575 - RNA, 17 nt, Homo sapiens
agcacuggccuugccuc

SEQ ID NO: 1834576 - RNA, 15 nt, Homo sapiens
gguucccaucauuuc

SEQ ID NO: 1834577 - RNA, 23 nt, Homo sapiens
cagcuauuuucaacauaacugaa

SEQ ID NO: 1834578 - RNA, 16 nt, Homo sapiens
agacaucagcccuugg

SEQ ID NO: 1834579 - RNA, 18 nt, Homo sapiens
cuuucagaguuugguuaa

SEQ ID NO: 1834580 - RNA, 16 nt, Homo sapiens
gagucugccacccagg

SEQ ID NO: 1834581 - RNA, 16 nt, Homo sapiens
cuagaauucacuccac

SEQ ID NO: 1834582 - RNA, 22 nt, Homo sapiens
agaaaaugauguguacccaaac

SEQ ID NO: 1834583 - RNA, 23 nt, Homo sapiens
agcuuucagacuccagcugugaa

SEQ ID NO: 1834584 - RNA, 14 nt, Homo sapiens
augaugccaaaaua

SEQ ID NO: 1834585 - RNA, 14 nt, Homo sapiens
aaaggggagaggga

SEQ ID NO: 1834586 - RNA, 20 nt, Homo sapiens
gccucccaaggaaaauggac

SEQ ID NO: 1834587 - RNA, 15 nt, Homo sapiens
uaccaguuuuccaga

SEQ ID NO: 1834588 - RNA, 20 nt, Homo sapiens
cuugggucucagcugcugac

SEQ ID NO: 1834589 - RNA, 22 nt, Homo sapiens
ggacgaaaaacacagugcacuc

SEQ ID NO: 1834590 - RNA, 15 nt, Homo sapiens
uccucuuugcaugga

SEQ ID NO: 1834591 - RNA, 20 nt, Homo sapiens
gcaauuuuucaagagcuccu

SEQ ID NO: 1834592 - RNA, 18 nt, Homo sapiens
ucucugucucucugucuc

SEQ ID NO: 1834593 - RNA, 20 nt, Homo sapiens
acaagugcccagccugugga

SEQ ID NO: 1834594 - RNA, 23 nt, Homo sapiens
aguuugcauuaauaauccuucca

SEQ ID NO: 1834595 - RNA, 13 nt, Homo sapiens
ugcuggugcacag

SEQ ID NO: 1834596 - RNA, 21 nt, Homo sapiens
guaaucuagguguggcuguga

SEQ ID NO: 1834597 - RNA, 17 nt, Homo sapiens
aaucuacaaacuuuuau

SEQ ID NO: 1834598 - RNA, 15 nt, Homo sapiens
aaaaugcauguugcc

SEQ ID NO: 1834599 - RNA, 21 nt, Homo sapiens
auaggaguggguauuaugcaa

SEQ ID NO: 1834600 - RNA, 12 nt, Homo sapiens
accaaaguccag

SEQ ID NO: 1834601 - RNA, 20 nt, Homo sapiens
gacauuuccaagcagacugu

SEQ ID NO: 1834602 - RNA, 16 nt, Homo sapiens
gugcccaugggguaga

SEQ ID NO: 1834603 - RNA, 22 nt, Homo sapiens
gggauuucucccucucagugga

SEQ ID NO: 1834604 - RNA, 15 nt, Homo sapiens
gaucucggugcugaa

SEQ ID NO: 1834605 - RNA, 21 nt, Homo sapiens
uaaguuaagugcauugaucau

SEQ ID NO: 1834606 - RNA, 11 nt, Homo sapiens
uucugcaauga

SEQ ID NO: 1834607 - RNA, 19 nt, Homo sapiens
uuccuauaauaaaauggca

SEQ ID NO: 1834608 - RNA, 20 nt, Homo sapiens
uggaguggggaaguguguca

SEQ ID NO: 1834609 - RNA, 15 nt, Homo sapiens
caaacacagcucucu

SEQ ID NO: 1834610 - RNA, 17 nt, Homo sapiens
auaaaggaaacauauaa

SEQ ID NO: 1834611 - RNA, 15 nt, Homo sapiens
agcauaacaaaaaga

SEQ ID NO: 1834612 - RNA, 14 nt, Homo sapiens
aauuuaucuuucaa

SEQ ID NO: 1834613 - RNA, 14 nt, Homo sapiens
gucucuacccagua

SEQ ID NO: 1834614 - RNA, 12 nt, Homo sapiens
ggagcucaguua

SEQ ID NO: 1834615 - RNA, 17 nt, Homo sapiens
agcaugugaaagugcac

SEQ ID NO: 1834616 - RNA, 18 nt, Homo sapiens
auauuaagcaaacacuug

SEQ ID NO: 1834617 - RNA, 18 nt, Homo sapiens
aacagaagacagcugcug

SEQ ID NO: 1834618 - RNA, 12 nt, Homo sapiens
gaguauccucuu

SEQ ID NO: 1834619 - RNA, 12 nt, Homo sapiens
gagcauccucuc

SEQ ID NO: 1834620 - RNA, 13 nt, Homo sapiens
gaggaauacuucu

SEQ ID NO: 1834621 - RNA, 19 nt, Homo sapiens
caggcugggcaucauagca

SEQ ID NO: 1834622 - RNA, 15 nt, Homo sapiens
uacuagggaaguuga

SEQ ID NO: 1834623 - RNA, 13 nt, Homo sapiens
ucauauggagcuc

SEQ ID NO: 1834624 - RNA, 15 nt, Homo sapiens
uucuguugccaguca

SEQ ID NO: 1834625 - RNA, 15 nt, Homo sapiens
ccucuagaagccaag

SEQ ID NO: 1834626 - RNA, 14 nt, Homo sapiens
uucuaggggugccu

SEQ ID NO: 1834627 - RNA, 22 nt, Homo sapiens
cuaugucuuguuuuaaguugcu

SEQ ID NO: 1834628 - RNA, 22 nt, Homo sapiens
acguagccugggcucacugugc

SEQ ID NO: 1834629 - RNA, 9 nt, Homo sapiens
uaaagcagu

SEQ ID NO: 1834630 - RNA, 19 nt, Homo sapiens
gucugaucccugccaaaaa

SEQ ID NO: 1834631 - RNA, 22 nt, Homo sapiens
acuaaccaucugaagaaacuuc

SEQ ID NO: 1834632 - RNA, 16 nt, Homo sapiens
cuguuaaaaauaauua

SEQ ID NO: 1834633 - RNA, 20 nt, Homo sapiens
caauucaguuuuaguuucaa

SEQ ID NO: 1834634 - RNA, 13 nt, Homo sapiens
uguuaaaauaacu

SEQ ID NO: 1834635 - RNA, 18 nt, Homo sapiens
ucucauaacucugugauc

SEQ ID NO: 1834636 - RNA, 14 nt, Homo sapiens
ucacacgcuuuuga

SEQ ID NO: 1834637 - RNA, 22 nt, Homo sapiens
agaaaaauccgcuuuucugcca

SEQ ID NO: 1834638 - RNA, 15 nt, Homo sapiens
acugcagaccaacua

SEQ ID NO: 1834639 - RNA, 12 nt, Homo sapiens
uuuuugaugcuu

SEQ ID NO: 1834640 - RNA, 15 nt, Homo sapiens
gauuuggggaccaaa

SEQ ID NO: 1834641 - RNA, 16 nt, Homo sapiens
gaaacugcuacuugug

SEQ ID NO: 1834642 - RNA, 21 nt, Homo sapiens
gccacuggaguccacacuuga

SEQ ID NO: 1834643 - RNA, 17 nt, Homo sapiens
uaaacuauuuguggcaa

SEQ ID NO: 1834644 - RNA, 14 nt, Homo sapiens
ccaggcaggcaccu

SEQ ID NO: 1834645 - RNA, 17 nt, Homo sapiens
aaaaauaaaaaacacug

SEQ ID NO: 1834646 - RNA, 13 nt, Homo sapiens
acccagaguccca

SEQ ID NO: 1834647 - RNA, 14 nt, Homo sapiens
caacaugcuuuaau

SEQ ID NO: 1834648 - RNA, 22 nt, Homo sapiens
uauucuuccaaguucauucaua

SEQ ID NO: 1834649 - RNA, 21 nt, Homo sapiens
auugccugguuuugauugaga

SEQ ID NO: 1834650 - RNA, 18 nt, Homo sapiens
ugcucuuucaucucugcu

SEQ ID NO: 1834651 - RNA, 22 nt, Homo sapiens
agugacauaauuguccaguuau

SEQ ID NO: 1834652 - RNA, 23 nt, Homo sapiens
augcauauccaacaugugcucag

SEQ ID NO: 1834653 - RNA, 19 nt, Homo sapiens
caguguuuguauaccauga

SEQ ID NO: 1834654 - RNA, 14 nt, Homo sapiens
auccaauaccucuu

SEQ ID NO: 1834655 - RNA, 18 nt, Homo sapiens
cccaacacaaggugggca

SEQ ID NO: 1834656 - RNA, 15 nt, Homo sapiens
aggucuaguguuccu

SEQ ID NO: 1834657 - RNA, 23 nt, Homo sapiens
gccuuuucuggucccucuucucu

SEQ ID NO: 1834658 - RNA, 16 nt, Homo sapiens
uagcucuauguuuaca

SEQ ID NO: 1834659 - RNA, 13 nt, Homo sapiens
gacccucucaggc

SEQ ID NO: 1834660 - RNA, 13 nt, Homo sapiens
cacugauguauga

SEQ ID NO: 1834661 - RNA, 19 nt, Homo sapiens
acuaacaaaggcagcugug

SEQ ID NO: 1834662 - RNA, 18 nt, Homo sapiens
gguucacucauucucaga

SEQ ID NO: 1834663 - RNA, 19 nt, Homo sapiens
ucgaccaaacucaguucaa

SEQ ID NO: 1834664 - RNA, 17 nt, Homo sapiens
accaaaggagacauauc

SEQ ID NO: 1834665 - RNA, 19 nt, Homo sapiens
cugacuguuuuuuuugcag

SEQ ID NO: 1834666 - RNA, 19 nt, Homo sapiens
ggugcgcccugucucugug

SEQ ID NO: 1834667 - RNA, 19 nt, Homo sapiens
agcacuuucauugccagug

SEQ ID NO: 1834668 - RNA, 17 nt, Homo sapiens
aagaagcugugacauau

SEQ ID NO: 1834669 - RNA, 17 nt, Homo sapiens
cacauccugaccuugca

SEQ ID NO: 1834670 - RNA, 13 nt, Homo sapiens
ucacccuaaggaa

SEQ ID NO: 1834671 - RNA, 15 nt, Homo sapiens
cagacauucaaugaa

SEQ ID NO: 1834672 - RNA, 15 nt, Homo sapiens
cggggcagggccuuc

SEQ ID NO: 1834673 - RNA, 13 nt, Homo sapiens
accacaucuucau

SEQ ID NO: 1834674 - RNA, 17 nt, Homo sapiens
ucuguugucauugcugu

SEQ ID NO: 1834675 - RNA, 23 nt, Homo sapiens
acgacagcucucugugcacugau

SEQ ID NO: 1834676 - RNA, 20 nt, Homo sapiens
cagaagaaaaaguugcaguc

SEQ ID NO: 1834677 - RNA, 15 nt, Homo sapiens
cgggcugcugcugau

SEQ ID NO: 1834678 - RNA, 18 nt, Homo sapiens
ugacuauuuccaccauca

SEQ ID NO: 1834679 - RNA, 21 nt, Homo sapiens
aguguuucuaauaaacuugga

SEQ ID NO: 1834680 - RNA, 15 nt, Homo sapiens
ugugaacaucccuua

SEQ ID NO: 1834681 - RNA, 15 nt, Homo sapiens
caacgaggcagucac

SEQ ID NO: 1834682 - RNA, 22 nt, Homo sapiens
uauuaaucuuggauagcuaaua

SEQ ID NO: 1834683 - RNA, 15 nt, Homo sapiens
ccuucuggaguucca

SEQ ID NO: 1834684 - RNA, 17 nt, Homo sapiens
ccucuucaccuuauuca

SEQ ID NO: 1834685 - RNA, 17 nt, Homo sapiens
cuccaaagcauuuccca

SEQ ID NO: 1834686 - RNA, 15 nt, Homo sapiens
auauaauuuaaugua

SEQ ID NO: 1834687 - RNA, 15 nt, Homo sapiens
uggcuuucccagugu

SEQ ID NO: 1834688 - RNA, 14 nt, Homo sapiens
agcaguugugucag

SEQ ID NO: 1834689 - RNA, 17 nt, Homo sapiens
aauaagacuaucgucuu

SEQ ID NO: 1834690 - RNA, 14 nt, Homo sapiens
cuuuugaccaaaua

SEQ ID NO: 1834691 - RNA, 14 nt, Homo sapiens
uaaaauacuaugca

SEQ ID NO: 1834692 - RNA, 14 nt, Homo sapiens
agagcaacaguaau

SEQ ID NO: 1834693 - RNA, 14 nt, Homo sapiens
aauaauacaaagca

SEQ ID NO: 1834694 - RNA, 15 nt, Homo sapiens
aaaaucuaccaagaa

SEQ ID NO: 1834695 - RNA, 18 nt, Homo sapiens
ugcagcaaggggacaucu

SEQ ID NO: 1834696 - RNA, 19 nt, Homo sapiens
aauauuuaaacagcagugu

SEQ ID NO: 1834697 - RNA, 16 nt, Homo sapiens
ugauccgcccaccuca

SEQ ID NO: 1834698 - RNA, 18 nt, Homo sapiens
uaaauauuuugcauauaa

SEQ ID NO: 1834699 - RNA, 21 nt, Homo sapiens
cugcucagccucauccugaga

SEQ ID NO: 1834700 - RNA, 15 nt, Homo sapiens
ccugucaacauuugg

SEQ ID NO: 1834701 - RNA, 13 nt, Homo sapiens
acuuggggaccag

SEQ ID NO: 1834702 - RNA, 20 nt, Homo sapiens
gugcaccugccuccaccagc

SEQ ID NO: 1834703 - RNA, 13 nt, Homo sapiens
gucuucaguggaa

SEQ ID NO: 1834704 - RNA, 20 nt, Homo sapiens
acaaaugaaagagaaaauau

SEQ ID NO: 1834705 - RNA, 17 nt, Homo sapiens
gucagcuguggggaaca

SEQ ID NO: 1834706 - RNA, 14 nt, Homo sapiens
uguaaugucuugag

SEQ ID NO: 1834707 - RNA, 19 nt, Homo sapiens
uuacuuuaccacccccaca

SEQ ID NO: 1834708 - RNA, 20 nt, Homo sapiens
gauaauagcguucagcagca

SEQ ID NO: 1834709 - RNA, 15 nt, Homo sapiens
aguugggugauaugu

SEQ ID NO: 1834710 - RNA, 18 nt, Homo sapiens
aguucaggugagaaacug

SEQ ID NO: 1834711 - RNA, 18 nt, Homo sapiens
cuauuagagaaacaaaca

SEQ ID NO: 1834712 - RNA, 19 nt, Homo sapiens
ugaauuagaagccaucuga

SEQ ID NO: 1834713 - RNA, 16 nt, Homo sapiens
gcuccauuaauccagg

SEQ ID NO: 1834714 - RNA, 15 nt, Homo sapiens
uccauucacaccagc

SEQ ID NO: 1834715 - RNA, 15 nt, Homo sapiens
uccaugaacaccaua

SEQ ID NO: 1834716 - RNA, 17 nt, Homo sapiens
acuucuuaaauauuuag

SEQ ID NO: 1834717 - RNA, 19 nt, Homo sapiens
gggcauagaugcaggugag

SEQ ID NO: 1834718 - RNA, 18 nt, Homo sapiens
caguuuugcuuauugugu

SEQ ID NO: 1834719 - RNA, 19 nt, Homo sapiens
ugaacacuggcuaaagaua

SEQ ID NO: 1834720 - RNA, 21 nt, Homo sapiens
acagagugccaacuucuuuca

SEQ ID NO: 1834721 - RNA, 21 nt, Homo sapiens
uggaagcugagauuacucuga

SEQ ID NO: 1834722 - RNA, 17 nt, Homo sapiens
auguuuucaaaaccaag

SEQ ID NO: 1834723 - RNA, 14 nt, Homo sapiens
aaugugcuaugaag

SEQ ID NO: 1834724 - RNA, 14 nt, Homo sapiens
uacuuaacauaucu

SEQ ID NO: 1834725 - RNA, 12 nt, Homo sapiens
gaggcuuugugu

SEQ ID NO: 1834726 - RNA, 14 nt, Homo sapiens
gagaaaagggaugg

SEQ ID NO: 1834727 - RNA, 19 nt, Homo sapiens
gagucugaggccguugcug

SEQ ID NO: 1834728 - RNA, 15 nt, Homo sapiens
gagucugaacagcug

SEQ ID NO: 1834729 - RNA, 21 nt, Homo sapiens
uccuugaaaaacaaaguuucu

SEQ ID NO: 1834730 - RNA, 12 nt, Homo sapiens
ugagauggaguc

SEQ ID NO: 1834731 - RNA, 21 nt, Homo sapiens
cuauucuuaagcacuuugaaa

SEQ ID NO: 1834732 - RNA, 18 nt, Homo sapiens
ugaauaagcacuuuuuaa

SEQ ID NO: 1834733 - RNA, 16 nt, Homo sapiens
cugugcaguagcauca

SEQ ID NO: 1834734 - RNA, 19 nt, Homo sapiens
uaacuggaaggccuuccac

SEQ ID NO: 1834735 - RNA, 16 nt, Homo sapiens
ccaucugcaucuuaac

SEQ ID NO: 1834736 - RNA, 22 nt, Homo sapiens
caggagcaaacucuucaggcuc

SEQ ID NO: 1834737 - RNA, 18 nt, Homo sapiens
uauucuuugcucuugcca

SEQ ID NO: 1834738 - RNA, 23 nt, Homo sapiens
cccgggacgcagggguugcagug

SEQ ID NO: 1834739 - RNA, 15 nt, Homo sapiens
uuccuucuacuccuc

SEQ ID NO: 1834740 - RNA, 15 nt, Homo sapiens
uaaauuucagcuuug

SEQ ID NO: 1834741 - RNA, 23 nt, Homo sapiens
acuccugaccucgugauuugccu

SEQ ID NO: 1834742 - RNA, 12 nt, Homo sapiens
acuccacuuugu

SEQ ID NO: 1834743 - RNA, 13 nt, Homo sapiens
auaaagugacaga

SEQ ID NO: 1834744 - RNA, 21 nt, Homo sapiens
uguucuggggggacccagugc

SEQ ID NO: 1834745 - RNA, 13 nt, Homo sapiens
uuaaauacauaaa

SEQ ID NO: 1834746 - RNA, 22 nt, Homo sapiens
ccuucaguuuccauccccagga

SEQ ID NO: 1834747 - RNA, 20 nt, Homo sapiens
uccacugcaaauaaagccuu

SEQ ID NO: 1834748 - RNA, 22 nt, Homo sapiens
acccaguguaaagaauaaauga

SEQ ID NO: 1834749 - RNA, 19 nt, Homo sapiens
aaagauucaccuaagagau

SEQ ID NO: 1834750 - RNA, 21 nt, Homo sapiens
uaugagaaaccuauauuucaa

SEQ ID NO: 1834751 - RNA, 21 nt, Homo sapiens
aauuauuauuuauauauguau

SEQ ID NO: 1834752 - RNA, 22 nt, Homo sapiens
uacagggagccggcggccucuc

SEQ ID NO: 1834753 - RNA, 17 nt, Homo sapiens
gguuuguugcagccaaa

SEQ ID NO: 1834754 - RNA, 12 nt, Homo sapiens
cagccaucugua

SEQ ID NO: 1834755 - RNA, 14 nt, Homo sapiens
aaaauaaacaucug

SEQ ID NO: 1834756 - RNA, 22 nt, Homo sapiens
uccuagauguaacauuccugau

SEQ ID NO: 1834757 - RNA, 13 nt, Homo sapiens
aaugggccuccag

SEQ ID NO: 1834758 - RNA, 21 nt, Homo sapiens
uggcaggugucauaugacuga

SEQ ID NO: 1834759 - RNA, 22 nt, Homo sapiens
ggaaaaaauaaaagaucuugaa

SEQ ID NO: 1834760 - RNA, 13 nt, Homo sapiens
aggauugcaaugc

SEQ ID NO: 1834761 - RNA, 16 nt, Homo sapiens
acacuguaaacauuca

SEQ ID NO: 1834762 - RNA, 19 nt, Homo sapiens
uagaauaaaauuguaaaau

SEQ ID NO: 1834763 - RNA, 18 nt, Homo sapiens
uucuguggaccacugcau

SEQ ID NO: 1834764 - RNA, 16 nt, Homo sapiens
aaucuucuuaugcaau

SEQ ID NO: 1834765 - RNA, 18 nt, Homo sapiens
gaaacuuaccaauugaug

SEQ ID NO: 1834766 - RNA, 17 nt, Homo sapiens
ccagugcgguuccucau

SEQ ID NO: 1834767 - RNA, 18 nt, Homo sapiens
ggagaggucgugaggcca

SEQ ID NO: 1834768 - RNA, 23 nt, Homo sapiens
ccauauuuuuuaugauggagcaa

SEQ ID NO: 1834769 - RNA, 15 nt, Homo sapiens
ugaacuaagcaucuu

SEQ ID NO: 1834770 - RNA, 11 nt, Homo sapiens
aaugaacuaau

SEQ ID NO: 1834771 - RNA, 13 nt, Homo sapiens
uuuauucagugac

SEQ ID NO: 1834772 - RNA, 22 nt, Homo sapiens
guggguaccucuggcacccauc

SEQ ID NO: 1834773 - RNA, 15 nt, Homo sapiens
gaaaaaccaaugauu

SEQ ID NO: 1834774 - RNA, 16 nt, Homo sapiens
agacaguuugcuuauu

SEQ ID NO: 1834775 - RNA, 16 nt, Homo sapiens
aaccucuuugucuaca

SEQ ID NO: 1834776 - RNA, 14 nt, Homo sapiens
auuaccuccaucca

SEQ ID NO: 1834777 - RNA, 16 nt, Homo sapiens
gucuugcucuguuacc

SEQ ID NO: 1834778 - RNA, 19 nt, Homo sapiens
acuugaaaauuaacaugaa

SEQ ID NO: 1834779 - RNA, 14 nt, Homo sapiens
agcaaccacaaaua

SEQ ID NO: 1834780 - RNA, 20 nt, Homo sapiens
ccugguugggaucacaccca

SEQ ID NO: 1834781 - RNA, 16 nt, Homo sapiens
agugaaauacuguaca

SEQ ID NO: 1834782 - RNA, 20 nt, Homo sapiens
cucccaaguaggugggauua

SEQ ID NO: 1834783 - RNA, 12 nt, Homo sapiens
cugggaacuggu

SEQ ID NO: 1834784 - RNA, 15 nt, Homo sapiens
agugacauccaggag

SEQ ID NO: 1834785 - RNA, 16 nt, Homo sapiens
uaaccucucugugcca

SEQ ID NO: 1834786 - RNA, 21 nt, Homo sapiens
ccaauugacucucacacugaa

SEQ ID NO: 1834787 - RNA, 16 nt, Homo sapiens
ugaaacacacaggcca

SEQ ID NO: 1834788 - RNA, 15 nt, Homo sapiens
gcagaauguacuuga

SEQ ID NO: 1834789 - RNA, 14 nt, Homo sapiens
uuaucagccugugc

SEQ ID NO: 1834790 - RNA, 14 nt, Homo sapiens
gacucacucuucca

SEQ ID NO: 1834791 - RNA, 21 nt, Homo sapiens
auuuuggggugaagauucagu

SEQ ID NO: 1834792 - RNA, 10 nt, Homo sapiens
gagggccagg

SEQ ID NO: 1834793 - RNA, 16 nt, Homo sapiens
uuaugauauauuucag

SEQ ID NO: 1834794 - RNA, 16 nt, Homo sapiens
gaacucauaucuguaa

SEQ ID NO: 1834795 - RNA, 21 nt, Homo sapiens
caguaccaaaguaacugaauu

SEQ ID NO: 1834796 - RNA, 14 nt, Homo sapiens
gagaucuugaucca

SEQ ID NO: 1834797 - RNA, 14 nt, Homo sapiens
ugcaauuuuacugu

SEQ ID NO: 1834798 - RNA, 17 nt, Homo sapiens
uuauagguuuccacugc

SEQ ID NO: 1834799 - RNA, 19 nt, Homo sapiens
uagaaaaaggacucugcuu

SEQ ID NO: 1834800 - RNA, 13 nt, Homo sapiens
gugcuggcccugc

SEQ ID NO: 1834801 - RNA, 20 nt, Homo sapiens
aacaaaaauguaaugaucau

SEQ ID NO: 1834802 - RNA, 18 nt, Homo sapiens
ggcaagugggaccaggau

SEQ ID NO: 1834803 - RNA, 17 nt, Homo sapiens
gaguuacuuccuaucaa

SEQ ID NO: 1834804 - RNA, 20 nt, Homo sapiens
aaguuguggugcugacaaag

SEQ ID NO: 1834805 - RNA, 19 nt, Homo sapiens
cuuauggacacugccuuag

SEQ ID NO: 1834806 - RNA, 13 nt, Homo sapiens
uuuaauauuuacu

SEQ ID NO: 1834807 - RNA, 15 nt, Homo sapiens
uauuucagaaggaga

SEQ ID NO: 1834808 - RNA, 11 nt, Homo sapiens
cagagugcaag

SEQ ID NO: 1834809 - RNA, 19 nt, Homo sapiens
cacugaggagauacugaac

SEQ ID NO: 1834810 - RNA, 17 nt, Homo sapiens
cguuccacaacaguccc

SEQ ID NO: 1834811 - RNA, 23 nt, Homo sapiens
cagugaccccugaccucacugug

SEQ ID NO: 1834812 - RNA, 15 nt, Homo sapiens
uagagaauuuccuua

SEQ ID NO: 1834813 - RNA, 16 nt, Homo sapiens
ggcagcaggaugcuca

SEQ ID NO: 1834814 - RNA, 15 nt, Homo sapiens
auuuaaggcaaaaaa

SEQ ID NO: 1834815 - RNA, 20 nt, Homo sapiens
uuaaaaucuaauucaaacua

SEQ ID NO: 1834816 - RNA, 15 nt, Homo sapiens
auaagucaagcacau

SEQ ID NO: 1834817 - RNA, 15 nt, Homo sapiens
ucacauucuuuccaa

SEQ ID NO: 1834818 - RNA, 18 nt, Homo sapiens
uaauuugaaaacauaauc

SEQ ID NO: 1834819 - RNA, 18 nt, Homo sapiens
gugcacaccgugugccau

SEQ ID NO: 1834820 - RNA, 19 nt, Homo sapiens
uagugaagaaugcauguau

SEQ ID NO: 1834821 - RNA, 22 nt, Homo sapiens
gccucaucuuucccaaaaccca

SEQ ID NO: 1834822 - RNA, 16 nt, Homo sapiens
uggggauaugauuuaa

SEQ ID NO: 1834823 - RNA, 23 nt, Homo sapiens
uuccugauuaggaauaugaccau

SEQ ID NO: 1834824 - RNA, 18 nt, Homo sapiens
cagugcagugcucaguaa

SEQ ID NO: 1834825 - RNA, 17 nt, Homo sapiens
ucauuguggccaguuua

SEQ ID NO: 1834826 - RNA, 22 nt, Homo sapiens
cucagagaaaagagauugagau

SEQ ID NO: 1834827 - RNA, 14 nt, Homo sapiens
caucaaugcaguuc

SEQ ID NO: 1834828 - RNA, 23 nt, Homo sapiens
ugcaggggaaguacuacuccuca

SEQ ID NO: 1834829 - RNA, 16 nt, Homo sapiens
ugauccccaaguggug

SEQ ID NO: 1834830 - RNA, 17 nt, Homo sapiens
ugagaaagggauugcug

SEQ ID NO: 1834831 - RNA, 13 nt, Homo sapiens
gaaaagagggaga

SEQ ID NO: 1834832 - RNA, 17 nt, Homo sapiens
uaauaauaaaacaacag

SEQ ID NO: 1834833 - RNA, 23 nt, Homo sapiens
agacauaaaguaaaauaguuuau

SEQ ID NO: 1834834 - RNA, 16 nt, Homo sapiens
uucucgcauuguagaa

SEQ ID NO: 1834835 - RNA, 23 nt, Homo sapiens
cuugugguugaaaaccacaguca

SEQ ID NO: 1834836 - RNA, 18 nt, Homo sapiens
uuuccuucauucaaccca

SEQ ID NO: 1834837 - RNA, 16 nt, Homo sapiens
uguucuauuugugcuu

SEQ ID NO: 1834838 - RNA, 19 nt, Homo sapiens
gaaggagaaguaagaggcu

SEQ ID NO: 1834839 - RNA, 11 nt, Homo sapiens
ccaacugucag

SEQ ID NO: 1834840 - RNA, 16 nt, Homo sapiens
cccagcaaaugggcau

SEQ ID NO: 1834841 - RNA, 23 nt, Homo sapiens
gagaguaucugaggcacauguca

SEQ ID NO: 1834842 - RNA, 13 nt, Homo sapiens
cuaaagcugccag

SEQ ID NO: 1834843 - RNA, 15 nt, Homo sapiens
gcuccucagcagucc

SEQ ID NO: 1834844 - RNA, 22 nt, Homo sapiens
acuggguggauuauaaacaaca

SEQ ID NO: 1834845 - RNA, 16 nt, Homo sapiens
uaacacucauuuccaa

SEQ ID NO: 1834846 - RNA, 22 nt, Homo sapiens
aagaggcuggaguugucacugc

SEQ ID NO: 1834847 - RNA, 15 nt, Homo sapiens
ugaagagcuauuaua

SEQ ID NO: 1834848 - RNA, 15 nt, Homo sapiens
cauguaauauauuuc

SEQ ID NO: 1834849 - RNA, 21 nt, Homo sapiens
uauucuggcugcaagggccag

SEQ ID NO: 1834850 - RNA, 16 nt, Homo sapiens
uggaguggggaagugu

SEQ ID NO: 1834851 - RNA, 11 nt, Homo sapiens
caggcucucug

SEQ ID NO: 1834852 - RNA, 18 nt, Homo sapiens
ucucccaaagccccaaau

SEQ ID NO: 1834853 - RNA, 23 nt, Homo sapiens
cucuuuugugaugaacauauuca

SEQ ID NO: 1834854 - RNA, 18 nt, Homo sapiens
ccggcaccuacaucccca

SEQ ID NO: 1834855 - RNA, 23 nt, Homo sapiens
guccaggcauguuggacucugag

SEQ ID NO: 1834856 - RNA, 23 nt, Homo sapiens
ccaguuuaggugauggccaguca

SEQ ID NO: 1834857 - RNA, 13 nt, Homo sapiens
aucauguagaaua

SEQ ID NO: 1834858 - RNA, 16 nt, Homo sapiens
auugagacacugucaa

SEQ ID NO: 1834859 - RNA, 16 nt, Homo sapiens
ucccaccauuccugcc

SEQ ID NO: 1834860 - RNA, 18 nt, Homo sapiens
accauguaucacaccuaa

SEQ ID NO: 1834861 - RNA, 22 nt, Homo sapiens
aaguagucucuccccuggccac

SEQ ID NO: 1834862 - RNA, 16 nt, Homo sapiens
aaauaaaccccaguuc

SEQ ID NO: 1834863 - RNA, 23 nt, Homo sapiens
ugggaggcuccuguuagcuccuc

SEQ ID NO: 1834864 - RNA, 21 nt, Homo sapiens
cauaucccuuccucucaggcu

SEQ ID NO: 1834865 - RNA, 21 nt, Homo sapiens
gaggaccagguuugaugccug

SEQ ID NO: 1834866 - RNA, 21 nt, Homo sapiens
uaaaacauguaauauaaagau

SEQ ID NO: 1834867 - RNA, 20 nt, Homo sapiens
ucccaagguccucucaguuc

SEQ ID NO: 1834868 - RNA, 14 nt, Homo sapiens
uuucugugucuuaa

SEQ ID NO: 1834869 - RNA, 18 nt, Homo sapiens
ccuugcacuguaucauuu

SEQ ID NO: 1834870 - RNA, 23 nt, Homo sapiens
gcauaaaauggaauaacauauca

SEQ ID NO: 1834871 - RNA, 14 nt, Homo sapiens
gcuacaauuacuuu

SEQ ID NO: 1834872 - RNA, 12 nt, Homo sapiens
agcauacuuugu

SEQ ID NO: 1834873 - RNA, 19 nt, Homo sapiens
gaaaaccacagucagugga

SEQ ID NO: 1834874 - RNA, 20 nt, Homo sapiens
aggaggcuuuaagcuccagc

SEQ ID NO: 1834875 - RNA, 18 nt, Homo sapiens
ggucccucugcagucucu

SEQ ID NO: 1834876 - RNA, 15 nt, Homo sapiens
gcccucccuuggaaa

SEQ ID NO: 1834877 - RNA, 23 nt, Homo sapiens
gggcagcuuuugggaagucucag

SEQ ID NO: 1834878 - RNA, 15 nt, Homo sapiens
cuuuaaaaugauuca

SEQ ID NO: 1834879 - RNA, 17 nt, Homo sapiens
guuuucccaucucaggu

SEQ ID NO: 1834880 - RNA, 15 nt, Homo sapiens
uauuucuaaaccaca

SEQ ID NO: 1834881 - RNA, 19 nt, Homo sapiens
cguacugauucuaaugggg

SEQ ID NO: 1834882 - RNA, 20 nt, Homo sapiens
uugugauacaaugcugugcc

SEQ ID NO: 1834883 - RNA, 14 nt, Homo sapiens
acucuuaccuacaa

SEQ ID NO: 1834884 - RNA, 16 nt, Homo sapiens
uugaauauauacauuc

SEQ ID NO: 1834885 - RNA, 17 nt, Homo sapiens
ccuuaauccccaugcuu

SEQ ID NO: 1834886 - RNA, 21 nt, Homo sapiens
ugugccccacacuaacgugug

SEQ ID NO: 1834887 - RNA, 22 nt, Homo sapiens
ugucaagcugcucugagccaca

SEQ ID NO: 1834888 - RNA, 20 nt, Homo sapiens
uuaaucccuuugucugucaa

SEQ ID NO: 1834889 - RNA, 13 nt, Homo sapiens
acugucuccaugg

SEQ ID NO: 1834890 - RNA, 14 nt, Homo sapiens
aaaaggugauucua

SEQ ID NO: 1834891 - RNA, 21 nt, Homo sapiens
ggcauuuucuucucacauuua

SEQ ID NO: 1834892 - RNA, 16 nt, Homo sapiens
gguucuucagggccag

SEQ ID NO: 1834893 - RNA, 18 nt, Homo sapiens
ccuacauucuaaagaguu

SEQ ID NO: 1834894 - RNA, 16 nt, Homo sapiens
agccacaguggccaaa

SEQ ID NO: 1834895 - RNA, 19 nt, Homo sapiens
agguuaagcagccugccau

SEQ ID NO: 1834896 - RNA, 22 nt, Homo sapiens
gagauuuccugacagggaaaag

SEQ ID NO: 1834897 - RNA, 14 nt, Homo sapiens
uaauguuccucaaa

SEQ ID NO: 1834898 - RNA, 12 nt, Homo sapiens
aagauucuugac

SEQ ID NO: 1834899 - RNA, 16 nt, Homo sapiens
uuuaaaaaagcuuaaa

SEQ ID NO: 1834900 - RNA, 16 nt, Homo sapiens
uuuauaagagcuaaag

SEQ ID NO: 1834901 - RNA, 15 nt, Homo sapiens
ugaugaaaacauuca

SEQ ID NO: 1834902 - RNA, 20 nt, Homo sapiens
gggugccgaagcuacuggac

SEQ ID NO: 1834903 - RNA, 23 nt, Homo sapiens
caucacugaaaugcuagcugcaa

SEQ ID NO: 1834904 - RNA, 14 nt, Homo sapiens
uggugagcagggga

SEQ ID NO: 1834905 - RNA, 20 nt, Homo sapiens
gagaccuggguugugcugac

SEQ ID NO: 1834906 - RNA, 19 nt, Homo sapiens
ugucacauggaaucuacau

SEQ ID NO: 1834907 - RNA, 14 nt, Homo sapiens
agaugcugggccag

SEQ ID NO: 1834908 - RNA, 23 nt, Homo sapiens
acuuauauugaagacaauuugau

SEQ ID NO: 1834909 - RNA, 23 nt, Homo sapiens
gagcucaccuguuugaaaccaag

SEQ ID NO: 1834910 - RNA, 19 nt, Homo sapiens
ccagcaucucccaguucau

SEQ ID NO: 1834911 - RNA, 23 nt, Homo sapiens
cucauccaacuccgaaagucuga

SEQ ID NO: 1834912 - RNA, 19 nt, Homo sapiens
ucauccaugcagauaacag

SEQ ID NO: 1834913 - RNA, 15 nt, Homo sapiens
acacucuuguuugau

SEQ ID NO: 1834914 - RNA, 19 nt, Homo sapiens
cuaucugccuggaggcaaa

SEQ ID NO: 1834915 - RNA, 18 nt, Homo sapiens
agcugcgccugcgcugca

SEQ ID NO: 1834916 - RNA, 16 nt, Homo sapiens
aucucaugugugcuca

SEQ ID NO: 1834917 - RNA, 24 nt, Homo sapiens
guuaauauuuauuaagugacuaua

SEQ ID NO: 1834918 - RNA, 14 nt, Homo sapiens
cggcccugaccaau

SEQ ID NO: 1834919 - RNA, 14 nt, Homo sapiens
uauugaauguuaaa

SEQ ID NO: 1834920 - RNA, 16 nt, Homo sapiens
cgguuugggagaacac

SEQ ID NO: 1834921 - RNA, 17 nt, Homo sapiens
ugugggcaugagcugcu

SEQ ID NO: 1834922 - RNA, 16 nt, Homo sapiens
uugcucuuucaucucu

SEQ ID NO: 1834923 - RNA, 19 nt, Homo sapiens
uaacaauguuaaaugcaau

SEQ ID NO: 1834924 - RNA, 15 nt, Homo sapiens
auaagcuacugccau

SEQ ID NO: 1834925 - RNA, 15 nt, Homo sapiens
cuucccaacaugccu

SEQ ID NO: 1834926 - RNA, 16 nt, Homo sapiens
agccuggcaucugugc

SEQ ID NO: 1834927 - RNA, 15 nt, Homo sapiens
uacaaaggaggacaa

SEQ ID NO: 1834928 - RNA, 20 nt, Homo sapiens
ucauuccuuagauaccuuga

SEQ ID NO: 1834929 - RNA, 15 nt, Homo sapiens
ugaucagaucuuaca

SEQ ID NO: 1834930 - RNA, 12 nt, Homo sapiens
ugggggaaaaua

SEQ ID NO: 1834931 - RNA, 19 nt, Homo sapiens
accuugcauuucaaaaugg

SEQ ID NO: 1834932 - RNA, 18 nt, Homo sapiens
guuucacagaaaauaagg

SEQ ID NO: 1834933 - RNA, 13 nt, Homo sapiens
aagcugauuugau

SEQ ID NO: 1834934 - RNA, 19 nt, Homo sapiens
aagcuuccaguccaaucuc

SEQ ID NO: 1834935 - RNA, 20 nt, Homo sapiens
uauaaaaacauugaaguauu

SEQ ID NO: 1834936 - RNA, 23 nt, Homo sapiens
ucgaugacugugaacugggcauu

SEQ ID NO: 1834937 - RNA, 22 nt, Homo sapiens
ccuuugcucccuguugcugaaa

SEQ ID NO: 1834938 - RNA, 19 nt, Homo sapiens
aaccauggugaacuccacc

SEQ ID NO: 1834939 - RNA, 12 nt, Homo sapiens
cuucuacugcua

SEQ ID NO: 1834940 - RNA, 12 nt, Homo sapiens
guuauacuccuc

SEQ ID NO: 1834941 - RNA, 16 nt, Homo sapiens
gcccuggaaggugcca

SEQ ID NO: 1834942 - RNA, 15 nt, Homo sapiens
uuuaaucccauugca

SEQ ID NO: 1834943 - RNA, 15 nt, Homo sapiens
agcagaggccugagg

SEQ ID NO: 1834944 - RNA, 16 nt, Homo sapiens
gccuggagacauauca

SEQ ID NO: 1834945 - RNA, 18 nt, Homo sapiens
aagccccgacacacgggg

SEQ ID NO: 1834946 - RNA, 15 nt, Homo sapiens
accgggcugggagcu

SEQ ID NO: 1834947 - RNA, 10 nt, Homo sapiens
ccaaacucag

SEQ ID NO: 1834948 - RNA, 18 nt, Homo sapiens
acagauaaaaaaugaaau

SEQ ID NO: 1834949 - RNA, 15 nt, Homo sapiens
cugaagggguucuca

SEQ ID NO: 1834950 - RNA, 21 nt, Homo sapiens
gcaaagcgugucccauagaaa

SEQ ID NO: 1834951 - RNA, 13 nt, Homo sapiens
cgucccaaacaga

SEQ ID NO: 1834952 - RNA, 13 nt, Homo sapiens
ucauuuaaccaag

SEQ ID NO: 1834953 - RNA, 14 nt, Homo sapiens
augacaucucaggg

SEQ ID NO: 1834954 - RNA, 12 nt, Homo sapiens
cugacacugucu

SEQ ID NO: 1834955 - RNA, 12 nt, Homo sapiens
gucacacucugu

SEQ ID NO: 1834956 - RNA, 23 nt, Homo sapiens
caacauuacuccauuacuaaaga

SEQ ID NO: 1834957 - RNA, 23 nt, Homo sapiens
aacaaaaaaaaaaaaacaaaaga

SEQ ID NO: 1834958 - RNA, 17 nt, Homo sapiens
ugaggugggcuggggcu

SEQ ID NO: 1834959 - RNA, 16 nt, Homo sapiens
ccaagggcaccuggag

SEQ ID NO: 1834960 - RNA, 16 nt, Homo sapiens
ugacagcugucuuugg

SEQ ID NO: 1834961 - RNA, 23 nt, Homo sapiens
acugaggccuugugugucaggcc

SEQ ID NO: 1834962 - RNA, 19 nt, Homo sapiens
aaaauuaaaugcauguccu

SEQ ID NO: 1834963 - RNA, 16 nt, Homo sapiens
guaugcagaauguuuu

SEQ ID NO: 1834964 - RNA, 17 nt, Homo sapiens
uaauaauuugcucacuu

SEQ ID NO: 1834965 - RNA, 17 nt, Homo sapiens
gcuccaggacuccacug

SEQ ID NO: 1834966 - RNA, 17 nt, Homo sapiens
gcaagugugugcacaug

SEQ ID NO: 1834967 - RNA, 14 nt, Homo sapiens
cuuucucaaugaau

SEQ ID NO: 1834968 - RNA, 23 nt, Homo sapiens
agaaggggacaauggcagaacag

SEQ ID NO: 1834969 - RNA, 14 nt, Homo sapiens
ugcauguccucaaa

SEQ ID NO: 1834970 - RNA, 13 nt, Homo sapiens
cuguauauguugu

SEQ ID NO: 1834971 - RNA, 22 nt, Homo sapiens
cccucccacugccaaagaacuu

SEQ ID NO: 1834972 - RNA, 15 nt, Homo sapiens
cacacccaauuccac

SEQ ID NO: 1834973 - RNA, 22 nt, Homo sapiens
cucagugagauauuugguacca

SEQ ID NO: 1834974 - RNA, 18 nt, Homo sapiens
ugucuccacggccugccc

SEQ ID NO: 1834975 - RNA, 16 nt, Homo sapiens
acacacguaccuucau

SEQ ID NO: 1834976 - RNA, 16 nt, Homo sapiens
caacaggucacuugau

SEQ ID NO: 1834977 - RNA, 19 nt, Homo sapiens
agacuggaauaguggcaua

SEQ ID NO: 1834978 - RNA, 17 nt, Homo sapiens
uuagcuugucugugauc

SEQ ID NO: 1834979 - RNA, 21 nt, Homo sapiens
cuccugucuuaugguccagaa

SEQ ID NO: 1834980 - RNA, 14 nt, Homo sapiens
aagcuuguguacuu

SEQ ID NO: 1834981 - RNA, 14 nt, Homo sapiens
caacaaaagcuuuu

SEQ ID NO: 1834982 - RNA, 19 nt, Homo sapiens
uguuauaacucugcacuac

SEQ ID NO: 1834983 - RNA, 16 nt, Homo sapiens
gaggcaugcuaagaau

SEQ ID NO: 1834984 - RNA, 16 nt, Homo sapiens
cagggauaauacugug

SEQ ID NO: 1834985 - RNA, 15 nt, Homo sapiens
cucuuauuugcucac

SEQ ID NO: 1834986 - RNA, 14 nt, Homo sapiens
ugaaucuaugccaa

SEQ ID NO: 1834987 - RNA, 20 nt, Homo sapiens
auauaauagaugacaguggc

SEQ ID NO: 1834988 - RNA, 23 nt, Homo sapiens
uuaaaaaaguuggguuuucucca

SEQ ID NO: 1834989 - RNA, 17 nt, Homo sapiens
cucagcaauagggugca

SEQ ID NO: 1834990 - RNA, 20 nt, Homo sapiens
ucagucccuaaaaacacaga

SEQ ID NO: 1834991 - RNA, 21 nt, Homo sapiens
gacagcuugaucaaaggcaca

SEQ ID NO: 1834992 - RNA, 13 nt, Homo sapiens
gaaaaaaguuacu

SEQ ID NO: 1834993 - RNA, 16 nt, Homo sapiens
cauccacacacaguaa

SEQ ID NO: 1834994 - RNA, 13 nt, Homo sapiens
uaaauuccauaua

SEQ ID NO: 1834995 - RNA, 20 nt, Homo sapiens
aauugauuuuccuuugugca

SEQ ID NO: 1834996 - RNA, 22 nt, Homo sapiens
acauauaacgcagucuaauuac

SEQ ID NO: 1834997 - RNA, 12 nt, Homo sapiens
aaggugaaucua

SEQ ID NO: 1834998 - RNA, 23 nt, Homo sapiens
gggccuguuuggugaggaccugc

SEQ ID NO: 1834999 - RNA, 17 nt, Homo sapiens
cucaaccauaacacuug

SEQ ID NO: 1835000 - RNA, 22 nt, Homo sapiens
cucacaggcgccuaaagucauu

SEQ ID NO: 1835001 - RNA, 15 nt, Homo sapiens
ccaggaaaacuggga

SEQ ID NO: 1835002 - RNA, 21 nt, Homo sapiens
guucccuuuccccauucagug

SEQ ID NO: 1835003 - RNA, 14 nt, Homo sapiens
gcagugaacugaga

SEQ ID NO: 1835004 - RNA, 19 nt, Homo sapiens
gcccaaacuggagugcagu

SEQ ID NO: 1835005 - RNA, 18 nt, Homo sapiens
gacacaugugcuggccac

SEQ ID NO: 1835006 - RNA, 12 nt, Homo sapiens
gcucuagggccu

SEQ ID NO: 1835007 - RNA, 22 nt, Homo sapiens
ucacucaauuucucugaggaca

SEQ ID NO: 1835008 - RNA, 16 nt, Homo sapiens
acugcccaauaugcag

SEQ ID NO: 1835009 - RNA, 21 nt, Homo sapiens
ggagcucuacgugcuccucag

SEQ ID NO: 1835010 - RNA, 21 nt, Homo sapiens
gccucucccaaguccagugug

SEQ ID NO: 1835011 - RNA, 18 nt, Homo sapiens
uaaaauuaggaacaguaa

SEQ ID NO: 1835012 - RNA, 19 nt, Homo sapiens
auccagcaucccaagauca

SEQ ID NO: 1835013 - RNA, 15 nt, Homo sapiens
cagcagcagugccau

SEQ ID NO: 1835014 - RNA, 23 nt, Homo sapiens
cuaaaauaaacaagcugugguau

SEQ ID NO: 1835015 - RNA, 15 nt, Homo sapiens
agagaggaagugguc

SEQ ID NO: 1835016 - RNA, 15 nt, Homo sapiens
aagguucuugcugcc

SEQ ID NO: 1835017 - RNA, 16 nt, Homo sapiens
augcuugaaugccacg

SEQ ID NO: 1835018 - RNA, 20 nt, Homo sapiens
cugcuugaccguacucucac

SEQ ID NO: 1835019 - RNA, 19 nt, Homo sapiens
cccaggauggagugcagug

SEQ ID NO: 1835020 - RNA, 22 nt, Homo sapiens
cuauaauuuauuaacuauuuau

SEQ ID NO: 1835021 - RNA, 21 nt, Homo sapiens
acaguaucccacauccaacuc

SEQ ID NO: 1835022 - RNA, 19 nt, Homo sapiens
uggcagagagcacagugau

SEQ ID NO: 1835023 - RNA, 18 nt, Homo sapiens
aacaguaucuuugcacuc

SEQ ID NO: 1835024 - RNA, 18 nt, Homo sapiens
caaauagaacuaauacug

SEQ ID NO: 1835025 - RNA, 15 nt, Homo sapiens
ugaaagaaaauaacg

SEQ ID NO: 1835026 - RNA, 13 nt, Homo sapiens
aaaaccuuccuuc

SEQ ID NO: 1835027 - RNA, 21 nt, Homo sapiens
uaggggauguggagugagaac

SEQ ID NO: 1835028 - RNA, 22 nt, Homo sapiens
gccuauggaguagccauucuau

SEQ ID NO: 1835029 - RNA, 22 nt, Homo sapiens
agccuuccugaguuucucucuc

SEQ ID NO: 1835030 - RNA, 20 nt, Homo sapiens
gcaaagcaucggucaugugu

SEQ ID NO: 1835031 - RNA, 21 nt, Homo sapiens
ggguggccugcgcuagcuucu

SEQ ID NO: 1835032 - RNA, 20 nt, Homo sapiens
caucuggacuauggguugua

SEQ ID NO: 1835033 - RNA, 14 nt, Homo sapiens
uauuacgugcaaua

SEQ ID NO: 1835034 - RNA, 14 nt, Homo sapiens
agugugaccacuga

SEQ ID NO: 1835035 - RNA, 12 nt, Homo sapiens
uuccucucucua

SEQ ID NO: 1835036 - RNA, 15 nt, Homo sapiens
uugcuguuugcaauu

SEQ ID NO: 1835037 - RNA, 18 nt, Homo sapiens
uggguaaauuaacugaac

SEQ ID NO: 1835038 - RNA, 12 nt, Homo sapiens
ggcgcaaagggc

SEQ ID NO: 1835039 - RNA, 22 nt, Homo sapiens
ucuaggcaggcaagagaauuga

SEQ ID NO: 1835040 - RNA, 23 nt, Homo sapiens
gccuccaugaugcaagccagcuu

SEQ ID NO: 1835041 - RNA, 20 nt, Homo sapiens
ugcgcccuucauugccacac

SEQ ID NO: 1835042 - RNA, 19 nt, Homo sapiens
cauggcugccucugaagag

SEQ ID NO: 1835043 - RNA, 18 nt, Homo sapiens
cuccauacuccacuccaa

SEQ ID NO: 1835044 - RNA, 17 nt, Homo sapiens
aauuuccauuuauauca

SEQ ID NO: 1835045 - RNA, 16 nt, Homo sapiens
cauacucagagcauua

SEQ ID NO: 1835046 - RNA, 19 nt, Homo sapiens
guugauucagcucugcaag

SEQ ID NO: 1835047 - RNA, 17 nt, Homo sapiens
cagaauguaaaauuggu

SEQ ID NO: 1835048 - RNA, 19 nt, Homo sapiens
ucuaaaugauuaucuugaa

SEQ ID NO: 1835049 - RNA, 15 nt, Homo sapiens
agggcagugcccuuu

SEQ ID NO: 1835050 - RNA, 15 nt, Homo sapiens
acauugccuguucug

SEQ ID NO: 1835051 - RNA, 21 nt, Homo sapiens
uggaacacuagacaagccaga

SEQ ID NO: 1835052 - RNA, 22 nt, Homo sapiens
ucuacuuauccucauuacccag

SEQ ID NO: 1835053 - RNA, 22 nt, Homo sapiens
gcuuaaucuagagcuaugcaca

SEQ ID NO: 1835054 - RNA, 15 nt, Homo sapiens
guuuguauugugauu

SEQ ID NO: 1835055 - RNA, 22 nt, Homo sapiens
aguagugcaccaucucacugca

SEQ ID NO: 1835056 - RNA, 19 nt, Homo sapiens
caaaagaagaaaccuucau

SEQ ID NO: 1835057 - RNA, 14 nt, Homo sapiens
cauguuagccuuag

SEQ ID NO: 1835058 - RNA, 14 nt, Homo sapiens
gaccacaauuaucu

SEQ ID NO: 1835059 - RNA, 21 nt, Homo sapiens
aucuuucaggacucuaccuca

SEQ ID NO: 1835060 - RNA, 18 nt, Homo sapiens
uaagggguaucauguaug

SEQ ID NO: 1835061 - RNA, 20 nt, Homo sapiens
agacaguccuuaaugcugaa

SEQ ID NO: 1835062 - RNA, 19 nt, Homo sapiens
uagcccaagacaccaugac

SEQ ID NO: 1835063 - RNA, 15 nt, Homo sapiens
agauguagcauuguu

SEQ ID NO: 1835064 - RNA, 14 nt, Homo sapiens
ugcugaauggaguu

SEQ ID NO: 1835065 - RNA, 17 nt, Homo sapiens
acgcuggacagcacucu

SEQ ID NO: 1835066 - RNA, 13 nt, Homo sapiens
gacuucacuguau

SEQ ID NO: 1835067 - RNA, 20 nt, Homo sapiens
gacagcauauaaauguaaua

SEQ ID NO: 1835068 - RNA, 22 nt, Homo sapiens
ccuauaugaauaugagaucuga

SEQ ID NO: 1835069 - RNA, 21 nt, Homo sapiens
ggcgcuucggcucccaggaca

SEQ ID NO: 1835070 - RNA, 17 nt, Homo sapiens
aguccgcagaagcccug

SEQ ID NO: 1835071 - RNA, 14 nt, Homo sapiens
gcagauacauauga

SEQ ID NO: 1835072 - RNA, 19 nt, Homo sapiens
gcuuuaauuaagcucucau

SEQ ID NO: 1835073 - RNA, 15 nt, Homo sapiens
uggggaagcugugaa

SEQ ID NO: 1835074 - RNA, 15 nt, Homo sapiens
cuaggaugugaugau

SEQ ID NO: 1835075 - RNA, 13 nt, Homo sapiens
uuagauaacgcuu

SEQ ID NO: 1835076 - RNA, 13 nt, Homo sapiens
aggcagagucuca

SEQ ID NO: 1835077 - RNA, 22 nt, Homo sapiens
aaaggugucuucuuugacuuaa

SEQ ID NO: 1835078 - RNA, 14 nt, Homo sapiens
cucucagaacauac

SEQ ID NO: 1835079 - RNA, 12 nt, Homo sapiens
uagcacuuuaua

SEQ ID NO: 1835080 - RNA, 24 nt, Homo sapiens
uuuauuacgauuaguauaugauca

SEQ ID NO: 1835081 - RNA, 14 nt, Homo sapiens
uugaauaggcauua

SEQ ID NO: 1835082 - RNA, 19 nt, Homo sapiens
cacuaccgaaugugucuuu

SEQ ID NO: 1835083 - RNA, 19 nt, Homo sapiens
ggauucagcgaagucucau

SEQ ID NO: 1835084 - RNA, 15 nt, Homo sapiens
uguuaaaaccaaacu

SEQ ID NO: 1835085 - RNA, 16 nt, Homo sapiens
acccagcccagcuugc

SEQ ID NO: 1835086 - RNA, 20 nt, Homo sapiens
uaacucaggaugccaagugg

SEQ ID NO: 1835087 - RNA, 15 nt, Homo sapiens
uggaugcagcaauaa

SEQ ID NO: 1835088 - RNA, 20 nt, Homo sapiens
cagaggauaaggaggcacug

SEQ ID NO: 1835089 - RNA, 17 nt, Homo sapiens
ucuauauuaaggcagua

SEQ ID NO: 1835090 - RNA, 17 nt, Homo sapiens
auuucauuaaccaaaga

SEQ ID NO: 1835091 - RNA, 20 nt, Homo sapiens
aauugauccucccaucucag

SEQ ID NO: 1835092 - RNA, 23 nt, Homo sapiens
ugauugggucagcuggcuuccua

SEQ ID NO: 1835093 - RNA, 20 nt, Homo sapiens
cagagaacuggaaagacaua

SEQ ID NO: 1835094 - RNA, 17 nt, Homo sapiens
ucauggauaacuacauu

SEQ ID NO: 1835095 - RNA, 17 nt, Homo sapiens
acagaaguugaagcaca

SEQ ID NO: 1835096 - RNA, 17 nt, Homo sapiens
guacauacguguucuau

SEQ ID NO: 1835097 - RNA, 11 nt, Homo sapiens
agcggacauca

SEQ ID NO: 1835098 - RNA, 21 nt, Homo sapiens
acgccacugcacuauagccua

SEQ ID NO: 1835099 - RNA, 16 nt, Homo sapiens
ccaguuccuucacuua

SEQ ID NO: 1835100 - RNA, 18 nt, Homo sapiens
uaaaacauuaugaguuuc

SEQ ID NO: 1835101 - RNA, 14 nt, Homo sapiens
aaguaggaguggcu

SEQ ID NO: 1835102 - RNA, 13 nt, Homo sapiens
cgggaguggccau

SEQ ID NO: 1835103 - RNA, 13 nt, Homo sapiens
auauguaaucucu

SEQ ID NO: 1835104 - RNA, 13 nt, Homo sapiens
ucacaauauccaa

SEQ ID NO: 1835105 - RNA, 18 nt, Homo sapiens
ugaggaaaauuaauauca

SEQ ID NO: 1835106 - RNA, 22 nt, Homo sapiens
ggaaauucuuauaacucaacau

SEQ ID NO: 1835107 - RNA, 19 nt, Homo sapiens
ugcaguggagcagaaggca

SEQ ID NO: 1835108 - RNA, 12 nt, Homo sapiens
gacuuguucuca

SEQ ID NO: 1835109 - RNA, 19 nt, Homo sapiens
cgcuuggagcuauuuucca

SEQ ID NO: 1835110 - RNA, 14 nt, Homo sapiens
acuacaucacuuga

SEQ ID NO: 1835111 - RNA, 16 nt, Homo sapiens
cuccuuccucuucuca

SEQ ID NO: 1835112 - RNA, 19 nt, Homo sapiens
uaagaucucgguuugccaa

SEQ ID NO: 1835113 - RNA, 14 nt, Homo sapiens
caucuuaguuuacu

SEQ ID NO: 1835114 - RNA, 21 nt, Homo sapiens
gcagaguauuaaugaaaagca

SEQ ID NO: 1835115 - RNA, 14 nt, Homo sapiens
acagacuguguuua

SEQ ID NO: 1835116 - RNA, 15 nt, Homo sapiens
gaucccugccaaaaa

SEQ ID NO: 1835117 - RNA, 19 nt, Homo sapiens
uacauuuuauuaagcuuuu

SEQ ID NO: 1835118 - RNA, 16 nt, Homo sapiens
uaccgagagccaaaca

SEQ ID NO: 1835119 - RNA, 21 nt, Homo sapiens
uguugagccaggccugggucu

SEQ ID NO: 1835120 - RNA, 17 nt, Homo sapiens
uucuugguaacugauua

SEQ ID NO: 1835121 - RNA, 14 nt, Homo sapiens
uguucugugucacg

SEQ ID NO: 1835122 - RNA, 15 nt, Homo sapiens
guuuuaaacauucuu

SEQ ID NO: 1835123 - RNA, 13 nt, Homo sapiens
cugugcaugccau

SEQ ID NO: 1835124 - RNA, 19 nt, Homo sapiens
cacaauaugggcacuuuaa

SEQ ID NO: 1835125 - RNA, 13 nt, Homo sapiens
augucgcagacuc

SEQ ID NO: 1835126 - RNA, 15 nt, Homo sapiens
uccaaagccagugaa

SEQ ID NO: 1835127 - RNA, 15 nt, Homo sapiens
aggcaucaccaugaa

SEQ ID NO: 1835128 - RNA, 14 nt, Homo sapiens
gcuguuuuauaugu

SEQ ID NO: 1835129 - RNA, 16 nt, Homo sapiens
auuccuaugcugcaau

SEQ ID NO: 1835130 - RNA, 11 nt, Homo sapiens
agcucaugccc

SEQ ID NO: 1835131 - RNA, 14 nt, Homo sapiens
uaaugaauaugcca

SEQ ID NO: 1835132 - RNA, 11 nt, Homo sapiens
agaucaugcca

SEQ ID NO: 1835133 - RNA, 17 nt, Homo sapiens
cuccugucucagccucc

SEQ ID NO: 1835134 - RNA, 23 nt, Homo sapiens
auucgaaugacgguaaguguucu

SEQ ID NO: 1835135 - RNA, 15 nt, Homo sapiens
gucaggggugacaca

SEQ ID NO: 1835136 - RNA, 22 nt, Homo sapiens
gaagucgggcaugguggcucau

SEQ ID NO: 1835137 - RNA, 21 nt, Homo sapiens
ccccucguugcccagcacugu

SEQ ID NO: 1835138 - RNA, 11 nt, Homo sapiens
gacacaaagga

SEQ ID NO: 1835139 - RNA, 21 nt, Homo sapiens
acagacagccacccugagaac

SEQ ID NO: 1835140 - RNA, 19 nt, Homo sapiens
augcauuagaagucagcca

SEQ ID NO: 1835141 - RNA, 21 nt, Homo sapiens
ccugcacggggcauuccugcu

SEQ ID NO: 1835142 - RNA, 17 nt, Homo sapiens
augucugcauggcagaa

SEQ ID NO: 1835143 - RNA, 13 nt, Homo sapiens
acaauuagccagg

SEQ ID NO: 1835144 - RNA, 12 nt, Homo sapiens
ugugugugccuc

SEQ ID NO: 1835145 - RNA, 21 nt, Homo sapiens
aauuuagagauaggaaacuga

SEQ ID NO: 1835146 - RNA, 19 nt, Homo sapiens
cuggucaaccccacaagca

SEQ ID NO: 1835147 - RNA, 19 nt, Homo sapiens
auagaauggcacaugucau

SEQ ID NO: 1835148 - RNA, 15 nt, Homo sapiens
ccucacguccaucac

SEQ ID NO: 1835149 - RNA, 22 nt, Homo sapiens
aaggugcacugagaagcaauca

SEQ ID NO: 1835150 - RNA, 23 nt, Homo sapiens
cuguuuaaucauaguuacugugu

SEQ ID NO: 1835151 - RNA, 17 nt, Homo sapiens
ggaguugaaacugcuau

SEQ ID NO: 1835152 - RNA, 15 nt, Homo sapiens
uuauauuuacuuuaa

SEQ ID NO: 1835153 - RNA, 13 nt, Homo sapiens
gaccccaucucau

SEQ ID NO: 1835154 - RNA, 16 nt, Homo sapiens
ucaguucucaaaugug

SEQ ID NO: 1835155 - RNA, 15 nt, Homo sapiens
gcguccucugacccc

SEQ ID NO: 1835156 - RNA, 22 nt, Homo sapiens
agcuuguuucugucaagcauau

SEQ ID NO: 1835157 - RNA, 20 nt, Homo sapiens
uuguauaaauuuauuuacug

SEQ ID NO: 1835158 - RNA, 21 nt, Homo sapiens
auaaacugagccucuuuucaa

SEQ ID NO: 1835159 - RNA, 20 nt, Homo sapiens
gagaacaccaaggcccagag

SEQ ID NO: 1835160 - RNA, 20 nt, Homo sapiens
accugcagggccaauggccu

SEQ ID NO: 1835161 - RNA, 23 nt, Homo sapiens
cauauuuuuaguagagacagggu

SEQ ID NO: 1835162 - RNA, 15 nt, Homo sapiens
cugaugagcacgguu

SEQ ID NO: 1835163 - RNA, 13 nt, Homo sapiens
caaacacugugua

SEQ ID NO: 1835164 - RNA, 15 nt, Homo sapiens
uguguuuaacauuca

SEQ ID NO: 1835165 - RNA, 13 nt, Homo sapiens
uuuucgaacauuc

SEQ ID NO: 1835166 - RNA, 14 nt, Homo sapiens
gcugaagugucaca

SEQ ID NO: 1835167 - RNA, 12 nt, Homo sapiens
cauuucuacucu

SEQ ID NO: 1835168 - RNA, 21 nt, Homo sapiens
gcucccagcugugcuguggag

SEQ ID NO: 1835169 - RNA, 16 nt, Homo sapiens
ugccugguaccagagg

SEQ ID NO: 1835170 - RNA, 22 nt, Homo sapiens
aucacggcucacugcagccuca

SEQ ID NO: 1835171 - RNA, 16 nt, Homo sapiens
ccaguggggauuugua

SEQ ID NO: 1835172 - RNA, 20 nt, Homo sapiens
ugccuuucucuggcuccaga

SEQ ID NO: 1835173 - RNA, 15 nt, Homo sapiens
caccaaagacaucag

SEQ ID NO: 1835174 - RNA, 11 nt, Homo sapiens
accugauacuu

SEQ ID NO: 1835175 - RNA, 16 nt, Homo sapiens
auugucagaguucugc

SEQ ID NO: 1835176 - RNA, 16 nt, Homo sapiens
gcuugggugugcugac

SEQ ID NO: 1835177 - RNA, 22 nt, Homo sapiens
cugcugagucagacugucagaa

SEQ ID NO: 1835178 - RNA, 14 nt, Homo sapiens
acgaagaccccagg

SEQ ID NO: 1835179 - RNA, 20 nt, Homo sapiens
gcagacuaaaacaaguacau

SEQ ID NO: 1835180 - RNA, 20 nt, Homo sapiens
uguucugacccugcuucaaa

SEQ ID NO: 1835181 - RNA, 14 nt, Homo sapiens
caaaaaaaguaauu

SEQ ID NO: 1835182 - RNA, 18 nt, Homo sapiens
uuuaaaaaaaacaauucc

SEQ ID NO: 1835183 - RNA, 20 nt, Homo sapiens
uccuugauuacuuccacuga

SEQ ID NO: 1835184 - RNA, 19 nt, Homo sapiens
cauauuaagaaacaccugu

SEQ ID NO: 1835185 - RNA, 13 nt, Homo sapiens
cuugaaucaaagc

SEQ ID NO: 1835186 - RNA, 13 nt, Homo sapiens
cugccaaacacau

SEQ ID NO: 1835187 - RNA, 23 nt, Homo sapiens
uauguggaagugugggucugugu

SEQ ID NO: 1835188 - RNA, 19 nt, Homo sapiens
cccugagcccuccacguca

SEQ ID NO: 1835189 - RNA, 16 nt, Homo sapiens
agcccagugcacugaa

SEQ ID NO: 1835190 - RNA, 18 nt, Homo sapiens
cugacacacagcucuguc

SEQ ID NO: 1835191 - RNA, 14 nt, Homo sapiens
ucaugccucugagg

SEQ ID NO: 1835192 - RNA, 14 nt, Homo sapiens
gaaugcuguguuaa

SEQ ID NO: 1835193 - RNA, 15 nt, Homo sapiens
uauuauuuacaucac

SEQ ID NO: 1835194 - RNA, 16 nt, Homo sapiens
agaacuacagcucuua

SEQ ID NO: 1835195 - RNA, 20 nt, Homo sapiens
uguacccuucuugucucucu

SEQ ID NO: 1835196 - RNA, 17 nt, Homo sapiens
agaagacuugccugcua

SEQ ID NO: 1835197 - RNA, 16 nt, Homo sapiens
uuuccuaggcagauca

SEQ ID NO: 1835198 - RNA, 15 nt, Homo sapiens
ugacacauaugaaca

SEQ ID NO: 1835199 - RNA, 22 nt, Homo sapiens
ugcauacacacacacacacagc

SEQ ID NO: 1835200 - RNA, 23 nt, Homo sapiens
ucaaucuaaggccuucccuguca

SEQ ID NO: 1835201 - RNA, 18 nt, Homo sapiens
cugguucuuuguucuguc

SEQ ID NO: 1835202 - RNA, 14 nt, Homo sapiens
gacugcuaccuuuc

SEQ ID NO: 1835203 - RNA, 14 nt, Homo sapiens
aaucaaugaauauu

SEQ ID NO: 1835204 - RNA, 17 nt, Homo sapiens
uaacaaaguuugcugaa

SEQ ID NO: 1835205 - RNA, 21 nt, Homo sapiens
gucuuucauggggugaugcug

SEQ ID NO: 1835206 - RNA, 14 nt, Homo sapiens
uaggaagagacaca

SEQ ID NO: 1835207 - RNA, 18 nt, Homo sapiens
ugcacacacccugagcuu

SEQ ID NO: 1835208 - RNA, 19 nt, Homo sapiens
cugacuuuuaaugucauuu

SEQ ID NO: 1835209 - RNA, 23 nt, Homo sapiens
aauaaaucguccucccaggccag

SEQ ID NO: 1835210 - RNA, 18 nt, Homo sapiens
uacccuagagguucauga

SEQ ID NO: 1835211 - RNA, 17 nt, Homo sapiens
ucugguauaauugugua

SEQ ID NO: 1835212 - RNA, 11 nt, Homo sapiens
caaacucccua

SEQ ID NO: 1835213 - RNA, 14 nt, Homo sapiens
aaacccauuuugaa

SEQ ID NO: 1835214 - RNA, 22 nt, Homo sapiens
uucccauuuccuugucuaaaga

SEQ ID NO: 1835215 - RNA, 23 nt, Homo sapiens
ggaaaacugccacaagcacaauu

SEQ ID NO: 1835216 - RNA, 22 nt, Homo sapiens
ugaauaacauuugugugguggg

SEQ ID NO: 1835217 - RNA, 15 nt, Homo sapiens
uacaaacugguuuga

SEQ ID NO: 1835218 - RNA, 23 nt, Homo sapiens
ccuacaguugaaaaacagcugag

SEQ ID NO: 1835219 - RNA, 14 nt, Homo sapiens
acuccucaucauca

SEQ ID NO: 1835220 - RNA, 13 nt, Homo sapiens
cagucuauuucca

SEQ ID NO: 1835221 - RNA, 21 nt, Homo sapiens
uauugcugcuggggcucccca

SEQ ID NO: 1835222 - RNA, 23 nt, Homo sapiens
agugguacuaagcacagaaacuc

SEQ ID NO: 1835223 - RNA, 21 nt, Homo sapiens
uggagacuccuaggcaggaca

SEQ ID NO: 1835224 - RNA, 21 nt, Homo sapiens
ccugaaaguuuagaucuagaa

SEQ ID NO: 1835225 - RNA, 22 nt, Homo sapiens
aagagaggcgucugcugucuca

SEQ ID NO: 1835226 - RNA, 14 nt, Homo sapiens
ccuuugucaucauu

SEQ ID NO: 1835227 - RNA, 18 nt, Homo sapiens
cacacugaggaacucaca

SEQ ID NO: 1835228 - RNA, 18 nt, Homo sapiens
uucuuggaugauugcagu

SEQ ID NO: 1835229 - RNA, 17 nt, Homo sapiens
guuaaaaacacugcuga

SEQ ID NO: 1835230 - RNA, 16 nt, Homo sapiens
uguccuccucugugaa

SEQ ID NO: 1835231 - RNA, 19 nt, Homo sapiens
cucuacccacuaugcacag

SEQ ID NO: 1835232 - RNA, 17 nt, Homo sapiens
acuguccaccaguuuau

SEQ ID NO: 1835233 - RNA, 19 nt, Homo sapiens
agcagguagugggugaaug

SEQ ID NO: 1835234 - RNA, 23 nt, Homo sapiens
augccacaaggacuuccugucca

SEQ ID NO: 1835235 - RNA, 18 nt, Homo sapiens
aaagaugaagcugagaug

SEQ ID NO: 1835236 - RNA, 18 nt, Homo sapiens
aucagucuccaacauguu

SEQ ID NO: 1835237 - RNA, 21 nt, Homo sapiens
agcaggcggugggcacccacc

SEQ ID NO: 1835238 - RNA, 12 nt, Homo sapiens
agaagcaguuua

SEQ ID NO: 1835239 - RNA, 14 nt, Homo sapiens
caguggaggaauuu

SEQ ID NO: 1835240 - RNA, 23 nt, Homo sapiens
gaggccuaugcagacaucucugg

SEQ ID NO: 1835241 - RNA, 16 nt, Homo sapiens
aaccacagucuuccca

SEQ ID NO: 1835242 - RNA, 17 nt, Homo sapiens
aggccugcccugcuauu

SEQ ID NO: 1835243 - RNA, 21 nt, Homo sapiens
ccugaacguuuucuucuuucc

SEQ ID NO: 1835244 - RNA, 20 nt, Homo sapiens
cccuuuauucauccuaaaaa

SEQ ID NO: 1835245 - RNA, 22 nt, Homo sapiens
aaauguggaggcuaucaacaaa

SEQ ID NO: 1835246 - RNA, 19 nt, Homo sapiens
caaauugcugggauuacag

SEQ ID NO: 1835247 - RNA, 18 nt, Homo sapiens
agucuuaccaaugacuuu

SEQ ID NO: 1835248 - RNA, 21 nt, Homo sapiens
cuugguuuuuggcucuuucag

SEQ ID NO: 1835249 - RNA, 13 nt, Homo sapiens
gccgaagcuacug

SEQ ID NO: 1835250 - RNA, 23 nt, Homo sapiens
caacauggugaaaccucaucucu

SEQ ID NO: 1835251 - RNA, 18 nt, Homo sapiens
acugggucugaccuggug

SEQ ID NO: 1835252 - RNA, 12 nt, Homo sapiens
ugcagggagaca

SEQ ID NO: 1835253 - RNA, 13 nt, Homo sapiens
auggugucaugcc

SEQ ID NO: 1835254 - RNA, 18 nt, Homo sapiens
ucaaaucuguaauuacca

SEQ ID NO: 1835255 - RNA, 19 nt, Homo sapiens
ucucgcacacacagugauu

SEQ ID NO: 1835256 - RNA, 21 nt, Homo sapiens
caacuaaaaaaaaugcaagga

SEQ ID NO: 1835257 - RNA, 19 nt, Homo sapiens
ugcugucucuuaaaucucu

SEQ ID NO: 1835258 - RNA, 13 nt, Homo sapiens
uuaaaucuugaua

SEQ ID NO: 1835259 - RNA, 19 nt, Homo sapiens
agggaagcuccuccaguga

SEQ ID NO: 1835260 - RNA, 19 nt, Homo sapiens
gaaagaguccuauuugcac

SEQ ID NO: 1835261 - RNA, 17 nt, Homo sapiens
ugaccuagcaauaggca

SEQ ID NO: 1835262 - RNA, 12 nt, Homo sapiens
ugggacuggggc

SEQ ID NO: 1835263 - RNA, 18 nt, Homo sapiens
cugaauacacaguauuca

SEQ ID NO: 1835264 - RNA, 23 nt, Homo sapiens
ccccacguugccucuacuuuauc

SEQ ID NO: 1835265 - RNA, 21 nt, Homo sapiens
cucucuauaaguguucagugu

SEQ ID NO: 1835266 - RNA, 23 nt, Homo sapiens
acugaaggcuuucagggccucca

SEQ ID NO: 1835267 - RNA, 15 nt, Homo sapiens
aucuugcuaccagua

SEQ ID NO: 1835268 - RNA, 18 nt, Homo sapiens
caaagaaaacauagcacu

SEQ ID NO: 1835269 - RNA, 19 nt, Homo sapiens
caaccuccgcaucccgggu

SEQ ID NO: 1835270 - RNA, 17 nt, Homo sapiens
ucagcaucuuugcccuu

SEQ ID NO: 1835271 - RNA, 19 nt, Homo sapiens
cuucccaggaucugcucca

SEQ ID NO: 1835272 - RNA, 22 nt, Homo sapiens
uaagaaaucauggcauucacac

SEQ ID NO: 1835273 - RNA, 18 nt, Homo sapiens
augacugaaggacaucug

SEQ ID NO: 1835274 - RNA, 17 nt, Homo sapiens
gaauaaagcccuugaac

SEQ ID NO: 1835275 - RNA, 16 nt, Homo sapiens
gcuggcuguauggaaa

SEQ ID NO: 1835276 - RNA, 13 nt, Homo sapiens
ccaccaggauauc

SEQ ID NO: 1835277 - RNA, 14 nt, Homo sapiens
acugacaaugggca

SEQ ID NO: 1835278 - RNA, 13 nt, Homo sapiens
gccaccucacccu

SEQ ID NO: 1835279 - RNA, 18 nt, Homo sapiens
cagauuuaaaaaaagaac

SEQ ID NO: 1835280 - RNA, 18 nt, Homo sapiens
ugcaguggugugaucucg

SEQ ID NO: 1835281 - RNA, 22 nt, Homo sapiens
uaaaaggucuaugcucauaacu

SEQ ID NO: 1835282 - RNA, 16 nt, Homo sapiens
uaaguccagcucuccc

SEQ ID NO: 1835283 - RNA, 19 nt, Homo sapiens
caagagugguaucuugcag

SEQ ID NO: 1835284 - RNA, 18 nt, Homo sapiens
ggaauuauucuaugucaa

SEQ ID NO: 1835285 - RNA, 14 nt, Homo sapiens
cagaagaucugaaa

SEQ ID NO: 1835286 - RNA, 22 nt, Homo sapiens
ccagagcaucucggaguucaga

SEQ ID NO: 1835287 - RNA, 18 nt, Homo sapiens
aaauaccacuaguggaaa

SEQ ID NO: 1835288 - RNA, 17 nt, Homo sapiens
aaacccacaauugaacu

SEQ ID NO: 1835289 - RNA, 14 nt, Homo sapiens
cuucuucagaagac

SEQ ID NO: 1835290 - RNA, 13 nt, Homo sapiens
ggaggccucaguu

SEQ ID NO: 1835291 - RNA, 12 nt, Homo sapiens
caauuuauccaa

SEQ ID NO: 1835292 - RNA, 17 nt, Homo sapiens
cucucacuauaccagua

SEQ ID NO: 1835293 - RNA, 16 nt, Homo sapiens
gauuguaacaaauuga

SEQ ID NO: 1835294 - RNA, 18 nt, Homo sapiens
acaaaguuauauauuuau

SEQ ID NO: 1835295 - RNA, 16 nt, Homo sapiens
uuaaaaucauucaaua

SEQ ID NO: 1835296 - RNA, 19 nt, Homo sapiens
uugcuuugauuuacagcaa

SEQ ID NO: 1835297 - RNA, 18 nt, Homo sapiens
aacauuauuuauucagcu

SEQ ID NO: 1835298 - RNA, 16 nt, Homo sapiens
ucuguugaguugcugc

SEQ ID NO: 1835299 - RNA, 15 nt, Homo sapiens
cucuccugaggagca

SEQ ID NO: 1835300 - RNA, 17 nt, Homo sapiens
uuauauuaauguacuug

SEQ ID NO: 1835301 - RNA, 15 nt, Homo sapiens
aggaauuguuuuuau

SEQ ID NO: 1835302 - RNA, 13 nt, Homo sapiens
aaauauauuguac

SEQ ID NO: 1835303 - RNA, 19 nt, Homo sapiens
aauuauuuuguucauacau

SEQ ID NO: 1835304 - RNA, 23 nt, Homo sapiens
uccacacauuuaaaacauuugaa

SEQ ID NO: 1835305 - RNA, 16 nt, Homo sapiens
acaauucacaucccca

SEQ ID NO: 1835306 - RNA, 11 nt, Homo sapiens
cuuucuucccu

SEQ ID NO: 1835307 - RNA, 22 nt, Homo sapiens
ggaagaggccgcugcagggugg

SEQ ID NO: 1835308 - RNA, 16 nt, Homo sapiens
cagaaaaacucaugga

SEQ ID NO: 1835309 - RNA, 15 nt, Homo sapiens
accauggguguggau

SEQ ID NO: 1835310 - RNA, 15 nt, Homo sapiens
accucaccaacuccu

SEQ ID NO: 1835311 - RNA, 18 nt, Homo sapiens
uuauaaggaaaggcacau

SEQ ID NO: 1835312 - RNA, 14 nt, Homo sapiens
gauuaauguuuuca

SEQ ID NO: 1835313 - RNA, 17 nt, Homo sapiens
aacacuuccagcauuua

SEQ ID NO: 1835314 - RNA, 17 nt, Homo sapiens
aauuuggggaaauccau

SEQ ID NO: 1835315 - RNA, 15 nt, Homo sapiens
cauuucuagccucua

SEQ ID NO: 1835316 - RNA, 19 nt, Homo sapiens
agaauaaaguuccugucau

SEQ ID NO: 1835317 - RNA, 17 nt, Homo sapiens
cuagacuguuugcugau

SEQ ID NO: 1835318 - RNA, 23 nt, Homo sapiens
cucaaagcaaauaauuuuucacu

SEQ ID NO: 1835319 - RNA, 14 nt, Homo sapiens
auuuuuuauacugu

SEQ ID NO: 1835320 - RNA, 14 nt, Homo sapiens
aaucuauaacuaca

SEQ ID NO: 1835321 - RNA, 18 nt, Homo sapiens
aacauguccuacaacagc

SEQ ID NO: 1835322 - RNA, 18 nt, Homo sapiens
agauuuggcuugacaaag

SEQ ID NO: 1835323 - RNA, 15 nt, Homo sapiens
aucacauucuuucca

SEQ ID NO: 1835324 - RNA, 22 nt, Homo sapiens
cucuaaugagcuagugucuuau

SEQ ID NO: 1835325 - RNA, 17 nt, Homo sapiens
cacauccccauccccuu

SEQ ID NO: 1835326 - RNA, 15 nt, Homo sapiens
aaaaauguguuccau

SEQ ID NO: 1835327 - RNA, 18 nt, Homo sapiens
accccuaaggcaacugga

SEQ ID NO: 1835328 - RNA, 11 nt, Homo sapiens
acugauccagc

SEQ ID NO: 1835329 - RNA, 14 nt, Homo sapiens
cagauuuguucauu

SEQ ID NO: 1835330 - RNA, 14 nt, Homo sapiens
uagagcugcucagc

SEQ ID NO: 1835331 - RNA, 13 nt, Homo sapiens
agccagcccggcc

SEQ ID NO: 1835332 - RNA, 15 nt, Homo sapiens
ucaccacugcuuuaa

SEQ ID NO: 1835333 - RNA, 15 nt, Homo sapiens
ucuucucugcacuua

SEQ ID NO: 1835334 - RNA, 19 nt, Homo sapiens
uagaagagccugacugugu

SEQ ID NO: 1835335 - RNA, 11 nt, Homo sapiens
aggccacagaa

SEQ ID NO: 1835336 - RNA, 19 nt, Homo sapiens
aggcugguauuuuugucug

SEQ ID NO: 1835337 - RNA, 13 nt, Homo sapiens
cacacccagccuc

SEQ ID NO: 1835338 - RNA, 18 nt, Homo sapiens
gaagagggggcuggccau

SEQ ID NO: 1835339 - RNA, 18 nt, Homo sapiens
aucuauaacuacauauug

SEQ ID NO: 1835340 - RNA, 15 nt, Homo sapiens
caccuugugucugua

SEQ ID NO: 1835341 - RNA, 12 nt, Homo sapiens
caauaaaccucc

SEQ ID NO: 1835342 - RNA, 23 nt, Homo sapiens
aaggcaagccccccaucuagcaa

SEQ ID NO: 1835343 - RNA, 22 nt, Homo sapiens
auaggauuaaacacacacaaaa

SEQ ID NO: 1835344 - RNA, 12 nt, Homo sapiens
gcauguccucaa

SEQ ID NO: 1835345 - RNA, 17 nt, Homo sapiens
uaaaacugauguuacua

SEQ ID NO: 1835346 - RNA, 16 nt, Homo sapiens
ugugauuuaaaauacu

SEQ ID NO: 1835347 - RNA, 14 nt, Homo sapiens
cgagcacugugagc

SEQ ID NO: 1835348 - RNA, 12 nt, Homo sapiens
aagaagacauga

SEQ ID NO: 1835349 - RNA, 12 nt, Homo sapiens
cuccagaccacc

SEQ ID NO: 1835350 - RNA, 12 nt, Homo sapiens
aaaaagacauaa

SEQ ID NO: 1835351 - RNA, 16 nt, Homo sapiens
agacugacaccucacu

SEQ ID NO: 1835352 - RNA, 17 nt, Homo sapiens
gaaaauaugcauaauca

SEQ ID NO: 1835353 - RNA, 17 nt, Homo sapiens
acauaaauaaaaauuca

SEQ ID NO: 1835354 - RNA, 20 nt, Homo sapiens
caucuugucaagaaauaucc

SEQ ID NO: 1835355 - RNA, 18 nt, Homo sapiens
uacaagggaagauuuaug

SEQ ID NO: 1835356 - RNA, 15 nt, Homo sapiens
caugaaaaugacauu

SEQ ID NO: 1835357 - RNA, 14 nt, Homo sapiens
agcuccugggaccc

SEQ ID NO: 1835358 - RNA, 14 nt, Homo sapiens
ccuuuccuccccau

SEQ ID NO: 1835359 - RNA, 21 nt, Homo sapiens
aauccggucagccaagugcag

SEQ ID NO: 1835360 - RNA, 20 nt, Homo sapiens
gagcaugaagauaaauccaa

SEQ ID NO: 1835361 - RNA, 21 nt, Homo sapiens
uaauguucacauagugaaaua

SEQ ID NO: 1835362 - RNA, 14 nt, Homo sapiens
ugguaacucagugu

SEQ ID NO: 1835363 - RNA, 16 nt, Homo sapiens
agucacccuucugggc

SEQ ID NO: 1835364 - RNA, 20 nt, Homo sapiens
ugaggcggggagcaugaaga

SEQ ID NO: 1835365 - RNA, 20 nt, Homo sapiens
uuagagaagggggauaaaga

SEQ ID NO: 1835366 - RNA, 13 nt, Homo sapiens
agagaaucugaag

SEQ ID NO: 1835367 - RNA, 12 nt, Homo sapiens
acucagauuuaa

SEQ ID NO: 1835368 - RNA, 11 nt, Homo sapiens
uuauuuuggaa

SEQ ID NO: 1835369 - RNA, 21 nt, Homo sapiens
gagugcaauggugcgaucuca

SEQ ID NO: 1835370 - RNA, 22 nt, Homo sapiens
agcucuucuccauccuaccaca

SEQ ID NO: 1835371 - RNA, 15 nt, Homo sapiens
gaccagaagccuugg

SEQ ID NO: 1835372 - RNA, 19 nt, Homo sapiens
auaguauuggcaauaugaa

SEQ ID NO: 1835373 - RNA, 20 nt, Homo sapiens
gucaaaucaauaaauuucag

SEQ ID NO: 1835374 - RNA, 13 nt, Homo sapiens
gucuccucuucaa

SEQ ID NO: 1835375 - RNA, 11 nt, Homo sapiens
uuuacuuuguu

SEQ ID NO: 1835376 - RNA, 22 nt, Homo sapiens
aaaauguuuugaaaagaacaaa

SEQ ID NO: 1835377 - RNA, 22 nt, Homo sapiens
uauugguccagcuugcucuuca

SEQ ID NO: 1835378 - RNA, 20 nt, Homo sapiens
uccuuacucccaggcacugu

SEQ ID NO: 1835379 - RNA, 19 nt, Homo sapiens
uucuaaacugcaucuggau

SEQ ID NO: 1835380 - RNA, 19 nt, Homo sapiens
uuccagggucaaaguacag

SEQ ID NO: 1835381 - RNA, 21 nt, Homo sapiens
acccacaagagcaucaggcuc

SEQ ID NO: 1835382 - RNA, 20 nt, Homo sapiens
gccaccaugccgggccauga

SEQ ID NO: 1835383 - RNA, 15 nt, Homo sapiens
agggcgcuuguccca

SEQ ID NO: 1835384 - RNA, 22 nt, Homo sapiens
uuuccagggucuuuacugggaa

SEQ ID NO: 1835385 - RNA, 22 nt, Homo sapiens
uagggcaugauuaacaaagcaa

SEQ ID NO: 1835386 - RNA, 19 nt, Homo sapiens
guccccuucucucaucucu

SEQ ID NO: 1835387 - RNA, 17 nt, Homo sapiens
gauaaaaauaaugcauu

SEQ ID NO: 1835388 - RNA, 15 nt, Homo sapiens
aagcaacuuuuccaa

SEQ ID NO: 1835389 - RNA, 13 nt, Homo sapiens
guuuaaaauccaa

SEQ ID NO: 1835390 - RNA, 21 nt, Homo sapiens
ucauuaggacauaacagacua

SEQ ID NO: 1835391 - RNA, 13 nt, Homo sapiens
gcacacugccagu

SEQ ID NO: 1835392 - RNA, 22 nt, Homo sapiens
accauauauugagguucauugg

SEQ ID NO: 1835393 - RNA, 10 nt, Homo sapiens
gcuugcucua

SEQ ID NO: 1835394 - RNA, 21 nt, Homo sapiens
cugcucugucuucuuugccca

SEQ ID NO: 1835395 - RNA, 18 nt, Homo sapiens
guuucugauuaaugcuaa

SEQ ID NO: 1835396 - RNA, 21 nt, Homo sapiens
uuucuuguaaacauugccuga

SEQ ID NO: 1835397 - RNA, 18 nt, Homo sapiens
aucuuuuaggccaaggaa

SEQ ID NO: 1835398 - RNA, 19 nt, Homo sapiens
agcaacucugagaucuaag

SEQ ID NO: 1835399 - RNA, 19 nt, Homo sapiens
uacaguauguuuuacaugu

SEQ ID NO: 1835400 - RNA, 18 nt, Homo sapiens
acauucaauagcauauca

SEQ ID NO: 1835401 - RNA, 21 nt, Homo sapiens
uccuauggaaggguaauuuga

SEQ ID NO: 1835402 - RNA, 21 nt, Homo sapiens
auccuugaacugucagcccac

SEQ ID NO: 1835403 - RNA, 23 nt, Homo sapiens
uugugcuauuaggaaauucugau

SEQ ID NO: 1835404 - RNA, 17 nt, Homo sapiens
auguacaggcugagaca

SEQ ID NO: 1835405 - RNA, 15 nt, Homo sapiens
cagaccugacugccu

SEQ ID NO: 1835406 - RNA, 21 nt, Homo sapiens
aaguuacauuuaccaagagag

SEQ ID NO: 1835407 - RNA, 15 nt, Homo sapiens
cagacaggacugcag

SEQ ID NO: 1835408 - RNA, 19 nt, Homo sapiens
agaaagcuuuauauguaau

SEQ ID NO: 1835409 - RNA, 19 nt, Homo sapiens
cccacggcucaacuccucc

SEQ ID NO: 1835410 - RNA, 23 nt, Homo sapiens
gcucaagcacuuuuccugucuca

SEQ ID NO: 1835411 - RNA, 13 nt, Homo sapiens
auccuugaugaau

SEQ ID NO: 1835412 - RNA, 20 nt, Homo sapiens
auccaggaucaugagacauu

SEQ ID NO: 1835413 - RNA, 21 nt, Homo sapiens
gccaaggggugggccugugaa

SEQ ID NO: 1835414 - RNA, 17 nt, Homo sapiens
cucccagggaauccgac

SEQ ID NO: 1835415 - RNA, 19 nt, Homo sapiens
cacugccagucucacugug

SEQ ID NO: 1835416 - RNA, 19 nt, Homo sapiens
auaacuguucuucaauaaa

SEQ ID NO: 1835417 - RNA, 19 nt, Homo sapiens
ccuaagcuggagugcagug

SEQ ID NO: 1835418 - RNA, 18 nt, Homo sapiens
aucugcauuuagcacaaa

SEQ ID NO: 1835419 - RNA, 15 nt, Homo sapiens
cuggucuccuugaga

SEQ ID NO: 1835420 - RNA, 13 nt, Homo sapiens
gagacgggaccgg

SEQ ID NO: 1835421 - RNA, 22 nt, Homo sapiens
ccugcuucagauguggagccag

SEQ ID NO: 1835422 - RNA, 17 nt, Homo sapiens
gguaccugcaagcagaa

SEQ ID NO: 1835423 - RNA, 15 nt, Homo sapiens
acuauccuaccccac

SEQ ID NO: 1835424 - RNA, 15 nt, Homo sapiens
agcugcuccuaagga

SEQ ID NO: 1835425 - RNA, 17 nt, Homo sapiens
cccaugggaagggucca

SEQ ID NO: 1835426 - RNA, 13 nt, Homo sapiens
uuaauccaguuua

SEQ ID NO: 1835427 - RNA, 19 nt, Homo sapiens
cugauucucuacaugcucu

SEQ ID NO: 1835428 - RNA, 14 nt, Homo sapiens
cuugaguguguuac

SEQ ID NO: 1835429 - RNA, 16 nt, Homo sapiens
uuguacacgaagacca

SEQ ID NO: 1835430 - RNA, 11 nt, Homo sapiens
cauaguagcaa

SEQ ID NO: 1835431 - RNA, 14 nt, Homo sapiens
uuacacaugugcug

SEQ ID NO: 1835432 - RNA, 14 nt, Homo sapiens
ugcccagacaagau

SEQ ID NO: 1835433 - RNA, 15 nt, Homo sapiens
uuggcauggcuuuau

SEQ ID NO: 1835434 - RNA, 16 nt, Homo sapiens
augaacagacugaccu

SEQ ID NO: 1835435 - RNA, 18 nt, Homo sapiens
ugcacaguggggagcaug

SEQ ID NO: 1835436 - RNA, 17 nt, Homo sapiens
aaauuucauugcacuuu

SEQ ID NO: 1835437 - RNA, 14 nt, Homo sapiens
acaaaacuuaucuc

SEQ ID NO: 1835438 - RNA, 18 nt, Homo sapiens
gccgacucagcaacuuuc

SEQ ID NO: 1835439 - RNA, 14 nt, Homo sapiens
uagcgucaguauuu

SEQ ID NO: 1835440 - RNA, 12 nt, Homo sapiens
auucauuuuccu

SEQ ID NO: 1835441 - RNA, 10 nt, Homo sapiens
aaaggugagc

SEQ ID NO: 1835442 - RNA, 19 nt, Homo sapiens
ucauguagccccagucaga

SEQ ID NO: 1835443 - RNA, 21 nt, Homo sapiens
acucuuuuuuaugccuauucu

SEQ ID NO: 1835444 - RNA, 16 nt, Homo sapiens
gugaaugauucagugu

SEQ ID NO: 1835445 - RNA, 11 nt, Homo sapiens
uucaacagugu

SEQ ID NO: 1835446 - RNA, 22 nt, Homo sapiens
ccaucuccaggccccuuaccug

SEQ ID NO: 1835447 - RNA, 22 nt, Homo sapiens
ucaauccugcccccagccaugg

SEQ ID NO: 1835448 - RNA, 16 nt, Homo sapiens
cuggagugagcucugu

SEQ ID NO: 1835449 - RNA, 23 nt, Homo sapiens
ggccaagguggguggaucacuug

SEQ ID NO: 1835450 - RNA, 14 nt, Homo sapiens
auggggacauucca

SEQ ID NO: 1835451 - RNA, 21 nt, Homo sapiens
cugcuuccuccccuccuggca

SEQ ID NO: 1835452 - RNA, 14 nt, Homo sapiens
ugcuuacagugaug

SEQ ID NO: 1835453 - RNA, 14 nt, Homo sapiens
agcuggaacccugg

SEQ ID NO: 1835454 - RNA, 22 nt, Homo sapiens
aauucugucacucaccacuaca

SEQ ID NO: 1835455 - RNA, 22 nt, Homo sapiens
cuaauuuuuaagaaauuuugcc

SEQ ID NO: 1835456 - RNA, 19 nt, Homo sapiens
uaauggagcaucaagccac

SEQ ID NO: 1835457 - RNA, 20 nt, Homo sapiens
guaaauuuaaagaagucaua

SEQ ID NO: 1835458 - RNA, 14 nt, Homo sapiens
aacauuuucuugaa

SEQ ID NO: 1835459 - RNA, 21 nt, Homo sapiens
gcaccucuagggccucuccag

SEQ ID NO: 1835460 - RNA, 16 nt, Homo sapiens
ccaagagggacaucag

SEQ ID NO: 1835461 - RNA, 22 nt, Homo sapiens
uaaaguuacuauucuguaucau

SEQ ID NO: 1835462 - RNA, 17 nt, Homo sapiens
caugugccagggcaaug

SEQ ID NO: 1835463 - RNA, 18 nt, Homo sapiens
gugaggcccucaccagaa

SEQ ID NO: 1835464 - RNA, 16 nt, Homo sapiens
cagcagcugaagccag

SEQ ID NO: 1835465 - RNA, 19 nt, Homo sapiens
ucuggagugguaacagcuc

SEQ ID NO: 1835466 - RNA, 13 nt, Homo sapiens
ucccaacucccuu

SEQ ID NO: 1835467 - RNA, 19 nt, Homo sapiens
ugacagccauuuguaauga

SEQ ID NO: 1835468 - RNA, 21 nt, Homo sapiens
caugcugugugcuggagacac

SEQ ID NO: 1835469 - RNA, 22 nt, Homo sapiens
guuguuugauucagacagcugc

SEQ ID NO: 1835470 - RNA, 21 nt, Homo sapiens
cuucaccuuugucgcuggguc

SEQ ID NO: 1835471 - RNA, 20 nt, Homo sapiens
gagauugugccacuucacuc

SEQ ID NO: 1835472 - RNA, 15 nt, Homo sapiens
ucauggguuaugugu

SEQ ID NO: 1835473 - RNA, 20 nt, Homo sapiens
agcccucgccucugcgagaa

SEQ ID NO: 1835474 - RNA, 20 nt, Homo sapiens
uguucaugauagugugauuu

SEQ ID NO: 1835475 - RNA, 19 nt, Homo sapiens
caaauagaucaugcauuua

SEQ ID NO: 1835476 - RNA, 15 nt, Homo sapiens
auaaguaauacuuca

SEQ ID NO: 1835477 - RNA, 23 nt, Homo sapiens
gucuggggucuccuauacucuau

SEQ ID NO: 1835478 - RNA, 18 nt, Homo sapiens
aagggaagaaaaggugaa

SEQ ID NO: 1835479 - RNA, 17 nt, Homo sapiens
gcguccgaggacuuugg

SEQ ID NO: 1835480 - RNA, 14 nt, Homo sapiens
gaagcucuggccaa

SEQ ID NO: 1835481 - RNA, 13 nt, Homo sapiens
ggcagcagugaag

SEQ ID NO: 1835482 - RNA, 21 nt, Homo sapiens
ucacagccuuucugaacugac

SEQ ID NO: 1835483 - RNA, 21 nt, Homo sapiens
uucauuucuuuuucauuugac

SEQ ID NO: 1835484 - RNA, 15 nt, Homo sapiens
gcaaugucagaugaa

SEQ ID NO: 1835485 - RNA, 17 nt, Homo sapiens
agauguggaaaagccaa

SEQ ID NO: 1835486 - RNA, 22 nt, Homo sapiens
uggcgccccuuccuaggucaug

SEQ ID NO: 1835487 - RNA, 17 nt, Homo sapiens
acaaagauuugugguaa

SEQ ID NO: 1835488 - RNA, 22 nt, Homo sapiens
uuuaacucccuaguuacccacc

SEQ ID NO: 1835489 - RNA, 15 nt, Homo sapiens
ugcuuuuaucacuua

SEQ ID NO: 1835490 - RNA, 22 nt, Homo sapiens
aguuuucgugcuuccuccugac

SEQ ID NO: 1835491 - RNA, 16 nt, Homo sapiens
ccaggacaaaaugcag

SEQ ID NO: 1835492 - RNA, 18 nt, Homo sapiens
gucaggaguuccagacca

SEQ ID NO: 1835493 - RNA, 20 nt, Homo sapiens
guccuccaacaccaagcaca

SEQ ID NO: 1835494 - RNA, 15 nt, Homo sapiens
gccagcccuccuuga

SEQ ID NO: 1835495 - RNA, 20 nt, Homo sapiens
cucauacagugguauugcua

SEQ ID NO: 1835496 - RNA, 15 nt, Homo sapiens
agggugggcucugac

SEQ ID NO: 1835497 - RNA, 21 nt, Homo sapiens
agacccacaaggccagguccu

SEQ ID NO: 1835498 - RNA, 16 nt, Homo sapiens
ucuuggaauacuugaa

SEQ ID NO: 1835499 - RNA, 13 nt, Homo sapiens
gccucucuugccc

SEQ ID NO: 1835500 - RNA, 21 nt, Homo sapiens
gcgggcccugcccacaccucc

SEQ ID NO: 1835501 - RNA, 16 nt, Homo sapiens
caccgcccuccuccac

SEQ ID NO: 1835502 - RNA, 14 nt, Homo sapiens
aucuauuacaccuu

SEQ ID NO: 1835503 - RNA, 18 nt, Homo sapiens
uaauauaagcccaauauc

SEQ ID NO: 1835504 - RNA, 23 nt, Homo sapiens
aacugagggccagggacccaggu

SEQ ID NO: 1835505 - RNA, 22 nt, Homo sapiens
gcacacaggaaggaaagcgcag

SEQ ID NO: 1835506 - RNA, 16 nt, Homo sapiens
cagacagacaacacug

SEQ ID NO: 1835507 - RNA, 11 nt, Homo sapiens
acuaugcacaa

SEQ ID NO: 1835508 - RNA, 17 nt, Homo sapiens
ucccugcagccaccaga

SEQ ID NO: 1835509 - RNA, 17 nt, Homo sapiens
gcucuuuucaaugaaua

SEQ ID NO: 1835510 - RNA, 18 nt, Homo sapiens
uaaccuugaaauggaaag

SEQ ID NO: 1835511 - RNA, 19 nt, Homo sapiens
aacuucacaagaauggugu

SEQ ID NO: 1835512 - RNA, 15 nt, Homo sapiens
acuguggccucagga

SEQ ID NO: 1835513 - RNA, 14 nt, Homo sapiens
cagaacgguucuuu

SEQ ID NO: 1835514 - RNA, 19 nt, Homo sapiens
uuaaacucaagacaaugca

SEQ ID NO: 1835515 - RNA, 21 nt, Homo sapiens
caauacugcacacugcacauu

SEQ ID NO: 1835516 - RNA, 18 nt, Homo sapiens
gcugggcaugguggcgca

SEQ ID NO: 1835517 - RNA, 17 nt, Homo sapiens
agacaaauucggaugua

SEQ ID NO: 1835518 - RNA, 21 nt, Homo sapiens
gaauccuggaccaagcacaaa

SEQ ID NO: 1835519 - RNA, 17 nt, Homo sapiens
uucagucucuauaccaa

SEQ ID NO: 1835520 - RNA, 17 nt, Homo sapiens
uucagauugcugaaugg

SEQ ID NO: 1835521 - RNA, 16 nt, Homo sapiens
aaagccugcaauuuca

SEQ ID NO: 1835522 - RNA, 18 nt, Homo sapiens
cacaucugccagaccuua

SEQ ID NO: 1835523 - RNA, 20 nt, Homo sapiens
cacagggaugaccuggaguc

SEQ ID NO: 1835524 - RNA, 21 nt, Homo sapiens
aaagacuaugaucucauccca

SEQ ID NO: 1835525 - RNA, 17 nt, Homo sapiens
ccaggagcuccaguguc

SEQ ID NO: 1835526 - RNA, 15 nt, Homo sapiens
uucucuuacaaucug

SEQ ID NO: 1835527 - RNA, 18 nt, Homo sapiens
gcugaguggucugacacc

SEQ ID NO: 1835528 - RNA, 20 nt, Homo sapiens
cugugcuaggucugaccaaa

SEQ ID NO: 1835529 - RNA, 13 nt, Homo sapiens
caaauggcugcuu

SEQ ID NO: 1835530 - RNA, 11 nt, Homo sapiens
cauuuacuuuu

SEQ ID NO: 1835531 - RNA, 23 nt, Homo sapiens
ccuuggaggacccagcacugacc

SEQ ID NO: 1835532 - RNA, 21 nt, Homo sapiens
augccagggcgcacuuuccac

SEQ ID NO: 1835533 - RNA, 15 nt, Homo sapiens
auacuuaacauugau

SEQ ID NO: 1835534 - RNA, 13 nt, Homo sapiens
cccgcaaugugcc

SEQ ID NO: 1835535 - RNA, 17 nt, Homo sapiens
aaaaugccaccauccaa

SEQ ID NO: 1835536 - RNA, 14 nt, Homo sapiens
uggggacaucucau

SEQ ID NO: 1835537 - RNA, 20 nt, Homo sapiens
gauuaugauauuauuugauu

SEQ ID NO: 1835538 - RNA, 21 nt, Homo sapiens
cagagacccucugccaccaga

SEQ ID NO: 1835539 - RNA, 15 nt, Homo sapiens
aaauuaacacaaagg

SEQ ID NO: 1835540 - RNA, 23 nt, Homo sapiens
guuucucaaagaugcguuugccu

SEQ ID NO: 1835541 - RNA, 19 nt, Homo sapiens
agaguguggggaaugggaa

SEQ ID NO: 1835542 - RNA, 13 nt, Homo sapiens
uauccaucuugaa

SEQ ID NO: 1835543 - RNA, 16 nt, Homo sapiens
auuuggugacugugua

SEQ ID NO: 1835544 - RNA, 14 nt, Homo sapiens
aauuaaaaugacaa

SEQ ID NO: 1835545 - RNA, 13 nt, Homo sapiens
cugcaguauggcc

SEQ ID NO: 1835546 - RNA, 19 nt, Homo sapiens
uaaggagauagacggguug

SEQ ID NO: 1835547 - RNA, 21 nt, Homo sapiens
gugggcaggcaggagcagggg

SEQ ID NO: 1835548 - RNA, 23 nt, Homo sapiens
gugauuuuccuuuguagcuacuu

SEQ ID NO: 1835549 - RNA, 20 nt, Homo sapiens
uuuaucgcucuaaaguaaaa

SEQ ID NO: 1835550 - RNA, 22 nt, Homo sapiens
gcuaguccccuucuuuuggccc

SEQ ID NO: 1835551 - RNA, 22 nt, Homo sapiens
agggccgcccgggcccagagga

SEQ ID NO: 1835552 - RNA, 21 nt, Homo sapiens
uuuauaguugagaugucaaga

SEQ ID NO: 1835553 - RNA, 13 nt, Homo sapiens
ucuaaaggggaca

SEQ ID NO: 1835554 - RNA, 17 nt, Homo sapiens
cuuuggcagcugcaaua

SEQ ID NO: 1835555 - RNA, 15 nt, Homo sapiens
uuugaagucuucccu

SEQ ID NO: 1835556 - RNA, 18 nt, Homo sapiens
guucaauaugagucucaa

SEQ ID NO: 1835557 - RNA, 18 nt, Homo sapiens
cuaauauuaaaccuuuca

SEQ ID NO: 1835558 - RNA, 16 nt, Homo sapiens
cuugugauccuaaaau

SEQ ID NO: 1835559 - RNA, 12 nt, Homo sapiens
gaacacuugaag

SEQ ID NO: 1835560 - RNA, 21 nt, Homo sapiens
augacaagaugggacagcaac

SEQ ID NO: 1835561 - RNA, 11 nt, Homo sapiens
aagccaaagaa

SEQ ID NO: 1835562 - RNA, 22 nt, Homo sapiens
acccaauaaaacugauguuacu

SEQ ID NO: 1835563 - RNA, 14 nt, Homo sapiens
gccaggcucaggag

SEQ ID NO: 1835564 - RNA, 13 nt, Homo sapiens
cacccuguggucu

SEQ ID NO: 1835565 - RNA, 21 nt, Homo sapiens
gugcacauccgcgugugccug

SEQ ID NO: 1835566 - RNA, 19 nt, Homo sapiens
auauacagcaggugcucaa

SEQ ID NO: 1835567 - RNA, 22 nt, Homo sapiens
aucagauugcaugugacucuga

SEQ ID NO: 1835568 - RNA, 16 nt, Homo sapiens
cugucuguaaugugaa

SEQ ID NO: 1835569 - RNA, 20 nt, Homo sapiens
ugggcggcuccuggugcuaa

SEQ ID NO: 1835570 - RNA, 22 nt, Homo sapiens
cagcagcucacacccuaccuuc

SEQ ID NO: 1835571 - RNA, 14 nt, Homo sapiens
cucacuauggugcc

SEQ ID NO: 1835572 - RNA, 16 nt, Homo sapiens
uguauaauuaacuuaa

SEQ ID NO: 1835573 - RNA, 16 nt, Homo sapiens
agaaggauagccucag

SEQ ID NO: 1835574 - RNA, 22 nt, Homo sapiens
ccuucuuuuucuggacucugga

SEQ ID NO: 1835575 - RNA, 17 nt, Homo sapiens
acauuauucaucucucc

SEQ ID NO: 1835576 - RNA, 16 nt, Homo sapiens
ggucccugccaguguu

SEQ ID NO: 1835577 - RNA, 20 nt, Homo sapiens
gaaagcacaagguaaauauu

SEQ ID NO: 1835578 - RNA, 20 nt, Homo sapiens
cauguauuagccagucauug

SEQ ID NO: 1835579 - RNA, 20 nt, Homo sapiens
ccacagcgaaggcacaugcc

SEQ ID NO: 1835580 - RNA, 17 nt, Homo sapiens
ccuggcauguuccugcc

SEQ ID NO: 1835581 - RNA, 18 nt, Homo sapiens
ugucugucccgggguccu

SEQ ID NO: 1835582 - RNA, 13 nt, Homo sapiens
agaaaugggagaa

SEQ ID NO: 1835583 - RNA, 13 nt, Homo sapiens
acaagucugagua

SEQ ID NO: 1835584 - RNA, 23 nt, Homo sapiens
uauauagaaugaucuauugcuca

SEQ ID NO: 1835585 - RNA, 12 nt, Homo sapiens
accaacugagcc

SEQ ID NO: 1835586 - RNA, 12 nt, Homo sapiens
agaaacugacac

SEQ ID NO: 1835587 - RNA, 20 nt, Homo sapiens
gugucuguccuuuaugaucc

SEQ ID NO: 1835588 - RNA, 20 nt, Homo sapiens
aaguuuuucagaaagcauua

SEQ ID NO: 1835589 - RNA, 18 nt, Homo sapiens
aauucaaaaagaacuaaa

SEQ ID NO: 1835590 - RNA, 12 nt, Homo sapiens
aacauagugucu

SEQ ID NO: 1835591 - RNA, 12 nt, Homo sapiens
gaacgcuuucau

SEQ ID NO: 1835592 - RNA, 22 nt, Homo sapiens
agcacauuuggcuuacaguaaa

SEQ ID NO: 1835593 - RNA, 23 nt, Homo sapiens
uacuuucuguguugaagcacugu

SEQ ID NO: 1835594 - RNA, 17 nt, Homo sapiens
uccccugcuacaccuau

SEQ ID NO: 1835595 - RNA, 19 nt, Homo sapiens
cucccugguucugaugaug

SEQ ID NO: 1835596 - RNA, 11 nt, Homo sapiens
cccagcacuug

SEQ ID NO: 1835597 - RNA, 15 nt, Homo sapiens
aguacuuuaccuccu

SEQ ID NO: 1835598 - RNA, 15 nt, Homo sapiens
ugcaguauucuugca

SEQ ID NO: 1835599 - RNA, 18 nt, Homo sapiens
acugaaccaguccaggug

SEQ ID NO: 1835600 - RNA, 12 nt, Homo sapiens
cuugacauuccu

SEQ ID NO: 1835601 - RNA, 13 nt, Homo sapiens
gagcaguuugcca

SEQ ID NO: 1835602 - RNA, 14 nt, Homo sapiens
uucugggccaguga

SEQ ID NO: 1835603 - RNA, 19 nt, Homo sapiens
aauucuauuacgugcaaua

SEQ ID NO: 1835604 - RNA, 16 nt, Homo sapiens
auucaguggucuuauu

SEQ ID NO: 1835605 - RNA, 13 nt, Homo sapiens
uacuagcauauga

SEQ ID NO: 1835606 - RNA, 19 nt, Homo sapiens
cugcagugugaguaaugcu

SEQ ID NO: 1835607 - RNA, 21 nt, Homo sapiens
cugccuuugaucacaggagca

SEQ ID NO: 1835608 - RNA, 19 nt, Homo sapiens
aggccgggcgcaguggcuc

SEQ ID NO: 1835609 - RNA, 22 nt, Homo sapiens
gcucccuagguaggcaccacag

SEQ ID NO: 1835610 - RNA, 13 nt, Homo sapiens
cuuugaccagcac

SEQ ID NO: 1835611 - RNA, 22 nt, Homo sapiens
acacuagagaccaaaaagggga

SEQ ID NO: 1835612 - RNA, 16 nt, Homo sapiens
cuccucugcuaggcua

SEQ ID NO: 1835613 - RNA, 12 nt, Homo sapiens
ugcucugugaac

SEQ ID NO: 1835614 - RNA, 19 nt, Homo sapiens
aagucccuugaccuuucca

SEQ ID NO: 1835615 - RNA, 19 nt, Homo sapiens
acuucucucagacuuacuu

SEQ ID NO: 1835616 - RNA, 21 nt, Homo sapiens
gaaguuaguuuuaguucugua

SEQ ID NO: 1835617 - RNA, 13 nt, Homo sapiens
agggaaugcucag

SEQ ID NO: 1835618 - RNA, 20 nt, Homo sapiens
gugaauuuuuaaucagcaau

SEQ ID NO: 1835619 - RNA, 17 nt, Homo sapiens
caagaagaccaugaucu

SEQ ID NO: 1835620 - RNA, 17 nt, Homo sapiens
auuuagcuggccauuca

SEQ ID NO: 1835621 - RNA, 18 nt, Homo sapiens
uccaggacuccacuggac

SEQ ID NO: 1835622 - RNA, 22 nt, Homo sapiens
aggauagggccgacgcugugcc

SEQ ID NO: 1835623 - RNA, 23 nt, Homo sapiens
gcaacuuaagcugggauaaucac

SEQ ID NO: 1835624 - RNA, 20 nt, Homo sapiens
aaacaaacuacugugucacu

SEQ ID NO: 1835625 - RNA, 16 nt, Homo sapiens
agccagccaagcuuua

SEQ ID NO: 1835626 - RNA, 22 nt, Homo sapiens
caguugcccuagcccagacucu

SEQ ID NO: 1835627 - RNA, 22 nt, Homo sapiens
cauagacaaaggccuuaacaaa

SEQ ID NO: 1835628 - RNA, 23 nt, Homo sapiens
ucugcaggaugggugaaaccaca

SEQ ID NO: 1835629 - RNA, 21 nt, Homo sapiens
uaaugaaaauaaacauguaua

SEQ ID NO: 1835630 - RNA, 18 nt, Homo sapiens
cagaaugcucuacuucuu

SEQ ID NO: 1835631 - RNA, 18 nt, Homo sapiens
gcaggagaaucacuugaa

SEQ ID NO: 1835632 - RNA, 19 nt, Homo sapiens
agggucuuuucaucuggga

SEQ ID NO: 1835633 - RNA, 22 nt, Homo sapiens
aggaucuucccacuuugccacu

SEQ ID NO: 1835634 - RNA, 14 nt, Homo sapiens
aagugacauugcau

SEQ ID NO: 1835635 - RNA, 21 nt, Homo sapiens
cauuuagugaaguugugcaac

SEQ ID NO: 1835636 - RNA, 20 nt, Homo sapiens
caaaauaaggaugacuuuag

SEQ ID NO: 1835637 - RNA, 15 nt, Homo sapiens
agaauuugucagaaa

SEQ ID NO: 1835638 - RNA, 11 nt, Homo sapiens
gcucacuuuug

SEQ ID NO: 1835639 - RNA, 20 nt, Homo sapiens
gucugugugcaagugugugc

SEQ ID NO: 1835640 - RNA, 13 nt, Homo sapiens
guggaggcuuccu

SEQ ID NO: 1835641 - RNA, 20 nt, Homo sapiens
auaaugaauaaagugcaaac

SEQ ID NO: 1835642 - RNA, 15 nt, Homo sapiens
auaagaaacaugaug

SEQ ID NO: 1835643 - RNA, 16 nt, Homo sapiens
aaagaaaagaaaaaga

SEQ ID NO: 1835644 - RNA, 16 nt, Homo sapiens
gauacagaaaugcaaa

SEQ ID NO: 1835645 - RNA, 20 nt, Homo sapiens
aucagugacucacuuccaaa

SEQ ID NO: 1835646 - RNA, 22 nt, Homo sapiens
guacuuugaguauaacaucaag

SEQ ID NO: 1835647 - RNA, 19 nt, Homo sapiens
cauacgagagcagaggucu

SEQ ID NO: 1835648 - RNA, 19 nt, Homo sapiens
auacauaucgcugacuuca

SEQ ID NO: 1835649 - RNA, 16 nt, Homo sapiens
auugugcuucacagua

SEQ ID NO: 1835650 - RNA, 9 nt, Homo sapiens
gguccaaaa

SEQ ID NO: 1835651 - RNA, 16 nt, Homo sapiens
aaguuggacuugagaa

SEQ ID NO: 1835652 - RNA, 22 nt, Homo sapiens
gacaaaauacuugucuguuuua

SEQ ID NO: 1835653 - RNA, 14 nt, Homo sapiens
guucuccauuacag

SEQ ID NO: 1835654 - RNA, 17 nt, Homo sapiens
ggauauuuuuuacuuua

SEQ ID NO: 1835655 - RNA, 19 nt, Homo sapiens
gaggcagagucucuaguuc

SEQ ID NO: 1835656 - RNA, 19 nt, Homo sapiens
ugccauaaaccucaaguua

SEQ ID NO: 1835657 - RNA, 16 nt, Homo sapiens
uggcauagccccggcc

SEQ ID NO: 1835658 - RNA, 12 nt, Homo sapiens
gcacaguacuca

SEQ ID NO: 1835659 - RNA, 13 nt, Homo sapiens
caucucuaauaau

SEQ ID NO: 1835660 - RNA, 14 nt, Homo sapiens
gauuaccugccaau

SEQ ID NO: 1835661 - RNA, 13 nt, Homo sapiens
uugguccuaagca

SEQ ID NO: 1835662 - RNA, 15 nt, Homo sapiens
cuuccccgugcccua

SEQ ID NO: 1835663 - RNA, 16 nt, Homo sapiens
gccugcuguguggacu

SEQ ID NO: 1835664 - RNA, 19 nt, Homo sapiens
uccauuguggaaacuggau

SEQ ID NO: 1835665 - RNA, 16 nt, Homo sapiens
cucugcaguacuugau

SEQ ID NO: 1835666 - RNA, 17 nt, Homo sapiens
agggcuagaaccuggag

SEQ ID NO: 1835667 - RNA, 19 nt, Homo sapiens
ugggggcucaugccuguaa

SEQ ID NO: 1835668 - RNA, 15 nt, Homo sapiens
uguuauuugcucuaa

SEQ ID NO: 1835669 - RNA, 20 nt, Homo sapiens
gaagcuccccucuuccucuc

SEQ ID NO: 1835670 - RNA, 16 nt, Homo sapiens
acaacuugcuacugac

SEQ ID NO: 1835671 - RNA, 22 nt, Homo sapiens
uaauugcuccuauacuauugaa

SEQ ID NO: 1835672 - RNA, 18 nt, Homo sapiens
gaaacauucuuuccuaaa

SEQ ID NO: 1835673 - RNA, 18 nt, Homo sapiens
gcacagaugggaucacag

SEQ ID NO: 1835674 - RNA, 13 nt, Homo sapiens
ggcucuccagacc

SEQ ID NO: 1835675 - RNA, 20 nt, Homo sapiens
agggguuagucaagaagcug

SEQ ID NO: 1835676 - RNA, 15 nt, Homo sapiens
ucauucacgggacua

SEQ ID NO: 1835677 - RNA, 17 nt, Homo sapiens
caaguagcugagacuac

SEQ ID NO: 1835678 - RNA, 14 nt, Homo sapiens
ugucaaagaagcuu

SEQ ID NO: 1835679 - RNA, 16 nt, Homo sapiens
guguuccuucugugaa

SEQ ID NO: 1835680 - RNA, 20 nt, Homo sapiens
auuaauuaucgugucugcau

SEQ ID NO: 1835681 - RNA, 11 nt, Homo sapiens
gagugccaacu

SEQ ID NO: 1835682 - RNA, 11 nt, Homo sapiens
gcuugccaaag

SEQ ID NO: 1835683 - RNA, 14 nt, Homo sapiens
ugaggcccgaggca

SEQ ID NO: 1835684 - RNA, 21 nt, Homo sapiens
cuccugguguggaagagcucc

SEQ ID NO: 1835685 - RNA, 22 nt, Homo sapiens
cuccacguggcgggaaugagcu

SEQ ID NO: 1835686 - RNA, 20 nt, Homo sapiens
gggaaaaugacuuuauugcu

SEQ ID NO: 1835687 - RNA, 21 nt, Homo sapiens
guaaggaaauggaauacugaa

SEQ ID NO: 1835688 - RNA, 15 nt, Homo sapiens
acugagaccaaagaa

SEQ ID NO: 1835689 - RNA, 20 nt, Homo sapiens
ccauggcuccucaccaccga

SEQ ID NO: 1835690 - RNA, 14 nt, Homo sapiens
auucuacuugcucu

SEQ ID NO: 1835691 - RNA, 13 nt, Homo sapiens
cugcucauucuaa

SEQ ID NO: 1835692 - RNA, 18 nt, Homo sapiens
aauucccuggccuuucau

SEQ ID NO: 1835693 - RNA, 17 nt, Homo sapiens
agccuucccuugcccau

SEQ ID NO: 1835694 - RNA, 14 nt, Homo sapiens
ucucacuugucuca

SEQ ID NO: 1835695 - RNA, 18 nt, Homo sapiens
cucccuccucacucccua

SEQ ID NO: 1835696 - RNA, 14 nt, Homo sapiens
agccucccaaagug

SEQ ID NO: 1835697 - RNA, 20 nt, Homo sapiens
ucgugcccaucaagugcagu

SEQ ID NO: 1835698 - RNA, 21 nt, Homo sapiens
caacuuuguggaugucuuccu

SEQ ID NO: 1835699 - RNA, 17 nt, Homo sapiens
ccagccucaugggaagu

SEQ ID NO: 1835700 - RNA, 20 nt, Homo sapiens
aacuuacuguccaccaguuu

SEQ ID NO: 1835701 - RNA, 15 nt, Homo sapiens
cacagacaccagcaa

SEQ ID NO: 1835702 - RNA, 12 nt, Homo sapiens
caugaauggaga

SEQ ID NO: 1835703 - RNA, 15 nt, Homo sapiens
auugagaaacaugaa

SEQ ID NO: 1835704 - RNA, 21 nt, Homo sapiens
gcagagcuugaacacagucuc

SEQ ID NO: 1835705 - RNA, 19 nt, Homo sapiens
cugcuuugaaacuugccug

SEQ ID NO: 1835706 - RNA, 19 nt, Homo sapiens
caggcuggagugcaauggc

SEQ ID NO: 1835707 - RNA, 14 nt, Homo sapiens
ucuuugcauuccag

SEQ ID NO: 1835708 - RNA, 23 nt, Homo sapiens
uauacuuucccuacccucuagag

SEQ ID NO: 1835709 - RNA, 19 nt, Homo sapiens
gcuuauaccagguuaccuc

SEQ ID NO: 1835710 - RNA, 17 nt, Homo sapiens
aacauuuuuucccagug

SEQ ID NO: 1835711 - RNA, 22 nt, Homo sapiens
aauacuaguugugaccuuagug

SEQ ID NO: 1835712 - RNA, 13 nt, Homo sapiens
uucaccuugggau

SEQ ID NO: 1835713 - RNA, 20 nt, Homo sapiens
uggaaauaugcaaccugugc

SEQ ID NO: 1835714 - RNA, 13 nt, Homo sapiens
auauccaagaagc

SEQ ID NO: 1835715 - RNA, 18 nt, Homo sapiens
ggaaauagugauuuccac

SEQ ID NO: 1835716 - RNA, 13 nt, Homo sapiens
ccaucaggacuuu

SEQ ID NO: 1835717 - RNA, 14 nt, Homo sapiens
auaaugucuuguua

SEQ ID NO: 1835718 - RNA, 23 nt, Homo sapiens
aaaagaugcuucucacugccaug

SEQ ID NO: 1835719 - RNA, 16 nt, Homo sapiens
gcaaauuccaauacau

SEQ ID NO: 1835720 - RNA, 16 nt, Homo sapiens
uccuuaucgaaacuca

SEQ ID NO: 1835721 - RNA, 22 nt, Homo sapiens
ucuuggcuaacucagauucaug

SEQ ID NO: 1835722 - RNA, 12 nt, Homo sapiens
auuagacuccau

SEQ ID NO: 1835723 - RNA, 13 nt, Homo sapiens
cuccucagacugc

SEQ ID NO: 1835724 - RNA, 15 nt, Homo sapiens
ucagcaacuguuuaa

SEQ ID NO: 1835725 - RNA, 20 nt, Homo sapiens
uuaaugccugcuuuuuggaa

SEQ ID NO: 1835726 - RNA, 17 nt, Homo sapiens
aucaucacccuuucauu

SEQ ID NO: 1835727 - RNA, 19 nt, Homo sapiens
ugugcuccagauggugcua

SEQ ID NO: 1835728 - RNA, 20 nt, Homo sapiens
ccaggucucucaacuucauc

SEQ ID NO: 1835729 - RNA, 17 nt, Homo sapiens
cagaaccgcagaagccu

SEQ ID NO: 1835730 - RNA, 17 nt, Homo sapiens
caugugagcaugucacu

SEQ ID NO: 1835731 - RNA, 22 nt, Homo sapiens
caaguggcugggugcccucuca

SEQ ID NO: 1835732 - RNA, 16 nt, Homo sapiens
ccacuugcacugugcu

SEQ ID NO: 1835733 - RNA, 16 nt, Homo sapiens
agguacuaaaaacacu

SEQ ID NO: 1835734 - RNA, 20 nt, Homo sapiens
gcagcuuuugggaagucuca

SEQ ID NO: 1835735 - RNA, 12 nt, Homo sapiens
acuaugcugcuu

SEQ ID NO: 1835736 - RNA, 22 nt, Homo sapiens
auauuaaaaauaggugugauuu

SEQ ID NO: 1835737 - RNA, 23 nt, Homo sapiens
aacccugacuccucuuugugcag

SEQ ID NO: 1835738 - RNA, 18 nt, Homo sapiens
uaugaguaauacaucaaa

SEQ ID NO: 1835739 - RNA, 23 nt, Homo sapiens
acugcauugaaggcgaggcugcc

SEQ ID NO: 1835740 - RNA, 19 nt, Homo sapiens
ccgaggcugagaaucagac

SEQ ID NO: 1835741 - RNA, 16 nt, Homo sapiens
uuuaauagagaacuuc

SEQ ID NO: 1835742 - RNA, 15 nt, Homo sapiens
cuguuucaggcuucc

SEQ ID NO: 1835743 - RNA, 15 nt, Homo sapiens
uggggcccagugcau

SEQ ID NO: 1835744 - RNA, 22 nt, Homo sapiens
cuccuaucuuuuauuucauuca

SEQ ID NO: 1835745 - RNA, 14 nt, Homo sapiens
uaaaacauagcaaa

SEQ ID NO: 1835746 - RNA, 14 nt, Homo sapiens
ugauacauaacuaa

SEQ ID NO: 1835747 - RNA, 15 nt, Homo sapiens
gaggucccacuugca

SEQ ID NO: 1835748 - RNA, 19 nt, Homo sapiens
augucugagagaccaucuc

SEQ ID NO: 1835749 - RNA, 15 nt, Homo sapiens
agcgaaucaucucaa

SEQ ID NO: 1835750 - RNA, 16 nt, Homo sapiens
aacacaagagacuuaa

SEQ ID NO: 1835751 - RNA, 15 nt, Homo sapiens
guuuuaaaaggcaag

SEQ ID NO: 1835752 - RNA, 16 nt, Homo sapiens
ucuuuuaagcuaucua

SEQ ID NO: 1835753 - RNA, 18 nt, Homo sapiens
uaccuaguacaaggcaac

SEQ ID NO: 1835754 - RNA, 15 nt, Homo sapiens
acacaaguuccugau

SEQ ID NO: 1835755 - RNA, 22 nt, Homo sapiens
aagaaucuucugccccagcuuu

SEQ ID NO: 1835756 - RNA, 17 nt, Homo sapiens
cuuggaugcaugagcua

SEQ ID NO: 1835757 - RNA, 23 nt, Homo sapiens
ugcccugccaucgccuccaucag

SEQ ID NO: 1835758 - RNA, 17 nt, Homo sapiens
augaccugcugcuguug

SEQ ID NO: 1835759 - RNA, 17 nt, Homo sapiens
cacccuaacucuugcuc

SEQ ID NO: 1835760 - RNA, 18 nt, Homo sapiens
aguaugccacugcacucc

SEQ ID NO: 1835761 - RNA, 13 nt, Homo sapiens
ccaggugagaaac

SEQ ID NO: 1835762 - RNA, 18 nt, Homo sapiens
ucggcucauguagccuca

SEQ ID NO: 1835763 - RNA, 14 nt, Homo sapiens
ucauugaugcugcu

SEQ ID NO: 1835764 - RNA, 22 nt, Homo sapiens
cuggagaugacagugaugcugc

SEQ ID NO: 1835765 - RNA, 13 nt, Homo sapiens
cucaauacuugaa

SEQ ID NO: 1835766 - RNA, 14 nt, Homo sapiens
acuugaugccauuc

SEQ ID NO: 1835767 - RNA, 16 nt, Homo sapiens
ccugaccuugugaucu

SEQ ID NO: 1835768 - RNA, 23 nt, Homo sapiens
ggacuugauagcaaacacugggg

SEQ ID NO: 1835769 - RNA, 16 nt, Homo sapiens
cugucaucugcugcga

SEQ ID NO: 1835770 - RNA, 22 nt, Homo sapiens
accauuccugccuuuaagccaa

SEQ ID NO: 1835771 - RNA, 18 nt, Homo sapiens
caucucuggaugccugau

SEQ ID NO: 1835772 - RNA, 16 nt, Homo sapiens
ucacagcucuguagaa

SEQ ID NO: 1835773 - RNA, 18 nt, Homo sapiens
cacuaaaaggaagacagu

SEQ ID NO: 1835774 - RNA, 13 nt, Homo sapiens
guguuuagcauua

SEQ ID NO: 1835775 - RNA, 21 nt, Homo sapiens
ucuucacagauuuuuaucuua

SEQ ID NO: 1835776 - RNA, 14 nt, Homo sapiens
cacccucuccagau

SEQ ID NO: 1835777 - RNA, 18 nt, Homo sapiens
uucugcuucucuuucaca

SEQ ID NO: 1835778 - RNA, 18 nt, Homo sapiens
cauuaaaacaaauccaua

SEQ ID NO: 1835779 - RNA, 22 nt, Homo sapiens
agauuuaauuaugaaugauuag

SEQ ID NO: 1835780 - RNA, 23 nt, Homo sapiens
cagcucccucgucuucagcugca

SEQ ID NO: 1835781 - RNA, 22 nt, Homo sapiens
gaaauauaggauagacacugga

SEQ ID NO: 1835782 - RNA, 21 nt, Homo sapiens
gagguuucugguauucacaga

SEQ ID NO: 1835783 - RNA, 21 nt, Homo sapiens
aaucuccuucuuuccuggacu

SEQ ID NO: 1835784 - RNA, 16 nt, Homo sapiens
ggcauaauagucaauu

SEQ ID NO: 1835785 - RNA, 19 nt, Homo sapiens
gagccaacucuaacaggca

SEQ ID NO: 1835786 - RNA, 20 nt, Homo sapiens
ucgauccuggauucacucac

SEQ ID NO: 1835787 - RNA, 22 nt, Homo sapiens
ggccaagccuaucaaaggaaau

SEQ ID NO: 1835788 - RNA, 20 nt, Homo sapiens
cugaucgugcuaaauuuuca

SEQ ID NO: 1835789 - RNA, 17 nt, Homo sapiens
ugcugccaugacagagg

SEQ ID NO: 1835790 - RNA, 13 nt, Homo sapiens
aagcauucuuuaa

SEQ ID NO: 1835791 - RNA, 15 nt, Homo sapiens
ucuugcucagugaag

SEQ ID NO: 1835792 - RNA, 16 nt, Homo sapiens
gccauaaugacucaga

SEQ ID NO: 1835793 - RNA, 17 nt, Homo sapiens
ucuuuuccuccaugaug

SEQ ID NO: 1835794 - RNA, 16 nt, Homo sapiens
uccgugggacccucag

SEQ ID NO: 1835795 - RNA, 18 nt, Homo sapiens
agcaaaaucagaaguaua

SEQ ID NO: 1835796 - RNA, 19 nt, Homo sapiens
cugaagguuuccuggucca

SEQ ID NO: 1835797 - RNA, 19 nt, Homo sapiens
gaaacccuaucucuacuaa

SEQ ID NO: 1835798 - RNA, 16 nt, Homo sapiens
ggccuugcuaccucaa

SEQ ID NO: 1835799 - RNA, 18 nt, Homo sapiens
uagcauuugucaacaaag

SEQ ID NO: 1835800 - RNA, 21 nt, Homo sapiens
auaugaccauuugacuguuca

SEQ ID NO: 1835801 - RNA, 15 nt, Homo sapiens
gcaguucucugccaa

SEQ ID NO: 1835802 - RNA, 22 nt, Homo sapiens
ccccugaaguauuuuuuaaucc

SEQ ID NO: 1835803 - RNA, 14 nt, Homo sapiens
accagaucagauaa

SEQ ID NO: 1835804 - RNA, 11 nt, Homo sapiens
gcugugcucuc

SEQ ID NO: 1835805 - RNA, 13 nt, Homo sapiens
guaaucugagcag

SEQ ID NO: 1835806 - RNA, 20 nt, Homo sapiens
ugacucuaaauagcccagau

SEQ ID NO: 1835807 - RNA, 21 nt, Homo sapiens
uggggaauucugaggaggaaa

SEQ ID NO: 1835808 - RNA, 17 nt, Homo sapiens
uguaagaggaugugguu

SEQ ID NO: 1835809 - RNA, 15 nt, Homo sapiens
aauucugaacuuuau

SEQ ID NO: 1835810 - RNA, 18 nt, Homo sapiens
cccagcugccuagauuca

SEQ ID NO: 1835811 - RNA, 15 nt, Homo sapiens
auaacaggcauugca

SEQ ID NO: 1835812 - RNA, 15 nt, Homo sapiens
gguagcaacaacaga

SEQ ID NO: 1835813 - RNA, 13 nt, Homo sapiens
aggaagguacaaa

SEQ ID NO: 1835814 - RNA, 18 nt, Homo sapiens
cagggccagcccacguca

SEQ ID NO: 1835815 - RNA, 15 nt, Homo sapiens
agaggggcaaaaaua

SEQ ID NO: 1835816 - RNA, 19 nt, Homo sapiens
cuaccaagaacugaaggca

SEQ ID NO: 1835817 - RNA, 17 nt, Homo sapiens
uacaauuuguauuacuu

SEQ ID NO: 1835818 - RNA, 19 nt, Homo sapiens
cucagaaucgcuccaccuu

SEQ ID NO: 1835819 - RNA, 15 nt, Homo sapiens
aaaguaccacacaaa

SEQ ID NO: 1835820 - RNA, 15 nt, Homo sapiens
ugcauuaaacugaau

SEQ ID NO: 1835821 - RNA, 17 nt, Homo sapiens
gauucuagaacugugaa

SEQ ID NO: 1835822 - RNA, 21 nt, Homo sapiens
cugggaaaauacaagaaccaa

SEQ ID NO: 1835823 - RNA, 14 nt, Homo sapiens
gguauuagcaccuc

SEQ ID NO: 1835824 - RNA, 19 nt, Homo sapiens
aucuaguucucaaucacug

SEQ ID NO: 1835825 - RNA, 13 nt, Homo sapiens
agucccacacugu

SEQ ID NO: 1835826 - RNA, 19 nt, Homo sapiens
uuaagcuaggaaaagaaau

SEQ ID NO: 1835827 - RNA, 18 nt, Homo sapiens
uucacuggggaagccagu

SEQ ID NO: 1835828 - RNA, 16 nt, Homo sapiens
ucacauccccaaaggu

SEQ ID NO: 1835829 - RNA, 17 nt, Homo sapiens
uuuaaaauaagcuuucu

SEQ ID NO: 1835830 - RNA, 20 nt, Homo sapiens
ccugagcaaugucugugcua

SEQ ID NO: 1835831 - RNA, 11 nt, Homo sapiens
ccucaaaagaa

SEQ ID NO: 1835832 - RNA, 13 nt, Homo sapiens
uuccuccaccugc

SEQ ID NO: 1835833 - RNA, 17 nt, Homo sapiens
gcacccuucuuuccucu

SEQ ID NO: 1835834 - RNA, 14 nt, Homo sapiens
uuggucacauauca

SEQ ID NO: 1835835 - RNA, 22 nt, Homo sapiens
gucccugaggcagguccccaga

SEQ ID NO: 1835836 - RNA, 19 nt, Homo sapiens
aguuaugcugucauggucc

SEQ ID NO: 1835837 - RNA, 21 nt, Homo sapiens
cugagggcuaguuaauccaaa

SEQ ID NO: 1835838 - RNA, 18 nt, Homo sapiens
uguguaugucuauuugca

SEQ ID NO: 1835839 - RNA, 13 nt, Homo sapiens
ccuccaccugaua

SEQ ID NO: 1835840 - RNA, 20 nt, Homo sapiens
cucacucuccccaguccuca

SEQ ID NO: 1835841 - RNA, 22 nt, Homo sapiens
gcagcugucauggaaaagccca

SEQ ID NO: 1835842 - RNA, 19 nt, Homo sapiens
aggggacucaggggcuugg

SEQ ID NO: 1835843 - RNA, 18 nt, Homo sapiens
ugacuacuacucugccaa

SEQ ID NO: 1835844 - RNA, 19 nt, Homo sapiens
gcagcaugcaaacuuggau

SEQ ID NO: 1835845 - RNA, 15 nt, Homo sapiens
acacuugcacccaug

SEQ ID NO: 1835846 - RNA, 17 nt, Homo sapiens
aauugcaauacauuuca

SEQ ID NO: 1835847 - RNA, 24 nt, Homo sapiens
agggacuucccuagaagucuucau

SEQ ID NO: 1835848 - RNA, 12 nt, Homo sapiens
uccaguacuuga

SEQ ID NO: 1835849 - RNA, 13 nt, Homo sapiens
uaaguguucucau

SEQ ID NO: 1835850 - RNA, 23 nt, Homo sapiens
ugaugccagagggccagcaggcu

SEQ ID NO: 1835851 - RNA, 17 nt, Homo sapiens
aggcaguucuguguccu

SEQ ID NO: 1835852 - RNA, 16 nt, Homo sapiens
cagaucugaacacagu

SEQ ID NO: 1835853 - RNA, 15 nt, Homo sapiens
uccaaucaugaaaag

SEQ ID NO: 1835854 - RNA, 20 nt, Homo sapiens
acaacugccagcucucugau

SEQ ID NO: 1835855 - RNA, 15 nt, Homo sapiens
ugccaauacagacaa

SEQ ID NO: 1835856 - RNA, 20 nt, Homo sapiens
aacagaaauuaaucuuacaa

SEQ ID NO: 1835857 - RNA, 16 nt, Homo sapiens
aacuauguaacaugua

SEQ ID NO: 1835858 - RNA, 16 nt, Homo sapiens
uagaucagaagacuac

SEQ ID NO: 1835859 - RNA, 15 nt, Homo sapiens
uaagaaacacacuga

SEQ ID NO: 1835860 - RNA, 12 nt, Homo sapiens
aaaauguuuaau

SEQ ID NO: 1835861 - RNA, 19 nt, Homo sapiens
uuaaaaauuaaauucucuc

SEQ ID NO: 1835862 - RNA, 17 nt, Homo sapiens
ugagaauucagcugccc

SEQ ID NO: 1835863 - RNA, 19 nt, Homo sapiens
uauuguuuuugcaccagac

SEQ ID NO: 1835864 - RNA, 16 nt, Homo sapiens
ucccuuuggagaugcu

SEQ ID NO: 1835865 - RNA, 18 nt, Homo sapiens
uucugggucagcuugaau

SEQ ID NO: 1835866 - RNA, 22 nt, Homo sapiens
caacacugugcccugguggaga

SEQ ID NO: 1835867 - RNA, 16 nt, Homo sapiens
caagccugucuucaga

SEQ ID NO: 1835868 - RNA, 15 nt, Homo sapiens
cuuguaccaaggcaa

SEQ ID NO: 1835869 - RNA, 21 nt, Homo sapiens
uuuuguauuuaaagcauuuug

SEQ ID NO: 1835870 - RNA, 18 nt, Homo sapiens
uccugaggcaaaguagug

SEQ ID NO: 1835871 - RNA, 20 nt, Homo sapiens
acacacuuuauaacccaaaa

SEQ ID NO: 1835872 - RNA, 14 nt, Homo sapiens
gaaugcuccaugaa

SEQ ID NO: 1835873 - RNA, 16 nt, Homo sapiens
ugcucaugguccccau

SEQ ID NO: 1835874 - RNA, 16 nt, Homo sapiens
agggaccuagaagcuu

SEQ ID NO: 1835875 - RNA, 19 nt, Homo sapiens
agaaggacagcucuucccc

SEQ ID NO: 1835876 - RNA, 19 nt, Homo sapiens
ugggacauggcacaggccc

SEQ ID NO: 1835877 - RNA, 20 nt, Homo sapiens
uacccaggguggagugcagu

SEQ ID NO: 1835878 - RNA, 22 nt, Homo sapiens
caucugcaguguucugugaaua

SEQ ID NO: 1835879 - RNA, 15 nt, Homo sapiens
gcacuuccuggucuu

SEQ ID NO: 1835880 - RNA, 14 nt, Homo sapiens
ucacccaaacacuu

SEQ ID NO: 1835881 - RNA, 12 nt, Homo sapiens
cuugccaugcag

SEQ ID NO: 1835882 - RNA, 22 nt, Homo sapiens
ccuucaggccuugccugggaua

SEQ ID NO: 1835883 - RNA, 22 nt, Homo sapiens
cagucuuccauuugcaagggaa

SEQ ID NO: 1835884 - RNA, 22 nt, Homo sapiens
cacuagcauuuucuugaaccaa

SEQ ID NO: 1835885 - RNA, 18 nt, Homo sapiens
aauucagccaacauguga

SEQ ID NO: 1835886 - RNA, 21 nt, Homo sapiens
gauaguugaugcauguuacua

SEQ ID NO: 1835887 - RNA, 19 nt, Homo sapiens
cagccucucgaagugcuga

SEQ ID NO: 1835888 - RNA, 19 nt, Homo sapiens
aagucugauauugcaguaa

SEQ ID NO: 1835889 - RNA, 14 nt, Homo sapiens
gugaccuccacagc

SEQ ID NO: 1835890 - RNA, 12 nt, Homo sapiens
ugcgugugaaac

SEQ ID NO: 1835891 - RNA, 17 nt, Homo sapiens
uguuauuacuguuccca

SEQ ID NO: 1835892 - RNA, 22 nt, Homo sapiens
acagagcccccaagccucugcc

SEQ ID NO: 1835893 - RNA, 13 nt, Homo sapiens
ccaggcaggcuaa

SEQ ID NO: 1835894 - RNA, 23 nt, Homo sapiens
cucugacgaguacucuugaacac

SEQ ID NO: 1835895 - RNA, 15 nt, Homo sapiens
aaauuccacagauua

SEQ ID NO: 1835896 - RNA, 15 nt, Homo sapiens
gaagcauguacaaau

SEQ ID NO: 1835897 - RNA, 17 nt, Homo sapiens
acacacaccucauguga

SEQ ID NO: 1835898 - RNA, 14 nt, Homo sapiens
aacacaucuaccaa

SEQ ID NO: 1835899 - RNA, 18 nt, Homo sapiens
ucaauccuccauuugcug

SEQ ID NO: 1835900 - RNA, 21 nt, Homo sapiens
gguguaggaggggcugcagca

SEQ ID NO: 1835901 - RNA, 15 nt, Homo sapiens
ugcaugucuaauuca

SEQ ID NO: 1835902 - RNA, 22 nt, Homo sapiens
cugugauauuuucacacuggua

SEQ ID NO: 1835903 - RNA, 14 nt, Homo sapiens
uuccuguuugucua

SEQ ID NO: 1835904 - RNA, 19 nt, Homo sapiens
uacaaucgagacugcaaug

SEQ ID NO: 1835905 - RNA, 24 nt, Homo sapiens
gguguagaugggggaacugugaau

SEQ ID NO: 1835906 - RNA, 16 nt, Homo sapiens
ggaaaaucacuugaac

SEQ ID NO: 1835907 - RNA, 12 nt, Homo sapiens
aauugcauuucc

SEQ ID NO: 1835908 - RNA, 19 nt, Homo sapiens
ucuuuggaucagucuuugu

SEQ ID NO: 1835909 - RNA, 16 nt, Homo sapiens
ccaaugcguggcucuc

SEQ ID NO: 1835910 - RNA, 20 nt, Homo sapiens
aaacaaaauggguuacuuga

SEQ ID NO: 1835911 - RNA, 16 nt, Homo sapiens
ucuugaacuccugacc

SEQ ID NO: 1835912 - RNA, 16 nt, Homo sapiens
uuaugguacacuccag

SEQ ID NO: 1835913 - RNA, 20 nt, Homo sapiens
caggaguugacgcauccugc

SEQ ID NO: 1835914 - RNA, 15 nt, Homo sapiens
uuuaccuauccacaa

SEQ ID NO: 1835915 - RNA, 12 nt, Homo sapiens
agaucacagugg

SEQ ID NO: 1835916 - RNA, 20 nt, Homo sapiens
ucagacugauagacaccaua

SEQ ID NO: 1835917 - RNA, 17 nt, Homo sapiens
ucccugauuaauggagg

SEQ ID NO: 1835918 - RNA, 12 nt, Homo sapiens
uccaaugaagga

SEQ ID NO: 1835919 - RNA, 14 nt, Homo sapiens
ucaggauucuucaa

SEQ ID NO: 1835920 - RNA, 19 nt, Homo sapiens
uccuagcuguguuauuccu

SEQ ID NO: 1835921 - RNA, 15 nt, Homo sapiens
uaagugucucacuaa

SEQ ID NO: 1835922 - RNA, 18 nt, Homo sapiens
auuaauaaucuuauuagg

SEQ ID NO: 1835923 - RNA, 18 nt, Homo sapiens
uuuccuuuucuugucucu

SEQ ID NO: 1835924 - RNA, 19 nt, Homo sapiens
gcccagagccacagaaaau

SEQ ID NO: 1835925 - RNA, 14 nt, Homo sapiens
cagcugaugggggu

SEQ ID NO: 1835926 - RNA, 17 nt, Homo sapiens
uaaagaaaauaugcaua

SEQ ID NO: 1835927 - RNA, 15 nt, Homo sapiens
cuauaccaacaucug

SEQ ID NO: 1835928 - RNA, 16 nt, Homo sapiens
acagcacuguaugugu

SEQ ID NO: 1835929 - RNA, 21 nt, Homo sapiens
ucagacugcugggacuggcca

SEQ ID NO: 1835930 - RNA, 20 nt, Homo sapiens
ccaugcccucccugcugcca

SEQ ID NO: 1835931 - RNA, 15 nt, Homo sapiens
gcuaauguacuacgu

SEQ ID NO: 1835932 - RNA, 17 nt, Homo sapiens
cugcagggacaaacauc

SEQ ID NO: 1835933 - RNA, 13 nt, Homo sapiens
agaagaccagacu

SEQ ID NO: 1835934 - RNA, 13 nt, Homo sapiens
ugcagaccugccu

SEQ ID NO: 1835935 - RNA, 23 nt, Homo sapiens
ggagcggacucacuugauguuuc

SEQ ID NO: 1835936 - RNA, 20 nt, Homo sapiens
uccccagggugucucuauga

SEQ ID NO: 1835937 - RNA, 20 nt, Homo sapiens
gagcuguggguaaauuaacu

SEQ ID NO: 1835938 - RNA, 16 nt, Homo sapiens
aaaauugccucucucu

SEQ ID NO: 1835939 - RNA, 21 nt, Homo sapiens
ccccauccuucuccaccaaag

SEQ ID NO: 1835940 - RNA, 16 nt, Homo sapiens
caguaaauaacuggaa

SEQ ID NO: 1835941 - RNA, 17 nt, Homo sapiens
ccaacucggcugcaauu

SEQ ID NO: 1835942 - RNA, 13 nt, Homo sapiens
gagcaaaagccuc

SEQ ID NO: 1835943 - RNA, 23 nt, Homo sapiens
aauggaauuuuuuacccauacaa

SEQ ID NO: 1835944 - RNA, 19 nt, Homo sapiens
aguccguguccuaccuccg

SEQ ID NO: 1835945 - RNA, 22 nt, Homo sapiens
uaaagauuauaauaugugccuu

SEQ ID NO: 1835946 - RNA, 18 nt, Homo sapiens
guccacccaccuaugugc

SEQ ID NO: 1835947 - RNA, 18 nt, Homo sapiens
ucacuagcugucucagga

SEQ ID NO: 1835948 - RNA, 17 nt, Homo sapiens
ucggguccaccaugagg

SEQ ID NO: 1835949 - RNA, 17 nt, Homo sapiens
uacauauuuguggaaua

SEQ ID NO: 1835950 - RNA, 19 nt, Homo sapiens
uaaacacacuauggcauga

SEQ ID NO: 1835951 - RNA, 17 nt, Homo sapiens
ggcaaacuugcaguuua

SEQ ID NO: 1835952 - RNA, 17 nt, Homo sapiens
cuuucucagcaguggug

SEQ ID NO: 1835953 - RNA, 19 nt, Homo sapiens
uugggagggauggggaaaa

SEQ ID NO: 1835954 - RNA, 17 nt, Homo sapiens
uuugcuaccugaacacu

SEQ ID NO: 1835955 - RNA, 14 nt, Homo sapiens
caaaaaaaaaagca

SEQ ID NO: 1835956 - RNA, 14 nt, Homo sapiens
uaguuacugucagc

SEQ ID NO: 1835957 - RNA, 18 nt, Homo sapiens
aauuccauuuacuugauc

SEQ ID NO: 1835958 - RNA, 20 nt, Homo sapiens
gaagccugucuguacuucau

SEQ ID NO: 1835959 - RNA, 20 nt, Homo sapiens
uccugaguagcugggauuac

SEQ ID NO: 1835960 - RNA, 12 nt, Homo sapiens
cccucugugaaa

SEQ ID NO: 1835961 - RNA, 14 nt, Homo sapiens
aacugccucaggac

SEQ ID NO: 1835962 - RNA, 20 nt, Homo sapiens
aggagaguaccccccugaga

SEQ ID NO: 1835963 - RNA, 19 nt, Homo sapiens
ccuauuuucagauagcaca

SEQ ID NO: 1835964 - RNA, 19 nt, Homo sapiens
gcaggcuuugccauuguga

SEQ ID NO: 1835965 - RNA, 20 nt, Homo sapiens
agaagcugaggcuaguucca

SEQ ID NO: 1835966 - RNA, 15 nt, Homo sapiens
aguggugugaucucg

SEQ ID NO: 1835967 - RNA, 15 nt, Homo sapiens
aggggucugagcucc

SEQ ID NO: 1835968 - RNA, 20 nt, Homo sapiens
ccagcccugggcacauagca

SEQ ID NO: 1835969 - RNA, 19 nt, Homo sapiens
cucagccuggccagacaca

SEQ ID NO: 1835970 - RNA, 15 nt, Homo sapiens
uaauaugguguacau

SEQ ID NO: 1835971 - RNA, 19 nt, Homo sapiens
uccagggcuggacugaggc

SEQ ID NO: 1835972 - RNA, 14 nt, Homo sapiens
cagggagcaugaga

SEQ ID NO: 1835973 - RNA, 14 nt, Homo sapiens
cucuccauccugcu

SEQ ID NO: 1835974 - RNA, 22 nt, Homo sapiens
guccauuaagcugagagugcua

SEQ ID NO: 1835975 - RNA, 14 nt, Homo sapiens
agaaaauugccaaa

SEQ ID NO: 1835976 - RNA, 12 nt, Homo sapiens
ccuagucuccac

SEQ ID NO: 1835977 - RNA, 14 nt, Homo sapiens
gcucuaauguacaa

SEQ ID NO: 1835978 - RNA, 17 nt, Homo sapiens
caaagcuuaugugacau

SEQ ID NO: 1835979 - RNA, 15 nt, Homo sapiens
ucaaaagacaauucu

SEQ ID NO: 1835980 - RNA, 10 nt, Homo sapiens
ccacagauua

SEQ ID NO: 1835981 - RNA, 21 nt, Homo sapiens
augcagcucacuacccuauuc

SEQ ID NO: 1835982 - RNA, 15 nt, Homo sapiens
ucuguauauaacuua

SEQ ID NO: 1835983 - RNA, 14 nt, Homo sapiens
ggaagagcugugug

SEQ ID NO: 1835984 - RNA, 13 nt, Homo sapiens
aagagagaucaaa

SEQ ID NO: 1835985 - RNA, 17 nt, Homo sapiens
auuguuaugaaaauccu

SEQ ID NO: 1835986 - RNA, 16 nt, Homo sapiens
guaaauguacugguaa

SEQ ID NO: 1835987 - RNA, 17 nt, Homo sapiens
caugugcaauaugccaa

SEQ ID NO: 1835988 - RNA, 14 nt, Homo sapiens
auucuugacuuaua

SEQ ID NO: 1835989 - RNA, 18 nt, Homo sapiens
uugcacaggucccacugc

SEQ ID NO: 1835990 - RNA, 18 nt, Homo sapiens
uugucaagccugugcaaa

SEQ ID NO: 1835991 - RNA, 12 nt, Homo sapiens
cuagacccguga

SEQ ID NO: 1835992 - RNA, 16 nt, Homo sapiens
agcuggcaccauucag

SEQ ID NO: 1835993 - RNA, 23 nt, Homo sapiens
cuacugugucuuggaaucuagcc

SEQ ID NO: 1835994 - RNA, 14 nt, Homo sapiens
agaguccucugaau

SEQ ID NO: 1835995 - RNA, 17 nt, Homo sapiens
ucaucuauaacaugcau

SEQ ID NO: 1835996 - RNA, 16 nt, Homo sapiens
gaguagggaguucauc

SEQ ID NO: 1835997 - RNA, 19 nt, Homo sapiens
acuuaccucaaauuaagca

SEQ ID NO: 1835998 - RNA, 22 nt, Homo sapiens
aguaguagacuguaaaagauuc

SEQ ID NO: 1835999 - RNA, 19 nt, Homo sapiens
acacuaaaaaggcauguaa

SEQ ID NO: 1836000 - RNA, 15 nt, Homo sapiens
uaaagugcaauugca

SEQ ID NO: 1836001 - RNA, 15 nt, Homo sapiens
gcauugaaagaauua

SEQ ID NO: 1836002 - RNA, 23 nt, Homo sapiens
ugagaaauuucugugaaaccugu

SEQ ID NO: 1836003 - RNA, 15 nt, Homo sapiens
ugcccagggugcagu

SEQ ID NO: 1836004 - RNA, 22 nt, Homo sapiens
uuuauuauggcuugugaacugc

SEQ ID NO: 1836005 - RNA, 16 nt, Homo sapiens
cggaaacaacguugcu

SEQ ID NO: 1836006 - RNA, 14 nt, Homo sapiens
ucacgaacuugaaa

SEQ ID NO: 1836007 - RNA, 16 nt, Homo sapiens
ggaagcacauguuuau

SEQ ID NO: 1836008 - RNA, 20 nt, Homo sapiens
ugucauggcucugaacugca

SEQ ID NO: 1836009 - RNA, 20 nt, Homo sapiens
uuacauauuuuuuguauauu

SEQ ID NO: 1836010 - RNA, 17 nt, Homo sapiens
uucccucucccagucca

SEQ ID NO: 1836011 - RNA, 15 nt, Homo sapiens
caucuuccaccucac

SEQ ID NO: 1836012 - RNA, 13 nt, Homo sapiens
aagaggcuggaaa

SEQ ID NO: 1836013 - RNA, 21 nt, Homo sapiens
uugauucuagaugaucaacau

SEQ ID NO: 1836014 - RNA, 17 nt, Homo sapiens
auccuagcuacuuggca

SEQ ID NO: 1836015 - RNA, 13 nt, Homo sapiens
cuguucaccuggg

SEQ ID NO: 1836016 - RNA, 20 nt, Homo sapiens
ugaugaauguacuaugucug

SEQ ID NO: 1836017 - RNA, 22 nt, Homo sapiens
caugacuucugccccagcuuua

SEQ ID NO: 1836018 - RNA, 17 nt, Homo sapiens
uuauuuucuguaauucu

SEQ ID NO: 1836019 - RNA, 16 nt, Homo sapiens
uguuaacuaaauaacu

SEQ ID NO: 1836020 - RNA, 16 nt, Homo sapiens
auauucacacauauuc

SEQ ID NO: 1836021 - RNA, 16 nt, Homo sapiens
uccugucccuggccau

SEQ ID NO: 1836022 - RNA, 14 nt, Homo sapiens
gaugcaagcaccug

SEQ ID NO: 1836023 - RNA, 21 nt, Homo sapiens
cagcuucauuaugcagcugag

SEQ ID NO: 1836024 - RNA, 20 nt, Homo sapiens
uagguuaauaggaggacaga

SEQ ID NO: 1836025 - RNA, 17 nt, Homo sapiens
uccagauuucuguaaau

SEQ ID NO: 1836026 - RNA, 21 nt, Homo sapiens
acgucugucaggggcuuggau

SEQ ID NO: 1836027 - RNA, 19 nt, Homo sapiens
aaucuucuccuaugcauuu

SEQ ID NO: 1836028 - RNA, 20 nt, Homo sapiens
uccucuaagccacucuucca

SEQ ID NO: 1836029 - RNA, 19 nt, Homo sapiens
guagcaggaccugccaaga

SEQ ID NO: 1836030 - RNA, 20 nt, Homo sapiens
cacuaaacauaugaaugcag

SEQ ID NO: 1836031 - RNA, 23 nt, Homo sapiens
auuuucauccuauaagcuuaaau

SEQ ID NO: 1836032 - RNA, 22 nt, Homo sapiens
caaacagccccucuggacacag

SEQ ID NO: 1836033 - RNA, 15 nt, Homo sapiens
aagcccagccacauu

SEQ ID NO: 1836034 - RNA, 14 nt, Homo sapiens
uagcuaguaucuuc

SEQ ID NO: 1836035 - RNA, 17 nt, Homo sapiens
guuuauuaaaauacugu

SEQ ID NO: 1836036 - RNA, 20 nt, Homo sapiens
ggagagacauggaaagggag

SEQ ID NO: 1836037 - RNA, 17 nt, Homo sapiens
caggcugcagaugauca

SEQ ID NO: 1836038 - RNA, 18 nt, Homo sapiens
gaucuaggaagacuuugg

SEQ ID NO: 1836039 - RNA, 20 nt, Homo sapiens
caguauauaacuaacaacca

SEQ ID NO: 1836040 - RNA, 22 nt, Homo sapiens
agaggagacagacacacacugg

SEQ ID NO: 1836041 - RNA, 20 nt, Homo sapiens
aaccaaaucuggaagccaaa

SEQ ID NO: 1836042 - RNA, 15 nt, Homo sapiens
cagccacuucugcag

SEQ ID NO: 1836043 - RNA, 22 nt, Homo sapiens
acgguuaaauacuguguggaac

SEQ ID NO: 1836044 - RNA, 23 nt, Homo sapiens
ccugugugcacccaacgugaugc

SEQ ID NO: 1836045 - RNA, 16 nt, Homo sapiens
uuccuaauaugcuuua

SEQ ID NO: 1836046 - RNA, 17 nt, Homo sapiens
uuauuuccacuugcccu

SEQ ID NO: 1836047 - RNA, 12 nt, Homo sapiens
gcaccccagugg

SEQ ID NO: 1836048 - RNA, 23 nt, Homo sapiens
cugggggccucuucugcuuucuc

SEQ ID NO: 1836049 - RNA, 18 nt, Homo sapiens
ugaguauguucauugcca

SEQ ID NO: 1836050 - RNA, 12 nt, Homo sapiens
ugaacaguguga

SEQ ID NO: 1836051 - RNA, 12 nt, Homo sapiens
gguuuacugcug

SEQ ID NO: 1836052 - RNA, 23 nt, Homo sapiens
accaucugugcacgcaguggccu

SEQ ID NO: 1836053 - RNA, 23 nt, Homo sapiens
gcugaguuuauuaguacaugggc

SEQ ID NO: 1836054 - RNA, 22 nt, Homo sapiens
aacugcuuuuaaaagugcacau

SEQ ID NO: 1836055 - RNA, 15 nt, Homo sapiens
auggcuuugugauuc

SEQ ID NO: 1836056 - RNA, 20 nt, Homo sapiens
auucuuccaucaucacugua

SEQ ID NO: 1836057 - RNA, 13 nt, Homo sapiens
gaggugaauuuca

SEQ ID NO: 1836058 - RNA, 14 nt, Homo sapiens
gcagaggccaugaa

SEQ ID NO: 1836059 - RNA, 18 nt, Homo sapiens
uacacucucgaguuaaag

SEQ ID NO: 1836060 - RNA, 21 nt, Homo sapiens
cucccuaaccaaaugcugucu

SEQ ID NO: 1836061 - RNA, 14 nt, Homo sapiens
ccuugugucuguac

SEQ ID NO: 1836062 - RNA, 17 nt, Homo sapiens
auccaggcuguucucag

SEQ ID NO: 1836063 - RNA, 19 nt, Homo sapiens
ucccaguccaccugaggaa

SEQ ID NO: 1836064 - RNA, 15 nt, Homo sapiens
cagcaccuacagugu

SEQ ID NO: 1836065 - RNA, 14 nt, Homo sapiens
cauuuaucaucaca

SEQ ID NO: 1836066 - RNA, 20 nt, Homo sapiens
ucaguucuuacacauuccau

SEQ ID NO: 1836067 - RNA, 19 nt, Homo sapiens
gagaaauuaaauacucuga

SEQ ID NO: 1836068 - RNA, 14 nt, Homo sapiens
ugggccaccagaga

SEQ ID NO: 1836069 - RNA, 21 nt, Homo sapiens
uuccugcuaauaauuugccau

SEQ ID NO: 1836070 - RNA, 16 nt, Homo sapiens
caaagacacagacuug

SEQ ID NO: 1836071 - RNA, 23 nt, Homo sapiens
gcuauauuccuuuuucuaugaaa

SEQ ID NO: 1836072 - RNA, 22 nt, Homo sapiens
gcacaggaguguccucuucccu

SEQ ID NO: 1836073 - RNA, 17 nt, Homo sapiens
aggagucagaaacuguu

SEQ ID NO: 1836074 - RNA, 22 nt, Homo sapiens
aggacagccugccucugccaca

SEQ ID NO: 1836075 - RNA, 22 nt, Homo sapiens
ccccacguggacucugugcuca

SEQ ID NO: 1836076 - RNA, 22 nt, Homo sapiens
aagaaaauuuugggguaaaaag

SEQ ID NO: 1836077 - RNA, 17 nt, Homo sapiens
cacaugccaagcacugu

SEQ ID NO: 1836078 - RNA, 20 nt, Homo sapiens
aagaagaauuggccaucuua

SEQ ID NO: 1836079 - RNA, 18 nt, Homo sapiens
ugugagaggaucaucugg

SEQ ID NO: 1836080 - RNA, 14 nt, Homo sapiens
aucuaguaugcauu

SEQ ID NO: 1836081 - RNA, 18 nt, Homo sapiens
ucccacaugaucuugaga

SEQ ID NO: 1836082 - RNA, 16 nt, Homo sapiens
aagucauggacauuca

SEQ ID NO: 1836083 - RNA, 18 nt, Homo sapiens
caagaaguuuauucucau

SEQ ID NO: 1836084 - RNA, 19 nt, Homo sapiens
aggggagccugugguggcc

SEQ ID NO: 1836085 - RNA, 20 nt, Homo sapiens
acagagagggggccaccucc

SEQ ID NO: 1836086 - RNA, 23 nt, Homo sapiens
uuaaucaaagauugaacacugcg

SEQ ID NO: 1836087 - RNA, 18 nt, Homo sapiens
ccaacgucugugccauuu

SEQ ID NO: 1836088 - RNA, 19 nt, Homo sapiens
uauugagcaguucccaagg

SEQ ID NO: 1836089 - RNA, 18 nt, Homo sapiens
ccuaaugagaagucaaca

SEQ ID NO: 1836090 - RNA, 21 nt, Homo sapiens
ucauccuccuuauaagcccag

SEQ ID NO: 1836091 - RNA, 15 nt, Homo sapiens
ucuuaugccauguua

SEQ ID NO: 1836092 - RNA, 17 nt, Homo sapiens
ucacucagccacacccc

SEQ ID NO: 1836093 - RNA, 16 nt, Homo sapiens
agcauccacucucccu

SEQ ID NO: 1836094 - RNA, 21 nt, Homo sapiens
auacaaaauaaagaucacaca

SEQ ID NO: 1836095 - RNA, 21 nt, Homo sapiens
uagaaaaggcagcuaaaggaa

SEQ ID NO: 1836096 - RNA, 20 nt, Homo sapiens
cuccucccucagacccagcg

SEQ ID NO: 1836097 - RNA, 23 nt, Homo sapiens
aaacucuuuuaacagucugggcu

SEQ ID NO: 1836098 - RNA, 13 nt, Homo sapiens
cugccuucucacu

SEQ ID NO: 1836099 - RNA, 17 nt, Homo sapiens
caaaagagcauggaugc

SEQ ID NO: 1836100 - RNA, 13 nt, Homo sapiens
aggaacacuggcu

SEQ ID NO: 1836101 - RNA, 18 nt, Homo sapiens
cuuaagacagaguauccu

SEQ ID NO: 1836102 - RNA, 17 nt, Homo sapiens
aggcucccuuccugggg

SEQ ID NO: 1836103 - RNA, 22 nt, Homo sapiens
uuuacuuggaaauuguuaacau

SEQ ID NO: 1836104 - RNA, 18 nt, Homo sapiens
guuuauaugcccauucuu

SEQ ID NO: 1836105 - RNA, 20 nt, Homo sapiens
aauguauauaaaguacuuua

SEQ ID NO: 1836106 - RNA, 22 nt, Homo sapiens
cauagagauaugcacacacaga

SEQ ID NO: 1836107 - RNA, 12 nt, Homo sapiens
cugucaacauuu

SEQ ID NO: 1836108 - RNA, 13 nt, Homo sapiens
ccaucuccagugg

SEQ ID NO: 1836109 - RNA, 15 nt, Homo sapiens
cucagggaccaagga

SEQ ID NO: 1836110 - RNA, 17 nt, Homo sapiens
auguuauccacaagcaa

SEQ ID NO: 1836111 - RNA, 17 nt, Homo sapiens
ugcacaugcacgugugu

SEQ ID NO: 1836112 - RNA, 14 nt, Homo sapiens
auuucucacugaga

SEQ ID NO: 1836113 - RNA, 22 nt, Homo sapiens
cuguucaagaaacaaccuuuca

SEQ ID NO: 1836114 - RNA, 14 nt, Homo sapiens
agcagcucauaaau

SEQ ID NO: 1836115 - RNA, 19 nt, Homo sapiens
ugcaaagcuuuggcugaga

SEQ ID NO: 1836116 - RNA, 13 nt, Homo sapiens
cuaccacuuugaa

SEQ ID NO: 1836117 - RNA, 13 nt, Homo sapiens
ugaguguguuugu

SEQ ID NO: 1836118 - RNA, 14 nt, Homo sapiens
cagaaaaccacuuu

SEQ ID NO: 1836119 - RNA, 13 nt, Homo sapiens
cuaaucugcagug

SEQ ID NO: 1836120 - RNA, 21 nt, Homo sapiens
caccuuacuucuucucauacu

SEQ ID NO: 1836121 - RNA, 21 nt, Homo sapiens
cacuucaguuaucuugaucuc

SEQ ID NO: 1836122 - RNA, 22 nt, Homo sapiens
ugaaaagaauuguuggggguuu

SEQ ID NO: 1836123 - RNA, 14 nt, Homo sapiens
agcauaaagcaauu

SEQ ID NO: 1836124 - RNA, 18 nt, Homo sapiens
aaucagcuacccauuaua

SEQ ID NO: 1836125 - RNA, 16 nt, Homo sapiens
ugaugucuccacuuuc

SEQ ID NO: 1836126 - RNA, 15 nt, Homo sapiens
uauaagcccagcucu

SEQ ID NO: 1836127 - RNA, 14 nt, Homo sapiens
caauacaaaaagcc

SEQ ID NO: 1836128 - RNA, 17 nt, Homo sapiens
gcuuggcagauguggau

SEQ ID NO: 1836129 - RNA, 14 nt, Homo sapiens
gcagccagggccag

SEQ ID NO: 1836130 - RNA, 18 nt, Homo sapiens
agaagggcaaauauuuau

SEQ ID NO: 1836131 - RNA, 14 nt, Homo sapiens
aauaaauugugaaa

SEQ ID NO: 1836132 - RNA, 20 nt, Homo sapiens
auuucuuauaccuucugaca

SEQ ID NO: 1836133 - RNA, 13 nt, Homo sapiens
ucugacuaccucc

SEQ ID NO: 1836134 - RNA, 14 nt, Homo sapiens
acuacagggagaaa

SEQ ID NO: 1836135 - RNA, 14 nt, Homo sapiens
aagcaagggcucca

SEQ ID NO: 1836136 - RNA, 21 nt, Homo sapiens
ccagguucaagcuauucucau

SEQ ID NO: 1836137 - RNA, 21 nt, Homo sapiens
cuccaaaacaauuuucugcag

SEQ ID NO: 1836138 - RNA, 16 nt, Homo sapiens
cacugaagucaccauu

SEQ ID NO: 1836139 - RNA, 22 nt, Homo sapiens
guuuuacuucugauagccggug

SEQ ID NO: 1836140 - RNA, 16 nt, Homo sapiens
ucaacaugacuggugg

SEQ ID NO: 1836141 - RNA, 15 nt, Homo sapiens
guugaaugagugugu

SEQ ID NO: 1836142 - RNA, 22 nt, Homo sapiens
ucugaucuauauuucuggugaa

SEQ ID NO: 1836143 - RNA, 20 nt, Homo sapiens
aagggaaauuucaauaaccu

SEQ ID NO: 1836144 - RNA, 19 nt, Homo sapiens
acuuuaguaacagcacaac

SEQ ID NO: 1836145 - RNA, 14 nt, Homo sapiens
ucccauacucucaa

SEQ ID NO: 1836146 - RNA, 20 nt, Homo sapiens
augucucugcuuccauggcu

SEQ ID NO: 1836147 - RNA, 20 nt, Homo sapiens
accuuugauuuuuugcccag

SEQ ID NO: 1836148 - RNA, 11 nt, Homo sapiens
cuccugaccaa

SEQ ID NO: 1836149 - RNA, 18 nt, Homo sapiens
agcuagaauuugauaugu

SEQ ID NO: 1836150 - RNA, 13 nt, Homo sapiens
auguggucuguca

SEQ ID NO: 1836151 - RNA, 17 nt, Homo sapiens
aguguugacauagccuu

SEQ ID NO: 1836152 - RNA, 16 nt, Homo sapiens
agucucagcagcucuu

SEQ ID NO: 1836153 - RNA, 15 nt, Homo sapiens
auagauuuuuucaga

SEQ ID NO: 1836154 - RNA, 15 nt, Homo sapiens
guccaccaccaccug

SEQ ID NO: 1836155 - RNA, 23 nt, Homo sapiens
gagccagcucucucuacccggcc

SEQ ID NO: 1836156 - RNA, 13 nt, Homo sapiens
ugacuggccaaaa

SEQ ID NO: 1836157 - RNA, 23 nt, Homo sapiens
caucauuccugucagagcuuuca

SEQ ID NO: 1836158 - RNA, 12 nt, Homo sapiens
uccauugcaugu

SEQ ID NO: 1836159 - RNA, 17 nt, Homo sapiens
gccccgcgaccaugugg

SEQ ID NO: 1836160 - RNA, 19 nt, Homo sapiens
uagcagaaggcaagcacca

SEQ ID NO: 1836161 - RNA, 13 nt, Homo sapiens
acacacagugauu

SEQ ID NO: 1836162 - RNA, 13 nt, Homo sapiens
ucauaccauggag

SEQ ID NO: 1836163 - RNA, 12 nt, Homo sapiens
uaaaacuguaua

SEQ ID NO: 1836164 - RNA, 12 nt, Homo sapiens
uauaacuguaaa

SEQ ID NO: 1836165 - RNA, 22 nt, Homo sapiens
acucagaaugcacuugauucag

SEQ ID NO: 1836166 - RNA, 15 nt, Homo sapiens
guguuuuuaaggaaa

SEQ ID NO: 1836167 - RNA, 12 nt, Homo sapiens
uuaaugagauag

SEQ ID NO: 1836168 - RNA, 23 nt, Homo sapiens
caagccaaaaaccuuagcucccu

SEQ ID NO: 1836169 - RNA, 20 nt, Homo sapiens
agcauaggcucuuuuugcug

SEQ ID NO: 1836170 - RNA, 14 nt, Homo sapiens
ccaagaacagaguc

SEQ ID NO: 1836171 - RNA, 13 nt, Homo sapiens
gagggagguguuu

SEQ ID NO: 1836172 - RNA, 15 nt, Homo sapiens
ucacacccuaauaag

SEQ ID NO: 1836173 - RNA, 22 nt, Homo sapiens
acuaaaacaaguacaucuguac

SEQ ID NO: 1836174 - RNA, 15 nt, Homo sapiens
gaucuacacucucga

SEQ ID NO: 1836175 - RNA, 21 nt, Homo sapiens
ucugcccuugccaacggagag

SEQ ID NO: 1836176 - RNA, 22 nt, Homo sapiens
gaguuagaagggccagauuuca

SEQ ID NO: 1836177 - RNA, 17 nt, Homo sapiens
ugcaagcaacaagcuau

SEQ ID NO: 1836178 - RNA, 20 nt, Homo sapiens
cauaauugugauuagacaga

SEQ ID NO: 1836179 - RNA, 23 nt, Homo sapiens
uuccucuuguucuaaucuuguca

SEQ ID NO: 1836180 - RNA, 18 nt, Homo sapiens
uacaauauaaauauauag

SEQ ID NO: 1836181 - RNA, 16 nt, Homo sapiens
aauggaauccuucccu

SEQ ID NO: 1836182 - RNA, 19 nt, Homo sapiens
auugcacugaucuuacucu

SEQ ID NO: 1836183 - RNA, 21 nt, Homo sapiens
uccugaagggggacacuccau

SEQ ID NO: 1836184 - RNA, 16 nt, Homo sapiens
ugcccaggcuggagua

SEQ ID NO: 1836185 - RNA, 18 nt, Homo sapiens
uuucacaccuuacaaagc

SEQ ID NO: 1836186 - RNA, 12 nt, Homo sapiens
gcagaccaacag

SEQ ID NO: 1836187 - RNA, 12 nt, Homo sapiens
aagaaccagaga

SEQ ID NO: 1836188 - RNA, 17 nt, Homo sapiens
uccuuaauucugccuaa

SEQ ID NO: 1836189 - RNA, 17 nt, Homo sapiens
uuagauguugguggugc

SEQ ID NO: 1836190 - RNA, 22 nt, Homo sapiens
aaaacaguccuuuaaauuuugc

SEQ ID NO: 1836191 - RNA, 17 nt, Homo sapiens
caccuaucacccaggcu

SEQ ID NO: 1836192 - RNA, 15 nt, Homo sapiens
cuuuuucacugccua

SEQ ID NO: 1836193 - RNA, 21 nt, Homo sapiens
gcaagaaaagcgcagagaaau

SEQ ID NO: 1836194 - RNA, 19 nt, Homo sapiens
ucgugggucagcucugagg

SEQ ID NO: 1836195 - RNA, 21 nt, Homo sapiens
agcacucgcuagcaguggcag

SEQ ID NO: 1836196 - RNA, 19 nt, Homo sapiens
ucuaagugggagacaauau

SEQ ID NO: 1836197 - RNA, 21 nt, Homo sapiens
ggcaauaaaagaaauguugcg

SEQ ID NO: 1836198 - RNA, 16 nt, Homo sapiens
ucuaaauaugcccaau

SEQ ID NO: 1836199 - RNA, 17 nt, Homo sapiens
ucuguugaaaagcacac

SEQ ID NO: 1836200 - RNA, 10 nt, Homo sapiens
aaccuuccaa

SEQ ID NO: 1836201 - RNA, 18 nt, Homo sapiens
aauaaacauuuguagcau

SEQ ID NO: 1836202 - RNA, 15 nt, Homo sapiens
cauacaaauuuuccc

SEQ ID NO: 1836203 - RNA, 13 nt, Homo sapiens
aaaauaguuaccu

SEQ ID NO: 1836204 - RNA, 20 nt, Homo sapiens
ucaagacccuuuucuguaug

SEQ ID NO: 1836205 - RNA, 22 nt, Homo sapiens
gggcacucccuugguggcaaga

SEQ ID NO: 1836206 - RNA, 22 nt, Homo sapiens
acaugauaaaaagaaaugugau

SEQ ID NO: 1836207 - RNA, 17 nt, Homo sapiens
ugugugaaaucuuucaa

SEQ ID NO: 1836208 - RNA, 17 nt, Homo sapiens
uccagaacuaccaaaau

SEQ ID NO: 1836209 - RNA, 21 nt, Homo sapiens
gagccagcugcagaagggugg

SEQ ID NO: 1836210 - RNA, 19 nt, Homo sapiens
aagaccaggucuacaguga

SEQ ID NO: 1836211 - RNA, 13 nt, Homo sapiens
cuuuaccuaccac

SEQ ID NO: 1836212 - RNA, 18 nt, Homo sapiens
aaugagaacaaucucaaa

SEQ ID NO: 1836213 - RNA, 15 nt, Homo sapiens
uguuagaaucaaaua

SEQ ID NO: 1836214 - RNA, 23 nt, Homo sapiens
aguuugccuaauucauguuuuca

SEQ ID NO: 1836215 - RNA, 18 nt, Homo sapiens
ccuuuggauggcuaugga

SEQ ID NO: 1836216 - RNA, 23 nt, Homo sapiens
agcucugucugcucaaugccauu

SEQ ID NO: 1836217 - RNA, 15 nt, Homo sapiens
aaaaugucuucuccc

SEQ ID NO: 1836218 - RNA, 15 nt, Homo sapiens
gaaacugaaacucac

SEQ ID NO: 1836219 - RNA, 18 nt, Homo sapiens
aaugugugguuuuuauga

SEQ ID NO: 1836220 - RNA, 15 nt, Homo sapiens
aggagacccacaggu

SEQ ID NO: 1836221 - RNA, 15 nt, Homo sapiens
uaacuuuucaccaau

SEQ ID NO: 1836222 - RNA, 22 nt, Homo sapiens
ucagaguggucgagugacacac

SEQ ID NO: 1836223 - RNA, 19 nt, Homo sapiens
cauacgauuugagccugaa

SEQ ID NO: 1836224 - RNA, 22 nt, Homo sapiens
cagcuucacccugaggugagca

SEQ ID NO: 1836225 - RNA, 16 nt, Homo sapiens
uugaccugcugaaguc

SEQ ID NO: 1836226 - RNA, 15 nt, Homo sapiens
aucucagaucacugc

SEQ ID NO: 1836227 - RNA, 23 nt, Homo sapiens
uguguucacaaaggcagagaguc

SEQ ID NO: 1836228 - RNA, 20 nt, Homo sapiens
ugaacuuaacaugcugugua

SEQ ID NO: 1836229 - RNA, 17 nt, Homo sapiens
caauaugacucagagaa

SEQ ID NO: 1836230 - RNA, 21 nt, Homo sapiens
uggcugguaaauugccauggc

SEQ ID NO: 1836231 - RNA, 19 nt, Homo sapiens
accaaguuaucaucucacc

SEQ ID NO: 1836232 - RNA, 13 nt, Homo sapiens
acaagugaccccc

SEQ ID NO: 1836233 - RNA, 23 nt, Homo sapiens
acuuuguuuucaagaugguguua

SEQ ID NO: 1836234 - RNA, 20 nt, Homo sapiens
gcuucauaaaugaagcagcu

SEQ ID NO: 1836235 - RNA, 17 nt, Homo sapiens
gccagagauccaaaaga

SEQ ID NO: 1836236 - RNA, 17 nt, Homo sapiens
caaaggggacagcugug

SEQ ID NO: 1836237 - RNA, 18 nt, Homo sapiens
accuccccagcccaggaa

SEQ ID NO: 1836238 - RNA, 22 nt, Homo sapiens
cauuucauuguaugauguguug

SEQ ID NO: 1836239 - RNA, 21 nt, Homo sapiens
caaauauuaucuuuguucucc

SEQ ID NO: 1836240 - RNA, 23 nt, Homo sapiens
aaauggggauauguuaacuauug

SEQ ID NO: 1836241 - RNA, 22 nt, Homo sapiens
uuccagcuuagaaugcaucuca

SEQ ID NO: 1836242 - RNA, 16 nt, Homo sapiens
ugcccugaacauacac

SEQ ID NO: 1836243 - RNA, 13 nt, Homo sapiens
auuuuuccauuuu

SEQ ID NO: 1836244 - RNA, 13 nt, Homo sapiens
agcuguccagcug

SEQ ID NO: 1836245 - RNA, 13 nt, Homo sapiens
uuccuuccuuccu

SEQ ID NO: 1836246 - RNA, 22 nt, Homo sapiens
ccuuguccccaacguuccacaa

SEQ ID NO: 1836247 - RNA, 23 nt, Homo sapiens
uguugauaauaguaaugguucua

SEQ ID NO: 1836248 - RNA, 23 nt, Homo sapiens
auuaucaccuuccccucacacuc

SEQ ID NO: 1836249 - RNA, 20 nt, Homo sapiens
gcauuuggucucacuacuug

SEQ ID NO: 1836250 - RNA, 15 nt, Homo sapiens
gcaagaaaugaacuu

SEQ ID NO: 1836251 - RNA, 14 nt, Homo sapiens
caccagggacugca

SEQ ID NO: 1836252 - RNA, 20 nt, Homo sapiens
cugagaagucaaacauuuca

SEQ ID NO: 1836253 - RNA, 15 nt, Homo sapiens
uggaagggguccagc

SEQ ID NO: 1836254 - RNA, 13 nt, Homo sapiens
uaucaauggugcu

SEQ ID NO: 1836255 - RNA, 20 nt, Homo sapiens
uaauuucagugcaguaauuu

SEQ ID NO: 1836256 - RNA, 23 nt, Homo sapiens
ccagguugguggcaagcugcaaa

SEQ ID NO: 1836257 - RNA, 15 nt, Homo sapiens
cacuggagcaugcag

SEQ ID NO: 1836258 - RNA, 14 nt, Homo sapiens
acugaccuuugucc

SEQ ID NO: 1836259 - RNA, 19 nt, Homo sapiens
gauuggagucagaggucaa

SEQ ID NO: 1836260 - RNA, 16 nt, Homo sapiens
aaaacuaagaaacuua

SEQ ID NO: 1836261 - RNA, 17 nt, Homo sapiens
ccuaaucuguaaucaca

SEQ ID NO: 1836262 - RNA, 18 nt, Homo sapiens
accagucccacaccgcug

SEQ ID NO: 1836263 - RNA, 12 nt, Homo sapiens
caggcagugcag

SEQ ID NO: 1836264 - RNA, 17 nt, Homo sapiens
acuccuccugagcucug

SEQ ID NO: 1836265 - RNA, 12 nt, Homo sapiens
aacacauucauu

SEQ ID NO: 1836266 - RNA, 15 nt, Homo sapiens
cagaugccugcagug

SEQ ID NO: 1836267 - RNA, 21 nt, Homo sapiens
uacauguagaauucgcaguga

SEQ ID NO: 1836268 - RNA, 18 nt, Homo sapiens
gggcacaaacugcagcug

SEQ ID NO: 1836269 - RNA, 23 nt, Homo sapiens
ucaagggucagggugagacguga

SEQ ID NO: 1836270 - RNA, 13 nt, Homo sapiens
ccuuuccaaaaac

SEQ ID NO: 1836271 - RNA, 17 nt, Homo sapiens
gcaaccauuauaaccuu

SEQ ID NO: 1836272 - RNA, 20 nt, Homo sapiens
auuugauaccauggcacuga

SEQ ID NO: 1836273 - RNA, 17 nt, Homo sapiens
ucauugaccucucaggg

SEQ ID NO: 1836274 - RNA, 20 nt, Homo sapiens
ggaguucacuucaucuucuc

SEQ ID NO: 1836275 - RNA, 21 nt, Homo sapiens
aacaucacugucuugccagau

SEQ ID NO: 1836276 - RNA, 14 nt, Homo sapiens
auaaaauugcacuu

SEQ ID NO: 1836277 - RNA, 19 nt, Homo sapiens
guaauauauacauauucaa

SEQ ID NO: 1836278 - RNA, 18 nt, Homo sapiens
ucuguuucaagccagugu

SEQ ID NO: 1836279 - RNA, 18 nt, Homo sapiens
cggggacuuuaccugcug

SEQ ID NO: 1836280 - RNA, 17 nt, Homo sapiens
cucagagugacagucau

SEQ ID NO: 1836281 - RNA, 16 nt, Homo sapiens
aaacugcuuaagugga

SEQ ID NO: 1836282 - RNA, 14 nt, Homo sapiens
aucugucuugucau

SEQ ID NO: 1836283 - RNA, 22 nt, Homo sapiens
gcaguauguacuucagugcacc

SEQ ID NO: 1836284 - RNA, 9 nt, Homo sapiens
cuaccccag

SEQ ID NO: 1836285 - RNA, 20 nt, Homo sapiens
ucuugccugcuccaucucau

SEQ ID NO: 1836286 - RNA, 16 nt, Homo sapiens
gacaaauaauaagcaa

SEQ ID NO: 1836287 - RNA, 13 nt, Homo sapiens
ucugcuaugcuau

SEQ ID NO: 1836288 - RNA, 19 nt, Homo sapiens
agaaccuggauguacuuaa

SEQ ID NO: 1836289 - RNA, 16 nt, Homo sapiens
cuguuaacuaugacag

SEQ ID NO: 1836290 - RNA, 16 nt, Homo sapiens
uggaaggcaguguuau

SEQ ID NO: 1836291 - RNA, 15 nt, Homo sapiens
ugccaugcucagaaa

SEQ ID NO: 1836292 - RNA, 15 nt, Homo sapiens
uguccgaugcuggag

SEQ ID NO: 1836293 - RNA, 17 nt, Homo sapiens
aaagugagaagaccucu

SEQ ID NO: 1836294 - RNA, 17 nt, Homo sapiens
gugacgugguagucacu

SEQ ID NO: 1836295 - RNA, 17 nt, Homo sapiens
auaguuuuuuacuucuc

SEQ ID NO: 1836296 - RNA, 13 nt, Homo sapiens
gaacugcacuuuu

SEQ ID NO: 1836297 - RNA, 15 nt, Homo sapiens
cacuccuacugaguu

SEQ ID NO: 1836298 - RNA, 16 nt, Homo sapiens
ucaaauaauaaaucua

SEQ ID NO: 1836299 - RNA, 15 nt, Homo sapiens
gguugagccucagaa

SEQ ID NO: 1836300 - RNA, 15 nt, Homo sapiens
uuguauuaccaaagc

SEQ ID NO: 1836301 - RNA, 15 nt, Homo sapiens
guggagaaggugaca

SEQ ID NO: 1836302 - RNA, 19 nt, Homo sapiens
ggacaggcuggugcuaaca

SEQ ID NO: 1836303 - RNA, 12 nt, Homo sapiens
cuggcuccuugc

SEQ ID NO: 1836304 - RNA, 16 nt, Homo sapiens
gacggccacucuguug

SEQ ID NO: 1836305 - RNA, 22 nt, Homo sapiens
auaugccuuggggaggacaaaa

SEQ ID NO: 1836306 - RNA, 12 nt, Homo sapiens
guggacugugau

SEQ ID NO: 1836307 - RNA, 16 nt, Homo sapiens
cagagugagagacauc

SEQ ID NO: 1836308 - RNA, 18 nt, Homo sapiens
caaugugacuaccgugcc

SEQ ID NO: 1836309 - RNA, 11 nt, Homo sapiens
aaacauuccau

SEQ ID NO: 1836310 - RNA, 22 nt, Homo sapiens
gaccccaaaucaccacaaagga

SEQ ID NO: 1836311 - RNA, 22 nt, Homo sapiens
gcaagucaggaaugauugcuga

SEQ ID NO: 1836312 - RNA, 15 nt, Homo sapiens
aguagcaugaucagu

SEQ ID NO: 1836313 - RNA, 23 nt, Homo sapiens
uuuagucaacaugccauaucuca

SEQ ID NO: 1836314 - RNA, 13 nt, Homo sapiens
aaaaugucaaaag

SEQ ID NO: 1836315 - RNA, 11 nt, Homo sapiens
gccacauggga

SEQ ID NO: 1836316 - RNA, 11 nt, Homo sapiens
ucaacaugugc

SEQ ID NO: 1836317 - RNA, 22 nt, Homo sapiens
ucucuuuuguuccuggcuuuga

SEQ ID NO: 1836318 - RNA, 22 nt, Homo sapiens
gaaaucuuucucccucaacuga

SEQ ID NO: 1836319 - RNA, 16 nt, Homo sapiens
ucuugcuguugacaua

SEQ ID NO: 1836320 - RNA, 24 nt, Homo sapiens
cuaucuuagguagucaugcugugc

SEQ ID NO: 1836321 - RNA, 19 nt, Homo sapiens
uccugaccuugugauccac

SEQ ID NO: 1836322 - RNA, 18 nt, Homo sapiens
augucuguucuaagucca

SEQ ID NO: 1836323 - RNA, 22 nt, Homo sapiens
cuccauaucccuuccucucagg

SEQ ID NO: 1836324 - RNA, 23 nt, Homo sapiens
ggccuggaguaacacaaagugaa

SEQ ID NO: 1836325 - RNA, 17 nt, Homo sapiens
aucuguuuguagccaca

SEQ ID NO: 1836326 - RNA, 23 nt, Homo sapiens
ccacaugguugugagucuugaca

SEQ ID NO: 1836327 - RNA, 19 nt, Homo sapiens
ugauauagaucacauaaca

SEQ ID NO: 1836328 - RNA, 18 nt, Homo sapiens
cauaucuuagguauauaa

SEQ ID NO: 1836329 - RNA, 19 nt, Homo sapiens
gagacccccuuuucuuccc

SEQ ID NO: 1836330 - RNA, 17 nt, Homo sapiens
uuuaccugagacuuuca

SEQ ID NO: 1836331 - RNA, 22 nt, Homo sapiens
cuguuccccaaggacucuucca

SEQ ID NO: 1836332 - RNA, 14 nt, Homo sapiens
ugaauauuugccac

SEQ ID NO: 1836333 - RNA, 16 nt, Homo sapiens
gcucugugugcucuga

SEQ ID NO: 1836334 - RNA, 21 nt, Homo sapiens
uauauuagggacacuuucaca

SEQ ID NO: 1836335 - RNA, 14 nt, Homo sapiens
cuagggcagaguau

SEQ ID NO: 1836336 - RNA, 14 nt, Homo sapiens
gaaaaaaacauaaa

SEQ ID NO: 1836337 - RNA, 14 nt, Homo sapiens
cuaaauaaguuaau

SEQ ID NO: 1836338 - RNA, 14 nt, Homo sapiens
uccccccacaagaa

SEQ ID NO: 1836339 - RNA, 17 nt, Homo sapiens
agagacagggaaagguc

SEQ ID NO: 1836340 - RNA, 14 nt, Homo sapiens
caaaucuuguuuac

SEQ ID NO: 1836341 - RNA, 17 nt, Homo sapiens
cagauuagagccuguaa

SEQ ID NO: 1836342 - RNA, 14 nt, Homo sapiens
acucaucuauccag

SEQ ID NO: 1836343 - RNA, 18 nt, Homo sapiens
gcaaugucccuugcacag

SEQ ID NO: 1836344 - RNA, 21 nt, Homo sapiens
aauuuaaaaaagcaaauggaa

SEQ ID NO: 1836345 - RNA, 20 nt, Homo sapiens
agauauacgcccucuuucau

SEQ ID NO: 1836346 - RNA, 19 nt, Homo sapiens
ucuaccauucauagccaga

SEQ ID NO: 1836347 - RNA, 20 nt, Homo sapiens
ucugauucuuuuuucaguca

SEQ ID NO: 1836348 - RNA, 16 nt, Homo sapiens
uggacuccacgaugcc

SEQ ID NO: 1836349 - RNA, 15 nt, Homo sapiens
ucucagagucauuga

SEQ ID NO: 1836350 - RNA, 20 nt, Homo sapiens
uuguaccacuucaucaaaau

SEQ ID NO: 1836351 - RNA, 17 nt, Homo sapiens
uuuauuuguaaaccauu

SEQ ID NO: 1836352 - RNA, 16 nt, Homo sapiens
guagaaugaaccacug

SEQ ID NO: 1836353 - RNA, 18 nt, Homo sapiens
uucaacccagcaaucuca

SEQ ID NO: 1836354 - RNA, 16 nt, Homo sapiens
ugaagaauuaaugaca

SEQ ID NO: 1836355 - RNA, 18 nt, Homo sapiens
cuucagagcaagcacugg

SEQ ID NO: 1836356 - RNA, 12 nt, Homo sapiens
aacccuguggaa

SEQ ID NO: 1836357 - RNA, 19 nt, Homo sapiens
uggcccacugcuggcugca

SEQ ID NO: 1836358 - RNA, 13 nt, Homo sapiens
agaaauuguuaag

SEQ ID NO: 1836359 - RNA, 20 nt, Homo sapiens
augaacugcaucaagacuuc

SEQ ID NO: 1836360 - RNA, 19 nt, Homo sapiens
ggauaagccacugggcacu

SEQ ID NO: 1836361 - RNA, 19 nt, Homo sapiens
uugaugucaaaaacuucaa

SEQ ID NO: 1836362 - RNA, 23 nt, Homo sapiens
cgcacaccggcuuaacacuauca

SEQ ID NO: 1836363 - RNA, 12 nt, Homo sapiens
ccagagaccaag

SEQ ID NO: 1836364 - RNA, 17 nt, Homo sapiens
uaaagagugaaugccau

SEQ ID NO: 1836365 - RNA, 22 nt, Homo sapiens
guuggcgggggcuuggcugugc

SEQ ID NO: 1836366 - RNA, 20 nt, Homo sapiens
agucccaugcuggcugaaga

SEQ ID NO: 1836367 - RNA, 24 nt, Homo sapiens
cagggauuccuucuaaguguacuu

SEQ ID NO: 1836368 - RNA, 15 nt, Homo sapiens
guuuucuagaauuua

SEQ ID NO: 1836369 - RNA, 20 nt, Homo sapiens
cuuuauuauuuacuuugcau

SEQ ID NO: 1836370 - RNA, 12 nt, Homo sapiens
acaagauuagaa

SEQ ID NO: 1836371 - RNA, 17 nt, Homo sapiens
guucaaagcaaccaccu

SEQ ID NO: 1836372 - RNA, 13 nt, Homo sapiens
gggcugucuuacc

SEQ ID NO: 1836373 - RNA, 19 nt, Homo sapiens
uaauagcuaauaauaccuu

SEQ ID NO: 1836374 - RNA, 16 nt, Homo sapiens
agcgugcucacugacc

SEQ ID NO: 1836375 - RNA, 16 nt, Homo sapiens
ucagaugcugagccaa

SEQ ID NO: 1836376 - RNA, 19 nt, Homo sapiens
ucuaaauaaaaagcauuau

SEQ ID NO: 1836377 - RNA, 16 nt, Homo sapiens
ucaaccuccccggcuc

SEQ ID NO: 1836378 - RNA, 13 nt, Homo sapiens
augugcucaugca

SEQ ID NO: 1836379 - RNA, 13 nt, Homo sapiens
uccggugugagau

SEQ ID NO: 1836380 - RNA, 15 nt, Homo sapiens
aguuuauacuucucu

SEQ ID NO: 1836381 - RNA, 22 nt, Homo sapiens
cuccucaggacccucccaggag

SEQ ID NO: 1836382 - RNA, 23 nt, Homo sapiens
auggucucucgcucugucuuucc

SEQ ID NO: 1836383 - RNA, 20 nt, Homo sapiens
aaaagaucuugaauagucuc

SEQ ID NO: 1836384 - RNA, 21 nt, Homo sapiens
cagguguuaacauuccaagac

SEQ ID NO: 1836385 - RNA, 19 nt, Homo sapiens
cugcaggauugauuaugca

SEQ ID NO: 1836386 - RNA, 17 nt, Homo sapiens
ugaggccuagacucugu

SEQ ID NO: 1836387 - RNA, 17 nt, Homo sapiens
ccuuaacuggagaccag

SEQ ID NO: 1836388 - RNA, 15 nt, Homo sapiens
acacacacuagccuu

SEQ ID NO: 1836389 - RNA, 19 nt, Homo sapiens
aaagacuacauauugucac

SEQ ID NO: 1836390 - RNA, 18 nt, Homo sapiens
gaaugcauugucaauauu

SEQ ID NO: 1836391 - RNA, 14 nt, Homo sapiens
accucacuauucaa

SEQ ID NO: 1836392 - RNA, 22 nt, Homo sapiens
cacuagagaaaauaaauuccaa

SEQ ID NO: 1836393 - RNA, 17 nt, Homo sapiens
ccacugccacacccucc

SEQ ID NO: 1836394 - RNA, 19 nt, Homo sapiens
cuccucccaacucuagccu

SEQ ID NO: 1836395 - RNA, 21 nt, Homo sapiens
cuaacaggauuagacagucaa

SEQ ID NO: 1836396 - RNA, 13 nt, Homo sapiens
caauguuuugcuu

SEQ ID NO: 1836397 - RNA, 21 nt, Homo sapiens
aaaguuauugauaaguucaua

SEQ ID NO: 1836398 - RNA, 14 nt, Homo sapiens
acuugucccgggac

SEQ ID NO: 1836399 - RNA, 20 nt, Homo sapiens
ggccaggcuggagugcagug

SEQ ID NO: 1836400 - RNA, 22 nt, Homo sapiens
uaaaagaagcaucucugaccag

SEQ ID NO: 1836401 - RNA, 23 nt, Homo sapiens
uaagcacauccaacuacuccuag

SEQ ID NO: 1836402 - RNA, 18 nt, Homo sapiens
gugauguuuugaaugugg

SEQ ID NO: 1836403 - RNA, 20 nt, Homo sapiens
aauuauaacuauuacagugu

SEQ ID NO: 1836404 - RNA, 17 nt, Homo sapiens
aucacuuccuauaugca

SEQ ID NO: 1836405 - RNA, 23 nt, Homo sapiens
cauuuauauaucuaaguucacag

SEQ ID NO: 1836406 - RNA, 21 nt, Homo sapiens
cauauugaggggcaacuccag

SEQ ID NO: 1836407 - RNA, 17 nt, Homo sapiens
aaggcguccauguuuau

SEQ ID NO: 1836408 - RNA, 16 nt, Homo sapiens
cuauuucuguuccagu

SEQ ID NO: 1836409 - RNA, 22 nt, Homo sapiens
uucaaagagucauauugcccag

SEQ ID NO: 1836410 - RNA, 19 nt, Homo sapiens
auuucaaaauauacauuca

SEQ ID NO: 1836411 - RNA, 13 nt, Homo sapiens
caucggucaugug

SEQ ID NO: 1836412 - RNA, 17 nt, Homo sapiens
aaaaagaagcaaccuca

SEQ ID NO: 1836413 - RNA, 17 nt, Homo sapiens
aaaucccuccuucaucc

SEQ ID NO: 1836414 - RNA, 21 nt, Homo sapiens
uuauaaagauugguaguuauc

SEQ ID NO: 1836415 - RNA, 18 nt, Homo sapiens
ccaugggggcaacagcca

SEQ ID NO: 1836416 - RNA, 18 nt, Homo sapiens
auacuugguucucuccac

SEQ ID NO: 1836417 - RNA, 14 nt, Homo sapiens
gaugcuuuaccaaa

SEQ ID NO: 1836418 - RNA, 15 nt, Homo sapiens
aggauaagagggauu

SEQ ID NO: 1836419 - RNA, 15 nt, Homo sapiens
ucucuacuaaaacau

SEQ ID NO: 1836420 - RNA, 19 nt, Homo sapiens
uuaaauggaaacagacuca

SEQ ID NO: 1836421 - RNA, 16 nt, Homo sapiens
aagaggcgacuuccuc

SEQ ID NO: 1836422 - RNA, 14 nt, Homo sapiens
guguucugugauau

SEQ ID NO: 1836423 - RNA, 17 nt, Homo sapiens
cauaacuaguuuaauua

SEQ ID NO: 1836424 - RNA, 14 nt, Homo sapiens
cucagaaaucuguu

SEQ ID NO: 1836425 - RNA, 19 nt, Homo sapiens
uuccagagaccaguauucc

SEQ ID NO: 1836426 - RNA, 23 nt, Homo sapiens
aaaggcucgauuuuguaucugca

SEQ ID NO: 1836427 - RNA, 15 nt, Homo sapiens
auguuugcaaacuug

SEQ ID NO: 1836428 - RNA, 19 nt, Homo sapiens
cugugucuccucucagagu

SEQ ID NO: 1836429 - RNA, 17 nt, Homo sapiens
gcaaagggagcacuggg

SEQ ID NO: 1836430 - RNA, 17 nt, Homo sapiens
ucccagcaagaccucau

SEQ ID NO: 1836431 - RNA, 20 nt, Homo sapiens
uucuccugccugugcuguga

SEQ ID NO: 1836432 - RNA, 14 nt, Homo sapiens
cugcaaauacugua

SEQ ID NO: 1836433 - RNA, 14 nt, Homo sapiens
acuccuuugcuaau

SEQ ID NO: 1836434 - RNA, 13 nt, Homo sapiens
aauggacuuucag

SEQ ID NO: 1836435 - RNA, 19 nt, Homo sapiens
cuggaugagacuuccaaac

SEQ ID NO: 1836436 - RNA, 19 nt, Homo sapiens
ggaaguuucguaugcacuc

SEQ ID NO: 1836437 - RNA, 12 nt, Homo sapiens
cugaauauugcc

SEQ ID NO: 1836438 - RNA, 16 nt, Homo sapiens
agacagugcugagauu

SEQ ID NO: 1836439 - RNA, 21 nt, Homo sapiens
aagccaccgcagcugcugcca

SEQ ID NO: 1836440 - RNA, 13 nt, Homo sapiens
gccuccagcacuc

SEQ ID NO: 1836441 - RNA, 19 nt, Homo sapiens
aaaucuuuuuaaauucugg

SEQ ID NO: 1836442 - RNA, 21 nt, Homo sapiens
uucuugugcccuuaaaaccaa

SEQ ID NO: 1836443 - RNA, 16 nt, Homo sapiens
uacagaacaagaaucu

SEQ ID NO: 1836444 - RNA, 15 nt, Homo sapiens
gacuuaccuguucag

SEQ ID NO: 1836445 - RNA, 13 nt, Homo sapiens
gagccagcagcga

SEQ ID NO: 1836446 - RNA, 17 nt, Homo sapiens
aaauucccuuuaugcac

SEQ ID NO: 1836447 - RNA, 18 nt, Homo sapiens
guucucaauuccaacagu

SEQ ID NO: 1836448 - RNA, 21 nt, Homo sapiens
uuaauaguuuugauccuaaau

SEQ ID NO: 1836449 - RNA, 20 nt, Homo sapiens
ccugguggcugcaggcaccg

SEQ ID NO: 1836450 - RNA, 20 nt, Homo sapiens
cuaugcugggguacacagug

SEQ ID NO: 1836451 - RNA, 21 nt, Homo sapiens
cuuagcagcauuccaucuucc

SEQ ID NO: 1836452 - RNA, 15 nt, Homo sapiens
caacaugcacugaug

SEQ ID NO: 1836453 - RNA, 21 nt, Homo sapiens
acuuggcuggggaggaccagg

SEQ ID NO: 1836454 - RNA, 20 nt, Homo sapiens
aaguugcugaugaacucuua

SEQ ID NO: 1836455 - RNA, 12 nt, Homo sapiens
ggccucccucaa

SEQ ID NO: 1836456 - RNA, 21 nt, Homo sapiens
uuauacuugaaaugaaauccu

SEQ ID NO: 1836457 - RNA, 20 nt, Homo sapiens
ggaagacauguccccauggc

SEQ ID NO: 1836458 - RNA, 15 nt, Homo sapiens
accuguuacuugaaa

SEQ ID NO: 1836459 - RNA, 13 nt, Homo sapiens
ccugauaaacaga

SEQ ID NO: 1836460 - RNA, 13 nt, Homo sapiens
guacuuuaccuaa

SEQ ID NO: 1836461 - RNA, 17 nt, Homo sapiens
uuacccugaggucacug

SEQ ID NO: 1836462 - RNA, 11 nt, Homo sapiens
aagcaaggaaa

SEQ ID NO: 1836463 - RNA, 21 nt, Homo sapiens
cucacgccucuguguucagga

SEQ ID NO: 1836464 - RNA, 23 nt, Homo sapiens
cccagaagcucaaggcugcagug

SEQ ID NO: 1836465 - RNA, 23 nt, Homo sapiens
gcccucccuuuaccuucauaugu

SEQ ID NO: 1836466 - RNA, 19 nt, Homo sapiens
ugggauucuagaacuguga

SEQ ID NO: 1836467 - RNA, 17 nt, Homo sapiens
agagugaauucccucac

SEQ ID NO: 1836468 - RNA, 22 nt, Homo sapiens
aucucugacuaaaaauacuuaa

SEQ ID NO: 1836469 - RNA, 14 nt, Homo sapiens
ucccuggggucacc

SEQ ID NO: 1836470 - RNA, 22 nt, Homo sapiens
aaaguguaacggccaacacuuu

SEQ ID NO: 1836471 - RNA, 22 nt, Homo sapiens
uaccaauaucuugccaguuuug

SEQ ID NO: 1836472 - RNA, 16 nt, Homo sapiens
uuauuauuagauucuc

SEQ ID NO: 1836473 - RNA, 22 nt, Homo sapiens
cuaucauuucuuuuccaaaauu

SEQ ID NO: 1836474 - RNA, 20 nt, Homo sapiens
auauucugaaucaccaauua

SEQ ID NO: 1836475 - RNA, 17 nt, Homo sapiens
accaaaucauacuuucu

SEQ ID NO: 1836476 - RNA, 22 nt, Homo sapiens
aaaguaccagauuauaaugcca

SEQ ID NO: 1836477 - RNA, 15 nt, Homo sapiens
uuaauggugccuuca

SEQ ID NO: 1836478 - RNA, 18 nt, Homo sapiens
aaacaucauaguuucuug

SEQ ID NO: 1836479 - RNA, 17 nt, Homo sapiens
ucaguuccucuuugcau

SEQ ID NO: 1836480 - RNA, 22 nt, Homo sapiens
uuaaguucccagauuggggcua

SEQ ID NO: 1836481 - RNA, 17 nt, Homo sapiens
uucuaggaaaucagaag

SEQ ID NO: 1836482 - RNA, 22 nt, Homo sapiens
aauagucauuugugaauuaucc

SEQ ID NO: 1836483 - RNA, 21 nt, Homo sapiens
uaccuugacuugaaaugcucu

SEQ ID NO: 1836484 - RNA, 20 nt, Homo sapiens
ugccuccucagaggacaguu

SEQ ID NO: 1836485 - RNA, 20 nt, Homo sapiens
uguuuugccauguuggccag

SEQ ID NO: 1836486 - RNA, 19 nt, Homo sapiens
ucuaagaaauccagcuuca

SEQ ID NO: 1836487 - RNA, 14 nt, Homo sapiens
gggggcagcagggg

SEQ ID NO: 1836488 - RNA, 22 nt, Homo sapiens
gauucaccuccauuaaccaaga

SEQ ID NO: 1836489 - RNA, 16 nt, Homo sapiens
ccgcugccugcacugg

SEQ ID NO: 1836490 - RNA, 17 nt, Homo sapiens
auuuauaucacacaaua

SEQ ID NO: 1836491 - RNA, 18 nt, Homo sapiens
auugcuuggacuaccuau

SEQ ID NO: 1836492 - RNA, 16 nt, Homo sapiens
cuuguagaguggugcu

SEQ ID NO: 1836493 - RNA, 18 nt, Homo sapiens
ucuuacccuggcaaagca

SEQ ID NO: 1836494 - RNA, 21 nt, Homo sapiens
aacugugcagcacccuuucac

SEQ ID NO: 1836495 - RNA, 17 nt, Homo sapiens
cuugagccugagccuua

SEQ ID NO: 1836496 - RNA, 21 nt, Homo sapiens
cauguguagguauugaaaaag

SEQ ID NO: 1836497 - RNA, 21 nt, Homo sapiens
ccuugcccaacucccagccac

SEQ ID NO: 1836498 - RNA, 17 nt, Homo sapiens
cagaaaugccacacuug

SEQ ID NO: 1836499 - RNA, 14 nt, Homo sapiens
cuuauaaaaucaaa

SEQ ID NO: 1836500 - RNA, 15 nt, Homo sapiens
gacauuaaaccugga

SEQ ID NO: 1836501 - RNA, 13 nt, Homo sapiens
ucguaaggguugc

SEQ ID NO: 1836502 - RNA, 17 nt, Homo sapiens
cauuuguauuacugcuu

SEQ ID NO: 1836503 - RNA, 16 nt, Homo sapiens
agauaaguuggagcag

SEQ ID NO: 1836504 - RNA, 16 nt, Homo sapiens
agguuggcaccccagc

SEQ ID NO: 1836505 - RNA, 17 nt, Homo sapiens
aauguuuguccuguaua

SEQ ID NO: 1836506 - RNA, 16 nt, Homo sapiens
gugugggaguguguaa

SEQ ID NO: 1836507 - RNA, 18 nt, Homo sapiens
cagggggagaaacccuuc

SEQ ID NO: 1836508 - RNA, 13 nt, Homo sapiens
ccaugcacucaaa

SEQ ID NO: 1836509 - RNA, 16 nt, Homo sapiens
ccauuucuaauuaugu

SEQ ID NO: 1836510 - RNA, 11 nt, Homo sapiens
uuuuugagaug

SEQ ID NO: 1836511 - RNA, 22 nt, Homo sapiens
ggcccuguagcccuggcccggu

SEQ ID NO: 1836512 - RNA, 14 nt, Homo sapiens
agacaauaugugag

SEQ ID NO: 1836513 - RNA, 15 nt, Homo sapiens
augaacucuucucaa

SEQ ID NO: 1836514 - RNA, 22 nt, Homo sapiens
caugugcagucccagcuacuca

SEQ ID NO: 1836515 - RNA, 16 nt, Homo sapiens
aggugaaagaaaccac

SEQ ID NO: 1836516 - RNA, 10 nt, Homo sapiens
accacugcac

SEQ ID NO: 1836517 - RNA, 16 nt, Homo sapiens
cuguaacacuguauaa

SEQ ID NO: 1836518 - RNA, 14 nt, Homo sapiens
caaucccauuugca

SEQ ID NO: 1836519 - RNA, 22 nt, Homo sapiens
gagucugggcaaugaaaccaaa

SEQ ID NO: 1836520 - RNA, 17 nt, Homo sapiens
cuaucuuuugcauccua

SEQ ID NO: 1836521 - RNA, 20 nt, Homo sapiens
ucuaugacuuagguaaaaua

SEQ ID NO: 1836522 - RNA, 16 nt, Homo sapiens
cuuauugucuaggcca

SEQ ID NO: 1836523 - RNA, 16 nt, Homo sapiens
ugacuagccaucucaa

SEQ ID NO: 1836524 - RNA, 19 nt, Homo sapiens
uaaaccguuuuuaacacau

SEQ ID NO: 1836525 - RNA, 17 nt, Homo sapiens
gacugauaaaacucaaa

SEQ ID NO: 1836526 - RNA, 15 nt, Homo sapiens
uccugugcuacuuug

SEQ ID NO: 1836527 - RNA, 22 nt, Homo sapiens
aaguuaacauucaguacuuuau

SEQ ID NO: 1836528 - RNA, 13 nt, Homo sapiens
uguccagcagcug

SEQ ID NO: 1836529 - RNA, 18 nt, Homo sapiens
uuacaccgugaggccaag

SEQ ID NO: 1836530 - RNA, 17 nt, Homo sapiens
aggaucuuuguuccucu

SEQ ID NO: 1836531 - RNA, 17 nt, Homo sapiens
ugccuuuugcaccccuc

SEQ ID NO: 1836532 - RNA, 18 nt, Homo sapiens
aaguucaacuuauuucau

SEQ ID NO: 1836533 - RNA, 19 nt, Homo sapiens
cucccagaacacacuccau

SEQ ID NO: 1836534 - RNA, 21 nt, Homo sapiens
gcuucuccuggcaaucuguca

SEQ ID NO: 1836535 - RNA, 22 nt, Homo sapiens
aacacagcgagacuccgucuca

SEQ ID NO: 1836536 - RNA, 16 nt, Homo sapiens
gugaaacccugucucu

SEQ ID NO: 1836537 - RNA, 22 nt, Homo sapiens
aagucuguguccuuugcuccuu

SEQ ID NO: 1836538 - RNA, 16 nt, Homo sapiens
uacaggauauuccaaa

SEQ ID NO: 1836539 - RNA, 18 nt, Homo sapiens
aagcauucuuguguaaua

SEQ ID NO: 1836540 - RNA, 15 nt, Homo sapiens
uccauaaaguacaaa

SEQ ID NO: 1836541 - RNA, 13 nt, Homo sapiens
auuagacuccucc

SEQ ID NO: 1836542 - RNA, 18 nt, Homo sapiens
uaccaagacaaauucaaa

SEQ ID NO: 1836543 - RNA, 23 nt, Homo sapiens
cugcugucaccucucccacggga

SEQ ID NO: 1836544 - RNA, 21 nt, Homo sapiens
uguauuucugauguguucucu

SEQ ID NO: 1836545 - RNA, 19 nt, Homo sapiens
ccuuucuggguaacaagcc

SEQ ID NO: 1836546 - RNA, 16 nt, Homo sapiens
ugacaaaauagcccag

SEQ ID NO: 1836547 - RNA, 14 nt, Homo sapiens
agaaauguguuauc

SEQ ID NO: 1836548 - RNA, 16 nt, Homo sapiens
cuaaaguauguuuuca

SEQ ID NO: 1836549 - RNA, 15 nt, Homo sapiens
gagagggacuggcag

SEQ ID NO: 1836550 - RNA, 17 nt, Homo sapiens
ggauccuccacagagag

SEQ ID NO: 1836551 - RNA, 20 nt, Homo sapiens
cacaugcugggccauuguga

SEQ ID NO: 1836552 - RNA, 15 nt, Homo sapiens
uugucuaccuucuuu

SEQ ID NO: 1836553 - RNA, 15 nt, Homo sapiens
auguuuagauuccag

SEQ ID NO: 1836554 - RNA, 22 nt, Homo sapiens
gccaaggcggguggaucacuug

SEQ ID NO: 1836555 - RNA, 14 nt, Homo sapiens
aagauaguaacaau

SEQ ID NO: 1836556 - RNA, 22 nt, Homo sapiens
caaaugccuuucuagcaauugc

SEQ ID NO: 1836557 - RNA, 14 nt, Homo sapiens
gaagguacugucau

SEQ ID NO: 1836558 - RNA, 14 nt, Homo sapiens
accuaaugcacucu

SEQ ID NO: 1836559 - RNA, 17 nt, Homo sapiens
aaaauccuacagugaaa

SEQ ID NO: 1836560 - RNA, 19 nt, Homo sapiens
uuucgaagucaucauuccu

SEQ ID NO: 1836561 - RNA, 18 nt, Homo sapiens
aacuguuccccuugguau

SEQ ID NO: 1836562 - RNA, 15 nt, Homo sapiens
agcacuagcgacauu

SEQ ID NO: 1836563 - RNA, 16 nt, Homo sapiens
cugcagucuggcugag

SEQ ID NO: 1836564 - RNA, 16 nt, Homo sapiens
cagugcugaauuuccc

SEQ ID NO: 1836565 - RNA, 18 nt, Homo sapiens
aaaacaguucuaggugcu

SEQ ID NO: 1836566 - RNA, 20 nt, Homo sapiens
ccagcugaggagcagguguc

SEQ ID NO: 1836567 - RNA, 20 nt, Homo sapiens
cagaaagcaaaucagacaca

SEQ ID NO: 1836568 - RNA, 23 nt, Homo sapiens
guguuucuuccccuuacucucac

SEQ ID NO: 1836569 - RNA, 21 nt, Homo sapiens
aaaacacugcuguucuuuaaa

SEQ ID NO: 1836570 - RNA, 20 nt, Homo sapiens
ugacagcuucuacuugcugu

SEQ ID NO: 1836571 - RNA, 22 nt, Homo sapiens
ucagaaacaaugacauccagaa

SEQ ID NO: 1836572 - RNA, 22 nt, Homo sapiens
uaaauaguuuuaaauaugaaca

SEQ ID NO: 1836573 - RNA, 23 nt, Homo sapiens
uauauauaaaauacacguguaua

SEQ ID NO: 1836574 - RNA, 19 nt, Homo sapiens
ugaagccuuugccagccau

SEQ ID NO: 1836575 - RNA, 18 nt, Homo sapiens
uuuaacugauuacuguag

SEQ ID NO: 1836576 - RNA, 13 nt, Homo sapiens
agaucacugugcu

SEQ ID NO: 1836577 - RNA, 20 nt, Homo sapiens
uaccuccuuagcuuucccug

SEQ ID NO: 1836578 - RNA, 21 nt, Homo sapiens
acucgucuuggcacaaucuca

SEQ ID NO: 1836579 - RNA, 17 nt, Homo sapiens
gcccugccccaccccau

SEQ ID NO: 1836580 - RNA, 15 nt, Homo sapiens
aauucuugaugguaa

SEQ ID NO: 1836581 - RNA, 14 nt, Homo sapiens
ugagacauuuacau

SEQ ID NO: 1836582 - RNA, 17 nt, Homo sapiens
ucccacguucuguuaau

SEQ ID NO: 1836583 - RNA, 15 nt, Homo sapiens
gcaacugaggcagac

SEQ ID NO: 1836584 - RNA, 21 nt, Homo sapiens
gcucugagagucuagauucuc

SEQ ID NO: 1836585 - RNA, 12 nt, Homo sapiens
gagcccuuccag

SEQ ID NO: 1836586 - RNA, 15 nt, Homo sapiens
agucagacugauaga

SEQ ID NO: 1836587 - RNA, 15 nt, Homo sapiens
ucacugccacuuugc

SEQ ID NO: 1836588 - RNA, 15 nt, Homo sapiens
cuuucaacuugcaau

SEQ ID NO: 1836589 - RNA, 12 nt, Homo sapiens
acagugugagca

SEQ ID NO: 1836590 - RNA, 17 nt, Homo sapiens
agcccagggaagacaca

SEQ ID NO: 1836591 - RNA, 22 nt, Homo sapiens
ggguccacugugagaggugaca

SEQ ID NO: 1836592 - RNA, 16 nt, Homo sapiens
gcccuccaguguauga

SEQ ID NO: 1836593 - RNA, 20 nt, Homo sapiens
augaggagaaaggggcccca

SEQ ID NO: 1836594 - RNA, 20 nt, Homo sapiens
aaaaccaaauuuguauuuaa

SEQ ID NO: 1836595 - RNA, 20 nt, Homo sapiens
ugcagguggugggacacugg

SEQ ID NO: 1836596 - RNA, 14 nt, Homo sapiens
ugucaccucuguga

SEQ ID NO: 1836597 - RNA, 16 nt, Homo sapiens
aguuaaauuggcuugu

SEQ ID NO: 1836598 - RNA, 14 nt, Homo sapiens
auaucccuaccuug

SEQ ID NO: 1836599 - RNA, 16 nt, Homo sapiens
gggcaaacaacugaac

SEQ ID NO: 1836600 - RNA, 22 nt, Homo sapiens
ugaguggcugaaauaaaagccu

SEQ ID NO: 1836601 - RNA, 18 nt, Homo sapiens
aaugugugaauucaauac

SEQ ID NO: 1836602 - RNA, 17 nt, Homo sapiens
aauccuuaacacauuca

SEQ ID NO: 1836603 - RNA, 20 nt, Homo sapiens
accucagccucccaaaaugc

SEQ ID NO: 1836604 - RNA, 18 nt, Homo sapiens
uuucucuaacuccugcca

SEQ ID NO: 1836605 - RNA, 18 nt, Homo sapiens
ucuuugaauuuaggugau

SEQ ID NO: 1836606 - RNA, 19 nt, Homo sapiens
cuuucuuagcucaagagag

SEQ ID NO: 1836607 - RNA, 23 nt, Homo sapiens
uccauucauaaggauucagggaa

SEQ ID NO: 1836608 - RNA, 20 nt, Homo sapiens
gauucaagacaagagcuguu

SEQ ID NO: 1836609 - RNA, 11 nt, Homo sapiens
cccagucccau

SEQ ID NO: 1836610 - RNA, 21 nt, Homo sapiens
acagaacacugucuugaagac

SEQ ID NO: 1836611 - RNA, 14 nt, Homo sapiens
ugagggugggguaa

SEQ ID NO: 1836612 - RNA, 14 nt, Homo sapiens
gaaugguguaggaa

SEQ ID NO: 1836613 - RNA, 17 nt, Homo sapiens
uguccaggguccucuag

SEQ ID NO: 1836614 - RNA, 14 nt, Homo sapiens
cauuccaguagaag

SEQ ID NO: 1836615 - RNA, 19 nt, Homo sapiens
cagggacuguaaacacaga

SEQ ID NO: 1836616 - RNA, 21 nt, Homo sapiens
accuggcuugaagcugcucac

SEQ ID NO: 1836617 - RNA, 17 nt, Homo sapiens
ucauuaaugcacaucug

SEQ ID NO: 1836618 - RNA, 20 nt, Homo sapiens
gacucuguguggcugugcaa

SEQ ID NO: 1836619 - RNA, 14 nt, Homo sapiens
acaugugauuguga

SEQ ID NO: 1836620 - RNA, 22 nt, Homo sapiens
ugucugugcaugucccccagga

SEQ ID NO: 1836621 - RNA, 19 nt, Homo sapiens
aacucugaccaacagugag

SEQ ID NO: 1836622 - RNA, 12 nt, Homo sapiens
aaguggagucca

SEQ ID NO: 1836623 - RNA, 17 nt, Homo sapiens
uugaagucacacuguaa

SEQ ID NO: 1836624 - RNA, 17 nt, Homo sapiens
gacacccacacaggugg

SEQ ID NO: 1836625 - RNA, 23 nt, Homo sapiens
guuaguaauaaacgucuugccac

SEQ ID NO: 1836626 - RNA, 12 nt, Homo sapiens
caguguuuacaa

SEQ ID NO: 1836627 - RNA, 16 nt, Homo sapiens
aguuauuaaacagugu

SEQ ID NO: 1836628 - RNA, 23 nt, Homo sapiens
aggaaguggaauggguaacucuu

SEQ ID NO: 1836629 - RNA, 16 nt, Homo sapiens
cuggagagcacugcca

SEQ ID NO: 1836630 - RNA, 14 nt, Homo sapiens
caccaccaaccacu

SEQ ID NO: 1836631 - RNA, 19 nt, Homo sapiens
agcaaguuucaucagucaa

SEQ ID NO: 1836632 - RNA, 16 nt, Homo sapiens
gcacgugccugugauc

SEQ ID NO: 1836633 - RNA, 19 nt, Homo sapiens
uuguguggagaacucagug

SEQ ID NO: 1836634 - RNA, 21 nt, Homo sapiens
ucccagccccuccucccucag

SEQ ID NO: 1836635 - RNA, 17 nt, Homo sapiens
cuggggaacuagaggga

SEQ ID NO: 1836636 - RNA, 20 nt, Homo sapiens
uucauauucucagaugggcu

SEQ ID NO: 1836637 - RNA, 20 nt, Homo sapiens
ugaaaaaucuuaaguaccaa

SEQ ID NO: 1836638 - RNA, 18 nt, Homo sapiens
agaaaaaagacccuauca

SEQ ID NO: 1836639 - RNA, 16 nt, Homo sapiens
acauuauugaaaagca

SEQ ID NO: 1836640 - RNA, 11 nt, Homo sapiens
ugccugugauu

SEQ ID NO: 1836641 - RNA, 14 nt, Homo sapiens
aucccuccauucau

SEQ ID NO: 1836642 - RNA, 20 nt, Homo sapiens
acaguugcauuuagcuucuu

SEQ ID NO: 1836643 - RNA, 21 nt, Homo sapiens
cugaggggggccgugcccagg

SEQ ID NO: 1836644 - RNA, 20 nt, Homo sapiens
ggcagcuucgugugcagcua

SEQ ID NO: 1836645 - RNA, 16 nt, Homo sapiens
uggaacuuacauacau

SEQ ID NO: 1836646 - RNA, 16 nt, Homo sapiens
ccccaucucugcaaaa

SEQ ID NO: 1836647 - RNA, 22 nt, Homo sapiens
agguggcccggaagaaccagaa

SEQ ID NO: 1836648 - RNA, 19 nt, Homo sapiens
ugagguauaaagacaagua

SEQ ID NO: 1836649 - RNA, 13 nt, Homo sapiens
cuaagcuguaacc

SEQ ID NO: 1836650 - RNA, 17 nt, Homo sapiens
gcucucuguaucagucu

SEQ ID NO: 1836651 - RNA, 15 nt, Homo sapiens
acguaucugcuacuu

SEQ ID NO: 1836652 - RNA, 23 nt, Homo sapiens
aucacuuguccucuugccagcuc

SEQ ID NO: 1836653 - RNA, 14 nt, Homo sapiens
accuccacauccca

SEQ ID NO: 1836654 - RNA, 15 nt, Homo sapiens
augcaaggucauuuu

SEQ ID NO: 1836655 - RNA, 23 nt, Homo sapiens
agccauggcugggcgugcuagag

SEQ ID NO: 1836656 - RNA, 15 nt, Homo sapiens
uguaagcaacacuuu

SEQ ID NO: 1836657 - RNA, 22 nt, Homo sapiens
guucauggauauguuauacuga

SEQ ID NO: 1836658 - RNA, 19 nt, Homo sapiens
ccaucagugguaacugcuu

SEQ ID NO: 1836659 - RNA, 13 nt, Homo sapiens
agguaaaaacuga

SEQ ID NO: 1836660 - RNA, 19 nt, Homo sapiens
ugggaaugaaauuaacaca

SEQ ID NO: 1836661 - RNA, 23 nt, Homo sapiens
ccuuccccucacacuccuaaaau

SEQ ID NO: 1836662 - RNA, 13 nt, Homo sapiens
guccucucaguaa

SEQ ID NO: 1836663 - RNA, 22 nt, Homo sapiens
cuguaagguggacuuccagcuu

SEQ ID NO: 1836664 - RNA, 15 nt, Homo sapiens
uaaaauuuacauuua

SEQ ID NO: 1836665 - RNA, 14 nt, Homo sapiens
uuacaaaauacagg

SEQ ID NO: 1836666 - RNA, 19 nt, Homo sapiens
auuggaccuggcccagugc

SEQ ID NO: 1836667 - RNA, 20 nt, Homo sapiens
uauccaccuccaucuucuuu

SEQ ID NO: 1836668 - RNA, 23 nt, Homo sapiens
ugguuagugcaugucacaugaca

SEQ ID NO: 1836669 - RNA, 21 nt, Homo sapiens
aucugucacuugcauuccacu

SEQ ID NO: 1836670 - RNA, 17 nt, Homo sapiens
gagcaguaucaugaagc

SEQ ID NO: 1836671 - RNA, 17 nt, Homo sapiens
gugaccagacugcacag

SEQ ID NO: 1836672 - RNA, 16 nt, Homo sapiens
aauaaacucacaacuc

SEQ ID NO: 1836673 - RNA, 13 nt, Homo sapiens
auuucaagcagau

SEQ ID NO: 1836674 - RNA, 19 nt, Homo sapiens
uuaaauugaugcacuacac

SEQ ID NO: 1836675 - RNA, 15 nt, Homo sapiens
cuuugccauuucuuc

SEQ ID NO: 1836676 - RNA, 12 nt, Homo sapiens
uggucacaugga

SEQ ID NO: 1836677 - RNA, 14 nt, Homo sapiens
ucagagaacauccc

SEQ ID NO: 1836678 - RNA, 15 nt, Homo sapiens
guggucuaaacaaaa

SEQ ID NO: 1836679 - RNA, 21 nt, Homo sapiens
aucgcaaccaggauugacagg

SEQ ID NO: 1836680 - RNA, 14 nt, Homo sapiens
uucugaaugcugcu

SEQ ID NO: 1836681 - RNA, 14 nt, Homo sapiens
gucugaauucugcu

SEQ ID NO: 1836682 - RNA, 15 nt, Homo sapiens
cugguuaugagccga

SEQ ID NO: 1836683 - RNA, 22 nt, Homo sapiens
aaccgaugguccucacaagccu

SEQ ID NO: 1836684 - RNA, 19 nt, Homo sapiens
uaagcaccauaaccaagaa

SEQ ID NO: 1836685 - RNA, 13 nt, Homo sapiens
caacuccacaggg

SEQ ID NO: 1836686 - RNA, 13 nt, Homo sapiens
cagggccacaacu

SEQ ID NO: 1836687 - RNA, 15 nt, Homo sapiens
gaaagcacuucuuau

SEQ ID NO: 1836688 - RNA, 21 nt, Homo sapiens
cauccaugugcuagucacugg

SEQ ID NO: 1836689 - RNA, 14 nt, Homo sapiens
cccguaagauuccu

SEQ ID NO: 1836690 - RNA, 20 nt, Homo sapiens
aagaaauacucaugugcaau

SEQ ID NO: 1836691 - RNA, 19 nt, Homo sapiens
aaaucuccuaacaaaagaa

SEQ ID NO: 1836692 - RNA, 20 nt, Homo sapiens
uggaauuuagugcauuucaa

SEQ ID NO: 1836693 - RNA, 17 nt, Homo sapiens
cagccgugcugagcaca

SEQ ID NO: 1836694 - RNA, 16 nt, Homo sapiens
cuaaagguguuuugua

SEQ ID NO: 1836695 - RNA, 17 nt, Homo sapiens
acauuuuucgacuguga

SEQ ID NO: 1836696 - RNA, 21 nt, Homo sapiens
ccauguuuaaguguacuggau

SEQ ID NO: 1836697 - RNA, 22 nt, Homo sapiens
cugggagacuuugaagaccagu

SEQ ID NO: 1836698 - RNA, 16 nt, Homo sapiens
ucgcuuuguugcccag

SEQ ID NO: 1836699 - RNA, 14 nt, Homo sapiens
caccuuccauguca

SEQ ID NO: 1836700 - RNA, 16 nt, Homo sapiens
agagguggcgauuugu

SEQ ID NO: 1836701 - RNA, 23 nt, Homo sapiens
gauauggaauucaaagcucuaau

SEQ ID NO: 1836702 - RNA, 22 nt, Homo sapiens
uagagacgaggucuugugauau

SEQ ID NO: 1836703 - RNA, 15 nt, Homo sapiens
cugugaaaccuuuac

SEQ ID NO: 1836704 - RNA, 14 nt, Homo sapiens
uggauauucauucu

SEQ ID NO: 1836705 - RNA, 17 nt, Homo sapiens
acaucucccauggcucu

SEQ ID NO: 1836706 - RNA, 20 nt, Homo sapiens
acuguaugugcuguaauuua

SEQ ID NO: 1836707 - RNA, 11 nt, Homo sapiens
aguaacuguaa

SEQ ID NO: 1836708 - RNA, 23 nt, Homo sapiens
uccauacagggucucuuccuucg

SEQ ID NO: 1836709 - RNA, 20 nt, Homo sapiens
aucugugcagucaucaacaa

SEQ ID NO: 1836710 - RNA, 23 nt, Homo sapiens
ugucucauccacauaagcacucc

SEQ ID NO: 1836711 - RNA, 21 nt, Homo sapiens
cugaaugccucccccaucucc

SEQ ID NO: 1836712 - RNA, 17 nt, Homo sapiens
auuuaccacaaaagcaa

SEQ ID NO: 1836713 - RNA, 14 nt, Homo sapiens
uguuaaugucuuca

SEQ ID NO: 1836714 - RNA, 13 nt, Homo sapiens
gugggagcagcuu

SEQ ID NO: 1836715 - RNA, 15 nt, Homo sapiens
ucagagccaccccua

SEQ ID NO: 1836716 - RNA, 21 nt, Homo sapiens
accgaugggcuuagagcucuc

SEQ ID NO: 1836717 - RNA, 18 nt, Homo sapiens
uauuuaacaaaaagugcu

SEQ ID NO: 1836718 - RNA, 19 nt, Homo sapiens
ggauccugcacugacucug

SEQ ID NO: 1836719 - RNA, 19 nt, Homo sapiens
uacuacggagaaacucauc

SEQ ID NO: 1836720 - RNA, 22 nt, Homo sapiens
aaacuuuauauuguucuuguaa

SEQ ID NO: 1836721 - RNA, 15 nt, Homo sapiens
cugccugccaaagua

SEQ ID NO: 1836722 - RNA, 14 nt, Homo sapiens
uccaguaggaaauc

SEQ ID NO: 1836723 - RNA, 21 nt, Homo sapiens
ugcuuugaaacuugccugggg

SEQ ID NO: 1836724 - RNA, 17 nt, Homo sapiens
ccucacuagcuccccaa

SEQ ID NO: 1836725 - RNA, 22 nt, Homo sapiens
aguuccuuccaggugauucugu

SEQ ID NO: 1836726 - RNA, 20 nt, Homo sapiens
ugacauaauuuacaugcaau

SEQ ID NO: 1836727 - RNA, 18 nt, Homo sapiens
agaacggggcucuucuca

SEQ ID NO: 1836728 - RNA, 22 nt, Homo sapiens
gacugagagacaggacuagcug

SEQ ID NO: 1836729 - RNA, 18 nt, Homo sapiens
gugcauuuguucagcucc

SEQ ID NO: 1836730 - RNA, 19 nt, Homo sapiens
uuccaaaccaggacacuac

SEQ ID NO: 1836731 - RNA, 16 nt, Homo sapiens
aagcucccaagggaug

SEQ ID NO: 1836732 - RNA, 18 nt, Homo sapiens
agcucaagcuuuugcuca

SEQ ID NO: 1836733 - RNA, 14 nt, Homo sapiens
gcucuacuaccugu

SEQ ID NO: 1836734 - RNA, 17 nt, Homo sapiens
guauggacgugugugaa

SEQ ID NO: 1836735 - RNA, 12 nt, Homo sapiens
uuuaauccuuaa

SEQ ID NO: 1836736 - RNA, 12 nt, Homo sapiens
acucauccacac

SEQ ID NO: 1836737 - RNA, 15 nt, Homo sapiens
ucugaggaaggugcu

SEQ ID NO: 1836738 - RNA, 14 nt, Homo sapiens
cauuguuauuuuca

SEQ ID NO: 1836739 - RNA, 11 nt, Homo sapiens
uuugggagacu

SEQ ID NO: 1836740 - RNA, 12 nt, Homo sapiens
cacuccuugcau

SEQ ID NO: 1836741 - RNA, 16 nt, Homo sapiens
gccacacccagaguag

SEQ ID NO: 1836742 - RNA, 16 nt, Homo sapiens
aaaugugaagugaaug

SEQ ID NO: 1836743 - RNA, 23 nt, Homo sapiens
acugcucuugugauguuugcuca

SEQ ID NO: 1836744 - RNA, 20 nt, Homo sapiens
cuacuuguaaaggugcugca

SEQ ID NO: 1836745 - RNA, 23 nt, Homo sapiens
cacuaagauaaauucaugcacuu

SEQ ID NO: 1836746 - RNA, 17 nt, Homo sapiens
aucuaaucuaugcaugu

SEQ ID NO: 1836747 - RNA, 22 nt, Homo sapiens
cacagaaaaggcugcugugaac

SEQ ID NO: 1836748 - RNA, 12 nt, Homo sapiens
acauauuuuaga

SEQ ID NO: 1836749 - RNA, 14 nt, Homo sapiens
gaaugaccacuuga

SEQ ID NO: 1836750 - RNA, 22 nt, Homo sapiens
ugauccauccccagaccaggac

SEQ ID NO: 1836751 - RNA, 18 nt, Homo sapiens
gaugcuggcccuacagua

SEQ ID NO: 1836752 - RNA, 15 nt, Homo sapiens
ugagugggugaauaa

SEQ ID NO: 1836753 - RNA, 14 nt, Homo sapiens
ccuggggauuccag

SEQ ID NO: 1836754 - RNA, 19 nt, Homo sapiens
aucucugcagggccgccag

SEQ ID NO: 1836755 - RNA, 15 nt, Homo sapiens
ucuccuuuaaugaca

SEQ ID NO: 1836756 - RNA, 16 nt, Homo sapiens
agauaccuccaacccu

SEQ ID NO: 1836757 - RNA, 17 nt, Homo sapiens
cugauuucacucagggu

SEQ ID NO: 1836758 - RNA, 17 nt, Homo sapiens
aucaagccaugugcuuu

SEQ ID NO: 1836759 - RNA, 17 nt, Homo sapiens
augcggcccacuuuccu

SEQ ID NO: 1836760 - RNA, 21 nt, Homo sapiens
cuucaugugguucagugccuu

SEQ ID NO: 1836761 - RNA, 20 nt, Homo sapiens
uccaggaauauaugucagug

SEQ ID NO: 1836762 - RNA, 22 nt, Homo sapiens
uggagcagaacuuuccagggau

SEQ ID NO: 1836763 - RNA, 18 nt, Homo sapiens
aaagugaacagauuuuau

SEQ ID NO: 1836764 - RNA, 19 nt, Homo sapiens
uuuggcuagguaucauuca

SEQ ID NO: 1836765 - RNA, 22 nt, Homo sapiens
guguggcuuggaacauuuggga

SEQ ID NO: 1836766 - RNA, 15 nt, Homo sapiens
cugcauuacauuccu

SEQ ID NO: 1836767 - RNA, 19 nt, Homo sapiens
auucguuuuuucauuugaa

SEQ ID NO: 1836768 - RNA, 18 nt, Homo sapiens
ugggggugcugcucucuc

SEQ ID NO: 1836769 - RNA, 18 nt, Homo sapiens
agguuugccuguguacag

SEQ ID NO: 1836770 - RNA, 23 nt, Homo sapiens
ucacauccucagaaagugcagca

SEQ ID NO: 1836771 - RNA, 18 nt, Homo sapiens
uuauuucauucacauuaa

SEQ ID NO: 1836772 - RNA, 17 nt, Homo sapiens
ugagacuacuuaagaua

SEQ ID NO: 1836773 - RNA, 13 nt, Homo sapiens
ugugagugcucug

SEQ ID NO: 1836774 - RNA, 21 nt, Homo sapiens
uugcaaaguagccucuuucau

SEQ ID NO: 1836775 - RNA, 14 nt, Homo sapiens
aauucugggagaau

SEQ ID NO: 1836776 - RNA, 23 nt, Homo sapiens
caggauauggcuuaggaaugacu

SEQ ID NO: 1836777 - RNA, 15 nt, Homo sapiens
agccuuaagccauag

SEQ ID NO: 1836778 - RNA, 21 nt, Homo sapiens
ucagccaaggacacuugauau

SEQ ID NO: 1836779 - RNA, 19 nt, Homo sapiens
cuauucaaguauuaggggu

SEQ ID NO: 1836780 - RNA, 21 nt, Homo sapiens
gaauaacucuuacagcuuugc

SEQ ID NO: 1836781 - RNA, 16 nt, Homo sapiens
uccagguuaguuuacu

SEQ ID NO: 1836782 - RNA, 21 nt, Homo sapiens
aggcacaagaaucacuugaac

SEQ ID NO: 1836783 - RNA, 19 nt, Homo sapiens
uacauucugcucugcccau

SEQ ID NO: 1836784 - RNA, 19 nt, Homo sapiens
gggcagccugccuugccca

SEQ ID NO: 1836785 - RNA, 23 nt, Homo sapiens
ucucaacuccaaacugacucuua

SEQ ID NO: 1836786 - RNA, 21 nt, Homo sapiens
uuaaaauaaaacaagccuuaa

SEQ ID NO: 1836787 - RNA, 19 nt, Homo sapiens
uccaggucuaaacagcuga

SEQ ID NO: 1836788 - RNA, 12 nt, Homo sapiens
aagguaugcaau

SEQ ID NO: 1836789 - RNA, 16 nt, Homo sapiens
acuaagaaauauucca

SEQ ID NO: 1836790 - RNA, 21 nt, Homo sapiens
ugugccaggcugaauuacagu

SEQ ID NO: 1836791 - RNA, 19 nt, Homo sapiens
guugggaucccuccuccag

SEQ ID NO: 1836792 - RNA, 20 nt, Homo sapiens
auguuucacauaaaaccuca

SEQ ID NO: 1836793 - RNA, 22 nt, Homo sapiens
gccuguauuuaacucauaugau

SEQ ID NO: 1836794 - RNA, 18 nt, Homo sapiens
gcuugcagagcaugaccu

SEQ ID NO: 1836795 - RNA, 22 nt, Homo sapiens
gaagggguuuucccaugacucu

SEQ ID NO: 1836796 - RNA, 17 nt, Homo sapiens
cuggaaucagaagcacu

SEQ ID NO: 1836797 - RNA, 17 nt, Homo sapiens
uauguugguacuuggac

SEQ ID NO: 1836798 - RNA, 13 nt, Homo sapiens
gccauaugaauaa

SEQ ID NO: 1836799 - RNA, 14 nt, Homo sapiens
cuuuauugcagaau

SEQ ID NO: 1836800 - RNA, 16 nt, Homo sapiens
aagacaaacacugcca

SEQ ID NO: 1836801 - RNA, 12 nt, Homo sapiens
uuuuugcauaac

SEQ ID NO: 1836802 - RNA, 15 nt, Homo sapiens
caaauccuuccaaaa

SEQ ID NO: 1836803 - RNA, 23 nt, Homo sapiens
guuucaggugggugaaaccuccu

SEQ ID NO: 1836804 - RNA, 21 nt, Homo sapiens
aacagauggauagucugucca

SEQ ID NO: 1836805 - RNA, 22 nt, Homo sapiens
uccauguuuuuggggacacuga

SEQ ID NO: 1836806 - RNA, 17 nt, Homo sapiens
gucgccaaguuggagug

SEQ ID NO: 1836807 - RNA, 12 nt, Homo sapiens
auaaacuguaaa

SEQ ID NO: 1836808 - RNA, 23 nt, Homo sapiens
uaggaccauuucucugcaggcca

SEQ ID NO: 1836809 - RNA, 18 nt, Homo sapiens
cagagucaucuaccugag

SEQ ID NO: 1836810 - RNA, 17 nt, Homo sapiens
cacaauguggauuuggg

SEQ ID NO: 1836811 - RNA, 20 nt, Homo sapiens
acgugcugcuuacacuccag

SEQ ID NO: 1836812 - RNA, 19 nt, Homo sapiens
ugaagagugagagggcaug

SEQ ID NO: 1836813 - RNA, 18 nt, Homo sapiens
aaccaaaagugcauucaa

SEQ ID NO: 1836814 - RNA, 21 nt, Homo sapiens
cuggagggggcagaguggccu

SEQ ID NO: 1836815 - RNA, 19 nt, Homo sapiens
aauagaucaguauuucacu

SEQ ID NO: 1836816 - RNA, 21 nt, Homo sapiens
guaguccaggcugucccugaa

SEQ ID NO: 1836817 - RNA, 17 nt, Homo sapiens
aaagcaucuaucucauc

SEQ ID NO: 1836818 - RNA, 13 nt, Homo sapiens
cugaauaauauca

SEQ ID NO: 1836819 - RNA, 18 nt, Homo sapiens
ucagaugcaagagaacaa

SEQ ID NO: 1836820 - RNA, 16 nt, Homo sapiens
auuuuaaaacauaaga

SEQ ID NO: 1836821 - RNA, 15 nt, Homo sapiens
caguaaaagucacau

SEQ ID NO: 1836822 - RNA, 20 nt, Homo sapiens
aguauugacuuguauaccuu

SEQ ID NO: 1836823 - RNA, 19 nt, Homo sapiens
aacagagcaagacuccauc

SEQ ID NO: 1836824 - RNA, 13 nt, Homo sapiens
agcauacaacuuu

SEQ ID NO: 1836825 - RNA, 22 nt, Homo sapiens
aagaugugcagcauuucacuua

SEQ ID NO: 1836826 - RNA, 19 nt, Homo sapiens
accaaucaauaauagcuag

SEQ ID NO: 1836827 - RNA, 13 nt, Homo sapiens
aauucugcugucu

SEQ ID NO: 1836828 - RNA, 14 nt, Homo sapiens
cuaaccaaaugcug

SEQ ID NO: 1836829 - RNA, 13 nt, Homo sapiens
ugaaaagugcuuu

SEQ ID NO: 1836830 - RNA, 23 nt, Homo sapiens
ugagauugcaccacugcacucca

SEQ ID NO: 1836831 - RNA, 23 nt, Homo sapiens
ugucuucccuucuuugcacuuuu

SEQ ID NO: 1836832 - RNA, 16 nt, Homo sapiens
augagcucaaauugau

SEQ ID NO: 1836833 - RNA, 14 nt, Homo sapiens
ccuugcagaaggca

SEQ ID NO: 1836834 - RNA, 17 nt, Homo sapiens
uaaaagaugaauuccua

SEQ ID NO: 1836835 - RNA, 17 nt, Homo sapiens
uucaaucaaacuuucag

SEQ ID NO: 1836836 - RNA, 18 nt, Homo sapiens
auaaaguuuuuuuccaaa

SEQ ID NO: 1836837 - RNA, 22 nt, Homo sapiens
uacuauauguugaccauuccaa

SEQ ID NO: 1836838 - RNA, 19 nt, Homo sapiens
agcuggggcgcgaugucaa

SEQ ID NO: 1836839 - RNA, 13 nt, Homo sapiens
caccacacauaca

SEQ ID NO: 1836840 - RNA, 22 nt, Homo sapiens
cugggccauucuccacagcaac

SEQ ID NO: 1836841 - RNA, 19 nt, Homo sapiens
ugaaaaacauuccaggaaa

SEQ ID NO: 1836842 - RNA, 17 nt, Homo sapiens
uuccaaccuccccugua

SEQ ID NO: 1836843 - RNA, 20 nt, Homo sapiens
gcagcuucaccagagcauuu

SEQ ID NO: 1836844 - RNA, 21 nt, Homo sapiens
ccccagcaaaguuaacuacac

SEQ ID NO: 1836845 - RNA, 19 nt, Homo sapiens
agaugccacuagcccuccu

SEQ ID NO: 1836846 - RNA, 20 nt, Homo sapiens
aggaccaguucacuugcccu

SEQ ID NO: 1836847 - RNA, 13 nt, Homo sapiens
uuaaacagugcca

SEQ ID NO: 1836848 - RNA, 14 nt, Homo sapiens
ggacccuguccaau

SEQ ID NO: 1836849 - RNA, 18 nt, Homo sapiens
gucaugggagcuacuuau

SEQ ID NO: 1836850 - RNA, 18 nt, Homo sapiens
agagacuaucugauuucc

SEQ ID NO: 1836851 - RNA, 22 nt, Homo sapiens
cagggucucuagugcugugaaa

SEQ ID NO: 1836852 - RNA, 17 nt, Homo sapiens
ggcugauuucucacaca

SEQ ID NO: 1836853 - RNA, 15 nt, Homo sapiens
auuauccacugcaaa

SEQ ID NO: 1836854 - RNA, 21 nt, Homo sapiens
auggaaguuuauuuccaucug

SEQ ID NO: 1836855 - RNA, 22 nt, Homo sapiens
guuugauaccugcacuguccug

SEQ ID NO: 1836856 - RNA, 20 nt, Homo sapiens
gggucccaucagugaaagaa

SEQ ID NO: 1836857 - RNA, 22 nt, Homo sapiens
gguaaagcccucagaucccagg

SEQ ID NO: 1836858 - RNA, 13 nt, Homo sapiens
uauauaacuaaca

SEQ ID NO: 1836859 - RNA, 14 nt, Homo sapiens
gccccaaccacaaa

SEQ ID NO: 1836860 - RNA, 15 nt, Homo sapiens
uuuucuugccaauga

SEQ ID NO: 1836861 - RNA, 16 nt, Homo sapiens
uggauuaacauauagc

SEQ ID NO: 1836862 - RNA, 17 nt, Homo sapiens
uccuuccaccaaauacu

SEQ ID NO: 1836863 - RNA, 13 nt, Homo sapiens
gaaugcacaguga

SEQ ID NO: 1836864 - RNA, 20 nt, Homo sapiens
gccuauagucgcagcuacua

SEQ ID NO: 1836865 - RNA, 14 nt, Homo sapiens
agcgaaucaucuca

SEQ ID NO: 1836866 - RNA, 18 nt, Homo sapiens
uuccuuuccuaaaagugu

SEQ ID NO: 1836867 - RNA, 15 nt, Homo sapiens
cucuaagaucuugcc

SEQ ID NO: 1836868 - RNA, 14 nt, Homo sapiens
guuagaugaggcac

SEQ ID NO: 1836869 - RNA, 21 nt, Homo sapiens
gaggcaugguguguggugcua

SEQ ID NO: 1836870 - RNA, 22 nt, Homo sapiens
caacccuuccugcugcugcuac

SEQ ID NO: 1836871 - RNA, 16 nt, Homo sapiens
ccuuagaauacuguau

SEQ ID NO: 1836872 - RNA, 23 nt, Homo sapiens
uauaaugggcucuccggggccau

SEQ ID NO: 1836873 - RNA, 17 nt, Homo sapiens
uugcuggucacugccau

SEQ ID NO: 1836874 - RNA, 18 nt, Homo sapiens
accucaucuccaagauag

SEQ ID NO: 1836875 - RNA, 15 nt, Homo sapiens
cauaacuaguuuaau

SEQ ID NO: 1836876 - RNA, 15 nt, Homo sapiens
acuaaagggugcaug

SEQ ID NO: 1836877 - RNA, 21 nt, Homo sapiens
ucccauggguuaagagcucac

SEQ ID NO: 1836878 - RNA, 20 nt, Homo sapiens
cauuaauggacuccacugaa

SEQ ID NO: 1836879 - RNA, 13 nt, Homo sapiens
ccugcagaccuca

SEQ ID NO: 1836880 - RNA, 23 nt, Homo sapiens
caguggaucuucagaacugcccu

SEQ ID NO: 1836881 - RNA, 13 nt, Homo sapiens
auucucagauucc

SEQ ID NO: 1836882 - RNA, 13 nt, Homo sapiens
gagcccaggagcu

SEQ ID NO: 1836883 - RNA, 13 nt, Homo sapiens
ucuaccagucuau

SEQ ID NO: 1836884 - RNA, 22 nt, Homo sapiens
guaaaaauaugugaaucuggau

SEQ ID NO: 1836885 - RNA, 13 nt, Homo sapiens
auggguccagggc

SEQ ID NO: 1836886 - RNA, 22 nt, Homo sapiens
acgacaagauuuucuacuuuuu

SEQ ID NO: 1836887 - RNA, 22 nt, Homo sapiens
aaugaaauaguuuuaucuggaa

SEQ ID NO: 1836888 - RNA, 14 nt, Homo sapiens
uacagaagggcagu

SEQ ID NO: 1836889 - RNA, 19 nt, Homo sapiens
agcugagaaaacuaaguca

SEQ ID NO: 1836890 - RNA, 16 nt, Homo sapiens
gugauauauaauuucc

SEQ ID NO: 1836891 - RNA, 21 nt, Homo sapiens
ugacaucuuauuuacuuguag

SEQ ID NO: 1836892 - RNA, 12 nt, Homo sapiens
aggaagcagcug

SEQ ID NO: 1836893 - RNA, 17 nt, Homo sapiens
aggcaggagaauggugu

SEQ ID NO: 1836894 - RNA, 12 nt, Homo sapiens
auuccucaagca

SEQ ID NO: 1836895 - RNA, 21 nt, Homo sapiens
gcaucucagaguccagucaag

SEQ ID NO: 1836896 - RNA, 15 nt, Homo sapiens
aaacccacucaugac

SEQ ID NO: 1836897 - RNA, 20 nt, Homo sapiens
aaaucaugguauucuucuga

SEQ ID NO: 1836898 - RNA, 16 nt, Homo sapiens
uuuggaugaaugcagu

SEQ ID NO: 1836899 - RNA, 17 nt, Homo sapiens
ugccaaauaaacagcua

SEQ ID NO: 1836900 - RNA, 18 nt, Homo sapiens
uuuaaucauggagcaaga

SEQ ID NO: 1836901 - RNA, 23 nt, Homo sapiens
gcaaugcacugaagcguguuucu

SEQ ID NO: 1836902 - RNA, 13 nt, Homo sapiens
ugaauaagcacuu

SEQ ID NO: 1836903 - RNA, 19 nt, Homo sapiens
agaaaguguucuguuacaa

SEQ ID NO: 1836904 - RNA, 20 nt, Homo sapiens
cuaaauaauguuaucugugu

SEQ ID NO: 1836905 - RNA, 17 nt, Homo sapiens
cuacguaaucucacuua

SEQ ID NO: 1836906 - RNA, 18 nt, Homo sapiens
auggcucuggcaccacua

SEQ ID NO: 1836907 - RNA, 18 nt, Homo sapiens
gauucuuuaaacuacuga

SEQ ID NO: 1836908 - RNA, 21 nt, Homo sapiens
uuccuucaugaucaucacaau

SEQ ID NO: 1836909 - RNA, 16 nt, Homo sapiens
ccaacaugugaugugu

SEQ ID NO: 1836910 - RNA, 19 nt, Homo sapiens
aucucuaauuagucuauca

SEQ ID NO: 1836911 - RNA, 13 nt, Homo sapiens
auaaucauuuuag

SEQ ID NO: 1836912 - RNA, 17 nt, Homo sapiens
caugccuguagucccag

SEQ ID NO: 1836913 - RNA, 22 nt, Homo sapiens
agcggcccugucauccagcuca

SEQ ID NO: 1836914 - RNA, 15 nt, Homo sapiens
uguccacaaauauaa

SEQ ID NO: 1836915 - RNA, 20 nt, Homo sapiens
uucuuauuuuguaauaaacu

SEQ ID NO: 1836916 - RNA, 22 nt, Homo sapiens
aacugacuagugagauggccug

SEQ ID NO: 1836917 - RNA, 21 nt, Homo sapiens
gacuuucugauuacuguccag

SEQ ID NO: 1836918 - RNA, 22 nt, Homo sapiens
aggcaagguuggcgacugucau

SEQ ID NO: 1836919 - RNA, 19 nt, Homo sapiens
uauaauaaauacucaguga

SEQ ID NO: 1836920 - RNA, 19 nt, Homo sapiens
caaugauguaaauauuuca

SEQ ID NO: 1836921 - RNA, 15 nt, Homo sapiens
acuucuggccucuag

SEQ ID NO: 1836922 - RNA, 22 nt, Homo sapiens
agaaaugauucaaauugcugcu

SEQ ID NO: 1836923 - RNA, 23 nt, Homo sapiens
augcuuucuuuggccuacauucu

SEQ ID NO: 1836924 - RNA, 15 nt, Homo sapiens
acagacccaaaccau

SEQ ID NO: 1836925 - RNA, 15 nt, Homo sapiens
ucugcacaugucuug

SEQ ID NO: 1836926 - RNA, 20 nt, Homo sapiens
ucuguucauagauauuggaa

SEQ ID NO: 1836927 - RNA, 22 nt, Homo sapiens
gagggaaacugugaaugcuucu

SEQ ID NO: 1836928 - RNA, 17 nt, Homo sapiens
cccguccaaaaagaaga

SEQ ID NO: 1836929 - RNA, 21 nt, Homo sapiens
uauguacugccuuagugcuga

SEQ ID NO: 1836930 - RNA, 12 nt, Homo sapiens
gcaucagaccuu

SEQ ID NO: 1836931 - RNA, 19 nt, Homo sapiens
ugcaccuccgcuugccaga

SEQ ID NO: 1836932 - RNA, 19 nt, Homo sapiens
aucaaacacaaugccucau

SEQ ID NO: 1836933 - RNA, 19 nt, Homo sapiens
gagguuucaucauguuggc

SEQ ID NO: 1836934 - RNA, 17 nt, Homo sapiens
aggcacccuuccaucug

SEQ ID NO: 1836935 - RNA, 16 nt, Homo sapiens
auaucugaaaauguau

SEQ ID NO: 1836936 - RNA, 11 nt, Homo sapiens
uauauguuaau

SEQ ID NO: 1836937 - RNA, 15 nt, Homo sapiens
ucuggaaacugugaa

SEQ ID NO: 1836938 - RNA, 13 nt, Homo sapiens
cacacagcacucu

SEQ ID NO: 1836939 - RNA, 12 nt, Homo sapiens
uguacauuucac

SEQ ID NO: 1836940 - RNA, 17 nt, Homo sapiens
aaugugacaacaugugg

SEQ ID NO: 1836941 - RNA, 16 nt, Homo sapiens
augaggcggagcucca

SEQ ID NO: 1836942 - RNA, 16 nt, Homo sapiens
aaaagaaugauuauga

SEQ ID NO: 1836943 - RNA, 23 nt, Homo sapiens
cauugucgcuauugauuuuuacu

SEQ ID NO: 1836944 - RNA, 16 nt, Homo sapiens
gagaacagaaauccac

SEQ ID NO: 1836945 - RNA, 19 nt, Homo sapiens
acacguuugauuucuuccu

SEQ ID NO: 1836946 - RNA, 15 nt, Homo sapiens
ugcuaaaaaagcaua

SEQ ID NO: 1836947 - RNA, 19 nt, Homo sapiens
ccuucuccauccacauggg

SEQ ID NO: 1836948 - RNA, 11 nt, Homo sapiens
agaccaaagac

SEQ ID NO: 1836949 - RNA, 23 nt, Homo sapiens
uaguaaguacuuaauaaacugug

SEQ ID NO: 1836950 - RNA, 16 nt, Homo sapiens
auucauuagcugugau

SEQ ID NO: 1836951 - RNA, 22 nt, Homo sapiens
caccccaugcuguugauugcua

SEQ ID NO: 1836952 - RNA, 22 nt, Homo sapiens
uaaaaauaaagaaaucagccau

SEQ ID NO: 1836953 - RNA, 15 nt, Homo sapiens
guuaugugaccucac

SEQ ID NO: 1836954 - RNA, 18 nt, Homo sapiens
gggacucucccccuuuca

SEQ ID NO: 1836955 - RNA, 18 nt, Homo sapiens
uagccagcugugcacuuu

SEQ ID NO: 1836956 - RNA, 20 nt, Homo sapiens
ucuagauagaauguuuucau

SEQ ID NO: 1836957 - RNA, 16 nt, Homo sapiens
ucugcagugaugcaau

SEQ ID NO: 1836958 - RNA, 19 nt, Homo sapiens
gaggacagaauuacaugaa

SEQ ID NO: 1836959 - RNA, 19 nt, Homo sapiens
aaaguacguguuuacuugg

SEQ ID NO: 1836960 - RNA, 13 nt, Homo sapiens
agcuacauuccuc

SEQ ID NO: 1836961 - RNA, 20 nt, Homo sapiens
acugaaaccucuguucucau

SEQ ID NO: 1836962 - RNA, 20 nt, Homo sapiens
uauuacccuucuuuccauuu

SEQ ID NO: 1836963 - RNA, 17 nt, Homo sapiens
auuuaaauagaacuuga

SEQ ID NO: 1836964 - RNA, 22 nt, Homo sapiens
ucucuuccugccccucuuucuc

SEQ ID NO: 1836965 - RNA, 21 nt, Homo sapiens
cuggcagaaacaggaggcucc

SEQ ID NO: 1836966 - RNA, 11 nt, Homo sapiens
cucaguaauac

SEQ ID NO: 1836967 - RNA, 16 nt, Homo sapiens
ccauauggucauccaa

SEQ ID NO: 1836968 - RNA, 16 nt, Homo sapiens
gacucugucuaccugg

SEQ ID NO: 1836969 - RNA, 13 nt, Homo sapiens
guucaaugaucua

SEQ ID NO: 1836970 - RNA, 20 nt, Homo sapiens
agaaacacauaaacaccauu

SEQ ID NO: 1836971 - RNA, 18 nt, Homo sapiens
gaggcaucucucugggau

SEQ ID NO: 1836972 - RNA, 21 nt, Homo sapiens
cagucuauuugagacuccuca

SEQ ID NO: 1836973 - RNA, 22 nt, Homo sapiens
aauauagagggcuuaugauuca

SEQ ID NO: 1836974 - RNA, 15 nt, Homo sapiens
acagucuaguacuua

SEQ ID NO: 1836975 - RNA, 17 nt, Homo sapiens
cucacgccuguaauccc

SEQ ID NO: 1836976 - RNA, 23 nt, Homo sapiens
caauuuaccuacucuauguaugc

SEQ ID NO: 1836977 - RNA, 19 nt, Homo sapiens
auauauuaaaagaaaccua

SEQ ID NO: 1836978 - RNA, 22 nt, Homo sapiens
cugggagcacuuuguaggcauu

SEQ ID NO: 1836979 - RNA, 12 nt, Homo sapiens
aaaacucuauuu

SEQ ID NO: 1836980 - RNA, 20 nt, Homo sapiens
ccugacaacagccugagaaa

SEQ ID NO: 1836981 - RNA, 21 nt, Homo sapiens
aauuccagugguccauggaau

SEQ ID NO: 1836982 - RNA, 17 nt, Homo sapiens
ucagcaaauuuauauca

SEQ ID NO: 1836983 - RNA, 18 nt, Homo sapiens
uugcucccuguugcugaa

SEQ ID NO: 1836984 - RNA, 13 nt, Homo sapiens
augaauacagaua

SEQ ID NO: 1836985 - RNA, 13 nt, Homo sapiens
acuacagccagaa

SEQ ID NO: 1836986 - RNA, 15 nt, Homo sapiens
cuauccugauuccaa

SEQ ID NO: 1836987 - RNA, 17 nt, Homo sapiens
caaugcacacacacaga

SEQ ID NO: 1836988 - RNA, 17 nt, Homo sapiens
cauggacaucagcauca

SEQ ID NO: 1836989 - RNA, 13 nt, Homo sapiens
cuuguugcugagu

SEQ ID NO: 1836990 - RNA, 11 nt, Homo sapiens
aaaaagggaau

SEQ ID NO: 1836991 - RNA, 16 nt, Homo sapiens
uuuuacuaagcacugu

SEQ ID NO: 1836992 - RNA, 11 nt, Homo sapiens
caggugcucaa

SEQ ID NO: 1836993 - RNA, 21 nt, Homo sapiens
cugaagcccaaagccugagga

SEQ ID NO: 1836994 - RNA, 16 nt, Homo sapiens
ucagaucgaaauugga

SEQ ID NO: 1836995 - RNA, 12 nt, Homo sapiens
aauuucauucaa

SEQ ID NO: 1836996 - RNA, 19 nt, Homo sapiens
uaggaaggcuacuggcauu

SEQ ID NO: 1836997 - RNA, 20 nt, Homo sapiens
acauuaaaauaaaccaaaua

SEQ ID NO: 1836998 - RNA, 17 nt, Homo sapiens
aaaaauggcaagagauc

SEQ ID NO: 1836999 - RNA, 16 nt, Homo sapiens
auuugcucauugcugu

SEQ ID NO: 1837000 - RNA, 16 nt, Homo sapiens
agccaggguacuccaa

SEQ ID NO: 1837001 - RNA, 17 nt, Homo sapiens
auuuguaaaaauacugu

SEQ ID NO: 1837002 - RNA, 21 nt, Homo sapiens
acaucuaccaacccugugcau

SEQ ID NO: 1837003 - RNA, 16 nt, Homo sapiens
cauacaucauuccaca

SEQ ID NO: 1837004 - RNA, 15 nt, Homo sapiens
gaugaguuacuugaa

SEQ ID NO: 1837005 - RNA, 10 nt, Homo sapiens
uaaaccaaac

SEQ ID NO: 1837006 - RNA, 20 nt, Homo sapiens
agaccucaagaaaaauucac

SEQ ID NO: 1837007 - RNA, 17 nt, Homo sapiens
cggauguaacgcugcca

SEQ ID NO: 1837008 - RNA, 19 nt, Homo sapiens
ucccaagaggccagggugg

SEQ ID NO: 1837009 - RNA, 19 nt, Homo sapiens
gaacugaaaacaagccaug

SEQ ID NO: 1837010 - RNA, 17 nt, Homo sapiens
agacucaucuuacugua

SEQ ID NO: 1837011 - RNA, 11 nt, Homo sapiens
uuaacaaucua

SEQ ID NO: 1837012 - RNA, 11 nt, Homo sapiens
ccaacaauuca

SEQ ID NO: 1837013 - RNA, 18 nt, Homo sapiens
aaucacacagccaagcca

SEQ ID NO: 1837014 - RNA, 16 nt, Homo sapiens
auuuauuccauauuca

SEQ ID NO: 1837015 - RNA, 21 nt, Homo sapiens
agucugaaagacagaauguca

SEQ ID NO: 1837016 - RNA, 17 nt, Homo sapiens
aagucaggguuggagca

SEQ ID NO: 1837017 - RNA, 17 nt, Homo sapiens
uguggaggggagauaua

SEQ ID NO: 1837018 - RNA, 16 nt, Homo sapiens
ccugugccuaacacca

SEQ ID NO: 1837019 - RNA, 16 nt, Homo sapiens
acacugauuccuuuau

SEQ ID NO: 1837020 - RNA, 19 nt, Homo sapiens
gaagagugaagagcauuug

SEQ ID NO: 1837021 - RNA, 14 nt, Homo sapiens
gguggccugugagg

SEQ ID NO: 1837022 - RNA, 21 nt, Homo sapiens
gggccagagccagggggguga

SEQ ID NO: 1837023 - RNA, 20 nt, Homo sapiens
caauugagggcuaaauccca

SEQ ID NO: 1837024 - RNA, 17 nt, Homo sapiens
gcagccuccacuucccu

SEQ ID NO: 1837025 - RNA, 18 nt, Homo sapiens
aagggucguuaccagaga

SEQ ID NO: 1837026 - RNA, 23 nt, Homo sapiens
cuaacccccagcccacagagccu

SEQ ID NO: 1837027 - RNA, 13 nt, Homo sapiens
ugugcaguacuua

SEQ ID NO: 1837028 - RNA, 19 nt, Homo sapiens
ugugauguggggaagagcu

SEQ ID NO: 1837029 - RNA, 20 nt, Homo sapiens
agauacaaaaccuuguguaa

SEQ ID NO: 1837030 - RNA, 17 nt, Homo sapiens
aagaagcccauaucaca

SEQ ID NO: 1837031 - RNA, 20 nt, Homo sapiens
cugagaaaugggguggaaua

SEQ ID NO: 1837032 - RNA, 20 nt, Homo sapiens
uuugcuauggggacauucca

SEQ ID NO: 1837033 - RNA, 16 nt, Homo sapiens
acaccacaccaucagg

SEQ ID NO: 1837034 - RNA, 15 nt, Homo sapiens
aauguagaccuguga

SEQ ID NO: 1837035 - RNA, 22 nt, Homo sapiens
ucuauaaagaucauauauuacu

SEQ ID NO: 1837036 - RNA, 23 nt, Homo sapiens
agaagguaucaguuauaugauau

SEQ ID NO: 1837037 - RNA, 16 nt, Homo sapiens
auuaauccacacauca

SEQ ID NO: 1837038 - RNA, 16 nt, Homo sapiens
acaaauacauucauaa

SEQ ID NO: 1837039 - RNA, 13 nt, Homo sapiens
cugauuccaaaua

SEQ ID NO: 1837040 - RNA, 22 nt, Homo sapiens
auauguaaacuuuaacuuccac

SEQ ID NO: 1837041 - RNA, 21 nt, Homo sapiens
ugcucucucacucccccauga

SEQ ID NO: 1837042 - RNA, 16 nt, Homo sapiens
gggacaaaacgcagac

SEQ ID NO: 1837043 - RNA, 21 nt, Homo sapiens
cugccuaggauucacacccca

SEQ ID NO: 1837044 - RNA, 20 nt, Homo sapiens
gggugugggccaccagagaa

SEQ ID NO: 1837045 - RNA, 18 nt, Homo sapiens
uucugguagcauauucau

SEQ ID NO: 1837046 - RNA, 13 nt, Homo sapiens
uggaaaagcaaaa

SEQ ID NO: 1837047 - RNA, 15 nt, Homo sapiens
aauaaaacugugcau

SEQ ID NO: 1837048 - RNA, 22 nt, Homo sapiens
uuagcagucccuccacauuucc

SEQ ID NO: 1837049 - RNA, 15 nt, Homo sapiens
uucgcagcucuggcc

SEQ ID NO: 1837050 - RNA, 14 nt, Homo sapiens
cagcccccaccuca

SEQ ID NO: 1837051 - RNA, 21 nt, Homo sapiens
cuuuaucaaagauuggccaug

SEQ ID NO: 1837052 - RNA, 15 nt, Homo sapiens
uagagcacagccuca

SEQ ID NO: 1837053 - RNA, 16 nt, Homo sapiens
aacuguggugccacau

SEQ ID NO: 1837054 - RNA, 15 nt, Homo sapiens
aaguaccuguaguga

SEQ ID NO: 1837055 - RNA, 16 nt, Homo sapiens
cuaauuuacuggacaa

SEQ ID NO: 1837056 - RNA, 14 nt, Homo sapiens
gacagaucacaggg

SEQ ID NO: 1837057 - RNA, 16 nt, Homo sapiens
gcuuugcuacaaauuu

SEQ ID NO: 1837058 - RNA, 15 nt, Homo sapiens
gcuccugaccaaaga

SEQ ID NO: 1837059 - RNA, 19 nt, Homo sapiens
ggccccagucgaacugggg

SEQ ID NO: 1837060 - RNA, 23 nt, Homo sapiens
uuucccuucccugggaggcuaga

SEQ ID NO: 1837061 - RNA, 14 nt, Homo sapiens
cuggauaagucacu

SEQ ID NO: 1837062 - RNA, 17 nt, Homo sapiens
ugugacugccaucaucu

SEQ ID NO: 1837063 - RNA, 19 nt, Homo sapiens
augacaaugaugaugauaa

SEQ ID NO: 1837064 - RNA, 18 nt, Homo sapiens
auuuaugcagagacagcu

SEQ ID NO: 1837065 - RNA, 18 nt, Homo sapiens
uaacuugcauguauccau

SEQ ID NO: 1837066 - RNA, 19 nt, Homo sapiens
caucucuacuaaaaauaca

SEQ ID NO: 1837067 - RNA, 13 nt, Homo sapiens
acauacugcagug

SEQ ID NO: 1837068 - RNA, 11 nt, Homo sapiens
uguugccaaau

SEQ ID NO: 1837069 - RNA, 23 nt, Homo sapiens
cucccagcucuagacaacccugc

SEQ ID NO: 1837070 - RNA, 23 nt, Homo sapiens
uuaacagaaccagaggguuguac

SEQ ID NO: 1837071 - RNA, 16 nt, Homo sapiens
ggaauuacgugcucug

SEQ ID NO: 1837072 - RNA, 19 nt, Homo sapiens
gcuucccucuucugugguc

SEQ ID NO: 1837073 - RNA, 17 nt, Homo sapiens
gaacugccccaucuccu

SEQ ID NO: 1837074 - RNA, 22 nt, Homo sapiens
accuuucggcaaggacgguaac

SEQ ID NO: 1837075 - RNA, 19 nt, Homo sapiens
acugcccuccagggccagg

SEQ ID NO: 1837076 - RNA, 19 nt, Homo sapiens
ucucaaacccccagccuca

SEQ ID NO: 1837077 - RNA, 16 nt, Homo sapiens
acagcaaauguuauag

SEQ ID NO: 1837078 - RNA, 18 nt, Homo sapiens
caauuauaaggugaagaa

SEQ ID NO: 1837079 - RNA, 15 nt, Homo sapiens
acccgcucuggacca

SEQ ID NO: 1837080 - RNA, 15 nt, Homo sapiens
cagcucaggggacac

SEQ ID NO: 1837081 - RNA, 21 nt, Homo sapiens
uacauaugagaauauaccuua

SEQ ID NO: 1837082 - RNA, 13 nt, Homo sapiens
uauuggagcacau

SEQ ID NO: 1837083 - RNA, 23 nt, Homo sapiens
auagaccucucaauuucuggaaa

SEQ ID NO: 1837084 - RNA, 17 nt, Homo sapiens
aauccagagagcagugu

SEQ ID NO: 1837085 - RNA, 21 nt, Homo sapiens
gguauauucauuucaaaggga

SEQ ID NO: 1837086 - RNA, 16 nt, Homo sapiens
ugacuaccuccacuca

SEQ ID NO: 1837087 - RNA, 13 nt, Homo sapiens
uaguauaguuuuc

SEQ ID NO: 1837088 - RNA, 16 nt, Homo sapiens
ucauggaaaagcccag

SEQ ID NO: 1837089 - RNA, 23 nt, Homo sapiens
aaauucaugcaucucaacaaagg

SEQ ID NO: 1837090 - RNA, 18 nt, Homo sapiens
ccuugagaagcugccaua

SEQ ID NO: 1837091 - RNA, 10 nt, Homo sapiens
aaauuuugcc

SEQ ID NO: 1837092 - RNA, 14 nt, Homo sapiens
uuauccaagaccug

SEQ ID NO: 1837093 - RNA, 17 nt, Homo sapiens
gacuagaggcuugcaua

SEQ ID NO: 1837094 - RNA, 16 nt, Homo sapiens
ccaggcagaaaacugg

SEQ ID NO: 1837095 - RNA, 20 nt, Homo sapiens
cacugcuccuugcugcauug

SEQ ID NO: 1837096 - RNA, 14 nt, Homo sapiens
cgacugaagugugu

SEQ ID NO: 1837097 - RNA, 22 nt, Homo sapiens
ucucaacuuugauacuuacuca

SEQ ID NO: 1837098 - RNA, 15 nt, Homo sapiens
uaaaauggcaccuuc

SEQ ID NO: 1837099 - RNA, 11 nt, Homo sapiens
aaagcuuuacu

SEQ ID NO: 1837100 - RNA, 20 nt, Homo sapiens
gaucaugggagcaugcuuac

SEQ ID NO: 1837101 - RNA, 19 nt, Homo sapiens
aacugcaaauauugucaua

SEQ ID NO: 1837102 - RNA, 22 nt, Homo sapiens
cuuuagcaguuuccucagugau

SEQ ID NO: 1837103 - RNA, 19 nt, Homo sapiens
aguucccccaguaccucca

SEQ ID NO: 1837104 - RNA, 20 nt, Homo sapiens
cugacugcagccagccacag

SEQ ID NO: 1837105 - RNA, 12 nt, Homo sapiens
gaaaaaaacugg

SEQ ID NO: 1837106 - RNA, 23 nt, Homo sapiens
cuuuucagcgauguaugcagcua

SEQ ID NO: 1837107 - RNA, 19 nt, Homo sapiens
agucuugcagcaggaucua

SEQ ID NO: 1837108 - RNA, 16 nt, Homo sapiens
aacuaaaauaguuuaa

SEQ ID NO: 1837109 - RNA, 20 nt, Homo sapiens
aaagcccugguaaaagggau

SEQ ID NO: 1837110 - RNA, 12 nt, Homo sapiens
caugcuguucca

SEQ ID NO: 1837111 - RNA, 20 nt, Homo sapiens
ggcaaucacggcucacugua

SEQ ID NO: 1837112 - RNA, 21 nt, Homo sapiens
ucaaacacaauuaaaucucuc

SEQ ID NO: 1837113 - RNA, 16 nt, Homo sapiens
cagagaagcuccugcu

SEQ ID NO: 1837114 - RNA, 18 nt, Homo sapiens
acuuccucucacuguugc

SEQ ID NO: 1837115 - RNA, 14 nt, Homo sapiens
gauuauuccucuac

SEQ ID NO: 1837116 - RNA, 19 nt, Homo sapiens
cuugaauauguagcucauc

SEQ ID NO: 1837117 - RNA, 22 nt, Homo sapiens
uagcuaagcuaccuugucauau

SEQ ID NO: 1837118 - RNA, 23 nt, Homo sapiens
uguacaucuauuuuggauuguau

SEQ ID NO: 1837119 - RNA, 11 nt, Homo sapiens
cuauuuccauu

SEQ ID NO: 1837120 - RNA, 16 nt, Homo sapiens
caagaacaaacacugc

SEQ ID NO: 1837121 - RNA, 14 nt, Homo sapiens
cccauugccaguga

SEQ ID NO: 1837122 - RNA, 19 nt, Homo sapiens
caguauaaauuacaugcau

SEQ ID NO: 1837123 - RNA, 22 nt, Homo sapiens
auuugaaaaaaacuucauucuc

SEQ ID NO: 1837124 - RNA, 19 nt, Homo sapiens
caaaugcaauuuccaacac

SEQ ID NO: 1837125 - RNA, 17 nt, Homo sapiens
accuccuguguggaaga

SEQ ID NO: 1837126 - RNA, 15 nt, Homo sapiens
ugcucauucuaauga

SEQ ID NO: 1837127 - RNA, 20 nt, Homo sapiens
cucuggauugagauacuuga

SEQ ID NO: 1837128 - RNA, 14 nt, Homo sapiens
ggauuagaaugccg

SEQ ID NO: 1837129 - RNA, 13 nt, Homo sapiens
auagaauugcaca

SEQ ID NO: 1837130 - RNA, 17 nt, Homo sapiens
cugacugccaagccaga

SEQ ID NO: 1837131 - RNA, 15 nt, Homo sapiens
aagccagucuuaaca

SEQ ID NO: 1837132 - RNA, 14 nt, Homo sapiens
gacuccuccuuuau

SEQ ID NO: 1837133 - RNA, 17 nt, Homo sapiens
acuggccauuugccaau

SEQ ID NO: 1837134 - RNA, 16 nt, Homo sapiens
uggucuugaacuccug

SEQ ID NO: 1837135 - RNA, 16 nt, Homo sapiens
auccagcuuccuucug

SEQ ID NO: 1837136 - RNA, 23 nt, Homo sapiens
ucaggcgauccaccugucucagc

SEQ ID NO: 1837137 - RNA, 17 nt, Homo sapiens
ucacugaaaccaggugg

SEQ ID NO: 1837138 - RNA, 15 nt, Homo sapiens
gaacugcugcugacc

SEQ ID NO: 1837139 - RNA, 17 nt, Homo sapiens
augcaaaguacauguau

SEQ ID NO: 1837140 - RNA, 18 nt, Homo sapiens
cacaauuuauauuuuccc

SEQ ID NO: 1837141 - RNA, 20 nt, Homo sapiens
uuuggcuuuuuccaucucaa

SEQ ID NO: 1837142 - RNA, 13 nt, Homo sapiens
uuccccacaguga

SEQ ID NO: 1837143 - RNA, 11 nt, Homo sapiens
auaacugugac

SEQ ID NO: 1837144 - RNA, 17 nt, Homo sapiens
ucucauuuggucugcca

SEQ ID NO: 1837145 - RNA, 23 nt, Homo sapiens
cugucaccacccugcucauccac

SEQ ID NO: 1837146 - RNA, 20 nt, Homo sapiens
acaaucaauaaaaauggcau

SEQ ID NO: 1837147 - RNA, 17 nt, Homo sapiens
auaccuccaacccugcc

SEQ ID NO: 1837148 - RNA, 22 nt, Homo sapiens
acaucuagcuggcuucccuguc

SEQ ID NO: 1837149 - RNA, 15 nt, Homo sapiens
agcgauucuccugcc

SEQ ID NO: 1837150 - RNA, 15 nt, Homo sapiens
agugauucucuugcc

SEQ ID NO: 1837151 - RNA, 22 nt, Homo sapiens
gagugaucucagcucacugcaa

SEQ ID NO: 1837152 - RNA, 17 nt, Homo sapiens
cagaugugaaccauuaa

SEQ ID NO: 1837153 - RNA, 23 nt, Homo sapiens
cgggaccgugggccgaggugacu

SEQ ID NO: 1837154 - RNA, 14 nt, Homo sapiens
aaaagaugguugcc

SEQ ID NO: 1837155 - RNA, 22 nt, Homo sapiens
uauaacuuaggccuagccucuu

SEQ ID NO: 1837156 - RNA, 16 nt, Homo sapiens
guguugaaauggucca

SEQ ID NO: 1837157 - RNA, 16 nt, Homo sapiens
ccuggguuuucuuaac

SEQ ID NO: 1837158 - RNA, 16 nt, Homo sapiens
gacaugcuaaauaacu

SEQ ID NO: 1837159 - RNA, 18 nt, Homo sapiens
guaucaaauacauuuaaa

SEQ ID NO: 1837160 - RNA, 17 nt, Homo sapiens
uuccaaccccuuuccac

SEQ ID NO: 1837161 - RNA, 16 nt, Homo sapiens
caguucauuauuuugu

SEQ ID NO: 1837162 - RNA, 21 nt, Homo sapiens
uuauucacaaccucaccaaac

SEQ ID NO: 1837163 - RNA, 15 nt, Homo sapiens
aucuguuagcauuau

SEQ ID NO: 1837164 - RNA, 15 nt, Homo sapiens
uccuacgcaccauuu

SEQ ID NO: 1837165 - RNA, 15 nt, Homo sapiens
gcguuguuacaggaa

SEQ ID NO: 1837166 - RNA, 15 nt, Homo sapiens
gaaaugaaagggaaa

SEQ ID NO: 1837167 - RNA, 14 nt, Homo sapiens
aggauuaagcuuuu

SEQ ID NO: 1837168 - RNA, 14 nt, Homo sapiens
caccuuuuaugaau

SEQ ID NO: 1837169 - RNA, 14 nt, Homo sapiens
ggccauucauuucu

SEQ ID NO: 1837170 - RNA, 16 nt, Homo sapiens
caguuuaggaguacug

SEQ ID NO: 1837171 - RNA, 22 nt, Homo sapiens
ccaaaccgcaggcaaacggguc

SEQ ID NO: 1837172 - RNA, 19 nt, Homo sapiens
uaaauuuuaaguaucccau

SEQ ID NO: 1837173 - RNA, 19 nt, Homo sapiens
accucgugauccaccugcc

SEQ ID NO: 1837174 - RNA, 19 nt, Homo sapiens
aaaauaauuauaaauauca

SEQ ID NO: 1837175 - RNA, 19 nt, Homo sapiens
gcuggaugugaguuuccac

SEQ ID NO: 1837176 - RNA, 15 nt, Homo sapiens
ugacucauggcagcu

SEQ ID NO: 1837177 - RNA, 23 nt, Homo sapiens
gcaggcuuaauaaaaaugacaga

SEQ ID NO: 1837178 - RNA, 20 nt, Homo sapiens
caguuuuguacauagcaaau

SEQ ID NO: 1837179 - RNA, 18 nt, Homo sapiens
gcaccgucucacugugug

SEQ ID NO: 1837180 - RNA, 20 nt, Homo sapiens
augauacaccuacuacucaa

SEQ ID NO: 1837181 - RNA, 19 nt, Homo sapiens
auguaucucaguaccccau

SEQ ID NO: 1837182 - RNA, 19 nt, Homo sapiens
aacguuugacaaacacaau

SEQ ID NO: 1837183 - RNA, 19 nt, Homo sapiens
gaaaagacuuuuguugaaa

SEQ ID NO: 1837184 - RNA, 22 nt, Homo sapiens
ccccgugaaugcuuaccuguga

SEQ ID NO: 1837185 - RNA, 20 nt, Homo sapiens
gugcuauccugcccaggcca

SEQ ID NO: 1837186 - RNA, 17 nt, Homo sapiens
ggggcaaugacuuuccu

SEQ ID NO: 1837187 - RNA, 21 nt, Homo sapiens
uuuauugcaggauggugucuc

SEQ ID NO: 1837188 - RNA, 14 nt, Homo sapiens
acacaauaauguga

SEQ ID NO: 1837189 - RNA, 14 nt, Homo sapiens
uaacucaaauucaa

SEQ ID NO: 1837190 - RNA, 22 nt, Homo sapiens
ggaaaguaaauauuucaggcau

SEQ ID NO: 1837191 - RNA, 14 nt, Homo sapiens
cuaucgaacuucac

SEQ ID NO: 1837192 - RNA, 17 nt, Homo sapiens
acccacaaaaguacaau

SEQ ID NO: 1837193 - RNA, 19 nt, Homo sapiens
gaaugaaugucagugugac

SEQ ID NO: 1837194 - RNA, 22 nt, Homo sapiens
ccauuuuaugaguucuguauaa

SEQ ID NO: 1837195 - RNA, 15 nt, Homo sapiens
gaguaugucugaugg

SEQ ID NO: 1837196 - RNA, 18 nt, Homo sapiens
gcucagacaucuacuaca

SEQ ID NO: 1837197 - RNA, 18 nt, Homo sapiens
cuaauuaaaaacugugau

SEQ ID NO: 1837198 - RNA, 14 nt, Homo sapiens
cagacaugccuugg

SEQ ID NO: 1837199 - RNA, 22 nt, Homo sapiens
gagaugggaaagcggcgccaca

SEQ ID NO: 1837200 - RNA, 22 nt, Homo sapiens
gcccucagaaucgcuccaccuu

SEQ ID NO: 1837201 - RNA, 18 nt, Homo sapiens
cugccccaugaagccaca

SEQ ID NO: 1837202 - RNA, 19 nt, Homo sapiens
ccacacaaacguauguaaa

SEQ ID NO: 1837203 - RNA, 17 nt, Homo sapiens
cugguagaccacugcca

SEQ ID NO: 1837204 - RNA, 19 nt, Homo sapiens
aacugaaacucacaguaau

SEQ ID NO: 1837205 - RNA, 13 nt, Homo sapiens
ggcucccaucuga

SEQ ID NO: 1837206 - RNA, 17 nt, Homo sapiens
aaguccaacaguagcau

SEQ ID NO: 1837207 - RNA, 14 nt, Homo sapiens
ucuuauuugcaaua

SEQ ID NO: 1837208 - RNA, 17 nt, Homo sapiens
auguacauagugcuaac

SEQ ID NO: 1837209 - RNA, 19 nt, Homo sapiens
aucuguuuuucaccacuuc

SEQ ID NO: 1837210 - RNA, 20 nt, Homo sapiens
cccggggcauggacagggcc

SEQ ID NO: 1837211 - RNA, 15 nt, Homo sapiens
cuggcuccuucacca

SEQ ID NO: 1837212 - RNA, 19 nt, Homo sapiens
acucaagcuucuucacuca

SEQ ID NO: 1837213 - RNA, 21 nt, Homo sapiens
uaugggagaaggccagugccc

SEQ ID NO: 1837214 - RNA, 20 nt, Homo sapiens
acugaggggcccuggucucc

SEQ ID NO: 1837215 - RNA, 22 nt, Homo sapiens
ggaccagagccagaugcaggac

SEQ ID NO: 1837216 - RNA, 13 nt, Homo sapiens
aauuacguuuaaa

SEQ ID NO: 1837217 - RNA, 21 nt, Homo sapiens
auuccagucugaagugccuac

SEQ ID NO: 1837218 - RNA, 15 nt, Homo sapiens
agggcucagggcagu

SEQ ID NO: 1837219 - RNA, 17 nt, Homo sapiens
augcaugucuaaccuga

SEQ ID NO: 1837220 - RNA, 18 nt, Homo sapiens
agacaguggaucaugaaa

SEQ ID NO: 1837221 - RNA, 23 nt, Homo sapiens
cauaaagaauuuuguauuuucau

SEQ ID NO: 1837222 - RNA, 12 nt, Homo sapiens
guucagugccuu

SEQ ID NO: 1837223 - RNA, 19 nt, Homo sapiens
ccuauuuaucugaucaaga

SEQ ID NO: 1837224 - RNA, 15 nt, Homo sapiens
uuugcaauuugucag

SEQ ID NO: 1837225 - RNA, 16 nt, Homo sapiens
gagccuggaacugacc

SEQ ID NO: 1837226 - RNA, 15 nt, Homo sapiens
ucaauaaacacuugu

SEQ ID NO: 1837227 - RNA, 21 nt, Homo sapiens
cagaugcugugcaaauguuau

SEQ ID NO: 1837228 - RNA, 19 nt, Homo sapiens
aggccaagggccaagagaa

SEQ ID NO: 1837229 - RNA, 15 nt, Homo sapiens
uggauuuauagcuau

SEQ ID NO: 1837230 - RNA, 19 nt, Homo sapiens
ccugaaucugaccacagac

SEQ ID NO: 1837231 - RNA, 19 nt, Homo sapiens
cuuuuaaagaaacuuggcu

SEQ ID NO: 1837232 - RNA, 13 nt, Homo sapiens
aagaggcagugag

SEQ ID NO: 1837233 - RNA, 21 nt, Homo sapiens
uggccggggcugaagccacac

SEQ ID NO: 1837234 - RNA, 19 nt, Homo sapiens
acaugagaaacgcuuaugu

SEQ ID NO: 1837235 - RNA, 17 nt, Homo sapiens
uguccaaagaggcugcc

SEQ ID NO: 1837236 - RNA, 15 nt, Homo sapiens
aguggaugacaaaaa

SEQ ID NO: 1837237 - RNA, 16 nt, Homo sapiens
aacagagaacccugug

SEQ ID NO: 1837238 - RNA, 21 nt, Homo sapiens
gaaucuuugucagcaguuccc

SEQ ID NO: 1837239 - RNA, 13 nt, Homo sapiens
caggaaucucaaa

SEQ ID NO: 1837240 - RNA, 18 nt, Homo sapiens
uaagccaguuuuacacua

SEQ ID NO: 1837241 - RNA, 17 nt, Homo sapiens
uaacuuuugggauuugu

SEQ ID NO: 1837242 - RNA, 18 nt, Homo sapiens
aaguaaguaccacucagg

SEQ ID NO: 1837243 - RNA, 24 nt, Homo sapiens
guagcugggacuacaggugugcac

SEQ ID NO: 1837244 - RNA, 11 nt, Homo sapiens
cccccagugug

SEQ ID NO: 1837245 - RNA, 16 nt, Homo sapiens
aucauaacauauagca

SEQ ID NO: 1837246 - RNA, 23 nt, Homo sapiens
cacaggguuuuguauucuuuacu

SEQ ID NO: 1837247 - RNA, 19 nt, Homo sapiens
auuagcuuugucacuguuu

SEQ ID NO: 1837248 - RNA, 14 nt, Homo sapiens
gggggccgugccuc

SEQ ID NO: 1837249 - RNA, 18 nt, Homo sapiens
agcauuuuucaaaugauc

SEQ ID NO: 1837250 - RNA, 14 nt, Homo sapiens
ggguccaggcaugu

SEQ ID NO: 1837251 - RNA, 18 nt, Homo sapiens
aaagcuguuaaacuguua

SEQ ID NO: 1837252 - RNA, 22 nt, Homo sapiens
accucuuuauuuuuugauugaa

SEQ ID NO: 1837253 - RNA, 16 nt, Homo sapiens
uagcugugaccugcug

SEQ ID NO: 1837254 - RNA, 23 nt, Homo sapiens
gaugauacuuggaugcagcucuu

SEQ ID NO: 1837255 - RNA, 21 nt, Homo sapiens
agggggaggcuaaagcccaga

SEQ ID NO: 1837256 - RNA, 17 nt, Homo sapiens
gucaacaaccaugccag

SEQ ID NO: 1837257 - RNA, 21 nt, Homo sapiens
acgcuggggcucucugagacu

SEQ ID NO: 1837258 - RNA, 14 nt, Homo sapiens
uuaaggaaauggug

SEQ ID NO: 1837259 - RNA, 16 nt, Homo sapiens
uccagaagaacaaaga

SEQ ID NO: 1837260 - RNA, 13 nt, Homo sapiens
guacuaaccugga

SEQ ID NO: 1837261 - RNA, 18 nt, Homo sapiens
auggggcacugacagaga

SEQ ID NO: 1837262 - RNA, 19 nt, Homo sapiens
auuuucaaguuuacacuuc

SEQ ID NO: 1837263 - RNA, 15 nt, Homo sapiens
cccagagaagccuca

SEQ ID NO: 1837264 - RNA, 21 nt, Homo sapiens
gagucagcaccccuccuagca

SEQ ID NO: 1837265 - RNA, 14 nt, Homo sapiens
cuuuuaugccuuca

SEQ ID NO: 1837266 - RNA, 20 nt, Homo sapiens
gauccuucaaagagucauau

SEQ ID NO: 1837267 - RNA, 14 nt, Homo sapiens
cuccccugccccuc

SEQ ID NO: 1837268 - RNA, 17 nt, Homo sapiens
uugagaagaaaaacuca

SEQ ID NO: 1837269 - RNA, 18 nt, Homo sapiens
ggcccuccccacaaugcc

SEQ ID NO: 1837270 - RNA, 19 nt, Homo sapiens
acaccaaugcccaacugcc

SEQ ID NO: 1837271 - RNA, 18 nt, Homo sapiens
cugcgcauauagacugua

SEQ ID NO: 1837272 - RNA, 17 nt, Homo sapiens
uguauguuucuuagccc

SEQ ID NO: 1837273 - RNA, 20 nt, Homo sapiens
gcugugccuacgacuaucug

SEQ ID NO: 1837274 - RNA, 18 nt, Homo sapiens
gucuguccugcguccucu

SEQ ID NO: 1837275 - RNA, 19 nt, Homo sapiens
accagauggaacacuggaa

SEQ ID NO: 1837276 - RNA, 22 nt, Homo sapiens
cuugcacuggggugggauuugg

SEQ ID NO: 1837277 - RNA, 15 nt, Homo sapiens
uuuugauaaguaucu

SEQ ID NO: 1837278 - RNA, 18 nt, Homo sapiens
caugccccuggaccagua

SEQ ID NO: 1837279 - RNA, 14 nt, Homo sapiens
acuuacacaagacu

SEQ ID NO: 1837280 - RNA, 23 nt, Homo sapiens
uacaaaacauuuuuuuguucucu

SEQ ID NO: 1837281 - RNA, 18 nt, Homo sapiens
ggaaggugccucuggaug

SEQ ID NO: 1837282 - RNA, 16 nt, Homo sapiens
aaaauaccagccagua

SEQ ID NO: 1837283 - RNA, 13 nt, Homo sapiens
acuucguuuaaug

SEQ ID NO: 1837284 - RNA, 16 nt, Homo sapiens
cuucuuucaaagugua

SEQ ID NO: 1837285 - RNA, 16 nt, Homo sapiens
gccucugccugcauuc

SEQ ID NO: 1837286 - RNA, 17 nt, Homo sapiens
ugccuccaggagcugca

SEQ ID NO: 1837287 - RNA, 14 nt, Homo sapiens
cauuuuuugucugu

SEQ ID NO: 1837288 - RNA, 17 nt, Homo sapiens
uaagaguaaaauuccuc

SEQ ID NO: 1837289 - RNA, 21 nt, Homo sapiens
cuauagugaugaugaucucau

SEQ ID NO: 1837290 - RNA, 14 nt, Homo sapiens
caauauaugauaua

SEQ ID NO: 1837291 - RNA, 12 nt, Homo sapiens
auguaaaccaca

SEQ ID NO: 1837292 - RNA, 22 nt, Homo sapiens
cagugccuggacaaaugaugcc

SEQ ID NO: 1837293 - RNA, 15 nt, Homo sapiens
uagauggaugaauua

SEQ ID NO: 1837294 - RNA, 14 nt, Homo sapiens
gacaaaauugcuga

SEQ ID NO: 1837295 - RNA, 18 nt, Homo sapiens
auaaaugugguacaagca

SEQ ID NO: 1837296 - RNA, 22 nt, Homo sapiens
uggugaauuuguuuaagguuaa

SEQ ID NO: 1837297 - RNA, 17 nt, Homo sapiens
uccagcugcaagggagu

SEQ ID NO: 1837298 - RNA, 18 nt, Homo sapiens
acugcagagggacagaug

SEQ ID NO: 1837299 - RNA, 12 nt, Homo sapiens
gguucucuacag

SEQ ID NO: 1837300 - RNA, 19 nt, Homo sapiens
aaauugaaauaaagauaaa

SEQ ID NO: 1837301 - RNA, 22 nt, Homo sapiens
ggaauggugcccuuggaggcaa

SEQ ID NO: 1837302 - RNA, 18 nt, Homo sapiens
agccgcgaggcuaaaaaa

SEQ ID NO: 1837303 - RNA, 14 nt, Homo sapiens
uuacauaucugacu

SEQ ID NO: 1837304 - RNA, 21 nt, Homo sapiens
cagaacugggaaaacagugaa

SEQ ID NO: 1837305 - RNA, 18 nt, Homo sapiens
ucugcguaugagucccau

SEQ ID NO: 1837306 - RNA, 20 nt, Homo sapiens
ccuuggcgcgcagcccggga

SEQ ID NO: 1837307 - RNA, 12 nt, Homo sapiens
uaucuccugaca

SEQ ID NO: 1837308 - RNA, 20 nt, Homo sapiens
ugccagguucuauuuggaau

SEQ ID NO: 1837309 - RNA, 21 nt, Homo sapiens
gguggauuuuguggaggugag

SEQ ID NO: 1837310 - RNA, 12 nt, Homo sapiens
uugcuuuacucu

SEQ ID NO: 1837311 - RNA, 16 nt, Homo sapiens
uugcugaacauggaua

SEQ ID NO: 1837312 - RNA, 19 nt, Homo sapiens
ugccacauuagccuuugca

SEQ ID NO: 1837313 - RNA, 13 nt, Homo sapiens
uaauuuaguucuc

SEQ ID NO: 1837314 - RNA, 21 nt, Homo sapiens
agaaagggcggugaacucugg

SEQ ID NO: 1837315 - RNA, 15 nt, Homo sapiens
aauacugggugcugu

SEQ ID NO: 1837316 - RNA, 23 nt, Homo sapiens
cucccaugugcugacucccccca

SEQ ID NO: 1837317 - RNA, 23 nt, Homo sapiens
cacuaagucucuuuuuuacaaag

SEQ ID NO: 1837318 - RNA, 19 nt, Homo sapiens
aguucucuagggucugaua

SEQ ID NO: 1837319 - RNA, 14 nt, Homo sapiens
uaaacucuuuuugg

SEQ ID NO: 1837320 - RNA, 20 nt, Homo sapiens
ggaaguuucuggugccauuu

SEQ ID NO: 1837321 - RNA, 14 nt, Homo sapiens
uaaauccuuuacaa

SEQ ID NO: 1837322 - RNA, 17 nt, Homo sapiens
ucaugggucugcccuug

SEQ ID NO: 1837323 - RNA, 16 nt, Homo sapiens
ugcaaauacaaucagc

SEQ ID NO: 1837324 - RNA, 17 nt, Homo sapiens
gucuuagucauaccauc

SEQ ID NO: 1837325 - RNA, 21 nt, Homo sapiens
cugauagauauccuuggcaca

SEQ ID NO: 1837326 - RNA, 17 nt, Homo sapiens
gacgggguuugccaugc

SEQ ID NO: 1837327 - RNA, 19 nt, Homo sapiens
aucaacugucaaauauguu

SEQ ID NO: 1837328 - RNA, 23 nt, Homo sapiens
cccuagauuuaaccauggcacug

SEQ ID NO: 1837329 - RNA, 13 nt, Homo sapiens
caggguuuuuacc

SEQ ID NO: 1837330 - RNA, 17 nt, Homo sapiens
ugccacggaaacauaca

SEQ ID NO: 1837331 - RNA, 17 nt, Homo sapiens
uaaauauuuuucaucaa

SEQ ID NO: 1837332 - RNA, 23 nt, Homo sapiens
auuaacuuuaauguuuuuugcca

SEQ ID NO: 1837333 - RNA, 17 nt, Homo sapiens
ugcucccgaugcugcua

SEQ ID NO: 1837334 - RNA, 14 nt, Homo sapiens
aagucaacaaccau

SEQ ID NO: 1837335 - RNA, 14 nt, Homo sapiens
ugcaguucuucauc

SEQ ID NO: 1837336 - RNA, 22 nt, Homo sapiens
uccacagccgccugaaagccac

SEQ ID NO: 1837337 - RNA, 20 nt, Homo sapiens
uauaguuaggcuuccaugau

SEQ ID NO: 1837338 - RNA, 18 nt, Homo sapiens
cuggacugugggacccuc

SEQ ID NO: 1837339 - RNA, 17 nt, Homo sapiens
guguaauuccucccuaa

SEQ ID NO: 1837340 - RNA, 22 nt, Homo sapiens
cauugcaauuuugcauagcuuu

SEQ ID NO: 1837341 - RNA, 19 nt, Homo sapiens
uaccuuuuguuaccacaga

SEQ ID NO: 1837342 - RNA, 18 nt, Homo sapiens
aucauuuccguuuugccu

SEQ ID NO: 1837343 - RNA, 17 nt, Homo sapiens
uucuuguaaacauugcc

SEQ ID NO: 1837344 - RNA, 13 nt, Homo sapiens
acccagugccagg

SEQ ID NO: 1837345 - RNA, 20 nt, Homo sapiens
aucuuccagaaacuacauga

SEQ ID NO: 1837346 - RNA, 22 nt, Homo sapiens
guagcauuuuucuaaaaccuua

SEQ ID NO: 1837347 - RNA, 17 nt, Homo sapiens
ucccugccuguuucccg

SEQ ID NO: 1837348 - RNA, 19 nt, Homo sapiens
acauucacacagggcucuu

SEQ ID NO: 1837349 - RNA, 19 nt, Homo sapiens
uuccucuugggcuuuugaa

SEQ ID NO: 1837350 - RNA, 12 nt, Homo sapiens
ucaaaguaauaa

SEQ ID NO: 1837351 - RNA, 16 nt, Homo sapiens
ucccgccuccaugacu

SEQ ID NO: 1837352 - RNA, 17 nt, Homo sapiens
ugcgaucuggguucacu

SEQ ID NO: 1837353 - RNA, 13 nt, Homo sapiens
agcuuagaccuca

SEQ ID NO: 1837354 - RNA, 20 nt, Homo sapiens
uuagagaaaagagacacaaa

SEQ ID NO: 1837355 - RNA, 16 nt, Homo sapiens
uucgugccccagagau

SEQ ID NO: 1837356 - RNA, 18 nt, Homo sapiens
gacccuccccacccugaa

SEQ ID NO: 1837357 - RNA, 18 nt, Homo sapiens
uauauuguaaagauccua

SEQ ID NO: 1837358 - RNA, 12 nt, Homo sapiens
cugucagauuaa

SEQ ID NO: 1837359 - RNA, 19 nt, Homo sapiens
agcuguaaaacgcugucaa

SEQ ID NO: 1837360 - RNA, 23 nt, Homo sapiens
uuccagaagaagagaagcugcug

SEQ ID NO: 1837361 - RNA, 17 nt, Homo sapiens
cuguagugcuacagggu

SEQ ID NO: 1837362 - RNA, 15 nt, Homo sapiens
agaaaagaacuggaa

SEQ ID NO: 1837363 - RNA, 16 nt, Homo sapiens
ugaaguggagucucau

SEQ ID NO: 1837364 - RNA, 16 nt, Homo sapiens
ugcauaucugccuccc

SEQ ID NO: 1837365 - RNA, 16 nt, Homo sapiens
uuacacaugugcugau

SEQ ID NO: 1837366 - RNA, 18 nt, Homo sapiens
cgagaucauucuucacuc

SEQ ID NO: 1837367 - RNA, 17 nt, Homo sapiens
gagcugcucucucauga

SEQ ID NO: 1837368 - RNA, 16 nt, Homo sapiens
ggcaaugucagaugaa

SEQ ID NO: 1837369 - RNA, 13 nt, Homo sapiens
aaagagaguuugu

SEQ ID NO: 1837370 - RNA, 20 nt, Homo sapiens
aucgcugccuugccaugucu

SEQ ID NO: 1837371 - RNA, 14 nt, Homo sapiens
accuugacagagca

SEQ ID NO: 1837372 - RNA, 20 nt, Homo sapiens
ugcaccgagagagauggaau

SEQ ID NO: 1837373 - RNA, 17 nt, Homo sapiens
agccagaggcaccucaa

SEQ ID NO: 1837374 - RNA, 18 nt, Homo sapiens
ucacugagaagauuguga

SEQ ID NO: 1837375 - RNA, 14 nt, Homo sapiens
uaucugucaucucu

SEQ ID NO: 1837376 - RNA, 15 nt, Homo sapiens
uuugguacugugaug

SEQ ID NO: 1837377 - RNA, 19 nt, Homo sapiens
uguuuuucuucagcauuua

SEQ ID NO: 1837378 - RNA, 17 nt, Homo sapiens
uuccugguccaucucau

SEQ ID NO: 1837379 - RNA, 19 nt, Homo sapiens
uuuuguaacauaaugcacu

SEQ ID NO: 1837380 - RNA, 18 nt, Homo sapiens
ugucuccacgauggugga

SEQ ID NO: 1837381 - RNA, 22 nt, Homo sapiens
uaaacugugugcaacagacaaa

SEQ ID NO: 1837382 - RNA, 22 nt, Homo sapiens
gauacugcucaucauuccuuga

SEQ ID NO: 1837383 - RNA, 18 nt, Homo sapiens
aguccuacccugaaccua

SEQ ID NO: 1837384 - RNA, 16 nt, Homo sapiens
ccuuccccuucccaca

SEQ ID NO: 1837385 - RNA, 17 nt, Homo sapiens
gacagccucugacucac

SEQ ID NO: 1837386 - RNA, 15 nt, Homo sapiens
cugaccuccacagcu

SEQ ID NO: 1837387 - RNA, 19 nt, Homo sapiens
auuuuaaaagaaugauuau

SEQ ID NO: 1837388 - RNA, 17 nt, Homo sapiens
ucuaacaaaacaaguug

SEQ ID NO: 1837389 - RNA, 13 nt, Homo sapiens
aauaaaaccagaa

SEQ ID NO: 1837390 - RNA, 16 nt, Homo sapiens
agcuauuacuguccac

SEQ ID NO: 1837391 - RNA, 21 nt, Homo sapiens
caagggucucacacugugaac

SEQ ID NO: 1837392 - RNA, 19 nt, Homo sapiens
uuaacuccuccugagcucu

SEQ ID NO: 1837393 - RNA, 12 nt, Homo sapiens
ucuuucuagccu

SEQ ID NO: 1837394 - RNA, 19 nt, Homo sapiens
aagaauuuuguauuuucau

SEQ ID NO: 1837395 - RNA, 23 nt, Homo sapiens
uacaucagauuagagagucucaa

SEQ ID NO: 1837396 - RNA, 21 nt, Homo sapiens
auuccuucuaagauaaaaaua

SEQ ID NO: 1837397 - RNA, 12 nt, Homo sapiens
ucaucuugccac

SEQ ID NO: 1837398 - RNA, 18 nt, Homo sapiens
uucucaguccuaauuuga

SEQ ID NO: 1837399 - RNA, 21 nt, Homo sapiens
aacuuccuaaugauuagcacu

SEQ ID NO: 1837400 - RNA, 15 nt, Homo sapiens
ccuuccccagccucu

SEQ ID NO: 1837401 - RNA, 22 nt, Homo sapiens
cucaaacccuguaaguuacagu

SEQ ID NO: 1837402 - RNA, 20 nt, Homo sapiens
gccucacccaggcaucugcu

SEQ ID NO: 1837403 - RNA, 16 nt, Homo sapiens
cacccaccucugccac

SEQ ID NO: 1837404 - RNA, 11 nt, Homo sapiens
uccccuaauaa

SEQ ID NO: 1837405 - RNA, 17 nt, Homo sapiens
agcuccaauuucaagag

SEQ ID NO: 1837406 - RNA, 17 nt, Homo sapiens
acacucaugcauugucc

SEQ ID NO: 1837407 - RNA, 15 nt, Homo sapiens
caaccuuggccuucu

SEQ ID NO: 1837408 - RNA, 15 nt, Homo sapiens
gcuuaggcauucuaa

SEQ ID NO: 1837409 - RNA, 11 nt, Homo sapiens
auguuaugcug

SEQ ID NO: 1837410 - RNA, 23 nt, Homo sapiens
cacugaagaagucacugaacaaa

SEQ ID NO: 1837411 - RNA, 18 nt, Homo sapiens
ccaaaucugacauauuau

SEQ ID NO: 1837412 - RNA, 19 nt, Homo sapiens
caagaaguaacaaaaguau

SEQ ID NO: 1837413 - RNA, 23 nt, Homo sapiens
accuucaugugguucagugccuu

SEQ ID NO: 1837414 - RNA, 14 nt, Homo sapiens
auccuggcuaacac

SEQ ID NO: 1837415 - RNA, 13 nt, Homo sapiens
ugggaguguuugu

SEQ ID NO: 1837416 - RNA, 22 nt, Homo sapiens
gucaagcuguugaagucucagg

SEQ ID NO: 1837417 - RNA, 22 nt, Homo sapiens
uccuaaguuuaauuacaacagc

SEQ ID NO: 1837418 - RNA, 15 nt, Homo sapiens
cuacugccacugugu

SEQ ID NO: 1837419 - RNA, 15 nt, Homo sapiens
gcccugccaucuucc

SEQ ID NO: 1837420 - RNA, 16 nt, Homo sapiens
cugcaaaaugggauga

SEQ ID NO: 1837421 - RNA, 20 nt, Homo sapiens
ucuacccugaucaccucagg

SEQ ID NO: 1837422 - RNA, 22 nt, Homo sapiens
uacagaaagagcgucauguccu

SEQ ID NO: 1837423 - RNA, 15 nt, Homo sapiens
uguccuccucuguga

SEQ ID NO: 1837424 - RNA, 22 nt, Homo sapiens
uggaugcagcaccucucaggau

SEQ ID NO: 1837425 - RNA, 15 nt, Homo sapiens
gagagcucacagacu

SEQ ID NO: 1837426 - RNA, 20 nt, Homo sapiens
caggcugggccauguccaaa

SEQ ID NO: 1837427 - RNA, 23 nt, Homo sapiens
cuggguuuaagcaaugcuucugc

SEQ ID NO: 1837428 - RNA, 21 nt, Homo sapiens
ggucagcuugaauguccccau

SEQ ID NO: 1837429 - RNA, 20 nt, Homo sapiens
acuggacaaagaauuccaaa

SEQ ID NO: 1837430 - RNA, 23 nt, Homo sapiens
cuuggaauagcuuguacacauau

SEQ ID NO: 1837431 - RNA, 17 nt, Homo sapiens
acccccgcacccuuaag

SEQ ID NO: 1837432 - RNA, 23 nt, Homo sapiens
ucuggcugccccaaccugcugaa

SEQ ID NO: 1837433 - RNA, 12 nt, Homo sapiens
cccagcagcacc

SEQ ID NO: 1837434 - RNA, 17 nt, Homo sapiens
gccuguagcaauggcca

SEQ ID NO: 1837435 - RNA, 13 nt, Homo sapiens
ccugugagcucaa

SEQ ID NO: 1837436 - RNA, 14 nt, Homo sapiens
auuguacauaaaag

SEQ ID NO: 1837437 - RNA, 19 nt, Homo sapiens
uggcagcugccccuggcac

SEQ ID NO: 1837438 - RNA, 18 nt, Homo sapiens
guucaaauuuccuuucau

SEQ ID NO: 1837439 - RNA, 20 nt, Homo sapiens
auuucugggugaugaaaaug

SEQ ID NO: 1837440 - RNA, 13 nt, Homo sapiens
caucucaauggca

SEQ ID NO: 1837441 - RNA, 13 nt, Homo sapiens
caguacaauguuu

SEQ ID NO: 1837442 - RNA, 18 nt, Homo sapiens
aagacucuggagccaagg

SEQ ID NO: 1837443 - RNA, 16 nt, Homo sapiens
aaaugaaaucuuccca

SEQ ID NO: 1837444 - RNA, 17 nt, Homo sapiens
acuggggggaccaaaua

SEQ ID NO: 1837445 - RNA, 19 nt, Homo sapiens
gacauugggucuauuccag

SEQ ID NO: 1837446 - RNA, 13 nt, Homo sapiens
aaucagugcuccu

SEQ ID NO: 1837447 - RNA, 14 nt, Homo sapiens
ugcugcucccucag

SEQ ID NO: 1837448 - RNA, 16 nt, Homo sapiens
guuaauugcagucuaa

SEQ ID NO: 1837449 - RNA, 17 nt, Homo sapiens
aggaucaaagaacugaa

SEQ ID NO: 1837450 - RNA, 23 nt, Homo sapiens
ggaugucugccacaccucuccaa

SEQ ID NO: 1837451 - RNA, 19 nt, Homo sapiens
gugacauuuuagaauguca

SEQ ID NO: 1837452 - RNA, 13 nt, Homo sapiens
ucucacacacaua

SEQ ID NO: 1837453 - RNA, 21 nt, Homo sapiens
gccagcagcgggggcggccca

SEQ ID NO: 1837454 - RNA, 17 nt, Homo sapiens
auuagaaauuuaauuuc

SEQ ID NO: 1837455 - RNA, 22 nt, Homo sapiens
cucccacauugucaccauuuca

SEQ ID NO: 1837456 - RNA, 16 nt, Homo sapiens
aaaaauggucaauaaa

SEQ ID NO: 1837457 - RNA, 22 nt, Homo sapiens
cagcggaaagcccugugcucca

SEQ ID NO: 1837458 - RNA, 16 nt, Homo sapiens
caaauccugaugcugu

SEQ ID NO: 1837459 - RNA, 11 nt, Homo sapiens
uauauaaacuc

SEQ ID NO: 1837460 - RNA, 15 nt, Homo sapiens
gcaaguacaauguua

SEQ ID NO: 1837461 - RNA, 17 nt, Homo sapiens
guucuguacaaaguacu

SEQ ID NO: 1837462 - RNA, 14 nt, Homo sapiens
uaagaugucuuccu

SEQ ID NO: 1837463 - RNA, 20 nt, Homo sapiens
acccagugcugccaugccac

SEQ ID NO: 1837464 - RNA, 16 nt, Homo sapiens
guucuucauuaccuca

SEQ ID NO: 1837465 - RNA, 13 nt, Homo sapiens
gaaggaaacauau

SEQ ID NO: 1837466 - RNA, 17 nt, Homo sapiens
uuaacaguuccuuucaa

SEQ ID NO: 1837467 - RNA, 18 nt, Homo sapiens
aacaacaaaaaccaaaaa

SEQ ID NO: 1837468 - RNA, 15 nt, Homo sapiens
caaaaaagcuguauu

SEQ ID NO: 1837469 - RNA, 21 nt, Homo sapiens
ccggccucagggcgcucagac

SEQ ID NO: 1837470 - RNA, 21 nt, Homo sapiens
auguaaucugauuuucaaaaa

SEQ ID NO: 1837471 - RNA, 16 nt, Homo sapiens
cuaacauguaauugca

SEQ ID NO: 1837472 - RNA, 14 nt, Homo sapiens
ggccaguaacgggu

SEQ ID NO: 1837473 - RNA, 15 nt, Homo sapiens
ucugcugaucucagu

SEQ ID NO: 1837474 - RNA, 17 nt, Homo sapiens
gaggccucucucaggag

SEQ ID NO: 1837475 - RNA, 14 nt, Homo sapiens
aucuucagaccuuu

SEQ ID NO: 1837476 - RNA, 14 nt, Homo sapiens
ugucccaagugcca

SEQ ID NO: 1837477 - RNA, 19 nt, Homo sapiens
aaagaaauuuagagucaau

SEQ ID NO: 1837478 - RNA, 23 nt, Homo sapiens
guccccccaccgcucagugucag

SEQ ID NO: 1837479 - RNA, 15 nt, Homo sapiens
cccucuugccagccu

SEQ ID NO: 1837480 - RNA, 16 nt, Homo sapiens
uuugaaaacauaaucu

SEQ ID NO: 1837481 - RNA, 17 nt, Homo sapiens
cucauuugaaugcuuaa

SEQ ID NO: 1837482 - RNA, 17 nt, Homo sapiens
cugcagccgugcaggac

SEQ ID NO: 1837483 - RNA, 22 nt, Homo sapiens
uugugauucaaacuucugugua

SEQ ID NO: 1837484 - RNA, 20 nt, Homo sapiens
guacuuguagaguggugcug

SEQ ID NO: 1837485 - RNA, 23 nt, Homo sapiens
uaucuacauuaaaaugacaaaca

SEQ ID NO: 1837486 - RNA, 20 nt, Homo sapiens
agauugcgccauugcacucc

SEQ ID NO: 1837487 - RNA, 22 nt, Homo sapiens
acaaacaaaaaacccauguguu

SEQ ID NO: 1837488 - RNA, 19 nt, Homo sapiens
cccugagauucagauguca

SEQ ID NO: 1837489 - RNA, 19 nt, Homo sapiens
uaagcuagccagaguuuuc

SEQ ID NO: 1837490 - RNA, 14 nt, Homo sapiens
augggccucaugga

SEQ ID NO: 1837491 - RNA, 14 nt, Homo sapiens
cagcaacuauucac

SEQ ID NO: 1837492 - RNA, 14 nt, Homo sapiens
caguaguuccagga

SEQ ID NO: 1837493 - RNA, 13 nt, Homo sapiens
aacacacagauuu

SEQ ID NO: 1837494 - RNA, 19 nt, Homo sapiens
uuugggaaaaaaacauaca

SEQ ID NO: 1837495 - RNA, 15 nt, Homo sapiens
accaaccucauagag

SEQ ID NO: 1837496 - RNA, 20 nt, Homo sapiens
cugauucuuaugauuacuau

SEQ ID NO: 1837497 - RNA, 17 nt, Homo sapiens
gaaaaauguuugucuca

SEQ ID NO: 1837498 - RNA, 17 nt, Homo sapiens
ucccaccccuaccucua

SEQ ID NO: 1837499 - RNA, 20 nt, Homo sapiens
auuaugaguaguguggaauu

SEQ ID NO: 1837500 - RNA, 13 nt, Homo sapiens
ggucauacaugca

SEQ ID NO: 1837501 - RNA, 16 nt, Homo sapiens
ccaacccacugcccau

SEQ ID NO: 1837502 - RNA, 16 nt, Homo sapiens
uaguauuggaucugaa

SEQ ID NO: 1837503 - RNA, 18 nt, Homo sapiens
agaccuccaccuccucca

SEQ ID NO: 1837504 - RNA, 13 nt, Homo sapiens
caagggaaaaccc

SEQ ID NO: 1837505 - RNA, 23 nt, Homo sapiens
uacagaaucauugcuuaugacau

SEQ ID NO: 1837506 - RNA, 16 nt, Homo sapiens
acauacugcauuucac

SEQ ID NO: 1837507 - RNA, 21 nt, Homo sapiens
gugauuacugcaaucacugug

SEQ ID NO: 1837508 - RNA, 17 nt, Homo sapiens
gugagcacaaugcauaa

SEQ ID NO: 1837509 - RNA, 13 nt, Homo sapiens
uagauauggaaaa

SEQ ID NO: 1837510 - RNA, 22 nt, Homo sapiens
aguacagagaaauucuguggug

SEQ ID NO: 1837511 - RNA, 16 nt, Homo sapiens
ccaccauccuauugca

SEQ ID NO: 1837512 - RNA, 13 nt, Homo sapiens
uuucucaaaaccc

SEQ ID NO: 1837513 - RNA, 18 nt, Homo sapiens
gaagcaucaaagcacugu

SEQ ID NO: 1837514 - RNA, 16 nt, Homo sapiens
ggucucaaacuccuga

SEQ ID NO: 1837515 - RNA, 17 nt, Homo sapiens
uacugauuacugccuau

SEQ ID NO: 1837516 - RNA, 23 nt, Homo sapiens
gaccaaccugggcaacauaguga

SEQ ID NO: 1837517 - RNA, 21 nt, Homo sapiens
agcuaagggugggugcucaga

SEQ ID NO: 1837518 - RNA, 18 nt, Homo sapiens
cacucuccccucccucuu

SEQ ID NO: 1837519 - RNA, 16 nt, Homo sapiens
cuccaggcccaucuca

SEQ ID NO: 1837520 - RNA, 20 nt, Homo sapiens
gugugagcguggccuuggga

SEQ ID NO: 1837521 - RNA, 23 nt, Homo sapiens
aacgauacaaauuuggccuuaag

SEQ ID NO: 1837522 - RNA, 23 nt, Homo sapiens
agcauucuggaggggagagcuuu

SEQ ID NO: 1837523 - RNA, 16 nt, Homo sapiens
ccaaaggaguggucaa

SEQ ID NO: 1837524 - RNA, 17 nt, Homo sapiens
agaguccaggccugggu

SEQ ID NO: 1837525 - RNA, 12 nt, Homo sapiens
uuugacauuucc

SEQ ID NO: 1837526 - RNA, 12 nt, Homo sapiens
agugacauagcc

SEQ ID NO: 1837527 - RNA, 18 nt, Homo sapiens
gguauuuuaagugauguc

SEQ ID NO: 1837528 - RNA, 21 nt, Homo sapiens
uccauggauaauugcuucaca

SEQ ID NO: 1837529 - RNA, 14 nt, Homo sapiens
accagcaaggggcu

SEQ ID NO: 1837530 - RNA, 19 nt, Homo sapiens
acuucuuguguguaugcac

SEQ ID NO: 1837531 - RNA, 18 nt, Homo sapiens
ugccagaaagcauaaaau

SEQ ID NO: 1837532 - RNA, 19 nt, Homo sapiens
cuuaucaagaguugugaca

SEQ ID NO: 1837533 - RNA, 19 nt, Homo sapiens
auuuuagaaacuacaaaua

SEQ ID NO: 1837534 - RNA, 20 nt, Homo sapiens
caggugugagccacccugcc

SEQ ID NO: 1837535 - RNA, 16 nt, Homo sapiens
uaaguuaugacuguga

SEQ ID NO: 1837536 - RNA, 19 nt, Homo sapiens
ggugcaguaucaugcccug

SEQ ID NO: 1837537 - RNA, 14 nt, Homo sapiens
ugggcugugcugcu

SEQ ID NO: 1837538 - RNA, 23 nt, Homo sapiens
cagaccccugggggaggcuucca

SEQ ID NO: 1837539 - RNA, 13 nt, Homo sapiens
cugaaauuuagua

SEQ ID NO: 1837540 - RNA, 17 nt, Homo sapiens
auuaauccauuuuaaca

SEQ ID NO: 1837541 - RNA, 14 nt, Homo sapiens
caucugacucacaa

SEQ ID NO: 1837542 - RNA, 16 nt, Homo sapiens
uuugaaugcggcccaa

SEQ ID NO: 1837543 - RNA, 13 nt, Homo sapiens
caaugacugugag

SEQ ID NO: 1837544 - RNA, 19 nt, Homo sapiens
agccuccgcgccuugccuc

SEQ ID NO: 1837545 - RNA, 18 nt, Homo sapiens
caucaguucacugcugca

SEQ ID NO: 1837546 - RNA, 18 nt, Homo sapiens
uaucagugcucugcuuuu

SEQ ID NO: 1837547 - RNA, 13 nt, Homo sapiens
ucugcuacugugu

SEQ ID NO: 1837548 - RNA, 13 nt, Homo sapiens
ugaucuacucauu

SEQ ID NO: 1837549 - RNA, 14 nt, Homo sapiens
ucacaucugucacg

SEQ ID NO: 1837550 - RNA, 19 nt, Homo sapiens
ugcaguauacacacuuucc

SEQ ID NO: 1837551 - RNA, 19 nt, Homo sapiens
aacugggccuguugcccuu

SEQ ID NO: 1837552 - RNA, 17 nt, Homo sapiens
uccuuugcucuugccaa

SEQ ID NO: 1837553 - RNA, 15 nt, Homo sapiens
gguccaucucagaga

SEQ ID NO: 1837554 - RNA, 20 nt, Homo sapiens
uauuugagaauaaguucaua

SEQ ID NO: 1837555 - RNA, 17 nt, Homo sapiens
aaaugagaaagcauuuc

SEQ ID NO: 1837556 - RNA, 16 nt, Homo sapiens
uaacccucacccacag

SEQ ID NO: 1837557 - RNA, 21 nt, Homo sapiens
uaaacagacuuuagcuuacag

SEQ ID NO: 1837558 - RNA, 20 nt, Homo sapiens
ucaaaucuagaagaugcagu

SEQ ID NO: 1837559 - RNA, 18 nt, Homo sapiens
gagccaugacaagaacaa

SEQ ID NO: 1837560 - RNA, 13 nt, Homo sapiens
ucuugugccucag

SEQ ID NO: 1837561 - RNA, 19 nt, Homo sapiens
acuauuucaauacuuacau

SEQ ID NO: 1837562 - RNA, 19 nt, Homo sapiens
ugcccagccucgcaugcca

SEQ ID NO: 1837563 - RNA, 14 nt, Homo sapiens
cgaaguagcuugcu

SEQ ID NO: 1837564 - RNA, 14 nt, Homo sapiens
gucagcugcucccu

SEQ ID NO: 1837565 - RNA, 20 nt, Homo sapiens
accccgucucuacuaaaaau

SEQ ID NO: 1837566 - RNA, 16 nt, Homo sapiens
caguaacaugcaacaa

SEQ ID NO: 1837567 - RNA, 19 nt, Homo sapiens
agcugccaucgaccuggag

SEQ ID NO: 1837568 - RNA, 14 nt, Homo sapiens
acagugaggcugca

SEQ ID NO: 1837569 - RNA, 17 nt, Homo sapiens
cccaggaaguggcucag

SEQ ID NO: 1837570 - RNA, 22 nt, Homo sapiens
cuguucggaagggguuccucaa

SEQ ID NO: 1837571 - RNA, 21 nt, Homo sapiens
ccauacacaugguaacauuga

SEQ ID NO: 1837572 - RNA, 23 nt, Homo sapiens
ugaaugucauuauuugauaacau

SEQ ID NO: 1837573 - RNA, 19 nt, Homo sapiens
gcuuuugguuauaaugugu

SEQ ID NO: 1837574 - RNA, 24 nt, Homo sapiens
gagaugauaaucccauacucucaa

SEQ ID NO: 1837575 - RNA, 15 nt, Homo sapiens
aggcaugacuguaga

SEQ ID NO: 1837576 - RNA, 18 nt, Homo sapiens
cacggcguuguaccugua

SEQ ID NO: 1837577 - RNA, 12 nt, Homo sapiens
ccagcacuggaa

SEQ ID NO: 1837578 - RNA, 12 nt, Homo sapiens
auuggaacugga

SEQ ID NO: 1837579 - RNA, 17 nt, Homo sapiens
ccaaagccuugugucua

SEQ ID NO: 1837580 - RNA, 16 nt, Homo sapiens
gaaaagauucuucuua

SEQ ID NO: 1837581 - RNA, 16 nt, Homo sapiens
auuauuuaaacaucag

SEQ ID NO: 1837582 - RNA, 24 nt, Homo sapiens
ccaaauuacaaguauucaguucca

SEQ ID NO: 1837583 - RNA, 20 nt, Homo sapiens
auguuucagagcucaccagg

SEQ ID NO: 1837584 - RNA, 17 nt, Homo sapiens
gguaauuucuacuuuga

SEQ ID NO: 1837585 - RNA, 20 nt, Homo sapiens
cagagaagugacgguuccua

SEQ ID NO: 1837586 - RNA, 13 nt, Homo sapiens
caagaacuugcaa

SEQ ID NO: 1837587 - RNA, 13 nt, Homo sapiens
cacgaacuugaaa

SEQ ID NO: 1837588 - RNA, 15 nt, Homo sapiens
gaugaucacugugaa

SEQ ID NO: 1837589 - RNA, 23 nt, Homo sapiens
uuagagaaaaccuuaaaaguaau

SEQ ID NO: 1837590 - RNA, 13 nt, Homo sapiens
ugagagucauuca

SEQ ID NO: 1837591 - RNA, 21 nt, Homo sapiens
ccaggaccugcagggccaaug

SEQ ID NO: 1837592 - RNA, 23 nt, Homo sapiens
uauuucuugaagaauaaauucua

SEQ ID NO: 1837593 - RNA, 15 nt, Homo sapiens
ccucagacccagcgg

SEQ ID NO: 1837594 - RNA, 22 nt, Homo sapiens
cugcgucgaagcuuugaaggcc

SEQ ID NO: 1837595 - RNA, 14 nt, Homo sapiens
auucugaugcauac

SEQ ID NO: 1837596 - RNA, 22 nt, Homo sapiens
uuaaguaacauaacuaguggcu

SEQ ID NO: 1837597 - RNA, 14 nt, Homo sapiens
cuugguaugcaucu

SEQ ID NO: 1837598 - RNA, 21 nt, Homo sapiens
aguacaauaauaaauccucag

SEQ ID NO: 1837599 - RNA, 16 nt, Homo sapiens
ugaauuaugcuacuca

SEQ ID NO: 1837600 - RNA, 20 nt, Homo sapiens
aaguaccacauuccaugacg

SEQ ID NO: 1837601 - RNA, 14 nt, Homo sapiens
accuguccucuuug

SEQ ID NO: 1837602 - RNA, 16 nt, Homo sapiens
agugcagccccucuca

SEQ ID NO: 1837603 - RNA, 16 nt, Homo sapiens
ucaauacacaguacuu

SEQ ID NO: 1837604 - RNA, 19 nt, Homo sapiens
agugaaaaaagucaccugc

SEQ ID NO: 1837605 - RNA, 19 nt, Homo sapiens
aucauuauuuagcaccguu

SEQ ID NO: 1837606 - RNA, 13 nt, Homo sapiens
ucaucccugauga

SEQ ID NO: 1837607 - RNA, 11 nt, Homo sapiens
agaaguauuug

SEQ ID NO: 1837608 - RNA, 17 nt, Homo sapiens
ucacacuucauuguaaa

SEQ ID NO: 1837609 - RNA, 14 nt, Homo sapiens
ucagccugugcagg

SEQ ID NO: 1837610 - RNA, 13 nt, Homo sapiens
auaaagcagucau

SEQ ID NO: 1837611 - RNA, 21 nt, Homo sapiens
accaggaugaaggcgugcaag

SEQ ID NO: 1837612 - RNA, 21 nt, Homo sapiens
gcaaaaaaaaacuuugacaaa

SEQ ID NO: 1837613 - RNA, 19 nt, Homo sapiens
gcagacagugucagaguca

SEQ ID NO: 1837614 - RNA, 22 nt, Homo sapiens
caguuuaugagaaugacccugu

SEQ ID NO: 1837615 - RNA, 17 nt, Homo sapiens
ugcaguugcucaggaca

SEQ ID NO: 1837616 - RNA, 15 nt, Homo sapiens
uaaucuaugcaugua

SEQ ID NO: 1837617 - RNA, 15 nt, Homo sapiens
ucaucaaugaaugaa

SEQ ID NO: 1837618 - RNA, 18 nt, Homo sapiens
ccuggccuuauaucauuu

SEQ ID NO: 1837619 - RNA, 14 nt, Homo sapiens
acuacagaauuuca

SEQ ID NO: 1837620 - RNA, 13 nt, Homo sapiens
acacaaccagagg

SEQ ID NO: 1837621 - RNA, 20 nt, Homo sapiens
cucuuuuguuccuggcuuug

SEQ ID NO: 1837622 - RNA, 19 nt, Homo sapiens
aauagaaggauguacauuu

SEQ ID NO: 1837623 - RNA, 22 nt, Homo sapiens
uaaaauauuuaucugauuaagu

SEQ ID NO: 1837624 - RNA, 15 nt, Homo sapiens
ucucccccuuuccaa

SEQ ID NO: 1837625 - RNA, 23 nt, Homo sapiens
ugaaauaccaaccugaagacacc

SEQ ID NO: 1837626 - RNA, 18 nt, Homo sapiens
cuaccccugaucugacau

SEQ ID NO: 1837627 - RNA, 20 nt, Homo sapiens
cccugaauucauugucucag

SEQ ID NO: 1837628 - RNA, 16 nt, Homo sapiens
aacguaacccauuaaa

SEQ ID NO: 1837629 - RNA, 13 nt, Homo sapiens
ccagaugaucucu

SEQ ID NO: 1837630 - RNA, 22 nt, Homo sapiens
ggccaggaugcucccccaggga

SEQ ID NO: 1837631 - RNA, 19 nt, Homo sapiens
gcaugaaaaggaugcuccg

SEQ ID NO: 1837632 - RNA, 17 nt, Homo sapiens
caaucuguucaauguuu

SEQ ID NO: 1837633 - RNA, 15 nt, Homo sapiens
ugucaaacagugcca

SEQ ID NO: 1837634 - RNA, 14 nt, Homo sapiens
auaaaaaucccaga

SEQ ID NO: 1837635 - RNA, 22 nt, Homo sapiens
aagccucuggucacauggcugu

SEQ ID NO: 1837636 - RNA, 15 nt, Homo sapiens
ucauguucagucaca

SEQ ID NO: 1837637 - RNA, 15 nt, Homo sapiens
ugcuauuuauauuca

SEQ ID NO: 1837638 - RNA, 20 nt, Homo sapiens
cacggccacauuugguucua

SEQ ID NO: 1837639 - RNA, 14 nt, Homo sapiens
gggccagaugcugg

SEQ ID NO: 1837640 - RNA, 12 nt, Homo sapiens
ucacacauucag

SEQ ID NO: 1837641 - RNA, 12 nt, Homo sapiens
acacacauacag

SEQ ID NO: 1837642 - RNA, 18 nt, Homo sapiens
acuucuuauacauuugau

SEQ ID NO: 1837643 - RNA, 23 nt, Homo sapiens
ucccucacaccgcgucuggugac

SEQ ID NO: 1837644 - RNA, 19 nt, Homo sapiens
auguacugaauucuuuauc

SEQ ID NO: 1837645 - RNA, 17 nt, Homo sapiens
ccccugcauggcugaga

SEQ ID NO: 1837646 - RNA, 13 nt, Homo sapiens
ucugccuccuggu

SEQ ID NO: 1837647 - RNA, 13 nt, Homo sapiens
auccacaugggua

SEQ ID NO: 1837648 - RNA, 13 nt, Homo sapiens
cugaaagagcaaa

SEQ ID NO: 1837649 - RNA, 14 nt, Homo sapiens
acuuuuucccucac

SEQ ID NO: 1837650 - RNA, 13 nt, Homo sapiens
cacaucugcauuu

SEQ ID NO: 1837651 - RNA, 19 nt, Homo sapiens
uaugaagagcugucuuccc

SEQ ID NO: 1837652 - RNA, 23 nt, Homo sapiens
cuggcagggcaggcagagcucag

SEQ ID NO: 1837653 - RNA, 20 nt, Homo sapiens
augggaauucuuuacaauaa

SEQ ID NO: 1837654 - RNA, 21 nt, Homo sapiens
uuguuaggccauucuugcauu

SEQ ID NO: 1837655 - RNA, 16 nt, Homo sapiens
ccaaaaagggcuucaa

SEQ ID NO: 1837656 - RNA, 21 nt, Homo sapiens
aagugcccaacugcagaccaa

SEQ ID NO: 1837657 - RNA, 19 nt, Homo sapiens
uucuggggggugaccgacu

SEQ ID NO: 1837658 - RNA, 12 nt, Homo sapiens
aggauaacacaa

SEQ ID NO: 1837659 - RNA, 20 nt, Homo sapiens
augcuauacuggauacucug

SEQ ID NO: 1837660 - RNA, 22 nt, Homo sapiens
acaccuggucuguuuucugugc

SEQ ID NO: 1837661 - RNA, 20 nt, Homo sapiens
agagaaggacucuuccagag

SEQ ID NO: 1837662 - RNA, 21 nt, Homo sapiens
uguucccuuccucugugccac

SEQ ID NO: 1837663 - RNA, 23 nt, Homo sapiens
ucccucaccuuggcaccagacac

SEQ ID NO: 1837664 - RNA, 13 nt, Homo sapiens
ugcacugcauucc

SEQ ID NO: 1837665 - RNA, 22 nt, Homo sapiens
aagacuuguguccccaccucag

SEQ ID NO: 1837666 - RNA, 12 nt, Homo sapiens
aaaaaggcaccu

SEQ ID NO: 1837667 - RNA, 20 nt, Homo sapiens
ccaguggggaaggaggccaa

SEQ ID NO: 1837668 - RNA, 22 nt, Homo sapiens
gcuaccuucucuacccaucucc

SEQ ID NO: 1837669 - RNA, 15 nt, Homo sapiens
ucuuaauucugaugc

SEQ ID NO: 1837670 - RNA, 21 nt, Homo sapiens
ccucuaguaagaugcacugaa

SEQ ID NO: 1837671 - RNA, 14 nt, Homo sapiens
ugaguccccuccag

SEQ ID NO: 1837672 - RNA, 15 nt, Homo sapiens
cuugcaaaacuacaa

SEQ ID NO: 1837673 - RNA, 23 nt, Homo sapiens
ggaauugugcuccaaaugucuac

SEQ ID NO: 1837674 - RNA, 18 nt, Homo sapiens
cgguggcucuugccugua

SEQ ID NO: 1837675 - RNA, 14 nt, Homo sapiens
aaaacucacuguga

SEQ ID NO: 1837676 - RNA, 19 nt, Homo sapiens
caggcagguuugccaguga

SEQ ID NO: 1837677 - RNA, 23 nt, Homo sapiens
uaugcaucagauaacaacuguga

SEQ ID NO: 1837678 - RNA, 22 nt, Homo sapiens
ccaccuuuauggacuggccccu

SEQ ID NO: 1837679 - RNA, 15 nt, Homo sapiens
ucaugcuuuugcuau

SEQ ID NO: 1837680 - RNA, 15 nt, Homo sapiens
uaccuugucauaugu

SEQ ID NO: 1837681 - RNA, 13 nt, Homo sapiens
cuccuccuaccag

SEQ ID NO: 1837682 - RNA, 12 nt, Homo sapiens
gcuacuguguca

SEQ ID NO: 1837683 - RNA, 12 nt, Homo sapiens
auuucuguaccu

SEQ ID NO: 1837684 - RNA, 22 nt, Homo sapiens
cuucuuauggaauugauuugca

SEQ ID NO: 1837685 - RNA, 16 nt, Homo sapiens
agaaugcccaacucuu

SEQ ID NO: 1837686 - RNA, 22 nt, Homo sapiens
agcaaaugagauguaugcccaa

SEQ ID NO: 1837687 - RNA, 18 nt, Homo sapiens
aguaggaagacuuuggaa

SEQ ID NO: 1837688 - RNA, 17 nt, Homo sapiens
acacucagaagccuggg

SEQ ID NO: 1837689 - RNA, 13 nt, Homo sapiens
aucugccaggacg

SEQ ID NO: 1837690 - RNA, 22 nt, Homo sapiens
aaaaaccugaugcagugcucca

SEQ ID NO: 1837691 - RNA, 22 nt, Homo sapiens
auugucuagugaggaagacaag

SEQ ID NO: 1837692 - RNA, 12 nt, Homo sapiens
acugucucaaga

SEQ ID NO: 1837693 - RNA, 15 nt, Homo sapiens
cuuauggcugcugaa

SEQ ID NO: 1837694 - RNA, 17 nt, Homo sapiens
uggagagaugggacaau

SEQ ID NO: 1837695 - RNA, 15 nt, Homo sapiens
gggugauaacucagg

SEQ ID NO: 1837696 - RNA, 13 nt, Homo sapiens
uuucccauauaca

SEQ ID NO: 1837697 - RNA, 13 nt, Homo sapiens
auuuucuaccugu

SEQ ID NO: 1837698 - RNA, 23 nt, Homo sapiens
uuaaaggagaaguagcugugaac

SEQ ID NO: 1837699 - RNA, 15 nt, Homo sapiens
cuuuugugucccuga

SEQ ID NO: 1837700 - RNA, 13 nt, Homo sapiens
aaacuuacuuugg

SEQ ID NO: 1837701 - RNA, 15 nt, Homo sapiens
aucagcgcccuggag

SEQ ID NO: 1837702 - RNA, 14 nt, Homo sapiens
gugcacggggccag

SEQ ID NO: 1837703 - RNA, 19 nt, Homo sapiens
uuguuauuuacacuggucu

SEQ ID NO: 1837704 - RNA, 17 nt, Homo sapiens
cccuuaccccacacaca

SEQ ID NO: 1837705 - RNA, 23 nt, Homo sapiens
cauagagcuuuuuaauagcacua

SEQ ID NO: 1837706 - RNA, 14 nt, Homo sapiens
aauaaucucacuac

SEQ ID NO: 1837707 - RNA, 19 nt, Homo sapiens
aacuguauuuugaauccuu

SEQ ID NO: 1837708 - RNA, 19 nt, Homo sapiens
auucaggguuauacacaga

SEQ ID NO: 1837709 - RNA, 21 nt, Homo sapiens
acugcagauggccuuguugcu

SEQ ID NO: 1837710 - RNA, 17 nt, Homo sapiens
uacgucuuucacaguuu

SEQ ID NO: 1837711 - RNA, 15 nt, Homo sapiens
aagcccuuuacuuga

SEQ ID NO: 1837712 - RNA, 15 nt, Homo sapiens
aggcauauacuuugu

SEQ ID NO: 1837713 - RNA, 20 nt, Homo sapiens
accucucagccccucagaga

SEQ ID NO: 1837714 - RNA, 22 nt, Homo sapiens
aggguuugggcuugauuccugu

SEQ ID NO: 1837715 - RNA, 14 nt, Homo sapiens
uuaauguaacuagc

SEQ ID NO: 1837716 - RNA, 18 nt, Homo sapiens
agcaggaagaacauugau

SEQ ID NO: 1837717 - RNA, 18 nt, Homo sapiens
auccccgucugaccaagg

SEQ ID NO: 1837718 - RNA, 22 nt, Homo sapiens
agaaaggcucugaagguccaaa

SEQ ID NO: 1837719 - RNA, 14 nt, Homo sapiens
uguuguuaucauga

SEQ ID NO: 1837720 - RNA, 20 nt, Homo sapiens
accacagagcugucacuuuu

SEQ ID NO: 1837721 - RNA, 16 nt, Homo sapiens
caucagccuguagcuc

SEQ ID NO: 1837722 - RNA, 19 nt, Homo sapiens
uuuaaaaauacaacacuga

SEQ ID NO: 1837723 - RNA, 17 nt, Homo sapiens
aaaacuucacuccaaag

SEQ ID NO: 1837724 - RNA, 18 nt, Homo sapiens
ugucuucauagcagauuu

SEQ ID NO: 1837725 - RNA, 16 nt, Homo sapiens
gaguccccuacucccu

SEQ ID NO: 1837726 - RNA, 17 nt, Homo sapiens
gccugagucagugcucu

SEQ ID NO: 1837727 - RNA, 15 nt, Homo sapiens
cuaauguuauuuucc

SEQ ID NO: 1837728 - RNA, 15 nt, Homo sapiens
gagccaguggugcua

SEQ ID NO: 1837729 - RNA, 18 nt, Homo sapiens
cuuacuucuggcauaacu

SEQ ID NO: 1837730 - RNA, 15 nt, Homo sapiens
uucugggugugucca

SEQ ID NO: 1837731 - RNA, 14 nt, Homo sapiens
uacauuagugccau

SEQ ID NO: 1837732 - RNA, 18 nt, Homo sapiens
ugggcacagcacagccag

SEQ ID NO: 1837733 - RNA, 21 nt, Homo sapiens
accccaggcucaacugaggau

SEQ ID NO: 1837734 - RNA, 15 nt, Homo sapiens
cuguccagcugcaaa

SEQ ID NO: 1837735 - RNA, 15 nt, Homo sapiens
uuccagccaggguga

SEQ ID NO: 1837736 - RNA, 15 nt, Homo sapiens
caccagaaccaguua

SEQ ID NO: 1837737 - RNA, 17 nt, Homo sapiens
cagaugacucacuccau

SEQ ID NO: 1837738 - RNA, 13 nt, Homo sapiens
uaacaucauugca

SEQ ID NO: 1837739 - RNA, 12 nt, Homo sapiens
ucuguccaggcc

SEQ ID NO: 1837740 - RNA, 21 nt, Homo sapiens
acuuucccuccaccagugugc

SEQ ID NO: 1837741 - RNA, 19 nt, Homo sapiens
guuucaccauguugcccag

SEQ ID NO: 1837742 - RNA, 19 nt, Homo sapiens
acaccuguccuucucaggc

SEQ ID NO: 1837743 - RNA, 17 nt, Homo sapiens
aagggcucccagccaca

SEQ ID NO: 1837744 - RNA, 22 nt, Homo sapiens
ugauuugaccauucuuuugcca

SEQ ID NO: 1837745 - RNA, 22 nt, Homo sapiens
cgcccagagaacaagcacugug

SEQ ID NO: 1837746 - RNA, 17 nt, Homo sapiens
accuguacacacacaga

SEQ ID NO: 1837747 - RNA, 19 nt, Homo sapiens
acaugggaccuauaacugc

SEQ ID NO: 1837748 - RNA, 13 nt, Homo sapiens
uacaugacauuua

SEQ ID NO: 1837749 - RNA, 21 nt, Homo sapiens
guucucucuuaguaacauaga

SEQ ID NO: 1837750 - RNA, 16 nt, Homo sapiens
cacugccgaugcccaa

SEQ ID NO: 1837751 - RNA, 15 nt, Homo sapiens
augugggugagccag

SEQ ID NO: 1837752 - RNA, 22 nt, Homo sapiens
agcauuugacccuugcugugaa

SEQ ID NO: 1837753 - RNA, 21 nt, Homo sapiens
gauaagagggcacacacugug

SEQ ID NO: 1837754 - RNA, 14 nt, Homo sapiens
uucacugguguaca

SEQ ID NO: 1837755 - RNA, 16 nt, Homo sapiens
caaucagagagcucac

SEQ ID NO: 1837756 - RNA, 20 nt, Homo sapiens
ugaugccuguguacugccuu

SEQ ID NO: 1837757 - RNA, 17 nt, Homo sapiens
aauuuguaauaaaacua

SEQ ID NO: 1837758 - RNA, 19 nt, Homo sapiens
agucuaggcuaagcacuuu

SEQ ID NO: 1837759 - RNA, 17 nt, Homo sapiens
aaagcguccucucagua

SEQ ID NO: 1837760 - RNA, 19 nt, Homo sapiens
uugcagcuguaaacauauu

SEQ ID NO: 1837761 - RNA, 12 nt, Homo sapiens
agugaugguugu

SEQ ID NO: 1837762 - RNA, 23 nt, Homo sapiens
aaucugccuaggguccuguccau

SEQ ID NO: 1837763 - RNA, 15 nt, Homo sapiens
acuaucucuugucau

SEQ ID NO: 1837764 - RNA, 12 nt, Homo sapiens
uaggcucugcac

SEQ ID NO: 1837765 - RNA, 21 nt, Homo sapiens
gaauugagauaauaucuguga

SEQ ID NO: 1837766 - RNA, 12 nt, Homo sapiens
aaugccauccag

SEQ ID NO: 1837767 - RNA, 14 nt, Homo sapiens
gaggaagauggagg

SEQ ID NO: 1837768 - RNA, 16 nt, Homo sapiens
ccccauccucacacag

SEQ ID NO: 1837769 - RNA, 16 nt, Homo sapiens
ugacuuggaguuuuau

SEQ ID NO: 1837770 - RNA, 22 nt, Homo sapiens
ccugggaucugcucgucaucau

SEQ ID NO: 1837771 - RNA, 11 nt, Homo sapiens
uuggagcugcc

SEQ ID NO: 1837772 - RNA, 13 nt, Homo sapiens
auuucauacugua

SEQ ID NO: 1837773 - RNA, 14 nt, Homo sapiens
aauaguaaaugcuu

SEQ ID NO: 1837774 - RNA, 15 nt, Homo sapiens
uuuagacuuccugua

SEQ ID NO: 1837775 - RNA, 18 nt, Homo sapiens
ggagauggcagcagugaa

SEQ ID NO: 1837776 - RNA, 20 nt, Homo sapiens
ucaauaccccuguuaagcaa

SEQ ID NO: 1837777 - RNA, 16 nt, Homo sapiens
aacuucccgucccaua

SEQ ID NO: 1837778 - RNA, 20 nt, Homo sapiens
uagggaaguaacauuugccu

SEQ ID NO: 1837779 - RNA, 14 nt, Homo sapiens
cuuccaucuaguca

SEQ ID NO: 1837780 - RNA, 17 nt, Homo sapiens
cagcuaucugcacucua

SEQ ID NO: 1837781 - RNA, 21 nt, Homo sapiens
uaacacccuuuagaaccuuaa

SEQ ID NO: 1837782 - RNA, 23 nt, Homo sapiens
augcucaaccuaaccaccuaccu

SEQ ID NO: 1837783 - RNA, 20 nt, Homo sapiens
aaugucuuuugaauauuccc

SEQ ID NO: 1837784 - RNA, 21 nt, Homo sapiens
ccuccuuuuuaauacauuaag

SEQ ID NO: 1837785 - RNA, 18 nt, Homo sapiens
acugcucuguguuuacag

SEQ ID NO: 1837786 - RNA, 15 nt, Homo sapiens
uuggccaaugugcau

SEQ ID NO: 1837787 - RNA, 18 nt, Homo sapiens
caguggaacagucuuccc

SEQ ID NO: 1837788 - RNA, 18 nt, Homo sapiens
cucuuagccccagacucu

SEQ ID NO: 1837789 - RNA, 11 nt, Homo sapiens
aaaacauucaa

SEQ ID NO: 1837790 - RNA, 12 nt, Homo sapiens
ucacugcugcuc

SEQ ID NO: 1837791 - RNA, 19 nt, Homo sapiens
caaaucuucuucagauuca

SEQ ID NO: 1837792 - RNA, 15 nt, Homo sapiens
aguggcaucaucuca

SEQ ID NO: 1837793 - RNA, 21 nt, Homo sapiens
aaucacuuuuggacaugcuuu

SEQ ID NO: 1837794 - RNA, 15 nt, Homo sapiens
auacauguacuccag

SEQ ID NO: 1837795 - RNA, 13 nt, Homo sapiens
ccugugaaugcca

SEQ ID NO: 1837796 - RNA, 23 nt, Homo sapiens
uguugcccaacuacuaucucaga

SEQ ID NO: 1837797 - RNA, 23 nt, Homo sapiens
cauuuccuccgucaccucagaga

SEQ ID NO: 1837798 - RNA, 12 nt, Homo sapiens
ggaagcacauaa

SEQ ID NO: 1837799 - RNA, 21 nt, Homo sapiens
ugaaugcagggaaugcaaucc

SEQ ID NO: 1837800 - RNA, 20 nt, Homo sapiens
gcugccugugaaugcugagu

SEQ ID NO: 1837801 - RNA, 15 nt, Homo sapiens
auaugcaacugcagu

SEQ ID NO: 1837802 - RNA, 22 nt, Homo sapiens
uccuuucaagguaacuguacug

SEQ ID NO: 1837803 - RNA, 22 nt, Homo sapiens
ccuuggccaagcugcugcuuug

SEQ ID NO: 1837804 - RNA, 20 nt, Homo sapiens
gucuucuguaauucauugag

SEQ ID NO: 1837805 - RNA, 14 nt, Homo sapiens
cuggcugugcacuu

SEQ ID NO: 1837806 - RNA, 12 nt, Homo sapiens
uuugaugcauua

SEQ ID NO: 1837807 - RNA, 19 nt, Homo sapiens
gugaaacuggggcuugcaa

SEQ ID NO: 1837808 - RNA, 17 nt, Homo sapiens
aaagggcugaaagccau

SEQ ID NO: 1837809 - RNA, 17 nt, Homo sapiens
guaccuucccacuggcc

SEQ ID NO: 1837810 - RNA, 16 nt, Homo sapiens
ugugucaaaagccaga

SEQ ID NO: 1837811 - RNA, 19 nt, Homo sapiens
cccagucgaccccaaagga

SEQ ID NO: 1837812 - RNA, 14 nt, Homo sapiens
ucaggaauugucaa

SEQ ID NO: 1837813 - RNA, 21 nt, Homo sapiens
auucuucagcguaaaauggug

SEQ ID NO: 1837814 - RNA, 13 nt, Homo sapiens
uagcuaagauaua

SEQ ID NO: 1837815 - RNA, 21 nt, Homo sapiens
gccuaauaggcaccucuucaa

SEQ ID NO: 1837816 - RNA, 18 nt, Homo sapiens
cagauguuggaccaacac

SEQ ID NO: 1837817 - RNA, 16 nt, Homo sapiens
gacuuuuuuuuugccc

SEQ ID NO: 1837818 - RNA, 14 nt, Homo sapiens
ucuuugcuugccuc

SEQ ID NO: 1837819 - RNA, 12 nt, Homo sapiens
caacuagccauc

SEQ ID NO: 1837820 - RNA, 21 nt, Homo sapiens
auuugaaaccaggacauuaaa

SEQ ID NO: 1837821 - RNA, 17 nt, Homo sapiens
ccgguucaggaccacuu

SEQ ID NO: 1837822 - RNA, 17 nt, Homo sapiens
ucugauauacaaaggga

SEQ ID NO: 1837823 - RNA, 17 nt, Homo sapiens
uuccacuugagugucaa

SEQ ID NO: 1837824 - RNA, 18 nt, Homo sapiens
uaugguaaauaacuguga

SEQ ID NO: 1837825 - RNA, 21 nt, Homo sapiens
uccaaagagaagggcacugua

SEQ ID NO: 1837826 - RNA, 22 nt, Homo sapiens
aaaauuuuggucauagcauuca

SEQ ID NO: 1837827 - RNA, 17 nt, Homo sapiens
aaaagaaacaauaugcu

SEQ ID NO: 1837828 - RNA, 14 nt, Homo sapiens
ccugacuggccaaa

SEQ ID NO: 1837829 - RNA, 17 nt, Homo sapiens
uauagaauggaacucaa

SEQ ID NO: 1837830 - RNA, 20 nt, Homo sapiens
ugaaauaaaaugauaaacaa

SEQ ID NO: 1837831 - RNA, 22 nt, Homo sapiens
ucucauuuguauuuucaguuug

SEQ ID NO: 1837832 - RNA, 17 nt, Homo sapiens
aauuucuuaugugacau

SEQ ID NO: 1837833 - RNA, 17 nt, Homo sapiens
uuuguauugagggccag

SEQ ID NO: 1837834 - RNA, 21 nt, Homo sapiens
caacaguuugaugcugaguca

SEQ ID NO: 1837835 - RNA, 20 nt, Homo sapiens
agccaagaucgcaccacugc

SEQ ID NO: 1837836 - RNA, 22 nt, Homo sapiens
caguggucccauuuauaucugc

SEQ ID NO: 1837837 - RNA, 13 nt, Homo sapiens
cuguguucaauua

SEQ ID NO: 1837838 - RNA, 17 nt, Homo sapiens
accagcgugaacccuca

SEQ ID NO: 1837839 - RNA, 20 nt, Homo sapiens
uuuaggaaaugggcagugaa

SEQ ID NO: 1837840 - RNA, 15 nt, Homo sapiens
cuaccuucuuuccag

SEQ ID NO: 1837841 - RNA, 16 nt, Homo sapiens
ccugugcuggacuguu

SEQ ID NO: 1837842 - RNA, 23 nt, Homo sapiens
agaucagaauuguugacuugcau

SEQ ID NO: 1837843 - RNA, 18 nt, Homo sapiens
ugagggucuuugcaagaa

SEQ ID NO: 1837844 - RNA, 15 nt, Homo sapiens
guuacugucauuccc

SEQ ID NO: 1837845 - RNA, 13 nt, Homo sapiens
uguuaccuucaca

SEQ ID NO: 1837846 - RNA, 13 nt, Homo sapiens
ggaggcgagccag

SEQ ID NO: 1837847 - RNA, 16 nt, Homo sapiens
gcugaaagacuaccuc

SEQ ID NO: 1837848 - RNA, 13 nt, Homo sapiens
agaacccugagac

SEQ ID NO: 1837849 - RNA, 13 nt, Homo sapiens
aaacuccugggcu

SEQ ID NO: 1837850 - RNA, 13 nt, Homo sapiens
acauugcuuuuaa

SEQ ID NO: 1837851 - RNA, 23 nt, Homo sapiens
cucccugggucuggggacaggcc

SEQ ID NO: 1837852 - RNA, 15 nt, Homo sapiens
uggcucccaugacca

SEQ ID NO: 1837853 - RNA, 20 nt, Homo sapiens
gaaaacauggaacagugugg

SEQ ID NO: 1837854 - RNA, 13 nt, Homo sapiens
caguaauguguca

SEQ ID NO: 1837855 - RNA, 22 nt, Homo sapiens
aacugcugcuuuuugagguggc

SEQ ID NO: 1837856 - RNA, 14 nt, Homo sapiens
acuaggugaucuca

SEQ ID NO: 1837857 - RNA, 22 nt, Homo sapiens
cacgcacacccugccccuggug

SEQ ID NO: 1837858 - RNA, 23 nt, Homo sapiens
ugaccaugagguggggguuuugg

SEQ ID NO: 1837859 - RNA, 13 nt, Homo sapiens
uuuucucaucucc

SEQ ID NO: 1837860 - RNA, 16 nt, Homo sapiens
cugccacuugcacugu

SEQ ID NO: 1837861 - RNA, 16 nt, Homo sapiens
acugagaaaggcucaa

SEQ ID NO: 1837862 - RNA, 18 nt, Homo sapiens
guacccccaggaccagaa

SEQ ID NO: 1837863 - RNA, 22 nt, Homo sapiens
uucacaccauucuccugccuca

SEQ ID NO: 1837864 - RNA, 13 nt, Homo sapiens
ucucagcugacca

SEQ ID NO: 1837865 - RNA, 18 nt, Homo sapiens
cagggaaugaugacaaca

SEQ ID NO: 1837866 - RNA, 18 nt, Homo sapiens
augugcaugcauaccaca

SEQ ID NO: 1837867 - RNA, 21 nt, Homo sapiens
ucaugaguagugggcuaugca

SEQ ID NO: 1837868 - RNA, 22 nt, Homo sapiens
ugagcuuccauuaugcugcaga

SEQ ID NO: 1837869 - RNA, 15 nt, Homo sapiens
cauaguaauucuuaa

SEQ ID NO: 1837870 - RNA, 13 nt, Homo sapiens
ucaauuaguacag

SEQ ID NO: 1837871 - RNA, 17 nt, Homo sapiens
aggcacaagccaaggaa

SEQ ID NO: 1837872 - RNA, 19 nt, Homo sapiens
ccaguggccuggcuccgcu

SEQ ID NO: 1837873 - RNA, 16 nt, Homo sapiens
cauguauuaaauuaca

SEQ ID NO: 1837874 - RNA, 23 nt, Homo sapiens
agggguuaaugcagauggcaagu

SEQ ID NO: 1837875 - RNA, 15 nt, Homo sapiens
agaguaucacuccca

SEQ ID NO: 1837876 - RNA, 22 nt, Homo sapiens
auaugucuauauacacagacau

SEQ ID NO: 1837877 - RNA, 18 nt, Homo sapiens
caaguauuuggcuauuaa

SEQ ID NO: 1837878 - RNA, 17 nt, Homo sapiens
uuugcuguuaacuguua

SEQ ID NO: 1837879 - RNA, 20 nt, Homo sapiens
uauaaacagacaauauguga

SEQ ID NO: 1837880 - RNA, 17 nt, Homo sapiens
aacuaauaaaagcauaa

SEQ ID NO: 1837881 - RNA, 22 nt, Homo sapiens
uguaaauaaugcuuaacauaaa

SEQ ID NO: 1837882 - RNA, 17 nt, Homo sapiens
ugauacuuagaccaaaa

SEQ ID NO: 1837883 - RNA, 13 nt, Homo sapiens
ugaauucccucac

SEQ ID NO: 1837884 - RNA, 18 nt, Homo sapiens
gaaaccacacagacuugg

SEQ ID NO: 1837885 - RNA, 13 nt, Homo sapiens
gccuuuuccaaau

SEQ ID NO: 1837886 - RNA, 13 nt, Homo sapiens
aggaauuuugcua

SEQ ID NO: 1837887 - RNA, 23 nt, Homo sapiens
guucggagcucuucugugcccug

SEQ ID NO: 1837888 - RNA, 14 nt, Homo sapiens
uagugugccuucca

SEQ ID NO: 1837889 - RNA, 17 nt, Homo sapiens
auaauguuuauaaguca

SEQ ID NO: 1837890 - RNA, 21 nt, Homo sapiens
ugcagacacaucagcuguuaa

SEQ ID NO: 1837891 - RNA, 22 nt, Homo sapiens
cucaagcccugcagucacagcu

SEQ ID NO: 1837892 - RNA, 21 nt, Homo sapiens
gcauccacuggaaaaggugaa

SEQ ID NO: 1837893 - RNA, 15 nt, Homo sapiens
gaggaucacagugac

SEQ ID NO: 1837894 - RNA, 14 nt, Homo sapiens
agccaggaccugcc

SEQ ID NO: 1837895 - RNA, 21 nt, Homo sapiens
cauuaaggucauuacucucaa

SEQ ID NO: 1837896 - RNA, 20 nt, Homo sapiens
uuggaguguaaaccaaauac

SEQ ID NO: 1837897 - RNA, 18 nt, Homo sapiens
gauuaucagaccucuuca

SEQ ID NO: 1837898 - RNA, 17 nt, Homo sapiens
gauuuucuccacaacac

SEQ ID NO: 1837899 - RNA, 17 nt, Homo sapiens
agcuaugaaaccacugc

SEQ ID NO: 1837900 - RNA, 18 nt, Homo sapiens
ugaacuuuuaaugaacuu

SEQ ID NO: 1837901 - RNA, 20 nt, Homo sapiens
uguuuucucuggaguauucu

SEQ ID NO: 1837902 - RNA, 22 nt, Homo sapiens
acaucaaggcucuuccguucca

SEQ ID NO: 1837903 - RNA, 16 nt, Homo sapiens
uuugcuaauaccaaaa

SEQ ID NO: 1837904 - RNA, 21 nt, Homo sapiens
agcccagaucaccaccugaac

SEQ ID NO: 1837905 - RNA, 12 nt, Homo sapiens
ggugcuucagga

SEQ ID NO: 1837906 - RNA, 13 nt, Homo sapiens
ccuuaugagcuca

SEQ ID NO: 1837907 - RNA, 23 nt, Homo sapiens
cgcacccccacuuucgccuccuc

SEQ ID NO: 1837908 - RNA, 16 nt, Homo sapiens
ccugugacugacaugu

SEQ ID NO: 1837909 - RNA, 14 nt, Homo sapiens
uccauaaaaguccu

SEQ ID NO: 1837910 - RNA, 13 nt, Homo sapiens
ugguguccagaca

SEQ ID NO: 1837911 - RNA, 22 nt, Homo sapiens
cuggggccccuaagcuccuagg

SEQ ID NO: 1837912 - RNA, 17 nt, Homo sapiens
aucuggggaaggaccaa

SEQ ID NO: 1837913 - RNA, 21 nt, Homo sapiens
uuaacuuaaaagaacauguau

SEQ ID NO: 1837914 - RNA, 20 nt, Homo sapiens
ugggauugaauuaaaacagc

SEQ ID NO: 1837915 - RNA, 14 nt, Homo sapiens
uuaacaccuaccuc

SEQ ID NO: 1837916 - RNA, 19 nt, Homo sapiens
acgcugauaauaugcaaau

SEQ ID NO: 1837917 - RNA, 15 nt, Homo sapiens
cuaagagugaaguag

SEQ ID NO: 1837918 - RNA, 19 nt, Homo sapiens
cuggggacagcuuccucac

SEQ ID NO: 1837919 - RNA, 15 nt, Homo sapiens
cccaaucccauuccu

SEQ ID NO: 1837920 - RNA, 21 nt, Homo sapiens
ugucaaccucuccuccaggcc

SEQ ID NO: 1837921 - RNA, 14 nt, Homo sapiens
gauuucuugcuaag

SEQ ID NO: 1837922 - RNA, 15 nt, Homo sapiens
cuggcugaagaauga

SEQ ID NO: 1837923 - RNA, 22 nt, Homo sapiens
uucauucucccuuucacuaaaa

SEQ ID NO: 1837924 - RNA, 16 nt, Homo sapiens
aucuaauaugauagcg

SEQ ID NO: 1837925 - RNA, 15 nt, Homo sapiens
aauaaaguaccauua

SEQ ID NO: 1837926 - RNA, 22 nt, Homo sapiens
uugcugauuuugaccuuguauu

SEQ ID NO: 1837927 - RNA, 15 nt, Homo sapiens
auucuucacucuguu

SEQ ID NO: 1837928 - RNA, 17 nt, Homo sapiens
ugccccucuuccaaagg

SEQ ID NO: 1837929 - RNA, 20 nt, Homo sapiens
aucuauuuagagaaacauuu

SEQ ID NO: 1837930 - RNA, 13 nt, Homo sapiens
ccacuucuuucag

SEQ ID NO: 1837931 - RNA, 17 nt, Homo sapiens
augguguuuucauuccc

SEQ ID NO: 1837932 - RNA, 15 nt, Homo sapiens
acggaaggcaaagag

SEQ ID NO: 1837933 - RNA, 15 nt, Homo sapiens
cauaauucuaaguua

SEQ ID NO: 1837934 - RNA, 17 nt, Homo sapiens
agcucaacucacagcuu

SEQ ID NO: 1837935 - RNA, 21 nt, Homo sapiens
aacauuauuuguaauagccaa

SEQ ID NO: 1837936 - RNA, 19 nt, Homo sapiens
agcacagauucaagugcaa

SEQ ID NO: 1837937 - RNA, 20 nt, Homo sapiens
cugauguuccacaaaacauu

SEQ ID NO: 1837938 - RNA, 18 nt, Homo sapiens
aaacuuucaggcacugga

SEQ ID NO: 1837939 - RNA, 18 nt, Homo sapiens
aggcgugagccaccucac

SEQ ID NO: 1837940 - RNA, 18 nt, Homo sapiens
ugcuauaaacuuuacaua

SEQ ID NO: 1837941 - RNA, 22 nt, Homo sapiens
cugaccccagcauuuccagagc

SEQ ID NO: 1837942 - RNA, 20 nt, Homo sapiens
auuucugugcccuccugacc

SEQ ID NO: 1837943 - RNA, 13 nt, Homo sapiens
auucauccaacag

SEQ ID NO: 1837944 - RNA, 19 nt, Homo sapiens
ucauggauauuugucaaca

SEQ ID NO: 1837945 - RNA, 12 nt, Homo sapiens
caagucauucuc

SEQ ID NO: 1837946 - RNA, 16 nt, Homo sapiens
gccugacaaccacugg

SEQ ID NO: 1837947 - RNA, 13 nt, Homo sapiens
aaagagcagcaca

SEQ ID NO: 1837948 - RNA, 19 nt, Homo sapiens
uugucaaaaugagauucca

SEQ ID NO: 1837949 - RNA, 21 nt, Homo sapiens
uuugggaagcucccacaccca

SEQ ID NO: 1837950 - RNA, 17 nt, Homo sapiens
ggaguaaguguacaauu

SEQ ID NO: 1837951 - RNA, 19 nt, Homo sapiens
agcugguuuuaaguggaac

SEQ ID NO: 1837952 - RNA, 21 nt, Homo sapiens
ucaucagccuguguaggcagu

SEQ ID NO: 1837953 - RNA, 15 nt, Homo sapiens
ccgcauagcacuugc

SEQ ID NO: 1837954 - RNA, 15 nt, Homo sapiens
acagugagacuguac

SEQ ID NO: 1837955 - RNA, 22 nt, Homo sapiens
acgugagguuucaguagcuccu

SEQ ID NO: 1837956 - RNA, 16 nt, Homo sapiens
agccccuccucccuca

SEQ ID NO: 1837957 - RNA, 17 nt, Homo sapiens
ccugucuuaugguccag

SEQ ID NO: 1837958 - RNA, 19 nt, Homo sapiens
guagaugccggcaggccuu

SEQ ID NO: 1837959 - RNA, 16 nt, Homo sapiens
auuugccuugacaaac

SEQ ID NO: 1837960 - RNA, 11 nt, Homo sapiens
uuaauugcuca

SEQ ID NO: 1837961 - RNA, 13 nt, Homo sapiens
ggcaauaugaaau

SEQ ID NO: 1837962 - RNA, 17 nt, Homo sapiens
accugcuucucugccca

SEQ ID NO: 1837963 - RNA, 13 nt, Homo sapiens
gcacuuugggagg

SEQ ID NO: 1837964 - RNA, 16 nt, Homo sapiens
agugugagauacugug

SEQ ID NO: 1837965 - RNA, 22 nt, Homo sapiens
auuaccaccugaccucuugcug

SEQ ID NO: 1837966 - RNA, 15 nt, Homo sapiens
agcacuguucugucc

SEQ ID NO: 1837967 - RNA, 15 nt, Homo sapiens
agaaagugagcagug

SEQ ID NO: 1837968 - RNA, 16 nt, Homo sapiens
guuagccucacccggu

SEQ ID NO: 1837969 - RNA, 17 nt, Homo sapiens
aauacauguacagacaa

SEQ ID NO: 1837970 - RNA, 16 nt, Homo sapiens
uuaaccucaaaacugu

SEQ ID NO: 1837971 - RNA, 17 nt, Homo sapiens
cccacccgggagcagug

SEQ ID NO: 1837972 - RNA, 23 nt, Homo sapiens
uuguaaacagcuaauaaugaagu

SEQ ID NO: 1837973 - RNA, 23 nt, Homo sapiens
caaacauuucuaacucuauuaau

SEQ ID NO: 1837974 - RNA, 16 nt, Homo sapiens
gcaucucccagcaaga

SEQ ID NO: 1837975 - RNA, 23 nt, Homo sapiens
ccauccuggcuaacacagugaaa

SEQ ID NO: 1837976 - RNA, 18 nt, Homo sapiens
cucuaaaacagcacuauc

SEQ ID NO: 1837977 - RNA, 17 nt, Homo sapiens
uacgcaguuacugaaau

SEQ ID NO: 1837978 - RNA, 16 nt, Homo sapiens
uuuuucuguaaagcaa

SEQ ID NO: 1837979 - RNA, 23 nt, Homo sapiens
ucugagcagugcuugaaugaagu

SEQ ID NO: 1837980 - RNA, 14 nt, Homo sapiens
ggcagcaccaucuc

SEQ ID NO: 1837981 - RNA, 21 nt, Homo sapiens
gagugcauuacuuugaaucaa

SEQ ID NO: 1837982 - RNA, 17 nt, Homo sapiens
ucuuagcugucugcuca

SEQ ID NO: 1837983 - RNA, 15 nt, Homo sapiens
ggaauugauuugcau

SEQ ID NO: 1837984 - RNA, 22 nt, Homo sapiens
auugauugggcacaucauuuca

SEQ ID NO: 1837985 - RNA, 18 nt, Homo sapiens
cugcugggggcaacuggc

SEQ ID NO: 1837986 - RNA, 21 nt, Homo sapiens
aggggcugaaagaacauggac

SEQ ID NO: 1837987 - RNA, 22 nt, Homo sapiens
gcucugccccagcuugggcaga

SEQ ID NO: 1837988 - RNA, 23 nt, Homo sapiens
uccaagagggugaaguccacaga

SEQ ID NO: 1837989 - RNA, 16 nt, Homo sapiens
accucugacacauuag

SEQ ID NO: 1837990 - RNA, 17 nt, Homo sapiens
uguucauacuuucaaaa

SEQ ID NO: 1837991 - RNA, 22 nt, Homo sapiens
gucuccuacucuguguaaauau

SEQ ID NO: 1837992 - RNA, 21 nt, Homo sapiens
caggugcucaauaaacacuug

SEQ ID NO: 1837993 - RNA, 15 nt, Homo sapiens
ugaaccuagauugca

SEQ ID NO: 1837994 - RNA, 15 nt, Homo sapiens
auugagggucauucu

SEQ ID NO: 1837995 - RNA, 18 nt, Homo sapiens
ugcaucaaaugcaugcgu

SEQ ID NO: 1837996 - RNA, 20 nt, Homo sapiens
cacaacugucuuagacugcu

SEQ ID NO: 1837997 - RNA, 12 nt, Homo sapiens
acuccccugcac

SEQ ID NO: 1837998 - RNA, 12 nt, Homo sapiens
uuuacaucagaa

SEQ ID NO: 1837999 - RNA, 22 nt, Homo sapiens
gaaaacaguaacuaagcacauu

SEQ ID NO: 1838000 - RNA, 21 nt, Homo sapiens
uauagggaaaaaugcaaaaaa

SEQ ID NO: 1838001 - RNA, 18 nt, Homo sapiens
auauuuccauucaugcca

SEQ ID NO: 1838002 - RNA, 14 nt, Homo sapiens
uuuaaaugacugcu

SEQ ID NO: 1838003 - RNA, 13 nt, Homo sapiens
ugcagaccucacu

SEQ ID NO: 1838004 - RNA, 21 nt, Homo sapiens
gcuaguccuagugaaccucac

SEQ ID NO: 1838005 - RNA, 23 nt, Homo sapiens
ugguacuuagaguuucuguuuga

SEQ ID NO: 1838006 - RNA, 17 nt, Homo sapiens
auuucuaaaguaaaauu

SEQ ID NO: 1838007 - RNA, 12 nt, Homo sapiens
ugccaugaaaau

SEQ ID NO: 1838008 - RNA, 12 nt, Homo sapiens
cagauagugccu

SEQ ID NO: 1838009 - RNA, 16 nt, Homo sapiens
cuaccuagggcacuuu

SEQ ID NO: 1838010 - RNA, 21 nt, Homo sapiens
cuguugaucccacuucacugu

SEQ ID NO: 1838011 - RNA, 17 nt, Homo sapiens
acagcucuucucagugu

SEQ ID NO: 1838012 - RNA, 23 nt, Homo sapiens
ugccugcacccuucccucuuccc

SEQ ID NO: 1838013 - RNA, 13 nt, Homo sapiens
gauugauggugcu

SEQ ID NO: 1838014 - RNA, 13 nt, Homo sapiens
acugccacugugg

SEQ ID NO: 1838015 - RNA, 16 nt, Homo sapiens
uagaaugaaccacugc

SEQ ID NO: 1838016 - RNA, 13 nt, Homo sapiens
uaauaauugauca

SEQ ID NO: 1838017 - RNA, 22 nt, Homo sapiens
uaacaaccaaagacuacauauu

SEQ ID NO: 1838018 - RNA, 22 nt, Homo sapiens
cugucacacacuggaccccacu

SEQ ID NO: 1838019 - RNA, 15 nt, Homo sapiens
caaacaaacaaaaac

SEQ ID NO: 1838020 - RNA, 16 nt, Homo sapiens
aagauucucugcccag

SEQ ID NO: 1838021 - RNA, 12 nt, Homo sapiens
uauucagaugua

SEQ ID NO: 1838022 - RNA, 20 nt, Homo sapiens
ugagaggaagggugggucug

SEQ ID NO: 1838023 - RNA, 14 nt, Homo sapiens
gaugcugucaggag

SEQ ID NO: 1838024 - RNA, 13 nt, Homo sapiens
gcgugcaggcagc

SEQ ID NO: 1838025 - RNA, 13 nt, Homo sapiens
ucccaggcacucu

SEQ ID NO: 1838026 - RNA, 13 nt, Homo sapiens
acuauggcuccaa

SEQ ID NO: 1838027 - RNA, 24 nt, Homo sapiens
gggggaaaaguuagucaauccugu

SEQ ID NO: 1838028 - RNA, 20 nt, Homo sapiens
uugagauaaagucaaaugcc

SEQ ID NO: 1838029 - RNA, 21 nt, Homo sapiens
uacacuacauuuuuucuaaua

SEQ ID NO: 1838030 - RNA, 23 nt, Homo sapiens
cuauuuaccugcaggcugagcca

SEQ ID NO: 1838031 - RNA, 21 nt, Homo sapiens
gagcuuuuguagaagucacau

SEQ ID NO: 1838032 - RNA, 13 nt, Homo sapiens
uguccacuucauu

SEQ ID NO: 1838033 - RNA, 13 nt, Homo sapiens
uaaaauccaagcg

SEQ ID NO: 1838034 - RNA, 19 nt, Homo sapiens
cuuaauaacuguguacugu

SEQ ID NO: 1838035 - RNA, 16 nt, Homo sapiens
auugacgccaccauaa

SEQ ID NO: 1838036 - RNA, 16 nt, Homo sapiens
cugacagccuccuagg

SEQ ID NO: 1838037 - RNA, 14 nt, Homo sapiens
agccacuucggcca

SEQ ID NO: 1838038 - RNA, 18 nt, Homo sapiens
ccccagaacacagugccu

SEQ ID NO: 1838039 - RNA, 23 nt, Homo sapiens
gggccccucacccccagcuggaa

SEQ ID NO: 1838040 - RNA, 14 nt, Homo sapiens
gagcgagacccugu

SEQ ID NO: 1838041 - RNA, 14 nt, Homo sapiens
gagccugacccuca

SEQ ID NO: 1838042 - RNA, 19 nt, Homo sapiens
uugguuuccuucacagaaa

SEQ ID NO: 1838043 - RNA, 18 nt, Homo sapiens
cuguggaccacccuagca

SEQ ID NO: 1838044 - RNA, 19 nt, Homo sapiens
gccauaggguccugaaugu

SEQ ID NO: 1838045 - RNA, 14 nt, Homo sapiens
auaaaccacugguc

SEQ ID NO: 1838046 - RNA, 17 nt, Homo sapiens
uuaaaaacccauaacua

SEQ ID NO: 1838047 - RNA, 13 nt, Homo sapiens
ugacuaguacaaa

SEQ ID NO: 1838048 - RNA, 19 nt, Homo sapiens
ucaaauucaaauaaaaauc

SEQ ID NO: 1838049 - RNA, 19 nt, Homo sapiens
aggggcuccgggucacugc

SEQ ID NO: 1838050 - RNA, 16 nt, Homo sapiens
aauuagaacccauaac

SEQ ID NO: 1838051 - RNA, 14 nt, Homo sapiens
auaauucagcacuu

SEQ ID NO: 1838052 - RNA, 19 nt, Homo sapiens
agcuacaacaacauguacc

SEQ ID NO: 1838053 - RNA, 22 nt, Homo sapiens
augagguuucuuugacuucaau

SEQ ID NO: 1838054 - RNA, 20 nt, Homo sapiens
ugcaccaaaucaucucucau

SEQ ID NO: 1838055 - RNA, 19 nt, Homo sapiens
gccuccccugccucaccag

SEQ ID NO: 1838056 - RNA, 17 nt, Homo sapiens
uuuuaaacagugcuuug

SEQ ID NO: 1838057 - RNA, 12 nt, Homo sapiens
ucagcucaggug

SEQ ID NO: 1838058 - RNA, 15 nt, Homo sapiens
caaguacacugagag

SEQ ID NO: 1838059 - RNA, 21 nt, Homo sapiens
auauauucugguuauaguucu

SEQ ID NO: 1838060 - RNA, 20 nt, Homo sapiens
ccaguaggaaaagcaaugcu

SEQ ID NO: 1838061 - RNA, 13 nt, Homo sapiens
ggccacaggcagu

SEQ ID NO: 1838062 - RNA, 14 nt, Homo sapiens
uacugccuuuagaa

SEQ ID NO: 1838063 - RNA, 19 nt, Homo sapiens
caagcacaauugaucucuu

SEQ ID NO: 1838064 - RNA, 20 nt, Homo sapiens
auccauuugcguuccaugau

SEQ ID NO: 1838065 - RNA, 20 nt, Homo sapiens
aucaacuuaauucuguuaca

SEQ ID NO: 1838066 - RNA, 13 nt, Homo sapiens
cccuggagggcaa

SEQ ID NO: 1838067 - RNA, 15 nt, Homo sapiens
auuuauuuacacucu

SEQ ID NO: 1838068 - RNA, 21 nt, Homo sapiens
gcugaaaugguccaguacaaa

SEQ ID NO: 1838069 - RNA, 16 nt, Homo sapiens
cucaggagaagggaua

SEQ ID NO: 1838070 - RNA, 19 nt, Homo sapiens
auuuuuuuugagaccgagu

SEQ ID NO: 1838071 - RNA, 14 nt, Homo sapiens
ugccccagccuguc

SEQ ID NO: 1838072 - RNA, 20 nt, Homo sapiens
gagaaagugaaaaugccacu

SEQ ID NO: 1838073 - RNA, 23 nt, Homo sapiens
caagucuuuaguguucaaauacu

SEQ ID NO: 1838074 - RNA, 21 nt, Homo sapiens
uaccugguagaucaagcauua

SEQ ID NO: 1838075 - RNA, 21 nt, Homo sapiens
ucuaaccuugaaugcugccag

SEQ ID NO: 1838076 - RNA, 11 nt, Homo sapiens
caaagcacuuu

SEQ ID NO: 1838077 - RNA, 19 nt, Homo sapiens
ggugagcuccagcugcugc

SEQ ID NO: 1838078 - RNA, 22 nt, Homo sapiens
agccccucucucacacaucaca

SEQ ID NO: 1838079 - RNA, 19 nt, Homo sapiens
acaagcgaaucucugccuu

SEQ ID NO: 1838080 - RNA, 14 nt, Homo sapiens
aguuuaaaugagac

SEQ ID NO: 1838081 - RNA, 12 nt, Homo sapiens
ggugcugagcuu

SEQ ID NO: 1838082 - RNA, 20 nt, Homo sapiens
aggaguccaagaccagacuc

SEQ ID NO: 1838083 - RNA, 18 nt, Homo sapiens
cugagauuacagguguga

SEQ ID NO: 1838084 - RNA, 17 nt, Homo sapiens
aguugguucacuucaaa

SEQ ID NO: 1838085 - RNA, 19 nt, Homo sapiens
cugcguguguauauuugua

SEQ ID NO: 1838086 - RNA, 15 nt, Homo sapiens
uggcccaacacaauu

SEQ ID NO: 1838087 - RNA, 17 nt, Homo sapiens
uauguacuuguuugcua

SEQ ID NO: 1838088 - RNA, 15 nt, Homo sapiens
aagacuaagcaccau

SEQ ID NO: 1838089 - RNA, 18 nt, Homo sapiens
uucaugagcuugaacaag

SEQ ID NO: 1838090 - RNA, 15 nt, Homo sapiens
ggucaugaugucugc

SEQ ID NO: 1838091 - RNA, 11 nt, Homo sapiens
uagugccuuga

SEQ ID NO: 1838092 - RNA, 18 nt, Homo sapiens
uacaaggacuuagugcau

SEQ ID NO: 1838093 - RNA, 22 nt, Homo sapiens
aacauaaguguugguagcacuu

SEQ ID NO: 1838094 - RNA, 13 nt, Homo sapiens
ugaauaaugauuu

SEQ ID NO: 1838095 - RNA, 14 nt, Homo sapiens
uuaagaaacuagca

SEQ ID NO: 1838096 - RNA, 17 nt, Homo sapiens
ccuucucccuugcccuc

SEQ ID NO: 1838097 - RNA, 17 nt, Homo sapiens
ccauuugaacacauuau

SEQ ID NO: 1838098 - RNA, 13 nt, Homo sapiens
ugccuuuguacuu

SEQ ID NO: 1838099 - RNA, 22 nt, Homo sapiens
gaaugucuuucagccaagccaa

SEQ ID NO: 1838100 - RNA, 18 nt, Homo sapiens
caugcaagacuucacugc

SEQ ID NO: 1838101 - RNA, 14 nt, Homo sapiens
aucagaaagggaga

SEQ ID NO: 1838102 - RNA, 15 nt, Homo sapiens
ccaaauuacagcaua

SEQ ID NO: 1838103 - RNA, 19 nt, Homo sapiens
gaaaaucaaccagcaggaa

SEQ ID NO: 1838104 - RNA, 15 nt, Homo sapiens
ucaucuugcuaccag

SEQ ID NO: 1838105 - RNA, 15 nt, Homo sapiens
uuucauuuuugccag

SEQ ID NO: 1838106 - RNA, 21 nt, Homo sapiens
aguaaagguacgauuauacuu

SEQ ID NO: 1838107 - RNA, 14 nt, Homo sapiens
uguguggagucauu

SEQ ID NO: 1838108 - RNA, 15 nt, Homo sapiens
auagccaaacaggag

SEQ ID NO: 1838109 - RNA, 14 nt, Homo sapiens
uacuuagauacuaa

SEQ ID NO: 1838110 - RNA, 19 nt, Homo sapiens
cccaaaggagucagagcau

SEQ ID NO: 1838111 - RNA, 19 nt, Homo sapiens
gaccuggagcaauaaaaga

SEQ ID NO: 1838112 - RNA, 20 nt, Homo sapiens
cuucucugcaguaaaacaca

SEQ ID NO: 1838113 - RNA, 18 nt, Homo sapiens
gauugagcgucugcagaa

SEQ ID NO: 1838114 - RNA, 18 nt, Homo sapiens
caaucugaaacagcuuca

SEQ ID NO: 1838115 - RNA, 14 nt, Homo sapiens
caaggucaugccac

SEQ ID NO: 1838116 - RNA, 22 nt, Homo sapiens
gcaggguccacgccucugcugu

SEQ ID NO: 1838117 - RNA, 15 nt, Homo sapiens
uuuaugggcauccuc

SEQ ID NO: 1838118 - RNA, 19 nt, Homo sapiens
aggcuccugggaggcccug

SEQ ID NO: 1838119 - RNA, 19 nt, Homo sapiens
agcuggggacaacugcggu

SEQ ID NO: 1838120 - RNA, 21 nt, Homo sapiens
cuuuagauuaggucacauuac

SEQ ID NO: 1838121 - RNA, 19 nt, Homo sapiens
cccugcucacaguguuuua

SEQ ID NO: 1838122 - RNA, 13 nt, Homo sapiens
caggucagagccc

SEQ ID NO: 1838123 - RNA, 23 nt, Homo sapiens
guauaguagaaagacaucugccu

SEQ ID NO: 1838124 - RNA, 22 nt, Homo sapiens
agugguggaggggccaccucag

SEQ ID NO: 1838125 - RNA, 19 nt, Homo sapiens
accccagccucuugagcug

SEQ ID NO: 1838126 - RNA, 15 nt, Homo sapiens
agaccccaugccugu

SEQ ID NO: 1838127 - RNA, 16 nt, Homo sapiens
accacagcggauguug

SEQ ID NO: 1838128 - RNA, 15 nt, Homo sapiens
auuuggacucugccu

SEQ ID NO: 1838129 - RNA, 23 nt, Homo sapiens
agcuuuacuuuguacaaauguaa

SEQ ID NO: 1838130 - RNA, 23 nt, Homo sapiens
ccacaaguguaacuaugcuguua

SEQ ID NO: 1838131 - RNA, 13 nt, Homo sapiens
ccugucaguguca

SEQ ID NO: 1838132 - RNA, 17 nt, Homo sapiens
uuaaggaacaucucugc

SEQ ID NO: 1838133 - RNA, 19 nt, Homo sapiens
cuagggaaugggacuguga

SEQ ID NO: 1838134 - RNA, 18 nt, Homo sapiens
uuaaagcaaaauaguauu

SEQ ID NO: 1838135 - RNA, 15 nt, Homo sapiens
cucuggggugcagcu

SEQ ID NO: 1838136 - RNA, 19 nt, Homo sapiens
augcaaauccuaugugauu

SEQ ID NO: 1838137 - RNA, 16 nt, Homo sapiens
gugugacaucaguggc

SEQ ID NO: 1838138 - RNA, 13 nt, Homo sapiens
agcgacuucugaa

SEQ ID NO: 1838139 - RNA, 12 nt, Homo sapiens
cuuugugcccaa

SEQ ID NO: 1838140 - RNA, 20 nt, Homo sapiens
ugggggguuuucuugccuug

SEQ ID NO: 1838141 - RNA, 16 nt, Homo sapiens
ccaggcacugccugga

SEQ ID NO: 1838142 - RNA, 20 nt, Homo sapiens
aaaaaugugguacauacaca

SEQ ID NO: 1838143 - RNA, 17 nt, Homo sapiens
uaacuuucucugugaaa

SEQ ID NO: 1838144 - RNA, 17 nt, Homo sapiens
aaaauguugaaccaaac

SEQ ID NO: 1838145 - RNA, 18 nt, Homo sapiens
cugccagccccaugccau

SEQ ID NO: 1838146 - RNA, 17 nt, Homo sapiens
agaaauccugcaaugaa

SEQ ID NO: 1838147 - RNA, 17 nt, Homo sapiens
auccuugauuacuucca

SEQ ID NO: 1838148 - RNA, 13 nt, Homo sapiens
ccagccuuggcac

SEQ ID NO: 1838149 - RNA, 19 nt, Homo sapiens
cuuuaauuuuuuacuauuu

SEQ ID NO: 1838150 - RNA, 13 nt, Homo sapiens
uuaaacaugagaa

SEQ ID NO: 1838151 - RNA, 19 nt, Homo sapiens
agauacucauuagugacuu

SEQ ID NO: 1838152 - RNA, 23 nt, Homo sapiens
uggcgccaucgccgggacuccag

SEQ ID NO: 1838153 - RNA, 20 nt, Homo sapiens
gcuauuuuuaauuuccugug

SEQ ID NO: 1838154 - RNA, 13 nt, Homo sapiens
cugauucauaaua

SEQ ID NO: 1838155 - RNA, 19 nt, Homo sapiens
accugaggcuccugugcua

SEQ ID NO: 1838156 - RNA, 16 nt, Homo sapiens
guugauaaugaucuga

SEQ ID NO: 1838157 - RNA, 12 nt, Homo sapiens
caucuaaucuau

SEQ ID NO: 1838158 - RNA, 22 nt, Homo sapiens
cuacuaaaaaaaaaauucuugc

SEQ ID NO: 1838159 - RNA, 21 nt, Homo sapiens
cugcuggacguccagguggag

SEQ ID NO: 1838160 - RNA, 11 nt, Homo sapiens
auaaugcacca

SEQ ID NO: 1838161 - RNA, 16 nt, Homo sapiens
ccgucuguacuaaaaa

SEQ ID NO: 1838162 - RNA, 14 nt, Homo sapiens
gugagugugugcaa

SEQ ID NO: 1838163 - RNA, 19 nt, Homo sapiens
guggccucugggaggccag

SEQ ID NO: 1838164 - RNA, 22 nt, Homo sapiens
gacuugcugaaucggaaucucu

SEQ ID NO: 1838165 - RNA, 15 nt, Homo sapiens
uucuuucucuucccu

SEQ ID NO: 1838166 - RNA, 16 nt, Homo sapiens
gugcugggggaaugag

SEQ ID NO: 1838167 - RNA, 12 nt, Homo sapiens
acacauacacac

SEQ ID NO: 1838168 - RNA, 12 nt, Homo sapiens
uucaauacuuca

SEQ ID NO: 1838169 - RNA, 21 nt, Homo sapiens
ccagcccuucaugggugguga

SEQ ID NO: 1838170 - RNA, 12 nt, Homo sapiens
aucucagaaaag

SEQ ID NO: 1838171 - RNA, 16 nt, Homo sapiens
agaaggguucagccca

SEQ ID NO: 1838172 - RNA, 18 nt, Homo sapiens
uuguguuguuguugcugc

SEQ ID NO: 1838173 - RNA, 21 nt, Homo sapiens
aguuugaaaguuguacaugau

SEQ ID NO: 1838174 - RNA, 15 nt, Homo sapiens
uuugauuauucagug

SEQ ID NO: 1838175 - RNA, 16 nt, Homo sapiens
ugaguaccuacugugu

SEQ ID NO: 1838176 - RNA, 13 nt, Homo sapiens
auacaugauugca

SEQ ID NO: 1838177 - RNA, 17 nt, Homo sapiens
ccucuucaucuguguag

SEQ ID NO: 1838178 - RNA, 13 nt, Homo sapiens
accuaaguucuca

SEQ ID NO: 1838179 - RNA, 20 nt, Homo sapiens
ugugguaguuaauaaaacac

SEQ ID NO: 1838180 - RNA, 22 nt, Homo sapiens
aacugcaguauggccaugggcu

SEQ ID NO: 1838181 - RNA, 10 nt, Homo sapiens
gagguccagg

SEQ ID NO: 1838182 - RNA, 20 nt, Homo sapiens
agaggccaaggaggccuugg

SEQ ID NO: 1838183 - RNA, 11 nt, Homo sapiens
aaggagcagug

SEQ ID NO: 1838184 - RNA, 15 nt, Homo sapiens
guucuauacuguaaa

SEQ ID NO: 1838185 - RNA, 19 nt, Homo sapiens
ggcuuugucccacagcuug

SEQ ID NO: 1838186 - RNA, 16 nt, Homo sapiens
uuaagugaaaaucuga

SEQ ID NO: 1838187 - RNA, 21 nt, Homo sapiens
aaaaugaugucaugucagcuc

SEQ ID NO: 1838188 - RNA, 16 nt, Homo sapiens
uaucaauuuuucccag

SEQ ID NO: 1838189 - RNA, 18 nt, Homo sapiens
acuucccagagaacuuca

SEQ ID NO: 1838190 - RNA, 19 nt, Homo sapiens
uuccucucuggauacugca

SEQ ID NO: 1838191 - RNA, 23 nt, Homo sapiens
aauauuuuuauaucaugcaaaau

SEQ ID NO: 1838192 - RNA, 13 nt, Homo sapiens
ugguaccagcuca

SEQ ID NO: 1838193 - RNA, 21 nt, Homo sapiens
uggaggcugccugcugugcug

SEQ ID NO: 1838194 - RNA, 17 nt, Homo sapiens
cuggauacuaagcacaa

SEQ ID NO: 1838195 - RNA, 16 nt, Homo sapiens
augggggcuccuggca

SEQ ID NO: 1838196 - RNA, 22 nt, Homo sapiens
cuguaaucccagcuacuccggg

SEQ ID NO: 1838197 - RNA, 12 nt, Homo sapiens
gucccuguggua

SEQ ID NO: 1838198 - RNA, 16 nt, Homo sapiens
ggggagagacaggcag

SEQ ID NO: 1838199 - RNA, 21 nt, Homo sapiens
guaaauuuucuuuaagucaga

SEQ ID NO: 1838200 - RNA, 18 nt, Homo sapiens
gcaccccagcugaccugg

SEQ ID NO: 1838201 - RNA, 20 nt, Homo sapiens
gggagcagucggcacagugc

SEQ ID NO: 1838202 - RNA, 17 nt, Homo sapiens
aaauucuauacauguau

SEQ ID NO: 1838203 - RNA, 12 nt, Homo sapiens
agaagagcaaaa

SEQ ID NO: 1838204 - RNA, 12 nt, Homo sapiens
aggagagcaaga

SEQ ID NO: 1838205 - RNA, 13 nt, Homo sapiens
gcauacucugugc

SEQ ID NO: 1838206 - RNA, 18 nt, Homo sapiens
gcagugagcuucuauuaa

SEQ ID NO: 1838207 - RNA, 13 nt, Homo sapiens
gcuacuucuuauu

SEQ ID NO: 1838208 - RNA, 13 nt, Homo sapiens
aaugaacacuuaa

SEQ ID NO: 1838209 - RNA, 15 nt, Homo sapiens
aguccuccucuuccu

SEQ ID NO: 1838210 - RNA, 22 nt, Homo sapiens
acaaauauugugaugcauuuau

SEQ ID NO: 1838211 - RNA, 18 nt, Homo sapiens
ccagacaagaagacuguc

SEQ ID NO: 1838212 - RNA, 14 nt, Homo sapiens
ggagcaaaccagcu

SEQ ID NO: 1838213 - RNA, 19 nt, Homo sapiens
uggacucaguuuucuugca

SEQ ID NO: 1838214 - RNA, 11 nt, Homo sapiens
cccuaccuaag

SEQ ID NO: 1838215 - RNA, 11 nt, Homo sapiens
ucccucuagcu

SEQ ID NO: 1838216 - RNA, 16 nt, Homo sapiens
agcacuuaauaauugc

SEQ ID NO: 1838217 - RNA, 21 nt, Homo sapiens
aaaaucaaacccacauauuaa

SEQ ID NO: 1838218 - RNA, 14 nt, Homo sapiens
ugcaauugcuccca

SEQ ID NO: 1838219 - RNA, 17 nt, Homo sapiens
agucuagcauucugcaa

SEQ ID NO: 1838220 - RNA, 15 nt, Homo sapiens
gcaauaccuaguucu

SEQ ID NO: 1838221 - RNA, 14 nt, Homo sapiens
aaauuuuacaguaa

SEQ ID NO: 1838222 - RNA, 18 nt, Homo sapiens
gauaauuguuucauucau

SEQ ID NO: 1838223 - RNA, 14 nt, Homo sapiens
ugcacuuacuugcu

SEQ ID NO: 1838224 - RNA, 16 nt, Homo sapiens
uucuucuuagcaccac

SEQ ID NO: 1838225 - RNA, 12 nt, Homo sapiens
aggccagguaug

SEQ ID NO: 1838226 - RNA, 21 nt, Homo sapiens
uaccacaaggcuccugaucau

SEQ ID NO: 1838227 - RNA, 22 nt, Homo sapiens
agaaguucuggcugaacacugg

SEQ ID NO: 1838228 - RNA, 22 nt, Homo sapiens
aaagacuucauuuaacacugag

SEQ ID NO: 1838229 - RNA, 20 nt, Homo sapiens
acaccaucuggagucuuccu

SEQ ID NO: 1838230 - RNA, 14 nt, Homo sapiens
gugcugagcaaagg

SEQ ID NO: 1838231 - RNA, 20 nt, Homo sapiens
cugauggcacuaacacuggg

SEQ ID NO: 1838232 - RNA, 16 nt, Homo sapiens
cacagaggaugcugac

SEQ ID NO: 1838233 - RNA, 15 nt, Homo sapiens
ccuccugcaccgaga

SEQ ID NO: 1838234 - RNA, 14 nt, Homo sapiens
caucuacaaucagu

SEQ ID NO: 1838235 - RNA, 12 nt, Homo sapiens
cccccaccacaa

SEQ ID NO: 1838236 - RNA, 15 nt, Homo sapiens
acugaccagccucca

SEQ ID NO: 1838237 - RNA, 20 nt, Homo sapiens
aguauaauauuaauaauacc

SEQ ID NO: 1838238 - RNA, 13 nt, Homo sapiens
cccaaauguauuc

SEQ ID NO: 1838239 - RNA, 14 nt, Homo sapiens
uucuucaccuguaa

SEQ ID NO: 1838240 - RNA, 19 nt, Homo sapiens
caggacgcacccccacugc

SEQ ID NO: 1838241 - RNA, 17 nt, Homo sapiens
gcuauacuggauacucu

SEQ ID NO: 1838242 - RNA, 22 nt, Homo sapiens
ccacccugggcaaugcagugca

SEQ ID NO: 1838243 - RNA, 20 nt, Homo sapiens
aaaaggagcuucaguauugu

SEQ ID NO: 1838244 - RNA, 23 nt, Homo sapiens
caaggguucuuggugaugcuggc

SEQ ID NO: 1838245 - RNA, 16 nt, Homo sapiens
uucucaggggugcugg

SEQ ID NO: 1838246 - RNA, 14 nt, Homo sapiens
auguugcacaauga

SEQ ID NO: 1838247 - RNA, 21 nt, Homo sapiens
gccagcuuggggccaccaaag

SEQ ID NO: 1838248 - RNA, 19 nt, Homo sapiens
gccaagcagccaagcuccu

SEQ ID NO: 1838249 - RNA, 18 nt, Homo sapiens
gccggcccccaggacaag

SEQ ID NO: 1838250 - RNA, 17 nt, Homo sapiens
caauacauuuuuuucuc

SEQ ID NO: 1838251 - RNA, 17 nt, Homo sapiens
ucuuggaaguacaugaa

SEQ ID NO: 1838252 - RNA, 17 nt, Homo sapiens
guguuuaguagccucaa

SEQ ID NO: 1838253 - RNA, 23 nt, Homo sapiens
auugaguaugaguguguuuuaua

SEQ ID NO: 1838254 - RNA, 23 nt, Homo sapiens
cacccagcucagcauuuccacac

SEQ ID NO: 1838255 - RNA, 21 nt, Homo sapiens
uaaucccagcaugcugagauu

SEQ ID NO: 1838256 - RNA, 18 nt, Homo sapiens
aacagacaaaacaauccc

SEQ ID NO: 1838257 - RNA, 14 nt, Homo sapiens
uauugcuaguacua

SEQ ID NO: 1838258 - RNA, 16 nt, Homo sapiens
ucccuccucaugccuu

SEQ ID NO: 1838259 - RNA, 21 nt, Homo sapiens
uaucugcucuuaggugcuucu

SEQ ID NO: 1838260 - RNA, 23 nt, Homo sapiens
cacuaccuucaugcauagguuua

SEQ ID NO: 1838261 - RNA, 16 nt, Homo sapiens
cucucaggcugaggga

SEQ ID NO: 1838262 - RNA, 17 nt, Homo sapiens
aaaggaaauaggaucuc

SEQ ID NO: 1838263 - RNA, 20 nt, Homo sapiens
cacucuagggcaguggaguc

SEQ ID NO: 1838264 - RNA, 20 nt, Homo sapiens
ucaggaagcauaaagcaauu

SEQ ID NO: 1838265 - RNA, 20 nt, Homo sapiens
augguaucaauggauuuauc

SEQ ID NO: 1838266 - RNA, 21 nt, Homo sapiens
ccaagagcauaacuguucuca

SEQ ID NO: 1838267 - RNA, 17 nt, Homo sapiens
cuauuuguuucauuaaa

SEQ ID NO: 1838268 - RNA, 16 nt, Homo sapiens
uagaaagaccacuggc

SEQ ID NO: 1838269 - RNA, 22 nt, Homo sapiens
aaguucuucuccaauccuauca

SEQ ID NO: 1838270 - RNA, 16 nt, Homo sapiens
aauaaagcguccucuc

SEQ ID NO: 1838271 - RNA, 14 nt, Homo sapiens
ucugguucugaugc

SEQ ID NO: 1838272 - RNA, 21 nt, Homo sapiens
gaaauuaguuucaaauuuacc

SEQ ID NO: 1838273 - RNA, 17 nt, Homo sapiens
aguuguaauagugccaa

SEQ ID NO: 1838274 - RNA, 14 nt, Homo sapiens
agagguuuucacaa

SEQ ID NO: 1838275 - RNA, 14 nt, Homo sapiens
cucucuggcccucu

SEQ ID NO: 1838276 - RNA, 14 nt, Homo sapiens
auaaauggacaaau

SEQ ID NO: 1838277 - RNA, 16 nt, Homo sapiens
ccugaaauguuuccag

SEQ ID NO: 1838278 - RNA, 14 nt, Homo sapiens
cagcaucuuuaaca

SEQ ID NO: 1838279 - RNA, 22 nt, Homo sapiens
aauacaggaggcagacaaugac

SEQ ID NO: 1838280 - RNA, 21 nt, Homo sapiens
ucagaauauauugaauaggca

SEQ ID NO: 1838281 - RNA, 17 nt, Homo sapiens
uaggaggagugagacag

SEQ ID NO: 1838282 - RNA, 19 nt, Homo sapiens
gaaacuaaaugacuuucaa

SEQ ID NO: 1838283 - RNA, 16 nt, Homo sapiens
cagcguccucagcacc

SEQ ID NO: 1838284 - RNA, 14 nt, Homo sapiens
uugguuacauggaa

SEQ ID NO: 1838285 - RNA, 14 nt, Homo sapiens
gugucuagaggcag

SEQ ID NO: 1838286 - RNA, 20 nt, Homo sapiens
gccagcucuaaaacagauug

SEQ ID NO: 1838287 - RNA, 24 nt, Homo sapiens
uuccuaugaaguuggcacauuuca

SEQ ID NO: 1838288 - RNA, 21 nt, Homo sapiens
agggaaguuucguaugcacuc

SEQ ID NO: 1838289 - RNA, 14 nt, Homo sapiens
auacccagugaugu

SEQ ID NO: 1838290 - RNA, 23 nt, Homo sapiens
cuccccagacaucuggacacugg

SEQ ID NO: 1838291 - RNA, 22 nt, Homo sapiens
cuaaaggaauuucuaaggacau

SEQ ID NO: 1838292 - RNA, 15 nt, Homo sapiens
aagcucagcugccuu

SEQ ID NO: 1838293 - RNA, 16 nt, Homo sapiens
aaaaauccuacuuuca

SEQ ID NO: 1838294 - RNA, 14 nt, Homo sapiens
agucucuaugaucu

SEQ ID NO: 1838295 - RNA, 24 nt, Homo sapiens
aggaagugggacuggcacuauuug

SEQ ID NO: 1838296 - RNA, 14 nt, Homo sapiens
caggagacauauau

SEQ ID NO: 1838297 - RNA, 18 nt, Homo sapiens
ccugggccccacuggaca

SEQ ID NO: 1838298 - RNA, 12 nt, Homo sapiens
aaaagaacaugc

SEQ ID NO: 1838299 - RNA, 14 nt, Homo sapiens
ugaagcaaucauuu

SEQ ID NO: 1838300 - RNA, 17 nt, Homo sapiens
acggaugggcccuaugu

SEQ ID NO: 1838301 - RNA, 12 nt, Homo sapiens
cagagacagaua

SEQ ID NO: 1838302 - RNA, 18 nt, Homo sapiens
ucucuccccuugcacugg

SEQ ID NO: 1838303 - RNA, 22 nt, Homo sapiens
ccagaugccuucuccagacaaa

SEQ ID NO: 1838304 - RNA, 23 nt, Homo sapiens
aaaccuacacagcuguuuccuca

SEQ ID NO: 1838305 - RNA, 15 nt, Homo sapiens
aacaucucacuuugc

SEQ ID NO: 1838306 - RNA, 20 nt, Homo sapiens
uaaaagcuauaaagcaguau

SEQ ID NO: 1838307 - RNA, 15 nt, Homo sapiens
agaaaaaaacuucuu

SEQ ID NO: 1838308 - RNA, 21 nt, Homo sapiens
cagaauuauccauuacgugca

SEQ ID NO: 1838309 - RNA, 19 nt, Homo sapiens
agcccagaccucugacaca

SEQ ID NO: 1838310 - RNA, 14 nt, Homo sapiens
gccgccccgugccu

SEQ ID NO: 1838311 - RNA, 19 nt, Homo sapiens
ccagggcuuccccaucagc

SEQ ID NO: 1838312 - RNA, 18 nt, Homo sapiens
uugcuguuuauccuguau

SEQ ID NO: 1838313 - RNA, 18 nt, Homo sapiens
ggagcugggugcccagua

SEQ ID NO: 1838314 - RNA, 18 nt, Homo sapiens
accggauggcggacaccu

SEQ ID NO: 1838315 - RNA, 17 nt, Homo sapiens
ucuaucugcuuagcaac

SEQ ID NO: 1838316 - RNA, 16 nt, Homo sapiens
cacgcuggagugcagu

SEQ ID NO: 1838317 - RNA, 15 nt, Homo sapiens
cagaaccuagucuug

SEQ ID NO: 1838318 - RNA, 13 nt, Homo sapiens
gaacccucaccca

SEQ ID NO: 1838319 - RNA, 21 nt, Homo sapiens
ugcuacagaaaauaaucuggu

SEQ ID NO: 1838320 - RNA, 12 nt, Homo sapiens
cuauuuugugaa

SEQ ID NO: 1838321 - RNA, 20 nt, Homo sapiens
ccucuguggucacccaugca

SEQ ID NO: 1838322 - RNA, 16 nt, Homo sapiens
cuccucuucagaggag

SEQ ID NO: 1838323 - RNA, 14 nt, Homo sapiens
aggacagugcugac

SEQ ID NO: 1838324 - RNA, 20 nt, Homo sapiens
ugaaaacacacucaaaagac

SEQ ID NO: 1838325 - RNA, 20 nt, Homo sapiens
acaacucauuccagauccca

SEQ ID NO: 1838326 - RNA, 23 nt, Homo sapiens
uucugagcaccuacuuacaugca

SEQ ID NO: 1838327 - RNA, 16 nt, Homo sapiens
caaaugucauuucaua

SEQ ID NO: 1838328 - RNA, 17 nt, Homo sapiens
ccaaagaaugaauuuca

SEQ ID NO: 1838329 - RNA, 22 nt, Homo sapiens
gcugggcgugcuagagguugca

SEQ ID NO: 1838330 - RNA, 21 nt, Homo sapiens
uccucagccaugggaaccuca

SEQ ID NO: 1838331 - RNA, 21 nt, Homo sapiens
ccuccaaacacugggcucuga

SEQ ID NO: 1838332 - RNA, 15 nt, Homo sapiens
uuccguaaacauaua

SEQ ID NO: 1838333 - RNA, 13 nt, Homo sapiens
cuguccuaccuuu

SEQ ID NO: 1838334 - RNA, 22 nt, Homo sapiens
uccuuuggaacaagacagccuu

SEQ ID NO: 1838335 - RNA, 15 nt, Homo sapiens
caaacucuuguguac

SEQ ID NO: 1838336 - RNA, 14 nt, Homo sapiens
ggcaugucauuugc

SEQ ID NO: 1838337 - RNA, 21 nt, Homo sapiens
uuuauucgccugauaagaaua

SEQ ID NO: 1838338 - RNA, 16 nt, Homo sapiens
acgugauggaccaaag

SEQ ID NO: 1838339 - RNA, 20 nt, Homo sapiens
ugacaaugguguuauuugaa

SEQ ID NO: 1838340 - RNA, 21 nt, Homo sapiens
aggccuggagggcacuuccuc

SEQ ID NO: 1838341 - RNA, 22 nt, Homo sapiens
cucaaacuccugaccucaggug

SEQ ID NO: 1838342 - RNA, 15 nt, Homo sapiens
cccugcccacuccca

SEQ ID NO: 1838343 - RNA, 13 nt, Homo sapiens
acagucuucccag

SEQ ID NO: 1838344 - RNA, 23 nt, Homo sapiens
gcuugacuuuccagaaugaccuu

SEQ ID NO: 1838345 - RNA, 20 nt, Homo sapiens
uugucagcaauaauauguga

SEQ ID NO: 1838346 - RNA, 18 nt, Homo sapiens
cucacuuaaacaaugucc

SEQ ID NO: 1838347 - RNA, 18 nt, Homo sapiens
accucugugggcacuggu

SEQ ID NO: 1838348 - RNA, 16 nt, Homo sapiens
uaggggaaguaugugu

SEQ ID NO: 1838349 - RNA, 13 nt, Homo sapiens
uaaguugucuuac

SEQ ID NO: 1838350 - RNA, 13 nt, Homo sapiens
uugaaaaaguaua

SEQ ID NO: 1838351 - RNA, 22 nt, Homo sapiens
cacugaucugcuagugcuguaa

SEQ ID NO: 1838352 - RNA, 12 nt, Homo sapiens
cuugggggcuca

SEQ ID NO: 1838353 - RNA, 17 nt, Homo sapiens
cuuugcugucuggugua

SEQ ID NO: 1838354 - RNA, 11 nt, Homo sapiens
uuggguucucu

SEQ ID NO: 1838355 - RNA, 18 nt, Homo sapiens
ugcugcccgcucugcaga

SEQ ID NO: 1838356 - RNA, 21 nt, Homo sapiens
uguaacacuguccaucuugca

SEQ ID NO: 1838357 - RNA, 16 nt, Homo sapiens
acuauucuagcaggag

SEQ ID NO: 1838358 - RNA, 15 nt, Homo sapiens
cuaugcccacucuaa

SEQ ID NO: 1838359 - RNA, 20 nt, Homo sapiens
aaccaagucaggccaggugg

SEQ ID NO: 1838360 - RNA, 16 nt, Homo sapiens
auucuaguuuugucaa

SEQ ID NO: 1838361 - RNA, 22 nt, Homo sapiens
uucagagggcguguuguuuuac

SEQ ID NO: 1838362 - RNA, 13 nt, Homo sapiens
gguguagcacuua

SEQ ID NO: 1838363 - RNA, 14 nt, Homo sapiens
aaauugccugcaaa

SEQ ID NO: 1838364 - RNA, 17 nt, Homo sapiens
cacgugcacaaauucau

SEQ ID NO: 1838365 - RNA, 16 nt, Homo sapiens
uguuacucaguguuag

SEQ ID NO: 1838366 - RNA, 24 nt, Homo sapiens
ccuguguagucucucuaguaguua

SEQ ID NO: 1838367 - RNA, 16 nt, Homo sapiens
ucaugaaaaucugcca

SEQ ID NO: 1838368 - RNA, 20 nt, Homo sapiens
aaaucuuuaagaauaguucu

SEQ ID NO: 1838369 - RNA, 17 nt, Homo sapiens
gccuaauucuuguuguu

SEQ ID NO: 1838370 - RNA, 13 nt, Homo sapiens
aggugccaugaug

SEQ ID NO: 1838371 - RNA, 12 nt, Homo sapiens
ccaagcugugac

SEQ ID NO: 1838372 - RNA, 17 nt, Homo sapiens
ccaauggcaacaucuug

SEQ ID NO: 1838373 - RNA, 17 nt, Homo sapiens
aggaaacauaagagcuu

SEQ ID NO: 1838374 - RNA, 16 nt, Homo sapiens
guucuccacuauggca

SEQ ID NO: 1838375 - RNA, 23 nt, Homo sapiens
augaguuuuuauuuugucucuga

SEQ ID NO: 1838376 - RNA, 21 nt, Homo sapiens
auucuaaccuacuaagucugu

SEQ ID NO: 1838377 - RNA, 17 nt, Homo sapiens
ugcuuaaaaugcaagga

SEQ ID NO: 1838378 - RNA, 23 nt, Homo sapiens
augcuugcuucaaccccaugaga

SEQ ID NO: 1838379 - RNA, 18 nt, Homo sapiens
ugccuuucagaagugauu

SEQ ID NO: 1838380 - RNA, 21 nt, Homo sapiens
uggagagggaaaaucuucacu

SEQ ID NO: 1838381 - RNA, 15 nt, Homo sapiens
uucaguauacugugu

SEQ ID NO: 1838382 - RNA, 15 nt, Homo sapiens
auugguuuuccauga

SEQ ID NO: 1838383 - RNA, 17 nt, Homo sapiens
acuaucucaugccagug

SEQ ID NO: 1838384 - RNA, 18 nt, Homo sapiens
auuuuagcaucuacuugu

SEQ ID NO: 1838385 - RNA, 22 nt, Homo sapiens
cagacacuaaagacuggguuac

SEQ ID NO: 1838386 - RNA, 12 nt, Homo sapiens
uaaaucuaugaa

SEQ ID NO: 1838387 - RNA, 22 nt, Homo sapiens
acaagcaccucuccugugagug

SEQ ID NO: 1838388 - RNA, 17 nt, Homo sapiens
auuuuaagaauuucaca

SEQ ID NO: 1838389 - RNA, 14 nt, Homo sapiens
cauuaaaucacuug

SEQ ID NO: 1838390 - RNA, 14 nt, Homo sapiens
cuucugaucuccaa

SEQ ID NO: 1838391 - RNA, 12 nt, Homo sapiens
uccuaacauaua

SEQ ID NO: 1838392 - RNA, 16 nt, Homo sapiens
uaaauauuuagucugc

SEQ ID NO: 1838393 - RNA, 16 nt, Homo sapiens
ccuguguauaaagcca

SEQ ID NO: 1838394 - RNA, 13 nt, Homo sapiens
uaguauacuuugu

SEQ ID NO: 1838395 - RNA, 19 nt, Homo sapiens
aacuaaaacuugaggcaga

SEQ ID NO: 1838396 - RNA, 22 nt, Homo sapiens
augacagugaagcagcacugug

SEQ ID NO: 1838397 - RNA, 21 nt, Homo sapiens
caggucucacgggcaugggca

SEQ ID NO: 1838398 - RNA, 19 nt, Homo sapiens
ucugugaagaaagagguua

SEQ ID NO: 1838399 - RNA, 17 nt, Homo sapiens
cuuaagccaacaaccac

SEQ ID NO: 1838400 - RNA, 14 nt, Homo sapiens
guaccugaugcuau

SEQ ID NO: 1838401 - RNA, 17 nt, Homo sapiens
ugcuucaugaaaauccu

SEQ ID NO: 1838402 - RNA, 18 nt, Homo sapiens
cagaaggaaaagaguaau

SEQ ID NO: 1838403 - RNA, 20 nt, Homo sapiens
gaaaauaggaagugaaccca

SEQ ID NO: 1838404 - RNA, 16 nt, Homo sapiens
uuucuuguagcuaaaa

SEQ ID NO: 1838405 - RNA, 22 nt, Homo sapiens
agaacuagagguuuuaugauau

SEQ ID NO: 1838406 - RNA, 13 nt, Homo sapiens
ccuuaagagucau

SEQ ID NO: 1838407 - RNA, 23 nt, Homo sapiens
aaaaggugcuacgguagugauga

SEQ ID NO: 1838408 - RNA, 13 nt, Homo sapiens
aucuccgccucca

SEQ ID NO: 1838409 - RNA, 19 nt, Homo sapiens
uucgugacaauguuuacaa

SEQ ID NO: 1838410 - RNA, 13 nt, Homo sapiens
aagaaaucuuucc

SEQ ID NO: 1838411 - RNA, 14 nt, Homo sapiens
cuucuguccaggac

SEQ ID NO: 1838412 - RNA, 15 nt, Homo sapiens
uucuuuuugccagcu

SEQ ID NO: 1838413 - RNA, 15 nt, Homo sapiens
uccaucaugucugua

SEQ ID NO: 1838414 - RNA, 18 nt, Homo sapiens
aagaagaaacugcuuaga

SEQ ID NO: 1838415 - RNA, 18 nt, Homo sapiens
ugaaauaacuaccuucca

SEQ ID NO: 1838416 - RNA, 17 nt, Homo sapiens
uauuuuuuaaguucaau

SEQ ID NO: 1838417 - RNA, 16 nt, Homo sapiens
aagcagggaauuccug

SEQ ID NO: 1838418 - RNA, 17 nt, Homo sapiens
auaugcaauaaauauua

SEQ ID NO: 1838419 - RNA, 20 nt, Homo sapiens
gagauaaccuuaaacucuga

SEQ ID NO: 1838420 - RNA, 19 nt, Homo sapiens
ccugaaauuguauaguguu

SEQ ID NO: 1838421 - RNA, 17 nt, Homo sapiens
cauauugggacucguau

SEQ ID NO: 1838422 - RNA, 15 nt, Homo sapiens
guuaaaguggucuga

SEQ ID NO: 1838423 - RNA, 22 nt, Homo sapiens
gggaaggucagcccagccccuc

SEQ ID NO: 1838424 - RNA, 15 nt, Homo sapiens
aaaggcccucaguga

SEQ ID NO: 1838425 - RNA, 17 nt, Homo sapiens
aagucaaucauuucuca

SEQ ID NO: 1838426 - RNA, 19 nt, Homo sapiens
uguacacagaauuguucca

SEQ ID NO: 1838427 - RNA, 15 nt, Homo sapiens
cugucaucaacauuc

SEQ ID NO: 1838428 - RNA, 15 nt, Homo sapiens
cccuggaucucccaa

SEQ ID NO: 1838429 - RNA, 17 nt, Homo sapiens
ccaugaaaaugcaacaa

SEQ ID NO: 1838430 - RNA, 23 nt, Homo sapiens
uagacuauaagcagaagcacaua

SEQ ID NO: 1838431 - RNA, 17 nt, Homo sapiens
caggacagccacagcca

SEQ ID NO: 1838432 - RNA, 17 nt, Homo sapiens
ccacgucacuucaugca

SEQ ID NO: 1838433 - RNA, 13 nt, Homo sapiens
cgucuguguaugu

SEQ ID NO: 1838434 - RNA, 16 nt, Homo sapiens
ucuuucacacggcaca

SEQ ID NO: 1838435 - RNA, 14 nt, Homo sapiens
ccucguaugcaugg

SEQ ID NO: 1838436 - RNA, 20 nt, Homo sapiens
ucuuagcugccaaguaaaua

SEQ ID NO: 1838437 - RNA, 22 nt, Homo sapiens
gaaagaucauuauuuaaccuag

SEQ ID NO: 1838438 - RNA, 22 nt, Homo sapiens
agaacuuucuaguugcccucua

SEQ ID NO: 1838439 - RNA, 19 nt, Homo sapiens
gagacaggaggauugccug

SEQ ID NO: 1838440 - RNA, 16 nt, Homo sapiens
ccuagucggucaccaa

SEQ ID NO: 1838441 - RNA, 22 nt, Homo sapiens
agcacaugauuugggcucuaga

SEQ ID NO: 1838442 - RNA, 23 nt, Homo sapiens
cccaagaggucaaggcugcagug

SEQ ID NO: 1838443 - RNA, 23 nt, Homo sapiens
ccagaaugugaagacaaguagua

SEQ ID NO: 1838444 - RNA, 22 nt, Homo sapiens
aagcaaauauuuaugaccucaa

SEQ ID NO: 1838445 - RNA, 12 nt, Homo sapiens
uuuuugcuauau

SEQ ID NO: 1838446 - RNA, 12 nt, Homo sapiens
acuuugcuucau

SEQ ID NO: 1838447 - RNA, 23 nt, Homo sapiens
uaaggacuuuaggaaaaaaagca

SEQ ID NO: 1838448 - RNA, 14 nt, Homo sapiens
gcuagaguccucac

SEQ ID NO: 1838449 - RNA, 18 nt, Homo sapiens
gugccucuuuucaguagu

SEQ ID NO: 1838450 - RNA, 12 nt, Homo sapiens
cagaagugcaau

SEQ ID NO: 1838451 - RNA, 15 nt, Homo sapiens
ucacauguccauuau

SEQ ID NO: 1838452 - RNA, 15 nt, Homo sapiens
aaacacuauuuccaa

SEQ ID NO: 1838453 - RNA, 19 nt, Homo sapiens
uaaugcacuaaaaguagua

SEQ ID NO: 1838454 - RNA, 13 nt, Homo sapiens
cggaggcaccugg

SEQ ID NO: 1838455 - RNA, 15 nt, Homo sapiens
ugggcacaucugcug

SEQ ID NO: 1838456 - RNA, 17 nt, Homo sapiens
aaaguaauaaugugcaa

SEQ ID NO: 1838457 - RNA, 20 nt, Homo sapiens
cuuuuaauccaauccacuaa

SEQ ID NO: 1838458 - RNA, 20 nt, Homo sapiens
cauuuaguagaauuccucuu

SEQ ID NO: 1838459 - RNA, 16 nt, Homo sapiens
auguggcccaacacaa

SEQ ID NO: 1838460 - RNA, 16 nt, Homo sapiens
ucuuauuuaaugaaag

SEQ ID NO: 1838461 - RNA, 14 nt, Homo sapiens
accauuuacaugca

SEQ ID NO: 1838462 - RNA, 18 nt, Homo sapiens
augggugaaggcuggcau

SEQ ID NO: 1838463 - RNA, 15 nt, Homo sapiens
cgccauggccgugua

SEQ ID NO: 1838464 - RNA, 23 nt, Homo sapiens
uuuuacaacuggaugugugacua

SEQ ID NO: 1838465 - RNA, 14 nt, Homo sapiens
ccagaggagggcag

SEQ ID NO: 1838466 - RNA, 13 nt, Homo sapiens
guagaacuuugua

SEQ ID NO: 1838467 - RNA, 19 nt, Homo sapiens
auuuaauuucuucauguga

SEQ ID NO: 1838468 - RNA, 17 nt, Homo sapiens
aacuacugaacuguuac

SEQ ID NO: 1838469 - RNA, 13 nt, Homo sapiens
auccuugaccuca

SEQ ID NO: 1838470 - RNA, 23 nt, Homo sapiens
uccagcuccguucccaaggauac

SEQ ID NO: 1838471 - RNA, 20 nt, Homo sapiens
uauuucaaaauauacauuca

SEQ ID NO: 1838472 - RNA, 14 nt, Homo sapiens
aaugucauggccuu

SEQ ID NO: 1838473 - RNA, 15 nt, Homo sapiens
agaggcaguggccac

SEQ ID NO: 1838474 - RNA, 19 nt, Homo sapiens
caaaauguuaauaaagguu

SEQ ID NO: 1838475 - RNA, 20 nt, Homo sapiens
gccucuuuuccccaugaacu

SEQ ID NO: 1838476 - RNA, 16 nt, Homo sapiens
aggccgaggugggcag

SEQ ID NO: 1838477 - RNA, 13 nt, Homo sapiens
gcuccacugucac

SEQ ID NO: 1838478 - RNA, 13 nt, Homo sapiens
cgacugggcucaa

SEQ ID NO: 1838479 - RNA, 18 nt, Homo sapiens
auguggggaaaaggcauu

SEQ ID NO: 1838480 - RNA, 18 nt, Homo sapiens
guauaucacauaauucca

SEQ ID NO: 1838481 - RNA, 17 nt, Homo sapiens
ucagguuauauccaaua

SEQ ID NO: 1838482 - RNA, 16 nt, Homo sapiens
ggugugccacaggcug

SEQ ID NO: 1838483 - RNA, 16 nt, Homo sapiens
caaauuauucuaguca

SEQ ID NO: 1838484 - RNA, 21 nt, Homo sapiens
auggugucugugacauuuccu

SEQ ID NO: 1838485 - RNA, 16 nt, Homo sapiens
aaacuguuuugacaaa

SEQ ID NO: 1838486 - RNA, 17 nt, Homo sapiens
uacagacucugauucua

SEQ ID NO: 1838487 - RNA, 19 nt, Homo sapiens
ucugcagggccgccaggga

SEQ ID NO: 1838488 - RNA, 13 nt, Homo sapiens
agaagcaaucugc

SEQ ID NO: 1838489 - RNA, 23 nt, Homo sapiens
aaaauaccccuaacauacugcau

SEQ ID NO: 1838490 - RNA, 12 nt, Homo sapiens
uuggcuauugaa

SEQ ID NO: 1838491 - RNA, 14 nt, Homo sapiens
auaauuagcaguau

SEQ ID NO: 1838492 - RNA, 21 nt, Homo sapiens
cugauaaaccuaauauucaau

SEQ ID NO: 1838493 - RNA, 15 nt, Homo sapiens
guugauuccacugaa

SEQ ID NO: 1838494 - RNA, 18 nt, Homo sapiens
uaugcuguauccacaaau

SEQ ID NO: 1838495 - RNA, 21 nt, Homo sapiens
ugacagaucaagcugugagac

SEQ ID NO: 1838496 - RNA, 12 nt, Homo sapiens
agccgaccucag

SEQ ID NO: 1838497 - RNA, 16 nt, Homo sapiens
auaaucuaugaugaag

SEQ ID NO: 1838498 - RNA, 17 nt, Homo sapiens
uucacacaaagacuccu

SEQ ID NO: 1838499 - RNA, 17 nt, Homo sapiens
uucauuacuagauaaaa

SEQ ID NO: 1838500 - RNA, 14 nt, Homo sapiens
cacagcguccuguc

SEQ ID NO: 1838501 - RNA, 15 nt, Homo sapiens
ugugcccuguucaaa

SEQ ID NO: 1838502 - RNA, 23 nt, Homo sapiens
ccaacucaggacagaacaguguu

SEQ ID NO: 1838503 - RNA, 18 nt, Homo sapiens
ugggcuacccuaaaggga

SEQ ID NO: 1838504 - RNA, 16 nt, Homo sapiens
agggccccuguucccc

SEQ ID NO: 1838505 - RNA, 15 nt, Homo sapiens
gccuggacaguaucc

SEQ ID NO: 1838506 - RNA, 16 nt, Homo sapiens
aguuaccacaccccau

SEQ ID NO: 1838507 - RNA, 15 nt, Homo sapiens
agggggccuccagga

SEQ ID NO: 1838508 - RNA, 23 nt, Homo sapiens
aauuagcuuggggccagggaagg

SEQ ID NO: 1838509 - RNA, 21 nt, Homo sapiens
agauugaugugcacugcauua

SEQ ID NO: 1838510 - RNA, 19 nt, Homo sapiens
ugcuggaaccugcaaaaaa

SEQ ID NO: 1838511 - RNA, 16 nt, Homo sapiens
ucacauaagcucagaa

SEQ ID NO: 1838512 - RNA, 18 nt, Homo sapiens
cagaaacaugucuugacu

SEQ ID NO: 1838513 - RNA, 17 nt, Homo sapiens
cuuuguguccagaguuu

SEQ ID NO: 1838514 - RNA, 22 nt, Homo sapiens
aaauaugcaccaaaucaucucu

SEQ ID NO: 1838515 - RNA, 23 nt, Homo sapiens
gcaggcugggccauguccaaaga

SEQ ID NO: 1838516 - RNA, 14 nt, Homo sapiens
augaucauuucuca

SEQ ID NO: 1838517 - RNA, 22 nt, Homo sapiens
ccacagccuuaccaaagcagac

SEQ ID NO: 1838518 - RNA, 17 nt, Homo sapiens
cagcugcagcagcaguu

SEQ ID NO: 1838519 - RNA, 19 nt, Homo sapiens
cuggaggugccagcaaagc

SEQ ID NO: 1838520 - RNA, 21 nt, Homo sapiens
caagagcagcugccauugcag

SEQ ID NO: 1838521 - RNA, 22 nt, Homo sapiens
caggaagaaagggaaauugcag

SEQ ID NO: 1838522 - RNA, 15 nt, Homo sapiens
gccuucacuggagac

SEQ ID NO: 1838523 - RNA, 13 nt, Homo sapiens
cuuccaugguggu

SEQ ID NO: 1838524 - RNA, 17 nt, Homo sapiens
uuuaaaauaagaucucu

SEQ ID NO: 1838525 - RNA, 20 nt, Homo sapiens
gccuggagccugggcagcac

SEQ ID NO: 1838526 - RNA, 13 nt, Homo sapiens
caaggaucuuuca

SEQ ID NO: 1838527 - RNA, 20 nt, Homo sapiens
cugcaauuuuaauugauuau

SEQ ID NO: 1838528 - RNA, 13 nt, Homo sapiens
acauuucuuucaa

SEQ ID NO: 1838529 - RNA, 22 nt, Homo sapiens
ucuacgugauuuggcugcacuu

SEQ ID NO: 1838530 - RNA, 14 nt, Homo sapiens
acuauaaccaucag

SEQ ID NO: 1838531 - RNA, 19 nt, Homo sapiens
caacaaaccauccagugac

SEQ ID NO: 1838532 - RNA, 21 nt, Homo sapiens
cucaggggugauaacucagga

SEQ ID NO: 1838533 - RNA, 15 nt, Homo sapiens
auaugcagauacuua

SEQ ID NO: 1838534 - RNA, 18 nt, Homo sapiens
uccucucguccuuggaua

SEQ ID NO: 1838535 - RNA, 21 nt, Homo sapiens
cauaggaugguaccaagcauu

SEQ ID NO: 1838536 - RNA, 17 nt, Homo sapiens
gcccaggauuauuguca

SEQ ID NO: 1838537 - RNA, 21 nt, Homo sapiens
agcuuggcugagggucuggga

SEQ ID NO: 1838538 - RNA, 21 nt, Homo sapiens
gcgcccauccuagugggcacu

SEQ ID NO: 1838539 - RNA, 21 nt, Homo sapiens
agauacuauuuauaaguugaa

SEQ ID NO: 1838540 - RNA, 10 nt, Homo sapiens
cagcacuaac

SEQ ID NO: 1838541 - RNA, 18 nt, Homo sapiens
acugggaaauaagcaaaa

SEQ ID NO: 1838542 - RNA, 16 nt, Homo sapiens
agcucagcagacaucc

SEQ ID NO: 1838543 - RNA, 20 nt, Homo sapiens
uccugccagccccacacagc

SEQ ID NO: 1838544 - RNA, 14 nt, Homo sapiens
uuucacugcugcuc

SEQ ID NO: 1838545 - RNA, 12 nt, Homo sapiens
uaagacugaugu

SEQ ID NO: 1838546 - RNA, 19 nt, Homo sapiens
caaggcuucagugagccau

SEQ ID NO: 1838547 - RNA, 12 nt, Homo sapiens
ugugugauuucc

SEQ ID NO: 1838548 - RNA, 24 nt, Homo sapiens
uuacuucucacuaauuuguaggaa

SEQ ID NO: 1838549 - RNA, 20 nt, Homo sapiens
agcgcuaaacguuggugacg

SEQ ID NO: 1838550 - RNA, 19 nt, Homo sapiens
acugugagcucccaggugc

SEQ ID NO: 1838551 - RNA, 14 nt, Homo sapiens
uauaauauacuaaa

SEQ ID NO: 1838552 - RNA, 21 nt, Homo sapiens
ucaguauuaaauuagauaucu

SEQ ID NO: 1838553 - RNA, 21 nt, Homo sapiens
acaugauggagcgcaccugcc

SEQ ID NO: 1838554 - RNA, 18 nt, Homo sapiens
acucuauaagauuccaaa

SEQ ID NO: 1838555 - RNA, 18 nt, Homo sapiens
cccaucccugccugguca

SEQ ID NO: 1838556 - RNA, 19 nt, Homo sapiens
ccagaauguugcuuucuga

SEQ ID NO: 1838557 - RNA, 14 nt, Homo sapiens
ggaagggacacaca

SEQ ID NO: 1838558 - RNA, 14 nt, Homo sapiens
gugauuaguaugcu

SEQ ID NO: 1838559 - RNA, 21 nt, Homo sapiens
gaauauuaugcccaguuucug

SEQ ID NO: 1838560 - RNA, 21 nt, Homo sapiens
cagagcugaagaacuuggcac

SEQ ID NO: 1838561 - RNA, 20 nt, Homo sapiens
aauaaguaucacacuguaua

SEQ ID NO: 1838562 - RNA, 13 nt, Homo sapiens
gcuuuuccucacc

SEQ ID NO: 1838563 - RNA, 21 nt, Homo sapiens
cauuacauguuguaagcaugg

SEQ ID NO: 1838564 - RNA, 16 nt, Homo sapiens
ccauggugacauugug

SEQ ID NO: 1838565 - RNA, 16 nt, Homo sapiens
cuggggaaauggugaa

SEQ ID NO: 1838566 - RNA, 12 nt, Homo sapiens
uuuaaagacaga

SEQ ID NO: 1838567 - RNA, 20 nt, Homo sapiens
cucuggagcaauguugcuua

SEQ ID NO: 1838568 - RNA, 15 nt, Homo sapiens
cagaauggcauuugc

SEQ ID NO: 1838569 - RNA, 18 nt, Homo sapiens
ccauccagagaccaaaua

SEQ ID NO: 1838570 - RNA, 16 nt, Homo sapiens
uguuaaccuaggcagu

SEQ ID NO: 1838571 - RNA, 17 nt, Homo sapiens
uaauuacucuuugaaca

SEQ ID NO: 1838572 - RNA, 13 nt, Homo sapiens
cauaccaaagcug

SEQ ID NO: 1838573 - RNA, 15 nt, Homo sapiens
ucaaaaguaaugccu

SEQ ID NO: 1838574 - RNA, 19 nt, Homo sapiens
gaucacuaaauaagcuucc

SEQ ID NO: 1838575 - RNA, 13 nt, Homo sapiens
ccuagacuuccca

SEQ ID NO: 1838576 - RNA, 14 nt, Homo sapiens
agccagacaacuuc

SEQ ID NO: 1838577 - RNA, 15 nt, Homo sapiens
aagaaauuugaugaa

SEQ ID NO: 1838578 - RNA, 18 nt, Homo sapiens
gauacuguaacacuuuac

SEQ ID NO: 1838579 - RNA, 23 nt, Homo sapiens
ugcuuucuucauguucagucaca

SEQ ID NO: 1838580 - RNA, 14 nt, Homo sapiens
ccuugcuuccugau

SEQ ID NO: 1838581 - RNA, 18 nt, Homo sapiens
aaccauugcugacuuuag

SEQ ID NO: 1838582 - RNA, 16 nt, Homo sapiens
auaggaugguaccaag

SEQ ID NO: 1838583 - RNA, 20 nt, Homo sapiens
ugcuggccaaauagcaaaga

SEQ ID NO: 1838584 - RNA, 20 nt, Homo sapiens
cauauuuaauaaagcacaaa

SEQ ID NO: 1838585 - RNA, 12 nt, Homo sapiens
gcucucagcuca

SEQ ID NO: 1838586 - RNA, 23 nt, Homo sapiens
cugcacugaggcagcgaccucaa

SEQ ID NO: 1838587 - RNA, 17 nt, Homo sapiens
cauaaaaauaaccaaaa

SEQ ID NO: 1838588 - RNA, 12 nt, Homo sapiens
caguaugcacaa

SEQ ID NO: 1838589 - RNA, 22 nt, Homo sapiens
auccucugagugugaccaggca

SEQ ID NO: 1838590 - RNA, 21 nt, Homo sapiens
uugguugguagauauucagga

SEQ ID NO: 1838591 - RNA, 16 nt, Homo sapiens
agucuucccagcaauu

SEQ ID NO: 1838592 - RNA, 23 nt, Homo sapiens
caguccccguggccaucccugug

SEQ ID NO: 1838593 - RNA, 11 nt, Homo sapiens
uggacacagau

SEQ ID NO: 1838594 - RNA, 21 nt, Homo sapiens
acacuagcuaaggaagggaaa

SEQ ID NO: 1838595 - RNA, 18 nt, Homo sapiens
accuuucagaacucacau

SEQ ID NO: 1838596 - RNA, 16 nt, Homo sapiens
auuguguguuaauguc

SEQ ID NO: 1838597 - RNA, 17 nt, Homo sapiens
ccaguagagagugcccu

SEQ ID NO: 1838598 - RNA, 17 nt, Homo sapiens
caugaacggcaauaugg

SEQ ID NO: 1838599 - RNA, 13 nt, Homo sapiens
acguauucauuca

SEQ ID NO: 1838600 - RNA, 18 nt, Homo sapiens
auguucauuaaguucuga

SEQ ID NO: 1838601 - RNA, 21 nt, Homo sapiens
gucauccauauuugcuaagaa

SEQ ID NO: 1838602 - RNA, 18 nt, Homo sapiens
cuuuaauuuuacauuucc

SEQ ID NO: 1838603 - RNA, 23 nt, Homo sapiens
uucgcgcgccuccgcuacuucca

SEQ ID NO: 1838604 - RNA, 21 nt, Homo sapiens
gaugcauuccugagucuucca

SEQ ID NO: 1838605 - RNA, 19 nt, Homo sapiens
gcaaguguguaugugcgug

SEQ ID NO: 1838606 - RNA, 21 nt, Homo sapiens
auauuauauaggauauugcua

SEQ ID NO: 1838607 - RNA, 20 nt, Homo sapiens
ccaaggagaaaggcaugaau

SEQ ID NO: 1838608 - RNA, 14 nt, Homo sapiens
uaaagucaaaucaa

SEQ ID NO: 1838609 - RNA, 15 nt, Homo sapiens
aaggcucauuuacuu

SEQ ID NO: 1838610 - RNA, 17 nt, Homo sapiens
cccuauucugccauggg

SEQ ID NO: 1838611 - RNA, 22 nt, Homo sapiens
uagccuaaaagacaauuuuccu

SEQ ID NO: 1838612 - RNA, 19 nt, Homo sapiens
gcauuuucuucucugcacu

SEQ ID NO: 1838613 - RNA, 15 nt, Homo sapiens
gagugaucucaccaa

SEQ ID NO: 1838614 - RNA, 23 nt, Homo sapiens
cacccccgcuuugguucuucaga

SEQ ID NO: 1838615 - RNA, 22 nt, Homo sapiens
gccauuuggccaggcuggucuu

SEQ ID NO: 1838616 - RNA, 15 nt, Homo sapiens
accacauaacauaaa

SEQ ID NO: 1838617 - RNA, 20 nt, Homo sapiens
uaucaaaacaaguacugguu

SEQ ID NO: 1838618 - RNA, 15 nt, Homo sapiens
augcacgaucucagu

SEQ ID NO: 1838619 - RNA, 20 nt, Homo sapiens
cauccuaugcuuaauaaaag

SEQ ID NO: 1838620 - RNA, 14 nt, Homo sapiens
aguggacuauaaua

SEQ ID NO: 1838621 - RNA, 21 nt, Homo sapiens
gauuuuaagcaaaagcaucca

SEQ ID NO: 1838622 - RNA, 15 nt, Homo sapiens
auccuaagacacaaa

SEQ ID NO: 1838623 - RNA, 20 nt, Homo sapiens
cuccaccucaccuccaugac

SEQ ID NO: 1838624 - RNA, 15 nt, Homo sapiens
gcauuauggucuaau

SEQ ID NO: 1838625 - RNA, 14 nt, Homo sapiens
uuuauagagugucu

SEQ ID NO: 1838626 - RNA, 21 nt, Homo sapiens
aaaaaacauuuguacauuccu

SEQ ID NO: 1838627 - RNA, 20 nt, Homo sapiens
ccuuuuugucaccucaauau

SEQ ID NO: 1838628 - RNA, 18 nt, Homo sapiens
cagggcugggucaggggu

SEQ ID NO: 1838629 - RNA, 20 nt, Homo sapiens
agugaaaaaagucaccugcc

SEQ ID NO: 1838630 - RNA, 12 nt, Homo sapiens
aaauugcugcug

SEQ ID NO: 1838631 - RNA, 18 nt, Homo sapiens
ggaagaagauagauccaa

SEQ ID NO: 1838632 - RNA, 22 nt, Homo sapiens
cugagauugcgccacugcacuc

SEQ ID NO: 1838633 - RNA, 21 nt, Homo sapiens
augacaaggagcacaagaagu

SEQ ID NO: 1838634 - RNA, 23 nt, Homo sapiens
auugugucuuuugcaugaugauc

SEQ ID NO: 1838635 - RNA, 13 nt, Homo sapiens
uuccuucaucucc

SEQ ID NO: 1838636 - RNA, 13 nt, Homo sapiens
uggaacagcccau

SEQ ID NO: 1838637 - RNA, 21 nt, Homo sapiens
auccucagguaguacugggaa

SEQ ID NO: 1838638 - RNA, 23 nt, Homo sapiens
ugauuuagugaauggcauuugcu

SEQ ID NO: 1838639 - RNA, 15 nt, Homo sapiens
caaugcuaagcuguu

SEQ ID NO: 1838640 - RNA, 19 nt, Homo sapiens
acauaugauuucacuagaa

SEQ ID NO: 1838641 - RNA, 17 nt, Homo sapiens
aauuaauuuucuaugaa

SEQ ID NO: 1838642 - RNA, 19 nt, Homo sapiens
agaaacugggcagcccuga

SEQ ID NO: 1838643 - RNA, 14 nt, Homo sapiens
auucugucuuccag

SEQ ID NO: 1838644 - RNA, 12 nt, Homo sapiens
acccacccagga

SEQ ID NO: 1838645 - RNA, 20 nt, Homo sapiens
cuuccugugauccacccaac

SEQ ID NO: 1838646 - RNA, 17 nt, Homo sapiens
accagagcaaaguguaa

SEQ ID NO: 1838647 - RNA, 24 nt, Homo sapiens
cgugaguguccguugacgugacca

SEQ ID NO: 1838648 - RNA, 12 nt, Homo sapiens
cucccucggggg

SEQ ID NO: 1838649 - RNA, 17 nt, Homo sapiens
cuugaaaaagacauuca

SEQ ID NO: 1838650 - RNA, 17 nt, Homo sapiens
gucaguucuaaccuccu

SEQ ID NO: 1838651 - RNA, 15 nt, Homo sapiens
aaauuggauacugcu

SEQ ID NO: 1838652 - RNA, 16 nt, Homo sapiens
ucagggcgcacagcau

SEQ ID NO: 1838653 - RNA, 13 nt, Homo sapiens
guccagcacagaa

SEQ ID NO: 1838654 - RNA, 20 nt, Homo sapiens
cgaucucagcucacugcaag

SEQ ID NO: 1838655 - RNA, 22 nt, Homo sapiens
aggcacgugaucaguguugcaa

SEQ ID NO: 1838656 - RNA, 20 nt, Homo sapiens
gcagcccuaaggaucucuca

SEQ ID NO: 1838657 - RNA, 14 nt, Homo sapiens
ugguaaaaacugca

SEQ ID NO: 1838658 - RNA, 22 nt, Homo sapiens
uagccauuucuccaugggccac

SEQ ID NO: 1838659 - RNA, 16 nt, Homo sapiens
aauguaauuuugaacu

SEQ ID NO: 1838660 - RNA, 16 nt, Homo sapiens
aauuuuaauuuuauca

SEQ ID NO: 1838661 - RNA, 16 nt, Homo sapiens
caguggcaugauguca

SEQ ID NO: 1838662 - RNA, 24 nt, Homo sapiens
gaauuauucagugaauuuguccau

SEQ ID NO: 1838663 - RNA, 13 nt, Homo sapiens
gaccucccaaagu

SEQ ID NO: 1838664 - RNA, 14 nt, Homo sapiens
acuagaucuccuau

SEQ ID NO: 1838665 - RNA, 15 nt, Homo sapiens
caggacuuccaucug

SEQ ID NO: 1838666 - RNA, 20 nt, Homo sapiens
ccuacuucggucuggccgcu

SEQ ID NO: 1838667 - RNA, 23 nt, Homo sapiens
ugcugauucaauaaaaugcacug

SEQ ID NO: 1838668 - RNA, 17 nt, Homo sapiens
uucccaaguaugccuua

SEQ ID NO: 1838669 - RNA, 15 nt, Homo sapiens
caagugauccuccca

SEQ ID NO: 1838670 - RNA, 22 nt, Homo sapiens
guaugagaaaccuauauuucaa

SEQ ID NO: 1838671 - RNA, 13 nt, Homo sapiens
uacccaaacccua

SEQ ID NO: 1838672 - RNA, 13 nt, Homo sapiens
ucuccaaacauua

SEQ ID NO: 1838673 - RNA, 16 nt, Homo sapiens
cuuuaaccauggugcu

SEQ ID NO: 1838674 - RNA, 17 nt, Homo sapiens
ccuauauguagcuuuau

SEQ ID NO: 1838675 - RNA, 13 nt, Homo sapiens
gaauaaagugaau

SEQ ID NO: 1838676 - RNA, 22 nt, Homo sapiens
auguauuuuccugcauaaucau

SEQ ID NO: 1838677 - RNA, 14 nt, Homo sapiens
agcugucuccagga

SEQ ID NO: 1838678 - RNA, 20 nt, Homo sapiens
agcacggcugugggugguga

SEQ ID NO: 1838679 - RNA, 22 nt, Homo sapiens
gggccuccagagaccccaggaa

SEQ ID NO: 1838680 - RNA, 14 nt, Homo sapiens
cagcucuucugacu

SEQ ID NO: 1838681 - RNA, 17 nt, Homo sapiens
cucuucacuuggccagu

SEQ ID NO: 1838682 - RNA, 22 nt, Homo sapiens
ggaaacugaucauuaaagccug

SEQ ID NO: 1838683 - RNA, 17 nt, Homo sapiens
cuaaagacaauucauuc

SEQ ID NO: 1838684 - RNA, 16 nt, Homo sapiens
ccuaagggggacacau

SEQ ID NO: 1838685 - RNA, 22 nt, Homo sapiens
uccagacccugccugagcccag

SEQ ID NO: 1838686 - RNA, 15 nt, Homo sapiens
caacaacgcggccac

SEQ ID NO: 1838687 - RNA, 22 nt, Homo sapiens
caaacuccuauuucaaugaguu

SEQ ID NO: 1838688 - RNA, 14 nt, Homo sapiens
guuuccugauuuuu

SEQ ID NO: 1838689 - RNA, 15 nt, Homo sapiens
gcaaaccuuccuggg

SEQ ID NO: 1838690 - RNA, 14 nt, Homo sapiens
gaaggaaaaugaua

SEQ ID NO: 1838691 - RNA, 13 nt, Homo sapiens
aaguagaggaauc

SEQ ID NO: 1838692 - RNA, 15 nt, Homo sapiens
agugaaucaccugug

SEQ ID NO: 1838693 - RNA, 22 nt, Homo sapiens
acuugaaaccugggcauggugg

SEQ ID NO: 1838694 - RNA, 17 nt, Homo sapiens
ccucaauuuucacugug

SEQ ID NO: 1838695 - RNA, 14 nt, Homo sapiens
cggccgcucgccca

SEQ ID NO: 1838696 - RNA, 17 nt, Homo sapiens
gccagccucagugccac

SEQ ID NO: 1838697 - RNA, 19 nt, Homo sapiens
ccuugauuacuuccacuga

SEQ ID NO: 1838698 - RNA, 18 nt, Homo sapiens
aaguaauaugcucucauu

SEQ ID NO: 1838699 - RNA, 13 nt, Homo sapiens
gagauuuaccugu

SEQ ID NO: 1838700 - RNA, 13 nt, Homo sapiens
uggcccuaaagga

SEQ ID NO: 1838701 - RNA, 13 nt, Homo sapiens
cauuugcaccuac

SEQ ID NO: 1838702 - RNA, 18 nt, Homo sapiens
gagacaggguuucaccau

SEQ ID NO: 1838703 - RNA, 15 nt, Homo sapiens
cacagaaacuugaac

SEQ ID NO: 1838704 - RNA, 18 nt, Homo sapiens
ggguccucuggggccuuc

SEQ ID NO: 1838705 - RNA, 12 nt, Homo sapiens
ccccugaccuca

SEQ ID NO: 1838706 - RNA, 18 nt, Homo sapiens
cuuuaaugauaacuaaaa

SEQ ID NO: 1838707 - RNA, 12 nt, Homo sapiens
aagcuccugaau

SEQ ID NO: 1838708 - RNA, 20 nt, Homo sapiens
gaagauggcauccugugaag

SEQ ID NO: 1838709 - RNA, 22 nt, Homo sapiens
cuuuccuuguuccccaucaucu

SEQ ID NO: 1838710 - RNA, 19 nt, Homo sapiens
ucacuuguuucuacucaaa

SEQ ID NO: 1838711 - RNA, 17 nt, Homo sapiens
agcaucucuucuucccu

SEQ ID NO: 1838712 - RNA, 19 nt, Homo sapiens
augcauguuuguuguauac

SEQ ID NO: 1838713 - RNA, 21 nt, Homo sapiens
cuaauuaaucuggaauaugca

SEQ ID NO: 1838714 - RNA, 16 nt, Homo sapiens
acucugucacccaggc

SEQ ID NO: 1838715 - RNA, 15 nt, Homo sapiens
aacucugcacuccau

SEQ ID NO: 1838716 - RNA, 12 nt, Homo sapiens
uccaaggcagug

SEQ ID NO: 1838717 - RNA, 22 nt, Homo sapiens
aaaguacuucaggcacgcugcc

SEQ ID NO: 1838718 - RNA, 22 nt, Homo sapiens
agccugguuugcaaagaccacc

SEQ ID NO: 1838719 - RNA, 21 nt, Homo sapiens
ccacagccccuggcacugcag

SEQ ID NO: 1838720 - RNA, 16 nt, Homo sapiens
gacugacccccaucug

SEQ ID NO: 1838721 - RNA, 18 nt, Homo sapiens
uauaaaugagcaaauauc

SEQ ID NO: 1838722 - RNA, 22 nt, Homo sapiens
guuuuuuuucagccacuaagaa

SEQ ID NO: 1838723 - RNA, 19 nt, Homo sapiens
gcauauuaagcacuuuaag

SEQ ID NO: 1838724 - RNA, 14 nt, Homo sapiens
gugaagccucugag

SEQ ID NO: 1838725 - RNA, 20 nt, Homo sapiens
aggaaaaacaugagcauccc

SEQ ID NO: 1838726 - RNA, 15 nt, Homo sapiens
cccccaccucaagug

SEQ ID NO: 1838727 - RNA, 17 nt, Homo sapiens
augagcacccauuccaa

SEQ ID NO: 1838728 - RNA, 18 nt, Homo sapiens
aaggcuggggccagugua

SEQ ID NO: 1838729 - RNA, 16 nt, Homo sapiens
auuuacagugccugua

SEQ ID NO: 1838730 - RNA, 15 nt, Homo sapiens
uuaaaaugagcauug

SEQ ID NO: 1838731 - RNA, 13 nt, Homo sapiens
cuugcccuauuau

SEQ ID NO: 1838732 - RNA, 16 nt, Homo sapiens
ucugccugaacacugc

SEQ ID NO: 1838733 - RNA, 22 nt, Homo sapiens
aagaccagucacagccauuuca

SEQ ID NO: 1838734 - RNA, 14 nt, Homo sapiens
cuugcaagauucca

SEQ ID NO: 1838735 - RNA, 19 nt, Homo sapiens
uccuucaugcuuuucucau

SEQ ID NO: 1838736 - RNA, 21 nt, Homo sapiens
ugcagauuuucuuaaggaauu

SEQ ID NO: 1838737 - RNA, 21 nt, Homo sapiens
ucagucaauaaauuugcaaau

SEQ ID NO: 1838738 - RNA, 16 nt, Homo sapiens
auuccagaaugaucau

SEQ ID NO: 1838739 - RNA, 18 nt, Homo sapiens
aaugcagcucaucacuug

SEQ ID NO: 1838740 - RNA, 15 nt, Homo sapiens
ccauugcuguuguug

SEQ ID NO: 1838741 - RNA, 15 nt, Homo sapiens
agcccccagcuggaa

SEQ ID NO: 1838742 - RNA, 20 nt, Homo sapiens
acuucuucucauacuauuua

SEQ ID NO: 1838743 - RNA, 15 nt, Homo sapiens
ccucugucacugcag

SEQ ID NO: 1838744 - RNA, 17 nt, Homo sapiens
ccuggcccagugcaauc

SEQ ID NO: 1838745 - RNA, 14 nt, Homo sapiens
aacguaaauacaca

SEQ ID NO: 1838746 - RNA, 21 nt, Homo sapiens
ucuauauccauaaccucuaua

SEQ ID NO: 1838747 - RNA, 15 nt, Homo sapiens
acaaagaccuaccua

SEQ ID NO: 1838748 - RNA, 20 nt, Homo sapiens
cuugcucaaccauggcugaa

SEQ ID NO: 1838749 - RNA, 18 nt, Homo sapiens
gaaaauaccuuagcuuca

SEQ ID NO: 1838750 - RNA, 18 nt, Homo sapiens
guuuauucauaugcauau

SEQ ID NO: 1838751 - RNA, 14 nt, Homo sapiens
ggacucaagggaaa

SEQ ID NO: 1838752 - RNA, 18 nt, Homo sapiens
cucuguggccacauuuuc

SEQ ID NO: 1838753 - RNA, 19 nt, Homo sapiens
caucacgugugauugacau

SEQ ID NO: 1838754 - RNA, 20 nt, Homo sapiens
uacugccauuucagugagaa

SEQ ID NO: 1838755 - RNA, 23 nt, Homo sapiens
uaauuccacacccucacugcugu

SEQ ID NO: 1838756 - RNA, 16 nt, Homo sapiens
ucaauuacaacaguga

SEQ ID NO: 1838757 - RNA, 19 nt, Homo sapiens
ggaugcagccucacagucc

SEQ ID NO: 1838758 - RNA, 19 nt, Homo sapiens
ucagggguuaagagcucag

SEQ ID NO: 1838759 - RNA, 15 nt, Homo sapiens
accugcccugccuga

SEQ ID NO: 1838760 - RNA, 19 nt, Homo sapiens
uggcguaucaucguacaca

SEQ ID NO: 1838761 - RNA, 12 nt, Homo sapiens
acagcaguagca

SEQ ID NO: 1838762 - RNA, 17 nt, Homo sapiens
uucugccuucucaggaa

SEQ ID NO: 1838763 - RNA, 12 nt, Homo sapiens
augcgugcauug

SEQ ID NO: 1838764 - RNA, 14 nt, Homo sapiens
ugcagagacagcug

SEQ ID NO: 1838765 - RNA, 23 nt, Homo sapiens
cugccuggggcccaaguugcagu

SEQ ID NO: 1838766 - RNA, 19 nt, Homo sapiens
agggcggugaacucuggcu

SEQ ID NO: 1838767 - RNA, 19 nt, Homo sapiens
ccugucaucaucauggcca

SEQ ID NO: 1838768 - RNA, 20 nt, Homo sapiens
agaugugagccaccgugccu

SEQ ID NO: 1838769 - RNA, 14 nt, Homo sapiens
ccauccaucuuucc

SEQ ID NO: 1838770 - RNA, 15 nt, Homo sapiens
ucugaaucagaaaag

SEQ ID NO: 1838771 - RNA, 14 nt, Homo sapiens
augaugcacaguau

SEQ ID NO: 1838772 - RNA, 22 nt, Homo sapiens
cuagauaauuucaagaaacuga

SEQ ID NO: 1838773 - RNA, 18 nt, Homo sapiens
auaauagcguucagcagc

SEQ ID NO: 1838774 - RNA, 22 nt, Homo sapiens
uaaaaaguguuuaaaugucaaa

SEQ ID NO: 1838775 - RNA, 20 nt, Homo sapiens
ucuuagccccagacucuuca

SEQ ID NO: 1838776 - RNA, 14 nt, Homo sapiens
cuucuggugugaua

SEQ ID NO: 1838777 - RNA, 14 nt, Homo sapiens
auccagaaggggag

SEQ ID NO: 1838778 - RNA, 16 nt, Homo sapiens
ucuugaguuuagugau

SEQ ID NO: 1838779 - RNA, 19 nt, Homo sapiens
ccacaucugugucucugga

SEQ ID NO: 1838780 - RNA, 15 nt, Homo sapiens
guugccacacuuuca

SEQ ID NO: 1838781 - RNA, 22 nt, Homo sapiens
gcaugcccuauggccuaugugc

SEQ ID NO: 1838782 - RNA, 15 nt, Homo sapiens
agaacuaaagcugga

SEQ ID NO: 1838783 - RNA, 14 nt, Homo sapiens
cuguuccugcagua

SEQ ID NO: 1838784 - RNA, 12 nt, Homo sapiens
cuguccacgugg

SEQ ID NO: 1838785 - RNA, 23 nt, Homo sapiens
uaugcccacauuuagucucuuua

SEQ ID NO: 1838786 - RNA, 22 nt, Homo sapiens
acugcagacgggaaugccuagg

SEQ ID NO: 1838787 - RNA, 20 nt, Homo sapiens
cuggcuuuggguagugccau

SEQ ID NO: 1838788 - RNA, 19 nt, Homo sapiens
gcugacaaagaugaccugc

SEQ ID NO: 1838789 - RNA, 16 nt, Homo sapiens
gaaaauaaaauuuaac

SEQ ID NO: 1838790 - RNA, 15 nt, Homo sapiens
ugccucucaucuuua

SEQ ID NO: 1838791 - RNA, 19 nt, Homo sapiens
aacaucucaacaaccugaa

SEQ ID NO: 1838792 - RNA, 15 nt, Homo sapiens
uauuuccauagucaa

SEQ ID NO: 1838793 - RNA, 15 nt, Homo sapiens
uacuaauuagcuuca

SEQ ID NO: 1838794 - RNA, 13 nt, Homo sapiens
cagcccuccccau

SEQ ID NO: 1838795 - RNA, 13 nt, Homo sapiens
agggcgagcacuu

SEQ ID NO: 1838796 - RNA, 19 nt, Homo sapiens
uuacauuacugauuuccag

SEQ ID NO: 1838797 - RNA, 20 nt, Homo sapiens
acccccagguggaaggcaga

SEQ ID NO: 1838798 - RNA, 16 nt, Homo sapiens
acaaacagcccuuccu

SEQ ID NO: 1838799 - RNA, 19 nt, Homo sapiens
aaagacauuuauauggguu

SEQ ID NO: 1838800 - RNA, 15 nt, Homo sapiens
cugaaauaaacacug

SEQ ID NO: 1838801 - RNA, 19 nt, Homo sapiens
gcccagggccacucugccu

SEQ ID NO: 1838802 - RNA, 17 nt, Homo sapiens
aauauuagcauugccaa

SEQ ID NO: 1838803 - RNA, 20 nt, Homo sapiens
agacagauaccuccaacccu

SEQ ID NO: 1838804 - RNA, 14 nt, Homo sapiens
aguagagacagggu

SEQ ID NO: 1838805 - RNA, 15 nt, Homo sapiens
ggugcagaggugagc

SEQ ID NO: 1838806 - RNA, 14 nt, Homo sapiens
guacuauaauguga

SEQ ID NO: 1838807 - RNA, 23 nt, Homo sapiens
acauuguguucccauuucagcug

SEQ ID NO: 1838808 - RNA, 21 nt, Homo sapiens
uuuggggaaaggcuuggcaca

SEQ ID NO: 1838809 - RNA, 18 nt, Homo sapiens
cuugaauuaguauuucag

SEQ ID NO: 1838810 - RNA, 21 nt, Homo sapiens
uguaaugaaaaugaauaucua

SEQ ID NO: 1838811 - RNA, 23 nt, Homo sapiens
caaauguccgauccccgaccuuc

SEQ ID NO: 1838812 - RNA, 14 nt, Homo sapiens
gacaaggugcuaac

SEQ ID NO: 1838813 - RNA, 15 nt, Homo sapiens
acaggacauucucau

SEQ ID NO: 1838814 - RNA, 16 nt, Homo sapiens
cucugggcucugagua

SEQ ID NO: 1838815 - RNA, 18 nt, Homo sapiens
aaaaauaauaaccauggc

SEQ ID NO: 1838816 - RNA, 18 nt, Homo sapiens
accuacagggaacuggga

SEQ ID NO: 1838817 - RNA, 20 nt, Homo sapiens
gcugaguccagagcuugugc

SEQ ID NO: 1838818 - RNA, 18 nt, Homo sapiens
auguuuuuaauucuagua

SEQ ID NO: 1838819 - RNA, 12 nt, Homo sapiens
caugagccuuug

SEQ ID NO: 1838820 - RNA, 17 nt, Homo sapiens
caauucauaauauguuc

SEQ ID NO: 1838821 - RNA, 15 nt, Homo sapiens
uuuaagccuugacac

SEQ ID NO: 1838822 - RNA, 16 nt, Homo sapiens
cugggaaaacagagga

SEQ ID NO: 1838823 - RNA, 22 nt, Homo sapiens
ccucaccuggucgccaauccau

SEQ ID NO: 1838824 - RNA, 16 nt, Homo sapiens
caaauuuucuggugcu

SEQ ID NO: 1838825 - RNA, 20 nt, Homo sapiens
gucacagccauacagcuguc

SEQ ID NO: 1838826 - RNA, 14 nt, Homo sapiens
gaauugaaacacuu

SEQ ID NO: 1838827 - RNA, 17 nt, Homo sapiens
gaguuuagggucaagga

SEQ ID NO: 1838828 - RNA, 19 nt, Homo sapiens
cccuuuuggggaucaccuc

SEQ ID NO: 1838829 - RNA, 21 nt, Homo sapiens
caauucauggauaugagggug

SEQ ID NO: 1838830 - RNA, 23 nt, Homo sapiens
acuuucaauugcuucugugcaau

SEQ ID NO: 1838831 - RNA, 22 nt, Homo sapiens
agaguauccacuguuuauucaa

SEQ ID NO: 1838832 - RNA, 17 nt, Homo sapiens
aucacacacaugcacac

SEQ ID NO: 1838833 - RNA, 17 nt, Homo sapiens
gacauaaauagagcaac

SEQ ID NO: 1838834 - RNA, 11 nt, Homo sapiens
agacuucccag

SEQ ID NO: 1838835 - RNA, 22 nt, Homo sapiens
caucuauaaagaagaacuugca

SEQ ID NO: 1838836 - RNA, 17 nt, Homo sapiens
augugaguguguggcac

SEQ ID NO: 1838837 - RNA, 20 nt, Homo sapiens
cucaagugagccaagaaaca

SEQ ID NO: 1838838 - RNA, 19 nt, Homo sapiens
agugaaagaagccacagcu

SEQ ID NO: 1838839 - RNA, 17 nt, Homo sapiens
aacacaccgaugcacac

SEQ ID NO: 1838840 - RNA, 15 nt, Homo sapiens
cugggagagucucac

SEQ ID NO: 1838841 - RNA, 15 nt, Homo sapiens
aggcuuuuccagugu

SEQ ID NO: 1838842 - RNA, 21 nt, Homo sapiens
aggaauauuugcaagacauag

SEQ ID NO: 1838843 - RNA, 15 nt, Homo sapiens
aggcggcuccagguc

SEQ ID NO: 1838844 - RNA, 18 nt, Homo sapiens
agcuguacuagugccauu

SEQ ID NO: 1838845 - RNA, 14 nt, Homo sapiens
gcgcuccaugccuc

SEQ ID NO: 1838846 - RNA, 22 nt, Homo sapiens
uaaaagguaccuuugucugcca

SEQ ID NO: 1838847 - RNA, 14 nt, Homo sapiens
cauauguugcaaga

SEQ ID NO: 1838848 - RNA, 14 nt, Homo sapiens
ggacacuccagugc

SEQ ID NO: 1838849 - RNA, 15 nt, Homo sapiens
gaaaacagaaaccau

SEQ ID NO: 1838850 - RNA, 23 nt, Homo sapiens
cuuuuauuuuacacagaaacacu

SEQ ID NO: 1838851 - RNA, 17 nt, Homo sapiens
gcccacaccgcagggac

SEQ ID NO: 1838852 - RNA, 21 nt, Homo sapiens
ugccuggggccucaccugcug

SEQ ID NO: 1838853 - RNA, 20 nt, Homo sapiens
acuuugccaucugaugucgu

SEQ ID NO: 1838854 - RNA, 12 nt, Homo sapiens
aagcaagcuccc

SEQ ID NO: 1838855 - RNA, 18 nt, Homo sapiens
ugcccugguagggcagua

SEQ ID NO: 1838856 - RNA, 17 nt, Homo sapiens
cacagcaugaaccuuua

SEQ ID NO: 1838857 - RNA, 18 nt, Homo sapiens
acugggcucacauuccca

SEQ ID NO: 1838858 - RNA, 13 nt, Homo sapiens
accuuauccugca

SEQ ID NO: 1838859 - RNA, 20 nt, Homo sapiens
uaacaaaagaaaacuuuauc

SEQ ID NO: 1838860 - RNA, 14 nt, Homo sapiens
uucccagcaguggg

SEQ ID NO: 1838861 - RNA, 21 nt, Homo sapiens
aucucgcccugccuccacuug

SEQ ID NO: 1838862 - RNA, 23 nt, Homo sapiens
agagagauuuuucauuuuuccau

SEQ ID NO: 1838863 - RNA, 18 nt, Homo sapiens
auuuuaaguaaaagucua

SEQ ID NO: 1838864 - RNA, 20 nt, Homo sapiens
gagauaacagccucuugccc

SEQ ID NO: 1838865 - RNA, 16 nt, Homo sapiens
ucccuauaaugcugga

SEQ ID NO: 1838866 - RNA, 18 nt, Homo sapiens
uugacaggcuuauggaag

SEQ ID NO: 1838867 - RNA, 15 nt, Homo sapiens
cuuuuccauccugag

SEQ ID NO: 1838868 - RNA, 16 nt, Homo sapiens
ugcuccgucauuugac

SEQ ID NO: 1838869 - RNA, 22 nt, Homo sapiens
gcugugagaggaucaucugggg

SEQ ID NO: 1838870 - RNA, 20 nt, Homo sapiens
gcucuuccccuagaccuccc

SEQ ID NO: 1838871 - RNA, 22 nt, Homo sapiens
cagcuacgaauauagaggguuu

SEQ ID NO: 1838872 - RNA, 22 nt, Homo sapiens
acauguucauggguuuaccacu

SEQ ID NO: 1838873 - RNA, 15 nt, Homo sapiens
acaugugcacuugaa

SEQ ID NO: 1838874 - RNA, 20 nt, Homo sapiens
uuaggcaggaucuguacaau

SEQ ID NO: 1838875 - RNA, 19 nt, Homo sapiens
gaauuaaaucaucccuuaa

SEQ ID NO: 1838876 - RNA, 16 nt, Homo sapiens
ggauaacacauuugau

SEQ ID NO: 1838877 - RNA, 15 nt, Homo sapiens
auagccaaucaucua

SEQ ID NO: 1838878 - RNA, 19 nt, Homo sapiens
ccuuaccacugcucugaug

SEQ ID NO: 1838879 - RNA, 14 nt, Homo sapiens
gagagauggaauaa

SEQ ID NO: 1838880 - RNA, 15 nt, Homo sapiens
aaauaaaagaacaca

SEQ ID NO: 1838881 - RNA, 16 nt, Homo sapiens
cuauaaacaaauaucg

SEQ ID NO: 1838882 - RNA, 18 nt, Homo sapiens
aaggguggaaaaaugccc

SEQ ID NO: 1838883 - RNA, 17 nt, Homo sapiens
acaagauacaaauaccu

SEQ ID NO: 1838884 - RNA, 11 nt, Homo sapiens
ccaaacccagc

SEQ ID NO: 1838885 - RNA, 16 nt, Homo sapiens
gagccguuacuacaca

SEQ ID NO: 1838886 - RNA, 20 nt, Homo sapiens
cauguaacuauuucuucaga

SEQ ID NO: 1838887 - RNA, 22 nt, Homo sapiens
aacugguacacuucauuuaucc

SEQ ID NO: 1838888 - RNA, 13 nt, Homo sapiens
cuguuucuauucu

SEQ ID NO: 1838889 - RNA, 14 nt, Homo sapiens
ggagucaugccaag

SEQ ID NO: 1838890 - RNA, 19 nt, Homo sapiens
agauauaccuaauguuaaa

SEQ ID NO: 1838891 - RNA, 19 nt, Homo sapiens
cuguggggaucucaggggc

SEQ ID NO: 1838892 - RNA, 17 nt, Homo sapiens
agauagccaaggccaaa

SEQ ID NO: 1838893 - RNA, 17 nt, Homo sapiens
auuaauuugacugugca

SEQ ID NO: 1838894 - RNA, 22 nt, Homo sapiens
gagucaauccccucauucagga

SEQ ID NO: 1838895 - RNA, 20 nt, Homo sapiens
agaaccagagaggcucugag

SEQ ID NO: 1838896 - RNA, 16 nt, Homo sapiens
auaaaacacaucaagu

SEQ ID NO: 1838897 - RNA, 15 nt, Homo sapiens
cccucgcaugacugu

SEQ ID NO: 1838898 - RNA, 14 nt, Homo sapiens
agccacccugccau

SEQ ID NO: 1838899 - RNA, 14 nt, Homo sapiens
ucaaguccacaagc

SEQ ID NO: 1838900 - RNA, 21 nt, Homo sapiens
uguaaacucuaucagcauugu

SEQ ID NO: 1838901 - RNA, 14 nt, Homo sapiens
augcucugugcaga

SEQ ID NO: 1838902 - RNA, 9 nt, Homo sapiens
agagccaau

SEQ ID NO: 1838903 - RNA, 12 nt, Homo sapiens
cccucucacuuu

SEQ ID NO: 1838904 - RNA, 15 nt, Homo sapiens
ucuacagagugagac

SEQ ID NO: 1838905 - RNA, 22 nt, Homo sapiens
guguaggcuuuacuuagcuuau

SEQ ID NO: 1838906 - RNA, 21 nt, Homo sapiens
uguuggcuuucccuuaucaaa

SEQ ID NO: 1838907 - RNA, 16 nt, Homo sapiens
uuuucuccgcauugga

SEQ ID NO: 1838908 - RNA, 18 nt, Homo sapiens
agggaaaaggaguaggga

SEQ ID NO: 1838909 - RNA, 22 nt, Homo sapiens
aaugcaguacauuaauauucau

SEQ ID NO: 1838910 - RNA, 21 nt, Homo sapiens
accuuuuaucaauaaagcacu

SEQ ID NO: 1838911 - RNA, 14 nt, Homo sapiens
aaguauuuuaucuu

SEQ ID NO: 1838912 - RNA, 16 nt, Homo sapiens
cuuucuuaucuggaaa

SEQ ID NO: 1838913 - RNA, 19 nt, Homo sapiens
ugcggaggaaggaggaccc

SEQ ID NO: 1838914 - RNA, 12 nt, Homo sapiens
uuucuguucccu

SEQ ID NO: 1838915 - RNA, 13 nt, Homo sapiens
uugaauacaaaga

SEQ ID NO: 1838916 - RNA, 12 nt, Homo sapiens
acaaauaugcag

SEQ ID NO: 1838917 - RNA, 22 nt, Homo sapiens
aggaaaugaauauucaacagcu

SEQ ID NO: 1838918 - RNA, 11 nt, Homo sapiens
cuguugcuugu

SEQ ID NO: 1838919 - RNA, 14 nt, Homo sapiens
uaacuuuaccaaau

SEQ ID NO: 1838920 - RNA, 15 nt, Homo sapiens
cuccaugagguacug

SEQ ID NO: 1838921 - RNA, 15 nt, Homo sapiens
auuauuguauuacau

SEQ ID NO: 1838922 - RNA, 15 nt, Homo sapiens
ggcauaguggcacuu

SEQ ID NO: 1838923 - RNA, 19 nt, Homo sapiens
aauccuccaggcccuucuc

SEQ ID NO: 1838924 - RNA, 19 nt, Homo sapiens
uuuaaccuaauaucacuua

SEQ ID NO: 1838925 - RNA, 14 nt, Homo sapiens
auucacguuuuucu

SEQ ID NO: 1838926 - RNA, 17 nt, Homo sapiens
ucaaaccaggugcaauu

SEQ ID NO: 1838927 - RNA, 14 nt, Homo sapiens
gcuaccuugugacc

SEQ ID NO: 1838928 - RNA, 16 nt, Homo sapiens
acccacuaccauacag

SEQ ID NO: 1838929 - RNA, 14 nt, Homo sapiens
ugcuccccugccac

SEQ ID NO: 1838930 - RNA, 15 nt, Homo sapiens
caaacagugacugua

SEQ ID NO: 1838931 - RNA, 14 nt, Homo sapiens
auuuaaccauucca

SEQ ID NO: 1838932 - RNA, 18 nt, Homo sapiens
acauaacaggcauugcac

SEQ ID NO: 1838933 - RNA, 18 nt, Homo sapiens
gcuuacauuuuuacaaua

SEQ ID NO: 1838934 - RNA, 16 nt, Homo sapiens
auaaaguaccacacau

SEQ ID NO: 1838935 - RNA, 13 nt, Homo sapiens
gggaguggcgcgc

SEQ ID NO: 1838936 - RNA, 15 nt, Homo sapiens
uaacuagacaucugc

SEQ ID NO: 1838937 - RNA, 16 nt, Homo sapiens
caacugaauaaauuca

SEQ ID NO: 1838938 - RNA, 14 nt, Homo sapiens
caacuuugaauaaa

SEQ ID NO: 1838939 - RNA, 24 nt, Homo sapiens
cccggggggacgacgaugacaaug

SEQ ID NO: 1838940 - RNA, 16 nt, Homo sapiens
auuagauguuuuacaa

SEQ ID NO: 1838941 - RNA, 21 nt, Homo sapiens
aauucccuuuuaacccagugu

SEQ ID NO: 1838942 - RNA, 22 nt, Homo sapiens
agaugagaaaacaggcucacag

SEQ ID NO: 1838943 - RNA, 12 nt, Homo sapiens
gcaaagucuaaa

SEQ ID NO: 1838944 - RNA, 16 nt, Homo sapiens
gaaggacacagugaug

SEQ ID NO: 1838945 - RNA, 19 nt, Homo sapiens
uuugggagggaaaagggaa

SEQ ID NO: 1838946 - RNA, 17 nt, Homo sapiens
gaagagauugagcuacu

SEQ ID NO: 1838947 - RNA, 20 nt, Homo sapiens
guauccugagagcccagaaa

SEQ ID NO: 1838948 - RNA, 14 nt, Homo sapiens
ccuuauuugucugu

SEQ ID NO: 1838949 - RNA, 16 nt, Homo sapiens
cacaaacuauuacuua

SEQ ID NO: 1838950 - RNA, 20 nt, Homo sapiens
ugagguggauuuacugagag

SEQ ID NO: 1838951 - RNA, 19 nt, Homo sapiens
gcaccacuugacagacugu

SEQ ID NO: 1838952 - RNA, 23 nt, Homo sapiens
aucuuccuuuguugcacaaauag

SEQ ID NO: 1838953 - RNA, 21 nt, Homo sapiens
uccaucuguugacaaaugaca

SEQ ID NO: 1838954 - RNA, 15 nt, Homo sapiens
gcuuauuagcagcug

SEQ ID NO: 1838955 - RNA, 16 nt, Homo sapiens
aaaguuauuuguucau

SEQ ID NO: 1838956 - RNA, 16 nt, Homo sapiens
aaauuuuuuuggucuu

SEQ ID NO: 1838957 - RNA, 15 nt, Homo sapiens
ggaaucaacagggca

SEQ ID NO: 1838958 - RNA, 12 nt, Homo sapiens
agccaucaagca

SEQ ID NO: 1838959 - RNA, 12 nt, Homo sapiens
cucagcauuuaa

SEQ ID NO: 1838960 - RNA, 16 nt, Homo sapiens
gcuuugguuaauacau

SEQ ID NO: 1838961 - RNA, 15 nt, Homo sapiens
uaaccaaacauaaca

SEQ ID NO: 1838962 - RNA, 19 nt, Homo sapiens
uuguaaaaagaaaaaccac

SEQ ID NO: 1838963 - RNA, 15 nt, Homo sapiens
guuucaauugaguaa

SEQ ID NO: 1838964 - RNA, 22 nt, Homo sapiens
cacucaguuuaugcugugcuaa

SEQ ID NO: 1838965 - RNA, 12 nt, Homo sapiens
cgucaucaucaa

SEQ ID NO: 1838966 - RNA, 14 nt, Homo sapiens
agcccugucugcua

SEQ ID NO: 1838967 - RNA, 15 nt, Homo sapiens
acugcaucucaaaaa

SEQ ID NO: 1838968 - RNA, 22 nt, Homo sapiens
gcacuccucucgcauggugugg

SEQ ID NO: 1838969 - RNA, 12 nt, Homo sapiens
uugaccacagag

SEQ ID NO: 1838970 - RNA, 15 nt, Homo sapiens
ugugccuacauuuaa

SEQ ID NO: 1838971 - RNA, 15 nt, Homo sapiens
cgggagggcggcaca

SEQ ID NO: 1838972 - RNA, 16 nt, Homo sapiens
uucccauuuuugcuua

SEQ ID NO: 1838973 - RNA, 21 nt, Homo sapiens
cuucgaccacaucagaaagaa

SEQ ID NO: 1838974 - RNA, 20 nt, Homo sapiens
gcuccucgcucgcaccugcc

SEQ ID NO: 1838975 - RNA, 23 nt, Homo sapiens
aaacaggaguucagcggagcuag

SEQ ID NO: 1838976 - RNA, 24 nt, Homo sapiens
cagcauuggugcucacugccagug

SEQ ID NO: 1838977 - RNA, 14 nt, Homo sapiens
aaccaauuucuucc

SEQ ID NO: 1838978 - RNA, 16 nt, Homo sapiens
gcagaaaacaaacaca

SEQ ID NO: 1838979 - RNA, 17 nt, Homo sapiens
guccaccugccuaucca

SEQ ID NO: 1838980 - RNA, 18 nt, Homo sapiens
caggaacauacagacaca

SEQ ID NO: 1838981 - RNA, 18 nt, Homo sapiens
gcaugucgugaccaacua

SEQ ID NO: 1838982 - RNA, 18 nt, Homo sapiens
gcaaaauugauguguuua

SEQ ID NO: 1838983 - RNA, 22 nt, Homo sapiens
agauaagcuuccaggcugcaua

SEQ ID NO: 1838984 - RNA, 19 nt, Homo sapiens
uuaagacuaaaaguugcau

SEQ ID NO: 1838985 - RNA, 22 nt, Homo sapiens
uacucaagcagaucucaucuca

SEQ ID NO: 1838986 - RNA, 15 nt, Homo sapiens
cuggcccacacagau

SEQ ID NO: 1838987 - RNA, 19 nt, Homo sapiens
augugcuauacacacacac

SEQ ID NO: 1838988 - RNA, 15 nt, Homo sapiens
aacgacaaagccaaa

SEQ ID NO: 1838989 - RNA, 18 nt, Homo sapiens
ccuuuuuuaaaaaugcaa

SEQ ID NO: 1838990 - RNA, 22 nt, Homo sapiens
cugugaugacuugccauuaaaa

SEQ ID NO: 1838991 - RNA, 13 nt, Homo sapiens
cuacuggcagcuc

SEQ ID NO: 1838992 - RNA, 21 nt, Homo sapiens
cuuaacacuaccaauuuccca

SEQ ID NO: 1838993 - RNA, 23 nt, Homo sapiens
ugguaaauauauuucaaaacuuc

SEQ ID NO: 1838994 - RNA, 21 nt, Homo sapiens
uucacuagaaaagcugaucau

SEQ ID NO: 1838995 - RNA, 20 nt, Homo sapiens
gaaaccgaagggacuggauc

SEQ ID NO: 1838996 - RNA, 14 nt, Homo sapiens
ggcauuguuuccac

SEQ ID NO: 1838997 - RNA, 21 nt, Homo sapiens
acaccaccacugugucccagu

SEQ ID NO: 1838998 - RNA, 16 nt, Homo sapiens
uguggggcugagcaac

SEQ ID NO: 1838999 - RNA, 22 nt, Homo sapiens
uuccuuuauuuugcugcuugau

SEQ ID NO: 1839000 - RNA, 22 nt, Homo sapiens
cgguguucugucccagugcggu

SEQ ID NO: 1839001 - RNA, 16 nt, Homo sapiens
uauaugcaccccugga

SEQ ID NO: 1839002 - RNA, 21 nt, Homo sapiens
ccugaggacacccaggccacc

SEQ ID NO: 1839003 - RNA, 14 nt, Homo sapiens
auauugacuuguau

SEQ ID NO: 1839004 - RNA, 23 nt, Homo sapiens
gcaggggcgguccagaggaggug

SEQ ID NO: 1839005 - RNA, 23 nt, Homo sapiens
ucauauuaguaaaagaugccaua

SEQ ID NO: 1839006 - RNA, 15 nt, Homo sapiens
cuuaaaucuuuucaa

SEQ ID NO: 1839007 - RNA, 21 nt, Homo sapiens
aaaguuuccccaccagugaau

SEQ ID NO: 1839008 - RNA, 15 nt, Homo sapiens
gccuucugcccuccc

SEQ ID NO: 1839009 - RNA, 21 nt, Homo sapiens
ugaaaacaucuggaaggggau

SEQ ID NO: 1839010 - RNA, 23 nt, Homo sapiens
uucauuacuugauuaagauuuua

SEQ ID NO: 1839011 - RNA, 22 nt, Homo sapiens
ucaguaccccugguaaaccaag

SEQ ID NO: 1839012 - RNA, 15 nt, Homo sapiens
agacagggcccuguc

SEQ ID NO: 1839013 - RNA, 23 nt, Homo sapiens
acaugucuuuggcuucagaauug

SEQ ID NO: 1839014 - RNA, 23 nt, Homo sapiens
uuggggguccuccuccagggaca

SEQ ID NO: 1839015 - RNA, 20 nt, Homo sapiens
acacaugagacuuacugcuc

SEQ ID NO: 1839016 - RNA, 22 nt, Homo sapiens
ggggcccugggucuaugcacag

SEQ ID NO: 1839017 - RNA, 23 nt, Homo sapiens
acuaguugauaacuuuggaguua

SEQ ID NO: 1839018 - RNA, 15 nt, Homo sapiens
accuguaaucucagc

SEQ ID NO: 1839019 - RNA, 17 nt, Homo sapiens
cccaccuccugcaauaa

SEQ ID NO: 1839020 - RNA, 16 nt, Homo sapiens
uuccuaguucuguaga

SEQ ID NO: 1839021 - RNA, 20 nt, Homo sapiens
uugggaccugaaucuaucac

SEQ ID NO: 1839022 - RNA, 16 nt, Homo sapiens
acuuaaugguguaugu

SEQ ID NO: 1839023 - RNA, 19 nt, Homo sapiens
uaguuugaccucacaguga

SEQ ID NO: 1839024 - RNA, 21 nt, Homo sapiens
ccugacggagaggcagaucaa

SEQ ID NO: 1839025 - RNA, 18 nt, Homo sapiens
uuuagaacuugcagcuga

SEQ ID NO: 1839026 - RNA, 13 nt, Homo sapiens
cugcuuaugagca

SEQ ID NO: 1839027 - RNA, 23 nt, Homo sapiens
gcaaaucuguauaaaugugaaau

SEQ ID NO: 1839028 - RNA, 21 nt, Homo sapiens
caccacuuauuuauuguugcc

SEQ ID NO: 1839029 - RNA, 21 nt, Homo sapiens
ucacucuugccaaccuguaau

SEQ ID NO: 1839030 - RNA, 22 nt, Homo sapiens
auugcauaauagauaaaaaccu

SEQ ID NO: 1839031 - RNA, 13 nt, Homo sapiens
agauggggaggag

SEQ ID NO: 1839032 - RNA, 16 nt, Homo sapiens
cucauguauacuucaa

SEQ ID NO: 1839033 - RNA, 15 nt, Homo sapiens
ugugaacacgugugu

SEQ ID NO: 1839034 - RNA, 15 nt, Homo sapiens
cuguugcauuguaau

SEQ ID NO: 1839035 - RNA, 16 nt, Homo sapiens
ucuccagccaaccuca

SEQ ID NO: 1839036 - RNA, 20 nt, Homo sapiens
ucccagcccuugcauugcag

SEQ ID NO: 1839037 - RNA, 16 nt, Homo sapiens
cugcuggcuaagcauu

SEQ ID NO: 1839038 - RNA, 19 nt, Homo sapiens
cuuuuccuuauacuguaua

SEQ ID NO: 1839039 - RNA, 16 nt, Homo sapiens
caccaaccuccagugu

SEQ ID NO: 1839040 - RNA, 20 nt, Homo sapiens
cugcagagcacaaacuucag

SEQ ID NO: 1839041 - RNA, 23 nt, Homo sapiens
aucuccaagcccuucugucuguc

SEQ ID NO: 1839042 - RNA, 20 nt, Homo sapiens
cccacuuguccuuagccugg

SEQ ID NO: 1839043 - RNA, 15 nt, Homo sapiens
uucgugaugacauau

SEQ ID NO: 1839044 - RNA, 23 nt, Homo sapiens
cauauauuuuuauauuuacuaaa

SEQ ID NO: 1839045 - RNA, 15 nt, Homo sapiens
acaaacaucauuguu

SEQ ID NO: 1839046 - RNA, 22 nt, Homo sapiens
cuuaaaacaaauucauuauucu

SEQ ID NO: 1839047 - RNA, 13 nt, Homo sapiens
uugagggaccaau

SEQ ID NO: 1839048 - RNA, 17 nt, Homo sapiens
uuauuuaucaaguguau

SEQ ID NO: 1839049 - RNA, 23 nt, Homo sapiens
ugaaaucuuguuuguuacuguca

SEQ ID NO: 1839050 - RNA, 16 nt, Homo sapiens
agcaaaaagcaaaauc

SEQ ID NO: 1839051 - RNA, 21 nt, Homo sapiens
gaccucccagagagugaauaa

SEQ ID NO: 1839052 - RNA, 19 nt, Homo sapiens
gagcaucacagaaugugau

SEQ ID NO: 1839053 - RNA, 23 nt, Homo sapiens
ugcuguccagggcagaggccaug

SEQ ID NO: 1839054 - RNA, 19 nt, Homo sapiens
ucuugugccaaaccuacua

SEQ ID NO: 1839055 - RNA, 16 nt, Homo sapiens
aagcuguuaggcucac

SEQ ID NO: 1839056 - RNA, 23 nt, Homo sapiens
ucuuucugaaauagucaaauacg

SEQ ID NO: 1839057 - RNA, 17 nt, Homo sapiens
augccacccuguuuuca

SEQ ID NO: 1839058 - RNA, 20 nt, Homo sapiens
auaaaugucuuuaaugcaau

SEQ ID NO: 1839059 - RNA, 13 nt, Homo sapiens
uuucauacauuau

SEQ ID NO: 1839060 - RNA, 13 nt, Homo sapiens
uuaauuacauaca

SEQ ID NO: 1839061 - RNA, 15 nt, Homo sapiens
cugaucagagcuuac

SEQ ID NO: 1839062 - RNA, 22 nt, Homo sapiens
ucgggcccagcuucacccugcg

SEQ ID NO: 1839063 - RNA, 13 nt, Homo sapiens
acuuguucccucu

SEQ ID NO: 1839064 - RNA, 14 nt, Homo sapiens
gucagaugucacau

SEQ ID NO: 1839065 - RNA, 16 nt, Homo sapiens
acaugugauugugauu

SEQ ID NO: 1839066 - RNA, 16 nt, Homo sapiens
augcuauuucacuuga

SEQ ID NO: 1839067 - RNA, 15 nt, Homo sapiens
uguagguaauauugu

SEQ ID NO: 1839068 - RNA, 15 nt, Homo sapiens
auuuuauaugaagau

SEQ ID NO: 1839069 - RNA, 21 nt, Homo sapiens
caagggucaauuguaacuaau

SEQ ID NO: 1839070 - RNA, 18 nt, Homo sapiens
ccccuccugaacuggcca

SEQ ID NO: 1839071 - RNA, 12 nt, Homo sapiens
acugccaaagaa

SEQ ID NO: 1839072 - RNA, 20 nt, Homo sapiens
uccagguggcgugagaggca

SEQ ID NO: 1839073 - RNA, 14 nt, Homo sapiens
acuguguugcccag

SEQ ID NO: 1839074 - RNA, 24 nt, Homo sapiens
uaaaagcggaaaguuagugcuugu

SEQ ID NO: 1839075 - RNA, 19 nt, Homo sapiens
uagaugcauuaguguugaa

SEQ ID NO: 1839076 - RNA, 15 nt, Homo sapiens
ugaggucacagucca

SEQ ID NO: 1839077 - RNA, 21 nt, Homo sapiens
agucgcucucaugaagcccuu

SEQ ID NO: 1839078 - RNA, 20 nt, Homo sapiens
gagauugaauuucacugucu

SEQ ID NO: 1839079 - RNA, 21 nt, Homo sapiens
ggcuugggguagagaggacag

SEQ ID NO: 1839080 - RNA, 21 nt, Homo sapiens
uuuccaagaaucggcauguau

SEQ ID NO: 1839081 - RNA, 16 nt, Homo sapiens
acacagaugugaaaug

SEQ ID NO: 1839082 - RNA, 21 nt, Homo sapiens
cuccuauuuaugaaaaccaua

SEQ ID NO: 1839083 - RNA, 21 nt, Homo sapiens
cugcuuguucaaauacugugu

SEQ ID NO: 1839084 - RNA, 12 nt, Homo sapiens
ucaaugaccugu

SEQ ID NO: 1839085 - RNA, 20 nt, Homo sapiens
aggaggccugggagggcaag

SEQ ID NO: 1839086 - RNA, 16 nt, Homo sapiens
aggcauuuauugccau

SEQ ID NO: 1839087 - RNA, 18 nt, Homo sapiens
augcauuuugcacuagaa

SEQ ID NO: 1839088 - RNA, 21 nt, Homo sapiens
ucuggggccuuuaucaaaaaa

SEQ ID NO: 1839089 - RNA, 14 nt, Homo sapiens
cacugacauuucac

SEQ ID NO: 1839090 - RNA, 15 nt, Homo sapiens
caaagauauuauuua

SEQ ID NO: 1839091 - RNA, 20 nt, Homo sapiens
cugaccagccgugagcaugu

SEQ ID NO: 1839092 - RNA, 23 nt, Homo sapiens
caugugugcgagugugugcaugu

SEQ ID NO: 1839093 - RNA, 23 nt, Homo sapiens
cacaggagcguguacuaccccag

SEQ ID NO: 1839094 - RNA, 21 nt, Homo sapiens
gcaccuaccuuagaaaacaag

SEQ ID NO: 1839095 - RNA, 17 nt, Homo sapiens
ggauuaacccacuagcu

SEQ ID NO: 1839096 - RNA, 14 nt, Homo sapiens
ucauguaauacuga

SEQ ID NO: 1839097 - RNA, 13 nt, Homo sapiens
aauaaacuuucag

SEQ ID NO: 1839098 - RNA, 18 nt, Homo sapiens
aacuugucucuguagaag

SEQ ID NO: 1839099 - RNA, 14 nt, Homo sapiens
augugcaacacuca

SEQ ID NO: 1839100 - RNA, 17 nt, Homo sapiens
gugcauauagaaaacaa

SEQ ID NO: 1839101 - RNA, 11 nt, Homo sapiens
ucuaucuucac

SEQ ID NO: 1839102 - RNA, 17 nt, Homo sapiens
ugggguuggagguuuca

SEQ ID NO: 1839103 - RNA, 23 nt, Homo sapiens
uugaagacuuuucuuucagccaa

SEQ ID NO: 1839104 - RNA, 15 nt, Homo sapiens
aucuccaagaccaga

SEQ ID NO: 1839105 - RNA, 16 nt, Homo sapiens
caagucaccaugcuga

SEQ ID NO: 1839106 - RNA, 14 nt, Homo sapiens
uacauccugcagcu

SEQ ID NO: 1839107 - RNA, 14 nt, Homo sapiens
gaugcagugcccua

SEQ ID NO: 1839108 - RNA, 18 nt, Homo sapiens
augaaaauaaaucaucuu

SEQ ID NO: 1839109 - RNA, 17 nt, Homo sapiens
auuauguacucuacuga

SEQ ID NO: 1839110 - RNA, 14 nt, Homo sapiens
ccaggccaauguca

SEQ ID NO: 1839111 - RNA, 23 nt, Homo sapiens
gagggaagaucuugaugguguuu

SEQ ID NO: 1839112 - RNA, 20 nt, Homo sapiens
ugucuauuuaagugcaauua

SEQ ID NO: 1839113 - RNA, 14 nt, Homo sapiens
acucccagcacuuu

SEQ ID NO: 1839114 - RNA, 14 nt, Homo sapiens
cugcugaagggagg

SEQ ID NO: 1839115 - RNA, 23 nt, Homo sapiens
uuuacccauuaaauuaagacuug

SEQ ID NO: 1839116 - RNA, 12 nt, Homo sapiens
uuuuauauccac

SEQ ID NO: 1839117 - RNA, 16 nt, Homo sapiens
agacaucuagucucag

SEQ ID NO: 1839118 - RNA, 18 nt, Homo sapiens
uuugaucuacuugccuca

SEQ ID NO: 1839119 - RNA, 18 nt, Homo sapiens
agacuaauucuaaugugg

SEQ ID NO: 1839120 - RNA, 23 nt, Homo sapiens
auuugaaaccccuguaggccuca

SEQ ID NO: 1839121 - RNA, 21 nt, Homo sapiens
aacagaaauuguauauuguaa

SEQ ID NO: 1839122 - RNA, 16 nt, Homo sapiens
ucacauuucuaugcca

SEQ ID NO: 1839123 - RNA, 17 nt, Homo sapiens
cugcacuaaaacccauc

SEQ ID NO: 1839124 - RNA, 17 nt, Homo sapiens
gcuccugagugucauga

SEQ ID NO: 1839125 - RNA, 18 nt, Homo sapiens
gagaaguaauuccucuga

SEQ ID NO: 1839126 - RNA, 16 nt, Homo sapiens
cugcauuuacacacac

SEQ ID NO: 1839127 - RNA, 20 nt, Homo sapiens
uacauuguauuaauaccaaa

SEQ ID NO: 1839128 - RNA, 15 nt, Homo sapiens
augaaaguugcagga

SEQ ID NO: 1839129 - RNA, 19 nt, Homo sapiens
ugcucccugguucugauga

SEQ ID NO: 1839130 - RNA, 14 nt, Homo sapiens
cuggcaacugcuaa

SEQ ID NO: 1839131 - RNA, 23 nt, Homo sapiens
ugguccccucucuucguccugau

SEQ ID NO: 1839132 - RNA, 23 nt, Homo sapiens
ugccaucaagaugagagaacugg

SEQ ID NO: 1839133 - RNA, 20 nt, Homo sapiens
uuacuuccgguuucuucaua

SEQ ID NO: 1839134 - RNA, 19 nt, Homo sapiens
uucuggguggccucgggac

SEQ ID NO: 1839135 - RNA, 13 nt, Homo sapiens
ugucccagaguua

SEQ ID NO: 1839136 - RNA, 13 nt, Homo sapiens
agcuccagugcca

SEQ ID NO: 1839137 - RNA, 13 nt, Homo sapiens
aauguacauguau

SEQ ID NO: 1839138 - RNA, 21 nt, Homo sapiens
auccuaauuuagccaggaccu

SEQ ID NO: 1839139 - RNA, 17 nt, Homo sapiens
ucggcucauugaaccuc

SEQ ID NO: 1839140 - RNA, 17 nt, Homo sapiens
uuaaugagucagucaau

SEQ ID NO: 1839141 - RNA, 14 nt, Homo sapiens
cauuguuagcacua

SEQ ID NO: 1839142 - RNA, 15 nt, Homo sapiens
acuguaacugcauua

SEQ ID NO: 1839143 - RNA, 19 nt, Homo sapiens
uggagaaaagggauggagc

SEQ ID NO: 1839144 - RNA, 20 nt, Homo sapiens
gcacacagggugguggcaca

SEQ ID NO: 1839145 - RNA, 17 nt, Homo sapiens
caacuugucacccaaag

SEQ ID NO: 1839146 - RNA, 14 nt, Homo sapiens
gaagcugcugugac

SEQ ID NO: 1839147 - RNA, 16 nt, Homo sapiens
ugguucaguaccacau

SEQ ID NO: 1839148 - RNA, 15 nt, Homo sapiens
ccagcaccaccaggu

SEQ ID NO: 1839149 - RNA, 21 nt, Homo sapiens
aaggguuuaugcuuacgucuc

SEQ ID NO: 1839150 - RNA, 10 nt, Homo sapiens
gucugccaag

SEQ ID NO: 1839151 - RNA, 22 nt, Homo sapiens
cacaaaccuucuuuaaggcaua

SEQ ID NO: 1839152 - RNA, 22 nt, Homo sapiens
gcuuaaucaacagaaguaucaa

SEQ ID NO: 1839153 - RNA, 14 nt, Homo sapiens
cuacuugcaauuca

SEQ ID NO: 1839154 - RNA, 14 nt, Homo sapiens
aagcaaaacuucac

SEQ ID NO: 1839155 - RNA, 12 nt, Homo sapiens
aagaucuugccu

SEQ ID NO: 1839156 - RNA, 16 nt, Homo sapiens
uaaagacuugugcauc

SEQ ID NO: 1839157 - RNA, 19 nt, Homo sapiens
uugacaccacuuagauuua

SEQ ID NO: 1839158 - RNA, 16 nt, Homo sapiens
uauggguugcauuugg

SEQ ID NO: 1839159 - RNA, 20 nt, Homo sapiens
cuuaaaauggcaaguuuucc

SEQ ID NO: 1839160 - RNA, 16 nt, Homo sapiens
gaacccucacccagag

SEQ ID NO: 1839161 - RNA, 23 nt, Homo sapiens
ucagaugaauuguuaauuaucua

SEQ ID NO: 1839162 - RNA, 13 nt, Homo sapiens
aaauaacuguauu

SEQ ID NO: 1839163 - RNA, 18 nt, Homo sapiens
aggucacauugugccuuu

SEQ ID NO: 1839164 - RNA, 15 nt, Homo sapiens
cuauaaaauguauca

SEQ ID NO: 1839165 - RNA, 15 nt, Homo sapiens
acugucucagccaac

SEQ ID NO: 1839166 - RNA, 20 nt, Homo sapiens
gguacacguaaaucuguuca

SEQ ID NO: 1839167 - RNA, 22 nt, Homo sapiens
ggguuccuuuuucaacuuggaa

SEQ ID NO: 1839168 - RNA, 21 nt, Homo sapiens
ccuucauuuaacucuuugaaa

SEQ ID NO: 1839169 - RNA, 16 nt, Homo sapiens
auguggagaacauuca

SEQ ID NO: 1839170 - RNA, 20 nt, Homo sapiens
caaguuguggugcugacaaa

SEQ ID NO: 1839171 - RNA, 19 nt, Homo sapiens
cccuuuccuacucucagga

SEQ ID NO: 1839172 - RNA, 16 nt, Homo sapiens
gauauuaucauaacau

SEQ ID NO: 1839173 - RNA, 17 nt, Homo sapiens
gcucugcagauccucug

SEQ ID NO: 1839174 - RNA, 13 nt, Homo sapiens
guaaauaugcaaa

SEQ ID NO: 1839175 - RNA, 23 nt, Homo sapiens
ccaacuuacaaaaacacuucguu

SEQ ID NO: 1839176 - RNA, 15 nt, Homo sapiens
gaaguagcagugucu

SEQ ID NO: 1839177 - RNA, 22 nt, Homo sapiens
aaccugucaccuggccugccac

SEQ ID NO: 1839178 - RNA, 14 nt, Homo sapiens
ggucagugugccac

SEQ ID NO: 1839179 - RNA, 16 nt, Homo sapiens
uguacaugacuguaua

SEQ ID NO: 1839180 - RNA, 18 nt, Homo sapiens
acagugaaacuccaucuc

SEQ ID NO: 1839181 - RNA, 10 nt, Homo sapiens
caaaagggga

SEQ ID NO: 1839182 - RNA, 10 nt, Homo sapiens
ccaaaggggc

SEQ ID NO: 1839183 - RNA, 19 nt, Homo sapiens
ccagccccugccuggguug

SEQ ID NO: 1839184 - RNA, 16 nt, Homo sapiens
gaaaauuagacauuua

SEQ ID NO: 1839185 - RNA, 21 nt, Homo sapiens
ucuacuacaaacuucaaagag

SEQ ID NO: 1839186 - RNA, 16 nt, Homo sapiens
aaaacauguuugcacu

SEQ ID NO: 1839187 - RNA, 21 nt, Homo sapiens
gagaugcaggauuucuucaca

SEQ ID NO: 1839188 - RNA, 20 nt, Homo sapiens
ucaagcauuuaccaugugcu

SEQ ID NO: 1839189 - RNA, 17 nt, Homo sapiens
cagcugcagcugaucca

SEQ ID NO: 1839190 - RNA, 20 nt, Homo sapiens
gucccauuuucagacugcuu

SEQ ID NO: 1839191 - RNA, 11 nt, Homo sapiens
uuccagugcag

SEQ ID NO: 1839192 - RNA, 18 nt, Homo sapiens
gauucaggugcuggagaa

SEQ ID NO: 1839193 - RNA, 22 nt, Homo sapiens
uguuauauuauuacuaauuguc

SEQ ID NO: 1839194 - RNA, 14 nt, Homo sapiens
gaaugggguagaaa

SEQ ID NO: 1839195 - RNA, 22 nt, Homo sapiens
auuaaauaaagguacacaugga

SEQ ID NO: 1839196 - RNA, 14 nt, Homo sapiens
agcugucugugaau

SEQ ID NO: 1839197 - RNA, 19 nt, Homo sapiens
ugacuuuaauuuauguaac

SEQ ID NO: 1839198 - RNA, 23 nt, Homo sapiens
ugauggggugggagacuuuccau

SEQ ID NO: 1839199 - RNA, 14 nt, Homo sapiens
caaggaacagaagu

SEQ ID NO: 1839200 - RNA, 17 nt, Homo sapiens
ugccuccccccacaaga

SEQ ID NO: 1839201 - RNA, 22 nt, Homo sapiens
ugaaugaccagcagcagcuuuc

SEQ ID NO: 1839202 - RNA, 13 nt, Homo sapiens
uugagucuggaua

SEQ ID NO: 1839203 - RNA, 19 nt, Homo sapiens
uuccacuuguuugcacugu

SEQ ID NO: 1839204 - RNA, 23 nt, Homo sapiens
uggaaaaugcugugugcugccau

SEQ ID NO: 1839205 - RNA, 20 nt, Homo sapiens
aaaaaucaucaaaguguuua

SEQ ID NO: 1839206 - RNA, 15 nt, Homo sapiens
gacacccaacacuuu

SEQ ID NO: 1839207 - RNA, 19 nt, Homo sapiens
auaagaggaguaggcccug

SEQ ID NO: 1839208 - RNA, 20 nt, Homo sapiens
gcuaaaauuagaugaacuca

SEQ ID NO: 1839209 - RNA, 19 nt, Homo sapiens
uggcaaagaacucauuuga

SEQ ID NO: 1839210 - RNA, 16 nt, Homo sapiens
auucacucccagguga

SEQ ID NO: 1839211 - RNA, 16 nt, Homo sapiens
acccacccugugccau

SEQ ID NO: 1839212 - RNA, 20 nt, Homo sapiens
agauugaagcuaaaacacuu

SEQ ID NO: 1839213 - RNA, 16 nt, Homo sapiens
ggacacugccaagagc

SEQ ID NO: 1839214 - RNA, 16 nt, Homo sapiens
uacaagagacauauaa

SEQ ID NO: 1839215 - RNA, 15 nt, Homo sapiens
uugaagacucccuga

SEQ ID NO: 1839216 - RNA, 14 nt, Homo sapiens
ugucaaguacaagc

SEQ ID NO: 1839217 - RNA, 17 nt, Homo sapiens
aaggcauggucggggga

SEQ ID NO: 1839218 - RNA, 22 nt, Homo sapiens
agaaaugguauguagagcuuag

SEQ ID NO: 1839219 - RNA, 22 nt, Homo sapiens
ucucuuaaacucucuucuucca

SEQ ID NO: 1839220 - RNA, 13 nt, Homo sapiens
cuccugaaguuag

SEQ ID NO: 1839221 - RNA, 19 nt, Homo sapiens
uuuguucaaguuugcugca

SEQ ID NO: 1839222 - RNA, 14 nt, Homo sapiens
gaacaauguugcaa

SEQ ID NO: 1839223 - RNA, 23 nt, Homo sapiens
gauuuuauuaauuauaaaaugca

SEQ ID NO: 1839224 - RNA, 20 nt, Homo sapiens
gccucuuccugcagccucac

SEQ ID NO: 1839225 - RNA, 13 nt, Homo sapiens
cuguucacagcca

SEQ ID NO: 1839226 - RNA, 17 nt, Homo sapiens
gaaccaugguaugaagg

SEQ ID NO: 1839227 - RNA, 14 nt, Homo sapiens
gucaagcucuguca

SEQ ID NO: 1839228 - RNA, 23 nt, Homo sapiens
aucaucuuugcugaaugucauua

SEQ ID NO: 1839229 - RNA, 18 nt, Homo sapiens
auuauuaccaucucucca

SEQ ID NO: 1839230 - RNA, 22 nt, Homo sapiens
aauucaggaagcagcuuucccc

SEQ ID NO: 1839231 - RNA, 16 nt, Homo sapiens
aucuuucaaguugcau

SEQ ID NO: 1839232 - RNA, 20 nt, Homo sapiens
ucagccacugucacaggcau

SEQ ID NO: 1839233 - RNA, 11 nt, Homo sapiens
cgcguauuuca

SEQ ID NO: 1839234 - RNA, 14 nt, Homo sapiens
ccaggagagacaga

SEQ ID NO: 1839235 - RNA, 22 nt, Homo sapiens
gaguuccuauaacacugugaag

SEQ ID NO: 1839236 - RNA, 14 nt, Homo sapiens
uaauuuuuugucug

SEQ ID NO: 1839237 - RNA, 17 nt, Homo sapiens
uuuaaucguacauuuuc

SEQ ID NO: 1839238 - RNA, 18 nt, Homo sapiens
uacauccagucacuuugc

SEQ ID NO: 1839239 - RNA, 18 nt, Homo sapiens
caaacucacugcucaaga

SEQ ID NO: 1839240 - RNA, 17 nt, Homo sapiens
cagguguuaaaaaccau

SEQ ID NO: 1839241 - RNA, 23 nt, Homo sapiens
aguagcgcuggcgccaucugcag

SEQ ID NO: 1839242 - RNA, 18 nt, Homo sapiens
gaaauuauaucugugguc

SEQ ID NO: 1839243 - RNA, 14 nt, Homo sapiens
agaagacucugacc

SEQ ID NO: 1839244 - RNA, 17 nt, Homo sapiens
gucauucuacacugagg

SEQ ID NO: 1839245 - RNA, 22 nt, Homo sapiens
ugcaagcgaaauuaaaucugaa

SEQ ID NO: 1839246 - RNA, 17 nt, Homo sapiens
ucagcgccagcacugua

SEQ ID NO: 1839247 - RNA, 13 nt, Homo sapiens
aauaauucaaguc

SEQ ID NO: 1839248 - RNA, 20 nt, Homo sapiens
caaaucaaggauaaauaucu

SEQ ID NO: 1839249 - RNA, 15 nt, Homo sapiens
accccuacacuguga

SEQ ID NO: 1839250 - RNA, 18 nt, Homo sapiens
auagcuacaucaguuuga

SEQ ID NO: 1839251 - RNA, 12 nt, Homo sapiens
ugcaguagggga

SEQ ID NO: 1839252 - RNA, 21 nt, Homo sapiens
aaggcgaguggauaauuccaa

SEQ ID NO: 1839253 - RNA, 13 nt, Homo sapiens
ggaucugcagcuc

SEQ ID NO: 1839254 - RNA, 16 nt, Homo sapiens
agauuacccccagucc

SEQ ID NO: 1839255 - RNA, 17 nt, Homo sapiens
ucaucagccuuccugac

SEQ ID NO: 1839256 - RNA, 16 nt, Homo sapiens
cagacagcccuccauc

SEQ ID NO: 1839257 - RNA, 18 nt, Homo sapiens
ccagugagaucaauguga

SEQ ID NO: 1839258 - RNA, 17 nt, Homo sapiens
cuacaugcuuguugaca

SEQ ID NO: 1839259 - RNA, 19 nt, Homo sapiens
ggugcacuuuucuguguca

SEQ ID NO: 1839260 - RNA, 22 nt, Homo sapiens
guucuuuaacccucacugggac

SEQ ID NO: 1839261 - RNA, 20 nt, Homo sapiens
cagguuuacuagcaccugcc

SEQ ID NO: 1839262 - RNA, 17 nt, Homo sapiens
auggaaacagaagacaa

SEQ ID NO: 1839263 - RNA, 14 nt, Homo sapiens
auuugaugcuuuaa

SEQ ID NO: 1839264 - RNA, 15 nt, Homo sapiens
ggucaaucaguguua

SEQ ID NO: 1839265 - RNA, 12 nt, Homo sapiens
ggacgaggucaa

SEQ ID NO: 1839266 - RNA, 14 nt, Homo sapiens
uaauacaucaaaga

SEQ ID NO: 1839267 - RNA, 19 nt, Homo sapiens
caacguggggcagcacaga

SEQ ID NO: 1839268 - RNA, 13 nt, Homo sapiens
uagauucagggaa

SEQ ID NO: 1839269 - RNA, 18 nt, Homo sapiens
uuaucuacaaacacugca

SEQ ID NO: 1839270 - RNA, 21 nt, Homo sapiens
cuucucagguguuucuagacc

SEQ ID NO: 1839271 - RNA, 18 nt, Homo sapiens
cguggcaaauuaacuuga

SEQ ID NO: 1839272 - RNA, 22 nt, Homo sapiens
guaaaucgggaaggaugggaaa

SEQ ID NO: 1839273 - RNA, 22 nt, Homo sapiens
aagacaaagcaaauaaaugccu

SEQ ID NO: 1839274 - RNA, 13 nt, Homo sapiens
aaaauguaacuuu

SEQ ID NO: 1839275 - RNA, 20 nt, Homo sapiens
cggggcuugcaacuuagcuc

SEQ ID NO: 1839276 - RNA, 20 nt, Homo sapiens
uuaugguuuuaaugcaauga

SEQ ID NO: 1839277 - RNA, 21 nt, Homo sapiens
uaaaauugggcuugugauuuc

SEQ ID NO: 1839278 - RNA, 18 nt, Homo sapiens
ggugauccacccaguuac

SEQ ID NO: 1839279 - RNA, 23 nt, Homo sapiens
uuuguugcuauggcuuuaccuau

SEQ ID NO: 1839280 - RNA, 21 nt, Homo sapiens
ucucugcagggccgccaggga

SEQ ID NO: 1839281 - RNA, 19 nt, Homo sapiens
uccuuggaaauacuuuauc

SEQ ID NO: 1839282 - RNA, 15 nt, Homo sapiens
ccagcacuaugcuuu

SEQ ID NO: 1839283 - RNA, 18 nt, Homo sapiens
cauaagaaagcacuauua

SEQ ID NO: 1839284 - RNA, 18 nt, Homo sapiens
ucaguccaugaagaugua

SEQ ID NO: 1839285 - RNA, 17 nt, Homo sapiens
aggacaaggauguucac

SEQ ID NO: 1839286 - RNA, 17 nt, Homo sapiens
auugggaaggaugagau

SEQ ID NO: 1839287 - RNA, 16 nt, Homo sapiens
aguauauguugcaaaa

SEQ ID NO: 1839288 - RNA, 14 nt, Homo sapiens
aucaaaacucuccu

SEQ ID NO: 1839289 - RNA, 15 nt, Homo sapiens
uuuguucaacaucua

SEQ ID NO: 1839290 - RNA, 17 nt, Homo sapiens
augucaguuccaaugag

SEQ ID NO: 1839291 - RNA, 17 nt, Homo sapiens
agcagugccagcuuucu

SEQ ID NO: 1839292 - RNA, 18 nt, Homo sapiens
uuaagaauuuaccagaaa

SEQ ID NO: 1839293 - RNA, 16 nt, Homo sapiens
gagugaagagcauuug

SEQ ID NO: 1839294 - RNA, 17 nt, Homo sapiens
ugagcagagauguacug

SEQ ID NO: 1839295 - RNA, 20 nt, Homo sapiens
ccagaagcggccugugcguu

SEQ ID NO: 1839296 - RNA, 19 nt, Homo sapiens
gcugcucccuuuaucaugu

SEQ ID NO: 1839297 - RNA, 18 nt, Homo sapiens
aguaaaagucccaguuaa

SEQ ID NO: 1839298 - RNA, 21 nt, Homo sapiens
gcugguacacaccaaaugagu

SEQ ID NO: 1839299 - RNA, 22 nt, Homo sapiens
uaaaauauccagugagcucuuu

SEQ ID NO: 1839300 - RNA, 13 nt, Homo sapiens
gcagauauagcau

SEQ ID NO: 1839301 - RNA, 17 nt, Homo sapiens
aggcccuggagaccucc

SEQ ID NO: 1839302 - RNA, 18 nt, Homo sapiens
guaauuccuguuacuuua

SEQ ID NO: 1839303 - RNA, 14 nt, Homo sapiens
ccaagaggucucca

SEQ ID NO: 1839304 - RNA, 15 nt, Homo sapiens
aaucuacacugccuu

SEQ ID NO: 1839305 - RNA, 23 nt, Homo sapiens
aauuacagcaguugacucagagu

SEQ ID NO: 1839306 - RNA, 13 nt, Homo sapiens
aguuuuaguugca

SEQ ID NO: 1839307 - RNA, 15 nt, Homo sapiens
aagcuguuucuugau

SEQ ID NO: 1839308 - RNA, 18 nt, Homo sapiens
agaaaaaggcaguggccu

SEQ ID NO: 1839309 - RNA, 19 nt, Homo sapiens
gcuucugauggugucaucu

SEQ ID NO: 1839310 - RNA, 15 nt, Homo sapiens
caauuacuauucccu

SEQ ID NO: 1839311 - RNA, 18 nt, Homo sapiens
aaauaaaagcuagauacu

SEQ ID NO: 1839312 - RNA, 22 nt, Homo sapiens
guaccauuuaugaagguuuguu

SEQ ID NO: 1839313 - RNA, 18 nt, Homo sapiens
uucuuucucaucuugaug

SEQ ID NO: 1839314 - RNA, 21 nt, Homo sapiens
gcgcaaucucggcucacugca

SEQ ID NO: 1839315 - RNA, 16 nt, Homo sapiens
augugacucuuuccaa

SEQ ID NO: 1839316 - RNA, 13 nt, Homo sapiens
acaucauuuguau

SEQ ID NO: 1839317 - RNA, 22 nt, Homo sapiens
acuugugauuuuuauaauacaa

SEQ ID NO: 1839318 - RNA, 23 nt, Homo sapiens
gcuuccagaugauccuugcacag

SEQ ID NO: 1839319 - RNA, 18 nt, Homo sapiens
ugccaccccacaguggga

SEQ ID NO: 1839320 - RNA, 22 nt, Homo sapiens
ccagagccagaaagggugccag

SEQ ID NO: 1839321 - RNA, 13 nt, Homo sapiens
uucuccucugcua

SEQ ID NO: 1839322 - RNA, 18 nt, Homo sapiens
uuagugucucauguggaa

SEQ ID NO: 1839323 - RNA, 15 nt, Homo sapiens
cuaggauaguuucac

SEQ ID NO: 1839324 - RNA, 18 nt, Homo sapiens
uaaucuauguauauacau

SEQ ID NO: 1839325 - RNA, 16 nt, Homo sapiens
uuguuucacaaacaga

SEQ ID NO: 1839326 - RNA, 12 nt, Homo sapiens
acuaguuuauuu

SEQ ID NO: 1839327 - RNA, 20 nt, Homo sapiens
guagcugccccuggcucuga

SEQ ID NO: 1839328 - RNA, 18 nt, Homo sapiens
ugcagucaucaacaauga

SEQ ID NO: 1839329 - RNA, 21 nt, Homo sapiens
auuuugggagaguaaagcuaa

SEQ ID NO: 1839330 - RNA, 13 nt, Homo sapiens
caaaaacauuuca

SEQ ID NO: 1839331 - RNA, 19 nt, Homo sapiens
gcucgcacggcgccaggug

SEQ ID NO: 1839332 - RNA, 12 nt, Homo sapiens
uuaugacaugau

SEQ ID NO: 1839333 - RNA, 12 nt, Homo sapiens
cacuaggugccu

SEQ ID NO: 1839334 - RNA, 11 nt, Homo sapiens
ugaacuuccau

SEQ ID NO: 1839335 - RNA, 21 nt, Homo sapiens
ggauacgacaguacacuguca

SEQ ID NO: 1839336 - RNA, 19 nt, Homo sapiens
gaagacuauuuaguggaac

SEQ ID NO: 1839337 - RNA, 14 nt, Homo sapiens
ugugcauuccucac

SEQ ID NO: 1839338 - RNA, 13 nt, Homo sapiens
gcuagaaugcaca

SEQ ID NO: 1839339 - RNA, 23 nt, Homo sapiens
uugcccugaacauacacaugcug

SEQ ID NO: 1839340 - RNA, 14 nt, Homo sapiens
ucugcccugccucc

SEQ ID NO: 1839341 - RNA, 14 nt, Homo sapiens
gccuggcuucuggg

SEQ ID NO: 1839342 - RNA, 18 nt, Homo sapiens
cagugggccuguggcauu

SEQ ID NO: 1839343 - RNA, 22 nt, Homo sapiens
aauuccuccagagacacugagc

SEQ ID NO: 1839344 - RNA, 22 nt, Homo sapiens
ucuacaaguaauuuugcacaga

SEQ ID NO: 1839345 - RNA, 15 nt, Homo sapiens
cgauuugggggcucg

SEQ ID NO: 1839346 - RNA, 16 nt, Homo sapiens
auuuuuaccugccuaa

SEQ ID NO: 1839347 - RNA, 23 nt, Homo sapiens
ggagacaaaauauuuuccugcca

SEQ ID NO: 1839348 - RNA, 15 nt, Homo sapiens
ugcauucguccuuag

SEQ ID NO: 1839349 - RNA, 13 nt, Homo sapiens
agaaagcauugcc

SEQ ID NO: 1839350 - RNA, 21 nt, Homo sapiens
augguccuugucccaagccca

SEQ ID NO: 1839351 - RNA, 14 nt, Homo sapiens
caauguaagcauac

SEQ ID NO: 1839352 - RNA, 13 nt, Homo sapiens
aagccuauugcaa

SEQ ID NO: 1839353 - RNA, 14 nt, Homo sapiens
uguaagaaacacac

SEQ ID NO: 1839354 - RNA, 14 nt, Homo sapiens
agcacauuaccaau

SEQ ID NO: 1839355 - RNA, 22 nt, Homo sapiens
ucgaacuccuggccucaaguga

SEQ ID NO: 1839356 - RNA, 19 nt, Homo sapiens
gucuguugcuucaguaaaa

SEQ ID NO: 1839357 - RNA, 22 nt, Homo sapiens
cagaacugcagucagcaugaau

SEQ ID NO: 1839358 - RNA, 15 nt, Homo sapiens
ucaaacagaaaagaa

SEQ ID NO: 1839359 - RNA, 21 nt, Homo sapiens
ugccgccccggacaguggcac

SEQ ID NO: 1839360 - RNA, 22 nt, Homo sapiens
agcugcuucugcccaccccgcc

SEQ ID NO: 1839361 - RNA, 13 nt, Homo sapiens
uguacaugguauu

SEQ ID NO: 1839362 - RNA, 22 nt, Homo sapiens
cuuaaaagaaacuauaaaguuu

SEQ ID NO: 1839363 - RNA, 21 nt, Homo sapiens
ccccuggggggcacagccaga

SEQ ID NO: 1839364 - RNA, 18 nt, Homo sapiens
aacuaucucagcaucaga

SEQ ID NO: 1839365 - RNA, 17 nt, Homo sapiens
cauaaaacccuauacaa

SEQ ID NO: 1839366 - RNA, 20 nt, Homo sapiens
ucccaaguagcugagacuac

SEQ ID NO: 1839367 - RNA, 16 nt, Homo sapiens
cuugucauuccagagu

SEQ ID NO: 1839368 - RNA, 15 nt, Homo sapiens
ggcuuuucacacggg

SEQ ID NO: 1839369 - RNA, 14 nt, Homo sapiens
cugucaugccaaaa

SEQ ID NO: 1839370 - RNA, 15 nt, Homo sapiens
auuuauaauuacaau

SEQ ID NO: 1839371 - RNA, 13 nt, Homo sapiens
uacacauacaugu

SEQ ID NO: 1839372 - RNA, 14 nt, Homo sapiens
uaccgcuggcccug

SEQ ID NO: 1839373 - RNA, 19 nt, Homo sapiens
guuuggcaaaacucaggca

SEQ ID NO: 1839374 - RNA, 21 nt, Homo sapiens
ccccgggaugcaccgguuauu

SEQ ID NO: 1839375 - RNA, 23 nt, Homo sapiens
ugucuuugucaccacguggggcu

SEQ ID NO: 1839376 - RNA, 17 nt, Homo sapiens
uaaagcaugaaauguga

SEQ ID NO: 1839377 - RNA, 15 nt, Homo sapiens
acuaagaaauaugca

SEQ ID NO: 1839378 - RNA, 18 nt, Homo sapiens
uucccuggugccaccagc

SEQ ID NO: 1839379 - RNA, 18 nt, Homo sapiens
ucccuucuuugcacuuuu

SEQ ID NO: 1839380 - RNA, 18 nt, Homo sapiens
uagcucuuccccaucuca

SEQ ID NO: 1839381 - RNA, 18 nt, Homo sapiens
aacugcuguugggaacca

SEQ ID NO: 1839382 - RNA, 19 nt, Homo sapiens
uggcagaguuacaguucug

SEQ ID NO: 1839383 - RNA, 17 nt, Homo sapiens
guaaaguacagacuuuu

SEQ ID NO: 1839384 - RNA, 19 nt, Homo sapiens
ugcaguaugaacuauugcc

SEQ ID NO: 1839385 - RNA, 14 nt, Homo sapiens
agaguauuaaugaa

SEQ ID NO: 1839386 - RNA, 16 nt, Homo sapiens
guauuugucauuccuc

SEQ ID NO: 1839387 - RNA, 22 nt, Homo sapiens
gauguuguacgcacuggagcug

SEQ ID NO: 1839388 - RNA, 15 nt, Homo sapiens
gaaagaugggcaauc

SEQ ID NO: 1839389 - RNA, 19 nt, Homo sapiens
auaguacuggcaugguacg

SEQ ID NO: 1839390 - RNA, 18 nt, Homo sapiens
aaaugggaaaaccagacu

SEQ ID NO: 1839391 - RNA, 23 nt, Homo sapiens
ucccaugugcauggaaauguccu

SEQ ID NO: 1839392 - RNA, 17 nt, Homo sapiens
cucagccucccaaagug

SEQ ID NO: 1839393 - RNA, 19 nt, Homo sapiens
ucugccuuggauuccuaga

SEQ ID NO: 1839394 - RNA, 21 nt, Homo sapiens
gcccgcgugauuguggcauuu

SEQ ID NO: 1839395 - RNA, 16 nt, Homo sapiens
agauuaacacacugaa

SEQ ID NO: 1839396 - RNA, 13 nt, Homo sapiens
aauuacuaacuuc

SEQ ID NO: 1839397 - RNA, 15 nt, Homo sapiens
agcgucuugcucugu

SEQ ID NO: 1839398 - RNA, 18 nt, Homo sapiens
agcaaggacaaccugccc

SEQ ID NO: 1839399 - RNA, 23 nt, Homo sapiens
uguuccuggagaaggcauuccag

SEQ ID NO: 1839400 - RNA, 15 nt, Homo sapiens
acauuugguugcuac

SEQ ID NO: 1839401 - RNA, 17 nt, Homo sapiens
caaguuccgucagucca

SEQ ID NO: 1839402 - RNA, 23 nt, Homo sapiens
uggucuucagccucuuucugucc

SEQ ID NO: 1839403 - RNA, 22 nt, Homo sapiens
uccaaaggaggauggcauauaa

SEQ ID NO: 1839404 - RNA, 15 nt, Homo sapiens
cccuggcuccaguga

SEQ ID NO: 1839405 - RNA, 14 nt, Homo sapiens
gaacuuuaagcaac

SEQ ID NO: 1839406 - RNA, 21 nt, Homo sapiens
cagaauuuaugacuccacugu

SEQ ID NO: 1839407 - RNA, 17 nt, Homo sapiens
acaauugucauguaugu

SEQ ID NO: 1839408 - RNA, 15 nt, Homo sapiens
caaaauuaauaugau

SEQ ID NO: 1839409 - RNA, 23 nt, Homo sapiens
gcaaaggcugggaccacgugaga

SEQ ID NO: 1839410 - RNA, 14 nt, Homo sapiens
agccuuaacauaua

SEQ ID NO: 1839411 - RNA, 18 nt, Homo sapiens
caucuuccuggaagcaga

SEQ ID NO: 1839412 - RNA, 14 nt, Homo sapiens
agggccgcccgggc

SEQ ID NO: 1839413 - RNA, 21 nt, Homo sapiens
ugggguauuuaccacagcagc

SEQ ID NO: 1839414 - RNA, 16 nt, Homo sapiens
auuaagauacacuccu

SEQ ID NO: 1839415 - RNA, 12 nt, Homo sapiens
aaccuagugaau

SEQ ID NO: 1839416 - RNA, 15 nt, Homo sapiens
auucauaaagugaau

SEQ ID NO: 1839417 - RNA, 16 nt, Homo sapiens
uuguccaugugcaaac

SEQ ID NO: 1839418 - RNA, 13 nt, Homo sapiens
auaaaugaacuga

SEQ ID NO: 1839419 - RNA, 16 nt, Homo sapiens
auuuucagcaucaaac

SEQ ID NO: 1839420 - RNA, 12 nt, Homo sapiens
guguaacuuuca

SEQ ID NO: 1839421 - RNA, 17 nt, Homo sapiens
agugauauugucuucau

SEQ ID NO: 1839422 - RNA, 21 nt, Homo sapiens
uaaaagguguuguaaugguga

SEQ ID NO: 1839423 - RNA, 20 nt, Homo sapiens
uuuuuaaaagcccuuuccaa

SEQ ID NO: 1839424 - RNA, 20 nt, Homo sapiens
aucaccaugaaagaagaaua

SEQ ID NO: 1839425 - RNA, 12 nt, Homo sapiens
aauuuccuugac

SEQ ID NO: 1839426 - RNA, 19 nt, Homo sapiens
gauuuauuaaauaaucucu

SEQ ID NO: 1839427 - RNA, 18 nt, Homo sapiens
gaggcagacagcagcuca

SEQ ID NO: 1839428 - RNA, 21 nt, Homo sapiens
caaaggcaggcacuucacaca

SEQ ID NO: 1839429 - RNA, 19 nt, Homo sapiens
uguaaucccagcacuuugg

SEQ ID NO: 1839430 - RNA, 17 nt, Homo sapiens
acuuggccaagcaggga

SEQ ID NO: 1839431 - RNA, 22 nt, Homo sapiens
cuuacccauuuuuuuuaccuca

SEQ ID NO: 1839432 - RNA, 17 nt, Homo sapiens
cuaaagaauagugccuc

SEQ ID NO: 1839433 - RNA, 18 nt, Homo sapiens
augaauauggaaaggcca

SEQ ID NO: 1839434 - RNA, 14 nt, Homo sapiens
gaucccaucuugau

SEQ ID NO: 1839435 - RNA, 15 nt, Homo sapiens
ugcagcacucuuauc

SEQ ID NO: 1839436 - RNA, 15 nt, Homo sapiens
cuccauaaacaugaa

SEQ ID NO: 1839437 - RNA, 18 nt, Homo sapiens
ucauaaagaaaugcaagg

SEQ ID NO: 1839438 - RNA, 20 nt, Homo sapiens
aaagagaauaaagacuucau

SEQ ID NO: 1839439 - RNA, 19 nt, Homo sapiens
gugucuuuuuguaucucau

SEQ ID NO: 1839440 - RNA, 21 nt, Homo sapiens
gcaucaauacaaccagcccaa

SEQ ID NO: 1839441 - RNA, 14 nt, Homo sapiens
ccccuucugggcaa

SEQ ID NO: 1839442 - RNA, 14 nt, Homo sapiens
aggaagggaucuga

SEQ ID NO: 1839443 - RNA, 18 nt, Homo sapiens
cucagcuuuaaugggugu

SEQ ID NO: 1839444 - RNA, 22 nt, Homo sapiens
caagucuuccugauacaugacu

SEQ ID NO: 1839445 - RNA, 12 nt, Homo sapiens
auccagcaauac

SEQ ID NO: 1839446 - RNA, 16 nt, Homo sapiens
ugaguguuauuugcac

SEQ ID NO: 1839447 - RNA, 14 nt, Homo sapiens
ucagccaaagcaga

SEQ ID NO: 1839448 - RNA, 20 nt, Homo sapiens
cacaauggugcucauuucau

SEQ ID NO: 1839449 - RNA, 14 nt, Homo sapiens
gcucucauugacuu

SEQ ID NO: 1839450 - RNA, 16 nt, Homo sapiens
uagacagaguugcuua

SEQ ID NO: 1839451 - RNA, 16 nt, Homo sapiens
ccuucuccaugcugag

SEQ ID NO: 1839452 - RNA, 19 nt, Homo sapiens
cauaauuuagaguguaugu

SEQ ID NO: 1839453 - RNA, 18 nt, Homo sapiens
gccccuccgaugcugagg

SEQ ID NO: 1839454 - RNA, 19 nt, Homo sapiens
auauuugggccugcuccag

SEQ ID NO: 1839455 - RNA, 22 nt, Homo sapiens
aaaucugccugauaggacccau

SEQ ID NO: 1839456 - RNA, 15 nt, Homo sapiens
agaugggggucucac

SEQ ID NO: 1839457 - RNA, 17 nt, Homo sapiens
cucauguuucuguagga

SEQ ID NO: 1839458 - RNA, 16 nt, Homo sapiens
uuguaaaugaccaaga

SEQ ID NO: 1839459 - RNA, 16 nt, Homo sapiens
ucaugauuugcaacuu

SEQ ID NO: 1839460 - RNA, 14 nt, Homo sapiens
cuagagguacuuuc

SEQ ID NO: 1839461 - RNA, 13 nt, Homo sapiens
cauaccuccuucc

SEQ ID NO: 1839462 - RNA, 20 nt, Homo sapiens
uaggucacucuccagcaguu

SEQ ID NO: 1839463 - RNA, 17 nt, Homo sapiens
ggaguguggcuccugug

SEQ ID NO: 1839464 - RNA, 19 nt, Homo sapiens
ugacucaacauguuacuga

SEQ ID NO: 1839465 - RNA, 17 nt, Homo sapiens
cuagcaaauaugcuguu

SEQ ID NO: 1839466 - RNA, 14 nt, Homo sapiens
aacaacugcuggga

SEQ ID NO: 1839467 - RNA, 14 nt, Homo sapiens
gcaucaaguucucc

SEQ ID NO: 1839468 - RNA, 23 nt, Homo sapiens
cuuccaucucagcacucuguggg

SEQ ID NO: 1839469 - RNA, 18 nt, Homo sapiens
aagucacauaaaaaugca

SEQ ID NO: 1839470 - RNA, 20 nt, Homo sapiens
caugacuauuguaacuagau

SEQ ID NO: 1839471 - RNA, 14 nt, Homo sapiens
aauguucugggaag

SEQ ID NO: 1839472 - RNA, 20 nt, Homo sapiens
auagaacuggucuuccauuu

SEQ ID NO: 1839473 - RNA, 12 nt, Homo sapiens
uguucacaugca

SEQ ID NO: 1839474 - RNA, 16 nt, Homo sapiens
cagaaucccccaaaga

SEQ ID NO: 1839475 - RNA, 14 nt, Homo sapiens
acauccagaucuau

SEQ ID NO: 1839476 - RNA, 16 nt, Homo sapiens
gaaagaaaaagcaaua

SEQ ID NO: 1839477 - RNA, 21 nt, Homo sapiens
gccaccaccggggcacuggcu

SEQ ID NO: 1839478 - RNA, 21 nt, Homo sapiens
uugagcuucacugucaucuuu

SEQ ID NO: 1839479 - RNA, 21 nt, Homo sapiens
cucauggugcauauaaauaua

SEQ ID NO: 1839480 - RNA, 18 nt, Homo sapiens
gacuauaaaaacugcccc

SEQ ID NO: 1839481 - RNA, 21 nt, Homo sapiens
agaaugcaucucaucaacuua

SEQ ID NO: 1839482 - RNA, 21 nt, Homo sapiens
acaaugcuccuccugaugacu

SEQ ID NO: 1839483 - RNA, 15 nt, Homo sapiens
ucacuacaguuucaa

SEQ ID NO: 1839484 - RNA, 17 nt, Homo sapiens
ccagcuuggcucaggcu

SEQ ID NO: 1839485 - RNA, 19 nt, Homo sapiens
aaauuaaaacaugcacaaa

SEQ ID NO: 1839486 - RNA, 23 nt, Homo sapiens
gcacaccccugcacacaccugca

SEQ ID NO: 1839487 - RNA, 14 nt, Homo sapiens
accuccccacugcc

SEQ ID NO: 1839488 - RNA, 15 nt, Homo sapiens
accuauaauaccagc

SEQ ID NO: 1839489 - RNA, 24 nt, Homo sapiens
aagaacugucuauuuucucaguca

SEQ ID NO: 1839490 - RNA, 21 nt, Homo sapiens
acacgcaacuggcucaaagac

SEQ ID NO: 1839491 - RNA, 15 nt, Homo sapiens
gaggaggaagucaug

SEQ ID NO: 1839492 - RNA, 23 nt, Homo sapiens
ccaggcuacaaucuucauuuaau

SEQ ID NO: 1839493 - RNA, 23 nt, Homo sapiens
agccauaggugcaguuugcuucu

SEQ ID NO: 1839494 - RNA, 15 nt, Homo sapiens
ccaaaauaaugcacc

SEQ ID NO: 1839495 - RNA, 14 nt, Homo sapiens
uuugaaaucuauga

SEQ ID NO: 1839496 - RNA, 21 nt, Homo sapiens
auccaagauguuuggacaccc

SEQ ID NO: 1839497 - RNA, 17 nt, Homo sapiens
aggagugggauuauuca

SEQ ID NO: 1839498 - RNA, 13 nt, Homo sapiens
cuuguaaaugugu

SEQ ID NO: 1839499 - RNA, 16 nt, Homo sapiens
uauuaccaguguuccc

SEQ ID NO: 1839500 - RNA, 15 nt, Homo sapiens
guuuuaaaaugagaa

SEQ ID NO: 1839501 - RNA, 22 nt, Homo sapiens
guaguuaggaaauaaaaccuuu

SEQ ID NO: 1839502 - RNA, 18 nt, Homo sapiens
ucaccccuacacugugaa

SEQ ID NO: 1839503 - RNA, 12 nt, Homo sapiens
gcuggaagcaca

SEQ ID NO: 1839504 - RNA, 18 nt, Homo sapiens
aguuucuaucauucugcu

SEQ ID NO: 1839505 - RNA, 11 nt, Homo sapiens
cuaacacaaaa

SEQ ID NO: 1839506 - RNA, 23 nt, Homo sapiens
uacagcaugugccuuaaugcuuc

SEQ ID NO: 1839507 - RNA, 19 nt, Homo sapiens
uguccccugacagggccag

SEQ ID NO: 1839508 - RNA, 15 nt, Homo sapiens
auaggccugggugcu

SEQ ID NO: 1839509 - RNA, 20 nt, Homo sapiens
aagugagcuccuaagccaug

SEQ ID NO: 1839510 - RNA, 14 nt, Homo sapiens
ugacaggccuuccu

SEQ ID NO: 1839511 - RNA, 22 nt, Homo sapiens
ccaaggucagcucccaucucau

SEQ ID NO: 1839512 - RNA, 23 nt, Homo sapiens
acaucauggaggguuuagugcuu

SEQ ID NO: 1839513 - RNA, 17 nt, Homo sapiens
gcagcugugaccccggg

SEQ ID NO: 1839514 - RNA, 17 nt, Homo sapiens
uauccuugaccaauuua

SEQ ID NO: 1839515 - RNA, 16 nt, Homo sapiens
uuauccuuuuaucuca

SEQ ID NO: 1839516 - RNA, 21 nt, Homo sapiens
gucauuuggugccaguauuuu

SEQ ID NO: 1839517 - RNA, 19 nt, Homo sapiens
ggcagaguucuauaaugua

SEQ ID NO: 1839518 - RNA, 17 nt, Homo sapiens
gcaggcgacaaaaucuc

SEQ ID NO: 1839519 - RNA, 17 nt, Homo sapiens
auagaacauauuuuccu

SEQ ID NO: 1839520 - RNA, 15 nt, Homo sapiens
acagaaauucugcaa

SEQ ID NO: 1839521 - RNA, 23 nt, Homo sapiens
auaaaaacuaaauuguaaacucc

SEQ ID NO: 1839522 - RNA, 20 nt, Homo sapiens
uccaaaaccucaguuaaacu

SEQ ID NO: 1839523 - RNA, 18 nt, Homo sapiens
uacaugcagcccaugccc

SEQ ID NO: 1839524 - RNA, 18 nt, Homo sapiens
cccaauccucccuggaga

SEQ ID NO: 1839525 - RNA, 18 nt, Homo sapiens
uggcagcucuccagucag

SEQ ID NO: 1839526 - RNA, 13 nt, Homo sapiens
uuuguuaugcaaa

SEQ ID NO: 1839527 - RNA, 20 nt, Homo sapiens
gcccaccuggggaguuuacu

SEQ ID NO: 1839528 - RNA, 19 nt, Homo sapiens
cugaggaaguugauucuua

SEQ ID NO: 1839529 - RNA, 22 nt, Homo sapiens
ggguguuuauccuaucucucca

SEQ ID NO: 1839530 - RNA, 15 nt, Homo sapiens
gcugggccuuuccag

SEQ ID NO: 1839531 - RNA, 22 nt, Homo sapiens
uauauuaaacauucuugcugcu

SEQ ID NO: 1839532 - RNA, 18 nt, Homo sapiens
uauacaguuuaccgaaaa

SEQ ID NO: 1839533 - RNA, 11 nt, Homo sapiens
gaagaacugac

SEQ ID NO: 1839534 - RNA, 16 nt, Homo sapiens
aguuaaagaagacauu

SEQ ID NO: 1839535 - RNA, 22 nt, Homo sapiens
gcuagacaagcuuguccaugua

SEQ ID NO: 1839536 - RNA, 21 nt, Homo sapiens
cacccuaaugcauaagcuuuu

SEQ ID NO: 1839537 - RNA, 21 nt, Homo sapiens
augccgagcguccucuuggcu

SEQ ID NO: 1839538 - RNA, 18 nt, Homo sapiens
ucuaucauuaaaguucua

SEQ ID NO: 1839539 - RNA, 20 nt, Homo sapiens
uguggaaaguguaaagcauu

SEQ ID NO: 1839540 - RNA, 17 nt, Homo sapiens
cuuguuuguuacuguca

SEQ ID NO: 1839541 - RNA, 20 nt, Homo sapiens
uguaguauaauaauuacugg

SEQ ID NO: 1839542 - RNA, 17 nt, Homo sapiens
ugugcacugucacuuug

SEQ ID NO: 1839543 - RNA, 21 nt, Homo sapiens
agcagcuccccaggagcucag

SEQ ID NO: 1839544 - RNA, 14 nt, Homo sapiens
guuuauguacugua

SEQ ID NO: 1839545 - RNA, 16 nt, Homo sapiens
aggcuaucaacaaaga

SEQ ID NO: 1839546 - RNA, 22 nt, Homo sapiens
uuccucucacuguugccugcau

SEQ ID NO: 1839547 - RNA, 15 nt, Homo sapiens
uggauaugacccaca

SEQ ID NO: 1839548 - RNA, 15 nt, Homo sapiens
caguaaccaugcccg

SEQ ID NO: 1839549 - RNA, 14 nt, Homo sapiens
ugcuguuguucucg

SEQ ID NO: 1839550 - RNA, 15 nt, Homo sapiens
guauuuuguaugcau

SEQ ID NO: 1839551 - RNA, 22 nt, Homo sapiens
gcagcagggagggcuucugcca

SEQ ID NO: 1839552 - RNA, 13 nt, Homo sapiens
aaaaagcugcuuc

SEQ ID NO: 1839553 - RNA, 13 nt, Homo sapiens
uaagaaagacuau

SEQ ID NO: 1839554 - RNA, 15 nt, Homo sapiens
caugcuuauaacauu

SEQ ID NO: 1839555 - RNA, 13 nt, Homo sapiens
uugagagggauuu

SEQ ID NO: 1839556 - RNA, 21 nt, Homo sapiens
aacaacguguauagugccuaa

SEQ ID NO: 1839557 - RNA, 13 nt, Homo sapiens
ucugcuuugcucu

SEQ ID NO: 1839558 - RNA, 17 nt, Homo sapiens
aaugcugucccuauaca

SEQ ID NO: 1839559 - RNA, 22 nt, Homo sapiens
ccauuguggccgccaugagcaa

SEQ ID NO: 1839560 - RNA, 13 nt, Homo sapiens
gggccccauggca

SEQ ID NO: 1839561 - RNA, 14 nt, Homo sapiens
caguagagaucuau

SEQ ID NO: 1839562 - RNA, 15 nt, Homo sapiens
ugucagccaugacca

SEQ ID NO: 1839563 - RNA, 23 nt, Homo sapiens
aaaguuggggacaugcugcuaca

SEQ ID NO: 1839564 - RNA, 21 nt, Homo sapiens
caggggcaaacaccugcugau

SEQ ID NO: 1839565 - RNA, 22 nt, Homo sapiens
uuuaagccaucaucagcuuaau

SEQ ID NO: 1839566 - RNA, 17 nt, Homo sapiens
aauuugaacucaaacca

SEQ ID NO: 1839567 - RNA, 16 nt, Homo sapiens
ccauggugucaugcca

SEQ ID NO: 1839568 - RNA, 17 nt, Homo sapiens
uccaaggcaaacccugu

SEQ ID NO: 1839569 - RNA, 20 nt, Homo sapiens
ggugguauguaauuuaugca

SEQ ID NO: 1839570 - RNA, 16 nt, Homo sapiens
aaucaagaccaaagag

SEQ ID NO: 1839571 - RNA, 22 nt, Homo sapiens
cagggcagcauuuucauaucca

SEQ ID NO: 1839572 - RNA, 19 nt, Homo sapiens
aguucuaaccuccuaagca

SEQ ID NO: 1839573 - RNA, 14 nt, Homo sapiens
caaguagcugcuac

SEQ ID NO: 1839574 - RNA, 20 nt, Homo sapiens
agacaugcacuaugaggaau

SEQ ID NO: 1839575 - RNA, 14 nt, Homo sapiens
gggcaagccaagug

SEQ ID NO: 1839576 - RNA, 22 nt, Homo sapiens
aaauuuuagagcauaccaguac

SEQ ID NO: 1839577 - RNA, 19 nt, Homo sapiens
ugacagacaggcucuuagc

SEQ ID NO: 1839578 - RNA, 16 nt, Homo sapiens
uaccuuuuauguagca

SEQ ID NO: 1839579 - RNA, 20 nt, Homo sapiens
aaugcacccaucagcacucu

SEQ ID NO: 1839580 - RNA, 14 nt, Homo sapiens
uaacauaucauuca

SEQ ID NO: 1839581 - RNA, 22 nt, Homo sapiens
agcauuccuuucucuucagugc

SEQ ID NO: 1839582 - RNA, 17 nt, Homo sapiens
auauaguagacaaagag

SEQ ID NO: 1839583 - RNA, 13 nt, Homo sapiens
gccagcaucugca

SEQ ID NO: 1839584 - RNA, 16 nt, Homo sapiens
agaaaagcugccauuu

SEQ ID NO: 1839585 - RNA, 23 nt, Homo sapiens
cugcguccuggggccugugcacu

SEQ ID NO: 1839586 - RNA, 22 nt, Homo sapiens
ucugugcccgagguuccuguca

SEQ ID NO: 1839587 - RNA, 15 nt, Homo sapiens
caguaacacuggcga

SEQ ID NO: 1839588 - RNA, 21 nt, Homo sapiens
aacugggggcucuguauauag

SEQ ID NO: 1839589 - RNA, 19 nt, Homo sapiens
gaaggccagcccacugggc

SEQ ID NO: 1839590 - RNA, 15 nt, Homo sapiens
aacaguuggcacugu

SEQ ID NO: 1839591 - RNA, 18 nt, Homo sapiens
cuucuggaacccagaaga

SEQ ID NO: 1839592 - RNA, 15 nt, Homo sapiens
gauucagcacuuugc

SEQ ID NO: 1839593 - RNA, 19 nt, Homo sapiens
caaauggcuuaagcaauaa

SEQ ID NO: 1839594 - RNA, 17 nt, Homo sapiens
auggcaauuuagcucuc

SEQ ID NO: 1839595 - RNA, 20 nt, Homo sapiens
aaucaugauacaguuuggau

SEQ ID NO: 1839596 - RNA, 23 nt, Homo sapiens
uagcuagaagaauuucaaggaaa

SEQ ID NO: 1839597 - RNA, 20 nt, Homo sapiens
cgccuucucccccccggggc

SEQ ID NO: 1839598 - RNA, 15 nt, Homo sapiens
ucacaggcaucagga

SEQ ID NO: 1839599 - RNA, 14 nt, Homo sapiens
uccaaacauccucu

SEQ ID NO: 1839600 - RNA, 18 nt, Homo sapiens
ucaaugaguuaccauucu

SEQ ID NO: 1839601 - RNA, 15 nt, Homo sapiens
aaucuugaacuuuau

SEQ ID NO: 1839602 - RNA, 17 nt, Homo sapiens
ucucuggguagugcuuu

SEQ ID NO: 1839603 - RNA, 22 nt, Homo sapiens
ccacuccagcccgcagcacauu

SEQ ID NO: 1839604 - RNA, 16 nt, Homo sapiens
aaaugugaauggaaac

SEQ ID NO: 1839605 - RNA, 17 nt, Homo sapiens
gccuuagggugcugagu

SEQ ID NO: 1839606 - RNA, 21 nt, Homo sapiens
gugguagagaagcaaguaaaa

SEQ ID NO: 1839607 - RNA, 16 nt, Homo sapiens
aucauaagggcacuga

SEQ ID NO: 1839608 - RNA, 19 nt, Homo sapiens
gacucuggaagauuuucau

SEQ ID NO: 1839609 - RNA, 10 nt, Homo sapiens
aggggaccau

SEQ ID NO: 1839610 - RNA, 23 nt, Homo sapiens
uggacagacccaggucuuccaga

SEQ ID NO: 1839611 - RNA, 16 nt, Homo sapiens
agcccauucauuccau

SEQ ID NO: 1839612 - RNA, 14 nt, Homo sapiens
aauuaacacaugau

SEQ ID NO: 1839613 - RNA, 15 nt, Homo sapiens
auaaaaacauuucuu

SEQ ID NO: 1839614 - RNA, 18 nt, Homo sapiens
aauggaacaaacaaugaa

SEQ ID NO: 1839615 - RNA, 17 nt, Homo sapiens
uauuuaaacaacagcuc

SEQ ID NO: 1839616 - RNA, 16 nt, Homo sapiens
ggcagagguugcagug

SEQ ID NO: 1839617 - RNA, 16 nt, Homo sapiens
aacaacagauucucuu

SEQ ID NO: 1839618 - RNA, 17 nt, Homo sapiens
cauuuaauaaagaugag

SEQ ID NO: 1839619 - RNA, 22 nt, Homo sapiens
aaagcuuccgggaaaacagcua

SEQ ID NO: 1839620 - RNA, 14 nt, Homo sapiens
aagauagaauucaa

SEQ ID NO: 1839621 - RNA, 23 nt, Homo sapiens
gauggcauaggccuuagcaguaa

SEQ ID NO: 1839622 - RNA, 11 nt, Homo sapiens
auaaauucuua

SEQ ID NO: 1839623 - RNA, 20 nt, Homo sapiens
ccacguguccguccacccuu

SEQ ID NO: 1839624 - RNA, 14 nt, Homo sapiens
gcaugguggugcac

SEQ ID NO: 1839625 - RNA, 19 nt, Homo sapiens
acuuccaggggaaccugcc

SEQ ID NO: 1839626 - RNA, 21 nt, Homo sapiens
agugugaaaaagaguuuggcu

SEQ ID NO: 1839627 - RNA, 17 nt, Homo sapiens
agcaugacuauuuccac

SEQ ID NO: 1839628 - RNA, 15 nt, Homo sapiens
gcuaguuaauccaaa

SEQ ID NO: 1839629 - RNA, 17 nt, Homo sapiens
uccccucaacaugcugc

SEQ ID NO: 1839630 - RNA, 23 nt, Homo sapiens
caaagugccagagucuaggcuaa

SEQ ID NO: 1839631 - RNA, 15 nt, Homo sapiens
ugagccacugugcuu

SEQ ID NO: 1839632 - RNA, 19 nt, Homo sapiens
accguuuggugucugaugu

SEQ ID NO: 1839633 - RNA, 14 nt, Homo sapiens
acccaaaaggcaga

SEQ ID NO: 1839634 - RNA, 19 nt, Homo sapiens
cagagucuucagagacuuc

SEQ ID NO: 1839635 - RNA, 23 nt, Homo sapiens
cucuaaccagauggaacacugga

SEQ ID NO: 1839636 - RNA, 16 nt, Homo sapiens
gaggacccgggaccac

SEQ ID NO: 1839637 - RNA, 15 nt, Homo sapiens
uuucugcaauccaau

SEQ ID NO: 1839638 - RNA, 16 nt, Homo sapiens
ccacauuuagaacuuu

SEQ ID NO: 1839639 - RNA, 22 nt, Homo sapiens
uacacaaauuauaagcauacaa

SEQ ID NO: 1839640 - RNA, 11 nt, Homo sapiens
agaaacuacug

SEQ ID NO: 1839641 - RNA, 15 nt, Homo sapiens
ugggacuacaggugu

SEQ ID NO: 1839642 - RNA, 22 nt, Homo sapiens
uccagaacaaauuguuuacaua

SEQ ID NO: 1839643 - RNA, 17 nt, Homo sapiens
cuucuauuuaaugcuuc

SEQ ID NO: 1839644 - RNA, 15 nt, Homo sapiens
uaagauuaaugaccu

SEQ ID NO: 1839645 - RNA, 20 nt, Homo sapiens
cacuuagaaugauguaauau

SEQ ID NO: 1839646 - RNA, 21 nt, Homo sapiens
caugugugagugugugcaagu

SEQ ID NO: 1839647 - RNA, 22 nt, Homo sapiens
cagcuaaacaccacgucacuuc

SEQ ID NO: 1839648 - RNA, 21 nt, Homo sapiens
agaagcagaagggcagaagau

SEQ ID NO: 1839649 - RNA, 15 nt, Homo sapiens
auuuauuuucaauua

SEQ ID NO: 1839650 - RNA, 23 nt, Homo sapiens
acaaaggagccuugauaauacuu

SEQ ID NO: 1839651 - RNA, 18 nt, Homo sapiens
uucaacagugugucuuca

SEQ ID NO: 1839652 - RNA, 11 nt, Homo sapiens
cagucaucuca

SEQ ID NO: 1839653 - RNA, 22 nt, Homo sapiens
augcugaacaaggggccuccaa

SEQ ID NO: 1839654 - RNA, 21 nt, Homo sapiens
aagggcauuaggaguguuuca

SEQ ID NO: 1839655 - RNA, 17 nt, Homo sapiens
caaaauaaagaauagca

SEQ ID NO: 1839656 - RNA, 18 nt, Homo sapiens
ggcaggagucaccaugca

SEQ ID NO: 1839657 - RNA, 17 nt, Homo sapiens
uaugagcagaaggaaac

SEQ ID NO: 1839658 - RNA, 17 nt, Homo sapiens
ccagagaugcuggacuu

SEQ ID NO: 1839659 - RNA, 20 nt, Homo sapiens
acaccuuuuuucaacaguga

SEQ ID NO: 1839660 - RNA, 20 nt, Homo sapiens
guguaugcaguauucuugca

SEQ ID NO: 1839661 - RNA, 23 nt, Homo sapiens
cuuaauuuccuuuuugacacuga

SEQ ID NO: 1839662 - RNA, 13 nt, Homo sapiens
uauucacuugagu

SEQ ID NO: 1839663 - RNA, 19 nt, Homo sapiens
gaacucgccucagccugau

SEQ ID NO: 1839664 - RNA, 16 nt, Homo sapiens
caauaaaucuuuggaa

SEQ ID NO: 1839665 - RNA, 20 nt, Homo sapiens
augaacuuuaaaaaagcaaa

SEQ ID NO: 1839666 - RNA, 12 nt, Homo sapiens
agcccugcauuu

SEQ ID NO: 1839667 - RNA, 15 nt, Homo sapiens
gccaccauccugcag

SEQ ID NO: 1839668 - RNA, 16 nt, Homo sapiens
gacauggacacaucag

SEQ ID NO: 1839669 - RNA, 22 nt, Homo sapiens
gacucuauuaaaaucuucaaua

SEQ ID NO: 1839670 - RNA, 22 nt, Homo sapiens
ccucacagcacuaguauuucau

SEQ ID NO: 1839671 - RNA, 16 nt, Homo sapiens
cuuuuccucaccagga

SEQ ID NO: 1839672 - RNA, 19 nt, Homo sapiens
acaggaaucucugauuaca

SEQ ID NO: 1839673 - RNA, 24 nt, Homo sapiens
aguaagacauugggucuauuccag

SEQ ID NO: 1839674 - RNA, 22 nt, Homo sapiens
ugggcuuacaggcaugagccac

SEQ ID NO: 1839675 - RNA, 15 nt, Homo sapiens
ucucccuagugccuu

SEQ ID NO: 1839676 - RNA, 21 nt, Homo sapiens
gagauggcgcuauugcacucc

SEQ ID NO: 1839677 - RNA, 23 nt, Homo sapiens
ugaagggaaacugcagcugggaa

SEQ ID NO: 1839678 - RNA, 17 nt, Homo sapiens
agagcugaacuauuaga

SEQ ID NO: 1839679 - RNA, 13 nt, Homo sapiens
aagcucagugaua

SEQ ID NO: 1839680 - RNA, 15 nt, Homo sapiens
ucuauacuuaaucuc

SEQ ID NO: 1839681 - RNA, 19 nt, Homo sapiens
augaagucucuaacaaugu

SEQ ID NO: 1839682 - RNA, 24 nt, Homo sapiens
agugugcuaaccucacugccucau

SEQ ID NO: 1839683 - RNA, 15 nt, Homo sapiens
cuguaaauaugucac

SEQ ID NO: 1839684 - RNA, 19 nt, Homo sapiens
gcagaaacccaugugcagg

SEQ ID NO: 1839685 - RNA, 16 nt, Homo sapiens
uuucucaguguccaga

SEQ ID NO: 1839686 - RNA, 11 nt, Homo sapiens
cacaguacuuu

SEQ ID NO: 1839687 - RNA, 22 nt, Homo sapiens
gauuucaucacuaguaugugug

SEQ ID NO: 1839688 - RNA, 23 nt, Homo sapiens
caaagggggacagugauuuucaa

SEQ ID NO: 1839689 - RNA, 22 nt, Homo sapiens
aaagccaggguccugaguggcu

SEQ ID NO: 1839690 - RNA, 19 nt, Homo sapiens
aacucagaaugcacuugau

SEQ ID NO: 1839691 - RNA, 17 nt, Homo sapiens
auggccugcaaacuggg

SEQ ID NO: 1839692 - RNA, 13 nt, Homo sapiens
gaaaaguguuauu

SEQ ID NO: 1839693 - RNA, 14 nt, Homo sapiens
ucugauuggcucac

SEQ ID NO: 1839694 - RNA, 21 nt, Homo sapiens
acuuaaacaaaaacuuuccau

SEQ ID NO: 1839695 - RNA, 19 nt, Homo sapiens
acagcaagacuccgucuca

SEQ ID NO: 1839696 - RNA, 22 nt, Homo sapiens
acuugcuugccaacugccaagc

SEQ ID NO: 1839697 - RNA, 23 nt, Homo sapiens
ggagccagggaauccugaccuga

SEQ ID NO: 1839698 - RNA, 15 nt, Homo sapiens
cuggacuguuucaua

SEQ ID NO: 1839699 - RNA, 12 nt, Homo sapiens
aaugacuuuucc

SEQ ID NO: 1839700 - RNA, 17 nt, Homo sapiens
aacaggaaacugaucau

SEQ ID NO: 1839701 - RNA, 18 nt, Homo sapiens
gauucggauuugacaaaa

SEQ ID NO: 1839702 - RNA, 14 nt, Homo sapiens
ucuucucuuucuca

SEQ ID NO: 1839703 - RNA, 16 nt, Homo sapiens
aaccagaccauugucu

SEQ ID NO: 1839704 - RNA, 20 nt, Homo sapiens
acugaagcaaagaagggaau

SEQ ID NO: 1839705 - RNA, 14 nt, Homo sapiens
agaucacaccacua

SEQ ID NO: 1839706 - RNA, 14 nt, Homo sapiens
agaucgcaccacug

SEQ ID NO: 1839707 - RNA, 16 nt, Homo sapiens
uauauguacaguuaua

SEQ ID NO: 1839708 - RNA, 18 nt, Homo sapiens
uauggaacauaugcacag

SEQ ID NO: 1839709 - RNA, 16 nt, Homo sapiens
ugucccgcggugcuga

SEQ ID NO: 1839710 - RNA, 16 nt, Homo sapiens
auauuaugugaaauca

SEQ ID NO: 1839711 - RNA, 17 nt, Homo sapiens
acggggcucagcaaugc

SEQ ID NO: 1839712 - RNA, 22 nt, Homo sapiens
ugggacucaguuguucugagca

SEQ ID NO: 1839713 - RNA, 23 nt, Homo sapiens
ucuaacucugauguaaaugaagu

SEQ ID NO: 1839714 - RNA, 19 nt, Homo sapiens
ugguuaauaaaacugcaca

SEQ ID NO: 1839715 - RNA, 21 nt, Homo sapiens
guaacaacucguguucacuca

SEQ ID NO: 1839716 - RNA, 23 nt, Homo sapiens
cuacuucuuggaaaaaaauuaca

SEQ ID NO: 1839717 - RNA, 19 nt, Homo sapiens
ugagccaaagagaaugcca

SEQ ID NO: 1839718 - RNA, 22 nt, Homo sapiens
caacuuccccucuaacuggaca

SEQ ID NO: 1839719 - RNA, 14 nt, Homo sapiens
ggaggcugagccag

SEQ ID NO: 1839720 - RNA, 16 nt, Homo sapiens
uugcaaaaagauuuac

SEQ ID NO: 1839721 - RNA, 12 nt, Homo sapiens
guuuucacuuuc

SEQ ID NO: 1839722 - RNA, 15 nt, Homo sapiens
gcuaugucugugaug

SEQ ID NO: 1839723 - RNA, 14 nt, Homo sapiens
ugcccgugccucug

SEQ ID NO: 1839724 - RNA, 14 nt, Homo sapiens
ccuccuugugccuu

SEQ ID NO: 1839725 - RNA, 14 nt, Homo sapiens
ugccucugccuccc

SEQ ID NO: 1839726 - RNA, 19 nt, Homo sapiens
gccuguacucccagcacuu

SEQ ID NO: 1839727 - RNA, 15 nt, Homo sapiens
uuuuuacugcucuga

SEQ ID NO: 1839728 - RNA, 13 nt, Homo sapiens
aaucuucauuuaa

SEQ ID NO: 1839729 - RNA, 14 nt, Homo sapiens
uaugauagcuuaug

SEQ ID NO: 1839730 - RNA, 20 nt, Homo sapiens
ggaguguccucuucccucuc

SEQ ID NO: 1839731 - RNA, 17 nt, Homo sapiens
gccugaagcaacugaag

SEQ ID NO: 1839732 - RNA, 21 nt, Homo sapiens
gacaucgguguucuucuuccc

SEQ ID NO: 1839733 - RNA, 21 nt, Homo sapiens
agcaauaacauacaugagaua

SEQ ID NO: 1839734 - RNA, 20 nt, Homo sapiens
gcuguuguguuguuguuauu

SEQ ID NO: 1839735 - RNA, 20 nt, Homo sapiens
uuucacauaaacacauacau

SEQ ID NO: 1839736 - RNA, 22 nt, Homo sapiens
aauccuuucauaaagcaccagc

SEQ ID NO: 1839737 - RNA, 17 nt, Homo sapiens
ugaccaguuuaaccuga

SEQ ID NO: 1839738 - RNA, 14 nt, Homo sapiens
ccugaauggucuca

SEQ ID NO: 1839739 - RNA, 14 nt, Homo sapiens
agcuccaugugcau

SEQ ID NO: 1839740 - RNA, 15 nt, Homo sapiens
augucuucaauggaa

SEQ ID NO: 1839741 - RNA, 19 nt, Homo sapiens
gaccugccucucacacaca

SEQ ID NO: 1839742 - RNA, 20 nt, Homo sapiens
cuccuggaggcccuggucag

SEQ ID NO: 1839743 - RNA, 21 nt, Homo sapiens
aggacaacagcaucuucccaa

SEQ ID NO: 1839744 - RNA, 22 nt, Homo sapiens
cuuuggcaaauaaaccuccuaa

SEQ ID NO: 1839745 - RNA, 19 nt, Homo sapiens
gaacaauaaaaugucuucu

SEQ ID NO: 1839746 - RNA, 17 nt, Homo sapiens
acagauguaaaugccac

SEQ ID NO: 1839747 - RNA, 17 nt, Homo sapiens
agucacugccacuuugc

SEQ ID NO: 1839748 - RNA, 22 nt, Homo sapiens
ugggaagucguccuuacuccug

SEQ ID NO: 1839749 - RNA, 15 nt, Homo sapiens
aaaguuaaauuagcu

SEQ ID NO: 1839750 - RNA, 15 nt, Homo sapiens
aauuagucaaaccac

SEQ ID NO: 1839751 - RNA, 15 nt, Homo sapiens
uuaaaagucacauaa

SEQ ID NO: 1839752 - RNA, 23 nt, Homo sapiens
accucuuuggauguuuuccccaa

SEQ ID NO: 1839753 - RNA, 17 nt, Homo sapiens
ucagguguuacuagaag

SEQ ID NO: 1839754 - RNA, 14 nt, Homo sapiens
agaaauacuguauu

SEQ ID NO: 1839755 - RNA, 18 nt, Homo sapiens
uugcacuguuuucugucg

SEQ ID NO: 1839756 - RNA, 17 nt, Homo sapiens
ucagaguugcuuuucua

SEQ ID NO: 1839757 - RNA, 22 nt, Homo sapiens
aaggcugacagacucacuggga

SEQ ID NO: 1839758 - RNA, 20 nt, Homo sapiens
uggcuuuugcggccaguauu

SEQ ID NO: 1839759 - RNA, 16 nt, Homo sapiens
gagcauuggcugagag

SEQ ID NO: 1839760 - RNA, 18 nt, Homo sapiens
auguaguuuugugaugca

SEQ ID NO: 1839761 - RNA, 12 nt, Homo sapiens
ccaggggaccag

SEQ ID NO: 1839762 - RNA, 20 nt, Homo sapiens
uaaacuaucaauaauacaaa

SEQ ID NO: 1839763 - RNA, 14 nt, Homo sapiens
ucugccccagucgu

SEQ ID NO: 1839764 - RNA, 13 nt, Homo sapiens
ugcaaugugcuac

SEQ ID NO: 1839765 - RNA, 17 nt, Homo sapiens
cagauagaguuccauau

SEQ ID NO: 1839766 - RNA, 20 nt, Homo sapiens
gacuacauuugugaacaaaa

SEQ ID NO: 1839767 - RNA, 17 nt, Homo sapiens
gaaugacggcaaacuca

SEQ ID NO: 1839768 - RNA, 18 nt, Homo sapiens
ucuaaaguuuugcaacaa

SEQ ID NO: 1839769 - RNA, 15 nt, Homo sapiens
uaccagaaagcaguu

SEQ ID NO: 1839770 - RNA, 15 nt, Homo sapiens
augauugaaaccaag

SEQ ID NO: 1839771 - RNA, 19 nt, Homo sapiens
auccagccuuuccaaguca

SEQ ID NO: 1839772 - RNA, 19 nt, Homo sapiens
gcccggcugugauugcugc

SEQ ID NO: 1839773 - RNA, 23 nt, Homo sapiens
caaggaaaaguucuuucaaccua

SEQ ID NO: 1839774 - RNA, 14 nt, Homo sapiens
cugcugccauuuga

SEQ ID NO: 1839775 - RNA, 12 nt, Homo sapiens
cagaugucuucu

SEQ ID NO: 1839776 - RNA, 21 nt, Homo sapiens
gcaguuugcuuuguaugcacu

SEQ ID NO: 1839777 - RNA, 21 nt, Homo sapiens
ugaccucgugaucuacccacc

SEQ ID NO: 1839778 - RNA, 22 nt, Homo sapiens
acucuguugaauauuuagcaua

SEQ ID NO: 1839779 - RNA, 16 nt, Homo sapiens
ccccuggggcuguauu

SEQ ID NO: 1839780 - RNA, 15 nt, Homo sapiens
cuaauucaacauaua

SEQ ID NO: 1839781 - RNA, 19 nt, Homo sapiens
gcauuuggugguuucagaa

SEQ ID NO: 1839782 - RNA, 20 nt, Homo sapiens
aggguagcuauuacugucca

SEQ ID NO: 1839783 - RNA, 15 nt, Homo sapiens
aaucauggccucuug

SEQ ID NO: 1839784 - RNA, 16 nt, Homo sapiens
ucccagggcccuagaa

SEQ ID NO: 1839785 - RNA, 19 nt, Homo sapiens
agauacaguggagacaucu

SEQ ID NO: 1839786 - RNA, 17 nt, Homo sapiens
uccuagggccacugaag

SEQ ID NO: 1839787 - RNA, 20 nt, Homo sapiens
uucuuugggauugcuaugaa

SEQ ID NO: 1839788 - RNA, 12 nt, Homo sapiens
aagacaucaaag

SEQ ID NO: 1839789 - RNA, 20 nt, Homo sapiens
cugucauuaguauuucacaa

SEQ ID NO: 1839790 - RNA, 18 nt, Homo sapiens
gggcaugggaaggugggc

SEQ ID NO: 1839791 - RNA, 18 nt, Homo sapiens
ccccaucauuacugguaa

SEQ ID NO: 1839792 - RNA, 21 nt, Homo sapiens
aagcacuccucccugauguac

SEQ ID NO: 1839793 - RNA, 19 nt, Homo sapiens
uuacacuauugugaauauu

SEQ ID NO: 1839794 - RNA, 10 nt, Homo sapiens
ccucugucac

SEQ ID NO: 1839795 - RNA, 16 nt, Homo sapiens
cacuccagguggaaca

SEQ ID NO: 1839796 - RNA, 19 nt, Homo sapiens
uagugguguuuuaaagaga

SEQ ID NO: 1839797 - RNA, 19 nt, Homo sapiens
acaagagugaauuugaccu

SEQ ID NO: 1839798 - RNA, 17 nt, Homo sapiens
ccugggguaccaugugg

SEQ ID NO: 1839799 - RNA, 17 nt, Homo sapiens
uaaaugaacugacuuca

SEQ ID NO: 1839800 - RNA, 13 nt, Homo sapiens
acauguaacuuuc

SEQ ID NO: 1839801 - RNA, 16 nt, Homo sapiens
aacauggauacuuccu

SEQ ID NO: 1839802 - RNA, 16 nt, Homo sapiens
agaccaucccugaaga

SEQ ID NO: 1839803 - RNA, 17 nt, Homo sapiens
ugccgguuaucucgaaa

SEQ ID NO: 1839804 - RNA, 17 nt, Homo sapiens
agagcuuuuuuacauaa

SEQ ID NO: 1839805 - RNA, 23 nt, Homo sapiens
gcauuuaggaaagcagugcagua

SEQ ID NO: 1839806 - RNA, 20 nt, Homo sapiens
gaaauucaaccugugucuua

SEQ ID NO: 1839807 - RNA, 20 nt, Homo sapiens
gucccagugggaggcgcgag

SEQ ID NO: 1839808 - RNA, 13 nt, Homo sapiens
uuagcaauacugg

SEQ ID NO: 1839809 - RNA, 19 nt, Homo sapiens
cuaacaucuugaauacucu

SEQ ID NO: 1839810 - RNA, 22 nt, Homo sapiens
uauucaucauucauucauucac

SEQ ID NO: 1839811 - RNA, 21 nt, Homo sapiens
aauucauacauaguacauaca

SEQ ID NO: 1839812 - RNA, 13 nt, Homo sapiens
agagcucucauga

SEQ ID NO: 1839813 - RNA, 18 nt, Homo sapiens
ucagauugcuuuggguaa

SEQ ID NO: 1839814 - RNA, 14 nt, Homo sapiens
guacuagugccauu

SEQ ID NO: 1839815 - RNA, 20 nt, Homo sapiens
accaaaugcuuuuugaucug

SEQ ID NO: 1839816 - RNA, 17 nt, Homo sapiens
caaaauugcaaaccacg

SEQ ID NO: 1839817 - RNA, 18 nt, Homo sapiens
caguguauuuggaaaaug

SEQ ID NO: 1839818 - RNA, 21 nt, Homo sapiens
uacgacuuauuuuguugaaau

SEQ ID NO: 1839819 - RNA, 23 nt, Homo sapiens
ugagaacauuuacacauucucac

SEQ ID NO: 1839820 - RNA, 20 nt, Homo sapiens
gugaggugugucacaaugag

SEQ ID NO: 1839821 - RNA, 14 nt, Homo sapiens
agcugcaauaggaa

SEQ ID NO: 1839822 - RNA, 18 nt, Homo sapiens
cccuaaucccagcacuuu

SEQ ID NO: 1839823 - RNA, 15 nt, Homo sapiens
cauauggucauccaa

SEQ ID NO: 1839824 - RNA, 16 nt, Homo sapiens
uauacaguucuaugca

SEQ ID NO: 1839825 - RNA, 13 nt, Homo sapiens
ccaggcucucugc

SEQ ID NO: 1839826 - RNA, 15 nt, Homo sapiens
uauuuagcaguauug

SEQ ID NO: 1839827 - RNA, 18 nt, Homo sapiens
cgauuauuuccaguguuc

SEQ ID NO: 1839828 - RNA, 12 nt, Homo sapiens
uggucugugaga

SEQ ID NO: 1839829 - RNA, 17 nt, Homo sapiens
gaguauguuauuucucu

SEQ ID NO: 1839830 - RNA, 19 nt, Homo sapiens
gaucauuugagcucaggag

SEQ ID NO: 1839831 - RNA, 20 nt, Homo sapiens
aggcccugcugcccaaucuc

SEQ ID NO: 1839832 - RNA, 23 nt, Homo sapiens
cauuaaaauaaaccaaauauguu

SEQ ID NO: 1839833 - RNA, 17 nt, Homo sapiens
uggguuguguguuuauu

SEQ ID NO: 1839834 - RNA, 13 nt, Homo sapiens
ccugccugcauuc

SEQ ID NO: 1839835 - RNA, 13 nt, Homo sapiens
acaguuaaggaau

SEQ ID NO: 1839836 - RNA, 13 nt, Homo sapiens
acagauaaggaaa

SEQ ID NO: 1839837 - RNA, 12 nt, Homo sapiens
aaucaacaucuc

SEQ ID NO: 1839838 - RNA, 16 nt, Homo sapiens
gaguggccagccagug

SEQ ID NO: 1839839 - RNA, 14 nt, Homo sapiens
guauaaaaucugaa

SEQ ID NO: 1839840 - RNA, 13 nt, Homo sapiens
uuucaaagacuua

SEQ ID NO: 1839841 - RNA, 14 nt, Homo sapiens
agccuagaacaucc

SEQ ID NO: 1839842 - RNA, 12 nt, Homo sapiens
uaaagcuuuauc

SEQ ID NO: 1839843 - RNA, 14 nt, Homo sapiens
caugagccacugca

SEQ ID NO: 1839844 - RNA, 13 nt, Homo sapiens
ucuugggucuugg

SEQ ID NO: 1839845 - RNA, 15 nt, Homo sapiens
auguugaccauucca

SEQ ID NO: 1839846 - RNA, 20 nt, Homo sapiens
cuuuccugccgagugcucug

SEQ ID NO: 1839847 - RNA, 15 nt, Homo sapiens
cucacugaaacaugg

SEQ ID NO: 1839848 - RNA, 16 nt, Homo sapiens
uagaugauuucuagca

SEQ ID NO: 1839849 - RNA, 16 nt, Homo sapiens
auaaaagguuguguac

SEQ ID NO: 1839850 - RNA, 23 nt, Homo sapiens
agcaacccaggagccuaguacaa

SEQ ID NO: 1839851 - RNA, 19 nt, Homo sapiens
uuuccuuuuugacacugaa

SEQ ID NO: 1839852 - RNA, 18 nt, Homo sapiens
aagagagaaaucugaaaa

SEQ ID NO: 1839853 - RNA, 13 nt, Homo sapiens
agugcaguggcuc

SEQ ID NO: 1839854 - RNA, 13 nt, Homo sapiens
gggagucauugcc

SEQ ID NO: 1839855 - RNA, 13 nt, Homo sapiens
ugaacacucuugg

SEQ ID NO: 1839856 - RNA, 14 nt, Homo sapiens
cagugaaagccaga

SEQ ID NO: 1839857 - RNA, 13 nt, Homo sapiens
gugcaaguguaug

SEQ ID NO: 1839858 - RNA, 17 nt, Homo sapiens
guaauucucaggccauc

SEQ ID NO: 1839859 - RNA, 20 nt, Homo sapiens
aauacauaaaguaugugcau

SEQ ID NO: 1839860 - RNA, 20 nt, Homo sapiens
gugguuuauugaaugugauu

SEQ ID NO: 1839861 - RNA, 18 nt, Homo sapiens
cauuguggacuguaucca

SEQ ID NO: 1839862 - RNA, 13 nt, Homo sapiens
aauuugauacuua

SEQ ID NO: 1839863 - RNA, 16 nt, Homo sapiens
gcccguuuccauacag

SEQ ID NO: 1839864 - RNA, 20 nt, Homo sapiens
acagauggaauuagaaauau

SEQ ID NO: 1839865 - RNA, 14 nt, Homo sapiens
uauagucucaaauc

SEQ ID NO: 1839866 - RNA, 19 nt, Homo sapiens
ccagcuuucuauuuucuaa

SEQ ID NO: 1839867 - RNA, 17 nt, Homo sapiens
uuaagguagaaccucac

SEQ ID NO: 1839868 - RNA, 13 nt, Homo sapiens
acaauuuagccag

SEQ ID NO: 1839869 - RNA, 15 nt, Homo sapiens
cugccucuggucaag

SEQ ID NO: 1839870 - RNA, 21 nt, Homo sapiens
gguagcauucuucuuuuggca

SEQ ID NO: 1839871 - RNA, 22 nt, Homo sapiens
ccugcuuagugucccuuaccug

SEQ ID NO: 1839872 - RNA, 20 nt, Homo sapiens
agguucccaggaggccucac

SEQ ID NO: 1839873 - RNA, 22 nt, Homo sapiens
augaugagguuuucuuaacuua

SEQ ID NO: 1839874 - RNA, 18 nt, Homo sapiens
uuaauuaccuggugagua

SEQ ID NO: 1839875 - RNA, 12 nt, Homo sapiens
auccacaucuaa

SEQ ID NO: 1839876 - RNA, 19 nt, Homo sapiens
auuucuaguaccugugacu

SEQ ID NO: 1839877 - RNA, 12 nt, Homo sapiens
caauccaucaaa

SEQ ID NO: 1839878 - RNA, 12 nt, Homo sapiens
ccuggagcucaa

SEQ ID NO: 1839879 - RNA, 12 nt, Homo sapiens
ccuuaucccaua

SEQ ID NO: 1839880 - RNA, 12 nt, Homo sapiens
ccaaggugguga

SEQ ID NO: 1839881 - RNA, 22 nt, Homo sapiens
aacccaaauguucaucaaugaa

SEQ ID NO: 1839882 - RNA, 13 nt, Homo sapiens
cuuaagugacaaa

SEQ ID NO: 1839883 - RNA, 11 nt, Homo sapiens
gaagcauguac

SEQ ID NO: 1839884 - RNA, 23 nt, Homo sapiens
auccaagaaggccuucauggccc

SEQ ID NO: 1839885 - RNA, 16 nt, Homo sapiens
aaucaaauuuugccag

SEQ ID NO: 1839886 - RNA, 20 nt, Homo sapiens
cuagaugugcaaaugcaagc

SEQ ID NO: 1839887 - RNA, 22 nt, Homo sapiens
ugaacaauugcuuuaacaguca

SEQ ID NO: 1839888 - RNA, 11 nt, Homo sapiens
agcuggcccag

SEQ ID NO: 1839889 - RNA, 15 nt, Homo sapiens
ugggggaaaacuaga

SEQ ID NO: 1839890 - RNA, 21 nt, Homo sapiens
accuagauuccauacagugac

SEQ ID NO: 1839891 - RNA, 14 nt, Homo sapiens
gugcugcuuugaua

SEQ ID NO: 1839892 - RNA, 13 nt, Homo sapiens
gacauaugcagug

SEQ ID NO: 1839893 - RNA, 22 nt, Homo sapiens
gccauggaggcgccuuccuggg

SEQ ID NO: 1839894 - RNA, 12 nt, Homo sapiens
caugcuuuauua

SEQ ID NO: 1839895 - RNA, 16 nt, Homo sapiens
cuuucuuuacucuggg

SEQ ID NO: 1839896 - RNA, 24 nt, Homo sapiens
aucccucuaauuucucauuuaugc

SEQ ID NO: 1839897 - RNA, 23 nt, Homo sapiens
acuugaaaauaauaaaguggcau

SEQ ID NO: 1839898 - RNA, 15 nt, Homo sapiens
uuucuaagccuuuga

SEQ ID NO: 1839899 - RNA, 14 nt, Homo sapiens
acccuuaauaacau

SEQ ID NO: 1839900 - RNA, 22 nt, Homo sapiens
gccgggccggccccaccugccu

SEQ ID NO: 1839901 - RNA, 15 nt, Homo sapiens
ugacauaucacaugu

SEQ ID NO: 1839902 - RNA, 22 nt, Homo sapiens
ugacagagugagacccugucuc

SEQ ID NO: 1839903 - RNA, 15 nt, Homo sapiens
cugccauuuuugcaa

SEQ ID NO: 1839904 - RNA, 17 nt, Homo sapiens
cgcucggcccggagcag

SEQ ID NO: 1839905 - RNA, 21 nt, Homo sapiens
caucugaagaaauugguccca

SEQ ID NO: 1839906 - RNA, 22 nt, Homo sapiens
ucaucuggggaugacaauggac

SEQ ID NO: 1839907 - RNA, 18 nt, Homo sapiens
uucagguaauacaaacua

SEQ ID NO: 1839908 - RNA, 19 nt, Homo sapiens
cucuaaccaguguacaggu

SEQ ID NO: 1839909 - RNA, 13 nt, Homo sapiens
gaagcaaucauuu

SEQ ID NO: 1839910 - RNA, 13 nt, Homo sapiens
uucucccauuucc

SEQ ID NO: 1839911 - RNA, 15 nt, Homo sapiens
ggcaagugaggcaag

SEQ ID NO: 1839912 - RNA, 15 nt, Homo sapiens
ucuggaccuagggug

SEQ ID NO: 1839913 - RNA, 19 nt, Homo sapiens
uguaaaaucuauuuaugaa

SEQ ID NO: 1839914 - RNA, 15 nt, Homo sapiens
uaaaaccacuguaca

SEQ ID NO: 1839915 - RNA, 14 nt, Homo sapiens
ugccaaagaacuug

SEQ ID NO: 1839916 - RNA, 23 nt, Homo sapiens
agaugucgcccuacucaccugag

SEQ ID NO: 1839917 - RNA, 23 nt, Homo sapiens
cugcugggggcagcaguaccauc

SEQ ID NO: 1839918 - RNA, 13 nt, Homo sapiens
agcuaccagcuau

SEQ ID NO: 1839919 - RNA, 18 nt, Homo sapiens
cuugauugguucuuccaa

SEQ ID NO: 1839920 - RNA, 15 nt, Homo sapiens
guagcuauucuuuga

SEQ ID NO: 1839921 - RNA, 20 nt, Homo sapiens
uuugucagcaucugaccauc

SEQ ID NO: 1839922 - RNA, 12 nt, Homo sapiens
gggugaggaccc

SEQ ID NO: 1839923 - RNA, 14 nt, Homo sapiens
gugaacuuacacuu

SEQ ID NO: 1839924 - RNA, 16 nt, Homo sapiens
cugcaagcccacuggc

SEQ ID NO: 1839925 - RNA, 18 nt, Homo sapiens
gacucuuugcaacagcac

SEQ ID NO: 1839926 - RNA, 20 nt, Homo sapiens
ugugugacaccaccacugug

SEQ ID NO: 1839927 - RNA, 14 nt, Homo sapiens
auaccucugaccaa

SEQ ID NO: 1839928 - RNA, 18 nt, Homo sapiens
aagacugaagacugcaca

SEQ ID NO: 1839929 - RNA, 18 nt, Homo sapiens
ccucagggagcagggaag

SEQ ID NO: 1839930 - RNA, 14 nt, Homo sapiens
ugaaaaauuacuua

SEQ ID NO: 1839931 - RNA, 19 nt, Homo sapiens
caguuccucccccaguucc

SEQ ID NO: 1839932 - RNA, 14 nt, Homo sapiens
guagauaacagcuu

SEQ ID NO: 1839933 - RNA, 14 nt, Homo sapiens
aaggcaguauuuca

SEQ ID NO: 1839934 - RNA, 22 nt, Homo sapiens
agagagcagcuucagugacaaa

SEQ ID NO: 1839935 - RNA, 19 nt, Homo sapiens
gggcaagagggaaggugac

SEQ ID NO: 1839936 - RNA, 15 nt, Homo sapiens
aaagcaugggaaaaa

SEQ ID NO: 1839937 - RNA, 21 nt, Homo sapiens
uucuuuuccaagcuccuuauu

SEQ ID NO: 1839938 - RNA, 16 nt, Homo sapiens
uauugaacuuaugcaa

SEQ ID NO: 1839939 - RNA, 11 nt, Homo sapiens
cgucauuucau

SEQ ID NO: 1839940 - RNA, 16 nt, Homo sapiens
uacuuuaucaaugugu

SEQ ID NO: 1839941 - RNA, 20 nt, Homo sapiens
gccccagacgcauagacuga

SEQ ID NO: 1839942 - RNA, 18 nt, Homo sapiens
ucauucaacucuccaaug

SEQ ID NO: 1839943 - RNA, 20 nt, Homo sapiens
ccucauauggcccaguguca

SEQ ID NO: 1839944 - RNA, 22 nt, Homo sapiens
gcaaaugaucagccuugcaaau

SEQ ID NO: 1839945 - RNA, 21 nt, Homo sapiens
ggguggcccccugugccagcu

SEQ ID NO: 1839946 - RNA, 14 nt, Homo sapiens
cggcaacaucucug

SEQ ID NO: 1839947 - RNA, 17 nt, Homo sapiens
agcuugcuuaaggcaua

SEQ ID NO: 1839948 - RNA, 21 nt, Homo sapiens
uacuucuucauccauagacac

SEQ ID NO: 1839949 - RNA, 17 nt, Homo sapiens
cauauguuccaugccug

SEQ ID NO: 1839950 - RNA, 19 nt, Homo sapiens
caugaaggacacucugcag

SEQ ID NO: 1839951 - RNA, 19 nt, Homo sapiens
ggcccugggccucaguuca

SEQ ID NO: 1839952 - RNA, 19 nt, Homo sapiens
agacggacagcguguggca

SEQ ID NO: 1839953 - RNA, 19 nt, Homo sapiens
gcccucuccugggcagcug

SEQ ID NO: 1839954 - RNA, 12 nt, Homo sapiens
uauguaccauau

SEQ ID NO: 1839955 - RNA, 15 nt, Homo sapiens
auaaaaagugacaca

SEQ ID NO: 1839956 - RNA, 12 nt, Homo sapiens
auuugcauuuca

SEQ ID NO: 1839957 - RNA, 17 nt, Homo sapiens
ccagaugccaaccagac

SEQ ID NO: 1839958 - RNA, 14 nt, Homo sapiens
gaaagcccucuugg

SEQ ID NO: 1839959 - RNA, 19 nt, Homo sapiens
ucccuucccuaaagugaug

SEQ ID NO: 1839960 - RNA, 21 nt, Homo sapiens
cuuuucccccaaagaugugua

SEQ ID NO: 1839961 - RNA, 14 nt, Homo sapiens
gugaagagcauuug

SEQ ID NO: 1839962 - RNA, 22 nt, Homo sapiens
caaauuacuccaagguuuauaa

SEQ ID NO: 1839963 - RNA, 18 nt, Homo sapiens
auguauguuuacauauca

SEQ ID NO: 1839964 - RNA, 13 nt, Homo sapiens
auuugcuauuuau

SEQ ID NO: 1839965 - RNA, 23 nt, Homo sapiens
ccuucaugcuuuuuucccagaau

SEQ ID NO: 1839966 - RNA, 17 nt, Homo sapiens
uuuuccaacuuggcugc

SEQ ID NO: 1839967 - RNA, 13 nt, Homo sapiens
cauuugccaggau

SEQ ID NO: 1839968 - RNA, 20 nt, Homo sapiens
ugccucacaucucccuucca

SEQ ID NO: 1839969 - RNA, 21 nt, Homo sapiens
acccuccuguccagcagguag

SEQ ID NO: 1839970 - RNA, 13 nt, Homo sapiens
aggggguguaaug

SEQ ID NO: 1839971 - RNA, 23 nt, Homo sapiens
aauccucagguaguacugggaau

SEQ ID NO: 1839972 - RNA, 21 nt, Homo sapiens
cccaggccacagccagccugu

SEQ ID NO: 1839973 - RNA, 21 nt, Homo sapiens
ucccacuggauccauccgucc

SEQ ID NO: 1839974 - RNA, 18 nt, Homo sapiens
aaaagcaagggaccuuca

SEQ ID NO: 1839975 - RNA, 18 nt, Homo sapiens
aauuugacuccucuucaa

SEQ ID NO: 1839976 - RNA, 15 nt, Homo sapiens
ucaucuaacugauga

SEQ ID NO: 1839977 - RNA, 23 nt, Homo sapiens
gaagcccuugccugaaagcaaga

SEQ ID NO: 1839978 - RNA, 17 nt, Homo sapiens
ugccugggccuuggcaa

SEQ ID NO: 1839979 - RNA, 18 nt, Homo sapiens
aguugaccccuccugaac

SEQ ID NO: 1839980 - RNA, 14 nt, Homo sapiens
augaaaaugaaucu

SEQ ID NO: 1839981 - RNA, 24 nt, Homo sapiens
uggccucccacggugcugagacua

SEQ ID NO: 1839982 - RNA, 17 nt, Homo sapiens
agcugggacuacaggug

SEQ ID NO: 1839983 - RNA, 23 nt, Homo sapiens
ugggugagcucuuccaggagcca

SEQ ID NO: 1839984 - RNA, 17 nt, Homo sapiens
augaguuuaucauguca

SEQ ID NO: 1839985 - RNA, 24 nt, Homo sapiens
aacucgcgaguguaacuuucauac

SEQ ID NO: 1839986 - RNA, 14 nt, Homo sapiens
uguauagugcaugu

SEQ ID NO: 1839987 - RNA, 23 nt, Homo sapiens
aauccaggaauuaaaucaucccu

SEQ ID NO: 1839988 - RNA, 15 nt, Homo sapiens
accaguguagcauug

SEQ ID NO: 1839989 - RNA, 14 nt, Homo sapiens
auucuaguacauaa

SEQ ID NO: 1839990 - RNA, 18 nt, Homo sapiens
cuuugaccccagcagcuu

SEQ ID NO: 1839991 - RNA, 16 nt, Homo sapiens
uacauauuaucucauu

SEQ ID NO: 1839992 - RNA, 17 nt, Homo sapiens
uagucccagcuacuccg

SEQ ID NO: 1839993 - RNA, 19 nt, Homo sapiens
caucuaccggcguccugcc

SEQ ID NO: 1839994 - RNA, 19 nt, Homo sapiens
ggcccagugcaaucugucc

SEQ ID NO: 1839995 - RNA, 19 nt, Homo sapiens
aaauuuccagugagcuuau

SEQ ID NO: 1839996 - RNA, 15 nt, Homo sapiens
agccaagaccaucuc

SEQ ID NO: 1839997 - RNA, 14 nt, Homo sapiens
acuuaucaguuugc

SEQ ID NO: 1839998 - RNA, 18 nt, Homo sapiens
ccugcagucaauguuucg

SEQ ID NO: 1839999 - RNA, 16 nt, Homo sapiens
cauuaacucccuccac

SEQ ID NO: 1840000 - RNA, 22 nt, Homo sapiens
cugugaaaucauaaaguccuuu

SEQ ID NO: 1840001 - RNA, 20 nt, Homo sapiens
ugggaggcagagguugcagu

SEQ ID NO: 1840002 - RNA, 15 nt, Homo sapiens
cugccugcccugaaa

SEQ ID NO: 1840003 - RNA, 13 nt, Homo sapiens
uuuacccauuugu

SEQ ID NO: 1840004 - RNA, 15 nt, Homo sapiens
gaaaagcaaaucugu

SEQ ID NO: 1840005 - RNA, 14 nt, Homo sapiens
cugguuguucuguu

SEQ ID NO: 1840006 - RNA, 21 nt, Homo sapiens
ucaaauggaagacacauugaa

SEQ ID NO: 1840007 - RNA, 15 nt, Homo sapiens
auccaaggccacuac

SEQ ID NO: 1840008 - RNA, 23 nt, Homo sapiens
ccuccugugccucccuuuucucc

SEQ ID NO: 1840009 - RNA, 12 nt, Homo sapiens
cacuuugcucuc

SEQ ID NO: 1840010 - RNA, 15 nt, Homo sapiens
ccuguguagcucuca

SEQ ID NO: 1840011 - RNA, 22 nt, Homo sapiens
cuauuuaauuauuucacuuuag

SEQ ID NO: 1840012 - RNA, 22 nt, Homo sapiens
uaauuaaacaagugcacuugaa

SEQ ID NO: 1840013 - RNA, 20 nt, Homo sapiens
cguggcugcugugggaaaug

SEQ ID NO: 1840014 - RNA, 20 nt, Homo sapiens
gagggcccagggucauucuu

SEQ ID NO: 1840015 - RNA, 17 nt, Homo sapiens
uagaaagagaaacaguu

SEQ ID NO: 1840016 - RNA, 14 nt, Homo sapiens
ucuuucaucaauca

SEQ ID NO: 1840017 - RNA, 17 nt, Homo sapiens
aaauuuuaaacuuauga

SEQ ID NO: 1840018 - RNA, 23 nt, Homo sapiens
cuuaaaugaaaaaaaugaucuau

SEQ ID NO: 1840019 - RNA, 17 nt, Homo sapiens
ugugcauuaaacaaaaa

SEQ ID NO: 1840020 - RNA, 23 nt, Homo sapiens
uuuaagggauugcuuucaucuaa

SEQ ID NO: 1840021 - RNA, 12 nt, Homo sapiens
uccaagcugugu

SEQ ID NO: 1840022 - RNA, 13 nt, Homo sapiens
caaaaauuugcau

SEQ ID NO: 1840023 - RNA, 14 nt, Homo sapiens
uacaugucuuccau

SEQ ID NO: 1840024 - RNA, 22 nt, Homo sapiens
uuguaaucaaggugacuaagaa

SEQ ID NO: 1840025 - RNA, 14 nt, Homo sapiens
agaaaucuacugaa

SEQ ID NO: 1840026 - RNA, 20 nt, Homo sapiens
gggaugcugggcugggcccu

SEQ ID NO: 1840027 - RNA, 23 nt, Homo sapiens
cacuucugggcccuaggcugcuu

SEQ ID NO: 1840028 - RNA, 11 nt, Homo sapiens
accguuuccaa

SEQ ID NO: 1840029 - RNA, 15 nt, Homo sapiens
agaggcccugugguc

SEQ ID NO: 1840030 - RNA, 15 nt, Homo sapiens
uguuucccagauuuc

SEQ ID NO: 1840031 - RNA, 13 nt, Homo sapiens
ucucaaauuuauu

SEQ ID NO: 1840032 - RNA, 23 nt, Homo sapiens
aagacuauucccuucuaaccuga

SEQ ID NO: 1840033 - RNA, 23 nt, Homo sapiens
accuuaaaaaugcgggcauuuaa

SEQ ID NO: 1840034 - RNA, 14 nt, Homo sapiens
aaauuacagaagaa

SEQ ID NO: 1840035 - RNA, 21 nt, Homo sapiens
cuguagacauuugcuaugagc

SEQ ID NO: 1840036 - RNA, 19 nt, Homo sapiens
aaaccauuuucaaaagcaa

SEQ ID NO: 1840037 - RNA, 17 nt, Homo sapiens
uccacaggcaacgcaga

SEQ ID NO: 1840038 - RNA, 19 nt, Homo sapiens
auaaacucagucaaaugua

SEQ ID NO: 1840039 - RNA, 22 nt, Homo sapiens
uguaacugcucagagcuuuaaa

SEQ ID NO: 1840040 - RNA, 14 nt, Homo sapiens
ugaaauaccacaag

SEQ ID NO: 1840041 - RNA, 18 nt, Homo sapiens
uguucccauuuuugcuua

SEQ ID NO: 1840042 - RNA, 15 nt, Homo sapiens
uuccauucuuggcau

SEQ ID NO: 1840043 - RNA, 15 nt, Homo sapiens
guguagugucuguaa

SEQ ID NO: 1840044 - RNA, 14 nt, Homo sapiens
gaaaacaacauugg

SEQ ID NO: 1840045 - RNA, 22 nt, Homo sapiens
aaugugaaauaaagaguucucc

SEQ ID NO: 1840046 - RNA, 22 nt, Homo sapiens
agccugaguccacgaccuaggc

SEQ ID NO: 1840047 - RNA, 20 nt, Homo sapiens
caaaugguggguacaaaaag

SEQ ID NO: 1840048 - RNA, 22 nt, Homo sapiens
agaguauagcucuguaguggaa

SEQ ID NO: 1840049 - RNA, 15 nt, Homo sapiens
ugguuggacaccauc

SEQ ID NO: 1840050 - RNA, 22 nt, Homo sapiens
aguaggcaucaguaugucacuc

SEQ ID NO: 1840051 - RNA, 20 nt, Homo sapiens
uggccucacuaccagaagaa

SEQ ID NO: 1840052 - RNA, 16 nt, Homo sapiens
cagggccugagcagcu

SEQ ID NO: 1840053 - RNA, 16 nt, Homo sapiens
uugugcugccauuuga

SEQ ID NO: 1840054 - RNA, 23 nt, Homo sapiens
gcugagggccucucuacuucccc

SEQ ID NO: 1840055 - RNA, 14 nt, Homo sapiens
gaagccuucugacc

SEQ ID NO: 1840056 - RNA, 23 nt, Homo sapiens
auugguuuuggggaaauguggag

SEQ ID NO: 1840057 - RNA, 12 nt, Homo sapiens
uuaagugccuuu

SEQ ID NO: 1840058 - RNA, 15 nt, Homo sapiens
gugagaggacucuga

SEQ ID NO: 1840059 - RNA, 21 nt, Homo sapiens
aacuugguuuguggugcacag

SEQ ID NO: 1840060 - RNA, 15 nt, Homo sapiens
uuaaaacuacuuuag

SEQ ID NO: 1840061 - RNA, 11 nt, Homo sapiens
caaaaauugac

SEQ ID NO: 1840062 - RNA, 12 nt, Homo sapiens
uuuacucugugu

SEQ ID NO: 1840063 - RNA, 15 nt, Homo sapiens
cugguaauagcugua

SEQ ID NO: 1840064 - RNA, 20 nt, Homo sapiens
gugauggcuaugccuugcac

SEQ ID NO: 1840065 - RNA, 16 nt, Homo sapiens
accaugggcucagggc

SEQ ID NO: 1840066 - RNA, 15 nt, Homo sapiens
ggccuugugugucag

SEQ ID NO: 1840067 - RNA, 15 nt, Homo sapiens
caaaggcacugaggc

SEQ ID NO: 1840068 - RNA, 15 nt, Homo sapiens
caagaaaacuggaaa

SEQ ID NO: 1840069 - RNA, 12 nt, Homo sapiens
cccccugaccac

SEQ ID NO: 1840070 - RNA, 19 nt, Homo sapiens
ugccuuccgugggucaucc

SEQ ID NO: 1840071 - RNA, 15 nt, Homo sapiens
gcacaugacauagca

SEQ ID NO: 1840072 - RNA, 18 nt, Homo sapiens
gagaguuaaaagcagcag

SEQ ID NO: 1840073 - RNA, 17 nt, Homo sapiens
acuguguaccucaugga

SEQ ID NO: 1840074 - RNA, 21 nt, Homo sapiens
caagaagucuugagaaaaaga

SEQ ID NO: 1840075 - RNA, 14 nt, Homo sapiens
agcaugauugugac

SEQ ID NO: 1840076 - RNA, 21 nt, Homo sapiens
aacauuuauuucaaacuauug

SEQ ID NO: 1840077 - RNA, 18 nt, Homo sapiens
ugguaaccucuacuauga

SEQ ID NO: 1840078 - RNA, 15 nt, Homo sapiens
ugaucgcuuucuaca

SEQ ID NO: 1840079 - RNA, 19 nt, Homo sapiens
ugcagccacgucagccaaa

SEQ ID NO: 1840080 - RNA, 17 nt, Homo sapiens
agccuuugucaauaaac

SEQ ID NO: 1840081 - RNA, 18 nt, Homo sapiens
uugauguuuguggccuca

SEQ ID NO: 1840082 - RNA, 17 nt, Homo sapiens
uaacuuggucagagcca

SEQ ID NO: 1840083 - RNA, 16 nt, Homo sapiens
aacugaggcccuguga

SEQ ID NO: 1840084 - RNA, 15 nt, Homo sapiens
ugcagauaaacagua

SEQ ID NO: 1840085 - RNA, 23 nt, Homo sapiens
gauguuuuauccuuacaauguga

SEQ ID NO: 1840086 - RNA, 20 nt, Homo sapiens
ucacugcugcaaauacugua

SEQ ID NO: 1840087 - RNA, 21 nt, Homo sapiens
uagucacauggccuaugcaca

SEQ ID NO: 1840088 - RNA, 22 nt, Homo sapiens
uugauugaggagcugcacugau

SEQ ID NO: 1840089 - RNA, 19 nt, Homo sapiens
agcuacagagaaaccagcu

SEQ ID NO: 1840090 - RNA, 16 nt, Homo sapiens
cugagguauggccaug

SEQ ID NO: 1840091 - RNA, 12 nt, Homo sapiens
ggugaacuccac

SEQ ID NO: 1840092 - RNA, 11 nt, Homo sapiens
cacccacguga

SEQ ID NO: 1840093 - RNA, 19 nt, Homo sapiens
ccucuucugacgugccuuu

SEQ ID NO: 1840094 - RNA, 17 nt, Homo sapiens
ccaccucgugaacacaa

SEQ ID NO: 1840095 - RNA, 17 nt, Homo sapiens
cccaggcuuuagcauua

SEQ ID NO: 1840096 - RNA, 12 nt, Homo sapiens
cguccugcagug

SEQ ID NO: 1840097 - RNA, 20 nt, Homo sapiens
aaagucacacgaaucucacc

SEQ ID NO: 1840098 - RNA, 13 nt, Homo sapiens
caccucagucuca

SEQ ID NO: 1840099 - RNA, 22 nt, Homo sapiens
cuccauuugcucuucagaugcc

SEQ ID NO: 1840100 - RNA, 18 nt, Homo sapiens
augaugaccaagaauuac

SEQ ID NO: 1840101 - RNA, 19 nt, Homo sapiens
uuguucuguuuugugagaa

SEQ ID NO: 1840102 - RNA, 16 nt, Homo sapiens
caaacaaaccaaaaug

SEQ ID NO: 1840103 - RNA, 17 nt, Homo sapiens
gacccaagagaacucac

SEQ ID NO: 1840104 - RNA, 21 nt, Homo sapiens
uccaguggaauggagauuuca

SEQ ID NO: 1840105 - RNA, 16 nt, Homo sapiens
cuccccuccucugaau

SEQ ID NO: 1840106 - RNA, 15 nt, Homo sapiens
acagaagguugccag

SEQ ID NO: 1840107 - RNA, 22 nt, Homo sapiens
gcgcaagccuguaaucccagcu

SEQ ID NO: 1840108 - RNA, 16 nt, Homo sapiens
auaauauugccuugau

SEQ ID NO: 1840109 - RNA, 19 nt, Homo sapiens
gaauuuuugcaauaaugca

SEQ ID NO: 1840110 - RNA, 18 nt, Homo sapiens
uagagaaggcugugagcc

SEQ ID NO: 1840111 - RNA, 18 nt, Homo sapiens
acacuucugcuuucacuu

SEQ ID NO: 1840112 - RNA, 22 nt, Homo sapiens
cucacagcccugcuuaccagau

SEQ ID NO: 1840113 - RNA, 16 nt, Homo sapiens
cucacugugaccugcu

SEQ ID NO: 1840114 - RNA, 21 nt, Homo sapiens
auuugugguugcaugucuguu

SEQ ID NO: 1840115 - RNA, 13 nt, Homo sapiens
agcucaacucggg

SEQ ID NO: 1840116 - RNA, 20 nt, Homo sapiens
acuacuugccacacacuguu

SEQ ID NO: 1840117 - RNA, 12 nt, Homo sapiens
aucuuugcagac

SEQ ID NO: 1840118 - RNA, 14 nt, Homo sapiens
ccuuucuccuguga

SEQ ID NO: 1840119 - RNA, 17 nt, Homo sapiens
acaccacuguacuccag

SEQ ID NO: 1840120 - RNA, 17 nt, Homo sapiens
cuugccaaccuguaaua

SEQ ID NO: 1840121 - RNA, 18 nt, Homo sapiens
ccgggcacugguggguga

SEQ ID NO: 1840122 - RNA, 16 nt, Homo sapiens
auaggccugucccuug

SEQ ID NO: 1840123 - RNA, 16 nt, Homo sapiens
caggaaggcugucuca

SEQ ID NO: 1840124 - RNA, 20 nt, Homo sapiens
ccugaaacgagaagugcccu

SEQ ID NO: 1840125 - RNA, 23 nt, Homo sapiens
gcaguuacagcucuguaguuuau

SEQ ID NO: 1840126 - RNA, 15 nt, Homo sapiens
augauaaaauacuaa

SEQ ID NO: 1840127 - RNA, 16 nt, Homo sapiens
uuuaucuucauuugaa

SEQ ID NO: 1840128 - RNA, 17 nt, Homo sapiens
aagaucauuaucuucau

SEQ ID NO: 1840129 - RNA, 22 nt, Homo sapiens
aaugugguuuguacauaucaaa

SEQ ID NO: 1840130 - RNA, 16 nt, Homo sapiens
acuccaucugcugcca

SEQ ID NO: 1840131 - RNA, 18 nt, Homo sapiens
agcaacuguuaugaaaua

SEQ ID NO: 1840132 - RNA, 13 nt, Homo sapiens
aucauucuucacu

SEQ ID NO: 1840133 - RNA, 21 nt, Homo sapiens
cuggaaaccuguuaugccaaa

SEQ ID NO: 1840134 - RNA, 23 nt, Homo sapiens
ggaauccgagauaggguggcaca

SEQ ID NO: 1840135 - RNA, 20 nt, Homo sapiens
accuccuuuuuugaggucag

SEQ ID NO: 1840136 - RNA, 15 nt, Homo sapiens
gcaaauuguuucagu

SEQ ID NO: 1840137 - RNA, 20 nt, Homo sapiens
gauugagauguaagucucaa

SEQ ID NO: 1840138 - RNA, 22 nt, Homo sapiens
uagucuuggaagcuguuuggaa

SEQ ID NO: 1840139 - RNA, 13 nt, Homo sapiens
uggcucucggcac

SEQ ID NO: 1840140 - RNA, 17 nt, Homo sapiens
gcuugguguacuuaaua

SEQ ID NO: 1840141 - RNA, 19 nt, Homo sapiens
gcuugggcaagugugugcc

SEQ ID NO: 1840142 - RNA, 17 nt, Homo sapiens
auuuuguaauaaacucu

SEQ ID NO: 1840143 - RNA, 16 nt, Homo sapiens
gugugaagaaagccag

SEQ ID NO: 1840144 - RNA, 17 nt, Homo sapiens
uuccggguucaagugac

SEQ ID NO: 1840145 - RNA, 23 nt, Homo sapiens
caugugacaaagggccagcaguc

SEQ ID NO: 1840146 - RNA, 15 nt, Homo sapiens
acuacaaaauuggaa

SEQ ID NO: 1840147 - RNA, 17 nt, Homo sapiens
gguuaauguguggcaua

SEQ ID NO: 1840148 - RNA, 14 nt, Homo sapiens
uggugcuaauauga

SEQ ID NO: 1840149 - RNA, 14 nt, Homo sapiens
cuggaauugccagc

SEQ ID NO: 1840150 - RNA, 19 nt, Homo sapiens
ccacuuucuucuaccagac

SEQ ID NO: 1840151 - RNA, 12 nt, Homo sapiens
cauugucugugg

SEQ ID NO: 1840152 - RNA, 16 nt, Homo sapiens
ugccacacggcucuca

SEQ ID NO: 1840153 - RNA, 21 nt, Homo sapiens
gcaccuguagucccagcuacu

SEQ ID NO: 1840154 - RNA, 20 nt, Homo sapiens
aagccuggcccauaauguga

SEQ ID NO: 1840155 - RNA, 19 nt, Homo sapiens
caaucucggcucacugcaa

SEQ ID NO: 1840156 - RNA, 11 nt, Homo sapiens
uuaugagacag

SEQ ID NO: 1840157 - RNA, 15 nt, Homo sapiens
gauuucggaggccau

SEQ ID NO: 1840158 - RNA, 22 nt, Homo sapiens
uuucccugggguacuacucucc

SEQ ID NO: 1840159 - RNA, 19 nt, Homo sapiens
cucaggacacagugggaca

SEQ ID NO: 1840160 - RNA, 15 nt, Homo sapiens
cacucugggcacaag

SEQ ID NO: 1840161 - RNA, 19 nt, Homo sapiens
cuugggaggcugaggcaga

SEQ ID NO: 1840162 - RNA, 19 nt, Homo sapiens
accagugguuuccagucau

SEQ ID NO: 1840163 - RNA, 16 nt, Homo sapiens
aguaacugugcuguac

SEQ ID NO: 1840164 - RNA, 23 nt, Homo sapiens
cugcuugugaucucacacacaga

SEQ ID NO: 1840165 - RNA, 23 nt, Homo sapiens
agagguaauuuuuuuguguagca

SEQ ID NO: 1840166 - RNA, 16 nt, Homo sapiens
uuucuaauuggcuuua

SEQ ID NO: 1840167 - RNA, 15 nt, Homo sapiens
aagcauucuuuaaca

SEQ ID NO: 1840168 - RNA, 13 nt, Homo sapiens
gcuuuuuucacau

SEQ ID NO: 1840169 - RNA, 17 nt, Homo sapiens
caucuugggaagggcca

SEQ ID NO: 1840170 - RNA, 16 nt, Homo sapiens
uuacaaaacugcuuug

SEQ ID NO: 1840171 - RNA, 12 nt, Homo sapiens
uaucaacuuuag

SEQ ID NO: 1840172 - RNA, 23 nt, Homo sapiens
auaggugcucuuccucaucucau

SEQ ID NO: 1840173 - RNA, 21 nt, Homo sapiens
cuucucucucaggccaccaca

SEQ ID NO: 1840174 - RNA, 23 nt, Homo sapiens
uucuccaccaacuggagcacuga

SEQ ID NO: 1840175 - RNA, 15 nt, Homo sapiens
ccgauuauuguguau

SEQ ID NO: 1840176 - RNA, 14 nt, Homo sapiens
agcccugacccugu

SEQ ID NO: 1840177 - RNA, 17 nt, Homo sapiens
auucuuucuaaacuaca

SEQ ID NO: 1840178 - RNA, 18 nt, Homo sapiens
ucugcugacagacacagg

SEQ ID NO: 1840179 - RNA, 14 nt, Homo sapiens
gagcugucaccucu

SEQ ID NO: 1840180 - RNA, 23 nt, Homo sapiens
gucauauuauuauuaauuuugcc

SEQ ID NO: 1840181 - RNA, 22 nt, Homo sapiens
uuuauaaaaaugagugcuuaaa

SEQ ID NO: 1840182 - RNA, 17 nt, Homo sapiens
aggggccauguccucuc

SEQ ID NO: 1840183 - RNA, 22 nt, Homo sapiens
aguuuccagcuaagccugauga

SEQ ID NO: 1840184 - RNA, 20 nt, Homo sapiens
aaucacccuacaagaugcca

SEQ ID NO: 1840185 - RNA, 18 nt, Homo sapiens
gcuggaacgcaguggugu

SEQ ID NO: 1840186 - RNA, 13 nt, Homo sapiens
ggauuuuugcucu

SEQ ID NO: 1840187 - RNA, 18 nt, Homo sapiens
acauucugggcugacuca

SEQ ID NO: 1840188 - RNA, 23 nt, Homo sapiens
cuuugaauuaaaauaaaacacau

SEQ ID NO: 1840189 - RNA, 19 nt, Homo sapiens
ugcuacccacaacaccuca

SEQ ID NO: 1840190 - RNA, 20 nt, Homo sapiens
acuaagggauggggcagucu

SEQ ID NO: 1840191 - RNA, 21 nt, Homo sapiens
acaggugugugccaucaugcc

SEQ ID NO: 1840192 - RNA, 15 nt, Homo sapiens
gccugagacacagcc

SEQ ID NO: 1840193 - RNA, 20 nt, Homo sapiens
ccugagcacccagaacucca

SEQ ID NO: 1840194 - RNA, 16 nt, Homo sapiens
gcgcuuacgugauaug

SEQ ID NO: 1840195 - RNA, 13 nt, Homo sapiens
uugaaggugcugc

SEQ ID NO: 1840196 - RNA, 15 nt, Homo sapiens
guuuauuugcacuau

SEQ ID NO: 1840197 - RNA, 20 nt, Homo sapiens
uuucauguaacauacauauu

SEQ ID NO: 1840198 - RNA, 20 nt, Homo sapiens
aacaauaaaaugucuucucc

SEQ ID NO: 1840199 - RNA, 23 nt, Homo sapiens
ugauuucggaccgaaggugacag

SEQ ID NO: 1840200 - RNA, 23 nt, Homo sapiens
aaauguuacagaaucuaacuggu

SEQ ID NO: 1840201 - RNA, 10 nt, Homo sapiens
uaacuacccu

SEQ ID NO: 1840202 - RNA, 12 nt, Homo sapiens
cgccuggugcug

SEQ ID NO: 1840203 - RNA, 22 nt, Homo sapiens
uaaaaaaaaaauccauuuuaca

SEQ ID NO: 1840204 - RNA, 22 nt, Homo sapiens
gcaguagacauuuuaacaagaa

SEQ ID NO: 1840205 - RNA, 17 nt, Homo sapiens
ggucucuagugcuguga

SEQ ID NO: 1840206 - RNA, 15 nt, Homo sapiens
uauaugcuauucaau

SEQ ID NO: 1840207 - RNA, 18 nt, Homo sapiens
gaaccuuugucaacuuca

SEQ ID NO: 1840208 - RNA, 13 nt, Homo sapiens
ucucuucugggcg

SEQ ID NO: 1840209 - RNA, 21 nt, Homo sapiens
gcaucacgucagugcucagaa

SEQ ID NO: 1840210 - RNA, 15 nt, Homo sapiens
uccauuuaagcaauu

SEQ ID NO: 1840211 - RNA, 15 nt, Homo sapiens
ucaauuaaagaaaua

SEQ ID NO: 1840212 - RNA, 20 nt, Homo sapiens
ucgaaccaaggcagccucca

SEQ ID NO: 1840213 - RNA, 13 nt, Homo sapiens
ugaauacagcagc

SEQ ID NO: 1840214 - RNA, 14 nt, Homo sapiens
uaaauaaucuacau

SEQ ID NO: 1840215 - RNA, 17 nt, Homo sapiens
aaaugaauaucaugcaa

SEQ ID NO: 1840216 - RNA, 17 nt, Homo sapiens
cuucuccaauacagcaa

SEQ ID NO: 1840217 - RNA, 21 nt, Homo sapiens
uuguuuuaaaauuaaagcuaa

SEQ ID NO: 1840218 - RNA, 19 nt, Homo sapiens
acucacauccauucuuccc

SEQ ID NO: 1840219 - RNA, 23 nt, Homo sapiens
auucacuccugccccugcccaca

SEQ ID NO: 1840220 - RNA, 19 nt, Homo sapiens
auauuaauaaaaguguuaa

SEQ ID NO: 1840221 - RNA, 19 nt, Homo sapiens
aaagaaaaacaaguuugcu

SEQ ID NO: 1840222 - RNA, 17 nt, Homo sapiens
auuuaucccuuuacaau

SEQ ID NO: 1840223 - RNA, 19 nt, Homo sapiens
uggcacaugauaugaguca

SEQ ID NO: 1840224 - RNA, 22 nt, Homo sapiens
aauauaugauuguauaauguga

SEQ ID NO: 1840225 - RNA, 17 nt, Homo sapiens
uggcagccaagagccau

SEQ ID NO: 1840226 - RNA, 16 nt, Homo sapiens
ccccuugcaagccaua

SEQ ID NO: 1840227 - RNA, 15 nt, Homo sapiens
auaauuuauuauuaa

SEQ ID NO: 1840228 - RNA, 12 nt, Homo sapiens
accacccuagca

SEQ ID NO: 1840229 - RNA, 14 nt, Homo sapiens
uacacauuacagcc

SEQ ID NO: 1840230 - RNA, 20 nt, Homo sapiens
cuaguuaauccaaacaugca

SEQ ID NO: 1840231 - RNA, 22 nt, Homo sapiens
auacauaauaaccaaacauaac

SEQ ID NO: 1840232 - RNA, 18 nt, Homo sapiens
aaggguucaccaggucag

SEQ ID NO: 1840233 - RNA, 20 nt, Homo sapiens
cugagcgggaggcagaguuu

SEQ ID NO: 1840234 - RNA, 15 nt, Homo sapiens
uccacugagucuuuc

SEQ ID NO: 1840235 - RNA, 16 nt, Homo sapiens
guccugcuacccagua

SEQ ID NO: 1840236 - RNA, 17 nt, Homo sapiens
uuuaaagacagaaggcc

SEQ ID NO: 1840237 - RNA, 17 nt, Homo sapiens
aaaaugacagauacaaa

SEQ ID NO: 1840238 - RNA, 15 nt, Homo sapiens
aagcgugugugaaca

SEQ ID NO: 1840239 - RNA, 21 nt, Homo sapiens
ccacuucuaugcaaaugccuc

SEQ ID NO: 1840240 - RNA, 16 nt, Homo sapiens
cuuaccucacagugau

SEQ ID NO: 1840241 - RNA, 20 nt, Homo sapiens
caaauagaauuugagcauca

SEQ ID NO: 1840242 - RNA, 23 nt, Homo sapiens
agauagucuauguauguguaaaa

SEQ ID NO: 1840243 - RNA, 16 nt, Homo sapiens
ccucaaagcauuugca

SEQ ID NO: 1840244 - RNA, 14 nt, Homo sapiens
gcuuugcacuuuuc

SEQ ID NO: 1840245 - RNA, 18 nt, Homo sapiens
uguaaucccagcacuuug

SEQ ID NO: 1840246 - RNA, 17 nt, Homo sapiens
aaacaaaaggguguaua

SEQ ID NO: 1840247 - RNA, 22 nt, Homo sapiens
aucacaauuuacgaaaccaaaa

SEQ ID NO: 1840248 - RNA, 22 nt, Homo sapiens
ucuaaauaaagacgacuacaga

SEQ ID NO: 1840249 - RNA, 21 nt, Homo sapiens
acaggcgugagccaccaugcc

SEQ ID NO: 1840250 - RNA, 15 nt, Homo sapiens
cguuugacuagccau

SEQ ID NO: 1840251 - RNA, 16 nt, Homo sapiens
ucacaggugugggaug

SEQ ID NO: 1840252 - RNA, 20 nt, Homo sapiens
uccucucaaccaccuuucag

SEQ ID NO: 1840253 - RNA, 16 nt, Homo sapiens
acucccuaaagcccuc

SEQ ID NO: 1840254 - RNA, 15 nt, Homo sapiens
augaggucuguuuaa

SEQ ID NO: 1840255 - RNA, 16 nt, Homo sapiens
gcauacgagagacuug

SEQ ID NO: 1840256 - RNA, 16 nt, Homo sapiens
uucuuugauucuccuu

SEQ ID NO: 1840257 - RNA, 14 nt, Homo sapiens
caccaaagcugccc

SEQ ID NO: 1840258 - RNA, 21 nt, Homo sapiens
caagagucuguauuccugaua

SEQ ID NO: 1840259 - RNA, 18 nt, Homo sapiens
ggcugaugcugggacccu

SEQ ID NO: 1840260 - RNA, 16 nt, Homo sapiens
ucauaucaaaggguaa

SEQ ID NO: 1840261 - RNA, 21 nt, Homo sapiens
aggugaauaaacacacagauc

SEQ ID NO: 1840262 - RNA, 17 nt, Homo sapiens
gaugaaucgcauuuccu

SEQ ID NO: 1840263 - RNA, 18 nt, Homo sapiens
cucacugugggcuagggu

SEQ ID NO: 1840264 - RNA, 17 nt, Homo sapiens
ccaaauuucauuucagc

SEQ ID NO: 1840265 - RNA, 17 nt, Homo sapiens
uaacuaauaaugcugga

SEQ ID NO: 1840266 - RNA, 15 nt, Homo sapiens
caggaugcugugaua

SEQ ID NO: 1840267 - RNA, 22 nt, Homo sapiens
aauauuuuggcauuguacuaau

SEQ ID NO: 1840268 - RNA, 18 nt, Homo sapiens
cagccgccuuaagcugau

SEQ ID NO: 1840269 - RNA, 19 nt, Homo sapiens
aguauuuugaaguuuacau

SEQ ID NO: 1840270 - RNA, 17 nt, Homo sapiens
auugcucagagaaggaa

SEQ ID NO: 1840271 - RNA, 17 nt, Homo sapiens
agcaacuccgugugccu

SEQ ID NO: 1840272 - RNA, 19 nt, Homo sapiens
ucagaguuccgacugccau

SEQ ID NO: 1840273 - RNA, 16 nt, Homo sapiens
ugccgucccaaauaca

SEQ ID NO: 1840274 - RNA, 14 nt, Homo sapiens
guggcaaccugcuu

SEQ ID NO: 1840275 - RNA, 13 nt, Homo sapiens
ccuucuacugcuu

SEQ ID NO: 1840276 - RNA, 18 nt, Homo sapiens
gacuccucuuugugcaga

SEQ ID NO: 1840277 - RNA, 20 nt, Homo sapiens
gcaucacagucacaugccca

SEQ ID NO: 1840278 - RNA, 17 nt, Homo sapiens
aaugacuucuaauuuau

SEQ ID NO: 1840279 - RNA, 15 nt, Homo sapiens
gugcuuguucuuccu

SEQ ID NO: 1840280 - RNA, 19 nt, Homo sapiens
cauaguaaaugguaucauu

SEQ ID NO: 1840281 - RNA, 21 nt, Homo sapiens
uuuuugugaugaaaaggcagc

SEQ ID NO: 1840282 - RNA, 14 nt, Homo sapiens
ccagaucaugccgc

SEQ ID NO: 1840283 - RNA, 22 nt, Homo sapiens
cugagacgcaaggaucacuuga

SEQ ID NO: 1840284 - RNA, 17 nt, Homo sapiens
ugagaguaaugaggcuu

SEQ ID NO: 1840285 - RNA, 21 nt, Homo sapiens
ucaagaaaaauucacaguuga

SEQ ID NO: 1840286 - RNA, 22 nt, Homo sapiens
uauggacacuggugccauguca

SEQ ID NO: 1840287 - RNA, 14 nt, Homo sapiens
agcugccaccugcc

SEQ ID NO: 1840288 - RNA, 16 nt, Homo sapiens
ccuacaccucuugaaa

SEQ ID NO: 1840289 - RNA, 11 nt, Homo sapiens
cguuccagugg

SEQ ID NO: 1840290 - RNA, 14 nt, Homo sapiens
uucuuuccugccuu

SEQ ID NO: 1840291 - RNA, 22 nt, Homo sapiens
agacaagaaugugcacucucug

SEQ ID NO: 1840292 - RNA, 15 nt, Homo sapiens
aaggggaauggaaga

SEQ ID NO: 1840293 - RNA, 15 nt, Homo sapiens
auaacaagcauauuu

SEQ ID NO: 1840294 - RNA, 14 nt, Homo sapiens
ugagccugauuauc

SEQ ID NO: 1840295 - RNA, 15 nt, Homo sapiens
ucacucaauuucucu

SEQ ID NO: 1840296 - RNA, 17 nt, Homo sapiens
gcugucauuucauugca

SEQ ID NO: 1840297 - RNA, 13 nt, Homo sapiens
aaggaaacuuuau

SEQ ID NO: 1840298 - RNA, 20 nt, Homo sapiens
acagcuucuugcuuguaaaa

SEQ ID NO: 1840299 - RNA, 20 nt, Homo sapiens
acuguaauuaaguaaaccaa

SEQ ID NO: 1840300 - RNA, 14 nt, Homo sapiens
cacauuauguaucu

SEQ ID NO: 1840301 - RNA, 17 nt, Homo sapiens
acuuccccugggcaaga

SEQ ID NO: 1840302 - RNA, 15 nt, Homo sapiens
uccaacuugaaggau

SEQ ID NO: 1840303 - RNA, 16 nt, Homo sapiens
acuuaucccucuccau

SEQ ID NO: 1840304 - RNA, 19 nt, Homo sapiens
gagagggaccaugugucac

SEQ ID NO: 1840305 - RNA, 14 nt, Homo sapiens
aguggugcugcuuu

SEQ ID NO: 1840306 - RNA, 14 nt, Homo sapiens
aaagucauuuguga

SEQ ID NO: 1840307 - RNA, 13 nt, Homo sapiens
ugggcagccagga

SEQ ID NO: 1840308 - RNA, 18 nt, Homo sapiens
ucaugccccggcugcaca

SEQ ID NO: 1840309 - RNA, 18 nt, Homo sapiens
ccuggaucccugcccuuc

SEQ ID NO: 1840310 - RNA, 23 nt, Homo sapiens
auugccaccucguauuucaccuc

SEQ ID NO: 1840311 - RNA, 17 nt, Homo sapiens
auucuucaucagcauuu

SEQ ID NO: 1840312 - RNA, 15 nt, Homo sapiens
uuggcaaugcacuga

SEQ ID NO: 1840313 - RNA, 21 nt, Homo sapiens
gagccugccaagagguacugu

SEQ ID NO: 1840314 - RNA, 15 nt, Homo sapiens
ucucugcucuugccu

SEQ ID NO: 1840315 - RNA, 15 nt, Homo sapiens
cacaugaaugcaguc

SEQ ID NO: 1840316 - RNA, 18 nt, Homo sapiens
acucugcucucaggagau

SEQ ID NO: 1840317 - RNA, 21 nt, Homo sapiens
guaccgggauauuaaaccucu

SEQ ID NO: 1840318 - RNA, 14 nt, Homo sapiens
gauuaaugcuaaau

SEQ ID NO: 1840319 - RNA, 18 nt, Homo sapiens
gcugccuguauucucuau

SEQ ID NO: 1840320 - RNA, 16 nt, Homo sapiens
ccuauuucauuaguag

SEQ ID NO: 1840321 - RNA, 20 nt, Homo sapiens
aacauacacugugaacucaa

SEQ ID NO: 1840322 - RNA, 15 nt, Homo sapiens
uccuguaaauggugu

SEQ ID NO: 1840323 - RNA, 20 nt, Homo sapiens
uaacucccuccucacacucc

SEQ ID NO: 1840324 - RNA, 17 nt, Homo sapiens
gaaaagcucacuaagaa

SEQ ID NO: 1840325 - RNA, 17 nt, Homo sapiens
cagagggccucaaucuc

SEQ ID NO: 1840326 - RNA, 17 nt, Homo sapiens
cuuuaugcaacuaacug

SEQ ID NO: 1840327 - RNA, 23 nt, Homo sapiens
uccuuaugacuuuucaugcagca

SEQ ID NO: 1840328 - RNA, 19 nt, Homo sapiens
caggggucgccaacacuug

SEQ ID NO: 1840329 - RNA, 22 nt, Homo sapiens
aaacuuuggagaacucauuuca

SEQ ID NO: 1840330 - RNA, 16 nt, Homo sapiens
ugucaggaaacauuca

SEQ ID NO: 1840331 - RNA, 16 nt, Homo sapiens
augccucuguauuuaa

SEQ ID NO: 1840332 - RNA, 18 nt, Homo sapiens
cagagaaaugugaagggu

SEQ ID NO: 1840333 - RNA, 21 nt, Homo sapiens
uuuugugggcugguugcugua

SEQ ID NO: 1840334 - RNA, 15 nt, Homo sapiens
ucccacuugucaugu

SEQ ID NO: 1840335 - RNA, 18 nt, Homo sapiens
auauuuauaucauauaua

SEQ ID NO: 1840336 - RNA, 11 nt, Homo sapiens
aauaugggagg

SEQ ID NO: 1840337 - RNA, 17 nt, Homo sapiens
uuccucgagaccauaca

SEQ ID NO: 1840338 - RNA, 20 nt, Homo sapiens
cuaugauguauacugccacu

SEQ ID NO: 1840339 - RNA, 17 nt, Homo sapiens
cccugggcaaugcagug

SEQ ID NO: 1840340 - RNA, 18 nt, Homo sapiens
cuauucccacuuucauuc

SEQ ID NO: 1840341 - RNA, 15 nt, Homo sapiens
ucuuaaaauucuugg

SEQ ID NO: 1840342 - RNA, 15 nt, Homo sapiens
ccauccucucccuuc

SEQ ID NO: 1840343 - RNA, 21 nt, Homo sapiens
acccuggagcccauccagucu

SEQ ID NO: 1840344 - RNA, 16 nt, Homo sapiens
ucaaaaggaauucagu

SEQ ID NO: 1840345 - RNA, 16 nt, Homo sapiens
gcuuugcauguauuag

SEQ ID NO: 1840346 - RNA, 13 nt, Homo sapiens
agacuacagcaca

SEQ ID NO: 1840347 - RNA, 21 nt, Homo sapiens
uuaaugaacacacaagcuugu

SEQ ID NO: 1840348 - RNA, 18 nt, Homo sapiens
gauguaauaaucauuuua

SEQ ID NO: 1840349 - RNA, 16 nt, Homo sapiens
cuaguauaaacaugac

SEQ ID NO: 1840350 - RNA, 14 nt, Homo sapiens
caaagagaggucca

SEQ ID NO: 1840351 - RNA, 17 nt, Homo sapiens
cuuguuagaaugcaagc

SEQ ID NO: 1840352 - RNA, 22 nt, Homo sapiens
acuguaugugaaaggaaaugca

SEQ ID NO: 1840353 - RNA, 13 nt, Homo sapiens
cugggcugugaug

SEQ ID NO: 1840354 - RNA, 18 nt, Homo sapiens
ggggaauaaaagagaucu

SEQ ID NO: 1840355 - RNA, 16 nt, Homo sapiens
aaauuagggagcucuu

SEQ ID NO: 1840356 - RNA, 22 nt, Homo sapiens
ucauuauuacguggcaaaaucc

SEQ ID NO: 1840357 - RNA, 18 nt, Homo sapiens
aguuuuaggacaaacagc

SEQ ID NO: 1840358 - RNA, 20 nt, Homo sapiens
guucaaaaccuugcacaggu

SEQ ID NO: 1840359 - RNA, 13 nt, Homo sapiens
ggcccagugcaug

SEQ ID NO: 1840360 - RNA, 17 nt, Homo sapiens
cacagcggagucugucc

SEQ ID NO: 1840361 - RNA, 19 nt, Homo sapiens
aguucuucaccucuaucca

SEQ ID NO: 1840362 - RNA, 14 nt, Homo sapiens
cauuuauguacaaa

SEQ ID NO: 1840363 - RNA, 22 nt, Homo sapiens
ugaacgaccuuacaaaugagga

SEQ ID NO: 1840364 - RNA, 18 nt, Homo sapiens
aaaguacagguacuuugu

SEQ ID NO: 1840365 - RNA, 18 nt, Homo sapiens
uaaucuuggcccuauuca

SEQ ID NO: 1840366 - RNA, 15 nt, Homo sapiens
gcagagggcuuucag

SEQ ID NO: 1840367 - RNA, 21 nt, Homo sapiens
ucuuaauuaagaucauugaag

SEQ ID NO: 1840368 - RNA, 23 nt, Homo sapiens
guccugggaauaugcuagugaug

SEQ ID NO: 1840369 - RNA, 12 nt, Homo sapiens
cuggaacccaga

SEQ ID NO: 1840370 - RNA, 19 nt, Homo sapiens
cugcaccaggggugcacaa

SEQ ID NO: 1840371 - RNA, 14 nt, Homo sapiens
gaccucaacaaaga

SEQ ID NO: 1840372 - RNA, 16 nt, Homo sapiens
guguugaagcacuguu

SEQ ID NO: 1840373 - RNA, 20 nt, Homo sapiens
gcgagcagucagcauucuua

SEQ ID NO: 1840374 - RNA, 17 nt, Homo sapiens
uguugguauuauauaau

SEQ ID NO: 1840375 - RNA, 18 nt, Homo sapiens
ugucccaccccuaccucu

SEQ ID NO: 1840376 - RNA, 16 nt, Homo sapiens
accaucccugccacau

SEQ ID NO: 1840377 - RNA, 16 nt, Homo sapiens
acuacucuuacaugua

SEQ ID NO: 1840378 - RNA, 21 nt, Homo sapiens
cuacucaaguagcauuuacug

SEQ ID NO: 1840379 - RNA, 13 nt, Homo sapiens
aaugcuacaugug

SEQ ID NO: 1840380 - RNA, 20 nt, Homo sapiens
gcgcucggucuccaccccag

SEQ ID NO: 1840381 - RNA, 20 nt, Homo sapiens
auucuuagaauaucuaaaca

SEQ ID NO: 1840382 - RNA, 16 nt, Homo sapiens
ucuguaaaaugcacca

SEQ ID NO: 1840383 - RNA, 19 nt, Homo sapiens
ucuuggagucaaaaggcaa

SEQ ID NO: 1840384 - RNA, 13 nt, Homo sapiens
cugugagcacaaa

SEQ ID NO: 1840385 - RNA, 23 nt, Homo sapiens
agugcaggcuuggggagcuuuaa

SEQ ID NO: 1840386 - RNA, 14 nt, Homo sapiens
gguguuaaaacacu

SEQ ID NO: 1840387 - RNA, 15 nt, Homo sapiens
uguugaagucucagg

SEQ ID NO: 1840388 - RNA, 20 nt, Homo sapiens
ccgccaacacgccuggcuaa

SEQ ID NO: 1840389 - RNA, 18 nt, Homo sapiens
aaaaauuuaagcauuguu

SEQ ID NO: 1840390 - RNA, 22 nt, Homo sapiens
aauacgugaaagaugcaagcac

SEQ ID NO: 1840391 - RNA, 20 nt, Homo sapiens
cugcuuuguaguuugcccag

SEQ ID NO: 1840392 - RNA, 15 nt, Homo sapiens
uagacuuaaaucuca

SEQ ID NO: 1840393 - RNA, 13 nt, Homo sapiens
uugcuuugccaaa

SEQ ID NO: 1840394 - RNA, 16 nt, Homo sapiens
cauucugaccauuuca

SEQ ID NO: 1840395 - RNA, 22 nt, Homo sapiens
uagacugagguauaaagacaag

SEQ ID NO: 1840396 - RNA, 17 nt, Homo sapiens
uugcagucacucuaguc

SEQ ID NO: 1840397 - RNA, 13 nt, Homo sapiens
ugcucagugcuug

SEQ ID NO: 1840398 - RNA, 22 nt, Homo sapiens
ccuaucauuuauuuacaucuau

SEQ ID NO: 1840399 - RNA, 17 nt, Homo sapiens
cucuuaaucacuacugu

SEQ ID NO: 1840400 - RNA, 17 nt, Homo sapiens
auuaacauaauauaugu

SEQ ID NO: 1840401 - RNA, 12 nt, Homo sapiens
ugacaguauauu

SEQ ID NO: 1840402 - RNA, 13 nt, Homo sapiens
ugaauaagauuaa

SEQ ID NO: 1840403 - RNA, 14 nt, Homo sapiens
ugggauuccugacc

SEQ ID NO: 1840404 - RNA, 15 nt, Homo sapiens
ugacuucacuaggca

SEQ ID NO: 1840405 - RNA, 19 nt, Homo sapiens
uggaggcugcagugagcug

SEQ ID NO: 1840406 - RNA, 15 nt, Homo sapiens
uuggccuaacccuca

SEQ ID NO: 1840407 - RNA, 18 nt, Homo sapiens
acugaagauuaucacuua

SEQ ID NO: 1840408 - RNA, 17 nt, Homo sapiens
auugugcugauugugga

SEQ ID NO: 1840409 - RNA, 17 nt, Homo sapiens
ucgcgccacuaagccaa

SEQ ID NO: 1840410 - RNA, 15 nt, Homo sapiens
cggcuccugcaaaag

SEQ ID NO: 1840411 - RNA, 23 nt, Homo sapiens
cuuagauuauguucaaugaauau

SEQ ID NO: 1840412 - RNA, 16 nt, Homo sapiens
acauaauuuaauuccu

SEQ ID NO: 1840413 - RNA, 21 nt, Homo sapiens
uaccuugguucccccacugau

SEQ ID NO: 1840414 - RNA, 15 nt, Homo sapiens
gaucguaaaaaaaua

SEQ ID NO: 1840415 - RNA, 11 nt, Homo sapiens
cuuucugugac

SEQ ID NO: 1840416 - RNA, 21 nt, Homo sapiens
gacaugcugaagccaaagcca

SEQ ID NO: 1840417 - RNA, 16 nt, Homo sapiens
uucucuacagacucca

SEQ ID NO: 1840418 - RNA, 14 nt, Homo sapiens
ugugcagacacuca

SEQ ID NO: 1840419 - RNA, 20 nt, Homo sapiens
cugggcaggguucuccaagg

SEQ ID NO: 1840420 - RNA, 18 nt, Homo sapiens
aaggaauaaagccuuuug

SEQ ID NO: 1840421 - RNA, 17 nt, Homo sapiens
cuacuggacuaugcuga

SEQ ID NO: 1840422 - RNA, 16 nt, Homo sapiens
cugagcaccuacuuac

SEQ ID NO: 1840423 - RNA, 20 nt, Homo sapiens
acacaaccacuaauuuguca

SEQ ID NO: 1840424 - RNA, 20 nt, Homo sapiens
uucucaguguagggcagaga

SEQ ID NO: 1840425 - RNA, 15 nt, Homo sapiens
uggguuuacucugug

SEQ ID NO: 1840426 - RNA, 19 nt, Homo sapiens
caaucaaauauuugcugaa

SEQ ID NO: 1840427 - RNA, 14 nt, Homo sapiens
uaacauucaguucc

SEQ ID NO: 1840428 - RNA, 12 nt, Homo sapiens
cuccugccccuu

SEQ ID NO: 1840429 - RNA, 19 nt, Homo sapiens
auuacuuuuuuaaaggcac

SEQ ID NO: 1840430 - RNA, 18 nt, Homo sapiens
caucaguagcaucuguaa

SEQ ID NO: 1840431 - RNA, 14 nt, Homo sapiens
cuguugagugcaac

SEQ ID NO: 1840432 - RNA, 17 nt, Homo sapiens
uuccuuuuucuuuccuu

SEQ ID NO: 1840433 - RNA, 12 nt, Homo sapiens
ucacucugcaau

SEQ ID NO: 1840434 - RNA, 21 nt, Homo sapiens
acacccuuggagcucugaguu

SEQ ID NO: 1840435 - RNA, 22 nt, Homo sapiens
ccgacuuuuguuuaccagagaa

SEQ ID NO: 1840436 - RNA, 16 nt, Homo sapiens
agaucuauguacugua

SEQ ID NO: 1840437 - RNA, 18 nt, Homo sapiens
agacauggcuugccacag

SEQ ID NO: 1840438 - RNA, 17 nt, Homo sapiens
cugucuggaacauggac

SEQ ID NO: 1840439 - RNA, 16 nt, Homo sapiens
augcuauuucacucua

SEQ ID NO: 1840440 - RNA, 19 nt, Homo sapiens
uccaggggaagccagugac

SEQ ID NO: 1840441 - RNA, 19 nt, Homo sapiens
auuauuuauugcuguguaa

SEQ ID NO: 1840442 - RNA, 22 nt, Homo sapiens
auaagaaagugcgaguccucca

SEQ ID NO: 1840443 - RNA, 19 nt, Homo sapiens
augcuguauuuucuuuuua

SEQ ID NO: 1840444 - RNA, 15 nt, Homo sapiens
auguucugacagcau

SEQ ID NO: 1840445 - RNA, 19 nt, Homo sapiens
cauuugaggggaaaacacc

SEQ ID NO: 1840446 - RNA, 20 nt, Homo sapiens
uuagaaauauuccaguucuc

SEQ ID NO: 1840447 - RNA, 13 nt, Homo sapiens
uguccccuaagag

SEQ ID NO: 1840448 - RNA, 13 nt, Homo sapiens
gaaagauucaaug

SEQ ID NO: 1840449 - RNA, 14 nt, Homo sapiens
uccccaccuuccaa

SEQ ID NO: 1840450 - RNA, 14 nt, Homo sapiens
uccaaaccuucaca

SEQ ID NO: 1840451 - RNA, 14 nt, Homo sapiens
uccauucuccugag

SEQ ID NO: 1840452 - RNA, 14 nt, Homo sapiens
uaggaccucaggcg

SEQ ID NO: 1840453 - RNA, 13 nt, Homo sapiens
uuuuuguaaagga

SEQ ID NO: 1840454 - RNA, 23 nt, Homo sapiens
cacuuggggguaaaggucugugg

SEQ ID NO: 1840455 - RNA, 23 nt, Homo sapiens
gauuucuuucuuugcaccaaaga

SEQ ID NO: 1840456 - RNA, 21 nt, Homo sapiens
uuggaagaaaaaaaucuucuc

SEQ ID NO: 1840457 - RNA, 19 nt, Homo sapiens
uccccuugccuaaauacaa

SEQ ID NO: 1840458 - RNA, 15 nt, Homo sapiens
caagaaaaauaugac

SEQ ID NO: 1840459 - RNA, 12 nt, Homo sapiens
auguaacuuuuc

SEQ ID NO: 1840460 - RNA, 11 nt, Homo sapiens
ccugcugagga

SEQ ID NO: 1840461 - RNA, 16 nt, Homo sapiens
aucuugaauagucuca

SEQ ID NO: 1840462 - RNA, 15 nt, Homo sapiens
ugucuuuaacuguca

SEQ ID NO: 1840463 - RNA, 22 nt, Homo sapiens
cagaugagaagacuagcagcua

SEQ ID NO: 1840464 - RNA, 20 nt, Homo sapiens
ucauaccuguuguacacuug

SEQ ID NO: 1840465 - RNA, 15 nt, Homo sapiens
gaaacauuuugcuga

SEQ ID NO: 1840466 - RNA, 12 nt, Homo sapiens
uuuucauuucac

SEQ ID NO: 1840467 - RNA, 12 nt, Homo sapiens
cuuccauuccau

SEQ ID NO: 1840468 - RNA, 17 nt, Homo sapiens
cagcauuuuuauuccca

SEQ ID NO: 1840469 - RNA, 20 nt, Homo sapiens
ucaccugugcagggcccucu

SEQ ID NO: 1840470 - RNA, 14 nt, Homo sapiens
acccaaaguaucag

SEQ ID NO: 1840471 - RNA, 19 nt, Homo sapiens
gcaaucaaauaauaaaucu

SEQ ID NO: 1840472 - RNA, 22 nt, Homo sapiens
ccuuaccucgugaagaggggaa

SEQ ID NO: 1840473 - RNA, 12 nt, Homo sapiens
ucuagcugucug

SEQ ID NO: 1840474 - RNA, 22 nt, Homo sapiens
caggccacagagaaccugaguu

SEQ ID NO: 1840475 - RNA, 12 nt, Homo sapiens
caagcaaaccuu

SEQ ID NO: 1840476 - RNA, 17 nt, Homo sapiens
caucuuggucacauaca

SEQ ID NO: 1840477 - RNA, 22 nt, Homo sapiens
guuguccucccaggaaccaaaa

SEQ ID NO: 1840478 - RNA, 14 nt, Homo sapiens
cuaaucaagucaaa

SEQ ID NO: 1840479 - RNA, 12 nt, Homo sapiens
uccccucuuccu

SEQ ID NO: 1840480 - RNA, 16 nt, Homo sapiens
cuaugaaaagcacaag

SEQ ID NO: 1840481 - RNA, 17 nt, Homo sapiens
auggaggccugcuucau

SEQ ID NO: 1840482 - RNA, 12 nt, Homo sapiens
ugcacacuucca

SEQ ID NO: 1840483 - RNA, 20 nt, Homo sapiens
aaaguaccacacauauugca

SEQ ID NO: 1840484 - RNA, 21 nt, Homo sapiens
auuccccugaugggcccugac

SEQ ID NO: 1840485 - RNA, 17 nt, Homo sapiens
cuuugucccacagcuug

SEQ ID NO: 1840486 - RNA, 17 nt, Homo sapiens
guaggugugacauguua

SEQ ID NO: 1840487 - RNA, 18 nt, Homo sapiens
auuuaauaaagcacaaaa

SEQ ID NO: 1840488 - RNA, 16 nt, Homo sapiens
cagucuucuaauuccu

SEQ ID NO: 1840489 - RNA, 21 nt, Homo sapiens
aagaaaguggucuuaagaaau

SEQ ID NO: 1840490 - RNA, 20 nt, Homo sapiens
ccucucauuucccuuugaua

SEQ ID NO: 1840491 - RNA, 16 nt, Homo sapiens
aacaugugcucaggga

SEQ ID NO: 1840492 - RNA, 15 nt, Homo sapiens
ccucauaucuuccuc

SEQ ID NO: 1840493 - RNA, 15 nt, Homo sapiens
cgugauuucaguuga

SEQ ID NO: 1840494 - RNA, 16 nt, Homo sapiens
cuaaauuuuaauugca

SEQ ID NO: 1840495 - RNA, 10 nt, Homo sapiens
ggcagccaga

SEQ ID NO: 1840496 - RNA, 20 nt, Homo sapiens
aagccauucuggacaccagg

SEQ ID NO: 1840497 - RNA, 19 nt, Homo sapiens
agagaacucgcgcucagua

SEQ ID NO: 1840498 - RNA, 15 nt, Homo sapiens
uccucaagaacacag

SEQ ID NO: 1840499 - RNA, 15 nt, Homo sapiens
aauaucacucauuaa

SEQ ID NO: 1840500 - RNA, 16 nt, Homo sapiens
uccagaugaacugaga

SEQ ID NO: 1840501 - RNA, 13 nt, Homo sapiens
agaggaugugcaa

SEQ ID NO: 1840502 - RNA, 14 nt, Homo sapiens
uugcuacauucuaa

SEQ ID NO: 1840503 - RNA, 22 nt, Homo sapiens
ccagaucagacuuuaauuucuc

SEQ ID NO: 1840504 - RNA, 19 nt, Homo sapiens
ggaauccugcucacaaaau

SEQ ID NO: 1840505 - RNA, 20 nt, Homo sapiens
agggaauccauaucagcucu

SEQ ID NO: 1840506 - RNA, 23 nt, Homo sapiens
auguuuuuaguucugacuuugaa

SEQ ID NO: 1840507 - RNA, 17 nt, Homo sapiens
ucuuucuucuaugugaa

SEQ ID NO: 1840508 - RNA, 21 nt, Homo sapiens
gccucagggacgacucugacc

SEQ ID NO: 1840509 - RNA, 14 nt, Homo sapiens
agaugccuacaacc

SEQ ID NO: 1840510 - RNA, 18 nt, Homo sapiens
uauguauuuuugucauag

SEQ ID NO: 1840511 - RNA, 20 nt, Homo sapiens
gaccccgguggcaguggaaa

SEQ ID NO: 1840512 - RNA, 23 nt, Homo sapiens
accugaccaggggcccuaccugg

SEQ ID NO: 1840513 - RNA, 17 nt, Homo sapiens
auuaagacaacugaguu

SEQ ID NO: 1840514 - RNA, 13 nt, Homo sapiens
cuguaacuacuuc

SEQ ID NO: 1840515 - RNA, 23 nt, Homo sapiens
aagcuuuuguaaaauaaaaccac

SEQ ID NO: 1840516 - RNA, 21 nt, Homo sapiens
cagcccucccugccgcugccu

SEQ ID NO: 1840517 - RNA, 20 nt, Homo sapiens
acugcucauuuggaucccag

SEQ ID NO: 1840518 - RNA, 15 nt, Homo sapiens
uucagauaccaugca

SEQ ID NO: 1840519 - RNA, 16 nt, Homo sapiens
agggcucccugcuccc

SEQ ID NO: 1840520 - RNA, 22 nt, Homo sapiens
gucaacuucagagacuaucuga

SEQ ID NO: 1840521 - RNA, 21 nt, Homo sapiens
aguaacgacauggaacugaaa

SEQ ID NO: 1840522 - RNA, 22 nt, Homo sapiens
uuccaaauucaguaaauuuugg

SEQ ID NO: 1840523 - RNA, 18 nt, Homo sapiens
ugcuucaccagacuuuuc

SEQ ID NO: 1840524 - RNA, 16 nt, Homo sapiens
gcagaaaauugccuaa

SEQ ID NO: 1840525 - RNA, 16 nt, Homo sapiens
ccaggcaccugcauuu

SEQ ID NO: 1840526 - RNA, 14 nt, Homo sapiens
guuggaaauauuca

SEQ ID NO: 1840527 - RNA, 18 nt, Homo sapiens
cagagggauugcugugaa

SEQ ID NO: 1840528 - RNA, 14 nt, Homo sapiens
ucugggaagggaga

SEQ ID NO: 1840529 - RNA, 14 nt, Homo sapiens
uugaacucagggag

SEQ ID NO: 1840530 - RNA, 20 nt, Homo sapiens
auaagggucccccacucuaa

SEQ ID NO: 1840531 - RNA, 14 nt, Homo sapiens
aaaaucuauuauca

SEQ ID NO: 1840532 - RNA, 20 nt, Homo sapiens
uaguacagguuuugcccuga

SEQ ID NO: 1840533 - RNA, 13 nt, Homo sapiens
auauuucaggcau

SEQ ID NO: 1840534 - RNA, 22 nt, Homo sapiens
cugguuuucucuuacugcagua

SEQ ID NO: 1840535 - RNA, 19 nt, Homo sapiens
caauaugaaggacuauuaa

SEQ ID NO: 1840536 - RNA, 22 nt, Homo sapiens
ucagggccuggcaggccagugu

SEQ ID NO: 1840537 - RNA, 12 nt, Homo sapiens
accuacuuugua

SEQ ID NO: 1840538 - RNA, 19 nt, Homo sapiens
uuccucccccaguuccucc

SEQ ID NO: 1840539 - RNA, 17 nt, Homo sapiens
uguuuacagcacuacuc

SEQ ID NO: 1840540 - RNA, 20 nt, Homo sapiens
auaugcacacacagaugcac

SEQ ID NO: 1840541 - RNA, 20 nt, Homo sapiens
uugaguccagaaguuugaga

SEQ ID NO: 1840542 - RNA, 17 nt, Homo sapiens
ccauuuuugaaaccaaa

SEQ ID NO: 1840543 - RNA, 13 nt, Homo sapiens
aagccuugccuaa

SEQ ID NO: 1840544 - RNA, 14 nt, Homo sapiens
cauagaagagccaa

SEQ ID NO: 1840545 - RNA, 19 nt, Homo sapiens
ucagugcaaagauuugcuu

SEQ ID NO: 1840546 - RNA, 17 nt, Homo sapiens
aguaauuccuguuacuu

SEQ ID NO: 1840547 - RNA, 13 nt, Homo sapiens
acccccagcacuu

SEQ ID NO: 1840548 - RNA, 17 nt, Homo sapiens
guuuaauuucaugugua

SEQ ID NO: 1840549 - RNA, 13 nt, Homo sapiens
cuggagucucucu

SEQ ID NO: 1840550 - RNA, 16 nt, Homo sapiens
cacagguagacaguau

SEQ ID NO: 1840551 - RNA, 19 nt, Homo sapiens
aacaaauuucauugcacuu

SEQ ID NO: 1840552 - RNA, 20 nt, Homo sapiens
caauuccaucagcacaaaga

SEQ ID NO: 1840553 - RNA, 19 nt, Homo sapiens
cugggcuccuccaccagcu

SEQ ID NO: 1840554 - RNA, 17 nt, Homo sapiens
aaugguacacaauguga

SEQ ID NO: 1840555 - RNA, 13 nt, Homo sapiens
aguuagucaaucc

SEQ ID NO: 1840556 - RNA, 21 nt, Homo sapiens
gaacuguugaaagaaaauaua

SEQ ID NO: 1840557 - RNA, 20 nt, Homo sapiens
uagucgagcuugggcaauuu

SEQ ID NO: 1840558 - RNA, 20 nt, Homo sapiens
guaacugucucagaaccacu

SEQ ID NO: 1840559 - RNA, 17 nt, Homo sapiens
guagaaagauacacuga

SEQ ID NO: 1840560 - RNA, 20 nt, Homo sapiens
auaaaaaauuaugacaaugu

SEQ ID NO: 1840561 - RNA, 10 nt, Homo sapiens
gaaacuaaua

SEQ ID NO: 1840562 - RNA, 18 nt, Homo sapiens
auaucucaacagaauuaa

SEQ ID NO: 1840563 - RNA, 15 nt, Homo sapiens
cauuuccucaggcaa

SEQ ID NO: 1840564 - RNA, 14 nt, Homo sapiens
accuccuuuaccag

SEQ ID NO: 1840565 - RNA, 16 nt, Homo sapiens
agcuauucaccucagu

SEQ ID NO: 1840566 - RNA, 23 nt, Homo sapiens
ugcuuuuguguaaggaaggugcu

SEQ ID NO: 1840567 - RNA, 22 nt, Homo sapiens
uaacagugccagcuucuuugca

SEQ ID NO: 1840568 - RNA, 19 nt, Homo sapiens
agccuggcuucaaauugua

SEQ ID NO: 1840569 - RNA, 21 nt, Homo sapiens
uuuaguagagaugggguuuca

SEQ ID NO: 1840570 - RNA, 22 nt, Homo sapiens
uaugcuggagauggacaacuca

SEQ ID NO: 1840571 - RNA, 16 nt, Homo sapiens
ugcuaaguggaagaca

SEQ ID NO: 1840572 - RNA, 22 nt, Homo sapiens
aggccccuuuucacucccucca

SEQ ID NO: 1840573 - RNA, 16 nt, Homo sapiens
uucaauuuauuacuga

SEQ ID NO: 1840574 - RNA, 20 nt, Homo sapiens
ugcuuccugcuguaugugag

SEQ ID NO: 1840575 - RNA, 18 nt, Homo sapiens
guuagagcugagcacuuu

SEQ ID NO: 1840576 - RNA, 19 nt, Homo sapiens
acuugcucagguacuugua

SEQ ID NO: 1840577 - RNA, 17 nt, Homo sapiens
ucaaaacaaacauuucu

SEQ ID NO: 1840578 - RNA, 15 nt, Homo sapiens
agcccugcugucaga

SEQ ID NO: 1840579 - RNA, 22 nt, Homo sapiens
ccagaacaaaccucuauauguu

SEQ ID NO: 1840580 - RNA, 16 nt, Homo sapiens
cucccagggcugugaa

SEQ ID NO: 1840581 - RNA, 17 nt, Homo sapiens
gcuuuccucccaaaggc

SEQ ID NO: 1840582 - RNA, 18 nt, Homo sapiens
cuaaguaaaaccacagca

SEQ ID NO: 1840583 - RNA, 19 nt, Homo sapiens
uuugaacagggcaguuuag

SEQ ID NO: 1840584 - RNA, 21 nt, Homo sapiens
gguccuaacccccuuacugug

SEQ ID NO: 1840585 - RNA, 17 nt, Homo sapiens
gaucucugaaacauauu

SEQ ID NO: 1840586 - RNA, 13 nt, Homo sapiens
ugacccuuuucau

SEQ ID NO: 1840587 - RNA, 13 nt, Homo sapiens
cccaggcagccuc

SEQ ID NO: 1840588 - RNA, 15 nt, Homo sapiens
cuugccgaaacugga

SEQ ID NO: 1840589 - RNA, 19 nt, Homo sapiens
uuaaaagcuggcuuucauc

SEQ ID NO: 1840590 - RNA, 18 nt, Homo sapiens
aucucaaguauaugucau

SEQ ID NO: 1840591 - RNA, 15 nt, Homo sapiens
uguguccuggugcuc

SEQ ID NO: 1840592 - RNA, 16 nt, Homo sapiens
aaggcaaaguggaaug

SEQ ID NO: 1840593 - RNA, 19 nt, Homo sapiens
cacauccugggauccagug

SEQ ID NO: 1840594 - RNA, 17 nt, Homo sapiens
caugaccauccugccau

SEQ ID NO: 1840595 - RNA, 19 nt, Homo sapiens
ucacaauacaguaaguaaa

SEQ ID NO: 1840596 - RNA, 13 nt, Homo sapiens
acugacauggugc

SEQ ID NO: 1840597 - RNA, 15 nt, Homo sapiens
cggaccaaagcaaga

SEQ ID NO: 1840598 - RNA, 21 nt, Homo sapiens
cccugggaggagagaaggggg

SEQ ID NO: 1840599 - RNA, 15 nt, Homo sapiens
aagauccacccucaa

SEQ ID NO: 1840600 - RNA, 14 nt, Homo sapiens
auucuuguucagau

SEQ ID NO: 1840601 - RNA, 19 nt, Homo sapiens
gauuucaguucacuguuca

SEQ ID NO: 1840602 - RNA, 22 nt, Homo sapiens
uucguacauaauacugaaccac

SEQ ID NO: 1840603 - RNA, 22 nt, Homo sapiens
ugacguagaauugagucuucca

SEQ ID NO: 1840604 - RNA, 13 nt, Homo sapiens
aauacaacaugua

SEQ ID NO: 1840605 - RNA, 13 nt, Homo sapiens
augaaaacaauuc

SEQ ID NO: 1840606 - RNA, 16 nt, Homo sapiens
ucagaguccuugcaaa

SEQ ID NO: 1840607 - RNA, 18 nt, Homo sapiens
ugaguuuccccacuuuag

SEQ ID NO: 1840608 - RNA, 19 nt, Homo sapiens
gugaacauucccagcccag

SEQ ID NO: 1840609 - RNA, 15 nt, Homo sapiens
ucucacccacuagga

SEQ ID NO: 1840610 - RNA, 17 nt, Homo sapiens
agacagugggggugccu

SEQ ID NO: 1840611 - RNA, 18 nt, Homo sapiens
uguccucacugcugauua

SEQ ID NO: 1840612 - RNA, 16 nt, Homo sapiens
uugcuuauuacauuua

SEQ ID NO: 1840613 - RNA, 20 nt, Homo sapiens
aggacguguuacccacugcc

SEQ ID NO: 1840614 - RNA, 23 nt, Homo sapiens
cccacccuucgcaguuacugguu

SEQ ID NO: 1840615 - RNA, 22 nt, Homo sapiens
cuuccgguuggaggcucucaug

SEQ ID NO: 1840616 - RNA, 14 nt, Homo sapiens
uuaauucccaaucc

SEQ ID NO: 1840617 - RNA, 18 nt, Homo sapiens
ugcuguuccuuaauuuga

SEQ ID NO: 1840618 - RNA, 21 nt, Homo sapiens
gguagaaggggaggacacugg

SEQ ID NO: 1840619 - RNA, 17 nt, Homo sapiens
ggcagaaagcuguggga

SEQ ID NO: 1840620 - RNA, 19 nt, Homo sapiens
uaaucaaggccagugcuaa

SEQ ID NO: 1840621 - RNA, 22 nt, Homo sapiens
acugccuuugucuuacuggcaa

SEQ ID NO: 1840622 - RNA, 18 nt, Homo sapiens
ugccaccuuccucuccca

SEQ ID NO: 1840623 - RNA, 19 nt, Homo sapiens
uccucugaaacagcugccu

SEQ ID NO: 1840624 - RNA, 17 nt, Homo sapiens
ucuacucuugucauuuu

SEQ ID NO: 1840625 - RNA, 11 nt, Homo sapiens
aaaaauacuuu

SEQ ID NO: 1840626 - RNA, 21 nt, Homo sapiens
uauugccgccagaagauccaa

SEQ ID NO: 1840627 - RNA, 20 nt, Homo sapiens
ccccacagaucaguuuuccu

SEQ ID NO: 1840628 - RNA, 18 nt, Homo sapiens
gaaugguguuguaugccu

SEQ ID NO: 1840629 - RNA, 22 nt, Homo sapiens
gcugcucacuuuccacccucuc

SEQ ID NO: 1840630 - RNA, 18 nt, Homo sapiens
uacucugauacucuuuaa

SEQ ID NO: 1840631 - RNA, 23 nt, Homo sapiens
cacuauagccuaggugacagagu

SEQ ID NO: 1840632 - RNA, 18 nt, Homo sapiens
uacugauucaauuugaug

SEQ ID NO: 1840633 - RNA, 16 nt, Homo sapiens
ccucuccgcaguuccu

SEQ ID NO: 1840634 - RNA, 14 nt, Homo sapiens
aucuggauuucauc

SEQ ID NO: 1840635 - RNA, 17 nt, Homo sapiens
acccccccacaaggaac

SEQ ID NO: 1840636 - RNA, 16 nt, Homo sapiens
auugcuuccuguguaa

SEQ ID NO: 1840637 - RNA, 15 nt, Homo sapiens
aaucucuauuugaga

SEQ ID NO: 1840638 - RNA, 16 nt, Homo sapiens
uccugccccaugcugc

SEQ ID NO: 1840639 - RNA, 19 nt, Homo sapiens
cugcugccuggccacugcu

SEQ ID NO: 1840640 - RNA, 22 nt, Homo sapiens
ugauuuuuaucuagaacauuca

SEQ ID NO: 1840641 - RNA, 15 nt, Homo sapiens
acaauauaagagcuu

SEQ ID NO: 1840642 - RNA, 17 nt, Homo sapiens
ucgcaugacuguuacag

SEQ ID NO: 1840643 - RNA, 22 nt, Homo sapiens
aaguucccuacuuccugugacu

SEQ ID NO: 1840644 - RNA, 20 nt, Homo sapiens
gcacccggucagucagagaa

SEQ ID NO: 1840645 - RNA, 13 nt, Homo sapiens
uguugacugcugc

SEQ ID NO: 1840646 - RNA, 22 nt, Homo sapiens
uggccugggggaggucagaaca

SEQ ID NO: 1840647 - RNA, 21 nt, Homo sapiens
ugugaagaaaaagaccugcau

SEQ ID NO: 1840648 - RNA, 20 nt, Homo sapiens
cuagaggcuauuccuaggcc

SEQ ID NO: 1840649 - RNA, 22 nt, Homo sapiens
aggaaaugaaugugugugguuu

SEQ ID NO: 1840650 - RNA, 20 nt, Homo sapiens
agaucagggauagcgcuguu

SEQ ID NO: 1840651 - RNA, 22 nt, Homo sapiens
gccgcauuggugacucacuuca

SEQ ID NO: 1840652 - RNA, 17 nt, Homo sapiens
auuuuaaaaagucuuca

SEQ ID NO: 1840653 - RNA, 12 nt, Homo sapiens
cgaugcacuuug

SEQ ID NO: 1840654 - RNA, 22 nt, Homo sapiens
cauuuauagcacgucuccuuga

SEQ ID NO: 1840655 - RNA, 17 nt, Homo sapiens
cuaacuugucuuuggac

SEQ ID NO: 1840656 - RNA, 14 nt, Homo sapiens
cuuugcuucucucc

SEQ ID NO: 1840657 - RNA, 16 nt, Homo sapiens
acucuucuagcauuua

SEQ ID NO: 1840658 - RNA, 16 nt, Homo sapiens
aagaaagcugagaaga

SEQ ID NO: 1840659 - RNA, 12 nt, Homo sapiens
ugccuccgugcc

SEQ ID NO: 1840660 - RNA, 11 nt, Homo sapiens
ugaagucuugu

SEQ ID NO: 1840661 - RNA, 20 nt, Homo sapiens
uauuuaaaaacaaaaggcaa

SEQ ID NO: 1840662 - RNA, 17 nt, Homo sapiens
augaucauugcuggcau

SEQ ID NO: 1840663 - RNA, 22 nt, Homo sapiens
ugaugugcgugcugucuguccu

SEQ ID NO: 1840664 - RNA, 16 nt, Homo sapiens
cagaacugcccccacu

SEQ ID NO: 1840665 - RNA, 16 nt, Homo sapiens
ccuuuuauaccagaga

SEQ ID NO: 1840666 - RNA, 14 nt, Homo sapiens
cccagggaagccug

SEQ ID NO: 1840667 - RNA, 16 nt, Homo sapiens
uguccugugacaacac

SEQ ID NO: 1840668 - RNA, 18 nt, Homo sapiens
aaugucuugagcucuauu

SEQ ID NO: 1840669 - RNA, 22 nt, Homo sapiens
acaaauggcagcuuagcuacaa

SEQ ID NO: 1840670 - RNA, 13 nt, Homo sapiens
accaacacacagg

SEQ ID NO: 1840671 - RNA, 14 nt, Homo sapiens
caacuuugugcuuu

SEQ ID NO: 1840672 - RNA, 22 nt, Homo sapiens
ccacuugccugugcuacaauuc

SEQ ID NO: 1840673 - RNA, 23 nt, Homo sapiens
aauugugugugaugugaagccaa

SEQ ID NO: 1840674 - RNA, 19 nt, Homo sapiens
cccgagcugggggccauga

SEQ ID NO: 1840675 - RNA, 20 nt, Homo sapiens
gacuuucaaaguggaugcaa

SEQ ID NO: 1840676 - RNA, 19 nt, Homo sapiens
caaacuguaaaaaaugugu

SEQ ID NO: 1840677 - RNA, 21 nt, Homo sapiens
uggauggggcuuccagcucag

SEQ ID NO: 1840678 - RNA, 17 nt, Homo sapiens
cucucuaaacccaaaua

SEQ ID NO: 1840679 - RNA, 14 nt, Homo sapiens
ucucuuugagucaa

SEQ ID NO: 1840680 - RNA, 21 nt, Homo sapiens
auuacuuugauaucugaucaa

SEQ ID NO: 1840681 - RNA, 15 nt, Homo sapiens
acaacaagaugaaau

SEQ ID NO: 1840682 - RNA, 13 nt, Homo sapiens
cagucuagugcaa

SEQ ID NO: 1840683 - RNA, 17 nt, Homo sapiens
acuccugccacaacaga

SEQ ID NO: 1840684 - RNA, 21 nt, Homo sapiens
cagcugguuuuguuccagaga

SEQ ID NO: 1840685 - RNA, 18 nt, Homo sapiens
gagcugucccaccugcac

SEQ ID NO: 1840686 - RNA, 23 nt, Homo sapiens
cucucuaccuccacccugcauuu

SEQ ID NO: 1840687 - RNA, 18 nt, Homo sapiens
ugauuugaaaaguauuau

SEQ ID NO: 1840688 - RNA, 12 nt, Homo sapiens
aauuaaaacuga

SEQ ID NO: 1840689 - RNA, 11 nt, Homo sapiens
cucgugccaug

SEQ ID NO: 1840690 - RNA, 21 nt, Homo sapiens
ugggcacugcacccuguuuaa

SEQ ID NO: 1840691 - RNA, 14 nt, Homo sapiens
cuuaauaguauuua

SEQ ID NO: 1840692 - RNA, 14 nt, Homo sapiens
ugcccaugggcuau

SEQ ID NO: 1840693 - RNA, 13 nt, Homo sapiens
agacaagaacuau

SEQ ID NO: 1840694 - RNA, 17 nt, Homo sapiens
ugcagucucuauaccaa

SEQ ID NO: 1840695 - RNA, 14 nt, Homo sapiens
aacccaaacucucc

SEQ ID NO: 1840696 - RNA, 17 nt, Homo sapiens
acacacauuaugagcuu

SEQ ID NO: 1840697 - RNA, 14 nt, Homo sapiens
acuugccuucugau

SEQ ID NO: 1840698 - RNA, 17 nt, Homo sapiens
uccaggagccucaucca

SEQ ID NO: 1840699 - RNA, 19 nt, Homo sapiens
aaagaaauauaucugugau

SEQ ID NO: 1840700 - RNA, 20 nt, Homo sapiens
guaacccgcucaucacugga

SEQ ID NO: 1840701 - RNA, 15 nt, Homo sapiens
ucuuagagggugaug

SEQ ID NO: 1840702 - RNA, 17 nt, Homo sapiens
aaagcacuggaauucag

SEQ ID NO: 1840703 - RNA, 17 nt, Homo sapiens
uggguuuauagacauua

SEQ ID NO: 1840704 - RNA, 19 nt, Homo sapiens
aagcaggacuaaaugucua

SEQ ID NO: 1840705 - RNA, 20 nt, Homo sapiens
auggcucuaacaaugacauu

SEQ ID NO: 1840706 - RNA, 23 nt, Homo sapiens
aagagaagauggccaugcccucc

SEQ ID NO: 1840707 - RNA, 12 nt, Homo sapiens
uucucuacugau

SEQ ID NO: 1840708 - RNA, 20 nt, Homo sapiens
acacuuaaauuucuuggcaa

SEQ ID NO: 1840709 - RNA, 13 nt, Homo sapiens
cuguauauuccau

SEQ ID NO: 1840710 - RNA, 22 nt, Homo sapiens
aaaaggacuauggccacauuca

SEQ ID NO: 1840711 - RNA, 21 nt, Homo sapiens
ggccuagccauccccucacua

SEQ ID NO: 1840712 - RNA, 10 nt, Homo sapiens
gaucugugau

SEQ ID NO: 1840713 - RNA, 19 nt, Homo sapiens
gaaaaauaaaggaaauuca

SEQ ID NO: 1840714 - RNA, 15 nt, Homo sapiens
uuccccacaggugaa

SEQ ID NO: 1840715 - RNA, 16 nt, Homo sapiens
ggacaaacagugcacu

SEQ ID NO: 1840716 - RNA, 12 nt, Homo sapiens
uuaacucagauc

SEQ ID NO: 1840717 - RNA, 17 nt, Homo sapiens
cuaaggagcacuagaau

SEQ ID NO: 1840718 - RNA, 14 nt, Homo sapiens
gaaaccaaggcuaa

SEQ ID NO: 1840719 - RNA, 21 nt, Homo sapiens
aucuucugggagcaggaacaa

SEQ ID NO: 1840720 - RNA, 14 nt, Homo sapiens
ugucacacagggaa

SEQ ID NO: 1840721 - RNA, 16 nt, Homo sapiens
uauuaauaaagcauuc

SEQ ID NO: 1840722 - RNA, 14 nt, Homo sapiens
cccacacacaaaga

SEQ ID NO: 1840723 - RNA, 15 nt, Homo sapiens
gauagccaaggccaa

SEQ ID NO: 1840724 - RNA, 13 nt, Homo sapiens
uaggaauaugacc

SEQ ID NO: 1840725 - RNA, 20 nt, Homo sapiens
agccuauuugaacuacuuaa

SEQ ID NO: 1840726 - RNA, 17 nt, Homo sapiens
aauggcauguauuccaa

SEQ ID NO: 1840727 - RNA, 22 nt, Homo sapiens
gaugaggugggcugaagggaag

SEQ ID NO: 1840728 - RNA, 23 nt, Homo sapiens
acacccugaagaaauccugggaa

SEQ ID NO: 1840729 - RNA, 20 nt, Homo sapiens
ucagauaccaugcaauaaua

SEQ ID NO: 1840730 - RNA, 14 nt, Homo sapiens
uggucuacacugug

SEQ ID NO: 1840731 - RNA, 13 nt, Homo sapiens
caagcaauucugc

SEQ ID NO: 1840732 - RNA, 13 nt, Homo sapiens
gaaaaugccauga

SEQ ID NO: 1840733 - RNA, 16 nt, Homo sapiens
gaguaaggcacaccca

SEQ ID NO: 1840734 - RNA, 14 nt, Homo sapiens
cucugugugcacac

SEQ ID NO: 1840735 - RNA, 17 nt, Homo sapiens
cgccagcguguggagca

SEQ ID NO: 1840736 - RNA, 23 nt, Homo sapiens
aagacuuauuauuuuauccugaa

SEQ ID NO: 1840737 - RNA, 15 nt, Homo sapiens
gcauaucaacuugag

SEQ ID NO: 1840738 - RNA, 19 nt, Homo sapiens
uaagccauaggcccaggau

SEQ ID NO: 1840739 - RNA, 17 nt, Homo sapiens
cgaggcggaucuuugga

SEQ ID NO: 1840740 - RNA, 15 nt, Homo sapiens
cagacuggcuccaac

SEQ ID NO: 1840741 - RNA, 19 nt, Homo sapiens
ugccuucuccaucaugccc

SEQ ID NO: 1840742 - RNA, 17 nt, Homo sapiens
aaacuguagucucagga

SEQ ID NO: 1840743 - RNA, 23 nt, Homo sapiens
gauauagaaguauaaagaauugu

SEQ ID NO: 1840744 - RNA, 13 nt, Homo sapiens
guuucaaaccugc

SEQ ID NO: 1840745 - RNA, 15 nt, Homo sapiens
cuucagaauuccaua

SEQ ID NO: 1840746 - RNA, 19 nt, Homo sapiens
aaagagucucuaccccuuu

SEQ ID NO: 1840747 - RNA, 18 nt, Homo sapiens
aaauggaccauccuugac

SEQ ID NO: 1840748 - RNA, 21 nt, Homo sapiens
gaucuggucuaguuaaccuag

SEQ ID NO: 1840749 - RNA, 18 nt, Homo sapiens
ggagcaggggaggcucac

SEQ ID NO: 1840750 - RNA, 15 nt, Homo sapiens
ccccaggagcucagg

SEQ ID NO: 1840751 - RNA, 18 nt, Homo sapiens
agcaguccuucagaauua

SEQ ID NO: 1840752 - RNA, 14 nt, Homo sapiens
uagcuccacaaagc

SEQ ID NO: 1840753 - RNA, 21 nt, Homo sapiens
ugguguuuuuuuuccaaaaac

SEQ ID NO: 1840754 - RNA, 16 nt, Homo sapiens
aguguaaauucagucu

SEQ ID NO: 1840755 - RNA, 18 nt, Homo sapiens
acaauaaaaaugcugcau

SEQ ID NO: 1840756 - RNA, 15 nt, Homo sapiens
auagacccgaggaaa

SEQ ID NO: 1840757 - RNA, 18 nt, Homo sapiens
uggauugcagacucauga

SEQ ID NO: 1840758 - RNA, 15 nt, Homo sapiens
gcuggucuuaaacuc

SEQ ID NO: 1840759 - RNA, 19 nt, Homo sapiens
gaacaauauugacuuuguc

SEQ ID NO: 1840760 - RNA, 17 nt, Homo sapiens
ucaaaacugcacuguca

SEQ ID NO: 1840761 - RNA, 14 nt, Homo sapiens
uggauccagcacug

SEQ ID NO: 1840762 - RNA, 17 nt, Homo sapiens
auggaucccaaucugag

SEQ ID NO: 1840763 - RNA, 17 nt, Homo sapiens
ucugucuuuucugggau

SEQ ID NO: 1840764 - RNA, 13 nt, Homo sapiens
uccuuugcauuca

SEQ ID NO: 1840765 - RNA, 16 nt, Homo sapiens
caggugcagugugaca

SEQ ID NO: 1840766 - RNA, 17 nt, Homo sapiens
gaauguuuuccuucuac

SEQ ID NO: 1840767 - RNA, 11 nt, Homo sapiens
gaauucagugc

SEQ ID NO: 1840768 - RNA, 23 nt, Homo sapiens
uuguauauuacacauuuguacag

SEQ ID NO: 1840769 - RNA, 16 nt, Homo sapiens
cuguaagcccagcauu

SEQ ID NO: 1840770 - RNA, 22 nt, Homo sapiens
ucuguucaucaccagucuguaa

SEQ ID NO: 1840771 - RNA, 13 nt, Homo sapiens
uuguacucuugcu

SEQ ID NO: 1840772 - RNA, 13 nt, Homo sapiens
ucauucucucaca

SEQ ID NO: 1840773 - RNA, 13 nt, Homo sapiens
auguucucaugca

SEQ ID NO: 1840774 - RNA, 18 nt, Homo sapiens
uagcucccugauuuggag

SEQ ID NO: 1840775 - RNA, 14 nt, Homo sapiens
aucccuacaaaaaa

SEQ ID NO: 1840776 - RNA, 20 nt, Homo sapiens
cuacacuuuuuuggucuguu

SEQ ID NO: 1840777 - RNA, 20 nt, Homo sapiens
ccucuuucccucccuuccuc

SEQ ID NO: 1840778 - RNA, 15 nt, Homo sapiens
cugaagcagagucaa

SEQ ID NO: 1840779 - RNA, 13 nt, Homo sapiens
ucucccugagaug

SEQ ID NO: 1840780 - RNA, 13 nt, Homo sapiens
guagaacuuggau

SEQ ID NO: 1840781 - RNA, 16 nt, Homo sapiens
gcuuccucuaaacuuc

SEQ ID NO: 1840782 - RNA, 23 nt, Homo sapiens
cacacguuuaaucccagcacuuu

SEQ ID NO: 1840783 - RNA, 14 nt, Homo sapiens
gaagaauggugugu

SEQ ID NO: 1840784 - RNA, 13 nt, Homo sapiens
aggugugacaugu

SEQ ID NO: 1840785 - RNA, 21 nt, Homo sapiens
guccaugcugaugauuuugca

SEQ ID NO: 1840786 - RNA, 15 nt, Homo sapiens
ggggagcaugggacu

SEQ ID NO: 1840787 - RNA, 13 nt, Homo sapiens
gauugguugccuc

SEQ ID NO: 1840788 - RNA, 22 nt, Homo sapiens
cuaaggucuuggaacuugccug

SEQ ID NO: 1840789 - RNA, 15 nt, Homo sapiens
gggaauugcagagua

SEQ ID NO: 1840790 - RNA, 12 nt, Homo sapiens
cugcagauuccu

SEQ ID NO: 1840791 - RNA, 20 nt, Homo sapiens
ucugcagcacucuuaucuac

SEQ ID NO: 1840792 - RNA, 22 nt, Homo sapiens
augugugaagcaaauuucuaga

SEQ ID NO: 1840793 - RNA, 17 nt, Homo sapiens
guuuuaagccucagaaa

SEQ ID NO: 1840794 - RNA, 16 nt, Homo sapiens
uagcccuaaaaugaca

SEQ ID NO: 1840795 - RNA, 16 nt, Homo sapiens
uauuaauacauucacc

SEQ ID NO: 1840796 - RNA, 17 nt, Homo sapiens
ugggccucugacucuga

SEQ ID NO: 1840797 - RNA, 20 nt, Homo sapiens
gucccugucaggacacaugg

SEQ ID NO: 1840798 - RNA, 17 nt, Homo sapiens
caauccucucaccucag

SEQ ID NO: 1840799 - RNA, 21 nt, Homo sapiens
acaaauguuguauaaccaaua

SEQ ID NO: 1840800 - RNA, 13 nt, Homo sapiens
cccucuccuucca

SEQ ID NO: 1840801 - RNA, 14 nt, Homo sapiens
ccugugcauuuucu

SEQ ID NO: 1840802 - RNA, 16 nt, Homo sapiens
cuuaauuaaauaucaa

SEQ ID NO: 1840803 - RNA, 15 nt, Homo sapiens
ucauaaggugcuauc

SEQ ID NO: 1840804 - RNA, 13 nt, Homo sapiens
gucuccacacugc

SEQ ID NO: 1840805 - RNA, 22 nt, Homo sapiens
guacacaacuuagaaaccaaau

SEQ ID NO: 1840806 - RNA, 22 nt, Homo sapiens
aguaugcacuaaucaauacuuu

SEQ ID NO: 1840807 - RNA, 20 nt, Homo sapiens
ccucucucuaccagucuauu

SEQ ID NO: 1840808 - RNA, 16 nt, Homo sapiens
aucccgagucugggac

SEQ ID NO: 1840809 - RNA, 15 nt, Homo sapiens
uaucugaacugugga

SEQ ID NO: 1840810 - RNA, 19 nt, Homo sapiens
aauuggcuuuucauagugc

SEQ ID NO: 1840811 - RNA, 22 nt, Homo sapiens
caauauguauagcauauggagu

SEQ ID NO: 1840812 - RNA, 15 nt, Homo sapiens
auggaauuacuccaa

SEQ ID NO: 1840813 - RNA, 15 nt, Homo sapiens
gcagcuucugccacu

SEQ ID NO: 1840814 - RNA, 21 nt, Homo sapiens
uagaaacaacauagcaaauua

SEQ ID NO: 1840815 - RNA, 16 nt, Homo sapiens
caaacacacuguaaau

SEQ ID NO: 1840816 - RNA, 12 nt, Homo sapiens
cauggccucaaa

SEQ ID NO: 1840817 - RNA, 19 nt, Homo sapiens
auagauuaauggcacugau

SEQ ID NO: 1840818 - RNA, 15 nt, Homo sapiens
aaaacaaucuuguca

SEQ ID NO: 1840819 - RNA, 17 nt, Homo sapiens
uacaaccaagcucucug

SEQ ID NO: 1840820 - RNA, 20 nt, Homo sapiens
auuagaauauuguaacucac

SEQ ID NO: 1840821 - RNA, 23 nt, Homo sapiens
ccuccaggacuggggcuugccag

SEQ ID NO: 1840822 - RNA, 12 nt, Homo sapiens
ccaucucuguag

SEQ ID NO: 1840823 - RNA, 22 nt, Homo sapiens
auuggagaauacuuugcuucau

SEQ ID NO: 1840824 - RNA, 19 nt, Homo sapiens
uguuuuuuuuuuauuccag

SEQ ID NO: 1840825 - RNA, 21 nt, Homo sapiens
ggaggcuccagagggcacucu

SEQ ID NO: 1840826 - RNA, 12 nt, Homo sapiens
ugaugugcucau

SEQ ID NO: 1840827 - RNA, 18 nt, Homo sapiens
ugugugcgcacacaccca

SEQ ID NO: 1840828 - RNA, 14 nt, Homo sapiens
ugaccucaacaaag

SEQ ID NO: 1840829 - RNA, 20 nt, Homo sapiens
gcccagggcaucccaugggg

SEQ ID NO: 1840830 - RNA, 18 nt, Homo sapiens
agcucaugcacaucagcu

SEQ ID NO: 1840831 - RNA, 15 nt, Homo sapiens
uuuccuuucugccac

SEQ ID NO: 1840832 - RNA, 12 nt, Homo sapiens
aggcauguaauu

SEQ ID NO: 1840833 - RNA, 21 nt, Homo sapiens
caccucaccucccgaagccac

SEQ ID NO: 1840834 - RNA, 20 nt, Homo sapiens
aggagagaaagugggugaga

SEQ ID NO: 1840835 - RNA, 15 nt, Homo sapiens
ggcacgcccuacucc

SEQ ID NO: 1840836 - RNA, 14 nt, Homo sapiens
gacagaaagagaca

SEQ ID NO: 1840837 - RNA, 22 nt, Homo sapiens
acuuuuuuuuuuuucugagaca

SEQ ID NO: 1840838 - RNA, 21 nt, Homo sapiens
caaacauguaagcauaacuua

SEQ ID NO: 1840839 - RNA, 14 nt, Homo sapiens
auaagcccacauau

SEQ ID NO: 1840840 - RNA, 19 nt, Homo sapiens
ccaagacucauugcuggag

SEQ ID NO: 1840841 - RNA, 21 nt, Homo sapiens
aaguagcuaguagcaaugugc

SEQ ID NO: 1840842 - RNA, 22 nt, Homo sapiens
auggugaugggguaaucuauaa

SEQ ID NO: 1840843 - RNA, 14 nt, Homo sapiens
agugauccaugucc

SEQ ID NO: 1840844 - RNA, 16 nt, Homo sapiens
agauugccccacugca

SEQ ID NO: 1840845 - RNA, 13 nt, Homo sapiens
ugcgcucuggguu

SEQ ID NO: 1840846 - RNA, 19 nt, Homo sapiens
ccacucaggccacaguggg

SEQ ID NO: 1840847 - RNA, 16 nt, Homo sapiens
cugccguugcugccag

SEQ ID NO: 1840848 - RNA, 15 nt, Homo sapiens
uuugaagucugcuca

SEQ ID NO: 1840849 - RNA, 13 nt, Homo sapiens
uuaucauuuauca

SEQ ID NO: 1840850 - RNA, 17 nt, Homo sapiens
uguagcaucugagaagg

SEQ ID NO: 1840851 - RNA, 21 nt, Homo sapiens
accgcuuguggggacccaggc

SEQ ID NO: 1840852 - RNA, 15 nt, Homo sapiens
gggcaugccaugucu

SEQ ID NO: 1840853 - RNA, 17 nt, Homo sapiens
caagcccaguaacugca

SEQ ID NO: 1840854 - RNA, 16 nt, Homo sapiens
auucuguucuacuuga

SEQ ID NO: 1840855 - RNA, 23 nt, Homo sapiens
ugcucauuccacacuguugagac

SEQ ID NO: 1840856 - RNA, 22 nt, Homo sapiens
cuugauagccugacagcagaga

SEQ ID NO: 1840857 - RNA, 21 nt, Homo sapiens
ccagaaaaccagucuguguuu

SEQ ID NO: 1840858 - RNA, 12 nt, Homo sapiens
cuggugagggag

SEQ ID NO: 1840859 - RNA, 13 nt, Homo sapiens
agugguaucugac

SEQ ID NO: 1840860 - RNA, 19 nt, Homo sapiens
uccucccuuccucaccucc

SEQ ID NO: 1840861 - RNA, 21 nt, Homo sapiens
uucaggaagguacaaacacaa

SEQ ID NO: 1840862 - RNA, 21 nt, Homo sapiens
aaagauucuuuaaacuacuga

SEQ ID NO: 1840863 - RNA, 19 nt, Homo sapiens
guugcucacagcuguaaua

SEQ ID NO: 1840864 - RNA, 14 nt, Homo sapiens
aaucagcauucuca

SEQ ID NO: 1840865 - RNA, 17 nt, Homo sapiens
cugcggcuccccugugu

SEQ ID NO: 1840866 - RNA, 22 nt, Homo sapiens
uaccugucauuuugcacuguaa

SEQ ID NO: 1840867 - RNA, 16 nt, Homo sapiens
ccucucaacaucacuu

SEQ ID NO: 1840868 - RNA, 16 nt, Homo sapiens
uuagaaacagugcaac

SEQ ID NO: 1840869 - RNA, 19 nt, Homo sapiens
uagccaggaaguacuucca

SEQ ID NO: 1840870 - RNA, 19 nt, Homo sapiens
gcggcaaaauuaccucucu

SEQ ID NO: 1840871 - RNA, 20 nt, Homo sapiens
ugagacaguuucuuagcuuu

SEQ ID NO: 1840872 - RNA, 20 nt, Homo sapiens
cuaucacagcggggaugcuu

SEQ ID NO: 1840873 - RNA, 20 nt, Homo sapiens
ugccagugauaagagcagug

SEQ ID NO: 1840874 - RNA, 18 nt, Homo sapiens
cuaauuuuuagauauuca

SEQ ID NO: 1840875 - RNA, 14 nt, Homo sapiens
cugugaaugcugag

SEQ ID NO: 1840876 - RNA, 15 nt, Homo sapiens
uuuguaugcuaaaug

SEQ ID NO: 1840877 - RNA, 17 nt, Homo sapiens
cacucuggagcauuucu

SEQ ID NO: 1840878 - RNA, 22 nt, Homo sapiens
uguaucaauccaggcuacaauc

SEQ ID NO: 1840879 - RNA, 20 nt, Homo sapiens
cuccuugauuuuaauagaga

SEQ ID NO: 1840880 - RNA, 20 nt, Homo sapiens
agaauucccaagagggcuuu

SEQ ID NO: 1840881 - RNA, 21 nt, Homo sapiens
ugaggaagcaagugacaagga

SEQ ID NO: 1840882 - RNA, 17 nt, Homo sapiens
aguaaaaggacagagau

SEQ ID NO: 1840883 - RNA, 12 nt, Homo sapiens
aacaagcugugc

SEQ ID NO: 1840884 - RNA, 22 nt, Homo sapiens
cacacacccugagcuuuugcca

SEQ ID NO: 1840885 - RNA, 21 nt, Homo sapiens
aaaaccauucuggacacuguc

SEQ ID NO: 1840886 - RNA, 17 nt, Homo sapiens
cccaaggagguggcugu

SEQ ID NO: 1840887 - RNA, 14 nt, Homo sapiens
ggauuuccucccuc

SEQ ID NO: 1840888 - RNA, 21 nt, Homo sapiens
agaaguacaugaagagcagcu

SEQ ID NO: 1840889 - RNA, 21 nt, Homo sapiens
caagauugugucccauucccc

SEQ ID NO: 1840890 - RNA, 19 nt, Homo sapiens
accugcccaaggaugcugu

SEQ ID NO: 1840891 - RNA, 23 nt, Homo sapiens
uuggugaggaaaagcggacauca

SEQ ID NO: 1840892 - RNA, 21 nt, Homo sapiens
gacguuggccuaacacugggc

SEQ ID NO: 1840893 - RNA, 19 nt, Homo sapiens
uugccuuaauucuuaccuc

SEQ ID NO: 1840894 - RNA, 11 nt, Homo sapiens
cuuugcauuac

SEQ ID NO: 1840895 - RNA, 15 nt, Homo sapiens
cuuacagaacaaaga

SEQ ID NO: 1840896 - RNA, 12 nt, Homo sapiens
ccugaaagccag

SEQ ID NO: 1840897 - RNA, 14 nt, Homo sapiens
aaaaggcagaguac

SEQ ID NO: 1840898 - RNA, 21 nt, Homo sapiens
cuguuugcuuguaguugaaua

SEQ ID NO: 1840899 - RNA, 19 nt, Homo sapiens
aaucucuuaauauugagaa

SEQ ID NO: 1840900 - RNA, 19 nt, Homo sapiens
caauaaauaccagacacgu

SEQ ID NO: 1840901 - RNA, 21 nt, Homo sapiens
gaguuuugcuuuugacuccag

SEQ ID NO: 1840902 - RNA, 14 nt, Homo sapiens
uauagaaaaaccaa

SEQ ID NO: 1840903 - RNA, 14 nt, Homo sapiens
auucaaaauucaga

SEQ ID NO: 1840904 - RNA, 20 nt, Homo sapiens
cauaaauuuuauaugcacag

SEQ ID NO: 1840905 - RNA, 13 nt, Homo sapiens
agacugcaucuca

SEQ ID NO: 1840906 - RNA, 23 nt, Homo sapiens
cacaggcugggauggagcacuuc

SEQ ID NO: 1840907 - RNA, 17 nt, Homo sapiens
aagucaguggcuuugca

SEQ ID NO: 1840908 - RNA, 21 nt, Homo sapiens
caaagugguaaauacugugaa

SEQ ID NO: 1840909 - RNA, 18 nt, Homo sapiens
ugggcaauauagcaagau

SEQ ID NO: 1840910 - RNA, 19 nt, Homo sapiens
auaaaaaaauuuuaauucc

SEQ ID NO: 1840911 - RNA, 12 nt, Homo sapiens
ugagacaggguc

SEQ ID NO: 1840912 - RNA, 19 nt, Homo sapiens
acuuguugcugauucaaga

SEQ ID NO: 1840913 - RNA, 20 nt, Homo sapiens
caauaaaagaaacugugguc

SEQ ID NO: 1840914 - RNA, 18 nt, Homo sapiens
ccaccucacaacuccuuc

SEQ ID NO: 1840915 - RNA, 20 nt, Homo sapiens
agcaaugaagggaagugcau

SEQ ID NO: 1840916 - RNA, 22 nt, Homo sapiens
auguugaaaaaguucugcagau

SEQ ID NO: 1840917 - RNA, 13 nt, Homo sapiens
ugcuuaaauaucc

SEQ ID NO: 1840918 - RNA, 13 nt, Homo sapiens
uccaccagugugc

SEQ ID NO: 1840919 - RNA, 13 nt, Homo sapiens
ugcaauccuucca

SEQ ID NO: 1840920 - RNA, 14 nt, Homo sapiens
cuggugacaccagc

SEQ ID NO: 1840921 - RNA, 19 nt, Homo sapiens
auuuuuaaaauauuacaca

SEQ ID NO: 1840922 - RNA, 17 nt, Homo sapiens
ucaaucuuuaacaaccu

SEQ ID NO: 1840923 - RNA, 16 nt, Homo sapiens
ugcauaggaauugcac

SEQ ID NO: 1840924 - RNA, 16 nt, Homo sapiens
auugauauugugaaca

SEQ ID NO: 1840925 - RNA, 21 nt, Homo sapiens
uuuguagguaauguuccugaa

SEQ ID NO: 1840926 - RNA, 19 nt, Homo sapiens
cagguggccagggcuccac

SEQ ID NO: 1840927 - RNA, 18 nt, Homo sapiens
cauggcauugagacaucu

SEQ ID NO: 1840928 - RNA, 23 nt, Homo sapiens
uucauugugagauugcaguucug

SEQ ID NO: 1840929 - RNA, 12 nt, Homo sapiens
uccagagauuug

SEQ ID NO: 1840930 - RNA, 19 nt, Homo sapiens
caguggugcccuuccugca

SEQ ID NO: 1840931 - RNA, 20 nt, Homo sapiens
acccugcugcuggugcacag

SEQ ID NO: 1840932 - RNA, 15 nt, Homo sapiens
aauugcuuugccaaa

SEQ ID NO: 1840933 - RNA, 20 nt, Homo sapiens
gaugcugccccucaucucuc

SEQ ID NO: 1840934 - RNA, 16 nt, Homo sapiens
auacuguugcacgugu

SEQ ID NO: 1840935 - RNA, 16 nt, Homo sapiens
uccuuuggcaauauca

SEQ ID NO: 1840936 - RNA, 15 nt, Homo sapiens
aguaaugagcaugau

SEQ ID NO: 1840937 - RNA, 23 nt, Homo sapiens
uauggauucagaauauacuaaau

SEQ ID NO: 1840938 - RNA, 22 nt, Homo sapiens
ugaaaauaauuguuccaaauga

SEQ ID NO: 1840939 - RNA, 14 nt, Homo sapiens
ccagcaacuugaac

SEQ ID NO: 1840940 - RNA, 14 nt, Homo sapiens
auguucaacuggag

SEQ ID NO: 1840941 - RNA, 21 nt, Homo sapiens
ucuaacugugacaaagaagac

SEQ ID NO: 1840942 - RNA, 22 nt, Homo sapiens
agcccauccaaacacugaggca

SEQ ID NO: 1840943 - RNA, 21 nt, Homo sapiens
guacacauuuuguaauuaccu

SEQ ID NO: 1840944 - RNA, 18 nt, Homo sapiens
uaagcuuuuagaagguaa

SEQ ID NO: 1840945 - RNA, 14 nt, Homo sapiens
agcuuaagaaccau

SEQ ID NO: 1840946 - RNA, 20 nt, Homo sapiens
auuuuagaauaaauucccaa

SEQ ID NO: 1840947 - RNA, 22 nt, Homo sapiens
ugcucagugggggcagagccac

SEQ ID NO: 1840948 - RNA, 21 nt, Homo sapiens
gcuuggauggagacuccauga

SEQ ID NO: 1840949 - RNA, 18 nt, Homo sapiens
uaaaagaccaucuccugu

SEQ ID NO: 1840950 - RNA, 16 nt, Homo sapiens
gauggauggcuguuaa

SEQ ID NO: 1840951 - RNA, 16 nt, Homo sapiens
gaugguaggcuguaua

SEQ ID NO: 1840952 - RNA, 16 nt, Homo sapiens
ugcaaaaugggaugau

SEQ ID NO: 1840953 - RNA, 19 nt, Homo sapiens
cugggagccauggggagca

SEQ ID NO: 1840954 - RNA, 22 nt, Homo sapiens
cacucucuaaaucuuccuugug

SEQ ID NO: 1840955 - RNA, 20 nt, Homo sapiens
ugccuagacuguuacuuugg

SEQ ID NO: 1840956 - RNA, 15 nt, Homo sapiens
auugcuguuccuuaa

SEQ ID NO: 1840957 - RNA, 18 nt, Homo sapiens
gggccaaaaguauccaag

SEQ ID NO: 1840958 - RNA, 18 nt, Homo sapiens
ugcugagcacacaacagg

SEQ ID NO: 1840959 - RNA, 15 nt, Homo sapiens
acucucacacugaau

SEQ ID NO: 1840960 - RNA, 14 nt, Homo sapiens
ugauaaaccugcca

SEQ ID NO: 1840961 - RNA, 16 nt, Homo sapiens
gcuaaauguaccugag

SEQ ID NO: 1840962 - RNA, 16 nt, Homo sapiens
aagaugaugcuauuaa

SEQ ID NO: 1840963 - RNA, 18 nt, Homo sapiens
uugaccggaucuacaccc

SEQ ID NO: 1840964 - RNA, 19 nt, Homo sapiens
ggggaccaugcaaaggaua

SEQ ID NO: 1840965 - RNA, 20 nt, Homo sapiens
aaugucuauauauuggccaa

SEQ ID NO: 1840966 - RNA, 19 nt, Homo sapiens
caggcacagguccccagau

SEQ ID NO: 1840967 - RNA, 13 nt, Homo sapiens
cucagaacccagg

SEQ ID NO: 1840968 - RNA, 13 nt, Homo sapiens
uuagaaacuccaa

SEQ ID NO: 1840969 - RNA, 13 nt, Homo sapiens
cacuagacaagcc

SEQ ID NO: 1840970 - RNA, 15 nt, Homo sapiens
auguacaaaaacaca

SEQ ID NO: 1840971 - RNA, 23 nt, Homo sapiens
agugguucucauuuggucugcca

SEQ ID NO: 1840972 - RNA, 18 nt, Homo sapiens
uaaacacuagacuguauc

SEQ ID NO: 1840973 - RNA, 22 nt, Homo sapiens
aaaaaucuugugcuagaauacu

SEQ ID NO: 1840974 - RNA, 20 nt, Homo sapiens
cacacuauucucugccuuuu

SEQ ID NO: 1840975 - RNA, 15 nt, Homo sapiens
augagcccucagaac

SEQ ID NO: 1840976 - RNA, 18 nt, Homo sapiens
ucaugacguuccugucua

SEQ ID NO: 1840977 - RNA, 15 nt, Homo sapiens
agcucuggaugaagg

SEQ ID NO: 1840978 - RNA, 19 nt, Homo sapiens
acuggccccuacuuugugg

SEQ ID NO: 1840979 - RNA, 18 nt, Homo sapiens
guauuuauuuauguacuu

SEQ ID NO: 1840980 - RNA, 12 nt, Homo sapiens
agcgcaaagugc

SEQ ID NO: 1840981 - RNA, 20 nt, Homo sapiens
aagaucacaucacugcacuc

SEQ ID NO: 1840982 - RNA, 20 nt, Homo sapiens
gagaucacgucacugcacuc

SEQ ID NO: 1840983 - RNA, 19 nt, Homo sapiens
uauucuccauacucuguaa

SEQ ID NO: 1840984 - RNA, 19 nt, Homo sapiens
gauggcauugggcaaacag

SEQ ID NO: 1840985 - RNA, 13 nt, Homo sapiens
caaaacacugucu

SEQ ID NO: 1840986 - RNA, 18 nt, Homo sapiens
uuucaaaagauggcuuau

SEQ ID NO: 1840987 - RNA, 20 nt, Homo sapiens
ucucaggagaucuggcugug

SEQ ID NO: 1840988 - RNA, 18 nt, Homo sapiens
cuuacacacugucuguau

SEQ ID NO: 1840989 - RNA, 16 nt, Homo sapiens
gcaccugauucucaca

SEQ ID NO: 1840990 - RNA, 15 nt, Homo sapiens
ugaagacaucuuccc

SEQ ID NO: 1840991 - RNA, 17 nt, Homo sapiens
uaauaacagugcauauu

SEQ ID NO: 1840992 - RNA, 19 nt, Homo sapiens
uuuggaaauugagucugaa

SEQ ID NO: 1840993 - RNA, 16 nt, Homo sapiens
cacacagcacaugcac

SEQ ID NO: 1840994 - RNA, 22 nt, Homo sapiens
cuuuccugguuuucaucaggaa

SEQ ID NO: 1840995 - RNA, 20 nt, Homo sapiens
ucccuguaauauuuagcugu

SEQ ID NO: 1840996 - RNA, 19 nt, Homo sapiens
gucccagauacuugggagg

SEQ ID NO: 1840997 - RNA, 21 nt, Homo sapiens
uccugauaaacauuaaacacu

SEQ ID NO: 1840998 - RNA, 20 nt, Homo sapiens
aagagcacccggucagucag

SEQ ID NO: 1840999 - RNA, 18 nt, Homo sapiens
cuuggccuugguuuugau

SEQ ID NO: 1841000 - RNA, 14 nt, Homo sapiens
ccacaccaagcagc

SEQ ID NO: 1841001 - RNA, 18 nt, Homo sapiens
auucuuggcccgcacaga

SEQ ID NO: 1841002 - RNA, 18 nt, Homo sapiens
cauuuucuucucugugaa

SEQ ID NO: 1841003 - RNA, 23 nt, Homo sapiens
ucaaagccauauggacacuguga

SEQ ID NO: 1841004 - RNA, 20 nt, Homo sapiens
uacauucuuuuuucuauuca

SEQ ID NO: 1841005 - RNA, 21 nt, Homo sapiens
aggacuguuuuauaaacugcu

SEQ ID NO: 1841006 - RNA, 23 nt, Homo sapiens
ucaguuuuauuuuugccaaggca

SEQ ID NO: 1841007 - RNA, 20 nt, Homo sapiens
aagagggaggggcccuguca

SEQ ID NO: 1841008 - RNA, 18 nt, Homo sapiens
cccagacaauuccauuca

SEQ ID NO: 1841009 - RNA, 23 nt, Homo sapiens
cuucagucuugaugcaguuucau

SEQ ID NO: 1841010 - RNA, 22 nt, Homo sapiens
accuccuccuccaguucugaug

SEQ ID NO: 1841011 - RNA, 16 nt, Homo sapiens
cauucucuagacaaaa

SEQ ID NO: 1841012 - RNA, 15 nt, Homo sapiens
ugcagacaucucugg

SEQ ID NO: 1841013 - RNA, 18 nt, Homo sapiens
aaaagggcagggcaucuc

SEQ ID NO: 1841014 - RNA, 19 nt, Homo sapiens
aaagaaauauuaagcaugu

SEQ ID NO: 1841015 - RNA, 16 nt, Homo sapiens
uguuuacuacauuucc

SEQ ID NO: 1841016 - RNA, 15 nt, Homo sapiens
ugccuccuacuccag

SEQ ID NO: 1841017 - RNA, 14 nt, Homo sapiens
guaaagcagaggau

SEQ ID NO: 1841018 - RNA, 14 nt, Homo sapiens
aguccaugcuccag

SEQ ID NO: 1841019 - RNA, 14 nt, Homo sapiens
caagaugcuuuuca

SEQ ID NO: 1841020 - RNA, 23 nt, Homo sapiens
uagacuugaaaguuuuccaguau

SEQ ID NO: 1841021 - RNA, 17 nt, Homo sapiens
auucauuuucaucacug

SEQ ID NO: 1841022 - RNA, 14 nt, Homo sapiens
cugccugguggcaa

SEQ ID NO: 1841023 - RNA, 18 nt, Homo sapiens
uuaguuuuuaacaaucua

SEQ ID NO: 1841024 - RNA, 23 nt, Homo sapiens
uugagccuaaaaauaaagcacaa

SEQ ID NO: 1841025 - RNA, 11 nt, Homo sapiens
uguuagauauu

SEQ ID NO: 1841026 - RNA, 18 nt, Homo sapiens
gaggaacaagcaugucuc

SEQ ID NO: 1841027 - RNA, 19 nt, Homo sapiens
ccaaugacaggacauuuga

SEQ ID NO: 1841028 - RNA, 14 nt, Homo sapiens
uccagaaauguacu

SEQ ID NO: 1841029 - RNA, 20 nt, Homo sapiens
cauggugggagagacuguga

SEQ ID NO: 1841030 - RNA, 17 nt, Homo sapiens
cuuggaacacauaagaa

SEQ ID NO: 1841031 - RNA, 22 nt, Homo sapiens
aacauugaaguuaaaacccaga

SEQ ID NO: 1841032 - RNA, 21 nt, Homo sapiens
ggaauucauuuucaucacugg

SEQ ID NO: 1841033 - RNA, 16 nt, Homo sapiens
aauucaauccuacuuu

SEQ ID NO: 1841034 - RNA, 21 nt, Homo sapiens
gauaaaacugguuuuagacaa

SEQ ID NO: 1841035 - RNA, 16 nt, Homo sapiens
ggccucugucaccuga

SEQ ID NO: 1841036 - RNA, 14 nt, Homo sapiens
uacccuauaucuau

SEQ ID NO: 1841037 - RNA, 13 nt, Homo sapiens
aaaagcucuuuca

SEQ ID NO: 1841038 - RNA, 19 nt, Homo sapiens
aagauggcacuguccaggg

SEQ ID NO: 1841039 - RNA, 19 nt, Homo sapiens
ggcuggagugcaauggugu

SEQ ID NO: 1841040 - RNA, 19 nt, Homo sapiens
cucuucccccacuccucuu

SEQ ID NO: 1841041 - RNA, 18 nt, Homo sapiens
acucccugucauaguuac

SEQ ID NO: 1841042 - RNA, 13 nt, Homo sapiens
guuaauguuuauu

SEQ ID NO: 1841043 - RNA, 20 nt, Homo sapiens
gaagaucucaaggauccaga

SEQ ID NO: 1841044 - RNA, 23 nt, Homo sapiens
auuucuucuggagggaagcacca

SEQ ID NO: 1841045 - RNA, 14 nt, Homo sapiens
uuacagagacagaa

SEQ ID NO: 1841046 - RNA, 13 nt, Homo sapiens
ggcccccaucucc

SEQ ID NO: 1841047 - RNA, 15 nt, Homo sapiens
uuuccagagcagagc

SEQ ID NO: 1841048 - RNA, 12 nt, Homo sapiens
ccucauguucuc

SEQ ID NO: 1841049 - RNA, 21 nt, Homo sapiens
cauuucaaauacaucuuugau

SEQ ID NO: 1841050 - RNA, 22 nt, Homo sapiens
aauuauuugcauaacaauuccu

SEQ ID NO: 1841051 - RNA, 10 nt, Homo sapiens
gagcuucccc

SEQ ID NO: 1841052 - RNA, 16 nt, Homo sapiens
cgaaagcaucacugcc

SEQ ID NO: 1841053 - RNA, 15 nt, Homo sapiens
acacagcaucagcuc

SEQ ID NO: 1841054 - RNA, 16 nt, Homo sapiens
cugucauccucaggaa

SEQ ID NO: 1841055 - RNA, 17 nt, Homo sapiens
acccaucagacagguaa

SEQ ID NO: 1841056 - RNA, 22 nt, Homo sapiens
gagugacggucccacacuggug

SEQ ID NO: 1841057 - RNA, 17 nt, Homo sapiens
accaaaggccaggguca

SEQ ID NO: 1841058 - RNA, 16 nt, Homo sapiens
cagagcaagacuccau

SEQ ID NO: 1841059 - RNA, 13 nt, Homo sapiens
uauuuaugcuaua

SEQ ID NO: 1841060 - RNA, 13 nt, Homo sapiens
cauauauguuaaa

SEQ ID NO: 1841061 - RNA, 20 nt, Homo sapiens
auguucaacuauuaauggau

SEQ ID NO: 1841062 - RNA, 17 nt, Homo sapiens
cagcucucuccuuucag

SEQ ID NO: 1841063 - RNA, 14 nt, Homo sapiens
acggcucaacuccu

SEQ ID NO: 1841064 - RNA, 19 nt, Homo sapiens
ccagccuaaucaagucaaa

SEQ ID NO: 1841065 - RNA, 16 nt, Homo sapiens
aguuuagggucccuaa

SEQ ID NO: 1841066 - RNA, 16 nt, Homo sapiens
ucauaaauuacuguuu

SEQ ID NO: 1841067 - RNA, 19 nt, Homo sapiens
aggcacacaccaccacgcc

SEQ ID NO: 1841068 - RNA, 19 nt, Homo sapiens
caaaucuaagggaaaaagc

SEQ ID NO: 1841069 - RNA, 19 nt, Homo sapiens
aagcaaacacacagacucu

SEQ ID NO: 1841070 - RNA, 13 nt, Homo sapiens
auucacagaauag

SEQ ID NO: 1841071 - RNA, 16 nt, Homo sapiens
guuacacagcccaaga

SEQ ID NO: 1841072 - RNA, 18 nt, Homo sapiens
augaauaauacauugaau

SEQ ID NO: 1841073 - RNA, 23 nt, Homo sapiens
cuuccuuaccgugggcacugaag

SEQ ID NO: 1841074 - RNA, 20 nt, Homo sapiens
gaaaauaauaaaguggcauu

SEQ ID NO: 1841075 - RNA, 16 nt, Homo sapiens
ccacauaaacacuucu

SEQ ID NO: 1841076 - RNA, 15 nt, Homo sapiens
aaauagcagcacagc

SEQ ID NO: 1841077 - RNA, 14 nt, Homo sapiens
cagauagaaagcau

SEQ ID NO: 1841078 - RNA, 14 nt, Homo sapiens
cuucagauguucuc

SEQ ID NO: 1841079 - RNA, 23 nt, Homo sapiens
ccauguucugcccccagcccaaa

SEQ ID NO: 1841080 - RNA, 19 nt, Homo sapiens
uacuuaugaugaugaaggg

SEQ ID NO: 1841081 - RNA, 15 nt, Homo sapiens
gucauaaagcauugg

SEQ ID NO: 1841082 - RNA, 20 nt, Homo sapiens
ccugccaccuggggcaguca

SEQ ID NO: 1841083 - RNA, 20 nt, Homo sapiens
uaaucagaaagccucuccag

SEQ ID NO: 1841084 - RNA, 22 nt, Homo sapiens
cagugacaaccaaaagucuuca

SEQ ID NO: 1841085 - RNA, 16 nt, Homo sapiens
ugccuguaacuugaga

SEQ ID NO: 1841086 - RNA, 15 nt, Homo sapiens
augcugcuauggaag

SEQ ID NO: 1841087 - RNA, 12 nt, Homo sapiens
aacucugucagg

SEQ ID NO: 1841088 - RNA, 15 nt, Homo sapiens
uaauuucuugcaauu

SEQ ID NO: 1841089 - RNA, 23 nt, Homo sapiens
ucccagauguugcaucccugaaa

SEQ ID NO: 1841090 - RNA, 19 nt, Homo sapiens
ggaucaguuaacuauugca

SEQ ID NO: 1841091 - RNA, 19 nt, Homo sapiens
guugaaugagcgucagcau

SEQ ID NO: 1841092 - RNA, 14 nt, Homo sapiens
aucuacuugcacac

SEQ ID NO: 1841093 - RNA, 16 nt, Homo sapiens
uaaaauguguuuuuca

SEQ ID NO: 1841094 - RNA, 15 nt, Homo sapiens
gagcugaaaaacuua

SEQ ID NO: 1841095 - RNA, 24 nt, Homo sapiens
uccagacaaaccagaagcaacaga

SEQ ID NO: 1841096 - RNA, 17 nt, Homo sapiens
uucuguuuccaucugcu

SEQ ID NO: 1841097 - RNA, 18 nt, Homo sapiens
caucugugaauaagccau

SEQ ID NO: 1841098 - RNA, 20 nt, Homo sapiens
cuccugaccucaagugaucu

SEQ ID NO: 1841099 - RNA, 22 nt, Homo sapiens
aacugagaccaagucucucuaa

SEQ ID NO: 1841100 - RNA, 14 nt, Homo sapiens
cuaaugucagcaca

SEQ ID NO: 1841101 - RNA, 16 nt, Homo sapiens
agacccaguaugaaau

SEQ ID NO: 1841102 - RNA, 20 nt, Homo sapiens
ggaaccucacucuugccaac

SEQ ID NO: 1841103 - RNA, 14 nt, Homo sapiens
auccuuccauuucu

SEQ ID NO: 1841104 - RNA, 16 nt, Homo sapiens
cuauaauuuuacaaag

SEQ ID NO: 1841105 - RNA, 17 nt, Homo sapiens
caggaaaggcuccagga

SEQ ID NO: 1841106 - RNA, 23 nt, Homo sapiens
uaauggaggugacggcacuccca

SEQ ID NO: 1841107 - RNA, 20 nt, Homo sapiens
aucccggagcgcaccugcuu

SEQ ID NO: 1841108 - RNA, 21 nt, Homo sapiens
ucuaaacagcugacccaguga

SEQ ID NO: 1841109 - RNA, 17 nt, Homo sapiens
cuguccugcagucccac

SEQ ID NO: 1841110 - RNA, 21 nt, Homo sapiens
agggaaccugguacauccagu

SEQ ID NO: 1841111 - RNA, 21 nt, Homo sapiens
ccacacgcugucucuugagaa

SEQ ID NO: 1841112 - RNA, 16 nt, Homo sapiens
uucuuucccauguauu

SEQ ID NO: 1841113 - RNA, 19 nt, Homo sapiens
uuucauguauguauauaau

SEQ ID NO: 1841114 - RNA, 21 nt, Homo sapiens
uccuucucugaacacaggcag

SEQ ID NO: 1841115 - RNA, 16 nt, Homo sapiens
ucugcacccagccaaa

SEQ ID NO: 1841116 - RNA, 22 nt, Homo sapiens
ggaaacuugaaaggucugagga

SEQ ID NO: 1841117 - RNA, 20 nt, Homo sapiens
aguaauuuuaaguaauuuca

SEQ ID NO: 1841118 - RNA, 16 nt, Homo sapiens
cugccucggacuccau

SEQ ID NO: 1841119 - RNA, 20 nt, Homo sapiens
gagggcaacauuccacagcu

SEQ ID NO: 1841120 - RNA, 19 nt, Homo sapiens
ucaccaugacaccugccau

SEQ ID NO: 1841121 - RNA, 19 nt, Homo sapiens
cccucagagaggcauguga

SEQ ID NO: 1841122 - RNA, 15 nt, Homo sapiens
auauuuaaaacauca

SEQ ID NO: 1841123 - RNA, 15 nt, Homo sapiens
uuugaguugaauuua

SEQ ID NO: 1841124 - RNA, 20 nt, Homo sapiens
ggaggauguucugggacaca

SEQ ID NO: 1841125 - RNA, 13 nt, Homo sapiens
uacuaugguucuc

SEQ ID NO: 1841126 - RNA, 18 nt, Homo sapiens
aaauagacaacucuucca

SEQ ID NO: 1841127 - RNA, 12 nt, Homo sapiens
ggcgugaucuug

SEQ ID NO: 1841128 - RNA, 13 nt, Homo sapiens
aaauugcauuugu

SEQ ID NO: 1841129 - RNA, 16 nt, Homo sapiens
gccaagacagugaagu

SEQ ID NO: 1841130 - RNA, 19 nt, Homo sapiens
gcccucgggccgggcacca

SEQ ID NO: 1841131 - RNA, 17 nt, Homo sapiens
agagaggccuuguccca

SEQ ID NO: 1841132 - RNA, 11 nt, Homo sapiens
caaugguguuu

SEQ ID NO: 1841133 - RNA, 19 nt, Homo sapiens
gucuauucccuggaauuca

SEQ ID NO: 1841134 - RNA, 20 nt, Homo sapiens
gcacuugccuguuggcugcu

SEQ ID NO: 1841135 - RNA, 20 nt, Homo sapiens
auaugcuuggcuaacuauau

SEQ ID NO: 1841136 - RNA, 18 nt, Homo sapiens
augagagaaggaggggag

SEQ ID NO: 1841137 - RNA, 17 nt, Homo sapiens
acauuccaggaaaccau

SEQ ID NO: 1841138 - RNA, 12 nt, Homo sapiens
gcuucuaccugc

SEQ ID NO: 1841139 - RNA, 20 nt, Homo sapiens
acacauuugcccaauuccag

SEQ ID NO: 1841140 - RNA, 20 nt, Homo sapiens
acaguuuggauguccucaaa

SEQ ID NO: 1841141 - RNA, 16 nt, Homo sapiens
uuaagggaaggaacuc

SEQ ID NO: 1841142 - RNA, 16 nt, Homo sapiens
uuucaauuuuaaacau

SEQ ID NO: 1841143 - RNA, 23 nt, Homo sapiens
cacuucagcuuaauaaguauuua

SEQ ID NO: 1841144 - RNA, 22 nt, Homo sapiens
uuuuacauuuagaguauuuaca

SEQ ID NO: 1841145 - RNA, 18 nt, Homo sapiens
ugggaaggaaacaaccau

SEQ ID NO: 1841146 - RNA, 23 nt, Homo sapiens
gcccacccugccccuuucuuccc

SEQ ID NO: 1841147 - RNA, 15 nt, Homo sapiens
agugugauguucacu

SEQ ID NO: 1841148 - RNA, 22 nt, Homo sapiens
uaggauaugcccuccuggugac

SEQ ID NO: 1841149 - RNA, 16 nt, Homo sapiens
cacagacaucuuucaa

SEQ ID NO: 1841150 - RNA, 16 nt, Homo sapiens
ggcaagucuuccauga

SEQ ID NO: 1841151 - RNA, 23 nt, Homo sapiens
ccugggcugucugucaccagcua

SEQ ID NO: 1841152 - RNA, 19 nt, Homo sapiens
cucaaaaucugugaccugu

SEQ ID NO: 1841153 - RNA, 19 nt, Homo sapiens
uuaauguaauaaagugaac

SEQ ID NO: 1841154 - RNA, 16 nt, Homo sapiens
ucagcacucuguaaaa

SEQ ID NO: 1841155 - RNA, 16 nt, Homo sapiens
ucagcucucuguauaa

SEQ ID NO: 1841156 - RNA, 15 nt, Homo sapiens
caugauacuauucag

SEQ ID NO: 1841157 - RNA, 18 nt, Homo sapiens
gacuugauuagugccuuc

SEQ ID NO: 1841158 - RNA, 15 nt, Homo sapiens
gcaucuggguuuguu

SEQ ID NO: 1841159 - RNA, 20 nt, Homo sapiens
gaauaggaggggaaaaaaca

SEQ ID NO: 1841160 - RNA, 15 nt, Homo sapiens
gaguaauaugccugc

SEQ ID NO: 1841161 - RNA, 15 nt, Homo sapiens
aggcuggggaggcca

SEQ ID NO: 1841162 - RNA, 22 nt, Homo sapiens
gcuucucuccacccaugaccuu

SEQ ID NO: 1841163 - RNA, 18 nt, Homo sapiens
accuguuuccuacagaca

SEQ ID NO: 1841164 - RNA, 18 nt, Homo sapiens
cacgcggauuaauuugca

SEQ ID NO: 1841165 - RNA, 18 nt, Homo sapiens
ccagcgagggagaggucg

SEQ ID NO: 1841166 - RNA, 15 nt, Homo sapiens
augauaacuggaaac

SEQ ID NO: 1841167 - RNA, 24 nt, Homo sapiens
gugcuuugugauaguucaguccca

SEQ ID NO: 1841168 - RNA, 19 nt, Homo sapiens
ucucaggaccaaagcuuuc

SEQ ID NO: 1841169 - RNA, 12 nt, Homo sapiens
caaaaucucuac

SEQ ID NO: 1841170 - RNA, 12 nt, Homo sapiens
gaacaucuguaa

SEQ ID NO: 1841171 - RNA, 15 nt, Homo sapiens
cugaccaaaaccaga

SEQ ID NO: 1841172 - RNA, 11 nt, Homo sapiens
augaacacaga

SEQ ID NO: 1841173 - RNA, 16 nt, Homo sapiens
cgaagccuuaagccau

SEQ ID NO: 1841174 - RNA, 15 nt, Homo sapiens
aaccuccacugcugc

SEQ ID NO: 1841175 - RNA, 23 nt, Homo sapiens
gcaauuuuaccuaguuugcacua

SEQ ID NO: 1841176 - RNA, 21 nt, Homo sapiens
augcaauauauguucauaucu

SEQ ID NO: 1841177 - RNA, 15 nt, Homo sapiens
aaaagaacaugcagu

SEQ ID NO: 1841178 - RNA, 20 nt, Homo sapiens
gcuaaucagucauuucuuca

SEQ ID NO: 1841179 - RNA, 16 nt, Homo sapiens
uuauccugugugauua

SEQ ID NO: 1841180 - RNA, 14 nt, Homo sapiens
agauugcuuucuuc

SEQ ID NO: 1841181 - RNA, 12 nt, Homo sapiens
uaaaaugaggcu

SEQ ID NO: 1841182 - RNA, 22 nt, Homo sapiens
auuugcauauugaaaagcacag

SEQ ID NO: 1841183 - RNA, 20 nt, Homo sapiens
guccugagaaagcucaaagg

SEQ ID NO: 1841184 - RNA, 14 nt, Homo sapiens
aaaugcacccauca

SEQ ID NO: 1841185 - RNA, 21 nt, Homo sapiens
gaccccacaacuucaggagcu

SEQ ID NO: 1841186 - RNA, 18 nt, Homo sapiens
acaaucugggacuuucac

SEQ ID NO: 1841187 - RNA, 20 nt, Homo sapiens
cuucucuacagacuccaaaa

SEQ ID NO: 1841188 - RNA, 21 nt, Homo sapiens
cuucucuucuuuauugcacua

SEQ ID NO: 1841189 - RNA, 14 nt, Homo sapiens
gcauaaacaauauu

SEQ ID NO: 1841190 - RNA, 17 nt, Homo sapiens
auuaaaugcauguccuc

SEQ ID NO: 1841191 - RNA, 12 nt, Homo sapiens
acacagcagcuc

SEQ ID NO: 1841192 - RNA, 17 nt, Homo sapiens
gaagguugcuauauagu

SEQ ID NO: 1841193 - RNA, 16 nt, Homo sapiens
ugcugaauaaaugauu

SEQ ID NO: 1841194 - RNA, 21 nt, Homo sapiens
ccuucugagucuccaacaucc

SEQ ID NO: 1841195 - RNA, 11 nt, Homo sapiens
uuauuacugaa

SEQ ID NO: 1841196 - RNA, 22 nt, Homo sapiens
acugagggccuggucaccacaa

SEQ ID NO: 1841197 - RNA, 18 nt, Homo sapiens
aaaucuaucaaaauuacc

SEQ ID NO: 1841198 - RNA, 22 nt, Homo sapiens
cuauccaaaccuuucaauucau

SEQ ID NO: 1841199 - RNA, 13 nt, Homo sapiens
ccugaaucacaac

SEQ ID NO: 1841200 - RNA, 12 nt, Homo sapiens
uaaaaaccgaau

SEQ ID NO: 1841201 - RNA, 18 nt, Homo sapiens
uaaaaucccaagucauuu

SEQ ID NO: 1841202 - RNA, 17 nt, Homo sapiens
cacgaucucaacucacu

SEQ ID NO: 1841203 - RNA, 15 nt, Homo sapiens
auaugagacuuucaa

SEQ ID NO: 1841204 - RNA, 19 nt, Homo sapiens
cagcugcuuccugcacaua

SEQ ID NO: 1841205 - RNA, 21 nt, Homo sapiens
uguuuaaaaucauuucugcau

SEQ ID NO: 1841206 - RNA, 21 nt, Homo sapiens
ucaauaaaguuguugcauucc

SEQ ID NO: 1841207 - RNA, 18 nt, Homo sapiens
ucugcaccacaccuggca

SEQ ID NO: 1841208 - RNA, 17 nt, Homo sapiens
cccagugcugcuguaaa

SEQ ID NO: 1841209 - RNA, 13 nt, Homo sapiens
cucagcuuugaua

SEQ ID NO: 1841210 - RNA, 18 nt, Homo sapiens
cucacaacagucaccuca

SEQ ID NO: 1841211 - RNA, 13 nt, Homo sapiens
aggccacaguggg

SEQ ID NO: 1841212 - RNA, 13 nt, Homo sapiens
auuccacaggugg

SEQ ID NO: 1841213 - RNA, 21 nt, Homo sapiens
gccuggguugcugcuguccag

SEQ ID NO: 1841214 - RNA, 13 nt, Homo sapiens
uagacuagugcuu

SEQ ID NO: 1841215 - RNA, 23 nt, Homo sapiens
caaguguucuuagguuuacugug

SEQ ID NO: 1841216 - RNA, 19 nt, Homo sapiens
accuaagucucugugaauu

SEQ ID NO: 1841217 - RNA, 19 nt, Homo sapiens
acagguaaacagaaauccu

SEQ ID NO: 1841218 - RNA, 17 nt, Homo sapiens
auucucuuuuaucuguu

SEQ ID NO: 1841219 - RNA, 22 nt, Homo sapiens
acuauucauggcuaccucagaa

SEQ ID NO: 1841220 - RNA, 22 nt, Homo sapiens
uagcacacuuuuccacauucca

SEQ ID NO: 1841221 - RNA, 16 nt, Homo sapiens
auuuuguuaaaaucua

SEQ ID NO: 1841222 - RNA, 17 nt, Homo sapiens
uagauucucaccugccu

SEQ ID NO: 1841223 - RNA, 23 nt, Homo sapiens
agggauaacacugucuaccucac

SEQ ID NO: 1841224 - RNA, 20 nt, Homo sapiens
gaaacuguuacuguccuguu

SEQ ID NO: 1841225 - RNA, 16 nt, Homo sapiens
agauggccagccccuu

SEQ ID NO: 1841226 - RNA, 19 nt, Homo sapiens
uagcugccuaucagaauuu

SEQ ID NO: 1841227 - RNA, 20 nt, Homo sapiens
acagucaccgacaacaugcu

SEQ ID NO: 1841228 - RNA, 20 nt, Homo sapiens
gcaugggggaccccuuccca

SEQ ID NO: 1841229 - RNA, 18 nt, Homo sapiens
uccuuccaguguccuuag

SEQ ID NO: 1841230 - RNA, 18 nt, Homo sapiens
agcacuuuccuguugcac

SEQ ID NO: 1841231 - RNA, 15 nt, Homo sapiens
ucaaaugauccuucc

SEQ ID NO: 1841232 - RNA, 20 nt, Homo sapiens
uuuaaugcaaugagcaaugu

SEQ ID NO: 1841233 - RNA, 19 nt, Homo sapiens
gucuucuccccucacccau

SEQ ID NO: 1841234 - RNA, 20 nt, Homo sapiens
gcuccuggacucauugcuuc

SEQ ID NO: 1841235 - RNA, 19 nt, Homo sapiens
cacauagcgccgugcugua

SEQ ID NO: 1841236 - RNA, 21 nt, Homo sapiens
aagcauuuccagccuaucuaa

SEQ ID NO: 1841237 - RNA, 22 nt, Homo sapiens
uagcuuaacacuaccaauuucc

SEQ ID NO: 1841238 - RNA, 20 nt, Homo sapiens
cuccaucccuuccccagaga

SEQ ID NO: 1841239 - RNA, 18 nt, Homo sapiens
uuguggaagcacuugcua

SEQ ID NO: 1841240 - RNA, 16 nt, Homo sapiens
uguguaugcacaugaa

SEQ ID NO: 1841241 - RNA, 20 nt, Homo sapiens
acacgagguaugaggucuag

SEQ ID NO: 1841242 - RNA, 14 nt, Homo sapiens
augaccuacagugc

SEQ ID NO: 1841243 - RNA, 12 nt, Homo sapiens
agggaaaacaca

SEQ ID NO: 1841244 - RNA, 13 nt, Homo sapiens
cugguagcacuug

SEQ ID NO: 1841245 - RNA, 13 nt, Homo sapiens
caauuuuccugug

SEQ ID NO: 1841246 - RNA, 15 nt, Homo sapiens
gugucacagccauag

SEQ ID NO: 1841247 - RNA, 17 nt, Homo sapiens
cugcaccacaccuggca

SEQ ID NO: 1841248 - RNA, 20 nt, Homo sapiens
gccgaauuugguacacaugu

SEQ ID NO: 1841249 - RNA, 15 nt, Homo sapiens
cccuuuaguucugcu

SEQ ID NO: 1841250 - RNA, 22 nt, Homo sapiens
uauuuuuucgugcacucugcua

SEQ ID NO: 1841251 - RNA, 12 nt, Homo sapiens
ccucuugcaaag

SEQ ID NO: 1841252 - RNA, 23 nt, Homo sapiens
uuccuaacaugcaccuugcuccc

SEQ ID NO: 1841253 - RNA, 13 nt, Homo sapiens
gcccaacaucucc

SEQ ID NO: 1841254 - RNA, 12 nt, Homo sapiens
ucuauguuaaua

SEQ ID NO: 1841255 - RNA, 12 nt, Homo sapiens
aaaauguuucaa

SEQ ID NO: 1841256 - RNA, 15 nt, Homo sapiens
uguugaaauugucaa

SEQ ID NO: 1841257 - RNA, 15 nt, Homo sapiens
cguggagacuggcag

SEQ ID NO: 1841258 - RNA, 19 nt, Homo sapiens
augcccagcucagugccac

SEQ ID NO: 1841259 - RNA, 13 nt, Homo sapiens
uaaccaacauuuu

SEQ ID NO: 1841260 - RNA, 13 nt, Homo sapiens
ccugcuccugacu

SEQ ID NO: 1841261 - RNA, 16 nt, Homo sapiens
ucauccuuuccagcau

SEQ ID NO: 1841262 - RNA, 17 nt, Homo sapiens
aguucccuuggccucag

SEQ ID NO: 1841263 - RNA, 14 nt, Homo sapiens
cugcugugaaucug

SEQ ID NO: 1841264 - RNA, 21 nt, Homo sapiens
gugcagccaaguagccucucc

SEQ ID NO: 1841265 - RNA, 21 nt, Homo sapiens
gcuuguaaugguucuuuacac

SEQ ID NO: 1841266 - RNA, 22 nt, Homo sapiens
auccggacuccugccgcaguga

SEQ ID NO: 1841267 - RNA, 14 nt, Homo sapiens
uuuuaaacucuaga

SEQ ID NO: 1841268 - RNA, 15 nt, Homo sapiens
ucaaucaaacaggga

SEQ ID NO: 1841269 - RNA, 22 nt, Homo sapiens
cgggaauacuagggagaagguu

SEQ ID NO: 1841270 - RNA, 22 nt, Homo sapiens
cucucucaaaagagaaaaacaa

SEQ ID NO: 1841271 - RNA, 17 nt, Homo sapiens
gaguaauuuucugaugg

SEQ ID NO: 1841272 - RNA, 14 nt, Homo sapiens
aacuuacuugccuc

SEQ ID NO: 1841273 - RNA, 23 nt, Homo sapiens
augaauggcuuggagugcacuga

SEQ ID NO: 1841274 - RNA, 16 nt, Homo sapiens
cugcugagaguacugu

SEQ ID NO: 1841275 - RNA, 16 nt, Homo sapiens
cuuucacgcugaaaca

SEQ ID NO: 1841276 - RNA, 23 nt, Homo sapiens
acccagggugugaacauguucuc

SEQ ID NO: 1841277 - RNA, 18 nt, Homo sapiens
cugauuucuucagaauua

SEQ ID NO: 1841278 - RNA, 15 nt, Homo sapiens
gaugugucuuaccag

SEQ ID NO: 1841279 - RNA, 20 nt, Homo sapiens
aacuuguaucugaagaccua

SEQ ID NO: 1841280 - RNA, 17 nt, Homo sapiens
cuuccaaaccucaauaa

SEQ ID NO: 1841281 - RNA, 14 nt, Homo sapiens
acucucacacugaa

SEQ ID NO: 1841282 - RNA, 22 nt, Homo sapiens
cuuucuuccgaucuguaccuga

SEQ ID NO: 1841283 - RNA, 16 nt, Homo sapiens
uaauaaguuucacuga

SEQ ID NO: 1841284 - RNA, 12 nt, Homo sapiens
agagauuucaag

SEQ ID NO: 1841285 - RNA, 18 nt, Homo sapiens
auuacaggugugagccac

SEQ ID NO: 1841286 - RNA, 20 nt, Homo sapiens
aggcuuuuaccauuagcaua

SEQ ID NO: 1841287 - RNA, 17 nt, Homo sapiens
gugagagaaagccacaa

SEQ ID NO: 1841288 - RNA, 22 nt, Homo sapiens
auuucaguuuguuuacuuuauc

SEQ ID NO: 1841289 - RNA, 14 nt, Homo sapiens
ggcagauccugccc

SEQ ID NO: 1841290 - RNA, 13 nt, Homo sapiens
aguacuguacagg

SEQ ID NO: 1841291 - RNA, 17 nt, Homo sapiens
cagaugggaucacagua

SEQ ID NO: 1841292 - RNA, 22 nt, Homo sapiens
gauccccaacugcuccagccuc

SEQ ID NO: 1841293 - RNA, 22 nt, Homo sapiens
aauguaauaaaaauaguuacag

SEQ ID NO: 1841294 - RNA, 21 nt, Homo sapiens
uauuucagggaccucaggggc

SEQ ID NO: 1841295 - RNA, 19 nt, Homo sapiens
uggcuacuuuuccauuguu

SEQ ID NO: 1841296 - RNA, 16 nt, Homo sapiens
aaugcaacaacaugua

SEQ ID NO: 1841297 - RNA, 13 nt, Homo sapiens
gacuugcuuuaaa

SEQ ID NO: 1841298 - RNA, 15 nt, Homo sapiens
cugcuuugaaagccc

SEQ ID NO: 1841299 - RNA, 16 nt, Homo sapiens
aguugaacaucucacu

SEQ ID NO: 1841300 - RNA, 12 nt, Homo sapiens
agugauggcauu

SEQ ID NO: 1841301 - RNA, 17 nt, Homo sapiens
cugucuggcccugggga

SEQ ID NO: 1841302 - RNA, 23 nt, Homo sapiens
uuaauauccuaggcaucugcugu

SEQ ID NO: 1841303 - RNA, 14 nt, Homo sapiens
ucuuugcaguucca

SEQ ID NO: 1841304 - RNA, 15 nt, Homo sapiens
uuguggcugauuuca

SEQ ID NO: 1841305 - RNA, 12 nt, Homo sapiens
ggacuuugccug

SEQ ID NO: 1841306 - RNA, 17 nt, Homo sapiens
ugacugggaccaggcac

SEQ ID NO: 1841307 - RNA, 12 nt, Homo sapiens
gaggcucuaauu

SEQ ID NO: 1841308 - RNA, 21 nt, Homo sapiens
uggacuuggcaggugccuguu

SEQ ID NO: 1841309 - RNA, 15 nt, Homo sapiens
acaagaaaucugaca

SEQ ID NO: 1841310 - RNA, 14 nt, Homo sapiens
uuaaagaaaaccac

SEQ ID NO: 1841311 - RNA, 23 nt, Homo sapiens
agauucugccuuugccaggugac

SEQ ID NO: 1841312 - RNA, 13 nt, Homo sapiens
uggagugaucuca

SEQ ID NO: 1841313 - RNA, 13 nt, Homo sapiens
uaaauuaccuugc

SEQ ID NO: 1841314 - RNA, 19 nt, Homo sapiens
caugaaguaauaugcacac

SEQ ID NO: 1841315 - RNA, 13 nt, Homo sapiens
ucacaaugccuag

SEQ ID NO: 1841316 - RNA, 12 nt, Homo sapiens
cacugugugaau

SEQ ID NO: 1841317 - RNA, 14 nt, Homo sapiens
agaucccaucucuc

SEQ ID NO: 1841318 - RNA, 12 nt, Homo sapiens
cucugcacaugu

SEQ ID NO: 1841319 - RNA, 14 nt, Homo sapiens
cuuccuucaggacu

SEQ ID NO: 1841320 - RNA, 21 nt, Homo sapiens
cucagcuauaccucauucaca

SEQ ID NO: 1841321 - RNA, 18 nt, Homo sapiens
gugaaauguauagcugcu

SEQ ID NO: 1841322 - RNA, 20 nt, Homo sapiens
acuaaugaggaaacugcacu

SEQ ID NO: 1841323 - RNA, 17 nt, Homo sapiens
cauuugugucauugaca

SEQ ID NO: 1841324 - RNA, 16 nt, Homo sapiens
cuguugcugccucaug

SEQ ID NO: 1841325 - RNA, 15 nt, Homo sapiens
uuaauuaaagccuua

SEQ ID NO: 1841326 - RNA, 22 nt, Homo sapiens
gaaauuaaacauauucaaggag

SEQ ID NO: 1841327 - RNA, 16 nt, Homo sapiens
uuauuuuuacaguucu

SEQ ID NO: 1841328 - RNA, 19 nt, Homo sapiens
ccuuguucucaguggugca

SEQ ID NO: 1841329 - RNA, 12 nt, Homo sapiens
ucauuuagcuuu

SEQ ID NO: 1841330 - RNA, 18 nt, Homo sapiens
cauuccuuuaaauucucc

SEQ ID NO: 1841331 - RNA, 15 nt, Homo sapiens
gccccaugaagccac

SEQ ID NO: 1841332 - RNA, 20 nt, Homo sapiens
caagagucucuccagccuca

SEQ ID NO: 1841333 - RNA, 18 nt, Homo sapiens
cuuccucuagaagccaag

SEQ ID NO: 1841334 - RNA, 13 nt, Homo sapiens
caagcaguucucc

SEQ ID NO: 1841335 - RNA, 19 nt, Homo sapiens
cuacucgagaggcugaggc

SEQ ID NO: 1841336 - RNA, 16 nt, Homo sapiens
ugccauugcauuccag

SEQ ID NO: 1841337 - RNA, 16 nt, Homo sapiens
cauucuuuugccacau

SEQ ID NO: 1841338 - RNA, 14 nt, Homo sapiens
ugagcucaaaguac

SEQ ID NO: 1841339 - RNA, 19 nt, Homo sapiens
ugaaggguggucaguaguu

SEQ ID NO: 1841340 - RNA, 22 nt, Homo sapiens
uagagauggggaaagaauuccu

SEQ ID NO: 1841341 - RNA, 20 nt, Homo sapiens
augaccauccaguagagauu

SEQ ID NO: 1841342 - RNA, 14 nt, Homo sapiens
aagaaguuaaauga

SEQ ID NO: 1841343 - RNA, 18 nt, Homo sapiens
ucagccacaccugucagc

SEQ ID NO: 1841344 - RNA, 20 nt, Homo sapiens
agggauugggucguggugga

SEQ ID NO: 1841345 - RNA, 21 nt, Homo sapiens
gcagaacugcuugaacccagg

SEQ ID NO: 1841346 - RNA, 21 nt, Homo sapiens
uuucaucucuuucuacucucc

SEQ ID NO: 1841347 - RNA, 12 nt, Homo sapiens
aguauccacaau

SEQ ID NO: 1841348 - RNA, 15 nt, Homo sapiens
ggcccucugcugagc

SEQ ID NO: 1841349 - RNA, 17 nt, Homo sapiens
ggcaaagaaaagccaga

SEQ ID NO: 1841350 - RNA, 12 nt, Homo sapiens
ucccucacuugu

SEQ ID NO: 1841351 - RNA, 20 nt, Homo sapiens
uguacaaauaauauugccuu

SEQ ID NO: 1841352 - RNA, 14 nt, Homo sapiens
cagcuagacuccca

SEQ ID NO: 1841353 - RNA, 14 nt, Homo sapiens
uaauucuggagaua

SEQ ID NO: 1841354 - RNA, 16 nt, Homo sapiens
gauuuuaugcuuuaaa

SEQ ID NO: 1841355 - RNA, 20 nt, Homo sapiens
gugugaauaaagugcugcgg

SEQ ID NO: 1841356 - RNA, 14 nt, Homo sapiens
uuuuagcuuuacaa

SEQ ID NO: 1841357 - RNA, 20 nt, Homo sapiens
agcauggcuaauagggccac

SEQ ID NO: 1841358 - RNA, 16 nt, Homo sapiens
ucacccuuguccuuga

SEQ ID NO: 1841359 - RNA, 14 nt, Homo sapiens
cccaugcacuguga

SEQ ID NO: 1841360 - RNA, 17 nt, Homo sapiens
ugccaccagcauccaca

SEQ ID NO: 1841361 - RNA, 15 nt, Homo sapiens
gcauuccagaacaaa

SEQ ID NO: 1841362 - RNA, 14 nt, Homo sapiens
uuauguaacaucca

SEQ ID NO: 1841363 - RNA, 14 nt, Homo sapiens
agaaguuuagcaca

SEQ ID NO: 1841364 - RNA, 20 nt, Homo sapiens
caauucuauuacgugcaaua

SEQ ID NO: 1841365 - RNA, 18 nt, Homo sapiens
gaaaaucucagcaaugau

SEQ ID NO: 1841366 - RNA, 13 nt, Homo sapiens
auuaaaaacugug

SEQ ID NO: 1841367 - RNA, 22 nt, Homo sapiens
aacccugcugaacacagugucu

SEQ ID NO: 1841368 - RNA, 19 nt, Homo sapiens
cugcuuaguagcuuuggaa

SEQ ID NO: 1841369 - RNA, 19 nt, Homo sapiens
uggcugaaaaucacuauaa

SEQ ID NO: 1841370 - RNA, 18 nt, Homo sapiens
caugccgacgcuugcacg

SEQ ID NO: 1841371 - RNA, 22 nt, Homo sapiens
aucuuagguauaacagcacaau

SEQ ID NO: 1841372 - RNA, 20 nt, Homo sapiens
aaucagaauggaaugcucug

SEQ ID NO: 1841373 - RNA, 14 nt, Homo sapiens
cuaguagaacugga

SEQ ID NO: 1841374 - RNA, 22 nt, Homo sapiens
augagcuguggacuagcaauau

SEQ ID NO: 1841375 - RNA, 17 nt, Homo sapiens
cagucacagccauacag

SEQ ID NO: 1841376 - RNA, 18 nt, Homo sapiens
cauuuaaaaaaaaucccu

SEQ ID NO: 1841377 - RNA, 13 nt, Homo sapiens
ccucguaccagcc

SEQ ID NO: 1841378 - RNA, 15 nt, Homo sapiens
ccuuagaagaucugc

SEQ ID NO: 1841379 - RNA, 16 nt, Homo sapiens
cugaggaauaaagcuu

SEQ ID NO: 1841380 - RNA, 22 nt, Homo sapiens
ugugucagcaucuuugcccuuc

SEQ ID NO: 1841381 - RNA, 20 nt, Homo sapiens
agcaggggcagggccugagg

SEQ ID NO: 1841382 - RNA, 15 nt, Homo sapiens
agauauuguacauaa

SEQ ID NO: 1841383 - RNA, 19 nt, Homo sapiens
ucuaagcugcucuaaaguc

SEQ ID NO: 1841384 - RNA, 16 nt, Homo sapiens
ccuggcccaucagugu

SEQ ID NO: 1841385 - RNA, 15 nt, Homo sapiens
accagguuaccucac

SEQ ID NO: 1841386 - RNA, 20 nt, Homo sapiens
uacauauauacauugcuuag

SEQ ID NO: 1841387 - RNA, 17 nt, Homo sapiens
cccaauacuuuugucca

SEQ ID NO: 1841388 - RNA, 16 nt, Homo sapiens
ucacaaaccaugcaaa

SEQ ID NO: 1841389 - RNA, 20 nt, Homo sapiens
ugucuuggacccaccugaaa

SEQ ID NO: 1841390 - RNA, 17 nt, Homo sapiens
ggcaauugcggggccca

SEQ ID NO: 1841391 - RNA, 21 nt, Homo sapiens
agauuuaagugaauacauuaa

SEQ ID NO: 1841392 - RNA, 17 nt, Homo sapiens
acaugcacagcuaacau

SEQ ID NO: 1841393 - RNA, 22 nt, Homo sapiens
gacggcaccaucuggaaggaca

SEQ ID NO: 1841394 - RNA, 17 nt, Homo sapiens
gauuuauuuuuauauga

SEQ ID NO: 1841395 - RNA, 14 nt, Homo sapiens
uuugggaaccaagc

SEQ ID NO: 1841396 - RNA, 21 nt, Homo sapiens
cagacaguguuuugcacauca

SEQ ID NO: 1841397 - RNA, 17 nt, Homo sapiens
caucuuguacaaacuuu

SEQ ID NO: 1841398 - RNA, 13 nt, Homo sapiens
uugcguacacaga

SEQ ID NO: 1841399 - RNA, 14 nt, Homo sapiens
cuccaaaacacuua

SEQ ID NO: 1841400 - RNA, 18 nt, Homo sapiens
aauaauggguuucuuuca

SEQ ID NO: 1841401 - RNA, 16 nt, Homo sapiens
cacacuguacucugca

SEQ ID NO: 1841402 - RNA, 15 nt, Homo sapiens
ugaugucuuuguuaa

SEQ ID NO: 1841403 - RNA, 11 nt, Homo sapiens
uucuucacuca

SEQ ID NO: 1841404 - RNA, 13 nt, Homo sapiens
accugcucaccaa

SEQ ID NO: 1841405 - RNA, 16 nt, Homo sapiens
aguagcauacauuuau

SEQ ID NO: 1841406 - RNA, 17 nt, Homo sapiens
ccagugcaaucugucca

SEQ ID NO: 1841407 - RNA, 14 nt, Homo sapiens
aaggugcucugugu

SEQ ID NO: 1841408 - RNA, 15 nt, Homo sapiens
gcauaaagguucugg

SEQ ID NO: 1841409 - RNA, 18 nt, Homo sapiens
ugaagaagcccuguucuc

SEQ ID NO: 1841410 - RNA, 19 nt, Homo sapiens
cugaacaaucaaagcacuu

SEQ ID NO: 1841411 - RNA, 20 nt, Homo sapiens
aaaaggucauagcugagauu

SEQ ID NO: 1841412 - RNA, 22 nt, Homo sapiens
cucacugcugcaaauacuguau

SEQ ID NO: 1841413 - RNA, 16 nt, Homo sapiens
gaagaucugcuucccu

SEQ ID NO: 1841414 - RNA, 20 nt, Homo sapiens
agaaguuggucuuacuuugu

SEQ ID NO: 1841415 - RNA, 22 nt, Homo sapiens
augaacuuccauuuguauucaa

SEQ ID NO: 1841416 - RNA, 16 nt, Homo sapiens
cucauccuuuacauuu

SEQ ID NO: 1841417 - RNA, 16 nt, Homo sapiens
uaaacacgccugcaaa

SEQ ID NO: 1841418 - RNA, 12 nt, Homo sapiens
auuucugcucag

SEQ ID NO: 1841419 - RNA, 13 nt, Homo sapiens
auucaaguguaca

SEQ ID NO: 1841420 - RNA, 22 nt, Homo sapiens
accacagugaauccagaccaac

SEQ ID NO: 1841421 - RNA, 16 nt, Homo sapiens
uagaacuggucuucca

SEQ ID NO: 1841422 - RNA, 20 nt, Homo sapiens
gcaccugggacccugcacag

SEQ ID NO: 1841423 - RNA, 23 nt, Homo sapiens
aucagcuauuuugugaagccaug

SEQ ID NO: 1841424 - RNA, 21 nt, Homo sapiens
aaagccuucacuucaaagaag

SEQ ID NO: 1841425 - RNA, 12 nt, Homo sapiens
ggcugguguaug

SEQ ID NO: 1841426 - RNA, 15 nt, Homo sapiens
auuguggagccaaag

SEQ ID NO: 1841427 - RNA, 20 nt, Homo sapiens
ccuagcaacauaucucugcc

SEQ ID NO: 1841428 - RNA, 19 nt, Homo sapiens
acaguuggcacuucugcca

SEQ ID NO: 1841429 - RNA, 17 nt, Homo sapiens
uucauauaccagcaaua

SEQ ID NO: 1841430 - RNA, 12 nt, Homo sapiens
uacgggccaguu

SEQ ID NO: 1841431 - RNA, 12 nt, Homo sapiens
ccagcucaggau

SEQ ID NO: 1841432 - RNA, 23 nt, Homo sapiens
uugucuaauuaaaacacuuucaa

SEQ ID NO: 1841433 - RNA, 12 nt, Homo sapiens
ccaucucugucu

SEQ ID NO: 1841434 - RNA, 23 nt, Homo sapiens
guuuccugggcacgcacuggguu

SEQ ID NO: 1841435 - RNA, 14 nt, Homo sapiens
ugcuucuagugauu

SEQ ID NO: 1841436 - RNA, 19 nt, Homo sapiens
uccccaguucuacugaccu

SEQ ID NO: 1841437 - RNA, 14 nt, Homo sapiens
guucugaggccaga

SEQ ID NO: 1841438 - RNA, 23 nt, Homo sapiens
caugugugcgugugcgugcaugu

SEQ ID NO: 1841439 - RNA, 15 nt, Homo sapiens
gaucaucuuugccac

SEQ ID NO: 1841440 - RNA, 17 nt, Homo sapiens
uccuccuguuacuugcu

SEQ ID NO: 1841441 - RNA, 14 nt, Homo sapiens
ugucuuucagccaa

SEQ ID NO: 1841442 - RNA, 23 nt, Homo sapiens
agagaaaggccugcacacaagcc

SEQ ID NO: 1841443 - RNA, 23 nt, Homo sapiens
guggagcaaaggcucaccuuugu

SEQ ID NO: 1841444 - RNA, 17 nt, Homo sapiens
gagagucugugacccac

SEQ ID NO: 1841445 - RNA, 22 nt, Homo sapiens
aguguacaugugugaaaacaau

SEQ ID NO: 1841446 - RNA, 15 nt, Homo sapiens
ugaguauuacacauu

SEQ ID NO: 1841447 - RNA, 20 nt, Homo sapiens
uaaacccacauaaacacuuc

SEQ ID NO: 1841448 - RNA, 18 nt, Homo sapiens
acagauggcagugccaua

SEQ ID NO: 1841449 - RNA, 13 nt, Homo sapiens
accgcaaugugac

SEQ ID NO: 1841450 - RNA, 11 nt, Homo sapiens
cuaacagagag

SEQ ID NO: 1841451 - RNA, 20 nt, Homo sapiens
aagaguugugacaacuuccu

SEQ ID NO: 1841452 - RNA, 17 nt, Homo sapiens
acuguccacaucugccu

SEQ ID NO: 1841453 - RNA, 15 nt, Homo sapiens
aaguccaguguuucu

SEQ ID NO: 1841454 - RNA, 16 nt, Homo sapiens
aaaguuuugucagaaa

SEQ ID NO: 1841455 - RNA, 14 nt, Homo sapiens
gggcuggcacguga

SEQ ID NO: 1841456 - RNA, 13 nt, Homo sapiens
aucuagauggaua

SEQ ID NO: 1841457 - RNA, 15 nt, Homo sapiens
cccgcucacgcugac

SEQ ID NO: 1841458 - RNA, 16 nt, Homo sapiens
gagaucuuucccaggc

SEQ ID NO: 1841459 - RNA, 14 nt, Homo sapiens
acuguagcacuuaa

SEQ ID NO: 1841460 - RNA, 21 nt, Homo sapiens
uucuggguggcuccugccacu

SEQ ID NO: 1841461 - RNA, 17 nt, Homo sapiens
auacgcuuuuaaugaaa

SEQ ID NO: 1841462 - RNA, 14 nt, Homo sapiens
cuagaauucuagug

SEQ ID NO: 1841463 - RNA, 23 nt, Homo sapiens
gcauugcugugugaauccaggag

SEQ ID NO: 1841464 - RNA, 22 nt, Homo sapiens
uggugaccugcggcaguaugua

SEQ ID NO: 1841465 - RNA, 15 nt, Homo sapiens
ggcaagggguuucca

SEQ ID NO: 1841466 - RNA, 14 nt, Homo sapiens
caauggcggacuca

SEQ ID NO: 1841467 - RNA, 14 nt, Homo sapiens
cagucuuccauuug

SEQ ID NO: 1841468 - RNA, 16 nt, Homo sapiens
agggaguuggugugcu

SEQ ID NO: 1841469 - RNA, 21 nt, Homo sapiens
cuuuaaaguuacuauucugua

SEQ ID NO: 1841470 - RNA, 16 nt, Homo sapiens
guacucucaugcaauu

SEQ ID NO: 1841471 - RNA, 21 nt, Homo sapiens
ucauugcuaaacugaugacuu

SEQ ID NO: 1841472 - RNA, 20 nt, Homo sapiens
ggcaaggagaagagcaaagu

SEQ ID NO: 1841473 - RNA, 16 nt, Homo sapiens
uaaacuugccuguuca

SEQ ID NO: 1841474 - RNA, 14 nt, Homo sapiens
cagaggccaagagu

SEQ ID NO: 1841475 - RNA, 16 nt, Homo sapiens
ugcuccugauauaaca

SEQ ID NO: 1841476 - RNA, 15 nt, Homo sapiens
aguuuauuauguacu

SEQ ID NO: 1841477 - RNA, 15 nt, Homo sapiens
auacuuagacaguau

SEQ ID NO: 1841478 - RNA, 15 nt, Homo sapiens
cuugguagccucgau

SEQ ID NO: 1841479 - RNA, 22 nt, Homo sapiens
ggcugacggugcagucugggug

SEQ ID NO: 1841480 - RNA, 14 nt, Homo sapiens
ucuuguggugcauu

SEQ ID NO: 1841481 - RNA, 15 nt, Homo sapiens
cuuuugcucauccac

SEQ ID NO: 1841482 - RNA, 21 nt, Homo sapiens
uugaagaugcuuguauuuuac

SEQ ID NO: 1841483 - RNA, 21 nt, Homo sapiens
aguucacaucagaacagacaa

SEQ ID NO: 1841484 - RNA, 20 nt, Homo sapiens
ccagcuccuuucaugcucca

SEQ ID NO: 1841485 - RNA, 22 nt, Homo sapiens
gcuucaaugucguuuuguaucu

SEQ ID NO: 1841486 - RNA, 13 nt, Homo sapiens
aaacacuagcucu

SEQ ID NO: 1841487 - RNA, 17 nt, Homo sapiens
acauucaucaagcugua

SEQ ID NO: 1841488 - RNA, 16 nt, Homo sapiens
acauuccugggcacag

SEQ ID NO: 1841489 - RNA, 16 nt, Homo sapiens
guccaaacuuucucug

SEQ ID NO: 1841490 - RNA, 16 nt, Homo sapiens
ugccgacuggcuguga

SEQ ID NO: 1841491 - RNA, 18 nt, Homo sapiens
cccaaucaccuuuccugu

SEQ ID NO: 1841492 - RNA, 17 nt, Homo sapiens
uggaauaaagcccuuga

SEQ ID NO: 1841493 - RNA, 20 nt, Homo sapiens
aacugcuuguaaaggugcuc

SEQ ID NO: 1841494 - RNA, 15 nt, Homo sapiens
cuguccagccgugug

SEQ ID NO: 1841495 - RNA, 15 nt, Homo sapiens
gguccauucucugag

SEQ ID NO: 1841496 - RNA, 22 nt, Homo sapiens
cacaggaugaaggcaaugccau

SEQ ID NO: 1841497 - RNA, 20 nt, Homo sapiens
uuuuuauggaggcuuugcau

SEQ ID NO: 1841498 - RNA, 13 nt, Homo sapiens
augcugugcucaa

SEQ ID NO: 1841499 - RNA, 15 nt, Homo sapiens
uuugauuuacauaua

SEQ ID NO: 1841500 - RNA, 23 nt, Homo sapiens
ccagacauauuguacucuuucua

SEQ ID NO: 1841501 - RNA, 15 nt, Homo sapiens
ugggauuacaggugu

SEQ ID NO: 1841502 - RNA, 16 nt, Homo sapiens
cccugcagagcaauaa

SEQ ID NO: 1841503 - RNA, 18 nt, Homo sapiens
ggcacuacucaguuauua

SEQ ID NO: 1841504 - RNA, 21 nt, Homo sapiens
aauguacaacuuuuuaccuag

SEQ ID NO: 1841505 - RNA, 23 nt, Homo sapiens
guggcuuagaaaguccaauucca

SEQ ID NO: 1841506 - RNA, 21 nt, Homo sapiens
gaacuccccuugaaaacugcu

SEQ ID NO: 1841507 - RNA, 14 nt, Homo sapiens
gagagagugcuauu

SEQ ID NO: 1841508 - RNA, 13 nt, Homo sapiens
ucuuguugcugca

SEQ ID NO: 1841509 - RNA, 21 nt, Homo sapiens
uaaguacuugagacucuugaa

SEQ ID NO: 1841510 - RNA, 16 nt, Homo sapiens
ucgcgcgacugagaac

SEQ ID NO: 1841511 - RNA, 14 nt, Homo sapiens
agauggaguuucac

SEQ ID NO: 1841512 - RNA, 17 nt, Homo sapiens
caggaaaugcaaaccau

SEQ ID NO: 1841513 - RNA, 14 nt, Homo sapiens
ucucuggaccugac

SEQ ID NO: 1841514 - RNA, 19 nt, Homo sapiens
gcacugccuccuguuuucu

SEQ ID NO: 1841515 - RNA, 19 nt, Homo sapiens
ucuuacuguaagaaacaag

SEQ ID NO: 1841516 - RNA, 14 nt, Homo sapiens
aaaagucacucuga

SEQ ID NO: 1841517 - RNA, 24 nt, Homo sapiens
agaucagcauucaaaauaguucua

SEQ ID NO: 1841518 - RNA, 12 nt, Homo sapiens
caacaugcacac

SEQ ID NO: 1841519 - RNA, 12 nt, Homo sapiens
cauuaugcacuu

SEQ ID NO: 1841520 - RNA, 15 nt, Homo sapiens
aauagcaacuugugu

SEQ ID NO: 1841521 - RNA, 17 nt, Homo sapiens
ucagucacaaguuacag

SEQ ID NO: 1841522 - RNA, 17 nt, Homo sapiens
uacaauaaguuacuuga

SEQ ID NO: 1841523 - RNA, 23 nt, Homo sapiens
agacuuccuugcaggagugacuc

SEQ ID NO: 1841524 - RNA, 14 nt, Homo sapiens
ugaggaaaauccau

SEQ ID NO: 1841525 - RNA, 19 nt, Homo sapiens
caaugucuuaggucaggag

SEQ ID NO: 1841526 - RNA, 20 nt, Homo sapiens
ccuuaggagacgcugcacuu

SEQ ID NO: 1841527 - RNA, 20 nt, Homo sapiens
ugaacaaauuuucuggugcu

SEQ ID NO: 1841528 - RNA, 17 nt, Homo sapiens
ugacuucacacacaccu

SEQ ID NO: 1841529 - RNA, 12 nt, Homo sapiens
acaaaagcaauu

SEQ ID NO: 1841530 - RNA, 12 nt, Homo sapiens
aaauaagcacua

SEQ ID NO: 1841531 - RNA, 16 nt, Homo sapiens
aacaauccccuaacac

SEQ ID NO: 1841532 - RNA, 14 nt, Homo sapiens
gaauugaccaaaua

SEQ ID NO: 1841533 - RNA, 12 nt, Homo sapiens
uuaaauuugcca

SEQ ID NO: 1841534 - RNA, 17 nt, Homo sapiens
aaacaaauauuucacuu

SEQ ID NO: 1841535 - RNA, 16 nt, Homo sapiens
auaucuuguagcuuua

SEQ ID NO: 1841536 - RNA, 19 nt, Homo sapiens
uggaauaaagcccuugaac

SEQ ID NO: 1841537 - RNA, 18 nt, Homo sapiens
ggagggaaaagagugccu

SEQ ID NO: 1841538 - RNA, 19 nt, Homo sapiens
aaauauuuagucugcauug

SEQ ID NO: 1841539 - RNA, 24 nt, Homo sapiens
cuucaguaauaauuauguauguua

SEQ ID NO: 1841540 - RNA, 18 nt, Homo sapiens
uguaauauuaacuaaaua

SEQ ID NO: 1841541 - RNA, 23 nt, Homo sapiens
gguguaccugcuggcacuaucca

SEQ ID NO: 1841542 - RNA, 21 nt, Homo sapiens
uuguggaaagaugaaugcaau

SEQ ID NO: 1841543 - RNA, 21 nt, Homo sapiens
auuuaauuuuuuaaacuguag

SEQ ID NO: 1841544 - RNA, 20 nt, Homo sapiens
acccaccuagaacacuaacu

SEQ ID NO: 1841545 - RNA, 13 nt, Homo sapiens
gcuaggauuacag

SEQ ID NO: 1841546 - RNA, 17 nt, Homo sapiens
gaauaaaggcaguuuuc

SEQ ID NO: 1841547 - RNA, 19 nt, Homo sapiens
acugggagggggacccgug

SEQ ID NO: 1841548 - RNA, 18 nt, Homo sapiens
accucaccccacuuaucc

SEQ ID NO: 1841549 - RNA, 17 nt, Homo sapiens
acugucuuugucaccac

SEQ ID NO: 1841550 - RNA, 20 nt, Homo sapiens
auggauugccaagucagcau

SEQ ID NO: 1841551 - RNA, 17 nt, Homo sapiens
aaaucccaccacugcac

SEQ ID NO: 1841552 - RNA, 18 nt, Homo sapiens
aauauauuuuaccauaca

SEQ ID NO: 1841553 - RNA, 18 nt, Homo sapiens
cuguauaaacaagccuaa

SEQ ID NO: 1841554 - RNA, 14 nt, Homo sapiens
cuuuagacuugaaa

SEQ ID NO: 1841555 - RNA, 17 nt, Homo sapiens
ucgcaucucagugcagg

SEQ ID NO: 1841556 - RNA, 19 nt, Homo sapiens
cuucaauagaacuguuuca

SEQ ID NO: 1841557 - RNA, 15 nt, Homo sapiens
caauauuuacauuuu

SEQ ID NO: 1841558 - RNA, 16 nt, Homo sapiens
aacucuacaucuagca

SEQ ID NO: 1841559 - RNA, 15 nt, Homo sapiens
augaugcaaccaaaa

SEQ ID NO: 1841560 - RNA, 23 nt, Homo sapiens
uccgggaggacaaccagaccaac

SEQ ID NO: 1841561 - RNA, 20 nt, Homo sapiens
gauacuaugguucuccacua

SEQ ID NO: 1841562 - RNA, 15 nt, Homo sapiens
auccugagcaaacaa

SEQ ID NO: 1841563 - RNA, 12 nt, Homo sapiens
uugccauuguca

SEQ ID NO: 1841564 - RNA, 17 nt, Homo sapiens
uggugaaacauggugaa

SEQ ID NO: 1841565 - RNA, 17 nt, Homo sapiens
aguucugccaggcaacu

SEQ ID NO: 1841566 - RNA, 14 nt, Homo sapiens
aaggaugggaccaa

SEQ ID NO: 1841567 - RNA, 12 nt, Homo sapiens
gcacaguuugaa

SEQ ID NO: 1841568 - RNA, 16 nt, Homo sapiens
auggaaaaauugacaa

SEQ ID NO: 1841569 - RNA, 16 nt, Homo sapiens
ugcuuuucacaaauca

SEQ ID NO: 1841570 - RNA, 12 nt, Homo sapiens
gauaucucagga

SEQ ID NO: 1841571 - RNA, 13 nt, Homo sapiens
ccauuuaauuucu

SEQ ID NO: 1841572 - RNA, 23 nt, Homo sapiens
ccugggaguuuuguauucaucuu

SEQ ID NO: 1841573 - RNA, 15 nt, Homo sapiens
uucuuauuaauuuca

SEQ ID NO: 1841574 - RNA, 21 nt, Homo sapiens
acauaacaauaaaaaccaaac

SEQ ID NO: 1841575 - RNA, 15 nt, Homo sapiens
uguuaacugacaagc

SEQ ID NO: 1841576 - RNA, 22 nt, Homo sapiens
uugucauggaaaauguccugug

SEQ ID NO: 1841577 - RNA, 20 nt, Homo sapiens
uagaagugucacagccauag

SEQ ID NO: 1841578 - RNA, 17 nt, Homo sapiens
ccucaugcugaucuucu

SEQ ID NO: 1841579 - RNA, 21 nt, Homo sapiens
ugcaacauaugaguguuuuga

SEQ ID NO: 1841580 - RNA, 15 nt, Homo sapiens
aaagucugucagguu

SEQ ID NO: 1841581 - RNA, 15 nt, Homo sapiens
ccaggccugaccagg

SEQ ID NO: 1841582 - RNA, 16 nt, Homo sapiens
aggauugucacuccaa

SEQ ID NO: 1841583 - RNA, 13 nt, Homo sapiens
aguugcagucuca

SEQ ID NO: 1841584 - RNA, 18 nt, Homo sapiens
acagagcagaucagucuu

SEQ ID NO: 1841585 - RNA, 16 nt, Homo sapiens
ugaaaaccacagucag

SEQ ID NO: 1841586 - RNA, 20 nt, Homo sapiens
aaccucucuaagccacagcu

SEQ ID NO: 1841587 - RNA, 22 nt, Homo sapiens
uccuuggagugcugcagcuuug

SEQ ID NO: 1841588 - RNA, 21 nt, Homo sapiens
cagacagagggucacaguguu

SEQ ID NO: 1841589 - RNA, 22 nt, Homo sapiens
augcaauuuuauuaaaugcauc

SEQ ID NO: 1841590 - RNA, 18 nt, Homo sapiens
uaauuucugucaaaugca

SEQ ID NO: 1841591 - RNA, 17 nt, Homo sapiens
auaauuucaaaccacac

SEQ ID NO: 1841592 - RNA, 18 nt, Homo sapiens
accugcuuccugaaauaa

SEQ ID NO: 1841593 - RNA, 15 nt, Homo sapiens
uauaacugugaugaa

SEQ ID NO: 1841594 - RNA, 17 nt, Homo sapiens
ucgacuuccccggccac

SEQ ID NO: 1841595 - RNA, 15 nt, Homo sapiens
agcccucaacuauuc

SEQ ID NO: 1841596 - RNA, 14 nt, Homo sapiens
caugcuggugcaua

SEQ ID NO: 1841597 - RNA, 19 nt, Homo sapiens
uggucacagacuucuggcc

SEQ ID NO: 1841598 - RNA, 21 nt, Homo sapiens
ccaguaggaaaucaggcaguu

SEQ ID NO: 1841599 - RNA, 13 nt, Homo sapiens
agcucacaaauag

SEQ ID NO: 1841600 - RNA, 22 nt, Homo sapiens
caaaaugugaaaauaauauuaa

SEQ ID NO: 1841601 - RNA, 17 nt, Homo sapiens
uccuacacaauggugcu

SEQ ID NO: 1841602 - RNA, 20 nt, Homo sapiens
ugaaaccauacagcuucaua

SEQ ID NO: 1841603 - RNA, 22 nt, Homo sapiens
cagggcccuggaugguccucuu

SEQ ID NO: 1841604 - RNA, 14 nt, Homo sapiens
ccuaugcacauaug

SEQ ID NO: 1841605 - RNA, 14 nt, Homo sapiens
guguuggaagccag

SEQ ID NO: 1841606 - RNA, 16 nt, Homo sapiens
aaggccaaugggcuag

SEQ ID NO: 1841607 - RNA, 17 nt, Homo sapiens
uucauuuuucuaauaau

SEQ ID NO: 1841608 - RNA, 13 nt, Homo sapiens
auccaacguguaa

SEQ ID NO: 1841609 - RNA, 14 nt, Homo sapiens
ucaucuucacugca

SEQ ID NO: 1841610 - RNA, 14 nt, Homo sapiens
uaauauucaaugaa

SEQ ID NO: 1841611 - RNA, 13 nt, Homo sapiens
gagcgcacaggga

SEQ ID NO: 1841612 - RNA, 17 nt, Homo sapiens
uaucugcaaaaugggau

SEQ ID NO: 1841613 - RNA, 16 nt, Homo sapiens
acucagcacuuggccc

SEQ ID NO: 1841614 - RNA, 23 nt, Homo sapiens
ccagaaugguacacaaugugauu

SEQ ID NO: 1841615 - RNA, 16 nt, Homo sapiens
gaaggucuuuguuaug

SEQ ID NO: 1841616 - RNA, 19 nt, Homo sapiens
auccagauagguuaccagu

SEQ ID NO: 1841617 - RNA, 17 nt, Homo sapiens
caucagugcucccucac

SEQ ID NO: 1841618 - RNA, 21 nt, Homo sapiens
acuuuucaucuaacgugcauu

SEQ ID NO: 1841619 - RNA, 17 nt, Homo sapiens
aaaugcauacuguugau

SEQ ID NO: 1841620 - RNA, 19 nt, Homo sapiens
ccaugggcucagggccagg

SEQ ID NO: 1841621 - RNA, 17 nt, Homo sapiens
accucccagagagugaa

SEQ ID NO: 1841622 - RNA, 18 nt, Homo sapiens
cuucggcagggaggugaa

SEQ ID NO: 1841623 - RNA, 24 nt, Homo sapiens
aaaauccaugguuaucugagauag

SEQ ID NO: 1841624 - RNA, 20 nt, Homo sapiens
uaauguuauaucauauguau

SEQ ID NO: 1841625 - RNA, 13 nt, Homo sapiens
uaccuaaggacaa

SEQ ID NO: 1841626 - RNA, 13 nt, Homo sapiens
uccaaaaggcccu

SEQ ID NO: 1841627 - RNA, 14 nt, Homo sapiens
aagcuacuguagaa

SEQ ID NO: 1841628 - RNA, 19 nt, Homo sapiens
aggccagggagcaguggcu

SEQ ID NO: 1841629 - RNA, 19 nt, Homo sapiens
uucacgcuuuuguuuucau

SEQ ID NO: 1841630 - RNA, 16 nt, Homo sapiens
aaaagcaugcauauca

SEQ ID NO: 1841631 - RNA, 13 nt, Homo sapiens
uguuaauuuagag

SEQ ID NO: 1841632 - RNA, 23 nt, Homo sapiens
ccagaucagauucuucucuuaau

SEQ ID NO: 1841633 - RNA, 22 nt, Homo sapiens
guauaagcacugaaaaacaaca

SEQ ID NO: 1841634 - RNA, 17 nt, Homo sapiens
aacuacuucucuugcau

SEQ ID NO: 1841635 - RNA, 14 nt, Homo sapiens
guacguggccaugu

SEQ ID NO: 1841636 - RNA, 21 nt, Homo sapiens
uaaagaauaaaugaaucuuac

SEQ ID NO: 1841637 - RNA, 23 nt, Homo sapiens
guccaggaacugccugggccaug

SEQ ID NO: 1841638 - RNA, 18 nt, Homo sapiens
auaaacuuauaaucaaua

SEQ ID NO: 1841639 - RNA, 17 nt, Homo sapiens
ccagaauggagccugcu

SEQ ID NO: 1841640 - RNA, 19 nt, Homo sapiens
caaaauugcugcaccaaug

SEQ ID NO: 1841641 - RNA, 22 nt, Homo sapiens
cuucauuugacacaaagcuucu

SEQ ID NO: 1841642 - RNA, 23 nt, Homo sapiens
ccaccuauauccagaaggggagc

SEQ ID NO: 1841643 - RNA, 15 nt, Homo sapiens
ucuuguuacugugau

SEQ ID NO: 1841644 - RNA, 23 nt, Homo sapiens
aaauauuugugaaagugccaaaa

SEQ ID NO: 1841645 - RNA, 22 nt, Homo sapiens
ccaugacuucagaguacaucca

SEQ ID NO: 1841646 - RNA, 13 nt, Homo sapiens
accaacccagaga

SEQ ID NO: 1841647 - RNA, 19 nt, Homo sapiens
acacaaaauguacccagua

SEQ ID NO: 1841648 - RNA, 21 nt, Homo sapiens
caaacagccccucuggacaca

SEQ ID NO: 1841649 - RNA, 17 nt, Homo sapiens
guggccucagcaucuca

SEQ ID NO: 1841650 - RNA, 21 nt, Homo sapiens
uauacuugggaauauaaagga

SEQ ID NO: 1841651 - RNA, 16 nt, Homo sapiens
uccacucccuuugcca

SEQ ID NO: 1841652 - RNA, 16 nt, Homo sapiens
ccuagcccuucucuca

SEQ ID NO: 1841653 - RNA, 14 nt, Homo sapiens
gaccugagaaccuu

SEQ ID NO: 1841654 - RNA, 18 nt, Homo sapiens
aggaaucaugucaggcca

SEQ ID NO: 1841655 - RNA, 12 nt, Homo sapiens
aagcaccaugaa

SEQ ID NO: 1841656 - RNA, 21 nt, Homo sapiens
cccaacaguugucaaauugau

SEQ ID NO: 1841657 - RNA, 20 nt, Homo sapiens
uauugcucaggcuggucuug

SEQ ID NO: 1841658 - RNA, 12 nt, Homo sapiens
caagaagcccuc

SEQ ID NO: 1841659 - RNA, 22 nt, Homo sapiens
ucaguaaaaauaaauaaaacag

SEQ ID NO: 1841660 - RNA, 11 nt, Homo sapiens
cuggcucucuc

SEQ ID NO: 1841661 - RNA, 13 nt, Homo sapiens
augaauuauuaua

SEQ ID NO: 1841662 - RNA, 21 nt, Homo sapiens
ucuacuuccccuucuugccau

SEQ ID NO: 1841663 - RNA, 12 nt, Homo sapiens
ggagacacugau

SEQ ID NO: 1841664 - RNA, 12 nt, Homo sapiens
ggugacacuguu

SEQ ID NO: 1841665 - RNA, 23 nt, Homo sapiens
accuuucuagccuuagacaaaug

SEQ ID NO: 1841666 - RNA, 17 nt, Homo sapiens
agggaauaaaccuggca

SEQ ID NO: 1841667 - RNA, 19 nt, Homo sapiens
cauaguaccucugcuauuu

SEQ ID NO: 1841668 - RNA, 23 nt, Homo sapiens
uccauauguuauaucaacagaua

SEQ ID NO: 1841669 - RNA, 18 nt, Homo sapiens
ucaaacccccaacccaaa

SEQ ID NO: 1841670 - RNA, 12 nt, Homo sapiens
uuuaaugccaag

SEQ ID NO: 1841671 - RNA, 13 nt, Homo sapiens
caacagggaaccg

SEQ ID NO: 1841672 - RNA, 14 nt, Homo sapiens
agccuuuguuuuuc

SEQ ID NO: 1841673 - RNA, 20 nt, Homo sapiens
cgccaacauggcacauguau

SEQ ID NO: 1841674 - RNA, 23 nt, Homo sapiens
ccaggcugguauuuaucugcaag

SEQ ID NO: 1841675 - RNA, 23 nt, Homo sapiens
acaguaaauaaauuguuugacca

SEQ ID NO: 1841676 - RNA, 18 nt, Homo sapiens
ugauccuucaacucugug

SEQ ID NO: 1841677 - RNA, 16 nt, Homo sapiens
aacucuuauaacacaa

SEQ ID NO: 1841678 - RNA, 16 nt, Homo sapiens
agacagauacuccucc

SEQ ID NO: 1841679 - RNA, 17 nt, Homo sapiens
acuucugcuuugcucuu

SEQ ID NO: 1841680 - RNA, 12 nt, Homo sapiens
auguaugcagcu

SEQ ID NO: 1841681 - RNA, 18 nt, Homo sapiens
uccaucuucccuacccuu

SEQ ID NO: 1841682 - RNA, 15 nt, Homo sapiens
uaauauuuagcugua

SEQ ID NO: 1841683 - RNA, 15 nt, Homo sapiens
uacagacauggaaca

SEQ ID NO: 1841684 - RNA, 19 nt, Homo sapiens
cuacacucaccugcacuaa

SEQ ID NO: 1841685 - RNA, 21 nt, Homo sapiens
uuugagcccauucuucugggu

SEQ ID NO: 1841686 - RNA, 18 nt, Homo sapiens
accagccuccuguuugca

SEQ ID NO: 1841687 - RNA, 22 nt, Homo sapiens
uuucauugcugugucacacucu

SEQ ID NO: 1841688 - RNA, 15 nt, Homo sapiens
auaaucacucuaauu

SEQ ID NO: 1841689 - RNA, 15 nt, Homo sapiens
gucaccuuccaggac

SEQ ID NO: 1841690 - RNA, 17 nt, Homo sapiens
aggacagugauguuggc

SEQ ID NO: 1841691 - RNA, 19 nt, Homo sapiens
ucagcugcauuucacaugc

SEQ ID NO: 1841692 - RNA, 21 nt, Homo sapiens
cgacuuuuaacuauguaauaa

SEQ ID NO: 1841693 - RNA, 16 nt, Homo sapiens
ccugauggagugugca

SEQ ID NO: 1841694 - RNA, 18 nt, Homo sapiens
agaacauacacugugaac

SEQ ID NO: 1841695 - RNA, 20 nt, Homo sapiens
ucagaaaagacgcaccagcc

SEQ ID NO: 1841696 - RNA, 19 nt, Homo sapiens
aaccuccccugguccugca

SEQ ID NO: 1841697 - RNA, 21 nt, Homo sapiens
cuuugccacaagaccuagccu

SEQ ID NO: 1841698 - RNA, 14 nt, Homo sapiens
aagcccacccagau

SEQ ID NO: 1841699 - RNA, 15 nt, Homo sapiens
cacauguaucuaugc

SEQ ID NO: 1841700 - RNA, 21 nt, Homo sapiens
gagaugaccacuuuuuagaaa

SEQ ID NO: 1841701 - RNA, 13 nt, Homo sapiens
agaauaacuucag

SEQ ID NO: 1841702 - RNA, 17 nt, Homo sapiens
uugucacaacacugaac

SEQ ID NO: 1841703 - RNA, 13 nt, Homo sapiens
uccaaaacauuuc

SEQ ID NO: 1841704 - RNA, 17 nt, Homo sapiens
cacccucuccuugucac

SEQ ID NO: 1841705 - RNA, 13 nt, Homo sapiens
cggcucacaaaga

SEQ ID NO: 1841706 - RNA, 18 nt, Homo sapiens
ccaaucccagcuaccuca

SEQ ID NO: 1841707 - RNA, 24 nt, Homo sapiens
gagugccuucaacacagcuugucu

SEQ ID NO: 1841708 - RNA, 14 nt, Homo sapiens
aaauuaaaguauac

SEQ ID NO: 1841709 - RNA, 14 nt, Homo sapiens
caagggaggggugg

SEQ ID NO: 1841710 - RNA, 13 nt, Homo sapiens
gaaaagugaaucu

SEQ ID NO: 1841711 - RNA, 16 nt, Homo sapiens
aauguuuuaacucuuu

SEQ ID NO: 1841712 - RNA, 14 nt, Homo sapiens
aaauauauuugaua

SEQ ID NO: 1841713 - RNA, 17 nt, Homo sapiens
auguuuauguacuguaa

SEQ ID NO: 1841714 - RNA, 18 nt, Homo sapiens
gcauguauuuuugucaau

SEQ ID NO: 1841715 - RNA, 16 nt, Homo sapiens
auuacucucaaccacc

SEQ ID NO: 1841716 - RNA, 18 nt, Homo sapiens
cucagcaggggaggguag

SEQ ID NO: 1841717 - RNA, 21 nt, Homo sapiens
acacugaaaaaucuaagugau

SEQ ID NO: 1841718 - RNA, 17 nt, Homo sapiens
aguuucaccacuccucu

SEQ ID NO: 1841719 - RNA, 15 nt, Homo sapiens
gucuggcaucuccca

SEQ ID NO: 1841720 - RNA, 23 nt, Homo sapiens
cacauuugauuauauacuaugua

SEQ ID NO: 1841721 - RNA, 19 nt, Homo sapiens
gcucccugcucaggagcag

SEQ ID NO: 1841722 - RNA, 14 nt, Homo sapiens
gcugcuacuagcuc

SEQ ID NO: 1841723 - RNA, 16 nt, Homo sapiens
ccccaggguccuguag

SEQ ID NO: 1841724 - RNA, 19 nt, Homo sapiens
aaggcaucuacacaauuua

SEQ ID NO: 1841725 - RNA, 23 nt, Homo sapiens
uagcccaucaagcuccugcccug

SEQ ID NO: 1841726 - RNA, 20 nt, Homo sapiens
uggcuguugacgcaccugug

SEQ ID NO: 1841727 - RNA, 15 nt, Homo sapiens
caucauuuucaccuc

SEQ ID NO: 1841728 - RNA, 18 nt, Homo sapiens
gauuaaauugcaccagaa

SEQ ID NO: 1841729 - RNA, 15 nt, Homo sapiens
gggaugggauuucau

SEQ ID NO: 1841730 - RNA, 16 nt, Homo sapiens
ggcucccgaguacagu

SEQ ID NO: 1841731 - RNA, 14 nt, Homo sapiens
aaaaaaauugcaca

SEQ ID NO: 1841732 - RNA, 17 nt, Homo sapiens
cuccaggaaagagcagu

SEQ ID NO: 1841733 - RNA, 20 nt, Homo sapiens
guaaacauauuggaauguac

SEQ ID NO: 1841734 - RNA, 16 nt, Homo sapiens
gcaucuucucauuccc

SEQ ID NO: 1841735 - RNA, 13 nt, Homo sapiens
cguggaaaggggc

SEQ ID NO: 1841736 - RNA, 18 nt, Homo sapiens
gcaaaggaaauaccaguu

SEQ ID NO: 1841737 - RNA, 13 nt, Homo sapiens
cauuccaugucca

SEQ ID NO: 1841738 - RNA, 14 nt, Homo sapiens
ugugucugugaaca

SEQ ID NO: 1841739 - RNA, 16 nt, Homo sapiens
cuuguacugugaccua

SEQ ID NO: 1841740 - RNA, 20 nt, Homo sapiens
gccugcagggccucugucaa

SEQ ID NO: 1841741 - RNA, 16 nt, Homo sapiens
aagcucccaccccacu

SEQ ID NO: 1841742 - RNA, 20 nt, Homo sapiens
uucacugugcaaauauaucu

SEQ ID NO: 1841743 - RNA, 16 nt, Homo sapiens
auccagugauccuuac

SEQ ID NO: 1841744 - RNA, 18 nt, Homo sapiens
guugauucaacaaaguau

SEQ ID NO: 1841745 - RNA, 17 nt, Homo sapiens
agcagucccaguauucu

SEQ ID NO: 1841746 - RNA, 15 nt, Homo sapiens
uugaauucuuuugcc

SEQ ID NO: 1841747 - RNA, 17 nt, Homo sapiens
cuaaaauuuuaggcacu

SEQ ID NO: 1841748 - RNA, 21 nt, Homo sapiens
uuacaagauguauuuguugua

SEQ ID NO: 1841749 - RNA, 23 nt, Homo sapiens
gcuggccaaggaggcuccugggg

SEQ ID NO: 1841750 - RNA, 12 nt, Homo sapiens
uaacuagauggu

SEQ ID NO: 1841751 - RNA, 19 nt, Homo sapiens
ugggaaggugccacuggua

SEQ ID NO: 1841752 - RNA, 22 nt, Homo sapiens
acuggccagggccacgcuccag

SEQ ID NO: 1841753 - RNA, 13 nt, Homo sapiens
cucuucucaaagc

SEQ ID NO: 1841754 - RNA, 22 nt, Homo sapiens
uuuaucacuucauucacauuca

SEQ ID NO: 1841755 - RNA, 13 nt, Homo sapiens
uaaucaacagaua

SEQ ID NO: 1841756 - RNA, 17 nt, Homo sapiens
gaccuuaggccuuccuc

SEQ ID NO: 1841757 - RNA, 20 nt, Homo sapiens
cagggauucuuccugcuuag

SEQ ID NO: 1841758 - RNA, 17 nt, Homo sapiens
aaaauaacaucauugua

SEQ ID NO: 1841759 - RNA, 18 nt, Homo sapiens
ggcauucuugaacugcug

SEQ ID NO: 1841760 - RNA, 13 nt, Homo sapiens
uaaauugaacuaa

SEQ ID NO: 1841761 - RNA, 20 nt, Homo sapiens
uacagauagauauaugcucu

SEQ ID NO: 1841762 - RNA, 19 nt, Homo sapiens
acccagaaaaaaagcccaa

SEQ ID NO: 1841763 - RNA, 20 nt, Homo sapiens
cguagaucgaagccaaagca

SEQ ID NO: 1841764 - RNA, 19 nt, Homo sapiens
cuacucaggaggcugaggc

SEQ ID NO: 1841765 - RNA, 16 nt, Homo sapiens
gugagaaacaucucaa

SEQ ID NO: 1841766 - RNA, 18 nt, Homo sapiens
aaagauggcuuaugucau

SEQ ID NO: 1841767 - RNA, 18 nt, Homo sapiens
acagcaacuuguguuccu

SEQ ID NO: 1841768 - RNA, 13 nt, Homo sapiens
uacaugcauuuga

SEQ ID NO: 1841769 - RNA, 17 nt, Homo sapiens
accccacauaugcaaug

SEQ ID NO: 1841770 - RNA, 15 nt, Homo sapiens
acuuuaaauacuauu

SEQ ID NO: 1841771 - RNA, 20 nt, Homo sapiens
uaaaacuuuuaaaacuucua

SEQ ID NO: 1841772 - RNA, 17 nt, Homo sapiens
gggcacuacauaauugc

SEQ ID NO: 1841773 - RNA, 16 nt, Homo sapiens
ucaauggaaagcugcu

SEQ ID NO: 1841774 - RNA, 14 nt, Homo sapiens
uuucagaauuuugc

SEQ ID NO: 1841775 - RNA, 15 nt, Homo sapiens
acugguuaccuggag

SEQ ID NO: 1841776 - RNA, 19 nt, Homo sapiens
cucucuuccagcugcuuca

SEQ ID NO: 1841777 - RNA, 16 nt, Homo sapiens
guugacuggccaaaaa

SEQ ID NO: 1841778 - RNA, 20 nt, Homo sapiens
aauuauguuauuugcucuaa

SEQ ID NO: 1841779 - RNA, 17 nt, Homo sapiens
acaaaaaggcauaugca

SEQ ID NO: 1841780 - RNA, 17 nt, Homo sapiens
gaauaaggaaaaauaca

SEQ ID NO: 1841781 - RNA, 16 nt, Homo sapiens
uccuuuucccuauuuc

SEQ ID NO: 1841782 - RNA, 16 nt, Homo sapiens
uacagcaucauugcau

SEQ ID NO: 1841783 - RNA, 20 nt, Homo sapiens
aggaucucacggaccauccg

SEQ ID NO: 1841784 - RNA, 13 nt, Homo sapiens
uaucaugugaaau

SEQ ID NO: 1841785 - RNA, 21 nt, Homo sapiens
cucaacugccuacuccaaaau

SEQ ID NO: 1841786 - RNA, 22 nt, Homo sapiens
ccagcucuucuccccaggugug

SEQ ID NO: 1841787 - RNA, 13 nt, Homo sapiens
caccuuggccucc

SEQ ID NO: 1841788 - RNA, 12 nt, Homo sapiens
gcuuuaucuacu

SEQ ID NO: 1841789 - RNA, 22 nt, Homo sapiens
acaaguauucugccuuugcaga

SEQ ID NO: 1841790 - RNA, 20 nt, Homo sapiens
ggcacaugauaugagucacu

SEQ ID NO: 1841791 - RNA, 12 nt, Homo sapiens
caaaauugcuaa

SEQ ID NO: 1841792 - RNA, 12 nt, Homo sapiens
agaccacucccu

SEQ ID NO: 1841793 - RNA, 16 nt, Homo sapiens
aacaucacucuugucu

SEQ ID NO: 1841794 - RNA, 15 nt, Homo sapiens
cacaauauuaccuua

SEQ ID NO: 1841795 - RNA, 16 nt, Homo sapiens
caaaauuugcugccaa

SEQ ID NO: 1841796 - RNA, 23 nt, Homo sapiens
ccaugacgacauacaugcuacuu

SEQ ID NO: 1841797 - RNA, 18 nt, Homo sapiens
uugggugugugguggauu

SEQ ID NO: 1841798 - RNA, 22 nt, Homo sapiens
ugacuauuauauuuccaagaaa

SEQ ID NO: 1841799 - RNA, 19 nt, Homo sapiens
uucugucagaaugcuauug

SEQ ID NO: 1841800 - RNA, 23 nt, Homo sapiens
cuuggaggagggcuguaggaaga

SEQ ID NO: 1841801 - RNA, 18 nt, Homo sapiens
agcuucucuucuuucuga

SEQ ID NO: 1841802 - RNA, 19 nt, Homo sapiens
cagaaggcaaaguuuccau

SEQ ID NO: 1841803 - RNA, 14 nt, Homo sapiens
cuugaaaaucugga

SEQ ID NO: 1841804 - RNA, 18 nt, Homo sapiens
gccagggagcuugccaca

SEQ ID NO: 1841805 - RNA, 16 nt, Homo sapiens
caaucgggaguagcaa

SEQ ID NO: 1841806 - RNA, 23 nt, Homo sapiens
gcuaucucucaagagugcugaga

SEQ ID NO: 1841807 - RNA, 17 nt, Homo sapiens
aaaaaucuaccuguucc

SEQ ID NO: 1841808 - RNA, 17 nt, Homo sapiens
cccugucuaaaaauuca

SEQ ID NO: 1841809 - RNA, 19 nt, Homo sapiens
ucauagauaauaguacaug

SEQ ID NO: 1841810 - RNA, 23 nt, Homo sapiens
ugcuaacugugcuccucacuucc

SEQ ID NO: 1841811 - RNA, 18 nt, Homo sapiens
uuucauuucuaacauaag

SEQ ID NO: 1841812 - RNA, 22 nt, Homo sapiens
caguccuagcucuuacacauag

SEQ ID NO: 1841813 - RNA, 21 nt, Homo sapiens
cucuucuguuugcacacccag

SEQ ID NO: 1841814 - RNA, 19 nt, Homo sapiens
gagacuggcagccagggag

SEQ ID NO: 1841815 - RNA, 17 nt, Homo sapiens
ugccuggcgagccucug

SEQ ID NO: 1841816 - RNA, 21 nt, Homo sapiens
uaauaugaugccacuuugcag

SEQ ID NO: 1841817 - RNA, 15 nt, Homo sapiens
uauuuggauaucaaa

SEQ ID NO: 1841818 - RNA, 16 nt, Homo sapiens
acaaaacuacaugaga

SEQ ID NO: 1841819 - RNA, 21 nt, Homo sapiens
cucccaucagaaagauucauu

SEQ ID NO: 1841820 - RNA, 15 nt, Homo sapiens
aaaucagcaugacaa

SEQ ID NO: 1841821 - RNA, 16 nt, Homo sapiens
ugcccuggcaccugug

SEQ ID NO: 1841822 - RNA, 18 nt, Homo sapiens
agcuuacacagguuucag

SEQ ID NO: 1841823 - RNA, 17 nt, Homo sapiens
uacuaaaaaucaugaga

SEQ ID NO: 1841824 - RNA, 18 nt, Homo sapiens
ccaaaggucauccuuaau

SEQ ID NO: 1841825 - RNA, 15 nt, Homo sapiens
uagcauuuuuauuca

SEQ ID NO: 1841826 - RNA, 18 nt, Homo sapiens
auaccagcuuaugagcuc

SEQ ID NO: 1841827 - RNA, 14 nt, Homo sapiens
auuaugugcaacau

SEQ ID NO: 1841828 - RNA, 22 nt, Homo sapiens
guacgauggaggccuaccucuc

SEQ ID NO: 1841829 - RNA, 18 nt, Homo sapiens
cauuuuuuugcaugcaug

SEQ ID NO: 1841830 - RNA, 18 nt, Homo sapiens
cuauaauucuauacuguu

SEQ ID NO: 1841831 - RNA, 16 nt, Homo sapiens
aaucauuccaggugug

SEQ ID NO: 1841832 - RNA, 22 nt, Homo sapiens
uacaugggugaauuauguuucc

SEQ ID NO: 1841833 - RNA, 16 nt, Homo sapiens
aucuauuacucugaca

SEQ ID NO: 1841834 - RNA, 15 nt, Homo sapiens
acguccuuccacuuc

SEQ ID NO: 1841835 - RNA, 17 nt, Homo sapiens
gcuuccggcuccugugc

SEQ ID NO: 1841836 - RNA, 17 nt, Homo sapiens
gcucccuguucuugggu

SEQ ID NO: 1841837 - RNA, 20 nt, Homo sapiens
ggcagucugagagaggccau

SEQ ID NO: 1841838 - RNA, 14 nt, Homo sapiens
auauauuuuuuaga

SEQ ID NO: 1841839 - RNA, 22 nt, Homo sapiens
ucacugcugcaaauacuguaua

SEQ ID NO: 1841840 - RNA, 15 nt, Homo sapiens
ugccgucaccaccac

SEQ ID NO: 1841841 - RNA, 18 nt, Homo sapiens
caaauaaagugcaguuua

SEQ ID NO: 1841842 - RNA, 17 nt, Homo sapiens
cauauaauggaagcaau

SEQ ID NO: 1841843 - RNA, 18 nt, Homo sapiens
aggaagcuuggcugcuca

SEQ ID NO: 1841844 - RNA, 22 nt, Homo sapiens
uuccagauucccagcuuccaga

SEQ ID NO: 1841845 - RNA, 13 nt, Homo sapiens
uauucagcccacu

SEQ ID NO: 1841846 - RNA, 22 nt, Homo sapiens
ggaaaucagagcuggcagccuc

SEQ ID NO: 1841847 - RNA, 23 nt, Homo sapiens
aucguucauugccuuuccagggu

SEQ ID NO: 1841848 - RNA, 20 nt, Homo sapiens
accuaauaaauauuuagucu

SEQ ID NO: 1841849 - RNA, 20 nt, Homo sapiens
aauuguuuagugauauuaca

SEQ ID NO: 1841850 - RNA, 14 nt, Homo sapiens
aguauuuaagccua

SEQ ID NO: 1841851 - RNA, 17 nt, Homo sapiens
uagcugucuccaaaaau

SEQ ID NO: 1841852 - RNA, 17 nt, Homo sapiens
cuaagaaaaaaagcaca

SEQ ID NO: 1841853 - RNA, 22 nt, Homo sapiens
agguggcuuuuagcauucugug

SEQ ID NO: 1841854 - RNA, 20 nt, Homo sapiens
auuucggagcgcaaugccau

SEQ ID NO: 1841855 - RNA, 17 nt, Homo sapiens
uugaggauuuugaucca

SEQ ID NO: 1841856 - RNA, 16 nt, Homo sapiens
guguguacaacacugg

SEQ ID NO: 1841857 - RNA, 21 nt, Homo sapiens
acuagauuuauaaaugcacug

SEQ ID NO: 1841858 - RNA, 17 nt, Homo sapiens
uagucuguuguucuuga

SEQ ID NO: 1841859 - RNA, 20 nt, Homo sapiens
aagcugaugacaacuuccca

SEQ ID NO: 1841860 - RNA, 18 nt, Homo sapiens
ccuuccugccaccaguca

SEQ ID NO: 1841861 - RNA, 21 nt, Homo sapiens
cagacaagucuugcugugcuu

SEQ ID NO: 1841862 - RNA, 23 nt, Homo sapiens
auggucucgauauccugaucucg

SEQ ID NO: 1841863 - RNA, 16 nt, Homo sapiens
aaauguucccuucaag

SEQ ID NO: 1841864 - RNA, 13 nt, Homo sapiens
auuaucuguccaa

SEQ ID NO: 1841865 - RNA, 16 nt, Homo sapiens
augauucaaauaucaa

SEQ ID NO: 1841866 - RNA, 16 nt, Homo sapiens
cuauggacaauuuacc

SEQ ID NO: 1841867 - RNA, 14 nt, Homo sapiens
guaacucuuggcca

SEQ ID NO: 1841868 - RNA, 21 nt, Homo sapiens
cgcagaaaacaagaugagauu

SEQ ID NO: 1841869 - RNA, 15 nt, Homo sapiens
augcuguuccaccuc

SEQ ID NO: 1841870 - RNA, 22 nt, Homo sapiens
cugcuugauuuuaauacauuga

SEQ ID NO: 1841871 - RNA, 16 nt, Homo sapiens
cuaucaauucuugaga

SEQ ID NO: 1841872 - RNA, 14 nt, Homo sapiens
gaaaggcugcugua

SEQ ID NO: 1841873 - RNA, 17 nt, Homo sapiens
uccauacacacgcugcc

SEQ ID NO: 1841874 - RNA, 16 nt, Homo sapiens
ggaggaacagauuuga

SEQ ID NO: 1841875 - RNA, 19 nt, Homo sapiens
acuagagcuugcagugaag

SEQ ID NO: 1841876 - RNA, 17 nt, Homo sapiens
gcuggacuucuaccugc

SEQ ID NO: 1841877 - RNA, 18 nt, Homo sapiens
ugauaaaugauagacaau

SEQ ID NO: 1841878 - RNA, 22 nt, Homo sapiens
uaggcuccugccaguguggaac

SEQ ID NO: 1841879 - RNA, 17 nt, Homo sapiens
aaauaaaacaucaccua

SEQ ID NO: 1841880 - RNA, 20 nt, Homo sapiens
cccaggauggagugcagugg

SEQ ID NO: 1841881 - RNA, 14 nt, Homo sapiens
cuccaguacuauuu

SEQ ID NO: 1841882 - RNA, 19 nt, Homo sapiens
aauacuucuuaaaaugugc

SEQ ID NO: 1841883 - RNA, 21 nt, Homo sapiens
gugugcaacagacaagugacu

SEQ ID NO: 1841884 - RNA, 22 nt, Homo sapiens
auugacuucuauuuuccuuaau

SEQ ID NO: 1841885 - RNA, 22 nt, Homo sapiens
gcacuccagccugggcaacaag

SEQ ID NO: 1841886 - RNA, 21 nt, Homo sapiens
ccuuucucuaucccaagccaa

SEQ ID NO: 1841887 - RNA, 15 nt, Homo sapiens
ugcagggccacugga

SEQ ID NO: 1841888 - RNA, 22 nt, Homo sapiens
cugaggucaucggcguggccca

SEQ ID NO: 1841889 - RNA, 18 nt, Homo sapiens
guccacucugaauaccaa

SEQ ID NO: 1841890 - RNA, 16 nt, Homo sapiens
gcuggcagugugcgga

SEQ ID NO: 1841891 - RNA, 11 nt, Homo sapiens
uuuaaccaaga

SEQ ID NO: 1841892 - RNA, 22 nt, Homo sapiens
acaugugugcgugugcgugcau

SEQ ID NO: 1841893 - RNA, 19 nt, Homo sapiens
cugucaagccggaugccua

SEQ ID NO: 1841894 - RNA, 19 nt, Homo sapiens
cacacucuuucuccugcuu

SEQ ID NO: 1841895 - RNA, 21 nt, Homo sapiens
ugcagaaguuacuaaguauua

SEQ ID NO: 1841896 - RNA, 19 nt, Homo sapiens
augggagcaugcuuaccuu

SEQ ID NO: 1841897 - RNA, 17 nt, Homo sapiens
aguguguguuucuugcu

SEQ ID NO: 1841898 - RNA, 23 nt, Homo sapiens
auaguuuucuccuuuuacuucac

SEQ ID NO: 1841899 - RNA, 18 nt, Homo sapiens
cuguccagccagcuccug

SEQ ID NO: 1841900 - RNA, 15 nt, Homo sapiens
agugugagaacuucc

SEQ ID NO: 1841901 - RNA, 21 nt, Homo sapiens
auccaguggggucucagucca

SEQ ID NO: 1841902 - RNA, 17 nt, Homo sapiens
ucuaguguucagaauuc

SEQ ID NO: 1841903 - RNA, 23 nt, Homo sapiens
auccuauuacauaguuugaaaaa

SEQ ID NO: 1841904 - RNA, 18 nt, Homo sapiens
caacccagccugagugca

SEQ ID NO: 1841905 - RNA, 16 nt, Homo sapiens
ugaaguaaaauugagu

SEQ ID NO: 1841906 - RNA, 22 nt, Homo sapiens
agccuccccagcucaccccugg

SEQ ID NO: 1841907 - RNA, 21 nt, Homo sapiens
uaaauagcuaaauggcaacaa

SEQ ID NO: 1841908 - RNA, 14 nt, Homo sapiens
uguacagcaaggua

SEQ ID NO: 1841909 - RNA, 15 nt, Homo sapiens
ccaggcuuccaagaa

SEQ ID NO: 1841910 - RNA, 17 nt, Homo sapiens
ucagauccccagcuuuc

SEQ ID NO: 1841911 - RNA, 19 nt, Homo sapiens
agaguauuagucacaauua

SEQ ID NO: 1841912 - RNA, 15 nt, Homo sapiens
caggcaaucuugccu

SEQ ID NO: 1841913 - RNA, 14 nt, Homo sapiens
cgugguaugugaau

SEQ ID NO: 1841914 - RNA, 15 nt, Homo sapiens
gacacccugaucuuc

SEQ ID NO: 1841915 - RNA, 13 nt, Homo sapiens
ugcacccaccuca

SEQ ID NO: 1841916 - RNA, 23 nt, Homo sapiens
cagugacaaacauauccuuucaa

SEQ ID NO: 1841917 - RNA, 16 nt, Homo sapiens
cugucauggugcaauu

SEQ ID NO: 1841918 - RNA, 11 nt, Homo sapiens
aaaaacaaagg

SEQ ID NO: 1841919 - RNA, 15 nt, Homo sapiens
ccagugccagcaccu

SEQ ID NO: 1841920 - RNA, 17 nt, Homo sapiens
uucuacaucauuaacca

SEQ ID NO: 1841921 - RNA, 18 nt, Homo sapiens
agacagagagacuggcca

SEQ ID NO: 1841922 - RNA, 20 nt, Homo sapiens
cacgccagcuccucucugaa

SEQ ID NO: 1841923 - RNA, 17 nt, Homo sapiens
aucauagcucacugcag

SEQ ID NO: 1841924 - RNA, 18 nt, Homo sapiens
uuugacccuugcugugaa

SEQ ID NO: 1841925 - RNA, 23 nt, Homo sapiens
cauuaaaacuugggcaccagcuu

SEQ ID NO: 1841926 - RNA, 19 nt, Homo sapiens
ugaucucggcucacugcaa

SEQ ID NO: 1841927 - RNA, 16 nt, Homo sapiens
acuuacuuaguguuau

SEQ ID NO: 1841928 - RNA, 21 nt, Homo sapiens
ggaaaaacaacaucauuccaa

SEQ ID NO: 1841929 - RNA, 20 nt, Homo sapiens
aagugagcaguguuagcuua

SEQ ID NO: 1841930 - RNA, 14 nt, Homo sapiens
uuaaagaaugcugc

SEQ ID NO: 1841931 - RNA, 21 nt, Homo sapiens
aacucacuccacuguacccag

SEQ ID NO: 1841932 - RNA, 22 nt, Homo sapiens
augugcauauaucuuucagauu

SEQ ID NO: 1841933 - RNA, 19 nt, Homo sapiens
gauaaaacacuaacuuaau

SEQ ID NO: 1841934 - RNA, 20 nt, Homo sapiens
aauuuucuguggaucauuuc

SEQ ID NO: 1841935 - RNA, 14 nt, Homo sapiens
aaacaagacuucag

SEQ ID NO: 1841936 - RNA, 14 nt, Homo sapiens
uccaguacuaugga

SEQ ID NO: 1841937 - RNA, 14 nt, Homo sapiens
acagccgugcacac

SEQ ID NO: 1841938 - RNA, 20 nt, Homo sapiens
aaacugaaugaacaaccucg

SEQ ID NO: 1841939 - RNA, 17 nt, Homo sapiens
guuccuggacaaacagc

SEQ ID NO: 1841940 - RNA, 18 nt, Homo sapiens
cuuagcuguaaaauggaa

SEQ ID NO: 1841941 - RNA, 19 nt, Homo sapiens
auauuaacgguggugaaaa

SEQ ID NO: 1841942 - RNA, 22 nt, Homo sapiens
auaaaaccagagcaggaaagau

SEQ ID NO: 1841943 - RNA, 20 nt, Homo sapiens
aaauguggaauugacugccu

SEQ ID NO: 1841944 - RNA, 18 nt, Homo sapiens
gacuuucucuuaacagcu

SEQ ID NO: 1841945 - RNA, 14 nt, Homo sapiens
uggguccaacacuu

SEQ ID NO: 1841946 - RNA, 15 nt, Homo sapiens
ugugugcgucacugu

SEQ ID NO: 1841947 - RNA, 13 nt, Homo sapiens
uccaucagauucu

SEQ ID NO: 1841948 - RNA, 19 nt, Homo sapiens
ccacccgugggaaugcugc

SEQ ID NO: 1841949 - RNA, 15 nt, Homo sapiens
ccagccugauuuaua

SEQ ID NO: 1841950 - RNA, 19 nt, Homo sapiens
cccugaaucugaccacaga

SEQ ID NO: 1841951 - RNA, 18 nt, Homo sapiens
aaugucucuuugugcucu

SEQ ID NO: 1841952 - RNA, 13 nt, Homo sapiens
guauaaacaaaag

SEQ ID NO: 1841953 - RNA, 19 nt, Homo sapiens
ucugucaggccuucagggu

SEQ ID NO: 1841954 - RNA, 16 nt, Homo sapiens
cugcagugaugcaaua

SEQ ID NO: 1841955 - RNA, 20 nt, Homo sapiens
gaguuuccagcuaagccuga

SEQ ID NO: 1841956 - RNA, 21 nt, Homo sapiens
gaaauguguguuguaacaaau

SEQ ID NO: 1841957 - RNA, 12 nt, Homo sapiens
ucuccuugcccu

SEQ ID NO: 1841958 - RNA, 12 nt, Homo sapiens
uccucuugccuc

SEQ ID NO: 1841959 - RNA, 17 nt, Homo sapiens
uaaaauauaagaucuga

SEQ ID NO: 1841960 - RNA, 19 nt, Homo sapiens
aauggacaaaauccaugaa

SEQ ID NO: 1841961 - RNA, 20 nt, Homo sapiens
gcugagcaaucugacccuau

SEQ ID NO: 1841962 - RNA, 14 nt, Homo sapiens
auuuaauaugucaa

SEQ ID NO: 1841963 - RNA, 16 nt, Homo sapiens
acuggauucauucuca

SEQ ID NO: 1841964 - RNA, 17 nt, Homo sapiens
agaguagcaacaaaagg

SEQ ID NO: 1841965 - RNA, 13 nt, Homo sapiens
aacucacuuuccc

SEQ ID NO: 1841966 - RNA, 16 nt, Homo sapiens
ccaggguggcugccag

SEQ ID NO: 1841967 - RNA, 21 nt, Homo sapiens
gauuccugggcaagaaccuaa

SEQ ID NO: 1841968 - RNA, 21 nt, Homo sapiens
cucaugcugcagaggguacuu

SEQ ID NO: 1841969 - RNA, 19 nt, Homo sapiens
aaagaaaauuaguaauugu

SEQ ID NO: 1841970 - RNA, 14 nt, Homo sapiens
agccuccugaguag

SEQ ID NO: 1841971 - RNA, 12 nt, Homo sapiens
uggugcccuucc

SEQ ID NO: 1841972 - RNA, 17 nt, Homo sapiens
cuuacauuauuaaucau

SEQ ID NO: 1841973 - RNA, 21 nt, Homo sapiens
caugcuggccugugugauaca

SEQ ID NO: 1841974 - RNA, 18 nt, Homo sapiens
cucuggagcccacuguac

SEQ ID NO: 1841975 - RNA, 15 nt, Homo sapiens
aucccugauuccugu

SEQ ID NO: 1841976 - RNA, 23 nt, Homo sapiens
acagccuauagaugaugaugugu

SEQ ID NO: 1841977 - RNA, 19 nt, Homo sapiens
uucaaaccacaauauccag

SEQ ID NO: 1841978 - RNA, 21 nt, Homo sapiens
gaccgagcccagcagaucuca

SEQ ID NO: 1841979 - RNA, 20 nt, Homo sapiens
auaaaaugcauuuaaacuca

SEQ ID NO: 1841980 - RNA, 16 nt, Homo sapiens
auuauauuguuaauca

SEQ ID NO: 1841981 - RNA, 15 nt, Homo sapiens
cuauuaccaguguuc

SEQ ID NO: 1841982 - RNA, 13 nt, Homo sapiens
agacagugggaaa

SEQ ID NO: 1841983 - RNA, 14 nt, Homo sapiens
cucuggcaccacac

SEQ ID NO: 1841984 - RNA, 22 nt, Homo sapiens
gaguaccaugggcuacaguguc

SEQ ID NO: 1841985 - RNA, 18 nt, Homo sapiens
acaagcuuguauauacau

SEQ ID NO: 1841986 - RNA, 15 nt, Homo sapiens
gaaaggaaguauaaa

SEQ ID NO: 1841987 - RNA, 15 nt, Homo sapiens
caaaucagcugcuac

SEQ ID NO: 1841988 - RNA, 18 nt, Homo sapiens
uggccaccgugucccuug

SEQ ID NO: 1841989 - RNA, 16 nt, Homo sapiens
gucccucccaucucua

SEQ ID NO: 1841990 - RNA, 18 nt, Homo sapiens
gccucugggaucugccaa

SEQ ID NO: 1841991 - RNA, 14 nt, Homo sapiens
cccacaaugccaga

SEQ ID NO: 1841992 - RNA, 23 nt, Homo sapiens
gggacugcagguugugcccugug

SEQ ID NO: 1841993 - RNA, 23 nt, Homo sapiens
gcaacuaggaaaaucacuugcca

SEQ ID NO: 1841994 - RNA, 21 nt, Homo sapiens
cugaguagucuguagcuugag

SEQ ID NO: 1841995 - RNA, 17 nt, Homo sapiens
uuggucugggacuuccu

SEQ ID NO: 1841996 - RNA, 18 nt, Homo sapiens
gcacucuguauauuugau

SEQ ID NO: 1841997 - RNA, 17 nt, Homo sapiens
auauggcuugaguuuaa

SEQ ID NO: 1841998 - RNA, 17 nt, Homo sapiens
uccuggugcucuaucca

SEQ ID NO: 1841999 - RNA, 19 nt, Homo sapiens
uguacagugaaaagucucc

SEQ ID NO: 1842000 - RNA, 16 nt, Homo sapiens
cuuguuuuaugcucag

SEQ ID NO: 1842001 - RNA, 16 nt, Homo sapiens
accccaguaagccacu

SEQ ID NO: 1842002 - RNA, 16 nt, Homo sapiens
ccaguguuguggauuu

SEQ ID NO: 1842003 - RNA, 17 nt, Homo sapiens
aaauuuuguaugccaau

SEQ ID NO: 1842004 - RNA, 22 nt, Homo sapiens
cacuccaccacccaaaagucaa

SEQ ID NO: 1842005 - RNA, 17 nt, Homo sapiens
ucaccaccaaaugccaa

SEQ ID NO: 1842006 - RNA, 23 nt, Homo sapiens
ugucuucuccuucaaaacauucu

SEQ ID NO: 1842007 - RNA, 24 nt, Homo sapiens
uuaaacauuugagagcuaacuaua

SEQ ID NO: 1842008 - RNA, 21 nt, Homo sapiens
ugaaauaaaaagaguauauuc

SEQ ID NO: 1842009 - RNA, 24 nt, Homo sapiens
auuaacagauguagcaacaugaga

SEQ ID NO: 1842010 - RNA, 19 nt, Homo sapiens
aucccaacaugguccuagc

SEQ ID NO: 1842011 - RNA, 19 nt, Homo sapiens
gacuccaaaaggcccuuuu

SEQ ID NO: 1842012 - RNA, 18 nt, Homo sapiens
aagaccaaaauuacuaau

SEQ ID NO: 1842013 - RNA, 21 nt, Homo sapiens
aaaccacuaugcaaagaacuc

SEQ ID NO: 1842014 - RNA, 18 nt, Homo sapiens
acccuuaaacaguugcac

SEQ ID NO: 1842015 - RNA, 21 nt, Homo sapiens
caucucagaaaacucugguaa

SEQ ID NO: 1842016 - RNA, 16 nt, Homo sapiens
uacauacauuguauag

SEQ ID NO: 1842017 - RNA, 21 nt, Homo sapiens
ucaacguuuuuggacacugug

SEQ ID NO: 1842018 - RNA, 17 nt, Homo sapiens
gacauauaucuauuaca

SEQ ID NO: 1842019 - RNA, 22 nt, Homo sapiens
auuacuaaauuacaaaugcaau

SEQ ID NO: 1842020 - RNA, 21 nt, Homo sapiens
cucacacugcuccaguuucac

SEQ ID NO: 1842021 - RNA, 18 nt, Homo sapiens
acaauguacaagguaugu

SEQ ID NO: 1842022 - RNA, 18 nt, Homo sapiens
cauaucacaugucagcca

SEQ ID NO: 1842023 - RNA, 20 nt, Homo sapiens
cggugacacaggucagggcu

SEQ ID NO: 1842024 - RNA, 15 nt, Homo sapiens
acaagacacagugac

SEQ ID NO: 1842025 - RNA, 22 nt, Homo sapiens
cuucugauuaaaguaaguagaa

SEQ ID NO: 1842026 - RNA, 23 nt, Homo sapiens
ggccuggaauuugggcagauaua

SEQ ID NO: 1842027 - RNA, 13 nt, Homo sapiens
agguucaguauua

SEQ ID NO: 1842028 - RNA, 18 nt, Homo sapiens
uaacugucaccugaaaua

SEQ ID NO: 1842029 - RNA, 19 nt, Homo sapiens
ccuguucaaaaacaagaca

SEQ ID NO: 1842030 - RNA, 13 nt, Homo sapiens
cauuggaggugaa

SEQ ID NO: 1842031 - RNA, 21 nt, Homo sapiens
auugacuauauacaucucuau

SEQ ID NO: 1842032 - RNA, 22 nt, Homo sapiens
aaaagauuguuuuauauguagu

SEQ ID NO: 1842033 - RNA, 14 nt, Homo sapiens
uuaaacccacagcc

SEQ ID NO: 1842034 - RNA, 18 nt, Homo sapiens
uugaggcugcagauuucc

SEQ ID NO: 1842035 - RNA, 18 nt, Homo sapiens
acagucagccaguggcuu

SEQ ID NO: 1842036 - RNA, 15 nt, Homo sapiens
cccuccgacuucucu

SEQ ID NO: 1842037 - RNA, 21 nt, Homo sapiens
ccugucugcuaggcgcugggg

SEQ ID NO: 1842038 - RNA, 14 nt, Homo sapiens
cagacgaaggcaac

SEQ ID NO: 1842039 - RNA, 18 nt, Homo sapiens
gaagucuuaaggacaaag

SEQ ID NO: 1842040 - RNA, 15 nt, Homo sapiens
uuggagucccagaau

SEQ ID NO: 1842041 - RNA, 21 nt, Homo sapiens
acaugcacuuggcugcauaaa

SEQ ID NO: 1842042 - RNA, 15 nt, Homo sapiens
gugucaccugugcuu

SEQ ID NO: 1842043 - RNA, 20 nt, Homo sapiens
ucccaauuugaauucaauuc

SEQ ID NO: 1842044 - RNA, 23 nt, Homo sapiens
guauaaauaaacacacuauggca

SEQ ID NO: 1842045 - RNA, 22 nt, Homo sapiens
agagguccuaaagaugcugacu

SEQ ID NO: 1842046 - RNA, 22 nt, Homo sapiens
agucacuugugucaaccacuaa

SEQ ID NO: 1842047 - RNA, 20 nt, Homo sapiens
cuggaaauagcccuguaaca

SEQ ID NO: 1842048 - RNA, 19 nt, Homo sapiens
gagcuaaggcagccuucag

SEQ ID NO: 1842049 - RNA, 22 nt, Homo sapiens
uuugaaccauccacuuacauau

SEQ ID NO: 1842050 - RNA, 12 nt, Homo sapiens
acuauuuuuacu

SEQ ID NO: 1842051 - RNA, 15 nt, Homo sapiens
ucuauaguagucaau

SEQ ID NO: 1842052 - RNA, 19 nt, Homo sapiens
uuccagugaacauucccag

SEQ ID NO: 1842053 - RNA, 11 nt, Homo sapiens
uaggcucucag

SEQ ID NO: 1842054 - RNA, 11 nt, Homo sapiens
cagcacuggac

SEQ ID NO: 1842055 - RNA, 18 nt, Homo sapiens
caggcuaugguugccacc

SEQ ID NO: 1842056 - RNA, 16 nt, Homo sapiens
acauauguugcaagac

SEQ ID NO: 1842057 - RNA, 14 nt, Homo sapiens
uuuuuauacauauc

SEQ ID NO: 1842058 - RNA, 23 nt, Homo sapiens
aggacaaaaggaggcucuucuca

SEQ ID NO: 1842059 - RNA, 19 nt, Homo sapiens
guggaugcaugugcgucac

SEQ ID NO: 1842060 - RNA, 15 nt, Homo sapiens
uaacuccguuuccaa

SEQ ID NO: 1842061 - RNA, 23 nt, Homo sapiens
ggauuagaaauaaagcaucucau

SEQ ID NO: 1842062 - RNA, 19 nt, Homo sapiens
guuuauacccguuucacau

SEQ ID NO: 1842063 - RNA, 23 nt, Homo sapiens
aaaggaaaauaaaugaacauaug

SEQ ID NO: 1842064 - RNA, 14 nt, Homo sapiens
ugcaucauguugaa

SEQ ID NO: 1842065 - RNA, 15 nt, Homo sapiens
cugguauguguggau

SEQ ID NO: 1842066 - RNA, 20 nt, Homo sapiens
acccuauacuguaguauucu

SEQ ID NO: 1842067 - RNA, 15 nt, Homo sapiens
ucacccaugugcaca

SEQ ID NO: 1842068 - RNA, 19 nt, Homo sapiens
uuucuuaaggaaauggugg

SEQ ID NO: 1842069 - RNA, 15 nt, Homo sapiens
ccaauggcuguaaac

SEQ ID NO: 1842070 - RNA, 19 nt, Homo sapiens
uguuugguaguuuugccaa

SEQ ID NO: 1842071 - RNA, 15 nt, Homo sapiens
ccaagggaaaggggu

SEQ ID NO: 1842072 - RNA, 14 nt, Homo sapiens
gccaugucaugugc

SEQ ID NO: 1842073 - RNA, 23 nt, Homo sapiens
accagacucguucuucugggaac

SEQ ID NO: 1842074 - RNA, 13 nt, Homo sapiens
ggaagcugagaug

SEQ ID NO: 1842075 - RNA, 13 nt, Homo sapiens
gggucauggggca

SEQ ID NO: 1842076 - RNA, 22 nt, Homo sapiens
guugugacaacuuccugaggga

SEQ ID NO: 1842077 - RNA, 14 nt, Homo sapiens
cggucaccuguugg

SEQ ID NO: 1842078 - RNA, 13 nt, Homo sapiens
auaguucuguuaa

SEQ ID NO: 1842079 - RNA, 14 nt, Homo sapiens
cugcccacucuggg

SEQ ID NO: 1842080 - RNA, 21 nt, Homo sapiens
ugaaaaaacuuucucuuugcc

SEQ ID NO: 1842081 - RNA, 22 nt, Homo sapiens
aggagcugauaaugaacuuuau

SEQ ID NO: 1842082 - RNA, 12 nt, Homo sapiens
ugcuugacaaag

SEQ ID NO: 1842083 - RNA, 20 nt, Homo sapiens
auacugugagcuuacauuga

SEQ ID NO: 1842084 - RNA, 13 nt, Homo sapiens
cgauucccugugu

SEQ ID NO: 1842085 - RNA, 17 nt, Homo sapiens
uuugccuuccaggaaau

SEQ ID NO: 1842086 - RNA, 20 nt, Homo sapiens
gagcccccugagagugucag

SEQ ID NO: 1842087 - RNA, 17 nt, Homo sapiens
cucuucugucugcagug

SEQ ID NO: 1842088 - RNA, 13 nt, Homo sapiens
auaaaacuaugug

SEQ ID NO: 1842089 - RNA, 13 nt, Homo sapiens
guaagacugugua

SEQ ID NO: 1842090 - RNA, 12 nt, Homo sapiens
agacacuggugg

SEQ ID NO: 1842091 - RNA, 15 nt, Homo sapiens
uguaaaucugccaca

SEQ ID NO: 1842092 - RNA, 22 nt, Homo sapiens
ugacggggaggaaccacugcac

SEQ ID NO: 1842093 - RNA, 17 nt, Homo sapiens
ccugcuagcugucucuc

SEQ ID NO: 1842094 - RNA, 15 nt, Homo sapiens
aaaugcguauuugca

SEQ ID NO: 1842095 - RNA, 18 nt, Homo sapiens
gcauggcguaucaggaaa

SEQ ID NO: 1842096 - RNA, 16 nt, Homo sapiens
uggcuugccacagcuc

SEQ ID NO: 1842097 - RNA, 21 nt, Homo sapiens
auagaucguagauguuguaga

SEQ ID NO: 1842098 - RNA, 22 nt, Homo sapiens
auuugucaguguauaagacaca

SEQ ID NO: 1842099 - RNA, 15 nt, Homo sapiens
cuuccacuccaagug

SEQ ID NO: 1842100 - RNA, 17 nt, Homo sapiens
auggcaaagaauucaaa

SEQ ID NO: 1842101 - RNA, 16 nt, Homo sapiens
cgcgugauuguggcau

SEQ ID NO: 1842102 - RNA, 12 nt, Homo sapiens
gaggguggcauc

SEQ ID NO: 1842103 - RNA, 18 nt, Homo sapiens
agaaauauuugugacaaa

SEQ ID NO: 1842104 - RNA, 19 nt, Homo sapiens
auguacauaggcagcacua

SEQ ID NO: 1842105 - RNA, 21 nt, Homo sapiens
cuuaaccagucucucaaguga

SEQ ID NO: 1842106 - RNA, 18 nt, Homo sapiens
aaucuuuaacugaacucu

SEQ ID NO: 1842107 - RNA, 21 nt, Homo sapiens
ucuccugucagagaucuggga

SEQ ID NO: 1842108 - RNA, 12 nt, Homo sapiens
ggggacugcugg

SEQ ID NO: 1842109 - RNA, 20 nt, Homo sapiens
cccuuaauuauuaacaaagu

SEQ ID NO: 1842110 - RNA, 12 nt, Homo sapiens
caggacacugcc

SEQ ID NO: 1842111 - RNA, 23 nt, Homo sapiens
aguauguuagugcaaauugucac

SEQ ID NO: 1842112 - RNA, 14 nt, Homo sapiens
caaagcuaccugug

SEQ ID NO: 1842113 - RNA, 14 nt, Homo sapiens
ccugagcacugacu

SEQ ID NO: 1842114 - RNA, 21 nt, Homo sapiens
accuggaggggcuagaaccua

SEQ ID NO: 1842115 - RNA, 17 nt, Homo sapiens
guucuuaguuugcaguu

SEQ ID NO: 1842116 - RNA, 15 nt, Homo sapiens
uaagaauguauauca

SEQ ID NO: 1842117 - RNA, 15 nt, Homo sapiens
agcugcucaaaucau

SEQ ID NO: 1842118 - RNA, 20 nt, Homo sapiens
gauacaggagaagaaacagc

SEQ ID NO: 1842119 - RNA, 22 nt, Homo sapiens
ccugggugacauuugggagaca

SEQ ID NO: 1842120 - RNA, 22 nt, Homo sapiens
uagcuuugaaacuccaugcaaa

SEQ ID NO: 1842121 - RNA, 14 nt, Homo sapiens
cuauguucaaagac

SEQ ID NO: 1842122 - RNA, 19 nt, Homo sapiens
gaugggauggguuccagag

SEQ ID NO: 1842123 - RNA, 17 nt, Homo sapiens
ggccuggacuuccagug

SEQ ID NO: 1842124 - RNA, 17 nt, Homo sapiens
auuuucaguaccaaaga

SEQ ID NO: 1842125 - RNA, 15 nt, Homo sapiens
gcacaggagcugcca

SEQ ID NO: 1842126 - RNA, 22 nt, Homo sapiens
gaauccaguccagauauuucac

SEQ ID NO: 1842127 - RNA, 14 nt, Homo sapiens
uggaugacuugaga

SEQ ID NO: 1842128 - RNA, 23 nt, Homo sapiens
gcaguuuccaauaaacgcaagcu

SEQ ID NO: 1842129 - RNA, 20 nt, Homo sapiens
ggcuccaggcuccucaugag

SEQ ID NO: 1842130 - RNA, 15 nt, Homo sapiens
aggcaagugggacca

SEQ ID NO: 1842131 - RNA, 12 nt, Homo sapiens
ucucugcauuga

SEQ ID NO: 1842132 - RNA, 17 nt, Homo sapiens
ugaaguuuugauuuauu

SEQ ID NO: 1842133 - RNA, 18 nt, Homo sapiens
cuuuccuguuccagagag

SEQ ID NO: 1842134 - RNA, 21 nt, Homo sapiens
gcucauuuacacucagcugcu

SEQ ID NO: 1842135 - RNA, 13 nt, Homo sapiens
aucagaugaacuc

SEQ ID NO: 1842136 - RNA, 20 nt, Homo sapiens
gacuauugcaauacauuucu

SEQ ID NO: 1842137 - RNA, 23 nt, Homo sapiens
ccuauguuuuuguucaaagccag

SEQ ID NO: 1842138 - RNA, 22 nt, Homo sapiens
uggcaaaaccaguagcuuccca

SEQ ID NO: 1842139 - RNA, 14 nt, Homo sapiens
guagcgccagugua

SEQ ID NO: 1842140 - RNA, 16 nt, Homo sapiens
ugcugauaccaccaga

SEQ ID NO: 1842141 - RNA, 16 nt, Homo sapiens
aaaguugcagauguau

SEQ ID NO: 1842142 - RNA, 18 nt, Homo sapiens
gaaaggcaagagcucaag

SEQ ID NO: 1842143 - RNA, 18 nt, Homo sapiens
ggcaaaaacuuccaucac

SEQ ID NO: 1842144 - RNA, 20 nt, Homo sapiens
uaagagucacaauuugcaaa

SEQ ID NO: 1842145 - RNA, 14 nt, Homo sapiens
gcuagaugugucuu

SEQ ID NO: 1842146 - RNA, 13 nt, Homo sapiens
gaacugggguuca

SEQ ID NO: 1842147 - RNA, 15 nt, Homo sapiens
auccccaaccugcac

SEQ ID NO: 1842148 - RNA, 18 nt, Homo sapiens
ugcucaguuggugcugcu

SEQ ID NO: 1842149 - RNA, 22 nt, Homo sapiens
acauauguauuaagccaaacau

SEQ ID NO: 1842150 - RNA, 16 nt, Homo sapiens
uuucacaaugugaaac

SEQ ID NO: 1842151 - RNA, 19 nt, Homo sapiens
cucccacagugcugggauu

SEQ ID NO: 1842152 - RNA, 19 nt, Homo sapiens
aauauuuuuaacaagucau

SEQ ID NO: 1842153 - RNA, 20 nt, Homo sapiens
uuguuuguccuuuauguauu

SEQ ID NO: 1842154 - RNA, 12 nt, Homo sapiens
ggcacugccuga

SEQ ID NO: 1842155 - RNA, 23 nt, Homo sapiens
cuaacccccacccccacugccag

SEQ ID NO: 1842156 - RNA, 14 nt, Homo sapiens
aaaaaugcucaauc

SEQ ID NO: 1842157 - RNA, 17 nt, Homo sapiens
accuuuauagcucucau

SEQ ID NO: 1842158 - RNA, 22 nt, Homo sapiens
cagcugcuuuguuaccuuaaaa

SEQ ID NO: 1842159 - RNA, 16 nt, Homo sapiens
cugagcagcauccacc

SEQ ID NO: 1842160 - RNA, 16 nt, Homo sapiens
ugugaccugugucacu

SEQ ID NO: 1842161 - RNA, 19 nt, Homo sapiens
auauuuucuauuacacaag

SEQ ID NO: 1842162 - RNA, 22 nt, Homo sapiens
uaaaaguaaugcaauaugugaa

SEQ ID NO: 1842163 - RNA, 18 nt, Homo sapiens
caggacaaggccuugcuc

SEQ ID NO: 1842164 - RNA, 23 nt, Homo sapiens
aacaccacuuugucucugagaac

SEQ ID NO: 1842165 - RNA, 20 nt, Homo sapiens
cuccaccgucuuucuuuuau

SEQ ID NO: 1842166 - RNA, 16 nt, Homo sapiens
acuuccacucgaugau

SEQ ID NO: 1842167 - RNA, 19 nt, Homo sapiens
aauauuccuuuauuuugcu

SEQ ID NO: 1842168 - RNA, 14 nt, Homo sapiens
uccucacaccacaa

SEQ ID NO: 1842169 - RNA, 21 nt, Homo sapiens
uauucugccaaaccuguguag

SEQ ID NO: 1842170 - RNA, 20 nt, Homo sapiens
ugccuuuuuuaacacuagaa

SEQ ID NO: 1842171 - RNA, 21 nt, Homo sapiens
ugcccaagagaucugugccau

SEQ ID NO: 1842172 - RNA, 22 nt, Homo sapiens
caguuuguuuggaagacuucua

SEQ ID NO: 1842173 - RNA, 22 nt, Homo sapiens
aucaugaguuuguuuacacuug

SEQ ID NO: 1842174 - RNA, 19 nt, Homo sapiens
aguucaguccacaggcaug

SEQ ID NO: 1842175 - RNA, 19 nt, Homo sapiens
ugaggcaaauuaacuguau

SEQ ID NO: 1842176 - RNA, 18 nt, Homo sapiens
aauccuagcuacuuggca

SEQ ID NO: 1842177 - RNA, 18 nt, Homo sapiens
gaaauucccgccuaauaa

SEQ ID NO: 1842178 - RNA, 18 nt, Homo sapiens
uucuauggauucacuucu

SEQ ID NO: 1842179 - RNA, 20 nt, Homo sapiens
acacacggaugcacacacag

SEQ ID NO: 1842180 - RNA, 20 nt, Homo sapiens
acccaccagaaauuccagua

SEQ ID NO: 1842181 - RNA, 19 nt, Homo sapiens
uguuaggaacagcaguguu

SEQ ID NO: 1842182 - RNA, 23 nt, Homo sapiens
aaauaaguaauaucuuucaguua

SEQ ID NO: 1842183 - RNA, 21 nt, Homo sapiens
acccugucuaaugaaaccugu

SEQ ID NO: 1842184 - RNA, 16 nt, Homo sapiens
uccaggacugugccag

SEQ ID NO: 1842185 - RNA, 21 nt, Homo sapiens
guggauguauggggaaucuaa

SEQ ID NO: 1842186 - RNA, 14 nt, Homo sapiens
cacucaguucugcu

SEQ ID NO: 1842187 - RNA, 17 nt, Homo sapiens
caaguauucuaccuaaa

SEQ ID NO: 1842188 - RNA, 16 nt, Homo sapiens
auaugucagggcacau

SEQ ID NO: 1842189 - RNA, 18 nt, Homo sapiens
ucacauuaauauuugcug

SEQ ID NO: 1842190 - RNA, 23 nt, Homo sapiens
uguaacacagcugagagacuuuu

SEQ ID NO: 1842191 - RNA, 17 nt, Homo sapiens
ugcuacaaaaacacagc

SEQ ID NO: 1842192 - RNA, 15 nt, Homo sapiens
cuugaaauuucucag

SEQ ID NO: 1842193 - RNA, 17 nt, Homo sapiens
agccaggcacacacugu

SEQ ID NO: 1842194 - RNA, 22 nt, Homo sapiens
acucaaggacagccaccaagaa

SEQ ID NO: 1842195 - RNA, 22 nt, Homo sapiens
uuuauaucaaaugccuucauga

SEQ ID NO: 1842196 - RNA, 12 nt, Homo sapiens
aaggaauccucu

SEQ ID NO: 1842197 - RNA, 16 nt, Homo sapiens
ugccugaaccuuccau

SEQ ID NO: 1842198 - RNA, 15 nt, Homo sapiens
aaauugcuuauucua

SEQ ID NO: 1842199 - RNA, 18 nt, Homo sapiens
gucguauccaccuugcac

SEQ ID NO: 1842200 - RNA, 20 nt, Homo sapiens
uggacaaaccgagugcaaug

SEQ ID NO: 1842201 - RNA, 18 nt, Homo sapiens
aagacuugccacuuuuca

SEQ ID NO: 1842202 - RNA, 16 nt, Homo sapiens
uccaccaccuugccaa

SEQ ID NO: 1842203 - RNA, 20 nt, Homo sapiens
aguuuguaaaugacuuucau

SEQ ID NO: 1842204 - RNA, 19 nt, Homo sapiens
ggcaguccuggaaucacau

SEQ ID NO: 1842205 - RNA, 22 nt, Homo sapiens
cucugccuuaaacacacauugc

SEQ ID NO: 1842206 - RNA, 12 nt, Homo sapiens
aauccuuacaaa

SEQ ID NO: 1842207 - RNA, 18 nt, Homo sapiens
uagauggguuauuucaac

SEQ ID NO: 1842208 - RNA, 19 nt, Homo sapiens
gccacuuagaauagcauuu

SEQ ID NO: 1842209 - RNA, 10 nt, Homo sapiens
gcaucugacc

SEQ ID NO: 1842210 - RNA, 14 nt, Homo sapiens
auuaaucaccucuc

SEQ ID NO: 1842211 - RNA, 17 nt, Homo sapiens
gaaaaaaagaaguaugu

SEQ ID NO: 1842212 - RNA, 23 nt, Homo sapiens
caguaugguucucggaguccaaa

SEQ ID NO: 1842213 - RNA, 15 nt, Homo sapiens
ucccccuucucccac

SEQ ID NO: 1842214 - RNA, 12 nt, Homo sapiens
agugcagggcug

SEQ ID NO: 1842215 - RNA, 15 nt, Homo sapiens
gggcuggaagcagaa

SEQ ID NO: 1842216 - RNA, 13 nt, Homo sapiens
agacuucccugaa

SEQ ID NO: 1842217 - RNA, 22 nt, Homo sapiens
uaaguggugcuuagaaaauuca

SEQ ID NO: 1842218 - RNA, 20 nt, Homo sapiens
ccauucucugccuguacuga

SEQ ID NO: 1842219 - RNA, 17 nt, Homo sapiens
auucacauauaucaaag

SEQ ID NO: 1842220 - RNA, 14 nt, Homo sapiens
aaaagggccaaaga

SEQ ID NO: 1842221 - RNA, 17 nt, Homo sapiens
ccuuccuggcacucuca

SEQ ID NO: 1842222 - RNA, 20 nt, Homo sapiens
aguaagagguuaugccaaaa

SEQ ID NO: 1842223 - RNA, 19 nt, Homo sapiens
aacccaucuuccuggaccu

SEQ ID NO: 1842224 - RNA, 20 nt, Homo sapiens
ugagcgucacggccaagugu

SEQ ID NO: 1842225 - RNA, 18 nt, Homo sapiens
uucugugggcugcugcag

SEQ ID NO: 1842226 - RNA, 14 nt, Homo sapiens
aagugacauugugu

SEQ ID NO: 1842227 - RNA, 16 nt, Homo sapiens
gcaacagacuguugag

SEQ ID NO: 1842228 - RNA, 17 nt, Homo sapiens
acaaacucuacuaucca

SEQ ID NO: 1842229 - RNA, 18 nt, Homo sapiens
cuucacccacgcauauac

SEQ ID NO: 1842230 - RNA, 21 nt, Homo sapiens
agcaagggggaaggcugcaaa

SEQ ID NO: 1842231 - RNA, 17 nt, Homo sapiens
cuagaaaucuguugcua

SEQ ID NO: 1842232 - RNA, 16 nt, Homo sapiens
guauuugggaaacuug

SEQ ID NO: 1842233 - RNA, 12 nt, Homo sapiens
aguggagccaug

SEQ ID NO: 1842234 - RNA, 13 nt, Homo sapiens
acacccaguggga

SEQ ID NO: 1842235 - RNA, 20 nt, Homo sapiens
auuauaaacaaucaggaaga

SEQ ID NO: 1842236 - RNA, 13 nt, Homo sapiens
cucucucuguggg

SEQ ID NO: 1842237 - RNA, 14 nt, Homo sapiens
ucacugcauccuca

SEQ ID NO: 1842238 - RNA, 16 nt, Homo sapiens
auaucucuccagcugu

SEQ ID NO: 1842239 - RNA, 12 nt, Homo sapiens
ucugcaccgacg

SEQ ID NO: 1842240 - RNA, 23 nt, Homo sapiens
gagagcccgaggaggugucucag

SEQ ID NO: 1842241 - RNA, 24 nt, Homo sapiens
gccaccgggacagaccuggacacu

SEQ ID NO: 1842242 - RNA, 14 nt, Homo sapiens
augccccaccugcc

SEQ ID NO: 1842243 - RNA, 14 nt, Homo sapiens
guuuauugaauuca

SEQ ID NO: 1842244 - RNA, 23 nt, Homo sapiens
uggaauuugcuuuaucuacuuua

SEQ ID NO: 1842245 - RNA, 13 nt, Homo sapiens
ugggaccuaggga

SEQ ID NO: 1842246 - RNA, 17 nt, Homo sapiens
auucuguuuauagaaua

SEQ ID NO: 1842247 - RNA, 16 nt, Homo sapiens
aaggaaaauugcacua

SEQ ID NO: 1842248 - RNA, 11 nt, Homo sapiens
auguugcccaa

SEQ ID NO: 1842249 - RNA, 11 nt, Homo sapiens
auauugcccag

SEQ ID NO: 1842250 - RNA, 15 nt, Homo sapiens
caucagacagaugga

SEQ ID NO: 1842251 - RNA, 15 nt, Homo sapiens
cccucaccucugaua

SEQ ID NO: 1842252 - RNA, 19 nt, Homo sapiens
cacauuuggaccacagcau

SEQ ID NO: 1842253 - RNA, 18 nt, Homo sapiens
uccagagucccugccugg

SEQ ID NO: 1842254 - RNA, 15 nt, Homo sapiens
acuugcagcauucau

SEQ ID NO: 1842255 - RNA, 19 nt, Homo sapiens
acagcaggaugugccugug

SEQ ID NO: 1842256 - RNA, 18 nt, Homo sapiens
agcugcaggugcccauua

SEQ ID NO: 1842257 - RNA, 19 nt, Homo sapiens
cuuugcauguaagcucuuu

SEQ ID NO: 1842258 - RNA, 23 nt, Homo sapiens
gcaaucucucucugugucuuucu

SEQ ID NO: 1842259 - RNA, 16 nt, Homo sapiens
uuucccguuagucucu

SEQ ID NO: 1842260 - RNA, 16 nt, Homo sapiens
ugauccucaaacacac

SEQ ID NO: 1842261 - RNA, 20 nt, Homo sapiens
agauucagaaaugaggccau

SEQ ID NO: 1842262 - RNA, 11 nt, Homo sapiens
cuaccaggugg

SEQ ID NO: 1842263 - RNA, 18 nt, Homo sapiens
caggcccuggugcgaaug

SEQ ID NO: 1842264 - RNA, 12 nt, Homo sapiens
cuaguucuuaag

SEQ ID NO: 1842265 - RNA, 12 nt, Homo sapiens
aggacacagugg

SEQ ID NO: 1842266 - RNA, 22 nt, Homo sapiens
ccaucuccaagauaagccugag

SEQ ID NO: 1842267 - RNA, 20 nt, Homo sapiens
agaaacuuacuaaauaucau

SEQ ID NO: 1842268 - RNA, 19 nt, Homo sapiens
aucucaagugccauauucu

SEQ ID NO: 1842269 - RNA, 18 nt, Homo sapiens
ccuaagcuggagugcagu

SEQ ID NO: 1842270 - RNA, 19 nt, Homo sapiens
aggagaggggaagggccag

SEQ ID NO: 1842271 - RNA, 21 nt, Homo sapiens
ucccucccgggggcacugccu

SEQ ID NO: 1842272 - RNA, 13 nt, Homo sapiens
gaacaggcugugu

SEQ ID NO: 1842273 - RNA, 16 nt, Homo sapiens
gaaaaugaauggacaa

SEQ ID NO: 1842274 - RNA, 12 nt, Homo sapiens
auauucucccca

SEQ ID NO: 1842275 - RNA, 13 nt, Homo sapiens
gaaugaaguguua

SEQ ID NO: 1842276 - RNA, 12 nt, Homo sapiens
uagagugcauau

SEQ ID NO: 1842277 - RNA, 21 nt, Homo sapiens
caugcuaagaauaaacaacua

SEQ ID NO: 1842278 - RNA, 21 nt, Homo sapiens
aggagggagggacacuuaccc

SEQ ID NO: 1842279 - RNA, 14 nt, Homo sapiens
aucucuaucuggcc

SEQ ID NO: 1842280 - RNA, 21 nt, Homo sapiens
aaauuaauauaucauuaucuu

SEQ ID NO: 1842281 - RNA, 15 nt, Homo sapiens
caaaacuugggaaua

SEQ ID NO: 1842282 - RNA, 20 nt, Homo sapiens
ccaguugcagaccaucgcac

SEQ ID NO: 1842283 - RNA, 20 nt, Homo sapiens
caaggucuacucccuccuca

SEQ ID NO: 1842284 - RNA, 21 nt, Homo sapiens
accuucaagcgcuccagggcc

SEQ ID NO: 1842285 - RNA, 15 nt, Homo sapiens
gccauuuuucugggg

SEQ ID NO: 1842286 - RNA, 21 nt, Homo sapiens
aggaauuuugucaacuaccca

SEQ ID NO: 1842287 - RNA, 17 nt, Homo sapiens
uaguaguuauuuguaua

SEQ ID NO: 1842288 - RNA, 17 nt, Homo sapiens
auaggcuaaccacuuua

SEQ ID NO: 1842289 - RNA, 19 nt, Homo sapiens
uacuuuuaaaaacauaaca

SEQ ID NO: 1842290 - RNA, 18 nt, Homo sapiens
uugagaccaaaucuugcu

SEQ ID NO: 1842291 - RNA, 12 nt, Homo sapiens
cuguuagcacau

SEQ ID NO: 1842292 - RNA, 15 nt, Homo sapiens
auuccuaaugcauua

SEQ ID NO: 1842293 - RNA, 15 nt, Homo sapiens
uguacuuaauccuuu

SEQ ID NO: 1842294 - RNA, 15 nt, Homo sapiens
ugugcugaccaaaga

SEQ ID NO: 1842295 - RNA, 18 nt, Homo sapiens
acaucuugcucugcugac

SEQ ID NO: 1842296 - RNA, 15 nt, Homo sapiens
ccacgcucaaucuca

SEQ ID NO: 1842297 - RNA, 16 nt, Homo sapiens
ucacucaagcacugau

SEQ ID NO: 1842298 - RNA, 14 nt, Homo sapiens
uggaagcugucaua

SEQ ID NO: 1842299 - RNA, 22 nt, Homo sapiens
ggauaaauauauaaaaaagcca

SEQ ID NO: 1842300 - RNA, 20 nt, Homo sapiens
gggucaaagugguacaggaa

SEQ ID NO: 1842301 - RNA, 20 nt, Homo sapiens
gcugaggccugggagucucu

SEQ ID NO: 1842302 - RNA, 13 nt, Homo sapiens
uuccucacuccaa

SEQ ID NO: 1842303 - RNA, 18 nt, Homo sapiens
cuccccaaacccaucaga

SEQ ID NO: 1842304 - RNA, 16 nt, Homo sapiens
agugaguguaggggug

SEQ ID NO: 1842305 - RNA, 24 nt, Homo sapiens
ccucucucccugccucacaucucc

SEQ ID NO: 1842306 - RNA, 20 nt, Homo sapiens
cugcuucuggggacaccuca

SEQ ID NO: 1842307 - RNA, 18 nt, Homo sapiens
aaguaagugaacuaccau

SEQ ID NO: 1842308 - RNA, 21 nt, Homo sapiens
ucaaaucacauggcuuuccac

SEQ ID NO: 1842309 - RNA, 12 nt, Homo sapiens
gaggagccuuuu

SEQ ID NO: 1842310 - RNA, 13 nt, Homo sapiens
cuucuuugcugca

SEQ ID NO: 1842311 - RNA, 11 nt, Homo sapiens
ggaucagagau

SEQ ID NO: 1842312 - RNA, 23 nt, Homo sapiens
gugagaccaccucucaauauuca

SEQ ID NO: 1842313 - RNA, 15 nt, Homo sapiens
agacuuaauucugau

SEQ ID NO: 1842314 - RNA, 15 nt, Homo sapiens
agcggaagaccugaa

SEQ ID NO: 1842315 - RNA, 16 nt, Homo sapiens
acuuauggacuccugu

SEQ ID NO: 1842316 - RNA, 14 nt, Homo sapiens
ugugggacugagug

SEQ ID NO: 1842317 - RNA, 16 nt, Homo sapiens
gacccaguggcagggc

SEQ ID NO: 1842318 - RNA, 20 nt, Homo sapiens
acccacuaugcacagauuaa

SEQ ID NO: 1842319 - RNA, 18 nt, Homo sapiens
uaaaacucaucacauaaa

SEQ ID NO: 1842320 - RNA, 22 nt, Homo sapiens
uaaacacauguucugugccugc

SEQ ID NO: 1842321 - RNA, 22 nt, Homo sapiens
cauuguaauaugacuccugugu

SEQ ID NO: 1842322 - RNA, 22 nt, Homo sapiens
auauucauuggcagcucaaaga

SEQ ID NO: 1842323 - RNA, 22 nt, Homo sapiens
ugcuuuaaauggaaacagacuc

SEQ ID NO: 1842324 - RNA, 19 nt, Homo sapiens
gcaguggccccuuaggcca

SEQ ID NO: 1842325 - RNA, 22 nt, Homo sapiens
ucaauugcaugaguauuugcua

SEQ ID NO: 1842326 - RNA, 15 nt, Homo sapiens
uguacaaagaccaca

SEQ ID NO: 1842327 - RNA, 13 nt, Homo sapiens
cuuccagcaaaau

SEQ ID NO: 1842328 - RNA, 13 nt, Homo sapiens
agccacauuucag

SEQ ID NO: 1842329 - RNA, 19 nt, Homo sapiens
cucugucuuaaaugagaag

SEQ ID NO: 1842330 - RNA, 20 nt, Homo sapiens
cauauggucauccaaaugga

SEQ ID NO: 1842331 - RNA, 15 nt, Homo sapiens
ggacaacauccuuaa

SEQ ID NO: 1842332 - RNA, 17 nt, Homo sapiens
cuuuuccugcucccuaa

SEQ ID NO: 1842333 - RNA, 17 nt, Homo sapiens
aaccuggauccagcacu

SEQ ID NO: 1842334 - RNA, 13 nt, Homo sapiens
uccauacuccacu

SEQ ID NO: 1842335 - RNA, 16 nt, Homo sapiens
aaauaaaaaaagacaa

SEQ ID NO: 1842336 - RNA, 16 nt, Homo sapiens
cugugaaccugggcac

SEQ ID NO: 1842337 - RNA, 15 nt, Homo sapiens
aaagcauuugcugug

SEQ ID NO: 1842338 - RNA, 11 nt, Homo sapiens
ucaagagccag

SEQ ID NO: 1842339 - RNA, 21 nt, Homo sapiens
cagagaaggaaaagacugaau

SEQ ID NO: 1842340 - RNA, 15 nt, Homo sapiens
uaugcagcucaucac

SEQ ID NO: 1842341 - RNA, 18 nt, Homo sapiens
uugcuaugagguuugcuu

SEQ ID NO: 1842342 - RNA, 12 nt, Homo sapiens
caaaucaaggau

SEQ ID NO: 1842343 - RNA, 17 nt, Homo sapiens
gacuauauacaugugug

SEQ ID NO: 1842344 - RNA, 23 nt, Homo sapiens
aucuuucauuucguauuucucau

SEQ ID NO: 1842345 - RNA, 14 nt, Homo sapiens
acuugagcuuuaaa

SEQ ID NO: 1842346 - RNA, 16 nt, Homo sapiens
gagcgucacggccaag

SEQ ID NO: 1842347 - RNA, 13 nt, Homo sapiens
aggugucucucac

SEQ ID NO: 1842348 - RNA, 16 nt, Homo sapiens
gaaaugcugcaggauu

SEQ ID NO: 1842349 - RNA, 11 nt, Homo sapiens
gccacuggccc

SEQ ID NO: 1842350 - RNA, 21 nt, Homo sapiens
cuuggacccuggugaccuccu

SEQ ID NO: 1842351 - RNA, 12 nt, Homo sapiens
gaagugccaguu

SEQ ID NO: 1842352 - RNA, 18 nt, Homo sapiens
aggcccugccauuggccu

SEQ ID NO: 1842353 - RNA, 23 nt, Homo sapiens
cuugaaggauggaugagucagac

SEQ ID NO: 1842354 - RNA, 21 nt, Homo sapiens
ggcacaauuuuaauucaaaag

SEQ ID NO: 1842355 - RNA, 12 nt, Homo sapiens
aggucucaucuc

SEQ ID NO: 1842356 - RNA, 16 nt, Homo sapiens
gcacagaguggcuugg

SEQ ID NO: 1842357 - RNA, 13 nt, Homo sapiens
auuaaaggcagca

SEQ ID NO: 1842358 - RNA, 16 nt, Homo sapiens
cuuuucccuaagccaa

SEQ ID NO: 1842359 - RNA, 18 nt, Homo sapiens
ugggauagagaauguucc

SEQ ID NO: 1842360 - RNA, 13 nt, Homo sapiens
gggggcaagagcu

SEQ ID NO: 1842361 - RNA, 22 nt, Homo sapiens
acauucacagcccagaaccaca

SEQ ID NO: 1842362 - RNA, 16 nt, Homo sapiens
aguaucuuuccagcau

SEQ ID NO: 1842363 - RNA, 13 nt, Homo sapiens
uugcugaauucuc

SEQ ID NO: 1842364 - RNA, 20 nt, Homo sapiens
accuggugggcucaaccaca

SEQ ID NO: 1842365 - RNA, 15 nt, Homo sapiens
uuggguuccagacag

SEQ ID NO: 1842366 - RNA, 16 nt, Homo sapiens
gauugaaagaaccaga

SEQ ID NO: 1842367 - RNA, 20 nt, Homo sapiens
uucccccagaacauggaaau

SEQ ID NO: 1842368 - RNA, 21 nt, Homo sapiens
uuguugucuacauuaaaucac

SEQ ID NO: 1842369 - RNA, 15 nt, Homo sapiens
acagaggacauacca

SEQ ID NO: 1842370 - RNA, 22 nt, Homo sapiens
ucaagguguuuugaaaugcaga

SEQ ID NO: 1842371 - RNA, 21 nt, Homo sapiens
agaugggggccucucuggaag

SEQ ID NO: 1842372 - RNA, 21 nt, Homo sapiens
cacugcaaauaaacuugguag

SEQ ID NO: 1842373 - RNA, 17 nt, Homo sapiens
auuuccuuuucuucccu

SEQ ID NO: 1842374 - RNA, 13 nt, Homo sapiens
aaugcaauugucu

SEQ ID NO: 1842375 - RNA, 15 nt, Homo sapiens
augaagccauaugaa

SEQ ID NO: 1842376 - RNA, 15 nt, Homo sapiens
cuguuuccauccagu

SEQ ID NO: 1842377 - RNA, 15 nt, Homo sapiens
caaaaucaacaugac

SEQ ID NO: 1842378 - RNA, 19 nt, Homo sapiens
aagucccugagaagccuca

SEQ ID NO: 1842379 - RNA, 19 nt, Homo sapiens
cugcaagaaguacaugaag

SEQ ID NO: 1842380 - RNA, 19 nt, Homo sapiens
ggccugugcgugccaucca

SEQ ID NO: 1842381 - RNA, 21 nt, Homo sapiens
uggugaaaccccaucucuacu

SEQ ID NO: 1842382 - RNA, 23 nt, Homo sapiens
ggugaacagcaggaugcccuguu

SEQ ID NO: 1842383 - RNA, 16 nt, Homo sapiens
acacuggaacauucca

SEQ ID NO: 1842384 - RNA, 19 nt, Homo sapiens
uacuccaggcuuccacacu

SEQ ID NO: 1842385 - RNA, 12 nt, Homo sapiens
ccuccugugguc

SEQ ID NO: 1842386 - RNA, 15 nt, Homo sapiens
cgcccaggcuggaau

SEQ ID NO: 1842387 - RNA, 22 nt, Homo sapiens
uacaagaagagaaagaccagug

SEQ ID NO: 1842388 - RNA, 18 nt, Homo sapiens
uacuauuuuucuuuccaa

SEQ ID NO: 1842389 - RNA, 21 nt, Homo sapiens
ugauuaaugauuuagcucccu

SEQ ID NO: 1842390 - RNA, 14 nt, Homo sapiens
agacuuaggccaga

SEQ ID NO: 1842391 - RNA, 19 nt, Homo sapiens
auugcagcuugaagccaau

SEQ ID NO: 1842392 - RNA, 15 nt, Homo sapiens
gucacaggcugugcc

SEQ ID NO: 1842393 - RNA, 13 nt, Homo sapiens
caagcucccaagg

SEQ ID NO: 1842394 - RNA, 14 nt, Homo sapiens
uaaaauucucauua

SEQ ID NO: 1842395 - RNA, 21 nt, Homo sapiens
cagguguucuucauuaccuca

SEQ ID NO: 1842396 - RNA, 17 nt, Homo sapiens
gcuuuccuuaguuuucu

SEQ ID NO: 1842397 - RNA, 14 nt, Homo sapiens
ugguucugugccaa

SEQ ID NO: 1842398 - RNA, 22 nt, Homo sapiens
uaauuacauccagaaagaagga

SEQ ID NO: 1842399 - RNA, 15 nt, Homo sapiens
cucuccaugauccca

SEQ ID NO: 1842400 - RNA, 20 nt, Homo sapiens
ggauuuaauuuccaggguug

SEQ ID NO: 1842401 - RNA, 23 nt, Homo sapiens
gcugaagugguugcauucuacua

SEQ ID NO: 1842402 - RNA, 17 nt, Homo sapiens
ucaaacauuauucucaa

SEQ ID NO: 1842403 - RNA, 20 nt, Homo sapiens
caggaggugugaaugcacgu

SEQ ID NO: 1842404 - RNA, 17 nt, Homo sapiens
uccugugaccacaacau

SEQ ID NO: 1842405 - RNA, 23 nt, Homo sapiens
caugcaggcccuuugaagccuca

SEQ ID NO: 1842406 - RNA, 17 nt, Homo sapiens
uuauguuaacucuauaa

SEQ ID NO: 1842407 - RNA, 21 nt, Homo sapiens
cuaggucaaaacauucaggua

SEQ ID NO: 1842408 - RNA, 22 nt, Homo sapiens
ucuggcaucacgucagugcuca

SEQ ID NO: 1842409 - RNA, 11 nt, Homo sapiens
uucaccaaaga

SEQ ID NO: 1842410 - RNA, 21 nt, Homo sapiens
ugagggaggaagaaggcagug

SEQ ID NO: 1842411 - RNA, 12 nt, Homo sapiens
uguggacugugc

SEQ ID NO: 1842412 - RNA, 21 nt, Homo sapiens
auaucauuuuaaaaacuuuau

SEQ ID NO: 1842413 - RNA, 20 nt, Homo sapiens
cuccccagacuccaccguca

SEQ ID NO: 1842414 - RNA, 17 nt, Homo sapiens
gucaccauacacacugu

SEQ ID NO: 1842415 - RNA, 13 nt, Homo sapiens
caucuugcagcau

SEQ ID NO: 1842416 - RNA, 14 nt, Homo sapiens
caguguaugcucau

SEQ ID NO: 1842417 - RNA, 16 nt, Homo sapiens
ucuuuuaagcuaucca

SEQ ID NO: 1842418 - RNA, 16 nt, Homo sapiens
cauaagcauuacuuua

SEQ ID NO: 1842419 - RNA, 13 nt, Homo sapiens
uaaguaucagagg

SEQ ID NO: 1842420 - RNA, 16 nt, Homo sapiens
acauuucacugaugcu

SEQ ID NO: 1842421 - RNA, 22 nt, Homo sapiens
cauuauuuggcuuaaaccagaa

SEQ ID NO: 1842422 - RNA, 12 nt, Homo sapiens
ccccugccagcu

SEQ ID NO: 1842423 - RNA, 23 nt, Homo sapiens
uucagacucccauuccugaagaa

SEQ ID NO: 1842424 - RNA, 18 nt, Homo sapiens
aaauaugccccauucaac

SEQ ID NO: 1842425 - RNA, 17 nt, Homo sapiens
agcugacauugccaaaa

SEQ ID NO: 1842426 - RNA, 13 nt, Homo sapiens
ugcugucacuguu

SEQ ID NO: 1842427 - RNA, 14 nt, Homo sapiens
gucuuccaugaccc

SEQ ID NO: 1842428 - RNA, 13 nt, Homo sapiens
uauaaagaucacc

SEQ ID NO: 1842429 - RNA, 16 nt, Homo sapiens
auuguuuacaggauau

SEQ ID NO: 1842430 - RNA, 22 nt, Homo sapiens
uuuccucagccuuaagaaccau

SEQ ID NO: 1842431 - RNA, 20 nt, Homo sapiens
gauaaaacuuauaaauuuca

SEQ ID NO: 1842432 - RNA, 16 nt, Homo sapiens
uacauaggaugacaaa

SEQ ID NO: 1842433 - RNA, 22 nt, Homo sapiens
ccugccccaaacaaauaugcaa

SEQ ID NO: 1842434 - RNA, 15 nt, Homo sapiens
aacacauaguggcuu

SEQ ID NO: 1842435 - RNA, 17 nt, Homo sapiens
ucaguaguuuuacugau

SEQ ID NO: 1842436 - RNA, 20 nt, Homo sapiens
ggccuuucagguccaggcca

SEQ ID NO: 1842437 - RNA, 17 nt, Homo sapiens
uaagaauuucaauauca

SEQ ID NO: 1842438 - RNA, 23 nt, Homo sapiens
cauaccauuucuacaccucaauc

SEQ ID NO: 1842439 - RNA, 22 nt, Homo sapiens
cauguucaaagugugacauuca

SEQ ID NO: 1842440 - RNA, 19 nt, Homo sapiens
guaggccuuccagugcagg

SEQ ID NO: 1842441 - RNA, 19 nt, Homo sapiens
uuaccaaggaugaaagagg

SEQ ID NO: 1842442 - RNA, 21 nt, Homo sapiens
cauguguggcccugucugcuu

SEQ ID NO: 1842443 - RNA, 16 nt, Homo sapiens
cugccagccacaucca

SEQ ID NO: 1842444 - RNA, 15 nt, Homo sapiens
augcuggggcacuuu

SEQ ID NO: 1842445 - RNA, 16 nt, Homo sapiens
cauucuucaguucucu

SEQ ID NO: 1842446 - RNA, 22 nt, Homo sapiens
aaggaacugcaauaauaucaaa

SEQ ID NO: 1842447 - RNA, 15 nt, Homo sapiens
guuuaaaacagaagc

SEQ ID NO: 1842448 - RNA, 20 nt, Homo sapiens
gccugcaguggugugaaaca

SEQ ID NO: 1842449 - RNA, 16 nt, Homo sapiens
ucagcagugaaguaua

SEQ ID NO: 1842450 - RNA, 17 nt, Homo sapiens
aguucucaugacuccua

SEQ ID NO: 1842451 - RNA, 19 nt, Homo sapiens
agggcgcugagggcagggu

SEQ ID NO: 1842452 - RNA, 15 nt, Homo sapiens
ggauacuauuuaauu

SEQ ID NO: 1842453 - RNA, 19 nt, Homo sapiens
uuggggagcaggaggccaa

SEQ ID NO: 1842454 - RNA, 17 nt, Homo sapiens
aucagacauucagagau

SEQ ID NO: 1842455 - RNA, 17 nt, Homo sapiens
gugugugcgugugucca

SEQ ID NO: 1842456 - RNA, 21 nt, Homo sapiens
cgucauccccggagucccuau

SEQ ID NO: 1842457 - RNA, 15 nt, Homo sapiens
gaaugaaaacaauau

SEQ ID NO: 1842458 - RNA, 13 nt, Homo sapiens
gcccuuggccaga

SEQ ID NO: 1842459 - RNA, 15 nt, Homo sapiens
ugucuccagcugccu

SEQ ID NO: 1842460 - RNA, 16 nt, Homo sapiens
accuuuauauauguac

SEQ ID NO: 1842461 - RNA, 16 nt, Homo sapiens
gaauucacaaugcauu

SEQ ID NO: 1842462 - RNA, 16 nt, Homo sapiens
gcuuuacuccaggaaa

SEQ ID NO: 1842463 - RNA, 20 nt, Homo sapiens
caaacauccaaaaguucaac

SEQ ID NO: 1842464 - RNA, 24 nt, Homo sapiens
cuguggccacucgagugcccaagg

SEQ ID NO: 1842465 - RNA, 13 nt, Homo sapiens
ccauggacgggaa

SEQ ID NO: 1842466 - RNA, 14 nt, Homo sapiens
uagcugggauuuga

SEQ ID NO: 1842467 - RNA, 18 nt, Homo sapiens
agagggaccagagcuugg

SEQ ID NO: 1842468 - RNA, 19 nt, Homo sapiens
caccaguuaugauaaccaa

SEQ ID NO: 1842469 - RNA, 18 nt, Homo sapiens
uaguguauccauaaugca

SEQ ID NO: 1842470 - RNA, 18 nt, Homo sapiens
accgccuggcccucugug

SEQ ID NO: 1842471 - RNA, 16 nt, Homo sapiens
uauuuuaaaggcaaaa

SEQ ID NO: 1842472 - RNA, 19 nt, Homo sapiens
uaccacugauuuggagaua

SEQ ID NO: 1842473 - RNA, 21 nt, Homo sapiens
cuaacacggugaaaccccuua

SEQ ID NO: 1842474 - RNA, 11 nt, Homo sapiens
uggcugugaga

SEQ ID NO: 1842475 - RNA, 14 nt, Homo sapiens
cucugugaucuugc

SEQ ID NO: 1842476 - RNA, 16 nt, Homo sapiens
cuguugauaaauccau

SEQ ID NO: 1842477 - RNA, 20 nt, Homo sapiens
cauugugacuguguuugcau

SEQ ID NO: 1842478 - RNA, 18 nt, Homo sapiens
cuucuggaacauuccaaa

SEQ ID NO: 1842479 - RNA, 13 nt, Homo sapiens
agaacaaccaaaa

SEQ ID NO: 1842480 - RNA, 20 nt, Homo sapiens
uccuauaaucugucaaaaca

SEQ ID NO: 1842481 - RNA, 13 nt, Homo sapiens
aaaauauauguau

SEQ ID NO: 1842482 - RNA, 17 nt, Homo sapiens
cuuguccaucacucuag

SEQ ID NO: 1842483 - RNA, 14 nt, Homo sapiens
guuaaugaauaugc

SEQ ID NO: 1842484 - RNA, 17 nt, Homo sapiens
uguaacuuaacuauuaa

SEQ ID NO: 1842485 - RNA, 19 nt, Homo sapiens
aacuaggcucauacucaau

SEQ ID NO: 1842486 - RNA, 17 nt, Homo sapiens
gccuuucccucuucccu

SEQ ID NO: 1842487 - RNA, 19 nt, Homo sapiens
acaacuugucuauuaccug

SEQ ID NO: 1842488 - RNA, 18 nt, Homo sapiens
uacuuagguuauuuugcu

SEQ ID NO: 1842489 - RNA, 23 nt, Homo sapiens
gggacuccggcugugcugggaga

SEQ ID NO: 1842490 - RNA, 12 nt, Homo sapiens
guauacauaugc

SEQ ID NO: 1842491 - RNA, 16 nt, Homo sapiens
uuccugaacucccagu

SEQ ID NO: 1842492 - RNA, 14 nt, Homo sapiens
aaacaccgagugag

SEQ ID NO: 1842493 - RNA, 19 nt, Homo sapiens
gagacccgagggcugcuuu

SEQ ID NO: 1842494 - RNA, 19 nt, Homo sapiens
uggugcugcgcccagggag

SEQ ID NO: 1842495 - RNA, 12 nt, Homo sapiens
uaggauugugcc

SEQ ID NO: 1842496 - RNA, 19 nt, Homo sapiens
ccuggcagaacugagcucc

SEQ ID NO: 1842497 - RNA, 17 nt, Homo sapiens
auuaacuaauaugggca

SEQ ID NO: 1842498 - RNA, 21 nt, Homo sapiens
cagcagcaggggaaagauuau

SEQ ID NO: 1842499 - RNA, 14 nt, Homo sapiens
agccagcuguuucc

SEQ ID NO: 1842500 - RNA, 15 nt, Homo sapiens
gcuuaaacaacaccu

SEQ ID NO: 1842501 - RNA, 20 nt, Homo sapiens
aagcauuccuuucucuucag

SEQ ID NO: 1842502 - RNA, 17 nt, Homo sapiens
cuucauagaaaccucuc

SEQ ID NO: 1842503 - RNA, 10 nt, Homo sapiens
ccccagcugu

SEQ ID NO: 1842504 - RNA, 22 nt, Homo sapiens
gccccucuccuccguggcacau

SEQ ID NO: 1842505 - RNA, 15 nt, Homo sapiens
aucccaacacuuugg

SEQ ID NO: 1842506 - RNA, 15 nt, Homo sapiens
aucccagcacuuuga

SEQ ID NO: 1842507 - RNA, 14 nt, Homo sapiens
accacaugauucug

SEQ ID NO: 1842508 - RNA, 21 nt, Homo sapiens
ccccaaucaauacccuuguga

SEQ ID NO: 1842509 - RNA, 18 nt, Homo sapiens
agguaacuaacugcauac

SEQ ID NO: 1842510 - RNA, 17 nt, Homo sapiens
cauuuaacugaacugug

SEQ ID NO: 1842511 - RNA, 16 nt, Homo sapiens
uccagagacacugagc

SEQ ID NO: 1842512 - RNA, 15 nt, Homo sapiens
gauggccaggccaga

SEQ ID NO: 1842513 - RNA, 18 nt, Homo sapiens
ucacuggggcaugagauu

SEQ ID NO: 1842514 - RNA, 21 nt, Homo sapiens
auucucucaggcuugcugcca

SEQ ID NO: 1842515 - RNA, 19 nt, Homo sapiens
uauuaaugaacugugacag

SEQ ID NO: 1842516 - RNA, 21 nt, Homo sapiens
ucccgacauaacauuguacug

SEQ ID NO: 1842517 - RNA, 16 nt, Homo sapiens
ucagagauuagucuua

SEQ ID NO: 1842518 - RNA, 21 nt, Homo sapiens
uuaaauaugaucacuucauac

SEQ ID NO: 1842519 - RNA, 12 nt, Homo sapiens
ucgauuagacug

SEQ ID NO: 1842520 - RNA, 17 nt, Homo sapiens
ggacaucaaauuugcca

SEQ ID NO: 1842521 - RNA, 22 nt, Homo sapiens
uauaaguaacacuaguagcugu

SEQ ID NO: 1842522 - RNA, 21 nt, Homo sapiens
aaccccauguccucagcauuu

SEQ ID NO: 1842523 - RNA, 15 nt, Homo sapiens
gccuugccugggaua

SEQ ID NO: 1842524 - RNA, 16 nt, Homo sapiens
uuuuauuuugucucug

SEQ ID NO: 1842525 - RNA, 14 nt, Homo sapiens
uauuucguguacug

SEQ ID NO: 1842526 - RNA, 22 nt, Homo sapiens
uggaagagcaacaacagacagg

SEQ ID NO: 1842527 - RNA, 22 nt, Homo sapiens
auguauaaaauguaacacugau

SEQ ID NO: 1842528 - RNA, 15 nt, Homo sapiens
cgaugcacacgcaca

SEQ ID NO: 1842529 - RNA, 17 nt, Homo sapiens
auguggucacagcugua

SEQ ID NO: 1842530 - RNA, 16 nt, Homo sapiens
cauauugugccaauau

SEQ ID NO: 1842531 - RNA, 18 nt, Homo sapiens
guauuccuuuuguguaca

SEQ ID NO: 1842532 - RNA, 15 nt, Homo sapiens
uuaacaaaauccuca

SEQ ID NO: 1842533 - RNA, 12 nt, Homo sapiens
ccuccacuccac

SEQ ID NO: 1842534 - RNA, 12 nt, Homo sapiens
ccugcacuccag

SEQ ID NO: 1842535 - RNA, 16 nt, Homo sapiens
gaaaucuuucucccuc

SEQ ID NO: 1842536 - RNA, 16 nt, Homo sapiens
uuaugaaaaccauaug

SEQ ID NO: 1842537 - RNA, 17 nt, Homo sapiens
aguccaaauugucuguc

SEQ ID NO: 1842538 - RNA, 14 nt, Homo sapiens
uccgcccugccacu

SEQ ID NO: 1842539 - RNA, 17 nt, Homo sapiens
ugaagacacagccuccc

SEQ ID NO: 1842540 - RNA, 18 nt, Homo sapiens
acagcuguccacacugaa

SEQ ID NO: 1842541 - RNA, 19 nt, Homo sapiens
uguaugccaagugaaaaaa

SEQ ID NO: 1842542 - RNA, 13 nt, Homo sapiens
gcuaaggcucuau

SEQ ID NO: 1842543 - RNA, 18 nt, Homo sapiens
caagaugaaugcagauua

SEQ ID NO: 1842544 - RNA, 15 nt, Homo sapiens
uuaaaaauaugugua

SEQ ID NO: 1842545 - RNA, 19 nt, Homo sapiens
uuaggaugugggaguaaaa

SEQ ID NO: 1842546 - RNA, 22 nt, Homo sapiens
gacaagcauggaaaaucaguga

SEQ ID NO: 1842547 - RNA, 13 nt, Homo sapiens
uccuucuugcccu

SEQ ID NO: 1842548 - RNA, 19 nt, Homo sapiens
uaaaagcuauggugagaug

SEQ ID NO: 1842549 - RNA, 19 nt, Homo sapiens
aagugaucauuucacaccc

SEQ ID NO: 1842550 - RNA, 17 nt, Homo sapiens
gaauauaaaacagucau

SEQ ID NO: 1842551 - RNA, 20 nt, Homo sapiens
aagggaagccgccuuugcaa

SEQ ID NO: 1842552 - RNA, 13 nt, Homo sapiens
ccccagaccagga

SEQ ID NO: 1842553 - RNA, 16 nt, Homo sapiens
aauauagcuguacaaa

SEQ ID NO: 1842554 - RNA, 22 nt, Homo sapiens
cuaauggaguguuugaaaacug

SEQ ID NO: 1842555 - RNA, 23 nt, Homo sapiens
uauuugagagagagaaccuuucc

SEQ ID NO: 1842556 - RNA, 16 nt, Homo sapiens
cacuuucaugcagugc

SEQ ID NO: 1842557 - RNA, 20 nt, Homo sapiens
cacagcaacauuuucuugaa

SEQ ID NO: 1842558 - RNA, 20 nt, Homo sapiens
guguccaggagaccuuccac

SEQ ID NO: 1842559 - RNA, 17 nt, Homo sapiens
cugcaccggaccauuga

SEQ ID NO: 1842560 - RNA, 17 nt, Homo sapiens
cugaaauaaacacuggu

SEQ ID NO: 1842561 - RNA, 17 nt, Homo sapiens
uggaauuggagucgugu

SEQ ID NO: 1842562 - RNA, 21 nt, Homo sapiens
aaacuauuugcagaugacaca

SEQ ID NO: 1842563 - RNA, 17 nt, Homo sapiens
ucaccuuuucuguggcu

SEQ ID NO: 1842564 - RNA, 15 nt, Homo sapiens
ugcuguauccaucca

SEQ ID NO: 1842565 - RNA, 18 nt, Homo sapiens
cagggcgagcacuuucca

SEQ ID NO: 1842566 - RNA, 21 nt, Homo sapiens
ggaaaaaaauucugauacauu

SEQ ID NO: 1842567 - RNA, 13 nt, Homo sapiens
cacaugugcucuc

SEQ ID NO: 1842568 - RNA, 23 nt, Homo sapiens
ugccuccucccugggcagaaagu

SEQ ID NO: 1842569 - RNA, 16 nt, Homo sapiens
auuuucuucucugcac

SEQ ID NO: 1842570 - RNA, 22 nt, Homo sapiens
auuagcuuguuaguaaugcucu

SEQ ID NO: 1842571 - RNA, 12 nt, Homo sapiens
cuccuacuguau

SEQ ID NO: 1842572 - RNA, 16 nt, Homo sapiens
ucagagaccagcacuc

SEQ ID NO: 1842573 - RNA, 19 nt, Homo sapiens
aacagcaauuguucaggga

SEQ ID NO: 1842574 - RNA, 22 nt, Homo sapiens
cccuuuuauuaauacauucacc

SEQ ID NO: 1842575 - RNA, 14 nt, Homo sapiens
augcaccaugucaa

SEQ ID NO: 1842576 - RNA, 19 nt, Homo sapiens
ugagcucacugaaaagacu

SEQ ID NO: 1842577 - RNA, 11 nt, Homo sapiens
aacauucugua

SEQ ID NO: 1842578 - RNA, 19 nt, Homo sapiens
uuauauacuguguauaucu

SEQ ID NO: 1842579 - RNA, 14 nt, Homo sapiens
agauguuggaccaa

SEQ ID NO: 1842580 - RNA, 23 nt, Homo sapiens
aguuaucuguucuuuugacuuaa

SEQ ID NO: 1842581 - RNA, 16 nt, Homo sapiens
aauggcuaguacugua

SEQ ID NO: 1842582 - RNA, 14 nt, Homo sapiens
uaaccucaauuuau

SEQ ID NO: 1842583 - RNA, 14 nt, Homo sapiens
ugaaaaaaauggag

SEQ ID NO: 1842584 - RNA, 19 nt, Homo sapiens
ugaaucagaaugccuucaa

SEQ ID NO: 1842585 - RNA, 23 nt, Homo sapiens
aauuuuaucuuuuuuaggcuucu

SEQ ID NO: 1842586 - RNA, 17 nt, Homo sapiens
cgugcaggacagcucuu

SEQ ID NO: 1842587 - RNA, 14 nt, Homo sapiens
cuccaaagucauaa

SEQ ID NO: 1842588 - RNA, 17 nt, Homo sapiens
gagacccuggugcugcc

SEQ ID NO: 1842589 - RNA, 17 nt, Homo sapiens
auggagcaaaacaaagc

SEQ ID NO: 1842590 - RNA, 15 nt, Homo sapiens
gugagaacuaaugcc

SEQ ID NO: 1842591 - RNA, 17 nt, Homo sapiens
ugaaacuguaucaucuu

SEQ ID NO: 1842592 - RNA, 14 nt, Homo sapiens
aacucuacauuuaa

SEQ ID NO: 1842593 - RNA, 14 nt, Homo sapiens
cauaauaccucaca

SEQ ID NO: 1842594 - RNA, 22 nt, Homo sapiens
agguaaccccagauucaugcac

SEQ ID NO: 1842595 - RNA, 16 nt, Homo sapiens
acuuuuguaccaaaua

SEQ ID NO: 1842596 - RNA, 17 nt, Homo sapiens
gagcugcugagggaccu

SEQ ID NO: 1842597 - RNA, 12 nt, Homo sapiens
uaagaagcaaua

SEQ ID NO: 1842598 - RNA, 16 nt, Homo sapiens
ugaacuagccaaucag

SEQ ID NO: 1842599 - RNA, 12 nt, Homo sapiens
gcacagugcagu

SEQ ID NO: 1842600 - RNA, 17 nt, Homo sapiens
ugcaggguccccaagga

SEQ ID NO: 1842601 - RNA, 21 nt, Homo sapiens
aucaguuuccaugaaagaccu

SEQ ID NO: 1842602 - RNA, 16 nt, Homo sapiens
uguaucuucagacuca

SEQ ID NO: 1842603 - RNA, 19 nt, Homo sapiens
auuaaaauuacacacuugc

SEQ ID NO: 1842604 - RNA, 22 nt, Homo sapiens
aagagacuuggaaaugggagac

SEQ ID NO: 1842605 - RNA, 19 nt, Homo sapiens
auuguugacaacugugacu

SEQ ID NO: 1842606 - RNA, 17 nt, Homo sapiens
aagaaaauaccaaggaa

SEQ ID NO: 1842607 - RNA, 13 nt, Homo sapiens
acagugacuguac

SEQ ID NO: 1842608 - RNA, 20 nt, Homo sapiens
uaaaacauuuucacacaaua

SEQ ID NO: 1842609 - RNA, 20 nt, Homo sapiens
gcgccuccauggcucugcag

SEQ ID NO: 1842610 - RNA, 20 nt, Homo sapiens
auacacacauauacauauau

SEQ ID NO: 1842611 - RNA, 19 nt, Homo sapiens
aauaaguuuucaguggacu

SEQ ID NO: 1842612 - RNA, 17 nt, Homo sapiens
aggaauggcugcaccuu

SEQ ID NO: 1842613 - RNA, 18 nt, Homo sapiens
uccaugaaaaacagcaga

SEQ ID NO: 1842614 - RNA, 15 nt, Homo sapiens
uaguguauaugcuaa

SEQ ID NO: 1842615 - RNA, 18 nt, Homo sapiens
ugugcaaacaaaucaugc

SEQ ID NO: 1842616 - RNA, 15 nt, Homo sapiens
uagaaggagagccca

SEQ ID NO: 1842617 - RNA, 23 nt, Homo sapiens
gugauacaacuucaagugcaugc

SEQ ID NO: 1842618 - RNA, 16 nt, Homo sapiens
uucuaguggucuuugu

SEQ ID NO: 1842619 - RNA, 15 nt, Homo sapiens
cugauuuucgcugau

SEQ ID NO: 1842620 - RNA, 20 nt, Homo sapiens
acacagauggcaccuguggc

SEQ ID NO: 1842621 - RNA, 22 nt, Homo sapiens
gcagacuuuuguguaaaaagca

SEQ ID NO: 1842622 - RNA, 15 nt, Homo sapiens
agugaugacggggug

SEQ ID NO: 1842623 - RNA, 15 nt, Homo sapiens
aauaaaaacagagaa

SEQ ID NO: 1842624 - RNA, 19 nt, Homo sapiens
cuggauaccagauauuuga

SEQ ID NO: 1842625 - RNA, 12 nt, Homo sapiens
acagugugcuca

SEQ ID NO: 1842626 - RNA, 14 nt, Homo sapiens
aguguuuaaaugaa

SEQ ID NO: 1842627 - RNA, 17 nt, Homo sapiens
acagagcugaguccucu

SEQ ID NO: 1842628 - RNA, 17 nt, Homo sapiens
ugucuggaaaagcccuc

SEQ ID NO: 1842629 - RNA, 22 nt, Homo sapiens
auggggaagguuaucagugcuu

SEQ ID NO: 1842630 - RNA, 16 nt, Homo sapiens
auuggacagauuucag

SEQ ID NO: 1842631 - RNA, 13 nt, Homo sapiens
uggucauaaugaa

SEQ ID NO: 1842632 - RNA, 23 nt, Homo sapiens
ccagucaugagcguuagacugac

SEQ ID NO: 1842633 - RNA, 14 nt, Homo sapiens
gcaugaccugauca

SEQ ID NO: 1842634 - RNA, 13 nt, Homo sapiens
accuugucugcua

SEQ ID NO: 1842635 - RNA, 19 nt, Homo sapiens
ucugcuuuucccauugcca

SEQ ID NO: 1842636 - RNA, 14 nt, Homo sapiens
uuaucaauaguucc

SEQ ID NO: 1842637 - RNA, 13 nt, Homo sapiens
ccccaggccaccu

SEQ ID NO: 1842638 - RNA, 16 nt, Homo sapiens
aaaauauggacuucca

SEQ ID NO: 1842639 - RNA, 19 nt, Homo sapiens
accuguuuaaauauuucaa

SEQ ID NO: 1842640 - RNA, 17 nt, Homo sapiens
accuaagggaguagugu

SEQ ID NO: 1842641 - RNA, 18 nt, Homo sapiens
aacccgauuauuguguau

SEQ ID NO: 1842642 - RNA, 20 nt, Homo sapiens
cugcuugaugaagcaaggaa

SEQ ID NO: 1842643 - RNA, 17 nt, Homo sapiens
agccaguggugauguaa

SEQ ID NO: 1842644 - RNA, 14 nt, Homo sapiens
gucuuguacuguga

SEQ ID NO: 1842645 - RNA, 19 nt, Homo sapiens
ucauaucaugguagucacu

SEQ ID NO: 1842646 - RNA, 13 nt, Homo sapiens
ccugccaaugcca

SEQ ID NO: 1842647 - RNA, 16 nt, Homo sapiens
uguagcucuuugccuc

SEQ ID NO: 1842648 - RNA, 18 nt, Homo sapiens
ucaaaauauacauucaaa

SEQ ID NO: 1842649 - RNA, 20 nt, Homo sapiens
uggauguuacucucuugcac

SEQ ID NO: 1842650 - RNA, 21 nt, Homo sapiens
aaauaauaaaauaaucauaca

SEQ ID NO: 1842651 - RNA, 15 nt, Homo sapiens
uaauaauaugugaug

SEQ ID NO: 1842652 - RNA, 19 nt, Homo sapiens
cagccauaagaaagcacua

SEQ ID NO: 1842653 - RNA, 15 nt, Homo sapiens
cugcugagugaauga

SEQ ID NO: 1842654 - RNA, 17 nt, Homo sapiens
ugggcagucuuucuuga

SEQ ID NO: 1842655 - RNA, 15 nt, Homo sapiens
agacacuucaccaaa

SEQ ID NO: 1842656 - RNA, 22 nt, Homo sapiens
ccauagucgugccuguuugcuu

SEQ ID NO: 1842657 - RNA, 16 nt, Homo sapiens
ccugugaagggacaca

SEQ ID NO: 1842658 - RNA, 20 nt, Homo sapiens
uuccuaugacauuacuguau

SEQ ID NO: 1842659 - RNA, 18 nt, Homo sapiens
aaagguauuauacaugug

SEQ ID NO: 1842660 - RNA, 18 nt, Homo sapiens
ccucaaauacaguauugu

SEQ ID NO: 1842661 - RNA, 23 nt, Homo sapiens
uccuggcccuggaaggugccacu

SEQ ID NO: 1842662 - RNA, 19 nt, Homo sapiens
agaaaucuagaagacuguc

SEQ ID NO: 1842663 - RNA, 12 nt, Homo sapiens
uauagugucaug

SEQ ID NO: 1842664 - RNA, 15 nt, Homo sapiens
augguggcaccagcg

SEQ ID NO: 1842665 - RNA, 17 nt, Homo sapiens
ucccagcccacaucuca

SEQ ID NO: 1842666 - RNA, 16 nt, Homo sapiens
cagaaauagcuccuca

SEQ ID NO: 1842667 - RNA, 18 nt, Homo sapiens
agauuuuagacuuaccuu

SEQ ID NO: 1842668 - RNA, 14 nt, Homo sapiens
gacugccacauaau

SEQ ID NO: 1842669 - RNA, 14 nt, Homo sapiens
gauaaucacacugc

SEQ ID NO: 1842670 - RNA, 19 nt, Homo sapiens
gugacaaggccccagagac

SEQ ID NO: 1842671 - RNA, 19 nt, Homo sapiens
uacaaaucaaucacagcuu

SEQ ID NO: 1842672 - RNA, 13 nt, Homo sapiens
acacacacuuuug

SEQ ID NO: 1842673 - RNA, 19 nt, Homo sapiens
aaaaauuugacauugucag

SEQ ID NO: 1842674 - RNA, 19 nt, Homo sapiens
ugugggagaccgaggacac

SEQ ID NO: 1842675 - RNA, 15 nt, Homo sapiens
aauagccucccugua

SEQ ID NO: 1842676 - RNA, 17 nt, Homo sapiens
aguugaccccuccugaa

SEQ ID NO: 1842677 - RNA, 14 nt, Homo sapiens
uugauuucacugga

SEQ ID NO: 1842678 - RNA, 15 nt, Homo sapiens
uguacagaacacaaa

SEQ ID NO: 1842679 - RNA, 12 nt, Homo sapiens
gacacagggaag

SEQ ID NO: 1842680 - RNA, 14 nt, Homo sapiens
cuguuaaccuauga

SEQ ID NO: 1842681 - RNA, 18 nt, Homo sapiens
ccugaaacugaguugaau

SEQ ID NO: 1842682 - RNA, 13 nt, Homo sapiens
auaaagugcaguu

SEQ ID NO: 1842683 - RNA, 20 nt, Homo sapiens
agaacaguuggauacaggag

SEQ ID NO: 1842684 - RNA, 15 nt, Homo sapiens
aaagcccuugaacca

SEQ ID NO: 1842685 - RNA, 13 nt, Homo sapiens
uccucuuugugaa

SEQ ID NO: 1842686 - RNA, 14 nt, Homo sapiens
cuaaccacuucaga

SEQ ID NO: 1842687 - RNA, 21 nt, Homo sapiens
ucugauuuacucuuugggauc

SEQ ID NO: 1842688 - RNA, 14 nt, Homo sapiens
uguccccuaccccc

SEQ ID NO: 1842689 - RNA, 19 nt, Homo sapiens
aaaggaaccgcccagugca

SEQ ID NO: 1842690 - RNA, 19 nt, Homo sapiens
aagcaccagcaguguuuaa

SEQ ID NO: 1842691 - RNA, 16 nt, Homo sapiens
ugauccuugcugauaa

SEQ ID NO: 1842692 - RNA, 16 nt, Homo sapiens
cuccuggggucacuca

SEQ ID NO: 1842693 - RNA, 19 nt, Homo sapiens
cuucuaccuuaaaauguaa

SEQ ID NO: 1842694 - RNA, 19 nt, Homo sapiens
aauuguuuaacccuggaua

SEQ ID NO: 1842695 - RNA, 17 nt, Homo sapiens
cauguagagaaaagcac

SEQ ID NO: 1842696 - RNA, 14 nt, Homo sapiens
uucaucuaauguga

SEQ ID NO: 1842697 - RNA, 13 nt, Homo sapiens
cagcagcucugag

SEQ ID NO: 1842698 - RNA, 17 nt, Homo sapiens
uagguccaagggccaua

SEQ ID NO: 1842699 - RNA, 14 nt, Homo sapiens
ucugugauugccau

SEQ ID NO: 1842700 - RNA, 17 nt, Homo sapiens
gggcaaggcgcucaggc

SEQ ID NO: 1842701 - RNA, 18 nt, Homo sapiens
acuuuuccauugaccagc

SEQ ID NO: 1842702 - RNA, 21 nt, Homo sapiens
cucugaagaagagggucugca

SEQ ID NO: 1842703 - RNA, 18 nt, Homo sapiens
guggagugggggcuucca

SEQ ID NO: 1842704 - RNA, 16 nt, Homo sapiens
aaggccgucauuucau

SEQ ID NO: 1842705 - RNA, 17 nt, Homo sapiens
uucugagaaagacuauu

SEQ ID NO: 1842706 - RNA, 18 nt, Homo sapiens
cacagcagacaccauuca

SEQ ID NO: 1842707 - RNA, 15 nt, Homo sapiens
ccugggauucaggaa

SEQ ID NO: 1842708 - RNA, 19 nt, Homo sapiens
guccuugcaagaauggaga

SEQ ID NO: 1842709 - RNA, 15 nt, Homo sapiens
cacagugcucaaggc

SEQ ID NO: 1842710 - RNA, 19 nt, Homo sapiens
uccgcaggcagacuacaca

SEQ ID NO: 1842711 - RNA, 21 nt, Homo sapiens
auucucagugagggcucugga

SEQ ID NO: 1842712 - RNA, 19 nt, Homo sapiens
aguucagacacuaccccau

SEQ ID NO: 1842713 - RNA, 17 nt, Homo sapiens
uuucuaagccuuugaga

SEQ ID NO: 1842714 - RNA, 22 nt, Homo sapiens
gcuacuuaacaaaguaaacaaa

SEQ ID NO: 1842715 - RNA, 14 nt, Homo sapiens
aaagacuacauauu

SEQ ID NO: 1842716 - RNA, 14 nt, Homo sapiens
ccuugggaagaugu

SEQ ID NO: 1842717 - RNA, 15 nt, Homo sapiens
ugcauucuucucugu

SEQ ID NO: 1842718 - RNA, 16 nt, Homo sapiens
ggucuagaaccacuaa

SEQ ID NO: 1842719 - RNA, 15 nt, Homo sapiens
cugggggauaccagc

SEQ ID NO: 1842720 - RNA, 19 nt, Homo sapiens
ucagggugcucccuccuca

SEQ ID NO: 1842721 - RNA, 15 nt, Homo sapiens
ugcagcuuccuguca

SEQ ID NO: 1842722 - RNA, 17 nt, Homo sapiens
gcuuuuaaaugaccaaa

SEQ ID NO: 1842723 - RNA, 18 nt, Homo sapiens
ccaggcugccugugugca

SEQ ID NO: 1842724 - RNA, 17 nt, Homo sapiens
agccgucagccugugaa

SEQ ID NO: 1842725 - RNA, 17 nt, Homo sapiens
agauauaguaguaccuu

SEQ ID NO: 1842726 - RNA, 15 nt, Homo sapiens
aggaccacaggcuca

SEQ ID NO: 1842727 - RNA, 17 nt, Homo sapiens
caauguuauuaccuaua

SEQ ID NO: 1842728 - RNA, 14 nt, Homo sapiens
cucuaguccuuggc

SEQ ID NO: 1842729 - RNA, 17 nt, Homo sapiens
agaaaguggugcucagu

SEQ ID NO: 1842730 - RNA, 14 nt, Homo sapiens
gauuaagaaugcca

SEQ ID NO: 1842731 - RNA, 19 nt, Homo sapiens
augcacuaaucaauacuuu

SEQ ID NO: 1842732 - RNA, 14 nt, Homo sapiens
uuuuaauccaaaga

SEQ ID NO: 1842733 - RNA, 23 nt, Homo sapiens
ccuguucugguauacauuuacug

SEQ ID NO: 1842734 - RNA, 20 nt, Homo sapiens
acgguguugcagagacgcaa

SEQ ID NO: 1842735 - RNA, 11 nt, Homo sapiens
acuauggugcu

SEQ ID NO: 1842736 - RNA, 17 nt, Homo sapiens
ccagucacugugagcuc

SEQ ID NO: 1842737 - RNA, 21 nt, Homo sapiens
aauacaguuuauuauguacua

SEQ ID NO: 1842738 - RNA, 19 nt, Homo sapiens
acaugcccaaaacuuaucc

SEQ ID NO: 1842739 - RNA, 12 nt, Homo sapiens
gcacuguucaca

SEQ ID NO: 1842740 - RNA, 17 nt, Homo sapiens
auggguauucaaaaaug

SEQ ID NO: 1842741 - RNA, 13 nt, Homo sapiens
ugguguaaucucu

SEQ ID NO: 1842742 - RNA, 22 nt, Homo sapiens
cucagaaugaaaauucauuccc

SEQ ID NO: 1842743 - RNA, 16 nt, Homo sapiens
gcccagugcauaugca

SEQ ID NO: 1842744 - RNA, 17 nt, Homo sapiens
acagugagugaccccag

SEQ ID NO: 1842745 - RNA, 16 nt, Homo sapiens
ccggggcgaguggcac

SEQ ID NO: 1842746 - RNA, 20 nt, Homo sapiens
caaauggggcaaacagucua

SEQ ID NO: 1842747 - RNA, 11 nt, Homo sapiens
caugucaggcc

SEQ ID NO: 1842748 - RNA, 20 nt, Homo sapiens
gcauuuuccuaaacccagug

SEQ ID NO: 1842749 - RNA, 15 nt, Homo sapiens
cuccuaacaaaagaa

SEQ ID NO: 1842750 - RNA, 15 nt, Homo sapiens
auccugaccaaagga

SEQ ID NO: 1842751 - RNA, 11 nt, Homo sapiens
ucaagacuuua

SEQ ID NO: 1842752 - RNA, 12 nt, Homo sapiens
aaccucaauaaa

SEQ ID NO: 1842753 - RNA, 20 nt, Homo sapiens
gccccaggccucgucuuuca

SEQ ID NO: 1842754 - RNA, 18 nt, Homo sapiens
caucuccucccaccagug

SEQ ID NO: 1842755 - RNA, 18 nt, Homo sapiens
augucuaaaauugucagu

SEQ ID NO: 1842756 - RNA, 23 nt, Homo sapiens
ucugaaguagccugaucuuucua

SEQ ID NO: 1842757 - RNA, 21 nt, Homo sapiens
acauccccugcuggccggaca

SEQ ID NO: 1842758 - RNA, 16 nt, Homo sapiens
gcuucuuauauugcaa

SEQ ID NO: 1842759 - RNA, 14 nt, Homo sapiens
acuauuuuuccaaa

SEQ ID NO: 1842760 - RNA, 17 nt, Homo sapiens
aauuguacaaccuguga

SEQ ID NO: 1842761 - RNA, 21 nt, Homo sapiens
ucagaucccucggucagcacc

SEQ ID NO: 1842762 - RNA, 13 nt, Homo sapiens
auuuuaccaaagc

SEQ ID NO: 1842763 - RNA, 18 nt, Homo sapiens
uugccacagaugauacuu

SEQ ID NO: 1842764 - RNA, 15 nt, Homo sapiens
cccauuuuuguaaua

SEQ ID NO: 1842765 - RNA, 14 nt, Homo sapiens
gacccucccaggga

SEQ ID NO: 1842766 - RNA, 12 nt, Homo sapiens
cacucaagaaga

SEQ ID NO: 1842767 - RNA, 15 nt, Homo sapiens
cggggucaagcugga

SEQ ID NO: 1842768 - RNA, 18 nt, Homo sapiens
ccaacuugucacuugcca

SEQ ID NO: 1842769 - RNA, 18 nt, Homo sapiens
acaccuggacaauuucua

SEQ ID NO: 1842770 - RNA, 22 nt, Homo sapiens
ugauuugauaccauggcacuga

SEQ ID NO: 1842771 - RNA, 12 nt, Homo sapiens
gacucucaggga

SEQ ID NO: 1842772 - RNA, 15 nt, Homo sapiens
ucuccaucaguucac

SEQ ID NO: 1842773 - RNA, 20 nt, Homo sapiens
ugauuaaagguggugccaau

SEQ ID NO: 1842774 - RNA, 18 nt, Homo sapiens
auucaaguauuugaucag

SEQ ID NO: 1842775 - RNA, 19 nt, Homo sapiens
gcuguuggccucugcaaag

SEQ ID NO: 1842776 - RNA, 21 nt, Homo sapiens
accguccagcaagugucauca

SEQ ID NO: 1842777 - RNA, 18 nt, Homo sapiens
acccuuccuucuguaaau

SEQ ID NO: 1842778 - RNA, 12 nt, Homo sapiens
aguggacuggag

SEQ ID NO: 1842779 - RNA, 23 nt, Homo sapiens
acgcuuguuugccugaaaguaau

SEQ ID NO: 1842780 - RNA, 15 nt, Homo sapiens
uuccuaauacuguca

SEQ ID NO: 1842781 - RNA, 19 nt, Homo sapiens
uuacuuuaauacucaccuc

SEQ ID NO: 1842782 - RNA, 22 nt, Homo sapiens
gccugggucaagggccagucag

SEQ ID NO: 1842783 - RNA, 15 nt, Homo sapiens
gucuauaaacaugaa

SEQ ID NO: 1842784 - RNA, 17 nt, Homo sapiens
uuuuuagaaaucacaac

SEQ ID NO: 1842785 - RNA, 16 nt, Homo sapiens
ugaguuugaacacaga

SEQ ID NO: 1842786 - RNA, 19 nt, Homo sapiens
uagggacugaccagcagcu

SEQ ID NO: 1842787 - RNA, 18 nt, Homo sapiens
acuaucaacacugcagca

SEQ ID NO: 1842788 - RNA, 20 nt, Homo sapiens
guuuaaaaagaaaaaaugca

SEQ ID NO: 1842789 - RNA, 21 nt, Homo sapiens
agucuguguuuaaagugaauu

SEQ ID NO: 1842790 - RNA, 15 nt, Homo sapiens
uccucacuucuagau

SEQ ID NO: 1842791 - RNA, 12 nt, Homo sapiens
caagaagccagc

SEQ ID NO: 1842792 - RNA, 13 nt, Homo sapiens
ccucuccagcuau

SEQ ID NO: 1842793 - RNA, 18 nt, Homo sapiens
gcugcccccacagaucca

SEQ ID NO: 1842794 - RNA, 18 nt, Homo sapiens
uuuuuccaauuagcuccu

SEQ ID NO: 1842795 - RNA, 18 nt, Homo sapiens
uguuaauuauuuugacaa

SEQ ID NO: 1842796 - RNA, 13 nt, Homo sapiens
aucaaagcacuug

SEQ ID NO: 1842797 - RNA, 13 nt, Homo sapiens
cccacagucccau

SEQ ID NO: 1842798 - RNA, 22 nt, Homo sapiens
gguggugcagccccaggaccaa

SEQ ID NO: 1842799 - RNA, 16 nt, Homo sapiens
uggcacucuguaguca

SEQ ID NO: 1842800 - RNA, 18 nt, Homo sapiens
cauguacgauucacuccu

SEQ ID NO: 1842801 - RNA, 22 nt, Homo sapiens
uaaaagaauaaaauugcacuuu

SEQ ID NO: 1842802 - RNA, 12 nt, Homo sapiens
cugagaugucag

SEQ ID NO: 1842803 - RNA, 19 nt, Homo sapiens
acccugccuuaucuugcac

SEQ ID NO: 1842804 - RNA, 13 nt, Homo sapiens
cugcaacacugga

SEQ ID NO: 1842805 - RNA, 21 nt, Homo sapiens
ucacuucccugggaacucauc

SEQ ID NO: 1842806 - RNA, 22 nt, Homo sapiens
aguaaaaagguccucacaggug

SEQ ID NO: 1842807 - RNA, 22 nt, Homo sapiens
auuagcccuuccuugccaguga

SEQ ID NO: 1842808 - RNA, 17 nt, Homo sapiens
ggcaaaaggaauuaaau

SEQ ID NO: 1842809 - RNA, 16 nt, Homo sapiens
uauaaugcuugcaccu

SEQ ID NO: 1842810 - RNA, 15 nt, Homo sapiens
uugucagcaguuccc

SEQ ID NO: 1842811 - RNA, 21 nt, Homo sapiens
agauuuaaaguggcagcuuca

SEQ ID NO: 1842812 - RNA, 23 nt, Homo sapiens
cuccuuuucugugaagcccuuug

SEQ ID NO: 1842813 - RNA, 12 nt, Homo sapiens
caguagacagaa

SEQ ID NO: 1842814 - RNA, 23 nt, Homo sapiens
agaggcuaugaagaaaacagcug

SEQ ID NO: 1842815 - RNA, 22 nt, Homo sapiens
aaugagcauguuugccuagaca

SEQ ID NO: 1842816 - RNA, 19 nt, Homo sapiens
ccagacauuuguuucugua

SEQ ID NO: 1842817 - RNA, 21 nt, Homo sapiens
ucuucuuggggcccagugcau

SEQ ID NO: 1842818 - RNA, 21 nt, Homo sapiens
uucccaacuccucaugucuuc

SEQ ID NO: 1842819 - RNA, 22 nt, Homo sapiens
uguuuauuugugucacaaagaa

SEQ ID NO: 1842820 - RNA, 21 nt, Homo sapiens
gaaucacuuaagccuggaagg

SEQ ID NO: 1842821 - RNA, 19 nt, Homo sapiens
agacuucagaacaugcugg

SEQ ID NO: 1842822 - RNA, 16 nt, Homo sapiens
auauguauuuuuguca

SEQ ID NO: 1842823 - RNA, 19 nt, Homo sapiens
gggcgucaggggugcacag

SEQ ID NO: 1842824 - RNA, 15 nt, Homo sapiens
uuguaaucacuccca

SEQ ID NO: 1842825 - RNA, 13 nt, Homo sapiens
gaauuuuguugcu

SEQ ID NO: 1842826 - RNA, 12 nt, Homo sapiens
acaaaaucacac

SEQ ID NO: 1842827 - RNA, 23 nt, Homo sapiens
acugucaaaaaguuugguucugu

SEQ ID NO: 1842828 - RNA, 12 nt, Homo sapiens
ucagccuuggaa

SEQ ID NO: 1842829 - RNA, 14 nt, Homo sapiens
cccuguauuaccuc

SEQ ID NO: 1842830 - RNA, 19 nt, Homo sapiens
gaccuugcugauggugaca

SEQ ID NO: 1842831 - RNA, 18 nt, Homo sapiens
gcugcaucccccccaccu

SEQ ID NO: 1842832 - RNA, 12 nt, Homo sapiens
cagagugcaagc

SEQ ID NO: 1842833 - RNA, 17 nt, Homo sapiens
ccaauugugguugugca

SEQ ID NO: 1842834 - RNA, 12 nt, Homo sapiens
ugcacuguccag

SEQ ID NO: 1842835 - RNA, 21 nt, Homo sapiens
gcuuucauccagccacugccc

SEQ ID NO: 1842836 - RNA, 23 nt, Homo sapiens
cucugcagucucuauaccaauaa

SEQ ID NO: 1842837 - RNA, 18 nt, Homo sapiens
ugucccaccaacuuaaaa

SEQ ID NO: 1842838 - RNA, 17 nt, Homo sapiens
cugaccuuccagagccc

SEQ ID NO: 1842839 - RNA, 15 nt, Homo sapiens
caccgcagucaccac

SEQ ID NO: 1842840 - RNA, 11 nt, Homo sapiens
ggaagugcuuc

SEQ ID NO: 1842841 - RNA, 22 nt, Homo sapiens
aaaggucaagaacacagugauu

SEQ ID NO: 1842842 - RNA, 19 nt, Homo sapiens
cagagaccucccuguucaa

SEQ ID NO: 1842843 - RNA, 16 nt, Homo sapiens
ccuucacaaucuguca

SEQ ID NO: 1842844 - RNA, 14 nt, Homo sapiens
ccaaccuccugacc

SEQ ID NO: 1842845 - RNA, 14 nt, Homo sapiens
cugguguucuugcu

SEQ ID NO: 1842846 - RNA, 21 nt, Homo sapiens
aacacgugaaggcaaugcuca

SEQ ID NO: 1842847 - RNA, 13 nt, Homo sapiens
aaguaagucuuuu

SEQ ID NO: 1842848 - RNA, 17 nt, Homo sapiens
ccauguuggccaggcug

SEQ ID NO: 1842849 - RNA, 19 nt, Homo sapiens
auucugauauguauccauc

SEQ ID NO: 1842850 - RNA, 23 nt, Homo sapiens
cagcuuuucccaggagaccauuu

SEQ ID NO: 1842851 - RNA, 24 nt, Homo sapiens
ucucuguguaugagugugaaugau

SEQ ID NO: 1842852 - RNA, 18 nt, Homo sapiens
ucaccccacucagcucac

SEQ ID NO: 1842853 - RNA, 20 nt, Homo sapiens
cccuuggggcucccuguguc

SEQ ID NO: 1842854 - RNA, 19 nt, Homo sapiens
ccgaaaaucauauaaucuu

SEQ ID NO: 1842855 - RNA, 19 nt, Homo sapiens
ucaggauuucauugacuga

SEQ ID NO: 1842856 - RNA, 23 nt, Homo sapiens
uuaaaaagaccaugcauucagau

SEQ ID NO: 1842857 - RNA, 14 nt, Homo sapiens
uuaaagaaccaaaa

SEQ ID NO: 1842858 - RNA, 13 nt, Homo sapiens
cagccucaaguca

SEQ ID NO: 1842859 - RNA, 12 nt, Homo sapiens
caccugcugcug

SEQ ID NO: 1842860 - RNA, 15 nt, Homo sapiens
gaauuaaaacagcug

SEQ ID NO: 1842861 - RNA, 14 nt, Homo sapiens
agcccagugcaaac

SEQ ID NO: 1842862 - RNA, 15 nt, Homo sapiens
aggaauaaagacuug

SEQ ID NO: 1842863 - RNA, 17 nt, Homo sapiens
uuaauuuuuccugauga

SEQ ID NO: 1842864 - RNA, 17 nt, Homo sapiens
ccacuuaaaauacauga

SEQ ID NO: 1842865 - RNA, 18 nt, Homo sapiens
uggcucagugccaccuau

SEQ ID NO: 1842866 - RNA, 16 nt, Homo sapiens
aguacauggagcucag

SEQ ID NO: 1842867 - RNA, 17 nt, Homo sapiens
cuggacggaaccacgua

SEQ ID NO: 1842868 - RNA, 16 nt, Homo sapiens
ccauauguagcauuaa

SEQ ID NO: 1842869 - RNA, 12 nt, Homo sapiens
ugcuuaccucac

SEQ ID NO: 1842870 - RNA, 15 nt, Homo sapiens
ggagcccagucugga

SEQ ID NO: 1842871 - RNA, 21 nt, Homo sapiens
acaauuuaguuuuaaggacuu

SEQ ID NO: 1842872 - RNA, 18 nt, Homo sapiens
gauaaaaagaaaugugau

SEQ ID NO: 1842873 - RNA, 18 nt, Homo sapiens
uuaaaauauuaguauaaa

SEQ ID NO: 1842874 - RNA, 16 nt, Homo sapiens
aguucuuuacugguga

SEQ ID NO: 1842875 - RNA, 17 nt, Homo sapiens
gcccuagaugcacgugg

SEQ ID NO: 1842876 - RNA, 17 nt, Homo sapiens
uaaaggcagcugccucu

SEQ ID NO: 1842877 - RNA, 17 nt, Homo sapiens
ccacacagcuaagggag

SEQ ID NO: 1842878 - RNA, 13 nt, Homo sapiens
aggucagggguga

SEQ ID NO: 1842879 - RNA, 15 nt, Homo sapiens
aguaauugauuugac

SEQ ID NO: 1842880 - RNA, 16 nt, Homo sapiens
ugcacacucacuggca

SEQ ID NO: 1842881 - RNA, 17 nt, Homo sapiens
cuggggaguuauaaaaa

SEQ ID NO: 1842882 - RNA, 16 nt, Homo sapiens
uacaugugauugugau

SEQ ID NO: 1842883 - RNA, 13 nt, Homo sapiens
augacgucuucac

SEQ ID NO: 1842884 - RNA, 13 nt, Homo sapiens
uagggcacuuuaa

SEQ ID NO: 1842885 - RNA, 20 nt, Homo sapiens
auaaauguauaggcagaugu

SEQ ID NO: 1842886 - RNA, 14 nt, Homo sapiens
gcuuuguugcccag

SEQ ID NO: 1842887 - RNA, 13 nt, Homo sapiens
ugcaugauguaaa

SEQ ID NO: 1842888 - RNA, 23 nt, Homo sapiens
ucccacugcacccccuccugcug

SEQ ID NO: 1842889 - RNA, 17 nt, Homo sapiens
cuuuagccgacaacaga

SEQ ID NO: 1842890 - RNA, 20 nt, Homo sapiens
accuuacaacucggggacaa

SEQ ID NO: 1842891 - RNA, 21 nt, Homo sapiens
acccuucuuuuaugagcagaa

SEQ ID NO: 1842892 - RNA, 20 nt, Homo sapiens
cuccagaacaaaccucuaua

SEQ ID NO: 1842893 - RNA, 18 nt, Homo sapiens
aaaagccuucccuugccc

SEQ ID NO: 1842894 - RNA, 19 nt, Homo sapiens
augugucccccaacuucau

SEQ ID NO: 1842895 - RNA, 20 nt, Homo sapiens
ccuaaauaaauuauuuguua

SEQ ID NO: 1842896 - RNA, 16 nt, Homo sapiens
caguggggugaucuca

SEQ ID NO: 1842897 - RNA, 13 nt, Homo sapiens
agucagcaaaucu

SEQ ID NO: 1842898 - RNA, 14 nt, Homo sapiens
aauaaaaccgaagg

SEQ ID NO: 1842899 - RNA, 12 nt, Homo sapiens
uuagaugugcaa

SEQ ID NO: 1842900 - RNA, 16 nt, Homo sapiens
auucaagauuggacau

SEQ ID NO: 1842901 - RNA, 21 nt, Homo sapiens
cauucuucccuaaucuuccac

SEQ ID NO: 1842902 - RNA, 23 nt, Homo sapiens
uuaccucuuuaaaaacaaaacaa

SEQ ID NO: 1842903 - RNA, 21 nt, Homo sapiens
cauuugguagaaggacugaac

SEQ ID NO: 1842904 - RNA, 15 nt, Homo sapiens
uaaauguaacagucu

SEQ ID NO: 1842905 - RNA, 19 nt, Homo sapiens
gggaaccucacucuugcca

SEQ ID NO: 1842906 - RNA, 14 nt, Homo sapiens
aguuauucucuaag

SEQ ID NO: 1842907 - RNA, 15 nt, Homo sapiens
uccauucagucugca

SEQ ID NO: 1842908 - RNA, 17 nt, Homo sapiens
accucacuguccuguga

SEQ ID NO: 1842909 - RNA, 12 nt, Homo sapiens
caaguucauuca

SEQ ID NO: 1842910 - RNA, 23 nt, Homo sapiens
aagaaaacccgacaacauuucug

SEQ ID NO: 1842911 - RNA, 14 nt, Homo sapiens
guccugagucugcc

SEQ ID NO: 1842912 - RNA, 20 nt, Homo sapiens
gaaacaguuccauucaacug

SEQ ID NO: 1842913 - RNA, 15 nt, Homo sapiens
aaauauuugcucaau

SEQ ID NO: 1842914 - RNA, 21 nt, Homo sapiens
accugaauaagggacuuugga

SEQ ID NO: 1842915 - RNA, 21 nt, Homo sapiens
ucauaucuuaauauauuucua

SEQ ID NO: 1842916 - RNA, 23 nt, Homo sapiens
cuaauagagucacagcuuuccca

SEQ ID NO: 1842917 - RNA, 14 nt, Homo sapiens
ccacauaccuggcc

SEQ ID NO: 1842918 - RNA, 17 nt, Homo sapiens
caaaugauuuacacuga

SEQ ID NO: 1842919 - RNA, 15 nt, Homo sapiens
ugaaccgugugcucc

SEQ ID NO: 1842920 - RNA, 19 nt, Homo sapiens
uagcagggauguuccuuac

SEQ ID NO: 1842921 - RNA, 14 nt, Homo sapiens
cuacaccucugauu

SEQ ID NO: 1842922 - RNA, 16 nt, Homo sapiens
guuauuggaaggcaag

SEQ ID NO: 1842923 - RNA, 17 nt, Homo sapiens
cuagaaacacacauuuc

SEQ ID NO: 1842924 - RNA, 18 nt, Homo sapiens
accaauggguuugccaag

SEQ ID NO: 1842925 - RNA, 19 nt, Homo sapiens
gcucacuuaaacaaugucc

SEQ ID NO: 1842926 - RNA, 18 nt, Homo sapiens
auauucccacagcacuaa

SEQ ID NO: 1842927 - RNA, 16 nt, Homo sapiens
uaaagcugcugucacu

SEQ ID NO: 1842928 - RNA, 23 nt, Homo sapiens
cuuuauuuguauuugccauucag

SEQ ID NO: 1842929 - RNA, 16 nt, Homo sapiens
augcccuaauccaucu

SEQ ID NO: 1842930 - RNA, 23 nt, Homo sapiens
aggcugauuuauggucagaauuu

SEQ ID NO: 1842931 - RNA, 23 nt, Homo sapiens
agugcaguggcgcgaucucagcu

SEQ ID NO: 1842932 - RNA, 16 nt, Homo sapiens
cacgcggaugcuacua

SEQ ID NO: 1842933 - RNA, 17 nt, Homo sapiens
caacuuauuuugcuuua

SEQ ID NO: 1842934 - RNA, 21 nt, Homo sapiens
gacuccucuuaauguuuccaa

SEQ ID NO: 1842935 - RNA, 17 nt, Homo sapiens
accgggcuacuaccugg

SEQ ID NO: 1842936 - RNA, 18 nt, Homo sapiens
acacucgccuacuaagua

SEQ ID NO: 1842937 - RNA, 16 nt, Homo sapiens
ugucagucacagccac

SEQ ID NO: 1842938 - RNA, 17 nt, Homo sapiens
aaaauuauggcauauau

SEQ ID NO: 1842939 - RNA, 22 nt, Homo sapiens
acuauguugccuaagcuggucu

SEQ ID NO: 1842940 - RNA, 19 nt, Homo sapiens
auaaaacaugggaaucucc

SEQ ID NO: 1842941 - RNA, 14 nt, Homo sapiens
uggaauaggaauaa

SEQ ID NO: 1842942 - RNA, 14 nt, Homo sapiens
agaaaaagaagaac

SEQ ID NO: 1842943 - RNA, 18 nt, Homo sapiens
aucaagagaguaaacaga

SEQ ID NO: 1842944 - RNA, 18 nt, Homo sapiens
gaaagauccacccucaaa

SEQ ID NO: 1842945 - RNA, 15 nt, Homo sapiens
caugaccacuuuccc

SEQ ID NO: 1842946 - RNA, 16 nt, Homo sapiens
uguucuaugaacaacu

SEQ ID NO: 1842947 - RNA, 15 nt, Homo sapiens
uagacacuggcugcc

SEQ ID NO: 1842948 - RNA, 16 nt, Homo sapiens
cuuaaagcauuucagg

SEQ ID NO: 1842949 - RNA, 15 nt, Homo sapiens
acccugccagacuga

SEQ ID NO: 1842950 - RNA, 18 nt, Homo sapiens
uauccccaccuacuccug

SEQ ID NO: 1842951 - RNA, 16 nt, Homo sapiens
ccaggauuacuaguca

SEQ ID NO: 1842952 - RNA, 21 nt, Homo sapiens
caugaaaaguuauuuaugcua

SEQ ID NO: 1842953 - RNA, 20 nt, Homo sapiens
ugcauaauucuugaugguaa

SEQ ID NO: 1842954 - RNA, 14 nt, Homo sapiens
uagcuguauucaua

SEQ ID NO: 1842955 - RNA, 19 nt, Homo sapiens
ucugacucccaaagagcug

SEQ ID NO: 1842956 - RNA, 17 nt, Homo sapiens
cccucuggguuccagca

SEQ ID NO: 1842957 - RNA, 17 nt, Homo sapiens
ggcuuccuucauuuccu

SEQ ID NO: 1842958 - RNA, 20 nt, Homo sapiens
agagauucugccucagccuc

SEQ ID NO: 1842959 - RNA, 18 nt, Homo sapiens
uuuucaaauaggaugcau

SEQ ID NO: 1842960 - RNA, 13 nt, Homo sapiens
ucugcccuugcca

SEQ ID NO: 1842961 - RNA, 18 nt, Homo sapiens
agacauuuucacuggaag

SEQ ID NO: 1842962 - RNA, 21 nt, Homo sapiens
ugggaggaugaaggagugcgu

SEQ ID NO: 1842963 - RNA, 16 nt, Homo sapiens
acaggaggacaauuca

SEQ ID NO: 1842964 - RNA, 20 nt, Homo sapiens
aauauuuauacauacaagau

SEQ ID NO: 1842965 - RNA, 20 nt, Homo sapiens
ccaacugcauugguuuucca

SEQ ID NO: 1842966 - RNA, 21 nt, Homo sapiens
gaaugaaguggaggaaguaac

SEQ ID NO: 1842967 - RNA, 17 nt, Homo sapiens
cagaguaugagugcaag

SEQ ID NO: 1842968 - RNA, 15 nt, Homo sapiens
ggauuccagcauuug

SEQ ID NO: 1842969 - RNA, 14 nt, Homo sapiens
cagggcccuguggc

SEQ ID NO: 1842970 - RNA, 23 nt, Homo sapiens
agaaacauuuuuuaaguaggcau

SEQ ID NO: 1842971 - RNA, 20 nt, Homo sapiens
aaggcagugauuagcacuug

SEQ ID NO: 1842972 - RNA, 20 nt, Homo sapiens
agccuggagccccuguguug

SEQ ID NO: 1842973 - RNA, 14 nt, Homo sapiens
uuguuuugccacuu

SEQ ID NO: 1842974 - RNA, 19 nt, Homo sapiens
ccagggucuuuacugggaa

SEQ ID NO: 1842975 - RNA, 22 nt, Homo sapiens
agccuuguguuuggucaugugg

SEQ ID NO: 1842976 - RNA, 17 nt, Homo sapiens
uuaucagaauucucaga

SEQ ID NO: 1842977 - RNA, 22 nt, Homo sapiens
uuccacugauggaaacaaagug

SEQ ID NO: 1842978 - RNA, 12 nt, Homo sapiens
agucuaccucuu

SEQ ID NO: 1842979 - RNA, 16 nt, Homo sapiens
accaaaucucaguggc

SEQ ID NO: 1842980 - RNA, 20 nt, Homo sapiens
cacaugcccuaaugucugua

SEQ ID NO: 1842981 - RNA, 12 nt, Homo sapiens
cuauuuucacaa

SEQ ID NO: 1842982 - RNA, 14 nt, Homo sapiens
aagcauuacuuuau

SEQ ID NO: 1842983 - RNA, 14 nt, Homo sapiens
uccacaguugucag

SEQ ID NO: 1842984 - RNA, 13 nt, Homo sapiens
gccuggacugcua

SEQ ID NO: 1842985 - RNA, 22 nt, Homo sapiens
gguaguuuagaucccaugucac

SEQ ID NO: 1842986 - RNA, 14 nt, Homo sapiens
ccuuagacacuuug

SEQ ID NO: 1842987 - RNA, 14 nt, Homo sapiens
caaaugacaaaaag

SEQ ID NO: 1842988 - RNA, 14 nt, Homo sapiens
aauauaaccauaaa

SEQ ID NO: 1842989 - RNA, 18 nt, Homo sapiens
caagauucuuccuuuuaa

SEQ ID NO: 1842990 - RNA, 16 nt, Homo sapiens
cacagucaauucugau

SEQ ID NO: 1842991 - RNA, 14 nt, Homo sapiens
aaagaugagcuuuu

SEQ ID NO: 1842992 - RNA, 15 nt, Homo sapiens
gguguauugaagucc

SEQ ID NO: 1842993 - RNA, 15 nt, Homo sapiens
agaggggcuguccau

SEQ ID NO: 1842994 - RNA, 22 nt, Homo sapiens
uuguaagaaauauauuugauaa

SEQ ID NO: 1842995 - RNA, 23 nt, Homo sapiens
cacccccuucucugcccauuccc

SEQ ID NO: 1842996 - RNA, 19 nt, Homo sapiens
cauuguuucguaacacagc

SEQ ID NO: 1842997 - RNA, 19 nt, Homo sapiens
acuagugacacauuguaca

SEQ ID NO: 1842998 - RNA, 24 nt, Homo sapiens
aacacucaguggcccauggcauuu

SEQ ID NO: 1842999 - RNA, 21 nt, Homo sapiens
uccuaaguuaccuuucuaggu

SEQ ID NO: 1843000 - RNA, 20 nt, Homo sapiens
cugcauaucauaaugggggu

SEQ ID NO: 1843001 - RNA, 22 nt, Homo sapiens
gcaaugugggaucucagaccca

SEQ ID NO: 1843002 - RNA, 23 nt, Homo sapiens
auucagguauguugccuuuaugg

SEQ ID NO: 1843003 - RNA, 13 nt, Homo sapiens
agcauguacucug

SEQ ID NO: 1843004 - RNA, 12 nt, Homo sapiens
ccucuccaaaga

SEQ ID NO: 1843005 - RNA, 17 nt, Homo sapiens
uuaucuguuuccugaca

SEQ ID NO: 1843006 - RNA, 20 nt, Homo sapiens
aaugugugggccgcaugcau

SEQ ID NO: 1843007 - RNA, 16 nt, Homo sapiens
cccuggaugguggcca

SEQ ID NO: 1843008 - RNA, 21 nt, Homo sapiens
uaucaaauauuagaugugauu

SEQ ID NO: 1843009 - RNA, 16 nt, Homo sapiens
aucaaucuuauuacug

SEQ ID NO: 1843010 - RNA, 13 nt, Homo sapiens
uccaaguguauaa

SEQ ID NO: 1843011 - RNA, 21 nt, Homo sapiens
cuaggugagaacccuugcacu

SEQ ID NO: 1843012 - RNA, 14 nt, Homo sapiens
cuguuaaaaugcau

SEQ ID NO: 1843013 - RNA, 21 nt, Homo sapiens
agcaaauaaacuguaagucau

SEQ ID NO: 1843014 - RNA, 17 nt, Homo sapiens
ccaacaaccccagcuuc

SEQ ID NO: 1843015 - RNA, 23 nt, Homo sapiens
ccacaucacuacaguacagugag

SEQ ID NO: 1843016 - RNA, 20 nt, Homo sapiens
ucccagcugcagaugccaca

SEQ ID NO: 1843017 - RNA, 18 nt, Homo sapiens
aaaguaacagccuuucaa

SEQ ID NO: 1843018 - RNA, 18 nt, Homo sapiens
augaacuuggauauucaa

SEQ ID NO: 1843019 - RNA, 16 nt, Homo sapiens
aaguuuaaaaaaccau

SEQ ID NO: 1843020 - RNA, 15 nt, Homo sapiens
ucugcaaacuaagga

SEQ ID NO: 1843021 - RNA, 20 nt, Homo sapiens
ugggguuguucaccucugua

SEQ ID NO: 1843022 - RNA, 23 nt, Homo sapiens
aggccaguauaaagggacuugaa

SEQ ID NO: 1843023 - RNA, 19 nt, Homo sapiens
acauuuguaaaaauacugu

SEQ ID NO: 1843024 - RNA, 14 nt, Homo sapiens
ugauacaacauuaa

SEQ ID NO: 1843025 - RNA, 16 nt, Homo sapiens
uuugaucuucaacaaa

SEQ ID NO: 1843026 - RNA, 17 nt, Homo sapiens
augaaguacucauacau

SEQ ID NO: 1843027 - RNA, 23 nt, Homo sapiens
uucucucugugguggagaaccac

SEQ ID NO: 1843028 - RNA, 16 nt, Homo sapiens
ccccucccugugugaa

SEQ ID NO: 1843029 - RNA, 13 nt, Homo sapiens
aaaagggcuuucu

SEQ ID NO: 1843030 - RNA, 12 nt, Homo sapiens
cagagagaauca

SEQ ID NO: 1843031 - RNA, 13 nt, Homo sapiens
cuagcagcaccgu

SEQ ID NO: 1843032 - RNA, 11 nt, Homo sapiens
ugcagcuguca

SEQ ID NO: 1843033 - RNA, 11 nt, Homo sapiens
uugacauugcg

SEQ ID NO: 1843034 - RNA, 13 nt, Homo sapiens
aaugcucaccucu

SEQ ID NO: 1843035 - RNA, 20 nt, Homo sapiens
aaagcacuguuuaacuggga

SEQ ID NO: 1843036 - RNA, 19 nt, Homo sapiens
caaauuuggggguuucuca

SEQ ID NO: 1843037 - RNA, 16 nt, Homo sapiens
agcaggguugccuuuu

SEQ ID NO: 1843038 - RNA, 24 nt, Homo sapiens
ggcuuuaaaacuuauccuccauga

SEQ ID NO: 1843039 - RNA, 14 nt, Homo sapiens
caauauuauacuga

SEQ ID NO: 1843040 - RNA, 21 nt, Homo sapiens
uauuuucagccuacaguuaug

SEQ ID NO: 1843041 - RNA, 21 nt, Homo sapiens
caaaggaaccgcccagugcag

SEQ ID NO: 1843042 - RNA, 18 nt, Homo sapiens
cuggggcucucugagacu

SEQ ID NO: 1843043 - RNA, 22 nt, Homo sapiens
cacaugggggucgcugcccuuc

SEQ ID NO: 1843044 - RNA, 15 nt, Homo sapiens
gaagaauggccauuu

SEQ ID NO: 1843045 - RNA, 20 nt, Homo sapiens
ccacacccgugugguaccuu

SEQ ID NO: 1843046 - RNA, 20 nt, Homo sapiens
acuucacuuauuagucuuag

SEQ ID NO: 1843047 - RNA, 17 nt, Homo sapiens
cacaagaccaucuacau

SEQ ID NO: 1843048 - RNA, 22 nt, Homo sapiens
uuagccaggaccugccaaugau

SEQ ID NO: 1843049 - RNA, 23 nt, Homo sapiens
cauaucuguuuauucugggaaau

SEQ ID NO: 1843050 - RNA, 16 nt, Homo sapiens
ucacugucaucugcca

SEQ ID NO: 1843051 - RNA, 21 nt, Homo sapiens
aauauuccacuauuugcagag

SEQ ID NO: 1843052 - RNA, 14 nt, Homo sapiens
cccucucuugcacc

SEQ ID NO: 1843053 - RNA, 18 nt, Homo sapiens
gcauguucugugacugaa

SEQ ID NO: 1843054 - RNA, 17 nt, Homo sapiens
ucagacucccgcgugaa

SEQ ID NO: 1843055 - RNA, 15 nt, Homo sapiens
acacuacaaguuuau

SEQ ID NO: 1843056 - RNA, 11 nt, Homo sapiens
agugggagaag

SEQ ID NO: 1843057 - RNA, 13 nt, Homo sapiens
caauacagaucau

SEQ ID NO: 1843058 - RNA, 23 nt, Homo sapiens
aaauucuuaacuuuuaacauaau

SEQ ID NO: 1843059 - RNA, 22 nt, Homo sapiens
cccaucuuacuggaagagaguu

SEQ ID NO: 1843060 - RNA, 17 nt, Homo sapiens
ugggguagagaggacag

SEQ ID NO: 1843061 - RNA, 22 nt, Homo sapiens
agggcggggugucugucuuccu

SEQ ID NO: 1843062 - RNA, 18 nt, Homo sapiens
guuucauaucuggucaag

SEQ ID NO: 1843063 - RNA, 17 nt, Homo sapiens
cggucccacacugguga

SEQ ID NO: 1843064 - RNA, 20 nt, Homo sapiens
aauuguuaugaucuacucau

SEQ ID NO: 1843065 - RNA, 14 nt, Homo sapiens
caguagaaagcuaa

SEQ ID NO: 1843066 - RNA, 14 nt, Homo sapiens
agcaggaacagaga

SEQ ID NO: 1843067 - RNA, 12 nt, Homo sapiens
guuuaugaauga

SEQ ID NO: 1843068 - RNA, 15 nt, Homo sapiens
gucucugccucccuc

SEQ ID NO: 1843069 - RNA, 15 nt, Homo sapiens
gacccugccacucuc

SEQ ID NO: 1843070 - RNA, 15 nt, Homo sapiens
aaagugcuuuccaug

SEQ ID NO: 1843071 - RNA, 14 nt, Homo sapiens
acugcacaucaugu

SEQ ID NO: 1843072 - RNA, 14 nt, Homo sapiens
aagucuccuuuugu

SEQ ID NO: 1843073 - RNA, 22 nt, Homo sapiens
uagaagcuaauaaauaaucauc

SEQ ID NO: 1843074 - RNA, 21 nt, Homo sapiens
aggaacccaucacugugucuc

SEQ ID NO: 1843075 - RNA, 18 nt, Homo sapiens
caguaaacuaaggguguc

SEQ ID NO: 1843076 - RNA, 17 nt, Homo sapiens
uccagcuugccagaugc

SEQ ID NO: 1843077 - RNA, 13 nt, Homo sapiens
ucucuuugagaga

SEQ ID NO: 1843078 - RNA, 22 nt, Homo sapiens
accaacugcugcugugcacauu

SEQ ID NO: 1843079 - RNA, 23 nt, Homo sapiens
ugagaccuacugggcugcauucc

SEQ ID NO: 1843080 - RNA, 16 nt, Homo sapiens
ugugguuacaguuuga

SEQ ID NO: 1843081 - RNA, 22 nt, Homo sapiens
cuugaagaauguugauggugcu

SEQ ID NO: 1843082 - RNA, 14 nt, Homo sapiens
gguagcgagcugcu

SEQ ID NO: 1843083 - RNA, 21 nt, Homo sapiens
ucauuguuuugcaaaagugua

SEQ ID NO: 1843084 - RNA, 17 nt, Homo sapiens
gcgcuguucuugcucca

SEQ ID NO: 1843085 - RNA, 21 nt, Homo sapiens
uuaaaaucuggcaaaguuaua

SEQ ID NO: 1843086 - RNA, 14 nt, Homo sapiens
agauuucauucuca

SEQ ID NO: 1843087 - RNA, 17 nt, Homo sapiens
uagagccuuugaucuuc

SEQ ID NO: 1843088 - RNA, 14 nt, Homo sapiens
guuucaccauacuu

SEQ ID NO: 1843089 - RNA, 22 nt, Homo sapiens
guccuuguauaaggagcuuugc

SEQ ID NO: 1843090 - RNA, 18 nt, Homo sapiens
caugaccagaaacaggga

SEQ ID NO: 1843091 - RNA, 16 nt, Homo sapiens
uuguuucaagaauuua

SEQ ID NO: 1843092 - RNA, 22 nt, Homo sapiens
agaaauuaggagugcugauaag

SEQ ID NO: 1843093 - RNA, 20 nt, Homo sapiens
cugucacacuaaacuucuua

SEQ ID NO: 1843094 - RNA, 22 nt, Homo sapiens
caacuuagaaaccaaauuacaa

SEQ ID NO: 1843095 - RNA, 14 nt, Homo sapiens
ccaaacuacuucau

SEQ ID NO: 1843096 - RNA, 21 nt, Homo sapiens
caagauacugcuacuguaauu

SEQ ID NO: 1843097 - RNA, 18 nt, Homo sapiens
uaaugaauacauuuccaa

SEQ ID NO: 1843098 - RNA, 20 nt, Homo sapiens
uaugcaaagaugaacccgag

SEQ ID NO: 1843099 - RNA, 16 nt, Homo sapiens
cucaaaugacccaaag

SEQ ID NO: 1843100 - RNA, 20 nt, Homo sapiens
acucugugguccagagucaa

SEQ ID NO: 1843101 - RNA, 18 nt, Homo sapiens
gcugcguugacuacugcu

SEQ ID NO: 1843102 - RNA, 20 nt, Homo sapiens
gcaaacacaccgaugcacac

SEQ ID NO: 1843103 - RNA, 15 nt, Homo sapiens
ucuggccccugagag

SEQ ID NO: 1843104 - RNA, 15 nt, Homo sapiens
uuagcuuucagauua

SEQ ID NO: 1843105 - RNA, 13 nt, Homo sapiens
gagcaaauggaac

SEQ ID NO: 1843106 - RNA, 19 nt, Homo sapiens
augaaguuuaaagauucua

SEQ ID NO: 1843107 - RNA, 17 nt, Homo sapiens
auaguaugaaugcagug

SEQ ID NO: 1843108 - RNA, 15 nt, Homo sapiens
augugaaaauguauc

SEQ ID NO: 1843109 - RNA, 17 nt, Homo sapiens
accaagcauguuucaca

SEQ ID NO: 1843110 - RNA, 17 nt, Homo sapiens
cuaauagcccaagaaug

SEQ ID NO: 1843111 - RNA, 17 nt, Homo sapiens
uuauauauuaugugaag

SEQ ID NO: 1843112 - RNA, 20 nt, Homo sapiens
gcuuagacuucgacucagga

SEQ ID NO: 1843113 - RNA, 22 nt, Homo sapiens
ccuggagaugcagcuacuggaa

SEQ ID NO: 1843114 - RNA, 21 nt, Homo sapiens
uuuguagcuggggcuuugaug

SEQ ID NO: 1843115 - RNA, 12 nt, Homo sapiens
agaacaaaugug

SEQ ID NO: 1843116 - RNA, 16 nt, Homo sapiens
agucugcagauagaaa

SEQ ID NO: 1843117 - RNA, 16 nt, Homo sapiens
aaucuggacacacugu

SEQ ID NO: 1843118 - RNA, 12 nt, Homo sapiens
agcaugugaugu

SEQ ID NO: 1843119 - RNA, 23 nt, Homo sapiens
ucuauacuagggacuggaucuca

SEQ ID NO: 1843120 - RNA, 17 nt, Homo sapiens
uguccauguauucacac

SEQ ID NO: 1843121 - RNA, 15 nt, Homo sapiens
caacaaccccagcuu

SEQ ID NO: 1843122 - RNA, 13 nt, Homo sapiens
cuguucauggcac

SEQ ID NO: 1843123 - RNA, 17 nt, Homo sapiens
aucacgucagugcucag

SEQ ID NO: 1843124 - RNA, 16 nt, Homo sapiens
aagcuguggugugaaa

SEQ ID NO: 1843125 - RNA, 16 nt, Homo sapiens
gaguuaaaacauuucu

SEQ ID NO: 1843126 - RNA, 12 nt, Homo sapiens
auaaaucaucuu

SEQ ID NO: 1843127 - RNA, 14 nt, Homo sapiens
uuuuagacuaacuu

SEQ ID NO: 1843128 - RNA, 20 nt, Homo sapiens
guugauucauauugcaucau

SEQ ID NO: 1843129 - RNA, 14 nt, Homo sapiens
gcucgcccaggaag

SEQ ID NO: 1843130 - RNA, 18 nt, Homo sapiens
ucuccuuccacaaugacu

SEQ ID NO: 1843131 - RNA, 21 nt, Homo sapiens
auaaguaacacuaguagcugu

SEQ ID NO: 1843132 - RNA, 18 nt, Homo sapiens
auuaugagacacaggaug

SEQ ID NO: 1843133 - RNA, 19 nt, Homo sapiens
uaaaaugcuacuuaacaaa

SEQ ID NO: 1843134 - RNA, 12 nt, Homo sapiens
auaauaucccac

SEQ ID NO: 1843135 - RNA, 19 nt, Homo sapiens
aagcuuugaggcucuguca

SEQ ID NO: 1843136 - RNA, 19 nt, Homo sapiens
uccuccauuacucuauuga

SEQ ID NO: 1843137 - RNA, 15 nt, Homo sapiens
cuggcccugccguuu

SEQ ID NO: 1843138 - RNA, 18 nt, Homo sapiens
augcucucucaccugcuc

SEQ ID NO: 1843139 - RNA, 20 nt, Homo sapiens
agggugugggccaccagaga

SEQ ID NO: 1843140 - RNA, 12 nt, Homo sapiens
uaauucagccau

SEQ ID NO: 1843141 - RNA, 13 nt, Homo sapiens
gacucacuguggg

SEQ ID NO: 1843142 - RNA, 22 nt, Homo sapiens
cacugucuuuaaaagucauuca

SEQ ID NO: 1843143 - RNA, 17 nt, Homo sapiens
uccugagugcuugcuuu

SEQ ID NO: 1843144 - RNA, 21 nt, Homo sapiens
guguugaggggaccaaagcca

SEQ ID NO: 1843145 - RNA, 23 nt, Homo sapiens
cucccugucugugucccagccac

SEQ ID NO: 1843146 - RNA, 14 nt, Homo sapiens
aguaguaaucucac

SEQ ID NO: 1843147 - RNA, 23 nt, Homo sapiens
ucaguaggcaucaguaugucacu

SEQ ID NO: 1843148 - RNA, 20 nt, Homo sapiens
gggccucugccccucccaac

SEQ ID NO: 1843149 - RNA, 17 nt, Homo sapiens
cugagacuaaguuguag

SEQ ID NO: 1843150 - RNA, 21 nt, Homo sapiens
gugcauagaauucuagcuuuu

SEQ ID NO: 1843151 - RNA, 20 nt, Homo sapiens
ucacuuuucaauuugucaug

SEQ ID NO: 1843152 - RNA, 22 nt, Homo sapiens
uuggagaaccagggcucuucuc

SEQ ID NO: 1843153 - RNA, 20 nt, Homo sapiens
gauugauuuuuuuucuuuaa

SEQ ID NO: 1843154 - RNA, 16 nt, Homo sapiens
ucugccuuuguucacu

SEQ ID NO: 1843155 - RNA, 22 nt, Homo sapiens
cuaaccucuaccagcacauuaa

SEQ ID NO: 1843156 - RNA, 20 nt, Homo sapiens
uuuaucaaggagauauauca

SEQ ID NO: 1843157 - RNA, 21 nt, Homo sapiens
aggguaccuugaacacugggg

SEQ ID NO: 1843158 - RNA, 17 nt, Homo sapiens
uauuaccagauucacuu

SEQ ID NO: 1843159 - RNA, 18 nt, Homo sapiens
ccucacccaucaaaagca

SEQ ID NO: 1843160 - RNA, 18 nt, Homo sapiens
gacggguugaaagacauc

SEQ ID NO: 1843161 - RNA, 16 nt, Homo sapiens
cuucuaaucugcuaug

SEQ ID NO: 1843162 - RNA, 19 nt, Homo sapiens
cauuuggaaugaauacagc

SEQ ID NO: 1843163 - RNA, 19 nt, Homo sapiens
guuuuccuaguauacccac

SEQ ID NO: 1843164 - RNA, 20 nt, Homo sapiens
aagaugauuucaguucauca

SEQ ID NO: 1843165 - RNA, 14 nt, Homo sapiens
ggccuuacuguaua

SEQ ID NO: 1843166 - RNA, 20 nt, Homo sapiens
gccccgucuguggcuuucag

SEQ ID NO: 1843167 - RNA, 21 nt, Homo sapiens
uaggagcccuagggccuggaa

SEQ ID NO: 1843168 - RNA, 23 nt, Homo sapiens
gaaucaggauuccuucuucccca

SEQ ID NO: 1843169 - RNA, 23 nt, Homo sapiens
guuuaucguauuugaugcuacag

SEQ ID NO: 1843170 - RNA, 16 nt, Homo sapiens
aauaauuguccaugag

SEQ ID NO: 1843171 - RNA, 22 nt, Homo sapiens
ugauaaaacugguuuuagacaa

SEQ ID NO: 1843172 - RNA, 17 nt, Homo sapiens
caaaacaaaauguuaug

SEQ ID NO: 1843173 - RNA, 17 nt, Homo sapiens
gcaguuagcucauuuga

SEQ ID NO: 1843174 - RNA, 21 nt, Homo sapiens
aaaaugugaguaguacaauga

SEQ ID NO: 1843175 - RNA, 15 nt, Homo sapiens
aauuuccaguaccuu

SEQ ID NO: 1843176 - RNA, 21 nt, Homo sapiens
guuaaugugauggauggcaca

SEQ ID NO: 1843177 - RNA, 23 nt, Homo sapiens
cauacaaacaaugcaaccaacua

SEQ ID NO: 1843178 - RNA, 23 nt, Homo sapiens
uacugcuuucaacuuaaaucacu

SEQ ID NO: 1843179 - RNA, 17 nt, Homo sapiens
ucccugaacugggaccu

SEQ ID NO: 1843180 - RNA, 23 nt, Homo sapiens
uaccaguucagacacuaccccau

SEQ ID NO: 1843181 - RNA, 15 nt, Homo sapiens
cucccagcauaggau

SEQ ID NO: 1843182 - RNA, 18 nt, Homo sapiens
guccacaagaacaauuca

SEQ ID NO: 1843183 - RNA, 22 nt, Homo sapiens
ugcucaagcccccagcuggaag

SEQ ID NO: 1843184 - RNA, 17 nt, Homo sapiens
uggcuccaggacagacc

SEQ ID NO: 1843185 - RNA, 14 nt, Homo sapiens
caugaucaucacaa

SEQ ID NO: 1843186 - RNA, 17 nt, Homo sapiens
cugcuucuccucccagc

SEQ ID NO: 1843187 - RNA, 19 nt, Homo sapiens
ggcuuuguggaaacagcug

SEQ ID NO: 1843188 - RNA, 16 nt, Homo sapiens
aaucuccaucucaaaa

SEQ ID NO: 1843189 - RNA, 18 nt, Homo sapiens
uuggauuauucauuuaaa

SEQ ID NO: 1843190 - RNA, 17 nt, Homo sapiens
uaugugcagcuuuccag

SEQ ID NO: 1843191 - RNA, 23 nt, Homo sapiens
ggcucagguuuugagaagccauc

SEQ ID NO: 1843192 - RNA, 13 nt, Homo sapiens
acgaucucagcuc

SEQ ID NO: 1843193 - RNA, 15 nt, Homo sapiens
uaaaauauuacugua

SEQ ID NO: 1843194 - RNA, 14 nt, Homo sapiens
acucaucugucacc

SEQ ID NO: 1843195 - RNA, 21 nt, Homo sapiens
ccugggaaggcuaaguucagu

SEQ ID NO: 1843196 - RNA, 17 nt, Homo sapiens
auucuuguagaugcauu

SEQ ID NO: 1843197 - RNA, 20 nt, Homo sapiens
ccugaggguggagacuaagc

SEQ ID NO: 1843198 - RNA, 12 nt, Homo sapiens
gacacaugccag

SEQ ID NO: 1843199 - RNA, 19 nt, Homo sapiens
ugacaucuacgaagccaca

SEQ ID NO: 1843200 - RNA, 13 nt, Homo sapiens
aaaucaagugcac

SEQ ID NO: 1843201 - RNA, 22 nt, Homo sapiens
cuucugaaacuggaguaucauu

SEQ ID NO: 1843202 - RNA, 18 nt, Homo sapiens
guggucacagaugcacaa

SEQ ID NO: 1843203 - RNA, 13 nt, Homo sapiens
ucucuacccagua

SEQ ID NO: 1843204 - RNA, 17 nt, Homo sapiens
cuguuccccugcucugu

SEQ ID NO: 1843205 - RNA, 12 nt, Homo sapiens
uagagaaaaccu

SEQ ID NO: 1843206 - RNA, 16 nt, Homo sapiens
uugugaacagccaaaa

SEQ ID NO: 1843207 - RNA, 14 nt, Homo sapiens
uuuuaaaguuuguu

SEQ ID NO: 1843208 - RNA, 22 nt, Homo sapiens
acagcuucggccuccacaucgu

SEQ ID NO: 1843209 - RNA, 16 nt, Homo sapiens
gaaacucuacauuuaa

SEQ ID NO: 1843210 - RNA, 14 nt, Homo sapiens
gcugcuccauggau

SEQ ID NO: 1843211 - RNA, 15 nt, Homo sapiens
aaccacacuucuuga

SEQ ID NO: 1843212 - RNA, 12 nt, Homo sapiens
gccaaucuccag

SEQ ID NO: 1843213 - RNA, 18 nt, Homo sapiens
ucuguguuuuauugacau

SEQ ID NO: 1843214 - RNA, 18 nt, Homo sapiens
aagugguuaaaacauagc

SEQ ID NO: 1843215 - RNA, 20 nt, Homo sapiens
aaaccaccccauuaaaaagu

SEQ ID NO: 1843216 - RNA, 12 nt, Homo sapiens
aggucaccagcu

SEQ ID NO: 1843217 - RNA, 17 nt, Homo sapiens
uccugaagaucaagcca

SEQ ID NO: 1843218 - RNA, 17 nt, Homo sapiens
augcaguuuucauauau

SEQ ID NO: 1843219 - RNA, 15 nt, Homo sapiens
uggguuuggcuuguu

SEQ ID NO: 1843220 - RNA, 19 nt, Homo sapiens
caccaaaaacacagugaaa

SEQ ID NO: 1843221 - RNA, 14 nt, Homo sapiens
aucuaaacaaugua

SEQ ID NO: 1843222 - RNA, 17 nt, Homo sapiens
uggggacccccucagga

SEQ ID NO: 1843223 - RNA, 13 nt, Homo sapiens
uaugauuucucaa

SEQ ID NO: 1843224 - RNA, 15 nt, Homo sapiens
cuuggagcaaucaga

SEQ ID NO: 1843225 - RNA, 22 nt, Homo sapiens
cauaaccucuggggaccccaac

SEQ ID NO: 1843226 - RNA, 15 nt, Homo sapiens
gcuugauaaacauaa

SEQ ID NO: 1843227 - RNA, 18 nt, Homo sapiens
caucuaguaggugcuuga

SEQ ID NO: 1843228 - RNA, 20 nt, Homo sapiens
aucccgccagggagugugau

SEQ ID NO: 1843229 - RNA, 14 nt, Homo sapiens
gucaucuugcacac

SEQ ID NO: 1843230 - RNA, 19 nt, Homo sapiens
gcuuuucuuuuuuaauuuc

SEQ ID NO: 1843231 - RNA, 13 nt, Homo sapiens
accaggucucaua

SEQ ID NO: 1843232 - RNA, 23 nt, Homo sapiens
cuguugagguggcuguagauggu

SEQ ID NO: 1843233 - RNA, 16 nt, Homo sapiens
guucuuuuuguuuaca

SEQ ID NO: 1843234 - RNA, 23 nt, Homo sapiens
cuaaauggugcugcagauuugau

SEQ ID NO: 1843235 - RNA, 17 nt, Homo sapiens
gacagcuuugcugcuga

SEQ ID NO: 1843236 - RNA, 16 nt, Homo sapiens
gugcugccgagggcug

SEQ ID NO: 1843237 - RNA, 14 nt, Homo sapiens
ccuacggagucagc

SEQ ID NO: 1843238 - RNA, 17 nt, Homo sapiens
aggcaagcuaacugcuu

SEQ ID NO: 1843239 - RNA, 22 nt, Homo sapiens
cagggagcucuggggacagcuu

SEQ ID NO: 1843240 - RNA, 22 nt, Homo sapiens
ggccugggugugugugagcuca

SEQ ID NO: 1843241 - RNA, 11 nt, Homo sapiens
ccagugacaca

SEQ ID NO: 1843242 - RNA, 11 nt, Homo sapiens
ccugugacacu

SEQ ID NO: 1843243 - RNA, 12 nt, Homo sapiens
ugaaaugcauau

SEQ ID NO: 1843244 - RNA, 20 nt, Homo sapiens
gguggcuucagaaauggaac

SEQ ID NO: 1843245 - RNA, 16 nt, Homo sapiens
uuucauggacacuuug

SEQ ID NO: 1843246 - RNA, 19 nt, Homo sapiens
uaguaaugagugaguucuc

SEQ ID NO: 1843247 - RNA, 19 nt, Homo sapiens
ucaggcagggugagcucca

SEQ ID NO: 1843248 - RNA, 17 nt, Homo sapiens
cuuuuagaaaaggccaa

SEQ ID NO: 1843249 - RNA, 18 nt, Homo sapiens
cuuuauuaacccucugag

SEQ ID NO: 1843250 - RNA, 23 nt, Homo sapiens
uugugcuuaguccaauuccuugc

SEQ ID NO: 1843251 - RNA, 14 nt, Homo sapiens
accaugcccagcua

SEQ ID NO: 1843252 - RNA, 22 nt, Homo sapiens
cugaugaaaaauaugugcuuga

SEQ ID NO: 1843253 - RNA, 18 nt, Homo sapiens
ucaguauucccagccuug

SEQ ID NO: 1843254 - RNA, 18 nt, Homo sapiens
uccgagugugauuugaau

SEQ ID NO: 1843255 - RNA, 15 nt, Homo sapiens
ugcagugagcugugu

SEQ ID NO: 1843256 - RNA, 18 nt, Homo sapiens
gacuaccucugugccuug

SEQ ID NO: 1843257 - RNA, 23 nt, Homo sapiens
uuccugaaagcuguuggauuuca

SEQ ID NO: 1843258 - RNA, 18 nt, Homo sapiens
uucacugugaccuugaga

SEQ ID NO: 1843259 - RNA, 18 nt, Homo sapiens
uuccuuuauccacuuuuc

SEQ ID NO: 1843260 - RNA, 22 nt, Homo sapiens
cucuuggugugauugcacagaa

SEQ ID NO: 1843261 - RNA, 19 nt, Homo sapiens
aacuauuuucaaagacuua

SEQ ID NO: 1843262 - RNA, 19 nt, Homo sapiens
ucacaguaccuaugacuuu

SEQ ID NO: 1843263 - RNA, 14 nt, Homo sapiens
auguuucaccaagg

SEQ ID NO: 1843264 - RNA, 21 nt, Homo sapiens
uggcaucacgucagugcucag

SEQ ID NO: 1843265 - RNA, 11 nt, Homo sapiens
auucauuucau

SEQ ID NO: 1843266 - RNA, 13 nt, Homo sapiens
aaccaacaauaua

SEQ ID NO: 1843267 - RNA, 15 nt, Homo sapiens
aaaaauagacaugua

SEQ ID NO: 1843268 - RNA, 19 nt, Homo sapiens
ccuguuuugagcuuaaaaa

SEQ ID NO: 1843269 - RNA, 21 nt, Homo sapiens
gcuggacaggggcgugggauu

SEQ ID NO: 1843270 - RNA, 13 nt, Homo sapiens
ucugagugccuuc

SEQ ID NO: 1843271 - RNA, 23 nt, Homo sapiens
acauuuguuccuggaguuuugau

SEQ ID NO: 1843272 - RNA, 16 nt, Homo sapiens
agaauguuaugugcaa

SEQ ID NO: 1843273 - RNA, 17 nt, Homo sapiens
ugauagauuugaccucc

SEQ ID NO: 1843274 - RNA, 18 nt, Homo sapiens
agcacaaugcauaauguc

SEQ ID NO: 1843275 - RNA, 12 nt, Homo sapiens
ucuuaauugcca

SEQ ID NO: 1843276 - RNA, 13 nt, Homo sapiens
ggaaggggcccca

SEQ ID NO: 1843277 - RNA, 19 nt, Homo sapiens
uggacuauccucuuuggaa

SEQ ID NO: 1843278 - RNA, 14 nt, Homo sapiens
uaaagcacuaccua

SEQ ID NO: 1843279 - RNA, 12 nt, Homo sapiens
uauucuugucaa

SEQ ID NO: 1843280 - RNA, 17 nt, Homo sapiens
gacuucucggaauucau

SEQ ID NO: 1843281 - RNA, 15 nt, Homo sapiens
gcucucagagcaccu

SEQ ID NO: 1843282 - RNA, 13 nt, Homo sapiens
ugagcaacugcga

SEQ ID NO: 1843283 - RNA, 16 nt, Homo sapiens
gcccaucccaccccau

SEQ ID NO: 1843284 - RNA, 17 nt, Homo sapiens
gaagugguugcauucua

SEQ ID NO: 1843285 - RNA, 12 nt, Homo sapiens
aaaugauggaau

SEQ ID NO: 1843286 - RNA, 20 nt, Homo sapiens
cuggaucucuuaagacagca

SEQ ID NO: 1843287 - RNA, 20 nt, Homo sapiens
cuuuuccaaaugcccaagga

SEQ ID NO: 1843288 - RNA, 17 nt, Homo sapiens
ugaaggaaauaaugcaa

SEQ ID NO: 1843289 - RNA, 17 nt, Homo sapiens
ugauguaaauauuucaa

SEQ ID NO: 1843290 - RNA, 12 nt, Homo sapiens
agaaacaauguu

SEQ ID NO: 1843291 - RNA, 12 nt, Homo sapiens
agauacaaugua

SEQ ID NO: 1843292 - RNA, 12 nt, Homo sapiens
aaagaagcuuug

SEQ ID NO: 1843293 - RNA, 19 nt, Homo sapiens
gaaacacacauggacaugu

SEQ ID NO: 1843294 - RNA, 16 nt, Homo sapiens
caaggcugugcucccu

SEQ ID NO: 1843295 - RNA, 14 nt, Homo sapiens
acccuacagcagau

SEQ ID NO: 1843296 - RNA, 11 nt, Homo sapiens
ccugcuugcaa

SEQ ID NO: 1843297 - RNA, 19 nt, Homo sapiens
gcuuguuuacaugcuuauu

SEQ ID NO: 1843298 - RNA, 14 nt, Homo sapiens
acaccgaguuucca

SEQ ID NO: 1843299 - RNA, 20 nt, Homo sapiens
cucggcucaccgugagaaag

SEQ ID NO: 1843300 - RNA, 18 nt, Homo sapiens
gucacaugcccauucaca

SEQ ID NO: 1843301 - RNA, 21 nt, Homo sapiens
gaaaaggcuugagucuggaua

SEQ ID NO: 1843302 - RNA, 19 nt, Homo sapiens
cccagguuggagugcagug

SEQ ID NO: 1843303 - RNA, 20 nt, Homo sapiens
uuucauggacacugaucacu

SEQ ID NO: 1843304 - RNA, 14 nt, Homo sapiens
agcuccagaagaac

SEQ ID NO: 1843305 - RNA, 20 nt, Homo sapiens
cccaucugaacacaaccaga

SEQ ID NO: 1843306 - RNA, 21 nt, Homo sapiens
aaacuauacacuuaaugauac

SEQ ID NO: 1843307 - RNA, 22 nt, Homo sapiens
uauuaaguaugauugacacagc

SEQ ID NO: 1843308 - RNA, 15 nt, Homo sapiens
acuaucccugcacau

SEQ ID NO: 1843309 - RNA, 14 nt, Homo sapiens
uucugucucuauga

SEQ ID NO: 1843310 - RNA, 20 nt, Homo sapiens
aagcagaggcaacacuggaa

SEQ ID NO: 1843311 - RNA, 12 nt, Homo sapiens
uuucuuugccau

SEQ ID NO: 1843312 - RNA, 14 nt, Homo sapiens
cuguguuaugcaaa

SEQ ID NO: 1843313 - RNA, 23 nt, Homo sapiens
cccucacuucuuuccucaaagaa

SEQ ID NO: 1843314 - RNA, 21 nt, Homo sapiens
cucgaggccugcaaaccuucc

SEQ ID NO: 1843315 - RNA, 14 nt, Homo sapiens
caucuguacuuugg

SEQ ID NO: 1843316 - RNA, 15 nt, Homo sapiens
auuaaaaaaauucca

SEQ ID NO: 1843317 - RNA, 16 nt, Homo sapiens
caguuccuagcacugc

SEQ ID NO: 1843318 - RNA, 16 nt, Homo sapiens
aaaaugagcuuguaaa

SEQ ID NO: 1843319 - RNA, 20 nt, Homo sapiens
gagaaagggcggugaacucu

SEQ ID NO: 1843320 - RNA, 23 nt, Homo sapiens
gucuucauuuuuuaaugugcucu

SEQ ID NO: 1843321 - RNA, 15 nt, Homo sapiens
ugacucgggccuuag

SEQ ID NO: 1843322 - RNA, 14 nt, Homo sapiens
agucaucauuccuc

SEQ ID NO: 1843323 - RNA, 19 nt, Homo sapiens
cagcuggaagggucaacau

SEQ ID NO: 1843324 - RNA, 13 nt, Homo sapiens
caacaaaccacaa

SEQ ID NO: 1843325 - RNA, 13 nt, Homo sapiens
ccgauucucugcc

SEQ ID NO: 1843326 - RNA, 13 nt, Homo sapiens
ccucaaaggagca

SEQ ID NO: 1843327 - RNA, 12 nt, Homo sapiens
caaucuguaauu

SEQ ID NO: 1843328 - RNA, 19 nt, Homo sapiens
aaauacaaaggaagaacau

SEQ ID NO: 1843329 - RNA, 21 nt, Homo sapiens
auccugcaaggggacauucca

SEQ ID NO: 1843330 - RNA, 23 nt, Homo sapiens
aauaaugcaugaugaacucaccu

SEQ ID NO: 1843331 - RNA, 20 nt, Homo sapiens
uuacaggagggaacauuucc

SEQ ID NO: 1843332 - RNA, 17 nt, Homo sapiens
agaagagcucacuaugg

SEQ ID NO: 1843333 - RNA, 15 nt, Homo sapiens
aguucuugaacaguu

SEQ ID NO: 1843334 - RNA, 15 nt, Homo sapiens
ugaaacuuaauuaca

SEQ ID NO: 1843335 - RNA, 19 nt, Homo sapiens
gugcaguggcgcgaucuca

SEQ ID NO: 1843336 - RNA, 22 nt, Homo sapiens
gcgagaggcagcaagguggcca

SEQ ID NO: 1843337 - RNA, 14 nt, Homo sapiens
cagacugccaaaga

SEQ ID NO: 1843338 - RNA, 20 nt, Homo sapiens
ccugagccaaggccuagugg

SEQ ID NO: 1843339 - RNA, 21 nt, Homo sapiens
aaugcuaaagaauccauaaaa

SEQ ID NO: 1843340 - RNA, 14 nt, Homo sapiens
auccacaugggagc

SEQ ID NO: 1843341 - RNA, 13 nt, Homo sapiens
cccagguaucuga

SEQ ID NO: 1843342 - RNA, 18 nt, Homo sapiens
uuccacccacucuucaca

SEQ ID NO: 1843343 - RNA, 13 nt, Homo sapiens
uguucuccugucc

SEQ ID NO: 1843344 - RNA, 13 nt, Homo sapiens
uucuuuccuuccu

SEQ ID NO: 1843345 - RNA, 13 nt, Homo sapiens
accuguauuccca

SEQ ID NO: 1843346 - RNA, 14 nt, Homo sapiens
gagaucgugccacu

SEQ ID NO: 1843347 - RNA, 12 nt, Homo sapiens
ggcauugcucag

SEQ ID NO: 1843348 - RNA, 16 nt, Homo sapiens
cauucuagaaacagga

SEQ ID NO: 1843349 - RNA, 19 nt, Homo sapiens
gcuccaucguccauccucu

SEQ ID NO: 1843350 - RNA, 21 nt, Homo sapiens
aaacaucggggcuaacagaga

SEQ ID NO: 1843351 - RNA, 22 nt, Homo sapiens
acagauccuuuuuccaucauuu

SEQ ID NO: 1843352 - RNA, 17 nt, Homo sapiens
ucccuggaccacgaggc

SEQ ID NO: 1843353 - RNA, 14 nt, Homo sapiens
cugauuuaacacuu

SEQ ID NO: 1843354 - RNA, 18 nt, Homo sapiens
aucaggugugcucagggg

SEQ ID NO: 1843355 - RNA, 23 nt, Homo sapiens
aaacauguuccuuauauuuacuc

SEQ ID NO: 1843356 - RNA, 17 nt, Homo sapiens
uaaguaaauacaguaga

SEQ ID NO: 1843357 - RNA, 20 nt, Homo sapiens
agcauaggaggggucuggac

SEQ ID NO: 1843358 - RNA, 15 nt, Homo sapiens
ccaagaggauuucuu

SEQ ID NO: 1843359 - RNA, 19 nt, Homo sapiens
cagaaugaugaguccagaa

SEQ ID NO: 1843360 - RNA, 22 nt, Homo sapiens
ugaauaaauccaaaacaaacau

SEQ ID NO: 1843361 - RNA, 21 nt, Homo sapiens
cuuagguauauaauaacuuug

SEQ ID NO: 1843362 - RNA, 11 nt, Homo sapiens
augacugagaa

SEQ ID NO: 1843363 - RNA, 11 nt, Homo sapiens
aaaacugagug

SEQ ID NO: 1843364 - RNA, 16 nt, Homo sapiens
gacucccgcgugaaga

SEQ ID NO: 1843365 - RNA, 15 nt, Homo sapiens
caaugaugacccacu

SEQ ID NO: 1843366 - RNA, 22 nt, Homo sapiens
ugauaccaccuuuacugugcuu

SEQ ID NO: 1843367 - RNA, 20 nt, Homo sapiens
ccaaaguaucaggacgagaa

SEQ ID NO: 1843368 - RNA, 17 nt, Homo sapiens
uaugagauggaucacau

SEQ ID NO: 1843369 - RNA, 13 nt, Homo sapiens
ccugaaacaugaa

SEQ ID NO: 1843370 - RNA, 13 nt, Homo sapiens
uuucaaacaagua

SEQ ID NO: 1843371 - RNA, 18 nt, Homo sapiens
cugggagucacacagugu

SEQ ID NO: 1843372 - RNA, 17 nt, Homo sapiens
acugagccauccucagc

SEQ ID NO: 1843373 - RNA, 14 nt, Homo sapiens
caauacugagccau

SEQ ID NO: 1843374 - RNA, 11 nt, Homo sapiens
agucacuucca

SEQ ID NO: 1843375 - RNA, 15 nt, Homo sapiens
cuugggugcauuugc

SEQ ID NO: 1843376 - RNA, 20 nt, Homo sapiens
ugaggaaaaguccacaagaa

SEQ ID NO: 1843377 - RNA, 22 nt, Homo sapiens
auguuaauugggcaggugaaaa

SEQ ID NO: 1843378 - RNA, 18 nt, Homo sapiens
cauuuccuuccagcccau

SEQ ID NO: 1843379 - RNA, 20 nt, Homo sapiens
aauaaaugguuucucauuaa

SEQ ID NO: 1843380 - RNA, 19 nt, Homo sapiens
accuuuucccugcaccacu

SEQ ID NO: 1843381 - RNA, 18 nt, Homo sapiens
auaaaagaucuugcagaa

SEQ ID NO: 1843382 - RNA, 17 nt, Homo sapiens
aggaaggugacugugug

SEQ ID NO: 1843383 - RNA, 20 nt, Homo sapiens
agaauaaucauauauaugca

SEQ ID NO: 1843384 - RNA, 21 nt, Homo sapiens
acagugcccuuuucaucucca

SEQ ID NO: 1843385 - RNA, 17 nt, Homo sapiens
gaagccugaugcugaca

SEQ ID NO: 1843386 - RNA, 15 nt, Homo sapiens
gccagugccauucca

SEQ ID NO: 1843387 - RNA, 15 nt, Homo sapiens
gcacugauguuguua

SEQ ID NO: 1843388 - RNA, 16 nt, Homo sapiens
cguguccagcacagaa

SEQ ID NO: 1843389 - RNA, 19 nt, Homo sapiens
auauugggacacacaucaa

SEQ ID NO: 1843390 - RNA, 21 nt, Homo sapiens
caucuuuguguuuugaacaaa

SEQ ID NO: 1843391 - RNA, 13 nt, Homo sapiens
aguuaaucuugcu

SEQ ID NO: 1843392 - RNA, 17 nt, Homo sapiens
cagcaguguugcucagc

SEQ ID NO: 1843393 - RNA, 18 nt, Homo sapiens
ugcuggaacucuugacag

SEQ ID NO: 1843394 - RNA, 24 nt, Homo sapiens
gagcacuuuugaaaagcuugucca

SEQ ID NO: 1843395 - RNA, 13 nt, Homo sapiens
uucuuaccaagag

SEQ ID NO: 1843396 - RNA, 17 nt, Homo sapiens
uccaccccuuucuagac

SEQ ID NO: 1843397 - RNA, 14 nt, Homo sapiens
augacaucagcaau

SEQ ID NO: 1843398 - RNA, 22 nt, Homo sapiens
agcuuucucucagaaaugcugu

SEQ ID NO: 1843399 - RNA, 14 nt, Homo sapiens
cacucaugcugaaa

SEQ ID NO: 1843400 - RNA, 17 nt, Homo sapiens
guaaucucacagcauuu

SEQ ID NO: 1843401 - RNA, 23 nt, Homo sapiens
ugugauugcugccaggcacuguu

SEQ ID NO: 1843402 - RNA, 14 nt, Homo sapiens
ucugugcauguccc

SEQ ID NO: 1843403 - RNA, 14 nt, Homo sapiens
aaauagcacaucca

SEQ ID NO: 1843404 - RNA, 20 nt, Homo sapiens
guacaaacucagauccuugg

SEQ ID NO: 1843405 - RNA, 13 nt, Homo sapiens
uggaccacgggcc

SEQ ID NO: 1843406 - RNA, 20 nt, Homo sapiens
auucaucuauggagggcaga

SEQ ID NO: 1843407 - RNA, 14 nt, Homo sapiens
gccauuacuacugu

SEQ ID NO: 1843408 - RNA, 22 nt, Homo sapiens
cuccagcuggaucccagggaaa

SEQ ID NO: 1843409 - RNA, 22 nt, Homo sapiens
gucaaagaagcuuccacaaaau

SEQ ID NO: 1843410 - RNA, 15 nt, Homo sapiens
ugccaguaacugugc

SEQ ID NO: 1843411 - RNA, 16 nt, Homo sapiens
uaaugcccagacauuu

SEQ ID NO: 1843412 - RNA, 11 nt, Homo sapiens
agaagccagac

SEQ ID NO: 1843413 - RNA, 14 nt, Homo sapiens
agccccaccucaca

SEQ ID NO: 1843414 - RNA, 23 nt, Homo sapiens
caauuuauaaugaauacuuucuu

SEQ ID NO: 1843415 - RNA, 23 nt, Homo sapiens
gcagggcucucuguaucagucuu

SEQ ID NO: 1843416 - RNA, 17 nt, Homo sapiens
acucccuccucacacuc

SEQ ID NO: 1843417 - RNA, 16 nt, Homo sapiens
ugagccuacgcugaag

SEQ ID NO: 1843418 - RNA, 15 nt, Homo sapiens
caguagcuuaucuca

SEQ ID NO: 1843419 - RNA, 17 nt, Homo sapiens
ucuccccagcccagaga

SEQ ID NO: 1843420 - RNA, 22 nt, Homo sapiens
cguaaucauccccauccuccag

SEQ ID NO: 1843421 - RNA, 22 nt, Homo sapiens
ccaggcuuuuuuaucaugugaa

SEQ ID NO: 1843422 - RNA, 22 nt, Homo sapiens
ugugaaccuuugagcuuucaua

SEQ ID NO: 1843423 - RNA, 14 nt, Homo sapiens
uauuuuuaucugaa

SEQ ID NO: 1843424 - RNA, 17 nt, Homo sapiens
cucccagcgcacacaaa

SEQ ID NO: 1843425 - RNA, 17 nt, Homo sapiens
ucauucgccugugggaa

SEQ ID NO: 1843426 - RNA, 18 nt, Homo sapiens
uggaugaugaaacauuca

SEQ ID NO: 1843427 - RNA, 21 nt, Homo sapiens
ugaaaauaguguaagaacugu

SEQ ID NO: 1843428 - RNA, 17 nt, Homo sapiens
uuugcugaguuguucua

SEQ ID NO: 1843429 - RNA, 13 nt, Homo sapiens
gaagccucagcua

SEQ ID NO: 1843430 - RNA, 14 nt, Homo sapiens
ggcgcucaauggga

SEQ ID NO: 1843431 - RNA, 14 nt, Homo sapiens
cuccugugcaacuu

SEQ ID NO: 1843432 - RNA, 15 nt, Homo sapiens
ggucuuuucuagucu

SEQ ID NO: 1843433 - RNA, 21 nt, Homo sapiens
uugaagaagagaaaauuugaa

SEQ ID NO: 1843434 - RNA, 13 nt, Homo sapiens
gacuugaacaaaa

SEQ ID NO: 1843435 - RNA, 23 nt, Homo sapiens
uuucuaaggaguaacuugcaagu

SEQ ID NO: 1843436 - RNA, 17 nt, Homo sapiens
gagcuuuaguccuagag

SEQ ID NO: 1843437 - RNA, 17 nt, Homo sapiens
ugaauaaauacaaagca

SEQ ID NO: 1843438 - RNA, 17 nt, Homo sapiens
ugaaauaauacauugca

SEQ ID NO: 1843439 - RNA, 21 nt, Homo sapiens
uccaaauaauuugaacagcuu

SEQ ID NO: 1843440 - RNA, 18 nt, Homo sapiens
aauacuuuuuacaauuaa

SEQ ID NO: 1843441 - RNA, 14 nt, Homo sapiens
acuugauugccaag

SEQ ID NO: 1843442 - RNA, 13 nt, Homo sapiens
cucccccauuuua

SEQ ID NO: 1843443 - RNA, 14 nt, Homo sapiens
uguccaaaccuggg

SEQ ID NO: 1843444 - RNA, 23 nt, Homo sapiens
uaucucuaaaugugacaugcaaa

SEQ ID NO: 1843445 - RNA, 14 nt, Homo sapiens
ucccaaucccauuc

SEQ ID NO: 1843446 - RNA, 21 nt, Homo sapiens
uaugguucaagauuguugaua

SEQ ID NO: 1843447 - RNA, 22 nt, Homo sapiens
auuccaugguguauaugugcca

SEQ ID NO: 1843448 - RNA, 21 nt, Homo sapiens
ggaccccacuccccucacaca

SEQ ID NO: 1843449 - RNA, 20 nt, Homo sapiens
aaaauucuauuacaguaugu

SEQ ID NO: 1843450 - RNA, 12 nt, Homo sapiens
aaugcugggaaa

SEQ ID NO: 1843451 - RNA, 14 nt, Homo sapiens
cugucugacaaccu

SEQ ID NO: 1843452 - RNA, 20 nt, Homo sapiens
uaucuccuuuauagccugua

SEQ ID NO: 1843453 - RNA, 13 nt, Homo sapiens
gugcuccugugca

SEQ ID NO: 1843454 - RNA, 13 nt, Homo sapiens
uccauccuuccaa

SEQ ID NO: 1843455 - RNA, 18 nt, Homo sapiens
aacuccaggguuugggcu

SEQ ID NO: 1843456 - RNA, 16 nt, Homo sapiens
cagccuuccguaucca

SEQ ID NO: 1843457 - RNA, 17 nt, Homo sapiens
acuaucauucucagugg

SEQ ID NO: 1843458 - RNA, 13 nt, Homo sapiens
accucuacuuucc

SEQ ID NO: 1843459 - RNA, 15 nt, Homo sapiens
caagcccugccccuc

SEQ ID NO: 1843460 - RNA, 15 nt, Homo sapiens
guccucuacugcuaa

SEQ ID NO: 1843461 - RNA, 19 nt, Homo sapiens
auuaggagacacagggaag

SEQ ID NO: 1843462 - RNA, 21 nt, Homo sapiens
guuuuguaggagacuugccag

SEQ ID NO: 1843463 - RNA, 16 nt, Homo sapiens
gaauuaguaacuguau

SEQ ID NO: 1843464 - RNA, 16 nt, Homo sapiens
gucaaaauaaucugaa

SEQ ID NO: 1843465 - RNA, 21 nt, Homo sapiens
ccauccgggacgcuuccagac

SEQ ID NO: 1843466 - RNA, 22 nt, Homo sapiens
aagcagcgaccgcccccuccuc

SEQ ID NO: 1843467 - RNA, 20 nt, Homo sapiens
aucaugggaaaguauucucu

SEQ ID NO: 1843468 - RNA, 22 nt, Homo sapiens
caggcugcgucccuccgagcuu

SEQ ID NO: 1843469 - RNA, 18 nt, Homo sapiens
ccaggccgggcacagugg

SEQ ID NO: 1843470 - RNA, 23 nt, Homo sapiens
uaaguuguagaaauuaacaaaug

SEQ ID NO: 1843471 - RNA, 18 nt, Homo sapiens
guugacaucacuggcaug

SEQ ID NO: 1843472 - RNA, 21 nt, Homo sapiens
aaauauuuucauacagcauua

SEQ ID NO: 1843473 - RNA, 23 nt, Homo sapiens
gcacagcaggcugccagugccug

SEQ ID NO: 1843474 - RNA, 11 nt, Homo sapiens
ccuaacacagu

SEQ ID NO: 1843475 - RNA, 14 nt, Homo sapiens
ugaugccauggcag

SEQ ID NO: 1843476 - RNA, 13 nt, Homo sapiens
aagaagauaugca

SEQ ID NO: 1843477 - RNA, 12 nt, Homo sapiens
gacauacaugcu

SEQ ID NO: 1843478 - RNA, 22 nt, Homo sapiens
uccgugcugacagcugcuccua

SEQ ID NO: 1843479 - RNA, 23 nt, Homo sapiens
ccuaaggucauuaccacaggcca

SEQ ID NO: 1843480 - RNA, 21 nt, Homo sapiens
uuaggaccaauaccuccucca

SEQ ID NO: 1843481 - RNA, 16 nt, Homo sapiens
agcauccaaaagcagg

SEQ ID NO: 1843482 - RNA, 17 nt, Homo sapiens
acagggccugacuuuua

SEQ ID NO: 1843483 - RNA, 21 nt, Homo sapiens
cauaaaugugguacaagcauu

SEQ ID NO: 1843484 - RNA, 18 nt, Homo sapiens
uuuaaauugauagcagau

SEQ ID NO: 1843485 - RNA, 15 nt, Homo sapiens
cccuccacuccaucc

SEQ ID NO: 1843486 - RNA, 14 nt, Homo sapiens
auucuccauacucu

SEQ ID NO: 1843487 - RNA, 20 nt, Homo sapiens
aaacccagucuccucuccau

SEQ ID NO: 1843488 - RNA, 22 nt, Homo sapiens
accuuuuggugaaagcugagaa

SEQ ID NO: 1843489 - RNA, 17 nt, Homo sapiens
cuacaaaaccacuggaa

SEQ ID NO: 1843490 - RNA, 16 nt, Homo sapiens
aagguuggagauguca

SEQ ID NO: 1843491 - RNA, 20 nt, Homo sapiens
ugggaggugauguucccauu

SEQ ID NO: 1843492 - RNA, 18 nt, Homo sapiens
ugcugcggagcuuuccac

SEQ ID NO: 1843493 - RNA, 13 nt, Homo sapiens
agugcaggggaug

SEQ ID NO: 1843494 - RNA, 20 nt, Homo sapiens
uugcagcagugagucucuuc

SEQ ID NO: 1843495 - RNA, 21 nt, Homo sapiens
aaccuuaaccucucuaagcca

SEQ ID NO: 1843496 - RNA, 17 nt, Homo sapiens
uaccuauuucugaugau

SEQ ID NO: 1843497 - RNA, 18 nt, Homo sapiens
ugcuggaaaaucuguaaa

SEQ ID NO: 1843498 - RNA, 12 nt, Homo sapiens
acacugucuucc

SEQ ID NO: 1843499 - RNA, 15 nt, Homo sapiens
ucuguugaucucagu

SEQ ID NO: 1843500 - RNA, 16 nt, Homo sapiens
gaaaaccaacaccauc

SEQ ID NO: 1843501 - RNA, 17 nt, Homo sapiens
agaaacuuuuaguauua

SEQ ID NO: 1843502 - RNA, 13 nt, Homo sapiens
gaaaaugaugcug

SEQ ID NO: 1843503 - RNA, 15 nt, Homo sapiens
acaugguuacauauc

SEQ ID NO: 1843504 - RNA, 15 nt, Homo sapiens
uugugacuagugcug

SEQ ID NO: 1843505 - RNA, 17 nt, Homo sapiens
auugacuucuucccaag

SEQ ID NO: 1843506 - RNA, 22 nt, Homo sapiens
ccgcagguuaugucagcagcuc

SEQ ID NO: 1843507 - RNA, 17 nt, Homo sapiens
uuuacacuccucuauca

SEQ ID NO: 1843508 - RNA, 12 nt, Homo sapiens
caggauugaaaa

SEQ ID NO: 1843509 - RNA, 16 nt, Homo sapiens
cggaacucuucaucuu

SEQ ID NO: 1843510 - RNA, 21 nt, Homo sapiens
gaagugauugaauauuguuaa

SEQ ID NO: 1843511 - RNA, 21 nt, Homo sapiens
uauuuguaauuaaaagcaaau

SEQ ID NO: 1843512 - RNA, 17 nt, Homo sapiens
ggagaaacuucugcuca

SEQ ID NO: 1843513 - RNA, 17 nt, Homo sapiens
ccacagcacuagaguca

SEQ ID NO: 1843514 - RNA, 16 nt, Homo sapiens
cccugucucccaaaaa

SEQ ID NO: 1843515 - RNA, 21 nt, Homo sapiens
ugcagaggaggagaaaaguga

SEQ ID NO: 1843516 - RNA, 18 nt, Homo sapiens
aauugacagucacucagc

SEQ ID NO: 1843517 - RNA, 17 nt, Homo sapiens
uccucccaggaagccca

SEQ ID NO: 1843518 - RNA, 17 nt, Homo sapiens
gccuggccaacauggug

SEQ ID NO: 1843519 - RNA, 11 nt, Homo sapiens
cuuuuuagugu

SEQ ID NO: 1843520 - RNA, 20 nt, Homo sapiens
aaaaagcaugugucaugcau

SEQ ID NO: 1843521 - RNA, 14 nt, Homo sapiens
ucuuacaugcauuu

SEQ ID NO: 1843522 - RNA, 19 nt, Homo sapiens
ugccgaaccaggagcugcu

SEQ ID NO: 1843523 - RNA, 23 nt, Homo sapiens
aucaauucuauuacgugcaauac

SEQ ID NO: 1843524 - RNA, 16 nt, Homo sapiens
cgauucaccuggguuu

SEQ ID NO: 1843525 - RNA, 14 nt, Homo sapiens
ugagcacacuuuag

SEQ ID NO: 1843526 - RNA, 20 nt, Homo sapiens
cuaugcaaaauagacaucuu

SEQ ID NO: 1843527 - RNA, 15 nt, Homo sapiens
aaaaugugaccaaaa

SEQ ID NO: 1843528 - RNA, 19 nt, Homo sapiens
aagcucagugcucucucca

SEQ ID NO: 1843529 - RNA, 16 nt, Homo sapiens
accagaaauuccagua

SEQ ID NO: 1843530 - RNA, 14 nt, Homo sapiens
gcagaagucccaag

SEQ ID NO: 1843531 - RNA, 19 nt, Homo sapiens
uccccuucuucuccaucuc

SEQ ID NO: 1843532 - RNA, 21 nt, Homo sapiens
uuauagaauauuuauuaccuc

SEQ ID NO: 1843533 - RNA, 19 nt, Homo sapiens
aaccacacagcuaagggag

SEQ ID NO: 1843534 - RNA, 19 nt, Homo sapiens
auuccaggcugagccauga

SEQ ID NO: 1843535 - RNA, 12 nt, Homo sapiens
aaccauucugcu

SEQ ID NO: 1843536 - RNA, 19 nt, Homo sapiens
acuuccaagaccugacuca

SEQ ID NO: 1843537 - RNA, 16 nt, Homo sapiens
cagcaggggaggugag

SEQ ID NO: 1843538 - RNA, 23 nt, Homo sapiens
gacuguggccaugguccccaaga

SEQ ID NO: 1843539 - RNA, 19 nt, Homo sapiens
aguauccugcuucugauau

SEQ ID NO: 1843540 - RNA, 16 nt, Homo sapiens
cagucgagaagccagg

SEQ ID NO: 1843541 - RNA, 13 nt, Homo sapiens
ugacacugagaac

SEQ ID NO: 1843542 - RNA, 18 nt, Homo sapiens
aacggaugaccauaugca

SEQ ID NO: 1843543 - RNA, 12 nt, Homo sapiens
gcaccuaccuca

SEQ ID NO: 1843544 - RNA, 21 nt, Homo sapiens
uaucaacuggggggaccaaau

SEQ ID NO: 1843545 - RNA, 21 nt, Homo sapiens
cauguagaauuauaacuaauu

SEQ ID NO: 1843546 - RNA, 18 nt, Homo sapiens
aguguacauaguguaaug

SEQ ID NO: 1843547 - RNA, 16 nt, Homo sapiens
acgucuguaaucccag

SEQ ID NO: 1843548 - RNA, 15 nt, Homo sapiens
cagagguggcugcug

SEQ ID NO: 1843549 - RNA, 18 nt, Homo sapiens
ugaccuguguuucacuua

SEQ ID NO: 1843550 - RNA, 20 nt, Homo sapiens
aaacuuguuacaccacauua

SEQ ID NO: 1843551 - RNA, 15 nt, Homo sapiens
ugguguuuucauucc

SEQ ID NO: 1843552 - RNA, 19 nt, Homo sapiens
ugauacgcaacauaauuaa

SEQ ID NO: 1843553 - RNA, 20 nt, Homo sapiens
ccucaaccaaugccaaaaaa

SEQ ID NO: 1843554 - RNA, 12 nt, Homo sapiens
aagcacaagcag

SEQ ID NO: 1843555 - RNA, 15 nt, Homo sapiens
cuguuuugcauauga

SEQ ID NO: 1843556 - RNA, 13 nt, Homo sapiens
ccucuacaagcaa

SEQ ID NO: 1843557 - RNA, 21 nt, Homo sapiens
ugaccagcagaucccagcuca

SEQ ID NO: 1843558 - RNA, 23 nt, Homo sapiens
acuuugacuuucuucugaauauu

SEQ ID NO: 1843559 - RNA, 22 nt, Homo sapiens
cugcuccaugcagaucuagcca

SEQ ID NO: 1843560 - RNA, 18 nt, Homo sapiens
gccuccugcucugugaag

SEQ ID NO: 1843561 - RNA, 22 nt, Homo sapiens
aaaaugaaaauuaggauuucau

SEQ ID NO: 1843562 - RNA, 14 nt, Homo sapiens
cuuugcugcaagag

SEQ ID NO: 1843563 - RNA, 24 nt, Homo sapiens
aaauagcauguccuaaugcuugcu

SEQ ID NO: 1843564 - RNA, 19 nt, Homo sapiens
cauuaagcaucacaaauga

SEQ ID NO: 1843565 - RNA, 16 nt, Homo sapiens
gaagaauucuguuuag

SEQ ID NO: 1843566 - RNA, 13 nt, Homo sapiens
agucuaaaacaca

SEQ ID NO: 1843567 - RNA, 17 nt, Homo sapiens
aacagcaauggugucag

SEQ ID NO: 1843568 - RNA, 17 nt, Homo sapiens
ucugcauuuagcacaaa

SEQ ID NO: 1843569 - RNA, 20 nt, Homo sapiens
ccugauccaaguuuacucaa

SEQ ID NO: 1843570 - RNA, 19 nt, Homo sapiens
aaaaauauauuuaaugaua

SEQ ID NO: 1843571 - RNA, 13 nt, Homo sapiens
caagcuuagguca

SEQ ID NO: 1843572 - RNA, 13 nt, Homo sapiens
ucuuuucaucaaa

SEQ ID NO: 1843573 - RNA, 14 nt, Homo sapiens
gaggaaaccuagca

SEQ ID NO: 1843574 - RNA, 23 nt, Homo sapiens
acauauucuuggagaacuuucca

SEQ ID NO: 1843575 - RNA, 12 nt, Homo sapiens
caaccccaacuc

SEQ ID NO: 1843576 - RNA, 21 nt, Homo sapiens
agcuuuccuuucuccaugugu

SEQ ID NO: 1843577 - RNA, 16 nt, Homo sapiens
gagccccccacugcag

SEQ ID NO: 1843578 - RNA, 18 nt, Homo sapiens
uauuugaccggaucuaca

SEQ ID NO: 1843579 - RNA, 15 nt, Homo sapiens
augccagaauauaau

SEQ ID NO: 1843580 - RNA, 23 nt, Homo sapiens
agugagagcacgccuguacuaga

SEQ ID NO: 1843581 - RNA, 15 nt, Homo sapiens
ccaccugcaagugcc

SEQ ID NO: 1843582 - RNA, 15 nt, Homo sapiens
aagaggcuacagggc

SEQ ID NO: 1843583 - RNA, 17 nt, Homo sapiens
aauauucaaugaacuuc

SEQ ID NO: 1843584 - RNA, 23 nt, Homo sapiens
auucuauccugugaggcuuuuaa

SEQ ID NO: 1843585 - RNA, 20 nt, Homo sapiens
gauuugcucccaccacgggg

SEQ ID NO: 1843586 - RNA, 14 nt, Homo sapiens
uaaaaaucccaaac

SEQ ID NO: 1843587 - RNA, 18 nt, Homo sapiens
gcugcggugucacugggc

SEQ ID NO: 1843588 - RNA, 12 nt, Homo sapiens
cccaguggugcc

SEQ ID NO: 1843589 - RNA, 22 nt, Homo sapiens
agcagcuucugccacuucccag

SEQ ID NO: 1843590 - RNA, 15 nt, Homo sapiens
cuugucauguacuga

SEQ ID NO: 1843591 - RNA, 15 nt, Homo sapiens
gcugaccuccacagc

SEQ ID NO: 1843592 - RNA, 17 nt, Homo sapiens
uaauuagagaacuggag

SEQ ID NO: 1843593 - RNA, 13 nt, Homo sapiens
uauuuaccagacc

SEQ ID NO: 1843594 - RNA, 24 nt, Homo sapiens
aaccuugugccuggcucagagcca

SEQ ID NO: 1843595 - RNA, 18 nt, Homo sapiens
agacuuaggaaccuacca

SEQ ID NO: 1843596 - RNA, 21 nt, Homo sapiens
ggcuccugaauaucagucacu

SEQ ID NO: 1843597 - RNA, 20 nt, Homo sapiens
cccaugagggagaugccaug

SEQ ID NO: 1843598 - RNA, 21 nt, Homo sapiens
gcuccauuucuacaaugcaca

SEQ ID NO: 1843599 - RNA, 10 nt, Homo sapiens
caucuggccc

SEQ ID NO: 1843600 - RNA, 14 nt, Homo sapiens
uuuauuuucacagc

SEQ ID NO: 1843601 - RNA, 22 nt, Homo sapiens
guuuuagauaucccuuacucca

SEQ ID NO: 1843602 - RNA, 15 nt, Homo sapiens
cuacuuccaucccug

SEQ ID NO: 1843603 - RNA, 18 nt, Homo sapiens
ccacacagguggccauca

SEQ ID NO: 1843604 - RNA, 17 nt, Homo sapiens
ccugcccugugccgcac

SEQ ID NO: 1843605 - RNA, 15 nt, Homo sapiens
gcauuguugaugcuc

SEQ ID NO: 1843606 - RNA, 12 nt, Homo sapiens
caccagcaaaac

SEQ ID NO: 1843607 - RNA, 16 nt, Homo sapiens
aggaaguaugguuuua

SEQ ID NO: 1843608 - RNA, 19 nt, Homo sapiens
uucaaguguacauguguga

SEQ ID NO: 1843609 - RNA, 19 nt, Homo sapiens
aaacuauaagccaauauuc

SEQ ID NO: 1843610 - RNA, 20 nt, Homo sapiens
aauuccuguuacuuuacaga

SEQ ID NO: 1843611 - RNA, 19 nt, Homo sapiens
uguacagagaagaagugcu

SEQ ID NO: 1843612 - RNA, 22 nt, Homo sapiens
gcuacgcuccagcugauccaga

SEQ ID NO: 1843613 - RNA, 19 nt, Homo sapiens
uaaacacacagugcugcca

SEQ ID NO: 1843614 - RNA, 20 nt, Homo sapiens
uuucuuagaauugaccaaau

SEQ ID NO: 1843615 - RNA, 13 nt, Homo sapiens
ccacuacuuagag

SEQ ID NO: 1843616 - RNA, 16 nt, Homo sapiens
uugagacauuugccaa

SEQ ID NO: 1843617 - RNA, 19 nt, Homo sapiens
ggguuuggaccacaucucu

SEQ ID NO: 1843618 - RNA, 14 nt, Homo sapiens
agcagccccgggag

SEQ ID NO: 1843619 - RNA, 21 nt, Homo sapiens
ccaugacugcauuuuacugua

SEQ ID NO: 1843620 - RNA, 21 nt, Homo sapiens
aaauuuggauuuacgacugaa

SEQ ID NO: 1843621 - RNA, 22 nt, Homo sapiens
guucuggggaggaagggccagg

SEQ ID NO: 1843622 - RNA, 18 nt, Homo sapiens
guauggcguugguuugug

SEQ ID NO: 1843623 - RNA, 17 nt, Homo sapiens
cucuaaccaaggcugug

SEQ ID NO: 1843624 - RNA, 16 nt, Homo sapiens
ccugcucacaaaauca

SEQ ID NO: 1843625 - RNA, 17 nt, Homo sapiens
gaagugcagaggcagac

SEQ ID NO: 1843626 - RNA, 23 nt, Homo sapiens
ugagacuuucuucuagugcuuuu

SEQ ID NO: 1843627 - RNA, 23 nt, Homo sapiens
auuuucuuucuccucugauuuca

SEQ ID NO: 1843628 - RNA, 19 nt, Homo sapiens
uaagguuaugcacugccug

SEQ ID NO: 1843629 - RNA, 15 nt, Homo sapiens
ugguaccaagcauuu

SEQ ID NO: 1843630 - RNA, 16 nt, Homo sapiens
uauucacuaaggacuu

SEQ ID NO: 1843631 - RNA, 21 nt, Homo sapiens
acucugagcaugccccaaaaa

SEQ ID NO: 1843632 - RNA, 14 nt, Homo sapiens
ccugguccaugaug

SEQ ID NO: 1843633 - RNA, 17 nt, Homo sapiens
uuaagaggggaaaacaa

SEQ ID NO: 1843634 - RNA, 13 nt, Homo sapiens
cagcacacuggac

SEQ ID NO: 1843635 - RNA, 22 nt, Homo sapiens
gcagucagcccuuauggccaau

SEQ ID NO: 1843636 - RNA, 14 nt, Homo sapiens
caucauaagggcac

SEQ ID NO: 1843637 - RNA, 17 nt, Homo sapiens
ggaguuacaucuuuauu

SEQ ID NO: 1843638 - RNA, 17 nt, Homo sapiens
acccuauaaaucaacac

SEQ ID NO: 1843639 - RNA, 20 nt, Homo sapiens
uaaccaauuucuuucuaaaa

SEQ ID NO: 1843640 - RNA, 19 nt, Homo sapiens
acacagaacaggaacuaga

SEQ ID NO: 1843641 - RNA, 19 nt, Homo sapiens
ucccacccacaugugacac

SEQ ID NO: 1843642 - RNA, 15 nt, Homo sapiens
gucaggauucuucaa

SEQ ID NO: 1843643 - RNA, 17 nt, Homo sapiens
acuugcugcaguaugaa

SEQ ID NO: 1843644 - RNA, 15 nt, Homo sapiens
guaugcaaucuuaau

SEQ ID NO: 1843645 - RNA, 14 nt, Homo sapiens
cauggcugaacgcg

SEQ ID NO: 1843646 - RNA, 22 nt, Homo sapiens
aauguuuucuagucacuuccuc

SEQ ID NO: 1843647 - RNA, 15 nt, Homo sapiens
cauccucccuguucc

SEQ ID NO: 1843648 - RNA, 23 nt, Homo sapiens
ucuuuccuggcacuaacguugag

SEQ ID NO: 1843649 - RNA, 15 nt, Homo sapiens
aggaugcacauuucu

SEQ ID NO: 1843650 - RNA, 14 nt, Homo sapiens
acauccugacuuca

SEQ ID NO: 1843651 - RNA, 22 nt, Homo sapiens
cggccuugaagaggcaggucug

SEQ ID NO: 1843652 - RNA, 21 nt, Homo sapiens
ugauuccuaaaacucugccag

SEQ ID NO: 1843653 - RNA, 18 nt, Homo sapiens
guuuaccuggugcucuca

SEQ ID NO: 1843654 - RNA, 18 nt, Homo sapiens
gcuagucgccccucagag

SEQ ID NO: 1843655 - RNA, 14 nt, Homo sapiens
acaccugugugcug

SEQ ID NO: 1843656 - RNA, 15 nt, Homo sapiens
caagucccaucucac

SEQ ID NO: 1843657 - RNA, 20 nt, Homo sapiens
guguauccgacucuaagcug

SEQ ID NO: 1843658 - RNA, 17 nt, Homo sapiens
gacccaggagagacaga

SEQ ID NO: 1843659 - RNA, 17 nt, Homo sapiens
ggacuacucagcacugu

SEQ ID NO: 1843660 - RNA, 15 nt, Homo sapiens
aguacuugugaaaca

SEQ ID NO: 1843661 - RNA, 12 nt, Homo sapiens
uggaaaugucug

SEQ ID NO: 1843662 - RNA, 20 nt, Homo sapiens
uuuuuaaccauggcagggug

SEQ ID NO: 1843663 - RNA, 13 nt, Homo sapiens
gcaauacauuuca

SEQ ID NO: 1843664 - RNA, 20 nt, Homo sapiens
agccacauggccccauccca

SEQ ID NO: 1843665 - RNA, 15 nt, Homo sapiens
ccaaggaaaccacag

SEQ ID NO: 1843666 - RNA, 23 nt, Homo sapiens
cuuccagcaagcaaagugcuuug

SEQ ID NO: 1843667 - RNA, 18 nt, Homo sapiens
auaaagcccuugaaccag

SEQ ID NO: 1843668 - RNA, 17 nt, Homo sapiens
cacaacaggcauuccag

SEQ ID NO: 1843669 - RNA, 19 nt, Homo sapiens
cuacggggaaaaugcauuu

SEQ ID NO: 1843670 - RNA, 21 nt, Homo sapiens
ugcucaauuaaacauuacugu

SEQ ID NO: 1843671 - RNA, 14 nt, Homo sapiens
uuagucaacauaua

SEQ ID NO: 1843672 - RNA, 19 nt, Homo sapiens
gaauaaaauuccuaucuca

SEQ ID NO: 1843673 - RNA, 17 nt, Homo sapiens
auucuuccuaaugucag

SEQ ID NO: 1843674 - RNA, 19 nt, Homo sapiens
ucacucuucaaaugccuga

SEQ ID NO: 1843675 - RNA, 15 nt, Homo sapiens
aguaugacaaccucu

SEQ ID NO: 1843676 - RNA, 18 nt, Homo sapiens
uggaguuuucugugagaa

SEQ ID NO: 1843677 - RNA, 18 nt, Homo sapiens
ucaagauuugaccaaauc

SEQ ID NO: 1843678 - RNA, 22 nt, Homo sapiens
cugaauuuguaagcaacuugcu

SEQ ID NO: 1843679 - RNA, 21 nt, Homo sapiens
cacauauauuuuuuacaaaca

SEQ ID NO: 1843680 - RNA, 19 nt, Homo sapiens
agggucaggcggggugcug

SEQ ID NO: 1843681 - RNA, 23 nt, Homo sapiens
cuugguaauuguacuaaagccaa

SEQ ID NO: 1843682 - RNA, 18 nt, Homo sapiens
uggcaaaaaggagccuuu

SEQ ID NO: 1843683 - RNA, 14 nt, Homo sapiens
caacgugugggcag

SEQ ID NO: 1843684 - RNA, 12 nt, Homo sapiens
aagaggugaccc

SEQ ID NO: 1843685 - RNA, 14 nt, Homo sapiens
ugcugaaaauaaca

SEQ ID NO: 1843686 - RNA, 16 nt, Homo sapiens
cacauuuuuugccacu

SEQ ID NO: 1843687 - RNA, 22 nt, Homo sapiens
accaaugccaaaaaaagacagg

SEQ ID NO: 1843688 - RNA, 19 nt, Homo sapiens
auucaaccuuaccaaaaaa

SEQ ID NO: 1843689 - RNA, 21 nt, Homo sapiens
caagucugcauuucauauuau

SEQ ID NO: 1843690 - RNA, 11 nt, Homo sapiens
aagcagcauuu

SEQ ID NO: 1843691 - RNA, 13 nt, Homo sapiens
uucuggcuguaga

SEQ ID NO: 1843692 - RNA, 14 nt, Homo sapiens
auaaaaguacugaa

SEQ ID NO: 1843693 - RNA, 14 nt, Homo sapiens
ucugcaguuuaaca

SEQ ID NO: 1843694 - RNA, 22 nt, Homo sapiens
agaauauggacuuaaauguuaa

SEQ ID NO: 1843695 - RNA, 16 nt, Homo sapiens
acgguaaguguucuca

SEQ ID NO: 1843696 - RNA, 22 nt, Homo sapiens
gcuguauuuuuauuuuugcaca

SEQ ID NO: 1843697 - RNA, 22 nt, Homo sapiens
ccucaaauacaugcacagucau

SEQ ID NO: 1843698 - RNA, 23 nt, Homo sapiens
gcccuuggggagaggugauucuc

SEQ ID NO: 1843699 - RNA, 22 nt, Homo sapiens
cugaaagucuguggcccaagag

SEQ ID NO: 1843700 - RNA, 19 nt, Homo sapiens
ugagaccagccugggcaac

SEQ ID NO: 1843701 - RNA, 20 nt, Homo sapiens
aagagccaaagaauauucca

SEQ ID NO: 1843702 - RNA, 22 nt, Homo sapiens
ugccccacugggagaguccuua

SEQ ID NO: 1843703 - RNA, 17 nt, Homo sapiens
cggagcgcaaugccauc

SEQ ID NO: 1843704 - RNA, 19 nt, Homo sapiens
aggcaaaguacauuguaaa

SEQ ID NO: 1843705 - RNA, 16 nt, Homo sapiens
guacauuugugcucca

SEQ ID NO: 1843706 - RNA, 16 nt, Homo sapiens
ugaaguugauucauau

SEQ ID NO: 1843707 - RNA, 15 nt, Homo sapiens
gaacuaugaaaucaa

SEQ ID NO: 1843708 - RNA, 23 nt, Homo sapiens
ggccgggcaggcgugacucagca

SEQ ID NO: 1843709 - RNA, 12 nt, Homo sapiens
uuuccaaccagg

SEQ ID NO: 1843710 - RNA, 14 nt, Homo sapiens
ugcacuuauucuca

SEQ ID NO: 1843711 - RNA, 11 nt, Homo sapiens
caaucuggaaa

SEQ ID NO: 1843712 - RNA, 19 nt, Homo sapiens
uuaagaguuguaugaacau

SEQ ID NO: 1843713 - RNA, 14 nt, Homo sapiens
ccaaaccuguaacc

SEQ ID NO: 1843714 - RNA, 21 nt, Homo sapiens
guaaaaggccuucaaggaaga

SEQ ID NO: 1843715 - RNA, 17 nt, Homo sapiens
acauuagcuaaaacugc

SEQ ID NO: 1843716 - RNA, 15 nt, Homo sapiens
ugagcugugugccac

SEQ ID NO: 1843717 - RNA, 14 nt, Homo sapiens
gugaacacacugau

SEQ ID NO: 1843718 - RNA, 13 nt, Homo sapiens
uucccugaucccu

SEQ ID NO: 1843719 - RNA, 23 nt, Homo sapiens
gguacuauaaaagcuuucugcca

SEQ ID NO: 1843720 - RNA, 13 nt, Homo sapiens
aggugggggagcc

SEQ ID NO: 1843721 - RNA, 19 nt, Homo sapiens
uuggaauugacauucucua

SEQ ID NO: 1843722 - RNA, 19 nt, Homo sapiens
aaagauggcuuauucacau

SEQ ID NO: 1843723 - RNA, 23 nt, Homo sapiens
uccuucacaggcagugcauguga

SEQ ID NO: 1843724 - RNA, 18 nt, Homo sapiens
gcuauuuucccaugccag

SEQ ID NO: 1843725 - RNA, 15 nt, Homo sapiens
ugaauagggguugag

SEQ ID NO: 1843726 - RNA, 17 nt, Homo sapiens
gacagacaccacagccu

SEQ ID NO: 1843727 - RNA, 14 nt, Homo sapiens
aaccacagauuuau

SEQ ID NO: 1843728 - RNA, 14 nt, Homo sapiens
cuucucagcacuuu

SEQ ID NO: 1843729 - RNA, 17 nt, Homo sapiens
uguaaaugcucaaagau

SEQ ID NO: 1843730 - RNA, 22 nt, Homo sapiens
uuagaggugggccuaguaggag

SEQ ID NO: 1843731 - RNA, 20 nt, Homo sapiens
auacaggcauacacaugcac

SEQ ID NO: 1843732 - RNA, 15 nt, Homo sapiens
aggggaggacacugg

SEQ ID NO: 1843733 - RNA, 15 nt, Homo sapiens
cccuggccuaaagaa

SEQ ID NO: 1843734 - RNA, 19 nt, Homo sapiens
accucuaacaacaaauuaa

SEQ ID NO: 1843735 - RNA, 12 nt, Homo sapiens
gacagcuucccc

SEQ ID NO: 1843736 - RNA, 13 nt, Homo sapiens
cugcuucccuuac

SEQ ID NO: 1843737 - RNA, 17 nt, Homo sapiens
acccuaguuucccugaa

SEQ ID NO: 1843738 - RNA, 17 nt, Homo sapiens
ucaaaagcuucgugcca

SEQ ID NO: 1843739 - RNA, 24 nt, Homo sapiens
uuuagucgguucuguaucuccagu

SEQ ID NO: 1843740 - RNA, 14 nt, Homo sapiens
cuuaaagugcaguu

SEQ ID NO: 1843741 - RNA, 14 nt, Homo sapiens
accuggucucuaca

SEQ ID NO: 1843742 - RNA, 21 nt, Homo sapiens
ucgcgcuacaagaggccacuc

SEQ ID NO: 1843743 - RNA, 17 nt, Homo sapiens
uccaauuccuugcacau

SEQ ID NO: 1843744 - RNA, 14 nt, Homo sapiens
cuccaggacuccac

SEQ ID NO: 1843745 - RNA, 14 nt, Homo sapiens
cggcagucaugcug

SEQ ID NO: 1843746 - RNA, 18 nt, Homo sapiens
auuccauuuauccuagaa

SEQ ID NO: 1843747 - RNA, 16 nt, Homo sapiens
uacucaggcagugcaa

SEQ ID NO: 1843748 - RNA, 17 nt, Homo sapiens
uuuucaaccuaguagaa

SEQ ID NO: 1843749 - RNA, 20 nt, Homo sapiens
ccagguuggcucugccaguc

SEQ ID NO: 1843750 - RNA, 19 nt, Homo sapiens
agcuccucuauauuuccac

SEQ ID NO: 1843751 - RNA, 15 nt, Homo sapiens
agcugaccugguacu

SEQ ID NO: 1843752 - RNA, 17 nt, Homo sapiens
accaccuucaccuggau

SEQ ID NO: 1843753 - RNA, 19 nt, Homo sapiens
uuccccugucugucccagg

SEQ ID NO: 1843754 - RNA, 14 nt, Homo sapiens
ugcuucacuuuccu

SEQ ID NO: 1843755 - RNA, 20 nt, Homo sapiens
aaccacugcacccaccuacu

SEQ ID NO: 1843756 - RNA, 12 nt, Homo sapiens
ggccauacuucu

SEQ ID NO: 1843757 - RNA, 18 nt, Homo sapiens
gcaauucucgauucuuug

SEQ ID NO: 1843758 - RNA, 20 nt, Homo sapiens
caagagaccacuuccuuaac

SEQ ID NO: 1843759 - RNA, 13 nt, Homo sapiens
cuuaguauugcaa

SEQ ID NO: 1843760 - RNA, 13 nt, Homo sapiens
guaggaauuuucu

SEQ ID NO: 1843761 - RNA, 14 nt, Homo sapiens
aaagugacacagca

SEQ ID NO: 1843762 - RNA, 19 nt, Homo sapiens
uuauuucugaucuauacaa

SEQ ID NO: 1843763 - RNA, 19 nt, Homo sapiens
ucaucccacccucucacag

SEQ ID NO: 1843764 - RNA, 23 nt, Homo sapiens
gaagaauaggcggggcacggugg

SEQ ID NO: 1843765 - RNA, 15 nt, Homo sapiens
cauaggucuccaaga

SEQ ID NO: 1843766 - RNA, 18 nt, Homo sapiens
ccauaacccccugcccac

SEQ ID NO: 1843767 - RNA, 15 nt, Homo sapiens
cuggcgcugugcuag

SEQ ID NO: 1843768 - RNA, 21 nt, Homo sapiens
aggaacaacagcaucuuucac

SEQ ID NO: 1843769 - RNA, 15 nt, Homo sapiens
augacauugcuaaga

SEQ ID NO: 1843770 - RNA, 13 nt, Homo sapiens
gugaaugccauuu

SEQ ID NO: 1843771 - RNA, 20 nt, Homo sapiens
aaggaguucguggcugcaaa

SEQ ID NO: 1843772 - RNA, 14 nt, Homo sapiens
ccuauuucugauga

SEQ ID NO: 1843773 - RNA, 18 nt, Homo sapiens
aagcucaggaccaggcaa

SEQ ID NO: 1843774 - RNA, 19 nt, Homo sapiens
uuuuuaaaguuucuugcau

SEQ ID NO: 1843775 - RNA, 16 nt, Homo sapiens
guuuugcuacauucua

SEQ ID NO: 1843776 - RNA, 19 nt, Homo sapiens
auauacuguuauuucacuu

SEQ ID NO: 1843777 - RNA, 15 nt, Homo sapiens
gggccccaccaccua

SEQ ID NO: 1843778 - RNA, 21 nt, Homo sapiens
auuccggaaacuaguguacau

SEQ ID NO: 1843779 - RNA, 22 nt, Homo sapiens
gccccuaaguuauuaccucucc

SEQ ID NO: 1843780 - RNA, 23 nt, Homo sapiens
uccaguuuucuccucugcuucuu

SEQ ID NO: 1843781 - RNA, 15 nt, Homo sapiens
ugcacaaaaucuuuu

SEQ ID NO: 1843782 - RNA, 20 nt, Homo sapiens
auaaaccguuuuuaacacau

SEQ ID NO: 1843783 - RNA, 13 nt, Homo sapiens
aguccuugcaaga

SEQ ID NO: 1843784 - RNA, 13 nt, Homo sapiens
auaacuaugccag

SEQ ID NO: 1843785 - RNA, 15 nt, Homo sapiens
cggggcuccacugaa

SEQ ID NO: 1843786 - RNA, 19 nt, Homo sapiens
ucugcucuuuggaaauggc

SEQ ID NO: 1843787 - RNA, 19 nt, Homo sapiens
ucaacaaauuucauugcac

SEQ ID NO: 1843788 - RNA, 23 nt, Homo sapiens
caccccccagaaccuguccuugc

SEQ ID NO: 1843789 - RNA, 14 nt, Homo sapiens
aauguuaugacuau

SEQ ID NO: 1843790 - RNA, 14 nt, Homo sapiens
ccuuuccaggguca

SEQ ID NO: 1843791 - RNA, 19 nt, Homo sapiens
ugagguccacacugacaca

SEQ ID NO: 1843792 - RNA, 18 nt, Homo sapiens
auuuaaaaaaagaacaua

SEQ ID NO: 1843793 - RNA, 16 nt, Homo sapiens
ugccucagccuuccaa

SEQ ID NO: 1843794 - RNA, 12 nt, Homo sapiens
acaaagugagac

SEQ ID NO: 1843795 - RNA, 21 nt, Homo sapiens
gaacuugauguuccugggaug

SEQ ID NO: 1843796 - RNA, 17 nt, Homo sapiens
gaagaucugcuucccug

SEQ ID NO: 1843797 - RNA, 21 nt, Homo sapiens
ugcaucaucaucacaaccuaa

SEQ ID NO: 1843798 - RNA, 14 nt, Homo sapiens
caggagcucuccac

SEQ ID NO: 1843799 - RNA, 17 nt, Homo sapiens
ugugucuuaggugcgca

SEQ ID NO: 1843800 - RNA, 22 nt, Homo sapiens
auuggcuacaaagaccuaccua

SEQ ID NO: 1843801 - RNA, 11 nt, Homo sapiens
uuuuguucuaa

SEQ ID NO: 1843802 - RNA, 22 nt, Homo sapiens
cuugaaccauaguuacuguaaa

SEQ ID NO: 1843803 - RNA, 22 nt, Homo sapiens
agauuuuuuccucugcauuuac

SEQ ID NO: 1843804 - RNA, 19 nt, Homo sapiens
uaugcugucacugccaaac

SEQ ID NO: 1843805 - RNA, 15 nt, Homo sapiens
auauauguacuagca

SEQ ID NO: 1843806 - RNA, 18 nt, Homo sapiens
auucacagcuccuuguga

SEQ ID NO: 1843807 - RNA, 19 nt, Homo sapiens
ucccucaugagcacagggu

SEQ ID NO: 1843808 - RNA, 18 nt, Homo sapiens
ugcugggggugaggacac

SEQ ID NO: 1843809 - RNA, 23 nt, Homo sapiens
agaagaaguuaucaacaugcaca

SEQ ID NO: 1843810 - RNA, 14 nt, Homo sapiens
ucugccucccaaag

SEQ ID NO: 1843811 - RNA, 21 nt, Homo sapiens
aguuaguggauaaccacaggg

SEQ ID NO: 1843812 - RNA, 16 nt, Homo sapiens
cuguguuucugcaaua

SEQ ID NO: 1843813 - RNA, 23 nt, Homo sapiens
cauuuuccucacacccaccugcu

SEQ ID NO: 1843814 - RNA, 15 nt, Homo sapiens
uuuggcucacugcag

SEQ ID NO: 1843815 - RNA, 14 nt, Homo sapiens
gcucaucugccaaa

SEQ ID NO: 1843816 - RNA, 13 nt, Homo sapiens
caauaaugugcaa

SEQ ID NO: 1843817 - RNA, 21 nt, Homo sapiens
cuucuugaacacucaugcuga

SEQ ID NO: 1843818 - RNA, 15 nt, Homo sapiens
gcaucuuguuucaua

SEQ ID NO: 1843819 - RNA, 11 nt, Homo sapiens
gggacacucca

SEQ ID NO: 1843820 - RNA, 16 nt, Homo sapiens
cuuuuugugugcaggc

SEQ ID NO: 1843821 - RNA, 22 nt, Homo sapiens
uuucacacuggauccaucuuga

SEQ ID NO: 1843822 - RNA, 18 nt, Homo sapiens
gaacguucucuaccuuca

SEQ ID NO: 1843823 - RNA, 20 nt, Homo sapiens
gggacauuuccaagcuguua

SEQ ID NO: 1843824 - RNA, 15 nt, Homo sapiens
caaugacugugcuca

SEQ ID NO: 1843825 - RNA, 14 nt, Homo sapiens
aaccauggcacuga

SEQ ID NO: 1843826 - RNA, 10 nt, Homo sapiens
uauacauaug

SEQ ID NO: 1843827 - RNA, 22 nt, Homo sapiens
uauuucaagugccuagacuguu

SEQ ID NO: 1843828 - RNA, 11 nt, Homo sapiens
ucacuugccca

SEQ ID NO: 1843829 - RNA, 21 nt, Homo sapiens
agagggcgugggcgcuugcac

SEQ ID NO: 1843830 - RNA, 19 nt, Homo sapiens
gugaaauguaacaugaagc

SEQ ID NO: 1843831 - RNA, 18 nt, Homo sapiens
ccaaggagcaucccuaau

SEQ ID NO: 1843832 - RNA, 14 nt, Homo sapiens
cagccccuagccca

SEQ ID NO: 1843833 - RNA, 23 nt, Homo sapiens
ugguuacgucagccgguccaugg

SEQ ID NO: 1843834 - RNA, 15 nt, Homo sapiens
uaauacuggugaaaa

SEQ ID NO: 1843835 - RNA, 22 nt, Homo sapiens
auaaauuggugauaaguggaaa

SEQ ID NO: 1843836 - RNA, 19 nt, Homo sapiens
gacacuucaaggugacaga

SEQ ID NO: 1843837 - RNA, 22 nt, Homo sapiens
aaccaugcauggugcaucagca

SEQ ID NO: 1843838 - RNA, 17 nt, Homo sapiens
ccagaggggccugccac

SEQ ID NO: 1843839 - RNA, 20 nt, Homo sapiens
uaggaaaagggauacuuuga

SEQ ID NO: 1843840 - RNA, 18 nt, Homo sapiens
ucaacucuucauugagcu

SEQ ID NO: 1843841 - RNA, 17 nt, Homo sapiens
caccucccauuacuuug

SEQ ID NO: 1843842 - RNA, 19 nt, Homo sapiens
aacacggugaaacccgucu

SEQ ID NO: 1843843 - RNA, 19 nt, Homo sapiens
gucuaugcucauaacugug

SEQ ID NO: 1843844 - RNA, 20 nt, Homo sapiens
gacacauuuguaaauuuuca

SEQ ID NO: 1843845 - RNA, 19 nt, Homo sapiens
acaacagauuuacauccca

SEQ ID NO: 1843846 - RNA, 21 nt, Homo sapiens
ccaaagaccugccugugugcu

SEQ ID NO: 1843847 - RNA, 18 nt, Homo sapiens
ccuuauuaaggccccaga

SEQ ID NO: 1843848 - RNA, 20 nt, Homo sapiens
gaaauaguuuuaucuggaaa

SEQ ID NO: 1843849 - RNA, 16 nt, Homo sapiens
cagauggucacacaga

SEQ ID NO: 1843850 - RNA, 14 nt, Homo sapiens
aucucucugggaug

SEQ ID NO: 1843851 - RNA, 22 nt, Homo sapiens
aagagcugggaucccacagccc

SEQ ID NO: 1843852 - RNA, 17 nt, Homo sapiens
gaaccaagggcccucac

SEQ ID NO: 1843853 - RNA, 17 nt, Homo sapiens
ugucugucuagugucug

SEQ ID NO: 1843854 - RNA, 15 nt, Homo sapiens
gccucagggaccaag

SEQ ID NO: 1843855 - RNA, 21 nt, Homo sapiens
uaaauucaggcuacugcuuca

SEQ ID NO: 1843856 - RNA, 21 nt, Homo sapiens
gauucaggggcuuugggccca

SEQ ID NO: 1843857 - RNA, 22 nt, Homo sapiens
gaugcugagccaacugcuugga

SEQ ID NO: 1843858 - RNA, 20 nt, Homo sapiens
gccaucuggggucuaugccc

SEQ ID NO: 1843859 - RNA, 19 nt, Homo sapiens
ucugcggugaggcagggga

SEQ ID NO: 1843860 - RNA, 16 nt, Homo sapiens
auuccugaucuuccca

SEQ ID NO: 1843861 - RNA, 17 nt, Homo sapiens
uuaauaauaaaauauca

SEQ ID NO: 1843862 - RNA, 14 nt, Homo sapiens
cuuguccugugcuu

SEQ ID NO: 1843863 - RNA, 24 nt, Homo sapiens
augcaaccuuuggaugcacuuuau

SEQ ID NO: 1843864 - RNA, 11 nt, Homo sapiens
uuugcuguaga

SEQ ID NO: 1843865 - RNA, 18 nt, Homo sapiens
gauuaccagucugauuau

SEQ ID NO: 1843866 - RNA, 21 nt, Homo sapiens
auaaacagaacuccacugcaa

SEQ ID NO: 1843867 - RNA, 18 nt, Homo sapiens
cuaaagggagaaaugcca

SEQ ID NO: 1843868 - RNA, 15 nt, Homo sapiens
caagaagcaugcaga

SEQ ID NO: 1843869 - RNA, 18 nt, Homo sapiens
ucccgggcacugucaugc

SEQ ID NO: 1843870 - RNA, 16 nt, Homo sapiens
caggcaugugccacaa

SEQ ID NO: 1843871 - RNA, 15 nt, Homo sapiens
aaauauaaacuguag

SEQ ID NO: 1843872 - RNA, 23 nt, Homo sapiens
accugaauuaaagucuacacugc

SEQ ID NO: 1843873 - RNA, 21 nt, Homo sapiens
gcacaggucaggggugacaca

SEQ ID NO: 1843874 - RNA, 13 nt, Homo sapiens
caucucugugacc

SEQ ID NO: 1843875 - RNA, 20 nt, Homo sapiens
ugcaguggugcgaucuuggc

SEQ ID NO: 1843876 - RNA, 13 nt, Homo sapiens
ugccugauuagau

SEQ ID NO: 1843877 - RNA, 22 nt, Homo sapiens
cugcauguguuguacaauacca

SEQ ID NO: 1843878 - RNA, 16 nt, Homo sapiens
acagccguuuguucua

SEQ ID NO: 1843879 - RNA, 18 nt, Homo sapiens
accucaguuauuacaugu

SEQ ID NO: 1843880 - RNA, 14 nt, Homo sapiens
agucaacaguucaa

SEQ ID NO: 1843881 - RNA, 14 nt, Homo sapiens
cuuuguguggcucc

SEQ ID NO: 1843882 - RNA, 21 nt, Homo sapiens
uuuaaacaguaaaccuuaaca

SEQ ID NO: 1843883 - RNA, 14 nt, Homo sapiens
uguucccuuacugu

SEQ ID NO: 1843884 - RNA, 16 nt, Homo sapiens
cacugaaggaacaguu

SEQ ID NO: 1843885 - RNA, 21 nt, Homo sapiens
uaagaaugaaguucugcuaca

SEQ ID NO: 1843886 - RNA, 21 nt, Homo sapiens
cuugcugaauucucugcucag

SEQ ID NO: 1843887 - RNA, 16 nt, Homo sapiens
gaauaugauuaguaaa

SEQ ID NO: 1843888 - RNA, 15 nt, Homo sapiens
ugcucuaugccaggc

SEQ ID NO: 1843889 - RNA, 22 nt, Homo sapiens
uaaaucaaaccaggugcaauua

SEQ ID NO: 1843890 - RNA, 14 nt, Homo sapiens
cauuguaaaccaca

SEQ ID NO: 1843891 - RNA, 23 nt, Homo sapiens
ggcgauaugagagggaugcagug

SEQ ID NO: 1843892 - RNA, 23 nt, Homo sapiens
aagucaaacuuucaccucagauu

SEQ ID NO: 1843893 - RNA, 18 nt, Homo sapiens
gagaucugaaaacucauu

SEQ ID NO: 1843894 - RNA, 17 nt, Homo sapiens
ucccaugaggucuuccc

SEQ ID NO: 1843895 - RNA, 21 nt, Homo sapiens
uuuuuucuguugccgaaauag

SEQ ID NO: 1843896 - RNA, 15 nt, Homo sapiens
auauguugcuauaau

SEQ ID NO: 1843897 - RNA, 18 nt, Homo sapiens
uugcuuuucacauccauu

SEQ ID NO: 1843898 - RNA, 15 nt, Homo sapiens
cugugacugauauga

SEQ ID NO: 1843899 - RNA, 18 nt, Homo sapiens
gcuaccccucaaacugca

SEQ ID NO: 1843900 - RNA, 21 nt, Homo sapiens
cggcuccuccuuaugacucca

SEQ ID NO: 1843901 - RNA, 22 nt, Homo sapiens
uuuucuagcuauagugucucga

SEQ ID NO: 1843902 - RNA, 11 nt, Homo sapiens
uggaaauggag

SEQ ID NO: 1843903 - RNA, 21 nt, Homo sapiens
acuuugccaaauauaaucuca

SEQ ID NO: 1843904 - RNA, 13 nt, Homo sapiens
caauacaauguac

SEQ ID NO: 1843905 - RNA, 17 nt, Homo sapiens
ucaaguuaacaaggaau

SEQ ID NO: 1843906 - RNA, 22 nt, Homo sapiens
gagucagugccagguccuugcc

SEQ ID NO: 1843907 - RNA, 16 nt, Homo sapiens
aaguguuucuguuauu

SEQ ID NO: 1843908 - RNA, 12 nt, Homo sapiens
ucucuaccccaa

SEQ ID NO: 1843909 - RNA, 23 nt, Homo sapiens
ugccugaccccuucacuaugacu

SEQ ID NO: 1843910 - RNA, 13 nt, Homo sapiens
accucacuauuca

SEQ ID NO: 1843911 - RNA, 16 nt, Homo sapiens
guuuuaaccaauaacu

SEQ ID NO: 1843912 - RNA, 17 nt, Homo sapiens
agcccauaucacuaaga

SEQ ID NO: 1843913 - RNA, 19 nt, Homo sapiens
uuggcuguggggaccccag

SEQ ID NO: 1843914 - RNA, 13 nt, Homo sapiens
cugcuuaguauua

SEQ ID NO: 1843915 - RNA, 14 nt, Homo sapiens
cuucaagauuccau

SEQ ID NO: 1843916 - RNA, 18 nt, Homo sapiens
aggguuccgccacuccag

SEQ ID NO: 1843917 - RNA, 20 nt, Homo sapiens
aacauucguucucuaaccau

SEQ ID NO: 1843918 - RNA, 20 nt, Homo sapiens
cuaagaauauaauacauuug

SEQ ID NO: 1843919 - RNA, 13 nt, Homo sapiens
ugcagaugcugcu

SEQ ID NO: 1843920 - RNA, 20 nt, Homo sapiens
cacuuuaguuauauucacug

SEQ ID NO: 1843921 - RNA, 22 nt, Homo sapiens
gaccaagcaggaagcucagacu

SEQ ID NO: 1843922 - RNA, 19 nt, Homo sapiens
ucccauuggcucccugugu

SEQ ID NO: 1843923 - RNA, 14 nt, Homo sapiens
ucuguccacucuga

SEQ ID NO: 1843924 - RNA, 15 nt, Homo sapiens
uggacagacacuguu

SEQ ID NO: 1843925 - RNA, 16 nt, Homo sapiens
gcuuggauggggugcc

SEQ ID NO: 1843926 - RNA, 19 nt, Homo sapiens
gaagggagccaagggaugg

SEQ ID NO: 1843927 - RNA, 17 nt, Homo sapiens
ccacuuuauugcaaugc

SEQ ID NO: 1843928 - RNA, 19 nt, Homo sapiens
acaaugaccacauccugaa

SEQ ID NO: 1843929 - RNA, 17 nt, Homo sapiens
ggaucucuuaagacagc

SEQ ID NO: 1843930 - RNA, 19 nt, Homo sapiens
ccagagcugagauggcaua

SEQ ID NO: 1843931 - RNA, 19 nt, Homo sapiens
gugcuuccgagcugggaug

SEQ ID NO: 1843932 - RNA, 14 nt, Homo sapiens
aacucugacuguaa

SEQ ID NO: 1843933 - RNA, 22 nt, Homo sapiens
uccaagcgcgguuacuauggcc

SEQ ID NO: 1843934 - RNA, 13 nt, Homo sapiens
uaccuauucugaa

SEQ ID NO: 1843935 - RNA, 13 nt, Homo sapiens
cugaaauuuaccu

SEQ ID NO: 1843936 - RNA, 16 nt, Homo sapiens
ugcccuggccacuggc

SEQ ID NO: 1843937 - RNA, 23 nt, Homo sapiens
cuuaaguuguggagagugcaaca

SEQ ID NO: 1843938 - RNA, 14 nt, Homo sapiens
caaagaaugggcuu

SEQ ID NO: 1843939 - RNA, 15 nt, Homo sapiens
uuccauuugcaacag

SEQ ID NO: 1843940 - RNA, 16 nt, Homo sapiens
gacucaaguguagaag

SEQ ID NO: 1843941 - RNA, 17 nt, Homo sapiens
uuucugaccuugagcca

SEQ ID NO: 1843942 - RNA, 23 nt, Homo sapiens
aggagaaaaaaagcaugugucau

SEQ ID NO: 1843943 - RNA, 17 nt, Homo sapiens
aaagcugcuaaaucucc

SEQ ID NO: 1843944 - RNA, 14 nt, Homo sapiens
gguuuaggucaaga

SEQ ID NO: 1843945 - RNA, 19 nt, Homo sapiens
aaccauaugaacauauauu

SEQ ID NO: 1843946 - RNA, 16 nt, Homo sapiens
gguuccuccagccacc

SEQ ID NO: 1843947 - RNA, 17 nt, Homo sapiens
gaggcugauuucucaca

SEQ ID NO: 1843948 - RNA, 20 nt, Homo sapiens
aaacugagcgaaauccaaga

SEQ ID NO: 1843949 - RNA, 21 nt, Homo sapiens
aagcacauuuuaaaagugcca

SEQ ID NO: 1843950 - RNA, 17 nt, Homo sapiens
gcucuaacauuacugcc

SEQ ID NO: 1843951 - RNA, 18 nt, Homo sapiens
gcuauaaacuuuacauau

SEQ ID NO: 1843952 - RNA, 14 nt, Homo sapiens
ggcucuaaaaccuu

SEQ ID NO: 1843953 - RNA, 22 nt, Homo sapiens
cagaauccuaguuuaugcacau

SEQ ID NO: 1843954 - RNA, 17 nt, Homo sapiens
auugugguuccaugcag

SEQ ID NO: 1843955 - RNA, 21 nt, Homo sapiens
ucacuguuuagauuugccaua

SEQ ID NO: 1843956 - RNA, 21 nt, Homo sapiens
guccugggugcugucaugccc

SEQ ID NO: 1843957 - RNA, 18 nt, Homo sapiens
augucuccucaacccaca

SEQ ID NO: 1843958 - RNA, 14 nt, Homo sapiens
gguuucaccuccca

SEQ ID NO: 1843959 - RNA, 21 nt, Homo sapiens
ggcugggccucuucugccucu

SEQ ID NO: 1843960 - RNA, 17 nt, Homo sapiens
caaaugaccuagaaaca

SEQ ID NO: 1843961 - RNA, 14 nt, Homo sapiens
ucuguuccaagugu

SEQ ID NO: 1843962 - RNA, 22 nt, Homo sapiens
ccaaacucuaucugaaauccca

SEQ ID NO: 1843963 - RNA, 21 nt, Homo sapiens
uucuuccuuuuguauccucca

SEQ ID NO: 1843964 - RNA, 18 nt, Homo sapiens
acaaguauucuaccuaaa

SEQ ID NO: 1843965 - RNA, 17 nt, Homo sapiens
caaugguucucuucccu

SEQ ID NO: 1843966 - RNA, 15 nt, Homo sapiens
ccugaggugagcauc

SEQ ID NO: 1843967 - RNA, 17 nt, Homo sapiens
caggauucucaccagcu

SEQ ID NO: 1843968 - RNA, 21 nt, Homo sapiens
guccacgcgugccguggcacc

SEQ ID NO: 1843969 - RNA, 20 nt, Homo sapiens
caacugagagucauauacau

SEQ ID NO: 1843970 - RNA, 23 nt, Homo sapiens
caucacuucccauuuuauggaau

SEQ ID NO: 1843971 - RNA, 22 nt, Homo sapiens
ucgauggaugggaugcacucuc

SEQ ID NO: 1843972 - RNA, 14 nt, Homo sapiens
gcuacuagcucuuu

SEQ ID NO: 1843973 - RNA, 19 nt, Homo sapiens
agaugaccauuuucugcca

SEQ ID NO: 1843974 - RNA, 21 nt, Homo sapiens
aaugaugaguauuaguucccu

SEQ ID NO: 1843975 - RNA, 21 nt, Homo sapiens
gauuguuuacaggauauucca

SEQ ID NO: 1843976 - RNA, 13 nt, Homo sapiens
agauuuauuuagu

SEQ ID NO: 1843977 - RNA, 16 nt, Homo sapiens
augccuaccuugugag

SEQ ID NO: 1843978 - RNA, 23 nt, Homo sapiens
cgguuucccauuuguugcugcug

SEQ ID NO: 1843979 - RNA, 13 nt, Homo sapiens
aauccaagacaaa

SEQ ID NO: 1843980 - RNA, 19 nt, Homo sapiens
gcgccuguaguuccagcua

SEQ ID NO: 1843981 - RNA, 19 nt, Homo sapiens
agccaaagauaaucucuca

SEQ ID NO: 1843982 - RNA, 13 nt, Homo sapiens
agaucuuauguca

SEQ ID NO: 1843983 - RNA, 22 nt, Homo sapiens
gcaaucacggcucacuguaguc

SEQ ID NO: 1843984 - RNA, 14 nt, Homo sapiens
agccauaugcaaua

SEQ ID NO: 1843985 - RNA, 16 nt, Homo sapiens
ucaguuuacucucucc

SEQ ID NO: 1843986 - RNA, 17 nt, Homo sapiens
uuucagagccagugaag

SEQ ID NO: 1843987 - RNA, 16 nt, Homo sapiens
gucuaaaaacauuugu

SEQ ID NO: 1843988 - RNA, 16 nt, Homo sapiens
uggaaccagcaguuga

SEQ ID NO: 1843989 - RNA, 17 nt, Homo sapiens
aucuugauacauucaaa

SEQ ID NO: 1843990 - RNA, 14 nt, Homo sapiens
aguuguuccaggga

SEQ ID NO: 1843991 - RNA, 19 nt, Homo sapiens
gacaccagagcccacuucc

SEQ ID NO: 1843992 - RNA, 22 nt, Homo sapiens
ccucugccucacaacauggcaa

SEQ ID NO: 1843993 - RNA, 21 nt, Homo sapiens
cccuggugccucugugcacag

SEQ ID NO: 1843994 - RNA, 15 nt, Homo sapiens
cagauccccagccuc

SEQ ID NO: 1843995 - RNA, 15 nt, Homo sapiens
acccucccaccacuc

SEQ ID NO: 1843996 - RNA, 18 nt, Homo sapiens
aggugaugggggacgagg

SEQ ID NO: 1843997 - RNA, 21 nt, Homo sapiens
ucucuuggaaaauaagacaau

SEQ ID NO: 1843998 - RNA, 14 nt, Homo sapiens
uguaaauacaauuc

SEQ ID NO: 1843999 - RNA, 18 nt, Homo sapiens
aggauuauagauacuuaa

SEQ ID NO: 1844000 - RNA, 13 nt, Homo sapiens
cuguacaugacau

SEQ ID NO: 1844001 - RNA, 19 nt, Homo sapiens
uccuggggaauacuggcca

SEQ ID NO: 1844002 - RNA, 14 nt, Homo sapiens
uguuucacaguuug

SEQ ID NO: 1844003 - RNA, 21 nt, Homo sapiens
acauacaugcauacacucuca

SEQ ID NO: 1844004 - RNA, 16 nt, Homo sapiens
uaaaaaaauacaguaa

SEQ ID NO: 1844005 - RNA, 23 nt, Homo sapiens
ggaaucaccaauggcuccuugcc

SEQ ID NO: 1844006 - RNA, 18 nt, Homo sapiens
cagaggggacgcugagga

SEQ ID NO: 1844007 - RNA, 17 nt, Homo sapiens
accuucaaaacaagaca

SEQ ID NO: 1844008 - RNA, 13 nt, Homo sapiens
aaaggcugagaag

SEQ ID NO: 1844009 - RNA, 20 nt, Homo sapiens
acuccugguucagugccacg

SEQ ID NO: 1844010 - RNA, 23 nt, Homo sapiens
cuagucuggaacugcugcugacc

SEQ ID NO: 1844011 - RNA, 16 nt, Homo sapiens
aguaacaaauaaauaa

SEQ ID NO: 1844012 - RNA, 19 nt, Homo sapiens
cgaaaagaggggaagagac

SEQ ID NO: 1844013 - RNA, 17 nt, Homo sapiens
caaugcuucaucccuuu

SEQ ID NO: 1844014 - RNA, 15 nt, Homo sapiens
cuccaguucugauga

SEQ ID NO: 1844015 - RNA, 13 nt, Homo sapiens
caggauauugaca

SEQ ID NO: 1844016 - RNA, 16 nt, Homo sapiens
ugaccuugcaauguuc

SEQ ID NO: 1844017 - RNA, 16 nt, Homo sapiens
ccgcgugugacagucu

SEQ ID NO: 1844018 - RNA, 13 nt, Homo sapiens
guauuaaagacag

SEQ ID NO: 1844019 - RNA, 14 nt, Homo sapiens
uuuaaacucaggga

SEQ ID NO: 1844020 - RNA, 16 nt, Homo sapiens
agaaugaaaggagcag

SEQ ID NO: 1844021 - RNA, 22 nt, Homo sapiens
gcugucaacuucccaucuggcu

SEQ ID NO: 1844022 - RNA, 18 nt, Homo sapiens
uauggaaccuucccucca

SEQ ID NO: 1844023 - RNA, 17 nt, Homo sapiens
aauaaaguauagguuua

SEQ ID NO: 1844024 - RNA, 23 nt, Homo sapiens
ugcagacaggaaucuuaaggugu

SEQ ID NO: 1844025 - RNA, 17 nt, Homo sapiens
gaggacaaucuagcucu

SEQ ID NO: 1844026 - RNA, 16 nt, Homo sapiens
uaaaauagcugaggga

SEQ ID NO: 1844027 - RNA, 13 nt, Homo sapiens
ucucuucugccuu

SEQ ID NO: 1844028 - RNA, 16 nt, Homo sapiens
auuacaagugggugaa

SEQ ID NO: 1844029 - RNA, 12 nt, Homo sapiens
ucccauugccau

SEQ ID NO: 1844030 - RNA, 18 nt, Homo sapiens
cagccugggcaaugugau

SEQ ID NO: 1844031 - RNA, 14 nt, Homo sapiens
gugaccgacuaccc

SEQ ID NO: 1844032 - RNA, 16 nt, Homo sapiens
aacaaauguauuucaa

SEQ ID NO: 1844033 - RNA, 13 nt, Homo sapiens
gcccguacccagc

SEQ ID NO: 1844034 - RNA, 15 nt, Homo sapiens
cugugaauuagcuca

SEQ ID NO: 1844035 - RNA, 14 nt, Homo sapiens
ggaagggacuggga

SEQ ID NO: 1844036 - RNA, 14 nt, Homo sapiens
aauugauucaaggg

SEQ ID NO: 1844037 - RNA, 16 nt, Homo sapiens
ugcguguguguagaca

SEQ ID NO: 1844038 - RNA, 16 nt, Homo sapiens
ugcccuguguacuucc

SEQ ID NO: 1844039 - RNA, 17 nt, Homo sapiens
gccaucguccugggacu

SEQ ID NO: 1844040 - RNA, 19 nt, Homo sapiens
cccucuuuccccaccucuu

SEQ ID NO: 1844041 - RNA, 14 nt, Homo sapiens
aaaagguugccaaa

SEQ ID NO: 1844042 - RNA, 22 nt, Homo sapiens
agaaauugguaccuugcacaca

SEQ ID NO: 1844043 - RNA, 14 nt, Homo sapiens
cauucucaagcccu

SEQ ID NO: 1844044 - RNA, 16 nt, Homo sapiens
aaaagucccucccugc

SEQ ID NO: 1844045 - RNA, 17 nt, Homo sapiens
auuugauggugaauauu

SEQ ID NO: 1844046 - RNA, 14 nt, Homo sapiens
ggcagaucaccuga

SEQ ID NO: 1844047 - RNA, 18 nt, Homo sapiens
aguaggcuuuuaccauua

SEQ ID NO: 1844048 - RNA, 17 nt, Homo sapiens
cuuaagggucauauguu

SEQ ID NO: 1844049 - RNA, 14 nt, Homo sapiens
gccaauagugucau

SEQ ID NO: 1844050 - RNA, 13 nt, Homo sapiens
uuuaccacuccca

SEQ ID NO: 1844051 - RNA, 22 nt, Homo sapiens
cacacucuccugugaacacugg

SEQ ID NO: 1844052 - RNA, 17 nt, Homo sapiens
aguauuuggggucauau

SEQ ID NO: 1844053 - RNA, 18 nt, Homo sapiens
cuauguaaacaaaccaca

SEQ ID NO: 1844054 - RNA, 13 nt, Homo sapiens
ccccauuggcacc

SEQ ID NO: 1844055 - RNA, 18 nt, Homo sapiens
uuuccuuaaacauccaau

SEQ ID NO: 1844056 - RNA, 20 nt, Homo sapiens
cuccuucaccuuugucccca

SEQ ID NO: 1844057 - RNA, 15 nt, Homo sapiens
aaagcauugagaucu

SEQ ID NO: 1844058 - RNA, 14 nt, Homo sapiens
uugacucaccugaa

SEQ ID NO: 1844059 - RNA, 19 nt, Homo sapiens
uaguuucauucauccauca

SEQ ID NO: 1844060 - RNA, 15 nt, Homo sapiens
gaucaagaaugcaau

SEQ ID NO: 1844061 - RNA, 17 nt, Homo sapiens
ucuggggccacuuggua

SEQ ID NO: 1844062 - RNA, 18 nt, Homo sapiens
accucauuccugggacua

SEQ ID NO: 1844063 - RNA, 15 nt, Homo sapiens
acaagaauugcuaaa

SEQ ID NO: 1844064 - RNA, 21 nt, Homo sapiens
aucucauccuuuccucuagcu

SEQ ID NO: 1844065 - RNA, 17 nt, Homo sapiens
agccccccuugccccac

SEQ ID NO: 1844066 - RNA, 14 nt, Homo sapiens
gacaaacuccugaa

SEQ ID NO: 1844067 - RNA, 21 nt, Homo sapiens
cucaguagccauaucuuccaa

SEQ ID NO: 1844068 - RNA, 14 nt, Homo sapiens
aauaaagcagucau

SEQ ID NO: 1844069 - RNA, 16 nt, Homo sapiens
ucccccagcuuuccau

SEQ ID NO: 1844070 - RNA, 17 nt, Homo sapiens
cugcaagccugucugag

SEQ ID NO: 1844071 - RNA, 18 nt, Homo sapiens
auugucccuguguugucc

SEQ ID NO: 1844072 - RNA, 21 nt, Homo sapiens
uaaauccuguugaaaagccau

SEQ ID NO: 1844073 - RNA, 21 nt, Homo sapiens
ucccuuccgacccucugggaa

SEQ ID NO: 1844074 - RNA, 23 nt, Homo sapiens
cagcugugccagaggcuggacca

SEQ ID NO: 1844075 - RNA, 12 nt, Homo sapiens
agaaaagcagac

SEQ ID NO: 1844076 - RNA, 17 nt, Homo sapiens
gcugcuucaaaggccag

SEQ ID NO: 1844077 - RNA, 15 nt, Homo sapiens
auccagcucugggag

SEQ ID NO: 1844078 - RNA, 13 nt, Homo sapiens
guacaaagacagg

SEQ ID NO: 1844079 - RNA, 19 nt, Homo sapiens
aauuugggggaaaauggca

SEQ ID NO: 1844080 - RNA, 16 nt, Homo sapiens
gcaaaacucauuuaca

SEQ ID NO: 1844081 - RNA, 16 nt, Homo sapiens
auacuagggagccauu

SEQ ID NO: 1844082 - RNA, 16 nt, Homo sapiens
auaauaugcaguuccu

SEQ ID NO: 1844083 - RNA, 19 nt, Homo sapiens
gaugaccccauagaccuaa

SEQ ID NO: 1844084 - RNA, 17 nt, Homo sapiens
uucacucaagcacugau

SEQ ID NO: 1844085 - RNA, 17 nt, Homo sapiens
acuuaaguggcauuaaa

SEQ ID NO: 1844086 - RNA, 22 nt, Homo sapiens
agcuggaagggucaacaucuuu

SEQ ID NO: 1844087 - RNA, 14 nt, Homo sapiens
uuguuauguacaaa

SEQ ID NO: 1844088 - RNA, 14 nt, Homo sapiens
auaaguagaauuaa

SEQ ID NO: 1844089 - RNA, 18 nt, Homo sapiens
aaaccuuaagugcugcag

SEQ ID NO: 1844090 - RNA, 17 nt, Homo sapiens
aagaaaguguuggcuaa

SEQ ID NO: 1844091 - RNA, 12 nt, Homo sapiens
aauaucugacau

SEQ ID NO: 1844092 - RNA, 13 nt, Homo sapiens
agacaaguguuua

SEQ ID NO: 1844093 - RNA, 16 nt, Homo sapiens
gugcuaugccaagcca

SEQ ID NO: 1844094 - RNA, 12 nt, Homo sapiens
aauaaaauuucu

SEQ ID NO: 1844095 - RNA, 16 nt, Homo sapiens
acccaaugucucccac

SEQ ID NO: 1844096 - RNA, 17 nt, Homo sapiens
aacacagucuacucuuu

SEQ ID NO: 1844097 - RNA, 17 nt, Homo sapiens
gcaccccuccuagcaac

SEQ ID NO: 1844098 - RNA, 23 nt, Homo sapiens
acugcuuaaauuccaaguccuga

SEQ ID NO: 1844099 - RNA, 20 nt, Homo sapiens
aaucaggggcaaacggagua

SEQ ID NO: 1844100 - RNA, 20 nt, Homo sapiens
ccugauaccccugagggugg

SEQ ID NO: 1844101 - RNA, 20 nt, Homo sapiens
gcugcuucaaacucaaacac

SEQ ID NO: 1844102 - RNA, 15 nt, Homo sapiens
accacagugucugua

SEQ ID NO: 1844103 - RNA, 18 nt, Homo sapiens
acuggauucuuaaccaag

SEQ ID NO: 1844104 - RNA, 22 nt, Homo sapiens
gagcuggccucucuagcacaau

SEQ ID NO: 1844105 - RNA, 15 nt, Homo sapiens
uaagaccccaucucu

SEQ ID NO: 1844106 - RNA, 20 nt, Homo sapiens
cuuuauuucuagcagaguga

SEQ ID NO: 1844107 - RNA, 13 nt, Homo sapiens
uguuaagcauuua

SEQ ID NO: 1844108 - RNA, 13 nt, Homo sapiens
aguauagcuuuau

SEQ ID NO: 1844109 - RNA, 16 nt, Homo sapiens
cuauuucuucuucaca

SEQ ID NO: 1844110 - RNA, 24 nt, Homo sapiens
uguugcccuggcaccuguggccag

SEQ ID NO: 1844111 - RNA, 13 nt, Homo sapiens
ggcagcccagugc

SEQ ID NO: 1844112 - RNA, 22 nt, Homo sapiens
gguaauuugauacugaccuugu

SEQ ID NO: 1844113 - RNA, 22 nt, Homo sapiens
guuuguugaugugaaacauuau

SEQ ID NO: 1844114 - RNA, 21 nt, Homo sapiens
ggcacuugcugaggccaagcc

SEQ ID NO: 1844115 - RNA, 11 nt, Homo sapiens
ccgagaacuuu

SEQ ID NO: 1844116 - RNA, 14 nt, Homo sapiens
ucacuccugagaaa

SEQ ID NO: 1844117 - RNA, 11 nt, Homo sapiens
aaaagcacuuu

SEQ ID NO: 1844118 - RNA, 16 nt, Homo sapiens
auauucaaggaucuca

SEQ ID NO: 1844119 - RNA, 21 nt, Homo sapiens
caugcuuagucacugccugca

SEQ ID NO: 1844120 - RNA, 22 nt, Homo sapiens
uguaacuuuguugcauuuuggc

SEQ ID NO: 1844121 - RNA, 21 nt, Homo sapiens
cugcaugguguuuaugcacac

SEQ ID NO: 1844122 - RNA, 13 nt, Homo sapiens
acaucauuucaag

SEQ ID NO: 1844123 - RNA, 21 nt, Homo sapiens
ggucaugcccgucgauguuuu

SEQ ID NO: 1844124 - RNA, 11 nt, Homo sapiens
cccagccacag

SEQ ID NO: 1844125 - RNA, 17 nt, Homo sapiens
ugggauuugagauacca

SEQ ID NO: 1844126 - RNA, 21 nt, Homo sapiens
ccaaggagggugagugcaagg

SEQ ID NO: 1844127 - RNA, 19 nt, Homo sapiens
aaggccugugauccaggaa

SEQ ID NO: 1844128 - RNA, 17 nt, Homo sapiens
uauucugguagcaaauu

SEQ ID NO: 1844129 - RNA, 21 nt, Homo sapiens
ucuuguguguaugcacaugaa

SEQ ID NO: 1844130 - RNA, 22 nt, Homo sapiens
gcaugcuuuaaaaaacacaguc

SEQ ID NO: 1844131 - RNA, 14 nt, Homo sapiens
uuuguugagccuaa

SEQ ID NO: 1844132 - RNA, 22 nt, Homo sapiens
uaaauuugggggacuuacauga

SEQ ID NO: 1844133 - RNA, 23 nt, Homo sapiens
aaucaaaacucacaagugcucau

SEQ ID NO: 1844134 - RNA, 15 nt, Homo sapiens
uguuggccaggcuug

SEQ ID NO: 1844135 - RNA, 10 nt, Homo sapiens
aacuauuuaa

SEQ ID NO: 1844136 - RNA, 17 nt, Homo sapiens
cccugcaccucauucca

SEQ ID NO: 1844137 - RNA, 17 nt, Homo sapiens
cuuuucauccuagucua

SEQ ID NO: 1844138 - RNA, 19 nt, Homo sapiens
cacacuuuugcacauauau

SEQ ID NO: 1844139 - RNA, 15 nt, Homo sapiens
uccagguuccaucca

SEQ ID NO: 1844140 - RNA, 18 nt, Homo sapiens
uaaggugaagaaucuuuu

SEQ ID NO: 1844141 - RNA, 17 nt, Homo sapiens
agaauucccugaucuaa

SEQ ID NO: 1844142 - RNA, 16 nt, Homo sapiens
uaugguucuuauucac

SEQ ID NO: 1844143 - RNA, 20 nt, Homo sapiens
agaaguuuaaaaaaccaugc

SEQ ID NO: 1844144 - RNA, 16 nt, Homo sapiens
ucaacgaugugacugc

SEQ ID NO: 1844145 - RNA, 23 nt, Homo sapiens
uuauuccaagggaauauugccaa

SEQ ID NO: 1844146 - RNA, 16 nt, Homo sapiens
ccagggcgagcacuuu

SEQ ID NO: 1844147 - RNA, 17 nt, Homo sapiens
auagguaugagccaggg

SEQ ID NO: 1844148 - RNA, 14 nt, Homo sapiens
ccgcagaauggacu

SEQ ID NO: 1844149 - RNA, 17 nt, Homo sapiens
agucagaguugugcaca

SEQ ID NO: 1844150 - RNA, 12 nt, Homo sapiens
guucacagugca

SEQ ID NO: 1844151 - RNA, 21 nt, Homo sapiens
ccagcagccugccagcaguua

SEQ ID NO: 1844152 - RNA, 14 nt, Homo sapiens
uggugcuggaacca

SEQ ID NO: 1844153 - RNA, 22 nt, Homo sapiens
gucaccccucuguccagccagc

SEQ ID NO: 1844154 - RNA, 18 nt, Homo sapiens
accauuuagcacacugcu

SEQ ID NO: 1844155 - RNA, 19 nt, Homo sapiens
agcacagauuuugaaucug

SEQ ID NO: 1844156 - RNA, 17 nt, Homo sapiens
acacaaauuaaggggaa

SEQ ID NO: 1844157 - RNA, 15 nt, Homo sapiens
gcuaucccacuguau

SEQ ID NO: 1844158 - RNA, 18 nt, Homo sapiens
auacuuauuaagagcaaa

SEQ ID NO: 1844159 - RNA, 15 nt, Homo sapiens
auccaggugggagag

SEQ ID NO: 1844160 - RNA, 19 nt, Homo sapiens
ucugucauuuguugugaug

SEQ ID NO: 1844161 - RNA, 19 nt, Homo sapiens
ccugacagaucuaguucuc

SEQ ID NO: 1844162 - RNA, 14 nt, Homo sapiens
gcaauauuaagaca

SEQ ID NO: 1844163 - RNA, 15 nt, Homo sapiens
acagugccugggaau

SEQ ID NO: 1844164 - RNA, 21 nt, Homo sapiens
uuggggcacagucauucacau

SEQ ID NO: 1844165 - RNA, 24 nt, Homo sapiens
uaaguacuuucguuaaucuugcug

SEQ ID NO: 1844166 - RNA, 21 nt, Homo sapiens
ccacuugcacugugcuugcuc

SEQ ID NO: 1844167 - RNA, 24 nt, Homo sapiens
ucgugauauccacaaaugcuauuc

SEQ ID NO: 1844168 - RNA, 22 nt, Homo sapiens
cagaauguuuuuaaaauaugag

SEQ ID NO: 1844169 - RNA, 13 nt, Homo sapiens
aguaaaucucaca

SEQ ID NO: 1844170 - RNA, 23 nt, Homo sapiens
cugcugugcacauuuaugaauca

SEQ ID NO: 1844171 - RNA, 18 nt, Homo sapiens
guugcugacuacuacucu

SEQ ID NO: 1844172 - RNA, 18 nt, Homo sapiens
aaaagacgcaccagccca

SEQ ID NO: 1844173 - RNA, 15 nt, Homo sapiens
ggcucuuauagagcc

SEQ ID NO: 1844174 - RNA, 16 nt, Homo sapiens
agagucucccuccauc

SEQ ID NO: 1844175 - RNA, 14 nt, Homo sapiens
ucuaaccacuucag

SEQ ID NO: 1844176 - RNA, 18 nt, Homo sapiens
gauaacagccucuugccc

SEQ ID NO: 1844177 - RNA, 15 nt, Homo sapiens
uuacgagcagggaug

SEQ ID NO: 1844178 - RNA, 22 nt, Homo sapiens
ccucagccucagaggagcucua

SEQ ID NO: 1844179 - RNA, 16 nt, Homo sapiens
aagcucuucucuccag

SEQ ID NO: 1844180 - RNA, 22 nt, Homo sapiens
cugagcaccuacuuacaugcau

SEQ ID NO: 1844181 - RNA, 22 nt, Homo sapiens
gaaucauuuuagcuggugucag

SEQ ID NO: 1844182 - RNA, 14 nt, Homo sapiens
aauuuuuuuguacg

SEQ ID NO: 1844183 - RNA, 16 nt, Homo sapiens
auguuuagaguugcaa

SEQ ID NO: 1844184 - RNA, 14 nt, Homo sapiens
aacaaacugcacau

SEQ ID NO: 1844185 - RNA, 16 nt, Homo sapiens
caagugggaucuguca

SEQ ID NO: 1844186 - RNA, 14 nt, Homo sapiens
cuguuuauugccau

SEQ ID NO: 1844187 - RNA, 14 nt, Homo sapiens
ugccuaaucuguaa

SEQ ID NO: 1844188 - RNA, 20 nt, Homo sapiens
agcaaauaagucaucugaug

SEQ ID NO: 1844189 - RNA, 16 nt, Homo sapiens
auccucuacugugcau

SEQ ID NO: 1844190 - RNA, 22 nt, Homo sapiens
auuuccaaaccuccacugcugc

SEQ ID NO: 1844191 - RNA, 15 nt, Homo sapiens
aguuaccuuacugaa

SEQ ID NO: 1844192 - RNA, 13 nt, Homo sapiens
ucucuccauauac

SEQ ID NO: 1844193 - RNA, 12 nt, Homo sapiens
aagacaccugca

SEQ ID NO: 1844194 - RNA, 23 nt, Homo sapiens
gucuuuugguugccauggucacc

SEQ ID NO: 1844195 - RNA, 21 nt, Homo sapiens
ugcugaaaaaguagauugagu

SEQ ID NO: 1844196 - RNA, 19 nt, Homo sapiens
caaauuguuaagaguauca

SEQ ID NO: 1844197 - RNA, 19 nt, Homo sapiens
aagccccagaguggcucac

SEQ ID NO: 1844198 - RNA, 14 nt, Homo sapiens
ucuccuuccagggc

SEQ ID NO: 1844199 - RNA, 16 nt, Homo sapiens
agguaaguuggcucac

SEQ ID NO: 1844200 - RNA, 22 nt, Homo sapiens
caccuggaugggggucccugug

SEQ ID NO: 1844201 - RNA, 19 nt, Homo sapiens
auccaguuaacaucaucac

SEQ ID NO: 1844202 - RNA, 21 nt, Homo sapiens
auugagaagccauguacucaa

SEQ ID NO: 1844203 - RNA, 22 nt, Homo sapiens
aaucuuggcucgcaaccuccgc

SEQ ID NO: 1844204 - RNA, 19 nt, Homo sapiens
ucuuacauuagugauucca

SEQ ID NO: 1844205 - RNA, 15 nt, Homo sapiens
aagcccugugcucca

SEQ ID NO: 1844206 - RNA, 15 nt, Homo sapiens
ccacacuaacgugug

SEQ ID NO: 1844207 - RNA, 15 nt, Homo sapiens
guauuuuguaauauu

SEQ ID NO: 1844208 - RNA, 18 nt, Homo sapiens
gcacagaugcccacguau

SEQ ID NO: 1844209 - RNA, 14 nt, Homo sapiens
agaggacacuucaa

SEQ ID NO: 1844210 - RNA, 14 nt, Homo sapiens
cuuggacaagacaa

SEQ ID NO: 1844211 - RNA, 17 nt, Homo sapiens
cucaagggcuuucccac

SEQ ID NO: 1844212 - RNA, 17 nt, Homo sapiens
augccacccugcaauaa

SEQ ID NO: 1844213 - RNA, 14 nt, Homo sapiens
aagggaacuaugga

SEQ ID NO: 1844214 - RNA, 18 nt, Homo sapiens
auuuuuaagagccuucaa

SEQ ID NO: 1844215 - RNA, 18 nt, Homo sapiens
aauggcuacaucuccaaa

SEQ ID NO: 1844216 - RNA, 15 nt, Homo sapiens
agcugcagugucugu

SEQ ID NO: 1844217 - RNA, 15 nt, Homo sapiens
uauauggauaaucug

SEQ ID NO: 1844218 - RNA, 15 nt, Homo sapiens
aaaaugaaaauucua

SEQ ID NO: 1844219 - RNA, 19 nt, Homo sapiens
ucuauacucagguaccucu

SEQ ID NO: 1844220 - RNA, 14 nt, Homo sapiens
acuaugaacuugga

SEQ ID NO: 1844221 - RNA, 23 nt, Homo sapiens
ugaaacuugugucauugauguaa

SEQ ID NO: 1844222 - RNA, 18 nt, Homo sapiens
caugauucagagcuuuca

SEQ ID NO: 1844223 - RNA, 18 nt, Homo sapiens
agaauauucaaaauucca

SEQ ID NO: 1844224 - RNA, 22 nt, Homo sapiens
cugguacugcaggaccuccagc

SEQ ID NO: 1844225 - RNA, 17 nt, Homo sapiens
aauuuuuuaacauauug

SEQ ID NO: 1844226 - RNA, 22 nt, Homo sapiens
ggaccacuccagguggaacaaa

SEQ ID NO: 1844227 - RNA, 16 nt, Homo sapiens
uguguccuuccuugaa

SEQ ID NO: 1844228 - RNA, 20 nt, Homo sapiens
ugcuggggacagguccucag

SEQ ID NO: 1844229 - RNA, 20 nt, Homo sapiens
cccuaagcuggggacagaga

SEQ ID NO: 1844230 - RNA, 23 nt, Homo sapiens
uaaguacuagaugcaucacuggg

SEQ ID NO: 1844231 - RNA, 17 nt, Homo sapiens
auaaaauagaaacauuu

SEQ ID NO: 1844232 - RNA, 24 nt, Homo sapiens
cacagcuaugaaggcuguacacug

SEQ ID NO: 1844233 - RNA, 21 nt, Homo sapiens
ccugucccugcagacaugaga

SEQ ID NO: 1844234 - RNA, 16 nt, Homo sapiens
cugaaagauacagggg

SEQ ID NO: 1844235 - RNA, 19 nt, Homo sapiens
ugacaaaucuguguauauu

SEQ ID NO: 1844236 - RNA, 13 nt, Homo sapiens
uucagaguccuca

SEQ ID NO: 1844237 - RNA, 21 nt, Homo sapiens
gcucuuagcagcuuccagauu

SEQ ID NO: 1844238 - RNA, 15 nt, Homo sapiens
ugcuuaaucugagaa

SEQ ID NO: 1844239 - RNA, 17 nt, Homo sapiens
aaugaauaaagugcaaa

SEQ ID NO: 1844240 - RNA, 16 nt, Homo sapiens
cgcaucaggccuggca

SEQ ID NO: 1844241 - RNA, 22 nt, Homo sapiens
uaugccagggcgcacuuuccac

SEQ ID NO: 1844242 - RNA, 23 nt, Homo sapiens
gccugggucccacucaggugaaa

SEQ ID NO: 1844243 - RNA, 18 nt, Homo sapiens
aggagacaaacagcccuu

SEQ ID NO: 1844244 - RNA, 20 nt, Homo sapiens
caggauugaggaugaacuca

SEQ ID NO: 1844245 - RNA, 11 nt, Homo sapiens
ugccagcugcc

SEQ ID NO: 1844246 - RNA, 13 nt, Homo sapiens
gugcaucugucag

SEQ ID NO: 1844247 - RNA, 15 nt, Homo sapiens
auguguacgugcaug

SEQ ID NO: 1844248 - RNA, 23 nt, Homo sapiens
uggagaagggugguuuccugcca

SEQ ID NO: 1844249 - RNA, 16 nt, Homo sapiens
gagaacugacaaagga

SEQ ID NO: 1844250 - RNA, 23 nt, Homo sapiens
cucuucaccaggugcaugcaugc

SEQ ID NO: 1844251 - RNA, 15 nt, Homo sapiens
uuacuuuggaauaca

SEQ ID NO: 1844252 - RNA, 23 nt, Homo sapiens
uguaccagcagcuggaaucugaa

SEQ ID NO: 1844253 - RNA, 15 nt, Homo sapiens
gagcccauccagucu

SEQ ID NO: 1844254 - RNA, 23 nt, Homo sapiens
aaaguaaaacuuguuacaccaca

SEQ ID NO: 1844255 - RNA, 20 nt, Homo sapiens
uggcccugggggucugggcg

SEQ ID NO: 1844256 - RNA, 19 nt, Homo sapiens
agugcaaccacacaccuca

SEQ ID NO: 1844257 - RNA, 21 nt, Homo sapiens
cauucuguaaagucuagcaca

SEQ ID NO: 1844258 - RNA, 20 nt, Homo sapiens
augacagaaugcuguuuuaa

SEQ ID NO: 1844259 - RNA, 14 nt, Homo sapiens
uucuucuuuuacuu

SEQ ID NO: 1844260 - RNA, 20 nt, Homo sapiens
ugugccccucccaacaugcu

SEQ ID NO: 1844261 - RNA, 17 nt, Homo sapiens
uccuuggggagcacuug

SEQ ID NO: 1844262 - RNA, 20 nt, Homo sapiens
acugggccccacauggcuua

SEQ ID NO: 1844263 - RNA, 13 nt, Homo sapiens
aauuugauuugaa

SEQ ID NO: 1844264 - RNA, 14 nt, Homo sapiens
aagauuaaaugugu

SEQ ID NO: 1844265 - RNA, 14 nt, Homo sapiens
aucaugaaaacugg

SEQ ID NO: 1844266 - RNA, 19 nt, Homo sapiens
uggaguguuggcuucucaa

SEQ ID NO: 1844267 - RNA, 17 nt, Homo sapiens
cgugugugcaagugucu

SEQ ID NO: 1844268 - RNA, 23 nt, Homo sapiens
cuuauuuaaugccgauauacucu

SEQ ID NO: 1844269 - RNA, 12 nt, Homo sapiens
aaccaagugcuu

SEQ ID NO: 1844270 - RNA, 17 nt, Homo sapiens
ugcuuuuuaaagcacau

SEQ ID NO: 1844271 - RNA, 16 nt, Homo sapiens
uccauuggaaauaacu

SEQ ID NO: 1844272 - RNA, 19 nt, Homo sapiens
uugaaaguuagagauuuua

SEQ ID NO: 1844273 - RNA, 18 nt, Homo sapiens
cuacccuauucuauccau

SEQ ID NO: 1844274 - RNA, 20 nt, Homo sapiens
caguggcaccaccauggcuc

SEQ ID NO: 1844275 - RNA, 22 nt, Homo sapiens
caucugcaaaggaaucacuuua

SEQ ID NO: 1844276 - RNA, 20 nt, Homo sapiens
cuggggaaagacacugccug

SEQ ID NO: 1844277 - RNA, 18 nt, Homo sapiens
cuggaggacgggacagau

SEQ ID NO: 1844278 - RNA, 10 nt, Homo sapiens
uucauugugu

SEQ ID NO: 1844279 - RNA, 23 nt, Homo sapiens
acaaauaccuuuaaauugauaaa

SEQ ID NO: 1844280 - RNA, 18 nt, Homo sapiens
cugucaggguugucuacc

SEQ ID NO: 1844281 - RNA, 21 nt, Homo sapiens
ugcuuauuaaaugagcgacuu

SEQ ID NO: 1844282 - RNA, 12 nt, Homo sapiens
cuucuauauccu

SEQ ID NO: 1844283 - RNA, 18 nt, Homo sapiens
auuccccauuuccuguac

SEQ ID NO: 1844284 - RNA, 15 nt, Homo sapiens
cuacugaagcccuug

SEQ ID NO: 1844285 - RNA, 22 nt, Homo sapiens
aguucucugccaaagcuugugg

SEQ ID NO: 1844286 - RNA, 11 nt, Homo sapiens
aauucagguau

SEQ ID NO: 1844287 - RNA, 12 nt, Homo sapiens
ccucagucuccc

SEQ ID NO: 1844288 - RNA, 19 nt, Homo sapiens
uguagaauuauaacuaauu

SEQ ID NO: 1844289 - RNA, 14 nt, Homo sapiens
uguggguaaauuaa

SEQ ID NO: 1844290 - RNA, 13 nt, Homo sapiens
cccuucugcugua

SEQ ID NO: 1844291 - RNA, 23 nt, Homo sapiens
acucaucuuuagagcaacaguaa

SEQ ID NO: 1844292 - RNA, 12 nt, Homo sapiens
uaucuacuacaa

SEQ ID NO: 1844293 - RNA, 13 nt, Homo sapiens
caaaaggcccuuu

SEQ ID NO: 1844294 - RNA, 20 nt, Homo sapiens
cuuacaacugcucuagauua

SEQ ID NO: 1844295 - RNA, 14 nt, Homo sapiens
agggcccccaaaga

SEQ ID NO: 1844296 - RNA, 18 nt, Homo sapiens
ugauuuuaacaguuuuac

SEQ ID NO: 1844297 - RNA, 14 nt, Homo sapiens
gucggagucuguaa

SEQ ID NO: 1844298 - RNA, 21 nt, Homo sapiens
uccaggcauuuagcccucaca

SEQ ID NO: 1844299 - RNA, 14 nt, Homo sapiens
agccuaguccagaa

SEQ ID NO: 1844300 - RNA, 17 nt, Homo sapiens
ucugagggagcugagua

SEQ ID NO: 1844301 - RNA, 16 nt, Homo sapiens
cagcacuuuguuucau

SEQ ID NO: 1844302 - RNA, 17 nt, Homo sapiens
cucgcuuuguugcccag

SEQ ID NO: 1844303 - RNA, 11 nt, Homo sapiens
gcacacuuugc

SEQ ID NO: 1844304 - RNA, 17 nt, Homo sapiens
gcacccucccuagcucu

SEQ ID NO: 1844305 - RNA, 22 nt, Homo sapiens
ugguaagagacagaauguaucu

SEQ ID NO: 1844306 - RNA, 23 nt, Homo sapiens
caaagccuuaucaagugucuucc

SEQ ID NO: 1844307 - RNA, 13 nt, Homo sapiens
ucucugccuguac

SEQ ID NO: 1844308 - RNA, 17 nt, Homo sapiens
cuacauuggaagcuuug

SEQ ID NO: 1844309 - RNA, 14 nt, Homo sapiens
uuucugaccaaaau

SEQ ID NO: 1844310 - RNA, 18 nt, Homo sapiens
aguuuugcucucugucag

SEQ ID NO: 1844311 - RNA, 21 nt, Homo sapiens
acucgggaggcugaggcacaa

SEQ ID NO: 1844312 - RNA, 20 nt, Homo sapiens
ggcccauguauggccaggaa

SEQ ID NO: 1844313 - RNA, 19 nt, Homo sapiens
cucccaaguagcugggauu

SEQ ID NO: 1844314 - RNA, 11 nt, Homo sapiens
gcaaaaaucuc

SEQ ID NO: 1844315 - RNA, 22 nt, Homo sapiens
auccucaacaacaaaccaaaac

SEQ ID NO: 1844316 - RNA, 19 nt, Homo sapiens
cuuuggcuggaauuacaaa

SEQ ID NO: 1844317 - RNA, 23 nt, Homo sapiens
ucaccugggagggugggaccaau

SEQ ID NO: 1844318 - RNA, 10 nt, Homo sapiens
ucacaaagug

SEQ ID NO: 1844319 - RNA, 15 nt, Homo sapiens
ucagccuuacauuug

SEQ ID NO: 1844320 - RNA, 15 nt, Homo sapiens
aaauguauuccugua

SEQ ID NO: 1844321 - RNA, 15 nt, Homo sapiens
uaaauaauaccauaa

SEQ ID NO: 1844322 - RNA, 19 nt, Homo sapiens
agacacagugaccauacua

SEQ ID NO: 1844323 - RNA, 20 nt, Homo sapiens
acugagacaaauccuaggcu

SEQ ID NO: 1844324 - RNA, 18 nt, Homo sapiens
uuaagguaacuacugcua

SEQ ID NO: 1844325 - RNA, 17 nt, Homo sapiens
aguagaugaaacauuaa

SEQ ID NO: 1844326 - RNA, 20 nt, Homo sapiens
ggcgcccacccugggcucca

SEQ ID NO: 1844327 - RNA, 16 nt, Homo sapiens
uaauguaaauaaacua

SEQ ID NO: 1844328 - RNA, 17 nt, Homo sapiens
aguaggagcugagcuuu

SEQ ID NO: 1844329 - RNA, 23 nt, Homo sapiens
uaaguauuauauaaacugugcca

SEQ ID NO: 1844330 - RNA, 13 nt, Homo sapiens
aucuuugcuguua

SEQ ID NO: 1844331 - RNA, 18 nt, Homo sapiens
guuacaaaauacaaaagu

SEQ ID NO: 1844332 - RNA, 13 nt, Homo sapiens
gaagagcauugca

SEQ ID NO: 1844333 - RNA, 13 nt, Homo sapiens
auggacucugcac

SEQ ID NO: 1844334 - RNA, 18 nt, Homo sapiens
ugagguuuagaugugcaa

SEQ ID NO: 1844335 - RNA, 19 nt, Homo sapiens
accggcugcccacagggaa

SEQ ID NO: 1844336 - RNA, 18 nt, Homo sapiens
uugcugaauaacaacaau

SEQ ID NO: 1844337 - RNA, 19 nt, Homo sapiens
ggagaucagagcaacagcu

SEQ ID NO: 1844338 - RNA, 16 nt, Homo sapiens
ccaaaccuuacucuga

SEQ ID NO: 1844339 - RNA, 16 nt, Homo sapiens
gccaauuucaccccau

SEQ ID NO: 1844340 - RNA, 19 nt, Homo sapiens
gauuaugacuaaaguacca

SEQ ID NO: 1844341 - RNA, 13 nt, Homo sapiens
aacagccccagug

SEQ ID NO: 1844342 - RNA, 15 nt, Homo sapiens
cacugaacuuugcaa

SEQ ID NO: 1844343 - RNA, 12 nt, Homo sapiens
ccacuccagaga

SEQ ID NO: 1844344 - RNA, 16 nt, Homo sapiens
accuucgugcaacugu

SEQ ID NO: 1844345 - RNA, 13 nt, Homo sapiens
cacauuccuccua

SEQ ID NO: 1844346 - RNA, 17 nt, Homo sapiens
ucuuagaagccauggga

SEQ ID NO: 1844347 - RNA, 21 nt, Homo sapiens
gagcauucagaaugucaauga

SEQ ID NO: 1844348 - RNA, 17 nt, Homo sapiens
ugucuaggcacaugugg

SEQ ID NO: 1844349 - RNA, 19 nt, Homo sapiens
cugccucuuuuccccauga

SEQ ID NO: 1844350 - RNA, 19 nt, Homo sapiens
cucuaauguaccaaugaug

SEQ ID NO: 1844351 - RNA, 17 nt, Homo sapiens
uccccugaggauggccu

SEQ ID NO: 1844352 - RNA, 16 nt, Homo sapiens
ccaccucuagucagag

SEQ ID NO: 1844353 - RNA, 22 nt, Homo sapiens
ucaucuacacagcaguaugaau

SEQ ID NO: 1844354 - RNA, 17 nt, Homo sapiens
ucauacaggaaugaagc

SEQ ID NO: 1844355 - RNA, 18 nt, Homo sapiens
cgucuucagaugcugagc

SEQ ID NO: 1844356 - RNA, 17 nt, Homo sapiens
guccagacaccaucacc

SEQ ID NO: 1844357 - RNA, 22 nt, Homo sapiens
caagugccucuuguugcagaga

SEQ ID NO: 1844358 - RNA, 15 nt, Homo sapiens
cuaugacuugggcac

SEQ ID NO: 1844359 - RNA, 17 nt, Homo sapiens
uauggagugcaccaaag

SEQ ID NO: 1844360 - RNA, 14 nt, Homo sapiens
gagagcggcuuccc

SEQ ID NO: 1844361 - RNA, 15 nt, Homo sapiens
gcuaauuuguguauu

SEQ ID NO: 1844362 - RNA, 13 nt, Homo sapiens
cucagaaggcaaa

SEQ ID NO: 1844363 - RNA, 18 nt, Homo sapiens
caugugccuuaguguccu

SEQ ID NO: 1844364 - RNA, 16 nt, Homo sapiens
ugaaaacacugugcac

SEQ ID NO: 1844365 - RNA, 13 nt, Homo sapiens
cuauuucuugaua

SEQ ID NO: 1844366 - RNA, 19 nt, Homo sapiens
uugccuaauaaacauccuu

SEQ ID NO: 1844367 - RNA, 11 nt, Homo sapiens
uuuuugccaug

SEQ ID NO: 1844368 - RNA, 12 nt, Homo sapiens
agggcauugcuu

SEQ ID NO: 1844369 - RNA, 17 nt, Homo sapiens
uuccucaagaacacagc

SEQ ID NO: 1844370 - RNA, 17 nt, Homo sapiens
aaugucacuauaucuuc

SEQ ID NO: 1844371 - RNA, 17 nt, Homo sapiens
gccagaucccucuccag

SEQ ID NO: 1844372 - RNA, 13 nt, Homo sapiens
cuuaacacaggcc

SEQ ID NO: 1844373 - RNA, 23 nt, Homo sapiens
ucaugucauugaugaacugccaa

SEQ ID NO: 1844374 - RNA, 22 nt, Homo sapiens
aaaaaacauacuuacauuucag

SEQ ID NO: 1844375 - RNA, 20 nt, Homo sapiens
ucuagaagcgguuuccaggc

SEQ ID NO: 1844376 - RNA, 18 nt, Homo sapiens
cauaccccacugggcaca

SEQ ID NO: 1844377 - RNA, 20 nt, Homo sapiens
uucuuuauuuucuucuccag

SEQ ID NO: 1844378 - RNA, 18 nt, Homo sapiens
ugcuuaucagugugcaau

SEQ ID NO: 1844379 - RNA, 15 nt, Homo sapiens
aggagccagccaggg

SEQ ID NO: 1844380 - RNA, 24 nt, Homo sapiens
cuuaugagcuccauguugcuucac

SEQ ID NO: 1844381 - RNA, 22 nt, Homo sapiens
agagucagacccuucaauggaa

SEQ ID NO: 1844382 - RNA, 22 nt, Homo sapiens
gcagccagacccacaaggccag

SEQ ID NO: 1844383 - RNA, 17 nt, Homo sapiens
ugugccaccaacauaaa

SEQ ID NO: 1844384 - RNA, 19 nt, Homo sapiens
aagcugacuuggcacuuaa

SEQ ID NO: 1844385 - RNA, 14 nt, Homo sapiens
aacuauugugcuca

SEQ ID NO: 1844386 - RNA, 16 nt, Homo sapiens
uuugagacagagucug

SEQ ID NO: 1844387 - RNA, 15 nt, Homo sapiens
gacugaagaccagcu

SEQ ID NO: 1844388 - RNA, 14 nt, Homo sapiens
cccugccauggagg

SEQ ID NO: 1844389 - RNA, 15 nt, Homo sapiens
ugugauuacaaggcu

SEQ ID NO: 1844390 - RNA, 15 nt, Homo sapiens
gccauccuacccagc

SEQ ID NO: 1844391 - RNA, 17 nt, Homo sapiens
cagaaucgcuccaccuu

SEQ ID NO: 1844392 - RNA, 19 nt, Homo sapiens
cuagagauuugguguacaa

SEQ ID NO: 1844393 - RNA, 12 nt, Homo sapiens
gcuauguaguca

SEQ ID NO: 1844394 - RNA, 20 nt, Homo sapiens
cuggagugcaauggcgugau

SEQ ID NO: 1844395 - RNA, 18 nt, Homo sapiens
aggguacagaugugcugu

SEQ ID NO: 1844396 - RNA, 14 nt, Homo sapiens
cuugcccucaagca

SEQ ID NO: 1844397 - RNA, 16 nt, Homo sapiens
uuucagggaguacaca

SEQ ID NO: 1844398 - RNA, 19 nt, Homo sapiens
cauugcaauagaaauccaa

SEQ ID NO: 1844399 - RNA, 19 nt, Homo sapiens
ucguauggauuucuaggcc

SEQ ID NO: 1844400 - RNA, 14 nt, Homo sapiens
auuagaacuucaag

SEQ ID NO: 1844401 - RNA, 14 nt, Homo sapiens
gcuccugcugaccu

SEQ ID NO: 1844402 - RNA, 21 nt, Homo sapiens
gaacaauuguggucucucuua

SEQ ID NO: 1844403 - RNA, 19 nt, Homo sapiens
uuuaggucuuugccuucca

SEQ ID NO: 1844404 - RNA, 20 nt, Homo sapiens
acagccuucuagcacacuuu

SEQ ID NO: 1844405 - RNA, 18 nt, Homo sapiens
ucccuagcucacacucau

SEQ ID NO: 1844406 - RNA, 15 nt, Homo sapiens
auuagucaaaccacu

SEQ ID NO: 1844407 - RNA, 16 nt, Homo sapiens
uucucaguuuucaaca

SEQ ID NO: 1844408 - RNA, 12 nt, Homo sapiens
uuuaugcaaaua

SEQ ID NO: 1844409 - RNA, 20 nt, Homo sapiens
cugagacuuggaaccucauu

SEQ ID NO: 1844410 - RNA, 16 nt, Homo sapiens
uaaaacgcaccaauca

SEQ ID NO: 1844411 - RNA, 16 nt, Homo sapiens
ucaaaugacccaaaga

SEQ ID NO: 1844412 - RNA, 21 nt, Homo sapiens
cugggaacaacuucaguccaa

SEQ ID NO: 1844413 - RNA, 21 nt, Homo sapiens
guacccagcgcuaauuuugaa

SEQ ID NO: 1844414 - RNA, 20 nt, Homo sapiens
auuuuaucaggggaauuuca

SEQ ID NO: 1844415 - RNA, 18 nt, Homo sapiens
caugcgguagccagcaca

SEQ ID NO: 1844416 - RNA, 19 nt, Homo sapiens
uuccucaugaaucucucaa

SEQ ID NO: 1844417 - RNA, 22 nt, Homo sapiens
gcagcacaggaggcuccgugag

SEQ ID NO: 1844418 - RNA, 22 nt, Homo sapiens
cacaucagcuuuaggacugaca

SEQ ID NO: 1844419 - RNA, 20 nt, Homo sapiens
aucuugguaugggcuguucu

SEQ ID NO: 1844420 - RNA, 17 nt, Homo sapiens
aagugaaaucugugcaa

SEQ ID NO: 1844421 - RNA, 15 nt, Homo sapiens
accaguguacugcuu

SEQ ID NO: 1844422 - RNA, 15 nt, Homo sapiens
ugcagaguugugcau

SEQ ID NO: 1844423 - RNA, 22 nt, Homo sapiens
aauucuuacuguucugaaauua

SEQ ID NO: 1844424 - RNA, 18 nt, Homo sapiens
aaauuuucuuuaagucag

SEQ ID NO: 1844425 - RNA, 16 nt, Homo sapiens
uauaguuaaucuauaa

SEQ ID NO: 1844426 - RNA, 12 nt, Homo sapiens
ccuucuaccucu

SEQ ID NO: 1844427 - RNA, 13 nt, Homo sapiens
accucguccuccc

SEQ ID NO: 1844428 - RNA, 16 nt, Homo sapiens
agaaagccuauuccau

SEQ ID NO: 1844429 - RNA, 23 nt, Homo sapiens
auuuuuccuaugcuauugacaau

SEQ ID NO: 1844430 - RNA, 19 nt, Homo sapiens
uaaauuuuagugugccuuc

SEQ ID NO: 1844431 - RNA, 19 nt, Homo sapiens
agaauggaaugcucugguc

SEQ ID NO: 1844432 - RNA, 21 nt, Homo sapiens
cgugcauuguguguaggggug

SEQ ID NO: 1844433 - RNA, 22 nt, Homo sapiens
gugaccccuccuggggccaggc

SEQ ID NO: 1844434 - RNA, 19 nt, Homo sapiens
uaacaaauuccaaauucuc

SEQ ID NO: 1844435 - RNA, 16 nt, Homo sapiens
aguccuggaaucacau

SEQ ID NO: 1844436 - RNA, 15 nt, Homo sapiens
agauucagucuugcc

SEQ ID NO: 1844437 - RNA, 16 nt, Homo sapiens
cucugggaucugccaa

SEQ ID NO: 1844438 - RNA, 22 nt, Homo sapiens
uguaagaauuucccagugaaau

SEQ ID NO: 1844439 - RNA, 14 nt, Homo sapiens
uuguuauguaaaac

SEQ ID NO: 1844440 - RNA, 18 nt, Homo sapiens
aguucgaggcugcaguca

SEQ ID NO: 1844441 - RNA, 15 nt, Homo sapiens
uuagaucuacacucu

SEQ ID NO: 1844442 - RNA, 19 nt, Homo sapiens
acuguauauaaacuccuua

SEQ ID NO: 1844443 - RNA, 22 nt, Homo sapiens
ggccaagcauuucuagcaguga

SEQ ID NO: 1844444 - RNA, 21 nt, Homo sapiens
agccaccuuccugacugggaa

SEQ ID NO: 1844445 - RNA, 16 nt, Homo sapiens
acccgagguuugcaaa

SEQ ID NO: 1844446 - RNA, 18 nt, Homo sapiens
cacaauacauguuuucac

SEQ ID NO: 1844447 - RNA, 15 nt, Homo sapiens
agcccucccuaccua

SEQ ID NO: 1844448 - RNA, 21 nt, Homo sapiens
aaugaguugaggccacugugu

SEQ ID NO: 1844449 - RNA, 12 nt, Homo sapiens
ggaaucagagag

SEQ ID NO: 1844450 - RNA, 14 nt, Homo sapiens
acgccugcccuccc

SEQ ID NO: 1844451 - RNA, 20 nt, Homo sapiens
guggucucccuggccucagg

SEQ ID NO: 1844452 - RNA, 12 nt, Homo sapiens
aaaaacuuccuu

SEQ ID NO: 1844453 - RNA, 22 nt, Homo sapiens
aacaaacugaauuaaacaugaa

SEQ ID NO: 1844454 - RNA, 20 nt, Homo sapiens
uaucuaguaggucugcacac

SEQ ID NO: 1844455 - RNA, 17 nt, Homo sapiens
gauuuuggagauuccca

SEQ ID NO: 1844456 - RNA, 17 nt, Homo sapiens
uuuucaauuuugugcua

SEQ ID NO: 1844457 - RNA, 20 nt, Homo sapiens
acucagaauccacagugucc

SEQ ID NO: 1844458 - RNA, 18 nt, Homo sapiens
cagccccaacuccagggg

SEQ ID NO: 1844459 - RNA, 22 nt, Homo sapiens
aagugcugggaugacaggugug

SEQ ID NO: 1844460 - RNA, 18 nt, Homo sapiens
gaagugguaggaaagccu

SEQ ID NO: 1844461 - RNA, 17 nt, Homo sapiens
ugauaccauaugaauga

SEQ ID NO: 1844462 - RNA, 23 nt, Homo sapiens
guggggcccuucucugcagucaa

SEQ ID NO: 1844463 - RNA, 14 nt, Homo sapiens
cuuccgauguuugu

SEQ ID NO: 1844464 - RNA, 20 nt, Homo sapiens
uuaaguauugacucauagaa

SEQ ID NO: 1844465 - RNA, 22 nt, Homo sapiens
cuaugcugggguacacagugag

SEQ ID NO: 1844466 - RNA, 15 nt, Homo sapiens
ugucuuccaagguag

SEQ ID NO: 1844467 - RNA, 14 nt, Homo sapiens
aaagcccaaccucu

SEQ ID NO: 1844468 - RNA, 23 nt, Homo sapiens
aguugccacauuuaguccuguac

SEQ ID NO: 1844469 - RNA, 12 nt, Homo sapiens
uauucucaagaa

SEQ ID NO: 1844470 - RNA, 22 nt, Homo sapiens
ccauggacgaauaugaauguca

SEQ ID NO: 1844471 - RNA, 19 nt, Homo sapiens
uuuguguaucguaaccagc

SEQ ID NO: 1844472 - RNA, 16 nt, Homo sapiens
agaccugcuuccugaa

SEQ ID NO: 1844473 - RNA, 12 nt, Homo sapiens
ugagaacuguga

SEQ ID NO: 1844474 - RNA, 12 nt, Homo sapiens
ccacagccaugg

SEQ ID NO: 1844475 - RNA, 12 nt, Homo sapiens
ccagagccaugc

SEQ ID NO: 1844476 - RNA, 21 nt, Homo sapiens
ugucuccaugugcguccauau

SEQ ID NO: 1844477 - RNA, 15 nt, Homo sapiens
caguauaauuguguu

SEQ ID NO: 1844478 - RNA, 18 nt, Homo sapiens
gugcuauuuuugaagcag

SEQ ID NO: 1844479 - RNA, 18 nt, Homo sapiens
uaaccaaggcuccaauaa

SEQ ID NO: 1844480 - RNA, 16 nt, Homo sapiens
caugcaccuugcuccc

SEQ ID NO: 1844481 - RNA, 13 nt, Homo sapiens
auuuaaacaucag

SEQ ID NO: 1844482 - RNA, 16 nt, Homo sapiens
agggcuuccucuuccg

SEQ ID NO: 1844483 - RNA, 19 nt, Homo sapiens
uaggaagguuaauguucau

SEQ ID NO: 1844484 - RNA, 20 nt, Homo sapiens
ucuaauaaaaaacaccuucu

SEQ ID NO: 1844485 - RNA, 19 nt, Homo sapiens
cuccucuacaauuugccau

SEQ ID NO: 1844486 - RNA, 16 nt, Homo sapiens
accauguacauagcuu

SEQ ID NO: 1844487 - RNA, 20 nt, Homo sapiens
aaagcugggaggccaaacac

SEQ ID NO: 1844488 - RNA, 13 nt, Homo sapiens
uuaaggucucucu

SEQ ID NO: 1844489 - RNA, 16 nt, Homo sapiens
ucagguagccaccacc

SEQ ID NO: 1844490 - RNA, 19 nt, Homo sapiens
aaaaguuaaugaauaugcc

SEQ ID NO: 1844491 - RNA, 23 nt, Homo sapiens
aucaggacuugggaaacagagaa

SEQ ID NO: 1844492 - RNA, 22 nt, Homo sapiens
agucuguugugugucaugccag

SEQ ID NO: 1844493 - RNA, 21 nt, Homo sapiens
gggucacgcuugccuggucac

SEQ ID NO: 1844494 - RNA, 18 nt, Homo sapiens
uugcuuucgguacuguaa

SEQ ID NO: 1844495 - RNA, 13 nt, Homo sapiens
ucuauaaugugcc

SEQ ID NO: 1844496 - RNA, 20 nt, Homo sapiens
auacuaauuuuugcuuaaca

SEQ ID NO: 1844497 - RNA, 19 nt, Homo sapiens
aggucauacaugcauacaa

SEQ ID NO: 1844498 - RNA, 14 nt, Homo sapiens
ucaaagcacuguuu

SEQ ID NO: 1844499 - RNA, 18 nt, Homo sapiens
aagcuaguguaccuccuc

SEQ ID NO: 1844500 - RNA, 23 nt, Homo sapiens
guuguucugcucaauacaucuca

SEQ ID NO: 1844501 - RNA, 12 nt, Homo sapiens
ucaaugucuucc

SEQ ID NO: 1844502 - RNA, 14 nt, Homo sapiens
aaguaaaagcagca

SEQ ID NO: 1844503 - RNA, 22 nt, Homo sapiens
cugcaagcuuuucaaaauugga

SEQ ID NO: 1844504 - RNA, 13 nt, Homo sapiens
cacaaagaugugc

SEQ ID NO: 1844505 - RNA, 16 nt, Homo sapiens
uggcuuuucuuuacca

SEQ ID NO: 1844506 - RNA, 16 nt, Homo sapiens
gaucaguacugacuuu

SEQ ID NO: 1844507 - RNA, 18 nt, Homo sapiens
uagaaacacacuuuugca

SEQ ID NO: 1844508 - RNA, 22 nt, Homo sapiens
gaguguaggugaaaugaaugaa

SEQ ID NO: 1844509 - RNA, 18 nt, Homo sapiens
uuuuauuaauuuauaugu

SEQ ID NO: 1844510 - RNA, 14 nt, Homo sapiens
cuacauaauuguga

SEQ ID NO: 1844511 - RNA, 20 nt, Homo sapiens
cuccaucugacaaauucaaa

SEQ ID NO: 1844512 - RNA, 15 nt, Homo sapiens
uccaaucggagacaa

SEQ ID NO: 1844513 - RNA, 16 nt, Homo sapiens
aauagauuacugaugu

SEQ ID NO: 1844514 - RNA, 15 nt, Homo sapiens
acacaaucacuccau

SEQ ID NO: 1844515 - RNA, 22 nt, Homo sapiens
aacauuugugauauauguauua

SEQ ID NO: 1844516 - RNA, 14 nt, Homo sapiens
gccaggacugugac

SEQ ID NO: 1844517 - RNA, 17 nt, Homo sapiens
acauccccuucugcaau

SEQ ID NO: 1844518 - RNA, 22 nt, Homo sapiens
augaucaaguccuuugugaaua

SEQ ID NO: 1844519 - RNA, 19 nt, Homo sapiens
ucacucaagcacugauauc

SEQ ID NO: 1844520 - RNA, 18 nt, Homo sapiens
agcuccucuccuugggcu

SEQ ID NO: 1844521 - RNA, 21 nt, Homo sapiens
ccagaggcuucuccaaaggga

SEQ ID NO: 1844522 - RNA, 19 nt, Homo sapiens
ccucgcugccagaugauug

SEQ ID NO: 1844523 - RNA, 19 nt, Homo sapiens
ggcagaccugaaucacaac

SEQ ID NO: 1844524 - RNA, 21 nt, Homo sapiens
uaaauuuuagaauauuuucua

SEQ ID NO: 1844525 - RNA, 19 nt, Homo sapiens
agaaaucauguuaugauaa

SEQ ID NO: 1844526 - RNA, 18 nt, Homo sapiens
caugagaaagaauuugag

SEQ ID NO: 1844527 - RNA, 18 nt, Homo sapiens
gugaugucauacagagaa

SEQ ID NO: 1844528 - RNA, 15 nt, Homo sapiens
uaagcucagugcucu

SEQ ID NO: 1844529 - RNA, 15 nt, Homo sapiens
guaaugccuuuucuc

SEQ ID NO: 1844530 - RNA, 22 nt, Homo sapiens
auuucuuugauuuaacugacuu

SEQ ID NO: 1844531 - RNA, 19 nt, Homo sapiens
augugauccugccuugcug

SEQ ID NO: 1844532 - RNA, 15 nt, Homo sapiens
cuacuguucuugaca

SEQ ID NO: 1844533 - RNA, 19 nt, Homo sapiens
aaucccaucuauucucugc

SEQ ID NO: 1844534 - RNA, 18 nt, Homo sapiens
uguguagcucucacaugc

SEQ ID NO: 1844535 - RNA, 19 nt, Homo sapiens
gaucuccaacagccagugu

SEQ ID NO: 1844536 - RNA, 22 nt, Homo sapiens
gaaccuggauccagcacuggug

SEQ ID NO: 1844537 - RNA, 13 nt, Homo sapiens
ucccacuuucauc

SEQ ID NO: 1844538 - RNA, 14 nt, Homo sapiens
auuugaagcucaga

SEQ ID NO: 1844539 - RNA, 22 nt, Homo sapiens
cucaacuuacauaugucuucaa

SEQ ID NO: 1844540 - RNA, 15 nt, Homo sapiens
cuucagauguuggua

SEQ ID NO: 1844541 - RNA, 19 nt, Homo sapiens
cucuauugcugcucucuca

SEQ ID NO: 1844542 - RNA, 17 nt, Homo sapiens
ucuccaccuuccaaaga

SEQ ID NO: 1844543 - RNA, 13 nt, Homo sapiens
aaaauaaauggac

SEQ ID NO: 1844544 - RNA, 21 nt, Homo sapiens
cauauaggccagaguugcaaa

SEQ ID NO: 1844545 - RNA, 13 nt, Homo sapiens
auaauucuuccaa

SEQ ID NO: 1844546 - RNA, 16 nt, Homo sapiens
ugcccaucagccauuu

SEQ ID NO: 1844547 - RNA, 16 nt, Homo sapiens
gaagauguguaaacag

SEQ ID NO: 1844548 - RNA, 22 nt, Homo sapiens
uggggcuggccucccaaaugag

SEQ ID NO: 1844549 - RNA, 17 nt, Homo sapiens
gagaugaggugcucaau

SEQ ID NO: 1844550 - RNA, 20 nt, Homo sapiens
ccagccccugcagauucuga

SEQ ID NO: 1844551 - RNA, 16 nt, Homo sapiens
ccgaugaacaaguuua

SEQ ID NO: 1844552 - RNA, 20 nt, Homo sapiens
caggcacuguucaucucagc

SEQ ID NO: 1844553 - RNA, 13 nt, Homo sapiens
gacacauucacac

SEQ ID NO: 1844554 - RNA, 11 nt, Homo sapiens
gugacuuugaa

SEQ ID NO: 1844555 - RNA, 14 nt, Homo sapiens
acaagugaugcuaa

SEQ ID NO: 1844556 - RNA, 15 nt, Homo sapiens
uucugcuaugugacu

SEQ ID NO: 1844557 - RNA, 15 nt, Homo sapiens
ugugaccauucugcc

SEQ ID NO: 1844558 - RNA, 13 nt, Homo sapiens
ucugugcugugag

SEQ ID NO: 1844559 - RNA, 16 nt, Homo sapiens
agugaaguugcugcuu

SEQ ID NO: 1844560 - RNA, 19 nt, Homo sapiens
aaaaagucauaaaauguau

SEQ ID NO: 1844561 - RNA, 23 nt, Homo sapiens
aauaaaugugagaacuguucuca

SEQ ID NO: 1844562 - RNA, 15 nt, Homo sapiens
acaaacugccuguua

SEQ ID NO: 1844563 - RNA, 22 nt, Homo sapiens
gcaguguacguuuuauuacuua

SEQ ID NO: 1844564 - RNA, 20 nt, Homo sapiens
uuucaaaguguugaugguaa

SEQ ID NO: 1844565 - RNA, 13 nt, Homo sapiens
cucuacuaccugu

SEQ ID NO: 1844566 - RNA, 21 nt, Homo sapiens
uagugacucuugaaguacuua

SEQ ID NO: 1844567 - RNA, 20 nt, Homo sapiens
ggauaaggaggcacugcuga

SEQ ID NO: 1844568 - RNA, 14 nt, Homo sapiens
uagaugaaugucag

SEQ ID NO: 1844569 - RNA, 14 nt, Homo sapiens
uaucugaauggaag

SEQ ID NO: 1844570 - RNA, 17 nt, Homo sapiens
ggggcauaaacuuuccu

SEQ ID NO: 1844571 - RNA, 20 nt, Homo sapiens
aucucaggagcuugcaagaa

SEQ ID NO: 1844572 - RNA, 13 nt, Homo sapiens
uuuguaaugcugc

SEQ ID NO: 1844573 - RNA, 13 nt, Homo sapiens
agagcacacugua

SEQ ID NO: 1844574 - RNA, 13 nt, Homo sapiens
auuguuucauuca

SEQ ID NO: 1844575 - RNA, 18 nt, Homo sapiens
guggaugauaccauuucc

SEQ ID NO: 1844576 - RNA, 18 nt, Homo sapiens
cauuuauauagauuauaa

SEQ ID NO: 1844577 - RNA, 14 nt, Homo sapiens
aacaauucaaucaa

SEQ ID NO: 1844578 - RNA, 12 nt, Homo sapiens
gacuacauugaa

SEQ ID NO: 1844579 - RNA, 18 nt, Homo sapiens
gagaaaguaacacaaaca

SEQ ID NO: 1844580 - RNA, 16 nt, Homo sapiens
acuguugagaaaaaag

SEQ ID NO: 1844581 - RNA, 21 nt, Homo sapiens
guaaauuaguuugacacugcu

SEQ ID NO: 1844582 - RNA, 20 nt, Homo sapiens
aaaauuuuguaaaacaaugc

SEQ ID NO: 1844583 - RNA, 19 nt, Homo sapiens
cagugcaagagacucuggc

SEQ ID NO: 1844584 - RNA, 22 nt, Homo sapiens
ugcaggaccuugggcacaucug

SEQ ID NO: 1844585 - RNA, 17 nt, Homo sapiens
aucuauuuucuauguac

SEQ ID NO: 1844586 - RNA, 20 nt, Homo sapiens
cucaaguuucuucaaucuga

SEQ ID NO: 1844587 - RNA, 23 nt, Homo sapiens
accguggagcuuaagccacugcc

SEQ ID NO: 1844588 - RNA, 19 nt, Homo sapiens
caacacuucucacaucuua

SEQ ID NO: 1844589 - RNA, 16 nt, Homo sapiens
cuucucacaucugucc

SEQ ID NO: 1844590 - RNA, 23 nt, Homo sapiens
agaaugaagucuuucccugguga

SEQ ID NO: 1844591 - RNA, 12 nt, Homo sapiens
acuucuuccagg

SEQ ID NO: 1844592 - RNA, 19 nt, Homo sapiens
cuuacccccaccacuaaga

SEQ ID NO: 1844593 - RNA, 20 nt, Homo sapiens
cccguguguauuucuaagaa

SEQ ID NO: 1844594 - RNA, 20 nt, Homo sapiens
gagguagguagauugcuuga

SEQ ID NO: 1844595 - RNA, 22 nt, Homo sapiens
uccaaggguaugggaagccaua

SEQ ID NO: 1844596 - RNA, 18 nt, Homo sapiens
cuguguauuauuuggacg

SEQ ID NO: 1844597 - RNA, 17 nt, Homo sapiens
ugaagcuggaagcacug

SEQ ID NO: 1844598 - RNA, 21 nt, Homo sapiens
gaauagacacuucaccaaaga

SEQ ID NO: 1844599 - RNA, 13 nt, Homo sapiens
ugacuacagccug

SEQ ID NO: 1844600 - RNA, 18 nt, Homo sapiens
aagauggcaacuguauua

SEQ ID NO: 1844601 - RNA, 22 nt, Homo sapiens
cacagcaguacuugcucaauaa

SEQ ID NO: 1844602 - RNA, 19 nt, Homo sapiens
gaaaaccuaccacauucac

SEQ ID NO: 1844603 - RNA, 14 nt, Homo sapiens
aaaaagacacuuga

SEQ ID NO: 1844604 - RNA, 18 nt, Homo sapiens
cacacuuuuccacauucc

SEQ ID NO: 1844605 - RNA, 20 nt, Homo sapiens
gcuucucuaaaacagcacua

SEQ ID NO: 1844606 - RNA, 18 nt, Homo sapiens
cuccagggaauucuuaca

SEQ ID NO: 1844607 - RNA, 15 nt, Homo sapiens
agacuguugcucaaa

SEQ ID NO: 1844608 - RNA, 20 nt, Homo sapiens
gcuccucuccccagcccaga

SEQ ID NO: 1844609 - RNA, 12 nt, Homo sapiens
guagaaucucag

SEQ ID NO: 1844610 - RNA, 14 nt, Homo sapiens
cccuggcuguaaua

SEQ ID NO: 1844611 - RNA, 19 nt, Homo sapiens
gaagcccauuccucugcca

SEQ ID NO: 1844612 - RNA, 21 nt, Homo sapiens
uaaauaaagaagaaaauaacc

SEQ ID NO: 1844613 - RNA, 15 nt, Homo sapiens
aaugggaccgugccc

SEQ ID NO: 1844614 - RNA, 17 nt, Homo sapiens
ucauacauuagugccau

SEQ ID NO: 1844615 - RNA, 22 nt, Homo sapiens
aaauguuuugaguguuauuuca

SEQ ID NO: 1844616 - RNA, 14 nt, Homo sapiens
ucaaagacuguauu

SEQ ID NO: 1844617 - RNA, 17 nt, Homo sapiens
gcaccuacuuacaugca

SEQ ID NO: 1844618 - RNA, 17 nt, Homo sapiens
uggugaaauggcuggag

SEQ ID NO: 1844619 - RNA, 12 nt, Homo sapiens
cucacugcagua

SEQ ID NO: 1844620 - RNA, 12 nt, Homo sapiens
cucccugcaguc

SEQ ID NO: 1844621 - RNA, 18 nt, Homo sapiens
gucauuaaacaugacauu

SEQ ID NO: 1844622 - RNA, 14 nt, Homo sapiens
agaggaaaaugccu

SEQ ID NO: 1844623 - RNA, 14 nt, Homo sapiens
acuuucuaaaugcc

SEQ ID NO: 1844624 - RNA, 20 nt, Homo sapiens
ccuugauuuccagccgcaau

SEQ ID NO: 1844625 - RNA, 20 nt, Homo sapiens
cccuguggccaacugcaaaa

SEQ ID NO: 1844626 - RNA, 20 nt, Homo sapiens
uccacaacuugagaagacau

SEQ ID NO: 1844627 - RNA, 19 nt, Homo sapiens
auggugguaaacauucucu

SEQ ID NO: 1844628 - RNA, 22 nt, Homo sapiens
guguaugguuuuugagauauua

SEQ ID NO: 1844629 - RNA, 15 nt, Homo sapiens
cuucagugugguaca

SEQ ID NO: 1844630 - RNA, 21 nt, Homo sapiens
ggguacugagagucugcacuu

SEQ ID NO: 1844631 - RNA, 16 nt, Homo sapiens
aagcucuaaagaccau

SEQ ID NO: 1844632 - RNA, 18 nt, Homo sapiens
ucaucaccacugacagau

SEQ ID NO: 1844633 - RNA, 22 nt, Homo sapiens
aaguuauugauaaguucauaca

SEQ ID NO: 1844634 - RNA, 23 nt, Homo sapiens
cauuaguuguuagugauggagcu

SEQ ID NO: 1844635 - RNA, 20 nt, Homo sapiens
ucacaacacagagcugcuau

SEQ ID NO: 1844636 - RNA, 12 nt, Homo sapiens
guugcucuguau

SEQ ID NO: 1844637 - RNA, 15 nt, Homo sapiens
cagaagcugcuccuu

SEQ ID NO: 1844638 - RNA, 16 nt, Homo sapiens
ccagcaugacgguguc

SEQ ID NO: 1844639 - RNA, 16 nt, Homo sapiens
cagaugugaaaacauc

SEQ ID NO: 1844640 - RNA, 16 nt, Homo sapiens
uccauccauccuucca

SEQ ID NO: 1844641 - RNA, 17 nt, Homo sapiens
uugcucccaggaucucc

SEQ ID NO: 1844642 - RNA, 20 nt, Homo sapiens
uuauauacuggaaauaaccu

SEQ ID NO: 1844643 - RNA, 14 nt, Homo sapiens
uuugaaaucccauc

SEQ ID NO: 1844644 - RNA, 23 nt, Homo sapiens
uuaauuugaaaacauaaucugca

SEQ ID NO: 1844645 - RNA, 13 nt, Homo sapiens
ugcacacucaguu

SEQ ID NO: 1844646 - RNA, 14 nt, Homo sapiens
auucuccaucucaa

SEQ ID NO: 1844647 - RNA, 19 nt, Homo sapiens
ucuggcaaugggacucuga

SEQ ID NO: 1844648 - RNA, 12 nt, Homo sapiens
agaccaggugug

SEQ ID NO: 1844649 - RNA, 22 nt, Homo sapiens
agcaggguagcuauuacugucc

SEQ ID NO: 1844650 - RNA, 17 nt, Homo sapiens
ugccaucgcugugaugc

SEQ ID NO: 1844651 - RNA, 23 nt, Homo sapiens
caaaggaacauugugucuaggau

SEQ ID NO: 1844652 - RNA, 14 nt, Homo sapiens
auugucauuaguga

SEQ ID NO: 1844653 - RNA, 20 nt, Homo sapiens
aagcauuugcaacagcuaca

SEQ ID NO: 1844654 - RNA, 11 nt, Homo sapiens
uaaauguaaua

SEQ ID NO: 1844655 - RNA, 14 nt, Homo sapiens
guacaguauucaau

SEQ ID NO: 1844656 - RNA, 19 nt, Homo sapiens
ucccgcgugaagaugucac

SEQ ID NO: 1844657 - RNA, 19 nt, Homo sapiens
acauccuggccuggcacau

SEQ ID NO: 1844658 - RNA, 16 nt, Homo sapiens
gauuuucaacauuuca

SEQ ID NO: 1844659 - RNA, 17 nt, Homo sapiens
aaaauacaaacauucua

SEQ ID NO: 1844660 - RNA, 12 nt, Homo sapiens
aagaauggaauc

SEQ ID NO: 1844661 - RNA, 17 nt, Homo sapiens
acucuaggcagugacag

SEQ ID NO: 1844662 - RNA, 21 nt, Homo sapiens
aauggccaaguguacauuuga

SEQ ID NO: 1844663 - RNA, 15 nt, Homo sapiens
ugaaggcccaugaag

SEQ ID NO: 1844664 - RNA, 21 nt, Homo sapiens
uaauuuugaaaaacugcucau

SEQ ID NO: 1844665 - RNA, 18 nt, Homo sapiens
cagaaagcagaacaguga

SEQ ID NO: 1844666 - RNA, 15 nt, Homo sapiens
auggagaccgugacc

SEQ ID NO: 1844667 - RNA, 18 nt, Homo sapiens
cuguuaauaguacuauua

SEQ ID NO: 1844668 - RNA, 13 nt, Homo sapiens
gcaguauaagccu

SEQ ID NO: 1844669 - RNA, 17 nt, Homo sapiens
uaauguggccauuucac

SEQ ID NO: 1844670 - RNA, 23 nt, Homo sapiens
cugccaagcuuccugugcccuca

SEQ ID NO: 1844671 - RNA, 15 nt, Homo sapiens
agauccuaccccuga

SEQ ID NO: 1844672 - RNA, 14 nt, Homo sapiens
uucuuccagauaau

SEQ ID NO: 1844673 - RNA, 14 nt, Homo sapiens
ugcucuuaaccuca

SEQ ID NO: 1844674 - RNA, 14 nt, Homo sapiens
uccacauaagcacu

SEQ ID NO: 1844675 - RNA, 24 nt, Homo sapiens
cccauucccugggaucuggugguc

SEQ ID NO: 1844676 - RNA, 20 nt, Homo sapiens
uacgacccuuuugagccuag

SEQ ID NO: 1844677 - RNA, 14 nt, Homo sapiens
cuucuucuuuagga

SEQ ID NO: 1844678 - RNA, 18 nt, Homo sapiens
ugaaaaccauaugauauu

SEQ ID NO: 1844679 - RNA, 16 nt, Homo sapiens
acaaacaauaccugaa

SEQ ID NO: 1844680 - RNA, 15 nt, Homo sapiens
aguguuccugagaca

SEQ ID NO: 1844681 - RNA, 16 nt, Homo sapiens
aaugcugacuggacug

SEQ ID NO: 1844682 - RNA, 13 nt, Homo sapiens
aucugcuccuagc

SEQ ID NO: 1844683 - RNA, 20 nt, Homo sapiens
cuuuuguugaaauagcuuua

SEQ ID NO: 1844684 - RNA, 17 nt, Homo sapiens
ccaggaggcuggcagua

SEQ ID NO: 1844685 - RNA, 21 nt, Homo sapiens
auuuaugcgaaccuaugucua

SEQ ID NO: 1844686 - RNA, 12 nt, Homo sapiens
cccguugugccu

SEQ ID NO: 1844687 - RNA, 20 nt, Homo sapiens
auaacaaauuaaaagcuaua

SEQ ID NO: 1844688 - RNA, 16 nt, Homo sapiens
auuacaauacaucuaa

SEQ ID NO: 1844689 - RNA, 21 nt, Homo sapiens
aggagguggcguccagcaguc

SEQ ID NO: 1844690 - RNA, 19 nt, Homo sapiens
uguacgcugcugcaggaca

SEQ ID NO: 1844691 - RNA, 21 nt, Homo sapiens
ucuccuuaucuuuauuggcuu

SEQ ID NO: 1844692 - RNA, 20 nt, Homo sapiens
gaauggccuuucaccuucuc

SEQ ID NO: 1844693 - RNA, 16 nt, Homo sapiens
caggcaguagcagcug

SEQ ID NO: 1844694 - RNA, 20 nt, Homo sapiens
cuucaacacagcuugucucu

SEQ ID NO: 1844695 - RNA, 20 nt, Homo sapiens
uacaaaguuauauucacagu

SEQ ID NO: 1844696 - RNA, 18 nt, Homo sapiens
uguuauuaaaaaauguga

SEQ ID NO: 1844697 - RNA, 21 nt, Homo sapiens
aaccaccccauaccagucacc

SEQ ID NO: 1844698 - RNA, 12 nt, Homo sapiens
uuauugccucac

SEQ ID NO: 1844699 - RNA, 11 nt, Homo sapiens
cugccaaaaag

SEQ ID NO: 1844700 - RNA, 23 nt, Homo sapiens
uccuagaauggaugugcucacug

SEQ ID NO: 1844701 - RNA, 15 nt, Homo sapiens
aggcagaguuugccu

SEQ ID NO: 1844702 - RNA, 16 nt, Homo sapiens
ccccuacugcugugaa

SEQ ID NO: 1844703 - RNA, 18 nt, Homo sapiens
cuacuacagcacugugau

SEQ ID NO: 1844704 - RNA, 12 nt, Homo sapiens
acguguggaauu

SEQ ID NO: 1844705 - RNA, 22 nt, Homo sapiens
acucagaaaauggggcuugccc

SEQ ID NO: 1844706 - RNA, 18 nt, Homo sapiens
aaaaaggaauuuuguaaa

SEQ ID NO: 1844707 - RNA, 17 nt, Homo sapiens
auggagcaugaauggua

SEQ ID NO: 1844708 - RNA, 22 nt, Homo sapiens
acagcuugggaggaaaccugag

SEQ ID NO: 1844709 - RNA, 14 nt, Homo sapiens
agcugggagccugg

SEQ ID NO: 1844710 - RNA, 20 nt, Homo sapiens
uagucugcgucucugcuuua

SEQ ID NO: 1844711 - RNA, 16 nt, Homo sapiens
cuacaaauagugcuaa

SEQ ID NO: 1844712 - RNA, 12 nt, Homo sapiens
cauccuugaugc

SEQ ID NO: 1844713 - RNA, 23 nt, Homo sapiens
cugggguuggagguuucacuugc

SEQ ID NO: 1844714 - RNA, 18 nt, Homo sapiens
uugagaauacacuaucaa

SEQ ID NO: 1844715 - RNA, 19 nt, Homo sapiens
ucaggagaucuggcuguga

SEQ ID NO: 1844716 - RNA, 13 nt, Homo sapiens
agccgggcaugac

SEQ ID NO: 1844717 - RNA, 22 nt, Homo sapiens
gcucccacaaugcugaugaaaa

SEQ ID NO: 1844718 - RNA, 15 nt, Homo sapiens
cauuuuuaacagcau

SEQ ID NO: 1844719 - RNA, 11 nt, Homo sapiens
auguccauuuu

SEQ ID NO: 1844720 - RNA, 21 nt, Homo sapiens
ccccgugaagcaaucauuucc

SEQ ID NO: 1844721 - RNA, 17 nt, Homo sapiens
gggccuguggggacuga

SEQ ID NO: 1844722 - RNA, 23 nt, Homo sapiens
gucacagguuuucagagaauuau

SEQ ID NO: 1844723 - RNA, 21 nt, Homo sapiens
uacgcacuggagcugcacugc

SEQ ID NO: 1844724 - RNA, 16 nt, Homo sapiens
guuuacaugagacuuu

SEQ ID NO: 1844725 - RNA, 19 nt, Homo sapiens
gaaauauucuuaggcagau

SEQ ID NO: 1844726 - RNA, 17 nt, Homo sapiens
cugauaauaauugauca

SEQ ID NO: 1844727 - RNA, 15 nt, Homo sapiens
auauuuauucaguga

SEQ ID NO: 1844728 - RNA, 15 nt, Homo sapiens
uuuguuuuacuuugu

SEQ ID NO: 1844729 - RNA, 21 nt, Homo sapiens
uguacaaugacacuuuuugca

SEQ ID NO: 1844730 - RNA, 13 nt, Homo sapiens
agcaguuuuguga

SEQ ID NO: 1844731 - RNA, 23 nt, Homo sapiens
gugugucgcuuaugucuauaacu

SEQ ID NO: 1844732 - RNA, 20 nt, Homo sapiens
caagucacccaggaugcugg

SEQ ID NO: 1844733 - RNA, 18 nt, Homo sapiens
auguuucugcuagcuaua

SEQ ID NO: 1844734 - RNA, 16 nt, Homo sapiens
uuagacaaaguucaag

SEQ ID NO: 1844735 - RNA, 12 nt, Homo sapiens
caucacaacauu

SEQ ID NO: 1844736 - RNA, 13 nt, Homo sapiens
ucacucuuguugc

SEQ ID NO: 1844737 - RNA, 23 nt, Homo sapiens
gccgaaaccugcaggcguucucu

SEQ ID NO: 1844738 - RNA, 12 nt, Homo sapiens
aagcauacuuug

SEQ ID NO: 1844739 - RNA, 18 nt, Homo sapiens
gcuucucuacagacucca

SEQ ID NO: 1844740 - RNA, 13 nt, Homo sapiens
uaaaccaguguga

SEQ ID NO: 1844741 - RNA, 22 nt, Homo sapiens
cuuucaguauguccccauaaga

SEQ ID NO: 1844742 - RNA, 22 nt, Homo sapiens
uuaauaguaccuaaaauugcaa

SEQ ID NO: 1844743 - RNA, 15 nt, Homo sapiens
ucacaucccuaugaa

SEQ ID NO: 1844744 - RNA, 17 nt, Homo sapiens
gucuugggggucagggg

SEQ ID NO: 1844745 - RNA, 22 nt, Homo sapiens
agaaagagagagauacaucuua

SEQ ID NO: 1844746 - RNA, 15 nt, Homo sapiens
accagagaccaaaug

SEQ ID NO: 1844747 - RNA, 17 nt, Homo sapiens
uuaguagcagaaauaua

SEQ ID NO: 1844748 - RNA, 18 nt, Homo sapiens
cuagaaucuggagagcua

SEQ ID NO: 1844749 - RNA, 14 nt, Homo sapiens
gcauggaacagcau

SEQ ID NO: 1844750 - RNA, 15 nt, Homo sapiens
gcaccauugcgcucu

SEQ ID NO: 1844751 - RNA, 15 nt, Homo sapiens
gcgccacugcacucc

SEQ ID NO: 1844752 - RNA, 20 nt, Homo sapiens
acugugagaggugacacugu

SEQ ID NO: 1844753 - RNA, 18 nt, Homo sapiens
uguaauuuaaaauuguga

SEQ ID NO: 1844754 - RNA, 18 nt, Homo sapiens
ccaagucucgcuacauuu

SEQ ID NO: 1844755 - RNA, 18 nt, Homo sapiens
uagaaaaacaucccaaga

SEQ ID NO: 1844756 - RNA, 17 nt, Homo sapiens
cagccucagcucucagu

SEQ ID NO: 1844757 - RNA, 17 nt, Homo sapiens
agugggaacucugacaa

SEQ ID NO: 1844758 - RNA, 14 nt, Homo sapiens
cauccugagccaaa

SEQ ID NO: 1844759 - RNA, 13 nt, Homo sapiens
aagugcacuuuaa

SEQ ID NO: 1844760 - RNA, 11 nt, Homo sapiens
auaacagcuaa

SEQ ID NO: 1844761 - RNA, 18 nt, Homo sapiens
agcugccauaauaaugcc

SEQ ID NO: 1844762 - RNA, 11 nt, Homo sapiens
uauacagcauu

SEQ ID NO: 1844763 - RNA, 20 nt, Homo sapiens
cagcuuuucccaaaagccca

SEQ ID NO: 1844764 - RNA, 22 nt, Homo sapiens
gcuaccaaaaacuagacauuau

SEQ ID NO: 1844765 - RNA, 20 nt, Homo sapiens
cagagcaagacccugucuca

SEQ ID NO: 1844766 - RNA, 17 nt, Homo sapiens
caccuguaauuccagca

SEQ ID NO: 1844767 - RNA, 16 nt, Homo sapiens
ggccagugagccacuc

SEQ ID NO: 1844768 - RNA, 21 nt, Homo sapiens
uccagguggagacccugagaa

SEQ ID NO: 1844769 - RNA, 22 nt, Homo sapiens
acaggacauggggcuccuggaa

SEQ ID NO: 1844770 - RNA, 14 nt, Homo sapiens
aguauuucucagga

SEQ ID NO: 1844771 - RNA, 18 nt, Homo sapiens
gcucuuccuuacucccag

SEQ ID NO: 1844772 - RNA, 14 nt, Homo sapiens
acgagcuggaaccc

SEQ ID NO: 1844773 - RNA, 15 nt, Homo sapiens
ugaaauacucuucca

SEQ ID NO: 1844774 - RNA, 14 nt, Homo sapiens
auauuuaucuuuca

SEQ ID NO: 1844775 - RNA, 17 nt, Homo sapiens
uauaugcuuuuucucag

SEQ ID NO: 1844776 - RNA, 18 nt, Homo sapiens
uucaaagcugcuugcugu

SEQ ID NO: 1844777 - RNA, 19 nt, Homo sapiens
ugagccaaaaugacuuuga

SEQ ID NO: 1844778 - RNA, 15 nt, Homo sapiens
ugagcucuucccuua

SEQ ID NO: 1844779 - RNA, 19 nt, Homo sapiens
auagacuuauugccaaaaa

SEQ ID NO: 1844780 - RNA, 14 nt, Homo sapiens
guaugucugccuaa

SEQ ID NO: 1844781 - RNA, 16 nt, Homo sapiens
cuugcaguugcucuga

SEQ ID NO: 1844782 - RNA, 17 nt, Homo sapiens
cauuucaaauaacugca

SEQ ID NO: 1844783 - RNA, 20 nt, Homo sapiens
uuuaagccgcagaccuggag

SEQ ID NO: 1844784 - RNA, 15 nt, Homo sapiens
aaccccaaacaguga

SEQ ID NO: 1844785 - RNA, 14 nt, Homo sapiens
caacgaguacuuca

SEQ ID NO: 1844786 - RNA, 22 nt, Homo sapiens
cuggaauuuucagucaucucau

SEQ ID NO: 1844787 - RNA, 17 nt, Homo sapiens
uggaaaagaagaaacuu

SEQ ID NO: 1844788 - RNA, 17 nt, Homo sapiens
aagaguagugcauuuaa

SEQ ID NO: 1844789 - RNA, 19 nt, Homo sapiens
ugaggcuauggaggguccu

SEQ ID NO: 1844790 - RNA, 13 nt, Homo sapiens
aaccgugugcucc

SEQ ID NO: 1844791 - RNA, 21 nt, Homo sapiens
cugacgcucaguaaccaugca

SEQ ID NO: 1844792 - RNA, 14 nt, Homo sapiens
cuguaacugcauua

SEQ ID NO: 1844793 - RNA, 13 nt, Homo sapiens
acuaaagauuaaa

SEQ ID NO: 1844794 - RNA, 18 nt, Homo sapiens
guaaacacgccugcaaac

SEQ ID NO: 1844795 - RNA, 15 nt, Homo sapiens
gauauucacucugug

SEQ ID NO: 1844796 - RNA, 13 nt, Homo sapiens
uuuggugacuuca

SEQ ID NO: 1844797 - RNA, 23 nt, Homo sapiens
auauaagucuugguaacaaauaa

SEQ ID NO: 1844798 - RNA, 18 nt, Homo sapiens
ccauggacacuacaccca

SEQ ID NO: 1844799 - RNA, 22 nt, Homo sapiens
gaaguggggcuaggucuugcca

SEQ ID NO: 1844800 - RNA, 18 nt, Homo sapiens
uauucuaagccaguuuuc

SEQ ID NO: 1844801 - RNA, 21 nt, Homo sapiens
aaaauacaguauucuguacca

SEQ ID NO: 1844802 - RNA, 16 nt, Homo sapiens
uggaaggaacauggag

SEQ ID NO: 1844803 - RNA, 20 nt, Homo sapiens
acccacaagaacuccuccca

SEQ ID NO: 1844804 - RNA, 22 nt, Homo sapiens
gcacauauccaggcaccaggac

SEQ ID NO: 1844805 - RNA, 19 nt, Homo sapiens
uuaaaaaaauuacugugaa

SEQ ID NO: 1844806 - RNA, 22 nt, Homo sapiens
uuuaauguuaaauucaauguag

SEQ ID NO: 1844807 - RNA, 20 nt, Homo sapiens
cauucuguauaaaugcaaau

SEQ ID NO: 1844808 - RNA, 21 nt, Homo sapiens
uuuuucuguaucccgcuguaa

SEQ ID NO: 1844809 - RNA, 14 nt, Homo sapiens
ccuugaugcucaua

SEQ ID NO: 1844810 - RNA, 16 nt, Homo sapiens
uuagagcuuuaccuaa

SEQ ID NO: 1844811 - RNA, 15 nt, Homo sapiens
cucuuaacuccuagc

SEQ ID NO: 1844812 - RNA, 19 nt, Homo sapiens
cagcuucuuaguuacuuug

SEQ ID NO: 1844813 - RNA, 13 nt, Homo sapiens
ggcuugaagccaa

SEQ ID NO: 1844814 - RNA, 14 nt, Homo sapiens
aaacaaucuuccaa

SEQ ID NO: 1844815 - RNA, 23 nt, Homo sapiens
gaugcuacgcuccagcugaucca

SEQ ID NO: 1844816 - RNA, 22 nt, Homo sapiens
guggucccucugugucugcucu

SEQ ID NO: 1844817 - RNA, 20 nt, Homo sapiens
uucuucuuuuguguccugcu

SEQ ID NO: 1844818 - RNA, 18 nt, Homo sapiens
cagacaggguucauugaa

SEQ ID NO: 1844819 - RNA, 14 nt, Homo sapiens
auugcuaaccacug

SEQ ID NO: 1844820 - RNA, 18 nt, Homo sapiens
aggaaaaaaagcaaaaag

SEQ ID NO: 1844821 - RNA, 12 nt, Homo sapiens
cccugucuugcu

SEQ ID NO: 1844822 - RNA, 22 nt, Homo sapiens
uccagggaugagccaaaccagc

SEQ ID NO: 1844823 - RNA, 20 nt, Homo sapiens
uccaacuccugaccucaggu

SEQ ID NO: 1844824 - RNA, 15 nt, Homo sapiens
uaaaagccccagcuu

SEQ ID NO: 1844825 - RNA, 22 nt, Homo sapiens
cugacugcugugggcugcucac

SEQ ID NO: 1844826 - RNA, 17 nt, Homo sapiens
uuucccuguuucuucca

SEQ ID NO: 1844827 - RNA, 16 nt, Homo sapiens
augcauguacccuaag

SEQ ID NO: 1844828 - RNA, 17 nt, Homo sapiens
acuuccuuuaaagauga

SEQ ID NO: 1844829 - RNA, 17 nt, Homo sapiens
ucuuuguaaaacaaaga

SEQ ID NO: 1844830 - RNA, 18 nt, Homo sapiens
cucaaacgguacacagac

SEQ ID NO: 1844831 - RNA, 17 nt, Homo sapiens
aaagggccuugacauca

SEQ ID NO: 1844832 - RNA, 22 nt, Homo sapiens
ggguuuuguggucaucuauucu

SEQ ID NO: 1844833 - RNA, 20 nt, Homo sapiens
cuuauuucuagaagcacaug

SEQ ID NO: 1844834 - RNA, 19 nt, Homo sapiens
aggagaugacuacauuuag

SEQ ID NO: 1844835 - RNA, 17 nt, Homo sapiens
ucuuauagaaagcacua

SEQ ID NO: 1844836 - RNA, 17 nt, Homo sapiens
gggcguucucccaaaga

SEQ ID NO: 1844837 - RNA, 13 nt, Homo sapiens
gaagccauauuca

SEQ ID NO: 1844838 - RNA, 13 nt, Homo sapiens
aaaggccugcaca

SEQ ID NO: 1844839 - RNA, 18 nt, Homo sapiens
uuccagugcugcaugcga

SEQ ID NO: 1844840 - RNA, 15 nt, Homo sapiens
ucaagcaggacccua

SEQ ID NO: 1844841 - RNA, 19 nt, Homo sapiens
caucagugcccuccaggau

SEQ ID NO: 1844842 - RNA, 14 nt, Homo sapiens
uuguaaauguacug

SEQ ID NO: 1844843 - RNA, 21 nt, Homo sapiens
cuuggcuggugugguacagag

SEQ ID NO: 1844844 - RNA, 16 nt, Homo sapiens
uggaaaccucaugcca

SEQ ID NO: 1844845 - RNA, 16 nt, Homo sapiens
ccuuauucccaguguu

SEQ ID NO: 1844846 - RNA, 19 nt, Homo sapiens
auauuuauuuaaagcauug

SEQ ID NO: 1844847 - RNA, 20 nt, Homo sapiens
ucccucauggaagaugcaag

SEQ ID NO: 1844848 - RNA, 23 nt, Homo sapiens
uccuguccagcuccaaccugcaa

SEQ ID NO: 1844849 - RNA, 16 nt, Homo sapiens
agcauggaugucaagu

SEQ ID NO: 1844850 - RNA, 12 nt, Homo sapiens
ucacaagcuauu

SEQ ID NO: 1844851 - RNA, 12 nt, Homo sapiens
ccuuaagccaac

SEQ ID NO: 1844852 - RNA, 15 nt, Homo sapiens
cuaccaucagggaca

SEQ ID NO: 1844853 - RNA, 23 nt, Homo sapiens
agguaggaugaacacaggcaaug

SEQ ID NO: 1844854 - RNA, 18 nt, Homo sapiens
uaaagugguucuggauau

SEQ ID NO: 1844855 - RNA, 13 nt, Homo sapiens
caauuauuaccau

SEQ ID NO: 1844856 - RNA, 21 nt, Homo sapiens
gaucauuacauggcugugguu

SEQ ID NO: 1844857 - RNA, 12 nt, Homo sapiens
ccucggugggag

SEQ ID NO: 1844858 - RNA, 12 nt, Homo sapiens
gguugaaggcag

SEQ ID NO: 1844859 - RNA, 20 nt, Homo sapiens
uacguuuguguggugacauu

SEQ ID NO: 1844860 - RNA, 20 nt, Homo sapiens
cggacuuagaaaaccagcuc

SEQ ID NO: 1844861 - RNA, 18 nt, Homo sapiens
aucuuggagaaugugaga

SEQ ID NO: 1844862 - RNA, 14 nt, Homo sapiens
uggccuuucacuuu

SEQ ID NO: 1844863 - RNA, 20 nt, Homo sapiens
ugccugugcuauuuuacuug

SEQ ID NO: 1844864 - RNA, 15 nt, Homo sapiens
gaacuggaccaucuc

SEQ ID NO: 1844865 - RNA, 14 nt, Homo sapiens
cucagucaaaugua

SEQ ID NO: 1844866 - RNA, 22 nt, Homo sapiens
gauggcucagagggggacugcu

SEQ ID NO: 1844867 - RNA, 19 nt, Homo sapiens
uuaaagagaguuugccacu

SEQ ID NO: 1844868 - RNA, 16 nt, Homo sapiens
gcaaagggaacaguga

SEQ ID NO: 1844869 - RNA, 20 nt, Homo sapiens
caguguuugggguguuucaa

SEQ ID NO: 1844870 - RNA, 22 nt, Homo sapiens
caauaggucuuucucucaguga

SEQ ID NO: 1844871 - RNA, 18 nt, Homo sapiens
ugguaaagagaugucaaa

SEQ ID NO: 1844872 - RNA, 13 nt, Homo sapiens
gccugcugguuuu

SEQ ID NO: 1844873 - RNA, 14 nt, Homo sapiens
aucgaucaugaugu

SEQ ID NO: 1844874 - RNA, 16 nt, Homo sapiens
cauuggcuacuauggc

SEQ ID NO: 1844875 - RNA, 20 nt, Homo sapiens
gacgccaggcaccacagccu

SEQ ID NO: 1844876 - RNA, 20 nt, Homo sapiens
uugaguugcugccacaaaca

SEQ ID NO: 1844877 - RNA, 15 nt, Homo sapiens
aaaggaacugcaaua

SEQ ID NO: 1844878 - RNA, 19 nt, Homo sapiens
auaaaguauuccaccuuaa

SEQ ID NO: 1844879 - RNA, 21 nt, Homo sapiens
uugaggaucuauuacugaccg

SEQ ID NO: 1844880 - RNA, 15 nt, Homo sapiens
auagccaacacccau

SEQ ID NO: 1844881 - RNA, 24 nt, Homo sapiens
ugcacagccuaguuaucaagggga

SEQ ID NO: 1844882 - RNA, 13 nt, Homo sapiens
uucaauguauuga

SEQ ID NO: 1844883 - RNA, 20 nt, Homo sapiens
caagccuagcccuucucuca

SEQ ID NO: 1844884 - RNA, 23 nt, Homo sapiens
gcuucauaaaugaagcagcuuua

SEQ ID NO: 1844885 - RNA, 23 nt, Homo sapiens
cugaaauuuuaauugaacuaaca

SEQ ID NO: 1844886 - RNA, 18 nt, Homo sapiens
aacccugugauacuauua

SEQ ID NO: 1844887 - RNA, 18 nt, Homo sapiens
ugcaggagagucggggga

SEQ ID NO: 1844888 - RNA, 12 nt, Homo sapiens
caggaacugugu

SEQ ID NO: 1844889 - RNA, 22 nt, Homo sapiens
cugcuucuuuucacuucagagc

SEQ ID NO: 1844890 - RNA, 14 nt, Homo sapiens
acuucugucuuccu

SEQ ID NO: 1844891 - RNA, 14 nt, Homo sapiens
ccauuuguauacuu

SEQ ID NO: 1844892 - RNA, 15 nt, Homo sapiens
gaccauaaagggaaa

SEQ ID NO: 1844893 - RNA, 19 nt, Homo sapiens
uggcacugguuuguucccu

SEQ ID NO: 1844894 - RNA, 12 nt, Homo sapiens
uuacagcaagaa

SEQ ID NO: 1844895 - RNA, 12 nt, Homo sapiens
ugacagcaauaa

SEQ ID NO: 1844896 - RNA, 13 nt, Homo sapiens
gucugcagucacc

SEQ ID NO: 1844897 - RNA, 16 nt, Homo sapiens
uaacagucugcaucau

SEQ ID NO: 1844898 - RNA, 19 nt, Homo sapiens
guucucccaccaccucacc

SEQ ID NO: 1844899 - RNA, 16 nt, Homo sapiens
ugcauggauacuacag

SEQ ID NO: 1844900 - RNA, 18 nt, Homo sapiens
aagucuuugaagugacuu

SEQ ID NO: 1844901 - RNA, 19 nt, Homo sapiens
ccucaucaguguguaaaua

SEQ ID NO: 1844902 - RNA, 15 nt, Homo sapiens
cuuuuaaaucaaaau

SEQ ID NO: 1844903 - RNA, 18 nt, Homo sapiens
acacccaaggauucuguu

SEQ ID NO: 1844904 - RNA, 15 nt, Homo sapiens
ugcaugagaauguca

SEQ ID NO: 1844905 - RNA, 15 nt, Homo sapiens
cuggaagaacaucaa

SEQ ID NO: 1844906 - RNA, 19 nt, Homo sapiens
aguaagaaaugggccucag

SEQ ID NO: 1844907 - RNA, 18 nt, Homo sapiens
uauccugacuucuaauau

SEQ ID NO: 1844908 - RNA, 21 nt, Homo sapiens
aguuaccucaugccgcugugu

SEQ ID NO: 1844909 - RNA, 15 nt, Homo sapiens
aaucuguacuaucca

SEQ ID NO: 1844910 - RNA, 13 nt, Homo sapiens
cuugaaguacuua

SEQ ID NO: 1844911 - RNA, 16 nt, Homo sapiens
cccggcgugugcagug

SEQ ID NO: 1844912 - RNA, 23 nt, Homo sapiens
auuuuauuguauaaaaaguuuca

SEQ ID NO: 1844913 - RNA, 19 nt, Homo sapiens
agaacucuaaccaguguac

SEQ ID NO: 1844914 - RNA, 13 nt, Homo sapiens
gccuugaaaaaga

SEQ ID NO: 1844915 - RNA, 19 nt, Homo sapiens
uaaagaagaaacuuguaaa

SEQ ID NO: 1844916 - RNA, 21 nt, Homo sapiens
aaucaugccauugcacuccag

SEQ ID NO: 1844917 - RNA, 17 nt, Homo sapiens
ucacucuuauugcccac

SEQ ID NO: 1844918 - RNA, 17 nt, Homo sapiens
auuccuuuccaguucau

SEQ ID NO: 1844919 - RNA, 20 nt, Homo sapiens
cuuuucaaccacaaaacuca

SEQ ID NO: 1844920 - RNA, 15 nt, Homo sapiens
aucuugauccuauga

SEQ ID NO: 1844921 - RNA, 19 nt, Homo sapiens
aaaacgcaaacaugaauau

SEQ ID NO: 1844922 - RNA, 15 nt, Homo sapiens
gcagagacugaaaau

SEQ ID NO: 1844923 - RNA, 13 nt, Homo sapiens
ugagauuacaggu

SEQ ID NO: 1844924 - RNA, 23 nt, Homo sapiens
agcuccuucuguccuacucugug

SEQ ID NO: 1844925 - RNA, 17 nt, Homo sapiens
cacaugguuacauauca

SEQ ID NO: 1844926 - RNA, 21 nt, Homo sapiens
ugccuucucuucuauccugca

SEQ ID NO: 1844927 - RNA, 10 nt, Homo sapiens
acucuugagc

SEQ ID NO: 1844928 - RNA, 12 nt, Homo sapiens
ccaacuaggcag

SEQ ID NO: 1844929 - RNA, 16 nt, Homo sapiens
augaacaugcaguuca

SEQ ID NO: 1844930 - RNA, 23 nt, Homo sapiens
caaacucuuuuuuaaaaauuacu

SEQ ID NO: 1844931 - RNA, 17 nt, Homo sapiens
caugauguuucuuccac

SEQ ID NO: 1844932 - RNA, 16 nt, Homo sapiens
uugguuagcuggacau

SEQ ID NO: 1844933 - RNA, 18 nt, Homo sapiens
uacguguggcuuggucac

SEQ ID NO: 1844934 - RNA, 20 nt, Homo sapiens
uggcugguuggugcuuuguu

SEQ ID NO: 1844935 - RNA, 17 nt, Homo sapiens
ccuggugagacugucca

SEQ ID NO: 1844936 - RNA, 21 nt, Homo sapiens
agcagaggaaaauaguggcag

SEQ ID NO: 1844937 - RNA, 16 nt, Homo sapiens
agaagaggacauugga

SEQ ID NO: 1844938 - RNA, 23 nt, Homo sapiens
cauccggcaugagggcugagaug

SEQ ID NO: 1844939 - RNA, 22 nt, Homo sapiens
gggucuucuugggcaccucucu

SEQ ID NO: 1844940 - RNA, 17 nt, Homo sapiens
aaacuugaugccagugg

SEQ ID NO: 1844941 - RNA, 14 nt, Homo sapiens
uauuuaagugcaau

SEQ ID NO: 1844942 - RNA, 20 nt, Homo sapiens
ucacaguccuggacuccugc

SEQ ID NO: 1844943 - RNA, 19 nt, Homo sapiens
acagugccgacagcucucc

SEQ ID NO: 1844944 - RNA, 12 nt, Homo sapiens
ucccucuacugu

SEQ ID NO: 1844945 - RNA, 22 nt, Homo sapiens
ucuggaaagaggcucuggacag

SEQ ID NO: 1844946 - RNA, 19 nt, Homo sapiens
agucccugcagcccuuugc

SEQ ID NO: 1844947 - RNA, 22 nt, Homo sapiens
cuaugcaaacaaaauccaagau

SEQ ID NO: 1844948 - RNA, 14 nt, Homo sapiens
agcaccaucucugc

SEQ ID NO: 1844949 - RNA, 13 nt, Homo sapiens
auaaaaaccauaa

SEQ ID NO: 1844950 - RNA, 15 nt, Homo sapiens
agcucuuuugagcau

SEQ ID NO: 1844951 - RNA, 18 nt, Homo sapiens
gaauaagucauggagccu

SEQ ID NO: 1844952 - RNA, 18 nt, Homo sapiens
ucaaugggcucuuccaac

SEQ ID NO: 1844953 - RNA, 21 nt, Homo sapiens
aagaaauccugugugucgcuu

SEQ ID NO: 1844954 - RNA, 12 nt, Homo sapiens
auugcccaugau

SEQ ID NO: 1844955 - RNA, 17 nt, Homo sapiens
ccagugacgcugcugac

SEQ ID NO: 1844956 - RNA, 16 nt, Homo sapiens
auggcuuuugugcauu

SEQ ID NO: 1844957 - RNA, 17 nt, Homo sapiens
uaagcauuuugugaugu

SEQ ID NO: 1844958 - RNA, 19 nt, Homo sapiens
ucugcauccagagauucau

SEQ ID NO: 1844959 - RNA, 14 nt, Homo sapiens
auuuccuugugcuc

SEQ ID NO: 1844960 - RNA, 22 nt, Homo sapiens
agaucgugccauuacacuccag

SEQ ID NO: 1844961 - RNA, 23 nt, Homo sapiens
ucagauugcugggaggacuggac

SEQ ID NO: 1844962 - RNA, 18 nt, Homo sapiens
gaccuccacccacugugg

SEQ ID NO: 1844963 - RNA, 22 nt, Homo sapiens
ucucaaaguuuuuacaguguau

SEQ ID NO: 1844964 - RNA, 17 nt, Homo sapiens
uugcccacagcuguaug

SEQ ID NO: 1844965 - RNA, 14 nt, Homo sapiens
gcagcccaaggaca

SEQ ID NO: 1844966 - RNA, 22 nt, Homo sapiens
ugagcaaugcuguuggaaaugu

SEQ ID NO: 1844967 - RNA, 14 nt, Homo sapiens
ggaccucaccugcu

SEQ ID NO: 1844968 - RNA, 16 nt, Homo sapiens
ugcaggcuuuuccucc

SEQ ID NO: 1844969 - RNA, 16 nt, Homo sapiens
gugggacugacauuuc

SEQ ID NO: 1844970 - RNA, 13 nt, Homo sapiens
agaggaacagcac

SEQ ID NO: 1844971 - RNA, 13 nt, Homo sapiens
agaugucacagau

SEQ ID NO: 1844972 - RNA, 20 nt, Homo sapiens
guacccggugacucuugggg

SEQ ID NO: 1844973 - RNA, 21 nt, Homo sapiens
guaucugucucauccaaaaag

SEQ ID NO: 1844974 - RNA, 16 nt, Homo sapiens
guucuacccguuccaa

SEQ ID NO: 1844975 - RNA, 18 nt, Homo sapiens
agccaggccccaagccca

SEQ ID NO: 1844976 - RNA, 23 nt, Homo sapiens
ccccguaccaccaugcacuguaa

SEQ ID NO: 1844977 - RNA, 14 nt, Homo sapiens
uccaucucccuuag

SEQ ID NO: 1844978 - RNA, 23 nt, Homo sapiens
caaaggguuuuaagccagggcac

SEQ ID NO: 1844979 - RNA, 21 nt, Homo sapiens
ucaggcaauugauugugaauu

SEQ ID NO: 1844980 - RNA, 12 nt, Homo sapiens
cuccaggcuucc

SEQ ID NO: 1844981 - RNA, 21 nt, Homo sapiens
agauuguccagugcaaccaca

SEQ ID NO: 1844982 - RNA, 17 nt, Homo sapiens
cuaaacuuuccaaaacc

SEQ ID NO: 1844983 - RNA, 18 nt, Homo sapiens
uagacaucaguauucugc

SEQ ID NO: 1844984 - RNA, 12 nt, Homo sapiens
cuucaaacuucc

SEQ ID NO: 1844985 - RNA, 22 nt, Homo sapiens
gccauacuucuguuuccaucug

SEQ ID NO: 1844986 - RNA, 14 nt, Homo sapiens
cugugcacaugccu

SEQ ID NO: 1844987 - RNA, 21 nt, Homo sapiens
ggaauccgccugcagaggaca

SEQ ID NO: 1844988 - RNA, 12 nt, Homo sapiens
uuugcugcacaa

SEQ ID NO: 1844989 - RNA, 18 nt, Homo sapiens
augaccugaucauuacau

SEQ ID NO: 1844990 - RNA, 15 nt, Homo sapiens
cugcauuuucugggu

SEQ ID NO: 1844991 - RNA, 23 nt, Homo sapiens
cacuugaccccugcccaccucuc

SEQ ID NO: 1844992 - RNA, 17 nt, Homo sapiens
ccccauaaucacugacc

SEQ ID NO: 1844993 - RNA, 19 nt, Homo sapiens
aucuguaaaauagucucau

SEQ ID NO: 1844994 - RNA, 15 nt, Homo sapiens
caaagaaacagccuu

SEQ ID NO: 1844995 - RNA, 15 nt, Homo sapiens
gccaggugcacagac

SEQ ID NO: 1844996 - RNA, 16 nt, Homo sapiens
gagugcaguggcacca

SEQ ID NO: 1844997 - RNA, 16 nt, Homo sapiens
agugagcuaagaucac

SEQ ID NO: 1844998 - RNA, 22 nt, Homo sapiens
cugccuuagugcugaugccugu

SEQ ID NO: 1844999 - RNA, 22 nt, Homo sapiens
aaaaucuucagcugguggaugg

SEQ ID NO: 1845000 - RNA, 20 nt, Homo sapiens
aguucugucuggacuuucca

SEQ ID NO: 1845001 - RNA, 18 nt, Homo sapiens
agaauugugcaaccauca

SEQ ID NO: 1845002 - RNA, 14 nt, Homo sapiens
ugaacaaaggaauu

SEQ ID NO: 1845003 - RNA, 19 nt, Homo sapiens
agaaauaagugcccucucc

SEQ ID NO: 1845004 - RNA, 14 nt, Homo sapiens
cgacugaaacugga

SEQ ID NO: 1845005 - RNA, 18 nt, Homo sapiens
uugcauggaaaucagcca

SEQ ID NO: 1845006 - RNA, 22 nt, Homo sapiens
cugcacucauagggugcucuga

SEQ ID NO: 1845007 - RNA, 21 nt, Homo sapiens
ugugucuagcaaagccaccaa

SEQ ID NO: 1845008 - RNA, 18 nt, Homo sapiens
caucucaacaaccugaau

SEQ ID NO: 1845009 - RNA, 22 nt, Homo sapiens
cuuggaaagcaucaccucaggc

SEQ ID NO: 1845010 - RNA, 17 nt, Homo sapiens
caaagugcugcgauuac

SEQ ID NO: 1845011 - RNA, 11 nt, Homo sapiens
cauuugcugcc

SEQ ID NO: 1845012 - RNA, 23 nt, Homo sapiens
cuugcuuuuaucacuuaauuuga

SEQ ID NO: 1845013 - RNA, 16 nt, Homo sapiens
uguuaaugauucuugu

SEQ ID NO: 1845014 - RNA, 18 nt, Homo sapiens
accuacaagguugugccc

SEQ ID NO: 1845015 - RNA, 16 nt, Homo sapiens
aggacucgcgcuacaa

SEQ ID NO: 1845016 - RNA, 16 nt, Homo sapiens
ccuucucaagacuuua

SEQ ID NO: 1845017 - RNA, 23 nt, Homo sapiens
cuugcucgggucccuucaccucc

SEQ ID NO: 1845018 - RNA, 19 nt, Homo sapiens
acuccccagaccucaggga

SEQ ID NO: 1845019 - RNA, 10 nt, Homo sapiens
caucuuuaag

SEQ ID NO: 1845020 - RNA, 16 nt, Homo sapiens
aguuucagagugugga

SEQ ID NO: 1845021 - RNA, 23 nt, Homo sapiens
caaaggccuaauucuaugccugu

SEQ ID NO: 1845022 - RNA, 12 nt, Homo sapiens
auuugccaacag

SEQ ID NO: 1845023 - RNA, 21 nt, Homo sapiens
cuggcaggagccggcugccua

SEQ ID NO: 1845024 - RNA, 22 nt, Homo sapiens
ccuuuguugaaaaauguugcuc

SEQ ID NO: 1845025 - RNA, 17 nt, Homo sapiens
cuauuaauacucugcag

SEQ ID NO: 1845026 - RNA, 21 nt, Homo sapiens
uucaguuuguccacacaagac

SEQ ID NO: 1845027 - RNA, 14 nt, Homo sapiens
guacaaucuuggga

SEQ ID NO: 1845028 - RNA, 18 nt, Homo sapiens
agggccaggauuccucuc

SEQ ID NO: 1845029 - RNA, 14 nt, Homo sapiens
cccuuuauguaucu

SEQ ID NO: 1845030 - RNA, 19 nt, Homo sapiens
aacuaaagauacauaccug

SEQ ID NO: 1845031 - RNA, 15 nt, Homo sapiens
cuauagucauggggu

SEQ ID NO: 1845032 - RNA, 20 nt, Homo sapiens
cacauccuaugcaauauauc

SEQ ID NO: 1845033 - RNA, 15 nt, Homo sapiens
uacucuuuguagcaa

SEQ ID NO: 1845034 - RNA, 12 nt, Homo sapiens
gcauauggugcu

SEQ ID NO: 1845035 - RNA, 22 nt, Homo sapiens
aacuuccucuuaggauguuuca

SEQ ID NO: 1845036 - RNA, 20 nt, Homo sapiens
guguggccacuucuguccau

SEQ ID NO: 1845037 - RNA, 17 nt, Homo sapiens
gcagccccacacccgcc

SEQ ID NO: 1845038 - RNA, 22 nt, Homo sapiens
ucaggaagaaaucacagaauca

SEQ ID NO: 1845039 - RNA, 23 nt, Homo sapiens
gauuauaugggaggguucugggu

SEQ ID NO: 1845040 - RNA, 12 nt, Homo sapiens
cucagcacuguu

SEQ ID NO: 1845041 - RNA, 12 nt, Homo sapiens
uguugcaccuca

SEQ ID NO: 1845042 - RNA, 21 nt, Homo sapiens
acaacuuugaaacuggaauaa

SEQ ID NO: 1845043 - RNA, 16 nt, Homo sapiens
ucuuggcaaaagccuu

SEQ ID NO: 1845044 - RNA, 18 nt, Homo sapiens
ccugcgugggggccaguc

SEQ ID NO: 1845045 - RNA, 19 nt, Homo sapiens
aacuucauauaacugagau

SEQ ID NO: 1845046 - RNA, 17 nt, Homo sapiens
gagcccagauugugcca

SEQ ID NO: 1845047 - RNA, 16 nt, Homo sapiens
gccgggcugacugccc

SEQ ID NO: 1845048 - RNA, 17 nt, Homo sapiens
uugcuuaaaagaaaguu

SEQ ID NO: 1845049 - RNA, 19 nt, Homo sapiens
auaacaccugccaccacua

SEQ ID NO: 1845050 - RNA, 14 nt, Homo sapiens
auuugcaccuagac

SEQ ID NO: 1845051 - RNA, 20 nt, Homo sapiens
gaggaagugcacuggcccuc

SEQ ID NO: 1845052 - RNA, 23 nt, Homo sapiens
cauuuaaaaacaggcagcucaua

SEQ ID NO: 1845053 - RNA, 15 nt, Homo sapiens
gagcaagaacauuca

SEQ ID NO: 1845054 - RNA, 22 nt, Homo sapiens
ugccuauauuuuuccucaaaga

SEQ ID NO: 1845055 - RNA, 18 nt, Homo sapiens
aacugaacagaaccacaa

SEQ ID NO: 1845056 - RNA, 13 nt, Homo sapiens
gcuuuuucucuca

SEQ ID NO: 1845057 - RNA, 18 nt, Homo sapiens
ucccucuuugccugugug

SEQ ID NO: 1845058 - RNA, 19 nt, Homo sapiens
auguuccugaaaauugcaa

SEQ ID NO: 1845059 - RNA, 19 nt, Homo sapiens
aaagaauuugauacuccuc

SEQ ID NO: 1845060 - RNA, 23 nt, Homo sapiens
uaaaucccauucauaacuuucau

SEQ ID NO: 1845061 - RNA, 19 nt, Homo sapiens
auauccaacagaaagcaua

SEQ ID NO: 1845062 - RNA, 18 nt, Homo sapiens
gggugccgcugucucuga

SEQ ID NO: 1845063 - RNA, 15 nt, Homo sapiens
guauaguacuggcau

SEQ ID NO: 1845064 - RNA, 17 nt, Homo sapiens
uaaaggcugaagcuuuu

SEQ ID NO: 1845065 - RNA, 16 nt, Homo sapiens
ugaaauuuuaauugaa

SEQ ID NO: 1845066 - RNA, 16 nt, Homo sapiens
agcuagaaaacauuuu

SEQ ID NO: 1845067 - RNA, 19 nt, Homo sapiens
auguucagaauguacggaa

SEQ ID NO: 1845068 - RNA, 14 nt, Homo sapiens
ucaguaagucucau

SEQ ID NO: 1845069 - RNA, 22 nt, Homo sapiens
uuaagacuuugguuauuuuacu

SEQ ID NO: 1845070 - RNA, 22 nt, Homo sapiens
agaacucccaggucacaugcac

SEQ ID NO: 1845071 - RNA, 20 nt, Homo sapiens
ugcauccuuuucaaaaccua

SEQ ID NO: 1845072 - RNA, 22 nt, Homo sapiens
cugggccaguggcacucugugu

SEQ ID NO: 1845073 - RNA, 20 nt, Homo sapiens
cuguccuggucaguuuucac

SEQ ID NO: 1845074 - RNA, 18 nt, Homo sapiens
ugcuauggacgaccucca

SEQ ID NO: 1845075 - RNA, 22 nt, Homo sapiens
ucacccaggcaucugcuuuacu

SEQ ID NO: 1845076 - RNA, 18 nt, Homo sapiens
ccccagcacaaagcacug

SEQ ID NO: 1845077 - RNA, 18 nt, Homo sapiens
cccucauguauacuucaa

SEQ ID NO: 1845078 - RNA, 19 nt, Homo sapiens
cagauuuuagacuuaccuu

SEQ ID NO: 1845079 - RNA, 13 nt, Homo sapiens
gguggaucaccug

SEQ ID NO: 1845080 - RNA, 11 nt, Homo sapiens
uaguuuugcuu

SEQ ID NO: 1845081 - RNA, 15 nt, Homo sapiens
uaaaguguccauuga

SEQ ID NO: 1845082 - RNA, 16 nt, Homo sapiens
cuuuaccaugcucaau

SEQ ID NO: 1845083 - RNA, 14 nt, Homo sapiens
uuuccucugugcaa

SEQ ID NO: 1845084 - RNA, 14 nt, Homo sapiens
ugugcucuggggaa

SEQ ID NO: 1845085 - RNA, 13 nt, Homo sapiens
ccuaaaaugcuuc

SEQ ID NO: 1845086 - RNA, 22 nt, Homo sapiens
aacucucaccaugaugugaaga

SEQ ID NO: 1845087 - RNA, 14 nt, Homo sapiens
acaucuuucacauu

SEQ ID NO: 1845088 - RNA, 20 nt, Homo sapiens
gaauuacaggcacauaccac

SEQ ID NO: 1845089 - RNA, 20 nt, Homo sapiens
cuucauacaauguaagguca

SEQ ID NO: 1845090 - RNA, 13 nt, Homo sapiens
caaaacauaucuu

SEQ ID NO: 1845091 - RNA, 13 nt, Homo sapiens
cuuccccuugccc

SEQ ID NO: 1845092 - RNA, 23 nt, Homo sapiens
ccaaaaguuaaacuuuaucucac

SEQ ID NO: 1845093 - RNA, 19 nt, Homo sapiens
agacaguuuacuuugccaa

SEQ ID NO: 1845094 - RNA, 15 nt, Homo sapiens
cugguuugccuauaa

SEQ ID NO: 1845095 - RNA, 19 nt, Homo sapiens
ucccaaucuuucuauauaa

SEQ ID NO: 1845096 - RNA, 24 nt, Homo sapiens
uuguauaaagcauuuguagcaauu

SEQ ID NO: 1845097 - RNA, 17 nt, Homo sapiens
cugggcaacacagugag

SEQ ID NO: 1845098 - RNA, 22 nt, Homo sapiens
ccucuccacucaugugacucuu

SEQ ID NO: 1845099 - RNA, 21 nt, Homo sapiens
acagacauuccuucuacaugu

SEQ ID NO: 1845100 - RNA, 14 nt, Homo sapiens
auuaagauggucau

SEQ ID NO: 1845101 - RNA, 20 nt, Homo sapiens
ccucaacugggaaccuucau

SEQ ID NO: 1845102 - RNA, 16 nt, Homo sapiens
cuuaguuauugcugaa

SEQ ID NO: 1845103 - RNA, 17 nt, Homo sapiens
accacauccuccgucca

SEQ ID NO: 1845104 - RNA, 19 nt, Homo sapiens
ucggggaaugacacacugc

SEQ ID NO: 1845105 - RNA, 22 nt, Homo sapiens
acaaccugaaauuuauucacau

SEQ ID NO: 1845106 - RNA, 16 nt, Homo sapiens
ugcagaaauacaguau

SEQ ID NO: 1845107 - RNA, 15 nt, Homo sapiens
acuucaaaagcuuuu

SEQ ID NO: 1845108 - RNA, 19 nt, Homo sapiens
ucuuugacaauuccuagau

SEQ ID NO: 1845109 - RNA, 15 nt, Homo sapiens
uugaaacugagaugu

SEQ ID NO: 1845110 - RNA, 12 nt, Homo sapiens
ccugccaagagg

SEQ ID NO: 1845111 - RNA, 22 nt, Homo sapiens
cagaaaugcaaggggcugcaug

SEQ ID NO: 1845112 - RNA, 19 nt, Homo sapiens
agauuucucaccuguaaga

SEQ ID NO: 1845113 - RNA, 23 nt, Homo sapiens
caaaauacaauuuuuuugguaaa

SEQ ID NO: 1845114 - RNA, 16 nt, Homo sapiens
cuucucucucugcucc

SEQ ID NO: 1845115 - RNA, 23 nt, Homo sapiens
accugagggggcccaucccugcc

SEQ ID NO: 1845116 - RNA, 18 nt, Homo sapiens
uaauuuguaaacuucuga

SEQ ID NO: 1845117 - RNA, 19 nt, Homo sapiens
uugacauaccuaccaguau

SEQ ID NO: 1845118 - RNA, 14 nt, Homo sapiens
uagcaucuacuugu

SEQ ID NO: 1845119 - RNA, 21 nt, Homo sapiens
uucaaucacugaaaaugugcu

SEQ ID NO: 1845120 - RNA, 21 nt, Homo sapiens
gcaaaacucuacuuaauccaa

SEQ ID NO: 1845121 - RNA, 23 nt, Homo sapiens
aucaucccuggauguggauuuca

SEQ ID NO: 1845122 - RNA, 20 nt, Homo sapiens
ugucucaguuuucacugucg

SEQ ID NO: 1845123 - RNA, 15 nt, Homo sapiens
agcucagaguugaga

SEQ ID NO: 1845124 - RNA, 15 nt, Homo sapiens
cccaacgugaugcua

SEQ ID NO: 1845125 - RNA, 21 nt, Homo sapiens
ugaaauucacccccuuuccug

SEQ ID NO: 1845126 - RNA, 13 nt, Homo sapiens
agcuguguccuca

SEQ ID NO: 1845127 - RNA, 22 nt, Homo sapiens
gagcgucacugcccaccaaagg

SEQ ID NO: 1845128 - RNA, 16 nt, Homo sapiens
caaaauuuuuacaggu

SEQ ID NO: 1845129 - RNA, 14 nt, Homo sapiens
ucuugaaguacuua

SEQ ID NO: 1845130 - RNA, 13 nt, Homo sapiens
cuaguaaccaagg

SEQ ID NO: 1845131 - RNA, 19 nt, Homo sapiens
ggccaaggugggcagauca

SEQ ID NO: 1845132 - RNA, 13 nt, Homo sapiens
gccggacguggug

SEQ ID NO: 1845133 - RNA, 15 nt, Homo sapiens
cuagucugcuagcca

SEQ ID NO: 1845134 - RNA, 20 nt, Homo sapiens
uacuuucuuauaaauuugga

SEQ ID NO: 1845135 - RNA, 22 nt, Homo sapiens
aagccuuuuguuucccuugcuu

SEQ ID NO: 1845136 - RNA, 18 nt, Homo sapiens
aguuuaggugauggccag

SEQ ID NO: 1845137 - RNA, 16 nt, Homo sapiens
aagacuuuucuuucag

SEQ ID NO: 1845138 - RNA, 15 nt, Homo sapiens
ucucacuagugucag

SEQ ID NO: 1845139 - RNA, 18 nt, Homo sapiens
auuaaaaucacucucagu

SEQ ID NO: 1845140 - RNA, 15 nt, Homo sapiens
uguguuagcacugau

SEQ ID NO: 1845141 - RNA, 17 nt, Homo sapiens
cuugcaguuauguuauc

SEQ ID NO: 1845142 - RNA, 14 nt, Homo sapiens
auuuauuaccucug

SEQ ID NO: 1845143 - RNA, 14 nt, Homo sapiens
acauuuuacuacag

SEQ ID NO: 1845144 - RNA, 18 nt, Homo sapiens
agugguguaggugggggu

SEQ ID NO: 1845145 - RNA, 17 nt, Homo sapiens
cagcugauugacugugc

SEQ ID NO: 1845146 - RNA, 17 nt, Homo sapiens
ucuugucucacaugcua

SEQ ID NO: 1845147 - RNA, 15 nt, Homo sapiens
cauccccuuguguca

SEQ ID NO: 1845148 - RNA, 23 nt, Homo sapiens
cuccuguguucuagaccucuggg

SEQ ID NO: 1845149 - RNA, 22 nt, Homo sapiens
gggauugucuuacuguugcaua

SEQ ID NO: 1845150 - RNA, 16 nt, Homo sapiens
uacauacuaaugaagu

SEQ ID NO: 1845151 - RNA, 17 nt, Homo sapiens
uuguacccauugucauc

SEQ ID NO: 1845152 - RNA, 14 nt, Homo sapiens
cauguugacugucu

SEQ ID NO: 1845153 - RNA, 13 nt, Homo sapiens
ugaagagguguuu

SEQ ID NO: 1845154 - RNA, 13 nt, Homo sapiens
agcuacaacagcc

SEQ ID NO: 1845155 - RNA, 16 nt, Homo sapiens
augcugacuucacuua

SEQ ID NO: 1845156 - RNA, 14 nt, Homo sapiens
auuuucuucacacu

SEQ ID NO: 1845157 - RNA, 20 nt, Homo sapiens
ucauuucagcucuugcuuca

SEQ ID NO: 1845158 - RNA, 12 nt, Homo sapiens
cagaagcucucg

SEQ ID NO: 1845159 - RNA, 19 nt, Homo sapiens
auuucacacagguccugaa

SEQ ID NO: 1845160 - RNA, 13 nt, Homo sapiens
cauauauaugaaa

SEQ ID NO: 1845161 - RNA, 15 nt, Homo sapiens
uugccuugcauuugu

SEQ ID NO: 1845162 - RNA, 14 nt, Homo sapiens
aggaaaagccaaca

SEQ ID NO: 1845163 - RNA, 12 nt, Homo sapiens
cacagugcaguu

SEQ ID NO: 1845164 - RNA, 18 nt, Homo sapiens
aggaagaugaauccuagc

SEQ ID NO: 1845165 - RNA, 15 nt, Homo sapiens
aaacuuguacaugga

SEQ ID NO: 1845166 - RNA, 19 nt, Homo sapiens
cggcuacugguuaccugga

SEQ ID NO: 1845167 - RNA, 20 nt, Homo sapiens
auguucagucacaugugcuc

SEQ ID NO: 1845168 - RNA, 22 nt, Homo sapiens
ccuguguguauguguguguuug

SEQ ID NO: 1845169 - RNA, 20 nt, Homo sapiens
aacucccagccaccaccacu

SEQ ID NO: 1845170 - RNA, 15 nt, Homo sapiens
gagggugcaguccag

SEQ ID NO: 1845171 - RNA, 14 nt, Homo sapiens
aaggaaaccaaagg

SEQ ID NO: 1845172 - RNA, 22 nt, Homo sapiens
ugauguuuuacuuuucacagua

SEQ ID NO: 1845173 - RNA, 13 nt, Homo sapiens
gucauuuauucaa

SEQ ID NO: 1845174 - RNA, 17 nt, Homo sapiens
aagggauuucauuugaa

SEQ ID NO: 1845175 - RNA, 13 nt, Homo sapiens
acccaacucugua

SEQ ID NO: 1845176 - RNA, 17 nt, Homo sapiens
aaagcggacaucagcug

SEQ ID NO: 1845177 - RNA, 17 nt, Homo sapiens
cugaaugcugcuacuua

SEQ ID NO: 1845178 - RNA, 22 nt, Homo sapiens
aaaagcuauuagccaggaucau

SEQ ID NO: 1845179 - RNA, 23 nt, Homo sapiens
aauuucauuucagccacuucugc

SEQ ID NO: 1845180 - RNA, 15 nt, Homo sapiens
ucuuaggagcaagaa

SEQ ID NO: 1845181 - RNA, 17 nt, Homo sapiens
aucugcccccacugucc

SEQ ID NO: 1845182 - RNA, 18 nt, Homo sapiens
ucucguaacugguuucau

SEQ ID NO: 1845183 - RNA, 18 nt, Homo sapiens
aucauggaacacaaacac

SEQ ID NO: 1845184 - RNA, 20 nt, Homo sapiens
gugggaaaaaaaugaaugag

SEQ ID NO: 1845185 - RNA, 16 nt, Homo sapiens
acuucccuacauggag

SEQ ID NO: 1845186 - RNA, 13 nt, Homo sapiens
agaagcaugucuc

SEQ ID NO: 1845187 - RNA, 13 nt, Homo sapiens
uugucuguucacu

SEQ ID NO: 1845188 - RNA, 20 nt, Homo sapiens
uuaaagucuacacugccuuu

SEQ ID NO: 1845189 - RNA, 16 nt, Homo sapiens
ccaugcagugccccua

SEQ ID NO: 1845190 - RNA, 12 nt, Homo sapiens
aaauaacuaccu

SEQ ID NO: 1845191 - RNA, 19 nt, Homo sapiens
agccgggcaugauggugca

SEQ ID NO: 1845192 - RNA, 13 nt, Homo sapiens
acuaggagaccag

SEQ ID NO: 1845193 - RNA, 20 nt, Homo sapiens
cuuucccuuuuccaucaucu

SEQ ID NO: 1845194 - RNA, 23 nt, Homo sapiens
ugggcuguaacguggcacuggua

SEQ ID NO: 1845195 - RNA, 14 nt, Homo sapiens
aggcccaucagcua

SEQ ID NO: 1845196 - RNA, 18 nt, Homo sapiens
cuuaaagaccaucuggua

SEQ ID NO: 1845197 - RNA, 20 nt, Homo sapiens
ugcucuccauucugcuccuu

SEQ ID NO: 1845198 - RNA, 18 nt, Homo sapiens
acuguugcgccgcaguuu

SEQ ID NO: 1845199 - RNA, 16 nt, Homo sapiens
auagacacuggacaug

SEQ ID NO: 1845200 - RNA, 16 nt, Homo sapiens
guaauuucgccuuaaa

SEQ ID NO: 1845201 - RNA, 14 nt, Homo sapiens
accaauccuauguc

SEQ ID NO: 1845202 - RNA, 19 nt, Homo sapiens
aaauguguuccauugccau

SEQ ID NO: 1845203 - RNA, 17 nt, Homo sapiens
gcuauuuggacucaggu

SEQ ID NO: 1845204 - RNA, 18 nt, Homo sapiens
auggcacuuuugaugaaa

SEQ ID NO: 1845205 - RNA, 13 nt, Homo sapiens
uuuccacuauaau

SEQ ID NO: 1845206 - RNA, 16 nt, Homo sapiens
caucugaggaaugaga

SEQ ID NO: 1845207 - RNA, 15 nt, Homo sapiens
gguucucuucacacu

SEQ ID NO: 1845208 - RNA, 15 nt, Homo sapiens
uauacaccauauacu

SEQ ID NO: 1845209 - RNA, 18 nt, Homo sapiens
aaggcuggagugcagugg

SEQ ID NO: 1845210 - RNA, 12 nt, Homo sapiens
agauacaaacug

SEQ ID NO: 1845211 - RNA, 23 nt, Homo sapiens
ucuuuccuguagucccauugaug

SEQ ID NO: 1845212 - RNA, 14 nt, Homo sapiens
aaagcacuggccuu

SEQ ID NO: 1845213 - RNA, 18 nt, Homo sapiens
uugaagaaaauagucagu

SEQ ID NO: 1845214 - RNA, 22 nt, Homo sapiens
uacacauacacaagugcacaga

SEQ ID NO: 1845215 - RNA, 19 nt, Homo sapiens
ccagcaucgggggccugca

SEQ ID NO: 1845216 - RNA, 23 nt, Homo sapiens
gcaggcggagcgagagagggaga

SEQ ID NO: 1845217 - RNA, 14 nt, Homo sapiens
acuuugcaaaaaga

SEQ ID NO: 1845218 - RNA, 20 nt, Homo sapiens
caguugcccagagcacuuua

SEQ ID NO: 1845219 - RNA, 19 nt, Homo sapiens
agccucagccauucacugc

SEQ ID NO: 1845220 - RNA, 18 nt, Homo sapiens
cugccaacuccaugacca

SEQ ID NO: 1845221 - RNA, 21 nt, Homo sapiens
gaaaauauuuuuuuccuuugc

SEQ ID NO: 1845222 - RNA, 20 nt, Homo sapiens
acacacgcgugcaugcacac

SEQ ID NO: 1845223 - RNA, 18 nt, Homo sapiens
aaaauguauuuuucacaa

SEQ ID NO: 1845224 - RNA, 12 nt, Homo sapiens
caagcucaaggc

SEQ ID NO: 1845225 - RNA, 14 nt, Homo sapiens
caaccccaacucca

SEQ ID NO: 1845226 - RNA, 20 nt, Homo sapiens
gaugcugccuaggguugcuu

SEQ ID NO: 1845227 - RNA, 22 nt, Homo sapiens
ugcacaagguggaguguacugg

SEQ ID NO: 1845228 - RNA, 22 nt, Homo sapiens
aagugggaucugucacaccagc

SEQ ID NO: 1845229 - RNA, 14 nt, Homo sapiens
agcagcagugaaaa

SEQ ID NO: 1845230 - RNA, 18 nt, Homo sapiens
ucuagaagcuuaagaauu

SEQ ID NO: 1845231 - RNA, 19 nt, Homo sapiens
gcacaugccuuaagccagu

SEQ ID NO: 1845232 - RNA, 14 nt, Homo sapiens
aagguucagcugaa

SEQ ID NO: 1845233 - RNA, 15 nt, Homo sapiens
cagcaaggaaauguc

SEQ ID NO: 1845234 - RNA, 17 nt, Homo sapiens
aggcuguaauuccauca

SEQ ID NO: 1845235 - RNA, 21 nt, Homo sapiens
acuuucugaagccucacuuau

SEQ ID NO: 1845236 - RNA, 20 nt, Homo sapiens
cccucguuaaucacaggauc

SEQ ID NO: 1845237 - RNA, 16 nt, Homo sapiens
ugaguuuuguucacaa

SEQ ID NO: 1845238 - RNA, 13 nt, Homo sapiens
augccacuuccuu

SEQ ID NO: 1845239 - RNA, 23 nt, Homo sapiens
gaagacccaguguaaagaauaaa

SEQ ID NO: 1845240 - RNA, 15 nt, Homo sapiens
auuuauagaggaaaa

SEQ ID NO: 1845241 - RNA, 12 nt, Homo sapiens
ccagcaucuccc

SEQ ID NO: 1845242 - RNA, 12 nt, Homo sapiens
cucccaucuuag

SEQ ID NO: 1845243 - RNA, 15 nt, Homo sapiens
agugugugacauucc

SEQ ID NO: 1845244 - RNA, 15 nt, Homo sapiens
agacacguucuugcc

SEQ ID NO: 1845245 - RNA, 24 nt, Homo sapiens
gaucacucuuugcacacucuugug

SEQ ID NO: 1845246 - RNA, 15 nt, Homo sapiens
cauaugcuguacaug

SEQ ID NO: 1845247 - RNA, 19 nt, Homo sapiens
auagcaaauguuuugacau

SEQ ID NO: 1845248 - RNA, 24 nt, Homo sapiens
ggccuaggcuaccucaagacucac

SEQ ID NO: 1845249 - RNA, 14 nt, Homo sapiens
aggaauaccugucc

SEQ ID NO: 1845250 - RNA, 12 nt, Homo sapiens
ucucucaucucu

SEQ ID NO: 1845251 - RNA, 15 nt, Homo sapiens
cuuuuauuuuacaca

SEQ ID NO: 1845252 - RNA, 17 nt, Homo sapiens
caacuucgugcucaggu

SEQ ID NO: 1845253 - RNA, 16 nt, Homo sapiens
cucagauuccaccuag

SEQ ID NO: 1845254 - RNA, 22 nt, Homo sapiens
aauaucugaggaugaccagaaa

SEQ ID NO: 1845255 - RNA, 18 nt, Homo sapiens
caagaagguuucuguccu

SEQ ID NO: 1845256 - RNA, 18 nt, Homo sapiens
uuaacauggacaugaucu

SEQ ID NO: 1845257 - RNA, 24 nt, Homo sapiens
acaacccaaaugucuaccaacuga

SEQ ID NO: 1845258 - RNA, 14 nt, Homo sapiens
uauuaagcacauua

SEQ ID NO: 1845259 - RNA, 14 nt, Homo sapiens
uggcuuucccagga

SEQ ID NO: 1845260 - RNA, 20 nt, Homo sapiens
gcucaaaucauuuaagaagg

SEQ ID NO: 1845261 - RNA, 12 nt, Homo sapiens
ccgggagacuga

SEQ ID NO: 1845262 - RNA, 15 nt, Homo sapiens
gccuugcugcaccug

SEQ ID NO: 1845263 - RNA, 11 nt, Homo sapiens
acaacugccaa

SEQ ID NO: 1845264 - RNA, 15 nt, Homo sapiens
ucugcauuuugcuau

SEQ ID NO: 1845265 - RNA, 19 nt, Homo sapiens
aguacaauuguuaugaucu

SEQ ID NO: 1845266 - RNA, 22 nt, Homo sapiens
uggaucuaccagcauaaauauc

SEQ ID NO: 1845267 - RNA, 23 nt, Homo sapiens
acaggagucugucucugcuaugg

SEQ ID NO: 1845268 - RNA, 19 nt, Homo sapiens
agcaaaaucagaaguauau

SEQ ID NO: 1845269 - RNA, 18 nt, Homo sapiens
gguauuugagacauucca

SEQ ID NO: 1845270 - RNA, 14 nt, Homo sapiens
ucaagccauucugc

SEQ ID NO: 1845271 - RNA, 19 nt, Homo sapiens
ccaacggugguaugcugca

SEQ ID NO: 1845272 - RNA, 14 nt, Homo sapiens
acaaugccaauagg

SEQ ID NO: 1845273 - RNA, 17 nt, Homo sapiens
ccucugggaaaaucuau

SEQ ID NO: 1845274 - RNA, 13 nt, Homo sapiens
gccaaagauuuca

SEQ ID NO: 1845275 - RNA, 21 nt, Homo sapiens
aagugcugcuauaucuaucca

SEQ ID NO: 1845276 - RNA, 20 nt, Homo sapiens
ugucuuccugcauucaccca

SEQ ID NO: 1845277 - RNA, 19 nt, Homo sapiens
uagcaucuccuuucacuuu

SEQ ID NO: 1845278 - RNA, 16 nt, Homo sapiens
acaagugcacuugaac

SEQ ID NO: 1845279 - RNA, 19 nt, Homo sapiens
gaacacaggcccagaugac

SEQ ID NO: 1845280 - RNA, 14 nt, Homo sapiens
cuagagugcagugg

SEQ ID NO: 1845281 - RNA, 14 nt, Homo sapiens
cuggagugcaaugg

SEQ ID NO: 1845282 - RNA, 18 nt, Homo sapiens
uguuaaagauuucaaaua

SEQ ID NO: 1845283 - RNA, 17 nt, Homo sapiens
aucucuuacuugauaga

SEQ ID NO: 1845284 - RNA, 15 nt, Homo sapiens
agacucgcaauuuca

SEQ ID NO: 1845285 - RNA, 13 nt, Homo sapiens
ggauagauuucau

SEQ ID NO: 1845286 - RNA, 14 nt, Homo sapiens
aaugacaucucagg

SEQ ID NO: 1845287 - RNA, 15 nt, Homo sapiens
caauaugcaauguga

SEQ ID NO: 1845288 - RNA, 18 nt, Homo sapiens
agaucucauguccucuau

SEQ ID NO: 1845289 - RNA, 13 nt, Homo sapiens
auccauucccaag

SEQ ID NO: 1845290 - RNA, 17 nt, Homo sapiens
guugggggcacucagcc

SEQ ID NO: 1845291 - RNA, 13 nt, Homo sapiens
cuaugcaggguag

SEQ ID NO: 1845292 - RNA, 14 nt, Homo sapiens
caguggagacaucu

SEQ ID NO: 1845293 - RNA, 17 nt, Homo sapiens
gagagugcagaucugug

SEQ ID NO: 1845294 - RNA, 16 nt, Homo sapiens
aagacacucccaccag

SEQ ID NO: 1845295 - RNA, 17 nt, Homo sapiens
cucuucagccccuagug

SEQ ID NO: 1845296 - RNA, 14 nt, Homo sapiens
aggggacauuccag

SEQ ID NO: 1845297 - RNA, 20 nt, Homo sapiens
cuucugacaaaggugguaaa

SEQ ID NO: 1845298 - RNA, 16 nt, Homo sapiens
gcugaauuucaggcau

SEQ ID NO: 1845299 - RNA, 20 nt, Homo sapiens
ccuccuguaagcaacacuuu

SEQ ID NO: 1845300 - RNA, 15 nt, Homo sapiens
ccguggaacauucug

SEQ ID NO: 1845301 - RNA, 15 nt, Homo sapiens
cagcuccuucugucc

SEQ ID NO: 1845302 - RNA, 17 nt, Homo sapiens
guaaaauccacagcuau

SEQ ID NO: 1845303 - RNA, 14 nt, Homo sapiens
gggaaaacauucca

SEQ ID NO: 1845304 - RNA, 17 nt, Homo sapiens
ucucacuaaaauggaua

SEQ ID NO: 1845305 - RNA, 19 nt, Homo sapiens
guccgagucucagcccuga

SEQ ID NO: 1845306 - RNA, 20 nt, Homo sapiens
gaaacugcuuugacaugacu

SEQ ID NO: 1845307 - RNA, 22 nt, Homo sapiens
uggcuagucugugccucaguga

SEQ ID NO: 1845308 - RNA, 18 nt, Homo sapiens
ucauucaaaacaaccauc

SEQ ID NO: 1845309 - RNA, 17 nt, Homo sapiens
cuggaugcaguggcuca

SEQ ID NO: 1845310 - RNA, 16 nt, Homo sapiens
accugggcccuggggc

SEQ ID NO: 1845311 - RNA, 17 nt, Homo sapiens
ggccagagucacaggaa

SEQ ID NO: 1845312 - RNA, 12 nt, Homo sapiens
cccaccauuccc

SEQ ID NO: 1845313 - RNA, 19 nt, Homo sapiens
cauauauaaauucuaagcc

SEQ ID NO: 1845314 - RNA, 22 nt, Homo sapiens
agauauuaaugcccagacaaaa

SEQ ID NO: 1845315 - RNA, 18 nt, Homo sapiens
ccagcucugacaucccuu

SEQ ID NO: 1845316 - RNA, 12 nt, Homo sapiens
cuggguggugcc

SEQ ID NO: 1845317 - RNA, 15 nt, Homo sapiens
aguuggugcugcuuu

SEQ ID NO: 1845318 - RNA, 22 nt, Homo sapiens
gaaucggcuggggacugcuacc

SEQ ID NO: 1845319 - RNA, 12 nt, Homo sapiens
acagugcaguga

SEQ ID NO: 1845320 - RNA, 17 nt, Homo sapiens
auuuacagcauacuuaa

SEQ ID NO: 1845321 - RNA, 20 nt, Homo sapiens
agcugcccuugaagacuucc

SEQ ID NO: 1845322 - RNA, 15 nt, Homo sapiens
cccugaaacaucuca

SEQ ID NO: 1845323 - RNA, 20 nt, Homo sapiens
agucuaagauguguuccuug

SEQ ID NO: 1845324 - RNA, 15 nt, Homo sapiens
ccuggaugaaguuau

SEQ ID NO: 1845325 - RNA, 12 nt, Homo sapiens
cugcuguugcca

SEQ ID NO: 1845326 - RNA, 21 nt, Homo sapiens
uuuuuauucuacuacuuggaa

SEQ ID NO: 1845327 - RNA, 15 nt, Homo sapiens
acuugaucauucuca

SEQ ID NO: 1845328 - RNA, 22 nt, Homo sapiens
acagagaugcaugcgcaggcuc

SEQ ID NO: 1845329 - RNA, 15 nt, Homo sapiens
caggauugaucauuc

SEQ ID NO: 1845330 - RNA, 20 nt, Homo sapiens
uaaccugcuagacacauuuu

SEQ ID NO: 1845331 - RNA, 20 nt, Homo sapiens
aacucuggcuccaggcagaa

SEQ ID NO: 1845332 - RNA, 14 nt, Homo sapiens
ccccacucuguaca

SEQ ID NO: 1845333 - RNA, 14 nt, Homo sapiens
gcucucucucacca

SEQ ID NO: 1845334 - RNA, 23 nt, Homo sapiens
gaaacaaauguguauaaacugcu

SEQ ID NO: 1845335 - RNA, 20 nt, Homo sapiens
gacaauuuucuaccacuggu

SEQ ID NO: 1845336 - RNA, 23 nt, Homo sapiens
cccuaaauguacucuugaacuuc

SEQ ID NO: 1845337 - RNA, 17 nt, Homo sapiens
ugaacccuggcauuugg

SEQ ID NO: 1845338 - RNA, 12 nt, Homo sapiens
cuguggucugug

SEQ ID NO: 1845339 - RNA, 15 nt, Homo sapiens
acuagggaagcucag

SEQ ID NO: 1845340 - RNA, 12 nt, Homo sapiens
gugcauuucaaa

SEQ ID NO: 1845341 - RNA, 19 nt, Homo sapiens
cauauguguaaagauuuau

SEQ ID NO: 1845342 - RNA, 20 nt, Homo sapiens
aguauucuaaaguuuugcaa

SEQ ID NO: 1845343 - RNA, 19 nt, Homo sapiens
uuaacacuaccaauuuccc

SEQ ID NO: 1845344 - RNA, 20 nt, Homo sapiens
cucuacuaaaaauacaaaau

SEQ ID NO: 1845345 - RNA, 21 nt, Homo sapiens
gagaaacccuucacaccccag

SEQ ID NO: 1845346 - RNA, 16 nt, Homo sapiens
ugggaagaacaugcua

SEQ ID NO: 1845347 - RNA, 16 nt, Homo sapiens
uuucccuuuaccuccu

SEQ ID NO: 1845348 - RNA, 17 nt, Homo sapiens
agaggacaggcuacccc

SEQ ID NO: 1845349 - RNA, 20 nt, Homo sapiens
uuuaaaaugcugcuuugucc

SEQ ID NO: 1845350 - RNA, 14 nt, Homo sapiens
aauuccuugauuca

SEQ ID NO: 1845351 - RNA, 17 nt, Homo sapiens
agacccagagguccagg

SEQ ID NO: 1845352 - RNA, 14 nt, Homo sapiens
uuucuguucaccuu

SEQ ID NO: 1845353 - RNA, 16 nt, Homo sapiens
gcagagaggcugaaua

SEQ ID NO: 1845354 - RNA, 19 nt, Homo sapiens
agaaagcucugcaugugug

SEQ ID NO: 1845355 - RNA, 19 nt, Homo sapiens
aauugcccguuuccauaca

SEQ ID NO: 1845356 - RNA, 22 nt, Homo sapiens
guuagucuacucuuaagccauc

SEQ ID NO: 1845357 - RNA, 15 nt, Homo sapiens
ucacucuugccaacc

SEQ ID NO: 1845358 - RNA, 17 nt, Homo sapiens
gugaugauagcacuggu

SEQ ID NO: 1845359 - RNA, 18 nt, Homo sapiens
uuucuguagcaccagaga

SEQ ID NO: 1845360 - RNA, 12 nt, Homo sapiens
augaaacagggc

SEQ ID NO: 1845361 - RNA, 13 nt, Homo sapiens
ucuuuugugagaa

SEQ ID NO: 1845362 - RNA, 22 nt, Homo sapiens
gagauugcgccacugcacucca

SEQ ID NO: 1845363 - RNA, 12 nt, Homo sapiens
cucaaacauguu

SEQ ID NO: 1845364 - RNA, 12 nt, Homo sapiens
uguuaacacuca

SEQ ID NO: 1845365 - RNA, 17 nt, Homo sapiens
aauagcauguuguagau

SEQ ID NO: 1845366 - RNA, 16 nt, Homo sapiens
cuguucacacugcaga

SEQ ID NO: 1845367 - RNA, 16 nt, Homo sapiens
auauaaccacauuucu

SEQ ID NO: 1845368 - RNA, 16 nt, Homo sapiens
aaacacuuauuuuaca

SEQ ID NO: 1845369 - RNA, 18 nt, Homo sapiens
agcaaggaaauaagucau

SEQ ID NO: 1845370 - RNA, 21 nt, Homo sapiens
gaggcgcugcugguguucuua

SEQ ID NO: 1845371 - RNA, 19 nt, Homo sapiens
uaaacucuaaguguaaaaa

SEQ ID NO: 1845372 - RNA, 21 nt, Homo sapiens
ugcauuuuuguaaauguguac

SEQ ID NO: 1845373 - RNA, 14 nt, Homo sapiens
aggaauugguuuca

SEQ ID NO: 1845374 - RNA, 21 nt, Homo sapiens
cuucuuacaauaauucuauga

SEQ ID NO: 1845375 - RNA, 24 nt, Homo sapiens
cauucucaccuaaacccucuguga

SEQ ID NO: 1845376 - RNA, 18 nt, Homo sapiens
gaaaacaucucaauaaca

SEQ ID NO: 1845377 - RNA, 20 nt, Homo sapiens
agcaugaagguggggccagu

SEQ ID NO: 1845378 - RNA, 20 nt, Homo sapiens
gagcaccagccccacccaag

SEQ ID NO: 1845379 - RNA, 15 nt, Homo sapiens
cagcuggaacccugg

SEQ ID NO: 1845380 - RNA, 18 nt, Homo sapiens
ccguucgcugagucccag

SEQ ID NO: 1845381 - RNA, 21 nt, Homo sapiens
agggaaaauguuuuguaagaa

SEQ ID NO: 1845382 - RNA, 12 nt, Homo sapiens
uggagacaaugu

SEQ ID NO: 1845383 - RNA, 22 nt, Homo sapiens
gcccggggcugucccgugcaug

SEQ ID NO: 1845384 - RNA, 13 nt, Homo sapiens
ugagagaaccuca

SEQ ID NO: 1845385 - RNA, 14 nt, Homo sapiens
cguucaaaagugga

SEQ ID NO: 1845386 - RNA, 13 nt, Homo sapiens
ucaugacacuguu

SEQ ID NO: 1845387 - RNA, 17 nt, Homo sapiens
guucugagauucaauau

SEQ ID NO: 1845388 - RNA, 20 nt, Homo sapiens
auucugggaaaggugcucaa

SEQ ID NO: 1845389 - RNA, 18 nt, Homo sapiens
aacuguagauaaaguggu

SEQ ID NO: 1845390 - RNA, 18 nt, Homo sapiens
aauuuaccaucaaacaaa

SEQ ID NO: 1845391 - RNA, 15 nt, Homo sapiens
gaugcucaaguccaa

SEQ ID NO: 1845392 - RNA, 22 nt, Homo sapiens
ccaugacaacuucuaauugcca

SEQ ID NO: 1845393 - RNA, 21 nt, Homo sapiens
uuuaacaagcucagcucugcu

SEQ ID NO: 1845394 - RNA, 19 nt, Homo sapiens
uuucucugcacacaagagg

SEQ ID NO: 1845395 - RNA, 18 nt, Homo sapiens
aguugcugugaauacuua

SEQ ID NO: 1845396 - RNA, 19 nt, Homo sapiens
auucacaaagguuaaguua

SEQ ID NO: 1845397 - RNA, 17 nt, Homo sapiens
uaggauaguugaugcau

SEQ ID NO: 1845398 - RNA, 13 nt, Homo sapiens
auaucuaccugcc

SEQ ID NO: 1845399 - RNA, 19 nt, Homo sapiens
auuacauaugaauuauuaa

SEQ ID NO: 1845400 - RNA, 12 nt, Homo sapiens
ugcccucuccca

SEQ ID NO: 1845401 - RNA, 14 nt, Homo sapiens
cuuuucuuggcaaa

SEQ ID NO: 1845402 - RNA, 14 nt, Homo sapiens
caagccaugugcuu

SEQ ID NO: 1845403 - RNA, 13 nt, Homo sapiens
acuuuauagcucu

SEQ ID NO: 1845404 - RNA, 23 nt, Homo sapiens
acauucuuguuuuaagugccuuu

SEQ ID NO: 1845405 - RNA, 18 nt, Homo sapiens
uucugcccgcuccaugga

SEQ ID NO: 1845406 - RNA, 18 nt, Homo sapiens
uugcauuuugauauugcu

SEQ ID NO: 1845407 - RNA, 23 nt, Homo sapiens
ucuccaccagccccucacaggcu

SEQ ID NO: 1845408 - RNA, 16 nt, Homo sapiens
cugggacucaguucuu

SEQ ID NO: 1845409 - RNA, 18 nt, Homo sapiens
aaugauuugcucuuugac

SEQ ID NO: 1845410 - RNA, 14 nt, Homo sapiens
agccagcaaccagc

SEQ ID NO: 1845411 - RNA, 21 nt, Homo sapiens
uuuccuggaccagugaccaaa

SEQ ID NO: 1845412 - RNA, 19 nt, Homo sapiens
cgcccacucuccaccucac

SEQ ID NO: 1845413 - RNA, 17 nt, Homo sapiens
acaaggaagccaaaguu

SEQ ID NO: 1845414 - RNA, 18 nt, Homo sapiens
caggccacuguggccaga

SEQ ID NO: 1845415 - RNA, 16 nt, Homo sapiens
uaagguguguacucag

SEQ ID NO: 1845416 - RNA, 22 nt, Homo sapiens
gccccucuuccccaaugcucca

SEQ ID NO: 1845417 - RNA, 20 nt, Homo sapiens
ucuucugacacuugugguau

SEQ ID NO: 1845418 - RNA, 22 nt, Homo sapiens
caaauugggacaacagugcuuu

SEQ ID NO: 1845419 - RNA, 22 nt, Homo sapiens
augcuacccacagcgucauuuu

SEQ ID NO: 1845420 - RNA, 15 nt, Homo sapiens
ucccaccuugaccaa

SEQ ID NO: 1845421 - RNA, 20 nt, Homo sapiens
aucuagaaauuuaccucaaa

SEQ ID NO: 1845422 - RNA, 15 nt, Homo sapiens
agacuaugacgguga

SEQ ID NO: 1845423 - RNA, 14 nt, Homo sapiens
uguaggcauuuuaa

SEQ ID NO: 1845424 - RNA, 14 nt, Homo sapiens
cuuauuuuucucca

SEQ ID NO: 1845425 - RNA, 17 nt, Homo sapiens
aagccgcaucccagacu

SEQ ID NO: 1845426 - RNA, 20 nt, Homo sapiens
agaccgugaccagugcugcu

SEQ ID NO: 1845427 - RNA, 12 nt, Homo sapiens
guugugucuuaa

SEQ ID NO: 1845428 - RNA, 21 nt, Homo sapiens
uuaacacuuccuauuagugac

SEQ ID NO: 1845429 - RNA, 22 nt, Homo sapiens
caaguucuaggccccccagaaa

SEQ ID NO: 1845430 - RNA, 21 nt, Homo sapiens
cagaauuuaaaccuauacuca

SEQ ID NO: 1845431 - RNA, 22 nt, Homo sapiens
aguaaaguaccuuuauguuaug

SEQ ID NO: 1845432 - RNA, 13 nt, Homo sapiens
caagaaugcagua

SEQ ID NO: 1845433 - RNA, 12 nt, Homo sapiens
auuauaccagug

SEQ ID NO: 1845434 - RNA, 14 nt, Homo sapiens
cuucaaacaaauaa

SEQ ID NO: 1845435 - RNA, 21 nt, Homo sapiens
aguaaaucuaucucuauauaa

SEQ ID NO: 1845436 - RNA, 15 nt, Homo sapiens
ccugacgucugccac

SEQ ID NO: 1845437 - RNA, 18 nt, Homo sapiens
caauccuuuauagcuuug

SEQ ID NO: 1845438 - RNA, 18 nt, Homo sapiens
gaaaauccuaacuuucag

SEQ ID NO: 1845439 - RNA, 19 nt, Homo sapiens
cagcacuguuuucaucaca

SEQ ID NO: 1845440 - RNA, 22 nt, Homo sapiens
acccaugaaucaaagacaugga

SEQ ID NO: 1845441 - RNA, 14 nt, Homo sapiens
cucaggggccagug

SEQ ID NO: 1845442 - RNA, 18 nt, Homo sapiens
uuguaaccugcugugaua

SEQ ID NO: 1845443 - RNA, 23 nt, Homo sapiens
gcugagacuacaggugagugcca

SEQ ID NO: 1845444 - RNA, 17 nt, Homo sapiens
uuguauuuugugaugaa

SEQ ID NO: 1845445 - RNA, 14 nt, Homo sapiens
ugugccuacauguu

SEQ ID NO: 1845446 - RNA, 14 nt, Homo sapiens
uuauauuauuacua

SEQ ID NO: 1845447 - RNA, 14 nt, Homo sapiens
cuccuauacucuau

SEQ ID NO: 1845448 - RNA, 20 nt, Homo sapiens
gcacccuucccccagcacca

SEQ ID NO: 1845449 - RNA, 16 nt, Homo sapiens
acacagauagaccuuu

SEQ ID NO: 1845450 - RNA, 16 nt, Homo sapiens
ggagcuuggcagagag

SEQ ID NO: 1845451 - RNA, 15 nt, Homo sapiens
aaagaauucugugag

SEQ ID NO: 1845452 - RNA, 20 nt, Homo sapiens
aaagguggacuugucuccca

SEQ ID NO: 1845453 - RNA, 23 nt, Homo sapiens
cagaauugccccugccauuucca

SEQ ID NO: 1845454 - RNA, 23 nt, Homo sapiens
aaacagcuccccaccaaccaaga

SEQ ID NO: 1845455 - RNA, 20 nt, Homo sapiens
uuccugugcccaucaucucu

SEQ ID NO: 1845456 - RNA, 20 nt, Homo sapiens
cuuaaaaauuaaauuggaaa

SEQ ID NO: 1845457 - RNA, 14 nt, Homo sapiens
uuuaaauuccacag

SEQ ID NO: 1845458 - RNA, 19 nt, Homo sapiens
aaagacaagacucugggga

SEQ ID NO: 1845459 - RNA, 16 nt, Homo sapiens
agaccuucguaucccc

SEQ ID NO: 1845460 - RNA, 15 nt, Homo sapiens
acaaaccaagccaug

SEQ ID NO: 1845461 - RNA, 21 nt, Homo sapiens
aagacccaguguaaagaauaa

SEQ ID NO: 1845462 - RNA, 22 nt, Homo sapiens
cauuuagaggacauucuggaaa

SEQ ID NO: 1845463 - RNA, 15 nt, Homo sapiens
ugauguuacugagau

SEQ ID NO: 1845464 - RNA, 17 nt, Homo sapiens
caacaucaagccuguga

SEQ ID NO: 1845465 - RNA, 15 nt, Homo sapiens
ucaguuuuccuaguc

SEQ ID NO: 1845466 - RNA, 22 nt, Homo sapiens
uuaaaggaaaaaucauaaccac

SEQ ID NO: 1845467 - RNA, 14 nt, Homo sapiens
uacacacacagaca

SEQ ID NO: 1845468 - RNA, 15 nt, Homo sapiens
cuuccucgacaucuu

SEQ ID NO: 1845469 - RNA, 19 nt, Homo sapiens
cgcccuggguuucaugagc

SEQ ID NO: 1845470 - RNA, 14 nt, Homo sapiens
guacugggccaugu

SEQ ID NO: 1845471 - RNA, 22 nt, Homo sapiens
aagcugucgccgcuagucuuau

SEQ ID NO: 1845472 - RNA, 18 nt, Homo sapiens
cuuggugcuaaaccacaa

SEQ ID NO: 1845473 - RNA, 14 nt, Homo sapiens
aacagugcccucca

SEQ ID NO: 1845474 - RNA, 13 nt, Homo sapiens
aaauaaaauguuc

SEQ ID NO: 1845475 - RNA, 13 nt, Homo sapiens
aaagcaaauguga

SEQ ID NO: 1845476 - RNA, 21 nt, Homo sapiens
acagauaccuccaacccugcc

SEQ ID NO: 1845477 - RNA, 15 nt, Homo sapiens
agggucucacugugu

SEQ ID NO: 1845478 - RNA, 15 nt, Homo sapiens
auucuuuugccaagg

SEQ ID NO: 1845479 - RNA, 18 nt, Homo sapiens
cacccucuccuugucaca

SEQ ID NO: 1845480 - RNA, 13 nt, Homo sapiens
cuagaaucagaua

SEQ ID NO: 1845481 - RNA, 20 nt, Homo sapiens
cuccuccugcccaccuguca

SEQ ID NO: 1845482 - RNA, 22 nt, Homo sapiens
aauugcuccuauacuauugaag

SEQ ID NO: 1845483 - RNA, 21 nt, Homo sapiens
gaauuuaccucuuaugagcuc

SEQ ID NO: 1845484 - RNA, 16 nt, Homo sapiens
cuuuccgucucccuaa

SEQ ID NO: 1845485 - RNA, 20 nt, Homo sapiens
uuugcauugaugaauuuugu

SEQ ID NO: 1845486 - RNA, 21 nt, Homo sapiens
acuugcaccugguacugcaca

SEQ ID NO: 1845487 - RNA, 22 nt, Homo sapiens
uccaucaggaaaaauacacccc

SEQ ID NO: 1845488 - RNA, 12 nt, Homo sapiens
aucaagucagca

SEQ ID NO: 1845489 - RNA, 14 nt, Homo sapiens
guccuuucuugcag

SEQ ID NO: 1845490 - RNA, 13 nt, Homo sapiens
cugguuuccucag

SEQ ID NO: 1845491 - RNA, 20 nt, Homo sapiens
aagagccagacucugucuca

SEQ ID NO: 1845492 - RNA, 17 nt, Homo sapiens
aagaaagccacacagag

SEQ ID NO: 1845493 - RNA, 21 nt, Homo sapiens
gugaauaguguuucaaaggua

SEQ ID NO: 1845494 - RNA, 16 nt, Homo sapiens
aagggagucauugccu

SEQ ID NO: 1845495 - RNA, 17 nt, Homo sapiens
ugggguuucaccauauu

SEQ ID NO: 1845496 - RNA, 20 nt, Homo sapiens
caguggcauucacaucucau

SEQ ID NO: 1845497 - RNA, 17 nt, Homo sapiens
uuaguccucuacugcua

SEQ ID NO: 1845498 - RNA, 20 nt, Homo sapiens
gccauuggguuuggggccau

SEQ ID NO: 1845499 - RNA, 19 nt, Homo sapiens
ugguccuggggaccauuca

SEQ ID NO: 1845500 - RNA, 21 nt, Homo sapiens
gagcaguggccaucauccucc

SEQ ID NO: 1845501 - RNA, 21 nt, Homo sapiens
agcuuacauugaaaacagaua

SEQ ID NO: 1845502 - RNA, 12 nt, Homo sapiens
auaaacuuuauu

SEQ ID NO: 1845503 - RNA, 16 nt, Homo sapiens
gugguccccguuccac

SEQ ID NO: 1845504 - RNA, 19 nt, Homo sapiens
auggaaugugguacaaauu

SEQ ID NO: 1845505 - RNA, 22 nt, Homo sapiens
gcaaaccaggccacuugccuca

SEQ ID NO: 1845506 - RNA, 19 nt, Homo sapiens
uucccccugagcugccacc

SEQ ID NO: 1845507 - RNA, 17 nt, Homo sapiens
caaagaaucaacaguga

SEQ ID NO: 1845508 - RNA, 22 nt, Homo sapiens
ggaagucguccuuacuccugug

SEQ ID NO: 1845509 - RNA, 17 nt, Homo sapiens
ccaaugcuuacugcgcu

SEQ ID NO: 1845510 - RNA, 18 nt, Homo sapiens
cuuggcccagcacugccc

SEQ ID NO: 1845511 - RNA, 20 nt, Homo sapiens
uugcccacccccaccaugca

SEQ ID NO: 1845512 - RNA, 16 nt, Homo sapiens
ucauauccauagauag

SEQ ID NO: 1845513 - RNA, 19 nt, Homo sapiens
gaaguaguccagccuucca

SEQ ID NO: 1845514 - RNA, 18 nt, Homo sapiens
ccaucuccucccaccagu

SEQ ID NO: 1845515 - RNA, 18 nt, Homo sapiens
ugggaaccgcccuccuga

SEQ ID NO: 1845516 - RNA, 21 nt, Homo sapiens
aucucacuggaugcaaagaaa

SEQ ID NO: 1845517 - RNA, 24 nt, Homo sapiens
ucucuugucacauggaaucuacau

SEQ ID NO: 1845518 - RNA, 21 nt, Homo sapiens
ccuguucugguauacauuuac

SEQ ID NO: 1845519 - RNA, 18 nt, Homo sapiens
cugccgucuucacuuccc

SEQ ID NO: 1845520 - RNA, 18 nt, Homo sapiens
aaguuguuuuuaaaacac

SEQ ID NO: 1845521 - RNA, 18 nt, Homo sapiens
ccaggggaaccugccaug

SEQ ID NO: 1845522 - RNA, 19 nt, Homo sapiens
aggugauccacccaccuca

SEQ ID NO: 1845523 - RNA, 20 nt, Homo sapiens
acucuccuugcuacccagaa

SEQ ID NO: 1845524 - RNA, 15 nt, Homo sapiens
uagucaugggguccc

SEQ ID NO: 1845525 - RNA, 19 nt, Homo sapiens
auugucuuguucugugaug

SEQ ID NO: 1845526 - RNA, 13 nt, Homo sapiens
accguucaccagu

SEQ ID NO: 1845527 - RNA, 22 nt, Homo sapiens
ugcaugcuacucuuagauagaa

SEQ ID NO: 1845528 - RNA, 21 nt, Homo sapiens
guccaacaaaccacacacagu

SEQ ID NO: 1845529 - RNA, 14 nt, Homo sapiens
gugguaaguggagg

SEQ ID NO: 1845530 - RNA, 22 nt, Homo sapiens
cuuucugugcagagaugacugu

SEQ ID NO: 1845531 - RNA, 18 nt, Homo sapiens
acucagauggaaccgcag

SEQ ID NO: 1845532 - RNA, 17 nt, Homo sapiens
caggaugacauagccaa

SEQ ID NO: 1845533 - RNA, 22 nt, Homo sapiens
cgaggcugcccacuauggucau

SEQ ID NO: 1845534 - RNA, 13 nt, Homo sapiens
gguuucuugcaag

SEQ ID NO: 1845535 - RNA, 16 nt, Homo sapiens
ucuauucuuugccuua

SEQ ID NO: 1845536 - RNA, 20 nt, Homo sapiens
ucucuccucagacugcucaa

SEQ ID NO: 1845537 - RNA, 14 nt, Homo sapiens
acaguauuuuccca

SEQ ID NO: 1845538 - RNA, 16 nt, Homo sapiens
agaggauagcuauauu

SEQ ID NO: 1845539 - RNA, 15 nt, Homo sapiens
uuuaucgaaguauau

SEQ ID NO: 1845540 - RNA, 15 nt, Homo sapiens
cacaauuuugucucu

SEQ ID NO: 1845541 - RNA, 19 nt, Homo sapiens
aauaauuuucuaagacagu

SEQ ID NO: 1845542 - RNA, 15 nt, Homo sapiens
gcugaacaugccugc

SEQ ID NO: 1845543 - RNA, 22 nt, Homo sapiens
uuccugaagaauugaaaaacca

SEQ ID NO: 1845544 - RNA, 20 nt, Homo sapiens
uguccuucauccaaugcagg

SEQ ID NO: 1845545 - RNA, 19 nt, Homo sapiens
acaauauuuuugaccugga

SEQ ID NO: 1845546 - RNA, 18 nt, Homo sapiens
cuccagcccccagugucc

SEQ ID NO: 1845547 - RNA, 17 nt, Homo sapiens
uuauauucagaguaugu

SEQ ID NO: 1845548 - RNA, 15 nt, Homo sapiens
ucccugcuaaucucc

SEQ ID NO: 1845549 - RNA, 15 nt, Homo sapiens
uaucaguuacccacu

SEQ ID NO: 1845550 - RNA, 12 nt, Homo sapiens
agggcagcagaa

SEQ ID NO: 1845551 - RNA, 14 nt, Homo sapiens
gugagaccuggcag

SEQ ID NO: 1845552 - RNA, 14 nt, Homo sapiens
gcccccaccagcag

SEQ ID NO: 1845553 - RNA, 16 nt, Homo sapiens
ugacagccugcagcag

SEQ ID NO: 1845554 - RNA, 13 nt, Homo sapiens
uugccucuaccag

SEQ ID NO: 1845555 - RNA, 12 nt, Homo sapiens
aaugacuuuccu

SEQ ID NO: 1845556 - RNA, 12 nt, Homo sapiens
guguugcaaagg

SEQ ID NO: 1845557 - RNA, 21 nt, Homo sapiens
aguuucagagauggacagaga

SEQ ID NO: 1845558 - RNA, 17 nt, Homo sapiens
gaccaggccugggccag

SEQ ID NO: 1845559 - RNA, 17 nt, Homo sapiens
cuguuugacaacauguu

SEQ ID NO: 1845560 - RNA, 23 nt, Homo sapiens
gccuaaaucccaagaaauggaau

SEQ ID NO: 1845561 - RNA, 13 nt, Homo sapiens
guauuucaccucu

SEQ ID NO: 1845562 - RNA, 17 nt, Homo sapiens
acccccuuccacaaugg

SEQ ID NO: 1845563 - RNA, 15 nt, Homo sapiens
acacacuaucaccua

SEQ ID NO: 1845564 - RNA, 12 nt, Homo sapiens
cccgaagccacc

SEQ ID NO: 1845565 - RNA, 15 nt, Homo sapiens
accacauccugaaaa

SEQ ID NO: 1845566 - RNA, 20 nt, Homo sapiens
gaugaggggaggggggcaca

SEQ ID NO: 1845567 - RNA, 20 nt, Homo sapiens
aagggaagaaggggccauca

SEQ ID NO: 1845568 - RNA, 13 nt, Homo sapiens
ugcucucaaaaga

SEQ ID NO: 1845569 - RNA, 17 nt, Homo sapiens
auaauugccacugagag

SEQ ID NO: 1845570 - RNA, 23 nt, Homo sapiens
ccauuugggcagagaggcugugg

SEQ ID NO: 1845571 - RNA, 17 nt, Homo sapiens
auggucaucgugacagc

SEQ ID NO: 1845572 - RNA, 22 nt, Homo sapiens
gagaaacucaccacaguguuuu

SEQ ID NO: 1845573 - RNA, 20 nt, Homo sapiens
aacccuagucaaaacuauuu

SEQ ID NO: 1845574 - RNA, 14 nt, Homo sapiens
cuccuggucuguga

SEQ ID NO: 1845575 - RNA, 13 nt, Homo sapiens
agagucucaggac

SEQ ID NO: 1845576 - RNA, 19 nt, Homo sapiens
auauuuuucaaaaucaaag

SEQ ID NO: 1845577 - RNA, 19 nt, Homo sapiens
uagucaauaacuaaacuaa

SEQ ID NO: 1845578 - RNA, 19 nt, Homo sapiens
gagugcaguggugcaauca

SEQ ID NO: 1845579 - RNA, 20 nt, Homo sapiens
caaucacaaaaguauauuca

SEQ ID NO: 1845580 - RNA, 19 nt, Homo sapiens
ggauccgugacagcacuuu

SEQ ID NO: 1845581 - RNA, 14 nt, Homo sapiens
ugcagugcugcuuu

SEQ ID NO: 1845582 - RNA, 20 nt, Homo sapiens
uaacuuuuaaaaugaagcuu

SEQ ID NO: 1845583 - RNA, 18 nt, Homo sapiens
ccauggguuaagagcuca

SEQ ID NO: 1845584 - RNA, 20 nt, Homo sapiens
cuucagacuuaaagcacuga

SEQ ID NO: 1845585 - RNA, 22 nt, Homo sapiens
gugaauguaggcuggcuuucag

SEQ ID NO: 1845586 - RNA, 22 nt, Homo sapiens
aacuauguaaacaaaaagggaa

SEQ ID NO: 1845587 - RNA, 22 nt, Homo sapiens
agguaugggacaggugccaggu

SEQ ID NO: 1845588 - RNA, 15 nt, Homo sapiens
ucaccaugacaccug

SEQ ID NO: 1845589 - RNA, 15 nt, Homo sapiens
agaccaggugaccuu

SEQ ID NO: 1845590 - RNA, 20 nt, Homo sapiens
gccuggccaguauggugaaa

SEQ ID NO: 1845591 - RNA, 23 nt, Homo sapiens
agagaugauucggauuugacaaa

SEQ ID NO: 1845592 - RNA, 19 nt, Homo sapiens
gccuggauuccagcaguga

SEQ ID NO: 1845593 - RNA, 16 nt, Homo sapiens
auuuuggacgugugag

SEQ ID NO: 1845594 - RNA, 20 nt, Homo sapiens
cagcccagcccgcugcucac

SEQ ID NO: 1845595 - RNA, 16 nt, Homo sapiens
uuaguaugugcauuua

SEQ ID NO: 1845596 - RNA, 20 nt, Homo sapiens
gcugaaaacugcaacuugua

SEQ ID NO: 1845597 - RNA, 23 nt, Homo sapiens
acuucaagaacccugacuccucu

SEQ ID NO: 1845598 - RNA, 12 nt, Homo sapiens
gaagaagccaga

SEQ ID NO: 1845599 - RNA, 20 nt, Homo sapiens
aaaccauagcuaaguagcau

SEQ ID NO: 1845600 - RNA, 21 nt, Homo sapiens
aauaggaaucuucacuagaag

SEQ ID NO: 1845601 - RNA, 22 nt, Homo sapiens
auuucacgcuuuuaauucucau

SEQ ID NO: 1845602 - RNA, 23 nt, Homo sapiens
ucaacuaaugaaaauaaaacauu

SEQ ID NO: 1845603 - RNA, 15 nt, Homo sapiens
aucaucaacccuaaa

SEQ ID NO: 1845604 - RNA, 23 nt, Homo sapiens
guuuuuuuagaagacaauuuuca

SEQ ID NO: 1845605 - RNA, 20 nt, Homo sapiens
gugccaccaacauaaaacaa

SEQ ID NO: 1845606 - RNA, 22 nt, Homo sapiens
cuacaauaaacugguaugaaua

SEQ ID NO: 1845607 - RNA, 20 nt, Homo sapiens
accugccugaacgcacauga

SEQ ID NO: 1845608 - RNA, 13 nt, Homo sapiens
accaaacauaaca

SEQ ID NO: 1845609 - RNA, 16 nt, Homo sapiens
cauccugugggaccug

SEQ ID NO: 1845610 - RNA, 17 nt, Homo sapiens
gcaagacuguugcucaa

SEQ ID NO: 1845611 - RNA, 13 nt, Homo sapiens
ccacuuucauuca

SEQ ID NO: 1845612 - RNA, 16 nt, Homo sapiens
ugcagucuuggcucac

SEQ ID NO: 1845613 - RNA, 16 nt, Homo sapiens
uagaauagugcauugu

SEQ ID NO: 1845614 - RNA, 22 nt, Homo sapiens
auaacccugccagugccagggu

SEQ ID NO: 1845615 - RNA, 21 nt, Homo sapiens
uaauaucucuaauauauccac

SEQ ID NO: 1845616 - RNA, 18 nt, Homo sapiens
gcccagaauucugggcaa

SEQ ID NO: 1845617 - RNA, 14 nt, Homo sapiens
cauccagaugugug

SEQ ID NO: 1845618 - RNA, 23 nt, Homo sapiens
augaauagccaggccugaccuca

SEQ ID NO: 1845619 - RNA, 15 nt, Homo sapiens
cugcugcuguuaucu

SEQ ID NO: 1845620 - RNA, 16 nt, Homo sapiens
gauucuaggauaagca

SEQ ID NO: 1845621 - RNA, 13 nt, Homo sapiens
cuuuaaacucagg

SEQ ID NO: 1845622 - RNA, 12 nt, Homo sapiens
aguguaccuccu

SEQ ID NO: 1845623 - RNA, 13 nt, Homo sapiens
acagaaugugucu

SEQ ID NO: 1845624 - RNA, 14 nt, Homo sapiens
aaguggcaguucuu

SEQ ID NO: 1845625 - RNA, 15 nt, Homo sapiens
gcuagaaugguggga

SEQ ID NO: 1845626 - RNA, 16 nt, Homo sapiens
gucaagcgugcagcuu

SEQ ID NO: 1845627 - RNA, 13 nt, Homo sapiens
ugagcaaauggaa

SEQ ID NO: 1845628 - RNA, 10 nt, Homo sapiens
cuauggaugu

SEQ ID NO: 1845629 - RNA, 13 nt, Homo sapiens
cacacacacacga

SEQ ID NO: 1845630 - RNA, 12 nt, Homo sapiens
acuacaaccucc

SEQ ID NO: 1845631 - RNA, 22 nt, Homo sapiens
ugagugcuggauauuuuacuac

SEQ ID NO: 1845632 - RNA, 15 nt, Homo sapiens
uaaacuacuuguaaa

SEQ ID NO: 1845633 - RNA, 18 nt, Homo sapiens
ccgcagugggaagugaau

SEQ ID NO: 1845634 - RNA, 22 nt, Homo sapiens
cugcauucauucugagcccccu

SEQ ID NO: 1845635 - RNA, 20 nt, Homo sapiens
agugcaguggcgugaucuca

SEQ ID NO: 1845636 - RNA, 14 nt, Homo sapiens
aaauggcuguggag

SEQ ID NO: 1845637 - RNA, 22 nt, Homo sapiens
cacuuacagaaccaauucacuu

SEQ ID NO: 1845638 - RNA, 15 nt, Homo sapiens
cuuugacuccuuuga

SEQ ID NO: 1845639 - RNA, 18 nt, Homo sapiens
ucauacucagagcauuau

SEQ ID NO: 1845640 - RNA, 15 nt, Homo sapiens
aaaggugccaucuca

SEQ ID NO: 1845641 - RNA, 21 nt, Homo sapiens
gcaacuagcugggcacagugg

SEQ ID NO: 1845642 - RNA, 11 nt, Homo sapiens
cgguguucuaa

SEQ ID NO: 1845643 - RNA, 14 nt, Homo sapiens
uguuccugacuguu

SEQ ID NO: 1845644 - RNA, 22 nt, Homo sapiens
cucccugcaagaaaucagccau

SEQ ID NO: 1845645 - RNA, 11 nt, Homo sapiens
gggaugaugau

SEQ ID NO: 1845646 - RNA, 18 nt, Homo sapiens
gaaaugcucuuuugcaca

SEQ ID NO: 1845647 - RNA, 14 nt, Homo sapiens
cagaauccacaacu

SEQ ID NO: 1845648 - RNA, 13 nt, Homo sapiens
aacaguuuuccaa

SEQ ID NO: 1845649 - RNA, 15 nt, Homo sapiens
cugccccacccucaa

SEQ ID NO: 1845650 - RNA, 18 nt, Homo sapiens
auagugcacuagcauuuu

SEQ ID NO: 1845651 - RNA, 14 nt, Homo sapiens
acuucucuagacau

SEQ ID NO: 1845652 - RNA, 13 nt, Homo sapiens
uuaaaauucaauu

SEQ ID NO: 1845653 - RNA, 22 nt, Homo sapiens
uccaccuuuuaaguuaaugaaa

SEQ ID NO: 1845654 - RNA, 17 nt, Homo sapiens
caggaggaaaagcccag

SEQ ID NO: 1845655 - RNA, 17 nt, Homo sapiens
ucuaucaauagucaaga

SEQ ID NO: 1845656 - RNA, 22 nt, Homo sapiens
acucaaaagcugggaaccagca

SEQ ID NO: 1845657 - RNA, 16 nt, Homo sapiens
gccuggaccuaugcag

SEQ ID NO: 1845658 - RNA, 23 nt, Homo sapiens
aacucuuggccagagcugagugg

SEQ ID NO: 1845659 - RNA, 21 nt, Homo sapiens
agaaguaagccucaucaucag

SEQ ID NO: 1845660 - RNA, 15 nt, Homo sapiens
gacacagaagcccca

SEQ ID NO: 1845661 - RNA, 17 nt, Homo sapiens
augugaucaucuuugcu

SEQ ID NO: 1845662 - RNA, 21 nt, Homo sapiens
accaaugggguuguuagcuuu

SEQ ID NO: 1845663 - RNA, 17 nt, Homo sapiens
ccaaauguagcaggugu

SEQ ID NO: 1845664 - RNA, 21 nt, Homo sapiens
ucaucccgagcaccuccacau

SEQ ID NO: 1845665 - RNA, 14 nt, Homo sapiens
aauuuauugcacau

SEQ ID NO: 1845666 - RNA, 19 nt, Homo sapiens
aacuucuauaccacacaga

SEQ ID NO: 1845667 - RNA, 16 nt, Homo sapiens
augcaugucugccuau

SEQ ID NO: 1845668 - RNA, 15 nt, Homo sapiens
accauugaacuguac

SEQ ID NO: 1845669 - RNA, 19 nt, Homo sapiens
uguuuaaggaaaugugcag

SEQ ID NO: 1845670 - RNA, 19 nt, Homo sapiens
ucaagcgauucucuugccu

SEQ ID NO: 1845671 - RNA, 16 nt, Homo sapiens
cucaacuuacauaugu

SEQ ID NO: 1845672 - RNA, 19 nt, Homo sapiens
ucaagugauucuccugccu

SEQ ID NO: 1845673 - RNA, 21 nt, Homo sapiens
auaaaaccaucaaaaauauuc

SEQ ID NO: 1845674 - RNA, 16 nt, Homo sapiens
acauuuguaaaucuau

SEQ ID NO: 1845675 - RNA, 15 nt, Homo sapiens
cugaaagaggccaaa

SEQ ID NO: 1845676 - RNA, 22 nt, Homo sapiens
gccuccucccugggcagaaagu

SEQ ID NO: 1845677 - RNA, 22 nt, Homo sapiens
cagucccuggagcuguccuuca

SEQ ID NO: 1845678 - RNA, 21 nt, Homo sapiens
guuuuucuuacuugcauuuau

SEQ ID NO: 1845679 - RNA, 14 nt, Homo sapiens
uaucccuacuguaa

SEQ ID NO: 1845680 - RNA, 18 nt, Homo sapiens
ggagaaacccuugaaaag

SEQ ID NO: 1845681 - RNA, 23 nt, Homo sapiens
ucagggaugcucauuccaugacu

SEQ ID NO: 1845682 - RNA, 22 nt, Homo sapiens
aaugcugacaaugcugccaugc

SEQ ID NO: 1845683 - RNA, 19 nt, Homo sapiens
auaggaucacuugggccca

SEQ ID NO: 1845684 - RNA, 22 nt, Homo sapiens
uggagauggggagaaaccuaca

SEQ ID NO: 1845685 - RNA, 23 nt, Homo sapiens
ugaaaaucuacacuccagugaga

SEQ ID NO: 1845686 - RNA, 21 nt, Homo sapiens
augucuauuuuugaugacuca

SEQ ID NO: 1845687 - RNA, 19 nt, Homo sapiens
ugugaguguauguauacac

SEQ ID NO: 1845688 - RNA, 23 nt, Homo sapiens
accuuguuguuguuaaauaucag

SEQ ID NO: 1845689 - RNA, 21 nt, Homo sapiens
guacuggggugggaucuugga

SEQ ID NO: 1845690 - RNA, 21 nt, Homo sapiens
guuaugagaaaaaaacagcag

SEQ ID NO: 1845691 - RNA, 15 nt, Homo sapiens
uaagagcaauucugg

SEQ ID NO: 1845692 - RNA, 22 nt, Homo sapiens
auauguuuuuaaagguggauuu

SEQ ID NO: 1845693 - RNA, 17 nt, Homo sapiens
uuaaguacaugugccag

SEQ ID NO: 1845694 - RNA, 20 nt, Homo sapiens
cuccuggguucaagugauuc

SEQ ID NO: 1845695 - RNA, 20 nt, Homo sapiens
ugaaagaccuuagacauaaa

SEQ ID NO: 1845696 - RNA, 15 nt, Homo sapiens
ucccacgagggugcc

SEQ ID NO: 1845697 - RNA, 18 nt, Homo sapiens
gaucuugguccuguguuu

SEQ ID NO: 1845698 - RNA, 18 nt, Homo sapiens
aaaauaaaguuacauugc

SEQ ID NO: 1845699 - RNA, 18 nt, Homo sapiens
acucagaaaagacgcacc

SEQ ID NO: 1845700 - RNA, 19 nt, Homo sapiens
caauuugaauuuaucuuuc

SEQ ID NO: 1845701 - RNA, 22 nt, Homo sapiens
uaacaugauaaaagacacuccc

SEQ ID NO: 1845702 - RNA, 19 nt, Homo sapiens
gcucuguugcccaagcugg

SEQ ID NO: 1845703 - RNA, 13 nt, Homo sapiens
ugagagucagggu

SEQ ID NO: 1845704 - RNA, 18 nt, Homo sapiens
ucagacaauccacucuca

SEQ ID NO: 1845705 - RNA, 18 nt, Homo sapiens
uuuccaaauacauuccag

SEQ ID NO: 1845706 - RNA, 17 nt, Homo sapiens
cucagaugaggacagag

SEQ ID NO: 1845707 - RNA, 19 nt, Homo sapiens
acauguaacgaaacacuuc

SEQ ID NO: 1845708 - RNA, 19 nt, Homo sapiens
gaaggaaggacuaugacaa

SEQ ID NO: 1845709 - RNA, 20 nt, Homo sapiens
cacgcaggagcacacccagc

SEQ ID NO: 1845710 - RNA, 14 nt, Homo sapiens
agcuguaucuguaa

SEQ ID NO: 1845711 - RNA, 17 nt, Homo sapiens
cagcaagagagaaccua

SEQ ID NO: 1845712 - RNA, 15 nt, Homo sapiens
ccaucaccuucucaa

SEQ ID NO: 1845713 - RNA, 21 nt, Homo sapiens
ggaagaaaaagcaaguguuca

SEQ ID NO: 1845714 - RNA, 20 nt, Homo sapiens
aagaugcacucgcugugauu

SEQ ID NO: 1845715 - RNA, 14 nt, Homo sapiens
gagaccauguuuca

SEQ ID NO: 1845716 - RNA, 18 nt, Homo sapiens
aaacacacuacuaccucu

SEQ ID NO: 1845717 - RNA, 14 nt, Homo sapiens
gccaggcacuuuga

SEQ ID NO: 1845718 - RNA, 16 nt, Homo sapiens
aagcaauaaccucaaa

SEQ ID NO: 1845719 - RNA, 16 nt, Homo sapiens
auccagcuucucaugu

SEQ ID NO: 1845720 - RNA, 18 nt, Homo sapiens
uuuggcuuuaugugcaaa

SEQ ID NO: 1845721 - RNA, 19 nt, Homo sapiens
cuaaacucuuucauccccu

SEQ ID NO: 1845722 - RNA, 15 nt, Homo sapiens
aagacuugugcaucc

SEQ ID NO: 1845723 - RNA, 19 nt, Homo sapiens
acuguaacuacuuccugau

SEQ ID NO: 1845724 - RNA, 16 nt, Homo sapiens
auccugugugucuuuu

SEQ ID NO: 1845725 - RNA, 22 nt, Homo sapiens
uaaaauguuuguuaaagcuaga

SEQ ID NO: 1845726 - RNA, 15 nt, Homo sapiens
aguuggucaguauug

SEQ ID NO: 1845727 - RNA, 22 nt, Homo sapiens
ugagaagaaaacaucuauucuc

SEQ ID NO: 1845728 - RNA, 16 nt, Homo sapiens
ugcuaauuuucagggu

SEQ ID NO: 1845729 - RNA, 21 nt, Homo sapiens
ucagggggucuggaaagaagg

SEQ ID NO: 1845730 - RNA, 15 nt, Homo sapiens
caaucaguugacuuu

SEQ ID NO: 1845731 - RNA, 18 nt, Homo sapiens
caucccuaagaauuccca

SEQ ID NO: 1845732 - RNA, 13 nt, Homo sapiens
aucccucauucau

SEQ ID NO: 1845733 - RNA, 14 nt, Homo sapiens
aaugcaaauucuca

SEQ ID NO: 1845734 - RNA, 12 nt, Homo sapiens
gaaagcuauaua

SEQ ID NO: 1845735 - RNA, 17 nt, Homo sapiens
guccucccccacucccu

SEQ ID NO: 1845736 - RNA, 12 nt, Homo sapiens
gguaugaugcug

SEQ ID NO: 1845737 - RNA, 21 nt, Homo sapiens
acuugcccugaacauacacau

SEQ ID NO: 1845738 - RNA, 11 nt, Homo sapiens
ugccagugcag

SEQ ID NO: 1845739 - RNA, 23 nt, Homo sapiens
auacuugcuccauucauacacaa

SEQ ID NO: 1845740 - RNA, 13 nt, Homo sapiens
ucauauaugcaaa

SEQ ID NO: 1845741 - RNA, 13 nt, Homo sapiens
uauuccucaaaaa

SEQ ID NO: 1845742 - RNA, 23 nt, Homo sapiens
gcgccaggagccuggacccggcc

SEQ ID NO: 1845743 - RNA, 23 nt, Homo sapiens
ugccccauugagaucuuccugcu

SEQ ID NO: 1845744 - RNA, 22 nt, Homo sapiens
ucccucacggggagagagacca

SEQ ID NO: 1845745 - RNA, 15 nt, Homo sapiens
caaucacauagugaa

SEQ ID NO: 1845746 - RNA, 16 nt, Homo sapiens
aauguuauagguuugu

SEQ ID NO: 1845747 - RNA, 21 nt, Homo sapiens
cagaauuuuuaacaaaaugag

SEQ ID NO: 1845748 - RNA, 14 nt, Homo sapiens
caguugcuguggac

SEQ ID NO: 1845749 - RNA, 22 nt, Homo sapiens
cugugggcaaaagaguguaaaa

SEQ ID NO: 1845750 - RNA, 22 nt, Homo sapiens
ccccuuccagaucacugccaca

SEQ ID NO: 1845751 - RNA, 14 nt, Homo sapiens
gaagauggauguaa

SEQ ID NO: 1845752 - RNA, 17 nt, Homo sapiens
agucugcagauagaaag

SEQ ID NO: 1845753 - RNA, 18 nt, Homo sapiens
cagauuaagaguugccaa

SEQ ID NO: 1845754 - RNA, 18 nt, Homo sapiens
ucagccaauuauguuaaa

SEQ ID NO: 1845755 - RNA, 15 nt, Homo sapiens
cuuuauauauguacu

SEQ ID NO: 1845756 - RNA, 22 nt, Homo sapiens
aucuccuggcuuuacagacaaa

SEQ ID NO: 1845757 - RNA, 16 nt, Homo sapiens
cccuaaagaacauacc

SEQ ID NO: 1845758 - RNA, 18 nt, Homo sapiens
aaaaccaguagcuuccca

SEQ ID NO: 1845759 - RNA, 19 nt, Homo sapiens
guauucuuugauguuaaca

SEQ ID NO: 1845760 - RNA, 17 nt, Homo sapiens
cagccucccaaagugcu

SEQ ID NO: 1845761 - RNA, 15 nt, Homo sapiens
cucugugcucuccua

SEQ ID NO: 1845762 - RNA, 18 nt, Homo sapiens
acaggguaacugugcuga

SEQ ID NO: 1845763 - RNA, 15 nt, Homo sapiens
ugggauuacagaucu

SEQ ID NO: 1845764 - RNA, 14 nt, Homo sapiens
uggaucuaccagca

SEQ ID NO: 1845765 - RNA, 17 nt, Homo sapiens
aacccgcaccccagugc

SEQ ID NO: 1845766 - RNA, 19 nt, Homo sapiens
agccuuggaagcaaacuua

SEQ ID NO: 1845767 - RNA, 15 nt, Homo sapiens
gagauguuugccaaa

SEQ ID NO: 1845768 - RNA, 18 nt, Homo sapiens
auaagcuacugaugagaa

SEQ ID NO: 1845769 - RNA, 23 nt, Homo sapiens
guuccugaauacaagccuaugcg

SEQ ID NO: 1845770 - RNA, 19 nt, Homo sapiens
ugggaccacuggguacaag

SEQ ID NO: 1845771 - RNA, 14 nt, Homo sapiens
uguggucaucaugg

SEQ ID NO: 1845772 - RNA, 21 nt, Homo sapiens
uaagguuucaacaaauuucau

SEQ ID NO: 1845773 - RNA, 19 nt, Homo sapiens
gaguaaauauauaugucaa

SEQ ID NO: 1845774 - RNA, 22 nt, Homo sapiens
agcacaaagugggagcccgaua

SEQ ID NO: 1845775 - RNA, 23 nt, Homo sapiens
augccuuucucucuuucucuuaa

SEQ ID NO: 1845776 - RNA, 13 nt, Homo sapiens
acacugccagugu

SEQ ID NO: 1845777 - RNA, 20 nt, Homo sapiens
uuguuuuuaaguccuguaua

SEQ ID NO: 1845778 - RNA, 19 nt, Homo sapiens
acuguguaagggccagaaa

SEQ ID NO: 1845779 - RNA, 16 nt, Homo sapiens
aucaauuccaucagca

SEQ ID NO: 1845780 - RNA, 19 nt, Homo sapiens
auccgccucugagccagga

SEQ ID NO: 1845781 - RNA, 18 nt, Homo sapiens
ccuuaauuauuaacaaag

SEQ ID NO: 1845782 - RNA, 14 nt, Homo sapiens
ccuccacagcagug

SEQ ID NO: 1845783 - RNA, 21 nt, Homo sapiens
caauuucccuucauacuccuu

SEQ ID NO: 1845784 - RNA, 21 nt, Homo sapiens
cauauaacuaagacauaugca

SEQ ID NO: 1845785 - RNA, 11 nt, Homo sapiens
caacacuuaag

SEQ ID NO: 1845786 - RNA, 15 nt, Homo sapiens
aacuguggugccaca

SEQ ID NO: 1845787 - RNA, 13 nt, Homo sapiens
auaccuccauguu

SEQ ID NO: 1845788 - RNA, 17 nt, Homo sapiens
cacuaugggugagcaua

SEQ ID NO: 1845789 - RNA, 14 nt, Homo sapiens
aaagacuaacuuga

SEQ ID NO: 1845790 - RNA, 21 nt, Homo sapiens
aaauggugguuguuucuucca

SEQ ID NO: 1845791 - RNA, 16 nt, Homo sapiens
gugacucuaccugcaa

SEQ ID NO: 1845792 - RNA, 18 nt, Homo sapiens
aguaccuacaucagucaa

SEQ ID NO: 1845793 - RNA, 12 nt, Homo sapiens
gcuaaucugccu

SEQ ID NO: 1845794 - RNA, 12 nt, Homo sapiens
cuuuucauuuaa

SEQ ID NO: 1845795 - RNA, 20 nt, Homo sapiens
ggaaagaauuaaugcucuaa

SEQ ID NO: 1845796 - RNA, 18 nt, Homo sapiens
uuuucuguugaagauuaa

SEQ ID NO: 1845797 - RNA, 17 nt, Homo sapiens
cugaucccagccaagga

SEQ ID NO: 1845798 - RNA, 19 nt, Homo sapiens
acagucuucccagcaauua

SEQ ID NO: 1845799 - RNA, 21 nt, Homo sapiens
aggacugacccuggauuccuc

SEQ ID NO: 1845800 - RNA, 16 nt, Homo sapiens
uugucugggugcagcu

SEQ ID NO: 1845801 - RNA, 23 nt, Homo sapiens
cagccagcuaccccuugugggca

SEQ ID NO: 1845802 - RNA, 17 nt, Homo sapiens
guguucucacacuggug

SEQ ID NO: 1845803 - RNA, 23 nt, Homo sapiens
agggcuccaaaucugccuagaaa

SEQ ID NO: 1845804 - RNA, 23 nt, Homo sapiens
guguuugcagcugugagaaguca

SEQ ID NO: 1845805 - RNA, 20 nt, Homo sapiens
aauuuaugaagcagauuuau

SEQ ID NO: 1845806 - RNA, 13 nt, Homo sapiens
gcagaaccaaagc

SEQ ID NO: 1845807 - RNA, 13 nt, Homo sapiens
gacucaccaccua

SEQ ID NO: 1845808 - RNA, 16 nt, Homo sapiens
ucaugaugucugcaaa

SEQ ID NO: 1845809 - RNA, 19 nt, Homo sapiens
acuguguucauguguaaag

SEQ ID NO: 1845810 - RNA, 19 nt, Homo sapiens
cagggacuccaugcugcca

SEQ ID NO: 1845811 - RNA, 15 nt, Homo sapiens
gaccccucuccucaa

SEQ ID NO: 1845812 - RNA, 14 nt, Homo sapiens
uggaaaauauguaa

SEQ ID NO: 1845813 - RNA, 21 nt, Homo sapiens
accccgacaaggagacugccu

SEQ ID NO: 1845814 - RNA, 14 nt, Homo sapiens
ugcuuuauugaauu

SEQ ID NO: 1845815 - RNA, 14 nt, Homo sapiens
aauaugcuacagua

SEQ ID NO: 1845816 - RNA, 15 nt, Homo sapiens
uaauuaaacaugauc

SEQ ID NO: 1845817 - RNA, 17 nt, Homo sapiens
uugaugcuguuucuaca

SEQ ID NO: 1845818 - RNA, 11 nt, Homo sapiens
uugcugugaaa

SEQ ID NO: 1845819 - RNA, 20 nt, Homo sapiens
ccaaagaaaugaacauucca

SEQ ID NO: 1845820 - RNA, 16 nt, Homo sapiens
ccacucccuuugccag

SEQ ID NO: 1845821 - RNA, 17 nt, Homo sapiens
agcgagacuccaucucu

SEQ ID NO: 1845822 - RNA, 18 nt, Homo sapiens
agggguuggauugcaaua

SEQ ID NO: 1845823 - RNA, 12 nt, Homo sapiens
ucaacucugauc

SEQ ID NO: 1845824 - RNA, 21 nt, Homo sapiens
cuuuguguagaaagccaaaua

SEQ ID NO: 1845825 - RNA, 20 nt, Homo sapiens
ucuccagccugggaggcaca

SEQ ID NO: 1845826 - RNA, 15 nt, Homo sapiens
aauuguugcuuuuac

SEQ ID NO: 1845827 - RNA, 14 nt, Homo sapiens
auaccaaagacaca

SEQ ID NO: 1845828 - RNA, 21 nt, Homo sapiens
gacagucaugcagucugggag

SEQ ID NO: 1845829 - RNA, 16 nt, Homo sapiens
gccuccaagcacagag

SEQ ID NO: 1845830 - RNA, 23 nt, Homo sapiens
uaaaaaaaauuugcucauaugaa

SEQ ID NO: 1845831 - RNA, 22 nt, Homo sapiens
gucaaaauugguagugucuguu

SEQ ID NO: 1845832 - RNA, 19 nt, Homo sapiens
ucacccacccuguggcuca

SEQ ID NO: 1845833 - RNA, 15 nt, Homo sapiens
aaccucucagcacua

SEQ ID NO: 1845834 - RNA, 13 nt, Homo sapiens
auuccuuccaucu

SEQ ID NO: 1845835 - RNA, 11 nt, Homo sapiens
uucccaccacc

SEQ ID NO: 1845836 - RNA, 22 nt, Homo sapiens
ugcucaguaacacagugcagug

SEQ ID NO: 1845837 - RNA, 14 nt, Homo sapiens
ugauccgagcucag

SEQ ID NO: 1845838 - RNA, 13 nt, Homo sapiens
guccuucauucuu

SEQ ID NO: 1845839 - RNA, 14 nt, Homo sapiens
acuagcauacuuaa

SEQ ID NO: 1845840 - RNA, 21 nt, Homo sapiens
gaaggguuuugcuacauucua

SEQ ID NO: 1845841 - RNA, 15 nt, Homo sapiens
aaauuagugcuguaa

SEQ ID NO: 1845842 - RNA, 19 nt, Homo sapiens
ucccucugauugguuuugg

SEQ ID NO: 1845843 - RNA, 14 nt, Homo sapiens
uguauccauucuac

SEQ ID NO: 1845844 - RNA, 23 nt, Homo sapiens
guauaaauguuauguuugcuaaa

SEQ ID NO: 1845845 - RNA, 15 nt, Homo sapiens
ucggccuccaugacc

SEQ ID NO: 1845846 - RNA, 13 nt, Homo sapiens
uauauauucccaa

SEQ ID NO: 1845847 - RNA, 20 nt, Homo sapiens
guccaggguggaugaucuca

SEQ ID NO: 1845848 - RNA, 18 nt, Homo sapiens
uauugagcuguacaugca

SEQ ID NO: 1845849 - RNA, 14 nt, Homo sapiens
uggugacuucacag

SEQ ID NO: 1845850 - RNA, 23 nt, Homo sapiens
aacauggugaaacccccaucucu

SEQ ID NO: 1845851 - RNA, 20 nt, Homo sapiens
guucuguuuccugugucucc

SEQ ID NO: 1845852 - RNA, 13 nt, Homo sapiens
agguguacuguac

SEQ ID NO: 1845853 - RNA, 12 nt, Homo sapiens
ccauuccaaagu

SEQ ID NO: 1845854 - RNA, 13 nt, Homo sapiens
uuuaaauuccaca

SEQ ID NO: 1845855 - RNA, 21 nt, Homo sapiens
guuauuggacuccaggccuga

SEQ ID NO: 1845856 - RNA, 19 nt, Homo sapiens
caaccugcuuggguggaga

SEQ ID NO: 1845857 - RNA, 18 nt, Homo sapiens
aacuuauugucuaggcca

SEQ ID NO: 1845858 - RNA, 14 nt, Homo sapiens
ugguguccagucuu

SEQ ID NO: 1845859 - RNA, 11 nt, Homo sapiens
uacagcuuucu

SEQ ID NO: 1845860 - RNA, 15 nt, Homo sapiens
gagacaggagccuag

SEQ ID NO: 1845861 - RNA, 15 nt, Homo sapiens
agguaacacuacaga

SEQ ID NO: 1845862 - RNA, 16 nt, Homo sapiens
cagaaacaaaaagccc

SEQ ID NO: 1845863 - RNA, 18 nt, Homo sapiens
cagauuuaaagcaucauc

SEQ ID NO: 1845864 - RNA, 16 nt, Homo sapiens
cuaccagacuguguau

SEQ ID NO: 1845865 - RNA, 13 nt, Homo sapiens
accuggguccuuu

SEQ ID NO: 1845866 - RNA, 20 nt, Homo sapiens
uacaccaguuugacugugcu

SEQ ID NO: 1845867 - RNA, 21 nt, Homo sapiens
ugaacucugguggcacaggag

SEQ ID NO: 1845868 - RNA, 21 nt, Homo sapiens
cagaugccaaaaaagaugcca

SEQ ID NO: 1845869 - RNA, 21 nt, Homo sapiens
ugcauuugugcccacucucca

SEQ ID NO: 1845870 - RNA, 15 nt, Homo sapiens
aggcacaggcucagu

SEQ ID NO: 1845871 - RNA, 12 nt, Homo sapiens
ucuaaaccuuac

SEQ ID NO: 1845872 - RNA, 18 nt, Homo sapiens
uucucucauaggcaaguc

SEQ ID NO: 1845873 - RNA, 16 nt, Homo sapiens
ugauaguucaguccca

SEQ ID NO: 1845874 - RNA, 14 nt, Homo sapiens
cugugaacacugga

SEQ ID NO: 1845875 - RNA, 12 nt, Homo sapiens
agcuuugucaua

SEQ ID NO: 1845876 - RNA, 21 nt, Homo sapiens
uaccaauaggcagacuguguc

SEQ ID NO: 1845877 - RNA, 18 nt, Homo sapiens
ucagcacagauaaaaagu

SEQ ID NO: 1845878 - RNA, 20 nt, Homo sapiens
aaccagagggggcgugccug

SEQ ID NO: 1845879 - RNA, 22 nt, Homo sapiens
uaagaaauaaaucaguaaggca

SEQ ID NO: 1845880 - RNA, 19 nt, Homo sapiens
uuagaauuaaaaaagcaua

SEQ ID NO: 1845881 - RNA, 19 nt, Homo sapiens
uucccuggugauggucucu

SEQ ID NO: 1845882 - RNA, 18 nt, Homo sapiens
uuuacacgcuuuugugau

SEQ ID NO: 1845883 - RNA, 16 nt, Homo sapiens
uacuucuaaaauuaca

SEQ ID NO: 1845884 - RNA, 16 nt, Homo sapiens
caccagaauugugcaa

SEQ ID NO: 1845885 - RNA, 13 nt, Homo sapiens
cccagccuggcca

SEQ ID NO: 1845886 - RNA, 21 nt, Homo sapiens
aauacucagggaaagcauuua

SEQ ID NO: 1845887 - RNA, 19 nt, Homo sapiens
gaugauacgaaugauguca

SEQ ID NO: 1845888 - RNA, 14 nt, Homo sapiens
caauugcucaugca

SEQ ID NO: 1845889 - RNA, 19 nt, Homo sapiens
cugcccauuuccauggugc

SEQ ID NO: 1845890 - RNA, 18 nt, Homo sapiens
uauguaacaaaccugcac

SEQ ID NO: 1845891 - RNA, 19 nt, Homo sapiens
agaguuggacuucuagacu

SEQ ID NO: 1845892 - RNA, 16 nt, Homo sapiens
acagcucuucuaagga

SEQ ID NO: 1845893 - RNA, 14 nt, Homo sapiens
aaaagugucuugaa

SEQ ID NO: 1845894 - RNA, 15 nt, Homo sapiens
uggaagcagaaagga

SEQ ID NO: 1845895 - RNA, 16 nt, Homo sapiens
ucuugccucaaccucc

SEQ ID NO: 1845896 - RNA, 12 nt, Homo sapiens
cuugcucaaguu

SEQ ID NO: 1845897 - RNA, 19 nt, Homo sapiens
caaaauacaugaagcuuca

SEQ ID NO: 1845898 - RNA, 12 nt, Homo sapiens
gaagaagcaaac

SEQ ID NO: 1845899 - RNA, 17 nt, Homo sapiens
aucuugaauagucucau

SEQ ID NO: 1845900 - RNA, 20 nt, Homo sapiens
acuuagaccaaaagcaacau

SEQ ID NO: 1845901 - RNA, 12 nt, Homo sapiens
gugcgucugugu

SEQ ID NO: 1845902 - RNA, 12 nt, Homo sapiens
uccugucuuccc

SEQ ID NO: 1845903 - RNA, 17 nt, Homo sapiens
gaaaaaugcugcuucuc

SEQ ID NO: 1845904 - RNA, 17 nt, Homo sapiens
gaagccagugggguccc

SEQ ID NO: 1845905 - RNA, 21 nt, Homo sapiens
gaagaacuggaaccccagcuu

SEQ ID NO: 1845906 - RNA, 12 nt, Homo sapiens
ccugugaucucc

SEQ ID NO: 1845907 - RNA, 18 nt, Homo sapiens
cuugggguucccccagac

SEQ ID NO: 1845908 - RNA, 19 nt, Homo sapiens
cucagaacaccaacuuaag

SEQ ID NO: 1845909 - RNA, 23 nt, Homo sapiens
uccccaaucaauacccuugugau

SEQ ID NO: 1845910 - RNA, 19 nt, Homo sapiens
gucugaacaaagugcuaga

SEQ ID NO: 1845911 - RNA, 13 nt, Homo sapiens
aggacuccuuaaa

SEQ ID NO: 1845912 - RNA, 13 nt, Homo sapiens
cuggcugagcuga

SEQ ID NO: 1845913 - RNA, 16 nt, Homo sapiens
cauaugcuaccaccag

SEQ ID NO: 1845914 - RNA, 19 nt, Homo sapiens
gaagagaauguauucugua

SEQ ID NO: 1845915 - RNA, 12 nt, Homo sapiens
ucgagaccucac

SEQ ID NO: 1845916 - RNA, 22 nt, Homo sapiens
auagcugccacuggcaugcucu

SEQ ID NO: 1845917 - RNA, 14 nt, Homo sapiens
uggcugcugcucac

SEQ ID NO: 1845918 - RNA, 19 nt, Homo sapiens
guaauagauuguuuugcca

SEQ ID NO: 1845919 - RNA, 13 nt, Homo sapiens
uuagugugccuuc

SEQ ID NO: 1845920 - RNA, 14 nt, Homo sapiens
ccucugagcccagc

SEQ ID NO: 1845921 - RNA, 14 nt, Homo sapiens
cagugccauuccac

SEQ ID NO: 1845922 - RNA, 20 nt, Homo sapiens
ggugacaguccaaaccacuc

SEQ ID NO: 1845923 - RNA, 22 nt, Homo sapiens
acugccgaaacccuugacuguu

SEQ ID NO: 1845924 - RNA, 13 nt, Homo sapiens
uagucacaaaaau

SEQ ID NO: 1845925 - RNA, 23 nt, Homo sapiens
cuacaauacggcuaaucuuucau

SEQ ID NO: 1845926 - RNA, 20 nt, Homo sapiens
agguuccuugguguucaaaa

SEQ ID NO: 1845927 - RNA, 23 nt, Homo sapiens
auuacaggugugaaccaccacac

SEQ ID NO: 1845928 - RNA, 20 nt, Homo sapiens
cuuacuucgugcgcaacaac

SEQ ID NO: 1845929 - RNA, 18 nt, Homo sapiens
augcacaaaucugccaaa

SEQ ID NO: 1845930 - RNA, 14 nt, Homo sapiens
ucccagucacuccu

SEQ ID NO: 1845931 - RNA, 16 nt, Homo sapiens
gcaguggcaucaucuc

SEQ ID NO: 1845932 - RNA, 14 nt, Homo sapiens
cacuaauucugcau

SEQ ID NO: 1845933 - RNA, 18 nt, Homo sapiens
uggaguagauauuaauua

SEQ ID NO: 1845934 - RNA, 17 nt, Homo sapiens
caaaacacugucugcau

SEQ ID NO: 1845935 - RNA, 22 nt, Homo sapiens
accucaaaggagcaagccuuga

SEQ ID NO: 1845936 - RNA, 22 nt, Homo sapiens
uccaaaguuauccccuccuuua

SEQ ID NO: 1845937 - RNA, 21 nt, Homo sapiens
agccugugguuacagugcaga

SEQ ID NO: 1845938 - RNA, 14 nt, Homo sapiens
acugauauccuccu

SEQ ID NO: 1845939 - RNA, 16 nt, Homo sapiens
gaggauaggaguucac

SEQ ID NO: 1845940 - RNA, 19 nt, Homo sapiens
ucccagcauaggauucauu

SEQ ID NO: 1845941 - RNA, 11 nt, Homo sapiens
gccacugggcc

SEQ ID NO: 1845942 - RNA, 11 nt, Homo sapiens
gggacuggggg

SEQ ID NO: 1845943 - RNA, 23 nt, Homo sapiens
gaaucagugaagaugccagugaa

SEQ ID NO: 1845944 - RNA, 13 nt, Homo sapiens
agccucacuccau

SEQ ID NO: 1845945 - RNA, 16 nt, Homo sapiens
gcagcccuuguuuaua

SEQ ID NO: 1845946 - RNA, 14 nt, Homo sapiens
gaaggggaugggaa

SEQ ID NO: 1845947 - RNA, 22 nt, Homo sapiens
cagagaacagcuccccuagaca

SEQ ID NO: 1845948 - RNA, 21 nt, Homo sapiens
ugucaccuggcugcuaggcca

SEQ ID NO: 1845949 - RNA, 16 nt, Homo sapiens
aucacagcugcaggcc

SEQ ID NO: 1845950 - RNA, 19 nt, Homo sapiens
acaacaugcgaccgugacc

SEQ ID NO: 1845951 - RNA, 16 nt, Homo sapiens
ugauuaaggacuacag

SEQ ID NO: 1845952 - RNA, 20 nt, Homo sapiens
gucucacgucucccuaaaaa

SEQ ID NO: 1845953 - RNA, 14 nt, Homo sapiens
aauucacagccuuu

SEQ ID NO: 1845954 - RNA, 23 nt, Homo sapiens
gaaucucuugccugcuccaucuc

SEQ ID NO: 1845955 - RNA, 20 nt, Homo sapiens
ggcuggaggacaguggcaca

SEQ ID NO: 1845956 - RNA, 14 nt, Homo sapiens
accuuauugaucuu

SEQ ID NO: 1845957 - RNA, 18 nt, Homo sapiens
aaguguucauugcacaau

SEQ ID NO: 1845958 - RNA, 20 nt, Homo sapiens
cagcagggggagaaacccuu

SEQ ID NO: 1845959 - RNA, 17 nt, Homo sapiens
ugaaacauccuaugaaa

SEQ ID NO: 1845960 - RNA, 22 nt, Homo sapiens
gacaagcugacuuggcacuuaa

SEQ ID NO: 1845961 - RNA, 20 nt, Homo sapiens
guuggacacccagugccagg

SEQ ID NO: 1845962 - RNA, 16 nt, Homo sapiens
guggccuguuucugca

SEQ ID NO: 1845963 - RNA, 16 nt, Homo sapiens
aguaacugaaccauuc

SEQ ID NO: 1845964 - RNA, 18 nt, Homo sapiens
cugcucaggaaaccacaa

SEQ ID NO: 1845965 - RNA, 13 nt, Homo sapiens
cagacagucacac

SEQ ID NO: 1845966 - RNA, 17 nt, Homo sapiens
gacucagagguccaggc

SEQ ID NO: 1845967 - RNA, 20 nt, Homo sapiens
augcagcugccuggggccca

SEQ ID NO: 1845968 - RNA, 21 nt, Homo sapiens
gcagugaugcuggaugcuccu

SEQ ID NO: 1845969 - RNA, 16 nt, Homo sapiens
cuucguaagaaggaau

SEQ ID NO: 1845970 - RNA, 13 nt, Homo sapiens
accaauauucaaa

SEQ ID NO: 1845971 - RNA, 16 nt, Homo sapiens
acuccuccaaggcaca

SEQ ID NO: 1845972 - RNA, 14 nt, Homo sapiens
auuucucaguauca

SEQ ID NO: 1845973 - RNA, 20 nt, Homo sapiens
ucugugguuguggaugggag

SEQ ID NO: 1845974 - RNA, 21 nt, Homo sapiens
ucuuuguaagaguggaaccaa

SEQ ID NO: 1845975 - RNA, 19 nt, Homo sapiens
agccacaucccuuugaaac

SEQ ID NO: 1845976 - RNA, 17 nt, Homo sapiens
agguggaggugccagga

SEQ ID NO: 1845977 - RNA, 16 nt, Homo sapiens
auaacuuuacagaaau

SEQ ID NO: 1845978 - RNA, 20 nt, Homo sapiens
cauggugugaguccaaagaa

SEQ ID NO: 1845979 - RNA, 14 nt, Homo sapiens
cccucuuuuggcca

SEQ ID NO: 1845980 - RNA, 17 nt, Homo sapiens
aaacguguaaauugcac

SEQ ID NO: 1845981 - RNA, 15 nt, Homo sapiens
ugagaaaacagggaa

SEQ ID NO: 1845982 - RNA, 14 nt, Homo sapiens
aacuauaagcaaga

SEQ ID NO: 1845983 - RNA, 20 nt, Homo sapiens
ggagcacauacuaccuagaa

SEQ ID NO: 1845984 - RNA, 20 nt, Homo sapiens
guuccagcuucaucuacccu

SEQ ID NO: 1845985 - RNA, 17 nt, Homo sapiens
ugaugauuaagugcaca

SEQ ID NO: 1845986 - RNA, 14 nt, Homo sapiens
cuccagagauuugc

SEQ ID NO: 1845987 - RNA, 16 nt, Homo sapiens
gacauagaagagccaa

SEQ ID NO: 1845988 - RNA, 23 nt, Homo sapiens
caccaucagucaaugaauaacag

SEQ ID NO: 1845989 - RNA, 17 nt, Homo sapiens
ccuuuugcacauuccaa

SEQ ID NO: 1845990 - RNA, 18 nt, Homo sapiens
uuagaaaccaaauuacaa

SEQ ID NO: 1845991 - RNA, 20 nt, Homo sapiens
acaccaguugaacugcagga

SEQ ID NO: 1845992 - RNA, 12 nt, Homo sapiens
guacagacaucc

SEQ ID NO: 1845993 - RNA, 18 nt, Homo sapiens
cugauagaagugcauucu

SEQ ID NO: 1845994 - RNA, 22 nt, Homo sapiens
ggaaacgccccgggcaaagggu

SEQ ID NO: 1845995 - RNA, 15 nt, Homo sapiens
cccaugguaguuuaa

SEQ ID NO: 1845996 - RNA, 21 nt, Homo sapiens
uuguagcucaauacaauguga

SEQ ID NO: 1845997 - RNA, 19 nt, Homo sapiens
agcuucuuaauuaauuuga

SEQ ID NO: 1845998 - RNA, 16 nt, Homo sapiens
gacaucuggacacugg

SEQ ID NO: 1845999 - RNA, 20 nt, Homo sapiens
ggucucgcuuuguugcccag

SEQ ID NO: 1846000 - RNA, 12 nt, Homo sapiens
ggucacaugcac

SEQ ID NO: 1846001 - RNA, 21 nt, Homo sapiens
cuaggccacuccuccaaagga

SEQ ID NO: 1846002 - RNA, 21 nt, Homo sapiens
gaugacaaaagaaaauuuucc

SEQ ID NO: 1846003 - RNA, 15 nt, Homo sapiens
caauuaggcucugaa

SEQ ID NO: 1846004 - RNA, 18 nt, Homo sapiens
gaaugugaauaguguuuc

SEQ ID NO: 1846005 - RNA, 15 nt, Homo sapiens
aagagaaaugagcuu

SEQ ID NO: 1846006 - RNA, 15 nt, Homo sapiens
uaaagccauguuucc

SEQ ID NO: 1846007 - RNA, 23 nt, Homo sapiens
ugagggugguaaauguaggagaa

SEQ ID NO: 1846008 - RNA, 19 nt, Homo sapiens
uuugucuaaguagggccag

SEQ ID NO: 1846009 - RNA, 21 nt, Homo sapiens
cuuuaaugaacuaacugacag

SEQ ID NO: 1846010 - RNA, 18 nt, Homo sapiens
uauuuaccuucuaccucu

SEQ ID NO: 1846011 - RNA, 12 nt, Homo sapiens
agcacagacuca

SEQ ID NO: 1846012 - RNA, 17 nt, Homo sapiens
gauacuaagcacaaagc

SEQ ID NO: 1846013 - RNA, 17 nt, Homo sapiens
aacuccuagcugacuca

SEQ ID NO: 1846014 - RNA, 22 nt, Homo sapiens
cuugagcgugaaucuguaucuu

SEQ ID NO: 1846015 - RNA, 21 nt, Homo sapiens
gcucaccuuuagaacaggaga

SEQ ID NO: 1846016 - RNA, 21 nt, Homo sapiens
ucuaacauuugcaaaauggaa

SEQ ID NO: 1846017 - RNA, 20 nt, Homo sapiens
cuguaugccuucagcauugc

SEQ ID NO: 1846018 - RNA, 13 nt, Homo sapiens
gaagaaggccaga

SEQ ID NO: 1846019 - RNA, 13 nt, Homo sapiens
acgccuguagucc

SEQ ID NO: 1846020 - RNA, 19 nt, Homo sapiens
acuuucucuucauacuuuu

SEQ ID NO: 1846021 - RNA, 23 nt, Homo sapiens
caacuuaacaaaacaagugcaag

SEQ ID NO: 1846022 - RNA, 22 nt, Homo sapiens
gcaugcagcuuugcaaacccau

SEQ ID NO: 1846023 - RNA, 20 nt, Homo sapiens
acuagaaagaaggacccaga

SEQ ID NO: 1846024 - RNA, 18 nt, Homo sapiens
ucucuucugccuuuauga

SEQ ID NO: 1846025 - RNA, 13 nt, Homo sapiens
gcagccucuguca

SEQ ID NO: 1846026 - RNA, 23 nt, Homo sapiens
ucugcucuuucucugccagugac

SEQ ID NO: 1846027 - RNA, 15 nt, Homo sapiens
aaccuaugauuguaa

SEQ ID NO: 1846028 - RNA, 20 nt, Homo sapiens
ugcaguauucuugcacugag

SEQ ID NO: 1846029 - RNA, 23 nt, Homo sapiens
ugauacauuuaagguauauugcu

SEQ ID NO: 1846030 - RNA, 20 nt, Homo sapiens
uuuucaaguuuacacuucau

SEQ ID NO: 1846031 - RNA, 20 nt, Homo sapiens
auguauccccacuuaucucg

SEQ ID NO: 1846032 - RNA, 12 nt, Homo sapiens
gaugaagcacau

SEQ ID NO: 1846033 - RNA, 13 nt, Homo sapiens
ucccucaacccca

SEQ ID NO: 1846034 - RNA, 24 nt, Homo sapiens
ccucaauggccuuuugcuacgugc

SEQ ID NO: 1846035 - RNA, 21 nt, Homo sapiens
ccuguguguccaaaacugccu

SEQ ID NO: 1846036 - RNA, 23 nt, Homo sapiens
caccugggccgggcuguagauca

SEQ ID NO: 1846037 - RNA, 23 nt, Homo sapiens
gacagagcgagacucugucucag

SEQ ID NO: 1846038 - RNA, 17 nt, Homo sapiens
augaacuugcaaacagg

SEQ ID NO: 1846039 - RNA, 15 nt, Homo sapiens
uucauuguucuuggc

SEQ ID NO: 1846040 - RNA, 14 nt, Homo sapiens
ugguauacaggugg

SEQ ID NO: 1846041 - RNA, 12 nt, Homo sapiens
uccagucuuccu

SEQ ID NO: 1846042 - RNA, 22 nt, Homo sapiens
guguuuucaucauuucagccaa

SEQ ID NO: 1846043 - RNA, 18 nt, Homo sapiens
ugccaagaauaaagaagu

SEQ ID NO: 1846044 - RNA, 12 nt, Homo sapiens
ggcccugugaua

SEQ ID NO: 1846045 - RNA, 17 nt, Homo sapiens
aagaugucccauugaua

SEQ ID NO: 1846046 - RNA, 23 nt, Homo sapiens
acauagugaaaccccaucucuac

SEQ ID NO: 1846047 - RNA, 19 nt, Homo sapiens
cagaauccuacaacuucca

SEQ ID NO: 1846048 - RNA, 15 nt, Homo sapiens
ccacuuugauaccau

SEQ ID NO: 1846049 - RNA, 15 nt, Homo sapiens
auucuaggccuccug

SEQ ID NO: 1846050 - RNA, 21 nt, Homo sapiens
cuuccccgagugacucuggau

SEQ ID NO: 1846051 - RNA, 14 nt, Homo sapiens
uguuuugcacuuuu

SEQ ID NO: 1846052 - RNA, 18 nt, Homo sapiens
caagccacagaaaugugu

SEQ ID NO: 1846053 - RNA, 19 nt, Homo sapiens
uaauccaaugaguguuaca

SEQ ID NO: 1846054 - RNA, 16 nt, Homo sapiens
ugaguuuuguguuugu

SEQ ID NO: 1846055 - RNA, 15 nt, Homo sapiens
aaauauuucccucac

SEQ ID NO: 1846056 - RNA, 15 nt, Homo sapiens
uucucuacucuggaa

SEQ ID NO: 1846057 - RNA, 20 nt, Homo sapiens
acagccccuuaagcaugcuu

SEQ ID NO: 1846058 - RNA, 18 nt, Homo sapiens
aaagauauaaaugccaaa

SEQ ID NO: 1846059 - RNA, 12 nt, Homo sapiens
caaacuguaaaa

SEQ ID NO: 1846060 - RNA, 14 nt, Homo sapiens
acaucccacugcca

SEQ ID NO: 1846061 - RNA, 21 nt, Homo sapiens
ugaauaaaguguaaguucaca

SEQ ID NO: 1846062 - RNA, 19 nt, Homo sapiens
uauguaguuuuguacauaa

SEQ ID NO: 1846063 - RNA, 19 nt, Homo sapiens
aagauuguuaaauucaaug

SEQ ID NO: 1846064 - RNA, 17 nt, Homo sapiens
agagcccugugucugua

SEQ ID NO: 1846065 - RNA, 13 nt, Homo sapiens
gcugcggugggca

SEQ ID NO: 1846066 - RNA, 14 nt, Homo sapiens
caccacagacacac

SEQ ID NO: 1846067 - RNA, 12 nt, Homo sapiens
cuaccucaaggg

SEQ ID NO: 1846068 - RNA, 17 nt, Homo sapiens
guauuuucacuggagac

SEQ ID NO: 1846069 - RNA, 21 nt, Homo sapiens
gaauaugaucauguaaaugau

SEQ ID NO: 1846070 - RNA, 17 nt, Homo sapiens
aagcaauaaaacugcua

SEQ ID NO: 1846071 - RNA, 23 nt, Homo sapiens
caugcugcuuuuuguacuuggaa

SEQ ID NO: 1846072 - RNA, 17 nt, Homo sapiens
ucccuuuguaugggagc

SEQ ID NO: 1846073 - RNA, 16 nt, Homo sapiens
ccauugcuccauucac

SEQ ID NO: 1846074 - RNA, 19 nt, Homo sapiens
gaccugggggagccgacca

SEQ ID NO: 1846075 - RNA, 20 nt, Homo sapiens
auuaccacugaagauagaag

SEQ ID NO: 1846076 - RNA, 17 nt, Homo sapiens
acagcaggcgccucggg

SEQ ID NO: 1846077 - RNA, 15 nt, Homo sapiens
gcuguccugcucacc

SEQ ID NO: 1846078 - RNA, 14 nt, Homo sapiens
uucucaucacauca

SEQ ID NO: 1846079 - RNA, 13 nt, Homo sapiens
augccguggauug

SEQ ID NO: 1846080 - RNA, 20 nt, Homo sapiens
ucuuccagggccucugggag

SEQ ID NO: 1846081 - RNA, 13 nt, Homo sapiens
cucagcaacagug

SEQ ID NO: 1846082 - RNA, 15 nt, Homo sapiens
aagacucauuacuac

SEQ ID NO: 1846083 - RNA, 17 nt, Homo sapiens
uuaaaccguacacugug

SEQ ID NO: 1846084 - RNA, 17 nt, Homo sapiens
aaugucuguaccuugau

SEQ ID NO: 1846085 - RNA, 19 nt, Homo sapiens
caaguuggagucacucuua

SEQ ID NO: 1846086 - RNA, 19 nt, Homo sapiens
uuauauucccaaaucucaa

SEQ ID NO: 1846087 - RNA, 20 nt, Homo sapiens
ugagcaccuggacaugucaa

SEQ ID NO: 1846088 - RNA, 15 nt, Homo sapiens
agcccugaacaaagc

SEQ ID NO: 1846089 - RNA, 17 nt, Homo sapiens
aguggccauuaccaucu

SEQ ID NO: 1846090 - RNA, 22 nt, Homo sapiens
uccccugcugaagguggggauu

SEQ ID NO: 1846091 - RNA, 14 nt, Homo sapiens
ugcaguuuugacau

SEQ ID NO: 1846092 - RNA, 22 nt, Homo sapiens
uguagagagagaaaaguaacug

SEQ ID NO: 1846093 - RNA, 19 nt, Homo sapiens
caccaauuguacauucccu

SEQ ID NO: 1846094 - RNA, 15 nt, Homo sapiens
auucggccucuccac

SEQ ID NO: 1846095 - RNA, 20 nt, Homo sapiens
cacaccuugcccaugcacaa

SEQ ID NO: 1846096 - RNA, 13 nt, Homo sapiens
cugacaugucuca

SEQ ID NO: 1846097 - RNA, 12 nt, Homo sapiens
aacagcugugag

SEQ ID NO: 1846098 - RNA, 22 nt, Homo sapiens
uauugaacuguaaauaugucac

SEQ ID NO: 1846099 - RNA, 16 nt, Homo sapiens
ugcauuucacaugccu

SEQ ID NO: 1846100 - RNA, 23 nt, Homo sapiens
gcgccccugccaccucccugacc

SEQ ID NO: 1846101 - RNA, 14 nt, Homo sapiens
cacagcacaugcac

SEQ ID NO: 1846102 - RNA, 17 nt, Homo sapiens
cguuaagauaaagggua

SEQ ID NO: 1846103 - RNA, 24 nt, Homo sapiens
gaaaguaauauaaugaugcugucu

SEQ ID NO: 1846104 - RNA, 15 nt, Homo sapiens
aaggaacuaagucag

SEQ ID NO: 1846105 - RNA, 20 nt, Homo sapiens
ugucgaggccacauugcugg

SEQ ID NO: 1846106 - RNA, 14 nt, Homo sapiens
cuacugcucugugu

SEQ ID NO: 1846107 - RNA, 16 nt, Homo sapiens
uuuugaugacuggcau

SEQ ID NO: 1846108 - RNA, 17 nt, Homo sapiens
aaggccuugaagaauuu

SEQ ID NO: 1846109 - RNA, 18 nt, Homo sapiens
gugugccaagaguucgau

SEQ ID NO: 1846110 - RNA, 13 nt, Homo sapiens
cuguuaacugaag

SEQ ID NO: 1846111 - RNA, 21 nt, Homo sapiens
caugaaauaaugcacugagua

SEQ ID NO: 1846112 - RNA, 17 nt, Homo sapiens
cccccggguguaaauag

SEQ ID NO: 1846113 - RNA, 15 nt, Homo sapiens
acaguuuugccuuaa

SEQ ID NO: 1846114 - RNA, 16 nt, Homo sapiens
cucaaggaaaggccug

SEQ ID NO: 1846115 - RNA, 14 nt, Homo sapiens
gagacuaaagacug

SEQ ID NO: 1846116 - RNA, 13 nt, Homo sapiens
aggugcagccaga

SEQ ID NO: 1846117 - RNA, 13 nt, Homo sapiens
gaccccacuggac

SEQ ID NO: 1846118 - RNA, 22 nt, Homo sapiens
auccuggaaggacacagugaug

SEQ ID NO: 1846119 - RNA, 16 nt, Homo sapiens
aaugggcacaaaaugg

SEQ ID NO: 1846120 - RNA, 14 nt, Homo sapiens
auguuucacagugg

SEQ ID NO: 1846121 - RNA, 14 nt, Homo sapiens
cauuuucaauuugg

SEQ ID NO: 1846122 - RNA, 12 nt, Homo sapiens
aaacauuccaag

SEQ ID NO: 1846123 - RNA, 15 nt, Homo sapiens
cagcgucuugcucug

SEQ ID NO: 1846124 - RNA, 13 nt, Homo sapiens
ggugagguccugu

SEQ ID NO: 1846125 - RNA, 21 nt, Homo sapiens
uaauuugauaguauugugcau

SEQ ID NO: 1846126 - RNA, 18 nt, Homo sapiens
ucugauuuuccuggacag

SEQ ID NO: 1846127 - RNA, 12 nt, Homo sapiens
gagacagugacu

SEQ ID NO: 1846128 - RNA, 23 nt, Homo sapiens
cagagcuggcagcaauggaugaa

SEQ ID NO: 1846129 - RNA, 20 nt, Homo sapiens
ggccuagucagauggaugua

SEQ ID NO: 1846130 - RNA, 12 nt, Homo sapiens
gcuacugucauu

SEQ ID NO: 1846131 - RNA, 15 nt, Homo sapiens
ccuuaucaccagccu

SEQ ID NO: 1846132 - RNA, 19 nt, Homo sapiens
ugcuuauuaagaccaaaga

SEQ ID NO: 1846133 - RNA, 17 nt, Homo sapiens
auccgggacgcuuccag

SEQ ID NO: 1846134 - RNA, 17 nt, Homo sapiens
ugggguuucaccaucuu

SEQ ID NO: 1846135 - RNA, 19 nt, Homo sapiens
cuaaucaaagccagggucu

SEQ ID NO: 1846136 - RNA, 14 nt, Homo sapiens
uauuagauuacuaa

SEQ ID NO: 1846137 - RNA, 18 nt, Homo sapiens
gcaggaagucccugagaa

SEQ ID NO: 1846138 - RNA, 22 nt, Homo sapiens
caagauaggggcacacuacaga

SEQ ID NO: 1846139 - RNA, 20 nt, Homo sapiens
aaugcuuauaaaauauacua

SEQ ID NO: 1846140 - RNA, 20 nt, Homo sapiens
aacaaaguuccacuuccagg

SEQ ID NO: 1846141 - RNA, 15 nt, Homo sapiens
aagugacuugcccag

SEQ ID NO: 1846142 - RNA, 17 nt, Homo sapiens
ugugaagaccacagucu

SEQ ID NO: 1846143 - RNA, 21 nt, Homo sapiens
cuguuuuucucuaaugcuuga

SEQ ID NO: 1846144 - RNA, 19 nt, Homo sapiens
uauagauagguagaacuau

SEQ ID NO: 1846145 - RNA, 23 nt, Homo sapiens
gcaaagaugaacccgaggcugag

SEQ ID NO: 1846146 - RNA, 14 nt, Homo sapiens
auuuauccuagaaa

SEQ ID NO: 1846147 - RNA, 11 nt, Homo sapiens
uggucucagcc

SEQ ID NO: 1846148 - RNA, 15 nt, Homo sapiens
auuuugucagauuca

SEQ ID NO: 1846149 - RNA, 16 nt, Homo sapiens
ucuucuucaagacucu

SEQ ID NO: 1846150 - RNA, 21 nt, Homo sapiens
ucuguaguuuaugaugcaaau

SEQ ID NO: 1846151 - RNA, 16 nt, Homo sapiens
ccccuccucgccgggc

SEQ ID NO: 1846152 - RNA, 14 nt, Homo sapiens
uagguucuuuuuau

SEQ ID NO: 1846153 - RNA, 21 nt, Homo sapiens
cguccacugucaaguguuuua

SEQ ID NO: 1846154 - RNA, 22 nt, Homo sapiens
cugcugcggugucacugggcua

SEQ ID NO: 1846155 - RNA, 15 nt, Homo sapiens
ucuuuggcgaccucc

SEQ ID NO: 1846156 - RNA, 18 nt, Homo sapiens
cagagucucuaguuccau

SEQ ID NO: 1846157 - RNA, 22 nt, Homo sapiens
cacuuguuauucgaaccacuga

SEQ ID NO: 1846158 - RNA, 22 nt, Homo sapiens
ugagguuuuguaaaacuguuau

SEQ ID NO: 1846159 - RNA, 14 nt, Homo sapiens
aauagaucuuuuca

SEQ ID NO: 1846160 - RNA, 22 nt, Homo sapiens
caucaccccuuccccauuuccu

SEQ ID NO: 1846161 - RNA, 20 nt, Homo sapiens
aaugugaaggggagagacag

SEQ ID NO: 1846162 - RNA, 16 nt, Homo sapiens
caauuccucugaacaa

SEQ ID NO: 1846163 - RNA, 19 nt, Homo sapiens
cuaguuaaccaaucgcaaa

SEQ ID NO: 1846164 - RNA, 23 nt, Homo sapiens
cuacaaggcuacaguaaccaaaa

SEQ ID NO: 1846165 - RNA, 19 nt, Homo sapiens
gguauuggccgaugagcug

SEQ ID NO: 1846166 - RNA, 18 nt, Homo sapiens
agcgucacaucugcagug

SEQ ID NO: 1846167 - RNA, 19 nt, Homo sapiens
uguugguauuuucagagaa

SEQ ID NO: 1846168 - RNA, 22 nt, Homo sapiens
guaaguagcaacccugugauac

SEQ ID NO: 1846169 - RNA, 17 nt, Homo sapiens
cacuaaacuucaugaau

SEQ ID NO: 1846170 - RNA, 17 nt, Homo sapiens
guccccucaccuccucu

SEQ ID NO: 1846171 - RNA, 15 nt, Homo sapiens
caacauuacagggaa

SEQ ID NO: 1846172 - RNA, 15 nt, Homo sapiens
aagaggccuguucau

SEQ ID NO: 1846173 - RNA, 14 nt, Homo sapiens
ucgacccugugcag

SEQ ID NO: 1846174 - RNA, 15 nt, Homo sapiens
guagguugccagcua

SEQ ID NO: 1846175 - RNA, 22 nt, Homo sapiens
cuacauuuaaaaauacuucucu

SEQ ID NO: 1846176 - RNA, 14 nt, Homo sapiens
ugaagccagaucca

SEQ ID NO: 1846177 - RNA, 14 nt, Homo sapiens
ugcugcugccaagu

SEQ ID NO: 1846178 - RNA, 18 nt, Homo sapiens
aagaaaaccucuggcaca

SEQ ID NO: 1846179 - RNA, 18 nt, Homo sapiens
gcagaaagggccuugaau

SEQ ID NO: 1846180 - RNA, 14 nt, Homo sapiens
uucucaacccaaga

SEQ ID NO: 1846181 - RNA, 12 nt, Homo sapiens
caauuugggcuu

SEQ ID NO: 1846182 - RNA, 21 nt, Homo sapiens
cuuaaacccuuuagugcuuug

SEQ ID NO: 1846183 - RNA, 15 nt, Homo sapiens
aguggccuguagucc

SEQ ID NO: 1846184 - RNA, 22 nt, Homo sapiens
aaaaccuacacacguaccuuca

SEQ ID NO: 1846185 - RNA, 20 nt, Homo sapiens
agaggccuugcuguggagcu

SEQ ID NO: 1846186 - RNA, 17 nt, Homo sapiens
gauucuuucccaauuca

SEQ ID NO: 1846187 - RNA, 14 nt, Homo sapiens
uugauaaucuucag

SEQ ID NO: 1846188 - RNA, 20 nt, Homo sapiens
cgcccgcucccuuccugcca

SEQ ID NO: 1846189 - RNA, 16 nt, Homo sapiens
ugaagaugcauuguag

SEQ ID NO: 1846190 - RNA, 12 nt, Homo sapiens
ugugcucaggga

SEQ ID NO: 1846191 - RNA, 20 nt, Homo sapiens
cccccuugccuccgugccca

SEQ ID NO: 1846192 - RNA, 18 nt, Homo sapiens
acaacuugucuauuaccu

SEQ ID NO: 1846193 - RNA, 15 nt, Homo sapiens
gcacacugaacuguu

SEQ ID NO: 1846194 - RNA, 20 nt, Homo sapiens
guauacccuguccuuucuca

SEQ ID NO: 1846195 - RNA, 18 nt, Homo sapiens
uacuggucuuguggaauu

SEQ ID NO: 1846196 - RNA, 19 nt, Homo sapiens
aaaugcacaaacaaugcaa

SEQ ID NO: 1846197 - RNA, 13 nt, Homo sapiens
auauuuauacaua

SEQ ID NO: 1846198 - RNA, 13 nt, Homo sapiens
ucaguaguuuuac

SEQ ID NO: 1846199 - RNA, 19 nt, Homo sapiens
agaaccagugacaaucuua

SEQ ID NO: 1846200 - RNA, 15 nt, Homo sapiens
guaaugucaccaccu

SEQ ID NO: 1846201 - RNA, 15 nt, Homo sapiens
gaaccaauauuugua

SEQ ID NO: 1846202 - RNA, 14 nt, Homo sapiens
cuucaugcauggaa

SEQ ID NO: 1846203 - RNA, 16 nt, Homo sapiens
cugcagugcucauuca

SEQ ID NO: 1846204 - RNA, 13 nt, Homo sapiens
cuuuacuguggaa

SEQ ID NO: 1846205 - RNA, 15 nt, Homo sapiens
ggcuggaaugcagug

SEQ ID NO: 1846206 - RNA, 16 nt, Homo sapiens
ccuuuuggcacugaga

SEQ ID NO: 1846207 - RNA, 17 nt, Homo sapiens
acaguguaguacucagu

SEQ ID NO: 1846208 - RNA, 22 nt, Homo sapiens
auggcaugggggccucagggca

SEQ ID NO: 1846209 - RNA, 14 nt, Homo sapiens
gguggguguggcca

SEQ ID NO: 1846210 - RNA, 16 nt, Homo sapiens
cuuguagcaguuuuca

SEQ ID NO: 1846211 - RNA, 15 nt, Homo sapiens
aauuaaagucuacac

SEQ ID NO: 1846212 - RNA, 18 nt, Homo sapiens
ugaaggacacuuccugcc

SEQ ID NO: 1846213 - RNA, 18 nt, Homo sapiens
aaagcccucccuaccuac

SEQ ID NO: 1846214 - RNA, 15 nt, Homo sapiens
acuacagacauuaaa

SEQ ID NO: 1846215 - RNA, 22 nt, Homo sapiens
ccaagggcugaguguccagcac

SEQ ID NO: 1846216 - RNA, 12 nt, Homo sapiens
gauauaucucaa

SEQ ID NO: 1846217 - RNA, 20 nt, Homo sapiens
gaauuuaauacagacaucua

SEQ ID NO: 1846218 - RNA, 14 nt, Homo sapiens
guugaauuccaagu

SEQ ID NO: 1846219 - RNA, 20 nt, Homo sapiens
cauaugugaucugucuugua

SEQ ID NO: 1846220 - RNA, 22 nt, Homo sapiens
uucaaacugugaagcauuuaca

SEQ ID NO: 1846221 - RNA, 20 nt, Homo sapiens
gcccugcucugaacacgaag

SEQ ID NO: 1846222 - RNA, 15 nt, Homo sapiens
uuucaaugaccugua

SEQ ID NO: 1846223 - RNA, 16 nt, Homo sapiens
agaauuuauccuuuau

SEQ ID NO: 1846224 - RNA, 21 nt, Homo sapiens
uguagugcauuuuuaaacuug

SEQ ID NO: 1846225 - RNA, 17 nt, Homo sapiens
uacacauuagauuuuau

SEQ ID NO: 1846226 - RNA, 15 nt, Homo sapiens
cauuguaggauguug

SEQ ID NO: 1846227 - RNA, 22 nt, Homo sapiens
aauguaagggaaacugccagca

SEQ ID NO: 1846228 - RNA, 13 nt, Homo sapiens
auacaugcauaua

SEQ ID NO: 1846229 - RNA, 13 nt, Homo sapiens
gcaccaaauguca

SEQ ID NO: 1846230 - RNA, 17 nt, Homo sapiens
uggcagucugcccugca

SEQ ID NO: 1846231 - RNA, 21 nt, Homo sapiens
ugccuuaaacacacauugcag

SEQ ID NO: 1846232 - RNA, 13 nt, Homo sapiens
auaauaggccagg

SEQ ID NO: 1846233 - RNA, 15 nt, Homo sapiens
caaaugacccaaaga

SEQ ID NO: 1846234 - RNA, 23 nt, Homo sapiens
caauucagagaauagcaguuuca

SEQ ID NO: 1846235 - RNA, 16 nt, Homo sapiens
gauugacacagcccau

SEQ ID NO: 1846236 - RNA, 15 nt, Homo sapiens
cuccacgccauuucc

SEQ ID NO: 1846237 - RNA, 17 nt, Homo sapiens
aagcauuaacuucucug

SEQ ID NO: 1846238 - RNA, 21 nt, Homo sapiens
augucucuuuggcgaccuccu

SEQ ID NO: 1846239 - RNA, 15 nt, Homo sapiens
uaccaaaauguuaau

SEQ ID NO: 1846240 - RNA, 21 nt, Homo sapiens
aucucagggaaacuugcguac

SEQ ID NO: 1846241 - RNA, 22 nt, Homo sapiens
caguaauuccuguuacuuuaca

SEQ ID NO: 1846242 - RNA, 12 nt, Homo sapiens
guaaacauuucu

SEQ ID NO: 1846243 - RNA, 10 nt, Homo sapiens
uugcauucau

SEQ ID NO: 1846244 - RNA, 13 nt, Homo sapiens
cauaauaaccaaa

SEQ ID NO: 1846245 - RNA, 16 nt, Homo sapiens
agccugaaacugaguu

SEQ ID NO: 1846246 - RNA, 23 nt, Homo sapiens
aggagagcaagccaggaggacau

SEQ ID NO: 1846247 - RNA, 21 nt, Homo sapiens
cacaugaaaaccauuaccuga

SEQ ID NO: 1846248 - RNA, 18 nt, Homo sapiens
ugcagaaauacaguauga

SEQ ID NO: 1846249 - RNA, 15 nt, Homo sapiens
aggccuguacagaug

SEQ ID NO: 1846250 - RNA, 22 nt, Homo sapiens
gagucuaggcuaagcacuuuau

SEQ ID NO: 1846251 - RNA, 24 nt, Homo sapiens
uuguaagugaaguaaaacuuaaga

SEQ ID NO: 1846252 - RNA, 14 nt, Homo sapiens
uucacaucacugau

SEQ ID NO: 1846253 - RNA, 15 nt, Homo sapiens
cagaaaccaagagac

SEQ ID NO: 1846254 - RNA, 19 nt, Homo sapiens
cuguaacucagacauucca

SEQ ID NO: 1846255 - RNA, 16 nt, Homo sapiens
ucuauaaaauacuggu

SEQ ID NO: 1846256 - RNA, 19 nt, Homo sapiens
ggcagcuguugcagugagc

SEQ ID NO: 1846257 - RNA, 15 nt, Homo sapiens
ggagggcgguggaca

SEQ ID NO: 1846258 - RNA, 12 nt, Homo sapiens
gucacguguauu

SEQ ID NO: 1846259 - RNA, 13 nt, Homo sapiens
auacauugcaauc

SEQ ID NO: 1846260 - RNA, 16 nt, Homo sapiens
cuuuucccuugcugua

SEQ ID NO: 1846261 - RNA, 14 nt, Homo sapiens
auugcugugaaauu

SEQ ID NO: 1846262 - RNA, 21 nt, Homo sapiens
guaggaaaagcaaugcuuucu

SEQ ID NO: 1846263 - RNA, 22 nt, Homo sapiens
acgguaccaauucagugucugu

SEQ ID NO: 1846264 - RNA, 20 nt, Homo sapiens
ucauaauuucuagaguaaau

SEQ ID NO: 1846265 - RNA, 23 nt, Homo sapiens
uuuagucagcacccccaccaaac

SEQ ID NO: 1846266 - RNA, 23 nt, Homo sapiens
cucuuucuauuuaugcaacucau

SEQ ID NO: 1846267 - RNA, 20 nt, Homo sapiens
cauguauccuuucacacauu

SEQ ID NO: 1846268 - RNA, 19 nt, Homo sapiens
caggccuugggcuccugau

SEQ ID NO: 1846269 - RNA, 14 nt, Homo sapiens
caguauaagcauuu

SEQ ID NO: 1846270 - RNA, 23 nt, Homo sapiens
uugggaaaaagugauacuuggau

SEQ ID NO: 1846271 - RNA, 22 nt, Homo sapiens
ggcugccuggugguugaugguu

SEQ ID NO: 1846272 - RNA, 14 nt, Homo sapiens
aggggaaugggagg

SEQ ID NO: 1846273 - RNA, 19 nt, Homo sapiens
aaucauggcuaagcuuaaa

SEQ ID NO: 1846274 - RNA, 16 nt, Homo sapiens
auuauuaacauaccua

SEQ ID NO: 1846275 - RNA, 20 nt, Homo sapiens
ccuuuuauuaagaguuugua

SEQ ID NO: 1846276 - RNA, 20 nt, Homo sapiens
uaccucccccugccuuccaa

SEQ ID NO: 1846277 - RNA, 20 nt, Homo sapiens
ucucucgugaguauauugau

SEQ ID NO: 1846278 - RNA, 22 nt, Homo sapiens
cuuaaagggucuuaugaaacaa

SEQ ID NO: 1846279 - RNA, 19 nt, Homo sapiens
caggugagugccaccacac

SEQ ID NO: 1846280 - RNA, 15 nt, Homo sapiens
ugcccugcauucaca

SEQ ID NO: 1846281 - RNA, 12 nt, Homo sapiens
gagggucagggu

SEQ ID NO: 1846282 - RNA, 13 nt, Homo sapiens
guccuguuugcag

SEQ ID NO: 1846283 - RNA, 16 nt, Homo sapiens
gcuaugugacuugcau

SEQ ID NO: 1846284 - RNA, 18 nt, Homo sapiens
ccggggaggaaacacuuu

SEQ ID NO: 1846285 - RNA, 21 nt, Homo sapiens
agcuucauauaccagcaauau

SEQ ID NO: 1846286 - RNA, 15 nt, Homo sapiens
aaugugguggcaaua

SEQ ID NO: 1846287 - RNA, 15 nt, Homo sapiens
gcaucaucaaaaacu

SEQ ID NO: 1846288 - RNA, 19 nt, Homo sapiens
uuaaaauaaacacaaaaac

SEQ ID NO: 1846289 - RNA, 17 nt, Homo sapiens
acgguccgcggccugca

SEQ ID NO: 1846290 - RNA, 19 nt, Homo sapiens
cuggcagacucgggaccaa

SEQ ID NO: 1846291 - RNA, 13 nt, Homo sapiens
aggaauguagggc

SEQ ID NO: 1846292 - RNA, 13 nt, Homo sapiens
gaaaaugugaagc

SEQ ID NO: 1846293 - RNA, 13 nt, Homo sapiens
ccuuguuucucaa

SEQ ID NO: 1846294 - RNA, 22 nt, Homo sapiens
cacagacauuuugugugagacu

SEQ ID NO: 1846295 - RNA, 14 nt, Homo sapiens
aaccggcuuugugg

SEQ ID NO: 1846296 - RNA, 19 nt, Homo sapiens
ccuacauacgucuuucaca

SEQ ID NO: 1846297 - RNA, 22 nt, Homo sapiens
gcuuuaugcaaauacaaucagc

SEQ ID NO: 1846298 - RNA, 14 nt, Homo sapiens
ugggaaagccauga

SEQ ID NO: 1846299 - RNA, 12 nt, Homo sapiens
cuguacacagaa

SEQ ID NO: 1846300 - RNA, 16 nt, Homo sapiens
uguuuuaaacugguag

SEQ ID NO: 1846301 - RNA, 14 nt, Homo sapiens
ugaagagagcauuu

SEQ ID NO: 1846302 - RNA, 17 nt, Homo sapiens
uuuuaaauggcaugaca

SEQ ID NO: 1846303 - RNA, 18 nt, Homo sapiens
uuuuucugauuccauccu

SEQ ID NO: 1846304 - RNA, 13 nt, Homo sapiens
cgaguucagcaaa

SEQ ID NO: 1846305 - RNA, 21 nt, Homo sapiens
aguaguaccuuucagaacuca

SEQ ID NO: 1846306 - RNA, 19 nt, Homo sapiens
aggaaaccacccugagggu

SEQ ID NO: 1846307 - RNA, 20 nt, Homo sapiens
acuucccuacccuaccccca

SEQ ID NO: 1846308 - RNA, 20 nt, Homo sapiens
cuuuuguuguccuugcccca

SEQ ID NO: 1846309 - RNA, 14 nt, Homo sapiens
uccccuugaaggag

SEQ ID NO: 1846310 - RNA, 17 nt, Homo sapiens
cacuucaggguucuccu

SEQ ID NO: 1846311 - RNA, 23 nt, Homo sapiens
aaugacuuggguuuaacaagcug

SEQ ID NO: 1846312 - RNA, 14 nt, Homo sapiens
acucuuuaucccau

SEQ ID NO: 1846313 - RNA, 16 nt, Homo sapiens
aggacugaaaagggaa

SEQ ID NO: 1846314 - RNA, 14 nt, Homo sapiens
cuucccacacuguc

SEQ ID NO: 1846315 - RNA, 14 nt, Homo sapiens
cacagagugcugga

SEQ ID NO: 1846316 - RNA, 15 nt, Homo sapiens
auuuguuucuucucu

SEQ ID NO: 1846317 - RNA, 21 nt, Homo sapiens
cuacagaugguagaacuaaac

SEQ ID NO: 1846318 - RNA, 15 nt, Homo sapiens
uaacaauugucuuaa

SEQ ID NO: 1846319 - RNA, 14 nt, Homo sapiens
cacuguccuaccag

SEQ ID NO: 1846320 - RNA, 16 nt, Homo sapiens
gagaugcagucacuua

SEQ ID NO: 1846321 - RNA, 15 nt, Homo sapiens
caaaacugacaguaa

SEQ ID NO: 1846322 - RNA, 15 nt, Homo sapiens
cauccagaccugagc

SEQ ID NO: 1846323 - RNA, 20 nt, Homo sapiens
uccucaguaugugggggcuu

SEQ ID NO: 1846324 - RNA, 21 nt, Homo sapiens
accagguuaccucacuuuuaa

SEQ ID NO: 1846325 - RNA, 21 nt, Homo sapiens
uauuuaugcacugugggaugu

SEQ ID NO: 1846326 - RNA, 22 nt, Homo sapiens
auccuccaaaacuuagacccau

SEQ ID NO: 1846327 - RNA, 15 nt, Homo sapiens
ugacuccauucaaau

SEQ ID NO: 1846328 - RNA, 22 nt, Homo sapiens
cagaaaugauucaggguuauuu

SEQ ID NO: 1846329 - RNA, 16 nt, Homo sapiens
ccgagaagcacuugag

SEQ ID NO: 1846330 - RNA, 18 nt, Homo sapiens
gucucuucuuggggccca

SEQ ID NO: 1846331 - RNA, 22 nt, Homo sapiens
cauccuuggacugagaaauuau

SEQ ID NO: 1846332 - RNA, 18 nt, Homo sapiens
accccugaaaucugaguu

SEQ ID NO: 1846333 - RNA, 13 nt, Homo sapiens
uucguuucugggg

SEQ ID NO: 1846334 - RNA, 13 nt, Homo sapiens
cgcauuuccugag

SEQ ID NO: 1846335 - RNA, 13 nt, Homo sapiens
ccguggcuuuuac

SEQ ID NO: 1846336 - RNA, 19 nt, Homo sapiens
acuaaacugguugucaguu

SEQ ID NO: 1846337 - RNA, 14 nt, Homo sapiens
ggcgugggauugaa

SEQ ID NO: 1846338 - RNA, 15 nt, Homo sapiens
cucucuucugcucca

SEQ ID NO: 1846339 - RNA, 19 nt, Homo sapiens
uuacaaaauccaacucucu

SEQ ID NO: 1846340 - RNA, 16 nt, Homo sapiens
aacauauuuaagaaau

SEQ ID NO: 1846341 - RNA, 22 nt, Homo sapiens
cagaaagcaggagcagcugugc

SEQ ID NO: 1846342 - RNA, 19 nt, Homo sapiens
ucaagugaggggcccuuug

SEQ ID NO: 1846343 - RNA, 20 nt, Homo sapiens
agaugauccacaacuugaga

SEQ ID NO: 1846344 - RNA, 19 nt, Homo sapiens
ggcacugugggacugggac

SEQ ID NO: 1846345 - RNA, 14 nt, Homo sapiens
gaggaucccuccau

SEQ ID NO: 1846346 - RNA, 22 nt, Homo sapiens
uuccagaauuaugaggcauuga

SEQ ID NO: 1846347 - RNA, 17 nt, Homo sapiens
ugugcagugauguggug

SEQ ID NO: 1846348 - RNA, 18 nt, Homo sapiens
ugguccaaauucuuuauu

SEQ ID NO: 1846349 - RNA, 19 nt, Homo sapiens
aaagugacccugcucucac

SEQ ID NO: 1846350 - RNA, 22 nt, Homo sapiens
ugaauauuccuggacuuacaaa

SEQ ID NO: 1846351 - RNA, 20 nt, Homo sapiens
agagcgauggagcagucucc

SEQ ID NO: 1846352 - RNA, 13 nt, Homo sapiens
cagaaaagcaccu

SEQ ID NO: 1846353 - RNA, 19 nt, Homo sapiens
aaaaguuacuaccugucaa

SEQ ID NO: 1846354 - RNA, 19 nt, Homo sapiens
acauuaagccucuugucua

SEQ ID NO: 1846355 - RNA, 19 nt, Homo sapiens
guuucaccauguuggucag

SEQ ID NO: 1846356 - RNA, 21 nt, Homo sapiens
caagauuccuuuccacuccaa

SEQ ID NO: 1846357 - RNA, 20 nt, Homo sapiens
acgucaaagaggcuccagaa

SEQ ID NO: 1846358 - RNA, 18 nt, Homo sapiens
uaaaaauggccauuugcu

SEQ ID NO: 1846359 - RNA, 14 nt, Homo sapiens
uccugcccaaguga

SEQ ID NO: 1846360 - RNA, 24 nt, Homo sapiens
ccaucagacugaacuuacacugua

SEQ ID NO: 1846361 - RNA, 21 nt, Homo sapiens
cucccacugggguccagggag

SEQ ID NO: 1846362 - RNA, 15 nt, Homo sapiens
gccacagccaagccc

SEQ ID NO: 1846363 - RNA, 19 nt, Homo sapiens
uuuauguuugaaugauuua

SEQ ID NO: 1846364 - RNA, 16 nt, Homo sapiens
augggauauuuugaaa

SEQ ID NO: 1846365 - RNA, 13 nt, Homo sapiens
agucguaaggguu

SEQ ID NO: 1846366 - RNA, 15 nt, Homo sapiens
agcagaagccagagg

SEQ ID NO: 1846367 - RNA, 18 nt, Homo sapiens
acuucuaugcaaaugccu

SEQ ID NO: 1846368 - RNA, 22 nt, Homo sapiens
gccaggaggcugccacacggaa

SEQ ID NO: 1846369 - RNA, 22 nt, Homo sapiens
caaugcaccuagcugugcaaga

SEQ ID NO: 1846370 - RNA, 22 nt, Homo sapiens
acauucucaucaccacagggau

SEQ ID NO: 1846371 - RNA, 13 nt, Homo sapiens
agcuguacuguaa

SEQ ID NO: 1846372 - RNA, 15 nt, Homo sapiens
aacugugaugaagcc

SEQ ID NO: 1846373 - RNA, 17 nt, Homo sapiens
gggcuggcacgugacag

SEQ ID NO: 1846374 - RNA, 19 nt, Homo sapiens
gaugucuucguacaguucu

SEQ ID NO: 1846375 - RNA, 19 nt, Homo sapiens
cugcuuggacagcagccag

SEQ ID NO: 1846376 - RNA, 15 nt, Homo sapiens
aaauguaacuugaaa

SEQ ID NO: 1846377 - RNA, 11 nt, Homo sapiens
gaaggggccac

SEQ ID NO: 1846378 - RNA, 13 nt, Homo sapiens
gcaaaaacauagu

SEQ ID NO: 1846379 - RNA, 14 nt, Homo sapiens
uacuauuaccauag

SEQ ID NO: 1846380 - RNA, 22 nt, Homo sapiens
gaauguacaguugagcucaggu

SEQ ID NO: 1846381 - RNA, 22 nt, Homo sapiens
cccucaacagccaagugugacc

SEQ ID NO: 1846382 - RNA, 17 nt, Homo sapiens
uaagacguauguaaaca

SEQ ID NO: 1846383 - RNA, 20 nt, Homo sapiens
uaagaaagguaaagacugcc

SEQ ID NO: 1846384 - RNA, 16 nt, Homo sapiens
uuauguaauaauguga

SEQ ID NO: 1846385 - RNA, 13 nt, Homo sapiens
cacacuugcauga

SEQ ID NO: 1846386 - RNA, 18 nt, Homo sapiens
agccccucaauccuauca

SEQ ID NO: 1846387 - RNA, 14 nt, Homo sapiens
ugaaauaccaguga

SEQ ID NO: 1846388 - RNA, 21 nt, Homo sapiens
auuagcugcuucuauguuuca

SEQ ID NO: 1846389 - RNA, 17 nt, Homo sapiens
uacauaacuaaauuuga

SEQ ID NO: 1846390 - RNA, 15 nt, Homo sapiens
gggagccauguuuca

SEQ ID NO: 1846391 - RNA, 16 nt, Homo sapiens
cacauucauguacaau

SEQ ID NO: 1846392 - RNA, 16 nt, Homo sapiens
uagcagaugguuucca

SEQ ID NO: 1846393 - RNA, 21 nt, Homo sapiens
aucacauagaagcuguccuug

SEQ ID NO: 1846394 - RNA, 22 nt, Homo sapiens
caugauaaucugggcaucucgu

SEQ ID NO: 1846395 - RNA, 21 nt, Homo sapiens
aaugaugucguuugaaucaca

SEQ ID NO: 1846396 - RNA, 23 nt, Homo sapiens
gugaaucccuuuaggauguuuuc

SEQ ID NO: 1846397 - RNA, 13 nt, Homo sapiens
gagccaaggguuc

SEQ ID NO: 1846398 - RNA, 23 nt, Homo sapiens
gcggcccugaccaaugugugaag

SEQ ID NO: 1846399 - RNA, 16 nt, Homo sapiens
gaaggcagcuagacac

SEQ ID NO: 1846400 - RNA, 14 nt, Homo sapiens
acccucaugcugug

SEQ ID NO: 1846401 - RNA, 16 nt, Homo sapiens
cauuggcaaguguaaa

SEQ ID NO: 1846402 - RNA, 20 nt, Homo sapiens
aggugcucagcccaggcaca

SEQ ID NO: 1846403 - RNA, 15 nt, Homo sapiens
augcguucacuccaa

SEQ ID NO: 1846404 - RNA, 21 nt, Homo sapiens
cacucaucuaaagucuaguga

SEQ ID NO: 1846405 - RNA, 22 nt, Homo sapiens
ccaaagaguagaauugcauuga

SEQ ID NO: 1846406 - RNA, 14 nt, Homo sapiens
gggacugcugugaa

SEQ ID NO: 1846407 - RNA, 14 nt, Homo sapiens
aaaucauaacucac

SEQ ID NO: 1846408 - RNA, 23 nt, Homo sapiens
uuuaggaaaggcugaugauggua

SEQ ID NO: 1846409 - RNA, 21 nt, Homo sapiens
uauuaguuuuuauuaaacuca

SEQ ID NO: 1846410 - RNA, 20 nt, Homo sapiens
aauaaauuauuuguuacugu

SEQ ID NO: 1846411 - RNA, 17 nt, Homo sapiens
ucuuucgucuacugcaa

SEQ ID NO: 1846412 - RNA, 22 nt, Homo sapiens
gaagugauauggugaagggaag

SEQ ID NO: 1846413 - RNA, 23 nt, Homo sapiens
aacuccuaaaaaguuacagccau

SEQ ID NO: 1846414 - RNA, 19 nt, Homo sapiens
uuaaaaaagccuguaagag

SEQ ID NO: 1846415 - RNA, 15 nt, Homo sapiens
aaagauuuucagaaa

SEQ ID NO: 1846416 - RNA, 17 nt, Homo sapiens
ccagcaaugacaucuca

SEQ ID NO: 1846417 - RNA, 14 nt, Homo sapiens
cucaaauacaugca

SEQ ID NO: 1846418 - RNA, 17 nt, Homo sapiens
gugagggcaagaggugc

SEQ ID NO: 1846419 - RNA, 13 nt, Homo sapiens
uaaacacagauua

SEQ ID NO: 1846420 - RNA, 14 nt, Homo sapiens
aucccaguacucug

SEQ ID NO: 1846421 - RNA, 17 nt, Homo sapiens
agacucuguaauugaau

SEQ ID NO: 1846422 - RNA, 12 nt, Homo sapiens
uuugucugugau

SEQ ID NO: 1846423 - RNA, 16 nt, Homo sapiens
cagauuucagaucaua

SEQ ID NO: 1846424 - RNA, 16 nt, Homo sapiens
gagauaaacaccacca

SEQ ID NO: 1846425 - RNA, 15 nt, Homo sapiens
caauaguuguugauu

SEQ ID NO: 1846426 - RNA, 16 nt, Homo sapiens
augccuugaggggugu

SEQ ID NO: 1846427 - RNA, 12 nt, Homo sapiens
cuccaggcuuuc

SEQ ID NO: 1846428 - RNA, 21 nt, Homo sapiens
uaagaaguggugacauuuugc

SEQ ID NO: 1846429 - RNA, 21 nt, Homo sapiens
agauuucccuaaaaauuccac

SEQ ID NO: 1846430 - RNA, 14 nt, Homo sapiens
gcuuugguuuauau

SEQ ID NO: 1846431 - RNA, 14 nt, Homo sapiens
aucaaaugcucaag

SEQ ID NO: 1846432 - RNA, 21 nt, Homo sapiens
cauuaauagcugccuucaagg

SEQ ID NO: 1846433 - RNA, 16 nt, Homo sapiens
uugucauugacucgau

SEQ ID NO: 1846434 - RNA, 12 nt, Homo sapiens
agaggagcauga

SEQ ID NO: 1846435 - RNA, 20 nt, Homo sapiens
gagcuagcaaauacaggagu

SEQ ID NO: 1846436 - RNA, 21 nt, Homo sapiens
auuccauguccauaugcaucu

SEQ ID NO: 1846437 - RNA, 22 nt, Homo sapiens
ccucugucuaggacugcagugu

SEQ ID NO: 1846438 - RNA, 17 nt, Homo sapiens
uuugcuguugcauugua

SEQ ID NO: 1846439 - RNA, 22 nt, Homo sapiens
gguggcaucagugucuuuccac

SEQ ID NO: 1846440 - RNA, 22 nt, Homo sapiens
agauguacuucucugugugcac

SEQ ID NO: 1846441 - RNA, 12 nt, Homo sapiens
gacacacuguaa

SEQ ID NO: 1846442 - RNA, 12 nt, Homo sapiens
acagcccugcuc

SEQ ID NO: 1846443 - RNA, 19 nt, Homo sapiens
caaugacugagcagcaucc

SEQ ID NO: 1846444 - RNA, 19 nt, Homo sapiens
gucauacucuuuuucccaa

SEQ ID NO: 1846445 - RNA, 20 nt, Homo sapiens
ucagccuuagcacuauggac

SEQ ID NO: 1846446 - RNA, 13 nt, Homo sapiens
uugcugaugcuuu

SEQ ID NO: 1846447 - RNA, 14 nt, Homo sapiens
accuuccucuucca

SEQ ID NO: 1846448 - RNA, 14 nt, Homo sapiens
uuucucuucagugc

SEQ ID NO: 1846449 - RNA, 21 nt, Homo sapiens
caaaaaugaagcugcucugaa

SEQ ID NO: 1846450 - RNA, 13 nt, Homo sapiens
auccacuuaccug

SEQ ID NO: 1846451 - RNA, 13 nt, Homo sapiens
cuguuuaacauuu

SEQ ID NO: 1846452 - RNA, 16 nt, Homo sapiens
gugaggucacagucca

SEQ ID NO: 1846453 - RNA, 22 nt, Homo sapiens
auacaaaaauaccuacugcuga

SEQ ID NO: 1846454 - RNA, 15 nt, Homo sapiens
aggucccugcugcca

SEQ ID NO: 1846455 - RNA, 21 nt, Homo sapiens
cacagggagaauugaaacuga

SEQ ID NO: 1846456 - RNA, 14 nt, Homo sapiens
gaugugacugccau

SEQ ID NO: 1846457 - RNA, 22 nt, Homo sapiens
ccugggguccccccucccugua

SEQ ID NO: 1846458 - RNA, 20 nt, Homo sapiens
accuugcucagccaucccgu

SEQ ID NO: 1846459 - RNA, 17 nt, Homo sapiens
acuuguuuuugcacaug

SEQ ID NO: 1846460 - RNA, 13 nt, Homo sapiens
agaaaaaguacaa

SEQ ID NO: 1846461 - RNA, 24 nt, Homo sapiens
gcacacacagaugcacacacagau

SEQ ID NO: 1846462 - RNA, 15 nt, Homo sapiens
acugaagguacuuua

SEQ ID NO: 1846463 - RNA, 22 nt, Homo sapiens
accaguccuguuugcagggaag

SEQ ID NO: 1846464 - RNA, 16 nt, Homo sapiens
gaauccuggcagccca

SEQ ID NO: 1846465 - RNA, 11 nt, Homo sapiens
gacacuguggg

SEQ ID NO: 1846466 - RNA, 14 nt, Homo sapiens
aauaaacaaucuua

SEQ ID NO: 1846467 - RNA, 14 nt, Homo sapiens
aucuguaucccuac

SEQ ID NO: 1846468 - RNA, 21 nt, Homo sapiens
cccucugucacccagucuguu

SEQ ID NO: 1846469 - RNA, 13 nt, Homo sapiens
aauaaacuauacu

SEQ ID NO: 1846470 - RNA, 16 nt, Homo sapiens
guaucauucuuuacau

SEQ ID NO: 1846471 - RNA, 21 nt, Homo sapiens
agucucugaacuaggugaucu

SEQ ID NO: 1846472 - RNA, 18 nt, Homo sapiens
uggccaccccuugcucuc

SEQ ID NO: 1846473 - RNA, 16 nt, Homo sapiens
aagacucgcaauuuca

SEQ ID NO: 1846474 - RNA, 20 nt, Homo sapiens
gcccgggacagggucuugca

SEQ ID NO: 1846475 - RNA, 14 nt, Homo sapiens
cagaauaauaagag

SEQ ID NO: 1846476 - RNA, 13 nt, Homo sapiens
aauaucaaugccc

SEQ ID NO: 1846477 - RNA, 15 nt, Homo sapiens
uugacagaacacugu

SEQ ID NO: 1846478 - RNA, 16 nt, Homo sapiens
cuuuagguauuacaca

SEQ ID NO: 1846479 - RNA, 23 nt, Homo sapiens
agaucaaaauccuacagaugccu

SEQ ID NO: 1846480 - RNA, 17 nt, Homo sapiens
cgacuggggcagggugu

SEQ ID NO: 1846481 - RNA, 15 nt, Homo sapiens
cugucaggacaccag

SEQ ID NO: 1846482 - RNA, 17 nt, Homo sapiens
cuccugccaccagcauc

SEQ ID NO: 1846483 - RNA, 13 nt, Homo sapiens
gagaaaaauaucu

SEQ ID NO: 1846484 - RNA, 14 nt, Homo sapiens
auaacugaacuguu

SEQ ID NO: 1846485 - RNA, 18 nt, Homo sapiens
uacuuuugugcuaucaau

SEQ ID NO: 1846486 - RNA, 17 nt, Homo sapiens
gaaaggcccauggauca

SEQ ID NO: 1846487 - RNA, 19 nt, Homo sapiens
ucuugguaacaaauaaccu

SEQ ID NO: 1846488 - RNA, 14 nt, Homo sapiens
cccauuacuuugau

SEQ ID NO: 1846489 - RNA, 22 nt, Homo sapiens
cacacagccuauaucaaacaug

SEQ ID NO: 1846490 - RNA, 19 nt, Homo sapiens
aauggggcggggcuucucu

SEQ ID NO: 1846491 - RNA, 21 nt, Homo sapiens
guuccugcagcagagccugga

SEQ ID NO: 1846492 - RNA, 16 nt, Homo sapiens
uuccucaaaaugggag

SEQ ID NO: 1846493 - RNA, 17 nt, Homo sapiens
ccaacucccucugggaa

SEQ ID NO: 1846494 - RNA, 17 nt, Homo sapiens
cauuuuauaaucuauau

SEQ ID NO: 1846495 - RNA, 15 nt, Homo sapiens
auuuuuaguuugcua

SEQ ID NO: 1846496 - RNA, 15 nt, Homo sapiens
aauuuauguaugcau

SEQ ID NO: 1846497 - RNA, 19 nt, Homo sapiens
gauggcuccuugggaugaa

SEQ ID NO: 1846498 - RNA, 21 nt, Homo sapiens
augcuuugauuguucauauca

SEQ ID NO: 1846499 - RNA, 14 nt, Homo sapiens
uccccuguuugcau

SEQ ID NO: 1846500 - RNA, 16 nt, Homo sapiens
ccuuccacagcuggcc

SEQ ID NO: 1846501 - RNA, 20 nt, Homo sapiens
gcuucuaaucccagcacuuu

SEQ ID NO: 1846502 - RNA, 18 nt, Homo sapiens
auuuggcauugaucuuaa

SEQ ID NO: 1846503 - RNA, 15 nt, Homo sapiens
aacaccuauugcacu

SEQ ID NO: 1846504 - RNA, 17 nt, Homo sapiens
uggaagcugucauaaaa

SEQ ID NO: 1846505 - RNA, 20 nt, Homo sapiens
gauacagauccgcauguguc

SEQ ID NO: 1846506 - RNA, 22 nt, Homo sapiens
cagagaugcaugcgcaggcuca

SEQ ID NO: 1846507 - RNA, 13 nt, Homo sapiens
guguuuaauuuga

SEQ ID NO: 1846508 - RNA, 15 nt, Homo sapiens
uucugauuaaugcua

SEQ ID NO: 1846509 - RNA, 14 nt, Homo sapiens
cuaguuugaccuca

SEQ ID NO: 1846510 - RNA, 22 nt, Homo sapiens
accaguaauaaaaagccaccac

SEQ ID NO: 1846511 - RNA, 18 nt, Homo sapiens
gcgcucucccuaccuugc

SEQ ID NO: 1846512 - RNA, 15 nt, Homo sapiens
gacguuuucuuuauc

SEQ ID NO: 1846513 - RNA, 13 nt, Homo sapiens
aaguccuuuaugu

SEQ ID NO: 1846514 - RNA, 17 nt, Homo sapiens
cugccuggcccaugugc

SEQ ID NO: 1846515 - RNA, 23 nt, Homo sapiens
aaucagagugcacaagcaccucu

SEQ ID NO: 1846516 - RNA, 16 nt, Homo sapiens
gcagagguugcaguga

SEQ ID NO: 1846517 - RNA, 16 nt, Homo sapiens
guucgcucgugcagua

SEQ ID NO: 1846518 - RNA, 14 nt, Homo sapiens
ugcaucaucaucac

SEQ ID NO: 1846519 - RNA, 20 nt, Homo sapiens
aaguuucuauuuaguuauuu

SEQ ID NO: 1846520 - RNA, 13 nt, Homo sapiens
cucugaaaucagc

SEQ ID NO: 1846521 - RNA, 14 nt, Homo sapiens
caggagaagaaaca

SEQ ID NO: 1846522 - RNA, 18 nt, Homo sapiens
ugccaacaccuucuuggc

SEQ ID NO: 1846523 - RNA, 13 nt, Homo sapiens
accccugucucua

SEQ ID NO: 1846524 - RNA, 23 nt, Homo sapiens
gggacuuauguauuuaugaccuu

SEQ ID NO: 1846525 - RNA, 17 nt, Homo sapiens
ugcagcccuugggcagu

SEQ ID NO: 1846526 - RNA, 20 nt, Homo sapiens
uaucugagcguuuaaaguac

SEQ ID NO: 1846527 - RNA, 20 nt, Homo sapiens
acuacacuccagccugggca

SEQ ID NO: 1846528 - RNA, 19 nt, Homo sapiens
caaaauauuuaagugaagg

SEQ ID NO: 1846529 - RNA, 18 nt, Homo sapiens
ccccugggacugcugcuu

SEQ ID NO: 1846530 - RNA, 14 nt, Homo sapiens
aaaauuaugaccau

SEQ ID NO: 1846531 - RNA, 19 nt, Homo sapiens
gagagagucuuacucugcc

SEQ ID NO: 1846532 - RNA, 13 nt, Homo sapiens
gucaaaugccaaa

SEQ ID NO: 1846533 - RNA, 23 nt, Homo sapiens
acucacuguguggccucagagaa

SEQ ID NO: 1846534 - RNA, 17 nt, Homo sapiens
caguaacauuucauuaa

SEQ ID NO: 1846535 - RNA, 21 nt, Homo sapiens
uaugaucagguaacuuucgac

SEQ ID NO: 1846536 - RNA, 16 nt, Homo sapiens
cccaaacccauggcuc

SEQ ID NO: 1846537 - RNA, 20 nt, Homo sapiens
cuauguugucuuuuaaaaag

SEQ ID NO: 1846538 - RNA, 23 nt, Homo sapiens
acuaaaaauacaauuagccaggu

SEQ ID NO: 1846539 - RNA, 22 nt, Homo sapiens
cuagaaccugggcugugcugcu

SEQ ID NO: 1846540 - RNA, 13 nt, Homo sapiens
acuauguuuccau

SEQ ID NO: 1846541 - RNA, 22 nt, Homo sapiens
uguauaaugguguuacuaaagu

SEQ ID NO: 1846542 - RNA, 21 nt, Homo sapiens
cuugaaauucucaucagucca

SEQ ID NO: 1846543 - RNA, 19 nt, Homo sapiens
ucagccaugucugugcugu

SEQ ID NO: 1846544 - RNA, 17 nt, Homo sapiens
gcuccagcccuugucag

SEQ ID NO: 1846545 - RNA, 17 nt, Homo sapiens
cucccugaaucugacca

SEQ ID NO: 1846546 - RNA, 19 nt, Homo sapiens
agcugggggcgcagaggac

SEQ ID NO: 1846547 - RNA, 12 nt, Homo sapiens
cuuuaaauauaa

SEQ ID NO: 1846548 - RNA, 21 nt, Homo sapiens
uauaguggccaaauagcacau

SEQ ID NO: 1846549 - RNA, 18 nt, Homo sapiens
ugcuuggaagccagguac

SEQ ID NO: 1846550 - RNA, 14 nt, Homo sapiens
ugucuguaucagug

SEQ ID NO: 1846551 - RNA, 16 nt, Homo sapiens
gggucccucucuugac

SEQ ID NO: 1846552 - RNA, 21 nt, Homo sapiens
uugggugaacuaaccaaauaa

SEQ ID NO: 1846553 - RNA, 16 nt, Homo sapiens
uaaaguguucugccag

SEQ ID NO: 1846554 - RNA, 22 nt, Homo sapiens
aauuaggauaacuucacugaga

SEQ ID NO: 1846555 - RNA, 21 nt, Homo sapiens
aaaaccauucuaaaacacaac

SEQ ID NO: 1846556 - RNA, 22 nt, Homo sapiens
uucaauaugaaccaaguaguau

SEQ ID NO: 1846557 - RNA, 17 nt, Homo sapiens
agucaaccaauguagaa

SEQ ID NO: 1846558 - RNA, 17 nt, Homo sapiens
ccaggagcugauggcag

SEQ ID NO: 1846559 - RNA, 17 nt, Homo sapiens
cuggagugcagugccac

SEQ ID NO: 1846560 - RNA, 15 nt, Homo sapiens
acaccaccaugcuca

SEQ ID NO: 1846561 - RNA, 19 nt, Homo sapiens
uacacagaaucuccugaua

SEQ ID NO: 1846562 - RNA, 19 nt, Homo sapiens
agacguccuuucccuacuc

SEQ ID NO: 1846563 - RNA, 21 nt, Homo sapiens
agguaugugucagccaugacc

SEQ ID NO: 1846564 - RNA, 19 nt, Homo sapiens
gauacugaguaaauccaug

SEQ ID NO: 1846565 - RNA, 14 nt, Homo sapiens
aaagacuguuuuca

SEQ ID NO: 1846566 - RNA, 22 nt, Homo sapiens
guccucugccugggcucuggaa

SEQ ID NO: 1846567 - RNA, 15 nt, Homo sapiens
ccaaccugcucauuu

SEQ ID NO: 1846568 - RNA, 14 nt, Homo sapiens
caguaauagcugaa

SEQ ID NO: 1846569 - RNA, 19 nt, Homo sapiens
uacuccgugaggcugcugc

SEQ ID NO: 1846570 - RNA, 18 nt, Homo sapiens
agcaguugcaaugaucag

SEQ ID NO: 1846571 - RNA, 18 nt, Homo sapiens
aaacucuauggucuuaua

SEQ ID NO: 1846572 - RNA, 16 nt, Homo sapiens
gccagugagaccagcc

SEQ ID NO: 1846573 - RNA, 14 nt, Homo sapiens
aggaggaugcugug

SEQ ID NO: 1846574 - RNA, 14 nt, Homo sapiens
augauccucagugc

SEQ ID NO: 1846575 - RNA, 13 nt, Homo sapiens
uucuaacccugac

SEQ ID NO: 1846576 - RNA, 17 nt, Homo sapiens
ccugguacugagguugg

SEQ ID NO: 1846577 - RNA, 15 nt, Homo sapiens
ggcaaaugacaugca

SEQ ID NO: 1846578 - RNA, 18 nt, Homo sapiens
gaauaguccauccccaga

SEQ ID NO: 1846579 - RNA, 18 nt, Homo sapiens
guuuagcccaaaaccaag

SEQ ID NO: 1846580 - RNA, 15 nt, Homo sapiens
aagagccacugccau

SEQ ID NO: 1846581 - RNA, 21 nt, Homo sapiens
ucucagagcccucaacuauuc

SEQ ID NO: 1846582 - RNA, 19 nt, Homo sapiens
caccuagagcuagaugugu

SEQ ID NO: 1846583 - RNA, 22 nt, Homo sapiens
ugcagguuccuuaucugucaca

SEQ ID NO: 1846584 - RNA, 23 nt, Homo sapiens
gaagcugcccuugaagacuuccc

SEQ ID NO: 1846585 - RNA, 12 nt, Homo sapiens
ggcgcucgccca

SEQ ID NO: 1846586 - RNA, 17 nt, Homo sapiens
gcccucacaucuuccac

SEQ ID NO: 1846587 - RNA, 15 nt, Homo sapiens
cccgucgugcuuccu

SEQ ID NO: 1846588 - RNA, 16 nt, Homo sapiens
agaaaaucaguaauug

SEQ ID NO: 1846589 - RNA, 14 nt, Homo sapiens
uauucuuugcacuu

SEQ ID NO: 1846590 - RNA, 21 nt, Homo sapiens
auucaccuggguuugcaagaa

SEQ ID NO: 1846591 - RNA, 16 nt, Homo sapiens
cuuucaaccucaguga

SEQ ID NO: 1846592 - RNA, 12 nt, Homo sapiens
gaaaggugcuga

SEQ ID NO: 1846593 - RNA, 23 nt, Homo sapiens
acccaguucugaauaacuugaag

SEQ ID NO: 1846594 - RNA, 13 nt, Homo sapiens
gccauuaccccau

SEQ ID NO: 1846595 - RNA, 20 nt, Homo sapiens
uacauaaaggugguaugugu

SEQ ID NO: 1846596 - RNA, 13 nt, Homo sapiens
ccauucagugaca

SEQ ID NO: 1846597 - RNA, 20 nt, Homo sapiens
acauacaaauauauguauau

SEQ ID NO: 1846598 - RNA, 18 nt, Homo sapiens
cagggcaccccagcugac

SEQ ID NO: 1846599 - RNA, 15 nt, Homo sapiens
uugaacccaggagau

SEQ ID NO: 1846600 - RNA, 18 nt, Homo sapiens
ccucugcucugugcacuc

SEQ ID NO: 1846601 - RNA, 21 nt, Homo sapiens
aaauccuaagacacaaaugca

SEQ ID NO: 1846602 - RNA, 21 nt, Homo sapiens
aaguuccccaucccugucauu

SEQ ID NO: 1846603 - RNA, 13 nt, Homo sapiens
ugaggcugucaca

SEQ ID NO: 1846604 - RNA, 13 nt, Homo sapiens
acaggcugagaca

SEQ ID NO: 1846605 - RNA, 23 nt, Homo sapiens
aagacguugccuauaacagugac

SEQ ID NO: 1846606 - RNA, 13 nt, Homo sapiens
uuaugaacacuug

SEQ ID NO: 1846607 - RNA, 13 nt, Homo sapiens
auacaaacucuca

SEQ ID NO: 1846608 - RNA, 13 nt, Homo sapiens
ucuaccgaccugu

SEQ ID NO: 1846609 - RNA, 22 nt, Homo sapiens
uauuuaaucaaacaguaaucua

SEQ ID NO: 1846610 - RNA, 20 nt, Homo sapiens
uauucugucuggcauuacaa

SEQ ID NO: 1846611 - RNA, 22 nt, Homo sapiens
agguccugcacauuacaugacu

SEQ ID NO: 1846612 - RNA, 15 nt, Homo sapiens
agaaacagaccugca

SEQ ID NO: 1846613 - RNA, 16 nt, Homo sapiens
aagcagucagcccuua

SEQ ID NO: 1846614 - RNA, 17 nt, Homo sapiens
cugggcagccagagccu

SEQ ID NO: 1846615 - RNA, 18 nt, Homo sapiens
aaagaacgcugcagcuuu

SEQ ID NO: 1846616 - RNA, 19 nt, Homo sapiens
uggggccauccacacccuc

SEQ ID NO: 1846617 - RNA, 17 nt, Homo sapiens
gcccaaggacggcacca

SEQ ID NO: 1846618 - RNA, 17 nt, Homo sapiens
acuaauaggaccucaaa

SEQ ID NO: 1846619 - RNA, 14 nt, Homo sapiens
cuuacaacuccccc

SEQ ID NO: 1846620 - RNA, 13 nt, Homo sapiens
acacauaagcaua

SEQ ID NO: 1846621 - RNA, 21 nt, Homo sapiens
cuuggguuagaccuacagggg

SEQ ID NO: 1846622 - RNA, 18 nt, Homo sapiens
aguguaaaaacaaugugc

SEQ ID NO: 1846623 - RNA, 17 nt, Homo sapiens
agcugaauccuuccauu

SEQ ID NO: 1846624 - RNA, 19 nt, Homo sapiens
gauccaucaagacaauggg

SEQ ID NO: 1846625 - RNA, 20 nt, Homo sapiens
cugugggucagugugccacc

SEQ ID NO: 1846626 - RNA, 19 nt, Homo sapiens
agauggccgggacaugcag

SEQ ID NO: 1846627 - RNA, 18 nt, Homo sapiens
cggccacucccugccaac

SEQ ID NO: 1846628 - RNA, 12 nt, Homo sapiens
ggugaccucucc

SEQ ID NO: 1846629 - RNA, 19 nt, Homo sapiens
guguuauuugugggguaca

SEQ ID NO: 1846630 - RNA, 21 nt, Homo sapiens
cacaguucuuaauacaggaga

SEQ ID NO: 1846631 - RNA, 17 nt, Homo sapiens
uuccuuugggagcucau

SEQ ID NO: 1846632 - RNA, 16 nt, Homo sapiens
agggcagcugugauga

SEQ ID NO: 1846633 - RNA, 20 nt, Homo sapiens
ugccccuuccgccacugggg

SEQ ID NO: 1846634 - RNA, 14 nt, Homo sapiens
gacagaauggauau

SEQ ID NO: 1846635 - RNA, 17 nt, Homo sapiens
cugucaggacacaugga

SEQ ID NO: 1846636 - RNA, 17 nt, Homo sapiens
cguggaacacauagguu

SEQ ID NO: 1846637 - RNA, 18 nt, Homo sapiens
uggaccccaucugugaau

SEQ ID NO: 1846638 - RNA, 16 nt, Homo sapiens
uuuccuuaaacugugu

SEQ ID NO: 1846639 - RNA, 18 nt, Homo sapiens
cagagucucugauacaca

SEQ ID NO: 1846640 - RNA, 16 nt, Homo sapiens
uaauucggauuugcca

SEQ ID NO: 1846641 - RNA, 19 nt, Homo sapiens
agaauuaagucagagccaa

SEQ ID NO: 1846642 - RNA, 17 nt, Homo sapiens
ccagcguccucguucaa

SEQ ID NO: 1846643 - RNA, 14 nt, Homo sapiens
aauaugaugccacu

SEQ ID NO: 1846644 - RNA, 23 nt, Homo sapiens
auugauaaucuucaggugaacac

SEQ ID NO: 1846645 - RNA, 16 nt, Homo sapiens
gggguugguguucuca

SEQ ID NO: 1846646 - RNA, 15 nt, Homo sapiens
aaugugguacaagca

SEQ ID NO: 1846647 - RNA, 22 nt, Homo sapiens
auggauaaaauaaugcugcaaa

SEQ ID NO: 1846648 - RNA, 18 nt, Homo sapiens
aaaauucauuucuaauua

SEQ ID NO: 1846649 - RNA, 21 nt, Homo sapiens
agauguugaaaaaaauugucu

SEQ ID NO: 1846650 - RNA, 20 nt, Homo sapiens
gcaaucagcuaccauucaaa

SEQ ID NO: 1846651 - RNA, 17 nt, Homo sapiens
caagaacuccugaaauc

SEQ ID NO: 1846652 - RNA, 18 nt, Homo sapiens
uauacugagcugcuaaaa

SEQ ID NO: 1846653 - RNA, 22 nt, Homo sapiens
gcagaagucaacgccucggugg

SEQ ID NO: 1846654 - RNA, 22 nt, Homo sapiens
auacuggucccacuucacagcu

SEQ ID NO: 1846655 - RNA, 17 nt, Homo sapiens
uucuggaaguuucuggu

SEQ ID NO: 1846656 - RNA, 19 nt, Homo sapiens
acuccagccugggugacag

SEQ ID NO: 1846657 - RNA, 12 nt, Homo sapiens
agucaagggcau

SEQ ID NO: 1846658 - RNA, 16 nt, Homo sapiens
cagaauuggaaucaca

SEQ ID NO: 1846659 - RNA, 21 nt, Homo sapiens
ugguuuuuugcauacugcuau

SEQ ID NO: 1846660 - RNA, 18 nt, Homo sapiens
agccugcagggugaccug

SEQ ID NO: 1846661 - RNA, 13 nt, Homo sapiens
aaagacagucaaa

SEQ ID NO: 1846662 - RNA, 12 nt, Homo sapiens
uuaacacuguca

SEQ ID NO: 1846663 - RNA, 19 nt, Homo sapiens
uucuugcuggucuagucac

SEQ ID NO: 1846664 - RNA, 19 nt, Homo sapiens
uaagaagcagccaucacau

SEQ ID NO: 1846665 - RNA, 13 nt, Homo sapiens
cuccaguagcucc

SEQ ID NO: 1846666 - RNA, 15 nt, Homo sapiens
uucaugaaacugucc

SEQ ID NO: 1846667 - RNA, 15 nt, Homo sapiens
ugggggaagacuuua

SEQ ID NO: 1846668 - RNA, 14 nt, Homo sapiens
augcaaauucucaa

SEQ ID NO: 1846669 - RNA, 13 nt, Homo sapiens
caaaugcuccucc

SEQ ID NO: 1846670 - RNA, 21 nt, Homo sapiens
uuaacuugaaaauuuuuuaac

SEQ ID NO: 1846671 - RNA, 22 nt, Homo sapiens
cuggguggcucacucagcacuu

SEQ ID NO: 1846672 - RNA, 11 nt, Homo sapiens
uuucagugccu

SEQ ID NO: 1846673 - RNA, 14 nt, Homo sapiens
agagccacuaccuu

SEQ ID NO: 1846674 - RNA, 13 nt, Homo sapiens
gcaccugugcugg

SEQ ID NO: 1846675 - RNA, 14 nt, Homo sapiens
caccuccugcuccu

SEQ ID NO: 1846676 - RNA, 18 nt, Homo sapiens
uucccguuagucucugaa

SEQ ID NO: 1846677 - RNA, 22 nt, Homo sapiens
acaacauggccgugaacuuuau

SEQ ID NO: 1846678 - RNA, 16 nt, Homo sapiens
accuuccaauuccuga

SEQ ID NO: 1846679 - RNA, 13 nt, Homo sapiens
gugagaugcagcu

SEQ ID NO: 1846680 - RNA, 12 nt, Homo sapiens
uggacagaagca

SEQ ID NO: 1846681 - RNA, 20 nt, Homo sapiens
cuuugccuucucuguucccu

SEQ ID NO: 1846682 - RNA, 17 nt, Homo sapiens
agcaccccugcugauac

SEQ ID NO: 1846683 - RNA, 17 nt, Homo sapiens
agcuucucucugagcug

SEQ ID NO: 1846684 - RNA, 17 nt, Homo sapiens
gugacuccugaaaccuc

SEQ ID NO: 1846685 - RNA, 22 nt, Homo sapiens
acauuuuuugagguaucacugc

SEQ ID NO: 1846686 - RNA, 10 nt, Homo sapiens
gccuguggug

SEQ ID NO: 1846687 - RNA, 20 nt, Homo sapiens
ccuuggcaugccuuccagca

SEQ ID NO: 1846688 - RNA, 20 nt, Homo sapiens
ggagguggagcuugcaguga

SEQ ID NO: 1846689 - RNA, 13 nt, Homo sapiens
accaaaaucagcu

SEQ ID NO: 1846690 - RNA, 16 nt, Homo sapiens
ugccugggggcugugg

SEQ ID NO: 1846691 - RNA, 22 nt, Homo sapiens
accaauguugugauuaacauca

SEQ ID NO: 1846692 - RNA, 21 nt, Homo sapiens
agcaggggacuacaugugaac

SEQ ID NO: 1846693 - RNA, 19 nt, Homo sapiens
gcuggggaacaaccagagg

SEQ ID NO: 1846694 - RNA, 16 nt, Homo sapiens
aguuuccugccagaua

SEQ ID NO: 1846695 - RNA, 15 nt, Homo sapiens
agaauugucuugcaa

SEQ ID NO: 1846696 - RNA, 16 nt, Homo sapiens
agagggcaaagcugau

SEQ ID NO: 1846697 - RNA, 15 nt, Homo sapiens
accacugcucuccag

SEQ ID NO: 1846698 - RNA, 19 nt, Homo sapiens
aguaaacuuuucaguauug

SEQ ID NO: 1846699 - RNA, 21 nt, Homo sapiens
uaucuaacccucccauggcac

SEQ ID NO: 1846700 - RNA, 21 nt, Homo sapiens
ggagacagagcugguugggaa

SEQ ID NO: 1846701 - RNA, 21 nt, Homo sapiens
cuugcagucucccagauguug

SEQ ID NO: 1846702 - RNA, 18 nt, Homo sapiens
aagaagagaaccaugaaa

SEQ ID NO: 1846703 - RNA, 16 nt, Homo sapiens
cugcacugacucugga

SEQ ID NO: 1846704 - RNA, 23 nt, Homo sapiens
uuuaaauaagauuuaauucacau

SEQ ID NO: 1846705 - RNA, 13 nt, Homo sapiens
caggaugcacauu

SEQ ID NO: 1846706 - RNA, 13 nt, Homo sapiens
aauaauacaacaa

SEQ ID NO: 1846707 - RNA, 19 nt, Homo sapiens
ucaccauugugaagcaccu

SEQ ID NO: 1846708 - RNA, 16 nt, Homo sapiens
cuaauguuacuagaga

SEQ ID NO: 1846709 - RNA, 15 nt, Homo sapiens
aagccauucuuuuaa

SEQ ID NO: 1846710 - RNA, 17 nt, Homo sapiens
uuccaaagccaauguga

SEQ ID NO: 1846711 - RNA, 11 nt, Homo sapiens
uucugugguaa

SEQ ID NO: 1846712 - RNA, 21 nt, Homo sapiens
caccaggcugggcagggacaa

SEQ ID NO: 1846713 - RNA, 14 nt, Homo sapiens
ggaucgcaccuuuu

SEQ ID NO: 1846714 - RNA, 20 nt, Homo sapiens
cuuccucgugccguccuccc

SEQ ID NO: 1846715 - RNA, 21 nt, Homo sapiens
auacagugauauacuuacuca

SEQ ID NO: 1846716 - RNA, 15 nt, Homo sapiens
guagaacugauuuua

SEQ ID NO: 1846717 - RNA, 23 nt, Homo sapiens
cagcugcugugccaggacuguga

SEQ ID NO: 1846718 - RNA, 23 nt, Homo sapiens
aaugaauucugggaauccacagc

SEQ ID NO: 1846719 - RNA, 16 nt, Homo sapiens
gaguguucccuaucca

SEQ ID NO: 1846720 - RNA, 18 nt, Homo sapiens
uuauccauccucugagau

SEQ ID NO: 1846721 - RNA, 15 nt, Homo sapiens
cagagccucagugag

SEQ ID NO: 1846722 - RNA, 14 nt, Homo sapiens
ugccuuaagccagu

SEQ ID NO: 1846723 - RNA, 12 nt, Homo sapiens
cauauuaaguaa

SEQ ID NO: 1846724 - RNA, 19 nt, Homo sapiens
aagcccccacuucucucca

SEQ ID NO: 1846725 - RNA, 13 nt, Homo sapiens
aaagaagaacuug

SEQ ID NO: 1846726 - RNA, 14 nt, Homo sapiens
guuacccacugcca

SEQ ID NO: 1846727 - RNA, 14 nt, Homo sapiens
guuccccacugaca

SEQ ID NO: 1846728 - RNA, 15 nt, Homo sapiens
cagcgggcacagggc

SEQ ID NO: 1846729 - RNA, 17 nt, Homo sapiens
cguugaaacaagugcaa

SEQ ID NO: 1846730 - RNA, 18 nt, Homo sapiens
uccuaggcauuugcugaa

SEQ ID NO: 1846731 - RNA, 11 nt, Homo sapiens
uuccuuugaac

SEQ ID NO: 1846732 - RNA, 11 nt, Homo sapiens
uuucuuugaau

SEQ ID NO: 1846733 - RNA, 16 nt, Homo sapiens
agugucaggaugguaa

SEQ ID NO: 1846734 - RNA, 13 nt, Homo sapiens
ugaauuucacugu

SEQ ID NO: 1846735 - RNA, 23 nt, Homo sapiens
acacuaacuuaauguguauucau

SEQ ID NO: 1846736 - RNA, 21 nt, Homo sapiens
ccagaguccucugguuccuua

SEQ ID NO: 1846737 - RNA, 23 nt, Homo sapiens
ugcaggggcaaacaccugcugau

SEQ ID NO: 1846738 - RNA, 14 nt, Homo sapiens
aauaauauuagcuu

SEQ ID NO: 1846739 - RNA, 15 nt, Homo sapiens
aauuucucccaguca

SEQ ID NO: 1846740 - RNA, 22 nt, Homo sapiens
cgcagcuguaaggcacgcugga

SEQ ID NO: 1846741 - RNA, 18 nt, Homo sapiens
ugcauugagaacugcaua

SEQ ID NO: 1846742 - RNA, 15 nt, Homo sapiens
uggaagucaucucau

SEQ ID NO: 1846743 - RNA, 23 nt, Homo sapiens
cuaacccccagugccacagagaa

SEQ ID NO: 1846744 - RNA, 22 nt, Homo sapiens
ugucaacaucaaagagcacauu

SEQ ID NO: 1846745 - RNA, 16 nt, Homo sapiens
cugccauaaaaucuca

SEQ ID NO: 1846746 - RNA, 19 nt, Homo sapiens
uuuaacuuauuuauaugaa

SEQ ID NO: 1846747 - RNA, 14 nt, Homo sapiens
gaaggggcuaggga

SEQ ID NO: 1846748 - RNA, 20 nt, Homo sapiens
uccuaccuguuuugugguca

SEQ ID NO: 1846749 - RNA, 17 nt, Homo sapiens
gaauuaaaaaagcauac

SEQ ID NO: 1846750 - RNA, 23 nt, Homo sapiens
cuggcccucguggguaaaugaca

SEQ ID NO: 1846751 - RNA, 12 nt, Homo sapiens
gacugugggugg

SEQ ID NO: 1846752 - RNA, 18 nt, Homo sapiens
accaaggaaucaugucag

SEQ ID NO: 1846753 - RNA, 18 nt, Homo sapiens
agcagagcagcucugcua

SEQ ID NO: 1846754 - RNA, 15 nt, Homo sapiens
gccuccagugcaguc

SEQ ID NO: 1846755 - RNA, 18 nt, Homo sapiens
accccuccaugauuccaa

SEQ ID NO: 1846756 - RNA, 23 nt, Homo sapiens
uaaggauggauggcacccuggaa

SEQ ID NO: 1846757 - RNA, 15 nt, Homo sapiens
gaagugucuaaugca

SEQ ID NO: 1846758 - RNA, 12 nt, Homo sapiens
gcaaaaccaaac

SEQ ID NO: 1846759 - RNA, 14 nt, Homo sapiens
uauugguuugcaca

SEQ ID NO: 1846760 - RNA, 18 nt, Homo sapiens
cacauugguuuaagccca

SEQ ID NO: 1846761 - RNA, 17 nt, Homo sapiens
uauguuuuaauuccaag

SEQ ID NO: 1846762 - RNA, 19 nt, Homo sapiens
aucuugaaggaacacaaag

SEQ ID NO: 1846763 - RNA, 21 nt, Homo sapiens
uaugcaccuugugucuguaca

SEQ ID NO: 1846764 - RNA, 20 nt, Homo sapiens
gagguucugucuacagggag

SEQ ID NO: 1846765 - RNA, 24 nt, Homo sapiens
aaaauccuauucugaugaaucuca

SEQ ID NO: 1846766 - RNA, 23 nt, Homo sapiens
ucucuuucucauuagagaucuga

SEQ ID NO: 1846767 - RNA, 23 nt, Homo sapiens
acuuuguuugucacaaguggugu

SEQ ID NO: 1846768 - RNA, 15 nt, Homo sapiens
ugcuucagugcugcu

SEQ ID NO: 1846769 - RNA, 19 nt, Homo sapiens
cuacucccucaaagcacac

SEQ ID NO: 1846770 - RNA, 16 nt, Homo sapiens
cauuuuauuacacuaa

SEQ ID NO: 1846771 - RNA, 16 nt, Homo sapiens
ucugucucauaugauu

SEQ ID NO: 1846772 - RNA, 18 nt, Homo sapiens
uaucgcuccuauugaaag

SEQ ID NO: 1846773 - RNA, 21 nt, Homo sapiens
agcggugaccagccugucacc

SEQ ID NO: 1846774 - RNA, 21 nt, Homo sapiens
cacgucugcagaaacagugca

SEQ ID NO: 1846775 - RNA, 14 nt, Homo sapiens
uaacugcauccagc

SEQ ID NO: 1846776 - RNA, 15 nt, Homo sapiens
ugccacauacuugca

SEQ ID NO: 1846777 - RNA, 21 nt, Homo sapiens
cugaagauggcauccugugaa

SEQ ID NO: 1846778 - RNA, 16 nt, Homo sapiens
aacuaaacucauuuau

SEQ ID NO: 1846779 - RNA, 14 nt, Homo sapiens
gaaaaagacugggu

SEQ ID NO: 1846780 - RNA, 16 nt, Homo sapiens
ggguauugcuugccac

SEQ ID NO: 1846781 - RNA, 12 nt, Homo sapiens
uuucauuugcca

SEQ ID NO: 1846782 - RNA, 14 nt, Homo sapiens
caucagccuccucc

SEQ ID NO: 1846783 - RNA, 17 nt, Homo sapiens
uuaccucuuaccuguaa

SEQ ID NO: 1846784 - RNA, 17 nt, Homo sapiens
cucugccaagauccauc

SEQ ID NO: 1846785 - RNA, 21 nt, Homo sapiens
caggaggguauggugcugcuc

SEQ ID NO: 1846786 - RNA, 21 nt, Homo sapiens
caacagacuucucaauaauca

SEQ ID NO: 1846787 - RNA, 12 nt, Homo sapiens
uaaugaugcugu

SEQ ID NO: 1846788 - RNA, 19 nt, Homo sapiens
aagggaguuggugugcuau

SEQ ID NO: 1846789 - RNA, 13 nt, Homo sapiens
auuaaagagccag

SEQ ID NO: 1846790 - RNA, 18 nt, Homo sapiens
uucuggccucagaccaac

SEQ ID NO: 1846791 - RNA, 17 nt, Homo sapiens
accugccccucccucua

SEQ ID NO: 1846792 - RNA, 23 nt, Homo sapiens
ggcuucuccgucacuccauucuc

SEQ ID NO: 1846793 - RNA, 23 nt, Homo sapiens
cccccacguggacucugugcuca

SEQ ID NO: 1846794 - RNA, 15 nt, Homo sapiens
aggcaccugcuggaa

SEQ ID NO: 1846795 - RNA, 13 nt, Homo sapiens
gagggacacuccu

SEQ ID NO: 1846796 - RNA, 16 nt, Homo sapiens
ccucaccacacagucc

SEQ ID NO: 1846797 - RNA, 22 nt, Homo sapiens
ugucuccacuucacuccagcau

SEQ ID NO: 1846798 - RNA, 17 nt, Homo sapiens
uggcagucccuuauaau

SEQ ID NO: 1846799 - RNA, 16 nt, Homo sapiens
ccagggguucugagaa

SEQ ID NO: 1846800 - RNA, 20 nt, Homo sapiens
gacucuaagcugugugcagg

SEQ ID NO: 1846801 - RNA, 16 nt, Homo sapiens
cagcugguuauccaaa

SEQ ID NO: 1846802 - RNA, 16 nt, Homo sapiens
ccugugauuucugugc

SEQ ID NO: 1846803 - RNA, 23 nt, Homo sapiens
ucaccccagccucauugugccaa

SEQ ID NO: 1846804 - RNA, 16 nt, Homo sapiens
aguaucccuacuguaa

SEQ ID NO: 1846805 - RNA, 20 nt, Homo sapiens
ggaacgaauacccugcucaa

SEQ ID NO: 1846806 - RNA, 22 nt, Homo sapiens
auggccccuccacuggggaaug

SEQ ID NO: 1846807 - RNA, 12 nt, Homo sapiens
ggaauaauguaa

SEQ ID NO: 1846808 - RNA, 17 nt, Homo sapiens
aauuuugaugcuuguau

SEQ ID NO: 1846809 - RNA, 11 nt, Homo sapiens
caaaugugcuc

SEQ ID NO: 1846810 - RNA, 14 nt, Homo sapiens
gccauagccccaua

SEQ ID NO: 1846811 - RNA, 20 nt, Homo sapiens
auuuuucacuuaaguugaga

SEQ ID NO: 1846812 - RNA, 18 nt, Homo sapiens
augucauaaaugucacaa

SEQ ID NO: 1846813 - RNA, 20 nt, Homo sapiens
uaguucuguggccaucugcu

SEQ ID NO: 1846814 - RNA, 19 nt, Homo sapiens
ugcccggccuaugauucuu

SEQ ID NO: 1846815 - RNA, 19 nt, Homo sapiens
gcucuccccacccagaccu

SEQ ID NO: 1846816 - RNA, 20 nt, Homo sapiens
aaaaguagagcaaaacuaua

SEQ ID NO: 1846817 - RNA, 16 nt, Homo sapiens
cccaucuuacuggaag

SEQ ID NO: 1846818 - RNA, 16 nt, Homo sapiens
acuugagaauuacccu

SEQ ID NO: 1846819 - RNA, 18 nt, Homo sapiens
uuccuacaaguuuaagua

SEQ ID NO: 1846820 - RNA, 22 nt, Homo sapiens
aguuucgacguuugacuagcca

SEQ ID NO: 1846821 - RNA, 12 nt, Homo sapiens
uauagauucuaa

SEQ ID NO: 1846822 - RNA, 14 nt, Homo sapiens
ucaccucugucagc

SEQ ID NO: 1846823 - RNA, 16 nt, Homo sapiens
aaaaugccuacacagu

SEQ ID NO: 1846824 - RNA, 15 nt, Homo sapiens
cagaaauaaacauug

SEQ ID NO: 1846825 - RNA, 19 nt, Homo sapiens
uucccccgcuuuggacaga

SEQ ID NO: 1846826 - RNA, 12 nt, Homo sapiens
agcacaaagaca

SEQ ID NO: 1846827 - RNA, 18 nt, Homo sapiens
augacaauguuuacucaa

SEQ ID NO: 1846828 - RNA, 21 nt, Homo sapiens
caaaggacuugacuugcaauu

SEQ ID NO: 1846829 - RNA, 19 nt, Homo sapiens
ugucacuacaaaaauacaa

SEQ ID NO: 1846830 - RNA, 21 nt, Homo sapiens
cguggagacugagaucacuga

SEQ ID NO: 1846831 - RNA, 16 nt, Homo sapiens
gcaauaacucucuaca

SEQ ID NO: 1846832 - RNA, 14 nt, Homo sapiens
gucccgcacagugg

SEQ ID NO: 1846833 - RNA, 12 nt, Homo sapiens
auugaagcaacu

SEQ ID NO: 1846834 - RNA, 13 nt, Homo sapiens
auuaacucugcau

SEQ ID NO: 1846835 - RNA, 24 nt, Homo sapiens
cccuaaccccuaugaacucuugau

SEQ ID NO: 1846836 - RNA, 13 nt, Homo sapiens
augauuaaugugu

SEQ ID NO: 1846837 - RNA, 22 nt, Homo sapiens
uuacaccguuguuguuuuacau

SEQ ID NO: 1846838 - RNA, 22 nt, Homo sapiens
auuuuuauaauucagaagacua

SEQ ID NO: 1846839 - RNA, 22 nt, Homo sapiens
cugggacuuuguaaacuuccaa

SEQ ID NO: 1846840 - RNA, 14 nt, Homo sapiens
aucucuuuugugga

SEQ ID NO: 1846841 - RNA, 14 nt, Homo sapiens
auguguaacaggau

SEQ ID NO: 1846842 - RNA, 20 nt, Homo sapiens
acaucagcagagaacuggaa

SEQ ID NO: 1846843 - RNA, 14 nt, Homo sapiens
cuguucauugccuc

SEQ ID NO: 1846844 - RNA, 23 nt, Homo sapiens
aacauaagagagccuugguucau

SEQ ID NO: 1846845 - RNA, 17 nt, Homo sapiens
cuaguaacaguauuucc

SEQ ID NO: 1846846 - RNA, 12 nt, Homo sapiens
agcuaccaggaa

SEQ ID NO: 1846847 - RNA, 17 nt, Homo sapiens
cuccuggaguugcauug

SEQ ID NO: 1846848 - RNA, 21 nt, Homo sapiens
auuuuggaaauaggcauauca

SEQ ID NO: 1846849 - RNA, 15 nt, Homo sapiens
ugauggggccugggu

SEQ ID NO: 1846850 - RNA, 20 nt, Homo sapiens
uuugaaaaauauugcuaaaa

SEQ ID NO: 1846851 - RNA, 16 nt, Homo sapiens
cuaggaccucauaucu

SEQ ID NO: 1846852 - RNA, 16 nt, Homo sapiens
uaaggcuuaggugcca

SEQ ID NO: 1846853 - RNA, 21 nt, Homo sapiens
ggaggggcugcuggacccaag

SEQ ID NO: 1846854 - RNA, 15 nt, Homo sapiens
uacgccagaacugcu

SEQ ID NO: 1846855 - RNA, 17 nt, Homo sapiens
ucaauuccuguccuuca

SEQ ID NO: 1846856 - RNA, 20 nt, Homo sapiens
uaaagaaaauaaacaccauu

SEQ ID NO: 1846857 - RNA, 14 nt, Homo sapiens
uguugucaaaaagu

SEQ ID NO: 1846858 - RNA, 15 nt, Homo sapiens
ucaaucauugagugg

SEQ ID NO: 1846859 - RNA, 16 nt, Homo sapiens
gugugcauguguguaa

SEQ ID NO: 1846860 - RNA, 16 nt, Homo sapiens
gugugcaaguguguau

SEQ ID NO: 1846861 - RNA, 18 nt, Homo sapiens
gcguauuuuguauuuaaa

SEQ ID NO: 1846862 - RNA, 12 nt, Homo sapiens
aaacuuauuuca

SEQ ID NO: 1846863 - RNA, 16 nt, Homo sapiens
cuuuaacagcugauaa

SEQ ID NO: 1846864 - RNA, 14 nt, Homo sapiens
uguccaugugcaaa

SEQ ID NO: 1846865 - RNA, 14 nt, Homo sapiens
gcccucuguagcuc

SEQ ID NO: 1846866 - RNA, 18 nt, Homo sapiens
auuacaggcgugagccac

SEQ ID NO: 1846867 - RNA, 19 nt, Homo sapiens
acuguagcaagaugcaaau

SEQ ID NO: 1846868 - RNA, 21 nt, Homo sapiens
ggccccacccuuuccucuuaa

SEQ ID NO: 1846869 - RNA, 20 nt, Homo sapiens
uacaucaaguccaucugaca

SEQ ID NO: 1846870 - RNA, 19 nt, Homo sapiens
gccaauuuuuccagcauuu

SEQ ID NO: 1846871 - RNA, 19 nt, Homo sapiens
caucauuucccaagcagac

SEQ ID NO: 1846872 - RNA, 19 nt, Homo sapiens
gccucggcaggaccccugg

SEQ ID NO: 1846873 - RNA, 21 nt, Homo sapiens
ugugaaucugaaagacuugaa

SEQ ID NO: 1846874 - RNA, 22 nt, Homo sapiens
ccuaagcacguagagaugauuc

SEQ ID NO: 1846875 - RNA, 19 nt, Homo sapiens
ugaacuauuagagcugccu

SEQ ID NO: 1846876 - RNA, 16 nt, Homo sapiens
aaguacagaacauauc

SEQ ID NO: 1846877 - RNA, 13 nt, Homo sapiens
augagucccauuu

SEQ ID NO: 1846878 - RNA, 19 nt, Homo sapiens
accacugggcaaacagaag

SEQ ID NO: 1846879 - RNA, 19 nt, Homo sapiens
ggaaugauugguagcaaag

SEQ ID NO: 1846880 - RNA, 18 nt, Homo sapiens
gacuuuuucaaagauuua

SEQ ID NO: 1846881 - RNA, 19 nt, Homo sapiens
ucuucccacuuugccacug

SEQ ID NO: 1846882 - RNA, 16 nt, Homo sapiens
acacacauugcagcuu

SEQ ID NO: 1846883 - RNA, 17 nt, Homo sapiens
cuagacuucugaguaau

SEQ ID NO: 1846884 - RNA, 14 nt, Homo sapiens
gcucacuacauggg

SEQ ID NO: 1846885 - RNA, 17 nt, Homo sapiens
aucccccuggggcacuu

SEQ ID NO: 1846886 - RNA, 12 nt, Homo sapiens
uguuuuccaaag

SEQ ID NO: 1846887 - RNA, 18 nt, Homo sapiens
ccuccaccacaucugcca

SEQ ID NO: 1846888 - RNA, 17 nt, Homo sapiens
gaaggaaccagcaauga

SEQ ID NO: 1846889 - RNA, 19 nt, Homo sapiens
uagauuucccuauugugac

SEQ ID NO: 1846890 - RNA, 22 nt, Homo sapiens
acugggaaccuagcuacacuga

SEQ ID NO: 1846891 - RNA, 16 nt, Homo sapiens
cugccuguauuugaga

SEQ ID NO: 1846892 - RNA, 21 nt, Homo sapiens
uagugauguccuuaaaaugug

SEQ ID NO: 1846893 - RNA, 17 nt, Homo sapiens
uugagauuuagagcaau

SEQ ID NO: 1846894 - RNA, 16 nt, Homo sapiens
caaauuuuucaucucu

SEQ ID NO: 1846895 - RNA, 20 nt, Homo sapiens
aauggcgcgaucuuggcuca

SEQ ID NO: 1846896 - RNA, 18 nt, Homo sapiens
cucuuccugucuuaccaa

SEQ ID NO: 1846897 - RNA, 12 nt, Homo sapiens
aagaaacaugau

SEQ ID NO: 1846898 - RNA, 23 nt, Homo sapiens
gcuuguuuacagcacuacucugu

SEQ ID NO: 1846899 - RNA, 21 nt, Homo sapiens
gaggcagcauugcacagugaa

SEQ ID NO: 1846900 - RNA, 18 nt, Homo sapiens
aagauaaaagaauggcca

SEQ ID NO: 1846901 - RNA, 16 nt, Homo sapiens
gcucauaaacugccaa

SEQ ID NO: 1846902 - RNA, 20 nt, Homo sapiens
aggccccuuuggaccugcag

SEQ ID NO: 1846903 - RNA, 17 nt, Homo sapiens
cugugccagcacaaagu

SEQ ID NO: 1846904 - RNA, 19 nt, Homo sapiens
ucuuuaugaaguuugcuau

SEQ ID NO: 1846905 - RNA, 16 nt, Homo sapiens
gagaaggugcagguga

SEQ ID NO: 1846906 - RNA, 23 nt, Homo sapiens
acaguuucguagcaugaguuuaa

SEQ ID NO: 1846907 - RNA, 21 nt, Homo sapiens
auccaccccguugcucaagcc

SEQ ID NO: 1846908 - RNA, 20 nt, Homo sapiens
ccuguuccccaaggacucuu

SEQ ID NO: 1846909 - RNA, 13 nt, Homo sapiens
cucaauagcuuga

SEQ ID NO: 1846910 - RNA, 17 nt, Homo sapiens
uuggggauucaaaaaca

SEQ ID NO: 1846911 - RNA, 23 nt, Homo sapiens
cucaccugucgcacccacuguga

SEQ ID NO: 1846912 - RNA, 16 nt, Homo sapiens
cagcugaacacccucc

SEQ ID NO: 1846913 - RNA, 18 nt, Homo sapiens
auaugcaccuugugucug

SEQ ID NO: 1846914 - RNA, 21 nt, Homo sapiens
cacccuuguccuugagugcuc

SEQ ID NO: 1846915 - RNA, 17 nt, Homo sapiens
auaguggcuuaacugga

SEQ ID NO: 1846916 - RNA, 21 nt, Homo sapiens
cugaccacuuuggagcacugu

SEQ ID NO: 1846917 - RNA, 18 nt, Homo sapiens
uugcugcuugugaucuca

SEQ ID NO: 1846918 - RNA, 14 nt, Homo sapiens
aauguaucugugaa

SEQ ID NO: 1846919 - RNA, 16 nt, Homo sapiens
guccagguuaguuuac

SEQ ID NO: 1846920 - RNA, 17 nt, Homo sapiens
uaaggacaaagugccaa

SEQ ID NO: 1846921 - RNA, 16 nt, Homo sapiens
aucuguggucuucaaa

SEQ ID NO: 1846922 - RNA, 14 nt, Homo sapiens
ucccucuuugccug

SEQ ID NO: 1846923 - RNA, 18 nt, Homo sapiens
aaaaugcugcuuucugcc

SEQ ID NO: 1846924 - RNA, 21 nt, Homo sapiens
cacugugucccucucucugga

SEQ ID NO: 1846925 - RNA, 20 nt, Homo sapiens
cacauuagagggacagccaa

SEQ ID NO: 1846926 - RNA, 21 nt, Homo sapiens
aaaugucuucuguauucacuu

SEQ ID NO: 1846927 - RNA, 23 nt, Homo sapiens
cuucacaaaccagagaccaaaug

SEQ ID NO: 1846928 - RNA, 16 nt, Homo sapiens
cuguggccugucucua

SEQ ID NO: 1846929 - RNA, 22 nt, Homo sapiens
ugaaaacacaugagauugaauc

SEQ ID NO: 1846930 - RNA, 10 nt, Homo sapiens
gacaaaaaua

SEQ ID NO: 1846931 - RNA, 15 nt, Homo sapiens
gcuucaguucagcuu

SEQ ID NO: 1846932 - RNA, 20 nt, Homo sapiens
cucaagguucucauuucuca

SEQ ID NO: 1846933 - RNA, 20 nt, Homo sapiens
cauucaggagcuuccugucc

SEQ ID NO: 1846934 - RNA, 21 nt, Homo sapiens
ccauggugaaaggguuugaua

SEQ ID NO: 1846935 - RNA, 14 nt, Homo sapiens
uggcaucuaucugg

SEQ ID NO: 1846936 - RNA, 15 nt, Homo sapiens
gcaacgcuccucuga

SEQ ID NO: 1846937 - RNA, 19 nt, Homo sapiens
aaccuccaccuccggguuc

SEQ ID NO: 1846938 - RNA, 23 nt, Homo sapiens
ucucucagcccaggucuccuggg

SEQ ID NO: 1846939 - RNA, 18 nt, Homo sapiens
ggaaaugggggggcgggg

SEQ ID NO: 1846940 - RNA, 23 nt, Homo sapiens
accagcagcuggaaucugaaggc

SEQ ID NO: 1846941 - RNA, 18 nt, Homo sapiens
uuuguuaugacagugaau

SEQ ID NO: 1846942 - RNA, 20 nt, Homo sapiens
ugagguuuccgggggaugaa

SEQ ID NO: 1846943 - RNA, 13 nt, Homo sapiens
uugcuuaugaaag

SEQ ID NO: 1846944 - RNA, 22 nt, Homo sapiens
caccaagcugcuguggccauca

SEQ ID NO: 1846945 - RNA, 17 nt, Homo sapiens
gaacugcguggugcucu

SEQ ID NO: 1846946 - RNA, 16 nt, Homo sapiens
agcccuauuucuugau

SEQ ID NO: 1846947 - RNA, 22 nt, Homo sapiens
ugaucuuguaaaaauagcaaaa

SEQ ID NO: 1846948 - RNA, 15 nt, Homo sapiens
gaagggacuggucca

SEQ ID NO: 1846949 - RNA, 17 nt, Homo sapiens
aaggcugaccaagagag

SEQ ID NO: 1846950 - RNA, 23 nt, Homo sapiens
uaacagauaauagcaacuuggga

SEQ ID NO: 1846951 - RNA, 16 nt, Homo sapiens
uuccucagcaggccaa

SEQ ID NO: 1846952 - RNA, 22 nt, Homo sapiens
cagaguuuuagaaaugagaucu

SEQ ID NO: 1846953 - RNA, 21 nt, Homo sapiens
ugggagauguggaaaagccaa

SEQ ID NO: 1846954 - RNA, 21 nt, Homo sapiens
caucuaugggagagugucaac

SEQ ID NO: 1846955 - RNA, 20 nt, Homo sapiens
gcaugagagaauuguaucau

SEQ ID NO: 1846956 - RNA, 22 nt, Homo sapiens
uccccaaaagaaaccaugacaa

SEQ ID NO: 1846957 - RNA, 22 nt, Homo sapiens
guuauuuuuucagacugugcaa

SEQ ID NO: 1846958 - RNA, 17 nt, Homo sapiens
uuccgagauccaccaga

SEQ ID NO: 1846959 - RNA, 21 nt, Homo sapiens
uguguaagacacugugcaaau

SEQ ID NO: 1846960 - RNA, 21 nt, Homo sapiens
auuuucaagagagugugacuc

SEQ ID NO: 1846961 - RNA, 17 nt, Homo sapiens
ugcugcugcucauucca

SEQ ID NO: 1846962 - RNA, 21 nt, Homo sapiens
cacuuuacacaagaaucuaga

SEQ ID NO: 1846963 - RNA, 21 nt, Homo sapiens
cauuuuuaguagagacagggu

SEQ ID NO: 1846964 - RNA, 15 nt, Homo sapiens
uaacaagaguuuuaa

SEQ ID NO: 1846965 - RNA, 19 nt, Homo sapiens
accuccuuguguugcacug

SEQ ID NO: 1846966 - RNA, 18 nt, Homo sapiens
gcaugucucccuccaguc

SEQ ID NO: 1846967 - RNA, 15 nt, Homo sapiens
cccuagaccauguca

SEQ ID NO: 1846968 - RNA, 22 nt, Homo sapiens
gacucuuuuuuugagugacagc

SEQ ID NO: 1846969 - RNA, 20 nt, Homo sapiens
guuuauggggcucucacaga

SEQ ID NO: 1846970 - RNA, 21 nt, Homo sapiens
agucucaaagguaauucugaa

SEQ ID NO: 1846971 - RNA, 14 nt, Homo sapiens
uucauccaaugcag

SEQ ID NO: 1846972 - RNA, 11 nt, Homo sapiens
agccaagggau

SEQ ID NO: 1846973 - RNA, 18 nt, Homo sapiens
ucaagcaauugucugccu

SEQ ID NO: 1846974 - RNA, 20 nt, Homo sapiens
uucuuuggaaaccaccuuaa

SEQ ID NO: 1846975 - RNA, 16 nt, Homo sapiens
uguaaucucagcacuu

SEQ ID NO: 1846976 - RNA, 17 nt, Homo sapiens
caucacugauucccucu

SEQ ID NO: 1846977 - RNA, 15 nt, Homo sapiens
gucuuggacacugua

SEQ ID NO: 1846978 - RNA, 15 nt, Homo sapiens
cucucagcugaccau

SEQ ID NO: 1846979 - RNA, 11 nt, Homo sapiens
gcacaugcaca

SEQ ID NO: 1846980 - RNA, 15 nt, Homo sapiens
ucaaacaacauucca

SEQ ID NO: 1846981 - RNA, 14 nt, Homo sapiens
uuauuaaugacaaa

SEQ ID NO: 1846982 - RNA, 14 nt, Homo sapiens
agccccuguagaac

SEQ ID NO: 1846983 - RNA, 17 nt, Homo sapiens
uuuaguucuuacugcuu

SEQ ID NO: 1846984 - RNA, 17 nt, Homo sapiens
gagaguaccuguguguu

SEQ ID NO: 1846985 - RNA, 15 nt, Homo sapiens
gaauucuccaaaaca

SEQ ID NO: 1846986 - RNA, 18 nt, Homo sapiens
ccucgaaagugucaucaa

SEQ ID NO: 1846987 - RNA, 20 nt, Homo sapiens
ccauggcaaaguggauccag

SEQ ID NO: 1846988 - RNA, 14 nt, Homo sapiens
cccuuuucagaaua

SEQ ID NO: 1846989 - RNA, 16 nt, Homo sapiens
auucacauaucugcuu

SEQ ID NO: 1846990 - RNA, 13 nt, Homo sapiens
uuuugaacauacu

SEQ ID NO: 1846991 - RNA, 23 nt, Homo sapiens
aaaggaauuugcauccagcagca

SEQ ID NO: 1846992 - RNA, 20 nt, Homo sapiens
uaaauuaugggaaucaagau

SEQ ID NO: 1846993 - RNA, 15 nt, Homo sapiens
ucauuucuacuguga

SEQ ID NO: 1846994 - RNA, 15 nt, Homo sapiens
auugugauuuauuuc

SEQ ID NO: 1846995 - RNA, 22 nt, Homo sapiens
agaccucucaacagaucugugg

SEQ ID NO: 1846996 - RNA, 16 nt, Homo sapiens
ggugacgguugggagc

SEQ ID NO: 1846997 - RNA, 17 nt, Homo sapiens
aaugucauuagauccuu

SEQ ID NO: 1846998 - RNA, 17 nt, Homo sapiens
ggccugcaccgacccga

SEQ ID NO: 1846999 - RNA, 15 nt, Homo sapiens
cucucucauacccuc

SEQ ID NO: 1847000 - RNA, 19 nt, Homo sapiens
cuccacccuauauguagua

SEQ ID NO: 1847001 - RNA, 23 nt, Homo sapiens
uaaccauaguuauuuacuugaaa

SEQ ID NO: 1847002 - RNA, 13 nt, Homo sapiens
guguuuaaacuga

SEQ ID NO: 1847003 - RNA, 21 nt, Homo sapiens
aggcaucuaagacauucacca

SEQ ID NO: 1847004 - RNA, 20 nt, Homo sapiens
gagaagggaagaaggggcca

SEQ ID NO: 1847005 - RNA, 20 nt, Homo sapiens
gcccaauggagaaaugaagc

SEQ ID NO: 1847006 - RNA, 16 nt, Homo sapiens
aggacagaaagaucuu

SEQ ID NO: 1847007 - RNA, 16 nt, Homo sapiens
ccugccuaaggaagcu

SEQ ID NO: 1847008 - RNA, 12 nt, Homo sapiens
gagggagugcug

SEQ ID NO: 1847009 - RNA, 22 nt, Homo sapiens
agguggauuccgaguggugaca

SEQ ID NO: 1847010 - RNA, 23 nt, Homo sapiens
ucacuuugcucucaauuaaaguc

SEQ ID NO: 1847011 - RNA, 22 nt, Homo sapiens
guacaaaaauaaauuuauauga

SEQ ID NO: 1847012 - RNA, 21 nt, Homo sapiens
cgcccacguggcagaccguga

SEQ ID NO: 1847013 - RNA, 18 nt, Homo sapiens
gcauuuucuuagaccucu

SEQ ID NO: 1847014 - RNA, 16 nt, Homo sapiens
cagccaggacaucucu

SEQ ID NO: 1847015 - RNA, 19 nt, Homo sapiens
guggagggugaccacaccu

SEQ ID NO: 1847016 - RNA, 17 nt, Homo sapiens
gagcgugaaucuguauc

SEQ ID NO: 1847017 - RNA, 16 nt, Homo sapiens
ccucaacagccaagug

SEQ ID NO: 1847018 - RNA, 15 nt, Homo sapiens
ccgaagaaggguccu

SEQ ID NO: 1847019 - RNA, 20 nt, Homo sapiens
cccgcagagcccaccuugag

SEQ ID NO: 1847020 - RNA, 13 nt, Homo sapiens
gacuucagacucu

SEQ ID NO: 1847021 - RNA, 14 nt, Homo sapiens
uuggcaaguguaaa

SEQ ID NO: 1847022 - RNA, 23 nt, Homo sapiens
uggagcaccugggccccacugga

SEQ ID NO: 1847023 - RNA, 14 nt, Homo sapiens
auaauaagacuuuu

SEQ ID NO: 1847024 - RNA, 20 nt, Homo sapiens
caccucccaccccacuccag

SEQ ID NO: 1847025 - RNA, 20 nt, Homo sapiens
caccaugucaaggguucaag

SEQ ID NO: 1847026 - RNA, 14 nt, Homo sapiens
uaggauaucuuggc

SEQ ID NO: 1847027 - RNA, 22 nt, Homo sapiens
ugcaagaacucaucacuguggc

SEQ ID NO: 1847028 - RNA, 17 nt, Homo sapiens
uguuucagggggccuuu

SEQ ID NO: 1847029 - RNA, 15 nt, Homo sapiens
ugaguuucucuccac

SEQ ID NO: 1847030 - RNA, 19 nt, Homo sapiens
caaauucuguuucuugaga

SEQ ID NO: 1847031 - RNA, 16 nt, Homo sapiens
cuguaaauuccaaaga

SEQ ID NO: 1847032 - RNA, 16 nt, Homo sapiens
augagggaacugugua

SEQ ID NO: 1847033 - RNA, 17 nt, Homo sapiens
aucaauauacauaauac

SEQ ID NO: 1847034 - RNA, 19 nt, Homo sapiens
ucgauuauucccuguacaa

SEQ ID NO: 1847035 - RNA, 20 nt, Homo sapiens
aagucaugaagcccaaguga

SEQ ID NO: 1847036 - RNA, 22 nt, Homo sapiens
auaaauuuaaacuuacaaacuu

SEQ ID NO: 1847037 - RNA, 17 nt, Homo sapiens
ucaacaugugugacugc

SEQ ID NO: 1847038 - RNA, 21 nt, Homo sapiens
cagggcaaaagggcagcugug

SEQ ID NO: 1847039 - RNA, 18 nt, Homo sapiens
accccuucccgcccuccc

SEQ ID NO: 1847040 - RNA, 22 nt, Homo sapiens
gaaggccagcccacacccagcu

SEQ ID NO: 1847041 - RNA, 19 nt, Homo sapiens
ucuacgugauuuggcugca

SEQ ID NO: 1847042 - RNA, 19 nt, Homo sapiens
agcaggacccaguggucag

SEQ ID NO: 1847043 - RNA, 14 nt, Homo sapiens
agccaggacaucuc

SEQ ID NO: 1847044 - RNA, 20 nt, Homo sapiens
caugguccuguggacuccuc

SEQ ID NO: 1847045 - RNA, 23 nt, Homo sapiens
caucuuuuuuugguucuuugguc

SEQ ID NO: 1847046 - RNA, 19 nt, Homo sapiens
uauggaaaaaaugaacuuu

SEQ ID NO: 1847047 - RNA, 15 nt, Homo sapiens
caagcacacuggaau

SEQ ID NO: 1847048 - RNA, 19 nt, Homo sapiens
uuagucuuuuguaauauca

SEQ ID NO: 1847049 - RNA, 18 nt, Homo sapiens
ugauucuaaaaugucuca

SEQ ID NO: 1847050 - RNA, 19 nt, Homo sapiens
cgguugcagucacugugau

SEQ ID NO: 1847051 - RNA, 22 nt, Homo sapiens
gaagcuacgggcacaacuggaa

SEQ ID NO: 1847052 - RNA, 14 nt, Homo sapiens
cauagucauuuagg

SEQ ID NO: 1847053 - RNA, 21 nt, Homo sapiens
gcaguggcgugaucucagcuc

SEQ ID NO: 1847054 - RNA, 22 nt, Homo sapiens
uggucuacccgugucuagaggc

SEQ ID NO: 1847055 - RNA, 14 nt, Homo sapiens
cuuagugcaaaaaa

SEQ ID NO: 1847056 - RNA, 16 nt, Homo sapiens
ucgggaccacaucugu

SEQ ID NO: 1847057 - RNA, 19 nt, Homo sapiens
guauuccgauacaaagugu

SEQ ID NO: 1847058 - RNA, 12 nt, Homo sapiens
aaauauugucau

SEQ ID NO: 1847059 - RNA, 14 nt, Homo sapiens
ugcuccacagggcc

SEQ ID NO: 1847060 - RNA, 19 nt, Homo sapiens
cucuuaaucacuacuguau

SEQ ID NO: 1847061 - RNA, 23 nt, Homo sapiens
acugccgccuacuggacgcugcc

SEQ ID NO: 1847062 - RNA, 12 nt, Homo sapiens
aucucucuggag

SEQ ID NO: 1847063 - RNA, 15 nt, Homo sapiens
gguuccccaauccau

SEQ ID NO: 1847064 - RNA, 15 nt, Homo sapiens
agcucacagcacauu

SEQ ID NO: 1847065 - RNA, 13 nt, Homo sapiens
accuucuuccaca

SEQ ID NO: 1847066 - RNA, 13 nt, Homo sapiens
accugcaacacaa

SEQ ID NO: 1847067 - RNA, 15 nt, Homo sapiens
guuuucagcuuuaag

SEQ ID NO: 1847068 - RNA, 16 nt, Homo sapiens
auucaaaggcauuucu

SEQ ID NO: 1847069 - RNA, 20 nt, Homo sapiens
agucagaaaauuagcaugaa

SEQ ID NO: 1847070 - RNA, 21 nt, Homo sapiens
accaguauggccccaccugcu

SEQ ID NO: 1847071 - RNA, 21 nt, Homo sapiens
auugauaauuuagacauugag

SEQ ID NO: 1847072 - RNA, 15 nt, Homo sapiens
caccucaggagcuuu

SEQ ID NO: 1847073 - RNA, 18 nt, Homo sapiens
cuaaaagaaacuaugaug

SEQ ID NO: 1847074 - RNA, 19 nt, Homo sapiens
uaauaaaacuuaacuucca

SEQ ID NO: 1847075 - RNA, 18 nt, Homo sapiens
uccugaccucgugaucua

SEQ ID NO: 1847076 - RNA, 16 nt, Homo sapiens
gcccucagacauuuau

SEQ ID NO: 1847077 - RNA, 17 nt, Homo sapiens
cacaugaccacauagca

SEQ ID NO: 1847078 - RNA, 18 nt, Homo sapiens
gacaggauaagagggauu

SEQ ID NO: 1847079 - RNA, 13 nt, Homo sapiens
aauccaaauuccc

SEQ ID NO: 1847080 - RNA, 12 nt, Homo sapiens
gauagcacuuuc

SEQ ID NO: 1847081 - RNA, 20 nt, Homo sapiens
ugcuggacgccgagaaggcc

SEQ ID NO: 1847082 - RNA, 18 nt, Homo sapiens
aauaauaugcugccaaau

SEQ ID NO: 1847083 - RNA, 19 nt, Homo sapiens
aguuaccauuaaaccaucu

SEQ ID NO: 1847084 - RNA, 13 nt, Homo sapiens
aguaaugaugucg

SEQ ID NO: 1847085 - RNA, 20 nt, Homo sapiens
cucaauaccccuaguaucug

SEQ ID NO: 1847086 - RNA, 13 nt, Homo sapiens
agcaccaagcuca

SEQ ID NO: 1847087 - RNA, 16 nt, Homo sapiens
uuucaucagaggaaaa

SEQ ID NO: 1847088 - RNA, 20 nt, Homo sapiens
aaaaauauuugcugagugaa

SEQ ID NO: 1847089 - RNA, 19 nt, Homo sapiens
caagcuuagugagcaguga

SEQ ID NO: 1847090 - RNA, 22 nt, Homo sapiens
ugcagugaaguguucugcugag

SEQ ID NO: 1847091 - RNA, 18 nt, Homo sapiens
uuaccucugcauaaauau

SEQ ID NO: 1847092 - RNA, 18 nt, Homo sapiens
accaugccuuccucagua

SEQ ID NO: 1847093 - RNA, 15 nt, Homo sapiens
gaaggaaaagcaugu

SEQ ID NO: 1847094 - RNA, 16 nt, Homo sapiens
aagugucuugggcuca

SEQ ID NO: 1847095 - RNA, 15 nt, Homo sapiens
ccugaagcaaauggg

SEQ ID NO: 1847096 - RNA, 20 nt, Homo sapiens
gagcucuggguugugcacau

SEQ ID NO: 1847097 - RNA, 19 nt, Homo sapiens
ucacauagguguugucaag

SEQ ID NO: 1847098 - RNA, 12 nt, Homo sapiens
cacuucaucuga

SEQ ID NO: 1847099 - RNA, 15 nt, Homo sapiens
gucugucucugucau

SEQ ID NO: 1847100 - RNA, 22 nt, Homo sapiens
uccaagccauucacuuccccaa

SEQ ID NO: 1847101 - RNA, 19 nt, Homo sapiens
aaggacuuagugcaucaga

SEQ ID NO: 1847102 - RNA, 18 nt, Homo sapiens
gcaagaaccaguguuuag

SEQ ID NO: 1847103 - RNA, 12 nt, Homo sapiens
uaccaaggccca

SEQ ID NO: 1847104 - RNA, 13 nt, Homo sapiens
ccucacucagcuc

SEQ ID NO: 1847105 - RNA, 19 nt, Homo sapiens
ugguuuggcuuccuauucu

SEQ ID NO: 1847106 - RNA, 19 nt, Homo sapiens
ccugaucauggucagcuca

SEQ ID NO: 1847107 - RNA, 20 nt, Homo sapiens
acugacccucaggcacaccu

SEQ ID NO: 1847108 - RNA, 12 nt, Homo sapiens
gaacaaauacac

SEQ ID NO: 1847109 - RNA, 20 nt, Homo sapiens
auaaaagcuauggugagaug

SEQ ID NO: 1847110 - RNA, 15 nt, Homo sapiens
uugaacugcugccaa

SEQ ID NO: 1847111 - RNA, 18 nt, Homo sapiens
aaggccucccacagugac

SEQ ID NO: 1847112 - RNA, 21 nt, Homo sapiens
ucuuggccucaagcgauccuc

SEQ ID NO: 1847113 - RNA, 19 nt, Homo sapiens
guccacuguucuguucuca

SEQ ID NO: 1847114 - RNA, 22 nt, Homo sapiens
auuccucaaaaaauugcacaua

SEQ ID NO: 1847115 - RNA, 15 nt, Homo sapiens
gugagcacaaaggua

SEQ ID NO: 1847116 - RNA, 17 nt, Homo sapiens
uugcaguuauuucaaaa

SEQ ID NO: 1847117 - RNA, 20 nt, Homo sapiens
caacuuuuuaccuaguacaa

SEQ ID NO: 1847118 - RNA, 16 nt, Homo sapiens
auggggcaggccaccu

SEQ ID NO: 1847119 - RNA, 18 nt, Homo sapiens
acugccauggaggcacac

SEQ ID NO: 1847120 - RNA, 18 nt, Homo sapiens
aacaaacauccuugcaaa

SEQ ID NO: 1847121 - RNA, 19 nt, Homo sapiens
guccuucgcccugugcacc

SEQ ID NO: 1847122 - RNA, 17 nt, Homo sapiens
uuaugugacuugcaaua

SEQ ID NO: 1847123 - RNA, 21 nt, Homo sapiens
ggaaggccccucuguggagcg

SEQ ID NO: 1847124 - RNA, 15 nt, Homo sapiens
ucuguaucagucuuu

SEQ ID NO: 1847125 - RNA, 15 nt, Homo sapiens
aguguugcucucuag

SEQ ID NO: 1847126 - RNA, 13 nt, Homo sapiens
gcaugacacucua

SEQ ID NO: 1847127 - RNA, 19 nt, Homo sapiens
gccuccucccauccagcgu

SEQ ID NO: 1847128 - RNA, 21 nt, Homo sapiens
uguuguaaaagaugcagagua

SEQ ID NO: 1847129 - RNA, 20 nt, Homo sapiens
ugacucaccuugcucugcca

SEQ ID NO: 1847130 - RNA, 15 nt, Homo sapiens
gauguuuuaguuuaa

SEQ ID NO: 1847131 - RNA, 23 nt, Homo sapiens
ugccuaacuuauccaucuuugaa

SEQ ID NO: 1847132 - RNA, 15 nt, Homo sapiens
gcucagcauuuccac

SEQ ID NO: 1847133 - RNA, 14 nt, Homo sapiens
auuucuaaucaaaa

SEQ ID NO: 1847134 - RNA, 21 nt, Homo sapiens
cucuccccagccuccccgugc

SEQ ID NO: 1847135 - RNA, 20 nt, Homo sapiens
gguuuggcuuccuauucuca

SEQ ID NO: 1847136 - RNA, 13 nt, Homo sapiens
uuacagcacacac

SEQ ID NO: 1847137 - RNA, 17 nt, Homo sapiens
caaggccugguguuucu

SEQ ID NO: 1847138 - RNA, 16 nt, Homo sapiens
ccagagacaagcagag

SEQ ID NO: 1847139 - RNA, 22 nt, Homo sapiens
caggggcccgcgauguggaacu

SEQ ID NO: 1847140 - RNA, 23 nt, Homo sapiens
cucaacauuguguucccauuuca

SEQ ID NO: 1847141 - RNA, 14 nt, Homo sapiens
uguuuauuacuuau

SEQ ID NO: 1847142 - RNA, 23 nt, Homo sapiens
acauuuuacuuuuuccuggcuca

SEQ ID NO: 1847143 - RNA, 18 nt, Homo sapiens
ggccccccaaagugcugg

SEQ ID NO: 1847144 - RNA, 17 nt, Homo sapiens
ccugcaaagggaacuga

SEQ ID NO: 1847145 - RNA, 18 nt, Homo sapiens
uguaaauauuguuuugca

SEQ ID NO: 1847146 - RNA, 19 nt, Homo sapiens
accugcucaucauauucca

SEQ ID NO: 1847147 - RNA, 15 nt, Homo sapiens
cagccugggugcaca

SEQ ID NO: 1847148 - RNA, 16 nt, Homo sapiens
uaaugagacugaccau

SEQ ID NO: 1847149 - RNA, 14 nt, Homo sapiens
uauucaacaguaug

SEQ ID NO: 1847150 - RNA, 14 nt, Homo sapiens
ggauucaggaaaag

SEQ ID NO: 1847151 - RNA, 15 nt, Homo sapiens
uugugauuguggaag

SEQ ID NO: 1847152 - RNA, 14 nt, Homo sapiens
cacacacacaugcu

SEQ ID NO: 1847153 - RNA, 14 nt, Homo sapiens
ccuucugccuuugu

SEQ ID NO: 1847154 - RNA, 16 nt, Homo sapiens
agccaggccccacccc

SEQ ID NO: 1847155 - RNA, 17 nt, Homo sapiens
cuagaagaaagggcaag

SEQ ID NO: 1847156 - RNA, 21 nt, Homo sapiens
uccuccaggguggcagcaaca

SEQ ID NO: 1847157 - RNA, 17 nt, Homo sapiens
cauuuaaauugacuuca

SEQ ID NO: 1847158 - RNA, 17 nt, Homo sapiens
caaugaguaacaggaaa

SEQ ID NO: 1847159 - RNA, 17 nt, Homo sapiens
aaauaaagcuguucuca

SEQ ID NO: 1847160 - RNA, 22 nt, Homo sapiens
uacuuuccacauauagagcucc

SEQ ID NO: 1847161 - RNA, 16 nt, Homo sapiens
ccaccccuaaagugcc

SEQ ID NO: 1847162 - RNA, 12 nt, Homo sapiens
gagcuuggcaga

SEQ ID NO: 1847163 - RNA, 18 nt, Homo sapiens
gcaucaguucacugcugc

SEQ ID NO: 1847164 - RNA, 20 nt, Homo sapiens
acaaaaaaaccucuaugcaa

SEQ ID NO: 1847165 - RNA, 16 nt, Homo sapiens
agacccucuucucugg

SEQ ID NO: 1847166 - RNA, 18 nt, Homo sapiens
uaguccugauguacuuua

SEQ ID NO: 1847167 - RNA, 17 nt, Homo sapiens
gagccgagaucaugcca

SEQ ID NO: 1847168 - RNA, 16 nt, Homo sapiens
aacuguagcugccaug

SEQ ID NO: 1847169 - RNA, 16 nt, Homo sapiens
uuaaagaugcacagaa

SEQ ID NO: 1847170 - RNA, 14 nt, Homo sapiens
ucacauaggcaaag

SEQ ID NO: 1847171 - RNA, 23 nt, Homo sapiens
uauccucuguauuugucauuccu

SEQ ID NO: 1847172 - RNA, 21 nt, Homo sapiens
aaggguuauagacugccaugc

SEQ ID NO: 1847173 - RNA, 16 nt, Homo sapiens
ucucaaaacaauauua

SEQ ID NO: 1847174 - RNA, 16 nt, Homo sapiens
ggcacccaauguuuga

SEQ ID NO: 1847175 - RNA, 17 nt, Homo sapiens
uggauaaaauaaaugca

SEQ ID NO: 1847176 - RNA, 17 nt, Homo sapiens
acaaucaucuucuccca

SEQ ID NO: 1847177 - RNA, 20 nt, Homo sapiens
uacaucccauguaacagaaa

SEQ ID NO: 1847178 - RNA, 21 nt, Homo sapiens
cugcaaccugauugauuauau

SEQ ID NO: 1847179 - RNA, 19 nt, Homo sapiens
gccaccagcggcccucgga

SEQ ID NO: 1847180 - RNA, 12 nt, Homo sapiens
uucuucagcucu

SEQ ID NO: 1847181 - RNA, 12 nt, Homo sapiens
uaauucagcaau

SEQ ID NO: 1847182 - RNA, 15 nt, Homo sapiens
uaccauucucaggug

SEQ ID NO: 1847183 - RNA, 14 nt, Homo sapiens
ccuauugucauuaa

SEQ ID NO: 1847184 - RNA, 17 nt, Homo sapiens
agcuguuccuguucagu

SEQ ID NO: 1847185 - RNA, 21 nt, Homo sapiens
gagauucaagggacccaugag

SEQ ID NO: 1847186 - RNA, 17 nt, Homo sapiens
acugauguauagcuuua

SEQ ID NO: 1847187 - RNA, 17 nt, Homo sapiens
auaccuuguaaguggau

SEQ ID NO: 1847188 - RNA, 15 nt, Homo sapiens
aaauauauaagcuca

SEQ ID NO: 1847189 - RNA, 19 nt, Homo sapiens
uaaguuugugaaugugacu

SEQ ID NO: 1847190 - RNA, 19 nt, Homo sapiens
cagaaaggagaacuaucca

SEQ ID NO: 1847191 - RNA, 13 nt, Homo sapiens
cuacacucauucu

SEQ ID NO: 1847192 - RNA, 21 nt, Homo sapiens
acugcagcucccgaagccuga

SEQ ID NO: 1847193 - RNA, 21 nt, Homo sapiens
auaacccgagggacuccagau

SEQ ID NO: 1847194 - RNA, 19 nt, Homo sapiens
uccagaaauguuugcugag

SEQ ID NO: 1847195 - RNA, 17 nt, Homo sapiens
ccucugagccaucccag

SEQ ID NO: 1847196 - RNA, 19 nt, Homo sapiens
ucaggguccagacccugaa

SEQ ID NO: 1847197 - RNA, 17 nt, Homo sapiens
agucuaggagcugggag

SEQ ID NO: 1847198 - RNA, 15 nt, Homo sapiens
accacuguacuccag

SEQ ID NO: 1847199 - RNA, 20 nt, Homo sapiens
aucaccagagaccaaacaag

SEQ ID NO: 1847200 - RNA, 16 nt, Homo sapiens
cuuugccuuccaggaa

SEQ ID NO: 1847201 - RNA, 16 nt, Homo sapiens
acagaccuuugaacua

SEQ ID NO: 1847202 - RNA, 12 nt, Homo sapiens
aggguuggcacc

SEQ ID NO: 1847203 - RNA, 23 nt, Homo sapiens
aucuuuaucaugaagcacaucaa

SEQ ID NO: 1847204 - RNA, 17 nt, Homo sapiens
cauaagaguuucuccaa

SEQ ID NO: 1847205 - RNA, 14 nt, Homo sapiens
aaaauaagcauuua

SEQ ID NO: 1847206 - RNA, 19 nt, Homo sapiens
uuguacccccagguggaag

SEQ ID NO: 1847207 - RNA, 22 nt, Homo sapiens
gacaucacuuacuauccauuuc

SEQ ID NO: 1847208 - RNA, 17 nt, Homo sapiens
uuagccuuaguuucuca

SEQ ID NO: 1847209 - RNA, 18 nt, Homo sapiens
gcugaguggccacuaggc

SEQ ID NO: 1847210 - RNA, 19 nt, Homo sapiens
acgauuauaguaccacugc

SEQ ID NO: 1847211 - RNA, 15 nt, Homo sapiens
uacauauuaucucau

SEQ ID NO: 1847212 - RNA, 23 nt, Homo sapiens
gaguacagauguaaaugccacaa

SEQ ID NO: 1847213 - RNA, 18 nt, Homo sapiens
acaaauguguaauuuuga

SEQ ID NO: 1847214 - RNA, 17 nt, Homo sapiens
auuugacucaugaacua

SEQ ID NO: 1847215 - RNA, 21 nt, Homo sapiens
caucuauucucugccuuuacu

SEQ ID NO: 1847216 - RNA, 12 nt, Homo sapiens
uucuccuuaacc

SEQ ID NO: 1847217 - RNA, 21 nt, Homo sapiens
auuugaucugauaucagucca

SEQ ID NO: 1847218 - RNA, 21 nt, Homo sapiens
uccaaagucucuggaauuuga

SEQ ID NO: 1847219 - RNA, 14 nt, Homo sapiens
acuucauaauccag

SEQ ID NO: 1847220 - RNA, 16 nt, Homo sapiens
cuuagaagaaaagccu

SEQ ID NO: 1847221 - RNA, 20 nt, Homo sapiens
aaugauuugggaaaacaauu

SEQ ID NO: 1847222 - RNA, 16 nt, Homo sapiens
uccaaaugaacuugca

SEQ ID NO: 1847223 - RNA, 17 nt, Homo sapiens
cuggcgacacucagggc

SEQ ID NO: 1847224 - RNA, 23 nt, Homo sapiens
gacuuaauguaaaacccaaaaca

SEQ ID NO: 1847225 - RNA, 17 nt, Homo sapiens
auaauugccaaauaccu

SEQ ID NO: 1847226 - RNA, 13 nt, Homo sapiens
cugccucugagau

SEQ ID NO: 1847227 - RNA, 14 nt, Homo sapiens
aaugggacugaugu

SEQ ID NO: 1847228 - RNA, 20 nt, Homo sapiens
uaaaugauagacaauugagg

SEQ ID NO: 1847229 - RNA, 18 nt, Homo sapiens
ugcuguauauccccucaa

SEQ ID NO: 1847230 - RNA, 17 nt, Homo sapiens
cauccaaauggcugcuu

SEQ ID NO: 1847231 - RNA, 22 nt, Homo sapiens
gggacaggcucuucuuucccaa

SEQ ID NO: 1847232 - RNA, 23 nt, Homo sapiens
uucaaaaauuauauuuugaacaa

SEQ ID NO: 1847233 - RNA, 21 nt, Homo sapiens
aucgucacugcuuaacuucac

SEQ ID NO: 1847234 - RNA, 16 nt, Homo sapiens
ggggcagggccacuca

SEQ ID NO: 1847235 - RNA, 16 nt, Homo sapiens
aauuacaugcaugagc

SEQ ID NO: 1847236 - RNA, 19 nt, Homo sapiens
uaagguguguacucagggc

SEQ ID NO: 1847237 - RNA, 12 nt, Homo sapiens
uaucuguuauau

SEQ ID NO: 1847238 - RNA, 13 nt, Homo sapiens
cauuuaaccccuu

SEQ ID NO: 1847239 - RNA, 17 nt, Homo sapiens
uacuuaacauaucugau

SEQ ID NO: 1847240 - RNA, 17 nt, Homo sapiens
accccgagggcugagga

SEQ ID NO: 1847241 - RNA, 17 nt, Homo sapiens
gaggacgugaagccucc

SEQ ID NO: 1847242 - RNA, 15 nt, Homo sapiens
gacuuaaagcacuga

SEQ ID NO: 1847243 - RNA, 15 nt, Homo sapiens
gcuuguaaaaccaac

SEQ ID NO: 1847244 - RNA, 19 nt, Homo sapiens
acgaaugaaugaacagcca

SEQ ID NO: 1847245 - RNA, 15 nt, Homo sapiens
aaaaugaaugacuca

SEQ ID NO: 1847246 - RNA, 14 nt, Homo sapiens
ccucccucauucca

SEQ ID NO: 1847247 - RNA, 16 nt, Homo sapiens
gcaagaguggacugaa

SEQ ID NO: 1847248 - RNA, 23 nt, Homo sapiens
ggaugauuaagagauugccauuu

SEQ ID NO: 1847249 - RNA, 21 nt, Homo sapiens
cccaagugaagacgaggccaa

SEQ ID NO: 1847250 - RNA, 21 nt, Homo sapiens
ugcuauaugccuuaagccaau

SEQ ID NO: 1847251 - RNA, 11 nt, Homo sapiens
cuaaaguuaua

SEQ ID NO: 1847252 - RNA, 20 nt, Homo sapiens
cgccuuaugccucagucuau

SEQ ID NO: 1847253 - RNA, 14 nt, Homo sapiens
aaagugugggagac

SEQ ID NO: 1847254 - RNA, 14 nt, Homo sapiens
acuaaaagaauuug

SEQ ID NO: 1847255 - RNA, 17 nt, Homo sapiens
gcuaaggacauuuccca

SEQ ID NO: 1847256 - RNA, 17 nt, Homo sapiens
ccaacaaaaagaacaaa

SEQ ID NO: 1847257 - RNA, 14 nt, Homo sapiens
cagcccuccagcgu

SEQ ID NO: 1847258 - RNA, 14 nt, Homo sapiens
gugcuccaguucca

SEQ ID NO: 1847259 - RNA, 22 nt, Homo sapiens
gccuacauguucucaugcaugu

SEQ ID NO: 1847260 - RNA, 14 nt, Homo sapiens
acauuaccauauaa

SEQ ID NO: 1847261 - RNA, 18 nt, Homo sapiens
acugccuuccucucucua

SEQ ID NO: 1847262 - RNA, 18 nt, Homo sapiens
cuauagaugggacugugu

SEQ ID NO: 1847263 - RNA, 19 nt, Homo sapiens
uuguuugugacccugagaa

SEQ ID NO: 1847264 - RNA, 18 nt, Homo sapiens
ugcaaaguguaugugacc

SEQ ID NO: 1847265 - RNA, 20 nt, Homo sapiens
auuuuuguuucuuccaaagc

SEQ ID NO: 1847266 - RNA, 16 nt, Homo sapiens
ucaggcuacaggugcc

SEQ ID NO: 1847267 - RNA, 20 nt, Homo sapiens
acucaggagcacagccauag

SEQ ID NO: 1847268 - RNA, 15 nt, Homo sapiens
ugccuauccucugua

SEQ ID NO: 1847269 - RNA, 20 nt, Homo sapiens
ucaguguugccucuugcaau

SEQ ID NO: 1847270 - RNA, 16 nt, Homo sapiens
gggcccacccauguca

SEQ ID NO: 1847271 - RNA, 16 nt, Homo sapiens
uuaccuauguaacaaa

SEQ ID NO: 1847272 - RNA, 16 nt, Homo sapiens
guuaugucccaugacc

SEQ ID NO: 1847273 - RNA, 18 nt, Homo sapiens
aagcagaguaacaggauc

SEQ ID NO: 1847274 - RNA, 20 nt, Homo sapiens
gauuuuauaugcacauuucu

SEQ ID NO: 1847275 - RNA, 22 nt, Homo sapiens
ugcaugcaggcuguguuuucga

SEQ ID NO: 1847276 - RNA, 13 nt, Homo sapiens
uuucagccaaaac

SEQ ID NO: 1847277 - RNA, 14 nt, Homo sapiens
acugugcuuggcca

SEQ ID NO: 1847278 - RNA, 18 nt, Homo sapiens
uagcuaguagcaaugugc

SEQ ID NO: 1847279 - RNA, 16 nt, Homo sapiens
aaguucuuaaaacacu

SEQ ID NO: 1847280 - RNA, 18 nt, Homo sapiens
cuuguagcuguuacugca

SEQ ID NO: 1847281 - RNA, 20 nt, Homo sapiens
caucacuuugugaauuaaca

SEQ ID NO: 1847282 - RNA, 14 nt, Homo sapiens
aaaauguguaacag

SEQ ID NO: 1847283 - RNA, 23 nt, Homo sapiens
cgagggaggaacaccugaucuua

SEQ ID NO: 1847284 - RNA, 12 nt, Homo sapiens
gagaagugcagc

SEQ ID NO: 1847285 - RNA, 16 nt, Homo sapiens
ucaccagcccuagcug

SEQ ID NO: 1847286 - RNA, 18 nt, Homo sapiens
agacaguacucuuaacuc

SEQ ID NO: 1847287 - RNA, 19 nt, Homo sapiens
uaaguguccuccaucaauu

SEQ ID NO: 1847288 - RNA, 20 nt, Homo sapiens
gaaaucaguaaacacugugu

SEQ ID NO: 1847289 - RNA, 13 nt, Homo sapiens
ccuacucugcaaa

SEQ ID NO: 1847290 - RNA, 16 nt, Homo sapiens
ccgagauagugcugga

SEQ ID NO: 1847291 - RNA, 16 nt, Homo sapiens
ccaagggaggggagca

SEQ ID NO: 1847292 - RNA, 14 nt, Homo sapiens
uccccaacugcucc

SEQ ID NO: 1847293 - RNA, 16 nt, Homo sapiens
guuugcuuuuuuaaca

SEQ ID NO: 1847294 - RNA, 16 nt, Homo sapiens
ggauauuugcacuuau

SEQ ID NO: 1847295 - RNA, 22 nt, Homo sapiens
agggaccgggcgcagcccuccc

SEQ ID NO: 1847296 - RNA, 23 nt, Homo sapiens
gggaaaggcagggcccugaaaug

SEQ ID NO: 1847297 - RNA, 18 nt, Homo sapiens
uuuaauagcgaaucuaau

SEQ ID NO: 1847298 - RNA, 15 nt, Homo sapiens
aaagaugcccacuga

SEQ ID NO: 1847299 - RNA, 22 nt, Homo sapiens
guauguugucauaacauuuaaa

SEQ ID NO: 1847300 - RNA, 13 nt, Homo sapiens
augcaccaagaaa

SEQ ID NO: 1847301 - RNA, 16 nt, Homo sapiens
uauaguuauacaucaa

SEQ ID NO: 1847302 - RNA, 14 nt, Homo sapiens
ccugggcaaagccu

SEQ ID NO: 1847303 - RNA, 15 nt, Homo sapiens
gcaucauucagcaaa

SEQ ID NO: 1847304 - RNA, 20 nt, Homo sapiens
cuggacuggguuuugucucu

SEQ ID NO: 1847305 - RNA, 20 nt, Homo sapiens
cugccuucucacuagcuguc

SEQ ID NO: 1847306 - RNA, 21 nt, Homo sapiens
aggcagcccugccaugucaca

SEQ ID NO: 1847307 - RNA, 12 nt, Homo sapiens
cugcaucccucc

SEQ ID NO: 1847308 - RNA, 17 nt, Homo sapiens
guccucacucccagucc

SEQ ID NO: 1847309 - RNA, 13 nt, Homo sapiens
cgccucucagguu

SEQ ID NO: 1847310 - RNA, 15 nt, Homo sapiens
aaaucaguuguguaa

SEQ ID NO: 1847311 - RNA, 16 nt, Homo sapiens
cugcagccucaaccuc

SEQ ID NO: 1847312 - RNA, 13 nt, Homo sapiens
uugucaacaguau

SEQ ID NO: 1847313 - RNA, 21 nt, Homo sapiens
uuaaauauuguaauaugacag

SEQ ID NO: 1847314 - RNA, 13 nt, Homo sapiens
agggaaguuuuau

SEQ ID NO: 1847315 - RNA, 14 nt, Homo sapiens
ggaagcacaggcca

SEQ ID NO: 1847316 - RNA, 13 nt, Homo sapiens
uaggaacagccca

SEQ ID NO: 1847317 - RNA, 21 nt, Homo sapiens
gacagucgcucagucuguuca

SEQ ID NO: 1847318 - RNA, 13 nt, Homo sapiens
ucuaaaagcuuuc

SEQ ID NO: 1847319 - RNA, 23 nt, Homo sapiens
uucucuccaccuuaguacuuuag

SEQ ID NO: 1847320 - RNA, 23 nt, Homo sapiens
aguaaccguccagcaagugucau

SEQ ID NO: 1847321 - RNA, 17 nt, Homo sapiens
cacacuuucacugggga

SEQ ID NO: 1847322 - RNA, 16 nt, Homo sapiens
ucaaggggacuaaagu

SEQ ID NO: 1847323 - RNA, 16 nt, Homo sapiens
gaauguuaagaauaac

SEQ ID NO: 1847324 - RNA, 12 nt, Homo sapiens
cugcaagcauuu

SEQ ID NO: 1847325 - RNA, 12 nt, Homo sapiens
cuguaagcauuc

SEQ ID NO: 1847326 - RNA, 12 nt, Homo sapiens
cagcaagcaauu

SEQ ID NO: 1847327 - RNA, 14 nt, Homo sapiens
aacagauaucuuca

SEQ ID NO: 1847328 - RNA, 12 nt, Homo sapiens
auaaugcugaag

SEQ ID NO: 1847329 - RNA, 19 nt, Homo sapiens
uuuaauacaaaaagcaaaa

SEQ ID NO: 1847330 - RNA, 13 nt, Homo sapiens
cuuuuuugcaaua

SEQ ID NO: 1847331 - RNA, 16 nt, Homo sapiens
cagaaggcaaacccau

SEQ ID NO: 1847332 - RNA, 13 nt, Homo sapiens
agaguauggauug

SEQ ID NO: 1847333 - RNA, 18 nt, Homo sapiens
uuaugucaugugcaccuu

SEQ ID NO: 1847334 - RNA, 14 nt, Homo sapiens
uccucuauuucaca

SEQ ID NO: 1847335 - RNA, 13 nt, Homo sapiens
gaacucacucccu

SEQ ID NO: 1847336 - RNA, 20 nt, Homo sapiens
acagauggggaaacugaggc

SEQ ID NO: 1847337 - RNA, 18 nt, Homo sapiens
uuuaaaaucacaacacag

SEQ ID NO: 1847338 - RNA, 18 nt, Homo sapiens
caggccauugucccugaa

SEQ ID NO: 1847339 - RNA, 22 nt, Homo sapiens
agaaugaucaucuguaaucuga

SEQ ID NO: 1847340 - RNA, 20 nt, Homo sapiens
gggcgguaccuugugcccag

SEQ ID NO: 1847341 - RNA, 19 nt, Homo sapiens
uuagaaguaguauguuauu

SEQ ID NO: 1847342 - RNA, 23 nt, Homo sapiens
cagugcccaccagccuuguccua

SEQ ID NO: 1847343 - RNA, 15 nt, Homo sapiens
cuugagauaacaauc

SEQ ID NO: 1847344 - RNA, 15 nt, Homo sapiens
cuaccaagcugugac

SEQ ID NO: 1847345 - RNA, 18 nt, Homo sapiens
acucuguaaaaacacuga

SEQ ID NO: 1847346 - RNA, 14 nt, Homo sapiens
acagcaaacaggug

SEQ ID NO: 1847347 - RNA, 18 nt, Homo sapiens
uggagggcucagggcagu

SEQ ID NO: 1847348 - RNA, 20 nt, Homo sapiens
aggaccaggcaaugugacuu

SEQ ID NO: 1847349 - RNA, 20 nt, Homo sapiens
cacagagggggccuucacag

SEQ ID NO: 1847350 - RNA, 20 nt, Homo sapiens
cuguucauuguaagcacuuu

SEQ ID NO: 1847351 - RNA, 16 nt, Homo sapiens
accccgauagugacac

SEQ ID NO: 1847352 - RNA, 17 nt, Homo sapiens
uauucauuuuguggcaa

SEQ ID NO: 1847353 - RNA, 21 nt, Homo sapiens
ccaggagggcuuugugucugg

SEQ ID NO: 1847354 - RNA, 15 nt, Homo sapiens
cugccucccaucuca

SEQ ID NO: 1847355 - RNA, 18 nt, Homo sapiens
cuuguagaaagugaggcu

SEQ ID NO: 1847356 - RNA, 11 nt, Homo sapiens
aguaacauaua

SEQ ID NO: 1847357 - RNA, 21 nt, Homo sapiens
auauauuggguuccauucuca

SEQ ID NO: 1847358 - RNA, 14 nt, Homo sapiens
gccagaaaacauau

SEQ ID NO: 1847359 - RNA, 18 nt, Homo sapiens
agaugguguggguguccu

SEQ ID NO: 1847360 - RNA, 18 nt, Homo sapiens
ccgacaaccgaugcucca

SEQ ID NO: 1847361 - RNA, 19 nt, Homo sapiens
caaggcggguggaucacaa

SEQ ID NO: 1847362 - RNA, 17 nt, Homo sapiens
ugucuacuggacuguaa

SEQ ID NO: 1847363 - RNA, 16 nt, Homo sapiens
acucccccaaccaagg

SEQ ID NO: 1847364 - RNA, 19 nt, Homo sapiens
ugaaugccggggacagaga

SEQ ID NO: 1847365 - RNA, 19 nt, Homo sapiens
aggaucucugaaacauauu

SEQ ID NO: 1847366 - RNA, 13 nt, Homo sapiens
ggugaacagaaca

SEQ ID NO: 1847367 - RNA, 18 nt, Homo sapiens
caaaccagcccuugaguc

SEQ ID NO: 1847368 - RNA, 21 nt, Homo sapiens
uucaagacuucugucuguauc

SEQ ID NO: 1847369 - RNA, 21 nt, Homo sapiens
caacaguuaaacuugcaauga

SEQ ID NO: 1847370 - RNA, 14 nt, Homo sapiens
cgagaacccugagc

SEQ ID NO: 1847371 - RNA, 12 nt, Homo sapiens
augcucucucau

SEQ ID NO: 1847372 - RNA, 21 nt, Homo sapiens
cagugguuacucaagcucaaa

SEQ ID NO: 1847373 - RNA, 14 nt, Homo sapiens
gcugggcacugggc

SEQ ID NO: 1847374 - RNA, 22 nt, Homo sapiens
ccugagcugaaauaaagugagu

SEQ ID NO: 1847375 - RNA, 15 nt, Homo sapiens
accaccaugcucaac

SEQ ID NO: 1847376 - RNA, 18 nt, Homo sapiens
uaaacuuuuuaccaagua

SEQ ID NO: 1847377 - RNA, 18 nt, Homo sapiens
uaguguuuugaccuuucu

SEQ ID NO: 1847378 - RNA, 14 nt, Homo sapiens
cuggauacugcaaa

SEQ ID NO: 1847379 - RNA, 13 nt, Homo sapiens
gaugauucuucca

SEQ ID NO: 1847380 - RNA, 12 nt, Homo sapiens
gauuuaugcauu

SEQ ID NO: 1847381 - RNA, 22 nt, Homo sapiens
agaaagccagucuuaacauuuc

SEQ ID NO: 1847382 - RNA, 16 nt, Homo sapiens
uggagggacaugacua

SEQ ID NO: 1847383 - RNA, 23 nt, Homo sapiens
cagucaaagauacacaaucugaa

SEQ ID NO: 1847384 - RNA, 22 nt, Homo sapiens
ccauucccauggaguugccaac

SEQ ID NO: 1847385 - RNA, 14 nt, Homo sapiens
aaaaaauuauuugc

SEQ ID NO: 1847386 - RNA, 19 nt, Homo sapiens
auaaaguuccccugugaca

SEQ ID NO: 1847387 - RNA, 18 nt, Homo sapiens
aucuucucuuugacaauu

SEQ ID NO: 1847388 - RNA, 19 nt, Homo sapiens
cuuggcuuuaugcaaauac

SEQ ID NO: 1847389 - RNA, 20 nt, Homo sapiens
ucccacacugaaaccaaaac

SEQ ID NO: 1847390 - RNA, 18 nt, Homo sapiens
cccggcuugccuguaauc

SEQ ID NO: 1847391 - RNA, 15 nt, Homo sapiens
gaggagaaaugcaau

SEQ ID NO: 1847392 - RNA, 18 nt, Homo sapiens
guaccuuccuuaagccag

SEQ ID NO: 1847393 - RNA, 17 nt, Homo sapiens
uuauuuuaugacauuuu

SEQ ID NO: 1847394 - RNA, 15 nt, Homo sapiens
ucagaccuucuucca

SEQ ID NO: 1847395 - RNA, 16 nt, Homo sapiens
aacucucuaaacuggu

SEQ ID NO: 1847396 - RNA, 17 nt, Homo sapiens
auguuccguucaucuga

SEQ ID NO: 1847397 - RNA, 18 nt, Homo sapiens
uguaauuccucccuaaga

SEQ ID NO: 1847398 - RNA, 19 nt, Homo sapiens
cuuccacaauucacuagac

SEQ ID NO: 1847399 - RNA, 16 nt, Homo sapiens
cccugggguaugagcu

SEQ ID NO: 1847400 - RNA, 14 nt, Homo sapiens
cucuuccauucccu

SEQ ID NO: 1847401 - RNA, 18 nt, Homo sapiens
caauucuguaauuacaua

SEQ ID NO: 1847402 - RNA, 14 nt, Homo sapiens
auuggcucuaguca

SEQ ID NO: 1847403 - RNA, 15 nt, Homo sapiens
caagggacugaguga

SEQ ID NO: 1847404 - RNA, 22 nt, Homo sapiens
uuaaacuugaaauauauaauau

SEQ ID NO: 1847405 - RNA, 23 nt, Homo sapiens
aauucauuguguuaccuguagau

SEQ ID NO: 1847406 - RNA, 11 nt, Homo sapiens
cauacuuccug

SEQ ID NO: 1847407 - RNA, 21 nt, Homo sapiens
ggugauaaguuccaaauaugu

SEQ ID NO: 1847408 - RNA, 15 nt, Homo sapiens
acgcugaagcgguca

SEQ ID NO: 1847409 - RNA, 16 nt, Homo sapiens
gauuaauuaguugauu

SEQ ID NO: 1847410 - RNA, 10 nt, Homo sapiens
ccacugggag

SEQ ID NO: 1847411 - RNA, 20 nt, Homo sapiens
gccuggccagcauggugaaa

SEQ ID NO: 1847412 - RNA, 20 nt, Homo sapiens
ccuuccacacucaccucuaa

SEQ ID NO: 1847413 - RNA, 19 nt, Homo sapiens
ugguaaagccucauuugaa

SEQ ID NO: 1847414 - RNA, 18 nt, Homo sapiens
cauggcuaaauacaaugg

SEQ ID NO: 1847415 - RNA, 14 nt, Homo sapiens
gucugcuucagugc

SEQ ID NO: 1847416 - RNA, 17 nt, Homo sapiens
aucugacaucucugcaa

SEQ ID NO: 1847417 - RNA, 14 nt, Homo sapiens
gccaaggagcugcu

SEQ ID NO: 1847418 - RNA, 17 nt, Homo sapiens
acuuuuaucuacuucuc

SEQ ID NO: 1847419 - RNA, 17 nt, Homo sapiens
ucuuaaauauacaacuu

SEQ ID NO: 1847420 - RNA, 15 nt, Homo sapiens
ggcugaaacuugaac

SEQ ID NO: 1847421 - RNA, 17 nt, Homo sapiens
ugccauauucuguagua

SEQ ID NO: 1847422 - RNA, 15 nt, Homo sapiens
gccaaacucugccag

SEQ ID NO: 1847423 - RNA, 13 nt, Homo sapiens
cucgaguacugug

SEQ ID NO: 1847424 - RNA, 17 nt, Homo sapiens
ccccaagggggcugcug

SEQ ID NO: 1847425 - RNA, 18 nt, Homo sapiens
aaugucuuugagccuuag

SEQ ID NO: 1847426 - RNA, 14 nt, Homo sapiens
acuugggugaaaag

SEQ ID NO: 1847427 - RNA, 17 nt, Homo sapiens
agcugugggacaauuau

SEQ ID NO: 1847428 - RNA, 11 nt, Homo sapiens
agagccuccag

SEQ ID NO: 1847429 - RNA, 14 nt, Homo sapiens
uuaguauuucacaa

SEQ ID NO: 1847430 - RNA, 18 nt, Homo sapiens
acuguuaagaagcagcca

SEQ ID NO: 1847431 - RNA, 23 nt, Homo sapiens
gcaaucuuugccuuuaucucuga

SEQ ID NO: 1847432 - RNA, 18 nt, Homo sapiens
gcccugcgaaguggcucu

SEQ ID NO: 1847433 - RNA, 20 nt, Homo sapiens
ccuauguagcucugcaucuc

SEQ ID NO: 1847434 - RNA, 16 nt, Homo sapiens
caugcucuuuggcacc

SEQ ID NO: 1847435 - RNA, 19 nt, Homo sapiens
ugcgcaaaacugccugaaa

SEQ ID NO: 1847436 - RNA, 20 nt, Homo sapiens
aauuuuaacacuaaccaaac

SEQ ID NO: 1847437 - RNA, 14 nt, Homo sapiens
ccaagucuacuuca

SEQ ID NO: 1847438 - RNA, 12 nt, Homo sapiens
uuggaaauggau

SEQ ID NO: 1847439 - RNA, 13 nt, Homo sapiens
ccagagaccccag

SEQ ID NO: 1847440 - RNA, 19 nt, Homo sapiens
cagccagaucgggagcaaa

SEQ ID NO: 1847441 - RNA, 16 nt, Homo sapiens
uagauuaccaugaaga

SEQ ID NO: 1847442 - RNA, 19 nt, Homo sapiens
auuaacucaccagauuuac

SEQ ID NO: 1847443 - RNA, 10 nt, Homo sapiens
uaacuuuuau

SEQ ID NO: 1847444 - RNA, 16 nt, Homo sapiens
ccuuggcugacaugaa

SEQ ID NO: 1847445 - RNA, 21 nt, Homo sapiens
ccuuuggcaauucuucuucuc

SEQ ID NO: 1847446 - RNA, 13 nt, Homo sapiens
aaggaaacccagc

SEQ ID NO: 1847447 - RNA, 23 nt, Homo sapiens
ggugaaggaugcggcaggugcuc

SEQ ID NO: 1847448 - RNA, 20 nt, Homo sapiens
ucauuccuaacacagcaugu

SEQ ID NO: 1847449 - RNA, 17 nt, Homo sapiens
cauuuugacagcaucuu

SEQ ID NO: 1847450 - RNA, 15 nt, Homo sapiens
uauauucauaccugu

SEQ ID NO: 1847451 - RNA, 20 nt, Homo sapiens
gccuccugugacuggcagca

SEQ ID NO: 1847452 - RNA, 13 nt, Homo sapiens
ccaauugaaguaa

SEQ ID NO: 1847453 - RNA, 14 nt, Homo sapiens
gaacagacacuuua

SEQ ID NO: 1847454 - RNA, 13 nt, Homo sapiens
gaggaaaggguuc

SEQ ID NO: 1847455 - RNA, 16 nt, Homo sapiens
gaaacuauacauuuau

SEQ ID NO: 1847456 - RNA, 16 nt, Homo sapiens
auuuguuuaaagaaua

SEQ ID NO: 1847457 - RNA, 13 nt, Homo sapiens
augccucaaccac

SEQ ID NO: 1847458 - RNA, 16 nt, Homo sapiens
ucuauaguucacugac

SEQ ID NO: 1847459 - RNA, 21 nt, Homo sapiens
cgcccuuggcuucugugauga

SEQ ID NO: 1847460 - RNA, 20 nt, Homo sapiens
auaccaggaacccagcggcu

SEQ ID NO: 1847461 - RNA, 17 nt, Homo sapiens
gaagaugaagaagccuu

SEQ ID NO: 1847462 - RNA, 14 nt, Homo sapiens
auacccuugugauu

SEQ ID NO: 1847463 - RNA, 19 nt, Homo sapiens
cauuggguuuggggccaug

SEQ ID NO: 1847464 - RNA, 18 nt, Homo sapiens
agcgaaacuccaucucaa

SEQ ID NO: 1847465 - RNA, 18 nt, Homo sapiens
gauagcaaauggccucau

SEQ ID NO: 1847466 - RNA, 23 nt, Homo sapiens
auuucccccuaaaccaacugaag

SEQ ID NO: 1847467 - RNA, 19 nt, Homo sapiens
uggccagacuggucuugaa

SEQ ID NO: 1847468 - RNA, 16 nt, Homo sapiens
acccacaauaaacucg

SEQ ID NO: 1847469 - RNA, 15 nt, Homo sapiens
gccagcucucucuac

SEQ ID NO: 1847470 - RNA, 18 nt, Homo sapiens
gauaccuggugagcucag

SEQ ID NO: 1847471 - RNA, 21 nt, Homo sapiens
aucauauguuagauacacaaa

SEQ ID NO: 1847472 - RNA, 13 nt, Homo sapiens
cuccugugugugg

SEQ ID NO: 1847473 - RNA, 18 nt, Homo sapiens
ccccggccggccacccag

SEQ ID NO: 1847474 - RNA, 16 nt, Homo sapiens
augaagacaucaggaa

SEQ ID NO: 1847475 - RNA, 14 nt, Homo sapiens
cacugcuguuauau

SEQ ID NO: 1847476 - RNA, 14 nt, Homo sapiens
ggguguaccaccca

SEQ ID NO: 1847477 - RNA, 20 nt, Homo sapiens
caccuuggaggaggaugcca

SEQ ID NO: 1847478 - RNA, 17 nt, Homo sapiens
uagggaaaaaaaacagg

SEQ ID NO: 1847479 - RNA, 12 nt, Homo sapiens
caacagacaccc

SEQ ID NO: 1847480 - RNA, 16 nt, Homo sapiens
uaacugccaauccuua

SEQ ID NO: 1847481 - RNA, 15 nt, Homo sapiens
aaugaagacaaugau

SEQ ID NO: 1847482 - RNA, 15 nt, Homo sapiens
gcuugacaacaaccu

SEQ ID NO: 1847483 - RNA, 15 nt, Homo sapiens
aguacccaggaugau

SEQ ID NO: 1847484 - RNA, 21 nt, Homo sapiens
agcaucuggucuuguuuccag

SEQ ID NO: 1847485 - RNA, 21 nt, Homo sapiens
cugguccaugcagggggcucc

SEQ ID NO: 1847486 - RNA, 18 nt, Homo sapiens
ucaauaaggcagugcagu

SEQ ID NO: 1847487 - RNA, 23 nt, Homo sapiens
uaucuggcccucgacacucacca

SEQ ID NO: 1847488 - RNA, 18 nt, Homo sapiens
cauaucucuagucccugu

SEQ ID NO: 1847489 - RNA, 21 nt, Homo sapiens
ggccagcguggcgcaguggcc

SEQ ID NO: 1847490 - RNA, 18 nt, Homo sapiens
aaaauaggauugcuucaa

SEQ ID NO: 1847491 - RNA, 12 nt, Homo sapiens
ucauacuguaac

SEQ ID NO: 1847492 - RNA, 12 nt, Homo sapiens
gcacacuggaau

SEQ ID NO: 1847493 - RNA, 17 nt, Homo sapiens
ucccuaaaauacauuua

SEQ ID NO: 1847494 - RNA, 23 nt, Homo sapiens
uucccaucacuggagcaccaggc

SEQ ID NO: 1847495 - RNA, 24 nt, Homo sapiens
ucaguuguuuguuuuugcuuguua

SEQ ID NO: 1847496 - RNA, 14 nt, Homo sapiens
aggcuacucugccc

SEQ ID NO: 1847497 - RNA, 15 nt, Homo sapiens
accaguauaagcauc

SEQ ID NO: 1847498 - RNA, 21 nt, Homo sapiens
acagaagggauaccgucuccu

SEQ ID NO: 1847499 - RNA, 17 nt, Homo sapiens
aaacccucuucuucccu

SEQ ID NO: 1847500 - RNA, 10 nt, Homo sapiens
aaucauucca

SEQ ID NO: 1847501 - RNA, 17 nt, Homo sapiens
caaaguggcagggaccg

SEQ ID NO: 1847502 - RNA, 13 nt, Homo sapiens
auuggccagugag

SEQ ID NO: 1847503 - RNA, 22 nt, Homo sapiens
cacuuacccacgugcuguucca

SEQ ID NO: 1847504 - RNA, 17 nt, Homo sapiens
uuuccuguucucuugua

SEQ ID NO: 1847505 - RNA, 13 nt, Homo sapiens
ccaccauucccug

SEQ ID NO: 1847506 - RNA, 20 nt, Homo sapiens
acccacuggucugcuuaaag

SEQ ID NO: 1847507 - RNA, 20 nt, Homo sapiens
cucccugauuaaagugccuu

SEQ ID NO: 1847508 - RNA, 22 nt, Homo sapiens
aauucuguuagcugcucacuua

SEQ ID NO: 1847509 - RNA, 17 nt, Homo sapiens
uuguuccaguacuaugg

SEQ ID NO: 1847510 - RNA, 22 nt, Homo sapiens
caaugggacucugagaacuccu

SEQ ID NO: 1847511 - RNA, 15 nt, Homo sapiens
cgguucuuugaccag

SEQ ID NO: 1847512 - RNA, 23 nt, Homo sapiens
ucuccuuccucuuggcugagaua

SEQ ID NO: 1847513 - RNA, 15 nt, Homo sapiens
ucuucagggggccag

SEQ ID NO: 1847514 - RNA, 15 nt, Homo sapiens
agguuacuuuggacu

SEQ ID NO: 1847515 - RNA, 19 nt, Homo sapiens
augaaugaggucccaggca

SEQ ID NO: 1847516 - RNA, 14 nt, Homo sapiens
uuccauauggguag

SEQ ID NO: 1847517 - RNA, 18 nt, Homo sapiens
guucauccgcacuguaaa

SEQ ID NO: 1847518 - RNA, 22 nt, Homo sapiens
uccacagggacacacgugagcc

SEQ ID NO: 1847519 - RNA, 20 nt, Homo sapiens
ggaucuguugggaaccagag

SEQ ID NO: 1847520 - RNA, 21 nt, Homo sapiens
uuuuauacuuuugaccaaaua

SEQ ID NO: 1847521 - RNA, 16 nt, Homo sapiens
uccuggguacugaaag

SEQ ID NO: 1847522 - RNA, 21 nt, Homo sapiens
uuaaccugaauuauuccaacu

SEQ ID NO: 1847523 - RNA, 23 nt, Homo sapiens
ccagggaaguuucguaugcacuc

SEQ ID NO: 1847524 - RNA, 22 nt, Homo sapiens
uuacacuggcaaugguaguuuc

SEQ ID NO: 1847525 - RNA, 11 nt, Homo sapiens
ugaagccuuug

SEQ ID NO: 1847526 - RNA, 23 nt, Homo sapiens
aaccauucugcuugguuccacaa

SEQ ID NO: 1847527 - RNA, 19 nt, Homo sapiens
ccacugcguuguccacaag

SEQ ID NO: 1847528 - RNA, 19 nt, Homo sapiens
cccuucauuuaaccaagcu

SEQ ID NO: 1847529 - RNA, 19 nt, Homo sapiens
uuaaaaagugggcaaagga

SEQ ID NO: 1847530 - RNA, 11 nt, Homo sapiens
aucuuuggaca

SEQ ID NO: 1847531 - RNA, 16 nt, Homo sapiens
ggaaaccgccuaguuu

SEQ ID NO: 1847532 - RNA, 18 nt, Homo sapiens
uagagauuaccuccugag

SEQ ID NO: 1847533 - RNA, 16 nt, Homo sapiens
cuaauaaaacuuugac

SEQ ID NO: 1847534 - RNA, 15 nt, Homo sapiens
uaauaguacuauuac

SEQ ID NO: 1847535 - RNA, 23 nt, Homo sapiens
gaaaaggagguaaucgccaaaua

SEQ ID NO: 1847536 - RNA, 16 nt, Homo sapiens
auauuaaggcuuacua

SEQ ID NO: 1847537 - RNA, 14 nt, Homo sapiens
uaugauaauuacaa

SEQ ID NO: 1847538 - RNA, 12 nt, Homo sapiens
cucucuccuuau

SEQ ID NO: 1847539 - RNA, 15 nt, Homo sapiens
cuagagugcaauggu

SEQ ID NO: 1847540 - RNA, 21 nt, Homo sapiens
uuguguguuuauuucacuuga

SEQ ID NO: 1847541 - RNA, 16 nt, Homo sapiens
gggaacggacugguau

SEQ ID NO: 1847542 - RNA, 14 nt, Homo sapiens
aauaguauuugcau

SEQ ID NO: 1847543 - RNA, 16 nt, Homo sapiens
accaauacuacuguaa

SEQ ID NO: 1847544 - RNA, 14 nt, Homo sapiens
aagauguacuucuc

SEQ ID NO: 1847545 - RNA, 22 nt, Homo sapiens
ggcuguggagagggucaaggag

SEQ ID NO: 1847546 - RNA, 19 nt, Homo sapiens
ccauccccuggacugggag

SEQ ID NO: 1847547 - RNA, 16 nt, Homo sapiens
cccaacaaaccaucca

SEQ ID NO: 1847548 - RNA, 16 nt, Homo sapiens
cuguuucaauguauaa

SEQ ID NO: 1847549 - RNA, 21 nt, Homo sapiens
ugccauaaaagccgcccagug

SEQ ID NO: 1847550 - RNA, 17 nt, Homo sapiens
cugcuccuggaguacac

SEQ ID NO: 1847551 - RNA, 23 nt, Homo sapiens
aagauuauugugacuucacugua

SEQ ID NO: 1847552 - RNA, 18 nt, Homo sapiens
uuagaaauguaacauacu

SEQ ID NO: 1847553 - RNA, 13 nt, Homo sapiens
auggcaaggcagc

SEQ ID NO: 1847554 - RNA, 14 nt, Homo sapiens
ccugggaaagccau

SEQ ID NO: 1847555 - RNA, 20 nt, Homo sapiens
aggcagcuccagcuguuacc

SEQ ID NO: 1847556 - RNA, 16 nt, Homo sapiens
guuugaagacauugca

SEQ ID NO: 1847557 - RNA, 15 nt, Homo sapiens
ccaguucacccugau

SEQ ID NO: 1847558 - RNA, 16 nt, Homo sapiens
cccagccgcacuggga

SEQ ID NO: 1847559 - RNA, 15 nt, Homo sapiens
uaucaaaauugccuu

SEQ ID NO: 1847560 - RNA, 14 nt, Homo sapiens
caaaaaaauugugc

SEQ ID NO: 1847561 - RNA, 22 nt, Homo sapiens
caggaaagaugucccacaggga

SEQ ID NO: 1847562 - RNA, 14 nt, Homo sapiens
guugauuucaauac

SEQ ID NO: 1847563 - RNA, 14 nt, Homo sapiens
gucucaucucuuca

SEQ ID NO: 1847564 - RNA, 16 nt, Homo sapiens
acaaagaagaaccauc

SEQ ID NO: 1847565 - RNA, 18 nt, Homo sapiens
ucaccccugcuauaacua

SEQ ID NO: 1847566 - RNA, 19 nt, Homo sapiens
gaccucagggacaacugcc

SEQ ID NO: 1847567 - RNA, 19 nt, Homo sapiens
caccaaagggaaggcuucc

SEQ ID NO: 1847568 - RNA, 17 nt, Homo sapiens
accugugccuccucaga

SEQ ID NO: 1847569 - RNA, 18 nt, Homo sapiens
aacagaccagugacccca

SEQ ID NO: 1847570 - RNA, 23 nt, Homo sapiens
aggccugagcugcuucacuaggg

SEQ ID NO: 1847571 - RNA, 13 nt, Homo sapiens
acagugcaguuua

SEQ ID NO: 1847572 - RNA, 16 nt, Homo sapiens
auauuuaaaacaaaga

SEQ ID NO: 1847573 - RNA, 17 nt, Homo sapiens
guccaacaagaaugcau

SEQ ID NO: 1847574 - RNA, 15 nt, Homo sapiens
aagaugccuuuuacc

SEQ ID NO: 1847575 - RNA, 19 nt, Homo sapiens
cgucucgaagcaguauucu

SEQ ID NO: 1847576 - RNA, 16 nt, Homo sapiens
uuaaucccuuugucug

SEQ ID NO: 1847577 - RNA, 14 nt, Homo sapiens
aaacccauuuacuu

SEQ ID NO: 1847578 - RNA, 17 nt, Homo sapiens
ugaucacauucuuucca

SEQ ID NO: 1847579 - RNA, 13 nt, Homo sapiens
ugauuaucuucag

SEQ ID NO: 1847580 - RNA, 12 nt, Homo sapiens
aauaucuuccac

SEQ ID NO: 1847581 - RNA, 14 nt, Homo sapiens
aauggaacuaucuc

SEQ ID NO: 1847582 - RNA, 20 nt, Homo sapiens
cagugauccauguccugaaa

SEQ ID NO: 1847583 - RNA, 16 nt, Homo sapiens
acuccccaacugaguu

SEQ ID NO: 1847584 - RNA, 22 nt, Homo sapiens
gaaagaggccagacaugguguc

SEQ ID NO: 1847585 - RNA, 20 nt, Homo sapiens
guaauaaaagugguuugugg

SEQ ID NO: 1847586 - RNA, 21 nt, Homo sapiens
gaaaccuggucucuacauaaa

SEQ ID NO: 1847587 - RNA, 14 nt, Homo sapiens
aaacauaucuugag

SEQ ID NO: 1847588 - RNA, 20 nt, Homo sapiens
caaucaacuuuacuguaaua

SEQ ID NO: 1847589 - RNA, 20 nt, Homo sapiens
uuaggguacaugugcacauu

SEQ ID NO: 1847590 - RNA, 16 nt, Homo sapiens
cuggccagcacccucu

SEQ ID NO: 1847591 - RNA, 21 nt, Homo sapiens
agcccagcacagguauuucag

SEQ ID NO: 1847592 - RNA, 15 nt, Homo sapiens
agauauuccagacca

SEQ ID NO: 1847593 - RNA, 15 nt, Homo sapiens
cagaucccucuccag

SEQ ID NO: 1847594 - RNA, 16 nt, Homo sapiens
agugcccaagcgcuug

SEQ ID NO: 1847595 - RNA, 19 nt, Homo sapiens
gcccuaacuguacauuuca

SEQ ID NO: 1847596 - RNA, 15 nt, Homo sapiens
caaugaaauuuugau

SEQ ID NO: 1847597 - RNA, 18 nt, Homo sapiens
gaagagagagacugugga

SEQ ID NO: 1847598 - RNA, 15 nt, Homo sapiens
caucauuauuacaua

SEQ ID NO: 1847599 - RNA, 12 nt, Homo sapiens
uuuaaaacucua

SEQ ID NO: 1847600 - RNA, 18 nt, Homo sapiens
ggccagagccaagaaaca

SEQ ID NO: 1847601 - RNA, 14 nt, Homo sapiens
guucuucuaucuca

SEQ ID NO: 1847602 - RNA, 13 nt, Homo sapiens
aguuacaugaauu

SEQ ID NO: 1847603 - RNA, 13 nt, Homo sapiens
ugcaguugugauu

SEQ ID NO: 1847604 - RNA, 14 nt, Homo sapiens
aagacuucuuugca

SEQ ID NO: 1847605 - RNA, 18 nt, Homo sapiens
gccuugggcuccugauga

SEQ ID NO: 1847606 - RNA, 20 nt, Homo sapiens
caagugauacaacugagucu

SEQ ID NO: 1847607 - RNA, 13 nt, Homo sapiens
cuuacccuucaau

SEQ ID NO: 1847608 - RNA, 17 nt, Homo sapiens
ccacaggucaucagaug

SEQ ID NO: 1847609 - RNA, 16 nt, Homo sapiens
ucagaguugagaccuu

SEQ ID NO: 1847610 - RNA, 15 nt, Homo sapiens
ucccauuuucauccu

SEQ ID NO: 1847611 - RNA, 17 nt, Homo sapiens
acucuucugaaggccaa

SEQ ID NO: 1847612 - RNA, 14 nt, Homo sapiens
ugaaggauccugga

SEQ ID NO: 1847613 - RNA, 16 nt, Homo sapiens
cuguuauguacuguac

SEQ ID NO: 1847614 - RNA, 17 nt, Homo sapiens
cuucccuucucuucacu

SEQ ID NO: 1847615 - RNA, 22 nt, Homo sapiens
uuagcacagauuuuaauuguca

SEQ ID NO: 1847616 - RNA, 23 nt, Homo sapiens
cucccuauuuuuuuucuguuaua

SEQ ID NO: 1847617 - RNA, 22 nt, Homo sapiens
agugagacaaaauugaugaucc

SEQ ID NO: 1847618 - RNA, 21 nt, Homo sapiens
auugucaccaggauuacuagu

SEQ ID NO: 1847619 - RNA, 17 nt, Homo sapiens
ggcugugaaacacacau

SEQ ID NO: 1847620 - RNA, 17 nt, Homo sapiens
acauccucauucacuaa

SEQ ID NO: 1847621 - RNA, 19 nt, Homo sapiens
ggcucuucuaaucagagcg

SEQ ID NO: 1847622 - RNA, 15 nt, Homo sapiens
acaccuguaauccca

SEQ ID NO: 1847623 - RNA, 14 nt, Homo sapiens
gguacaaacccaaa

SEQ ID NO: 1847624 - RNA, 11 nt, Homo sapiens
caaaccucaua

SEQ ID NO: 1847625 - RNA, 21 nt, Homo sapiens
ggucucuuuccaaagcauuuu

SEQ ID NO: 1847626 - RNA, 19 nt, Homo sapiens
gcuuuggacgcacacagcu

SEQ ID NO: 1847627 - RNA, 20 nt, Homo sapiens
aacuucugcuuuaauggcuu

SEQ ID NO: 1847628 - RNA, 22 nt, Homo sapiens
uccaaaaauuauuauaagcauu

SEQ ID NO: 1847629 - RNA, 20 nt, Homo sapiens
gacagagggucacaguguuu

SEQ ID NO: 1847630 - RNA, 22 nt, Homo sapiens
acauaguuuauuucaacuauuu

SEQ ID NO: 1847631 - RNA, 12 nt, Homo sapiens
auauggugcaaa

SEQ ID NO: 1847632 - RNA, 22 nt, Homo sapiens
gaaucuccuuuggaaggugaca

SEQ ID NO: 1847633 - RNA, 17 nt, Homo sapiens
uucaguuuauuuccacu

SEQ ID NO: 1847634 - RNA, 14 nt, Homo sapiens
auaugaucaaauac

SEQ ID NO: 1847635 - RNA, 13 nt, Homo sapiens
ccuaaaagcacac

SEQ ID NO: 1847636 - RNA, 23 nt, Homo sapiens
agcacccauaucugugugcccua

SEQ ID NO: 1847637 - RNA, 16 nt, Homo sapiens
cugacacaggggacac

SEQ ID NO: 1847638 - RNA, 17 nt, Homo sapiens
ggaaggacauccauguu

SEQ ID NO: 1847639 - RNA, 20 nt, Homo sapiens
gcaacugucucucuucucag

SEQ ID NO: 1847640 - RNA, 22 nt, Homo sapiens
caggaggaucauuugagcucau

SEQ ID NO: 1847641 - RNA, 13 nt, Homo sapiens
agguucacugagc

SEQ ID NO: 1847642 - RNA, 19 nt, Homo sapiens
aucacugagaagauggcac

SEQ ID NO: 1847643 - RNA, 17 nt, Homo sapiens
ucacauggaaucuacau

SEQ ID NO: 1847644 - RNA, 20 nt, Homo sapiens
caacaggaaucucagagaca

SEQ ID NO: 1847645 - RNA, 13 nt, Homo sapiens
agggcagcugccu

SEQ ID NO: 1847646 - RNA, 12 nt, Homo sapiens
ccaaaaccagaa

SEQ ID NO: 1847647 - RNA, 18 nt, Homo sapiens
agaaugcaguacuaacau

SEQ ID NO: 1847648 - RNA, 18 nt, Homo sapiens
gagaauuccuccuggcag

SEQ ID NO: 1847649 - RNA, 17 nt, Homo sapiens
gcagauucaagagccag

SEQ ID NO: 1847650 - RNA, 16 nt, Homo sapiens
agugcccacauuugau

SEQ ID NO: 1847651 - RNA, 17 nt, Homo sapiens
guagguagauaccaaau

SEQ ID NO: 1847652 - RNA, 17 nt, Homo sapiens
uuggagaaaagcacuua

SEQ ID NO: 1847653 - RNA, 17 nt, Homo sapiens
ugaaaauuacaacagau

SEQ ID NO: 1847654 - RNA, 20 nt, Homo sapiens
agaauauuuuaaguauugca

SEQ ID NO: 1847655 - RNA, 20 nt, Homo sapiens
gcaguuaccauuaaaccauc

SEQ ID NO: 1847656 - RNA, 21 nt, Homo sapiens
gcacagugcugccccuugcaa

SEQ ID NO: 1847657 - RNA, 12 nt, Homo sapiens
ccugcucaggug

SEQ ID NO: 1847658 - RNA, 23 nt, Homo sapiens
cuuuccagacuucgcuauuccca

SEQ ID NO: 1847659 - RNA, 18 nt, Homo sapiens
uucagugcuguacuugau

SEQ ID NO: 1847660 - RNA, 17 nt, Homo sapiens
gcagcauggucccugcc

SEQ ID NO: 1847661 - RNA, 13 nt, Homo sapiens
ccugcuccagaag

SEQ ID NO: 1847662 - RNA, 19 nt, Homo sapiens
gucaacauuuuugauucua

SEQ ID NO: 1847663 - RNA, 20 nt, Homo sapiens
cucacuugaaugugucacua

SEQ ID NO: 1847664 - RNA, 22 nt, Homo sapiens
acaucccugauucucucuccau

SEQ ID NO: 1847665 - RNA, 20 nt, Homo sapiens
aagagaguuaaaagcagcag

SEQ ID NO: 1847666 - RNA, 19 nt, Homo sapiens
aaauuccauacuucucuca

SEQ ID NO: 1847667 - RNA, 22 nt, Homo sapiens
cauguuuaauaauauguacaaa

SEQ ID NO: 1847668 - RNA, 13 nt, Homo sapiens
agacagucucaag

SEQ ID NO: 1847669 - RNA, 16 nt, Homo sapiens
uaauuuauuuugucca

SEQ ID NO: 1847670 - RNA, 19 nt, Homo sapiens
gcuguccaggaacuuucca

SEQ ID NO: 1847671 - RNA, 12 nt, Homo sapiens
gauauggcuuuu

SEQ ID NO: 1847672 - RNA, 22 nt, Homo sapiens
uuguauguuaaguuacuucacu

SEQ ID NO: 1847673 - RNA, 18 nt, Homo sapiens
guuucuuacacacugucu

SEQ ID NO: 1847674 - RNA, 18 nt, Homo sapiens
guauuguaagcuuuccau

SEQ ID NO: 1847675 - RNA, 19 nt, Homo sapiens
cagcaggagagacugagca

SEQ ID NO: 1847676 - RNA, 23 nt, Homo sapiens
cugaucccuuucccaugauccag

SEQ ID NO: 1847677 - RNA, 18 nt, Homo sapiens
cauuccugagucuuccag

SEQ ID NO: 1847678 - RNA, 22 nt, Homo sapiens
caaggagcaucccuaauucuuc

SEQ ID NO: 1847679 - RNA, 13 nt, Homo sapiens
acguuugacaaac

SEQ ID NO: 1847680 - RNA, 23 nt, Homo sapiens
augccuguaaucucagcacuuug

SEQ ID NO: 1847681 - RNA, 18 nt, Homo sapiens
gucuugauucagucacau

SEQ ID NO: 1847682 - RNA, 20 nt, Homo sapiens
gacuugucccgggacaccua

SEQ ID NO: 1847683 - RNA, 16 nt, Homo sapiens
uguaaccgauaugcac

SEQ ID NO: 1847684 - RNA, 16 nt, Homo sapiens
cauauucuuuucugca

SEQ ID NO: 1847685 - RNA, 20 nt, Homo sapiens
uucucgugguagaagccagu

SEQ ID NO: 1847686 - RNA, 20 nt, Homo sapiens
caaaugcaguucauugcaga

SEQ ID NO: 1847687 - RNA, 23 nt, Homo sapiens
ugcaagugcuggagucuccugag

SEQ ID NO: 1847688 - RNA, 16 nt, Homo sapiens
auuucaggcacaucau

SEQ ID NO: 1847689 - RNA, 18 nt, Homo sapiens
uaaauacucccuuuuuga

SEQ ID NO: 1847690 - RNA, 16 nt, Homo sapiens
cgaacccaaucugcac

SEQ ID NO: 1847691 - RNA, 22 nt, Homo sapiens
ugcagaggggaaagacuuccau

SEQ ID NO: 1847692 - RNA, 17 nt, Homo sapiens
uuucaacuaauauaucu

SEQ ID NO: 1847693 - RNA, 13 nt, Homo sapiens
agaauugugcaaa

SEQ ID NO: 1847694 - RNA, 15 nt, Homo sapiens
cccagccacaucauc

SEQ ID NO: 1847695 - RNA, 15 nt, Homo sapiens
agcagagauuuucaa

SEQ ID NO: 1847696 - RNA, 12 nt, Homo sapiens
cucccucagucc

SEQ ID NO: 1847697 - RNA, 19 nt, Homo sapiens
cuaagaaugucuauuucca

SEQ ID NO: 1847698 - RNA, 13 nt, Homo sapiens
ucgcccugugcac

SEQ ID NO: 1847699 - RNA, 23 nt, Homo sapiens
uaaguaccccugauaagcaaauu

SEQ ID NO: 1847700 - RNA, 19 nt, Homo sapiens
aucauuuuuaaauauaggu

SEQ ID NO: 1847701 - RNA, 10 nt, Homo sapiens
ccaugaauua

SEQ ID NO: 1847702 - RNA, 23 nt, Homo sapiens
ccucucugcaaauggcuuagcua

SEQ ID NO: 1847703 - RNA, 19 nt, Homo sapiens
cacaggagcguguacuacc

SEQ ID NO: 1847704 - RNA, 20 nt, Homo sapiens
ccacuuucagaauguugaag

SEQ ID NO: 1847705 - RNA, 18 nt, Homo sapiens
gagacuccugauugcucu

SEQ ID NO: 1847706 - RNA, 22 nt, Homo sapiens
aucauacuaccggcuacaucaa

SEQ ID NO: 1847707 - RNA, 16 nt, Homo sapiens
acaaucaaagcacuug

SEQ ID NO: 1847708 - RNA, 23 nt, Homo sapiens
agaacacgauaaaccauggccaa

SEQ ID NO: 1847709 - RNA, 18 nt, Homo sapiens
guuaacguauauugcugu

SEQ ID NO: 1847710 - RNA, 18 nt, Homo sapiens
agcaacccaaauguucau

SEQ ID NO: 1847711 - RNA, 18 nt, Homo sapiens
cccaaauucuuucagugg

SEQ ID NO: 1847712 - RNA, 19 nt, Homo sapiens
caggauggucucgaucucc

SEQ ID NO: 1847713 - RNA, 23 nt, Homo sapiens
guaacugugcuguacugagcacu

SEQ ID NO: 1847714 - RNA, 15 nt, Homo sapiens
acccuuuagugcuuu

SEQ ID NO: 1847715 - RNA, 11 nt, Homo sapiens
uuugcacugac

SEQ ID NO: 1847716 - RNA, 19 nt, Homo sapiens
ugcuccccgugagcacugc

SEQ ID NO: 1847717 - RNA, 16 nt, Homo sapiens
ucuguuuugccuucac

SEQ ID NO: 1847718 - RNA, 14 nt, Homo sapiens
ccauaauugcaagg

SEQ ID NO: 1847719 - RNA, 14 nt, Homo sapiens
ugaagauauggaau

SEQ ID NO: 1847720 - RNA, 19 nt, Homo sapiens
guaacaacuguggucaauc

SEQ ID NO: 1847721 - RNA, 16 nt, Homo sapiens
cuuuccucuaauccag

SEQ ID NO: 1847722 - RNA, 17 nt, Homo sapiens
caaauuaaaaaaucaaa

SEQ ID NO: 1847723 - RNA, 15 nt, Homo sapiens
agccucugggucuga

SEQ ID NO: 1847724 - RNA, 17 nt, Homo sapiens
aggaaagaaaaaaagua

SEQ ID NO: 1847725 - RNA, 14 nt, Homo sapiens
cagcagccugugag

SEQ ID NO: 1847726 - RNA, 17 nt, Homo sapiens
agccaaggucugaaccc

SEQ ID NO: 1847727 - RNA, 22 nt, Homo sapiens
ugacaugcagauucagugcaau

SEQ ID NO: 1847728 - RNA, 13 nt, Homo sapiens
ccuuccacccuca

SEQ ID NO: 1847729 - RNA, 14 nt, Homo sapiens
aacggcuacugaaa

SEQ ID NO: 1847730 - RNA, 15 nt, Homo sapiens
uuuaaaguucugugu

SEQ ID NO: 1847731 - RNA, 15 nt, Homo sapiens
acccuccccuaguca

SEQ ID NO: 1847732 - RNA, 19 nt, Homo sapiens
aucaauacugcacacugca

SEQ ID NO: 1847733 - RNA, 15 nt, Homo sapiens
gugugacaagugugu

SEQ ID NO: 1847734 - RNA, 17 nt, Homo sapiens
gaaguaagggagucauu

SEQ ID NO: 1847735 - RNA, 17 nt, Homo sapiens
cagaggggcggggccag

SEQ ID NO: 1847736 - RNA, 12 nt, Homo sapiens
gcccacuggccg

SEQ ID NO: 1847737 - RNA, 16 nt, Homo sapiens
auugugcccagcccuu

SEQ ID NO: 1847738 - RNA, 22 nt, Homo sapiens
auaaaacguuaguuaaucccuu

SEQ ID NO: 1847739 - RNA, 16 nt, Homo sapiens
ugugugcacguacaca

SEQ ID NO: 1847740 - RNA, 16 nt, Homo sapiens
agucaguaguauucua

SEQ ID NO: 1847741 - RNA, 19 nt, Homo sapiens
aauaaaagaucuugaauag

SEQ ID NO: 1847742 - RNA, 17 nt, Homo sapiens
gccuccuucaccaaaga

SEQ ID NO: 1847743 - RNA, 17 nt, Homo sapiens
auggcacuguccagggc

SEQ ID NO: 1847744 - RNA, 22 nt, Homo sapiens
aagaugcuguaguaacugccuc

SEQ ID NO: 1847745 - RNA, 18 nt, Homo sapiens
cuugaacuccuagacuca

SEQ ID NO: 1847746 - RNA, 13 nt, Homo sapiens
agucaugguguug

SEQ ID NO: 1847747 - RNA, 22 nt, Homo sapiens
uauccauucuuucugauaacua

SEQ ID NO: 1847748 - RNA, 14 nt, Homo sapiens
uccugccaccacgc

SEQ ID NO: 1847749 - RNA, 18 nt, Homo sapiens
ucacugcuugaugaagca

SEQ ID NO: 1847750 - RNA, 14 nt, Homo sapiens
cugucccccaaaaa

SEQ ID NO: 1847751 - RNA, 17 nt, Homo sapiens
uacugauuuuugugauu

SEQ ID NO: 1847752 - RNA, 17 nt, Homo sapiens
uccaguaagaucacugu

SEQ ID NO: 1847753 - RNA, 20 nt, Homo sapiens
caaucuguccguucacaugu

SEQ ID NO: 1847754 - RNA, 14 nt, Homo sapiens
uuccagugucuguc

SEQ ID NO: 1847755 - RNA, 12 nt, Homo sapiens
uuaucagcuuuc

SEQ ID NO: 1847756 - RNA, 23 nt, Homo sapiens
uggguucauuugugaugacauaa

SEQ ID NO: 1847757 - RNA, 20 nt, Homo sapiens
ccauuaaagagccaguuuau

SEQ ID NO: 1847758 - RNA, 16 nt, Homo sapiens
ugaugcugagauucuu

SEQ ID NO: 1847759 - RNA, 18 nt, Homo sapiens
gccaccagggcacugucu

SEQ ID NO: 1847760 - RNA, 22 nt, Homo sapiens
agauagguggugccaguggcuu

SEQ ID NO: 1847761 - RNA, 19 nt, Homo sapiens
uaaaaugcaaaugcacuca

SEQ ID NO: 1847762 - RNA, 20 nt, Homo sapiens
ucaacauguuuuugauauuu

SEQ ID NO: 1847763 - RNA, 21 nt, Homo sapiens
auuaaacaagugcacuugaac

SEQ ID NO: 1847764 - RNA, 23 nt, Homo sapiens
gaguggcugggaggaagccagaa

SEQ ID NO: 1847765 - RNA, 22 nt, Homo sapiens
caguauauuuguccagauaauu

SEQ ID NO: 1847766 - RNA, 18 nt, Homo sapiens
auuuaguaaagcuuuucu

SEQ ID NO: 1847767 - RNA, 14 nt, Homo sapiens
gcaucaaagaaucu

SEQ ID NO: 1847768 - RNA, 17 nt, Homo sapiens
ccugaucuagcacuccu

SEQ ID NO: 1847769 - RNA, 13 nt, Homo sapiens
ugagauguguuca

SEQ ID NO: 1847770 - RNA, 23 nt, Homo sapiens
uacccucccagcgaguugcgcug

SEQ ID NO: 1847771 - RNA, 14 nt, Homo sapiens
uacuguaugccuuc

SEQ ID NO: 1847772 - RNA, 14 nt, Homo sapiens
uaauguaugcauuc

SEQ ID NO: 1847773 - RNA, 17 nt, Homo sapiens
uacgguuuucauugaca

SEQ ID NO: 1847774 - RNA, 17 nt, Homo sapiens
ugggcucgcacugccca

SEQ ID NO: 1847775 - RNA, 14 nt, Homo sapiens
cuuuucaucuccag

SEQ ID NO: 1847776 - RNA, 12 nt, Homo sapiens
ccucccagagag

SEQ ID NO: 1847777 - RNA, 11 nt, Homo sapiens
ugcaacauucu

SEQ ID NO: 1847778 - RNA, 23 nt, Homo sapiens
cauagcgcugcucuuaugccauu

SEQ ID NO: 1847779 - RNA, 17 nt, Homo sapiens
gcccugcuucacugccc

SEQ ID NO: 1847780 - RNA, 16 nt, Homo sapiens
cuggcuacugagucau

SEQ ID NO: 1847781 - RNA, 12 nt, Homo sapiens
ucauuacuguga

SEQ ID NO: 1847782 - RNA, 18 nt, Homo sapiens
caaucugcaaggacauuu

SEQ ID NO: 1847783 - RNA, 17 nt, Homo sapiens
auguggaagaacuguga

SEQ ID NO: 1847784 - RNA, 19 nt, Homo sapiens
aagucugaucccugccaaa

SEQ ID NO: 1847785 - RNA, 15 nt, Homo sapiens
gagcuccaguguccu

SEQ ID NO: 1847786 - RNA, 18 nt, Homo sapiens
ugaagggucuuucucaaa

SEQ ID NO: 1847787 - RNA, 22 nt, Homo sapiens
cauaaauuacuuuuucauucuu

SEQ ID NO: 1847788 - RNA, 15 nt, Homo sapiens
agacaaagccuuaag

SEQ ID NO: 1847789 - RNA, 19 nt, Homo sapiens
gcaggaucucagaucacug

SEQ ID NO: 1847790 - RNA, 23 nt, Homo sapiens
gguugguuuccccugcacucccg

SEQ ID NO: 1847791 - RNA, 15 nt, Homo sapiens
gcacuuacaauccca

SEQ ID NO: 1847792 - RNA, 15 nt, Homo sapiens
cuggccaaggugucc

SEQ ID NO: 1847793 - RNA, 16 nt, Homo sapiens
gggugacggcccucau

SEQ ID NO: 1847794 - RNA, 16 nt, Homo sapiens
uccucacacccauuua

SEQ ID NO: 1847795 - RNA, 18 nt, Homo sapiens
ucuacuggucuuguggaa

SEQ ID NO: 1847796 - RNA, 15 nt, Homo sapiens
aagauagcagggcau

SEQ ID NO: 1847797 - RNA, 15 nt, Homo sapiens
gaaugaacacucccc

SEQ ID NO: 1847798 - RNA, 19 nt, Homo sapiens
cucgacaagaccacacuuu

SEQ ID NO: 1847799 - RNA, 17 nt, Homo sapiens
gccucagugccacuuga

SEQ ID NO: 1847800 - RNA, 16 nt, Homo sapiens
gacauucucaucacca

SEQ ID NO: 1847801 - RNA, 13 nt, Homo sapiens
aaaggugcuccuc

SEQ ID NO: 1847802 - RNA, 19 nt, Homo sapiens
cccagcucuagccucugga

SEQ ID NO: 1847803 - RNA, 19 nt, Homo sapiens
ugacagcuuugcugcugaa

SEQ ID NO: 1847804 - RNA, 22 nt, Homo sapiens
cccaggacgccacucauuucau

SEQ ID NO: 1847805 - RNA, 18 nt, Homo sapiens
acauaauuuaauuccuuc

SEQ ID NO: 1847806 - RNA, 18 nt, Homo sapiens
cuguaauguuaauauuga

SEQ ID NO: 1847807 - RNA, 19 nt, Homo sapiens
acaguacagcuauuucuca

SEQ ID NO: 1847808 - RNA, 13 nt, Homo sapiens
gacaacgaugaau

SEQ ID NO: 1847809 - RNA, 18 nt, Homo sapiens
uucuccuaaugcucugaa

SEQ ID NO: 1847810 - RNA, 22 nt, Homo sapiens
gucacuuuuuccccugcaaugc

SEQ ID NO: 1847811 - RNA, 18 nt, Homo sapiens
uaaagaacgcgacuucca

SEQ ID NO: 1847812 - RNA, 18 nt, Homo sapiens
uguaaagaucuacaugaa

SEQ ID NO: 1847813 - RNA, 18 nt, Homo sapiens
uucccuucuuugcugcug

SEQ ID NO: 1847814 - RNA, 14 nt, Homo sapiens
auuguaaauacugg

SEQ ID NO: 1847815 - RNA, 16 nt, Homo sapiens
agcaguaaauuugcua

SEQ ID NO: 1847816 - RNA, 15 nt, Homo sapiens
cagcugggauuugaa

SEQ ID NO: 1847817 - RNA, 16 nt, Homo sapiens
cugucaccaagcauga

SEQ ID NO: 1847818 - RNA, 17 nt, Homo sapiens
uauucaaagcagcugua

SEQ ID NO: 1847819 - RNA, 17 nt, Homo sapiens
agcuugagcugcucugc

SEQ ID NO: 1847820 - RNA, 20 nt, Homo sapiens
cguauuaucuguugccuuau

SEQ ID NO: 1847821 - RNA, 20 nt, Homo sapiens
aggcaaucauggugcucaga

SEQ ID NO: 1847822 - RNA, 20 nt, Homo sapiens
uuguucuuugccagucucau

SEQ ID NO: 1847823 - RNA, 18 nt, Homo sapiens
guaggaaagucacccaaa

SEQ ID NO: 1847824 - RNA, 14 nt, Homo sapiens
acaaaaaccaaaaa

SEQ ID NO: 1847825 - RNA, 18 nt, Homo sapiens
guagcaaguucuagagaa

SEQ ID NO: 1847826 - RNA, 18 nt, Homo sapiens
uacaggcgccugccacca

SEQ ID NO: 1847827 - RNA, 20 nt, Homo sapiens
cugcuuccaauuuucuggaa

SEQ ID NO: 1847828 - RNA, 13 nt, Homo sapiens
uuaaaaaguaaaa

SEQ ID NO: 1847829 - RNA, 19 nt, Homo sapiens
aacaaaauaguuacugugc

SEQ ID NO: 1847830 - RNA, 15 nt, Homo sapiens
uuuuaacauuccuca

SEQ ID NO: 1847831 - RNA, 16 nt, Homo sapiens
aggacagaccacagag

SEQ ID NO: 1847832 - RNA, 19 nt, Homo sapiens
cucccuaguuagcauccag

SEQ ID NO: 1847833 - RNA, 14 nt, Homo sapiens
ucacacccuaccuu

SEQ ID NO: 1847834 - RNA, 14 nt, Homo sapiens
uuggcuaugccuuc

SEQ ID NO: 1847835 - RNA, 22 nt, Homo sapiens
uguaggaagucauccugccaac

SEQ ID NO: 1847836 - RNA, 19 nt, Homo sapiens
aauuaagaaugucaauuua

SEQ ID NO: 1847837 - RNA, 16 nt, Homo sapiens
cucuuaggaggcauuu

SEQ ID NO: 1847838 - RNA, 19 nt, Homo sapiens
ccuguggaugcugcugccc

SEQ ID NO: 1847839 - RNA, 20 nt, Homo sapiens
aucuggaguugaacagcaaa

SEQ ID NO: 1847840 - RNA, 17 nt, Homo sapiens
ucagagaaaacuguuga

SEQ ID NO: 1847841 - RNA, 19 nt, Homo sapiens
acaaauuauaagcauacaa

SEQ ID NO: 1847842 - RNA, 22 nt, Homo sapiens
cuucucuacacccacccaaaag

SEQ ID NO: 1847843 - RNA, 21 nt, Homo sapiens
gcucccacagucccaucugcu

SEQ ID NO: 1847844 - RNA, 21 nt, Homo sapiens
ccaacuucauuugaugcuaaa

SEQ ID NO: 1847845 - RNA, 21 nt, Homo sapiens
gacauuaacaguuuuccauga

SEQ ID NO: 1847846 - RNA, 15 nt, Homo sapiens
gccacccauucuucc

SEQ ID NO: 1847847 - RNA, 17 nt, Homo sapiens
cccaucccccaccugcc

SEQ ID NO: 1847848 - RNA, 15 nt, Homo sapiens
cuagcauccacugau

SEQ ID NO: 1847849 - RNA, 23 nt, Homo sapiens
aggugccccgugguacauucaca

SEQ ID NO: 1847850 - RNA, 19 nt, Homo sapiens
guagcaaauuaacuuuaca

SEQ ID NO: 1847851 - RNA, 19 nt, Homo sapiens
gccugagucacccaugaag

SEQ ID NO: 1847852 - RNA, 15 nt, Homo sapiens
ugcuucucuuucaca

SEQ ID NO: 1847853 - RNA, 22 nt, Homo sapiens
ccacaggcuuacgcugcucucc

SEQ ID NO: 1847854 - RNA, 13 nt, Homo sapiens
ucacuguugcuua

SEQ ID NO: 1847855 - RNA, 22 nt, Homo sapiens
ccagguaugaccuuuuaaguga

SEQ ID NO: 1847856 - RNA, 17 nt, Homo sapiens
cgcagcccccacugacc

SEQ ID NO: 1847857 - RNA, 15 nt, Homo sapiens
agaauucuuacaugu

SEQ ID NO: 1847858 - RNA, 14 nt, Homo sapiens
aucuucuacuguau

SEQ ID NO: 1847859 - RNA, 14 nt, Homo sapiens
aagcacuacaccuu

SEQ ID NO: 1847860 - RNA, 20 nt, Homo sapiens
ugugaagaauuuagaucuua

SEQ ID NO: 1847861 - RNA, 20 nt, Homo sapiens
accacugcccugacugucac

SEQ ID NO: 1847862 - RNA, 22 nt, Homo sapiens
caugcaaguuacugcaguucau

SEQ ID NO: 1847863 - RNA, 13 nt, Homo sapiens
ccugugaggugca

SEQ ID NO: 1847864 - RNA, 17 nt, Homo sapiens
cagcagccuacugagua

SEQ ID NO: 1847865 - RNA, 13 nt, Homo sapiens
gaaggucaccagc

SEQ ID NO: 1847866 - RNA, 14 nt, Homo sapiens
ggcagugcaugugg

SEQ ID NO: 1847867 - RNA, 16 nt, Homo sapiens
caagcccaggugccag

SEQ ID NO: 1847868 - RNA, 19 nt, Homo sapiens
auggaguggcugccaugga

SEQ ID NO: 1847869 - RNA, 13 nt, Homo sapiens
cugcgggggagug

SEQ ID NO: 1847870 - RNA, 14 nt, Homo sapiens
ccucacacagcccu

SEQ ID NO: 1847871 - RNA, 18 nt, Homo sapiens
ucucaggccugacucuca

SEQ ID NO: 1847872 - RNA, 19 nt, Homo sapiens
uccauuuggugaccaucug

SEQ ID NO: 1847873 - RNA, 20 nt, Homo sapiens
auuuuaaaugacgcacaaac

SEQ ID NO: 1847874 - RNA, 16 nt, Homo sapiens
ucccuaauucugccuu

SEQ ID NO: 1847875 - RNA, 12 nt, Homo sapiens
aaguugcacaug

SEQ ID NO: 1847876 - RNA, 20 nt, Homo sapiens
aauguuuuuggcaacaggag

SEQ ID NO: 1847877 - RNA, 15 nt, Homo sapiens
uauuucagcugcuuu

SEQ ID NO: 1847878 - RNA, 14 nt, Homo sapiens
ccuccccaauccau

SEQ ID NO: 1847879 - RNA, 16 nt, Homo sapiens
gagcuguuaccauuca

SEQ ID NO: 1847880 - RNA, 13 nt, Homo sapiens
caacuguuuucau

SEQ ID NO: 1847881 - RNA, 12 nt, Homo sapiens
gcccagcacuug

SEQ ID NO: 1847882 - RNA, 18 nt, Homo sapiens
uccaacuaucucauuucc

SEQ ID NO: 1847883 - RNA, 13 nt, Homo sapiens
gcagcccagagac

SEQ ID NO: 1847884 - RNA, 24 nt, Homo sapiens
ugguauccuacugagcauuugcac

SEQ ID NO: 1847885 - RNA, 17 nt, Homo sapiens
agcuucugccacuuccc

SEQ ID NO: 1847886 - RNA, 18 nt, Homo sapiens
uauaaauacacuuccugc

SEQ ID NO: 1847887 - RNA, 23 nt, Homo sapiens
uggcccuguugugggggugucac

SEQ ID NO: 1847888 - RNA, 19 nt, Homo sapiens
gguucaccauguugcccag

SEQ ID NO: 1847889 - RNA, 21 nt, Homo sapiens
aacaacacgauuuacauaaaa

SEQ ID NO: 1847890 - RNA, 14 nt, Homo sapiens
cccacaagccagga

SEQ ID NO: 1847891 - RNA, 17 nt, Homo sapiens
cacugcaaaaugucuua

SEQ ID NO: 1847892 - RNA, 14 nt, Homo sapiens
uuguggugcauuga

SEQ ID NO: 1847893 - RNA, 16 nt, Homo sapiens
augugcagcauuucac

SEQ ID NO: 1847894 - RNA, 19 nt, Homo sapiens
cuguuauauuucaucauga

SEQ ID NO: 1847895 - RNA, 16 nt, Homo sapiens
auuuuuguacauguuc

SEQ ID NO: 1847896 - RNA, 17 nt, Homo sapiens
caccuguucuuuccucc

SEQ ID NO: 1847897 - RNA, 19 nt, Homo sapiens
gagucugugcugguugcca

SEQ ID NO: 1847898 - RNA, 14 nt, Homo sapiens
cagggaagcccuga

SEQ ID NO: 1847899 - RNA, 15 nt, Homo sapiens
aagcugauucacuau

SEQ ID NO: 1847900 - RNA, 18 nt, Homo sapiens
acacuauugcauuguuca

SEQ ID NO: 1847901 - RNA, 14 nt, Homo sapiens
gccaggccuguaug

SEQ ID NO: 1847902 - RNA, 18 nt, Homo sapiens
ucggcccuguuccccaag

SEQ ID NO: 1847903 - RNA, 15 nt, Homo sapiens
cuggcucacaguaca

SEQ ID NO: 1847904 - RNA, 20 nt, Homo sapiens
caggcugcagucccuggaaa

SEQ ID NO: 1847905 - RNA, 16 nt, Homo sapiens
cugagggcagacuggg

SEQ ID NO: 1847906 - RNA, 20 nt, Homo sapiens
uggcagcuagccagugcuca

SEQ ID NO: 1847907 - RNA, 15 nt, Homo sapiens
gcaucuuugcccuuc

SEQ ID NO: 1847908 - RNA, 14 nt, Homo sapiens
uugaacuccugacg

SEQ ID NO: 1847909 - RNA, 21 nt, Homo sapiens
augagggugacguagaauuga

SEQ ID NO: 1847910 - RNA, 18 nt, Homo sapiens
gacaaaauguugauaaau

SEQ ID NO: 1847911 - RNA, 17 nt, Homo sapiens
aaaccagaacaguauga

SEQ ID NO: 1847912 - RNA, 22 nt, Homo sapiens
caagaccugauuucugagcauu

SEQ ID NO: 1847913 - RNA, 17 nt, Homo sapiens
ccucaucucacugccca

SEQ ID NO: 1847914 - RNA, 14 nt, Homo sapiens
uaacagugaagauu

SEQ ID NO: 1847915 - RNA, 14 nt, Homo sapiens
ucuauguaugcauc

SEQ ID NO: 1847916 - RNA, 20 nt, Homo sapiens
guucccuuugcuugucuucu

SEQ ID NO: 1847917 - RNA, 21 nt, Homo sapiens
acauuugccaacucgaacaaa

SEQ ID NO: 1847918 - RNA, 17 nt, Homo sapiens
ugcaaacaguucuugga

SEQ ID NO: 1847919 - RNA, 21 nt, Homo sapiens
agugccauuccacuccacuca

SEQ ID NO: 1847920 - RNA, 14 nt, Homo sapiens
ugaaagccacaaug

SEQ ID NO: 1847921 - RNA, 16 nt, Homo sapiens
aacuaccagugggcau

SEQ ID NO: 1847922 - RNA, 17 nt, Homo sapiens
cccuggggcugugcauu

SEQ ID NO: 1847923 - RNA, 22 nt, Homo sapiens
gagcuuuugcccacacacuuuc

SEQ ID NO: 1847924 - RNA, 22 nt, Homo sapiens
aggccagugccagcaccugccc

SEQ ID NO: 1847925 - RNA, 17 nt, Homo sapiens
guuaugcuuuacugcga

SEQ ID NO: 1847926 - RNA, 14 nt, Homo sapiens
cagagcuuuggcca

SEQ ID NO: 1847927 - RNA, 21 nt, Homo sapiens
caacuucauuugaugcuaaau

SEQ ID NO: 1847928 - RNA, 14 nt, Homo sapiens
ggagaggggggcca

SEQ ID NO: 1847929 - RNA, 14 nt, Homo sapiens
uuuauaaugauuca

SEQ ID NO: 1847930 - RNA, 17 nt, Homo sapiens
aauugaaacacagaguu

SEQ ID NO: 1847931 - RNA, 17 nt, Homo sapiens
uauucaaacacacagua

SEQ ID NO: 1847932 - RNA, 16 nt, Homo sapiens
cacaauccuugccaca

SEQ ID NO: 1847933 - RNA, 19 nt, Homo sapiens
agaugucuucuugcaauau

SEQ ID NO: 1847934 - RNA, 18 nt, Homo sapiens
agacacaaaugcaugaac

SEQ ID NO: 1847935 - RNA, 18 nt, Homo sapiens
gaccccacugccaagugg

SEQ ID NO: 1847936 - RNA, 16 nt, Homo sapiens
accagaccacucugcu

SEQ ID NO: 1847937 - RNA, 22 nt, Homo sapiens
agacugaaaauauauaagcuca

SEQ ID NO: 1847938 - RNA, 21 nt, Homo sapiens
caugcuuccuccuuugcucuu

SEQ ID NO: 1847939 - RNA, 16 nt, Homo sapiens
cauuuggugacugugu

SEQ ID NO: 1847940 - RNA, 22 nt, Homo sapiens
cuccuccugcucugcccaggag

SEQ ID NO: 1847941 - RNA, 22 nt, Homo sapiens
gucuuaguacauccucacuuuu

SEQ ID NO: 1847942 - RNA, 15 nt, Homo sapiens
cagagaacccugugg

SEQ ID NO: 1847943 - RNA, 21 nt, Homo sapiens
ccacguccugggugcugucau

SEQ ID NO: 1847944 - RNA, 12 nt, Homo sapiens
acacuuucccau

SEQ ID NO: 1847945 - RNA, 22 nt, Homo sapiens
guauuugguauauacuuugcca

SEQ ID NO: 1847946 - RNA, 18 nt, Homo sapiens
cuuucccaaaacugccac

SEQ ID NO: 1847947 - RNA, 23 nt, Homo sapiens
uauggacaaaauuaauacauucu

SEQ ID NO: 1847948 - RNA, 17 nt, Homo sapiens
gcaaacguuucuugaac

SEQ ID NO: 1847949 - RNA, 13 nt, Homo sapiens
caaacaagcacau

SEQ ID NO: 1847950 - RNA, 10 nt, Homo sapiens
gccagugugu

SEQ ID NO: 1847951 - RNA, 17 nt, Homo sapiens
gccuccugaguucaagc

SEQ ID NO: 1847952 - RNA, 15 nt, Homo sapiens
cuaaugucagaguag

SEQ ID NO: 1847953 - RNA, 16 nt, Homo sapiens
agucauaucuuaauau

SEQ ID NO: 1847954 - RNA, 17 nt, Homo sapiens
ugccauuccagcuuccu

SEQ ID NO: 1847955 - RNA, 21 nt, Homo sapiens
uuuaaaaucauuucugcauca

SEQ ID NO: 1847956 - RNA, 21 nt, Homo sapiens
cuuuucucucuauuuguauug

SEQ ID NO: 1847957 - RNA, 21 nt, Homo sapiens
ccuaauuccacagcugcucaa

SEQ ID NO: 1847958 - RNA, 19 nt, Homo sapiens
aaauaaauaugaauggagu

SEQ ID NO: 1847959 - RNA, 19 nt, Homo sapiens
cagcaguccacaaagcauu

SEQ ID NO: 1847960 - RNA, 19 nt, Homo sapiens
ccucaccauuuuuguucua

SEQ ID NO: 1847961 - RNA, 18 nt, Homo sapiens
gucuauagaaaugaucau

SEQ ID NO: 1847962 - RNA, 21 nt, Homo sapiens
guauuuccuuccacuguagcu

SEQ ID NO: 1847963 - RNA, 21 nt, Homo sapiens
cuuaagccagcacucacacca

SEQ ID NO: 1847964 - RNA, 22 nt, Homo sapiens
cggauugcucuggagcagccaa

SEQ ID NO: 1847965 - RNA, 14 nt, Homo sapiens
cagagcuggaacac

SEQ ID NO: 1847966 - RNA, 23 nt, Homo sapiens
uggugugaucccagcucacugca

SEQ ID NO: 1847967 - RNA, 21 nt, Homo sapiens
acaccacgcuggagcugugua

SEQ ID NO: 1847968 - RNA, 16 nt, Homo sapiens
ugcagguugcauaggu

SEQ ID NO: 1847969 - RNA, 20 nt, Homo sapiens
cagagaguugauggggugca

SEQ ID NO: 1847970 - RNA, 20 nt, Homo sapiens
auuacuuugaaagaugaaaa

SEQ ID NO: 1847971 - RNA, 12 nt, Homo sapiens
ugucacaaagau

SEQ ID NO: 1847972 - RNA, 12 nt, Homo sapiens
ucucacaaacau

SEQ ID NO: 1847973 - RNA, 22 nt, Homo sapiens
auucauucccuucucucagccu

SEQ ID NO: 1847974 - RNA, 18 nt, Homo sapiens
ccucuguucauuucacac

SEQ ID NO: 1847975 - RNA, 18 nt, Homo sapiens
augugauuuauuuugaaa

SEQ ID NO: 1847976 - RNA, 16 nt, Homo sapiens
agauccacccaaauau

SEQ ID NO: 1847977 - RNA, 19 nt, Homo sapiens
cgaaacaguuugaaaggga

SEQ ID NO: 1847978 - RNA, 21 nt, Homo sapiens
cuuaaaugcucauuuucuggu

SEQ ID NO: 1847979 - RNA, 20 nt, Homo sapiens
cuccuuuuuaauacauuaag

SEQ ID NO: 1847980 - RNA, 14 nt, Homo sapiens
gccuucacugacag

SEQ ID NO: 1847981 - RNA, 18 nt, Homo sapiens
aauccauuuuacacagca

SEQ ID NO: 1847982 - RNA, 19 nt, Homo sapiens
agcagguggcaucucuaau

SEQ ID NO: 1847983 - RNA, 15 nt, Homo sapiens
ggaaaacaguaacua

SEQ ID NO: 1847984 - RNA, 14 nt, Homo sapiens
cagagcacuuuagc

SEQ ID NO: 1847985 - RNA, 19 nt, Homo sapiens
aaugauaccuacauucuaa

SEQ ID NO: 1847986 - RNA, 18 nt, Homo sapiens
cuggcaccaccaggcacc

SEQ ID NO: 1847987 - RNA, 14 nt, Homo sapiens
cacugggaucacag

SEQ ID NO: 1847988 - RNA, 14 nt, Homo sapiens
cucuuuaccaaaau

SEQ ID NO: 1847989 - RNA, 20 nt, Homo sapiens
cacuggcaucucacuuuaug

SEQ ID NO: 1847990 - RNA, 20 nt, Homo sapiens
gaauagguuucaacauauga

SEQ ID NO: 1847991 - RNA, 15 nt, Homo sapiens
ugcaccaaguacagc

SEQ ID NO: 1847992 - RNA, 21 nt, Homo sapiens
uccuagauguuuccccagacc

SEQ ID NO: 1847993 - RNA, 23 nt, Homo sapiens
ggucucagccuaggcccucauga

SEQ ID NO: 1847994 - RNA, 15 nt, Homo sapiens
auauguaaagcacau

SEQ ID NO: 1847995 - RNA, 15 nt, Homo sapiens
aauaaaucuuuggaa

SEQ ID NO: 1847996 - RNA, 15 nt, Homo sapiens
ugucaaauggaugua

SEQ ID NO: 1847997 - RNA, 18 nt, Homo sapiens
agcccccuuuucuugacc

SEQ ID NO: 1847998 - RNA, 23 nt, Homo sapiens
caggcugagcaccucagccuuua

SEQ ID NO: 1847999 - RNA, 12 nt, Homo sapiens
uuuaauuccaua

SEQ ID NO: 1848000 - RNA, 17 nt, Homo sapiens
gccauggggcccuccca

SEQ ID NO: 1848001 - RNA, 13 nt, Homo sapiens
agaccucagggac

SEQ ID NO: 1848002 - RNA, 20 nt, Homo sapiens
cugaucaauugaccuuguga

SEQ ID NO: 1848003 - RNA, 20 nt, Homo sapiens
agcuauuuaagaaaaguauc

SEQ ID NO: 1848004 - RNA, 20 nt, Homo sapiens
ucguggguguguguagccaa

SEQ ID NO: 1848005 - RNA, 18 nt, Homo sapiens
cacaucaagacuaucuac

SEQ ID NO: 1848006 - RNA, 22 nt, Homo sapiens
gagaagccggcucuucaaagac

SEQ ID NO: 1848007 - RNA, 14 nt, Homo sapiens
ucucugcuauggaa

SEQ ID NO: 1848008 - RNA, 21 nt, Homo sapiens
uuccacacccucacugcugua

SEQ ID NO: 1848009 - RNA, 18 nt, Homo sapiens
cucucugagacugcuaag

SEQ ID NO: 1848010 - RNA, 17 nt, Homo sapiens
auagauacuuuugauaa

SEQ ID NO: 1848011 - RNA, 22 nt, Homo sapiens
ugcuacuuuuuuuuaguucaau

SEQ ID NO: 1848012 - RNA, 18 nt, Homo sapiens
uguuuuguguaacauauu

SEQ ID NO: 1848013 - RNA, 13 nt, Homo sapiens
ccugguuaauuca

SEQ ID NO: 1848014 - RNA, 14 nt, Homo sapiens
auggcaacaaacac

SEQ ID NO: 1848015 - RNA, 17 nt, Homo sapiens
cagcccccugaccugga

SEQ ID NO: 1848016 - RNA, 22 nt, Homo sapiens
cacuaaauucuagaaaguacuu

SEQ ID NO: 1848017 - RNA, 15 nt, Homo sapiens
ucacuacuacaucug

SEQ ID NO: 1848018 - RNA, 20 nt, Homo sapiens
aacaucacaccauugcacuc

SEQ ID NO: 1848019 - RNA, 18 nt, Homo sapiens
caguuguggccucauuca

SEQ ID NO: 1848020 - RNA, 14 nt, Homo sapiens
ugugauaucuaaua

SEQ ID NO: 1848021 - RNA, 18 nt, Homo sapiens
uuggaaggcaaagacauu

SEQ ID NO: 1848022 - RNA, 20 nt, Homo sapiens
agcaaugggacuggagucag

SEQ ID NO: 1848023 - RNA, 15 nt, Homo sapiens
uucagcaccaagcau

SEQ ID NO: 1848024 - RNA, 19 nt, Homo sapiens
uauaaaccuaaaaaagaua

SEQ ID NO: 1848025 - RNA, 17 nt, Homo sapiens
aacuguaccaugugcua

SEQ ID NO: 1848026 - RNA, 20 nt, Homo sapiens
auguguuuaaauacugcaau

SEQ ID NO: 1848027 - RNA, 14 nt, Homo sapiens
ggacgcagccacac

SEQ ID NO: 1848028 - RNA, 22 nt, Homo sapiens
gaaaguuuaacaaaugacugua

SEQ ID NO: 1848029 - RNA, 13 nt, Homo sapiens
aucuuuccuccaa

SEQ ID NO: 1848030 - RNA, 13 nt, Homo sapiens
ccacuugacagac

SEQ ID NO: 1848031 - RNA, 19 nt, Homo sapiens
uaaaauauccuuucaucaa

SEQ ID NO: 1848032 - RNA, 18 nt, Homo sapiens
ccagaacaaucuggauuu

SEQ ID NO: 1848033 - RNA, 14 nt, Homo sapiens
cgguuuaauucugu

SEQ ID NO: 1848034 - RNA, 16 nt, Homo sapiens
caggggccucagggga

SEQ ID NO: 1848035 - RNA, 14 nt, Homo sapiens
uggcugggcccagc

SEQ ID NO: 1848036 - RNA, 19 nt, Homo sapiens
aacauguaaaacaguuaca

SEQ ID NO: 1848037 - RNA, 18 nt, Homo sapiens
ugccuucucaugauccaa

SEQ ID NO: 1848038 - RNA, 12 nt, Homo sapiens
acaagugucagg

SEQ ID NO: 1848039 - RNA, 14 nt, Homo sapiens
cuuuaaaccaccua

SEQ ID NO: 1848040 - RNA, 19 nt, Homo sapiens
augauacugcugcuuguca

SEQ ID NO: 1848041 - RNA, 20 nt, Homo sapiens
ggaagagaaaauacuacuuu

SEQ ID NO: 1848042 - RNA, 21 nt, Homo sapiens
ucuccaagcacuagccuuccc

SEQ ID NO: 1848043 - RNA, 15 nt, Homo sapiens
ucuggacuccaccuu

SEQ ID NO: 1848044 - RNA, 18 nt, Homo sapiens
guucuucuuggucucagu

SEQ ID NO: 1848045 - RNA, 16 nt, Homo sapiens
acucuucucauuacuu

SEQ ID NO: 1848046 - RNA, 12 nt, Homo sapiens
uucucugugaag

SEQ ID NO: 1848047 - RNA, 19 nt, Homo sapiens
acaguauagauaaauccaa

SEQ ID NO: 1848048 - RNA, 13 nt, Homo sapiens
gcuccauuccuga

SEQ ID NO: 1848049 - RNA, 23 nt, Homo sapiens
agaugaauggucuggcaauauuc

SEQ ID NO: 1848050 - RNA, 21 nt, Homo sapiens
auaaaauguuuucacuguaau

SEQ ID NO: 1848051 - RNA, 18 nt, Homo sapiens
ccacagacucaaaugcuc

SEQ ID NO: 1848052 - RNA, 15 nt, Homo sapiens
uaaauguugcaaugc

SEQ ID NO: 1848053 - RNA, 15 nt, Homo sapiens
uuaauuuaauugcuu

SEQ ID NO: 1848054 - RNA, 17 nt, Homo sapiens
aauuaauaucacagcau

SEQ ID NO: 1848055 - RNA, 13 nt, Homo sapiens
agucacaauuuca

SEQ ID NO: 1848056 - RNA, 12 nt, Homo sapiens
cgcgcucaggag

SEQ ID NO: 1848057 - RNA, 18 nt, Homo sapiens
gcaaaaaaaucauauaag

SEQ ID NO: 1848058 - RNA, 19 nt, Homo sapiens
ccucauccaugcugugcug

SEQ ID NO: 1848059 - RNA, 24 nt, Homo sapiens
gacuguggaacuauuuuaccuuaa

SEQ ID NO: 1848060 - RNA, 13 nt, Homo sapiens
gugucucauucuc

SEQ ID NO: 1848061 - RNA, 13 nt, Homo sapiens
ugcgcucaggggc

SEQ ID NO: 1848062 - RNA, 17 nt, Homo sapiens
gcauaaaaaaccacagc

SEQ ID NO: 1848063 - RNA, 16 nt, Homo sapiens
ggccuccugugugugc

SEQ ID NO: 1848064 - RNA, 15 nt, Homo sapiens
aucagcuaugcaaau

SEQ ID NO: 1848065 - RNA, 20 nt, Homo sapiens
cacgugggcaaacaggcagu

SEQ ID NO: 1848066 - RNA, 21 nt, Homo sapiens
gacugcaacaggaacuuggag

SEQ ID NO: 1848067 - RNA, 22 nt, Homo sapiens
gagcugcccccuccaggccagu

SEQ ID NO: 1848068 - RNA, 21 nt, Homo sapiens
ugucugugaguaccuggucau

SEQ ID NO: 1848069 - RNA, 17 nt, Homo sapiens
cuauuuccacugaacaa

SEQ ID NO: 1848070 - RNA, 20 nt, Homo sapiens
gccucccccucagaugaucu

SEQ ID NO: 1848071 - RNA, 16 nt, Homo sapiens
accuacccaugaccug

SEQ ID NO: 1848072 - RNA, 20 nt, Homo sapiens
aggccacuugaugaccccca

SEQ ID NO: 1848073 - RNA, 17 nt, Homo sapiens
agcgggacucuguccaa

SEQ ID NO: 1848074 - RNA, 22 nt, Homo sapiens
aggucugcugcccaggaacccu

SEQ ID NO: 1848075 - RNA, 14 nt, Homo sapiens
ggcagcuucugccc

SEQ ID NO: 1848076 - RNA, 15 nt, Homo sapiens
auuucauuaccaagu

SEQ ID NO: 1848077 - RNA, 14 nt, Homo sapiens
cccgggcauccagu

SEQ ID NO: 1848078 - RNA, 22 nt, Homo sapiens
agacacuccccccuccauuccc

SEQ ID NO: 1848079 - RNA, 20 nt, Homo sapiens
ugcaguccugggauguggcu

SEQ ID NO: 1848080 - RNA, 23 nt, Homo sapiens
aggccuuugcuuuacagcacugu

SEQ ID NO: 1848081 - RNA, 17 nt, Homo sapiens
gagcaguccugccucag

SEQ ID NO: 1848082 - RNA, 16 nt, Homo sapiens
ucaggugaacacuuag

SEQ ID NO: 1848083 - RNA, 18 nt, Homo sapiens
uuuggcuggaauuacaaa

SEQ ID NO: 1848084 - RNA, 21 nt, Homo sapiens
cagucuagggugaacaauccc

SEQ ID NO: 1848085 - RNA, 18 nt, Homo sapiens
uuaaaugaaccaaaccaa

SEQ ID NO: 1848086 - RNA, 11 nt, Homo sapiens
gucugcagcuc

SEQ ID NO: 1848087 - RNA, 15 nt, Homo sapiens
aauggaacucgcuca

SEQ ID NO: 1848088 - RNA, 20 nt, Homo sapiens
gacaauuugcugccaaacac

SEQ ID NO: 1848089 - RNA, 14 nt, Homo sapiens
aaaccaggacauua

SEQ ID NO: 1848090 - RNA, 14 nt, Homo sapiens
guuuccacacagcc

SEQ ID NO: 1848091 - RNA, 16 nt, Homo sapiens
uaguuggaaagcaaag

SEQ ID NO: 1848092 - RNA, 14 nt, Homo sapiens
gaggauguggcugu

SEQ ID NO: 1848093 - RNA, 21 nt, Homo sapiens
ccuggagugcccugcaggcac

SEQ ID NO: 1848094 - RNA, 17 nt, Homo sapiens
gucuucagcacauucca

SEQ ID NO: 1848095 - RNA, 18 nt, Homo sapiens
guacaccacaagggucac

SEQ ID NO: 1848096 - RNA, 15 nt, Homo sapiens
uggcuaacacaguga

SEQ ID NO: 1848097 - RNA, 17 nt, Homo sapiens
cauuuauccacaggaaa

SEQ ID NO: 1848098 - RNA, 19 nt, Homo sapiens
cguucgauuucuaccucag

SEQ ID NO: 1848099 - RNA, 16 nt, Homo sapiens
cauguuauucucucac

SEQ ID NO: 1848100 - RNA, 19 nt, Homo sapiens
ccagcauuuuuauaaacua

SEQ ID NO: 1848101 - RNA, 20 nt, Homo sapiens
acagacacucccacuuggca

SEQ ID NO: 1848102 - RNA, 13 nt, Homo sapiens
cuagccaaucaga

SEQ ID NO: 1848103 - RNA, 14 nt, Homo sapiens
acgccgagaaggcc

SEQ ID NO: 1848104 - RNA, 22 nt, Homo sapiens
gccucagccuggggcucucuga

SEQ ID NO: 1848105 - RNA, 13 nt, Homo sapiens
agcagauuugcac

SEQ ID NO: 1848106 - RNA, 19 nt, Homo sapiens
augaggaccuccuaccccc

SEQ ID NO: 1848107 - RNA, 16 nt, Homo sapiens
accaauuccaauuuca

SEQ ID NO: 1848108 - RNA, 20 nt, Homo sapiens
cccuuacccucccaccacuc

SEQ ID NO: 1848109 - RNA, 20 nt, Homo sapiens
cuuauuaaaaaucuaacaaa

SEQ ID NO: 1848110 - RNA, 20 nt, Homo sapiens
cucuugggcugagacuggau

SEQ ID NO: 1848111 - RNA, 13 nt, Homo sapiens
agaaccucuuccc

SEQ ID NO: 1848112 - RNA, 18 nt, Homo sapiens
cuuacuccaucgugugug

SEQ ID NO: 1848113 - RNA, 12 nt, Homo sapiens
gcugucugcuca

SEQ ID NO: 1848114 - RNA, 15 nt, Homo sapiens
caaaucaaaaucucu

SEQ ID NO: 1848115 - RNA, 16 nt, Homo sapiens
ggacagcacacgguga

SEQ ID NO: 1848116 - RNA, 19 nt, Homo sapiens
agagaaacugaggcccaga

SEQ ID NO: 1848117 - RNA, 18 nt, Homo sapiens
uuccuccuuucucuguau

SEQ ID NO: 1848118 - RNA, 19 nt, Homo sapiens
gaauaucuguaaugguacu

SEQ ID NO: 1848119 - RNA, 15 nt, Homo sapiens
augacaucaacauuc

SEQ ID NO: 1848120 - RNA, 19 nt, Homo sapiens
acaaaaguuaaccaggugu

SEQ ID NO: 1848121 - RNA, 21 nt, Homo sapiens
gcuguuuccaguuguuacuga

SEQ ID NO: 1848122 - RNA, 17 nt, Homo sapiens
aaacaauauguuugcaa

SEQ ID NO: 1848123 - RNA, 14 nt, Homo sapiens
aagacaaauucugu

SEQ ID NO: 1848124 - RNA, 23 nt, Homo sapiens
uuuuuaauaaaaguacugaagac

SEQ ID NO: 1848125 - RNA, 19 nt, Homo sapiens
cuggcacugcuuccaguga

SEQ ID NO: 1848126 - RNA, 18 nt, Homo sapiens
uauuauuugcacagaaga

SEQ ID NO: 1848127 - RNA, 20 nt, Homo sapiens
augcugcuuccacucagggc

SEQ ID NO: 1848128 - RNA, 17 nt, Homo sapiens
accccuguuucuggcac

SEQ ID NO: 1848129 - RNA, 16 nt, Homo sapiens
ucaguuggcccuuuaa

SEQ ID NO: 1848130 - RNA, 14 nt, Homo sapiens
ccagaucacugcca

SEQ ID NO: 1848131 - RNA, 14 nt, Homo sapiens
ccagcucacugcaa

SEQ ID NO: 1848132 - RNA, 10 nt, Homo sapiens
acaacacuga

SEQ ID NO: 1848133 - RNA, 21 nt, Homo sapiens
gacaaagccaaacucugccag

SEQ ID NO: 1848134 - RNA, 16 nt, Homo sapiens
gcauguccacgugugu

SEQ ID NO: 1848135 - RNA, 11 nt, Homo sapiens
caggagaagaa

SEQ ID NO: 1848136 - RNA, 16 nt, Homo sapiens
gcaguaucacaggcca

SEQ ID NO: 1848137 - RNA, 13 nt, Homo sapiens
guuagucuuaccg

SEQ ID NO: 1848138 - RNA, 17 nt, Homo sapiens
aagaugaucauuugccc

SEQ ID NO: 1848139 - RNA, 22 nt, Homo sapiens
ccaauuuaaagaaaacuguuaa

SEQ ID NO: 1848140 - RNA, 17 nt, Homo sapiens
aguguuccucaccaaua

SEQ ID NO: 1848141 - RNA, 21 nt, Homo sapiens
auucaauuaguggucauaaaa

SEQ ID NO: 1848142 - RNA, 14 nt, Homo sapiens
aacggaacucuuca

SEQ ID NO: 1848143 - RNA, 22 nt, Homo sapiens
caaauaaauaagaucagacucu

SEQ ID NO: 1848144 - RNA, 22 nt, Homo sapiens
cacugaggcauuuuuacuacua

SEQ ID NO: 1848145 - RNA, 16 nt, Homo sapiens
caggaaggacuaugaa

SEQ ID NO: 1848146 - RNA, 18 nt, Homo sapiens
aauacggaacacugucaa

SEQ ID NO: 1848147 - RNA, 22 nt, Homo sapiens
agaauaaagccucugugcugca

SEQ ID NO: 1848148 - RNA, 15 nt, Homo sapiens
caguaacacagugca

SEQ ID NO: 1848149 - RNA, 15 nt, Homo sapiens
aaagcaccauuguga

SEQ ID NO: 1848150 - RNA, 20 nt, Homo sapiens
gcaguggccaggcagggagu

SEQ ID NO: 1848151 - RNA, 19 nt, Homo sapiens
acacaguguuuccugagua

SEQ ID NO: 1848152 - RNA, 21 nt, Homo sapiens
auuucuggaaugcuucugcau

SEQ ID NO: 1848153 - RNA, 15 nt, Homo sapiens
caagcugcauggcaa

SEQ ID NO: 1848154 - RNA, 20 nt, Homo sapiens
caaacuuuuuccagcaaaau

SEQ ID NO: 1848155 - RNA, 23 nt, Homo sapiens
ccaagcugugcccugaccacccu

SEQ ID NO: 1848156 - RNA, 17 nt, Homo sapiens
cuuucugaauugcacau

SEQ ID NO: 1848157 - RNA, 14 nt, Homo sapiens
aucauauauauagu

SEQ ID NO: 1848158 - RNA, 16 nt, Homo sapiens
acacagagauaugcac

SEQ ID NO: 1848159 - RNA, 22 nt, Homo sapiens
caaggccuuacugucugcacuu

SEQ ID NO: 1848160 - RNA, 19 nt, Homo sapiens
ccuuccagagaacacaggg

SEQ ID NO: 1848161 - RNA, 22 nt, Homo sapiens
gugcaagaccgagauugaggga

SEQ ID NO: 1848162 - RNA, 15 nt, Homo sapiens
agucccacacugugg

SEQ ID NO: 1848163 - RNA, 18 nt, Homo sapiens
gucaauccugucauauaa

SEQ ID NO: 1848164 - RNA, 14 nt, Homo sapiens
ccuccggggcucag

SEQ ID NO: 1848165 - RNA, 19 nt, Homo sapiens
agguauaugccaaaucucu

SEQ ID NO: 1848166 - RNA, 19 nt, Homo sapiens
uucuacucuucaaccucua

SEQ ID NO: 1848167 - RNA, 19 nt, Homo sapiens
ccaucucucccacuuccuc

SEQ ID NO: 1848168 - RNA, 21 nt, Homo sapiens
aauuugauguuuacaggugga

SEQ ID NO: 1848169 - RNA, 12 nt, Homo sapiens
ugcugccuucac

SEQ ID NO: 1848170 - RNA, 16 nt, Homo sapiens
gaauuauugacacuga

SEQ ID NO: 1848171 - RNA, 16 nt, Homo sapiens
uguucuuugcagugaa

SEQ ID NO: 1848172 - RNA, 23 nt, Homo sapiens
agugcugcuauaucuauccauuu

SEQ ID NO: 1848173 - RNA, 18 nt, Homo sapiens
uagcaggaaguacucaua

SEQ ID NO: 1848174 - RNA, 16 nt, Homo sapiens
uaaguuuuauacauaa

SEQ ID NO: 1848175 - RNA, 16 nt, Homo sapiens
uacauaccuacugacu

SEQ ID NO: 1848176 - RNA, 21 nt, Homo sapiens
caaugugauucuaaugucuuc

SEQ ID NO: 1848177 - RNA, 18 nt, Homo sapiens
cacauccccagaauccau

SEQ ID NO: 1848178 - RNA, 14 nt, Homo sapiens
gaaugcauguguga

SEQ ID NO: 1848179 - RNA, 11 nt, Homo sapiens
aacugugauaa

SEQ ID NO: 1848180 - RNA, 17 nt, Homo sapiens
acccacuucucaucaca

SEQ ID NO: 1848181 - RNA, 21 nt, Homo sapiens
guuguucaaauguuccuuuua

SEQ ID NO: 1848182 - RNA, 23 nt, Homo sapiens
cuuuuuuuuuuuuaaaccaggga

SEQ ID NO: 1848183 - RNA, 13 nt, Homo sapiens
uccagacucucau

SEQ ID NO: 1848184 - RNA, 14 nt, Homo sapiens
ugcacccuggaagg

SEQ ID NO: 1848185 - RNA, 11 nt, Homo sapiens
aaaacauaucu

SEQ ID NO: 1848186 - RNA, 12 nt, Homo sapiens
ugaaugcuuccu

SEQ ID NO: 1848187 - RNA, 23 nt, Homo sapiens
aucacugaucuaagcaguggcau

SEQ ID NO: 1848188 - RNA, 12 nt, Homo sapiens
aaauuuacuuuu

SEQ ID NO: 1848189 - RNA, 12 nt, Homo sapiens
uaacuuacauuc

SEQ ID NO: 1848190 - RNA, 14 nt, Homo sapiens
cgauuauaaucucc

SEQ ID NO: 1848191 - RNA, 18 nt, Homo sapiens
augcaucugcuacugugu

SEQ ID NO: 1848192 - RNA, 14 nt, Homo sapiens
ugagcggaccuucc

SEQ ID NO: 1848193 - RNA, 21 nt, Homo sapiens
cucugcgccggacuuggugcg

SEQ ID NO: 1848194 - RNA, 15 nt, Homo sapiens
cguucauucauucag

SEQ ID NO: 1848195 - RNA, 21 nt, Homo sapiens
gucuuaaaauggguauucaaa

SEQ ID NO: 1848196 - RNA, 18 nt, Homo sapiens
cuggcacauuuuucucuu

SEQ ID NO: 1848197 - RNA, 14 nt, Homo sapiens
gguggcucaugccu

SEQ ID NO: 1848198 - RNA, 14 nt, Homo sapiens
cauuagccaaggau

SEQ ID NO: 1848199 - RNA, 19 nt, Homo sapiens
cuuguucugagauucaaua

SEQ ID NO: 1848200 - RNA, 15 nt, Homo sapiens
uuguuuauugcacuu

SEQ ID NO: 1848201 - RNA, 14 nt, Homo sapiens
gcgcucagggccau

SEQ ID NO: 1848202 - RNA, 21 nt, Homo sapiens
ccuggcagcuagccagugcuc

SEQ ID NO: 1848203 - RNA, 17 nt, Homo sapiens
cagagucucacucuguu

SEQ ID NO: 1848204 - RNA, 21 nt, Homo sapiens
aucccaaagcaaggagaucau

SEQ ID NO: 1848205 - RNA, 11 nt, Homo sapiens
gccacaaagaa

SEQ ID NO: 1848206 - RNA, 20 nt, Homo sapiens
acaagaaagaguaacacuga

SEQ ID NO: 1848207 - RNA, 14 nt, Homo sapiens
ugcuucaauguagu

SEQ ID NO: 1848208 - RNA, 16 nt, Homo sapiens
agggaagacauugcaa

SEQ ID NO: 1848209 - RNA, 23 nt, Homo sapiens
gucuguuuuaaaaaccuguucaa

SEQ ID NO: 1848210 - RNA, 23 nt, Homo sapiens
gcuuaaggagaggagaaacugag

SEQ ID NO: 1848211 - RNA, 20 nt, Homo sapiens
ugauaacuagauggugcuga

SEQ ID NO: 1848212 - RNA, 21 nt, Homo sapiens
uccuuuccuacuguccuggaa

SEQ ID NO: 1848213 - RNA, 15 nt, Homo sapiens
ugacccucaccugaa

SEQ ID NO: 1848214 - RNA, 20 nt, Homo sapiens
aaugaggugguacuaugauu

SEQ ID NO: 1848215 - RNA, 18 nt, Homo sapiens
guaaauuuugugaugaau

SEQ ID NO: 1848216 - RNA, 15 nt, Homo sapiens
uggaggcugauucua

SEQ ID NO: 1848217 - RNA, 18 nt, Homo sapiens
uauguuuggaauauucca

SEQ ID NO: 1848218 - RNA, 22 nt, Homo sapiens
aacucuugacuuccugccaugg

SEQ ID NO: 1848219 - RNA, 22 nt, Homo sapiens
uuaaaaaaaagaauaaagguau

SEQ ID NO: 1848220 - RNA, 20 nt, Homo sapiens
gauuuagcaaugcugugaau

SEQ ID NO: 1848221 - RNA, 21 nt, Homo sapiens
ugguaaaaguauuugcuuaaa

SEQ ID NO: 1848222 - RNA, 20 nt, Homo sapiens
uggaggccggaaucucagcc

SEQ ID NO: 1848223 - RNA, 20 nt, Homo sapiens
uacccuuacucugccagagu

SEQ ID NO: 1848224 - RNA, 19 nt, Homo sapiens
ugucuacaugccaugaccu

SEQ ID NO: 1848225 - RNA, 17 nt, Homo sapiens
caaaacugacaguaaau

SEQ ID NO: 1848226 - RNA, 20 nt, Homo sapiens
uucccaaaccuaaugaucau

SEQ ID NO: 1848227 - RNA, 17 nt, Homo sapiens
cgucagucucucaaaga

SEQ ID NO: 1848228 - RNA, 13 nt, Homo sapiens
aauuucuccaaag

SEQ ID NO: 1848229 - RNA, 19 nt, Homo sapiens
gaagccuggacucuaagcu

SEQ ID NO: 1848230 - RNA, 16 nt, Homo sapiens
ucaacugguuguauau

SEQ ID NO: 1848231 - RNA, 21 nt, Homo sapiens
ccaccacuuuuggauuuuaug

SEQ ID NO: 1848232 - RNA, 16 nt, Homo sapiens
gacagggucaaagugu

SEQ ID NO: 1848233 - RNA, 16 nt, Homo sapiens
caacucuucgaagccu

SEQ ID NO: 1848234 - RNA, 15 nt, Homo sapiens
uccauguuugcaccu

SEQ ID NO: 1848235 - RNA, 20 nt, Homo sapiens
uucaaacuauacuacaaggc

SEQ ID NO: 1848236 - RNA, 16 nt, Homo sapiens
agcuuugaaaauucag

SEQ ID NO: 1848237 - RNA, 21 nt, Homo sapiens
aaauuaagagauacauucccu

SEQ ID NO: 1848238 - RNA, 22 nt, Homo sapiens
ugugucucccgugcaugcucug

SEQ ID NO: 1848239 - RNA, 16 nt, Homo sapiens
caguuuuuuucuuugu

SEQ ID NO: 1848240 - RNA, 16 nt, Homo sapiens
cagaggucuucagggc

SEQ ID NO: 1848241 - RNA, 22 nt, Homo sapiens
cauccaggcuggccagugcugc

SEQ ID NO: 1848242 - RNA, 16 nt, Homo sapiens
uucccuggugaugguc

SEQ ID NO: 1848243 - RNA, 23 nt, Homo sapiens
uacucauuuggaaaugcuacaaa

SEQ ID NO: 1848244 - RNA, 13 nt, Homo sapiens
uccugacugaaag

SEQ ID NO: 1848245 - RNA, 12 nt, Homo sapiens
ccuccugugcua

SEQ ID NO: 1848246 - RNA, 23 nt, Homo sapiens
caacucguguucacucagcacuu

SEQ ID NO: 1848247 - RNA, 21 nt, Homo sapiens
auacugcagggccaggacuga

SEQ ID NO: 1848248 - RNA, 18 nt, Homo sapiens
cagagacccucucagccc

SEQ ID NO: 1848249 - RNA, 19 nt, Homo sapiens
uauaggggaaaaaacucgg

SEQ ID NO: 1848250 - RNA, 13 nt, Homo sapiens
cucacauucccuc

SEQ ID NO: 1848251 - RNA, 20 nt, Homo sapiens
uccauuccagucaaaucugg

SEQ ID NO: 1848252 - RNA, 15 nt, Homo sapiens
ccaaacuggugcaug

SEQ ID NO: 1848253 - RNA, 20 nt, Homo sapiens
cugguggcaccagaugcaac

SEQ ID NO: 1848254 - RNA, 13 nt, Homo sapiens
gaaucaacaaacc

SEQ ID NO: 1848255 - RNA, 13 nt, Homo sapiens
ucagucucuauac

SEQ ID NO: 1848256 - RNA, 21 nt, Homo sapiens
ugggcagcaaaacgacacugc

SEQ ID NO: 1848257 - RNA, 16 nt, Homo sapiens
agugccaggugaucuc

SEQ ID NO: 1848258 - RNA, 16 nt, Homo sapiens
uuaagaagaaacuagg

SEQ ID NO: 1848259 - RNA, 13 nt, Homo sapiens
cugggaaacacuc

SEQ ID NO: 1848260 - RNA, 23 nt, Homo sapiens
gcuuaacacuaccaauuucccau

SEQ ID NO: 1848261 - RNA, 22 nt, Homo sapiens
gccuucuguuuuccaaaggagu

SEQ ID NO: 1848262 - RNA, 18 nt, Homo sapiens
gcuauuuuagaaagcuaa

SEQ ID NO: 1848263 - RNA, 18 nt, Homo sapiens
gaugacugccuugccucc

SEQ ID NO: 1848264 - RNA, 20 nt, Homo sapiens
uuaagcucugagcugucaac

SEQ ID NO: 1848265 - RNA, 13 nt, Homo sapiens
cugggucaaucca

SEQ ID NO: 1848266 - RNA, 22 nt, Homo sapiens
uggguaaccagucccaggugaa

SEQ ID NO: 1848267 - RNA, 14 nt, Homo sapiens
uagauugugaauaa

SEQ ID NO: 1848268 - RNA, 17 nt, Homo sapiens
aagugaacagauuuuau

SEQ ID NO: 1848269 - RNA, 20 nt, Homo sapiens
cuugauguuuguuugcauga

SEQ ID NO: 1848270 - RNA, 20 nt, Homo sapiens
ggcccaagagucuggggacc

SEQ ID NO: 1848271 - RNA, 11 nt, Homo sapiens
aagacuuuucu

SEQ ID NO: 1848272 - RNA, 17 nt, Homo sapiens
uuuccugauacauuaaa

SEQ ID NO: 1848273 - RNA, 20 nt, Homo sapiens
cacagaucacacacaugcac

SEQ ID NO: 1848274 - RNA, 16 nt, Homo sapiens
aaucuuaauacuguua

SEQ ID NO: 1848275 - RNA, 17 nt, Homo sapiens
acuuugagcugagugcu

SEQ ID NO: 1848276 - RNA, 15 nt, Homo sapiens
ggcuuuaaaagucau

SEQ ID NO: 1848277 - RNA, 15 nt, Homo sapiens
cagggcugugggugg

SEQ ID NO: 1848278 - RNA, 16 nt, Homo sapiens
cauuccaauuugcacu

SEQ ID NO: 1848279 - RNA, 17 nt, Homo sapiens
auucaaggcuuaucucu

SEQ ID NO: 1848280 - RNA, 23 nt, Homo sapiens
gccccacccaccccacagacucc

SEQ ID NO: 1848281 - RNA, 17 nt, Homo sapiens
uaacaauguuugucauu

SEQ ID NO: 1848282 - RNA, 22 nt, Homo sapiens
auagugcuucacaaaaugcacu

SEQ ID NO: 1848283 - RNA, 19 nt, Homo sapiens
auaaugacucuuaggacau

SEQ ID NO: 1848284 - RNA, 12 nt, Homo sapiens
gacugauuucag

SEQ ID NO: 1848285 - RNA, 16 nt, Homo sapiens
aggaaacccccagugu

SEQ ID NO: 1848286 - RNA, 15 nt, Homo sapiens
gugauguguuuccau

SEQ ID NO: 1848287 - RNA, 16 nt, Homo sapiens
uuagaggaccagugag

SEQ ID NO: 1848288 - RNA, 16 nt, Homo sapiens
ccacuggguuacagaa

SEQ ID NO: 1848289 - RNA, 21 nt, Homo sapiens
gccgcgcaucagacugugaac

SEQ ID NO: 1848290 - RNA, 14 nt, Homo sapiens
ucccacacugucca

SEQ ID NO: 1848291 - RNA, 13 nt, Homo sapiens
uuuagcucugaga

SEQ ID NO: 1848292 - RNA, 13 nt, Homo sapiens
auaagcucaguga

SEQ ID NO: 1848293 - RNA, 23 nt, Homo sapiens
agcccaguaacugcaccaacgag

SEQ ID NO: 1848294 - RNA, 16 nt, Homo sapiens
uuggacauuuucuuca

SEQ ID NO: 1848295 - RNA, 20 nt, Homo sapiens
uugacuccuuuccaauagaa

SEQ ID NO: 1848296 - RNA, 18 nt, Homo sapiens
auucuccuguccuuguac

SEQ ID NO: 1848297 - RNA, 19 nt, Homo sapiens
ccacuacccggcaggguac

SEQ ID NO: 1848298 - RNA, 13 nt, Homo sapiens
ggaacugcaauaa

SEQ ID NO: 1848299 - RNA, 15 nt, Homo sapiens
auggguaacacugau

SEQ ID NO: 1848300 - RNA, 14 nt, Homo sapiens
ugcuuaguauuaga

SEQ ID NO: 1848301 - RNA, 19 nt, Homo sapiens
caccuugcccaugcacaag

SEQ ID NO: 1848302 - RNA, 20 nt, Homo sapiens
ucagcacaggccugggaccu

SEQ ID NO: 1848303 - RNA, 15 nt, Homo sapiens
cugcuguauacugua

SEQ ID NO: 1848304 - RNA, 19 nt, Homo sapiens
gugcuggcauuacaggugu

SEQ ID NO: 1848305 - RNA, 20 nt, Homo sapiens
gcuuccgcugucacccagca

SEQ ID NO: 1848306 - RNA, 14 nt, Homo sapiens
cagacaagcuugaa

SEQ ID NO: 1848307 - RNA, 16 nt, Homo sapiens
gaauacugcagcacuc

SEQ ID NO: 1848308 - RNA, 21 nt, Homo sapiens
gaugagaguacaccccaacag

SEQ ID NO: 1848309 - RNA, 16 nt, Homo sapiens
caagccugccucaauc

SEQ ID NO: 1848310 - RNA, 14 nt, Homo sapiens
guuaaagagacaaa

SEQ ID NO: 1848311 - RNA, 18 nt, Homo sapiens
uguaagcauucugagcug

SEQ ID NO: 1848312 - RNA, 12 nt, Homo sapiens
uugauacaguca

SEQ ID NO: 1848313 - RNA, 12 nt, Homo sapiens
ugccuacagggc

SEQ ID NO: 1848314 - RNA, 20 nt, Homo sapiens
uaugagcccuauauauucaa

SEQ ID NO: 1848315 - RNA, 23 nt, Homo sapiens
ccugccuggguugggggcacuca

SEQ ID NO: 1848316 - RNA, 21 nt, Homo sapiens
accagacacucacagcaagga

SEQ ID NO: 1848317 - RNA, 15 nt, Homo sapiens
uauuaaaacauugga

SEQ ID NO: 1848318 - RNA, 17 nt, Homo sapiens
cugggaguccuuaccuc

SEQ ID NO: 1848319 - RNA, 11 nt, Homo sapiens
acagcuuuguu

SEQ ID NO: 1848320 - RNA, 17 nt, Homo sapiens
accacaucucuaucugg

SEQ ID NO: 1848321 - RNA, 20 nt, Homo sapiens
gagagguuuuucuugggaaa

SEQ ID NO: 1848322 - RNA, 21 nt, Homo sapiens
augguguguuccuaacauaaa

SEQ ID NO: 1848323 - RNA, 19 nt, Homo sapiens
caggauccaagugacaaag

SEQ ID NO: 1848324 - RNA, 19 nt, Homo sapiens
ucgacgaggaggagugcau

SEQ ID NO: 1848325 - RNA, 12 nt, Homo sapiens
uacuacuguaaa

SEQ ID NO: 1848326 - RNA, 16 nt, Homo sapiens
caucccccagcacuga

SEQ ID NO: 1848327 - RNA, 15 nt, Homo sapiens
guguugggauuacag

SEQ ID NO: 1848328 - RNA, 17 nt, Homo sapiens
cacccuggauuugcaua

SEQ ID NO: 1848329 - RNA, 13 nt, Homo sapiens
uucagcucccuua

SEQ ID NO: 1848330 - RNA, 18 nt, Homo sapiens
gacuggacccccuggaag

SEQ ID NO: 1848331 - RNA, 15 nt, Homo sapiens
uugauguucuuucac

SEQ ID NO: 1848332 - RNA, 17 nt, Homo sapiens
gacaaaacuucuuguca

SEQ ID NO: 1848333 - RNA, 16 nt, Homo sapiens
ugugcaauauucuuaa

SEQ ID NO: 1848334 - RNA, 17 nt, Homo sapiens
uucuggggcuuugccau

SEQ ID NO: 1848335 - RNA, 20 nt, Homo sapiens
aucuguagaagguucuacca

SEQ ID NO: 1848336 - RNA, 20 nt, Homo sapiens
caaaagaagacaacauuucu

SEQ ID NO: 1848337 - RNA, 16 nt, Homo sapiens
cuuccaaucuccauca

SEQ ID NO: 1848338 - RNA, 20 nt, Homo sapiens
auuucaagaauguuauucaa

SEQ ID NO: 1848339 - RNA, 16 nt, Homo sapiens
gccagugccauuucag

SEQ ID NO: 1848340 - RNA, 22 nt, Homo sapiens
auuuucacaggugugguguaau

SEQ ID NO: 1848341 - RNA, 16 nt, Homo sapiens
cccaaaggcuuugccc

SEQ ID NO: 1848342 - RNA, 19 nt, Homo sapiens
agauccccccacaaagugg

SEQ ID NO: 1848343 - RNA, 19 nt, Homo sapiens
aagucuaacgcugaacuga

SEQ ID NO: 1848344 - RNA, 19 nt, Homo sapiens
agggaacugaacauuccag

SEQ ID NO: 1848345 - RNA, 22 nt, Homo sapiens
aaaaggacucugcuucagucca

SEQ ID NO: 1848346 - RNA, 12 nt, Homo sapiens
gucacugucuuc

SEQ ID NO: 1848347 - RNA, 24 nt, Homo sapiens
aaugaaagcauguggcauguucau

SEQ ID NO: 1848348 - RNA, 19 nt, Homo sapiens
guuuaagugugcagccaua

SEQ ID NO: 1848349 - RNA, 14 nt, Homo sapiens
ucugaaucucccaa

SEQ ID NO: 1848350 - RNA, 22 nt, Homo sapiens
cagaacucuccuaucugaaccu

SEQ ID NO: 1848351 - RNA, 15 nt, Homo sapiens
ugagaucuuccugcu

SEQ ID NO: 1848352 - RNA, 15 nt, Homo sapiens
gauaauuauuuacaa

SEQ ID NO: 1848353 - RNA, 13 nt, Homo sapiens
agagacacuggug

SEQ ID NO: 1848354 - RNA, 13 nt, Homo sapiens
uuugcucauggaa

SEQ ID NO: 1848355 - RNA, 12 nt, Homo sapiens
aaaaucuacuuu

SEQ ID NO: 1848356 - RNA, 22 nt, Homo sapiens
ccagaaaucugcugcauuucac

SEQ ID NO: 1848357 - RNA, 16 nt, Homo sapiens
acaccuuuucuauuua

SEQ ID NO: 1848358 - RNA, 19 nt, Homo sapiens
uaagaaauacucaugugca

SEQ ID NO: 1848359 - RNA, 12 nt, Homo sapiens
auugaaagggag

SEQ ID NO: 1848360 - RNA, 15 nt, Homo sapiens
aggcgggagcucucc

SEQ ID NO: 1848361 - RNA, 14 nt, Homo sapiens
agcaacucagagaa

SEQ ID NO: 1848362 - RNA, 18 nt, Homo sapiens
caagaaacguggaucucc

SEQ ID NO: 1848363 - RNA, 15 nt, Homo sapiens
acuuugggggaggag

SEQ ID NO: 1848364 - RNA, 14 nt, Homo sapiens
uaaugcuaaaugug

SEQ ID NO: 1848365 - RNA, 21 nt, Homo sapiens
ccuagcuacuuggcaggcuaa

SEQ ID NO: 1848366 - RNA, 16 nt, Homo sapiens
ccaccagggacaccuc

SEQ ID NO: 1848367 - RNA, 19 nt, Homo sapiens
ucuguuaccaugucacugu

SEQ ID NO: 1848368 - RNA, 20 nt, Homo sapiens
auuuugugaugaaucuacau

SEQ ID NO: 1848369 - RNA, 16 nt, Homo sapiens
augucagggcacaugu

SEQ ID NO: 1848370 - RNA, 17 nt, Homo sapiens
uuugaaacugaauguuu

SEQ ID NO: 1848371 - RNA, 17 nt, Homo sapiens
aaugugauuugucuucc

SEQ ID NO: 1848372 - RNA, 16 nt, Homo sapiens
gacuucauacuuugaa

SEQ ID NO: 1848373 - RNA, 15 nt, Homo sapiens
uuguagacuuccuuu

SEQ ID NO: 1848374 - RNA, 15 nt, Homo sapiens
ugguaauuauccuca

SEQ ID NO: 1848375 - RNA, 23 nt, Homo sapiens
uuuccaugggaccacaacuauuu

SEQ ID NO: 1848376 - RNA, 20 nt, Homo sapiens
uuucuuauuggugauuguca

SEQ ID NO: 1848377 - RNA, 19 nt, Homo sapiens
ggauuggcuauaacauguc

SEQ ID NO: 1848378 - RNA, 15 nt, Homo sapiens
accauuggcuugcca

SEQ ID NO: 1848379 - RNA, 21 nt, Homo sapiens
uguugcaugggcuaaugaaga

SEQ ID NO: 1848380 - RNA, 13 nt, Homo sapiens
uaaaccacuaaaa

SEQ ID NO: 1848381 - RNA, 13 nt, Homo sapiens
cuccccaccucca

SEQ ID NO: 1848382 - RNA, 17 nt, Homo sapiens
gaccuacugcacugagu

SEQ ID NO: 1848383 - RNA, 14 nt, Homo sapiens
gucgucaccaaauc

SEQ ID NO: 1848384 - RNA, 18 nt, Homo sapiens
gccuuuuguagcugucau

SEQ ID NO: 1848385 - RNA, 23 nt, Homo sapiens
agaacaggggucgccaacacuug

SEQ ID NO: 1848386 - RNA, 17 nt, Homo sapiens
ucccuuuuuauauccca

SEQ ID NO: 1848387 - RNA, 18 nt, Homo sapiens
agcccauggugaauguau

SEQ ID NO: 1848388 - RNA, 22 nt, Homo sapiens
cugccacccccuucccugggag

SEQ ID NO: 1848389 - RNA, 16 nt, Homo sapiens
acaauguauguacaau

SEQ ID NO: 1848390 - RNA, 19 nt, Homo sapiens
cgccucuguucaguucauu

SEQ ID NO: 1848391 - RNA, 21 nt, Homo sapiens
augagggugucggcugugagg

SEQ ID NO: 1848392 - RNA, 14 nt, Homo sapiens
cuuaacauucugua

SEQ ID NO: 1848393 - RNA, 14 nt, Homo sapiens
agaacuugaccccc

SEQ ID NO: 1848394 - RNA, 21 nt, Homo sapiens
ugacuugaaaugcucuuuugc

SEQ ID NO: 1848395 - RNA, 20 nt, Homo sapiens
caaucagaugacaacaaaga

SEQ ID NO: 1848396 - RNA, 23 nt, Homo sapiens
agcggggccaccgcgacguugca

SEQ ID NO: 1848397 - RNA, 21 nt, Homo sapiens
ccugugggaagagaagggaag

SEQ ID NO: 1848398 - RNA, 23 nt, Homo sapiens
ugggaccaggcuccaauggggcg

SEQ ID NO: 1848399 - RNA, 13 nt, Homo sapiens
uuaugaucuaugu

SEQ ID NO: 1848400 - RNA, 13 nt, Homo sapiens
aaucugccuucca

SEQ ID NO: 1848401 - RNA, 15 nt, Homo sapiens
guaggagcugccuug

SEQ ID NO: 1848402 - RNA, 19 nt, Homo sapiens
uaauaaaguaauugacaaa

SEQ ID NO: 1848403 - RNA, 16 nt, Homo sapiens
cagcccaaaacccagg

SEQ ID NO: 1848404 - RNA, 21 nt, Homo sapiens
cuuaugucaaguucuacauca

SEQ ID NO: 1848405 - RNA, 17 nt, Homo sapiens
guggucuccuugcacuu

SEQ ID NO: 1848406 - RNA, 24 nt, Homo sapiens
uacagcagcaugcauucauaacag

SEQ ID NO: 1848407 - RNA, 17 nt, Homo sapiens
uucauagggauggcagu

SEQ ID NO: 1848408 - RNA, 23 nt, Homo sapiens
uuauguggaaaacagaacaucau

SEQ ID NO: 1848409 - RNA, 12 nt, Homo sapiens
guaaacagugag

SEQ ID NO: 1848410 - RNA, 16 nt, Homo sapiens
cugagaaguaccuuug

SEQ ID NO: 1848411 - RNA, 20 nt, Homo sapiens
guguaacccccaguucaaga

SEQ ID NO: 1848412 - RNA, 15 nt, Homo sapiens
cauaaucacugacca

SEQ ID NO: 1848413 - RNA, 18 nt, Homo sapiens
ccugggaaccaugaagcu

SEQ ID NO: 1848414 - RNA, 15 nt, Homo sapiens
agggcaggcugaggu

SEQ ID NO: 1848415 - RNA, 17 nt, Homo sapiens
uaagggaaaaguucucc

SEQ ID NO: 1848416 - RNA, 18 nt, Homo sapiens
uugaaaaccacagucagu

SEQ ID NO: 1848417 - RNA, 13 nt, Homo sapiens
guaggaguggcug

SEQ ID NO: 1848418 - RNA, 13 nt, Homo sapiens
auuauacauuuga

SEQ ID NO: 1848419 - RNA, 17 nt, Homo sapiens
cacuauggcaacuaacu

SEQ ID NO: 1848420 - RNA, 18 nt, Homo sapiens
cagcauguacggauuuuc

SEQ ID NO: 1848421 - RNA, 23 nt, Homo sapiens
gcgaaaaaaaaaaaugcacugug

SEQ ID NO: 1848422 - RNA, 14 nt, Homo sapiens
uaagccucuugucu

SEQ ID NO: 1848423 - RNA, 23 nt, Homo sapiens
agccugucggccacaccccagac

SEQ ID NO: 1848424 - RNA, 20 nt, Homo sapiens
cagacuuuuguguaaaaagc

SEQ ID NO: 1848425 - RNA, 12 nt, Homo sapiens
aaugcuguagaa

SEQ ID NO: 1848426 - RNA, 15 nt, Homo sapiens
cacaaugagaugcau

SEQ ID NO: 1848427 - RNA, 12 nt, Homo sapiens
gaauucuacuga

SEQ ID NO: 1848428 - RNA, 22 nt, Homo sapiens
ucccccagaugcagggcugcag

SEQ ID NO: 1848429 - RNA, 13 nt, Homo sapiens
uucccuugcucau

SEQ ID NO: 1848430 - RNA, 23 nt, Homo sapiens
uagaaaaugacuuauuucugcuc

SEQ ID NO: 1848431 - RNA, 21 nt, Homo sapiens
guaugaaacaaacuacugugu

SEQ ID NO: 1848432 - RNA, 14 nt, Homo sapiens
gacccgcuacaaaa

SEQ ID NO: 1848433 - RNA, 16 nt, Homo sapiens
acuccuuccucuuugc

SEQ ID NO: 1848434 - RNA, 14 nt, Homo sapiens
ccacacauauugca

SEQ ID NO: 1848435 - RNA, 22 nt, Homo sapiens
uccauuuuuuucuaauggaaug

SEQ ID NO: 1848436 - RNA, 19 nt, Homo sapiens
cucuugccaaccuguaaua

SEQ ID NO: 1848437 - RNA, 18 nt, Homo sapiens
acacaggcccaugcccuc

SEQ ID NO: 1848438 - RNA, 13 nt, Homo sapiens
uuaauacuguuua

SEQ ID NO: 1848439 - RNA, 15 nt, Homo sapiens
uccucagauggggca

SEQ ID NO: 1848440 - RNA, 16 nt, Homo sapiens
aagagcuuuaucccua

SEQ ID NO: 1848441 - RNA, 19 nt, Homo sapiens
cuaauaaaaccucuaauuc

SEQ ID NO: 1848442 - RNA, 14 nt, Homo sapiens
uuagcacacucaca

SEQ ID NO: 1848443 - RNA, 14 nt, Homo sapiens
uucuccacaaagua

SEQ ID NO: 1848444 - RNA, 13 nt, Homo sapiens
aggaaaagggaua

SEQ ID NO: 1848445 - RNA, 16 nt, Homo sapiens
agggccaaagcacagc

SEQ ID NO: 1848446 - RNA, 23 nt, Homo sapiens
cuaauguguggaaugugcagauu

SEQ ID NO: 1848447 - RNA, 14 nt, Homo sapiens
auucccagccagca

SEQ ID NO: 1848448 - RNA, 12 nt, Homo sapiens
agucacugccug

SEQ ID NO: 1848449 - RNA, 15 nt, Homo sapiens
aauggucauccaaac

SEQ ID NO: 1848450 - RNA, 14 nt, Homo sapiens
uaacuucucuguga

SEQ ID NO: 1848451 - RNA, 18 nt, Homo sapiens
uaguggacauggucacag

SEQ ID NO: 1848452 - RNA, 14 nt, Homo sapiens
acagacacuuacau

SEQ ID NO: 1848453 - RNA, 20 nt, Homo sapiens
ccaugaaguuuaaagauucu

SEQ ID NO: 1848454 - RNA, 19 nt, Homo sapiens
ccuccucuucugacgugcc

SEQ ID NO: 1848455 - RNA, 17 nt, Homo sapiens
auaagcacugugcuaau

SEQ ID NO: 1848456 - RNA, 16 nt, Homo sapiens
ucauaagacacuuaga

SEQ ID NO: 1848457 - RNA, 20 nt, Homo sapiens
cuuacucuaagaucuuagau

SEQ ID NO: 1848458 - RNA, 14 nt, Homo sapiens
aagcagauacuuga

SEQ ID NO: 1848459 - RNA, 15 nt, Homo sapiens
ugaagcaaacaguug

SEQ ID NO: 1848460 - RNA, 14 nt, Homo sapiens
ugcucuugccaaaa

SEQ ID NO: 1848461 - RNA, 19 nt, Homo sapiens
cuuuggugaccccauacau

SEQ ID NO: 1848462 - RNA, 14 nt, Homo sapiens
acccacuuccugau

SEQ ID NO: 1848463 - RNA, 23 nt, Homo sapiens
ccacaccugcggcccaauccaag

SEQ ID NO: 1848464 - RNA, 19 nt, Homo sapiens
caggagacuccaaggagcu

SEQ ID NO: 1848465 - RNA, 21 nt, Homo sapiens
aguuaauaaucuaugaugaag

SEQ ID NO: 1848466 - RNA, 15 nt, Homo sapiens
uuaagcaugcuucua

SEQ ID NO: 1848467 - RNA, 21 nt, Homo sapiens
caccuagugcuuccacuucua

SEQ ID NO: 1848468 - RNA, 15 nt, Homo sapiens
cuugguaauuguacu

SEQ ID NO: 1848469 - RNA, 13 nt, Homo sapiens
gacaauaugugcc

SEQ ID NO: 1848470 - RNA, 19 nt, Homo sapiens
cucucacacuuuugcuuga

SEQ ID NO: 1848471 - RNA, 15 nt, Homo sapiens
cacacuguacucugc

SEQ ID NO: 1848472 - RNA, 21 nt, Homo sapiens
acugcuccaagggacaggugg

SEQ ID NO: 1848473 - RNA, 20 nt, Homo sapiens
ccugucgcacccacugugaa

SEQ ID NO: 1848474 - RNA, 22 nt, Homo sapiens
auguugacuuuauuucugagca

SEQ ID NO: 1848475 - RNA, 23 nt, Homo sapiens
uaucaaaaagguuucugcacauu

SEQ ID NO: 1848476 - RNA, 18 nt, Homo sapiens
caguaguauaugguguuc

SEQ ID NO: 1848477 - RNA, 17 nt, Homo sapiens
ucaggaggcugaggcag

SEQ ID NO: 1848478 - RNA, 22 nt, Homo sapiens
agcacuggaauucagaugcaag

SEQ ID NO: 1848479 - RNA, 14 nt, Homo sapiens
uguuuaacugugaa

SEQ ID NO: 1848480 - RNA, 18 nt, Homo sapiens
accaacugggcccaagac

SEQ ID NO: 1848481 - RNA, 19 nt, Homo sapiens
ggaaauaugaaauguauuu

SEQ ID NO: 1848482 - RNA, 13 nt, Homo sapiens
gucuacacugccu

SEQ ID NO: 1848483 - RNA, 23 nt, Homo sapiens
cacaauaaauggccagugcugcu

SEQ ID NO: 1848484 - RNA, 18 nt, Homo sapiens
ucucuuacccagaauauu

SEQ ID NO: 1848485 - RNA, 13 nt, Homo sapiens
cgaaguuugcaac

SEQ ID NO: 1848486 - RNA, 21 nt, Homo sapiens
aauaaucaacugaauugcaaa

SEQ ID NO: 1848487 - RNA, 17 nt, Homo sapiens
ggauuuuaccaaagcau

SEQ ID NO: 1848488 - RNA, 12 nt, Homo sapiens
cuugaaggcauu

SEQ ID NO: 1848489 - RNA, 16 nt, Homo sapiens
aucuuuuuucccccac

SEQ ID NO: 1848490 - RNA, 13 nt, Homo sapiens
ugguuaugugcau

SEQ ID NO: 1848491 - RNA, 20 nt, Homo sapiens
uagagacauccuucauuuga

SEQ ID NO: 1848492 - RNA, 15 nt, Homo sapiens
ucagcuacuuuccau

SEQ ID NO: 1848493 - RNA, 19 nt, Homo sapiens
ccagucuuccugacacuuu

SEQ ID NO: 1848494 - RNA, 23 nt, Homo sapiens
ccccagugcagggaaccgugaua

SEQ ID NO: 1848495 - RNA, 22 nt, Homo sapiens
guucagaaaagcaccucuugaa

SEQ ID NO: 1848496 - RNA, 18 nt, Homo sapiens
ucuuugacuauaacaaaa

SEQ ID NO: 1848497 - RNA, 15 nt, Homo sapiens
aggcuccugccugag

SEQ ID NO: 1848498 - RNA, 14 nt, Homo sapiens
gcaaaaaaguacaa

SEQ ID NO: 1848499 - RNA, 20 nt, Homo sapiens
auacauaagcagcauuucau

SEQ ID NO: 1848500 - RNA, 23 nt, Homo sapiens
cugaggacccgugugacucgcca

SEQ ID NO: 1848501 - RNA, 23 nt, Homo sapiens
ccuaaaacccaaagguggcagcu

SEQ ID NO: 1848502 - RNA, 21 nt, Homo sapiens
cuuucagauuauggaugauua

SEQ ID NO: 1848503 - RNA, 12 nt, Homo sapiens
caauuaguacag

SEQ ID NO: 1848504 - RNA, 15 nt, Homo sapiens
uauguuuuacacugu

SEQ ID NO: 1848505 - RNA, 20 nt, Homo sapiens
uagagggagaggaagcacac

SEQ ID NO: 1848506 - RNA, 17 nt, Homo sapiens
cccccuuucacacugga

SEQ ID NO: 1848507 - RNA, 15 nt, Homo sapiens
ugcauuuacuuuuaa

SEQ ID NO: 1848508 - RNA, 16 nt, Homo sapiens
cucagaggacuuggca

SEQ ID NO: 1848509 - RNA, 20 nt, Homo sapiens
cccagggaggcugugcacag

SEQ ID NO: 1848510 - RNA, 18 nt, Homo sapiens
cuuucuaagcaaccacac

SEQ ID NO: 1848511 - RNA, 16 nt, Homo sapiens
auuauauauacuauau

SEQ ID NO: 1848512 - RNA, 16 nt, Homo sapiens
ucaucagucaucaggu

SEQ ID NO: 1848513 - RNA, 20 nt, Homo sapiens
aauuauuuaauaugcaucuu

SEQ ID NO: 1848514 - RNA, 14 nt, Homo sapiens
ggcuggucuugggg

SEQ ID NO: 1848515 - RNA, 20 nt, Homo sapiens
uccuuuacgguccaugccuu

SEQ ID NO: 1848516 - RNA, 15 nt, Homo sapiens
cuuccuugaccagca

SEQ ID NO: 1848517 - RNA, 16 nt, Homo sapiens
aagcaagggacugagu

SEQ ID NO: 1848518 - RNA, 14 nt, Homo sapiens
agaguucagacuca

SEQ ID NO: 1848519 - RNA, 14 nt, Homo sapiens
uggccgggcagggu

SEQ ID NO: 1848520 - RNA, 13 nt, Homo sapiens
cggagccauguca

SEQ ID NO: 1848521 - RNA, 21 nt, Homo sapiens
gucaucuugcacacacuuuca

SEQ ID NO: 1848522 - RNA, 18 nt, Homo sapiens
cauuuucugaaacuaaug

SEQ ID NO: 1848523 - RNA, 19 nt, Homo sapiens
ugccaacuucuucagagcu

SEQ ID NO: 1848524 - RNA, 20 nt, Homo sapiens
aaggcaacauuuccgaagac

SEQ ID NO: 1848525 - RNA, 14 nt, Homo sapiens
augagucagucucu

SEQ ID NO: 1848526 - RNA, 14 nt, Homo sapiens
ucccuguuccucaa

SEQ ID NO: 1848527 - RNA, 14 nt, Homo sapiens
cuucuguuuuccaa

SEQ ID NO: 1848528 - RNA, 23 nt, Homo sapiens
guaacagcauuaacugucuuaaa

SEQ ID NO: 1848529 - RNA, 21 nt, Homo sapiens
ugccuccagugcaguccauuu

SEQ ID NO: 1848530 - RNA, 20 nt, Homo sapiens
augccuccccaccaccaauu

SEQ ID NO: 1848531 - RNA, 21 nt, Homo sapiens
caagaacaauaucgacuuccc

SEQ ID NO: 1848532 - RNA, 18 nt, Homo sapiens
uugcuugggacauugcaa

SEQ ID NO: 1848533 - RNA, 22 nt, Homo sapiens
auuaauaaauccuacaguauuu

SEQ ID NO: 1848534 - RNA, 18 nt, Homo sapiens
auagucccagcuacccag

SEQ ID NO: 1848535 - RNA, 20 nt, Homo sapiens
cagcuguguucacacuguaa

SEQ ID NO: 1848536 - RNA, 13 nt, Homo sapiens
caaauaacagucu

SEQ ID NO: 1848537 - RNA, 23 nt, Homo sapiens
cuugucaccauuggacagucucc

SEQ ID NO: 1848538 - RNA, 22 nt, Homo sapiens
cacuuaaacuugcaucacuuaa

SEQ ID NO: 1848539 - RNA, 22 nt, Homo sapiens
caagauccugucuugcugaggg

SEQ ID NO: 1848540 - RNA, 18 nt, Homo sapiens
aaaagaaacacgcacuua

SEQ ID NO: 1848541 - RNA, 15 nt, Homo sapiens
ccugacuuuagaugu

SEQ ID NO: 1848542 - RNA, 20 nt, Homo sapiens
acagucuugcagcaggaucu

SEQ ID NO: 1848543 - RNA, 14 nt, Homo sapiens
ugccuccuugaaag

SEQ ID NO: 1848544 - RNA, 13 nt, Homo sapiens
cauaaguagcauu

SEQ ID NO: 1848545 - RNA, 18 nt, Homo sapiens
caguucuuugggccagac

SEQ ID NO: 1848546 - RNA, 20 nt, Homo sapiens
cgagauagcaccauugcacu

SEQ ID NO: 1848547 - RNA, 17 nt, Homo sapiens
caagacuggcccagugc

SEQ ID NO: 1848548 - RNA, 15 nt, Homo sapiens
accccuugcucucug

SEQ ID NO: 1848549 - RNA, 13 nt, Homo sapiens
ggaaucagugaag

SEQ ID NO: 1848550 - RNA, 18 nt, Homo sapiens
aguauuucagcugcaaua

SEQ ID NO: 1848551 - RNA, 18 nt, Homo sapiens
aauugcaauacauuucaa

SEQ ID NO: 1848552 - RNA, 23 nt, Homo sapiens
gaaaugcccaucuaugucccuug

SEQ ID NO: 1848553 - RNA, 18 nt, Homo sapiens
guuucuguacaacuaccu

SEQ ID NO: 1848554 - RNA, 19 nt, Homo sapiens
ccacuaauuugucacugga

SEQ ID NO: 1848555 - RNA, 17 nt, Homo sapiens
uuucaucauaacauaaa

SEQ ID NO: 1848556 - RNA, 18 nt, Homo sapiens
caggagcaggaagggcca

SEQ ID NO: 1848557 - RNA, 16 nt, Homo sapiens
aaaaucauauugagaa

SEQ ID NO: 1848558 - RNA, 20 nt, Homo sapiens
aaaacuacagcaucauugca

SEQ ID NO: 1848559 - RNA, 12 nt, Homo sapiens
agccucuugucu

SEQ ID NO: 1848560 - RNA, 15 nt, Homo sapiens
guuacuuuuuuacac

SEQ ID NO: 1848561 - RNA, 14 nt, Homo sapiens
cuucuugucauucu

SEQ ID NO: 1848562 - RNA, 13 nt, Homo sapiens
uguagauucccuu

SEQ ID NO: 1848563 - RNA, 20 nt, Homo sapiens
ggcuuugccgccaugggaug

SEQ ID NO: 1848564 - RNA, 18 nt, Homo sapiens
uugagauguaugaaggcu

SEQ ID NO: 1848565 - RNA, 16 nt, Homo sapiens
ggaacuuguagccaga

SEQ ID NO: 1848566 - RNA, 13 nt, Homo sapiens
cuuauaccaaagg

SEQ ID NO: 1848567 - RNA, 13 nt, Homo sapiens
aagcuggucucaa

SEQ ID NO: 1848568 - RNA, 19 nt, Homo sapiens
guguaaaauuaauguaaua

SEQ ID NO: 1848569 - RNA, 14 nt, Homo sapiens
cuuauucuauccac

SEQ ID NO: 1848570 - RNA, 22 nt, Homo sapiens
ccagaauauuuauccuucacca

SEQ ID NO: 1848571 - RNA, 14 nt, Homo sapiens
agggcgaaggccau

SEQ ID NO: 1848572 - RNA, 20 nt, Homo sapiens
cucucacccagaaucccucu

SEQ ID NO: 1848573 - RNA, 21 nt, Homo sapiens
auggcagugagaugucagaca

SEQ ID NO: 1848574 - RNA, 20 nt, Homo sapiens
cagggucucacuguguugcc

SEQ ID NO: 1848575 - RNA, 14 nt, Homo sapiens
acaagacuguaaau

SEQ ID NO: 1848576 - RNA, 18 nt, Homo sapiens
gagucaacuggcuggcca

SEQ ID NO: 1848577 - RNA, 15 nt, Homo sapiens
cucuuucuucauuca

SEQ ID NO: 1848578 - RNA, 19 nt, Homo sapiens
ccuuuugaaugaugccuuu

SEQ ID NO: 1848579 - RNA, 21 nt, Homo sapiens
cuuaaguuuuagaaaugagaa

SEQ ID NO: 1848580 - RNA, 15 nt, Homo sapiens
aggccagccuuggca

SEQ ID NO: 1848581 - RNA, 22 nt, Homo sapiens
uguuuuuaguucugacuuugaa

SEQ ID NO: 1848582 - RNA, 15 nt, Homo sapiens
cccagggaucacugg

SEQ ID NO: 1848583 - RNA, 16 nt, Homo sapiens
uuuugcuuuaauucca

SEQ ID NO: 1848584 - RNA, 13 nt, Homo sapiens
agaaacucaaugc

SEQ ID NO: 1848585 - RNA, 16 nt, Homo sapiens
aguccagguguucucc

SEQ ID NO: 1848586 - RNA, 13 nt, Homo sapiens
uguacaauaaagc

SEQ ID NO: 1848587 - RNA, 13 nt, Homo sapiens
aagcuuaaugugu

SEQ ID NO: 1848588 - RNA, 21 nt, Homo sapiens
cagugagccgagaucaugcca

SEQ ID NO: 1848589 - RNA, 13 nt, Homo sapiens
ggcaagucuucca

SEQ ID NO: 1848590 - RNA, 12 nt, Homo sapiens
acuacugcuauu

SEQ ID NO: 1848591 - RNA, 19 nt, Homo sapiens
ucuguucuguuucaaggca

SEQ ID NO: 1848592 - RNA, 18 nt, Homo sapiens
gagucaggcuucucuugc

SEQ ID NO: 1848593 - RNA, 21 nt, Homo sapiens
ucugaugaccuaaccuaagca

SEQ ID NO: 1848594 - RNA, 22 nt, Homo sapiens
cucuguauuacagcuuucacag

SEQ ID NO: 1848595 - RNA, 12 nt, Homo sapiens
uugccaccagaa

SEQ ID NO: 1848596 - RNA, 18 nt, Homo sapiens
uugggaaaugcugauuua

SEQ ID NO: 1848597 - RNA, 18 nt, Homo sapiens
aacaugacaguauuccau

SEQ ID NO: 1848598 - RNA, 21 nt, Homo sapiens
uauguagaucaaggaugucca

SEQ ID NO: 1848599 - RNA, 13 nt, Homo sapiens
gguuuuuucacau

SEQ ID NO: 1848600 - RNA, 19 nt, Homo sapiens
ggaguugcucacucaggac

SEQ ID NO: 1848601 - RNA, 21 nt, Homo sapiens
uagaaaauaucuagcccaaag

SEQ ID NO: 1848602 - RNA, 15 nt, Homo sapiens
aaguccaacaguagc

SEQ ID NO: 1848603 - RNA, 22 nt, Homo sapiens
uuuuaugaugguuuuaucaaaa

SEQ ID NO: 1848604 - RNA, 22 nt, Homo sapiens
uuucugugggaggagaagggga

SEQ ID NO: 1848605 - RNA, 21 nt, Homo sapiens
acuaucucaugccagugccuu

SEQ ID NO: 1848606 - RNA, 13 nt, Homo sapiens
uucuggacauguc

SEQ ID NO: 1848607 - RNA, 16 nt, Homo sapiens
uccagaccaaccuucc

SEQ ID NO: 1848608 - RNA, 17 nt, Homo sapiens
acuuauuuuuuucccaa

SEQ ID NO: 1848609 - RNA, 20 nt, Homo sapiens
gggucuagcuggccacugcu

SEQ ID NO: 1848610 - RNA, 14 nt, Homo sapiens
uaacauugauuuau

SEQ ID NO: 1848611 - RNA, 17 nt, Homo sapiens
ccguuuacuuguuucag

SEQ ID NO: 1848612 - RNA, 12 nt, Homo sapiens
auugcaaugccc

SEQ ID NO: 1848613 - RNA, 15 nt, Homo sapiens
caguuuuuaaacuag

SEQ ID NO: 1848614 - RNA, 14 nt, Homo sapiens
ccauugaacuguac

SEQ ID NO: 1848615 - RNA, 17 nt, Homo sapiens
uaaaacuucugauuucu

SEQ ID NO: 1848616 - RNA, 18 nt, Homo sapiens
ucuccaagucuagcuuuc

SEQ ID NO: 1848617 - RNA, 19 nt, Homo sapiens
uguauucugcaacagccug

SEQ ID NO: 1848618 - RNA, 17 nt, Homo sapiens
aguacauuuauacuaaa

SEQ ID NO: 1848619 - RNA, 15 nt, Homo sapiens
aaaauagaagacaua

SEQ ID NO: 1848620 - RNA, 16 nt, Homo sapiens
aauauagaaaguugau

SEQ ID NO: 1848621 - RNA, 14 nt, Homo sapiens
cuucuuuuccaauu

SEQ ID NO: 1848622 - RNA, 14 nt, Homo sapiens
gcacauuuguuaau

SEQ ID NO: 1848623 - RNA, 17 nt, Homo sapiens
gaagcagucuugcucug

SEQ ID NO: 1848624 - RNA, 16 nt, Homo sapiens
aauagauaccacugaa

SEQ ID NO: 1848625 - RNA, 15 nt, Homo sapiens
ugacaccaccaucua

SEQ ID NO: 1848626 - RNA, 11 nt, Homo sapiens
auuuguugaaa

SEQ ID NO: 1848627 - RNA, 13 nt, Homo sapiens
cagacaccugugc

SEQ ID NO: 1848628 - RNA, 20 nt, Homo sapiens
uucucagaguaaaauaggca

SEQ ID NO: 1848629 - RNA, 16 nt, Homo sapiens
cugugugacauuggga

SEQ ID NO: 1848630 - RNA, 15 nt, Homo sapiens
ggcugagguggcaga

SEQ ID NO: 1848631 - RNA, 22 nt, Homo sapiens
auuucucauaucaacuuaguca

SEQ ID NO: 1848632 - RNA, 10 nt, Homo sapiens
cucucugagg

SEQ ID NO: 1848633 - RNA, 15 nt, Homo sapiens
agcacaugugcugcc

SEQ ID NO: 1848634 - RNA, 15 nt, Homo sapiens
acguaaggucucauu

SEQ ID NO: 1848635 - RNA, 19 nt, Homo sapiens
aagauuuugcaccuguaaa

SEQ ID NO: 1848636 - RNA, 18 nt, Homo sapiens
ucauaaaagucacuuuau

SEQ ID NO: 1848637 - RNA, 13 nt, Homo sapiens
caguuucuaucaa

SEQ ID NO: 1848638 - RNA, 23 nt, Homo sapiens
uugguccuaagcaccugccucag

SEQ ID NO: 1848639 - RNA, 15 nt, Homo sapiens
aacaugauguacuaa

SEQ ID NO: 1848640 - RNA, 16 nt, Homo sapiens
aaaaccucuaugcaau

SEQ ID NO: 1848641 - RNA, 17 nt, Homo sapiens
ucucagagcauguguca

SEQ ID NO: 1848642 - RNA, 15 nt, Homo sapiens
gcccucggccucuuc

SEQ ID NO: 1848643 - RNA, 18 nt, Homo sapiens
gacuccaucuccugaccu

SEQ ID NO: 1848644 - RNA, 24 nt, Homo sapiens
cagcaggccucugggacccacaga

SEQ ID NO: 1848645 - RNA, 21 nt, Homo sapiens
ccagcuugggcagaucuccca

SEQ ID NO: 1848646 - RNA, 16 nt, Homo sapiens
acccggaucuccaggc

SEQ ID NO: 1848647 - RNA, 14 nt, Homo sapiens
cuccagcacccaga

SEQ ID NO: 1848648 - RNA, 16 nt, Homo sapiens
cuaauguaacuuccuc

SEQ ID NO: 1848649 - RNA, 19 nt, Homo sapiens
caucuugaauccuuccauu

SEQ ID NO: 1848650 - RNA, 15 nt, Homo sapiens
gcacagccagacgca

SEQ ID NO: 1848651 - RNA, 19 nt, Homo sapiens
cuacucgggaggcugaggc

SEQ ID NO: 1848652 - RNA, 20 nt, Homo sapiens
ggaagggccaugggaggucc

SEQ ID NO: 1848653 - RNA, 16 nt, Homo sapiens
cacauauguaguauaa

SEQ ID NO: 1848654 - RNA, 16 nt, Homo sapiens
ucagagcucucucuac

SEQ ID NO: 1848655 - RNA, 14 nt, Homo sapiens
ucgaucuuuuccua

SEQ ID NO: 1848656 - RNA, 14 nt, Homo sapiens
caagggaaaggcaa

SEQ ID NO: 1848657 - RNA, 19 nt, Homo sapiens
uggaagccaggacugugau

SEQ ID NO: 1848658 - RNA, 19 nt, Homo sapiens
ugguagauauucaggaaau

SEQ ID NO: 1848659 - RNA, 18 nt, Homo sapiens
agcuggagggagggguga

SEQ ID NO: 1848660 - RNA, 13 nt, Homo sapiens
acacuugcuuuau

SEQ ID NO: 1848661 - RNA, 22 nt, Homo sapiens
acucaucuugggaagggccaug

SEQ ID NO: 1848662 - RNA, 23 nt, Homo sapiens
gcaaggauuacagaaacugaugc

SEQ ID NO: 1848663 - RNA, 16 nt, Homo sapiens
accgcaaggagcaaac

SEQ ID NO: 1848664 - RNA, 18 nt, Homo sapiens
cccuccuuaucaaaggac

SEQ ID NO: 1848665 - RNA, 19 nt, Homo sapiens
agggaagauggagacaccc

SEQ ID NO: 1848666 - RNA, 17 nt, Homo sapiens
aggaaugacuuacuuuc

SEQ ID NO: 1848667 - RNA, 12 nt, Homo sapiens
aaauauucuaca

SEQ ID NO: 1848668 - RNA, 17 nt, Homo sapiens
gcaagauuccuuuccac

SEQ ID NO: 1848669 - RNA, 13 nt, Homo sapiens
acccuucaacucc

SEQ ID NO: 1848670 - RNA, 13 nt, Homo sapiens
ugcauucauguac

SEQ ID NO: 1848671 - RNA, 13 nt, Homo sapiens
agaagcaaguggu

SEQ ID NO: 1848672 - RNA, 22 nt, Homo sapiens
auguuuaguuugcuuuagucau

SEQ ID NO: 1848673 - RNA, 15 nt, Homo sapiens
gguugaaaaccacag

SEQ ID NO: 1848674 - RNA, 20 nt, Homo sapiens
uguuagcguggguuagggga

SEQ ID NO: 1848675 - RNA, 21 nt, Homo sapiens
aaacaaaaagccccauugggc

SEQ ID NO: 1848676 - RNA, 23 nt, Homo sapiens
ggugaaaguuaauccacugugac

SEQ ID NO: 1848677 - RNA, 17 nt, Homo sapiens
cuucauuuaacacugag

SEQ ID NO: 1848678 - RNA, 17 nt, Homo sapiens
cccugauacaggcaugg

SEQ ID NO: 1848679 - RNA, 17 nt, Homo sapiens
ucccaaguaugccuuaa

SEQ ID NO: 1848680 - RNA, 15 nt, Homo sapiens
aauuaaacuaaagag

SEQ ID NO: 1848681 - RNA, 19 nt, Homo sapiens
uuaacaaaaugagcaguaa

SEQ ID NO: 1848682 - RNA, 19 nt, Homo sapiens
guuucuuaaaaaacauaua

SEQ ID NO: 1848683 - RNA, 18 nt, Homo sapiens
aauuauacguacauacac

SEQ ID NO: 1848684 - RNA, 22 nt, Homo sapiens
aaaucaacccugcaaucacuuu

SEQ ID NO: 1848685 - RNA, 14 nt, Homo sapiens
ugacuuaugugcag

SEQ ID NO: 1848686 - RNA, 19 nt, Homo sapiens
auuccagaacgcccugugu

SEQ ID NO: 1848687 - RNA, 15 nt, Homo sapiens
uccugucaccaagga

SEQ ID NO: 1848688 - RNA, 15 nt, Homo sapiens
ugugacacauaugca

SEQ ID NO: 1848689 - RNA, 16 nt, Homo sapiens
gaaugcaaccaaguca

SEQ ID NO: 1848690 - RNA, 18 nt, Homo sapiens
agugcggacaaguuuuaa

SEQ ID NO: 1848691 - RNA, 14 nt, Homo sapiens
ugcugacaugguuu

SEQ ID NO: 1848692 - RNA, 20 nt, Homo sapiens
cuuugauucuccaguauucc

SEQ ID NO: 1848693 - RNA, 19 nt, Homo sapiens
uuaauaccacugagaccuu

SEQ ID NO: 1848694 - RNA, 20 nt, Homo sapiens
auaguuuaaacugcauuaua

SEQ ID NO: 1848695 - RNA, 17 nt, Homo sapiens
guuuuugcuuguuauau

SEQ ID NO: 1848696 - RNA, 14 nt, Homo sapiens
ccucacuucuucca

SEQ ID NO: 1848697 - RNA, 24 nt, Homo sapiens
ccccacccugagcgccugggucca

SEQ ID NO: 1848698 - RNA, 18 nt, Homo sapiens
gaugcauauagacacaca

SEQ ID NO: 1848699 - RNA, 19 nt, Homo sapiens
cguccucagcaguccacaa

SEQ ID NO: 1848700 - RNA, 13 nt, Homo sapiens
cuaauauauucca

SEQ ID NO: 1848701 - RNA, 15 nt, Homo sapiens
uacacguguccugua

SEQ ID NO: 1848702 - RNA, 16 nt, Homo sapiens
caguugaucagacuga

SEQ ID NO: 1848703 - RNA, 14 nt, Homo sapiens
uaugugugaagccu

SEQ ID NO: 1848704 - RNA, 14 nt, Homo sapiens
caggaugucccuga

SEQ ID NO: 1848705 - RNA, 20 nt, Homo sapiens
cuggcuucacagauguguga

SEQ ID NO: 1848706 - RNA, 16 nt, Homo sapiens
ugaaagaguagugcau

SEQ ID NO: 1848707 - RNA, 21 nt, Homo sapiens
uauuauuugacaacaauccaa

SEQ ID NO: 1848708 - RNA, 20 nt, Homo sapiens
acucuucuuacuggugcuau

SEQ ID NO: 1848709 - RNA, 16 nt, Homo sapiens
aacucccucugggaag

SEQ ID NO: 1848710 - RNA, 17 nt, Homo sapiens
gcuccugccacugaccu

SEQ ID NO: 1848711 - RNA, 14 nt, Homo sapiens
gagucaccuuccag

SEQ ID NO: 1848712 - RNA, 12 nt, Homo sapiens
uccugucuacag

SEQ ID NO: 1848713 - RNA, 19 nt, Homo sapiens
guaguuggaaacaaaucau

SEQ ID NO: 1848714 - RNA, 19 nt, Homo sapiens
cuuuucgcaggauucuucc

SEQ ID NO: 1848715 - RNA, 22 nt, Homo sapiens
aaacuuccaagucauucucacc

SEQ ID NO: 1848716 - RNA, 20 nt, Homo sapiens
acucugcccauccccacccc

SEQ ID NO: 1848717 - RNA, 14 nt, Homo sapiens
ucauaaaaauaacc

SEQ ID NO: 1848718 - RNA, 12 nt, Homo sapiens
auuucugugcaa

SEQ ID NO: 1848719 - RNA, 23 nt, Homo sapiens
ugcuagggccccuagaaaccacc

SEQ ID NO: 1848720 - RNA, 16 nt, Homo sapiens
ccuccucaucagugug

SEQ ID NO: 1848721 - RNA, 20 nt, Homo sapiens
acauugaccaagaacugcau

SEQ ID NO: 1848722 - RNA, 13 nt, Homo sapiens
cgacaucuucuca

SEQ ID NO: 1848723 - RNA, 16 nt, Homo sapiens
aaacaaaugcuccucc

SEQ ID NO: 1848724 - RNA, 16 nt, Homo sapiens
uuggccauguucucca

SEQ ID NO: 1848725 - RNA, 18 nt, Homo sapiens
cagucggaagcuccagaa

SEQ ID NO: 1848726 - RNA, 18 nt, Homo sapiens
agcaacaacagaagggaa

SEQ ID NO: 1848727 - RNA, 13 nt, Homo sapiens
caccucuuccuuc

SEQ ID NO: 1848728 - RNA, 15 nt, Homo sapiens
uaggccuggggcuau

SEQ ID NO: 1848729 - RNA, 18 nt, Homo sapiens
agccucccugcagccacc

SEQ ID NO: 1848730 - RNA, 16 nt, Homo sapiens
augucaauagcaaaug

SEQ ID NO: 1848731 - RNA, 22 nt, Homo sapiens
gcaaucccacuuagcagggaca

SEQ ID NO: 1848732 - RNA, 16 nt, Homo sapiens
agauugcgccacugca

SEQ ID NO: 1848733 - RNA, 17 nt, Homo sapiens
ugcagaccugguuccca

SEQ ID NO: 1848734 - RNA, 22 nt, Homo sapiens
aagcuaccccucaaacugcaca

SEQ ID NO: 1848735 - RNA, 14 nt, Homo sapiens
ugguagcaggaaaa

SEQ ID NO: 1848736 - RNA, 20 nt, Homo sapiens
uaaaggggcugucucccaau

SEQ ID NO: 1848737 - RNA, 17 nt, Homo sapiens
augauggcacugagaaa

SEQ ID NO: 1848738 - RNA, 23 nt, Homo sapiens
gagggacggcucacgaggcuugg

SEQ ID NO: 1848739 - RNA, 22 nt, Homo sapiens
ccaaacccaugaggcaauguca

SEQ ID NO: 1848740 - RNA, 15 nt, Homo sapiens
guccaacaguagcau

SEQ ID NO: 1848741 - RNA, 22 nt, Homo sapiens
gacuggcagcauugacucugug

SEQ ID NO: 1848742 - RNA, 16 nt, Homo sapiens
cucucaccaugugaca

SEQ ID NO: 1848743 - RNA, 16 nt, Homo sapiens
cagacaucaacagaua

SEQ ID NO: 1848744 - RNA, 21 nt, Homo sapiens
cgcaccgacuagacacacaaa

SEQ ID NO: 1848745 - RNA, 13 nt, Homo sapiens
gccaugucucaga

SEQ ID NO: 1848746 - RNA, 22 nt, Homo sapiens
uauuuccguuuuccacuugugg

SEQ ID NO: 1848747 - RNA, 16 nt, Homo sapiens
accaccucaacauugg

SEQ ID NO: 1848748 - RNA, 15 nt, Homo sapiens
gucuguucacugcau

SEQ ID NO: 1848749 - RNA, 23 nt, Homo sapiens
guaacuuccucuuaggauguuuc

SEQ ID NO: 1848750 - RNA, 20 nt, Homo sapiens
ucaaagcucuaauggaccuu

SEQ ID NO: 1848751 - RNA, 15 nt, Homo sapiens
acugaaaaccucucc

SEQ ID NO: 1848752 - RNA, 19 nt, Homo sapiens
cuuuauacuuugcuguuga

SEQ ID NO: 1848753 - RNA, 11 nt, Homo sapiens
aaaauagccaa

SEQ ID NO: 1848754 - RNA, 20 nt, Homo sapiens
uaaaaugaaggguguggggu

SEQ ID NO: 1848755 - RNA, 14 nt, Homo sapiens
uucuagguucaaaa

SEQ ID NO: 1848756 - RNA, 14 nt, Homo sapiens
gaaccaaugcaaga

SEQ ID NO: 1848757 - RNA, 21 nt, Homo sapiens
cuuacuaaaaaguauaaaaua

SEQ ID NO: 1848758 - RNA, 21 nt, Homo sapiens
cccagaccuguuagcagacag

SEQ ID NO: 1848759 - RNA, 23 nt, Homo sapiens
ucauccuggcacgcccuacucca

SEQ ID NO: 1848760 - RNA, 17 nt, Homo sapiens
acagggccagugcaguu

SEQ ID NO: 1848761 - RNA, 18 nt, Homo sapiens
aacaaaaaacuaugugau

SEQ ID NO: 1848762 - RNA, 13 nt, Homo sapiens
acguaagcacugu

SEQ ID NO: 1848763 - RNA, 23 nt, Homo sapiens
guuccguccaaguugcugcaaaa

SEQ ID NO: 1848764 - RNA, 22 nt, Homo sapiens
uggaaguuuauuuccaucugua

SEQ ID NO: 1848765 - RNA, 16 nt, Homo sapiens
acaccgugaggccaag

SEQ ID NO: 1848766 - RNA, 13 nt, Homo sapiens
aggacuggcuuug

SEQ ID NO: 1848767 - RNA, 15 nt, Homo sapiens
cucugugucuucaaa

SEQ ID NO: 1848768 - RNA, 17 nt, Homo sapiens
ugauuaagccuccuccu

SEQ ID NO: 1848769 - RNA, 14 nt, Homo sapiens
uuugguucuaugcu

SEQ ID NO: 1848770 - RNA, 22 nt, Homo sapiens
ucaagcaguuauuugauuugug

SEQ ID NO: 1848771 - RNA, 14 nt, Homo sapiens
gauagcuccuccau

SEQ ID NO: 1848772 - RNA, 14 nt, Homo sapiens
gcugccccaugugu

SEQ ID NO: 1848773 - RNA, 21 nt, Homo sapiens
cguuguguacagaauuuuucu

SEQ ID NO: 1848774 - RNA, 15 nt, Homo sapiens
agaaaggguuccaaa

SEQ ID NO: 1848775 - RNA, 18 nt, Homo sapiens
gugcguuaaauaagcaaa

SEQ ID NO: 1848776 - RNA, 23 nt, Homo sapiens
aggaaauagggaauccaauggaa

SEQ ID NO: 1848777 - RNA, 23 nt, Homo sapiens
guauuuuuuccacuacacaacug

SEQ ID NO: 1848778 - RNA, 19 nt, Homo sapiens
ucaacuuuuucccucacua

SEQ ID NO: 1848779 - RNA, 16 nt, Homo sapiens
agaggacucacuugcc

SEQ ID NO: 1848780 - RNA, 23 nt, Homo sapiens
aagcuuuccugacuucuccuagc

SEQ ID NO: 1848781 - RNA, 23 nt, Homo sapiens
ccagacuucucuuucuuauuuug

SEQ ID NO: 1848782 - RNA, 17 nt, Homo sapiens
caauaccagaucacuca

SEQ ID NO: 1848783 - RNA, 16 nt, Homo sapiens
caccugucugugcaga

SEQ ID NO: 1848784 - RNA, 20 nt, Homo sapiens
aagccucugugucacuggcu

SEQ ID NO: 1848785 - RNA, 22 nt, Homo sapiens
uacagaaagcacaaagaauuga

SEQ ID NO: 1848786 - RNA, 21 nt, Homo sapiens
cugaagugaccccagcuccag

SEQ ID NO: 1848787 - RNA, 19 nt, Homo sapiens
cccaugcaggcccuuugaa

SEQ ID NO: 1848788 - RNA, 19 nt, Homo sapiens
gcagacuccacacucagua

SEQ ID NO: 1848789 - RNA, 13 nt, Homo sapiens
acuucacugagaa

SEQ ID NO: 1848790 - RNA, 22 nt, Homo sapiens
uagugcuuugugauaguucagu

SEQ ID NO: 1848791 - RNA, 15 nt, Homo sapiens
uaauuuucagccaug

SEQ ID NO: 1848792 - RNA, 21 nt, Homo sapiens
uuagaaacugauuucuucaga

SEQ ID NO: 1848793 - RNA, 23 nt, Homo sapiens
uuccccccucccuccaguaccau

SEQ ID NO: 1848794 - RNA, 18 nt, Homo sapiens
ugacacaacaucugagac

SEQ ID NO: 1848795 - RNA, 17 nt, Homo sapiens
ugaaagagaaacacgua

SEQ ID NO: 1848796 - RNA, 17 nt, Homo sapiens
accagaugaacauuuca

SEQ ID NO: 1848797 - RNA, 14 nt, Homo sapiens
uggccaacuguuac

SEQ ID NO: 1848798 - RNA, 14 nt, Homo sapiens
cggcuuugcagugc

SEQ ID NO: 1848799 - RNA, 13 nt, Homo sapiens
uuauucucuagau

SEQ ID NO: 1848800 - RNA, 23 nt, Homo sapiens
guaaaacagucaucuagaauuca

SEQ ID NO: 1848801 - RNA, 19 nt, Homo sapiens
caaauagaagcuucuugcu

SEQ ID NO: 1848802 - RNA, 20 nt, Homo sapiens
auuucuuuucauuguaauca

SEQ ID NO: 1848803 - RNA, 20 nt, Homo sapiens
aacauaggccugcucagccu

SEQ ID NO: 1848804 - RNA, 24 nt, Homo sapiens
auugcucuucuccacgucuuuccu

SEQ ID NO: 1848805 - RNA, 14 nt, Homo sapiens
aucuuuuuccuccc

SEQ ID NO: 1848806 - RNA, 17 nt, Homo sapiens
gcaugcagugcccucac

SEQ ID NO: 1848807 - RNA, 21 nt, Homo sapiens
auuacuaaggaagauuacuca

SEQ ID NO: 1848808 - RNA, 22 nt, Homo sapiens
caggcucccugaccacccugcc

SEQ ID NO: 1848809 - RNA, 19 nt, Homo sapiens
agaagcguuaugugcagua

SEQ ID NO: 1848810 - RNA, 14 nt, Homo sapiens
ucugugggcacugg

SEQ ID NO: 1848811 - RNA, 13 nt, Homo sapiens
accuuggccuccc

SEQ ID NO: 1848812 - RNA, 15 nt, Homo sapiens
ccuguaccugggcuu

SEQ ID NO: 1848813 - RNA, 15 nt, Homo sapiens
acccaauagcugccc

SEQ ID NO: 1848814 - RNA, 17 nt, Homo sapiens
agauaaagcuuuauucu

SEQ ID NO: 1848815 - RNA, 18 nt, Homo sapiens
acaaagggaaagccucug

SEQ ID NO: 1848816 - RNA, 19 nt, Homo sapiens
ggaacucuggcuuccaggu

SEQ ID NO: 1848817 - RNA, 18 nt, Homo sapiens
cuuuucgccaaggcucac

SEQ ID NO: 1848818 - RNA, 16 nt, Homo sapiens
auuugcagauguucaa

SEQ ID NO: 1848819 - RNA, 17 nt, Homo sapiens
acguuuagcugacaaaa

SEQ ID NO: 1848820 - RNA, 16 nt, Homo sapiens
ggaauuuuaagucuuu

SEQ ID NO: 1848821 - RNA, 14 nt, Homo sapiens
agaguggugcugcu

SEQ ID NO: 1848822 - RNA, 17 nt, Homo sapiens
aagcaggacagugcuug

SEQ ID NO: 1848823 - RNA, 18 nt, Homo sapiens
augucacugaaauugaau

SEQ ID NO: 1848824 - RNA, 23 nt, Homo sapiens
ugcaggcuguuuauauguucaca

SEQ ID NO: 1848825 - RNA, 17 nt, Homo sapiens
caaugauuuacucaaua

SEQ ID NO: 1848826 - RNA, 23 nt, Homo sapiens
auauauuuuuaaaaaucuaccug

SEQ ID NO: 1848827 - RNA, 13 nt, Homo sapiens
aaggcucagucuc

SEQ ID NO: 1848828 - RNA, 14 nt, Homo sapiens
gcacucucacccca

SEQ ID NO: 1848829 - RNA, 17 nt, Homo sapiens
caggauaagagggauua

SEQ ID NO: 1848830 - RNA, 17 nt, Homo sapiens
ucuacaauuugccauug

SEQ ID NO: 1848831 - RNA, 17 nt, Homo sapiens
gccgcaaaccacacugg

SEQ ID NO: 1848832 - RNA, 18 nt, Homo sapiens
auuuuuugggcagcaauu

SEQ ID NO: 1848833 - RNA, 16 nt, Homo sapiens
gcuguguuuccaucuc

SEQ ID NO: 1848834 - RNA, 20 nt, Homo sapiens
ucuauacaaaaugauuuuga

SEQ ID NO: 1848835 - RNA, 16 nt, Homo sapiens
uucccucccuaucuaa

SEQ ID NO: 1848836 - RNA, 21 nt, Homo sapiens
cucaguuuccucaucugcaaa

SEQ ID NO: 1848837 - RNA, 19 nt, Homo sapiens
uacucaugaggcugaggca

SEQ ID NO: 1848838 - RNA, 14 nt, Homo sapiens
augcagcuacccag

SEQ ID NO: 1848839 - RNA, 14 nt, Homo sapiens
gcccuccugugcuc

SEQ ID NO: 1848840 - RNA, 16 nt, Homo sapiens
ucaggaucacugggcu

SEQ ID NO: 1848841 - RNA, 21 nt, Homo sapiens
agugaagcaauuucaguuuua

SEQ ID NO: 1848842 - RNA, 21 nt, Homo sapiens
ggcaaaagagucaacaguauc

SEQ ID NO: 1848843 - RNA, 19 nt, Homo sapiens
ugcaaauccacuagcaccg

SEQ ID NO: 1848844 - RNA, 23 nt, Homo sapiens
agauacugaagugcagcucagga

SEQ ID NO: 1848845 - RNA, 19 nt, Homo sapiens
gcccgcagugcugggacca

SEQ ID NO: 1848846 - RNA, 16 nt, Homo sapiens
uaguuaaaagccuuuc

SEQ ID NO: 1848847 - RNA, 17 nt, Homo sapiens
ucuugaggccugugcuc

SEQ ID NO: 1848848 - RNA, 14 nt, Homo sapiens
uucucucugcccaa

SEQ ID NO: 1848849 - RNA, 21 nt, Homo sapiens
aucuaccaggugaucuauuca

SEQ ID NO: 1848850 - RNA, 23 nt, Homo sapiens
agcccagaaggccagaaaaggca

SEQ ID NO: 1848851 - RNA, 12 nt, Homo sapiens
ggcuguacugcu

SEQ ID NO: 1848852 - RNA, 21 nt, Homo sapiens
gcuugacaacaaccuaugcac

SEQ ID NO: 1848853 - RNA, 16 nt, Homo sapiens
auaaaguuguauuuca

SEQ ID NO: 1848854 - RNA, 20 nt, Homo sapiens
uccaagaaacguggaucucc

SEQ ID NO: 1848855 - RNA, 21 nt, Homo sapiens
ugcauuuuugaagacaucaaa

SEQ ID NO: 1848856 - RNA, 14 nt, Homo sapiens
uccugagacuuuuc

SEQ ID NO: 1848857 - RNA, 14 nt, Homo sapiens
uuacuauugcucuu

SEQ ID NO: 1848858 - RNA, 17 nt, Homo sapiens
ugaacacuagccagaca

SEQ ID NO: 1848859 - RNA, 16 nt, Homo sapiens
ggacaucagcaucacg

SEQ ID NO: 1848860 - RNA, 17 nt, Homo sapiens
uuagaaacuccaaugaa

SEQ ID NO: 1848861 - RNA, 20 nt, Homo sapiens
uggggagguggcacuaggga

SEQ ID NO: 1848862 - RNA, 13 nt, Homo sapiens
uucugggacacag

SEQ ID NO: 1848863 - RNA, 13 nt, Homo sapiens
uucauggacacuu

SEQ ID NO: 1848864 - RNA, 14 nt, Homo sapiens
uauuuuucuuuaac

SEQ ID NO: 1848865 - RNA, 20 nt, Homo sapiens
cagggccguaguaccuccca

SEQ ID NO: 1848866 - RNA, 23 nt, Homo sapiens
caugagauuugggcaggaacaca

SEQ ID NO: 1848867 - RNA, 17 nt, Homo sapiens
agacaggaaggaagcac

SEQ ID NO: 1848868 - RNA, 15 nt, Homo sapiens
ccaggcugaaaagaa

SEQ ID NO: 1848869 - RNA, 15 nt, Homo sapiens
uuaggcaaaguacaa

SEQ ID NO: 1848870 - RNA, 13 nt, Homo sapiens
uaaauaacauguu

SEQ ID NO: 1848871 - RNA, 17 nt, Homo sapiens
cguaaaucaacuuguca

SEQ ID NO: 1848872 - RNA, 16 nt, Homo sapiens
uguagaaaaauacuga

SEQ ID NO: 1848873 - RNA, 20 nt, Homo sapiens
ucuuguucauaagauuauga

SEQ ID NO: 1848874 - RNA, 22 nt, Homo sapiens
uguuuguuguauacuuccuuau

SEQ ID NO: 1848875 - RNA, 21 nt, Homo sapiens
ugccuugugaauuugcugcua

SEQ ID NO: 1848876 - RNA, 19 nt, Homo sapiens
aacccuaaucuuucacuug

SEQ ID NO: 1848877 - RNA, 15 nt, Homo sapiens
ccgauuccaccaaau

SEQ ID NO: 1848878 - RNA, 17 nt, Homo sapiens
uaguuuuuagucugugu

SEQ ID NO: 1848879 - RNA, 16 nt, Homo sapiens
cuacacugggugcuga

SEQ ID NO: 1848880 - RNA, 15 nt, Homo sapiens
caucuuuucuaauca

SEQ ID NO: 1848881 - RNA, 13 nt, Homo sapiens
cccaggacugggc

SEQ ID NO: 1848882 - RNA, 20 nt, Homo sapiens
gguucuaggcugcugcacac

SEQ ID NO: 1848883 - RNA, 22 nt, Homo sapiens
aacugguuaaacauuaauauuu

SEQ ID NO: 1848884 - RNA, 22 nt, Homo sapiens
auuuauugguuuugcagaagaa

SEQ ID NO: 1848885 - RNA, 15 nt, Homo sapiens
aacaagcaaugagaa

SEQ ID NO: 1848886 - RNA, 16 nt, Homo sapiens
aaccucccccaggugc

SEQ ID NO: 1848887 - RNA, 19 nt, Homo sapiens
cagauguacgacuugcaua

SEQ ID NO: 1848888 - RNA, 20 nt, Homo sapiens
acuacucagccuucaaugua

SEQ ID NO: 1848889 - RNA, 14 nt, Homo sapiens
uauaagauuccaaa

SEQ ID NO: 1848890 - RNA, 22 nt, Homo sapiens
acuuuaguaacagcacaacaaa

SEQ ID NO: 1848891 - RNA, 16 nt, Homo sapiens
cugagcacugaaccac

SEQ ID NO: 1848892 - RNA, 23 nt, Homo sapiens
ccaacuuguaaauacaccaccuc

SEQ ID NO: 1848893 - RNA, 19 nt, Homo sapiens
gcccacugugaaaccacua

SEQ ID NO: 1848894 - RNA, 18 nt, Homo sapiens
ucaggaguucgagaccaa

SEQ ID NO: 1848895 - RNA, 18 nt, Homo sapiens
uggacagcugagcacuaa

SEQ ID NO: 1848896 - RNA, 22 nt, Homo sapiens
acugaucucgaugcagguggau

SEQ ID NO: 1848897 - RNA, 12 nt, Homo sapiens
uauggacuucca

SEQ ID NO: 1848898 - RNA, 17 nt, Homo sapiens
acaaauuguacauuuga

SEQ ID NO: 1848899 - RNA, 14 nt, Homo sapiens
uaauuuaaugcaug

SEQ ID NO: 1848900 - RNA, 12 nt, Homo sapiens
uaguauugugau

SEQ ID NO: 1848901 - RNA, 16 nt, Homo sapiens
cagaccacggcucgau

SEQ ID NO: 1848902 - RNA, 15 nt, Homo sapiens
caacuguccuacuca

SEQ ID NO: 1848903 - RNA, 18 nt, Homo sapiens
aaggcgauguggugaccc

SEQ ID NO: 1848904 - RNA, 19 nt, Homo sapiens
cuuggagaauacugccaaa

SEQ ID NO: 1848905 - RNA, 12 nt, Homo sapiens
ucuuccauucca

SEQ ID NO: 1848906 - RNA, 12 nt, Homo sapiens
cuaguuccagaa

SEQ ID NO: 1848907 - RNA, 16 nt, Homo sapiens
gccugugggagucaug

SEQ ID NO: 1848908 - RNA, 20 nt, Homo sapiens
cugugccuuggugugcugua

SEQ ID NO: 1848909 - RNA, 14 nt, Homo sapiens
augugccuagacac

SEQ ID NO: 1848910 - RNA, 17 nt, Homo sapiens
guguucaccaucccaaa

SEQ ID NO: 1848911 - RNA, 23 nt, Homo sapiens
cccugcucccaccaccagugaga

SEQ ID NO: 1848912 - RNA, 13 nt, Homo sapiens
aaguaauuuugcc

SEQ ID NO: 1848913 - RNA, 13 nt, Homo sapiens
cugucuacugugg

SEQ ID NO: 1848914 - RNA, 15 nt, Homo sapiens
guauaaucuuuucau

SEQ ID NO: 1848915 - RNA, 17 nt, Homo sapiens
ugcccuaaaguguauuu

SEQ ID NO: 1848916 - RNA, 14 nt, Homo sapiens
gagaagacauucug

SEQ ID NO: 1848917 - RNA, 20 nt, Homo sapiens
uucagugcuuuuacuaucug

SEQ ID NO: 1848918 - RNA, 19 nt, Homo sapiens
uaaagcauauuggugcuag

SEQ ID NO: 1848919 - RNA, 23 nt, Homo sapiens
ugugaaggaauuauucccaugag

SEQ ID NO: 1848920 - RNA, 22 nt, Homo sapiens
caauuugauguaguucuuuuca

SEQ ID NO: 1848921 - RNA, 17 nt, Homo sapiens
auacuucuguacacagu

SEQ ID NO: 1848922 - RNA, 16 nt, Homo sapiens
uucccccugcaaaaag

SEQ ID NO: 1848923 - RNA, 22 nt, Homo sapiens
ggcaauaaaagauaagugcagu

SEQ ID NO: 1848924 - RNA, 18 nt, Homo sapiens
ccaaccuggggggcagug

SEQ ID NO: 1848925 - RNA, 15 nt, Homo sapiens
aacugguucaugaaa

SEQ ID NO: 1848926 - RNA, 21 nt, Homo sapiens
aaugcugcuuccauuugacaa

SEQ ID NO: 1848927 - RNA, 15 nt, Homo sapiens
agggugugugcuagc

SEQ ID NO: 1848928 - RNA, 20 nt, Homo sapiens
cuaucuauugauaauuuaga

SEQ ID NO: 1848929 - RNA, 23 nt, Homo sapiens
ggucucacucuguugaccaggcu

SEQ ID NO: 1848930 - RNA, 22 nt, Homo sapiens
ugcccuggugcauggccuuagc

SEQ ID NO: 1848931 - RNA, 16 nt, Homo sapiens
cagacacaacacaguu

SEQ ID NO: 1848932 - RNA, 13 nt, Homo sapiens
uauuugaauauca

SEQ ID NO: 1848933 - RNA, 14 nt, Homo sapiens
uuuagaaacuacaa

SEQ ID NO: 1848934 - RNA, 19 nt, Homo sapiens
ugggcuauuuggacucagg

SEQ ID NO: 1848935 - RNA, 14 nt, Homo sapiens
cuacagauagaaaa

SEQ ID NO: 1848936 - RNA, 23 nt, Homo sapiens
ccacgggcccggguugggucacc

SEQ ID NO: 1848937 - RNA, 20 nt, Homo sapiens
caccugcaaauggugcuuca

SEQ ID NO: 1848938 - RNA, 15 nt, Homo sapiens
uucuugaggggacca

SEQ ID NO: 1848939 - RNA, 19 nt, Homo sapiens
gagaaaaggaaaagccaac

SEQ ID NO: 1848940 - RNA, 22 nt, Homo sapiens
uauuauccuagauuauaucaaa

SEQ ID NO: 1848941 - RNA, 22 nt, Homo sapiens
aacaccagccgaggccacagaa

SEQ ID NO: 1848942 - RNA, 14 nt, Homo sapiens
aggcacugcccuuu

SEQ ID NO: 1848943 - RNA, 23 nt, Homo sapiens
uucaacuguauaguuuuauuuac

SEQ ID NO: 1848944 - RNA, 21 nt, Homo sapiens
caagguauugagacauauuac

SEQ ID NO: 1848945 - RNA, 17 nt, Homo sapiens
cugaaauuggaagacuu

SEQ ID NO: 1848946 - RNA, 21 nt, Homo sapiens
agcucauguaggugagccugg

SEQ ID NO: 1848947 - RNA, 17 nt, Homo sapiens
acaagacaaaaccaaaa

SEQ ID NO: 1848948 - RNA, 11 nt, Homo sapiens
cugaagauauu

SEQ ID NO: 1848949 - RNA, 12 nt, Homo sapiens
uuuccaggguug

SEQ ID NO: 1848950 - RNA, 23 nt, Homo sapiens
cagcaacugaauaaauaccucuu

SEQ ID NO: 1848951 - RNA, 22 nt, Homo sapiens
ccagaaugaccccaucgagaug

SEQ ID NO: 1848952 - RNA, 19 nt, Homo sapiens
cuccucacucaccuucagu

SEQ ID NO: 1848953 - RNA, 19 nt, Homo sapiens
accccagguacauccauga

SEQ ID NO: 1848954 - RNA, 20 nt, Homo sapiens
cuuauuucaagugaugguca

SEQ ID NO: 1848955 - RNA, 18 nt, Homo sapiens
ucuuccugcuuuccaugg

SEQ ID NO: 1848956 - RNA, 15 nt, Homo sapiens
gacugugacacagcu

SEQ ID NO: 1848957 - RNA, 16 nt, Homo sapiens
uucucugggcugaaug

SEQ ID NO: 1848958 - RNA, 14 nt, Homo sapiens
gcugacauucacug

SEQ ID NO: 1848959 - RNA, 15 nt, Homo sapiens
aggagagguccacuu

SEQ ID NO: 1848960 - RNA, 18 nt, Homo sapiens
uaaacagccucuuuuuga

SEQ ID NO: 1848961 - RNA, 20 nt, Homo sapiens
aaaggaugguauugaaucua

SEQ ID NO: 1848962 - RNA, 20 nt, Homo sapiens
agccugaauuggcuaugcag

SEQ ID NO: 1848963 - RNA, 21 nt, Homo sapiens
gaagcaggaguaaguuucuca

SEQ ID NO: 1848964 - RNA, 17 nt, Homo sapiens
aggauagagugggacag

SEQ ID NO: 1848965 - RNA, 15 nt, Homo sapiens
aagaucccaccgacc

SEQ ID NO: 1848966 - RNA, 19 nt, Homo sapiens
gaaacagagaacccugugg

SEQ ID NO: 1848967 - RNA, 19 nt, Homo sapiens
acugaauggcugaccugac

SEQ ID NO: 1848968 - RNA, 22 nt, Homo sapiens
agaaaaguauuuccaacuuguc

SEQ ID NO: 1848969 - RNA, 21 nt, Homo sapiens
ucacuauucuuaagcacuuug

SEQ ID NO: 1848970 - RNA, 19 nt, Homo sapiens
uccacuuugcucugaaugu

SEQ ID NO: 1848971 - RNA, 23 nt, Homo sapiens
ucucaugcagaagccugagcuca

SEQ ID NO: 1848972 - RNA, 16 nt, Homo sapiens
accuggcccuugcaau

SEQ ID NO: 1848973 - RNA, 19 nt, Homo sapiens
gaugaugcaugaugcccuc

SEQ ID NO: 1848974 - RNA, 22 nt, Homo sapiens
ucuggcucaaguucgucucuga

SEQ ID NO: 1848975 - RNA, 21 nt, Homo sapiens
agcacggacugucaguucucu

SEQ ID NO: 1848976 - RNA, 19 nt, Homo sapiens
uggcaccuuaguugcauga

SEQ ID NO: 1848977 - RNA, 23 nt, Homo sapiens
gauggaauuuggaacaauagaau

SEQ ID NO: 1848978 - RNA, 22 nt, Homo sapiens
auggaaaacuuaguuugugaau

SEQ ID NO: 1848979 - RNA, 13 nt, Homo sapiens
cucagggaccaag

SEQ ID NO: 1848980 - RNA, 21 nt, Homo sapiens
agcugucuuccuguguaccuc

SEQ ID NO: 1848981 - RNA, 14 nt, Homo sapiens
caaaccuccuguca

SEQ ID NO: 1848982 - RNA, 19 nt, Homo sapiens
ucuucuaguuaccacggca

SEQ ID NO: 1848983 - RNA, 17 nt, Homo sapiens
cagugccgcuccugcuu

SEQ ID NO: 1848984 - RNA, 12 nt, Homo sapiens
ucggcaucuucu

SEQ ID NO: 1848985 - RNA, 20 nt, Homo sapiens
acaaggaggaguuccaccau

SEQ ID NO: 1848986 - RNA, 15 nt, Homo sapiens
acagugggagccagg

SEQ ID NO: 1848987 - RNA, 22 nt, Homo sapiens
cagacaucuccagugugccaga

SEQ ID NO: 1848988 - RNA, 18 nt, Homo sapiens
auugacaaucgugauagu

SEQ ID NO: 1848989 - RNA, 23 nt, Homo sapiens
cuauuuuaggguucuaaaugcaa

SEQ ID NO: 1848990 - RNA, 21 nt, Homo sapiens
gaacaaaaucaccuauucacu

SEQ ID NO: 1848991 - RNA, 20 nt, Homo sapiens
ccaguccuggggagcuucac

SEQ ID NO: 1848992 - RNA, 14 nt, Homo sapiens
uucuuuccaugcag

SEQ ID NO: 1848993 - RNA, 20 nt, Homo sapiens
aagaacuccaggucuaaaca

SEQ ID NO: 1848994 - RNA, 16 nt, Homo sapiens
uaaacuggcaguuaca

SEQ ID NO: 1848995 - RNA, 13 nt, Homo sapiens
gcauagccauuca

SEQ ID NO: 1848996 - RNA, 23 nt, Homo sapiens
gucuuaucaagcagccaagggau

SEQ ID NO: 1848997 - RNA, 20 nt, Homo sapiens
gggucccucggagcugccag

SEQ ID NO: 1848998 - RNA, 19 nt, Homo sapiens
aaacagguggagaaauucc

SEQ ID NO: 1848999 - RNA, 23 nt, Homo sapiens
ugagcgcaagccacagccugucu

SEQ ID NO: 1849000 - RNA, 18 nt, Homo sapiens
uugaauagggcuaggaau

SEQ ID NO: 1849001 - RNA, 20 nt, Homo sapiens
uuacuguacccucgcaugac

SEQ ID NO: 1849002 - RNA, 15 nt, Homo sapiens
acucuucugaauuga

SEQ ID NO: 1849003 - RNA, 12 nt, Homo sapiens
ccauccugaugg

SEQ ID NO: 1849004 - RNA, 15 nt, Homo sapiens
ccugcccucugggag

SEQ ID NO: 1849005 - RNA, 17 nt, Homo sapiens
aagacuuaauucugauu

SEQ ID NO: 1849006 - RNA, 20 nt, Homo sapiens
ggggacaggauuuggccaca

SEQ ID NO: 1849007 - RNA, 17 nt, Homo sapiens
cuguuuucuccuaggcc

SEQ ID NO: 1849008 - RNA, 17 nt, Homo sapiens
ucuugcacuauuccaca

SEQ ID NO: 1849009 - RNA, 14 nt, Homo sapiens
ggaaucuaaguggg

SEQ ID NO: 1849010 - RNA, 18 nt, Homo sapiens
aaucagaguuuaauaauu

SEQ ID NO: 1849011 - RNA, 13 nt, Homo sapiens
cagacaauuccau

SEQ ID NO: 1849012 - RNA, 21 nt, Homo sapiens
caauuugguaaaaaugcugcu

SEQ ID NO: 1849013 - RNA, 13 nt, Homo sapiens
uaccaaggcaaaa

SEQ ID NO: 1849014 - RNA, 15 nt, Homo sapiens
cuuucuuguugcugc

SEQ ID NO: 1849015 - RNA, 12 nt, Homo sapiens
acaucacuuugu

SEQ ID NO: 1849016 - RNA, 15 nt, Homo sapiens
uggaacuaaagcaaa

SEQ ID NO: 1849017 - RNA, 17 nt, Homo sapiens
cugcacuauagccauuu

SEQ ID NO: 1849018 - RNA, 19 nt, Homo sapiens
aggugcuucugccugugca

SEQ ID NO: 1849019 - RNA, 21 nt, Homo sapiens
uucaacagccaagcuggcaca

SEQ ID NO: 1849020 - RNA, 21 nt, Homo sapiens
caugugagguuaaaccaguuu

SEQ ID NO: 1849021 - RNA, 14 nt, Homo sapiens
ggugcagugccgcu

SEQ ID NO: 1849022 - RNA, 23 nt, Homo sapiens
gccagaguuugccucccugcacu

SEQ ID NO: 1849023 - RNA, 15 nt, Homo sapiens
accauuacuguaauu

SEQ ID NO: 1849024 - RNA, 15 nt, Homo sapiens
cgcuccacagagaua

SEQ ID NO: 1849025 - RNA, 13 nt, Homo sapiens
aaacacuggaccu

SEQ ID NO: 1849026 - RNA, 16 nt, Homo sapiens
auuucacuggagcaca

SEQ ID NO: 1849027 - RNA, 23 nt, Homo sapiens
auuacugaaaacaaaauaucuga

SEQ ID NO: 1849028 - RNA, 17 nt, Homo sapiens
aguucacucuccauuua

SEQ ID NO: 1849029 - RNA, 16 nt, Homo sapiens
ucaaucaaacuuucag

SEQ ID NO: 1849030 - RNA, 21 nt, Homo sapiens
cuuccuaaauauuaugagaug

SEQ ID NO: 1849031 - RNA, 22 nt, Homo sapiens
ucucagcucacugcaaccucug

SEQ ID NO: 1849032 - RNA, 21 nt, Homo sapiens
cuguguguguucuucaagcca

SEQ ID NO: 1849033 - RNA, 21 nt, Homo sapiens
aagagaacucgcgcucaguaa

SEQ ID NO: 1849034 - RNA, 13 nt, Homo sapiens
ugaccccaaagac

SEQ ID NO: 1849035 - RNA, 17 nt, Homo sapiens
gccagcaaugaugucca

SEQ ID NO: 1849036 - RNA, 17 nt, Homo sapiens
uaaacaagugcacuuga

SEQ ID NO: 1849037 - RNA, 17 nt, Homo sapiens
caaaaccugacuugaaa

SEQ ID NO: 1849038 - RNA, 21 nt, Homo sapiens
agggguaauauauugcugcug

SEQ ID NO: 1849039 - RNA, 19 nt, Homo sapiens
ucucuugccauuuguagcu

SEQ ID NO: 1849040 - RNA, 21 nt, Homo sapiens
ucagauuuuuuccucugcauu

SEQ ID NO: 1849041 - RNA, 23 nt, Homo sapiens
uauuuuauauaauaaaguauucc

SEQ ID NO: 1849042 - RNA, 22 nt, Homo sapiens
acucacugaggccaucagggcc

SEQ ID NO: 1849043 - RNA, 18 nt, Homo sapiens
accacagagccucgggac

SEQ ID NO: 1849044 - RNA, 14 nt, Homo sapiens
agaacaggacucca

SEQ ID NO: 1849045 - RNA, 14 nt, Homo sapiens
ccuuuaggaucuca

SEQ ID NO: 1849046 - RNA, 22 nt, Homo sapiens
aguuucaaugugauucuaaugu

SEQ ID NO: 1849047 - RNA, 20 nt, Homo sapiens
ccaaacuaaauacuguaaca

SEQ ID NO: 1849048 - RNA, 16 nt, Homo sapiens
cgaucuccugaccucg

SEQ ID NO: 1849049 - RNA, 19 nt, Homo sapiens
gagaaaccgaggugcaaau

SEQ ID NO: 1849050 - RNA, 15 nt, Homo sapiens
gacgguucaccagcc

SEQ ID NO: 1849051 - RNA, 15 nt, Homo sapiens
agagggacugaauag

SEQ ID NO: 1849052 - RNA, 17 nt, Homo sapiens
aauagauaaacuauaca

SEQ ID NO: 1849053 - RNA, 10 nt, Homo sapiens
uuauccugua

SEQ ID NO: 1849054 - RNA, 23 nt, Homo sapiens
auccuucaucaugucaguuccaa

SEQ ID NO: 1849055 - RNA, 23 nt, Homo sapiens
uauuuugggaaaaaaacauacac

SEQ ID NO: 1849056 - RNA, 12 nt, Homo sapiens
acuuugccaaaa

SEQ ID NO: 1849057 - RNA, 12 nt, Homo sapiens
uauaugccucau

SEQ ID NO: 1849058 - RNA, 22 nt, Homo sapiens
aaaagcuuaaaaaaauuacugu

SEQ ID NO: 1849059 - RNA, 19 nt, Homo sapiens
uaaagcucugaacaaaagc

SEQ ID NO: 1849060 - RNA, 19 nt, Homo sapiens
ccuccaagugaaugaguuu

SEQ ID NO: 1849061 - RNA, 23 nt, Homo sapiens
uuaagaggacauaaugggguccu

SEQ ID NO: 1849062 - RNA, 23 nt, Homo sapiens
agauggcugcugcucacccuccu

SEQ ID NO: 1849063 - RNA, 15 nt, Homo sapiens
uggugaugguuucca

SEQ ID NO: 1849064 - RNA, 16 nt, Homo sapiens
auuccuauauguagcu

SEQ ID NO: 1849065 - RNA, 11 nt, Homo sapiens
uacauguuaag

SEQ ID NO: 1849066 - RNA, 12 nt, Homo sapiens
ucuguaaucuuc

SEQ ID NO: 1849067 - RNA, 16 nt, Homo sapiens
ugggagaaaucuggcu

SEQ ID NO: 1849068 - RNA, 13 nt, Homo sapiens
gucuaaagcuaaa

SEQ ID NO: 1849069 - RNA, 19 nt, Homo sapiens
ugcugcuuuuggugcucuc

SEQ ID NO: 1849070 - RNA, 12 nt, Homo sapiens
ccucugacugua

SEQ ID NO: 1849071 - RNA, 16 nt, Homo sapiens
ucugcacuggugugag

SEQ ID NO: 1849072 - RNA, 19 nt, Homo sapiens
caaaugcuuuuugaucugu

SEQ ID NO: 1849073 - RNA, 21 nt, Homo sapiens
cucaagucugcacagagcaag

SEQ ID NO: 1849074 - RNA, 14 nt, Homo sapiens
cagaccguguuguu

SEQ ID NO: 1849075 - RNA, 21 nt, Homo sapiens
gaauacugggaaucaagacaa

SEQ ID NO: 1849076 - RNA, 22 nt, Homo sapiens
acagagucuguguguagccagg

SEQ ID NO: 1849077 - RNA, 17 nt, Homo sapiens
caaaccuaauugcacaa

SEQ ID NO: 1849078 - RNA, 19 nt, Homo sapiens
ucacuucaaaacaguauug

SEQ ID NO: 1849079 - RNA, 23 nt, Homo sapiens
guuucagaguuuguauugugauu

SEQ ID NO: 1849080 - RNA, 20 nt, Homo sapiens
gagauugcgccauugcacuc

SEQ ID NO: 1849081 - RNA, 20 nt, Homo sapiens
gagauugcaccauugcgcuc

SEQ ID NO: 1849082 - RNA, 15 nt, Homo sapiens
cuucucuuucucuga

SEQ ID NO: 1849083 - RNA, 19 nt, Homo sapiens
guaaaugcuugauggaauu

SEQ ID NO: 1849084 - RNA, 15 nt, Homo sapiens
gccuuauuggcagcu

SEQ ID NO: 1849085 - RNA, 15 nt, Homo sapiens
uguugacuucuaucc

SEQ ID NO: 1849086 - RNA, 18 nt, Homo sapiens
ucaagaagucugaagcga

SEQ ID NO: 1849087 - RNA, 17 nt, Homo sapiens
cuccugggcuauauucc

SEQ ID NO: 1849088 - RNA, 22 nt, Homo sapiens
ucagaccucggugggcauucac

SEQ ID NO: 1849089 - RNA, 13 nt, Homo sapiens
gagcagcauuccc

SEQ ID NO: 1849090 - RNA, 23 nt, Homo sapiens
agcugcucuccuaucagaagcuc

SEQ ID NO: 1849091 - RNA, 13 nt, Homo sapiens
caguuugaucaaa

SEQ ID NO: 1849092 - RNA, 21 nt, Homo sapiens
agagauauugauauugaagga

SEQ ID NO: 1849093 - RNA, 15 nt, Homo sapiens
agcacugacugggac

SEQ ID NO: 1849094 - RNA, 17 nt, Homo sapiens
uugucuuguucugugau

SEQ ID NO: 1849095 - RNA, 13 nt, Homo sapiens
ccaaugcacacac

SEQ ID NO: 1849096 - RNA, 20 nt, Homo sapiens
cuuguauauauggaucagag

SEQ ID NO: 1849097 - RNA, 22 nt, Homo sapiens
cacagcugccaagucauuugag

SEQ ID NO: 1849098 - RNA, 14 nt, Homo sapiens
gucacaacacugaa

SEQ ID NO: 1849099 - RNA, 21 nt, Homo sapiens
uacucucugccugguggucag

SEQ ID NO: 1849100 - RNA, 19 nt, Homo sapiens
gaacacagcaugugccaag

SEQ ID NO: 1849101 - RNA, 21 nt, Homo sapiens
uaucccgccagggagugugau

SEQ ID NO: 1849102 - RNA, 20 nt, Homo sapiens
aaucaugaacagcucugaga

SEQ ID NO: 1849103 - RNA, 17 nt, Homo sapiens
caaagggaaaaaagagu

SEQ ID NO: 1849104 - RNA, 18 nt, Homo sapiens
gagggugggguaaccaaa

SEQ ID NO: 1849105 - RNA, 22 nt, Homo sapiens
guucaaaaugcagauuccucag

SEQ ID NO: 1849106 - RNA, 22 nt, Homo sapiens
ucccauguaccagcagcuggaa

SEQ ID NO: 1849107 - RNA, 21 nt, Homo sapiens
cuugaacuucaccugcaaagc

SEQ ID NO: 1849108 - RNA, 13 nt, Homo sapiens
agauaaguuauuu

SEQ ID NO: 1849109 - RNA, 19 nt, Homo sapiens
aaugacugccggucauuug

SEQ ID NO: 1849110 - RNA, 16 nt, Homo sapiens
cuugaguugccugaug

SEQ ID NO: 1849111 - RNA, 19 nt, Homo sapiens
cuacgagaccuucacagag

SEQ ID NO: 1849112 - RNA, 22 nt, Homo sapiens
aaaauaucagacaagcacuauu

SEQ ID NO: 1849113 - RNA, 16 nt, Homo sapiens
ugauucaacacuuaag

SEQ ID NO: 1849114 - RNA, 18 nt, Homo sapiens
gcccauccccaggcaccu

SEQ ID NO: 1849115 - RNA, 22 nt, Homo sapiens
agccacaaaugccuugaacugu

SEQ ID NO: 1849116 - RNA, 12 nt, Homo sapiens
caggaccaauaa

SEQ ID NO: 1849117 - RNA, 13 nt, Homo sapiens
uucuaggugcccg

SEQ ID NO: 1849118 - RNA, 19 nt, Homo sapiens
auaacaaugucuucuugaa

SEQ ID NO: 1849119 - RNA, 23 nt, Homo sapiens
uuuccuccccuuugacccuauuc

SEQ ID NO: 1849120 - RNA, 16 nt, Homo sapiens
aauaaagcuucucucu

SEQ ID NO: 1849121 - RNA, 20 nt, Homo sapiens
aauguuuuguaaacauuuau

SEQ ID NO: 1849122 - RNA, 23 nt, Homo sapiens
ucuuuuuucaauguacuguauug

SEQ ID NO: 1849123 - RNA, 16 nt, Homo sapiens
acaccgguucccugaa

SEQ ID NO: 1849124 - RNA, 13 nt, Homo sapiens
uaaguugaaggaa

SEQ ID NO: 1849125 - RNA, 16 nt, Homo sapiens
caggaaacuaacuggu

SEQ ID NO: 1849126 - RNA, 19 nt, Homo sapiens
cugcaaucugagccagugc

SEQ ID NO: 1849127 - RNA, 22 nt, Homo sapiens
acaacauuuacaacucauucca

SEQ ID NO: 1849128 - RNA, 19 nt, Homo sapiens
uacacuggguucugcuacu

SEQ ID NO: 1849129 - RNA, 14 nt, Homo sapiens
ugggcuuccagaaa

SEQ ID NO: 1849130 - RNA, 16 nt, Homo sapiens
uuauugaauucuucac

SEQ ID NO: 1849131 - RNA, 19 nt, Homo sapiens
gugacuaaacuacauuaua

SEQ ID NO: 1849132 - RNA, 15 nt, Homo sapiens
cccugggaagccugu

SEQ ID NO: 1849133 - RNA, 16 nt, Homo sapiens
gccucccacagugacu

SEQ ID NO: 1849134 - RNA, 14 nt, Homo sapiens
uggaaacauucacu

SEQ ID NO: 1849135 - RNA, 17 nt, Homo sapiens
cucuguacgggccaguu

SEQ ID NO: 1849136 - RNA, 23 nt, Homo sapiens
acacacaucuaucuauacauaau

SEQ ID NO: 1849137 - RNA, 12 nt, Homo sapiens
gagcugccagug

SEQ ID NO: 1849138 - RNA, 17 nt, Homo sapiens
ugcuccucugccugugc

SEQ ID NO: 1849139 - RNA, 18 nt, Homo sapiens
uauguaccaagaaucuug

SEQ ID NO: 1849140 - RNA, 21 nt, Homo sapiens
uaaaaugugcuauuugcaaac

SEQ ID NO: 1849141 - RNA, 14 nt, Homo sapiens
acuuuucacacugu

SEQ ID NO: 1849142 - RNA, 18 nt, Homo sapiens
ugucuauuaucacauuaa

SEQ ID NO: 1849143 - RNA, 21 nt, Homo sapiens
cagaauaaugaauggacucaa

SEQ ID NO: 1849144 - RNA, 22 nt, Homo sapiens
ucugaucugcaguuuuugccug

SEQ ID NO: 1849145 - RNA, 22 nt, Homo sapiens
gcaaauccugucggucuccagu

SEQ ID NO: 1849146 - RNA, 18 nt, Homo sapiens
ugaauauuuauucaguga

SEQ ID NO: 1849147 - RNA, 16 nt, Homo sapiens
cagucggaagcuccag

SEQ ID NO: 1849148 - RNA, 21 nt, Homo sapiens
agaaacuuucuggugcugucu

SEQ ID NO: 1849149 - RNA, 20 nt, Homo sapiens
auacauagacugauugauua

SEQ ID NO: 1849150 - RNA, 14 nt, Homo sapiens
gauuugagcacaaa

SEQ ID NO: 1849151 - RNA, 20 nt, Homo sapiens
cuguuuuggggcuuucccag

SEQ ID NO: 1849152 - RNA, 21 nt, Homo sapiens
ggacuauugcaauacauuucu

SEQ ID NO: 1849153 - RNA, 18 nt, Homo sapiens
acaugcugaagccaaagc

SEQ ID NO: 1849154 - RNA, 21 nt, Homo sapiens
accaaaacuauccugauucca

SEQ ID NO: 1849155 - RNA, 14 nt, Homo sapiens
gguguggagugacu

SEQ ID NO: 1849156 - RNA, 19 nt, Homo sapiens
uuuuuauucagcucaugga

SEQ ID NO: 1849157 - RNA, 18 nt, Homo sapiens
ucauuugagauaaaguca

SEQ ID NO: 1849158 - RNA, 13 nt, Homo sapiens
auguuacugacca

SEQ ID NO: 1849159 - RNA, 21 nt, Homo sapiens
ucuagggaaugggacugugag

SEQ ID NO: 1849160 - RNA, 17 nt, Homo sapiens
auucuaguuucucucaa

SEQ ID NO: 1849161 - RNA, 14 nt, Homo sapiens
auuuccgggugauu

SEQ ID NO: 1849162 - RNA, 14 nt, Homo sapiens
gaugacugccuugc

SEQ ID NO: 1849163 - RNA, 22 nt, Homo sapiens
acgcagacuccacacucaguag

SEQ ID NO: 1849164 - RNA, 19 nt, Homo sapiens
cuccuggccucaagugauc

SEQ ID NO: 1849165 - RNA, 17 nt, Homo sapiens
uacugccaucuuuauca

SEQ ID NO: 1849166 - RNA, 14 nt, Homo sapiens
ucacauucuuggcu

SEQ ID NO: 1849167 - RNA, 14 nt, Homo sapiens
caggcccuggugag

SEQ ID NO: 1849168 - RNA, 18 nt, Homo sapiens
uuugcccuuuuuaaggaa

SEQ ID NO: 1849169 - RNA, 20 nt, Homo sapiens
ccugcuguggagggugccca

SEQ ID NO: 1849170 - RNA, 16 nt, Homo sapiens
cucuggaccugaccag

SEQ ID NO: 1849171 - RNA, 12 nt, Homo sapiens
uuugcagaugau

SEQ ID NO: 1849172 - RNA, 12 nt, Homo sapiens
uucuuugcccac

SEQ ID NO: 1849173 - RNA, 18 nt, Homo sapiens
ucugaccgggucugcuuc

SEQ ID NO: 1849174 - RNA, 19 nt, Homo sapiens
uucccucuuuccccaccuc

SEQ ID NO: 1849175 - RNA, 18 nt, Homo sapiens
uuaaaauauuguguaaga

SEQ ID NO: 1849176 - RNA, 13 nt, Homo sapiens
ccacuaugccuga

SEQ ID NO: 1849177 - RNA, 11 nt, Homo sapiens
cuuugaucucg

SEQ ID NO: 1849178 - RNA, 13 nt, Homo sapiens
gccuauuguguau

SEQ ID NO: 1849179 - RNA, 15 nt, Homo sapiens
gguccuucugacccc

SEQ ID NO: 1849180 - RNA, 19 nt, Homo sapiens
aaugagccacaacacccag

SEQ ID NO: 1849181 - RNA, 15 nt, Homo sapiens
augaauuugacuggu

SEQ ID NO: 1849182 - RNA, 14 nt, Homo sapiens
ggagacgcauugua

SEQ ID NO: 1849183 - RNA, 19 nt, Homo sapiens
ucagacagggucugaagga

SEQ ID NO: 1849184 - RNA, 16 nt, Homo sapiens
guuuauauaaggaaua

SEQ ID NO: 1849185 - RNA, 17 nt, Homo sapiens
caucuucacugcaauuu

SEQ ID NO: 1849186 - RNA, 20 nt, Homo sapiens
cucccuggcaggaugcugag

SEQ ID NO: 1849187 - RNA, 19 nt, Homo sapiens
ugcuuacaaagaaagcacu

SEQ ID NO: 1849188 - RNA, 21 nt, Homo sapiens
acagccauuuguaaugaauuu

SEQ ID NO: 1849189 - RNA, 20 nt, Homo sapiens
uuaaggggaacuccauguau

SEQ ID NO: 1849190 - RNA, 12 nt, Homo sapiens
cauucacaucuc

SEQ ID NO: 1849191 - RNA, 22 nt, Homo sapiens
ucuugaaauuugugauggccaa

SEQ ID NO: 1849192 - RNA, 19 nt, Homo sapiens
ucccguggacuacacagcu

SEQ ID NO: 1849193 - RNA, 22 nt, Homo sapiens
ugcccucacuauugaugcauuu

SEQ ID NO: 1849194 - RNA, 19 nt, Homo sapiens
cagccuagucuggacugcu

SEQ ID NO: 1849195 - RNA, 17 nt, Homo sapiens
aaucccaauucuguccc

SEQ ID NO: 1849196 - RNA, 20 nt, Homo sapiens
ggacuggaaggggaagggac

SEQ ID NO: 1849197 - RNA, 22 nt, Homo sapiens
ucaauuucuaguaccugugacu

SEQ ID NO: 1849198 - RNA, 16 nt, Homo sapiens
agucaucugucuuuca

SEQ ID NO: 1849199 - RNA, 21 nt, Homo sapiens
gacuggagaaaugcuuacuuc

SEQ ID NO: 1849200 - RNA, 22 nt, Homo sapiens
gauucauuuuaccuuugacaag

SEQ ID NO: 1849201 - RNA, 23 nt, Homo sapiens
gaaaccaaauuacaaguauucag

SEQ ID NO: 1849202 - RNA, 16 nt, Homo sapiens
agccacugcugguguu

SEQ ID NO: 1849203 - RNA, 15 nt, Homo sapiens
agccaucuacuggau

SEQ ID NO: 1849204 - RNA, 19 nt, Homo sapiens
aucacacguggugaccuca

SEQ ID NO: 1849205 - RNA, 15 nt, Homo sapiens
uccacucagcaguaa

SEQ ID NO: 1849206 - RNA, 21 nt, Homo sapiens
cccugaaacugagucugugga

SEQ ID NO: 1849207 - RNA, 13 nt, Homo sapiens
aguuacucauuca

SEQ ID NO: 1849208 - RNA, 17 nt, Homo sapiens
gcuaucuacuaccagaa

SEQ ID NO: 1849209 - RNA, 14 nt, Homo sapiens
uacaggucaucugc

SEQ ID NO: 1849210 - RNA, 21 nt, Homo sapiens
gagccuucacaaccagccaca

SEQ ID NO: 1849211 - RNA, 22 nt, Homo sapiens
cagauccaggaacacaugcaca

SEQ ID NO: 1849212 - RNA, 16 nt, Homo sapiens
aaguaaucaguaugca

SEQ ID NO: 1849213 - RNA, 16 nt, Homo sapiens
auucauguaacucucc

SEQ ID NO: 1849214 - RNA, 16 nt, Homo sapiens
uaaagccuugugauca

SEQ ID NO: 1849215 - RNA, 13 nt, Homo sapiens
uugucgcaaagac

SEQ ID NO: 1849216 - RNA, 19 nt, Homo sapiens
gaaagguauguuacuguag

SEQ ID NO: 1849217 - RNA, 21 nt, Homo sapiens
agccggggugggguggcugca

SEQ ID NO: 1849218 - RNA, 21 nt, Homo sapiens
agaaagaaguugauuccuuca

SEQ ID NO: 1849219 - RNA, 23 nt, Homo sapiens
uaccuucaugugguucagugccu

SEQ ID NO: 1849220 - RNA, 15 nt, Homo sapiens
caaucuggaagaaag

SEQ ID NO: 1849221 - RNA, 21 nt, Homo sapiens
cagcacaauuaugugugaagc

SEQ ID NO: 1849222 - RNA, 23 nt, Homo sapiens
aaacacucuugaauagacuucca

SEQ ID NO: 1849223 - RNA, 21 nt, Homo sapiens
uggaugcuugaggaauauugc

SEQ ID NO: 1849224 - RNA, 14 nt, Homo sapiens
ccugcauugaacag

SEQ ID NO: 1849225 - RNA, 15 nt, Homo sapiens
agugcuuccacuucu

SEQ ID NO: 1849226 - RNA, 23 nt, Homo sapiens
aguagaaguuacuuaauugccag

SEQ ID NO: 1849227 - RNA, 14 nt, Homo sapiens
cccacgucacuuga

SEQ ID NO: 1849228 - RNA, 20 nt, Homo sapiens
uggcugaugggaaccauuuc

SEQ ID NO: 1849229 - RNA, 20 nt, Homo sapiens
aauaucacaguauuaucugu

SEQ ID NO: 1849230 - RNA, 15 nt, Homo sapiens
aggagaaggggccca

SEQ ID NO: 1849231 - RNA, 13 nt, Homo sapiens
agucaugccaagc

SEQ ID NO: 1849232 - RNA, 13 nt, Homo sapiens
aguuuucccacau

SEQ ID NO: 1849233 - RNA, 20 nt, Homo sapiens
gauacugcaaaggcuugugg

SEQ ID NO: 1849234 - RNA, 17 nt, Homo sapiens
uucaccccugcacuuca

SEQ ID NO: 1849235 - RNA, 15 nt, Homo sapiens
ugauucuaaagggga

SEQ ID NO: 1849236 - RNA, 19 nt, Homo sapiens
uaaauucacaucucaagga

SEQ ID NO: 1849237 - RNA, 17 nt, Homo sapiens
uuuccacauuugucaca

SEQ ID NO: 1849238 - RNA, 14 nt, Homo sapiens
cuacccaugaccug

SEQ ID NO: 1849239 - RNA, 18 nt, Homo sapiens
ucuuugacucugucacac

SEQ ID NO: 1849240 - RNA, 18 nt, Homo sapiens
ucaggaguuugagacuag

SEQ ID NO: 1849241 - RNA, 16 nt, Homo sapiens
acuagaagagauuucu

SEQ ID NO: 1849242 - RNA, 19 nt, Homo sapiens
uaugcauggugccccagga

SEQ ID NO: 1849243 - RNA, 20 nt, Homo sapiens
aaacaagcuucaaagccaua

SEQ ID NO: 1849244 - RNA, 14 nt, Homo sapiens
acuaacaacuggga

SEQ ID NO: 1849245 - RNA, 11 nt, Homo sapiens
cggaaagccuu

SEQ ID NO: 1849246 - RNA, 16 nt, Homo sapiens
acucgccaacauggug

SEQ ID NO: 1849247 - RNA, 13 nt, Homo sapiens
guccuaugcaaua

SEQ ID NO: 1849248 - RNA, 19 nt, Homo sapiens
agcuguugagguaccucca

SEQ ID NO: 1849249 - RNA, 11 nt, Homo sapiens
cccucuugcca

SEQ ID NO: 1849250 - RNA, 13 nt, Homo sapiens
cacuuacagaauu

SEQ ID NO: 1849251 - RNA, 17 nt, Homo sapiens
caaaauauuuaagugaa

SEQ ID NO: 1849252 - RNA, 19 nt, Homo sapiens
aagagagggcugagccaug

SEQ ID NO: 1849253 - RNA, 21 nt, Homo sapiens
uguguccccugaccuguccag

SEQ ID NO: 1849254 - RNA, 16 nt, Homo sapiens
augaacucuuaaucaa

SEQ ID NO: 1849255 - RNA, 17 nt, Homo sapiens
uuuuccccuuucuugua

SEQ ID NO: 1849256 - RNA, 14 nt, Homo sapiens
uaaaggcuguguca

SEQ ID NO: 1849257 - RNA, 15 nt, Homo sapiens
caauaugcuuuacac

SEQ ID NO: 1849258 - RNA, 17 nt, Homo sapiens
uuuaccugagaccaguu

SEQ ID NO: 1849259 - RNA, 15 nt, Homo sapiens
acuugccuguagucu

SEQ ID NO: 1849260 - RNA, 18 nt, Homo sapiens
cuggauauuugcacuuau

SEQ ID NO: 1849261 - RNA, 18 nt, Homo sapiens
ggguggcacucagucucu

SEQ ID NO: 1849262 - RNA, 14 nt, Homo sapiens
ucaagagugcaguu

SEQ ID NO: 1849263 - RNA, 16 nt, Homo sapiens
agacauggaaagggag

SEQ ID NO: 1849264 - RNA, 13 nt, Homo sapiens
aagacagggaaua

SEQ ID NO: 1849265 - RNA, 13 nt, Homo sapiens
agauccaauuccc

SEQ ID NO: 1849266 - RNA, 16 nt, Homo sapiens
agugggagccaaugaa

SEQ ID NO: 1849267 - RNA, 18 nt, Homo sapiens
ugggcagcauagcaagac

SEQ ID NO: 1849268 - RNA, 19 nt, Homo sapiens
ccaccuuggucccucucag

SEQ ID NO: 1849269 - RNA, 16 nt, Homo sapiens
gcucaguugagaaaca

SEQ ID NO: 1849270 - RNA, 23 nt, Homo sapiens
uaacauggugaaaccccgucucu

SEQ ID NO: 1849271 - RNA, 22 nt, Homo sapiens
uuauuucggagcgcaaugccau

SEQ ID NO: 1849272 - RNA, 17 nt, Homo sapiens
ugccuaaaauuguauga

SEQ ID NO: 1849273 - RNA, 12 nt, Homo sapiens
uucuucuauggg

SEQ ID NO: 1849274 - RNA, 20 nt, Homo sapiens
aaaauuauuauauauacaug

SEQ ID NO: 1849275 - RNA, 13 nt, Homo sapiens
aaguacuugucau

SEQ ID NO: 1849276 - RNA, 23 nt, Homo sapiens
guuugucccuccugccaugugua

SEQ ID NO: 1849277 - RNA, 16 nt, Homo sapiens
cugccuaugucuccuc

SEQ ID NO: 1849278 - RNA, 20 nt, Homo sapiens
ccaggggcuucccacuuugg

SEQ ID NO: 1849279 - RNA, 12 nt, Homo sapiens
auuuauugccuc

SEQ ID NO: 1849280 - RNA, 15 nt, Homo sapiens
uuuuggcagccagac

SEQ ID NO: 1849281 - RNA, 14 nt, Homo sapiens
gguuggguuccaga

SEQ ID NO: 1849282 - RNA, 14 nt, Homo sapiens
cgcaccauugcacu

SEQ ID NO: 1849283 - RNA, 15 nt, Homo sapiens
aaauacagcuaugaa

SEQ ID NO: 1849284 - RNA, 16 nt, Homo sapiens
agacaggguuucacca

SEQ ID NO: 1849285 - RNA, 14 nt, Homo sapiens
uuuuaauaugacaa

SEQ ID NO: 1849286 - RNA, 19 nt, Homo sapiens
agguuccuuuugaagcuca

SEQ ID NO: 1849287 - RNA, 13 nt, Homo sapiens
ugccacaaugccu

SEQ ID NO: 1849288 - RNA, 13 nt, Homo sapiens
caguacaacaguu

SEQ ID NO: 1849289 - RNA, 18 nt, Homo sapiens
caguacuuugaauuuuag

SEQ ID NO: 1849290 - RNA, 23 nt, Homo sapiens
agcaagacuucucuuugccucaa

SEQ ID NO: 1849291 - RNA, 15 nt, Homo sapiens
gcccagaauacugau

SEQ ID NO: 1849292 - RNA, 20 nt, Homo sapiens
uggucccggggccagcacuu

SEQ ID NO: 1849293 - RNA, 12 nt, Homo sapiens
gagccucuuagu

SEQ ID NO: 1849294 - RNA, 21 nt, Homo sapiens
ccacauuuccauggugugaga

SEQ ID NO: 1849295 - RNA, 22 nt, Homo sapiens
ugcuacugagucacacaaggga

SEQ ID NO: 1849296 - RNA, 21 nt, Homo sapiens
caccccagaaaucacugugaa

SEQ ID NO: 1849297 - RNA, 22 nt, Homo sapiens
agcgacauuucuccaaguggaa

SEQ ID NO: 1849298 - RNA, 15 nt, Homo sapiens
agugcuugucaugga

SEQ ID NO: 1849299 - RNA, 15 nt, Homo sapiens
gggaagcccauuccu

SEQ ID NO: 1849300 - RNA, 16 nt, Homo sapiens
cuacugcacugaguua

SEQ ID NO: 1849301 - RNA, 14 nt, Homo sapiens
uaggguacuuuuau

SEQ ID NO: 1849302 - RNA, 15 nt, Homo sapiens
aggccugaggaugag

SEQ ID NO: 1849303 - RNA, 23 nt, Homo sapiens
auccugagcagugccagcuuucu

SEQ ID NO: 1849304 - RNA, 19 nt, Homo sapiens
gaaccgaacauaucauuug

SEQ ID NO: 1849305 - RNA, 19 nt, Homo sapiens
augggaagcauguggauga

SEQ ID NO: 1849306 - RNA, 23 nt, Homo sapiens
acuguucucuauuagacuuuaga

SEQ ID NO: 1849307 - RNA, 13 nt, Homo sapiens
cuuguauuccuaa

SEQ ID NO: 1849308 - RNA, 23 nt, Homo sapiens
uuuuuauaaaaaauggugccuga

SEQ ID NO: 1849309 - RNA, 15 nt, Homo sapiens
uacccuaugacuuua

SEQ ID NO: 1849310 - RNA, 23 nt, Homo sapiens
acuucuccaaggagcaugucacu

SEQ ID NO: 1849311 - RNA, 19 nt, Homo sapiens
cgucuugaucagacauuca

SEQ ID NO: 1849312 - RNA, 15 nt, Homo sapiens
acuuagaaaccaaau

SEQ ID NO: 1849313 - RNA, 18 nt, Homo sapiens
aaggacacuagaagauuu

SEQ ID NO: 1849314 - RNA, 16 nt, Homo sapiens
agacaaaagaaacuua

SEQ ID NO: 1849315 - RNA, 17 nt, Homo sapiens
ugaaaaaugugcaaaac

SEQ ID NO: 1849316 - RNA, 12 nt, Homo sapiens
aaggcaaaaaua

SEQ ID NO: 1849317 - RNA, 12 nt, Homo sapiens
aagacaaaaaug

SEQ ID NO: 1849318 - RNA, 16 nt, Homo sapiens
gcagcuguugcaguga

SEQ ID NO: 1849319 - RNA, 20 nt, Homo sapiens
guguaaaaaaaccaccaaaa

SEQ ID NO: 1849320 - RNA, 16 nt, Homo sapiens
aacauuuaaauuccac

SEQ ID NO: 1849321 - RNA, 21 nt, Homo sapiens
gaccacuuuggagacuggggu

SEQ ID NO: 1849322 - RNA, 19 nt, Homo sapiens
gcauaacaaaaagaugacc

SEQ ID NO: 1849323 - RNA, 14 nt, Homo sapiens
accaaugccaaaag

SEQ ID NO: 1849324 - RNA, 17 nt, Homo sapiens
uucauuagccaaauuga

SEQ ID NO: 1849325 - RNA, 14 nt, Homo sapiens
uacccuugugauuu

SEQ ID NO: 1849326 - RNA, 24 nt, Homo sapiens
auuacccuuccucaucugugccug

SEQ ID NO: 1849327 - RNA, 11 nt, Homo sapiens
cucugcucccu

SEQ ID NO: 1849328 - RNA, 23 nt, Homo sapiens
gcaaaacugccgcaagucugcag

SEQ ID NO: 1849329 - RNA, 19 nt, Homo sapiens
agggcaguaucucucugcc

SEQ ID NO: 1849330 - RNA, 14 nt, Homo sapiens
gcagcauuucugaa

SEQ ID NO: 1849331 - RNA, 13 nt, Homo sapiens
caugacggggaca

SEQ ID NO: 1849332 - RNA, 19 nt, Homo sapiens
cugcuuaucagugugcaau

SEQ ID NO: 1849333 - RNA, 19 nt, Homo sapiens
agccaguggggaagugcgu

SEQ ID NO: 1849334 - RNA, 16 nt, Homo sapiens
ucgcucagucuguuca

SEQ ID NO: 1849335 - RNA, 14 nt, Homo sapiens
ccuaucugcaaaau

SEQ ID NO: 1849336 - RNA, 21 nt, Homo sapiens
cccauccaauggauugugcaa

SEQ ID NO: 1849337 - RNA, 18 nt, Homo sapiens
agugaucuguguucaaaa

SEQ ID NO: 1849338 - RNA, 18 nt, Homo sapiens
ucaguccaacaaaccaca

SEQ ID NO: 1849339 - RNA, 22 nt, Homo sapiens
gcuuguucuuccucuuaccugu

SEQ ID NO: 1849340 - RNA, 20 nt, Homo sapiens
acgcacgcucgcugccauca

SEQ ID NO: 1849341 - RNA, 19 nt, Homo sapiens
cugucgcacccacugugaa

SEQ ID NO: 1849342 - RNA, 19 nt, Homo sapiens
cugcagccccggcugacac

SEQ ID NO: 1849343 - RNA, 17 nt, Homo sapiens
gaauaaaguaaugccuc

SEQ ID NO: 1849344 - RNA, 15 nt, Homo sapiens
cagcagccgcugcca

SEQ ID NO: 1849345 - RNA, 14 nt, Homo sapiens
uguuuuccuauaau

SEQ ID NO: 1849346 - RNA, 22 nt, Homo sapiens
uuggcauugcugcauauuugac

SEQ ID NO: 1849347 - RNA, 17 nt, Homo sapiens
ugacaggaaaguggaug

SEQ ID NO: 1849348 - RNA, 18 nt, Homo sapiens
cauggccccaucccaguu

SEQ ID NO: 1849349 - RNA, 17 nt, Homo sapiens
aauauccuccacuuuca

SEQ ID NO: 1849350 - RNA, 18 nt, Homo sapiens
aguuguggugaggccacc

SEQ ID NO: 1849351 - RNA, 20 nt, Homo sapiens
ggaggcagaggcugcauuga

SEQ ID NO: 1849352 - RNA, 12 nt, Homo sapiens
ucaaaauucuca

SEQ ID NO: 1849353 - RNA, 19 nt, Homo sapiens
aaaguaaaagcagcauaaa

SEQ ID NO: 1849354 - RNA, 19 nt, Homo sapiens
ccaguauaugcugauggac

SEQ ID NO: 1849355 - RNA, 20 nt, Homo sapiens
acugcauguuugcuguucca

SEQ ID NO: 1849356 - RNA, 15 nt, Homo sapiens
uaggauguugcucag

SEQ ID NO: 1849357 - RNA, 21 nt, Homo sapiens
uuaaacaagucaauucugugu

SEQ ID NO: 1849358 - RNA, 23 nt, Homo sapiens
cuacaggugcaagccacuauguc

SEQ ID NO: 1849359 - RNA, 23 nt, Homo sapiens
ucccucacagcacuaguauuuca

SEQ ID NO: 1849360 - RNA, 13 nt, Homo sapiens
cugaggaccucag

SEQ ID NO: 1849361 - RNA, 18 nt, Homo sapiens
auuuuacuuccaugauac

SEQ ID NO: 1849362 - RNA, 17 nt, Homo sapiens
ucacugcaaugucaaag

SEQ ID NO: 1849363 - RNA, 22 nt, Homo sapiens
auaauugccuacagagggauuu

SEQ ID NO: 1849364 - RNA, 21 nt, Homo sapiens
cauaccuggcccugugccuug

SEQ ID NO: 1849365 - RNA, 15 nt, Homo sapiens
cacccugugccauca

SEQ ID NO: 1849366 - RNA, 11 nt, Homo sapiens
aaagccuuccu

SEQ ID NO: 1849367 - RNA, 23 nt, Homo sapiens
gucagaagaguugugcacgcaga

SEQ ID NO: 1849368 - RNA, 14 nt, Homo sapiens
ugaagcugaggcug

SEQ ID NO: 1849369 - RNA, 21 nt, Homo sapiens
uaauaaauugcuuacugauau

SEQ ID NO: 1849370 - RNA, 19 nt, Homo sapiens
cauaaaggcauggcauuug

SEQ ID NO: 1849371 - RNA, 22 nt, Homo sapiens
auuucuggacccuccacuucaa

SEQ ID NO: 1849372 - RNA, 14 nt, Homo sapiens
uccaacuuuucauc

SEQ ID NO: 1849373 - RNA, 17 nt, Homo sapiens
ugggacguggacaugcc

SEQ ID NO: 1849374 - RNA, 18 nt, Homo sapiens
caggagacucugggaacu

SEQ ID NO: 1849375 - RNA, 15 nt, Homo sapiens
cccugccccugccuu

SEQ ID NO: 1849376 - RNA, 14 nt, Homo sapiens
uucucuaaauauga

SEQ ID NO: 1849377 - RNA, 22 nt, Homo sapiens
ucuaauuagaucaauuacuuau

SEQ ID NO: 1849378 - RNA, 15 nt, Homo sapiens
ucucuuucacacaau

SEQ ID NO: 1849379 - RNA, 18 nt, Homo sapiens
gguucguuuaccaaauag

SEQ ID NO: 1849380 - RNA, 23 nt, Homo sapiens
cauaaacuaagagaaacugugua

SEQ ID NO: 1849381 - RNA, 18 nt, Homo sapiens
gaaccuguccaacauguu

SEQ ID NO: 1849382 - RNA, 16 nt, Homo sapiens
aaaaagucagagacag

SEQ ID NO: 1849383 - RNA, 22 nt, Homo sapiens
uuaaaaaaaaaggcauauugcu

SEQ ID NO: 1849384 - RNA, 13 nt, Homo sapiens
uuccccugucuuc

SEQ ID NO: 1849385 - RNA, 17 nt, Homo sapiens
ccucugaauuuaauucu

SEQ ID NO: 1849386 - RNA, 17 nt, Homo sapiens
cuuaucuacugacugaa

SEQ ID NO: 1849387 - RNA, 22 nt, Homo sapiens
cuuaagucucagacugauuucu

SEQ ID NO: 1849388 - RNA, 17 nt, Homo sapiens
agacaccauucauucca

SEQ ID NO: 1849389 - RNA, 17 nt, Homo sapiens
auuauagaaguuuagau

SEQ ID NO: 1849390 - RNA, 11 nt, Homo sapiens
gacccaaaaca

SEQ ID NO: 1849391 - RNA, 11 nt, Homo sapiens
aaaccaaagcc

SEQ ID NO: 1849392 - RNA, 13 nt, Homo sapiens
agaagccagcuuu

SEQ ID NO: 1849393 - RNA, 19 nt, Homo sapiens
cuuugcccacacacacucc

SEQ ID NO: 1849394 - RNA, 20 nt, Homo sapiens
uguuugcugaagugaaaaaa

SEQ ID NO: 1849395 - RNA, 18 nt, Homo sapiens
acccagguggagggcaca

SEQ ID NO: 1849396 - RNA, 16 nt, Homo sapiens
aaagaccccucccacu

SEQ ID NO: 1849397 - RNA, 23 nt, Homo sapiens
gcaggcuggcagcucuccaguca

SEQ ID NO: 1849398 - RNA, 16 nt, Homo sapiens
aaugacaggacauuug

SEQ ID NO: 1849399 - RNA, 13 nt, Homo sapiens
ucaucucagugcu

SEQ ID NO: 1849400 - RNA, 18 nt, Homo sapiens
caccugacacaccaggcg

SEQ ID NO: 1849401 - RNA, 19 nt, Homo sapiens
ucuaugguacuaaggaagu

SEQ ID NO: 1849402 - RNA, 16 nt, Homo sapiens
acuauggagaaacuuu

SEQ ID NO: 1849403 - RNA, 23 nt, Homo sapiens
auuucuuugccuguucaguuaca

SEQ ID NO: 1849404 - RNA, 14 nt, Homo sapiens
aaaagcguauuuaa

SEQ ID NO: 1849405 - RNA, 22 nt, Homo sapiens
uuaugaagcaagccccacuuau

SEQ ID NO: 1849406 - RNA, 16 nt, Homo sapiens
cccagggcacugaggg

SEQ ID NO: 1849407 - RNA, 14 nt, Homo sapiens
ucucagaacuccug

SEQ ID NO: 1849408 - RNA, 14 nt, Homo sapiens
acaacauuugcaga

SEQ ID NO: 1849409 - RNA, 22 nt, Homo sapiens
cuucucuauugggcacagccua

SEQ ID NO: 1849410 - RNA, 20 nt, Homo sapiens
ucuggucacauggcugucga

SEQ ID NO: 1849411 - RNA, 15 nt, Homo sapiens
ugaugguaggcugua

SEQ ID NO: 1849412 - RNA, 17 nt, Homo sapiens
uacaauuaaaaugacaa

SEQ ID NO: 1849413 - RNA, 21 nt, Homo sapiens
acagccguccucccuccuagg

SEQ ID NO: 1849414 - RNA, 17 nt, Homo sapiens
aaaaaugaaauuagucu

SEQ ID NO: 1849415 - RNA, 21 nt, Homo sapiens
cacugcaguagugcaccaucu

SEQ ID NO: 1849416 - RNA, 19 nt, Homo sapiens
agaagguucacccagcacc

SEQ ID NO: 1849417 - RNA, 19 nt, Homo sapiens
cagaaaucuagaagacugu

SEQ ID NO: 1849418 - RNA, 19 nt, Homo sapiens
augugucauuggaagccau

SEQ ID NO: 1849419 - RNA, 20 nt, Homo sapiens
aagcuuuuuuugaaucauca

SEQ ID NO: 1849420 - RNA, 19 nt, Homo sapiens
uauuaccuggucauuucaa

SEQ ID NO: 1849421 - RNA, 18 nt, Homo sapiens
ccauccccucacuauucc

SEQ ID NO: 1849422 - RNA, 13 nt, Homo sapiens
aaagugccaaaga

SEQ ID NO: 1849423 - RNA, 21 nt, Homo sapiens
cuggcaacaacagauucucuu

SEQ ID NO: 1849424 - RNA, 23 nt, Homo sapiens
augacuguacauuuuagugauuu

SEQ ID NO: 1849425 - RNA, 15 nt, Homo sapiens
agcagaaacuuuaca

SEQ ID NO: 1849426 - RNA, 13 nt, Homo sapiens
aauuggcucuagu

SEQ ID NO: 1849427 - RNA, 24 nt, Homo sapiens
uucuccaagcaggacauggacaag

SEQ ID NO: 1849428 - RNA, 17 nt, Homo sapiens
ucaggccaacaagccaa

SEQ ID NO: 1849429 - RNA, 17 nt, Homo sapiens
cuggacaccuagcuuua

SEQ ID NO: 1849430 - RNA, 12 nt, Homo sapiens
aucaaacuucca

SEQ ID NO: 1849431 - RNA, 18 nt, Homo sapiens
cgccauucuccugccuca

SEQ ID NO: 1849432 - RNA, 21 nt, Homo sapiens
auaaagucuauggacagggcu

SEQ ID NO: 1849433 - RNA, 18 nt, Homo sapiens
acuagaggcuugcauaau

SEQ ID NO: 1849434 - RNA, 14 nt, Homo sapiens
aggcaaaguggaau

SEQ ID NO: 1849435 - RNA, 16 nt, Homo sapiens
gcagaucauuucccaa

SEQ ID NO: 1849436 - RNA, 23 nt, Homo sapiens
acuuuguaccccccaaccccuga

SEQ ID NO: 1849437 - RNA, 23 nt, Homo sapiens
cauucuggacaccaggggaccug

SEQ ID NO: 1849438 - RNA, 17 nt, Homo sapiens
gcuuaugaaaccccaau

SEQ ID NO: 1849439 - RNA, 16 nt, Homo sapiens
gccucacuucuuccau

SEQ ID NO: 1849440 - RNA, 13 nt, Homo sapiens
ucgccaugugcug

SEQ ID NO: 1849441 - RNA, 16 nt, Homo sapiens
gagaagcuuugcccuc

SEQ ID NO: 1849442 - RNA, 16 nt, Homo sapiens
ugcauaauuauauacu

SEQ ID NO: 1849443 - RNA, 18 nt, Homo sapiens
acacuuaaauucucuaac

SEQ ID NO: 1849444 - RNA, 18 nt, Homo sapiens
caaacuuuagcaacaguu

SEQ ID NO: 1849445 - RNA, 21 nt, Homo sapiens
ucuucccucauuaaauugcuu

SEQ ID NO: 1849446 - RNA, 17 nt, Homo sapiens
ucacaugguuacauauc

SEQ ID NO: 1849447 - RNA, 15 nt, Homo sapiens
caugcauuguuggcu

SEQ ID NO: 1849448 - RNA, 15 nt, Homo sapiens
aucauuuuauucaca

SEQ ID NO: 1849449 - RNA, 17 nt, Homo sapiens
uauaucgcuuaaucuua

SEQ ID NO: 1849450 - RNA, 17 nt, Homo sapiens
auuuuuuuaaauuugca

SEQ ID NO: 1849451 - RNA, 21 nt, Homo sapiens
aaccuggcagguuagaaccua

SEQ ID NO: 1849452 - RNA, 20 nt, Homo sapiens
uuucuugccuuaaccagucu

SEQ ID NO: 1849453 - RNA, 15 nt, Homo sapiens
aguguucccgugccu

SEQ ID NO: 1849454 - RNA, 13 nt, Homo sapiens
ggcuuugcaggga

SEQ ID NO: 1849455 - RNA, 15 nt, Homo sapiens
acuugcaucacuuaa

SEQ ID NO: 1849456 - RNA, 24 nt, Homo sapiens
auuuaguugugcagucagugucaa

SEQ ID NO: 1849457 - RNA, 11 nt, Homo sapiens
cuugcacuguc

SEQ ID NO: 1849458 - RNA, 14 nt, Homo sapiens
gaguuuagugugau

SEQ ID NO: 1849459 - RNA, 15 nt, Homo sapiens
ucuuuuauaugcuaa

SEQ ID NO: 1849460 - RNA, 22 nt, Homo sapiens
gaauauguuaaugcaaagcuaa

SEQ ID NO: 1849461 - RNA, 16 nt, Homo sapiens
gaaaaugggacauuag

SEQ ID NO: 1849462 - RNA, 20 nt, Homo sapiens
gacauuagauugaugugcac

SEQ ID NO: 1849463 - RNA, 17 nt, Homo sapiens
uuucuucuagugcuuuu

SEQ ID NO: 1849464 - RNA, 22 nt, Homo sapiens
aaaggccugucccugcagacau

SEQ ID NO: 1849465 - RNA, 22 nt, Homo sapiens
auuaaaccugucuccacugugc

SEQ ID NO: 1849466 - RNA, 20 nt, Homo sapiens
ccugacacgugauggaccaa

SEQ ID NO: 1849467 - RNA, 15 nt, Homo sapiens
gauuuaacacuaucc

SEQ ID NO: 1849468 - RNA, 15 nt, Homo sapiens
gauuugccaaaguga

SEQ ID NO: 1849469 - RNA, 17 nt, Homo sapiens
cagccaggcccugagau

SEQ ID NO: 1849470 - RNA, 17 nt, Homo sapiens
cuguccccuucucucau

SEQ ID NO: 1849471 - RNA, 23 nt, Homo sapiens
aucaccccuuccuccuuccucuu

SEQ ID NO: 1849472 - RNA, 12 nt, Homo sapiens
gaacccucaggc

SEQ ID NO: 1849473 - RNA, 13 nt, Homo sapiens
uucuuguauucau

SEQ ID NO: 1849474 - RNA, 18 nt, Homo sapiens
aacugauguauagcuuua

SEQ ID NO: 1849475 - RNA, 22 nt, Homo sapiens
ccagcaccaagggcgggcagca

SEQ ID NO: 1849476 - RNA, 19 nt, Homo sapiens
aagcgauuaugaaagcaac

SEQ ID NO: 1849477 - RNA, 19 nt, Homo sapiens
guggagucauucucauuga

SEQ ID NO: 1849478 - RNA, 13 nt, Homo sapiens
aacgccuggcuaa

SEQ ID NO: 1849479 - RNA, 21 nt, Homo sapiens
uggaaauuccuguacuguguc

SEQ ID NO: 1849480 - RNA, 15 nt, Homo sapiens
aauucucucuuguca

SEQ ID NO: 1849481 - RNA, 16 nt, Homo sapiens
aggaauauacauaguc

SEQ ID NO: 1849482 - RNA, 19 nt, Homo sapiens
aaagcaucaucuguucgau

SEQ ID NO: 1849483 - RNA, 19 nt, Homo sapiens
gaauguaaaaugcaaaauc

SEQ ID NO: 1849484 - RNA, 15 nt, Homo sapiens
uugcauggcauuaau

SEQ ID NO: 1849485 - RNA, 15 nt, Homo sapiens
ccccagacccagaga

SEQ ID NO: 1849486 - RNA, 16 nt, Homo sapiens
acaaaaauuacaaaga

SEQ ID NO: 1849487 - RNA, 12 nt, Homo sapiens
ucuauacugugg

SEQ ID NO: 1849488 - RNA, 14 nt, Homo sapiens
cuuugcugcuguga

SEQ ID NO: 1849489 - RNA, 23 nt, Homo sapiens
aaaaauuaccuguauaauggaga

SEQ ID NO: 1849490 - RNA, 22 nt, Homo sapiens
gccaugauggccuuacacugaa

SEQ ID NO: 1849491 - RNA, 16 nt, Homo sapiens
ggcagcucagcuguuu

SEQ ID NO: 1849492 - RNA, 21 nt, Homo sapiens
aaugaacuucagaagugccau

SEQ ID NO: 1849493 - RNA, 18 nt, Homo sapiens
uucuguccuaaucauaca

SEQ ID NO: 1849494 - RNA, 17 nt, Homo sapiens
acuuuccucuuccugcc

SEQ ID NO: 1849495 - RNA, 19 nt, Homo sapiens
agggcucccuauguugccc

SEQ ID NO: 1849496 - RNA, 20 nt, Homo sapiens
gacaucgcuggaaaugaaua

SEQ ID NO: 1849497 - RNA, 22 nt, Homo sapiens
accccuugcucucaacccagga

SEQ ID NO: 1849498 - RNA, 23 nt, Homo sapiens
uguauauuuguuuuaugcuacug

SEQ ID NO: 1849499 - RNA, 20 nt, Homo sapiens
auuguucacuucuaaaccaa

SEQ ID NO: 1849500 - RNA, 19 nt, Homo sapiens
agggugagacuccaucuca

SEQ ID NO: 1849501 - RNA, 13 nt, Homo sapiens
ugcacacaccaga

SEQ ID NO: 1849502 - RNA, 15 nt, Homo sapiens
uggagggcauuugcu

SEQ ID NO: 1849503 - RNA, 17 nt, Homo sapiens
gcuguggccaucaaccu

SEQ ID NO: 1849504 - RNA, 18 nt, Homo sapiens
uuguaaacauuaguucua

SEQ ID NO: 1849505 - RNA, 17 nt, Homo sapiens
cuucucaaguucuaaga

SEQ ID NO: 1849506 - RNA, 21 nt, Homo sapiens
cagaguuucacucuuguugcc

SEQ ID NO: 1849507 - RNA, 17 nt, Homo sapiens
cuggguuucucuguaua

SEQ ID NO: 1849508 - RNA, 20 nt, Homo sapiens
uuuaaaaaaaaaaguuacag

SEQ ID NO: 1849509 - RNA, 20 nt, Homo sapiens
caguuugcuuuguaugcacu

SEQ ID NO: 1849510 - RNA, 22 nt, Homo sapiens
gaaggaacagcaauggugucag

SEQ ID NO: 1849511 - RNA, 16 nt, Homo sapiens
gauagauuugaccucc

SEQ ID NO: 1849512 - RNA, 13 nt, Homo sapiens
aagaaauauuccu

SEQ ID NO: 1849513 - RNA, 12 nt, Homo sapiens
uucagaauggaa

SEQ ID NO: 1849514 - RNA, 23 nt, Homo sapiens
uuugccuacguuggugcaagugu

SEQ ID NO: 1849515 - RNA, 17 nt, Homo sapiens
ccccacucagugccucc

SEQ ID NO: 1849516 - RNA, 16 nt, Homo sapiens
uucucggcucagguuu

SEQ ID NO: 1849517 - RNA, 18 nt, Homo sapiens
agcacugcuccagugggg

SEQ ID NO: 1849518 - RNA, 19 nt, Homo sapiens
uuguuugggccacugccag

SEQ ID NO: 1849519 - RNA, 23 nt, Homo sapiens
accugcccugggccacacugacc

SEQ ID NO: 1849520 - RNA, 18 nt, Homo sapiens
acuuuuaaaaugaagcuu

SEQ ID NO: 1849521 - RNA, 19 nt, Homo sapiens
uggcuugccucuugcaauu

SEQ ID NO: 1849522 - RNA, 15 nt, Homo sapiens
ccaacaaaccacaca

SEQ ID NO: 1849523 - RNA, 21 nt, Homo sapiens
cagggacauggggcaagccag

SEQ ID NO: 1849524 - RNA, 16 nt, Homo sapiens
caaauuggauacugcu

SEQ ID NO: 1849525 - RNA, 18 nt, Homo sapiens
guuucaaagggauugcuu

SEQ ID NO: 1849526 - RNA, 12 nt, Homo sapiens
aucagcacucug

SEQ ID NO: 1849527 - RNA, 14 nt, Homo sapiens
cgugaccagugcug

SEQ ID NO: 1849528 - RNA, 19 nt, Homo sapiens
accaagcugugcccugacc

SEQ ID NO: 1849529 - RNA, 14 nt, Homo sapiens
uaguuuuucacuuu

SEQ ID NO: 1849530 - RNA, 21 nt, Homo sapiens
uuaucaugcauguccuguaaa

SEQ ID NO: 1849531 - RNA, 22 nt, Homo sapiens
gagacccaccuucaagcagcug

SEQ ID NO: 1849532 - RNA, 17 nt, Homo sapiens
ccuuucucaacuguccc

SEQ ID NO: 1849533 - RNA, 14 nt, Homo sapiens
ugauaucuaauaau

SEQ ID NO: 1849534 - RNA, 20 nt, Homo sapiens
gacugaagugaacuaugaag

SEQ ID NO: 1849535 - RNA, 12 nt, Homo sapiens
ccucuuuuccaa

SEQ ID NO: 1849536 - RNA, 9 nt, Homo sapiens
gugcauuca

SEQ ID NO: 1849537 - RNA, 20 nt, Homo sapiens
gaauucagcaccagugaaag

SEQ ID NO: 1849538 - RNA, 20 nt, Homo sapiens
ccaguucauuuucaguuauu

SEQ ID NO: 1849539 - RNA, 22 nt, Homo sapiens
agaucacuucaggucaggaguu

SEQ ID NO: 1849540 - RNA, 20 nt, Homo sapiens
auuaaaaagaauucuuccac

SEQ ID NO: 1849541 - RNA, 15 nt, Homo sapiens
uacacuaacauuucc

SEQ ID NO: 1849542 - RNA, 14 nt, Homo sapiens
aucagaguggccaa

SEQ ID NO: 1849543 - RNA, 22 nt, Homo sapiens
uccuagcgcagccaugugauua

SEQ ID NO: 1849544 - RNA, 22 nt, Homo sapiens
cugccaccacugggcaaacaga

SEQ ID NO: 1849545 - RNA, 23 nt, Homo sapiens
aaccugaugcagugcuccaucca

SEQ ID NO: 1849546 - RNA, 22 nt, Homo sapiens
aguccaggagccccagccagcc

SEQ ID NO: 1849547 - RNA, 22 nt, Homo sapiens
aaaugcucaaucaugugccaga

SEQ ID NO: 1849548 - RNA, 16 nt, Homo sapiens
caaaccuuacucugag

SEQ ID NO: 1849549 - RNA, 15 nt, Homo sapiens
agagcaagacuccau

SEQ ID NO: 1849550 - RNA, 19 nt, Homo sapiens
augcugauauuuacuggaa

SEQ ID NO: 1849551 - RNA, 16 nt, Homo sapiens
uuguggaugucuuccu

SEQ ID NO: 1849552 - RNA, 18 nt, Homo sapiens
auaagacucacaguauaa

SEQ ID NO: 1849553 - RNA, 13 nt, Homo sapiens
gucccacagggag

SEQ ID NO: 1849554 - RNA, 17 nt, Homo sapiens
aagugcauuaaacugaa

SEQ ID NO: 1849555 - RNA, 12 nt, Homo sapiens
auuuagaauuaa

SEQ ID NO: 1849556 - RNA, 13 nt, Homo sapiens
uugcaugaggcua

SEQ ID NO: 1849557 - RNA, 19 nt, Homo sapiens
aagcaaauauguuugcauu

SEQ ID NO: 1849558 - RNA, 22 nt, Homo sapiens
caaauaaguauuuauaauagca

SEQ ID NO: 1849559 - RNA, 14 nt, Homo sapiens
ucucacaugcacag

SEQ ID NO: 1849560 - RNA, 21 nt, Homo sapiens
uucacaaggucuuuaaaguga

SEQ ID NO: 1849561 - RNA, 16 nt, Homo sapiens
uucauuugcuguucau

SEQ ID NO: 1849562 - RNA, 15 nt, Homo sapiens
uguucccgugccugg

SEQ ID NO: 1849563 - RNA, 18 nt, Homo sapiens
aagucauuuuuuacuuga

SEQ ID NO: 1849564 - RNA, 16 nt, Homo sapiens
uugauucaucucuggu

SEQ ID NO: 1849565 - RNA, 14 nt, Homo sapiens
aaacuaagaaucau

SEQ ID NO: 1849566 - RNA, 22 nt, Homo sapiens
agauuucuuaaugucugucaga

SEQ ID NO: 1849567 - RNA, 15 nt, Homo sapiens
guaugagucaaugug

SEQ ID NO: 1849568 - RNA, 15 nt, Homo sapiens
cagugaaugugugua

SEQ ID NO: 1849569 - RNA, 15 nt, Homo sapiens
cugccucugagccac

SEQ ID NO: 1849570 - RNA, 13 nt, Homo sapiens
auggaaacacuga

SEQ ID NO: 1849571 - RNA, 13 nt, Homo sapiens
augggaacacugg

SEQ ID NO: 1849572 - RNA, 22 nt, Homo sapiens
uuuuggaucuaucaccugucau

SEQ ID NO: 1849573 - RNA, 22 nt, Homo sapiens
gucaauacugccuuaaugagaa

SEQ ID NO: 1849574 - RNA, 18 nt, Homo sapiens
accuuguuuugccaguga

SEQ ID NO: 1849575 - RNA, 23 nt, Homo sapiens
aaacccaguuuucccucugggag

SEQ ID NO: 1849576 - RNA, 22 nt, Homo sapiens
gcucccucuauuuauguuugca

SEQ ID NO: 1849577 - RNA, 13 nt, Homo sapiens
cguguacugcaaa

SEQ ID NO: 1849578 - RNA, 16 nt, Homo sapiens
aaauaugcaaccugug

SEQ ID NO: 1849579 - RNA, 19 nt, Homo sapiens
auuuauaaacuagaucucc

SEQ ID NO: 1849580 - RNA, 16 nt, Homo sapiens
acaaaggcaguucagu

SEQ ID NO: 1849581 - RNA, 15 nt, Homo sapiens
aauguugauggugcu

SEQ ID NO: 1849582 - RNA, 15 nt, Homo sapiens
gccaguuacauaaaa

SEQ ID NO: 1849583 - RNA, 16 nt, Homo sapiens
gauggaaacucuuuaa

SEQ ID NO: 1849584 - RNA, 13 nt, Homo sapiens
gccaaggacaggg

SEQ ID NO: 1849585 - RNA, 21 nt, Homo sapiens
uuugaggcaaauuaacuguau

SEQ ID NO: 1849586 - RNA, 20 nt, Homo sapiens
uggcaucgaccacaccagcc

SEQ ID NO: 1849587 - RNA, 15 nt, Homo sapiens
gguccuggcuccuga

SEQ ID NO: 1849588 - RNA, 16 nt, Homo sapiens
caggcagcugcaguua

SEQ ID NO: 1849589 - RNA, 21 nt, Homo sapiens
cugaagucuuuguacagacaa

SEQ ID NO: 1849590 - RNA, 23 nt, Homo sapiens
agcccuguggaugagcccucaga

SEQ ID NO: 1849591 - RNA, 16 nt, Homo sapiens
ugaagcgaaacacaga

SEQ ID NO: 1849592 - RNA, 14 nt, Homo sapiens
uguucguucugaua

SEQ ID NO: 1849593 - RNA, 13 nt, Homo sapiens
agcucaauggagc

SEQ ID NO: 1849594 - RNA, 13 nt, Homo sapiens
aaaguaaugacuu

SEQ ID NO: 1849595 - RNA, 13 nt, Homo sapiens
augaguuaccuca

SEQ ID NO: 1849596 - RNA, 21 nt, Homo sapiens
cuguuaggaacagcaguguuc

SEQ ID NO: 1849597 - RNA, 16 nt, Homo sapiens
cacaugguuuccaagg

SEQ ID NO: 1849598 - RNA, 23 nt, Homo sapiens
cauauguaguauaauuucuagaa

SEQ ID NO: 1849599 - RNA, 15 nt, Homo sapiens
aggaacuucuagcuc

SEQ ID NO: 1849600 - RNA, 22 nt, Homo sapiens
ggacuucuccuccaguggaccu

SEQ ID NO: 1849601 - RNA, 14 nt, Homo sapiens
agcugucuugucau

SEQ ID NO: 1849602 - RNA, 21 nt, Homo sapiens
uacagaagauuaagacagaga

SEQ ID NO: 1849603 - RNA, 21 nt, Homo sapiens
gcacuuuccaaugccacagac

SEQ ID NO: 1849604 - RNA, 15 nt, Homo sapiens
gggccacaccaccua

SEQ ID NO: 1849605 - RNA, 22 nt, Homo sapiens
gcccugaggaauaaagcuucuc

SEQ ID NO: 1849606 - RNA, 11 nt, Homo sapiens
ccuaacacauu

SEQ ID NO: 1849607 - RNA, 12 nt, Homo sapiens
aacccugucuga

SEQ ID NO: 1849608 - RNA, 11 nt, Homo sapiens
gcuaugaauga

SEQ ID NO: 1849609 - RNA, 15 nt, Homo sapiens
cuuagauacuaauaa

SEQ ID NO: 1849610 - RNA, 18 nt, Homo sapiens
ucucugaccucugcugag

SEQ ID NO: 1849611 - RNA, 21 nt, Homo sapiens
uuccuuauuaauacaaacaca

SEQ ID NO: 1849612 - RNA, 18 nt, Homo sapiens
gucuguugcugcuccaug

SEQ ID NO: 1849613 - RNA, 22 nt, Homo sapiens
uccugaaaaaugcucaaucuca

SEQ ID NO: 1849614 - RNA, 16 nt, Homo sapiens
ggcagccacccaagcc

SEQ ID NO: 1849615 - RNA, 15 nt, Homo sapiens
uuaagaaaaaagugu

SEQ ID NO: 1849616 - RNA, 13 nt, Homo sapiens
ggcgcugacucug

SEQ ID NO: 1849617 - RNA, 16 nt, Homo sapiens
gacccagggccugacu

SEQ ID NO: 1849618 - RNA, 15 nt, Homo sapiens
aaaauuugcugccaa

SEQ ID NO: 1849619 - RNA, 15 nt, Homo sapiens
ugagaaacaguucca

SEQ ID NO: 1849620 - RNA, 15 nt, Homo sapiens
agccuauuuauuuga

SEQ ID NO: 1849621 - RNA, 15 nt, Homo sapiens
ugucuguuaacuuaa

SEQ ID NO: 1849622 - RNA, 18 nt, Homo sapiens
aagcaccccagucacuag

SEQ ID NO: 1849623 - RNA, 22 nt, Homo sapiens
ccacauuaggucaccugugcac

SEQ ID NO: 1849624 - RNA, 18 nt, Homo sapiens
aagaaaucucuaugcaaa

SEQ ID NO: 1849625 - RNA, 14 nt, Homo sapiens
cugucccacccaca

SEQ ID NO: 1849626 - RNA, 14 nt, Homo sapiens
aucuaccaacgaaa

SEQ ID NO: 1849627 - RNA, 17 nt, Homo sapiens
ggcucucauggggucca

SEQ ID NO: 1849628 - RNA, 15 nt, Homo sapiens
ccauuuuaaaaacca

SEQ ID NO: 1849629 - RNA, 22 nt, Homo sapiens
caggaagguagcccagcacugu

SEQ ID NO: 1849630 - RNA, 14 nt, Homo sapiens
gacugaugucaucu

SEQ ID NO: 1849631 - RNA, 16 nt, Homo sapiens
ucugggcacugggaau

SEQ ID NO: 1849632 - RNA, 18 nt, Homo sapiens
ucccaggggcagccacac

SEQ ID NO: 1849633 - RNA, 21 nt, Homo sapiens
cuggaagggcagaguagccag

SEQ ID NO: 1849634 - RNA, 22 nt, Homo sapiens
caugccuguaaucucagcacuu

SEQ ID NO: 1849635 - RNA, 17 nt, Homo sapiens
ucauaggcugacaccaa

SEQ ID NO: 1849636 - RNA, 18 nt, Homo sapiens
acaguuuauugauuucaa

SEQ ID NO: 1849637 - RNA, 17 nt, Homo sapiens
agagaaagaguuugaaa

SEQ ID NO: 1849638 - RNA, 12 nt, Homo sapiens
cauagucccugc

SEQ ID NO: 1849639 - RNA, 22 nt, Homo sapiens
gcaauccaugaucuauacacau

SEQ ID NO: 1849640 - RNA, 13 nt, Homo sapiens
gaauuacauaaca

SEQ ID NO: 1849641 - RNA, 21 nt, Homo sapiens
aaacaccacuaauuguguaca

SEQ ID NO: 1849642 - RNA, 19 nt, Homo sapiens
aucucagguggcauuugca

SEQ ID NO: 1849643 - RNA, 17 nt, Homo sapiens
uugcccagacuacaggg

SEQ ID NO: 1849644 - RNA, 18 nt, Homo sapiens
ggaauauaauauugucuc

SEQ ID NO: 1849645 - RNA, 18 nt, Homo sapiens
uaaccucaaggaaccaua

SEQ ID NO: 1849646 - RNA, 18 nt, Homo sapiens
ggacucagccuugcaaau

SEQ ID NO: 1849647 - RNA, 16 nt, Homo sapiens
cucauucaaucuccag

SEQ ID NO: 1849648 - RNA, 13 nt, Homo sapiens
uuucuauccaaau

SEQ ID NO: 1849649 - RNA, 13 nt, Homo sapiens
uuuccauccaaac

SEQ ID NO: 1849650 - RNA, 13 nt, Homo sapiens
aaugacaaugaag

SEQ ID NO: 1849651 - RNA, 23 nt, Homo sapiens
acuaagauuuccuuuggcaauau

SEQ ID NO: 1849652 - RNA, 15 nt, Homo sapiens
cagaaaacauugacu

SEQ ID NO: 1849653 - RNA, 15 nt, Homo sapiens
augaucaccauguau

SEQ ID NO: 1849654 - RNA, 15 nt, Homo sapiens
aagaucaccuuguau

SEQ ID NO: 1849655 - RNA, 18 nt, Homo sapiens
aaacaaaauccaagauuc

SEQ ID NO: 1849656 - RNA, 17 nt, Homo sapiens
uguccaugugaucucau

SEQ ID NO: 1849657 - RNA, 20 nt, Homo sapiens
cuuggcuuuaugcaaauaca

SEQ ID NO: 1849658 - RNA, 12 nt, Homo sapiens
gcuccugcaaaa

SEQ ID NO: 1849659 - RNA, 14 nt, Homo sapiens
ugaaagaccuucuc

SEQ ID NO: 1849660 - RNA, 17 nt, Homo sapiens
ccuccccacaguccuca

SEQ ID NO: 1849661 - RNA, 20 nt, Homo sapiens
agcaggcuccuggcugugcc

SEQ ID NO: 1849662 - RNA, 16 nt, Homo sapiens
ucuaacuggacaugaa

SEQ ID NO: 1849663 - RNA, 18 nt, Homo sapiens
ucccugaagagaagggca

SEQ ID NO: 1849664 - RNA, 17 nt, Homo sapiens
cccaccaaccccuccaa

SEQ ID NO: 1849665 - RNA, 19 nt, Homo sapiens
ugaaacuugcaacuuugag

SEQ ID NO: 1849666 - RNA, 23 nt, Homo sapiens
aucugucauaagcauuacuuuau

SEQ ID NO: 1849667 - RNA, 14 nt, Homo sapiens
cagaaacucuggaa

SEQ ID NO: 1849668 - RNA, 14 nt, Homo sapiens
aaaggacuauaaga

SEQ ID NO: 1849669 - RNA, 20 nt, Homo sapiens
cacagcuggagaaauggcau

SEQ ID NO: 1849670 - RNA, 21 nt, Homo sapiens
gcauccuggcuggcugugucc

SEQ ID NO: 1849671 - RNA, 21 nt, Homo sapiens
cugagaacauaaaaucuuggc

SEQ ID NO: 1849672 - RNA, 14 nt, Homo sapiens
ccucgcaugacugu

SEQ ID NO: 1849673 - RNA, 14 nt, Homo sapiens
aguauucuaagcca

SEQ ID NO: 1849674 - RNA, 21 nt, Homo sapiens
ucacacuguauauaaacauau

SEQ ID NO: 1849675 - RNA, 22 nt, Homo sapiens
caaaucguccagcgaccuuccu

SEQ ID NO: 1849676 - RNA, 19 nt, Homo sapiens
auguaucuauuuguacaau

SEQ ID NO: 1849677 - RNA, 19 nt, Homo sapiens
gcuggagugcaauggcaca

SEQ ID NO: 1849678 - RNA, 15 nt, Homo sapiens
ucguaaauauucccu

SEQ ID NO: 1849679 - RNA, 19 nt, Homo sapiens
gauuuccgugaaaaugcaa

SEQ ID NO: 1849680 - RNA, 18 nt, Homo sapiens
uucucuccuccacucuga

SEQ ID NO: 1849681 - RNA, 23 nt, Homo sapiens
uauguaugcaucuauauguguau

SEQ ID NO: 1849682 - RNA, 16 nt, Homo sapiens
uguggagagugagaau

SEQ ID NO: 1849683 - RNA, 16 nt, Homo sapiens
auuugucaaugcauca

SEQ ID NO: 1849684 - RNA, 20 nt, Homo sapiens
gcuuuggugagaaccugggu

SEQ ID NO: 1849685 - RNA, 17 nt, Homo sapiens
acaccaacgaggugauc

SEQ ID NO: 1849686 - RNA, 14 nt, Homo sapiens
gcuuucaggacuug

SEQ ID NO: 1849687 - RNA, 22 nt, Homo sapiens
cucucuuuuuggaggugcuuaa

SEQ ID NO: 1849688 - RNA, 16 nt, Homo sapiens
ccugauuaacugaggc

SEQ ID NO: 1849689 - RNA, 15 nt, Homo sapiens
auccaaaccuuucaa

SEQ ID NO: 1849690 - RNA, 14 nt, Homo sapiens
auuaaaaagccuua

SEQ ID NO: 1849691 - RNA, 17 nt, Homo sapiens
aggcuugucagcacuuc

SEQ ID NO: 1849692 - RNA, 20 nt, Homo sapiens
gaugcuugauauaauaauua

SEQ ID NO: 1849693 - RNA, 21 nt, Homo sapiens
ccgaagggcccccacauuugu

SEQ ID NO: 1849694 - RNA, 19 nt, Homo sapiens
cuccccagagcauuugaua

SEQ ID NO: 1849695 - RNA, 22 nt, Homo sapiens
agccagucuuuacagcugagca

SEQ ID NO: 1849696 - RNA, 13 nt, Homo sapiens
ugaagcacugagc

SEQ ID NO: 1849697 - RNA, 17 nt, Homo sapiens
uauaccugggcauacua

SEQ ID NO: 1849698 - RNA, 16 nt, Homo sapiens
caugguucaaguauua

SEQ ID NO: 1849699 - RNA, 16 nt, Homo sapiens
uugcugguagcacuug

SEQ ID NO: 1849700 - RNA, 12 nt, Homo sapiens
ugcagacuuccc

SEQ ID NO: 1849701 - RNA, 21 nt, Homo sapiens
uagauccaauucccaccacua

SEQ ID NO: 1849702 - RNA, 17 nt, Homo sapiens
uagaacuucucuaagcc

SEQ ID NO: 1849703 - RNA, 17 nt, Homo sapiens
guacauuuggcauuugu

SEQ ID NO: 1849704 - RNA, 15 nt, Homo sapiens
ugacaguaugcauua

SEQ ID NO: 1849705 - RNA, 18 nt, Homo sapiens
gacuuugugaguuagcau

SEQ ID NO: 1849706 - RNA, 18 nt, Homo sapiens
uuggagcuuuuuugcaua

SEQ ID NO: 1849707 - RNA, 15 nt, Homo sapiens
uccugcuuuacagga

SEQ ID NO: 1849708 - RNA, 15 nt, Homo sapiens
cuguuuuccaaagga

SEQ ID NO: 1849709 - RNA, 19 nt, Homo sapiens
cccaaugcgacaaguaguu

SEQ ID NO: 1849710 - RNA, 19 nt, Homo sapiens
ugaaauaacauggccuugg

SEQ ID NO: 1849711 - RNA, 18 nt, Homo sapiens
uuuugugaagacugggaa

SEQ ID NO: 1849712 - RNA, 20 nt, Homo sapiens
cagagugaagcaucaaccua

SEQ ID NO: 1849713 - RNA, 12 nt, Homo sapiens
ccugcucacugg

SEQ ID NO: 1849714 - RNA, 20 nt, Homo sapiens
ugugagagcugguugcuaca

SEQ ID NO: 1849715 - RNA, 17 nt, Homo sapiens
uccaucauggcugcuug

SEQ ID NO: 1849716 - RNA, 17 nt, Homo sapiens
aggacagccaccaagaa

SEQ ID NO: 1849717 - RNA, 17 nt, Homo sapiens
cccugaucuagugcagu

SEQ ID NO: 1849718 - RNA, 18 nt, Homo sapiens
aggccaaggaaugaucca

SEQ ID NO: 1849719 - RNA, 19 nt, Homo sapiens
gauuuguucacaugcauca

SEQ ID NO: 1849720 - RNA, 16 nt, Homo sapiens
uugacuuucuagcuuc

SEQ ID NO: 1849721 - RNA, 17 nt, Homo sapiens
agccuuuggcucuggag

SEQ ID NO: 1849722 - RNA, 20 nt, Homo sapiens
accauauuuauuuauaauga

SEQ ID NO: 1849723 - RNA, 19 nt, Homo sapiens
auauacacauauaccuaua

SEQ ID NO: 1849724 - RNA, 18 nt, Homo sapiens
ucuuucaacuucaucuca

SEQ ID NO: 1849725 - RNA, 16 nt, Homo sapiens
caugauaaaagacacu

SEQ ID NO: 1849726 - RNA, 21 nt, Homo sapiens
auugaaccucuuggguucaag

SEQ ID NO: 1849727 - RNA, 18 nt, Homo sapiens
guggaacugcuauuuucc

SEQ ID NO: 1849728 - RNA, 21 nt, Homo sapiens
auuaauaaacaaucucccaag

SEQ ID NO: 1849729 - RNA, 14 nt, Homo sapiens
uagauccagaugag

SEQ ID NO: 1849730 - RNA, 22 nt, Homo sapiens
cuguuaacuuuuguaccaaaua

SEQ ID NO: 1849731 - RNA, 12 nt, Homo sapiens
acgauuagcuuu

SEQ ID NO: 1849732 - RNA, 15 nt, Homo sapiens
uccucaguuccugca

SEQ ID NO: 1849733 - RNA, 12 nt, Homo sapiens
cccaauuuccaa

SEQ ID NO: 1849734 - RNA, 12 nt, Homo sapiens
uaaaauuuuaca

SEQ ID NO: 1849735 - RNA, 17 nt, Homo sapiens
uaaugcuguugccucau

SEQ ID NO: 1849736 - RNA, 14 nt, Homo sapiens
gucauauguucuca

SEQ ID NO: 1849737 - RNA, 15 nt, Homo sapiens
guccaggacuggguc

SEQ ID NO: 1849738 - RNA, 17 nt, Homo sapiens
uaguaacuauaagauac

SEQ ID NO: 1849739 - RNA, 16 nt, Homo sapiens
guuaagggaagcugau

SEQ ID NO: 1849740 - RNA, 19 nt, Homo sapiens
auuacuguugcauuuacuu

SEQ ID NO: 1849741 - RNA, 15 nt, Homo sapiens
aaauaauuugcacug

SEQ ID NO: 1849742 - RNA, 20 nt, Homo sapiens
auguccuuuccaucugucca

SEQ ID NO: 1849743 - RNA, 23 nt, Homo sapiens
uaugucaguuauaauaaccuggu

SEQ ID NO: 1849744 - RNA, 17 nt, Homo sapiens
cugauuaaugcuaaaug

SEQ ID NO: 1849745 - RNA, 16 nt, Homo sapiens
ugacauaacagugcag

SEQ ID NO: 1849746 - RNA, 17 nt, Homo sapiens
gcugagaacaaaaucac

SEQ ID NO: 1849747 - RNA, 19 nt, Homo sapiens
aaguuuuugcaugcuacaa

SEQ ID NO: 1849748 - RNA, 16 nt, Homo sapiens
acaaagccucaauuac

SEQ ID NO: 1849749 - RNA, 22 nt, Homo sapiens
ugguacugcacauuuuguacaa

SEQ ID NO: 1849750 - RNA, 16 nt, Homo sapiens
ugcaucuuguuucaua

SEQ ID NO: 1849751 - RNA, 11 nt, Homo sapiens
cuggggaccau

SEQ ID NO: 1849752 - RNA, 20 nt, Homo sapiens
gauguaucccugccccgugg

SEQ ID NO: 1849753 - RNA, 13 nt, Homo sapiens
acaggugccucac

SEQ ID NO: 1849754 - RNA, 19 nt, Homo sapiens
ugcaguggcgugaucucag

SEQ ID NO: 1849755 - RNA, 16 nt, Homo sapiens
aaaucuaaguguuuca

SEQ ID NO: 1849756 - RNA, 12 nt, Homo sapiens
gaaugcauugau

SEQ ID NO: 1849757 - RNA, 20 nt, Homo sapiens
uuuacaggaaagaugcauuu

SEQ ID NO: 1849758 - RNA, 18 nt, Homo sapiens
cugguagcaaauuaacuu

SEQ ID NO: 1849759 - RNA, 23 nt, Homo sapiens
ccaugcuuuccuuuucuuccuuc

SEQ ID NO: 1849760 - RNA, 23 nt, Homo sapiens
agaaauuugccuuguucaauaau

SEQ ID NO: 1849761 - RNA, 18 nt, Homo sapiens
ucugggugauaaaauuau

SEQ ID NO: 1849762 - RNA, 15 nt, Homo sapiens
ucuguuccuuuugca

SEQ ID NO: 1849763 - RNA, 19 nt, Homo sapiens
aaacaugaccuuccacaau

SEQ ID NO: 1849764 - RNA, 16 nt, Homo sapiens
cccugaacucccagaa

SEQ ID NO: 1849765 - RNA, 18 nt, Homo sapiens
gaaaaaucauccaagaca

SEQ ID NO: 1849766 - RNA, 12 nt, Homo sapiens
gcaaaauauuca

SEQ ID NO: 1849767 - RNA, 14 nt, Homo sapiens
ucuggucacuucaa

SEQ ID NO: 1849768 - RNA, 12 nt, Homo sapiens
gggaaacaauga

SEQ ID NO: 1849769 - RNA, 15 nt, Homo sapiens
gcuggauuugugcuu

SEQ ID NO: 1849770 - RNA, 16 nt, Homo sapiens
auuccaggcgaugugc

SEQ ID NO: 1849771 - RNA, 21 nt, Homo sapiens
ucagggcauaaagcauguuuc

SEQ ID NO: 1849772 - RNA, 16 nt, Homo sapiens
cugccucuggucccag

SEQ ID NO: 1849773 - RNA, 23 nt, Homo sapiens
ucagaauuuuggaaaaaugucac

SEQ ID NO: 1849774 - RNA, 16 nt, Homo sapiens
auugccagcucuucca

SEQ ID NO: 1849775 - RNA, 14 nt, Homo sapiens
uuacauaaagugag

SEQ ID NO: 1849776 - RNA, 11 nt, Homo sapiens
aauacugaugg

SEQ ID NO: 1849777 - RNA, 17 nt, Homo sapiens
uugaauuuuuuuuaaca

SEQ ID NO: 1849778 - RNA, 16 nt, Homo sapiens
uagaaacuccaaugaa

SEQ ID NO: 1849779 - RNA, 22 nt, Homo sapiens
cuucacuggcuuccaucagugg

SEQ ID NO: 1849780 - RNA, 12 nt, Homo sapiens
gauugcugccau

SEQ ID NO: 1849781 - RNA, 12 nt, Homo sapiens
auuaccaagaga

SEQ ID NO: 1849782 - RNA, 17 nt, Homo sapiens
gucuauuuuuguacaaa

SEQ ID NO: 1849783 - RNA, 22 nt, Homo sapiens
cagaugugggaaaaauauguga

SEQ ID NO: 1849784 - RNA, 14 nt, Homo sapiens
gaguguuguguuaa

SEQ ID NO: 1849785 - RNA, 13 nt, Homo sapiens
caaccaaguuaca

SEQ ID NO: 1849786 - RNA, 19 nt, Homo sapiens
uauauauuuauaacucauc

SEQ ID NO: 1849787 - RNA, 14 nt, Homo sapiens
gaccucacuguccu

SEQ ID NO: 1849788 - RNA, 14 nt, Homo sapiens
agccacuucacuuu

SEQ ID NO: 1849789 - RNA, 12 nt, Homo sapiens
uaacacacucca

SEQ ID NO: 1849790 - RNA, 15 nt, Homo sapiens
cuggguuugagaaau

SEQ ID NO: 1849791 - RNA, 22 nt, Homo sapiens
caaggacuuggacccaugacuc

SEQ ID NO: 1849792 - RNA, 19 nt, Homo sapiens
aucugggucucccaggaca

SEQ ID NO: 1849793 - RNA, 18 nt, Homo sapiens
auuuaaaaauaaauacca

SEQ ID NO: 1849794 - RNA, 20 nt, Homo sapiens
gaguuugugucuguugcuug

SEQ ID NO: 1849795 - RNA, 19 nt, Homo sapiens
aaguguucauuuuaaguaa

SEQ ID NO: 1849796 - RNA, 19 nt, Homo sapiens
ccauucuucacucuuugaa

SEQ ID NO: 1849797 - RNA, 14 nt, Homo sapiens
uacacacuuuccaa

SEQ ID NO: 1849798 - RNA, 21 nt, Homo sapiens
gucagaauuagcugcuucuau

SEQ ID NO: 1849799 - RNA, 15 nt, Homo sapiens
cuagcuuacugauga

SEQ ID NO: 1849800 - RNA, 14 nt, Homo sapiens
cagaaacucugcca

SEQ ID NO: 1849801 - RNA, 24 nt, Homo sapiens
uguuugcacugugugcugacugaa

SEQ ID NO: 1849802 - RNA, 23 nt, Homo sapiens
ccagaaaagauggaaaagaaauu

SEQ ID NO: 1849803 - RNA, 15 nt, Homo sapiens
uaagaacaaaacugu

SEQ ID NO: 1849804 - RNA, 22 nt, Homo sapiens
aauacauuguuguaagagugau

SEQ ID NO: 1849805 - RNA, 22 nt, Homo sapiens
cuccagcuugggcaacagggcg

SEQ ID NO: 1849806 - RNA, 15 nt, Homo sapiens
auauaccuaauguua

SEQ ID NO: 1849807 - RNA, 23 nt, Homo sapiens
cuaaauaaaaauauguaauuuca

SEQ ID NO: 1849808 - RNA, 15 nt, Homo sapiens
caugcugcccuguga

SEQ ID NO: 1849809 - RNA, 17 nt, Homo sapiens
uuauucagcuucuauaa

SEQ ID NO: 1849810 - RNA, 17 nt, Homo sapiens
uccuagccccgagacac

SEQ ID NO: 1849811 - RNA, 16 nt, Homo sapiens
ucuccccgaaucucaa

SEQ ID NO: 1849812 - RNA, 17 nt, Homo sapiens
aaaauaaauaccaaaga

SEQ ID NO: 1849813 - RNA, 17 nt, Homo sapiens
gucucacuauguugccc

SEQ ID NO: 1849814 - RNA, 15 nt, Homo sapiens
cagugccaccaucau

SEQ ID NO: 1849815 - RNA, 19 nt, Homo sapiens
cauguuuuuucugcaauga

SEQ ID NO: 1849816 - RNA, 14 nt, Homo sapiens
cuguggccugggca

SEQ ID NO: 1849817 - RNA, 12 nt, Homo sapiens
guggggcuuccu

SEQ ID NO: 1849818 - RNA, 21 nt, Homo sapiens
ccuccucucaguguuuuggac

SEQ ID NO: 1849819 - RNA, 13 nt, Homo sapiens
ucccucuggauca

SEQ ID NO: 1849820 - RNA, 21 nt, Homo sapiens
gaauucugggaauccacagcu

SEQ ID NO: 1849821 - RNA, 17 nt, Homo sapiens
acaccgagacaccaccu

SEQ ID NO: 1849822 - RNA, 16 nt, Homo sapiens
ugcagagcugaagauu

SEQ ID NO: 1849823 - RNA, 16 nt, Homo sapiens
acacagcaacaaugac

SEQ ID NO: 1849824 - RNA, 18 nt, Homo sapiens
agcccucccuaccuacca

SEQ ID NO: 1849825 - RNA, 16 nt, Homo sapiens
uguauauaaacauauc

SEQ ID NO: 1849826 - RNA, 18 nt, Homo sapiens
cauuaggcaaaguacaaa

SEQ ID NO: 1849827 - RNA, 13 nt, Homo sapiens
uagaggcagugag

SEQ ID NO: 1849828 - RNA, 20 nt, Homo sapiens
agauccugaagcaguucaga

SEQ ID NO: 1849829 - RNA, 21 nt, Homo sapiens
caaagcccuuauguuuaauca

SEQ ID NO: 1849830 - RNA, 14 nt, Homo sapiens
aaggcgcucaggca

SEQ ID NO: 1849831 - RNA, 22 nt, Homo sapiens
gugcugucuugaugacugcuga

SEQ ID NO: 1849832 - RNA, 17 nt, Homo sapiens
cucaucccuguuccuca

SEQ ID NO: 1849833 - RNA, 17 nt, Homo sapiens
auucauuucuagacuca

SEQ ID NO: 1849834 - RNA, 17 nt, Homo sapiens
uaggaccaauaccuccu

SEQ ID NO: 1849835 - RNA, 22 nt, Homo sapiens
gcacuacaggcacccgccacca

SEQ ID NO: 1849836 - RNA, 22 nt, Homo sapiens
uuaguggugguagaaaugauuc

SEQ ID NO: 1849837 - RNA, 18 nt, Homo sapiens
cuugcuucucuucuuucc

SEQ ID NO: 1849838 - RNA, 13 nt, Homo sapiens
ucuucuggucugu

SEQ ID NO: 1849839 - RNA, 18 nt, Homo sapiens
auauuuuguuuugugcag

SEQ ID NO: 1849840 - RNA, 17 nt, Homo sapiens
cugcagaccaugccaga

SEQ ID NO: 1849841 - RNA, 11 nt, Homo sapiens
aggauggcgca

SEQ ID NO: 1849842 - RNA, 15 nt, Homo sapiens
uuaaggccacacugg

SEQ ID NO: 1849843 - RNA, 19 nt, Homo sapiens
cagugggaggacagagccg

SEQ ID NO: 1849844 - RNA, 18 nt, Homo sapiens
uuggccaagcugcugcuu

SEQ ID NO: 1849845 - RNA, 13 nt, Homo sapiens
ccgcagggcgggg

SEQ ID NO: 1849846 - RNA, 14 nt, Homo sapiens
cagcauuuguccuu

SEQ ID NO: 1849847 - RNA, 15 nt, Homo sapiens
gugagucaccacuuc

SEQ ID NO: 1849848 - RNA, 17 nt, Homo sapiens
gaggcuggggacccaga

SEQ ID NO: 1849849 - RNA, 19 nt, Homo sapiens
ccuuuauguggaaaacaga

SEQ ID NO: 1849850 - RNA, 15 nt, Homo sapiens
acacaggcaaugacu

SEQ ID NO: 1849851 - RNA, 12 nt, Homo sapiens
ucagugcugcuc

SEQ ID NO: 1849852 - RNA, 12 nt, Homo sapiens
ucugugcugcac

SEQ ID NO: 1849853 - RNA, 16 nt, Homo sapiens
caaaccaggccuccaa

SEQ ID NO: 1849854 - RNA, 15 nt, Homo sapiens
cuucccuacauggag

SEQ ID NO: 1849855 - RNA, 22 nt, Homo sapiens
auguagggguuaacuuggucag

SEQ ID NO: 1849856 - RNA, 19 nt, Homo sapiens
aagaaggccaauugccuaa

SEQ ID NO: 1849857 - RNA, 18 nt, Homo sapiens
auacccacugccagacau

SEQ ID NO: 1849858 - RNA, 15 nt, Homo sapiens
gaaagagacuguggg

SEQ ID NO: 1849859 - RNA, 15 nt, Homo sapiens
ggggaggugguaaga

SEQ ID NO: 1849860 - RNA, 14 nt, Homo sapiens
guaaauacaucaaa

SEQ ID NO: 1849861 - RNA, 17 nt, Homo sapiens
gcccugcucuuccucag

SEQ ID NO: 1849862 - RNA, 15 nt, Homo sapiens
gaaucaguguguuac

SEQ ID NO: 1849863 - RNA, 18 nt, Homo sapiens
accacagaagcuuguauu

SEQ ID NO: 1849864 - RNA, 18 nt, Homo sapiens
cuuaaacaaaacuggaac

SEQ ID NO: 1849865 - RNA, 23 nt, Homo sapiens
cuugcugcccgcgggagacagcu

SEQ ID NO: 1849866 - RNA, 15 nt, Homo sapiens
uugccuaagcauugc

SEQ ID NO: 1849867 - RNA, 17 nt, Homo sapiens
uucaaagcaaagcucuu

SEQ ID NO: 1849868 - RNA, 17 nt, Homo sapiens
uaaauaagcacuauucu

SEQ ID NO: 1849869 - RNA, 13 nt, Homo sapiens
ucaugacauaaua

SEQ ID NO: 1849870 - RNA, 21 nt, Homo sapiens
uauuaauuuuccaaugcacag

SEQ ID NO: 1849871 - RNA, 15 nt, Homo sapiens
cacucugcaauggaa

SEQ ID NO: 1849872 - RNA, 16 nt, Homo sapiens
cuacccuaaagggaga

SEQ ID NO: 1849873 - RNA, 18 nt, Homo sapiens
aaugacauguuccuuuaa

SEQ ID NO: 1849874 - RNA, 18 nt, Homo sapiens
auugauagaguguuauca

SEQ ID NO: 1849875 - RNA, 17 nt, Homo sapiens
uggagaagucucagcua

SEQ ID NO: 1849876 - RNA, 19 nt, Homo sapiens
ucugggaaucaacagcaua

SEQ ID NO: 1849877 - RNA, 14 nt, Homo sapiens
uacaagcuuguaaa

SEQ ID NO: 1849878 - RNA, 23 nt, Homo sapiens
caugcaagggaugaauuguaaaa

SEQ ID NO: 1849879 - RNA, 16 nt, Homo sapiens
uuugauuuugauuuua

SEQ ID NO: 1849880 - RNA, 16 nt, Homo sapiens
uccuuuuaaaacaaua

SEQ ID NO: 1849881 - RNA, 17 nt, Homo sapiens
aaaaugggagaucuucu

SEQ ID NO: 1849882 - RNA, 20 nt, Homo sapiens
acacugagcaagaucuuguc

SEQ ID NO: 1849883 - RNA, 15 nt, Homo sapiens
caugcucaaccuuca

SEQ ID NO: 1849884 - RNA, 20 nt, Homo sapiens
cacgacuguuguacaagcuc

SEQ ID NO: 1849885 - RNA, 14 nt, Homo sapiens
aacuuaaacacaga

SEQ ID NO: 1849886 - RNA, 17 nt, Homo sapiens
aagagugggcuuugugg

SEQ ID NO: 1849887 - RNA, 17 nt, Homo sapiens
gccuccaaaguggagcu

SEQ ID NO: 1849888 - RNA, 14 nt, Homo sapiens
ggacccagugcaga

SEQ ID NO: 1849889 - RNA, 18 nt, Homo sapiens
uggucauuuccuaugcaa

SEQ ID NO: 1849890 - RNA, 17 nt, Homo sapiens
ggaaacgucucccagau

SEQ ID NO: 1849891 - RNA, 15 nt, Homo sapiens
augauaugugcuugu

SEQ ID NO: 1849892 - RNA, 23 nt, Homo sapiens
gagacgcagcccugggggccagc

SEQ ID NO: 1849893 - RNA, 18 nt, Homo sapiens
uggcuguccccagcaccu

SEQ ID NO: 1849894 - RNA, 20 nt, Homo sapiens
guuggccaggcugaucucaa

SEQ ID NO: 1849895 - RNA, 20 nt, Homo sapiens
cugugcucagccaccaucug

SEQ ID NO: 1849896 - RNA, 14 nt, Homo sapiens
uacugagacauuac

SEQ ID NO: 1849897 - RNA, 21 nt, Homo sapiens
guccacugagaagaucaauga

SEQ ID NO: 1849898 - RNA, 17 nt, Homo sapiens
ucccaccccggccucca

SEQ ID NO: 1849899 - RNA, 11 nt, Homo sapiens
auguguucucu

SEQ ID NO: 1849900 - RNA, 11 nt, Homo sapiens
uuguguucacu

SEQ ID NO: 1849901 - RNA, 21 nt, Homo sapiens
cuggaucuugccuaaauccca

SEQ ID NO: 1849902 - RNA, 14 nt, Homo sapiens
ugcaauguuuuaga

SEQ ID NO: 1849903 - RNA, 11 nt, Homo sapiens
ggagcucucca

SEQ ID NO: 1849904 - RNA, 19 nt, Homo sapiens
cuacagggccacaacugcc

SEQ ID NO: 1849905 - RNA, 20 nt, Homo sapiens
guaaaaacugcagugucuuu

SEQ ID NO: 1849906 - RNA, 23 nt, Homo sapiens
ugacgugaguggggaggagacuc

SEQ ID NO: 1849907 - RNA, 19 nt, Homo sapiens
uaucuuguggcauauccau

SEQ ID NO: 1849908 - RNA, 12 nt, Homo sapiens
aaggauguugcc

SEQ ID NO: 1849909 - RNA, 15 nt, Homo sapiens
cuaccuggugccuug

SEQ ID NO: 1849910 - RNA, 20 nt, Homo sapiens
caaacuucuguguacugggu

SEQ ID NO: 1849911 - RNA, 20 nt, Homo sapiens
cauuuacuguggcuucuuaa

SEQ ID NO: 1849912 - RNA, 12 nt, Homo sapiens
agaaaugcugcc

SEQ ID NO: 1849913 - RNA, 13 nt, Homo sapiens
uaauugcauuuaa

SEQ ID NO: 1849914 - RNA, 12 nt, Homo sapiens
agaccaaagacc

SEQ ID NO: 1849915 - RNA, 18 nt, Homo sapiens
uacagacucugauucuac

SEQ ID NO: 1849916 - RNA, 13 nt, Homo sapiens
ggagcuuccagug

SEQ ID NO: 1849917 - RNA, 21 nt, Homo sapiens
cagaagaagugggagcagcuu

SEQ ID NO: 1849918 - RNA, 20 nt, Homo sapiens
ugaacccaagaaauguaaua

SEQ ID NO: 1849919 - RNA, 19 nt, Homo sapiens
uuguaaaagcaacaucagc

SEQ ID NO: 1849920 - RNA, 17 nt, Homo sapiens
agggcucacucagccac

SEQ ID NO: 1849921 - RNA, 16 nt, Homo sapiens
augugaauuuugccau

SEQ ID NO: 1849922 - RNA, 22 nt, Homo sapiens
gugaaaacagcagcaaugcaau

SEQ ID NO: 1849923 - RNA, 12 nt, Homo sapiens
ugcugaaaucau

SEQ ID NO: 1849924 - RNA, 21 nt, Homo sapiens
agcucccaagggauggugccc

SEQ ID NO: 1849925 - RNA, 18 nt, Homo sapiens
ccaaugccaaaaaaagac

SEQ ID NO: 1849926 - RNA, 16 nt, Homo sapiens
uagauuccucuugccu

SEQ ID NO: 1849927 - RNA, 23 nt, Homo sapiens
aucagcuuucccuggcucaggga

SEQ ID NO: 1849928 - RNA, 16 nt, Homo sapiens
caacagcuucagucca

SEQ ID NO: 1849929 - RNA, 15 nt, Homo sapiens
augguccugucuguc

SEQ ID NO: 1849930 - RNA, 19 nt, Homo sapiens
aaucucgacucucgugaua

SEQ ID NO: 1849931 - RNA, 16 nt, Homo sapiens
gaugagaaaacaggcu

SEQ ID NO: 1849932 - RNA, 13 nt, Homo sapiens
uccuugacuuuga

SEQ ID NO: 1849933 - RNA, 15 nt, Homo sapiens
uccuggcagcccugu

SEQ ID NO: 1849934 - RNA, 21 nt, Homo sapiens
gggaaccucacucuugccaac

SEQ ID NO: 1849935 - RNA, 19 nt, Homo sapiens
ucuugagauuggguuuugc

SEQ ID NO: 1849936 - RNA, 16 nt, Homo sapiens
aacugcuguguucuca

SEQ ID NO: 1849937 - RNA, 18 nt, Homo sapiens
auauccuuucaagacaga

SEQ ID NO: 1849938 - RNA, 21 nt, Homo sapiens
uccucauucacuaagccaugc

SEQ ID NO: 1849939 - RNA, 22 nt, Homo sapiens
ccugugcuucuauuucuuggaa

SEQ ID NO: 1849940 - RNA, 11 nt, Homo sapiens
cagagugugaa

SEQ ID NO: 1849941 - RNA, 14 nt, Homo sapiens
cugaauugaaucua

SEQ ID NO: 1849942 - RNA, 16 nt, Homo sapiens
accucacuaugcugcu

SEQ ID NO: 1849943 - RNA, 15 nt, Homo sapiens
ucuuuucuccuacuc

SEQ ID NO: 1849944 - RNA, 19 nt, Homo sapiens
ccuggagaaggcauuccag

SEQ ID NO: 1849945 - RNA, 14 nt, Homo sapiens
uccugugaauuucu

SEQ ID NO: 1849946 - RNA, 16 nt, Homo sapiens
ccugcccugcucugcc

SEQ ID NO: 1849947 - RNA, 19 nt, Homo sapiens
cuuugggaggcugagaugg

SEQ ID NO: 1849948 - RNA, 19 nt, Homo sapiens
gagccuggcuccaaacccu

SEQ ID NO: 1849949 - RNA, 16 nt, Homo sapiens
cagucuacacucacaa

SEQ ID NO: 1849950 - RNA, 21 nt, Homo sapiens
cuggcggcaggaagccaaaga

SEQ ID NO: 1849951 - RNA, 15 nt, Homo sapiens
uauagauguuuacua

SEQ ID NO: 1849952 - RNA, 15 nt, Homo sapiens
gcagucagcacagag

SEQ ID NO: 1849953 - RNA, 13 nt, Homo sapiens
agggagggggaag

SEQ ID NO: 1849954 - RNA, 13 nt, Homo sapiens
gccuuucucccag

SEQ ID NO: 1849955 - RNA, 16 nt, Homo sapiens
uuuuguuacagauuaa

SEQ ID NO: 1849956 - RNA, 21 nt, Homo sapiens
gaccuaaaaaggucuguuaau

SEQ ID NO: 1849957 - RNA, 22 nt, Homo sapiens
gacaaugcaaugaaacagauga

SEQ ID NO: 1849958 - RNA, 14 nt, Homo sapiens
acccagaugcucuc

SEQ ID NO: 1849959 - RNA, 14 nt, Homo sapiens
ggaacucagaucca

SEQ ID NO: 1849960 - RNA, 17 nt, Homo sapiens
aaaccuacccucaguga

SEQ ID NO: 1849961 - RNA, 21 nt, Homo sapiens
cuuaagcccagugcacugaaa

SEQ ID NO: 1849962 - RNA, 17 nt, Homo sapiens
auuacaggcacgugcca

SEQ ID NO: 1849963 - RNA, 19 nt, Homo sapiens
cucuacuugucauaucacu

SEQ ID NO: 1849964 - RNA, 15 nt, Homo sapiens
aagguauuucuccag

SEQ ID NO: 1849965 - RNA, 14 nt, Homo sapiens
ucuauauaguguau

SEQ ID NO: 1849966 - RNA, 21 nt, Homo sapiens
ggcauguccuaggcucugggu

SEQ ID NO: 1849967 - RNA, 16 nt, Homo sapiens
augauaauuuaucuac

SEQ ID NO: 1849968 - RNA, 21 nt, Homo sapiens
gguaaccccagauucaugcac

SEQ ID NO: 1849969 - RNA, 23 nt, Homo sapiens
uuaaagcuuggugcuaaaccaca

SEQ ID NO: 1849970 - RNA, 17 nt, Homo sapiens
gaaggcaccucucuggg

SEQ ID NO: 1849971 - RNA, 16 nt, Homo sapiens
cauuuaaggagcagug

SEQ ID NO: 1849972 - RNA, 22 nt, Homo sapiens
aggagggcagagacuuuguguu

SEQ ID NO: 1849973 - RNA, 19 nt, Homo sapiens
uccugccucagccuuccaa

SEQ ID NO: 1849974 - RNA, 21 nt, Homo sapiens
cguucccaguguggcugaggc

SEQ ID NO: 1849975 - RNA, 13 nt, Homo sapiens
cgucugugcucug

SEQ ID NO: 1849976 - RNA, 17 nt, Homo sapiens
agccaggugaacuggaa

SEQ ID NO: 1849977 - RNA, 17 nt, Homo sapiens
cucccaggaagcccagg

SEQ ID NO: 1849978 - RNA, 14 nt, Homo sapiens
aucauguuacuuga

SEQ ID NO: 1849979 - RNA, 20 nt, Homo sapiens
acagauuuccaaaaguacua

SEQ ID NO: 1849980 - RNA, 21 nt, Homo sapiens
cacauagauucaccuguaaaa

SEQ ID NO: 1849981 - RNA, 20 nt, Homo sapiens
gguuccuacgccuugucauu

SEQ ID NO: 1849982 - RNA, 23 nt, Homo sapiens
uguuaguaaauaaaauuaacaaa

SEQ ID NO: 1849983 - RNA, 20 nt, Homo sapiens
aagagcccugagcucaggcu

SEQ ID NO: 1849984 - RNA, 21 nt, Homo sapiens
gcccgucauguuccucaaaag

SEQ ID NO: 1849985 - RNA, 18 nt, Homo sapiens
auugaucgacuugccaaa

SEQ ID NO: 1849986 - RNA, 16 nt, Homo sapiens
ccugguauauccaaaa

SEQ ID NO: 1849987 - RNA, 10 nt, Homo sapiens
cccacuuuga

SEQ ID NO: 1849988 - RNA, 21 nt, Homo sapiens
cugggcaaggcgcucaggcau

SEQ ID NO: 1849989 - RNA, 18 nt, Homo sapiens
cugggccaguggcacucu

SEQ ID NO: 1849990 - RNA, 13 nt, Homo sapiens
uucaccaccaaau

SEQ ID NO: 1849991 - RNA, 14 nt, Homo sapiens
uguuaaaacuacuu

SEQ ID NO: 1849992 - RNA, 20 nt, Homo sapiens
ucacugcaagucacauaaaa

SEQ ID NO: 1849993 - RNA, 19 nt, Homo sapiens
aauggcaagagaucauauc

SEQ ID NO: 1849994 - RNA, 23 nt, Homo sapiens
gagccugacuguguucagugccu

SEQ ID NO: 1849995 - RNA, 14 nt, Homo sapiens
aaagaggaagcaaa

SEQ ID NO: 1849996 - RNA, 21 nt, Homo sapiens
agucuuagcuccuguguuaca

SEQ ID NO: 1849997 - RNA, 15 nt, Homo sapiens
accaugccuccuucc

SEQ ID NO: 1849998 - RNA, 23 nt, Homo sapiens
acgccugcaggcuggagacugga

SEQ ID NO: 1849999 - RNA, 16 nt, Homo sapiens
aaaaaugcacccaacu

SEQ ID NO: 1850000 - RNA, 16 nt, Homo sapiens
acaacucgaaucacuc

SEQ ID NO: 1850001 - RNA, 21 nt, Homo sapiens
gcugagaucgugccacugcac

SEQ ID NO: 1850002 - RNA, 21 nt, Homo sapiens
gccgagaucgcgccacugcac

SEQ ID NO: 1850003 - RNA, 15 nt, Homo sapiens
ggccacugaauuaug

SEQ ID NO: 1850004 - RNA, 22 nt, Homo sapiens
uaguccucacuucuagaucuca

SEQ ID NO: 1850005 - RNA, 21 nt, Homo sapiens
uuuaaugugaggaacucacau

SEQ ID NO: 1850006 - RNA, 18 nt, Homo sapiens
gagauacucuucugccuc

SEQ ID NO: 1850007 - RNA, 16 nt, Homo sapiens
agaauuauaacccaga

SEQ ID NO: 1850008 - RNA, 18 nt, Homo sapiens
auaaguugugauuugacg

SEQ ID NO: 1850009 - RNA, 16 nt, Homo sapiens
guuaucauuaucauca

SEQ ID NO: 1850010 - RNA, 22 nt, Homo sapiens
uggaaaucauugugugucuuca

SEQ ID NO: 1850011 - RNA, 14 nt, Homo sapiens
uauauuuuggcuca

SEQ ID NO: 1850012 - RNA, 13 nt, Homo sapiens
agcugcccuugca

SEQ ID NO: 1850013 - RNA, 13 nt, Homo sapiens
gauauugcacuag

SEQ ID NO: 1850014 - RNA, 22 nt, Homo sapiens
uccuggggaccaagauuuacca

SEQ ID NO: 1850015 - RNA, 16 nt, Homo sapiens
uaaaggggagauacuc

SEQ ID NO: 1850016 - RNA, 20 nt, Homo sapiens
aaaauacaucaaggaguuau

SEQ ID NO: 1850017 - RNA, 14 nt, Homo sapiens
auuuuaauuugaua

SEQ ID NO: 1850018 - RNA, 21 nt, Homo sapiens
cauuaaaagcauuguccaaaa

SEQ ID NO: 1850019 - RNA, 14 nt, Homo sapiens
gcuguccugcugcc

SEQ ID NO: 1850020 - RNA, 20 nt, Homo sapiens
agcaugcaagcuuggucaaa

SEQ ID NO: 1850021 - RNA, 22 nt, Homo sapiens
cuggaacuuuagugaaacauaa

SEQ ID NO: 1850022 - RNA, 17 nt, Homo sapiens
aguagcaggaccugcca

SEQ ID NO: 1850023 - RNA, 22 nt, Homo sapiens
agagcgugcuuucaaguguccu

SEQ ID NO: 1850024 - RNA, 19 nt, Homo sapiens
uacccuggcuggcaggcac

SEQ ID NO: 1850025 - RNA, 13 nt, Homo sapiens
uguucaacauuuu

SEQ ID NO: 1850026 - RNA, 18 nt, Homo sapiens
uggaugggaugcacucuc

SEQ ID NO: 1850027 - RNA, 21 nt, Homo sapiens
gcuuuucuuuucuaaccaaga

SEQ ID NO: 1850028 - RNA, 23 nt, Homo sapiens
acaauauaaacugaaaaauguca

SEQ ID NO: 1850029 - RNA, 22 nt, Homo sapiens
ugacuaaucagaugauggccau

SEQ ID NO: 1850030 - RNA, 20 nt, Homo sapiens
ccaagacucugaaaucucag

SEQ ID NO: 1850031 - RNA, 17 nt, Homo sapiens
guauugagggccaguga

SEQ ID NO: 1850032 - RNA, 16 nt, Homo sapiens
aaggaauccuggugga

SEQ ID NO: 1850033 - RNA, 20 nt, Homo sapiens
cucugaauuggauccagggg

SEQ ID NO: 1850034 - RNA, 13 nt, Homo sapiens
gcacuuuggacau

SEQ ID NO: 1850035 - RNA, 20 nt, Homo sapiens
uauucaauacacaguacuuc

SEQ ID NO: 1850036 - RNA, 17 nt, Homo sapiens
cacacauccugucagug

SEQ ID NO: 1850037 - RNA, 15 nt, Homo sapiens
uggggcaggaucuca

SEQ ID NO: 1850038 - RNA, 14 nt, Homo sapiens
ucauuagugacuuc

SEQ ID NO: 1850039 - RNA, 17 nt, Homo sapiens
uagcucuggaccugucu

SEQ ID NO: 1850040 - RNA, 14 nt, Homo sapiens
uaaccuacuagaca

SEQ ID NO: 1850041 - RNA, 16 nt, Homo sapiens
ugaauauguugaucau

SEQ ID NO: 1850042 - RNA, 14 nt, Homo sapiens
accacgcccagcua

SEQ ID NO: 1850043 - RNA, 14 nt, Homo sapiens
ccaaacugccucaa

SEQ ID NO: 1850044 - RNA, 14 nt, Homo sapiens
cugaacguagcaua

SEQ ID NO: 1850045 - RNA, 18 nt, Homo sapiens
cagaauggggacaucuug

SEQ ID NO: 1850046 - RNA, 23 nt, Homo sapiens
accuagggagguugaagaaugag

SEQ ID NO: 1850047 - RNA, 15 nt, Homo sapiens
auuaaaagaguagaa

SEQ ID NO: 1850048 - RNA, 15 nt, Homo sapiens
acauaauaaccaaac

SEQ ID NO: 1850049 - RNA, 12 nt, Homo sapiens
gagacacagccc

SEQ ID NO: 1850050 - RNA, 18 nt, Homo sapiens
agcaauugaaaugcauug

SEQ ID NO: 1850051 - RNA, 22 nt, Homo sapiens
ggaggcccaugggcagaagaua

SEQ ID NO: 1850052 - RNA, 19 nt, Homo sapiens
uccgugaacuugugagaac

SEQ ID NO: 1850053 - RNA, 21 nt, Homo sapiens
cuguuguuuggacuguaacau

SEQ ID NO: 1850054 - RNA, 17 nt, Homo sapiens
gcaaaugucaugcugcc

SEQ ID NO: 1850055 - RNA, 21 nt, Homo sapiens
cucaucauagcaauaacauuc

SEQ ID NO: 1850056 - RNA, 20 nt, Homo sapiens
ugucuaggauuuuggauguu

SEQ ID NO: 1850057 - RNA, 22 nt, Homo sapiens
ccuauguacuuaauccuuuaac

SEQ ID NO: 1850058 - RNA, 18 nt, Homo sapiens
aacuauaagcccacuguu

SEQ ID NO: 1850059 - RNA, 14 nt, Homo sapiens
cuuguugugcucuu

SEQ ID NO: 1850060 - RNA, 14 nt, Homo sapiens
uucaucaugacaac

SEQ ID NO: 1850061 - RNA, 19 nt, Homo sapiens
aucugaacagaaauaccaa

SEQ ID NO: 1850062 - RNA, 20 nt, Homo sapiens
cauuggaagcuuugaguuga

SEQ ID NO: 1850063 - RNA, 14 nt, Homo sapiens
uaucaguccugucc

SEQ ID NO: 1850064 - RNA, 20 nt, Homo sapiens
ggccagggccucugugcaga

SEQ ID NO: 1850065 - RNA, 21 nt, Homo sapiens
agucugaacacaagcauuuca

SEQ ID NO: 1850066 - RNA, 18 nt, Homo sapiens
ucuauuguuuguugcacu

SEQ ID NO: 1850067 - RNA, 18 nt, Homo sapiens
uccuccacagugcugcuu

SEQ ID NO: 1850068 - RNA, 18 nt, Homo sapiens
uccaacccaugagugcua

SEQ ID NO: 1850069 - RNA, 15 nt, Homo sapiens
cagaacacauuucaa

SEQ ID NO: 1850070 - RNA, 18 nt, Homo sapiens
cucuacgggugacagauc

SEQ ID NO: 1850071 - RNA, 14 nt, Homo sapiens
gcuaauaagugcuu

SEQ ID NO: 1850072 - RNA, 18 nt, Homo sapiens
cauccucuuaccagaucc

SEQ ID NO: 1850073 - RNA, 14 nt, Homo sapiens
aaugaaagccaaau

SEQ ID NO: 1850074 - RNA, 23 nt, Homo sapiens
aacucugagcagugcuugaauga

SEQ ID NO: 1850075 - RNA, 21 nt, Homo sapiens
uagagauacccucugagacag

SEQ ID NO: 1850076 - RNA, 22 nt, Homo sapiens
cccaguggaaccaaaacccauc

SEQ ID NO: 1850077 - RNA, 17 nt, Homo sapiens
aagagggggaccugcca

SEQ ID NO: 1850078 - RNA, 14 nt, Homo sapiens
cccuuucuccagcc

SEQ ID NO: 1850079 - RNA, 15 nt, Homo sapiens
caagggaggggagca

SEQ ID NO: 1850080 - RNA, 19 nt, Homo sapiens
augucaauuuuuaacuuau

SEQ ID NO: 1850081 - RNA, 16 nt, Homo sapiens
gagguuaggucuuagg

SEQ ID NO: 1850082 - RNA, 17 nt, Homo sapiens
aauuuaacaucacuaca

SEQ ID NO: 1850083 - RNA, 22 nt, Homo sapiens
gucccagggcugaugcuguaca

SEQ ID NO: 1850084 - RNA, 18 nt, Homo sapiens
gucaaugagauuuugccc

SEQ ID NO: 1850085 - RNA, 18 nt, Homo sapiens
guaaauccuagacuugaa

SEQ ID NO: 1850086 - RNA, 21 nt, Homo sapiens
cugguccacugggaacucaaa

SEQ ID NO: 1850087 - RNA, 20 nt, Homo sapiens
cuccugaccucaggugaucc

SEQ ID NO: 1850088 - RNA, 19 nt, Homo sapiens
ugcguccucaugguacugu

SEQ ID NO: 1850089 - RNA, 14 nt, Homo sapiens
cguccucucaguaa

SEQ ID NO: 1850090 - RNA, 14 nt, Homo sapiens
guccaguauucuac

SEQ ID NO: 1850091 - RNA, 19 nt, Homo sapiens
uucccauuaaagagccagu

SEQ ID NO: 1850092 - RNA, 20 nt, Homo sapiens
cuuuacauuuucaguaccaa

SEQ ID NO: 1850093 - RNA, 19 nt, Homo sapiens
cuucaugcuugacauaccu

SEQ ID NO: 1850094 - RNA, 18 nt, Homo sapiens
ugugucaggaaacauauu

SEQ ID NO: 1850095 - RNA, 23 nt, Homo sapiens
gaacugagccaaacacacuguaa

SEQ ID NO: 1850096 - RNA, 12 nt, Homo sapiens
uuuucacuguau

SEQ ID NO: 1850097 - RNA, 14 nt, Homo sapiens
aaggugaagcacau

SEQ ID NO: 1850098 - RNA, 19 nt, Homo sapiens
cccugaggugagcaucauc

SEQ ID NO: 1850099 - RNA, 22 nt, Homo sapiens
cccagagggauugcugugaaau

SEQ ID NO: 1850100 - RNA, 15 nt, Homo sapiens
cagauggagacauug

SEQ ID NO: 1850101 - RNA, 23 nt, Homo sapiens
cucugacuguaaaauacauggua

SEQ ID NO: 1850102 - RNA, 18 nt, Homo sapiens
uggucacagagcacugua

SEQ ID NO: 1850103 - RNA, 21 nt, Homo sapiens
gccaggguggucuugaucucc

SEQ ID NO: 1850104 - RNA, 15 nt, Homo sapiens
ccagaggacugugau

SEQ ID NO: 1850105 - RNA, 21 nt, Homo sapiens
aagaacauguccuacaacagc

SEQ ID NO: 1850106 - RNA, 23 nt, Homo sapiens
uauaguuucaagccaacugugga

SEQ ID NO: 1850107 - RNA, 13 nt, Homo sapiens
uauaacccagaaa

SEQ ID NO: 1850108 - RNA, 22 nt, Homo sapiens
cuccucagugacaucaaagccu

SEQ ID NO: 1850109 - RNA, 22 nt, Homo sapiens
uaaccucaauuuauguuaacag

SEQ ID NO: 1850110 - RNA, 13 nt, Homo sapiens
ugcacaccuguaa

SEQ ID NO: 1850111 - RNA, 16 nt, Homo sapiens
caucaccaagauuuug

SEQ ID NO: 1850112 - RNA, 13 nt, Homo sapiens
gaaauaccugaga

SEQ ID NO: 1850113 - RNA, 13 nt, Homo sapiens
ccaaauugcugag

SEQ ID NO: 1850114 - RNA, 15 nt, Homo sapiens
agcaucaucuguucg

SEQ ID NO: 1850115 - RNA, 15 nt, Homo sapiens
ucaucaacaauuuga

SEQ ID NO: 1850116 - RNA, 12 nt, Homo sapiens
aggcuggucuca

SEQ ID NO: 1850117 - RNA, 12 nt, Homo sapiens
aggauggucucc

SEQ ID NO: 1850118 - RNA, 13 nt, Homo sapiens
ugccagugccuua

SEQ ID NO: 1850119 - RNA, 21 nt, Homo sapiens
agaggaugaauguaugugcac

SEQ ID NO: 1850120 - RNA, 20 nt, Homo sapiens
aauucccccuuaaacuucca

SEQ ID NO: 1850121 - RNA, 20 nt, Homo sapiens
ucucuucacagugccaggaa

SEQ ID NO: 1850122 - RNA, 14 nt, Homo sapiens
augcuuauuccaug

SEQ ID NO: 1850123 - RNA, 20 nt, Homo sapiens
ccaauaaaaaguucagaguu

SEQ ID NO: 1850124 - RNA, 16 nt, Homo sapiens
agcuauuagugaauau

SEQ ID NO: 1850125 - RNA, 18 nt, Homo sapiens
ugucccagggcugaugcu

SEQ ID NO: 1850126 - RNA, 16 nt, Homo sapiens
agacgccacagucucc

SEQ ID NO: 1850127 - RNA, 18 nt, Homo sapiens
uggccuccuucaccaaag

SEQ ID NO: 1850128 - RNA, 16 nt, Homo sapiens
ugugaagcaaggagcu

SEQ ID NO: 1850129 - RNA, 19 nt, Homo sapiens
cagcuucaccagagcauuu

SEQ ID NO: 1850130 - RNA, 14 nt, Homo sapiens
aacauuuuuagguu

SEQ ID NO: 1850131 - RNA, 11 nt, Homo sapiens
cuuggggccau

SEQ ID NO: 1850132 - RNA, 22 nt, Homo sapiens
accugggggccuggccuugcaa

SEQ ID NO: 1850133 - RNA, 18 nt, Homo sapiens
acuuguuucuacucaaaa

SEQ ID NO: 1850134 - RNA, 19 nt, Homo sapiens
gaccuacuguucggacaaa

SEQ ID NO: 1850135 - RNA, 16 nt, Homo sapiens
augguggagggcacuu

SEQ ID NO: 1850136 - RNA, 13 nt, Homo sapiens
acagcaaugcaga

SEQ ID NO: 1850137 - RNA, 16 nt, Homo sapiens
agcuaacuuauuuucc

SEQ ID NO: 1850138 - RNA, 19 nt, Homo sapiens
aucauuuuuauacaggaca

SEQ ID NO: 1850139 - RNA, 16 nt, Homo sapiens
cuacacacacacuccc

SEQ ID NO: 1850140 - RNA, 16 nt, Homo sapiens
cucaagcaaccaugaa

SEQ ID NO: 1850141 - RNA, 21 nt, Homo sapiens
agggaacccugcuugcacuuu

SEQ ID NO: 1850142 - RNA, 19 nt, Homo sapiens
cuaaguuauuuacuuuuac

SEQ ID NO: 1850143 - RNA, 12 nt, Homo sapiens
ugaggacaaugu

SEQ ID NO: 1850144 - RNA, 22 nt, Homo sapiens
ugacacuaaaacaagaggacac

SEQ ID NO: 1850145 - RNA, 14 nt, Homo sapiens
guuccuaacuggaa

SEQ ID NO: 1850146 - RNA, 19 nt, Homo sapiens
acuucaguuuaaugucucc

SEQ ID NO: 1850147 - RNA, 16 nt, Homo sapiens
auuaaccugccaggga

SEQ ID NO: 1850148 - RNA, 15 nt, Homo sapiens
uugucacacgauaaa

SEQ ID NO: 1850149 - RNA, 17 nt, Homo sapiens
cuuguggcuugggacau

SEQ ID NO: 1850150 - RNA, 19 nt, Homo sapiens
agccacugucacaggcaua

SEQ ID NO: 1850151 - RNA, 18 nt, Homo sapiens
gcugcagcgcuuguuaau

SEQ ID NO: 1850152 - RNA, 16 nt, Homo sapiens
cagcuccuugaccuau

SEQ ID NO: 1850153 - RNA, 21 nt, Homo sapiens
ucuguggccuuggcccugacc

SEQ ID NO: 1850154 - RNA, 12 nt, Homo sapiens
aaccaaugauuc

SEQ ID NO: 1850155 - RNA, 12 nt, Homo sapiens
cacuaaugcuuu

SEQ ID NO: 1850156 - RNA, 12 nt, Homo sapiens
gacaaacaugca

SEQ ID NO: 1850157 - RNA, 12 nt, Homo sapiens
ugggaacagagg

SEQ ID NO: 1850158 - RNA, 13 nt, Homo sapiens
ucugauuucauaa

SEQ ID NO: 1850159 - RNA, 21 nt, Homo sapiens
acugcugccaacuccauguca

SEQ ID NO: 1850160 - RNA, 17 nt, Homo sapiens
uauucuuggcuaaagga

SEQ ID NO: 1850161 - RNA, 15 nt, Homo sapiens
ugcuggcccacagcu

SEQ ID NO: 1850162 - RNA, 15 nt, Homo sapiens
ccaagggacacagga

SEQ ID NO: 1850163 - RNA, 18 nt, Homo sapiens
cacgugauuuccagugag

SEQ ID NO: 1850164 - RNA, 16 nt, Homo sapiens
ggcuggaguucagugg

SEQ ID NO: 1850165 - RNA, 18 nt, Homo sapiens
uaaaccuaauaaucugaa

SEQ ID NO: 1850166 - RNA, 17 nt, Homo sapiens
uuggccaggcuguucuc

SEQ ID NO: 1850167 - RNA, 18 nt, Homo sapiens
cgagacacaggcacgggu

SEQ ID NO: 1850168 - RNA, 22 nt, Homo sapiens
cugaaggcucguuuggcuuuau

SEQ ID NO: 1850169 - RNA, 19 nt, Homo sapiens
gccacagugucacugguca

SEQ ID NO: 1850170 - RNA, 22 nt, Homo sapiens
uuugcucaguggaucacacaca

SEQ ID NO: 1850171 - RNA, 16 nt, Homo sapiens
aauaauuuaacuaauu

SEQ ID NO: 1850172 - RNA, 20 nt, Homo sapiens
aauugucuuguaccuugagu

SEQ ID NO: 1850173 - RNA, 23 nt, Homo sapiens
aauuaauugggccagcuuuucaa

SEQ ID NO: 1850174 - RNA, 17 nt, Homo sapiens
acccaguuagcucucaa

SEQ ID NO: 1850175 - RNA, 15 nt, Homo sapiens
gucccgguaccuucc

SEQ ID NO: 1850176 - RNA, 14 nt, Homo sapiens
cuucacaauuucaa

SEQ ID NO: 1850177 - RNA, 18 nt, Homo sapiens
cuuccucucucaggggug

SEQ ID NO: 1850178 - RNA, 12 nt, Homo sapiens
ucacucuugcca

SEQ ID NO: 1850179 - RNA, 14 nt, Homo sapiens
aagggugucuuccu

SEQ ID NO: 1850180 - RNA, 15 nt, Homo sapiens
agcacagauuugcau

SEQ ID NO: 1850181 - RNA, 18 nt, Homo sapiens
uuucacgggcaacacuca

SEQ ID NO: 1850182 - RNA, 16 nt, Homo sapiens
accauggcagacucac

SEQ ID NO: 1850183 - RNA, 18 nt, Homo sapiens
aagguuauaguaacauca

SEQ ID NO: 1850184 - RNA, 23 nt, Homo sapiens
gccaggcugggucgcccuggacu

SEQ ID NO: 1850185 - RNA, 22 nt, Homo sapiens
ucacuggucaaaaccuacacag

SEQ ID NO: 1850186 - RNA, 14 nt, Homo sapiens
caaggcaagaucua

SEQ ID NO: 1850187 - RNA, 16 nt, Homo sapiens
ucagaaugcuauugaa

SEQ ID NO: 1850188 - RNA, 19 nt, Homo sapiens
uacuuuuguuguaugggau

SEQ ID NO: 1850189 - RNA, 12 nt, Homo sapiens
caguacugggag

SEQ ID NO: 1850190 - RNA, 15 nt, Homo sapiens
uucaagcuuguccag

SEQ ID NO: 1850191 - RNA, 19 nt, Homo sapiens
uuuauaggacgaaugccaa

SEQ ID NO: 1850192 - RNA, 16 nt, Homo sapiens
cagacaacacugggaa

SEQ ID NO: 1850193 - RNA, 14 nt, Homo sapiens
aaaccaaaccauua

SEQ ID NO: 1850194 - RNA, 22 nt, Homo sapiens
augcaugugaagaaaggguguu

SEQ ID NO: 1850195 - RNA, 19 nt, Homo sapiens
gcugacccagaguggaguc

SEQ ID NO: 1850196 - RNA, 21 nt, Homo sapiens
aaucaaguucuagcauuuuag

SEQ ID NO: 1850197 - RNA, 17 nt, Homo sapiens
ccacaugauuuuacuca

SEQ ID NO: 1850198 - RNA, 19 nt, Homo sapiens
ggcaacagagcaagaccca

SEQ ID NO: 1850199 - RNA, 13 nt, Homo sapiens
acagucauuuaaa

SEQ ID NO: 1850200 - RNA, 11 nt, Homo sapiens
ccuguuugcau

SEQ ID NO: 1850201 - RNA, 20 nt, Homo sapiens
ccggccagcgggcacagggc

SEQ ID NO: 1850202 - RNA, 19 nt, Homo sapiens
ggaggcucgaccaccucaa

SEQ ID NO: 1850203 - RNA, 17 nt, Homo sapiens
ucaucuguggagcugcc

SEQ ID NO: 1850204 - RNA, 19 nt, Homo sapiens
agaggaguucaaugaucua

SEQ ID NO: 1850205 - RNA, 20 nt, Homo sapiens
ucuucugaacucaaacugag

SEQ ID NO: 1850206 - RNA, 15 nt, Homo sapiens
acguugagcaucuau

SEQ ID NO: 1850207 - RNA, 19 nt, Homo sapiens
agaaagugcgaguccucca

SEQ ID NO: 1850208 - RNA, 18 nt, Homo sapiens
caacccccgacuucaucc

SEQ ID NO: 1850209 - RNA, 14 nt, Homo sapiens
aaccacuucccuca

SEQ ID NO: 1850210 - RNA, 16 nt, Homo sapiens
caagacccucucaggc

SEQ ID NO: 1850211 - RNA, 15 nt, Homo sapiens
cccucuuaucucauc

SEQ ID NO: 1850212 - RNA, 13 nt, Homo sapiens
caggccagugucu

SEQ ID NO: 1850213 - RNA, 17 nt, Homo sapiens
gagaauuauuccuuucc

SEQ ID NO: 1850214 - RNA, 18 nt, Homo sapiens
acaaaauuaaacuucaaa

SEQ ID NO: 1850215 - RNA, 16 nt, Homo sapiens
cuuuuccuuaccuuua

SEQ ID NO: 1850216 - RNA, 18 nt, Homo sapiens
gaacuguaaauaugucac

SEQ ID NO: 1850217 - RNA, 21 nt, Homo sapiens
ucguguaauuggcccaaguca

SEQ ID NO: 1850218 - RNA, 18 nt, Homo sapiens
uggcggaaccuggcugcg

SEQ ID NO: 1850219 - RNA, 19 nt, Homo sapiens
cauuuucaucuucuuccau

SEQ ID NO: 1850220 - RNA, 20 nt, Homo sapiens
aauguuuuaaucuccucuga

SEQ ID NO: 1850221 - RNA, 23 nt, Homo sapiens
uuucagaagugagcuuugcugcu

SEQ ID NO: 1850222 - RNA, 18 nt, Homo sapiens
gcaguggcuucuuuccag

SEQ ID NO: 1850223 - RNA, 19 nt, Homo sapiens
aaggaaagauuugugaacu

SEQ ID NO: 1850224 - RNA, 14 nt, Homo sapiens
uugaauacuuugaa

SEQ ID NO: 1850225 - RNA, 22 nt, Homo sapiens
ugcguccuggggccugugcacu

SEQ ID NO: 1850226 - RNA, 15 nt, Homo sapiens
aggagccggcugccu

SEQ ID NO: 1850227 - RNA, 22 nt, Homo sapiens
gcacucucgcacacacagugau

SEQ ID NO: 1850228 - RNA, 15 nt, Homo sapiens
ugaaaucucagaauu

SEQ ID NO: 1850229 - RNA, 19 nt, Homo sapiens
cugugcuugggagccugug

SEQ ID NO: 1850230 - RNA, 19 nt, Homo sapiens
cugaguuuggaugucugua

SEQ ID NO: 1850231 - RNA, 23 nt, Homo sapiens
ccaguuauugugaaaacagaaga

SEQ ID NO: 1850232 - RNA, 12 nt, Homo sapiens
augugaagacaa

SEQ ID NO: 1850233 - RNA, 23 nt, Homo sapiens
ccagggugggcagacagacagau

SEQ ID NO: 1850234 - RNA, 21 nt, Homo sapiens
uucugcugaauuuucacauga

SEQ ID NO: 1850235 - RNA, 15 nt, Homo sapiens
ccuucuccaccaaag

SEQ ID NO: 1850236 - RNA, 15 nt, Homo sapiens
agcaccuccccagac

SEQ ID NO: 1850237 - RNA, 21 nt, Homo sapiens
agcugaguaggaggccuccac

SEQ ID NO: 1850238 - RNA, 14 nt, Homo sapiens
aucaaaaaguauua

SEQ ID NO: 1850239 - RNA, 14 nt, Homo sapiens
uuugaagaccaguc

SEQ ID NO: 1850240 - RNA, 16 nt, Homo sapiens
ugugucccuccuggga

SEQ ID NO: 1850241 - RNA, 13 nt, Homo sapiens
ggacgaauuugca

SEQ ID NO: 1850242 - RNA, 20 nt, Homo sapiens
ucaggagguggagucccugg

SEQ ID NO: 1850243 - RNA, 11 nt, Homo sapiens
agugggccagg

SEQ ID NO: 1850244 - RNA, 17 nt, Homo sapiens
uucgucuguugugcgaa

SEQ ID NO: 1850245 - RNA, 15 nt, Homo sapiens
cucaaucuacaggcc

SEQ ID NO: 1850246 - RNA, 15 nt, Homo sapiens
uaacccccugcccac

SEQ ID NO: 1850247 - RNA, 13 nt, Homo sapiens
ggaugcugugccu

SEQ ID NO: 1850248 - RNA, 22 nt, Homo sapiens
gaaggaggcuuaggacuuucca

SEQ ID NO: 1850249 - RNA, 21 nt, Homo sapiens
cuggcccccucccuggaugac

SEQ ID NO: 1850250 - RNA, 14 nt, Homo sapiens
acaaucugaaacag

SEQ ID NO: 1850251 - RNA, 16 nt, Homo sapiens
aggcugucgccugcac

SEQ ID NO: 1850252 - RNA, 18 nt, Homo sapiens
gcuucccgcugcacaugg

SEQ ID NO: 1850253 - RNA, 22 nt, Homo sapiens
cuguccaaggcacaaaccuuac

SEQ ID NO: 1850254 - RNA, 15 nt, Homo sapiens
aucuguguacaaaga

SEQ ID NO: 1850255 - RNA, 22 nt, Homo sapiens
acaugaaaggacccugugagcc

SEQ ID NO: 1850256 - RNA, 21 nt, Homo sapiens
accacuuuccccgugggccau

SEQ ID NO: 1850257 - RNA, 16 nt, Homo sapiens
uugcaagacccaggga

SEQ ID NO: 1850258 - RNA, 20 nt, Homo sapiens
ccuucauuaaugaugaucuu

SEQ ID NO: 1850259 - RNA, 14 nt, Homo sapiens
aagggucacuuuaa

SEQ ID NO: 1850260 - RNA, 23 nt, Homo sapiens
guccucuggguaggaaucagcaa

SEQ ID NO: 1850261 - RNA, 15 nt, Homo sapiens
cuggauucacucacu

SEQ ID NO: 1850262 - RNA, 15 nt, Homo sapiens
cuuuguuaaauccaa

SEQ ID NO: 1850263 - RNA, 21 nt, Homo sapiens
aggaguuuuggcagccagacu

SEQ ID NO: 1850264 - RNA, 22 nt, Homo sapiens
cauugggaaauuuuucuuucua

SEQ ID NO: 1850265 - RNA, 17 nt, Homo sapiens
ucuuccuucauuguucu

SEQ ID NO: 1850266 - RNA, 19 nt, Homo sapiens
aaccgaguagaaaauguga

SEQ ID NO: 1850267 - RNA, 14 nt, Homo sapiens
guuauacacagcuu

SEQ ID NO: 1850268 - RNA, 10 nt, Homo sapiens
uaacaucccu

SEQ ID NO: 1850269 - RNA, 22 nt, Homo sapiens
cagacagucacaaauuucucug

SEQ ID NO: 1850270 - RNA, 19 nt, Homo sapiens
caaacaggaauuucuguua

SEQ ID NO: 1850271 - RNA, 22 nt, Homo sapiens
gagccagcugcuuuuugugauu

SEQ ID NO: 1850272 - RNA, 15 nt, Homo sapiens
cuugcugugacccaa

SEQ ID NO: 1850273 - RNA, 14 nt, Homo sapiens
gauggcccagcuga

SEQ ID NO: 1850274 - RNA, 19 nt, Homo sapiens
ccccacccuggagggccag

SEQ ID NO: 1850275 - RNA, 20 nt, Homo sapiens
uaguaaaugguaucauuugg

SEQ ID NO: 1850276 - RNA, 15 nt, Homo sapiens
gucuugcuuacugua

SEQ ID NO: 1850277 - RNA, 15 nt, Homo sapiens
uacagucugucauga

SEQ ID NO: 1850278 - RNA, 20 nt, Homo sapiens
gagcuuuacagcagaagcug

SEQ ID NO: 1850279 - RNA, 21 nt, Homo sapiens
acucacauauaacaugcaaac

SEQ ID NO: 1850280 - RNA, 14 nt, Homo sapiens
caaaaaaucugacc

SEQ ID NO: 1850281 - RNA, 20 nt, Homo sapiens
aaaaagauggcuuaugucau

SEQ ID NO: 1850282 - RNA, 22 nt, Homo sapiens
uccgagaugacccaaucugccu

SEQ ID NO: 1850283 - RNA, 21 nt, Homo sapiens
ugaaugacacgccuaagguca

SEQ ID NO: 1850284 - RNA, 16 nt, Homo sapiens
aaaacagccacugaau

SEQ ID NO: 1850285 - RNA, 13 nt, Homo sapiens
ucauauauacugu

SEQ ID NO: 1850286 - RNA, 14 nt, Homo sapiens
cagaccaucgcaca

SEQ ID NO: 1850287 - RNA, 14 nt, Homo sapiens
auugcauacuuugu

SEQ ID NO: 1850288 - RNA, 15 nt, Homo sapiens
ccacuggaaacuuag

SEQ ID NO: 1850289 - RNA, 17 nt, Homo sapiens
uccauaucccuuugcag

SEQ ID NO: 1850290 - RNA, 16 nt, Homo sapiens
aacaucaguucaugcc

SEQ ID NO: 1850291 - RNA, 12 nt, Homo sapiens
agcaaagacuuu

SEQ ID NO: 1850292 - RNA, 20 nt, Homo sapiens
uaacuauuuuaaauauccau

SEQ ID NO: 1850293 - RNA, 19 nt, Homo sapiens
ggugaucaauuaaauguag

SEQ ID NO: 1850294 - RNA, 15 nt, Homo sapiens
uuacuauaaugccuu

SEQ ID NO: 1850295 - RNA, 13 nt, Homo sapiens
cuacagacauuaa

SEQ ID NO: 1850296 - RNA, 19 nt, Homo sapiens
gcuaggaugguucugugac

SEQ ID NO: 1850297 - RNA, 13 nt, Homo sapiens
ccaaucuccauca

SEQ ID NO: 1850298 - RNA, 15 nt, Homo sapiens
agcagaagcacauuu

SEQ ID NO: 1850299 - RNA, 15 nt, Homo sapiens
aacguggcacuggua

SEQ ID NO: 1850300 - RNA, 21 nt, Homo sapiens
uucuggaaaaaaaauauauau

SEQ ID NO: 1850301 - RNA, 14 nt, Homo sapiens
accagagcaccuca

SEQ ID NO: 1850302 - RNA, 15 nt, Homo sapiens
agccaguacagagaa

SEQ ID NO: 1850303 - RNA, 22 nt, Homo sapiens
guaagcuucgugaggcccucac

SEQ ID NO: 1850304 - RNA, 22 nt, Homo sapiens
ucagcuugcuuagauguuccaa

SEQ ID NO: 1850305 - RNA, 15 nt, Homo sapiens
gacaaaucuguuguu

SEQ ID NO: 1850306 - RNA, 20 nt, Homo sapiens
gaagucaccccuuucugucc

SEQ ID NO: 1850307 - RNA, 14 nt, Homo sapiens
auagccugccucag

SEQ ID NO: 1850308 - RNA, 18 nt, Homo sapiens
uaaccuaauaucacuuaa

SEQ ID NO: 1850309 - RNA, 13 nt, Homo sapiens
uuuaucaugaagc

SEQ ID NO: 1850310 - RNA, 17 nt, Homo sapiens
auuccaaggccugugaa

SEQ ID NO: 1850311 - RNA, 16 nt, Homo sapiens
caucuguagugaccca

SEQ ID NO: 1850312 - RNA, 15 nt, Homo sapiens
uggccugacugguug

SEQ ID NO: 1850313 - RNA, 22 nt, Homo sapiens
ugaacggcaucaaggugcugaa

SEQ ID NO: 1850314 - RNA, 17 nt, Homo sapiens
gagcugaggacucucac

SEQ ID NO: 1850315 - RNA, 14 nt, Homo sapiens
cggacaagcagcug

SEQ ID NO: 1850316 - RNA, 16 nt, Homo sapiens
ugaaacagcagcugaa

SEQ ID NO: 1850317 - RNA, 19 nt, Homo sapiens
auuuuguaaaacaaugcca

SEQ ID NO: 1850318 - RNA, 21 nt, Homo sapiens
agagaaaaagcccucuucaau

SEQ ID NO: 1850319 - RNA, 14 nt, Homo sapiens
auucucgcuuaaaa

SEQ ID NO: 1850320 - RNA, 20 nt, Homo sapiens
ccucgccccaaaguugcuca

SEQ ID NO: 1850321 - RNA, 21 nt, Homo sapiens
gcaaaaacugcuuaaguggau

SEQ ID NO: 1850322 - RNA, 20 nt, Homo sapiens
uucagacaacauuaugaucu

SEQ ID NO: 1850323 - RNA, 15 nt, Homo sapiens
aaagggaaggcuucc

SEQ ID NO: 1850324 - RNA, 13 nt, Homo sapiens
ugcuggggaacaa

SEQ ID NO: 1850325 - RNA, 14 nt, Homo sapiens
agagguuugucaac

SEQ ID NO: 1850326 - RNA, 20 nt, Homo sapiens
acgccuggcuuccagcagag

SEQ ID NO: 1850327 - RNA, 14 nt, Homo sapiens
auuccccagugacu

SEQ ID NO: 1850328 - RNA, 21 nt, Homo sapiens
uagugcuucacaaaaugcacu

SEQ ID NO: 1850329 - RNA, 18 nt, Homo sapiens
gaaaaggccuucuuccca

SEQ ID NO: 1850330 - RNA, 18 nt, Homo sapiens
uaagagguuuauuugggu

SEQ ID NO: 1850331 - RNA, 16 nt, Homo sapiens
aggcggcagugcaaca

SEQ ID NO: 1850332 - RNA, 18 nt, Homo sapiens
cagccccggcaagccaca

SEQ ID NO: 1850333 - RNA, 13 nt, Homo sapiens
agcagaaugccuu

SEQ ID NO: 1850334 - RNA, 21 nt, Homo sapiens
uguauguaaauagcuaagaua

SEQ ID NO: 1850335 - RNA, 23 nt, Homo sapiens
ccccccagcuaauacccagagca

SEQ ID NO: 1850336 - RNA, 20 nt, Homo sapiens
uacuugggaggcugaggcag

SEQ ID NO: 1850337 - RNA, 22 nt, Homo sapiens
uuugagaccaaaucuugcucug

SEQ ID NO: 1850338 - RNA, 13 nt, Homo sapiens
ccuggacagggcu

SEQ ID NO: 1850339 - RNA, 19 nt, Homo sapiens
uucuucccagaaucucuga

SEQ ID NO: 1850340 - RNA, 17 nt, Homo sapiens
ccuggacgcagccacac

SEQ ID NO: 1850341 - RNA, 12 nt, Homo sapiens
ucggauaugauu

SEQ ID NO: 1850342 - RNA, 19 nt, Homo sapiens
cccagccgggguggggugc

SEQ ID NO: 1850343 - RNA, 19 nt, Homo sapiens
uuggacagaagcagcucuu

SEQ ID NO: 1850344 - RNA, 11 nt, Homo sapiens
cggaagccaaa

SEQ ID NO: 1850345 - RNA, 17 nt, Homo sapiens
agcucugugggagacca

SEQ ID NO: 1850346 - RNA, 20 nt, Homo sapiens
gcugguucugcaaugacugc

SEQ ID NO: 1850347 - RNA, 20 nt, Homo sapiens
gcucguuuacacugcacauu

SEQ ID NO: 1850348 - RNA, 16 nt, Homo sapiens
uccuuuugaccaaaua

SEQ ID NO: 1850349 - RNA, 15 nt, Homo sapiens
agacuccggccugua

SEQ ID NO: 1850350 - RNA, 19 nt, Homo sapiens
aguuugauaugggcuuucu

SEQ ID NO: 1850351 - RNA, 16 nt, Homo sapiens
uuaagaagucuauaau

SEQ ID NO: 1850352 - RNA, 17 nt, Homo sapiens
gaauguuuucaaaacca

SEQ ID NO: 1850353 - RNA, 14 nt, Homo sapiens
cucucagcugacca

SEQ ID NO: 1850354 - RNA, 15 nt, Homo sapiens
agacaugaaauugag

SEQ ID NO: 1850355 - RNA, 23 nt, Homo sapiens
accuggcuugcagggaagcaucu

SEQ ID NO: 1850356 - RNA, 18 nt, Homo sapiens
gguuucuauuuucucuga

SEQ ID NO: 1850357 - RNA, 18 nt, Homo sapiens
ccagaggcucagcacuuu

SEQ ID NO: 1850358 - RNA, 14 nt, Homo sapiens
cuacucugcucaca

SEQ ID NO: 1850359 - RNA, 16 nt, Homo sapiens
acacaugcccaugaug

SEQ ID NO: 1850360 - RNA, 17 nt, Homo sapiens
uaauacauuaauacuuc

SEQ ID NO: 1850361 - RNA, 20 nt, Homo sapiens
aucaaguuccaguaacccaa

SEQ ID NO: 1850362 - RNA, 21 nt, Homo sapiens
gcucuucuguggaccacugca

SEQ ID NO: 1850363 - RNA, 23 nt, Homo sapiens
ccaggcugcuggagugcaguggc

SEQ ID NO: 1850364 - RNA, 16 nt, Homo sapiens
gcaauauaaccaaugu

SEQ ID NO: 1850365 - RNA, 18 nt, Homo sapiens
uugcaucauaguuugcuu

SEQ ID NO: 1850366 - RNA, 15 nt, Homo sapiens
aauccuaacauucag

SEQ ID NO: 1850367 - RNA, 15 nt, Homo sapiens
auuccagacuuucua

SEQ ID NO: 1850368 - RNA, 20 nt, Homo sapiens
uguucaguguugacauagcc

SEQ ID NO: 1850369 - RNA, 22 nt, Homo sapiens
auuagauuuggaggcuaccuca

SEQ ID NO: 1850370 - RNA, 17 nt, Homo sapiens
gcucagcacacaugcau

SEQ ID NO: 1850371 - RNA, 21 nt, Homo sapiens
acucucucuuaucaccccuuc

SEQ ID NO: 1850372 - RNA, 19 nt, Homo sapiens
uaaauugauaacauggaaa

SEQ ID NO: 1850373 - RNA, 18 nt, Homo sapiens
aaagcccaccauuuggca

SEQ ID NO: 1850374 - RNA, 13 nt, Homo sapiens
aauuaaugcucua

SEQ ID NO: 1850375 - RNA, 14 nt, Homo sapiens
gagcaaaggcucac

SEQ ID NO: 1850376 - RNA, 23 nt, Homo sapiens
ugugaauagccuggccaccagcc

SEQ ID NO: 1850377 - RNA, 13 nt, Homo sapiens
auauggacucagc

SEQ ID NO: 1850378 - RNA, 13 nt, Homo sapiens
accauuaccuuaa

SEQ ID NO: 1850379 - RNA, 18 nt, Homo sapiens
cagucccgucgugcaguc

SEQ ID NO: 1850380 - RNA, 23 nt, Homo sapiens
cagagaagcuccugcuacuuccc

SEQ ID NO: 1850381 - RNA, 18 nt, Homo sapiens
cauguaugcaaaccucau

SEQ ID NO: 1850382 - RNA, 12 nt, Homo sapiens
aagucacccagc

SEQ ID NO: 1850383 - RNA, 19 nt, Homo sapiens
auaagagaaucaacauuuc

SEQ ID NO: 1850384 - RNA, 17 nt, Homo sapiens
auuuuaaacauauccaa

SEQ ID NO: 1850385 - RNA, 23 nt, Homo sapiens
ugagcucugcucucagcagauuu

SEQ ID NO: 1850386 - RNA, 17 nt, Homo sapiens
ggaaauaauaacagaca

SEQ ID NO: 1850387 - RNA, 22 nt, Homo sapiens
uguagcgccaguguaauccccc

SEQ ID NO: 1850388 - RNA, 15 nt, Homo sapiens
gaucuccagcucuaa

SEQ ID NO: 1850389 - RNA, 13 nt, Homo sapiens
uaaggaaagccaa

SEQ ID NO: 1850390 - RNA, 15 nt, Homo sapiens
uuaauucaacuuaac

SEQ ID NO: 1850391 - RNA, 15 nt, Homo sapiens
ucuaaaguuacuacu

SEQ ID NO: 1850392 - RNA, 22 nt, Homo sapiens
uuccugaugccccugacaucau

SEQ ID NO: 1850393 - RNA, 18 nt, Homo sapiens
cugcagagagaagccugu

SEQ ID NO: 1850394 - RNA, 17 nt, Homo sapiens
caggagaaaaugcaauu

SEQ ID NO: 1850395 - RNA, 16 nt, Homo sapiens
uguuucauuuaccucu

SEQ ID NO: 1850396 - RNA, 13 nt, Homo sapiens
uuauuuuaauaca

SEQ ID NO: 1850397 - RNA, 18 nt, Homo sapiens
cuguaauccuagcacuuu

SEQ ID NO: 1850398 - RNA, 13 nt, Homo sapiens
ugaaauagcuuua

SEQ ID NO: 1850399 - RNA, 12 nt, Homo sapiens
aggccaucuuuu

SEQ ID NO: 1850400 - RNA, 12 nt, Homo sapiens
auggagaagcuc

SEQ ID NO: 1850401 - RNA, 20 nt, Homo sapiens
cuggagauaugaaggauuac

SEQ ID NO: 1850402 - RNA, 10 nt, Homo sapiens
aaaugagcuc

SEQ ID NO: 1850403 - RNA, 15 nt, Homo sapiens
guaucucucacuauu

SEQ ID NO: 1850404 - RNA, 20 nt, Homo sapiens
augucccugaagucuugcau

SEQ ID NO: 1850405 - RNA, 23 nt, Homo sapiens
acuaaggaaccaacaaucuuccu

SEQ ID NO: 1850406 - RNA, 17 nt, Homo sapiens
ccuuagagcaucucugc

SEQ ID NO: 1850407 - RNA, 15 nt, Homo sapiens
augaaagucaaauuu

SEQ ID NO: 1850408 - RNA, 19 nt, Homo sapiens
uucuuacauaugauccagu

SEQ ID NO: 1850409 - RNA, 21 nt, Homo sapiens
auagaacugaaugagaaccaa

SEQ ID NO: 1850410 - RNA, 14 nt, Homo sapiens
uucaacuccagaag

SEQ ID NO: 1850411 - RNA, 21 nt, Homo sapiens
gccaaaugacuuugcaccugc

SEQ ID NO: 1850412 - RNA, 12 nt, Homo sapiens
cacccuaccuuc

SEQ ID NO: 1850413 - RNA, 15 nt, Homo sapiens
auuacauuugaacua

SEQ ID NO: 1850414 - RNA, 18 nt, Homo sapiens
cuuuuuaaacaguguuua

SEQ ID NO: 1850415 - RNA, 12 nt, Homo sapiens
ucuaaacuauca

SEQ ID NO: 1850416 - RNA, 12 nt, Homo sapiens
acuaaacuuuca

SEQ ID NO: 1850417 - RNA, 14 nt, Homo sapiens
aggccaucuuccag

SEQ ID NO: 1850418 - RNA, 14 nt, Homo sapiens
ucuccucuuugaac

SEQ ID NO: 1850419 - RNA, 20 nt, Homo sapiens
ggcagagggaugaaaugcca

SEQ ID NO: 1850420 - RNA, 20 nt, Homo sapiens
ccucugccucccaggcucaa

SEQ ID NO: 1850421 - RNA, 14 nt, Homo sapiens
ugcugcccaggaac

SEQ ID NO: 1850422 - RNA, 15 nt, Homo sapiens
ccggggcagcccugc

SEQ ID NO: 1850423 - RNA, 23 nt, Homo sapiens
agauuucccacauucccaugaau

SEQ ID NO: 1850424 - RNA, 18 nt, Homo sapiens
cagguaacagguguguau

SEQ ID NO: 1850425 - RNA, 18 nt, Homo sapiens
gccaggcguuggugccac

SEQ ID NO: 1850426 - RNA, 22 nt, Homo sapiens
ccuugccuaaauuuaaugcugc

SEQ ID NO: 1850427 - RNA, 21 nt, Homo sapiens
ugcacaucuguaaaucuacac

SEQ ID NO: 1850428 - RNA, 16 nt, Homo sapiens
ccucauggucauggac

SEQ ID NO: 1850429 - RNA, 22 nt, Homo sapiens
aauacaauccgagcuacaaagc

SEQ ID NO: 1850430 - RNA, 16 nt, Homo sapiens
aggcaaggucuggccu

SEQ ID NO: 1850431 - RNA, 14 nt, Homo sapiens
auuucuguucuucc

SEQ ID NO: 1850432 - RNA, 14 nt, Homo sapiens
gauucucugugguu

SEQ ID NO: 1850433 - RNA, 16 nt, Homo sapiens
agagauaaacuacaua

SEQ ID NO: 1850434 - RNA, 12 nt, Homo sapiens
cuacacacaaac

SEQ ID NO: 1850435 - RNA, 21 nt, Homo sapiens
ccaucauuacugguaaagccu

SEQ ID NO: 1850436 - RNA, 16 nt, Homo sapiens
cuuugaggaacauuca

SEQ ID NO: 1850437 - RNA, 21 nt, Homo sapiens
uugcaaauuauucuagucaac

SEQ ID NO: 1850438 - RNA, 17 nt, Homo sapiens
agggcccagcuguagcc

SEQ ID NO: 1850439 - RNA, 18 nt, Homo sapiens
aucagacgggcacagugg

SEQ ID NO: 1850440 - RNA, 14 nt, Homo sapiens
auggugcgaucuca

SEQ ID NO: 1850441 - RNA, 21 nt, Homo sapiens
cccaguaauuauuuucuuccu

SEQ ID NO: 1850442 - RNA, 23 nt, Homo sapiens
uggccuguguguuacaaugauau

SEQ ID NO: 1850443 - RNA, 16 nt, Homo sapiens
cugccuguaacagcca

SEQ ID NO: 1850444 - RNA, 13 nt, Homo sapiens
aaguucaagagaa

SEQ ID NO: 1850445 - RNA, 14 nt, Homo sapiens
guugcugacuuaga

SEQ ID NO: 1850446 - RNA, 21 nt, Homo sapiens
ccugccagguuuaaacaucac

SEQ ID NO: 1850447 - RNA, 15 nt, Homo sapiens
guggaacucagucau

SEQ ID NO: 1850448 - RNA, 20 nt, Homo sapiens
ucgauggaugggaugcacuc

SEQ ID NO: 1850449 - RNA, 20 nt, Homo sapiens
caacuaagaaaaaaagcaca

SEQ ID NO: 1850450 - RNA, 21 nt, Homo sapiens
gcaggguauugcgaaacaacu

SEQ ID NO: 1850451 - RNA, 13 nt, Homo sapiens
uggcaaaugcacu

SEQ ID NO: 1850452 - RNA, 13 nt, Homo sapiens
uggaaaaugcaau

SEQ ID NO: 1850453 - RNA, 13 nt, Homo sapiens
uggcugugacaau

SEQ ID NO: 1850454 - RNA, 17 nt, Homo sapiens
guucagagaaccagggu

SEQ ID NO: 1850455 - RNA, 21 nt, Homo sapiens
gaugaagaccaggacuacagc

SEQ ID NO: 1850456 - RNA, 13 nt, Homo sapiens
gguggugcuaaag

SEQ ID NO: 1850457 - RNA, 20 nt, Homo sapiens
ugcccaggcuggagugcagu

SEQ ID NO: 1850458 - RNA, 20 nt, Homo sapiens
ugcccaggcuagagugcaau

SEQ ID NO: 1850459 - RNA, 13 nt, Homo sapiens
acgacaacgauga

SEQ ID NO: 1850460 - RNA, 15 nt, Homo sapiens
cuaguaugcccugua

SEQ ID NO: 1850461 - RNA, 19 nt, Homo sapiens
uccccaccccuuccaauga

SEQ ID NO: 1850462 - RNA, 20 nt, Homo sapiens
uaaaaauucauaaccaaaga

SEQ ID NO: 1850463 - RNA, 22 nt, Homo sapiens
aaucugaaaauagcaacccaga

SEQ ID NO: 1850464 - RNA, 17 nt, Homo sapiens
aauuauagaaucuacuu

SEQ ID NO: 1850465 - RNA, 21 nt, Homo sapiens
aucacuuacagaaccaauuca

SEQ ID NO: 1850466 - RNA, 13 nt, Homo sapiens
cuaauucuuuaau

SEQ ID NO: 1850467 - RNA, 18 nt, Homo sapiens
cuuucucugagaaccaaa

SEQ ID NO: 1850468 - RNA, 16 nt, Homo sapiens
uccuccaacaccaagc

SEQ ID NO: 1850469 - RNA, 13 nt, Homo sapiens
augugcugucacg

SEQ ID NO: 1850470 - RNA, 12 nt, Homo sapiens
cauuuaugcaca

SEQ ID NO: 1850471 - RNA, 22 nt, Homo sapiens
augucuauaaucccagcacuuu

SEQ ID NO: 1850472 - RNA, 19 nt, Homo sapiens
aaaacgcacaagccagacc

SEQ ID NO: 1850473 - RNA, 15 nt, Homo sapiens
ccuguauuugagaga

SEQ ID NO: 1850474 - RNA, 22 nt, Homo sapiens
gaaaaugcuaaagaauccauaa

SEQ ID NO: 1850475 - RNA, 15 nt, Homo sapiens
cuugggcaauaaagg

SEQ ID NO: 1850476 - RNA, 19 nt, Homo sapiens
uugaacuucuuuaguauua

SEQ ID NO: 1850477 - RNA, 14 nt, Homo sapiens
cuuugacaguguuu

SEQ ID NO: 1850478 - RNA, 17 nt, Homo sapiens
gcugggagaaaagccag

SEQ ID NO: 1850479 - RNA, 17 nt, Homo sapiens
cacuugcauguacagag

SEQ ID NO: 1850480 - RNA, 23 nt, Homo sapiens
caugaacaucuuuaggagacuaa

SEQ ID NO: 1850481 - RNA, 18 nt, Homo sapiens
auuuuggaaaaugauuag

SEQ ID NO: 1850482 - RNA, 15 nt, Homo sapiens
uaguacaugcucugu

SEQ ID NO: 1850483 - RNA, 16 nt, Homo sapiens
gugaugcuaaaaccug

SEQ ID NO: 1850484 - RNA, 14 nt, Homo sapiens
cuucauacacauga

SEQ ID NO: 1850485 - RNA, 18 nt, Homo sapiens
cuguauaaguaacacuag

SEQ ID NO: 1850486 - RNA, 16 nt, Homo sapiens
aaaugauaaguacuac

SEQ ID NO: 1850487 - RNA, 16 nt, Homo sapiens
gcuggacugaggacca

SEQ ID NO: 1850488 - RNA, 15 nt, Homo sapiens
agaagccagagggug

SEQ ID NO: 1850489 - RNA, 14 nt, Homo sapiens
uucuaaaggacaua

SEQ ID NO: 1850490 - RNA, 17 nt, Homo sapiens
aucauacuuaacuuuac

SEQ ID NO: 1850491 - RNA, 22 nt, Homo sapiens
uguauuuuaaagggacaguuug

SEQ ID NO: 1850492 - RNA, 15 nt, Homo sapiens
cugguuuucugccaa

SEQ ID NO: 1850493 - RNA, 21 nt, Homo sapiens
cauuuugcuugcgugcuggga

SEQ ID NO: 1850494 - RNA, 15 nt, Homo sapiens
acauuagucauucaa

SEQ ID NO: 1850495 - RNA, 14 nt, Homo sapiens
cucuuuuagcugau

SEQ ID NO: 1850496 - RNA, 19 nt, Homo sapiens
ucagacagcaggaagccau

SEQ ID NO: 1850497 - RNA, 19 nt, Homo sapiens
ugcagauuuuggccaugaa

SEQ ID NO: 1850498 - RNA, 19 nt, Homo sapiens
gagagaccagcagcccaag

SEQ ID NO: 1850499 - RNA, 21 nt, Homo sapiens
cuuauuucacuaaauguaaaa

SEQ ID NO: 1850500 - RNA, 20 nt, Homo sapiens
auauuccucuaaaacucuca

SEQ ID NO: 1850501 - RNA, 15 nt, Homo sapiens
ugaauuaaacuuaag

SEQ ID NO: 1850502 - RNA, 22 nt, Homo sapiens
gggcuuccucaaauacaugcac

SEQ ID NO: 1850503 - RNA, 19 nt, Homo sapiens
uguaaucccagcacuaugg

SEQ ID NO: 1850504 - RNA, 19 nt, Homo sapiens
auaaauacuuuaacuucca

SEQ ID NO: 1850505 - RNA, 19 nt, Homo sapiens
gguugggacccaguggcag

SEQ ID NO: 1850506 - RNA, 13 nt, Homo sapiens
gagccuaccuuca

SEQ ID NO: 1850507 - RNA, 23 nt, Homo sapiens
auaguacagguaaggugagggaa

SEQ ID NO: 1850508 - RNA, 17 nt, Homo sapiens
ggacuucuggcagggaa

SEQ ID NO: 1850509 - RNA, 21 nt, Homo sapiens
agagaaaguuggugcugcuca

SEQ ID NO: 1850510 - RNA, 19 nt, Homo sapiens
cauuuaauacccugcaaug

SEQ ID NO: 1850511 - RNA, 15 nt, Homo sapiens
acccgggagcagugu

SEQ ID NO: 1850512 - RNA, 18 nt, Homo sapiens
auucuuacaaaacauuuu

SEQ ID NO: 1850513 - RNA, 19 nt, Homo sapiens
guucaaguccgacaacacc

SEQ ID NO: 1850514 - RNA, 18 nt, Homo sapiens
uaagaaaagccagucaaa

SEQ ID NO: 1850515 - RNA, 15 nt, Homo sapiens
cugaaccuuccaucu

SEQ ID NO: 1850516 - RNA, 18 nt, Homo sapiens
gaccuuaggccuuccucu

SEQ ID NO: 1850517 - RNA, 18 nt, Homo sapiens
ucaaauguucuccaguca

SEQ ID NO: 1850518 - RNA, 18 nt, Homo sapiens
acauccagcagauuucca

SEQ ID NO: 1850519 - RNA, 15 nt, Homo sapiens
uuccaaaacauuucu

SEQ ID NO: 1850520 - RNA, 21 nt, Homo sapiens
gacaaauugagacagugcaca

SEQ ID NO: 1850521 - RNA, 17 nt, Homo sapiens
gcccgaucuccacuguu

SEQ ID NO: 1850522 - RNA, 19 nt, Homo sapiens
uuacaagaggauuguaaaa

SEQ ID NO: 1850523 - RNA, 18 nt, Homo sapiens
ucuaccugcccucucuca

SEQ ID NO: 1850524 - RNA, 14 nt, Homo sapiens
aguauacaaaaaga

SEQ ID NO: 1850525 - RNA, 21 nt, Homo sapiens
caugcagucuuguacugugac

SEQ ID NO: 1850526 - RNA, 15 nt, Homo sapiens
caggaaggggcgggg

SEQ ID NO: 1850527 - RNA, 17 nt, Homo sapiens
aaacacaccgaugcaca

SEQ ID NO: 1850528 - RNA, 16 nt, Homo sapiens
aucaguguaccauuug

SEQ ID NO: 1850529 - RNA, 22 nt, Homo sapiens
uucugugaaaaaccugaugcag

SEQ ID NO: 1850530 - RNA, 22 nt, Homo sapiens
cucuggcuuugccuuggcuuug

SEQ ID NO: 1850531 - RNA, 16 nt, Homo sapiens
auaaauggugucauaa

SEQ ID NO: 1850532 - RNA, 15 nt, Homo sapiens
auggaugaucuggga

SEQ ID NO: 1850533 - RNA, 21 nt, Homo sapiens
uuagugucaacuuuuaacuuu

SEQ ID NO: 1850534 - RNA, 23 nt, Homo sapiens
guguuccuccuccccucuccuag

SEQ ID NO: 1850535 - RNA, 19 nt, Homo sapiens
ugagagaacagggcugaag

SEQ ID NO: 1850536 - RNA, 13 nt, Homo sapiens
accacugagcccu

SEQ ID NO: 1850537 - RNA, 23 nt, Homo sapiens
cugccaguuucuccauccagcuc

SEQ ID NO: 1850538 - RNA, 19 nt, Homo sapiens
gauagaggaugggcagcug

SEQ ID NO: 1850539 - RNA, 20 nt, Homo sapiens
aaaauaccauuuaucuacua

SEQ ID NO: 1850540 - RNA, 18 nt, Homo sapiens
augcaugcgcaggcucau

SEQ ID NO: 1850541 - RNA, 18 nt, Homo sapiens
ucaacuugcaauuugcaa

SEQ ID NO: 1850542 - RNA, 16 nt, Homo sapiens
gaggaacugguccagg

SEQ ID NO: 1850543 - RNA, 17 nt, Homo sapiens
uaaacauucuugcugcu

SEQ ID NO: 1850544 - RNA, 12 nt, Homo sapiens
gcuccucaucca

SEQ ID NO: 1850545 - RNA, 19 nt, Homo sapiens
cagguuuggggaugaguca

SEQ ID NO: 1850546 - RNA, 16 nt, Homo sapiens
cagccuacaaagagau

SEQ ID NO: 1850547 - RNA, 15 nt, Homo sapiens
cuuggaaucaugcaa

SEQ ID NO: 1850548 - RNA, 16 nt, Homo sapiens
aauuaagauuauguga

SEQ ID NO: 1850549 - RNA, 16 nt, Homo sapiens
aaugaucauuaggaca

SEQ ID NO: 1850550 - RNA, 22 nt, Homo sapiens
aaaagguuaaacccacagccaa

SEQ ID NO: 1850551 - RNA, 14 nt, Homo sapiens
gcaaagugcccaug

SEQ ID NO: 1850552 - RNA, 20 nt, Homo sapiens
cugagauacugaagugcagc

SEQ ID NO: 1850553 - RNA, 20 nt, Homo sapiens
uacucacacuaugugcaaaa

SEQ ID NO: 1850554 - RNA, 19 nt, Homo sapiens
cagcagacguggugugaga

SEQ ID NO: 1850555 - RNA, 17 nt, Homo sapiens
ugagauaacauuuccaa

SEQ ID NO: 1850556 - RNA, 14 nt, Homo sapiens
cacuauuuacauac

SEQ ID NO: 1850557 - RNA, 20 nt, Homo sapiens
uguaacaugacacauuugaa

SEQ ID NO: 1850558 - RNA, 14 nt, Homo sapiens
uuugaacucaggga

SEQ ID NO: 1850559 - RNA, 18 nt, Homo sapiens
caccguggccuaccuggg

SEQ ID NO: 1850560 - RNA, 13 nt, Homo sapiens
guucacuucaucu

SEQ ID NO: 1850561 - RNA, 19 nt, Homo sapiens
caugugacuccugaaggga

SEQ ID NO: 1850562 - RNA, 22 nt, Homo sapiens
aaagaacguggucagaguagaa

SEQ ID NO: 1850563 - RNA, 23 nt, Homo sapiens
auuccauuuugugaauugugaca

SEQ ID NO: 1850564 - RNA, 21 nt, Homo sapiens
ucuggaggacacacagucuca

SEQ ID NO: 1850565 - RNA, 14 nt, Homo sapiens
uuugguuuuggaca

SEQ ID NO: 1850566 - RNA, 16 nt, Homo sapiens
gcacagaccucuccca

SEQ ID NO: 1850567 - RNA, 23 nt, Homo sapiens
gccccgaaccucaccugaccuca

SEQ ID NO: 1850568 - RNA, 20 nt, Homo sapiens
auaacaaaauggacauggug

SEQ ID NO: 1850569 - RNA, 15 nt, Homo sapiens
uaugaaacugcacau

SEQ ID NO: 1850570 - RNA, 20 nt, Homo sapiens
ucuacaaucucccuucacaa

SEQ ID NO: 1850571 - RNA, 21 nt, Homo sapiens
aauugauucuuagacauugca

SEQ ID NO: 1850572 - RNA, 19 nt, Homo sapiens
ugggaucgcaccuuuuaua

SEQ ID NO: 1850573 - RNA, 13 nt, Homo sapiens
guuuugucuuucc

SEQ ID NO: 1850574 - RNA, 16 nt, Homo sapiens
ucaucuuuagagcaac

SEQ ID NO: 1850575 - RNA, 23 nt, Homo sapiens
gggauaaagagagagaaggacug

SEQ ID NO: 1850576 - RNA, 17 nt, Homo sapiens
guauauaguaugaaugc

SEQ ID NO: 1850577 - RNA, 22 nt, Homo sapiens
aucucggcucacugaaaccucu

SEQ ID NO: 1850578 - RNA, 14 nt, Homo sapiens
cauuucucuuucaa

SEQ ID NO: 1850579 - RNA, 17 nt, Homo sapiens
cuuucccccacuuuucu

SEQ ID NO: 1850580 - RNA, 14 nt, Homo sapiens
cuauaguauuugau

SEQ ID NO: 1850581 - RNA, 19 nt, Homo sapiens
acugauucaagaacaagca

SEQ ID NO: 1850582 - RNA, 18 nt, Homo sapiens
uaggaugagguuucuuca

SEQ ID NO: 1850583 - RNA, 18 nt, Homo sapiens
caaacuuuguuugucaca

SEQ ID NO: 1850584 - RNA, 18 nt, Homo sapiens
acugauagggauacaugc

SEQ ID NO: 1850585 - RNA, 16 nt, Homo sapiens
uggaaagacugauugu

SEQ ID NO: 1850586 - RNA, 23 nt, Homo sapiens
aagauguaugcuuugaaugcaaa

SEQ ID NO: 1850587 - RNA, 18 nt, Homo sapiens
cauauuguacccccucau

SEQ ID NO: 1850588 - RNA, 14 nt, Homo sapiens
gagugguugcuaua

SEQ ID NO: 1850589 - RNA, 14 nt, Homo sapiens
aagagguuacuuua

SEQ ID NO: 1850590 - RNA, 13 nt, Homo sapiens
acaucagcaucac

SEQ ID NO: 1850591 - RNA, 16 nt, Homo sapiens
ugacccuaugaccaaa

SEQ ID NO: 1850592 - RNA, 17 nt, Homo sapiens
acaaaugcaucuuugau

SEQ ID NO: 1850593 - RNA, 20 nt, Homo sapiens
ccuugagcuaagcagaauaa

SEQ ID NO: 1850594 - RNA, 16 nt, Homo sapiens
gugaugaacgugccug

SEQ ID NO: 1850595 - RNA, 22 nt, Homo sapiens
acuuauauggaaauucugcuca

SEQ ID NO: 1850596 - RNA, 17 nt, Homo sapiens
uccauuuuauacaagaa

SEQ ID NO: 1850597 - RNA, 16 nt, Homo sapiens
uugcauugucuaauga

SEQ ID NO: 1850598 - RNA, 19 nt, Homo sapiens
caaaaacuacauuuugcaa

SEQ ID NO: 1850599 - RNA, 22 nt, Homo sapiens
auaucuuuuguaagacauuucc

SEQ ID NO: 1850600 - RNA, 13 nt, Homo sapiens
aacggagucucac

SEQ ID NO: 1850601 - RNA, 18 nt, Homo sapiens
gcuuaaaacaacacucac

SEQ ID NO: 1850602 - RNA, 15 nt, Homo sapiens
aauggcacuguugca

SEQ ID NO: 1850603 - RNA, 17 nt, Homo sapiens
accaguacguacauauu

SEQ ID NO: 1850604 - RNA, 21 nt, Homo sapiens
ggcuaauggaguguuugaaaa

SEQ ID NO: 1850605 - RNA, 20 nt, Homo sapiens
aaacaagaaaccaagugggc

SEQ ID NO: 1850606 - RNA, 18 nt, Homo sapiens
ucuuugagggacugccuc

SEQ ID NO: 1850607 - RNA, 13 nt, Homo sapiens
ccgaaugugcagg

SEQ ID NO: 1850608 - RNA, 22 nt, Homo sapiens
guaaguauuuagaagugugaau

SEQ ID NO: 1850609 - RNA, 23 nt, Homo sapiens
ucuguguguguguaugugggggu

SEQ ID NO: 1850610 - RNA, 13 nt, Homo sapiens
aagaugaaagcuu

SEQ ID NO: 1850611 - RNA, 14 nt, Homo sapiens
uccacgauggugga

SEQ ID NO: 1850612 - RNA, 19 nt, Homo sapiens
uuaggacuuuuauugugaa

SEQ ID NO: 1850613 - RNA, 12 nt, Homo sapiens
gagaggcugugu

SEQ ID NO: 1850614 - RNA, 18 nt, Homo sapiens
uacauuggcacaauguau

SEQ ID NO: 1850615 - RNA, 23 nt, Homo sapiens
agugcauuugccuugucaccugu

SEQ ID NO: 1850616 - RNA, 17 nt, Homo sapiens
ggaagaaaaugguuuau

SEQ ID NO: 1850617 - RNA, 16 nt, Homo sapiens
cugcugaaugcauuca

SEQ ID NO: 1850618 - RNA, 16 nt, Homo sapiens
agaugggugggaggag

SEQ ID NO: 1850619 - RNA, 19 nt, Homo sapiens
uuuaggaaaugggcaguga

SEQ ID NO: 1850620 - RNA, 20 nt, Homo sapiens
cauuaccuguucuugccuaa

SEQ ID NO: 1850621 - RNA, 12 nt, Homo sapiens
ucagcuggaaaa

SEQ ID NO: 1850622 - RNA, 21 nt, Homo sapiens
ucggcgccagcagcuccaaaa

SEQ ID NO: 1850623 - RNA, 22 nt, Homo sapiens
aauuccuguauucuacagcaga

SEQ ID NO: 1850624 - RNA, 17 nt, Homo sapiens
aauagacauacagagau

SEQ ID NO: 1850625 - RNA, 24 nt, Homo sapiens
ccacaugacuuauuaugcauaaag

SEQ ID NO: 1850626 - RNA, 15 nt, Homo sapiens
ccucuagaacagcca

SEQ ID NO: 1850627 - RNA, 20 nt, Homo sapiens
cagagaagggaaagcagucu

SEQ ID NO: 1850628 - RNA, 19 nt, Homo sapiens
ggagcagcaucauucagca

SEQ ID NO: 1850629 - RNA, 18 nt, Homo sapiens
acugcugaauuaauguga

SEQ ID NO: 1850630 - RNA, 21 nt, Homo sapiens
caagauagagagccgacucca

SEQ ID NO: 1850631 - RNA, 13 nt, Homo sapiens
aaugaugaucuuc

SEQ ID NO: 1850632 - RNA, 20 nt, Homo sapiens
cugggaaaugagcagggaug

SEQ ID NO: 1850633 - RNA, 22 nt, Homo sapiens
gaugcaguuucaaguaccaaaa

SEQ ID NO: 1850634 - RNA, 15 nt, Homo sapiens
guaaggcagugcagu

SEQ ID NO: 1850635 - RNA, 15 nt, Homo sapiens
cagcaauacaaagac

SEQ ID NO: 1850636 - RNA, 22 nt, Homo sapiens
acuuucuaaguaggaugaauca

SEQ ID NO: 1850637 - RNA, 21 nt, Homo sapiens
cuucuagagggagaagacugu

SEQ ID NO: 1850638 - RNA, 21 nt, Homo sapiens
ugaggaaagcaagaaucagag

SEQ ID NO: 1850639 - RNA, 14 nt, Homo sapiens
ucuuuuagcacaug

SEQ ID NO: 1850640 - RNA, 13 nt, Homo sapiens
ccucccugggguc

SEQ ID NO: 1850641 - RNA, 14 nt, Homo sapiens
aaagcugacuuggc

SEQ ID NO: 1850642 - RNA, 17 nt, Homo sapiens
aaagauggaaguguauu

SEQ ID NO: 1850643 - RNA, 16 nt, Homo sapiens
aaauaaaaaccuucca

SEQ ID NO: 1850644 - RNA, 20 nt, Homo sapiens
caggagugccaggaccagcc

SEQ ID NO: 1850645 - RNA, 16 nt, Homo sapiens
gcccaccugcacguga

SEQ ID NO: 1850646 - RNA, 14 nt, Homo sapiens
aaaagcuucaggga

SEQ ID NO: 1850647 - RNA, 17 nt, Homo sapiens
ugugcccuagggcucag

SEQ ID NO: 1850648 - RNA, 18 nt, Homo sapiens
uaauccagaaaaacugug

SEQ ID NO: 1850649 - RNA, 15 nt, Homo sapiens
aguaugguaauuaaa

SEQ ID NO: 1850650 - RNA, 22 nt, Homo sapiens
uaacagauaaagaaacugaggc

SEQ ID NO: 1850651 - RNA, 19 nt, Homo sapiens
ugcccuaguugugggcaac

SEQ ID NO: 1850652 - RNA, 12 nt, Homo sapiens
acaccuuggccu

SEQ ID NO: 1850653 - RNA, 12 nt, Homo sapiens
guuuagagcagu

SEQ ID NO: 1850654 - RNA, 20 nt, Homo sapiens
ugauuuaaaagggaagucua

SEQ ID NO: 1850655 - RNA, 20 nt, Homo sapiens
ccugcagcuccucugccuuu

SEQ ID NO: 1850656 - RNA, 17 nt, Homo sapiens
uuguguuaccuguagau

SEQ ID NO: 1850657 - RNA, 20 nt, Homo sapiens
gucaaugcaucaauuuaccu

SEQ ID NO: 1850658 - RNA, 16 nt, Homo sapiens
ggcagcccuauuucag

SEQ ID NO: 1850659 - RNA, 16 nt, Homo sapiens
cuaucaagagaguaaa

SEQ ID NO: 1850660 - RNA, 18 nt, Homo sapiens
uugaaaagaaaaagaaga

SEQ ID NO: 1850661 - RNA, 19 nt, Homo sapiens
gccaagcaggacagugcuu

SEQ ID NO: 1850662 - RNA, 12 nt, Homo sapiens
gcccuccgccua

SEQ ID NO: 1850663 - RNA, 15 nt, Homo sapiens
acacacacagguggg

SEQ ID NO: 1850664 - RNA, 19 nt, Homo sapiens
agaaaauggaauuacucca

SEQ ID NO: 1850665 - RNA, 21 nt, Homo sapiens
aaauuuuuccacacuaugugu

SEQ ID NO: 1850666 - RNA, 16 nt, Homo sapiens
aucaauugcaugagua

SEQ ID NO: 1850667 - RNA, 24 nt, Homo sapiens
cugaaaccucugggucaucucuca

SEQ ID NO: 1850668 - RNA, 20 nt, Homo sapiens
cagauuuaaaaaaagaacau

SEQ ID NO: 1850669 - RNA, 12 nt, Homo sapiens
uaaaaccaaagg

SEQ ID NO: 1850670 - RNA, 17 nt, Homo sapiens
uuaaaccuuucaguacu

SEQ ID NO: 1850671 - RNA, 20 nt, Homo sapiens
uggcacauggcuggcacuga

SEQ ID NO: 1850672 - RNA, 18 nt, Homo sapiens
caaccccuccucccucag

SEQ ID NO: 1850673 - RNA, 22 nt, Homo sapiens
cuaagaauuuuguuuuacuuuu

SEQ ID NO: 1850674 - RNA, 19 nt, Homo sapiens
cuacaauacaacacauuga

SEQ ID NO: 1850675 - RNA, 15 nt, Homo sapiens
uccaccuuucaggag

SEQ ID NO: 1850676 - RNA, 15 nt, Homo sapiens
acauuuaaacucagc

SEQ ID NO: 1850677 - RNA, 13 nt, Homo sapiens
acauugagguucc

SEQ ID NO: 1850678 - RNA, 13 nt, Homo sapiens
ccugaagucacac

SEQ ID NO: 1850679 - RNA, 16 nt, Homo sapiens
gcccaagguugcacag

SEQ ID NO: 1850680 - RNA, 20 nt, Homo sapiens
auuuaguuuguacucagugg

SEQ ID NO: 1850681 - RNA, 18 nt, Homo sapiens
gcuaguucguagcuuucc

SEQ ID NO: 1850682 - RNA, 14 nt, Homo sapiens
aagaugcguuugcc

SEQ ID NO: 1850683 - RNA, 21 nt, Homo sapiens
caaauugugugugcucugcuu

SEQ ID NO: 1850684 - RNA, 23 nt, Homo sapiens
uucuucaaaaaauguuuaauuaa

SEQ ID NO: 1850685 - RNA, 16 nt, Homo sapiens
aauguugcccuaauaa

SEQ ID NO: 1850686 - RNA, 22 nt, Homo sapiens
cugccagaugcugauguucagu

SEQ ID NO: 1850687 - RNA, 17 nt, Homo sapiens
aaagacaguaaagacca

SEQ ID NO: 1850688 - RNA, 21 nt, Homo sapiens
gacaugacugcaaucaugugc

SEQ ID NO: 1850689 - RNA, 22 nt, Homo sapiens
uauugauuauagcaaugugauu

SEQ ID NO: 1850690 - RNA, 13 nt, Homo sapiens
ugcguggggacag

SEQ ID NO: 1850691 - RNA, 12 nt, Homo sapiens
ucuucagugaau

SEQ ID NO: 1850692 - RNA, 13 nt, Homo sapiens
aagugguucucau

SEQ ID NO: 1850693 - RNA, 15 nt, Homo sapiens
augagguacucuccu

SEQ ID NO: 1850694 - RNA, 18 nt, Homo sapiens
gaugaugucggucuugca

SEQ ID NO: 1850695 - RNA, 17 nt, Homo sapiens
cucuugucccuuggcac

SEQ ID NO: 1850696 - RNA, 16 nt, Homo sapiens
ggccacucgggggggu

SEQ ID NO: 1850697 - RNA, 22 nt, Homo sapiens
uuccccaccccagcucaugccc

SEQ ID NO: 1850698 - RNA, 15 nt, Homo sapiens
agucauacugucacu

SEQ ID NO: 1850699 - RNA, 13 nt, Homo sapiens
gaaagccaugacc

SEQ ID NO: 1850700 - RNA, 16 nt, Homo sapiens
gaagguguucaaacac

SEQ ID NO: 1850701 - RNA, 16 nt, Homo sapiens
aguaaaaauaaaucaa

SEQ ID NO: 1850702 - RNA, 22 nt, Homo sapiens
cuagguaucauucaacucucca

SEQ ID NO: 1850703 - RNA, 20 nt, Homo sapiens
aaccaggggcugacaaugcg

SEQ ID NO: 1850704 - RNA, 17 nt, Homo sapiens
uuccaauaaaacuuuau

SEQ ID NO: 1850705 - RNA, 18 nt, Homo sapiens
auauuaugaaauuucacu

SEQ ID NO: 1850706 - RNA, 11 nt, Homo sapiens
cauauagcucg

SEQ ID NO: 1850707 - RNA, 11 nt, Homo sapiens
cuccugcaaac

SEQ ID NO: 1850708 - RNA, 11 nt, Homo sapiens
caccugcaauc

SEQ ID NO: 1850709 - RNA, 13 nt, Homo sapiens
uggugucaggcag

SEQ ID NO: 1850710 - RNA, 14 nt, Homo sapiens
ucaaaacacugugg

SEQ ID NO: 1850711 - RNA, 22 nt, Homo sapiens
caugaauucuggucacauucca

SEQ ID NO: 1850712 - RNA, 14 nt, Homo sapiens
auggcucaugucug

SEQ ID NO: 1850713 - RNA, 16 nt, Homo sapiens
aggcauaggucucuuu

SEQ ID NO: 1850714 - RNA, 19 nt, Homo sapiens
gcuguguuugagcuuucau

SEQ ID NO: 1850715 - RNA, 21 nt, Homo sapiens
uccaagaucuuuuuccagguu

SEQ ID NO: 1850716 - RNA, 21 nt, Homo sapiens
cuaagcccuguucuccugucc

SEQ ID NO: 1850717 - RNA, 15 nt, Homo sapiens
accagcaaacagcug

SEQ ID NO: 1850718 - RNA, 18 nt, Homo sapiens
cacccuccaccucuucac

SEQ ID NO: 1850719 - RNA, 21 nt, Homo sapiens
uuaaaaugugagugaccucac

SEQ ID NO: 1850720 - RNA, 18 nt, Homo sapiens
cucaaaugcacaucucau

SEQ ID NO: 1850721 - RNA, 21 nt, Homo sapiens
cauggacacuccagugccagc

SEQ ID NO: 1850722 - RNA, 13 nt, Homo sapiens
aacaucuccaugg

SEQ ID NO: 1850723 - RNA, 11 nt, Homo sapiens
cccuguugcaa

SEQ ID NO: 1850724 - RNA, 22 nt, Homo sapiens
cgcagauugggcuggcucugaa

SEQ ID NO: 1850725 - RNA, 20 nt, Homo sapiens
ccauuccggaggcuaaauaa

SEQ ID NO: 1850726 - RNA, 19 nt, Homo sapiens
caugugggccccagccauc

SEQ ID NO: 1850727 - RNA, 20 nt, Homo sapiens
gaccuaaagggacuaccucu

SEQ ID NO: 1850728 - RNA, 15 nt, Homo sapiens
ucugugugugccugu

SEQ ID NO: 1850729 - RNA, 14 nt, Homo sapiens
acuugcucugcucu

SEQ ID NO: 1850730 - RNA, 15 nt, Homo sapiens
aggggggagggucuu

SEQ ID NO: 1850731 - RNA, 16 nt, Homo sapiens
ugggguuucaccaucu

SEQ ID NO: 1850732 - RNA, 14 nt, Homo sapiens
cagccucaucccag

SEQ ID NO: 1850733 - RNA, 18 nt, Homo sapiens
cucagcaaucacaagcca

SEQ ID NO: 1850734 - RNA, 12 nt, Homo sapiens
acagcagaauaa

SEQ ID NO: 1850735 - RNA, 17 nt, Homo sapiens
gcuauuucuaguagaaa

SEQ ID NO: 1850736 - RNA, 14 nt, Homo sapiens
ggguagaugugcaa

SEQ ID NO: 1850737 - RNA, 17 nt, Homo sapiens
ggcagaaggagggagac

SEQ ID NO: 1850738 - RNA, 21 nt, Homo sapiens
uucuuccuugagcuaagcaga

SEQ ID NO: 1850739 - RNA, 17 nt, Homo sapiens
ucugucuggacuuucca

SEQ ID NO: 1850740 - RNA, 17 nt, Homo sapiens
gcaaaauugggcuguga

SEQ ID NO: 1850741 - RNA, 22 nt, Homo sapiens
augccuuucuaguccuauucua

SEQ ID NO: 1850742 - RNA, 18 nt, Homo sapiens
uuuguucuugccuagggu

SEQ ID NO: 1850743 - RNA, 20 nt, Homo sapiens
ccuuguagagcacagaguag

SEQ ID NO: 1850744 - RNA, 17 nt, Homo sapiens
caggacaacaucagcuc

SEQ ID NO: 1850745 - RNA, 18 nt, Homo sapiens
gcagggacuuuggucuau

SEQ ID NO: 1850746 - RNA, 12 nt, Homo sapiens
uccaaugccaau

SEQ ID NO: 1850747 - RNA, 15 nt, Homo sapiens
uccaaccuucccaaa

SEQ ID NO: 1850748 - RNA, 21 nt, Homo sapiens
aauuuaacaucacuacaaaaa

SEQ ID NO: 1850749 - RNA, 17 nt, Homo sapiens
ucuuggucucaguguca

SEQ ID NO: 1850750 - RNA, 16 nt, Homo sapiens
auuguagauaauacug

SEQ ID NO: 1850751 - RNA, 18 nt, Homo sapiens
agaccugaaaaaguuuug

SEQ ID NO: 1850752 - RNA, 22 nt, Homo sapiens
cccggaauccgagauagggugg

SEQ ID NO: 1850753 - RNA, 16 nt, Homo sapiens
cuauugagcagagccu

SEQ ID NO: 1850754 - RNA, 14 nt, Homo sapiens
uacauuucugcaga

SEQ ID NO: 1850755 - RNA, 14 nt, Homo sapiens
augaggccaucuca

SEQ ID NO: 1850756 - RNA, 18 nt, Homo sapiens
ucccggagagggagucag

SEQ ID NO: 1850757 - RNA, 21 nt, Homo sapiens
cacgccugguucuguacaugu

SEQ ID NO: 1850758 - RNA, 23 nt, Homo sapiens
uaagaucugaguugagaccuuug

SEQ ID NO: 1850759 - RNA, 16 nt, Homo sapiens
agccuaggugacagag

SEQ ID NO: 1850760 - RNA, 19 nt, Homo sapiens
gaaauuuaaauaagauuua

SEQ ID NO: 1850761 - RNA, 17 nt, Homo sapiens
uguguuccaaguuucca

SEQ ID NO: 1850762 - RNA, 18 nt, Homo sapiens
cccaggcucaacugagga

SEQ ID NO: 1850763 - RNA, 15 nt, Homo sapiens
uaauagugacaugca

SEQ ID NO: 1850764 - RNA, 16 nt, Homo sapiens
uaggcugacaccaaga

SEQ ID NO: 1850765 - RNA, 15 nt, Homo sapiens
ccagaugaacauuuc

SEQ ID NO: 1850766 - RNA, 11 nt, Homo sapiens
ccuuccagugg

SEQ ID NO: 1850767 - RNA, 19 nt, Homo sapiens
cauuuugugucugugaaca

SEQ ID NO: 1850768 - RNA, 16 nt, Homo sapiens
ugucuccucugucagu

SEQ ID NO: 1850769 - RNA, 14 nt, Homo sapiens
agcaguucugcaaa

SEQ ID NO: 1850770 - RNA, 18 nt, Homo sapiens
gaauacuuacucuugucg

SEQ ID NO: 1850771 - RNA, 20 nt, Homo sapiens
aguugaagggaauacugugc

SEQ ID NO: 1850772 - RNA, 11 nt, Homo sapiens
guaaaaucacu

SEQ ID NO: 1850773 - RNA, 12 nt, Homo sapiens
ccuugucugcac

SEQ ID NO: 1850774 - RNA, 10 nt, Homo sapiens
cagggaccag

SEQ ID NO: 1850775 - RNA, 16 nt, Homo sapiens
ugaaguaaguucauca

SEQ ID NO: 1850776 - RNA, 16 nt, Homo sapiens
aacuauguaaugcuua

SEQ ID NO: 1850777 - RNA, 16 nt, Homo sapiens
gggccuaggcugcauu

SEQ ID NO: 1850778 - RNA, 23 nt, Homo sapiens
uacagguccguuuccuuacacau

SEQ ID NO: 1850779 - RNA, 12 nt, Homo sapiens
uggggucuguaa

SEQ ID NO: 1850780 - RNA, 10 nt, Homo sapiens
aaguauuuaa

SEQ ID NO: 1850781 - RNA, 20 nt, Homo sapiens
uggaaucauauaguauguaa

SEQ ID NO: 1850782 - RNA, 17 nt, Homo sapiens
ucuguaauuucacuuua

SEQ ID NO: 1850783 - RNA, 18 nt, Homo sapiens
agacaacagauuuacauc

SEQ ID NO: 1850784 - RNA, 17 nt, Homo sapiens
uaucugugauuagccau

SEQ ID NO: 1850785 - RNA, 23 nt, Homo sapiens
ccaagugaaugaguuuccagcua

SEQ ID NO: 1850786 - RNA, 20 nt, Homo sapiens
ugaaucagcugcugacuggc

SEQ ID NO: 1850787 - RNA, 20 nt, Homo sapiens
uuauaaaggauaaagaagga

SEQ ID NO: 1850788 - RNA, 16 nt, Homo sapiens
cuggaucucccugaga

SEQ ID NO: 1850789 - RNA, 16 nt, Homo sapiens
agguauggcucugcac

SEQ ID NO: 1850790 - RNA, 18 nt, Homo sapiens
cagaggcuuccagucuca

SEQ ID NO: 1850791 - RNA, 20 nt, Homo sapiens
ugggaugggcagaugggccu

SEQ ID NO: 1850792 - RNA, 19 nt, Homo sapiens
cugggagguggagguugca

SEQ ID NO: 1850793 - RNA, 21 nt, Homo sapiens
acaccacgguagugccugaaa

SEQ ID NO: 1850794 - RNA, 14 nt, Homo sapiens
cauagguaugcuua

SEQ ID NO: 1850795 - RNA, 16 nt, Homo sapiens
uucaagcauugcuaaa

SEQ ID NO: 1850796 - RNA, 16 nt, Homo sapiens
uucaugauuugcaacu

SEQ ID NO: 1850797 - RNA, 22 nt, Homo sapiens
cccugaaauauuuucuacuuua

SEQ ID NO: 1850798 - RNA, 15 nt, Homo sapiens
ugguaccauggugua

SEQ ID NO: 1850799 - RNA, 19 nt, Homo sapiens
caauccuugccacagugug

SEQ ID NO: 1850800 - RNA, 22 nt, Homo sapiens
cagagacgcagacaugugcacu

SEQ ID NO: 1850801 - RNA, 14 nt, Homo sapiens
ggacacuugauauu

SEQ ID NO: 1850802 - RNA, 19 nt, Homo sapiens
gaugugucuucaaugucaa

SEQ ID NO: 1850803 - RNA, 21 nt, Homo sapiens
caggucuugacaccagcuguu

SEQ ID NO: 1850804 - RNA, 18 nt, Homo sapiens
acugugguauggcuaaua

SEQ ID NO: 1850805 - RNA, 11 nt, Homo sapiens
uggaacuggag

SEQ ID NO: 1850806 - RNA, 15 nt, Homo sapiens
accuguuuauucucu

SEQ ID NO: 1850807 - RNA, 13 nt, Homo sapiens
aaccagacagagg

SEQ ID NO: 1850808 - RNA, 13 nt, Homo sapiens
ggauaaacaucac

SEQ ID NO: 1850809 - RNA, 13 nt, Homo sapiens
cagacacuacaug

SEQ ID NO: 1850810 - RNA, 16 nt, Homo sapiens
gaaaaguccacauaac

SEQ ID NO: 1850811 - RNA, 13 nt, Homo sapiens
gcauugccaagug

SEQ ID NO: 1850812 - RNA, 14 nt, Homo sapiens
cuuuuaguggguga

SEQ ID NO: 1850813 - RNA, 12 nt, Homo sapiens
accucacuuuag

SEQ ID NO: 1850814 - RNA, 19 nt, Homo sapiens
gaucuagugccauuauuuc

SEQ ID NO: 1850815 - RNA, 19 nt, Homo sapiens
uugaggaauaaaugccuuu

SEQ ID NO: 1850816 - RNA, 23 nt, Homo sapiens
ccccacuggacugaccuggucca

SEQ ID NO: 1850817 - RNA, 20 nt, Homo sapiens
cucuucccggagaauccagc

SEQ ID NO: 1850818 - RNA, 18 nt, Homo sapiens
ggauccugguuucgugug

SEQ ID NO: 1850819 - RNA, 18 nt, Homo sapiens
uuacagauuaucacauua

SEQ ID NO: 1850820 - RNA, 21 nt, Homo sapiens
aguaaucucacagcauuugcc

SEQ ID NO: 1850821 - RNA, 15 nt, Homo sapiens
cagacuguugcacuc

SEQ ID NO: 1850822 - RNA, 15 nt, Homo sapiens
agaaaagccucucca

SEQ ID NO: 1850823 - RNA, 15 nt, Homo sapiens
cucucagcagaaaca

SEQ ID NO: 1850824 - RNA, 16 nt, Homo sapiens
uaguuucagacuugga

SEQ ID NO: 1850825 - RNA, 22 nt, Homo sapiens
ccagguugcaguagcaguggau

SEQ ID NO: 1850826 - RNA, 15 nt, Homo sapiens
cagccaucaugugcc

SEQ ID NO: 1850827 - RNA, 16 nt, Homo sapiens
uggcaaaugaaagcau

SEQ ID NO: 1850828 - RNA, 18 nt, Homo sapiens
cuacugcagcaccuccag

SEQ ID NO: 1850829 - RNA, 21 nt, Homo sapiens
cugaucccauaaagaaaguga

SEQ ID NO: 1850830 - RNA, 19 nt, Homo sapiens
auacuuucccacagcacua

SEQ ID NO: 1850831 - RNA, 16 nt, Homo sapiens
aaaccuauacucacuu

SEQ ID NO: 1850832 - RNA, 13 nt, Homo sapiens
aauauccugugua

SEQ ID NO: 1850833 - RNA, 19 nt, Homo sapiens
ucuuuaagaguauguugcu

SEQ ID NO: 1850834 - RNA, 15 nt, Homo sapiens
aggauaggaguucac

SEQ ID NO: 1850835 - RNA, 14 nt, Homo sapiens
cccacaaaguuuca

SEQ ID NO: 1850836 - RNA, 14 nt, Homo sapiens
acaggcauuccaga

SEQ ID NO: 1850837 - RNA, 13 nt, Homo sapiens
uuugccaaaguga

SEQ ID NO: 1850838 - RNA, 14 nt, Homo sapiens
uauaauuaacauaa

SEQ ID NO: 1850839 - RNA, 11 nt, Homo sapiens
uuaaagacaug

SEQ ID NO: 1850840 - RNA, 23 nt, Homo sapiens
gagggagcccagucuggaugugg

SEQ ID NO: 1850841 - RNA, 11 nt, Homo sapiens
uuaaacucugu

SEQ ID NO: 1850842 - RNA, 14 nt, Homo sapiens
aaauaggcauauca

SEQ ID NO: 1850843 - RNA, 16 nt, Homo sapiens
cacaugaauauaaaug

SEQ ID NO: 1850844 - RNA, 17 nt, Homo sapiens
guuuucuauuucacuaa

SEQ ID NO: 1850845 - RNA, 18 nt, Homo sapiens
agugcaauaaaucugacc

SEQ ID NO: 1850846 - RNA, 19 nt, Homo sapiens
uguccccuaaaccaaaaac

SEQ ID NO: 1850847 - RNA, 15 nt, Homo sapiens
ucuaguuuugucaaa

SEQ ID NO: 1850848 - RNA, 15 nt, Homo sapiens
caguugucuauucau

SEQ ID NO: 1850849 - RNA, 18 nt, Homo sapiens
aaauagcaaaacuaaaua

SEQ ID NO: 1850850 - RNA, 15 nt, Homo sapiens
auagacuuaauacau

SEQ ID NO: 1850851 - RNA, 14 nt, Homo sapiens
auaucuaguaugaa

SEQ ID NO: 1850852 - RNA, 18 nt, Homo sapiens
uaucccaaacuaagcuau

SEQ ID NO: 1850853 - RNA, 14 nt, Homo sapiens
gaaagcaggggcua

SEQ ID NO: 1850854 - RNA, 21 nt, Homo sapiens
ccucucagauuguaccauuga

SEQ ID NO: 1850855 - RNA, 16 nt, Homo sapiens
aaauaaaguaccacac

SEQ ID NO: 1850856 - RNA, 17 nt, Homo sapiens
aauacgaaaaucccaug

SEQ ID NO: 1850857 - RNA, 23 nt, Homo sapiens
aaagcuugucugaucguucaaag

SEQ ID NO: 1850858 - RNA, 12 nt, Homo sapiens
guguauguguau

SEQ ID NO: 1850859 - RNA, 13 nt, Homo sapiens
ccugagacuggaa

SEQ ID NO: 1850860 - RNA, 19 nt, Homo sapiens
aauuucuccucccuuccuu

SEQ ID NO: 1850861 - RNA, 16 nt, Homo sapiens
augugcucaugcauug

SEQ ID NO: 1850862 - RNA, 21 nt, Homo sapiens
caaugacaucucaggggccag

SEQ ID NO: 1850863 - RNA, 15 nt, Homo sapiens
ucaagagacacugcu

SEQ ID NO: 1850864 - RNA, 20 nt, Homo sapiens
gcccuagcccugcuccaacu

SEQ ID NO: 1850865 - RNA, 17 nt, Homo sapiens
uucucauuuguucucac

SEQ ID NO: 1850866 - RNA, 20 nt, Homo sapiens
aucugagauaggagauacaa

SEQ ID NO: 1850867 - RNA, 18 nt, Homo sapiens
ccuggauugggagccauu

SEQ ID NO: 1850868 - RNA, 19 nt, Homo sapiens
uacuggggaaagugcauuu

SEQ ID NO: 1850869 - RNA, 24 nt, Homo sapiens
guggucaguaaauaacaggcauuu

SEQ ID NO: 1850870 - RNA, 14 nt, Homo sapiens
uguagucuuaugaa

SEQ ID NO: 1850871 - RNA, 14 nt, Homo sapiens
uauccacuuagcac

SEQ ID NO: 1850872 - RNA, 19 nt, Homo sapiens
agucacuugggagcugcug

SEQ ID NO: 1850873 - RNA, 12 nt, Homo sapiens
gcaaagggcaag

SEQ ID NO: 1850874 - RNA, 12 nt, Homo sapiens
gaaacuuaccug

SEQ ID NO: 1850875 - RNA, 20 nt, Homo sapiens
auguuuuuuuaaaccucaua

SEQ ID NO: 1850876 - RNA, 18 nt, Homo sapiens
caguucccccaguaccuc

SEQ ID NO: 1850877 - RNA, 18 nt, Homo sapiens
uaaggacaaagugccaaa

SEQ ID NO: 1850878 - RNA, 18 nt, Homo sapiens
gugggagagacacuccca

SEQ ID NO: 1850879 - RNA, 16 nt, Homo sapiens
auuaagccucuugucu

SEQ ID NO: 1850880 - RNA, 20 nt, Homo sapiens
uggaguaucauucuuuacau

SEQ ID NO: 1850881 - RNA, 12 nt, Homo sapiens
guuuucauuugc

SEQ ID NO: 1850882 - RNA, 15 nt, Homo sapiens
uuacaucuacaaaca

SEQ ID NO: 1850883 - RNA, 21 nt, Homo sapiens
aguccaccugaggaacugucu

SEQ ID NO: 1850884 - RNA, 21 nt, Homo sapiens
caggaaggcggggcuucaacc

SEQ ID NO: 1850885 - RNA, 18 nt, Homo sapiens
ggacauagccugcaaagc

SEQ ID NO: 1850886 - RNA, 24 nt, Homo sapiens
caaaauacgaaguggagauuuaca

SEQ ID NO: 1850887 - RNA, 15 nt, Homo sapiens
auuauuuuaugcaca

SEQ ID NO: 1850888 - RNA, 14 nt, Homo sapiens
agaugacaaccucc

SEQ ID NO: 1850889 - RNA, 20 nt, Homo sapiens
aguuaaggggagcaacagag

SEQ ID NO: 1850890 - RNA, 20 nt, Homo sapiens
gccaccggaggucacuccac

SEQ ID NO: 1850891 - RNA, 17 nt, Homo sapiens
uauguugcccagugugu

SEQ ID NO: 1850892 - RNA, 15 nt, Homo sapiens
gugccacgcacaggu

SEQ ID NO: 1850893 - RNA, 14 nt, Homo sapiens
aaaugccaauaaca

SEQ ID NO: 1850894 - RNA, 14 nt, Homo sapiens
gagugcaacccagu

SEQ ID NO: 1850895 - RNA, 18 nt, Homo sapiens
uggagagaagcucuucaa

SEQ ID NO: 1850896 - RNA, 19 nt, Homo sapiens
cccuuggccagaagucaag

SEQ ID NO: 1850897 - RNA, 16 nt, Homo sapiens
auucccuccugcuacu

SEQ ID NO: 1850898 - RNA, 15 nt, Homo sapiens
gccccagugaccggg

SEQ ID NO: 1850899 - RNA, 19 nt, Homo sapiens
agaugugaacacaucagcu

SEQ ID NO: 1850900 - RNA, 12 nt, Homo sapiens
augaaggccaca

SEQ ID NO: 1850901 - RNA, 22 nt, Homo sapiens
auauguaggugucugcacccag

SEQ ID NO: 1850902 - RNA, 18 nt, Homo sapiens
aucuguaaaauagucuca

SEQ ID NO: 1850903 - RNA, 18 nt, Homo sapiens
guacucaguaacagugca

SEQ ID NO: 1850904 - RNA, 16 nt, Homo sapiens
ucugagaguuccagau

SEQ ID NO: 1850905 - RNA, 13 nt, Homo sapiens
auggaccaugaaa

SEQ ID NO: 1850906 - RNA, 18 nt, Homo sapiens
aucccugaaacaucucaa

SEQ ID NO: 1850907 - RNA, 15 nt, Homo sapiens
uaacuggggggccac

SEQ ID NO: 1850908 - RNA, 16 nt, Homo sapiens
ccgcagacgggcacag

SEQ ID NO: 1850909 - RNA, 18 nt, Homo sapiens
uugaaaugcucuuuugca

SEQ ID NO: 1850910 - RNA, 20 nt, Homo sapiens
ccugcccccgcccacccucc

SEQ ID NO: 1850911 - RNA, 22 nt, Homo sapiens
ugagauguguggacuguggcac

SEQ ID NO: 1850912 - RNA, 21 nt, Homo sapiens
agcugucuccucuucaaauaa

SEQ ID NO: 1850913 - RNA, 16 nt, Homo sapiens
uggaaugccauuugca

SEQ ID NO: 1850914 - RNA, 16 nt, Homo sapiens
ucugauccgagcucag

SEQ ID NO: 1850915 - RNA, 17 nt, Homo sapiens
acuuaagcccucgugca

SEQ ID NO: 1850916 - RNA, 19 nt, Homo sapiens
cuuuuaauaaacugcaagu

SEQ ID NO: 1850917 - RNA, 22 nt, Homo sapiens
uucauccaguuuguucuccggg

SEQ ID NO: 1850918 - RNA, 14 nt, Homo sapiens
auccuagucuucac

SEQ ID NO: 1850919 - RNA, 17 nt, Homo sapiens
agguucugguuccauuu

SEQ ID NO: 1850920 - RNA, 16 nt, Homo sapiens
uuaucauuuacugugu

SEQ ID NO: 1850921 - RNA, 20 nt, Homo sapiens
gcacagccauacggcacuga

SEQ ID NO: 1850922 - RNA, 17 nt, Homo sapiens
caguaacugcaccaacg

SEQ ID NO: 1850923 - RNA, 16 nt, Homo sapiens
ugcuguuuuuaaucca

SEQ ID NO: 1850924 - RNA, 14 nt, Homo sapiens
cuaaccccuaugaa

SEQ ID NO: 1850925 - RNA, 17 nt, Homo sapiens
aggcaggaacacuggag

SEQ ID NO: 1850926 - RNA, 14 nt, Homo sapiens
auaugacaauguug

SEQ ID NO: 1850927 - RNA, 18 nt, Homo sapiens
cagggcagcgccaggcug

SEQ ID NO: 1850928 - RNA, 16 nt, Homo sapiens
aaaaacucccauauca

SEQ ID NO: 1850929 - RNA, 14 nt, Homo sapiens
ucuuaguugcugua

SEQ ID NO: 1850930 - RNA, 14 nt, Homo sapiens
gccauguccaaaga

SEQ ID NO: 1850931 - RNA, 14 nt, Homo sapiens
guaaaugucuucau

SEQ ID NO: 1850932 - RNA, 15 nt, Homo sapiens
uccucacagaccucu

SEQ ID NO: 1850933 - RNA, 18 nt, Homo sapiens
ucuggaauggcucaggga

SEQ ID NO: 1850934 - RNA, 16 nt, Homo sapiens
uccagugugacuuuau

SEQ ID NO: 1850935 - RNA, 18 nt, Homo sapiens
uguuacuuugcuaugugc

SEQ ID NO: 1850936 - RNA, 16 nt, Homo sapiens
gucccaucugcuccuc

SEQ ID NO: 1850937 - RNA, 23 nt, Homo sapiens
caaaacaaaacccucagcacugu

SEQ ID NO: 1850938 - RNA, 19 nt, Homo sapiens
caggcaguuaggugcugaa

SEQ ID NO: 1850939 - RNA, 22 nt, Homo sapiens
aaaauggagcucaguaacauaa

SEQ ID NO: 1850940 - RNA, 14 nt, Homo sapiens
aauuacacuuugaa

SEQ ID NO: 1850941 - RNA, 14 nt, Homo sapiens
uuauacacaaagaa

SEQ ID NO: 1850942 - RNA, 16 nt, Homo sapiens
ucccacccaccuguag

SEQ ID NO: 1850943 - RNA, 12 nt, Homo sapiens
ggauccagcacu

SEQ ID NO: 1850944 - RNA, 19 nt, Homo sapiens
ucgccccagccaagccuga

SEQ ID NO: 1850945 - RNA, 20 nt, Homo sapiens
ucaccaaguaaauuuguaua

SEQ ID NO: 1850946 - RNA, 18 nt, Homo sapiens
cacugugguaaaugccac

SEQ ID NO: 1850947 - RNA, 15 nt, Homo sapiens
gcagggacuuuccug

SEQ ID NO: 1850948 - RNA, 17 nt, Homo sapiens
agucucuucuaagcaaa

SEQ ID NO: 1850949 - RNA, 18 nt, Homo sapiens
agccuuagcucccagcua

SEQ ID NO: 1850950 - RNA, 19 nt, Homo sapiens
aucucacacaccagggcau

SEQ ID NO: 1850951 - RNA, 14 nt, Homo sapiens
uggaagaaagcuaa

SEQ ID NO: 1850952 - RNA, 15 nt, Homo sapiens
acgucauuacaagcu

SEQ ID NO: 1850953 - RNA, 16 nt, Homo sapiens
uuuauaaaauuuugcu

SEQ ID NO: 1850954 - RNA, 15 nt, Homo sapiens
uucauguauuccagu

SEQ ID NO: 1850955 - RNA, 19 nt, Homo sapiens
ccuucugacggcccugcaa

SEQ ID NO: 1850956 - RNA, 21 nt, Homo sapiens
uuucugauauagaauugcaau

SEQ ID NO: 1850957 - RNA, 13 nt, Homo sapiens
ccugccuggucac

SEQ ID NO: 1850958 - RNA, 14 nt, Homo sapiens
cggacaguggcacc

SEQ ID NO: 1850959 - RNA, 13 nt, Homo sapiens
ccugcuucucugg

SEQ ID NO: 1850960 - RNA, 18 nt, Homo sapiens
uaaaaaaaaaaggaugaa

SEQ ID NO: 1850961 - RNA, 17 nt, Homo sapiens
uaaacugacuuuuuccc

SEQ ID NO: 1850962 - RNA, 18 nt, Homo sapiens
cuacacacacacucccug

SEQ ID NO: 1850963 - RNA, 15 nt, Homo sapiens
uuaaaauuacuuuga

SEQ ID NO: 1850964 - RNA, 14 nt, Homo sapiens
gaaauacaguauga

SEQ ID NO: 1850965 - RNA, 21 nt, Homo sapiens
uuaaugguagcaacugaaaga

SEQ ID NO: 1850966 - RNA, 13 nt, Homo sapiens
uuugaagcaaagc

SEQ ID NO: 1850967 - RNA, 17 nt, Homo sapiens
gauacucucagcaccaa

SEQ ID NO: 1850968 - RNA, 23 nt, Homo sapiens
gcugugaaauccauauauaugaa

SEQ ID NO: 1850969 - RNA, 17 nt, Homo sapiens
ccuaggauaucuucucc

SEQ ID NO: 1850970 - RNA, 16 nt, Homo sapiens
ucagccuuauccaggu

SEQ ID NO: 1850971 - RNA, 22 nt, Homo sapiens
ucagcauuucuuuucuggccaa

SEQ ID NO: 1850972 - RNA, 17 nt, Homo sapiens
acucccgccacauuuua

SEQ ID NO: 1850973 - RNA, 18 nt, Homo sapiens
cugugaacuuucauguca

SEQ ID NO: 1850974 - RNA, 18 nt, Homo sapiens
uucugcucuguucuggau

SEQ ID NO: 1850975 - RNA, 16 nt, Homo sapiens
aaauggaaauugaugg

SEQ ID NO: 1850976 - RNA, 19 nt, Homo sapiens
ucuaggggugccucugugu

SEQ ID NO: 1850977 - RNA, 22 nt, Homo sapiens
cugucuguuuuaauuuaaccca

SEQ ID NO: 1850978 - RNA, 20 nt, Homo sapiens
uuuaccccucauccaaaguu

SEQ ID NO: 1850979 - RNA, 18 nt, Homo sapiens
gcauauuaagcacuuuaa

SEQ ID NO: 1850980 - RNA, 13 nt, Homo sapiens
aauuugaauucaa

SEQ ID NO: 1850981 - RNA, 21 nt, Homo sapiens
uuguauuuuacuuugugcaau

SEQ ID NO: 1850982 - RNA, 21 nt, Homo sapiens
augauucacaacuaggaccuc

SEQ ID NO: 1850983 - RNA, 14 nt, Homo sapiens
aguucuacaguuaa

SEQ ID NO: 1850984 - RNA, 18 nt, Homo sapiens
uaccuuuaaaauuuacca

SEQ ID NO: 1850985 - RNA, 15 nt, Homo sapiens
uauauuacucucauu

SEQ ID NO: 1850986 - RNA, 21 nt, Homo sapiens
acuuuaaaauaucuacauuaa

SEQ ID NO: 1850987 - RNA, 18 nt, Homo sapiens
ugaaauaauuacagaaua

SEQ ID NO: 1850988 - RNA, 16 nt, Homo sapiens
ucuacugaggugcuau

SEQ ID NO: 1850989 - RNA, 15 nt, Homo sapiens
uguuuauacacugug

SEQ ID NO: 1850990 - RNA, 13 nt, Homo sapiens
auggcugcugaaa

SEQ ID NO: 1850991 - RNA, 15 nt, Homo sapiens
aucccuuauguauga

SEQ ID NO: 1850992 - RNA, 15 nt, Homo sapiens
augccacguggucac

SEQ ID NO: 1850993 - RNA, 15 nt, Homo sapiens
auucccaguguucca

SEQ ID NO: 1850994 - RNA, 12 nt, Homo sapiens
uucaaguguaaa

SEQ ID NO: 1850995 - RNA, 16 nt, Homo sapiens
aagaauaaaugaaucu

SEQ ID NO: 1850996 - RNA, 16 nt, Homo sapiens
uguuuaauucauuaau

SEQ ID NO: 1850997 - RNA, 14 nt, Homo sapiens
gacucacuucucag

SEQ ID NO: 1850998 - RNA, 16 nt, Homo sapiens
agcuuucugaacagcu

SEQ ID NO: 1850999 - RNA, 20 nt, Homo sapiens
ugauuggccacacacugagu

SEQ ID NO: 1851000 - RNA, 20 nt, Homo sapiens
cugcuucaugggaaaacaga

SEQ ID NO: 1851001 - RNA, 16 nt, Homo sapiens
gcauuaucuugcucau

SEQ ID NO: 1851002 - RNA, 16 nt, Homo sapiens
auguggcccaagucau

SEQ ID NO: 1851003 - RNA, 16 nt, Homo sapiens
cccacccccucuuugu

SEQ ID NO: 1851004 - RNA, 19 nt, Homo sapiens
cucauguucucauguuugu

SEQ ID NO: 1851005 - RNA, 24 nt, Homo sapiens
acaucagcaagacuuuauaauucc

SEQ ID NO: 1851006 - RNA, 14 nt, Homo sapiens
gcaguggcugugaa

SEQ ID NO: 1851007 - RNA, 19 nt, Homo sapiens
cuggaaaaauuccagaaga

SEQ ID NO: 1851008 - RNA, 21 nt, Homo sapiens
aucccagcaugcugagauuac

SEQ ID NO: 1851009 - RNA, 20 nt, Homo sapiens
cugaguggaugacaaaaaga

SEQ ID NO: 1851010 - RNA, 18 nt, Homo sapiens
gcauuuacuaugccacag

SEQ ID NO: 1851011 - RNA, 23 nt, Homo sapiens
uaggaaagucacccaaacacuuc

SEQ ID NO: 1851012 - RNA, 13 nt, Homo sapiens
ucgugauuugccu

SEQ ID NO: 1851013 - RNA, 17 nt, Homo sapiens
cuaaaaccacaugugca

SEQ ID NO: 1851014 - RNA, 16 nt, Homo sapiens
uugaugcuacaaaaca

SEQ ID NO: 1851015 - RNA, 11 nt, Homo sapiens
cucccaaagug

SEQ ID NO: 1851016 - RNA, 16 nt, Homo sapiens
augaauuuaaggcaaa

SEQ ID NO: 1851017 - RNA, 15 nt, Homo sapiens
ucccagcucacugca

SEQ ID NO: 1851018 - RNA, 14 nt, Homo sapiens
ucuuuuuuugcaua

SEQ ID NO: 1851019 - RNA, 13 nt, Homo sapiens
gaacaaaaucugu

SEQ ID NO: 1851020 - RNA, 21 nt, Homo sapiens
gucuccucugcagcucaggga

SEQ ID NO: 1851021 - RNA, 15 nt, Homo sapiens
auacucugugcaagg

SEQ ID NO: 1851022 - RNA, 14 nt, Homo sapiens
acagugcccagggc

SEQ ID NO: 1851023 - RNA, 14 nt, Homo sapiens
cuuuaaccacuccu

SEQ ID NO: 1851024 - RNA, 15 nt, Homo sapiens
gaauuuaaugcugaa

SEQ ID NO: 1851025 - RNA, 23 nt, Homo sapiens
agcggucccugcagaagccagaa

SEQ ID NO: 1851026 - RNA, 21 nt, Homo sapiens
cuauaauucuauacuguugau

SEQ ID NO: 1851027 - RNA, 13 nt, Homo sapiens
cauggaugcaugc

SEQ ID NO: 1851028 - RNA, 13 nt, Homo sapiens
cacagaugcacac

SEQ ID NO: 1851029 - RNA, 13 nt, Homo sapiens
gacagauggacac

SEQ ID NO: 1851030 - RNA, 23 nt, Homo sapiens
cccugccccgccccccagagcca

SEQ ID NO: 1851031 - RNA, 18 nt, Homo sapiens
uuacguggcaaaaucccu

SEQ ID NO: 1851032 - RNA, 19 nt, Homo sapiens
uuuagguaaaaagcuuaaa

SEQ ID NO: 1851033 - RNA, 13 nt, Homo sapiens
gcgaguucugcca

SEQ ID NO: 1851034 - RNA, 16 nt, Homo sapiens
uccccauugacccuca

SEQ ID NO: 1851035 - RNA, 19 nt, Homo sapiens
aauguacagaguaaccuau

SEQ ID NO: 1851036 - RNA, 22 nt, Homo sapiens
cugaauucauugucucagugaa

SEQ ID NO: 1851037 - RNA, 21 nt, Homo sapiens
cucgaaauaauuuuuuaguua

SEQ ID NO: 1851038 - RNA, 23 nt, Homo sapiens
ucccuguaugucuaccucugacu

SEQ ID NO: 1851039 - RNA, 18 nt, Homo sapiens
cugggacuucuuacccaa

SEQ ID NO: 1851040 - RNA, 12 nt, Homo sapiens
aagaggagaaaa

SEQ ID NO: 1851041 - RNA, 17 nt, Homo sapiens
gaacaucauaacccaug

SEQ ID NO: 1851042 - RNA, 19 nt, Homo sapiens
cucgccucauuacugugag

SEQ ID NO: 1851043 - RNA, 21 nt, Homo sapiens
cagguauuuuauaauucuggg

SEQ ID NO: 1851044 - RNA, 18 nt, Homo sapiens
gccaccccacucuaccuc

SEQ ID NO: 1851045 - RNA, 20 nt, Homo sapiens
ccagacucuaaauauuucau

SEQ ID NO: 1851046 - RNA, 18 nt, Homo sapiens
gaagacauaucaugugug

SEQ ID NO: 1851047 - RNA, 19 nt, Homo sapiens
ccagcauccccaacugcga

SEQ ID NO: 1851048 - RNA, 17 nt, Homo sapiens
gcucccagggacugaca

SEQ ID NO: 1851049 - RNA, 15 nt, Homo sapiens
gcagauaaacaguag

SEQ ID NO: 1851050 - RNA, 13 nt, Homo sapiens
uaaagugacccug

SEQ ID NO: 1851051 - RNA, 18 nt, Homo sapiens
aaagcaagggaccuucau

SEQ ID NO: 1851052 - RNA, 17 nt, Homo sapiens
ugcuaaggcuccuccuu

SEQ ID NO: 1851053 - RNA, 22 nt, Homo sapiens
aagccaccagggcuucuggaac

SEQ ID NO: 1851054 - RNA, 15 nt, Homo sapiens
ugcaggggccagggg

SEQ ID NO: 1851055 - RNA, 23 nt, Homo sapiens
aucacuccccaaggaagagccaa

SEQ ID NO: 1851056 - RNA, 13 nt, Homo sapiens
aaggcgauagcug

SEQ ID NO: 1851057 - RNA, 11 nt, Homo sapiens
uacucuuccaa

SEQ ID NO: 1851058 - RNA, 18 nt, Homo sapiens
ucuguccgagugugccac

SEQ ID NO: 1851059 - RNA, 21 nt, Homo sapiens
uuauuuaugcacugugggaug

SEQ ID NO: 1851060 - RNA, 18 nt, Homo sapiens
acagugggccauucauuu

SEQ ID NO: 1851061 - RNA, 14 nt, Homo sapiens
ccagaguggcccaa

SEQ ID NO: 1851062 - RNA, 14 nt, Homo sapiens
cauagggggcugca

SEQ ID NO: 1851063 - RNA, 23 nt, Homo sapiens
ccucagucuacacucacaaucau

SEQ ID NO: 1851064 - RNA, 18 nt, Homo sapiens
cuguuccaccaaauacaa

SEQ ID NO: 1851065 - RNA, 13 nt, Homo sapiens
gaccaaagcaaga

SEQ ID NO: 1851066 - RNA, 12 nt, Homo sapiens
auauacaaauag

SEQ ID NO: 1851067 - RNA, 12 nt, Homo sapiens
aaguacaaaagg

SEQ ID NO: 1851068 - RNA, 17 nt, Homo sapiens
gcaaugggcacugggau

SEQ ID NO: 1851069 - RNA, 20 nt, Homo sapiens
cucugccuuucuaagacuca

SEQ ID NO: 1851070 - RNA, 23 nt, Homo sapiens
uccaucgcaguguucaaggccau

SEQ ID NO: 1851071 - RNA, 12 nt, Homo sapiens
uauacagaggaa

SEQ ID NO: 1851072 - RNA, 18 nt, Homo sapiens
gugagccgugucguauga

SEQ ID NO: 1851073 - RNA, 20 nt, Homo sapiens
uauuaaacauuuuucacuua

SEQ ID NO: 1851074 - RNA, 22 nt, Homo sapiens
accaauagauugggcacugugg

SEQ ID NO: 1851075 - RNA, 13 nt, Homo sapiens
caauaccuaauaa

SEQ ID NO: 1851076 - RNA, 22 nt, Homo sapiens
cugccacugaggggggauccag

SEQ ID NO: 1851077 - RNA, 21 nt, Homo sapiens
acucccucgucgagcuggaug

SEQ ID NO: 1851078 - RNA, 22 nt, Homo sapiens
ccagcucccacucccuuuccaa

SEQ ID NO: 1851079 - RNA, 23 nt, Homo sapiens
cagaaguugaagcacaaccacug

SEQ ID NO: 1851080 - RNA, 12 nt, Homo sapiens
caagaaaucuga

SEQ ID NO: 1851081 - RNA, 19 nt, Homo sapiens
ucagggcauugccugugac

SEQ ID NO: 1851082 - RNA, 13 nt, Homo sapiens
aggacauggacaa

SEQ ID NO: 1851083 - RNA, 13 nt, Homo sapiens
agguaauggacuc

SEQ ID NO: 1851084 - RNA, 19 nt, Homo sapiens
aguccagacauuuguuuca

SEQ ID NO: 1851085 - RNA, 20 nt, Homo sapiens
gccugcaucuucuugcaucu

SEQ ID NO: 1851086 - RNA, 20 nt, Homo sapiens
ucuuaauugcaucaguauuu

SEQ ID NO: 1851087 - RNA, 20 nt, Homo sapiens
aagaaauuuaaucaguguga

SEQ ID NO: 1851088 - RNA, 23 nt, Homo sapiens
ccacacacagguggugucacugu

SEQ ID NO: 1851089 - RNA, 17 nt, Homo sapiens
aacagcuccaccuuacu

SEQ ID NO: 1851090 - RNA, 23 nt, Homo sapiens
agucgagcccugcagccaaacag

SEQ ID NO: 1851091 - RNA, 22 nt, Homo sapiens
aauaauucauauucuucauauc

SEQ ID NO: 1851092 - RNA, 17 nt, Homo sapiens
uggugaaugugugagaa

SEQ ID NO: 1851093 - RNA, 20 nt, Homo sapiens
gaugaaacuggaaaacuaca

SEQ ID NO: 1851094 - RNA, 18 nt, Homo sapiens
uaugcuguacccaguuuc

SEQ ID NO: 1851095 - RNA, 12 nt, Homo sapiens
ggaacuggcaaa

SEQ ID NO: 1851096 - RNA, 22 nt, Homo sapiens
augauuucuaugcugaguuugu

SEQ ID NO: 1851097 - RNA, 22 nt, Homo sapiens
agagagauggaauaaagcccuu

SEQ ID NO: 1851098 - RNA, 21 nt, Homo sapiens
accugcugacauaguggaugg

SEQ ID NO: 1851099 - RNA, 20 nt, Homo sapiens
cuugcauaauuauauacucc

SEQ ID NO: 1851100 - RNA, 21 nt, Homo sapiens
uaugcuucuuggagucuucca

SEQ ID NO: 1851101 - RNA, 15 nt, Homo sapiens
ugauucaggcuucca

SEQ ID NO: 1851102 - RNA, 19 nt, Homo sapiens
aaccugugcucauuuugca

SEQ ID NO: 1851103 - RNA, 23 nt, Homo sapiens
acucuugagucucuuuaccuaau

SEQ ID NO: 1851104 - RNA, 23 nt, Homo sapiens
gugcaccccuccccauucacaga

SEQ ID NO: 1851105 - RNA, 17 nt, Homo sapiens
aagagaaaaugcgucuc

SEQ ID NO: 1851106 - RNA, 21 nt, Homo sapiens
ucaucugaaggggcaaauucu

SEQ ID NO: 1851107 - RNA, 20 nt, Homo sapiens
auccaugcuuggguguaaca

SEQ ID NO: 1851108 - RNA, 12 nt, Homo sapiens
aggaucacuuga

SEQ ID NO: 1851109 - RNA, 23 nt, Homo sapiens
uaaagcccagaucucugcaucuc

SEQ ID NO: 1851110 - RNA, 15 nt, Homo sapiens
ucuaaauauuuccau

SEQ ID NO: 1851111 - RNA, 18 nt, Homo sapiens
aucucuccccauauauaa

SEQ ID NO: 1851112 - RNA, 16 nt, Homo sapiens
uggaauuuaagaaaua

SEQ ID NO: 1851113 - RNA, 15 nt, Homo sapiens
guuuauagaccagaa

SEQ ID NO: 1851114 - RNA, 19 nt, Homo sapiens
agaauguucagaaagccua

SEQ ID NO: 1851115 - RNA, 21 nt, Homo sapiens
guaguguauucucuaaaagcu

SEQ ID NO: 1851116 - RNA, 17 nt, Homo sapiens
cccugggcuugugaaca

SEQ ID NO: 1851117 - RNA, 16 nt, Homo sapiens
cagcccaacaccaccu

SEQ ID NO: 1851118 - RNA, 22 nt, Homo sapiens
caacucuucauuuugagucuca

SEQ ID NO: 1851119 - RNA, 20 nt, Homo sapiens
cauccuucuguguaccacuu

SEQ ID NO: 1851120 - RNA, 20 nt, Homo sapiens
ugaaauuuuagaaauauuca

SEQ ID NO: 1851121 - RNA, 19 nt, Homo sapiens
aauauugugcaugcuagug

SEQ ID NO: 1851122 - RNA, 17 nt, Homo sapiens
agagaacaaagggccaa

SEQ ID NO: 1851123 - RNA, 22 nt, Homo sapiens
agaccugagucugcaugugcac

SEQ ID NO: 1851124 - RNA, 14 nt, Homo sapiens
caaugcacugagug

SEQ ID NO: 1851125 - RNA, 19 nt, Homo sapiens
cccucuugaaucucugaau

SEQ ID NO: 1851126 - RNA, 11 nt, Homo sapiens
uugaugccaua

SEQ ID NO: 1851127 - RNA, 11 nt, Homo sapiens
uagaugccaaa

SEQ ID NO: 1851128 - RNA, 21 nt, Homo sapiens
cgccuguaaucccaacacuuu

SEQ ID NO: 1851129 - RNA, 22 nt, Homo sapiens
gaagaaaauagaacagcucaua

SEQ ID NO: 1851130 - RNA, 21 nt, Homo sapiens
gcacucacaauuguugacuaa

SEQ ID NO: 1851131 - RNA, 20 nt, Homo sapiens
cucauaucaugguagucacu

SEQ ID NO: 1851132 - RNA, 18 nt, Homo sapiens
auuucagccaaacuguag

SEQ ID NO: 1851133 - RNA, 16 nt, Homo sapiens
aaagacauucuuccca

SEQ ID NO: 1851134 - RNA, 19 nt, Homo sapiens
ggcccuaaguuaagcaaaa

SEQ ID NO: 1851135 - RNA, 20 nt, Homo sapiens
uacgauagguagaauugugg

SEQ ID NO: 1851136 - RNA, 17 nt, Homo sapiens
agcaauggcacuguugc

SEQ ID NO: 1851137 - RNA, 17 nt, Homo sapiens
caguugaaaacuuguaa

SEQ ID NO: 1851138 - RNA, 15 nt, Homo sapiens
uggaacugucucuca

SEQ ID NO: 1851139 - RNA, 21 nt, Homo sapiens
ugcuguguaugugaaccaccc

SEQ ID NO: 1851140 - RNA, 19 nt, Homo sapiens
accaugaaagguugguucu

SEQ ID NO: 1851141 - RNA, 12 nt, Homo sapiens
cuucuuacugga

SEQ ID NO: 1851142 - RNA, 18 nt, Homo sapiens
cagcuaucugucaucucu

SEQ ID NO: 1851143 - RNA, 15 nt, Homo sapiens
ucuucaaaugucuaa

SEQ ID NO: 1851144 - RNA, 15 nt, Homo sapiens
cuguuucacauugca

SEQ ID NO: 1851145 - RNA, 23 nt, Homo sapiens
agcuauuugauguaauacuucuu

SEQ ID NO: 1851146 - RNA, 23 nt, Homo sapiens
ccacccccaaauuuucuuuuuau

SEQ ID NO: 1851147 - RNA, 16 nt, Homo sapiens
cuuuaucaucuuucac

SEQ ID NO: 1851148 - RNA, 17 nt, Homo sapiens
uaauacacaaugcauca

SEQ ID NO: 1851149 - RNA, 18 nt, Homo sapiens
ccuggccaacauggcaaa

SEQ ID NO: 1851150 - RNA, 14 nt, Homo sapiens
gggacaagggauuu

SEQ ID NO: 1851151 - RNA, 14 nt, Homo sapiens
uacauuaaggagca

SEQ ID NO: 1851152 - RNA, 22 nt, Homo sapiens
caaguagcugggaguacaggcg

SEQ ID NO: 1851153 - RNA, 23 nt, Homo sapiens
aaagcagcacauagcacugggaa

SEQ ID NO: 1851154 - RNA, 21 nt, Homo sapiens
ucaccucugugccucugucuc

SEQ ID NO: 1851155 - RNA, 20 nt, Homo sapiens
uuuugaauucagaccuggaa

SEQ ID NO: 1851156 - RNA, 20 nt, Homo sapiens
uaaacacaaagcuguugaaa

SEQ ID NO: 1851157 - RNA, 14 nt, Homo sapiens
aucgacuugccaaa

SEQ ID NO: 1851158 - RNA, 21 nt, Homo sapiens
ugccucaucacgccacuggag

SEQ ID NO: 1851159 - RNA, 17 nt, Homo sapiens
agucacccacugucagc

SEQ ID NO: 1851160 - RNA, 19 nt, Homo sapiens
uuucauaaacuucagggau

SEQ ID NO: 1851161 - RNA, 22 nt, Homo sapiens
ugaguuucauuuuucauuuucu

SEQ ID NO: 1851162 - RNA, 18 nt, Homo sapiens
uccuaaucaagagucucu

SEQ ID NO: 1851163 - RNA, 22 nt, Homo sapiens
gauaagcacuagaucucccuua

SEQ ID NO: 1851164 - RNA, 23 nt, Homo sapiens
ugcuaaucaugugggugagccag

SEQ ID NO: 1851165 - RNA, 13 nt, Homo sapiens
agaaucauaugau

SEQ ID NO: 1851166 - RNA, 14 nt, Homo sapiens
caacccuguccuca

SEQ ID NO: 1851167 - RNA, 15 nt, Homo sapiens
auccacuucacaguu

SEQ ID NO: 1851168 - RNA, 17 nt, Homo sapiens
caguguagaucaacuca

SEQ ID NO: 1851169 - RNA, 16 nt, Homo sapiens
agaaaagugggccagu

SEQ ID NO: 1851170 - RNA, 22 nt, Homo sapiens
gaucaaguuauuuuuaauuugg

SEQ ID NO: 1851171 - RNA, 20 nt, Homo sapiens
accccggaagccaaaccucu

SEQ ID NO: 1851172 - RNA, 17 nt, Homo sapiens
gucaagcuucauuauua

SEQ ID NO: 1851173 - RNA, 21 nt, Homo sapiens
cacaaguaacacauuuggcca

SEQ ID NO: 1851174 - RNA, 14 nt, Homo sapiens
uugggccacugcca

SEQ ID NO: 1851175 - RNA, 22 nt, Homo sapiens
cggccuccggcgucuugcccag

SEQ ID NO: 1851176 - RNA, 15 nt, Homo sapiens
acaaguauccaguca

SEQ ID NO: 1851177 - RNA, 18 nt, Homo sapiens
gcugaaggcuuacuucag

SEQ ID NO: 1851178 - RNA, 21 nt, Homo sapiens
uaggagcuccccuguuugcau

SEQ ID NO: 1851179 - RNA, 22 nt, Homo sapiens
aauguucuguuugcuguggaac

SEQ ID NO: 1851180 - RNA, 13 nt, Homo sapiens
gccuucucaggga

SEQ ID NO: 1851181 - RNA, 14 nt, Homo sapiens
uaaacaacuaccuc

SEQ ID NO: 1851182 - RNA, 21 nt, Homo sapiens
cugcaaucugagccagugcuu

SEQ ID NO: 1851183 - RNA, 13 nt, Homo sapiens
auguccuauccaa

SEQ ID NO: 1851184 - RNA, 15 nt, Homo sapiens
gucugggguaaaauu

SEQ ID NO: 1851185 - RNA, 21 nt, Homo sapiens
cauucagggcuauuuuuuccc

SEQ ID NO: 1851186 - RNA, 13 nt, Homo sapiens
aagggcagugaga

SEQ ID NO: 1851187 - RNA, 20 nt, Homo sapiens
gucuucugcuguucuucacu

SEQ ID NO: 1851188 - RNA, 13 nt, Homo sapiens
ccauacucaaaau

SEQ ID NO: 1851189 - RNA, 13 nt, Homo sapiens
ugaccuccacagc

SEQ ID NO: 1851190 - RNA, 17 nt, Homo sapiens
ccaucuugugguaacuu

SEQ ID NO: 1851191 - RNA, 18 nt, Homo sapiens
gacucuucccccacuccu

SEQ ID NO: 1851192 - RNA, 21 nt, Homo sapiens
uauguauucuggguauucuau

SEQ ID NO: 1851193 - RNA, 23 nt, Homo sapiens
ucccaccucuccuuuugaggcuu

SEQ ID NO: 1851194 - RNA, 16 nt, Homo sapiens
ggaaaagaggaguuuc

SEQ ID NO: 1851195 - RNA, 17 nt, Homo sapiens
caguaaauaacuggaaa

SEQ ID NO: 1851196 - RNA, 20 nt, Homo sapiens
caagccccagcagcccucaa

SEQ ID NO: 1851197 - RNA, 23 nt, Homo sapiens
cucucugggccucaguuuuccca

SEQ ID NO: 1851198 - RNA, 15 nt, Homo sapiens
aauaauagcaauuca

SEQ ID NO: 1851199 - RNA, 16 nt, Homo sapiens
auuucaauacuuacau

SEQ ID NO: 1851200 - RNA, 15 nt, Homo sapiens
guuuacagugaugcc

SEQ ID NO: 1851201 - RNA, 21 nt, Homo sapiens
cuguuuuauaaugaacccauc

SEQ ID NO: 1851202 - RNA, 16 nt, Homo sapiens
auuuguugagccccag

SEQ ID NO: 1851203 - RNA, 13 nt, Homo sapiens
uuuugauggcuau

SEQ ID NO: 1851204 - RNA, 17 nt, Homo sapiens
auuaggucucuguugac

SEQ ID NO: 1851205 - RNA, 22 nt, Homo sapiens
ucccucugucccucuccuugcc

SEQ ID NO: 1851206 - RNA, 14 nt, Homo sapiens
auaagcaagagaca

SEQ ID NO: 1851207 - RNA, 15 nt, Homo sapiens
ggaaacucgaauaaa

SEQ ID NO: 1851208 - RNA, 16 nt, Homo sapiens
gugcucagcuacuucu

SEQ ID NO: 1851209 - RNA, 17 nt, Homo sapiens
acagagauaccauucaa

SEQ ID NO: 1851210 - RNA, 17 nt, Homo sapiens
gccuuaagaaagcuaua

SEQ ID NO: 1851211 - RNA, 21 nt, Homo sapiens
gaaaugccgggcacaggccag

SEQ ID NO: 1851212 - RNA, 17 nt, Homo sapiens
cccuuuccucaggcaag

SEQ ID NO: 1851213 - RNA, 20 nt, Homo sapiens
auccauucuuaaaguacuug

SEQ ID NO: 1851214 - RNA, 23 nt, Homo sapiens
guuauuucccaacccaggauuca

SEQ ID NO: 1851215 - RNA, 20 nt, Homo sapiens
aaucacacgucuggcuucac

SEQ ID NO: 1851216 - RNA, 19 nt, Homo sapiens
gagugccccacugcacucc

SEQ ID NO: 1851217 - RNA, 12 nt, Homo sapiens
aaaggugcagga

SEQ ID NO: 1851218 - RNA, 20 nt, Homo sapiens
cagcucuguguuucugggga

SEQ ID NO: 1851219 - RNA, 20 nt, Homo sapiens
acacauacugcaugcucagg

SEQ ID NO: 1851220 - RNA, 12 nt, Homo sapiens
cagguguguuca

SEQ ID NO: 1851221 - RNA, 18 nt, Homo sapiens
cauucaaaaacauggcca

SEQ ID NO: 1851222 - RNA, 23 nt, Homo sapiens
caaugaacuguuucaguagccaa

SEQ ID NO: 1851223 - RNA, 22 nt, Homo sapiens
cucugccugaagucacacagug

SEQ ID NO: 1851224 - RNA, 13 nt, Homo sapiens
acacgaagaccau

SEQ ID NO: 1851225 - RNA, 20 nt, Homo sapiens
ccuucuuagaacucugcuua

SEQ ID NO: 1851226 - RNA, 18 nt, Homo sapiens
ccaagugugugugcaaug

SEQ ID NO: 1851227 - RNA, 22 nt, Homo sapiens
gcagcagcucacacccuaccuu

SEQ ID NO: 1851228 - RNA, 16 nt, Homo sapiens
cucaaaacuguacugu

SEQ ID NO: 1851229 - RNA, 15 nt, Homo sapiens
gggcaggaacugcag

SEQ ID NO: 1851230 - RNA, 18 nt, Homo sapiens
gauggagguucucagagc

SEQ ID NO: 1851231 - RNA, 15 nt, Homo sapiens
uuaauaaccugccag

SEQ ID NO: 1851232 - RNA, 21 nt, Homo sapiens
acacgcccuccccagacucca

SEQ ID NO: 1851233 - RNA, 23 nt, Homo sapiens
uugagcagaacccagacccugag

SEQ ID NO: 1851234 - RNA, 18 nt, Homo sapiens
gcauauaucuuucagauu

SEQ ID NO: 1851235 - RNA, 15 nt, Homo sapiens
caauauuuauuacac

SEQ ID NO: 1851236 - RNA, 14 nt, Homo sapiens
aaccacacuugaaa

SEQ ID NO: 1851237 - RNA, 17 nt, Homo sapiens
ucccuacuuccccaaau

SEQ ID NO: 1851238 - RNA, 16 nt, Homo sapiens
agccccauccaacacu

SEQ ID NO: 1851239 - RNA, 15 nt, Homo sapiens
guccugcuguggaaa

SEQ ID NO: 1851240 - RNA, 13 nt, Homo sapiens
ccuccacauuucc

SEQ ID NO: 1851241 - RNA, 19 nt, Homo sapiens
gagcacagccccugcugug

SEQ ID NO: 1851242 - RNA, 20 nt, Homo sapiens
agggccagaccugccugcau

SEQ ID NO: 1851243 - RNA, 22 nt, Homo sapiens
augccagcucagucccaucaga

SEQ ID NO: 1851244 - RNA, 16 nt, Homo sapiens
cuugaacugcugccaa

SEQ ID NO: 1851245 - RNA, 21 nt, Homo sapiens
acagaacuucagaaagacuug

SEQ ID NO: 1851246 - RNA, 13 nt, Homo sapiens
uucaccugcaaac

SEQ ID NO: 1851247 - RNA, 21 nt, Homo sapiens
agguggggagggccucuggac

SEQ ID NO: 1851248 - RNA, 15 nt, Homo sapiens
ucugggaggcccuga

SEQ ID NO: 1851249 - RNA, 15 nt, Homo sapiens
cucugccuuaaacac

SEQ ID NO: 1851250 - RNA, 21 nt, Homo sapiens
caauuaauggaaaacuguuaa

SEQ ID NO: 1851251 - RNA, 17 nt, Homo sapiens
cuguuccuuaauuugau

SEQ ID NO: 1851252 - RNA, 21 nt, Homo sapiens
ucacaugcuagcaacauacca

SEQ ID NO: 1851253 - RNA, 18 nt, Homo sapiens
cuuccuggaguacaaaca

SEQ ID NO: 1851254 - RNA, 21 nt, Homo sapiens
ucggauccccuuccuaccacc

SEQ ID NO: 1851255 - RNA, 22 nt, Homo sapiens
ggauuuucaaagauuguuggca

SEQ ID NO: 1851256 - RNA, 20 nt, Homo sapiens
uccagcccagacccagugga

SEQ ID NO: 1851257 - RNA, 19 nt, Homo sapiens
uuacgcuuuucuaagaaua

SEQ ID NO: 1851258 - RNA, 15 nt, Homo sapiens
aaagaggcugccccu

SEQ ID NO: 1851259 - RNA, 11 nt, Homo sapiens
uaaaaccacua

SEQ ID NO: 1851260 - RNA, 23 nt, Homo sapiens
guaauuucugccaauaaauucua

SEQ ID NO: 1851261 - RNA, 14 nt, Homo sapiens
uauggacucugcac

SEQ ID NO: 1851262 - RNA, 15 nt, Homo sapiens
ugcucacugcucaca

SEQ ID NO: 1851263 - RNA, 13 nt, Homo sapiens
cugcuaggccaga

SEQ ID NO: 1851264 - RNA, 15 nt, Homo sapiens
agauaaucucucagc

SEQ ID NO: 1851265 - RNA, 21 nt, Homo sapiens
guaagagaauguugaauacuu

SEQ ID NO: 1851266 - RNA, 15 nt, Homo sapiens
agauccucugcugac

SEQ ID NO: 1851267 - RNA, 13 nt, Homo sapiens
cccucugcagucu

SEQ ID NO: 1851268 - RNA, 17 nt, Homo sapiens
acucagaaccugcuccu

SEQ ID NO: 1851269 - RNA, 17 nt, Homo sapiens
caauaaaugaaugaaua

SEQ ID NO: 1851270 - RNA, 18 nt, Homo sapiens
cacuaaccccauucauga

SEQ ID NO: 1851271 - RNA, 21 nt, Homo sapiens
ugacggcccugcaauguaucc

SEQ ID NO: 1851272 - RNA, 16 nt, Homo sapiens
uaagcugacucuuugc

SEQ ID NO: 1851273 - RNA, 15 nt, Homo sapiens
gugaacugcagugau

SEQ ID NO: 1851274 - RNA, 14 nt, Homo sapiens
ccauggaaugcuug

SEQ ID NO: 1851275 - RNA, 22 nt, Homo sapiens
ggauugugaagauuucauggac

SEQ ID NO: 1851276 - RNA, 17 nt, Homo sapiens
ugaccuugacuugccau

SEQ ID NO: 1851277 - RNA, 19 nt, Homo sapiens
aacucagcaauggcagauu

SEQ ID NO: 1851278 - RNA, 15 nt, Homo sapiens
aagcaguugcaauga

SEQ ID NO: 1851279 - RNA, 23 nt, Homo sapiens
ccauuguguugggaccugugauc

SEQ ID NO: 1851280 - RNA, 19 nt, Homo sapiens
aagagccagacucugucuc

SEQ ID NO: 1851281 - RNA, 16 nt, Homo sapiens
cuguuaaagauguugc

SEQ ID NO: 1851282 - RNA, 17 nt, Homo sapiens
gaccagggccaucuccu

SEQ ID NO: 1851283 - RNA, 16 nt, Homo sapiens
aaacaacuuucucuug

SEQ ID NO: 1851284 - RNA, 19 nt, Homo sapiens
ggcaggagggcaugugcag

SEQ ID NO: 1851285 - RNA, 22 nt, Homo sapiens
caucccugaaacauugcaugua

SEQ ID NO: 1851286 - RNA, 18 nt, Homo sapiens
uggcuaaaggucccaagg

SEQ ID NO: 1851287 - RNA, 17 nt, Homo sapiens
uauucucuuaauuuuuc

SEQ ID NO: 1851288 - RNA, 17 nt, Homo sapiens
ccugccccccagucucc

SEQ ID NO: 1851289 - RNA, 18 nt, Homo sapiens
cugagauucuucguguau

SEQ ID NO: 1851290 - RNA, 20 nt, Homo sapiens
caccaggcucugcuggaugu

SEQ ID NO: 1851291 - RNA, 14 nt, Homo sapiens
ugcuccccugugaa

SEQ ID NO: 1851292 - RNA, 22 nt, Homo sapiens
agaaauugacacaaguggaccu

SEQ ID NO: 1851293 - RNA, 21 nt, Homo sapiens
uaauacaccgauaaccacagg

SEQ ID NO: 1851294 - RNA, 22 nt, Homo sapiens
caacagccaugcccgcauuagc

SEQ ID NO: 1851295 - RNA, 20 nt, Homo sapiens
uauugaaguuuugacaucaa

SEQ ID NO: 1851296 - RNA, 12 nt, Homo sapiens
acuggaccgcug

SEQ ID NO: 1851297 - RNA, 20 nt, Homo sapiens
aagccuccccaguucuacug

SEQ ID NO: 1851298 - RNA, 22 nt, Homo sapiens
gauuuucaugauucaugagcug

SEQ ID NO: 1851299 - RNA, 18 nt, Homo sapiens
ucucgucuccugacaugu

SEQ ID NO: 1851300 - RNA, 23 nt, Homo sapiens
ggucugggugggggcaaagagac

SEQ ID NO: 1851301 - RNA, 15 nt, Homo sapiens
ugguguuuuuacaga

SEQ ID NO: 1851302 - RNA, 19 nt, Homo sapiens
aaacucuggaugauucuuc

SEQ ID NO: 1851303 - RNA, 21 nt, Homo sapiens
ucuuggagucaaaaggcaaau

SEQ ID NO: 1851304 - RNA, 14 nt, Homo sapiens
ugauauaugccuau

SEQ ID NO: 1851305 - RNA, 15 nt, Homo sapiens
guauuuaagacauaa

SEQ ID NO: 1851306 - RNA, 19 nt, Homo sapiens
cagaucaacagcaaccucu

SEQ ID NO: 1851307 - RNA, 21 nt, Homo sapiens
acacugaggagagauucccgc

SEQ ID NO: 1851308 - RNA, 13 nt, Homo sapiens
gcaacccucugaa

SEQ ID NO: 1851309 - RNA, 12 nt, Homo sapiens
acucugugucag

SEQ ID NO: 1851310 - RNA, 13 nt, Homo sapiens
cugaaacaaaagu

SEQ ID NO: 1851311 - RNA, 21 nt, Homo sapiens
accugacaggggucacucauu

SEQ ID NO: 1851312 - RNA, 20 nt, Homo sapiens
ucaaauggggccagauccag

SEQ ID NO: 1851313 - RNA, 14 nt, Homo sapiens
cuguaaagacuuuu

SEQ ID NO: 1851314 - RNA, 21 nt, Homo sapiens
aaguuagggaugacugugauu

SEQ ID NO: 1851315 - RNA, 22 nt, Homo sapiens
cuuuacggguguaaacacugau

SEQ ID NO: 1851316 - RNA, 18 nt, Homo sapiens
aggccaauaaaaaguuca

SEQ ID NO: 1851317 - RNA, 17 nt, Homo sapiens
auccacgcacacaugga

SEQ ID NO: 1851318 - RNA, 22 nt, Homo sapiens
caguccacugagcaagcaaggg

SEQ ID NO: 1851319 - RNA, 22 nt, Homo sapiens
ccuggugggugguguccugaag

SEQ ID NO: 1851320 - RNA, 18 nt, Homo sapiens
cagaacaucgauauguau

SEQ ID NO: 1851321 - RNA, 15 nt, Homo sapiens
aucuuccaaauccaa

SEQ ID NO: 1851322 - RNA, 15 nt, Homo sapiens
aacagggucacuugg

SEQ ID NO: 1851323 - RNA, 22 nt, Homo sapiens
uuugaauagccuguuccuuuaa

SEQ ID NO: 1851324 - RNA, 18 nt, Homo sapiens
aggcuggagugcaaugca

SEQ ID NO: 1851325 - RNA, 18 nt, Homo sapiens
ugagccguugcuaaugcc

SEQ ID NO: 1851326 - RNA, 19 nt, Homo sapiens
acugcgcguuuucaaagac

SEQ ID NO: 1851327 - RNA, 23 nt, Homo sapiens
ucccagccuggccaccagcuucc

SEQ ID NO: 1851328 - RNA, 23 nt, Homo sapiens
uaccuugaaaaaaagaaaagugu

SEQ ID NO: 1851329 - RNA, 16 nt, Homo sapiens
accaggggcugacaau

SEQ ID NO: 1851330 - RNA, 15 nt, Homo sapiens
uuugcuguaccacaa

SEQ ID NO: 1851331 - RNA, 15 nt, Homo sapiens
uuugcuauaccacag

SEQ ID NO: 1851332 - RNA, 21 nt, Homo sapiens
gaggccccaccugaagggugg

SEQ ID NO: 1851333 - RNA, 16 nt, Homo sapiens
acuuccuugcucuccc

SEQ ID NO: 1851334 - RNA, 16 nt, Homo sapiens
augaguuaacugugaa

SEQ ID NO: 1851335 - RNA, 18 nt, Homo sapiens
gacuacuagggaaaugcc

SEQ ID NO: 1851336 - RNA, 14 nt, Homo sapiens
guagcaagaugagc

SEQ ID NO: 1851337 - RNA, 13 nt, Homo sapiens
ggcauagccuuuc

SEQ ID NO: 1851338 - RNA, 17 nt, Homo sapiens
uaauaugucaccuggca

SEQ ID NO: 1851339 - RNA, 11 nt, Homo sapiens
uggcaucuccc

SEQ ID NO: 1851340 - RNA, 19 nt, Homo sapiens
caguaggauauuggcauuu

SEQ ID NO: 1851341 - RNA, 23 nt, Homo sapiens
uacuucucacuaauuuguaggaa

SEQ ID NO: 1851342 - RNA, 14 nt, Homo sapiens
uaucacacuugcaa

SEQ ID NO: 1851343 - RNA, 20 nt, Homo sapiens
acguuggccuaacacugggc

SEQ ID NO: 1851344 - RNA, 13 nt, Homo sapiens
cacuacuaccucu

SEQ ID NO: 1851345 - RNA, 14 nt, Homo sapiens
ccuggagauccucc

SEQ ID NO: 1851346 - RNA, 16 nt, Homo sapiens
ggccacuggcccuguu

SEQ ID NO: 1851347 - RNA, 15 nt, Homo sapiens
uaccugggaccucac

SEQ ID NO: 1851348 - RNA, 14 nt, Homo sapiens
uugccaaaaacaaa

SEQ ID NO: 1851349 - RNA, 15 nt, Homo sapiens
cucuguaaacuucca

SEQ ID NO: 1851350 - RNA, 17 nt, Homo sapiens
aaugugacauguugcuc

SEQ ID NO: 1851351 - RNA, 15 nt, Homo sapiens
aagugccauuaacaa

SEQ ID NO: 1851352 - RNA, 16 nt, Homo sapiens
ugccuuggcuuugcca

SEQ ID NO: 1851353 - RNA, 17 nt, Homo sapiens
uucucuucucucuucaa

SEQ ID NO: 1851354 - RNA, 21 nt, Homo sapiens
uauauauuuuaagguugcaca

SEQ ID NO: 1851355 - RNA, 11 nt, Homo sapiens
aauuugcaccu

SEQ ID NO: 1851356 - RNA, 12 nt, Homo sapiens
gcaaaguaauag

SEQ ID NO: 1851357 - RNA, 20 nt, Homo sapiens
gugacucgagucacacucaa

SEQ ID NO: 1851358 - RNA, 19 nt, Homo sapiens
acaauuucaacuacaguga

SEQ ID NO: 1851359 - RNA, 20 nt, Homo sapiens
acaggaccaccuccucugcc

SEQ ID NO: 1851360 - RNA, 20 nt, Homo sapiens
cugcaaaauagacauauuaa

SEQ ID NO: 1851361 - RNA, 14 nt, Homo sapiens
auaccugcucuugu

SEQ ID NO: 1851362 - RNA, 15 nt, Homo sapiens
aggaaucugugcaga

SEQ ID NO: 1851363 - RNA, 15 nt, Homo sapiens
cuugugauguuuuga

SEQ ID NO: 1851364 - RNA, 18 nt, Homo sapiens
uguaaaauuguuaguaaa

SEQ ID NO: 1851365 - RNA, 17 nt, Homo sapiens
aacagauuuaagcaaga

SEQ ID NO: 1851366 - RNA, 19 nt, Homo sapiens
acuguuugaaucuugucuc

SEQ ID NO: 1851367 - RNA, 17 nt, Homo sapiens
ccugggggaugcaaaua

SEQ ID NO: 1851368 - RNA, 14 nt, Homo sapiens
ugcccccaucuuuc

SEQ ID NO: 1851369 - RNA, 15 nt, Homo sapiens
cacuggacuugucca

SEQ ID NO: 1851370 - RNA, 17 nt, Homo sapiens
cuuguauuuaauacaca

SEQ ID NO: 1851371 - RNA, 16 nt, Homo sapiens
acuggcgaagccugag

SEQ ID NO: 1851372 - RNA, 14 nt, Homo sapiens
cgcaaggcugugcu

SEQ ID NO: 1851373 - RNA, 16 nt, Homo sapiens
guuccaugccugcucu

SEQ ID NO: 1851374 - RNA, 16 nt, Homo sapiens
gggagacugccagugg

SEQ ID NO: 1851375 - RNA, 15 nt, Homo sapiens
uuuccauagcucuuc

SEQ ID NO: 1851376 - RNA, 15 nt, Homo sapiens
caagcagaugaacua

SEQ ID NO: 1851377 - RNA, 19 nt, Homo sapiens
ugcuuuuuuaaacuugaau

SEQ ID NO: 1851378 - RNA, 17 nt, Homo sapiens
uuugaagcagucuugcu

SEQ ID NO: 1851379 - RNA, 13 nt, Homo sapiens
acauaauguauca

SEQ ID NO: 1851380 - RNA, 18 nt, Homo sapiens
agaacugccccaucuccu

SEQ ID NO: 1851381 - RNA, 15 nt, Homo sapiens
cagcuucuucuuuca

SEQ ID NO: 1851382 - RNA, 19 nt, Homo sapiens
uaauaugucaaaaagggcu

SEQ ID NO: 1851383 - RNA, 17 nt, Homo sapiens
cacauggaaggugaugg

SEQ ID NO: 1851384 - RNA, 19 nt, Homo sapiens
uggagggcuagaaccugga

SEQ ID NO: 1851385 - RNA, 22 nt, Homo sapiens
aacauuauguggcccucuggau

SEQ ID NO: 1851386 - RNA, 16 nt, Homo sapiens
ccgaggcccugcaugg

SEQ ID NO: 1851387 - RNA, 19 nt, Homo sapiens
aauuuaacaugacuucugc

SEQ ID NO: 1851388 - RNA, 12 nt, Homo sapiens
ggaauguguuca

SEQ ID NO: 1851389 - RNA, 13 nt, Homo sapiens
aauguuucagcug

SEQ ID NO: 1851390 - RNA, 22 nt, Homo sapiens
uguauuacaucuaaugcuucaa

SEQ ID NO: 1851391 - RNA, 17 nt, Homo sapiens
auuaaguacaugugcca

SEQ ID NO: 1851392 - RNA, 19 nt, Homo sapiens
accuaaauugaacugccaa

SEQ ID NO: 1851393 - RNA, 23 nt, Homo sapiens
uauaugaugauuuuuuucucaau

SEQ ID NO: 1851394 - RNA, 11 nt, Homo sapiens
uugcaauaagg

SEQ ID NO: 1851395 - RNA, 13 nt, Homo sapiens
uggccccucucag

SEQ ID NO: 1851396 - RNA, 16 nt, Homo sapiens
cauugugaaccaaugc

SEQ ID NO: 1851397 - RNA, 14 nt, Homo sapiens
acaagcaaugcaag

SEQ ID NO: 1851398 - RNA, 16 nt, Homo sapiens
uuuuuccucauugaga

SEQ ID NO: 1851399 - RNA, 19 nt, Homo sapiens
aagggcaaggaguuuauua

SEQ ID NO: 1851400 - RNA, 12 nt, Homo sapiens
guagugaccuaa

SEQ ID NO: 1851401 - RNA, 16 nt, Homo sapiens
aauccacaaaugaugc

SEQ ID NO: 1851402 - RNA, 18 nt, Homo sapiens
cuugucuuuggacccuga

SEQ ID NO: 1851403 - RNA, 20 nt, Homo sapiens
cuuaagugcccacauuugau

SEQ ID NO: 1851404 - RNA, 21 nt, Homo sapiens
guccagccccuccucccucag

SEQ ID NO: 1851405 - RNA, 13 nt, Homo sapiens
acuccuagacuuu

SEQ ID NO: 1851406 - RNA, 13 nt, Homo sapiens
ggcucuagggccu

SEQ ID NO: 1851407 - RNA, 17 nt, Homo sapiens
agugaccugcccuacau

SEQ ID NO: 1851408 - RNA, 14 nt, Homo sapiens
aauuguacauuccc

SEQ ID NO: 1851409 - RNA, 22 nt, Homo sapiens
ugcacccaggaggggaacacug

SEQ ID NO: 1851410 - RNA, 13 nt, Homo sapiens
cccacagguauga

SEQ ID NO: 1851411 - RNA, 17 nt, Homo sapiens
auaaaacacaucaucaa

SEQ ID NO: 1851412 - RNA, 16 nt, Homo sapiens
aaaucaguugugaaua

SEQ ID NO: 1851413 - RNA, 20 nt, Homo sapiens
ugagucagugccaugacuga

SEQ ID NO: 1851414 - RNA, 13 nt, Homo sapiens
aaauaguuaucuu

SEQ ID NO: 1851415 - RNA, 14 nt, Homo sapiens
uuagcuuuacaaau

SEQ ID NO: 1851416 - RNA, 14 nt, Homo sapiens
auuuucagccaaag

SEQ ID NO: 1851417 - RNA, 14 nt, Homo sapiens
aucuuccuccucua

SEQ ID NO: 1851418 - RNA, 14 nt, Homo sapiens
aucucccuccucca

SEQ ID NO: 1851419 - RNA, 16 nt, Homo sapiens
aaaugcuuuuccucaa

SEQ ID NO: 1851420 - RNA, 15 nt, Homo sapiens
ccagauuccauuuca

SEQ ID NO: 1851421 - RNA, 14 nt, Homo sapiens
ucuguucacgucca

SEQ ID NO: 1851422 - RNA, 19 nt, Homo sapiens
aggaaacuuggacauuuau

SEQ ID NO: 1851423 - RNA, 15 nt, Homo sapiens
gaucacacaguguua

SEQ ID NO: 1851424 - RNA, 14 nt, Homo sapiens
uugcccagagcucu

SEQ ID NO: 1851425 - RNA, 17 nt, Homo sapiens
ucucuauguauguagcg

SEQ ID NO: 1851426 - RNA, 14 nt, Homo sapiens
ucugcauacgagag

SEQ ID NO: 1851427 - RNA, 17 nt, Homo sapiens
caguucaaaaacaagac

SEQ ID NO: 1851428 - RNA, 15 nt, Homo sapiens
uauuucuugcauuca

SEQ ID NO: 1851429 - RNA, 14 nt, Homo sapiens
cagggcauuuuaca

SEQ ID NO: 1851430 - RNA, 16 nt, Homo sapiens
ccacucaccacaagcu

SEQ ID NO: 1851431 - RNA, 20 nt, Homo sapiens
auuacuuucugccgcuguca

SEQ ID NO: 1851432 - RNA, 17 nt, Homo sapiens
uucuuccaugucuauua

SEQ ID NO: 1851433 - RNA, 13 nt, Homo sapiens
ugcacuaagacaa

SEQ ID NO: 1851434 - RNA, 16 nt, Homo sapiens
uaauaaauugucauca

SEQ ID NO: 1851435 - RNA, 18 nt, Homo sapiens
agaaccuuuugagugccu

SEQ ID NO: 1851436 - RNA, 22 nt, Homo sapiens
acaacccucuccuguuuacuga

SEQ ID NO: 1851437 - RNA, 13 nt, Homo sapiens
uaguauacauugu

SEQ ID NO: 1851438 - RNA, 16 nt, Homo sapiens
cuacucuuaaguuucu

SEQ ID NO: 1851439 - RNA, 19 nt, Homo sapiens
uguacaauaaguuacuuga

SEQ ID NO: 1851440 - RNA, 23 nt, Homo sapiens
gcaugggcuuugucuuggacucu

SEQ ID NO: 1851441 - RNA, 23 nt, Homo sapiens
accuacgguggucggugggaccc

SEQ ID NO: 1851442 - RNA, 11 nt, Homo sapiens
cgugugcccac

SEQ ID NO: 1851443 - RNA, 21 nt, Homo sapiens
gacuuauggcaugacucuuca

SEQ ID NO: 1851444 - RNA, 18 nt, Homo sapiens
cagaaugaugccaaaaua

SEQ ID NO: 1851445 - RNA, 12 nt, Homo sapiens
cugccccucggg

SEQ ID NO: 1851446 - RNA, 19 nt, Homo sapiens
ucuccugugauccuuugau

SEQ ID NO: 1851447 - RNA, 17 nt, Homo sapiens
gggcggcccacacccag

SEQ ID NO: 1851448 - RNA, 18 nt, Homo sapiens
cagcuucucaaaguacug

SEQ ID NO: 1851449 - RNA, 16 nt, Homo sapiens
caucuaagacauucac

SEQ ID NO: 1851450 - RNA, 12 nt, Homo sapiens
caaacugcaaua

SEQ ID NO: 1851451 - RNA, 16 nt, Homo sapiens
cuaaagagucuggaac

SEQ ID NO: 1851452 - RNA, 15 nt, Homo sapiens
agcuuucaagcucau

SEQ ID NO: 1851453 - RNA, 21 nt, Homo sapiens
uggggacgggggcugcuucuc

SEQ ID NO: 1851454 - RNA, 15 nt, Homo sapiens
ccuuaaccguggacu

SEQ ID NO: 1851455 - RNA, 23 nt, Homo sapiens
cuaaugcacucugggucuggcca

SEQ ID NO: 1851456 - RNA, 13 nt, Homo sapiens
gcccagugcacac

SEQ ID NO: 1851457 - RNA, 20 nt, Homo sapiens
caaagugagacuccgucaca

SEQ ID NO: 1851458 - RNA, 22 nt, Homo sapiens
cuuguguguaccacacccugcc

SEQ ID NO: 1851459 - RNA, 17 nt, Homo sapiens
ccaaccggucacccagg

SEQ ID NO: 1851460 - RNA, 17 nt, Homo sapiens
aggccaagucuaaugaa

SEQ ID NO: 1851461 - RNA, 13 nt, Homo sapiens
agacaacuugcuc

SEQ ID NO: 1851462 - RNA, 16 nt, Homo sapiens
acuaccuucaugcaua

SEQ ID NO: 1851463 - RNA, 16 nt, Homo sapiens
acauaaguuaugguuu

SEQ ID NO: 1851464 - RNA, 15 nt, Homo sapiens
cacaaaucauuccau

SEQ ID NO: 1851465 - RNA, 18 nt, Homo sapiens
auuccuguucccaugaga

SEQ ID NO: 1851466 - RNA, 14 nt, Homo sapiens
uucuuacacacugu

SEQ ID NO: 1851467 - RNA, 14 nt, Homo sapiens
auacuacaaccuca

SEQ ID NO: 1851468 - RNA, 12 nt, Homo sapiens
cuguaacuacuu

SEQ ID NO: 1851469 - RNA, 12 nt, Homo sapiens
acuaaacucuga

SEQ ID NO: 1851470 - RNA, 23 nt, Homo sapiens
ucugcccgggaaggucaccagca

SEQ ID NO: 1851471 - RNA, 19 nt, Homo sapiens
accucugaucaaagcaccu

SEQ ID NO: 1851472 - RNA, 21 nt, Homo sapiens
cuccuaaaauaaacaugaagc

SEQ ID NO: 1851473 - RNA, 19 nt, Homo sapiens
cagaaaaaaaagugucuca

SEQ ID NO: 1851474 - RNA, 18 nt, Homo sapiens
gggcgcucucccuaccuu

SEQ ID NO: 1851475 - RNA, 12 nt, Homo sapiens
ucucacaugcag

SEQ ID NO: 1851476 - RNA, 12 nt, Homo sapiens
gcugacauucac

SEQ ID NO: 1851477 - RNA, 20 nt, Homo sapiens
guugaaucuugcacauauuu

SEQ ID NO: 1851478 - RNA, 13 nt, Homo sapiens
cuguccugcaaau

SEQ ID NO: 1851479 - RNA, 17 nt, Homo sapiens
cggaggucucuguaaaa

SEQ ID NO: 1851480 - RNA, 19 nt, Homo sapiens
gaaaacuagauaaacugcu

SEQ ID NO: 1851481 - RNA, 21 nt, Homo sapiens
cauuuuuuuuauauugccuua

SEQ ID NO: 1851482 - RNA, 22 nt, Homo sapiens
gacgcugcugucacaaccaaga

SEQ ID NO: 1851483 - RNA, 22 nt, Homo sapiens
cagaaauuuuaagccaaaaaca

SEQ ID NO: 1851484 - RNA, 17 nt, Homo sapiens
ugaaaacaucuggaagg

SEQ ID NO: 1851485 - RNA, 17 nt, Homo sapiens
acuucaguugcuuugca

SEQ ID NO: 1851486 - RNA, 22 nt, Homo sapiens
agugccuuccgugggucauccc

SEQ ID NO: 1851487 - RNA, 20 nt, Homo sapiens
cccagcguagucaagggugg

SEQ ID NO: 1851488 - RNA, 15 nt, Homo sapiens
uccaaucagagaaua

SEQ ID NO: 1851489 - RNA, 15 nt, Homo sapiens
cuuugauucaccaaa

SEQ ID NO: 1851490 - RNA, 12 nt, Homo sapiens
cgaagcccaguu

SEQ ID NO: 1851491 - RNA, 18 nt, Homo sapiens
caacuaaugccuuacucu

SEQ ID NO: 1851492 - RNA, 19 nt, Homo sapiens
ugaaaguguuuuacucuuu

SEQ ID NO: 1851493 - RNA, 17 nt, Homo sapiens
caaccagagaugacuga

SEQ ID NO: 1851494 - RNA, 13 nt, Homo sapiens
ucuugccaugugc

SEQ ID NO: 1851495 - RNA, 16 nt, Homo sapiens
gccacuagguuucacc

SEQ ID NO: 1851496 - RNA, 23 nt, Homo sapiens
ggcagguaggucggcacuuggac

SEQ ID NO: 1851497 - RNA, 20 nt, Homo sapiens
guauguccccauaagacaaa

SEQ ID NO: 1851498 - RNA, 20 nt, Homo sapiens
auucacucccacacccaaga

SEQ ID NO: 1851499 - RNA, 18 nt, Homo sapiens
ugaacaggaugcugaugu

SEQ ID NO: 1851500 - RNA, 22 nt, Homo sapiens
ggcccuggaauugcagcuguac

SEQ ID NO: 1851501 - RNA, 16 nt, Homo sapiens
uccagucuguucucac

SEQ ID NO: 1851502 - RNA, 13 nt, Homo sapiens
ccagcugacuguu

SEQ ID NO: 1851503 - RNA, 15 nt, Homo sapiens
acaucagaaagggag

SEQ ID NO: 1851504 - RNA, 16 nt, Homo sapiens
aaagggcgggccuguu

SEQ ID NO: 1851505 - RNA, 20 nt, Homo sapiens
ccaggacccaucuuucucac

SEQ ID NO: 1851506 - RNA, 14 nt, Homo sapiens
uggcuucuccguca

SEQ ID NO: 1851507 - RNA, 14 nt, Homo sapiens
uccagaacugcacu

SEQ ID NO: 1851508 - RNA, 14 nt, Homo sapiens
ucagcaacugaggu

SEQ ID NO: 1851509 - RNA, 19 nt, Homo sapiens
aucugguuuaagaguaaca

SEQ ID NO: 1851510 - RNA, 15 nt, Homo sapiens
aacuuaaaucacuga

SEQ ID NO: 1851511 - RNA, 18 nt, Homo sapiens
uuaucugagucaacuccu

SEQ ID NO: 1851512 - RNA, 20 nt, Homo sapiens
aucaccgugggcucccugac

SEQ ID NO: 1851513 - RNA, 14 nt, Homo sapiens
caagcuuuugcuug

SEQ ID NO: 1851514 - RNA, 15 nt, Homo sapiens
uccacacacagcagc

SEQ ID NO: 1851515 - RNA, 12 nt, Homo sapiens
acugucuguaua

SEQ ID NO: 1851516 - RNA, 19 nt, Homo sapiens
ccuuggucacaugugacau

SEQ ID NO: 1851517 - RNA, 22 nt, Homo sapiens
gucagcauguuuccagcacuau

SEQ ID NO: 1851518 - RNA, 20 nt, Homo sapiens
aaaucugagaaacucuacau

SEQ ID NO: 1851519 - RNA, 20 nt, Homo sapiens
gccuucacauuccccugggg

SEQ ID NO: 1851520 - RNA, 23 nt, Homo sapiens
ugagccucaugucugguauauau

SEQ ID NO: 1851521 - RNA, 15 nt, Homo sapiens
gaaaaacaaauaaaa

SEQ ID NO: 1851522 - RNA, 20 nt, Homo sapiens
ugguuaucuaauauguaaca

SEQ ID NO: 1851523 - RNA, 19 nt, Homo sapiens
gagggaagguucuucauga

SEQ ID NO: 1851524 - RNA, 18 nt, Homo sapiens
uuaaugugaccuagcaau

SEQ ID NO: 1851525 - RNA, 19 nt, Homo sapiens
uccccuuugguuuuacuac

SEQ ID NO: 1851526 - RNA, 18 nt, Homo sapiens
gcauuuuuaaucagugga

SEQ ID NO: 1851527 - RNA, 18 nt, Homo sapiens
auagacacauacauguca

SEQ ID NO: 1851528 - RNA, 12 nt, Homo sapiens
agacgccuguua

SEQ ID NO: 1851529 - RNA, 21 nt, Homo sapiens
guagaugccacccaguuguga

SEQ ID NO: 1851530 - RNA, 20 nt, Homo sapiens
uccaacuccuuucagccaca

SEQ ID NO: 1851531 - RNA, 23 nt, Homo sapiens
cgucuuucgcacauucuccugau

SEQ ID NO: 1851532 - RNA, 17 nt, Homo sapiens
cuguucccuccaggcaa

SEQ ID NO: 1851533 - RNA, 15 nt, Homo sapiens
cagacucuggucaag

SEQ ID NO: 1851534 - RNA, 13 nt, Homo sapiens
aggccugaagcca

SEQ ID NO: 1851535 - RNA, 16 nt, Homo sapiens
acagaguagaaacuca

SEQ ID NO: 1851536 - RNA, 17 nt, Homo sapiens
ccuucaccuccagguuc

SEQ ID NO: 1851537 - RNA, 19 nt, Homo sapiens
aucccaaucaaagaauuac

SEQ ID NO: 1851538 - RNA, 14 nt, Homo sapiens
uccucaccgucucg

SEQ ID NO: 1851539 - RNA, 18 nt, Homo sapiens
ugcccccuucucccacac

SEQ ID NO: 1851540 - RNA, 23 nt, Homo sapiens
cuagugaaaauacagcaggcaga

SEQ ID NO: 1851541 - RNA, 20 nt, Homo sapiens
aaaucaucucucaucacuuu

SEQ ID NO: 1851542 - RNA, 20 nt, Homo sapiens
aggcaggagaaucacuggaa

SEQ ID NO: 1851543 - RNA, 13 nt, Homo sapiens
uaaggaacauaaa

SEQ ID NO: 1851544 - RNA, 23 nt, Homo sapiens
uccccuaaaccaaaaacugaaag

SEQ ID NO: 1851545 - RNA, 23 nt, Homo sapiens
ccugcgugccgggagaggacucu

SEQ ID NO: 1851546 - RNA, 15 nt, Homo sapiens
ucuacaucacucuca

SEQ ID NO: 1851547 - RNA, 23 nt, Homo sapiens
acauaugauaaaaaaguguccua

SEQ ID NO: 1851548 - RNA, 16 nt, Homo sapiens
accuuccacucuggaa

SEQ ID NO: 1851549 - RNA, 22 nt, Homo sapiens
acuggcuggcccucucauucuc

SEQ ID NO: 1851550 - RNA, 20 nt, Homo sapiens
uugaaacuaucucaugccag

SEQ ID NO: 1851551 - RNA, 18 nt, Homo sapiens
cuggacggggacugggga

SEQ ID NO: 1851552 - RNA, 22 nt, Homo sapiens
agcugaccucagaggaguuuaa

SEQ ID NO: 1851553 - RNA, 18 nt, Homo sapiens
ggacccagggaacagcca

SEQ ID NO: 1851554 - RNA, 20 nt, Homo sapiens
ccaggauucccccaacacac

SEQ ID NO: 1851555 - RNA, 13 nt, Homo sapiens
cgccagaucugca

SEQ ID NO: 1851556 - RNA, 16 nt, Homo sapiens
ggaguaggacauacca

SEQ ID NO: 1851557 - RNA, 20 nt, Homo sapiens
accuaauugcacaacagaga

SEQ ID NO: 1851558 - RNA, 17 nt, Homo sapiens
guccuucacaucaccca

SEQ ID NO: 1851559 - RNA, 14 nt, Homo sapiens
agauggagaggcau

SEQ ID NO: 1851560 - RNA, 22 nt, Homo sapiens
auaaugcugccucauuuucaca

SEQ ID NO: 1851561 - RNA, 22 nt, Homo sapiens
uugaugccuuuuuuuucaugac

SEQ ID NO: 1851562 - RNA, 15 nt, Homo sapiens
gcgagacuccaucuc

SEQ ID NO: 1851563 - RNA, 22 nt, Homo sapiens
uggaauauaaggaaagcaauaa

SEQ ID NO: 1851564 - RNA, 16 nt, Homo sapiens
gccaggaaagcagcaa

SEQ ID NO: 1851565 - RNA, 13 nt, Homo sapiens
cagcccuccuacg

SEQ ID NO: 1851566 - RNA, 18 nt, Homo sapiens
uggcccgcaauacuguag

SEQ ID NO: 1851567 - RNA, 16 nt, Homo sapiens
cacagaggaucugcuu

SEQ ID NO: 1851568 - RNA, 14 nt, Homo sapiens
uuaaaaucugugaa

SEQ ID NO: 1851569 - RNA, 17 nt, Homo sapiens
augcauaaaagggucaa

SEQ ID NO: 1851570 - RNA, 18 nt, Homo sapiens
cuuuucauagugcucaga

SEQ ID NO: 1851571 - RNA, 16 nt, Homo sapiens
agggucaaaguacaga

SEQ ID NO: 1851572 - RNA, 13 nt, Homo sapiens
uaggaagcacuga

SEQ ID NO: 1851573 - RNA, 14 nt, Homo sapiens
gucauuugugcaag

SEQ ID NO: 1851574 - RNA, 20 nt, Homo sapiens
gccuggucaauaaaccacug

SEQ ID NO: 1851575 - RNA, 20 nt, Homo sapiens
ugaaaaaucacauccuggcc

SEQ ID NO: 1851576 - RNA, 18 nt, Homo sapiens
cugagaaucagacugaca

SEQ ID NO: 1851577 - RNA, 12 nt, Homo sapiens
gaaggugccacu

SEQ ID NO: 1851578 - RNA, 22 nt, Homo sapiens
uagcaugcugcuuuuuguacuu

SEQ ID NO: 1851579 - RNA, 19 nt, Homo sapiens
aaucauauucauaugcaga

SEQ ID NO: 1851580 - RNA, 16 nt, Homo sapiens
ugaccucacugugacc

SEQ ID NO: 1851581 - RNA, 18 nt, Homo sapiens
uaucugugaauucagauu

SEQ ID NO: 1851582 - RNA, 17 nt, Homo sapiens
cuuuacuucccaguaua

SEQ ID NO: 1851583 - RNA, 15 nt, Homo sapiens
cuaagcaaugcaaau

SEQ ID NO: 1851584 - RNA, 14 nt, Homo sapiens
agcaagcagugccc

SEQ ID NO: 1851585 - RNA, 15 nt, Homo sapiens
cagaaauuuucuaca

SEQ ID NO: 1851586 - RNA, 15 nt, Homo sapiens
aaaggaauauaccac

SEQ ID NO: 1851587 - RNA, 13 nt, Homo sapiens
gugaaacugcugu

SEQ ID NO: 1851588 - RNA, 18 nt, Homo sapiens
gugauguuuuagugcuuu

SEQ ID NO: 1851589 - RNA, 21 nt, Homo sapiens
gaccacaguggccaagaucac

SEQ ID NO: 1851590 - RNA, 21 nt, Homo sapiens
acaguaugagucaaugugcag

SEQ ID NO: 1851591 - RNA, 14 nt, Homo sapiens
uugaauaagaucca

SEQ ID NO: 1851592 - RNA, 21 nt, Homo sapiens
ugaggaacaccacuaucuuaa

SEQ ID NO: 1851593 - RNA, 19 nt, Homo sapiens
ccaagagcucuucaucugc

SEQ ID NO: 1851594 - RNA, 13 nt, Homo sapiens
ugugugugcacau

SEQ ID NO: 1851595 - RNA, 18 nt, Homo sapiens
acaucaagugccagaugu

SEQ ID NO: 1851596 - RNA, 14 nt, Homo sapiens
uucaggagugcaag

SEQ ID NO: 1851597 - RNA, 23 nt, Homo sapiens
gacugacuggcaccaacacuuug

SEQ ID NO: 1851598 - RNA, 14 nt, Homo sapiens
ggcuuucccagugu

SEQ ID NO: 1851599 - RNA, 20 nt, Homo sapiens
gagucaauagcuugucuucg

SEQ ID NO: 1851600 - RNA, 22 nt, Homo sapiens
acaaugacugcuuuguuuggau

SEQ ID NO: 1851601 - RNA, 19 nt, Homo sapiens
aucuuaccagguucacuua

SEQ ID NO: 1851602 - RNA, 21 nt, Homo sapiens
uagcacgggauucaugcagug

SEQ ID NO: 1851603 - RNA, 16 nt, Homo sapiens
ugucucugcaucucau

SEQ ID NO: 1851604 - RNA, 19 nt, Homo sapiens
ucuagacuauuaggugcaa

SEQ ID NO: 1851605 - RNA, 19 nt, Homo sapiens
uccuaaggaaacugcuuua

SEQ ID NO: 1851606 - RNA, 15 nt, Homo sapiens
gcaccagcaggcacu

SEQ ID NO: 1851607 - RNA, 22 nt, Homo sapiens
agguaaauaaucauacacagaa

SEQ ID NO: 1851608 - RNA, 20 nt, Homo sapiens
gcccagacacagacuggcaa

SEQ ID NO: 1851609 - RNA, 15 nt, Homo sapiens
uccuccuacuguauu

SEQ ID NO: 1851610 - RNA, 23 nt, Homo sapiens
aauuucagccuacauugaugcca

SEQ ID NO: 1851611 - RNA, 15 nt, Homo sapiens
aacuacaaacacaag

SEQ ID NO: 1851612 - RNA, 21 nt, Homo sapiens
auuugcuguguaagcucacau

SEQ ID NO: 1851613 - RNA, 18 nt, Homo sapiens
gaacaaaaaaaucugcag

SEQ ID NO: 1851614 - RNA, 17 nt, Homo sapiens
ccugagggaggaggcag

SEQ ID NO: 1851615 - RNA, 21 nt, Homo sapiens
auuaguguugaaccaaugcuu

SEQ ID NO: 1851616 - RNA, 18 nt, Homo sapiens
uacaguuuauaaagccaa

SEQ ID NO: 1851617 - RNA, 17 nt, Homo sapiens
gcccaggccuaccucac

SEQ ID NO: 1851618 - RNA, 13 nt, Homo sapiens
cuuggccucccaa

SEQ ID NO: 1851619 - RNA, 16 nt, Homo sapiens
cauucuguguucacau

SEQ ID NO: 1851620 - RNA, 16 nt, Homo sapiens
ugccugcuguauuuau

SEQ ID NO: 1851621 - RNA, 20 nt, Homo sapiens
aauaaauuuauuucaauauu

SEQ ID NO: 1851622 - RNA, 19 nt, Homo sapiens
uggcaggugugggcuccca

SEQ ID NO: 1851623 - RNA, 22 nt, Homo sapiens
cuuuuagaaaaugcagucauuu

SEQ ID NO: 1851624 - RNA, 18 nt, Homo sapiens
aucuaucuauauauacau

SEQ ID NO: 1851625 - RNA, 14 nt, Homo sapiens
agaaccacacuguu

SEQ ID NO: 1851626 - RNA, 17 nt, Homo sapiens
gaaaugcuccuccaggg

SEQ ID NO: 1851627 - RNA, 16 nt, Homo sapiens
auaguguuggaaaaug

SEQ ID NO: 1851628 - RNA, 23 nt, Homo sapiens
acacacggugccuuuauuuccac

SEQ ID NO: 1851629 - RNA, 21 nt, Homo sapiens
gcucaugccucuaaucucagc

SEQ ID NO: 1851630 - RNA, 15 nt, Homo sapiens
uuaguuuuucugucc

SEQ ID NO: 1851631 - RNA, 17 nt, Homo sapiens
gagcuucccacaccugc

SEQ ID NO: 1851632 - RNA, 21 nt, Homo sapiens
aauucuauaggaacauaugaa

SEQ ID NO: 1851633 - RNA, 23 nt, Homo sapiens
gagcaucucugccuccaacccag

SEQ ID NO: 1851634 - RNA, 22 nt, Homo sapiens
gaaauuagguugaaacauaucu

SEQ ID NO: 1851635 - RNA, 11 nt, Homo sapiens
gagaaagggag

SEQ ID NO: 1851636 - RNA, 19 nt, Homo sapiens
gaaaagcagguugauaaau

SEQ ID NO: 1851637 - RNA, 16 nt, Homo sapiens
agaggcagacaggugu

SEQ ID NO: 1851638 - RNA, 14 nt, Homo sapiens
cacuguaucuaggc

SEQ ID NO: 1851639 - RNA, 22 nt, Homo sapiens
aacaauuccaaaggaaucucca

SEQ ID NO: 1851640 - RNA, 23 nt, Homo sapiens
acacguucugauuucugcccuug

SEQ ID NO: 1851641 - RNA, 23 nt, Homo sapiens
cuacgaggccauccaguccuucg

SEQ ID NO: 1851642 - RNA, 22 nt, Homo sapiens
aagcacuuugaaaaauuguucc

SEQ ID NO: 1851643 - RNA, 18 nt, Homo sapiens
cacuuuggacauggcuca

SEQ ID NO: 1851644 - RNA, 22 nt, Homo sapiens
ugcagauaaacaguagugauag

SEQ ID NO: 1851645 - RNA, 23 nt, Homo sapiens
gcucuucccuugcucaugagcuc

SEQ ID NO: 1851646 - RNA, 15 nt, Homo sapiens
auaaauagcauuugg

SEQ ID NO: 1851647 - RNA, 22 nt, Homo sapiens
uauaagaugaaauuaaccauuu

SEQ ID NO: 1851648 - RNA, 12 nt, Homo sapiens
accuagcaauag

SEQ ID NO: 1851649 - RNA, 18 nt, Homo sapiens
gaaaaauccugagcaaac

SEQ ID NO: 1851650 - RNA, 16 nt, Homo sapiens
uaauuacccuuuugca

SEQ ID NO: 1851651 - RNA, 23 nt, Homo sapiens
acacuugguccauccauuuccaa

SEQ ID NO: 1851652 - RNA, 20 nt, Homo sapiens
cccuuugcuucauucaaguc

SEQ ID NO: 1851653 - RNA, 20 nt, Homo sapiens
uguccugacaccugcuucag

SEQ ID NO: 1851654 - RNA, 19 nt, Homo sapiens
cccucagacugucaggcaa

SEQ ID NO: 1851655 - RNA, 13 nt, Homo sapiens
aacaguccaaacu

SEQ ID NO: 1851656 - RNA, 11 nt, Homo sapiens
acaaaagugaa

SEQ ID NO: 1851657 - RNA, 17 nt, Homo sapiens
gcucccuaggagaccaa

SEQ ID NO: 1851658 - RNA, 19 nt, Homo sapiens
aucuugauuaauguacuuu

SEQ ID NO: 1851659 - RNA, 15 nt, Homo sapiens
cccccagacagagcc

SEQ ID NO: 1851660 - RNA, 23 nt, Homo sapiens
aaggagccuuucuuauggaagaa

SEQ ID NO: 1851661 - RNA, 17 nt, Homo sapiens
acauuuaauaauaucaa

SEQ ID NO: 1851662 - RNA, 17 nt, Homo sapiens
gcuacagaagaaacugg

SEQ ID NO: 1851663 - RNA, 16 nt, Homo sapiens
uuuacuagaaaggcau

SEQ ID NO: 1851664 - RNA, 24 nt, Homo sapiens
auuggguuuugcuuuagagugcaa

SEQ ID NO: 1851665 - RNA, 22 nt, Homo sapiens
gagugauaauaguccuuuacaa

SEQ ID NO: 1851666 - RNA, 16 nt, Homo sapiens
acaaaugcaguauaua

SEQ ID NO: 1851667 - RNA, 16 nt, Homo sapiens
uaugugcgugugugca

SEQ ID NO: 1851668 - RNA, 16 nt, Homo sapiens
uaugugugugugugua

SEQ ID NO: 1851669 - RNA, 16 nt, Homo sapiens
uaugcacgugugcaca

SEQ ID NO: 1851670 - RNA, 16 nt, Homo sapiens
uauauauguguauaua

SEQ ID NO: 1851671 - RNA, 14 nt, Homo sapiens
uaagagucucuauu

SEQ ID NO: 1851672 - RNA, 18 nt, Homo sapiens
ccugaccgguuugcuaca

SEQ ID NO: 1851673 - RNA, 20 nt, Homo sapiens
auuccauauuagaaaacuuu

SEQ ID NO: 1851674 - RNA, 15 nt, Homo sapiens
cuggagcagaacuuu

SEQ ID NO: 1851675 - RNA, 22 nt, Homo sapiens
cacaccauuauauuuaauucua

SEQ ID NO: 1851676 - RNA, 22 nt, Homo sapiens
ccugccccagaggucgcagcua

SEQ ID NO: 1851677 - RNA, 18 nt, Homo sapiens
gaagcuggagugcugcuu

SEQ ID NO: 1851678 - RNA, 16 nt, Homo sapiens
uauccuagucuucaca

SEQ ID NO: 1851679 - RNA, 16 nt, Homo sapiens
cuucuagaaccugggc

SEQ ID NO: 1851680 - RNA, 15 nt, Homo sapiens
cagagagaccugcug

SEQ ID NO: 1851681 - RNA, 12 nt, Homo sapiens
ccaccaugagga

SEQ ID NO: 1851682 - RNA, 17 nt, Homo sapiens
acuauggcuuauucagu

SEQ ID NO: 1851683 - RNA, 17 nt, Homo sapiens
uguagccccagugacag

SEQ ID NO: 1851684 - RNA, 17 nt, Homo sapiens
ucagcacucuguaaaau

SEQ ID NO: 1851685 - RNA, 18 nt, Homo sapiens
ugccuggguugcugcugu

SEQ ID NO: 1851686 - RNA, 19 nt, Homo sapiens
aaagaggcccaagugcaaa

SEQ ID NO: 1851687 - RNA, 22 nt, Homo sapiens
ugcccagggcagcuuugcccuc

SEQ ID NO: 1851688 - RNA, 19 nt, Homo sapiens
ggaacaagacagccuucac

SEQ ID NO: 1851689 - RNA, 15 nt, Homo sapiens
uaaugcuuuguuaaa

SEQ ID NO: 1851690 - RNA, 23 nt, Homo sapiens
ucuaagaugauucaaaguaguuu

SEQ ID NO: 1851691 - RNA, 21 nt, Homo sapiens
uuuauaguuguagacuaugga

SEQ ID NO: 1851692 - RNA, 22 nt, Homo sapiens
aucaagucugugaaagucuccu

SEQ ID NO: 1851693 - RNA, 23 nt, Homo sapiens
ccagguagaaaagaaaugguaug

SEQ ID NO: 1851694 - RNA, 23 nt, Homo sapiens
acuuuuuuuuuuuuuugagacag

SEQ ID NO: 1851695 - RNA, 22 nt, Homo sapiens
auuucugauuucacucagggug

SEQ ID NO: 1851696 - RNA, 19 nt, Homo sapiens
auauaguuccuugccuuaa

SEQ ID NO: 1851697 - RNA, 14 nt, Homo sapiens
accaagaacugaag

SEQ ID NO: 1851698 - RNA, 14 nt, Homo sapiens
accaaaaacugaaa

SEQ ID NO: 1851699 - RNA, 17 nt, Homo sapiens
agaauucuagugcugcu

SEQ ID NO: 1851700 - RNA, 20 nt, Homo sapiens
guuuauuugaguauugcuga

SEQ ID NO: 1851701 - RNA, 18 nt, Homo sapiens
caagucuucucaagaucc

SEQ ID NO: 1851702 - RNA, 16 nt, Homo sapiens
gaaaugccacucacca

SEQ ID NO: 1851703 - RNA, 20 nt, Homo sapiens
ggaguucguggcugcaaaag

SEQ ID NO: 1851704 - RNA, 22 nt, Homo sapiens
agccucacguauuucacagagc

SEQ ID NO: 1851705 - RNA, 18 nt, Homo sapiens
uggcagaaugaaaaucag

SEQ ID NO: 1851706 - RNA, 20 nt, Homo sapiens
aggucugcucugcuccugaa

SEQ ID NO: 1851707 - RNA, 22 nt, Homo sapiens
uuaggaaauuuaagacuagaua

SEQ ID NO: 1851708 - RNA, 17 nt, Homo sapiens
cuugucucuaccaaaau

SEQ ID NO: 1851709 - RNA, 15 nt, Homo sapiens
ugcagaaauacagua

SEQ ID NO: 1851710 - RNA, 17 nt, Homo sapiens
cucucaggaccagagaa

SEQ ID NO: 1851711 - RNA, 16 nt, Homo sapiens
cagaucacgaggucag

SEQ ID NO: 1851712 - RNA, 19 nt, Homo sapiens
agaagugagcuuugcugcu

SEQ ID NO: 1851713 - RNA, 21 nt, Homo sapiens
uguacacacacagaugcacac

SEQ ID NO: 1851714 - RNA, 14 nt, Homo sapiens
uuugggccagacau

SEQ ID NO: 1851715 - RNA, 20 nt, Homo sapiens
gagauggcuggcuggugaua

SEQ ID NO: 1851716 - RNA, 20 nt, Homo sapiens
cacuaauucauuaaucugcc

SEQ ID NO: 1851717 - RNA, 23 nt, Homo sapiens
ggucaucgugacagcagcagcuc

SEQ ID NO: 1851718 - RNA, 15 nt, Homo sapiens
caaguauaauuacau

SEQ ID NO: 1851719 - RNA, 18 nt, Homo sapiens
uauguuuacguccuuugg

SEQ ID NO: 1851720 - RNA, 15 nt, Homo sapiens
acguggagagugcac

SEQ ID NO: 1851721 - RNA, 14 nt, Homo sapiens
gucuacccagacuc

SEQ ID NO: 1851722 - RNA, 19 nt, Homo sapiens
caauguauugagcauguga

SEQ ID NO: 1851723 - RNA, 16 nt, Homo sapiens
cuggauugaaagugaa

SEQ ID NO: 1851724 - RNA, 21 nt, Homo sapiens
ugaagaauguugauggugcua

SEQ ID NO: 1851725 - RNA, 19 nt, Homo sapiens
auauuugacauucuucacu

SEQ ID NO: 1851726 - RNA, 15 nt, Homo sapiens
gccgcugccaugcuu

SEQ ID NO: 1851727 - RNA, 14 nt, Homo sapiens
accaacaacaguca

SEQ ID NO: 1851728 - RNA, 14 nt, Homo sapiens
caggccagugucug

SEQ ID NO: 1851729 - RNA, 17 nt, Homo sapiens
agaaucguaauggguau

SEQ ID NO: 1851730 - RNA, 19 nt, Homo sapiens
uaaaaauguagcagcuucu

SEQ ID NO: 1851731 - RNA, 14 nt, Homo sapiens
guaaacuagcuuug

SEQ ID NO: 1851732 - RNA, 22 nt, Homo sapiens
ccacuggccucaagugagccaa

SEQ ID NO: 1851733 - RNA, 15 nt, Homo sapiens
aggccccaguggcug

SEQ ID NO: 1851734 - RNA, 21 nt, Homo sapiens
gaaguguugagccaugcuaca

SEQ ID NO: 1851735 - RNA, 18 nt, Homo sapiens
caauuuccucuccacugc

SEQ ID NO: 1851736 - RNA, 23 nt, Homo sapiens
gugaacuuaucaaaaaugcaaau

SEQ ID NO: 1851737 - RNA, 17 nt, Homo sapiens
gcucagcccuagcccuc

SEQ ID NO: 1851738 - RNA, 22 nt, Homo sapiens
cuggaggcccuggucagcuugc

SEQ ID NO: 1851739 - RNA, 23 nt, Homo sapiens
gggaugucuccgucucugucuca

SEQ ID NO: 1851740 - RNA, 13 nt, Homo sapiens
gauggauuuccag

SEQ ID NO: 1851741 - RNA, 13 nt, Homo sapiens
gaugcauuuccac

SEQ ID NO: 1851742 - RNA, 23 nt, Homo sapiens
ucauccguuugccaaucauugca

SEQ ID NO: 1851743 - RNA, 13 nt, Homo sapiens
auuuuuggaagag

SEQ ID NO: 1851744 - RNA, 19 nt, Homo sapiens
acagcacgggggccaagga

SEQ ID NO: 1851745 - RNA, 15 nt, Homo sapiens
auucuccuccuucau

SEQ ID NO: 1851746 - RNA, 12 nt, Homo sapiens
agcccugcccac

SEQ ID NO: 1851747 - RNA, 14 nt, Homo sapiens
cgacuggcugugag

SEQ ID NO: 1851748 - RNA, 14 nt, Homo sapiens
uggagguagaauga

SEQ ID NO: 1851749 - RNA, 15 nt, Homo sapiens
uaaucccagcuauuu

SEQ ID NO: 1851750 - RNA, 20 nt, Homo sapiens
uaaaacccacaaaaguacaa

SEQ ID NO: 1851751 - RNA, 18 nt, Homo sapiens
ccuguaaucccagcauuu

SEQ ID NO: 1851752 - RNA, 14 nt, Homo sapiens
uggauugcaucucc

SEQ ID NO: 1851753 - RNA, 13 nt, Homo sapiens
ggguccacuuccc

SEQ ID NO: 1851754 - RNA, 20 nt, Homo sapiens
uaaagagagaauguagauau

SEQ ID NO: 1851755 - RNA, 11 nt, Homo sapiens
aaaaugacaaa

SEQ ID NO: 1851756 - RNA, 17 nt, Homo sapiens
uugggcaccucucuggg

SEQ ID NO: 1851757 - RNA, 13 nt, Homo sapiens
augcguguuccag

SEQ ID NO: 1851758 - RNA, 22 nt, Homo sapiens
uaggcaauuuuuacaaccugag

SEQ ID NO: 1851759 - RNA, 21 nt, Homo sapiens
uucccagagcacuuugcaacu

SEQ ID NO: 1851760 - RNA, 13 nt, Homo sapiens
uaaaccacugguc

SEQ ID NO: 1851761 - RNA, 17 nt, Homo sapiens
uuauucauuagcuguga

SEQ ID NO: 1851762 - RNA, 17 nt, Homo sapiens
aaauucagaugcuguua

SEQ ID NO: 1851763 - RNA, 19 nt, Homo sapiens
ggaucucuaaccccucuga

SEQ ID NO: 1851764 - RNA, 19 nt, Homo sapiens
aauaacagccauagugugu

SEQ ID NO: 1851765 - RNA, 21 nt, Homo sapiens
aguguccaggagaugggaugg

SEQ ID NO: 1851766 - RNA, 18 nt, Homo sapiens
gucuguagaaucuagcca

SEQ ID NO: 1851767 - RNA, 15 nt, Homo sapiens
aauacaaauacaaag

SEQ ID NO: 1851768 - RNA, 18 nt, Homo sapiens
auaaaugauggcaaaaac

SEQ ID NO: 1851769 - RNA, 12 nt, Homo sapiens
cuuaugggguga

SEQ ID NO: 1851770 - RNA, 20 nt, Homo sapiens
uugucuguuaucgaacacau

SEQ ID NO: 1851771 - RNA, 19 nt, Homo sapiens
cgagugaaacuccgucuca

SEQ ID NO: 1851772 - RNA, 19 nt, Homo sapiens
caaggcucuucuuccucac

SEQ ID NO: 1851773 - RNA, 17 nt, Homo sapiens
aagaaaggacagcucag

SEQ ID NO: 1851774 - RNA, 12 nt, Homo sapiens
cccaaugcugua

SEQ ID NO: 1851775 - RNA, 15 nt, Homo sapiens
ccaucuguuugauac

SEQ ID NO: 1851776 - RNA, 21 nt, Homo sapiens
auuggaggggcuggcacugga

SEQ ID NO: 1851777 - RNA, 18 nt, Homo sapiens
aucugcucaccagaucuc

SEQ ID NO: 1851778 - RNA, 16 nt, Homo sapiens
gcucugcccaggcaag

SEQ ID NO: 1851779 - RNA, 15 nt, Homo sapiens
caggccuuggggaca

SEQ ID NO: 1851780 - RNA, 21 nt, Homo sapiens
ugcugcggccagccugacuag

SEQ ID NO: 1851781 - RNA, 21 nt, Homo sapiens
caagauccaaaugcugugcaa

SEQ ID NO: 1851782 - RNA, 18 nt, Homo sapiens
cagauguugcaucccuga

SEQ ID NO: 1851783 - RNA, 15 nt, Homo sapiens
aagaaaauaccaagg

SEQ ID NO: 1851784 - RNA, 15 nt, Homo sapiens
agauggauuugacac

SEQ ID NO: 1851785 - RNA, 23 nt, Homo sapiens
caauuuuaaaaaauaacauauuc

SEQ ID NO: 1851786 - RNA, 19 nt, Homo sapiens
auguaguuuuauuacacau

SEQ ID NO: 1851787 - RNA, 18 nt, Homo sapiens
ggacccugagccugugug

SEQ ID NO: 1851788 - RNA, 23 nt, Homo sapiens
cucagaguguuuaauuguacuca

SEQ ID NO: 1851789 - RNA, 21 nt, Homo sapiens
aucuaauccuuaaaagcauaa

SEQ ID NO: 1851790 - RNA, 21 nt, Homo sapiens
caugcuuuucugccacuccau

SEQ ID NO: 1851791 - RNA, 19 nt, Homo sapiens
cagaaaacaggguccagga

SEQ ID NO: 1851792 - RNA, 18 nt, Homo sapiens
ugauagccuguuacagga

SEQ ID NO: 1851793 - RNA, 15 nt, Homo sapiens
agggcagcuccagug

SEQ ID NO: 1851794 - RNA, 20 nt, Homo sapiens
gaucacaucacugcacucca

SEQ ID NO: 1851795 - RNA, 22 nt, Homo sapiens
guacccuacccugcacauuguu

SEQ ID NO: 1851796 - RNA, 20 nt, Homo sapiens
agcugacuuucaaaguggau

SEQ ID NO: 1851797 - RNA, 22 nt, Homo sapiens
auuguucagacauuccauggug

SEQ ID NO: 1851798 - RNA, 22 nt, Homo sapiens
ggaagaacccucaggucacaag

SEQ ID NO: 1851799 - RNA, 17 nt, Homo sapiens
ggccccucacuggcugg

SEQ ID NO: 1851800 - RNA, 23 nt, Homo sapiens
uuucucuugcuggaacuguugaa

SEQ ID NO: 1851801 - RNA, 17 nt, Homo sapiens
acgcaguugauuccuug

SEQ ID NO: 1851802 - RNA, 13 nt, Homo sapiens
uuauucaucuugc

SEQ ID NO: 1851803 - RNA, 17 nt, Homo sapiens
auucaaccuuaccaaaa

SEQ ID NO: 1851804 - RNA, 15 nt, Homo sapiens
acauggcagagcagu

SEQ ID NO: 1851805 - RNA, 17 nt, Homo sapiens
uggagacaguaacacug

SEQ ID NO: 1851806 - RNA, 15 nt, Homo sapiens
cugucccugccaaug

SEQ ID NO: 1851807 - RNA, 21 nt, Homo sapiens
ggaauauaaggaaagcaauaa

SEQ ID NO: 1851808 - RNA, 19 nt, Homo sapiens
acauuccaugacgcaggag

SEQ ID NO: 1851809 - RNA, 23 nt, Homo sapiens
cucaauugauccucccaucucag

SEQ ID NO: 1851810 - RNA, 20 nt, Homo sapiens
gagaaaacuuauuugaguga

SEQ ID NO: 1851811 - RNA, 14 nt, Homo sapiens
uuacuaaaaacaca

SEQ ID NO: 1851812 - RNA, 17 nt, Homo sapiens
cagagacugcuguguuu

SEQ ID NO: 1851813 - RNA, 13 nt, Homo sapiens
auugcuuugccaa

SEQ ID NO: 1851814 - RNA, 22 nt, Homo sapiens
caccucuucucuuccuguaaca

SEQ ID NO: 1851815 - RNA, 22 nt, Homo sapiens
gacuguaaguugggcuugcuau

SEQ ID NO: 1851816 - RNA, 16 nt, Homo sapiens
agcucagacuugccag

SEQ ID NO: 1851817 - RNA, 21 nt, Homo sapiens
guuucugucaagcauauugga

SEQ ID NO: 1851818 - RNA, 23 nt, Homo sapiens
gguucuuccuuucccuggagcug

SEQ ID NO: 1851819 - RNA, 17 nt, Homo sapiens
aaguugcagaacagaca

SEQ ID NO: 1851820 - RNA, 21 nt, Homo sapiens
gaacuuugcauagcagcugcu

SEQ ID NO: 1851821 - RNA, 17 nt, Homo sapiens
gacccuugucaucucuc

SEQ ID NO: 1851822 - RNA, 21 nt, Homo sapiens
agaucccagcuucggcauuug

SEQ ID NO: 1851823 - RNA, 19 nt, Homo sapiens
caaaaaaaaaauuugccaa

SEQ ID NO: 1851824 - RNA, 19 nt, Homo sapiens
cacuaaaccgauaaugcau

SEQ ID NO: 1851825 - RNA, 20 nt, Homo sapiens
uuccaucaaaccuuugccaa

SEQ ID NO: 1851826 - RNA, 14 nt, Homo sapiens
ccucagaugaucuc

SEQ ID NO: 1851827 - RNA, 15 nt, Homo sapiens
aguccagcacuggaa

SEQ ID NO: 1851828 - RNA, 14 nt, Homo sapiens
acaaaauaguuuua

SEQ ID NO: 1851829 - RNA, 17 nt, Homo sapiens
aagacaaagacauuuca

SEQ ID NO: 1851830 - RNA, 19 nt, Homo sapiens
ccucucagaacauacugau

SEQ ID NO: 1851831 - RNA, 23 nt, Homo sapiens
uuagaaaagacugaccuugaugu

SEQ ID NO: 1851832 - RNA, 12 nt, Homo sapiens
uauugcuaguac

SEQ ID NO: 1851833 - RNA, 16 nt, Homo sapiens
uaaguaaaagucugua

SEQ ID NO: 1851834 - RNA, 16 nt, Homo sapiens
gggacaaggaaggaaa

SEQ ID NO: 1851835 - RNA, 19 nt, Homo sapiens
auuuauuaguccuaauuca

SEQ ID NO: 1851836 - RNA, 13 nt, Homo sapiens
gggaccccgagaa

SEQ ID NO: 1851837 - RNA, 15 nt, Homo sapiens
uguuauuaacagaua

SEQ ID NO: 1851838 - RNA, 15 nt, Homo sapiens
acaguaaauguuuau

SEQ ID NO: 1851839 - RNA, 15 nt, Homo sapiens
gcaugaaacauguuc

SEQ ID NO: 1851840 - RNA, 14 nt, Homo sapiens
ugaauuccauggaa

SEQ ID NO: 1851841 - RNA, 19 nt, Homo sapiens
agagaaagagaaugggagc

SEQ ID NO: 1851842 - RNA, 13 nt, Homo sapiens
ugcaccaugcugc

SEQ ID NO: 1851843 - RNA, 23 nt, Homo sapiens
ccccagcuucagccugcugggca

SEQ ID NO: 1851844 - RNA, 20 nt, Homo sapiens
uggagccccauccuguguua

SEQ ID NO: 1851845 - RNA, 19 nt, Homo sapiens
aacauuaccuuacugugga

SEQ ID NO: 1851846 - RNA, 20 nt, Homo sapiens
aggauacaggugacagugaa

SEQ ID NO: 1851847 - RNA, 22 nt, Homo sapiens
agaagauggcacuuauaaccaa

SEQ ID NO: 1851848 - RNA, 15 nt, Homo sapiens
aggagugccagcuca

SEQ ID NO: 1851849 - RNA, 18 nt, Homo sapiens
gaugaaauaaaauaucaa

SEQ ID NO: 1851850 - RNA, 19 nt, Homo sapiens
ugaacuagauugcaugcuu

SEQ ID NO: 1851851 - RNA, 19 nt, Homo sapiens
aaugagcugguuugucaaa

SEQ ID NO: 1851852 - RNA, 13 nt, Homo sapiens
uacauuaguacac

SEQ ID NO: 1851853 - RNA, 13 nt, Homo sapiens
auguaacuaucaa

SEQ ID NO: 1851854 - RNA, 19 nt, Homo sapiens
uuaaaaaauaaaaacugac

SEQ ID NO: 1851855 - RNA, 23 nt, Homo sapiens
agguauccaaaaauguguaagaa

SEQ ID NO: 1851856 - RNA, 22 nt, Homo sapiens
gucacaggggugucuugucuga

SEQ ID NO: 1851857 - RNA, 19 nt, Homo sapiens
cugucagucguguugcuua

SEQ ID NO: 1851858 - RNA, 15 nt, Homo sapiens
uggcaugauccaagc

SEQ ID NO: 1851859 - RNA, 23 nt, Homo sapiens
uaaauaugguuugaagugaauug

SEQ ID NO: 1851860 - RNA, 15 nt, Homo sapiens
cugaaccuugagcaa

SEQ ID NO: 1851861 - RNA, 19 nt, Homo sapiens
caaagcauuuucauuucua

SEQ ID NO: 1851862 - RNA, 17 nt, Homo sapiens
cuaugacagagguguga

SEQ ID NO: 1851863 - RNA, 17 nt, Homo sapiens
gaagugugcugugacaa

SEQ ID NO: 1851864 - RNA, 15 nt, Homo sapiens
cugaccgaguaccug

SEQ ID NO: 1851865 - RNA, 22 nt, Homo sapiens
uuugaagcucaacuguugccag

SEQ ID NO: 1851866 - RNA, 21 nt, Homo sapiens
cucucuucaauaaaccacaag

SEQ ID NO: 1851867 - RNA, 20 nt, Homo sapiens
accaccuucccagcucuccc

SEQ ID NO: 1851868 - RNA, 12 nt, Homo sapiens
caguguuuccac

SEQ ID NO: 1851869 - RNA, 12 nt, Homo sapiens
cacuggaucaag

SEQ ID NO: 1851870 - RNA, 20 nt, Homo sapiens
acuuuuuauucucaguuuaa

SEQ ID NO: 1851871 - RNA, 16 nt, Homo sapiens
aacaauaaaaugucuu

SEQ ID NO: 1851872 - RNA, 15 nt, Homo sapiens
auccuacaagacaca

SEQ ID NO: 1851873 - RNA, 15 nt, Homo sapiens
acugacaaagucauc

SEQ ID NO: 1851874 - RNA, 17 nt, Homo sapiens
ugacuguccaagugcca

SEQ ID NO: 1851875 - RNA, 19 nt, Homo sapiens
uaccccagccacuccucaa

SEQ ID NO: 1851876 - RNA, 17 nt, Homo sapiens
uauuuaucaauuuuucc

SEQ ID NO: 1851877 - RNA, 17 nt, Homo sapiens
aaaauuuuuaaauauuc

SEQ ID NO: 1851878 - RNA, 16 nt, Homo sapiens
agacagugaugccugc

SEQ ID NO: 1851879 - RNA, 15 nt, Homo sapiens
cuuguuuuuuacuca

SEQ ID NO: 1851880 - RNA, 17 nt, Homo sapiens
ucaaugugacauguugc

SEQ ID NO: 1851881 - RNA, 17 nt, Homo sapiens
ugauuucacgaaggcaa

SEQ ID NO: 1851882 - RNA, 18 nt, Homo sapiens
cccagccccaaagacagc

SEQ ID NO: 1851883 - RNA, 21 nt, Homo sapiens
gugcaaacgccuagauugcuu

SEQ ID NO: 1851884 - RNA, 20 nt, Homo sapiens
guggcuugguuuggucaugc

SEQ ID NO: 1851885 - RNA, 17 nt, Homo sapiens
uagucaaaccacuguua

SEQ ID NO: 1851886 - RNA, 20 nt, Homo sapiens
gacugaagcgaacaucuuca

SEQ ID NO: 1851887 - RNA, 15 nt, Homo sapiens
uuuucagacuuuaaa

SEQ ID NO: 1851888 - RNA, 17 nt, Homo sapiens
cauggagauguaaaaug

SEQ ID NO: 1851889 - RNA, 17 nt, Homo sapiens
cucuguaucuccagcca

SEQ ID NO: 1851890 - RNA, 15 nt, Homo sapiens
aagucuagcacaguu

SEQ ID NO: 1851891 - RNA, 20 nt, Homo sapiens
caaucucccacagggugcug

SEQ ID NO: 1851892 - RNA, 16 nt, Homo sapiens
acucaaucuccagggc

SEQ ID NO: 1851893 - RNA, 16 nt, Homo sapiens
uuuguaaaggauauca

SEQ ID NO: 1851894 - RNA, 15 nt, Homo sapiens
auaaccucaaggaac

SEQ ID NO: 1851895 - RNA, 20 nt, Homo sapiens
uuagagcugccugugccuuu

SEQ ID NO: 1851896 - RNA, 19 nt, Homo sapiens
agcaaugacaucucagggg

SEQ ID NO: 1851897 - RNA, 19 nt, Homo sapiens
cagagauucccaagccaaa

SEQ ID NO: 1851898 - RNA, 22 nt, Homo sapiens
uaucugcagggacagagcauug

SEQ ID NO: 1851899 - RNA, 13 nt, Homo sapiens
cauuuucuauuca

SEQ ID NO: 1851900 - RNA, 13 nt, Homo sapiens
caccuucuaucua

SEQ ID NO: 1851901 - RNA, 13 nt, Homo sapiens
aaccaucucucuu

SEQ ID NO: 1851902 - RNA, 19 nt, Homo sapiens
cuccacuuacuauaauggu

SEQ ID NO: 1851903 - RNA, 14 nt, Homo sapiens
uguuucugaucuga

SEQ ID NO: 1851904 - RNA, 22 nt, Homo sapiens
ggccuccgccugggucaugggc

SEQ ID NO: 1851905 - RNA, 13 nt, Homo sapiens
aucauguauauau

SEQ ID NO: 1851906 - RNA, 14 nt, Homo sapiens
guuaaauaauguga

SEQ ID NO: 1851907 - RNA, 23 nt, Homo sapiens
ggccauuuagccaccaucuuugc

SEQ ID NO: 1851908 - RNA, 13 nt, Homo sapiens
gauuuaugaauua

SEQ ID NO: 1851909 - RNA, 22 nt, Homo sapiens
uauuugggggaacuggacacaa

SEQ ID NO: 1851910 - RNA, 16 nt, Homo sapiens
ugcugcaccaaugcac

SEQ ID NO: 1851911 - RNA, 16 nt, Homo sapiens
ugauacuucacuacuu

SEQ ID NO: 1851912 - RNA, 14 nt, Homo sapiens
uguaaucaacaugg

SEQ ID NO: 1851913 - RNA, 16 nt, Homo sapiens
uaagcuaucuucaaau

SEQ ID NO: 1851914 - RNA, 21 nt, Homo sapiens
ucugauuuuuaaaguacuuuc

SEQ ID NO: 1851915 - RNA, 20 nt, Homo sapiens
ucuaaaaagaaaaagagaua

SEQ ID NO: 1851916 - RNA, 20 nt, Homo sapiens
ugggaaaagcagaagaggga

SEQ ID NO: 1851917 - RNA, 14 nt, Homo sapiens
caaguuauuucagg

SEQ ID NO: 1851918 - RNA, 18 nt, Homo sapiens
ccaaauuacugauaucag

SEQ ID NO: 1851919 - RNA, 16 nt, Homo sapiens
agugacaugugcugga

SEQ ID NO: 1851920 - RNA, 22 nt, Homo sapiens
ucuaugaacaacaguaguuucu

SEQ ID NO: 1851921 - RNA, 23 nt, Homo sapiens
gucaugaacauggucagaaccuu

SEQ ID NO: 1851922 - RNA, 19 nt, Homo sapiens
caagacucccagaucagcu

SEQ ID NO: 1851923 - RNA, 15 nt, Homo sapiens
gagcuugcaaugagc

SEQ ID NO: 1851924 - RNA, 15 nt, Homo sapiens
ccuauaucuuaggua

SEQ ID NO: 1851925 - RNA, 19 nt, Homo sapiens
ugcacuccagccuaggcaa

SEQ ID NO: 1851926 - RNA, 11 nt, Homo sapiens
uaccucagcuu

SEQ ID NO: 1851927 - RNA, 22 nt, Homo sapiens
ggccucugcucuccgaccucuc

SEQ ID NO: 1851928 - RNA, 10 nt, Homo sapiens
agaaacagcu

SEQ ID NO: 1851929 - RNA, 13 nt, Homo sapiens
auaacagugcaua

SEQ ID NO: 1851930 - RNA, 19 nt, Homo sapiens
cuuaaaauuaauaaaucau

SEQ ID NO: 1851931 - RNA, 23 nt, Homo sapiens
aaaguacucuuuaagagugaaau

SEQ ID NO: 1851932 - RNA, 17 nt, Homo sapiens
gauacugcgacuuucug

SEQ ID NO: 1851933 - RNA, 18 nt, Homo sapiens
aggcagagguugugguga

SEQ ID NO: 1851934 - RNA, 22 nt, Homo sapiens
cacaauuaauucaucccuuaau

SEQ ID NO: 1851935 - RNA, 14 nt, Homo sapiens
acuuucuguuacua

SEQ ID NO: 1851936 - RNA, 22 nt, Homo sapiens
guucaaauucaaaccauuuuua

SEQ ID NO: 1851937 - RNA, 17 nt, Homo sapiens
uauagacggacuucauu

SEQ ID NO: 1851938 - RNA, 16 nt, Homo sapiens
caguuguuccuacuca

SEQ ID NO: 1851939 - RNA, 16 nt, Homo sapiens
ucaccagagacuuuag

SEQ ID NO: 1851940 - RNA, 23 nt, Homo sapiens
ccacugaggagacagaaagccuc

SEQ ID NO: 1851941 - RNA, 22 nt, Homo sapiens
aaguguuaggauuacaggcaug

SEQ ID NO: 1851942 - RNA, 15 nt, Homo sapiens
agcauugcaguaugg

SEQ ID NO: 1851943 - RNA, 14 nt, Homo sapiens
cauggguacagagg

SEQ ID NO: 1851944 - RNA, 18 nt, Homo sapiens
cugacauaauggggauua

SEQ ID NO: 1851945 - RNA, 23 nt, Homo sapiens
aaugacuuagaaacaauguuugc

SEQ ID NO: 1851946 - RNA, 17 nt, Homo sapiens
uuccucuuccacuuuga

SEQ ID NO: 1851947 - RNA, 16 nt, Homo sapiens
cuaugagcacauagga

SEQ ID NO: 1851948 - RNA, 22 nt, Homo sapiens
uugagauaaagucaaaugccaa

SEQ ID NO: 1851949 - RNA, 17 nt, Homo sapiens
ccagauggcccuggaca

SEQ ID NO: 1851950 - RNA, 17 nt, Homo sapiens
guggauuccagugcaug

SEQ ID NO: 1851951 - RNA, 12 nt, Homo sapiens
cuggaacuggag

SEQ ID NO: 1851952 - RNA, 16 nt, Homo sapiens
agauuuuaugcugcug

SEQ ID NO: 1851953 - RNA, 23 nt, Homo sapiens
agcggccacacuguacucugcac

SEQ ID NO: 1851954 - RNA, 16 nt, Homo sapiens
cacugggacacuguca

SEQ ID NO: 1851955 - RNA, 16 nt, Homo sapiens
accaaaacuaguucaa

SEQ ID NO: 1851956 - RNA, 13 nt, Homo sapiens
cuggugggugaca

SEQ ID NO: 1851957 - RNA, 16 nt, Homo sapiens
ucaguccuauucugua

SEQ ID NO: 1851958 - RNA, 23 nt, Homo sapiens
ggcuacuaccuagggcacuuuaa

SEQ ID NO: 1851959 - RNA, 13 nt, Homo sapiens
uucauguuuugcu

SEQ ID NO: 1851960 - RNA, 16 nt, Homo sapiens
agugagaggcaaacca

SEQ ID NO: 1851961 - RNA, 12 nt, Homo sapiens
ugcacaccaaaa

SEQ ID NO: 1851962 - RNA, 16 nt, Homo sapiens
augcucuuucccagga

SEQ ID NO: 1851963 - RNA, 16 nt, Homo sapiens
acagccugccucugcc

SEQ ID NO: 1851964 - RNA, 21 nt, Homo sapiens
gagaucgcgccauugcacucc

SEQ ID NO: 1851965 - RNA, 21 nt, Homo sapiens
gagaucgcgccacugcacucu

SEQ ID NO: 1851966 - RNA, 14 nt, Homo sapiens
cucaaaaccuccaa

SEQ ID NO: 1851967 - RNA, 14 nt, Homo sapiens
ucuaaaacucucaa

SEQ ID NO: 1851968 - RNA, 22 nt, Homo sapiens
uaaaauuuggccaaacaagugu

SEQ ID NO: 1851969 - RNA, 23 nt, Homo sapiens
aagcaucucagccuaccaugaga

SEQ ID NO: 1851970 - RNA, 15 nt, Homo sapiens
agcaucacaguuuug

SEQ ID NO: 1851971 - RNA, 14 nt, Homo sapiens
aucugaauguucau

SEQ ID NO: 1851972 - RNA, 15 nt, Homo sapiens
agcucagaaggcucu

SEQ ID NO: 1851973 - RNA, 22 nt, Homo sapiens
ucagacuuuguguucauuucau

SEQ ID NO: 1851974 - RNA, 16 nt, Homo sapiens
ggagauuccacacagg

SEQ ID NO: 1851975 - RNA, 16 nt, Homo sapiens
acugaucucauuucua

SEQ ID NO: 1851976 - RNA, 15 nt, Homo sapiens
ggugcccagucuuga

SEQ ID NO: 1851977 - RNA, 21 nt, Homo sapiens
ccuuguugucucugucucuca

SEQ ID NO: 1851978 - RNA, 17 nt, Homo sapiens
cgguucacucuucucag

SEQ ID NO: 1851979 - RNA, 16 nt, Homo sapiens
aaguuuaaucagagga

SEQ ID NO: 1851980 - RNA, 12 nt, Homo sapiens
cuaacaugguga

SEQ ID NO: 1851981 - RNA, 21 nt, Homo sapiens
agcuacaagugcagcugugac

SEQ ID NO: 1851982 - RNA, 15 nt, Homo sapiens
cucugagcugcaguu

SEQ ID NO: 1851983 - RNA, 18 nt, Homo sapiens
uauuuacaagacugcuga

SEQ ID NO: 1851984 - RNA, 11 nt, Homo sapiens
ugguacucugc

SEQ ID NO: 1851985 - RNA, 14 nt, Homo sapiens
cuagucucuaucau

SEQ ID NO: 1851986 - RNA, 15 nt, Homo sapiens
guguuggcaguguuu

SEQ ID NO: 1851987 - RNA, 15 nt, Homo sapiens
uacuguuauuucacu

SEQ ID NO: 1851988 - RNA, 16 nt, Homo sapiens
aaauuauuguauuaca

SEQ ID NO: 1851989 - RNA, 20 nt, Homo sapiens
ugaaugccguggauugcacg

SEQ ID NO: 1851990 - RNA, 18 nt, Homo sapiens
auugagcagaagaucaag

SEQ ID NO: 1851991 - RNA, 16 nt, Homo sapiens
uagcuuuagggcaaua

SEQ ID NO: 1851992 - RNA, 22 nt, Homo sapiens
gggcucagcaaggccaccucuu

SEQ ID NO: 1851993 - RNA, 23 nt, Homo sapiens
aaacaccgagugaggccauagca

SEQ ID NO: 1851994 - RNA, 15 nt, Homo sapiens
uguguccucagggag

SEQ ID NO: 1851995 - RNA, 20 nt, Homo sapiens
gaaugauucccucuugcuau

SEQ ID NO: 1851996 - RNA, 13 nt, Homo sapiens
guguuuuccugaa

SEQ ID NO: 1851997 - RNA, 16 nt, Homo sapiens
auaaaagcuauuacuu

SEQ ID NO: 1851998 - RNA, 22 nt, Homo sapiens
auacuguaaaugcauuggaaua

SEQ ID NO: 1851999 - RNA, 15 nt, Homo sapiens
gagggauguggagca

SEQ ID NO: 1852000 - RNA, 15 nt, Homo sapiens
cagugauccugcaag

SEQ ID NO: 1852001 - RNA, 17 nt, Homo sapiens
uagguucaaaagcaauc

SEQ ID NO: 1852002 - RNA, 16 nt, Homo sapiens
aagaaaaaaaaacugg

SEQ ID NO: 1852003 - RNA, 13 nt, Homo sapiens
aaugagcaccugg

SEQ ID NO: 1852004 - RNA, 22 nt, Homo sapiens
accagugcaucacaucugcaca

SEQ ID NO: 1852005 - RNA, 16 nt, Homo sapiens
acuugcaauuugcaag

SEQ ID NO: 1852006 - RNA, 15 nt, Homo sapiens
gcuauuugcauuucu

SEQ ID NO: 1852007 - RNA, 17 nt, Homo sapiens
auggacuucuggaugcc

SEQ ID NO: 1852008 - RNA, 22 nt, Homo sapiens
aucuguauuggcagcacagcua

SEQ ID NO: 1852009 - RNA, 17 nt, Homo sapiens
cuggaucccguucagaa

SEQ ID NO: 1852010 - RNA, 13 nt, Homo sapiens
uucuuguugcaaa

SEQ ID NO: 1852011 - RNA, 13 nt, Homo sapiens
guucuucuaccac

SEQ ID NO: 1852012 - RNA, 14 nt, Homo sapiens
uguacaacuaccuc

SEQ ID NO: 1852013 - RNA, 20 nt, Homo sapiens
uauuuauccuaguauuccua

SEQ ID NO: 1852014 - RNA, 17 nt, Homo sapiens
cugcaguggacaguccc

SEQ ID NO: 1852015 - RNA, 16 nt, Homo sapiens
gaugaacuguggugcc

SEQ ID NO: 1852016 - RNA, 17 nt, Homo sapiens
ucagcccucucuugcca

SEQ ID NO: 1852017 - RNA, 23 nt, Homo sapiens
aauguguuaggaaauuacaguca

SEQ ID NO: 1852018 - RNA, 16 nt, Homo sapiens
uucccaaacuugacag

SEQ ID NO: 1852019 - RNA, 19 nt, Homo sapiens
auaaaccacuugagccuau

SEQ ID NO: 1852020 - RNA, 15 nt, Homo sapiens
aaucauacuuaacau

SEQ ID NO: 1852021 - RNA, 19 nt, Homo sapiens
gacucugcagagucacuca

SEQ ID NO: 1852022 - RNA, 12 nt, Homo sapiens
uuugagcacaaa

SEQ ID NO: 1852023 - RNA, 23 nt, Homo sapiens
caggauugucacuccaaaccuua

SEQ ID NO: 1852024 - RNA, 19 nt, Homo sapiens
ucuuccagggccucuggga

SEQ ID NO: 1852025 - RNA, 19 nt, Homo sapiens
ugcaauaucugaagcccuc

SEQ ID NO: 1852026 - RNA, 21 nt, Homo sapiens
agcagcugugcauugacauca

SEQ ID NO: 1852027 - RNA, 17 nt, Homo sapiens
acauagcagacuuuccc

SEQ ID NO: 1852028 - RNA, 18 nt, Homo sapiens
agacuuaaaaaauacuug

SEQ ID NO: 1852029 - RNA, 16 nt, Homo sapiens
gacacugaaaaaucua

SEQ ID NO: 1852030 - RNA, 15 nt, Homo sapiens
ugccuccuuguauua

SEQ ID NO: 1852031 - RNA, 21 nt, Homo sapiens
gcaucuacuuggcaaggucau

SEQ ID NO: 1852032 - RNA, 9 nt, Homo sapiens
uaacuuuga

SEQ ID NO: 1852033 - RNA, 23 nt, Homo sapiens
uccucuuguucuaaucuugucaa

SEQ ID NO: 1852034 - RNA, 21 nt, Homo sapiens
uggugacaaugggagacucca

SEQ ID NO: 1852035 - RNA, 15 nt, Homo sapiens
ccuuguguacuuucu

SEQ ID NO: 1852036 - RNA, 22 nt, Homo sapiens
gguaugaaguaucuuugacaug

SEQ ID NO: 1852037 - RNA, 12 nt, Homo sapiens
ucaaugccauug

SEQ ID NO: 1852038 - RNA, 20 nt, Homo sapiens
ccagugacuuaggaggcuga

SEQ ID NO: 1852039 - RNA, 17 nt, Homo sapiens
uauuaucuaacagacaa

SEQ ID NO: 1852040 - RNA, 18 nt, Homo sapiens
uuuauuuacacucuugau

SEQ ID NO: 1852041 - RNA, 16 nt, Homo sapiens
ugaucuuggcacaaau

SEQ ID NO: 1852042 - RNA, 18 nt, Homo sapiens
cuguaagcaacacuuuaa

SEQ ID NO: 1852043 - RNA, 19 nt, Homo sapiens
uuuucgccaaggcucacau

SEQ ID NO: 1852044 - RNA, 22 nt, Homo sapiens
guuuuacaaauuuaauuuugca

SEQ ID NO: 1852045 - RNA, 13 nt, Homo sapiens
ccaaagacuacac

SEQ ID NO: 1852046 - RNA, 15 nt, Homo sapiens
gaaccccugucacac

SEQ ID NO: 1852047 - RNA, 16 nt, Homo sapiens
accaugacgcacugcu

SEQ ID NO: 1852048 - RNA, 19 nt, Homo sapiens
gcuccugccagcucaggau

SEQ ID NO: 1852049 - RNA, 23 nt, Homo sapiens
caagauggcgaccaccaaaguca

SEQ ID NO: 1852050 - RNA, 15 nt, Homo sapiens
gguugaaacauaucu

SEQ ID NO: 1852051 - RNA, 14 nt, Homo sapiens
gaacgcucuaggca

SEQ ID NO: 1852052 - RNA, 18 nt, Homo sapiens
ucaggucuccaccaagga

SEQ ID NO: 1852053 - RNA, 16 nt, Homo sapiens
gaucuugcauucccag

SEQ ID NO: 1852054 - RNA, 16 nt, Homo sapiens
gcaucuucccgcugag

SEQ ID NO: 1852055 - RNA, 14 nt, Homo sapiens
ggauuuaauuucca

SEQ ID NO: 1852056 - RNA, 15 nt, Homo sapiens
uagaaaugucucaag

SEQ ID NO: 1852057 - RNA, 22 nt, Homo sapiens
ucagaguugcugcaaaccugac

SEQ ID NO: 1852058 - RNA, 18 nt, Homo sapiens
auuucaagugauggucau

SEQ ID NO: 1852059 - RNA, 15 nt, Homo sapiens
gacagugccuaacuc

SEQ ID NO: 1852060 - RNA, 17 nt, Homo sapiens
uucaagauugaucauuu

SEQ ID NO: 1852061 - RNA, 12 nt, Homo sapiens
cugggaaccagc

SEQ ID NO: 1852062 - RNA, 17 nt, Homo sapiens
uuguaaucauaaauacu

SEQ ID NO: 1852063 - RNA, 16 nt, Homo sapiens
uuuguacauacuguau

SEQ ID NO: 1852064 - RNA, 16 nt, Homo sapiens
gaagagcgcaguguuu

SEQ ID NO: 1852065 - RNA, 19 nt, Homo sapiens
gucacagaagcagcuaaac

SEQ ID NO: 1852066 - RNA, 15 nt, Homo sapiens
cuuuugaccaaauaa

SEQ ID NO: 1852067 - RNA, 21 nt, Homo sapiens
gaugauuuccgucaugcuccc

SEQ ID NO: 1852068 - RNA, 23 nt, Homo sapiens
gucaacgcaacgucuaacuggac

SEQ ID NO: 1852069 - RNA, 21 nt, Homo sapiens
uauuaucuucaggacacucac

SEQ ID NO: 1852070 - RNA, 15 nt, Homo sapiens
acgacuaaguugaau

SEQ ID NO: 1852071 - RNA, 20 nt, Homo sapiens
uucuacacuuuauacuugcc

SEQ ID NO: 1852072 - RNA, 12 nt, Homo sapiens
auaaauguaucu

SEQ ID NO: 1852073 - RNA, 18 nt, Homo sapiens
cacuugcuggcugugaaa

SEQ ID NO: 1852074 - RNA, 14 nt, Homo sapiens
uguguucacacugu

SEQ ID NO: 1852075 - RNA, 23 nt, Homo sapiens
gaaacaaccguauaccugagaaa

SEQ ID NO: 1852076 - RNA, 18 nt, Homo sapiens
uguccuuguagagcacag

SEQ ID NO: 1852077 - RNA, 13 nt, Homo sapiens
uuaacaccuucau

SEQ ID NO: 1852078 - RNA, 20 nt, Homo sapiens
aagccucgggccacaugggu

SEQ ID NO: 1852079 - RNA, 19 nt, Homo sapiens
ccuugcuguccugaucugu

SEQ ID NO: 1852080 - RNA, 14 nt, Homo sapiens
uagcacucacaugc

SEQ ID NO: 1852081 - RNA, 15 nt, Homo sapiens
aaccgcaucugcuca

SEQ ID NO: 1852082 - RNA, 18 nt, Homo sapiens
gccuuaacacacuggcca

SEQ ID NO: 1852083 - RNA, 22 nt, Homo sapiens
agaguucugucuggacuuucca

SEQ ID NO: 1852084 - RNA, 13 nt, Homo sapiens
ccuagacuugaaa

SEQ ID NO: 1852085 - RNA, 14 nt, Homo sapiens
agagggauggcuca

SEQ ID NO: 1852086 - RNA, 18 nt, Homo sapiens
ucauagcaauacuuggag

SEQ ID NO: 1852087 - RNA, 14 nt, Homo sapiens
cuccuauucaccca

SEQ ID NO: 1852088 - RNA, 17 nt, Homo sapiens
cccaucccaguguccua

SEQ ID NO: 1852089 - RNA, 13 nt, Homo sapiens
ucgcccuggccag

SEQ ID NO: 1852090 - RNA, 21 nt, Homo sapiens
cugugugugaugugcauggga

SEQ ID NO: 1852091 - RNA, 17 nt, Homo sapiens
agaguauuucugcccca

SEQ ID NO: 1852092 - RNA, 17 nt, Homo sapiens
guguguagaaacacagc

SEQ ID NO: 1852093 - RNA, 17 nt, Homo sapiens
gaguugugaucauccca

SEQ ID NO: 1852094 - RNA, 20 nt, Homo sapiens
uugcagcuguuuuguugaca

SEQ ID NO: 1852095 - RNA, 20 nt, Homo sapiens
auuucuucucucuguucccu

SEQ ID NO: 1852096 - RNA, 19 nt, Homo sapiens
gacuuauuaggacuuugaa

SEQ ID NO: 1852097 - RNA, 17 nt, Homo sapiens
acacacccugucugccc

SEQ ID NO: 1852098 - RNA, 19 nt, Homo sapiens
uuuuguuuuuucuugccag

SEQ ID NO: 1852099 - RNA, 15 nt, Homo sapiens
aucuuuacucaggca

SEQ ID NO: 1852100 - RNA, 17 nt, Homo sapiens
cagcucuccugcugcag

SEQ ID NO: 1852101 - RNA, 15 nt, Homo sapiens
uaacaaaaguauagu

SEQ ID NO: 1852102 - RNA, 19 nt, Homo sapiens
uaaggaaguccagaaauca

SEQ ID NO: 1852103 - RNA, 15 nt, Homo sapiens
uuuacagaacaguuu

SEQ ID NO: 1852104 - RNA, 19 nt, Homo sapiens
ugcagcauuuuguauuugu

SEQ ID NO: 1852105 - RNA, 16 nt, Homo sapiens
cuaagggcccaaaggc

SEQ ID NO: 1852106 - RNA, 21 nt, Homo sapiens
ucacaggcagguccaggguuu

SEQ ID NO: 1852107 - RNA, 17 nt, Homo sapiens
aauguuaugacuaugua

SEQ ID NO: 1852108 - RNA, 14 nt, Homo sapiens
accauguuagccuu

SEQ ID NO: 1852109 - RNA, 14 nt, Homo sapiens
agacauuuacaaag

SEQ ID NO: 1852110 - RNA, 21 nt, Homo sapiens
auuauuugacaacaauccaaa

SEQ ID NO: 1852111 - RNA, 21 nt, Homo sapiens
agccuggccaacauggugaaa

SEQ ID NO: 1852112 - RNA, 16 nt, Homo sapiens
uacaaccuauguaauu

SEQ ID NO: 1852113 - RNA, 14 nt, Homo sapiens
gacaucccggccca

SEQ ID NO: 1852114 - RNA, 14 nt, Homo sapiens
aacagaugccccag

SEQ ID NO: 1852115 - RNA, 12 nt, Homo sapiens
uauguugcccag

SEQ ID NO: 1852116 - RNA, 19 nt, Homo sapiens
aauucaaaaagaacuaaau

SEQ ID NO: 1852117 - RNA, 12 nt, Homo sapiens
uaaagccuucaa

SEQ ID NO: 1852118 - RNA, 18 nt, Homo sapiens
aauaacaaaugccaaauu

SEQ ID NO: 1852119 - RNA, 18 nt, Homo sapiens
caguaauuuguggcacua

SEQ ID NO: 1852120 - RNA, 13 nt, Homo sapiens
acagcacuaugua

SEQ ID NO: 1852121 - RNA, 13 nt, Homo sapiens
cccugacagcugu

SEQ ID NO: 1852122 - RNA, 18 nt, Homo sapiens
gggaaucagaagagccug

SEQ ID NO: 1852123 - RNA, 19 nt, Homo sapiens
ccuugaguuucauauauaa

SEQ ID NO: 1852124 - RNA, 19 nt, Homo sapiens
uucacuguagcucuaaaau

SEQ ID NO: 1852125 - RNA, 19 nt, Homo sapiens
cugggccccaugcucugcc

SEQ ID NO: 1852126 - RNA, 19 nt, Homo sapiens
gaagaguuggagugagaug

SEQ ID NO: 1852127 - RNA, 19 nt, Homo sapiens
acucaaauggggccagauc

SEQ ID NO: 1852128 - RNA, 18 nt, Homo sapiens
uccuuuccccucccucag

SEQ ID NO: 1852129 - RNA, 18 nt, Homo sapiens
cucaugcauagacaagug

SEQ ID NO: 1852130 - RNA, 14 nt, Homo sapiens
ugacucuccagaaa

SEQ ID NO: 1852131 - RNA, 22 nt, Homo sapiens
gggggcacucagccacgaccag

SEQ ID NO: 1852132 - RNA, 17 nt, Homo sapiens
gcuucccagaggccagg

SEQ ID NO: 1852133 - RNA, 18 nt, Homo sapiens
uaugacagaaaaguaaug

SEQ ID NO: 1852134 - RNA, 16 nt, Homo sapiens
guaauaaagugaacuu

SEQ ID NO: 1852135 - RNA, 18 nt, Homo sapiens
guaugucuuuaucaaagg

SEQ ID NO: 1852136 - RNA, 16 nt, Homo sapiens
ugacagagacccagau

SEQ ID NO: 1852137 - RNA, 12 nt, Homo sapiens
cgauaaagggau

SEQ ID NO: 1852138 - RNA, 12 nt, Homo sapiens
gcagaaagccag

SEQ ID NO: 1852139 - RNA, 21 nt, Homo sapiens
ugcguggugcucuuugcugca

SEQ ID NO: 1852140 - RNA, 16 nt, Homo sapiens
gaaauguauucaccuu

SEQ ID NO: 1852141 - RNA, 23 nt, Homo sapiens
aaaacaugcugaaaacuacacaa

SEQ ID NO: 1852142 - RNA, 22 nt, Homo sapiens
uauucagaaaagaugugcagau

SEQ ID NO: 1852143 - RNA, 20 nt, Homo sapiens
cagcugaggcugucauucca

SEQ ID NO: 1852144 - RNA, 20 nt, Homo sapiens
uaggagaaacuuagaggaaa

SEQ ID NO: 1852145 - RNA, 20 nt, Homo sapiens
auuuucuuguuuaacauaua

SEQ ID NO: 1852146 - RNA, 19 nt, Homo sapiens
augugcacugcaaugccag

SEQ ID NO: 1852147 - RNA, 12 nt, Homo sapiens
agcaugcugcug

SEQ ID NO: 1852148 - RNA, 12 nt, Homo sapiens
caaaauaccuuc

SEQ ID NO: 1852149 - RNA, 18 nt, Homo sapiens
cugcaccugaccugcuga

SEQ ID NO: 1852150 - RNA, 18 nt, Homo sapiens
caggccucaguuucuuca

SEQ ID NO: 1852151 - RNA, 16 nt, Homo sapiens
cugcaguccuacucaa

SEQ ID NO: 1852152 - RNA, 18 nt, Homo sapiens
aggucgggacagcugugc

SEQ ID NO: 1852153 - RNA, 19 nt, Homo sapiens
cuucagccaucaacaagag

SEQ ID NO: 1852154 - RNA, 18 nt, Homo sapiens
uugcacagcuagcaauug

SEQ ID NO: 1852155 - RNA, 11 nt, Homo sapiens
gucaugcugcc

SEQ ID NO: 1852156 - RNA, 11 nt, Homo sapiens
guaaugcugca

SEQ ID NO: 1852157 - RNA, 20 nt, Homo sapiens
cagauugauaaguaaugaaa

SEQ ID NO: 1852158 - RNA, 22 nt, Homo sapiens
acccccuccccccaaucccuca

SEQ ID NO: 1852159 - RNA, 13 nt, Homo sapiens
guaguucuugucu

SEQ ID NO: 1852160 - RNA, 16 nt, Homo sapiens
cagauuuuagagcaaa

SEQ ID NO: 1852161 - RNA, 18 nt, Homo sapiens
gcccaaucauuugcaaug

SEQ ID NO: 1852162 - RNA, 17 nt, Homo sapiens
gaggcacgaaugaucuu

SEQ ID NO: 1852163 - RNA, 22 nt, Homo sapiens
cucuaaccaguguacaggucac

SEQ ID NO: 1852164 - RNA, 12 nt, Homo sapiens
aggagagccugg

SEQ ID NO: 1852165 - RNA, 13 nt, Homo sapiens
gugcuacaaaaac

SEQ ID NO: 1852166 - RNA, 14 nt, Homo sapiens
accucacugccuca

SEQ ID NO: 1852167 - RNA, 14 nt, Homo sapiens
gcugcucuacugcu

SEQ ID NO: 1852168 - RNA, 14 nt, Homo sapiens
ggagaacuagagaa

SEQ ID NO: 1852169 - RNA, 14 nt, Homo sapiens
acacaccugcacac

SEQ ID NO: 1852170 - RNA, 21 nt, Homo sapiens
ucuaugaagcccacccagaaa

SEQ ID NO: 1852171 - RNA, 13 nt, Homo sapiens
uaauagcugcuag

SEQ ID NO: 1852172 - RNA, 18 nt, Homo sapiens
aauguuagguuacuguau

SEQ ID NO: 1852173 - RNA, 23 nt, Homo sapiens
ccaggauauugacaagaauacac

SEQ ID NO: 1852174 - RNA, 23 nt, Homo sapiens
auuacaggcuugagccuccaugc

SEQ ID NO: 1852175 - RNA, 19 nt, Homo sapiens
ucgcccaccugugggccag

SEQ ID NO: 1852176 - RNA, 14 nt, Homo sapiens
uguucacuaccugu

SEQ ID NO: 1852177 - RNA, 16 nt, Homo sapiens
gacguuugacuagcca

SEQ ID NO: 1852178 - RNA, 19 nt, Homo sapiens
ccucucucucccuccacuc

SEQ ID NO: 1852179 - RNA, 14 nt, Homo sapiens
cugugccccaccac

SEQ ID NO: 1852180 - RNA, 20 nt, Homo sapiens
guguagcuguccucucagaa

SEQ ID NO: 1852181 - RNA, 16 nt, Homo sapiens
gugggcaacacaugca

SEQ ID NO: 1852182 - RNA, 19 nt, Homo sapiens
caguuucuaggcaccucag

SEQ ID NO: 1852183 - RNA, 13 nt, Homo sapiens
auauuaaaguuac

SEQ ID NO: 1852184 - RNA, 21 nt, Homo sapiens
agacaaaauuaagaaugucaa

SEQ ID NO: 1852185 - RNA, 12 nt, Homo sapiens
uaaagugcuuaa

SEQ ID NO: 1852186 - RNA, 15 nt, Homo sapiens
agugaaggguuuugu

SEQ ID NO: 1852187 - RNA, 15 nt, Homo sapiens
gaaugaacaaccucg

SEQ ID NO: 1852188 - RNA, 14 nt, Homo sapiens
cccauuuguugcug

SEQ ID NO: 1852189 - RNA, 19 nt, Homo sapiens
cagcuucaacuuuucucuu

SEQ ID NO: 1852190 - RNA, 16 nt, Homo sapiens
gggagcugagccaguc

SEQ ID NO: 1852191 - RNA, 20 nt, Homo sapiens
ccaaugcuguggguuuccaa

SEQ ID NO: 1852192 - RNA, 23 nt, Homo sapiens
agaugguugagauaugaguucuu

SEQ ID NO: 1852193 - RNA, 15 nt, Homo sapiens
ccggggaacuggcca

SEQ ID NO: 1852194 - RNA, 16 nt, Homo sapiens
uccuuaaacagggcau

SEQ ID NO: 1852195 - RNA, 13 nt, Homo sapiens
aauagaauacccu

SEQ ID NO: 1852196 - RNA, 18 nt, Homo sapiens
ucacuucuaccuacauau

SEQ ID NO: 1852197 - RNA, 21 nt, Homo sapiens
gccaggcugaauuacagugaa

SEQ ID NO: 1852198 - RNA, 20 nt, Homo sapiens
ugaagguuuauacuaauuca

SEQ ID NO: 1852199 - RNA, 19 nt, Homo sapiens
aaacugauuuuuagcuuua

SEQ ID NO: 1852200 - RNA, 19 nt, Homo sapiens
aacuuauaacccacuuuaa

SEQ ID NO: 1852201 - RNA, 16 nt, Homo sapiens
acaguguuuccaguga

SEQ ID NO: 1852202 - RNA, 17 nt, Homo sapiens
gaauuuggaaggcaaag

SEQ ID NO: 1852203 - RNA, 13 nt, Homo sapiens
uaugcaaccugug

SEQ ID NO: 1852204 - RNA, 19 nt, Homo sapiens
ugccagaagcuacugcgau

SEQ ID NO: 1852205 - RNA, 21 nt, Homo sapiens
gauuuaucacacaaagcagaa

SEQ ID NO: 1852206 - RNA, 17 nt, Homo sapiens
aagaugcgcauucuaac

SEQ ID NO: 1852207 - RNA, 20 nt, Homo sapiens
aggaaaaguuauugugauaa

SEQ ID NO: 1852208 - RNA, 15 nt, Homo sapiens
gacuuggggacaccc

SEQ ID NO: 1852209 - RNA, 16 nt, Homo sapiens
agcugauauaaauucu

SEQ ID NO: 1852210 - RNA, 20 nt, Homo sapiens
acugaugagagaauguggaa

SEQ ID NO: 1852211 - RNA, 14 nt, Homo sapiens
uccccuugccuuau

SEQ ID NO: 1852212 - RNA, 18 nt, Homo sapiens
uauuaaaaacccauaacu

SEQ ID NO: 1852213 - RNA, 22 nt, Homo sapiens
gaaauaaaaauggcaaaugcac

SEQ ID NO: 1852214 - RNA, 13 nt, Homo sapiens
cagguacuuguaa

SEQ ID NO: 1852215 - RNA, 16 nt, Homo sapiens
uggaucuaauaaacuu

SEQ ID NO: 1852216 - RNA, 20 nt, Homo sapiens
auuuaaaaagcccaaccucu

SEQ ID NO: 1852217 - RNA, 14 nt, Homo sapiens
agaagcaaacaagc

SEQ ID NO: 1852218 - RNA, 13 nt, Homo sapiens
acuuaugauuuca

SEQ ID NO: 1852219 - RNA, 20 nt, Homo sapiens
accacuuuucuauauugcag

SEQ ID NO: 1852220 - RNA, 12 nt, Homo sapiens
aucuaugggaga

SEQ ID NO: 1852221 - RNA, 14 nt, Homo sapiens
auagcuguuugaaa

SEQ ID NO: 1852222 - RNA, 14 nt, Homo sapiens
agaaaaguugggcu

SEQ ID NO: 1852223 - RNA, 23 nt, Homo sapiens
cacauguguaugauacuaaagac

SEQ ID NO: 1852224 - RNA, 16 nt, Homo sapiens
cugaauuaagcagcuc

SEQ ID NO: 1852225 - RNA, 15 nt, Homo sapiens
uaaaauacaguauau

SEQ ID NO: 1852226 - RNA, 14 nt, Homo sapiens
aaucccuacagggu

SEQ ID NO: 1852227 - RNA, 16 nt, Homo sapiens
ccaucuguacuuuggu

SEQ ID NO: 1852228 - RNA, 17 nt, Homo sapiens
acaggaaaucaugaggg

SEQ ID NO: 1852229 - RNA, 11 nt, Homo sapiens
ccuggcacaau

SEQ ID NO: 1852230 - RNA, 13 nt, Homo sapiens
aauguaguuuuaa

SEQ ID NO: 1852231 - RNA, 17 nt, Homo sapiens
gaaugaaccacugcccc

SEQ ID NO: 1852232 - RNA, 16 nt, Homo sapiens
ccccuguacauuugug

SEQ ID NO: 1852233 - RNA, 14 nt, Homo sapiens
ugugaccagggaca

SEQ ID NO: 1852234 - RNA, 15 nt, Homo sapiens
aaaauuaaacaaaua

SEQ ID NO: 1852235 - RNA, 15 nt, Homo sapiens
aauuaaaaacuuuaa

SEQ ID NO: 1852236 - RNA, 19 nt, Homo sapiens
cuguuccaaagccagugaa

SEQ ID NO: 1852237 - RNA, 18 nt, Homo sapiens
ugccaccacgcccagcua

SEQ ID NO: 1852238 - RNA, 20 nt, Homo sapiens
uuacuaggagauaccaccga

SEQ ID NO: 1852239 - RNA, 16 nt, Homo sapiens
caauaaaaacauugcc

SEQ ID NO: 1852240 - RNA, 19 nt, Homo sapiens
aaauaggagucuucugccu

SEQ ID NO: 1852241 - RNA, 18 nt, Homo sapiens
ccguaacaacugugguca

SEQ ID NO: 1852242 - RNA, 16 nt, Homo sapiens
augagugucaacucca

SEQ ID NO: 1852243 - RNA, 21 nt, Homo sapiens
accagaacaguaugaauuuga

SEQ ID NO: 1852244 - RNA, 18 nt, Homo sapiens
ucacggcugcaccugcag

SEQ ID NO: 1852245 - RNA, 16 nt, Homo sapiens
ucuuucucacugccuu

SEQ ID NO: 1852246 - RNA, 19 nt, Homo sapiens
cauuaaaauaaaccaaaua

SEQ ID NO: 1852247 - RNA, 18 nt, Homo sapiens
ucccaucucuccauauac

SEQ ID NO: 1852248 - RNA, 13 nt, Homo sapiens
cagcaugugcuuu

SEQ ID NO: 1852249 - RNA, 16 nt, Homo sapiens
agcaucugcagccacu

SEQ ID NO: 1852250 - RNA, 16 nt, Homo sapiens
agguaggaagcacuga

SEQ ID NO: 1852251 - RNA, 14 nt, Homo sapiens
ggcaggagggcaug

SEQ ID NO: 1852252 - RNA, 16 nt, Homo sapiens
aacucuaaaagaagaa

SEQ ID NO: 1852253 - RNA, 18 nt, Homo sapiens
cuugucagcacuuccagu

SEQ ID NO: 1852254 - RNA, 21 nt, Homo sapiens
ucugauggcugcuccacuggg

SEQ ID NO: 1852255 - RNA, 22 nt, Homo sapiens
cacagacacacacacgcacgca

SEQ ID NO: 1852256 - RNA, 20 nt, Homo sapiens
uuuguaacuacccucucaaa

SEQ ID NO: 1852257 - RNA, 15 nt, Homo sapiens
gcuggcucaccuggg

SEQ ID NO: 1852258 - RNA, 19 nt, Homo sapiens
ucacaaugucaguauuuca

SEQ ID NO: 1852259 - RNA, 15 nt, Homo sapiens
auuggcaugccacag

SEQ ID NO: 1852260 - RNA, 18 nt, Homo sapiens
augcaaaugaguucagga

SEQ ID NO: 1852261 - RNA, 19 nt, Homo sapiens
ccacggugccuccagaugg

SEQ ID NO: 1852262 - RNA, 15 nt, Homo sapiens
gcucugacaagaugg

SEQ ID NO: 1852263 - RNA, 14 nt, Homo sapiens
gagaggaagccuga

SEQ ID NO: 1852264 - RNA, 16 nt, Homo sapiens
caagguggacaucuuc

SEQ ID NO: 1852265 - RNA, 17 nt, Homo sapiens
gaccccagcauucucag

SEQ ID NO: 1852266 - RNA, 17 nt, Homo sapiens
ucaccauuggacagucu

SEQ ID NO: 1852267 - RNA, 15 nt, Homo sapiens
uauugucauaaccaa

SEQ ID NO: 1852268 - RNA, 18 nt, Homo sapiens
gccaggccuuggggacaa

SEQ ID NO: 1852269 - RNA, 20 nt, Homo sapiens
uuuccucccugcagagccaa

SEQ ID NO: 1852270 - RNA, 19 nt, Homo sapiens
uuccucccuauuaaccuag

SEQ ID NO: 1852271 - RNA, 18 nt, Homo sapiens
ggaccuggcacaccuuag

SEQ ID NO: 1852272 - RNA, 22 nt, Homo sapiens
aacugucaaagaaucaauccag

SEQ ID NO: 1852273 - RNA, 17 nt, Homo sapiens
ccccauccccaccacug

SEQ ID NO: 1852274 - RNA, 21 nt, Homo sapiens
uguaacuauaguccagcuuug

SEQ ID NO: 1852275 - RNA, 16 nt, Homo sapiens
caacauguaccucacc

SEQ ID NO: 1852276 - RNA, 16 nt, Homo sapiens
agcuggacagagggga

SEQ ID NO: 1852277 - RNA, 16 nt, Homo sapiens
auaaugauaguuauaa

SEQ ID NO: 1852278 - RNA, 18 nt, Homo sapiens
gucauuccacacauuucc

SEQ ID NO: 1852279 - RNA, 18 nt, Homo sapiens
uccugugcuacuuugccu

SEQ ID NO: 1852280 - RNA, 18 nt, Homo sapiens
guuuaccgagcacuguga

SEQ ID NO: 1852281 - RNA, 18 nt, Homo sapiens
accuaacugaaaugagau

SEQ ID NO: 1852282 - RNA, 16 nt, Homo sapiens
uguucccgauggucuc

SEQ ID NO: 1852283 - RNA, 21 nt, Homo sapiens
gugucaggugguuaccaggca

SEQ ID NO: 1852284 - RNA, 14 nt, Homo sapiens
uagggggaagacag

SEQ ID NO: 1852285 - RNA, 16 nt, Homo sapiens
auacaguaucucaggg

SEQ ID NO: 1852286 - RNA, 21 nt, Homo sapiens
cccugcccaaccucugugguc

SEQ ID NO: 1852287 - RNA, 21 nt, Homo sapiens
ccuuagcucccuguucuugga

SEQ ID NO: 1852288 - RNA, 19 nt, Homo sapiens
auguuaggaaaauuucaca

SEQ ID NO: 1852289 - RNA, 23 nt, Homo sapiens
agaccagccuggccaacauguca

SEQ ID NO: 1852290 - RNA, 16 nt, Homo sapiens
gcagacuauaaaaucu

SEQ ID NO: 1852291 - RNA, 16 nt, Homo sapiens
cuuugucucaccagcu

SEQ ID NO: 1852292 - RNA, 21 nt, Homo sapiens
cucuucugacuacugggcaaa

SEQ ID NO: 1852293 - RNA, 14 nt, Homo sapiens
ugcccuucauucag

SEQ ID NO: 1852294 - RNA, 23 nt, Homo sapiens
gagcucuugugucauuguuagaa

SEQ ID NO: 1852295 - RNA, 17 nt, Homo sapiens
gcauuuucugcaucucc

SEQ ID NO: 1852296 - RNA, 18 nt, Homo sapiens
augcuguuugacaaaguu

SEQ ID NO: 1852297 - RNA, 15 nt, Homo sapiens
ucaaggugaagcaca

SEQ ID NO: 1852298 - RNA, 21 nt, Homo sapiens
agaaccaugcaggaaggaaaa

SEQ ID NO: 1852299 - RNA, 13 nt, Homo sapiens
cuccuugaaguuc

SEQ ID NO: 1852300 - RNA, 19 nt, Homo sapiens
uucacagaauagcacaaac

SEQ ID NO: 1852301 - RNA, 15 nt, Homo sapiens
gcuuucccacuuccc

SEQ ID NO: 1852302 - RNA, 22 nt, Homo sapiens
aauguuggaguggaacauuggg

SEQ ID NO: 1852303 - RNA, 22 nt, Homo sapiens
ugcauagcgaagaccaguaugg

SEQ ID NO: 1852304 - RNA, 19 nt, Homo sapiens
cuacccacagagcaaguga

SEQ ID NO: 1852305 - RNA, 17 nt, Homo sapiens
agauauucauacuuucc

SEQ ID NO: 1852306 - RNA, 19 nt, Homo sapiens
uccacaaacaccaucuuca

SEQ ID NO: 1852307 - RNA, 18 nt, Homo sapiens
gucagcagaugcuguugu

SEQ ID NO: 1852308 - RNA, 22 nt, Homo sapiens
ugcuaagggaaauaacaguauu

SEQ ID NO: 1852309 - RNA, 16 nt, Homo sapiens
ccgagcccacaccauc

SEQ ID NO: 1852310 - RNA, 22 nt, Homo sapiens
ucuuaauacuuuaugaugcuau

SEQ ID NO: 1852311 - RNA, 14 nt, Homo sapiens
cucuuuccuccugc

SEQ ID NO: 1852312 - RNA, 23 nt, Homo sapiens
ggauuacaggugugggccacugc

SEQ ID NO: 1852313 - RNA, 19 nt, Homo sapiens
gucauaucuagucacuugu

SEQ ID NO: 1852314 - RNA, 21 nt, Homo sapiens
acuguccacuuggagcuaaaa

SEQ ID NO: 1852315 - RNA, 18 nt, Homo sapiens
gagggucacgcuugccug

SEQ ID NO: 1852316 - RNA, 18 nt, Homo sapiens
gccagucagguuauuuaa

SEQ ID NO: 1852317 - RNA, 18 nt, Homo sapiens
gucucucccuuccaggaa

SEQ ID NO: 1852318 - RNA, 15 nt, Homo sapiens
ggacugaagccaaag

SEQ ID NO: 1852319 - RNA, 21 nt, Homo sapiens
uaaagacauaggaacauguag

SEQ ID NO: 1852320 - RNA, 18 nt, Homo sapiens
acuuuggguuuuuaacuc

SEQ ID NO: 1852321 - RNA, 14 nt, Homo sapiens
guauacauuuacug

SEQ ID NO: 1852322 - RNA, 20 nt, Homo sapiens
ggaaaagcugcugacagugu

SEQ ID NO: 1852323 - RNA, 23 nt, Homo sapiens
aauuugcaaaacugugcuuuuau

SEQ ID NO: 1852324 - RNA, 23 nt, Homo sapiens
cuaugaguguaguugaugacugu

SEQ ID NO: 1852325 - RNA, 15 nt, Homo sapiens
aaccaaggacugagc

SEQ ID NO: 1852326 - RNA, 21 nt, Homo sapiens
ucaaguuuuggguauguuuaa

SEQ ID NO: 1852327 - RNA, 13 nt, Homo sapiens
cuaccaugucuua

SEQ ID NO: 1852328 - RNA, 22 nt, Homo sapiens
cagggcauauuaguugaugaaa

SEQ ID NO: 1852329 - RNA, 14 nt, Homo sapiens
guguuugugucuga

SEQ ID NO: 1852330 - RNA, 14 nt, Homo sapiens
gugugugugucuua

SEQ ID NO: 1852331 - RNA, 21 nt, Homo sapiens
acaugagcuuacauucuuaca

SEQ ID NO: 1852332 - RNA, 21 nt, Homo sapiens
guauguucguugcagcacugc

SEQ ID NO: 1852333 - RNA, 20 nt, Homo sapiens
uucacaaguuacaguucguc

SEQ ID NO: 1852334 - RNA, 23 nt, Homo sapiens
gccacauaagggguuugccauuu

SEQ ID NO: 1852335 - RNA, 16 nt, Homo sapiens
aggcagguugaucacc

SEQ ID NO: 1852336 - RNA, 14 nt, Homo sapiens
gccagguguggaac

SEQ ID NO: 1852337 - RNA, 15 nt, Homo sapiens
uaacauaaugcacuu

SEQ ID NO: 1852338 - RNA, 12 nt, Homo sapiens
guguccuuccau

SEQ ID NO: 1852339 - RNA, 15 nt, Homo sapiens
agaccagcuucuagc

SEQ ID NO: 1852340 - RNA, 18 nt, Homo sapiens
aggucauggccacacugu

SEQ ID NO: 1852341 - RNA, 19 nt, Homo sapiens
accuuggccucccaaagug

SEQ ID NO: 1852342 - RNA, 20 nt, Homo sapiens
caaaauaaaaaccaagaaga

SEQ ID NO: 1852343 - RNA, 14 nt, Homo sapiens
agcgaaucucugcc

SEQ ID NO: 1852344 - RNA, 13 nt, Homo sapiens
acugagcacuuug

SEQ ID NO: 1852345 - RNA, 13 nt, Homo sapiens
ccagagcugccac

SEQ ID NO: 1852346 - RNA, 20 nt, Homo sapiens
uuggauauaccuagauucca

SEQ ID NO: 1852347 - RNA, 20 nt, Homo sapiens
acuaaaauauuaguguuauu

SEQ ID NO: 1852348 - RNA, 12 nt, Homo sapiens
acugugacugug

SEQ ID NO: 1852349 - RNA, 18 nt, Homo sapiens
aguagcuugggacaaauc

SEQ ID NO: 1852350 - RNA, 23 nt, Homo sapiens
gcacacagugucuguguacaugu

SEQ ID NO: 1852351 - RNA, 14 nt, Homo sapiens
caguggcaguguau

SEQ ID NO: 1852352 - RNA, 15 nt, Homo sapiens
aagauaguaacugua

SEQ ID NO: 1852353 - RNA, 20 nt, Homo sapiens
uguaauagaucagcauccaa

SEQ ID NO: 1852354 - RNA, 13 nt, Homo sapiens
uugaaagaaccag

SEQ ID NO: 1852355 - RNA, 15 nt, Homo sapiens
uggcagccauggcca

SEQ ID NO: 1852356 - RNA, 16 nt, Homo sapiens
gccccccguguucaca

SEQ ID NO: 1852357 - RNA, 16 nt, Homo sapiens
ccuugaacccuaauaa

SEQ ID NO: 1852358 - RNA, 22 nt, Homo sapiens
agcuguuuccucacguccauca

SEQ ID NO: 1852359 - RNA, 21 nt, Homo sapiens
uacccgggcagggcucccaca

SEQ ID NO: 1852360 - RNA, 13 nt, Homo sapiens
ucuaaucagugau

SEQ ID NO: 1852361 - RNA, 20 nt, Homo sapiens
guuucuugcucugagugcua

SEQ ID NO: 1852362 - RNA, 18 nt, Homo sapiens
ccacugggucucacuccu

SEQ ID NO: 1852363 - RNA, 22 nt, Homo sapiens
uauuuccauauuaaaaucacaa

SEQ ID NO: 1852364 - RNA, 14 nt, Homo sapiens
cccagcuauacugu

SEQ ID NO: 1852365 - RNA, 11 nt, Homo sapiens
agcuacagugu

SEQ ID NO: 1852366 - RNA, 15 nt, Homo sapiens
ucugauuuucuccua

SEQ ID NO: 1852367 - RNA, 17 nt, Homo sapiens
agaguggaaauggggaa

SEQ ID NO: 1852368 - RNA, 22 nt, Homo sapiens
ucucaaaaccggguugccagcu

SEQ ID NO: 1852369 - RNA, 13 nt, Homo sapiens
uuaauacuugauu

SEQ ID NO: 1852370 - RNA, 16 nt, Homo sapiens
ggagcagcaucucuga

SEQ ID NO: 1852371 - RNA, 15 nt, Homo sapiens
uucuuuccuuuucau

SEQ ID NO: 1852372 - RNA, 17 nt, Homo sapiens
ucccauuaaagagccag

SEQ ID NO: 1852373 - RNA, 23 nt, Homo sapiens
uggcauuacaggugugagccacg

SEQ ID NO: 1852374 - RNA, 17 nt, Homo sapiens
gcccugagccacugagu

SEQ ID NO: 1852375 - RNA, 13 nt, Homo sapiens
gccucagggccag

SEQ ID NO: 1852376 - RNA, 17 nt, Homo sapiens
uucagcagcaggugcuu

SEQ ID NO: 1852377 - RNA, 15 nt, Homo sapiens
uuugagaagcacugu

SEQ ID NO: 1852378 - RNA, 12 nt, Homo sapiens
aauaagauuuaa

SEQ ID NO: 1852379 - RNA, 14 nt, Homo sapiens
gcccacagggacca

SEQ ID NO: 1852380 - RNA, 14 nt, Homo sapiens
acuuacuguagccu

SEQ ID NO: 1852381 - RNA, 16 nt, Homo sapiens
uggaucaucuauugcu

SEQ ID NO: 1852382 - RNA, 17 nt, Homo sapiens
gucuacugucuggaaga

SEQ ID NO: 1852383 - RNA, 19 nt, Homo sapiens
ggauaguacuaagcauuuc

SEQ ID NO: 1852384 - RNA, 22 nt, Homo sapiens
ccaaugaggucugaaauggagg

SEQ ID NO: 1852385 - RNA, 15 nt, Homo sapiens
aagcacaguuugaac

SEQ ID NO: 1852386 - RNA, 12 nt, Homo sapiens
uaagaaaaccaa

SEQ ID NO: 1852387 - RNA, 16 nt, Homo sapiens
aaaggagccugugaac

SEQ ID NO: 1852388 - RNA, 16 nt, Homo sapiens
aaauuggacuggugaa

SEQ ID NO: 1852389 - RNA, 15 nt, Homo sapiens
uuuccauuacaugau

SEQ ID NO: 1852390 - RNA, 19 nt, Homo sapiens
ccuuguuccaauuugacaa

SEQ ID NO: 1852391 - RNA, 18 nt, Homo sapiens
uacaucuuguaggaucua

SEQ ID NO: 1852392 - RNA, 13 nt, Homo sapiens
gaugcggcccuga

SEQ ID NO: 1852393 - RNA, 15 nt, Homo sapiens
ugaaagcggcugccu

SEQ ID NO: 1852394 - RNA, 21 nt, Homo sapiens
cuguggcugcuagcacuugga

SEQ ID NO: 1852395 - RNA, 18 nt, Homo sapiens
guuauuaccuuuacauau

SEQ ID NO: 1852396 - RNA, 18 nt, Homo sapiens
aaccccccagcacugagg

SEQ ID NO: 1852397 - RNA, 20 nt, Homo sapiens
ccuuguguuccuucugugaa

SEQ ID NO: 1852398 - RNA, 14 nt, Homo sapiens
aaauaaacaucagu

SEQ ID NO: 1852399 - RNA, 16 nt, Homo sapiens
uaaagcaguugagauu

SEQ ID NO: 1852400 - RNA, 16 nt, Homo sapiens
uaacuaauuugcucug

SEQ ID NO: 1852401 - RNA, 23 nt, Homo sapiens
accaagaauucuccaaaacaauu

SEQ ID NO: 1852402 - RNA, 14 nt, Homo sapiens
uugguguaagccuu

SEQ ID NO: 1852403 - RNA, 18 nt, Homo sapiens
gcuugaccgugaggccag

SEQ ID NO: 1852404 - RNA, 15 nt, Homo sapiens
cgugggccgcacugg

SEQ ID NO: 1852405 - RNA, 13 nt, Homo sapiens
uguuauguccaga

SEQ ID NO: 1852406 - RNA, 20 nt, Homo sapiens
uccucaguuuuugugaaaag

SEQ ID NO: 1852407 - RNA, 17 nt, Homo sapiens
augccaagucccuggaa

SEQ ID NO: 1852408 - RNA, 18 nt, Homo sapiens
acaaggauagaugcuggc

SEQ ID NO: 1852409 - RNA, 12 nt, Homo sapiens
gaaguaagcaaa

SEQ ID NO: 1852410 - RNA, 16 nt, Homo sapiens
ccuaucuuccuuccuc

SEQ ID NO: 1852411 - RNA, 16 nt, Homo sapiens
accaggccaaugucag

SEQ ID NO: 1852412 - RNA, 17 nt, Homo sapiens
cuuacccucccaccacu

SEQ ID NO: 1852413 - RNA, 20 nt, Homo sapiens
uccugugacugucucacuua

SEQ ID NO: 1852414 - RNA, 12 nt, Homo sapiens
uaauucugugau

SEQ ID NO: 1852415 - RNA, 22 nt, Homo sapiens
auucuuccuaaugucagaacag

SEQ ID NO: 1852416 - RNA, 10 nt, Homo sapiens
uuugccauuu

SEQ ID NO: 1852417 - RNA, 16 nt, Homo sapiens
ccaugacucauaagcu

SEQ ID NO: 1852418 - RNA, 19 nt, Homo sapiens
acuaaugucagcacauguu

SEQ ID NO: 1852419 - RNA, 14 nt, Homo sapiens
ugguuuaccugcac

SEQ ID NO: 1852420 - RNA, 23 nt, Homo sapiens
guccauuaagcugagagugcuau

SEQ ID NO: 1852421 - RNA, 17 nt, Homo sapiens
gcaggccugccuucuca

SEQ ID NO: 1852422 - RNA, 20 nt, Homo sapiens
ucaccauguacauagcuuga

SEQ ID NO: 1852423 - RNA, 17 nt, Homo sapiens
gaacccuccagaccucc

SEQ ID NO: 1852424 - RNA, 16 nt, Homo sapiens
acuugugucuguccaa

SEQ ID NO: 1852425 - RNA, 20 nt, Homo sapiens
aucugacccucccagucuca

SEQ ID NO: 1852426 - RNA, 21 nt, Homo sapiens
aaccccuuacccaucucucua

SEQ ID NO: 1852427 - RNA, 13 nt, Homo sapiens
cagcuacuggaau

SEQ ID NO: 1852428 - RNA, 14 nt, Homo sapiens
aagacacagacugc

SEQ ID NO: 1852429 - RNA, 20 nt, Homo sapiens
augguuuuugaaggcuuuag

SEQ ID NO: 1852430 - RNA, 23 nt, Homo sapiens
ucacaaucucuguuuguaugugg

SEQ ID NO: 1852431 - RNA, 11 nt, Homo sapiens
gcagggccuug

SEQ ID NO: 1852432 - RNA, 18 nt, Homo sapiens
guacaauuuucaucccac

SEQ ID NO: 1852433 - RNA, 13 nt, Homo sapiens
aagucccuuucug

SEQ ID NO: 1852434 - RNA, 16 nt, Homo sapiens
acauuagucucaguga

SEQ ID NO: 1852435 - RNA, 18 nt, Homo sapiens
cuaauguauuaauaccac

SEQ ID NO: 1852436 - RNA, 12 nt, Homo sapiens
cacgcugccauu

SEQ ID NO: 1852437 - RNA, 17 nt, Homo sapiens
uaaguacuugagacucu

SEQ ID NO: 1852438 - RNA, 15 nt, Homo sapiens
augucagucugucca

SEQ ID NO: 1852439 - RNA, 16 nt, Homo sapiens
gaaauacuauaacaua

SEQ ID NO: 1852440 - RNA, 14 nt, Homo sapiens
agagcaucugcaac

SEQ ID NO: 1852441 - RNA, 21 nt, Homo sapiens
ucggauacccuggagcaagac

SEQ ID NO: 1852442 - RNA, 23 nt, Homo sapiens
aaggaugcugucaagcaccugca

SEQ ID NO: 1852443 - RNA, 20 nt, Homo sapiens
ugacaaaacaucuuuucaca

SEQ ID NO: 1852444 - RNA, 20 nt, Homo sapiens
uuagauguaauuuuguguaa

SEQ ID NO: 1852445 - RNA, 21 nt, Homo sapiens
acuaagaugugcagcauuuca

SEQ ID NO: 1852446 - RNA, 23 nt, Homo sapiens
gggaagaugcccucaacucaccc

SEQ ID NO: 1852447 - RNA, 21 nt, Homo sapiens
gagugaauuacagacaaccua

SEQ ID NO: 1852448 - RNA, 17 nt, Homo sapiens
gcaauuuuguguaaauu

SEQ ID NO: 1852449 - RNA, 18 nt, Homo sapiens
aagaaagcaaaacucacu

SEQ ID NO: 1852450 - RNA, 14 nt, Homo sapiens
aaucauggcauuca

SEQ ID NO: 1852451 - RNA, 23 nt, Homo sapiens
gugaagaacaucccaagccagaa

SEQ ID NO: 1852452 - RNA, 18 nt, Homo sapiens
uccacuuuaugugcaucu

SEQ ID NO: 1852453 - RNA, 23 nt, Homo sapiens
agcauccuggaauaucuccguca

SEQ ID NO: 1852454 - RNA, 21 nt, Homo sapiens
auguagaagcaugaagucuua

SEQ ID NO: 1852455 - RNA, 20 nt, Homo sapiens
aaguguguugggaauugcau

SEQ ID NO: 1852456 - RNA, 21 nt, Homo sapiens
cucagaagaaaaagaagcuga

SEQ ID NO: 1852457 - RNA, 22 nt, Homo sapiens
gaggacccgugugacucgccag

SEQ ID NO: 1852458 - RNA, 14 nt, Homo sapiens
ccuuugugcccuau

SEQ ID NO: 1852459 - RNA, 21 nt, Homo sapiens
caauguauuuuaauaacauau

SEQ ID NO: 1852460 - RNA, 14 nt, Homo sapiens
cccagaagugcaga

SEQ ID NO: 1852461 - RNA, 18 nt, Homo sapiens
ugcaauuucuccaaagcu

SEQ ID NO: 1852462 - RNA, 17 nt, Homo sapiens
acaaaaagaagaguuug

SEQ ID NO: 1852463 - RNA, 21 nt, Homo sapiens
agaaguuaaaccaugugacua

SEQ ID NO: 1852464 - RNA, 15 nt, Homo sapiens
caguuugauaacuag

SEQ ID NO: 1852465 - RNA, 18 nt, Homo sapiens
aaauauugaggcuuugug

SEQ ID NO: 1852466 - RNA, 17 nt, Homo sapiens
uauagcccggugcagcc

SEQ ID NO: 1852467 - RNA, 23 nt, Homo sapiens
accgcugauucucagggucucug

SEQ ID NO: 1852468 - RNA, 13 nt, Homo sapiens
ccaucuuccaugu

SEQ ID NO: 1852469 - RNA, 17 nt, Homo sapiens
uggucacagagcacugu

SEQ ID NO: 1852470 - RNA, 14 nt, Homo sapiens
aacuugagucacaa

SEQ ID NO: 1852471 - RNA, 23 nt, Homo sapiens
uauucaggcuuuaggcauaugcu

SEQ ID NO: 1852472 - RNA, 16 nt, Homo sapiens
gcagaucugugccugg

SEQ ID NO: 1852473 - RNA, 23 nt, Homo sapiens
ugcacagggggaggccauaaaga

SEQ ID NO: 1852474 - RNA, 18 nt, Homo sapiens
uguggggaagaguggucu

SEQ ID NO: 1852475 - RNA, 17 nt, Homo sapiens
aucccugcucucugagu

SEQ ID NO: 1852476 - RNA, 22 nt, Homo sapiens
uccuaaacccaaugacuucccu

SEQ ID NO: 1852477 - RNA, 13 nt, Homo sapiens
auugcuccaugau

SEQ ID NO: 1852478 - RNA, 19 nt, Homo sapiens
aguaaaacuuuaaugggag

SEQ ID NO: 1852479 - RNA, 14 nt, Homo sapiens
gucacacacuggac

SEQ ID NO: 1852480 - RNA, 16 nt, Homo sapiens
accugugcugaccaaa

SEQ ID NO: 1852481 - RNA, 15 nt, Homo sapiens
augaaggcuugucag

SEQ ID NO: 1852482 - RNA, 20 nt, Homo sapiens
uuccuguuagcagucuguaa

SEQ ID NO: 1852483 - RNA, 22 nt, Homo sapiens
guuuuaaaaaggaacugcagca

SEQ ID NO: 1852484 - RNA, 19 nt, Homo sapiens
acagagcacuguagcacuu

SEQ ID NO: 1852485 - RNA, 21 nt, Homo sapiens
cccugacugggaguugaucgc

SEQ ID NO: 1852486 - RNA, 22 nt, Homo sapiens
ugacuccacgauccugccaccc

SEQ ID NO: 1852487 - RNA, 16 nt, Homo sapiens
auaauacaguaucuca

SEQ ID NO: 1852488 - RNA, 21 nt, Homo sapiens
gucuuugcccugaauggucuc

SEQ ID NO: 1852489 - RNA, 11 nt, Homo sapiens
guccauuccaa

SEQ ID NO: 1852490 - RNA, 16 nt, Homo sapiens
uuaugcuaagugaaau

SEQ ID NO: 1852491 - RNA, 16 nt, Homo sapiens
uggccugugugauaca

SEQ ID NO: 1852492 - RNA, 16 nt, Homo sapiens
gccccuuugccuguca

SEQ ID NO: 1852493 - RNA, 23 nt, Homo sapiens
uugggccagccccagcaccucau

SEQ ID NO: 1852494 - RNA, 19 nt, Homo sapiens
gaagguggggacagggaug

SEQ ID NO: 1852495 - RNA, 19 nt, Homo sapiens
gaaacuuuuagagccagaa

SEQ ID NO: 1852496 - RNA, 19 nt, Homo sapiens
guuagggaugacugugauu

SEQ ID NO: 1852497 - RNA, 15 nt, Homo sapiens
uggauugcacguggc

SEQ ID NO: 1852498 - RNA, 19 nt, Homo sapiens
ggaaagagcacccucgaga

SEQ ID NO: 1852499 - RNA, 12 nt, Homo sapiens
cuugcucugcau

SEQ ID NO: 1852500 - RNA, 14 nt, Homo sapiens
cugaacugggaccu

SEQ ID NO: 1852501 - RNA, 16 nt, Homo sapiens
gcaggcgguggggaga

SEQ ID NO: 1852502 - RNA, 15 nt, Homo sapiens
uucacuauaauguga

SEQ ID NO: 1852503 - RNA, 19 nt, Homo sapiens
ugcccuaggauacccagau

SEQ ID NO: 1852504 - RNA, 20 nt, Homo sapiens
uguggaacuauuuuaccuua

SEQ ID NO: 1852505 - RNA, 18 nt, Homo sapiens
cuaaugggggcagucucc

SEQ ID NO: 1852506 - RNA, 23 nt, Homo sapiens
acucagaaagccaacauguggcu

SEQ ID NO: 1852507 - RNA, 18 nt, Homo sapiens
gaauuucaguaaacaaug

SEQ ID NO: 1852508 - RNA, 16 nt, Homo sapiens
uacucuugaauacaag

SEQ ID NO: 1852509 - RNA, 17 nt, Homo sapiens
auucagcucugaucuga

SEQ ID NO: 1852510 - RNA, 20 nt, Homo sapiens
gcucggcccucaagugcccg

SEQ ID NO: 1852511 - RNA, 19 nt, Homo sapiens
uuuauucauuagcugugau

SEQ ID NO: 1852512 - RNA, 17 nt, Homo sapiens
agugggucccacuuccc

SEQ ID NO: 1852513 - RNA, 18 nt, Homo sapiens
ccuucaucugggacaaaa

SEQ ID NO: 1852514 - RNA, 22 nt, Homo sapiens
cuggaagguacugaaggcuucu

SEQ ID NO: 1852515 - RNA, 21 nt, Homo sapiens
aauagcauuaucuuaucauuu

SEQ ID NO: 1852516 - RNA, 20 nt, Homo sapiens
ugaaacccuccaaaucucca

SEQ ID NO: 1852517 - RNA, 16 nt, Homo sapiens
agaacauugauuucau

SEQ ID NO: 1852518 - RNA, 14 nt, Homo sapiens
aagcagaacucuca

SEQ ID NO: 1852519 - RNA, 14 nt, Homo sapiens
augccaaacacuag

SEQ ID NO: 1852520 - RNA, 16 nt, Homo sapiens
ucgagcaaaauucaaa

SEQ ID NO: 1852521 - RNA, 15 nt, Homo sapiens
cagcugccccgggga

SEQ ID NO: 1852522 - RNA, 22 nt, Homo sapiens
auuauguguugccaaaaccaaa

SEQ ID NO: 1852523 - RNA, 22 nt, Homo sapiens
ugccaggggcuucccacuuugg

SEQ ID NO: 1852524 - RNA, 21 nt, Homo sapiens
uauguccuaauaauaucccac

SEQ ID NO: 1852525 - RNA, 23 nt, Homo sapiens
ccaugggcuagugugaguggcag

SEQ ID NO: 1852526 - RNA, 19 nt, Homo sapiens
uuggaauuuguaaccucag

SEQ ID NO: 1852527 - RNA, 20 nt, Homo sapiens
gaaguucaguuuuuacugag

SEQ ID NO: 1852528 - RNA, 21 nt, Homo sapiens
gguguccuacagaaaaaccuu

SEQ ID NO: 1852529 - RNA, 19 nt, Homo sapiens
caacaccccucccugccac

SEQ ID NO: 1852530 - RNA, 16 nt, Homo sapiens
uaaaaguggauuuaga

SEQ ID NO: 1852531 - RNA, 20 nt, Homo sapiens
agcuccucaaagccucaaaa

SEQ ID NO: 1852532 - RNA, 13 nt, Homo sapiens
aaauaaacuucac

SEQ ID NO: 1852533 - RNA, 17 nt, Homo sapiens
ucucugaggacacuaac

SEQ ID NO: 1852534 - RNA, 17 nt, Homo sapiens
uccccugacagggccag

SEQ ID NO: 1852535 - RNA, 19 nt, Homo sapiens
uuuaaacguuaaaagugua

SEQ ID NO: 1852536 - RNA, 22 nt, Homo sapiens
cuguauaauacuuuguauacaa

SEQ ID NO: 1852537 - RNA, 13 nt, Homo sapiens
cuuaaguuuuaga

SEQ ID NO: 1852538 - RNA, 17 nt, Homo sapiens
ccauuuuucaaagcaau

SEQ ID NO: 1852539 - RNA, 16 nt, Homo sapiens
aagagaagagggccca

SEQ ID NO: 1852540 - RNA, 19 nt, Homo sapiens
ugccuggaguccuugaccg

SEQ ID NO: 1852541 - RNA, 19 nt, Homo sapiens
cauaauauuggaagcagcc

SEQ ID NO: 1852542 - RNA, 14 nt, Homo sapiens
ccaagucauccucc

SEQ ID NO: 1852543 - RNA, 17 nt, Homo sapiens
cacccaugaaucaaaga

SEQ ID NO: 1852544 - RNA, 19 nt, Homo sapiens
cacacacagccugucccug

SEQ ID NO: 1852545 - RNA, 19 nt, Homo sapiens
gugaaggauaagagaaaca

SEQ ID NO: 1852546 - RNA, 15 nt, Homo sapiens
gaggacuaugccccu

SEQ ID NO: 1852547 - RNA, 14 nt, Homo sapiens
cugcugugaugacu

SEQ ID NO: 1852548 - RNA, 15 nt, Homo sapiens
agggacuaccaaugc

SEQ ID NO: 1852549 - RNA, 23 nt, Homo sapiens
uaaacaugaccacgaagaaugcu

SEQ ID NO: 1852550 - RNA, 19 nt, Homo sapiens
cuaugucgucguuuucacc

SEQ ID NO: 1852551 - RNA, 21 nt, Homo sapiens
cuacuccccagaccucaggga

SEQ ID NO: 1852552 - RNA, 18 nt, Homo sapiens
uucugaaguuuccuauga

SEQ ID NO: 1852553 - RNA, 15 nt, Homo sapiens
ugccucuguauuuaa

SEQ ID NO: 1852554 - RNA, 16 nt, Homo sapiens
cucaauauuaaagggu

SEQ ID NO: 1852555 - RNA, 20 nt, Homo sapiens
ucuaagaaauccagcuucau

SEQ ID NO: 1852556 - RNA, 20 nt, Homo sapiens
gggcuggaggcugagcugca

SEQ ID NO: 1852557 - RNA, 17 nt, Homo sapiens
cagccaucguccuggga

SEQ ID NO: 1852558 - RNA, 15 nt, Homo sapiens
aauguaugugcacau

SEQ ID NO: 1852559 - RNA, 19 nt, Homo sapiens
gaauagugggaucaaagcu

SEQ ID NO: 1852560 - RNA, 18 nt, Homo sapiens
uaggagcaugagugccgu

SEQ ID NO: 1852561 - RNA, 14 nt, Homo sapiens
ucaccauggccuua

SEQ ID NO: 1852562 - RNA, 15 nt, Homo sapiens
agucaugcacucagg

SEQ ID NO: 1852563 - RNA, 18 nt, Homo sapiens
gauuccggugccuccuga

SEQ ID NO: 1852564 - RNA, 20 nt, Homo sapiens
cuuuuuauuguuaguucuca

SEQ ID NO: 1852565 - RNA, 14 nt, Homo sapiens
cccucccuuucucc

SEQ ID NO: 1852566 - RNA, 21 nt, Homo sapiens
aggcuguucucgaacuccuga

SEQ ID NO: 1852567 - RNA, 12 nt, Homo sapiens
gaaagauguuug

SEQ ID NO: 1852568 - RNA, 14 nt, Homo sapiens
cacagcugugguga

SEQ ID NO: 1852569 - RNA, 16 nt, Homo sapiens
uugcaggagacauuuu

SEQ ID NO: 1852570 - RNA, 18 nt, Homo sapiens
cugagucaaugcgcaaaa

SEQ ID NO: 1852571 - RNA, 14 nt, Homo sapiens
ugaauccuacauac

SEQ ID NO: 1852572 - RNA, 13 nt, Homo sapiens
cuagucacaaaga

SEQ ID NO: 1852573 - RNA, 13 nt, Homo sapiens
auugucaccauga

SEQ ID NO: 1852574 - RNA, 13 nt, Homo sapiens
acauaacauucaa

SEQ ID NO: 1852575 - RNA, 13 nt, Homo sapiens
ucaauacaaucuu

SEQ ID NO: 1852576 - RNA, 17 nt, Homo sapiens
uaaaugggcagugccuc

SEQ ID NO: 1852577 - RNA, 18 nt, Homo sapiens
ccaggauaaggagacuga

SEQ ID NO: 1852578 - RNA, 23 nt, Homo sapiens
ccagagccaaccuggacuuccug

SEQ ID NO: 1852579 - RNA, 22 nt, Homo sapiens
gucccuguuuucccacgaggaa

SEQ ID NO: 1852580 - RNA, 17 nt, Homo sapiens
cagagacccagaucuca

SEQ ID NO: 1852581 - RNA, 19 nt, Homo sapiens
aagagcucuucaucugcua

SEQ ID NO: 1852582 - RNA, 20 nt, Homo sapiens
ccacaguaggcacucaauaa

SEQ ID NO: 1852583 - RNA, 17 nt, Homo sapiens
ccaacagcuacaacagc

SEQ ID NO: 1852584 - RNA, 21 nt, Homo sapiens
cuaaugccaguuccagcuuca

SEQ ID NO: 1852585 - RNA, 18 nt, Homo sapiens
uaagcuccaugugcauau

SEQ ID NO: 1852586 - RNA, 14 nt, Homo sapiens
caugcuacauguac

SEQ ID NO: 1852587 - RNA, 15 nt, Homo sapiens
guaacaguuauauca

SEQ ID NO: 1852588 - RNA, 22 nt, Homo sapiens
cucucaauuaaagucuauucaa

SEQ ID NO: 1852589 - RNA, 13 nt, Homo sapiens
ucuaggaaagugc

SEQ ID NO: 1852590 - RNA, 15 nt, Homo sapiens
gcuuagaauggggcu

SEQ ID NO: 1852591 - RNA, 14 nt, Homo sapiens
ucuguuugagauuu

SEQ ID NO: 1852592 - RNA, 16 nt, Homo sapiens
gccaggacacauuucc

SEQ ID NO: 1852593 - RNA, 18 nt, Homo sapiens
ucuaaaaugauacugugu

SEQ ID NO: 1852594 - RNA, 15 nt, Homo sapiens
ccgucagaucucugu

SEQ ID NO: 1852595 - RNA, 16 nt, Homo sapiens
ugauucuccucuccca

SEQ ID NO: 1852596 - RNA, 16 nt, Homo sapiens
ugauuuuccucucuca

SEQ ID NO: 1852597 - RNA, 14 nt, Homo sapiens
ugcagccaugacca

SEQ ID NO: 1852598 - RNA, 14 nt, Homo sapiens
ugcagacaugaccc

SEQ ID NO: 1852599 - RNA, 18 nt, Homo sapiens
aggccauuaggguugccu

SEQ ID NO: 1852600 - RNA, 20 nt, Homo sapiens
agauugcagaaauacaguau

SEQ ID NO: 1852601 - RNA, 22 nt, Homo sapiens
gcucuaucuuuuccuucaguga

SEQ ID NO: 1852602 - RNA, 18 nt, Homo sapiens
cacuguaccgacuuugau

SEQ ID NO: 1852603 - RNA, 12 nt, Homo sapiens
augacugcucag

SEQ ID NO: 1852604 - RNA, 15 nt, Homo sapiens
agcccauucauucca

SEQ ID NO: 1852605 - RNA, 22 nt, Homo sapiens
cugugcuucuauuucuuggaau

SEQ ID NO: 1852606 - RNA, 20 nt, Homo sapiens
caaaagcaguaaauuugcua

SEQ ID NO: 1852607 - RNA, 12 nt, Homo sapiens
uuuagacacugg

SEQ ID NO: 1852608 - RNA, 16 nt, Homo sapiens
agaauuuuaagccuuu

SEQ ID NO: 1852609 - RNA, 15 nt, Homo sapiens
aaugaacucuuucaa

SEQ ID NO: 1852610 - RNA, 16 nt, Homo sapiens
gcucagucuguucacu

SEQ ID NO: 1852611 - RNA, 19 nt, Homo sapiens
uucugaaaaagaacuguau

SEQ ID NO: 1852612 - RNA, 22 nt, Homo sapiens
agccauuugggagaagaucuca

SEQ ID NO: 1852613 - RNA, 13 nt, Homo sapiens
aacagacugaccu

SEQ ID NO: 1852614 - RNA, 16 nt, Homo sapiens
ucccuggggcacuccc

SEQ ID NO: 1852615 - RNA, 12 nt, Homo sapiens
uuguagccagaa

SEQ ID NO: 1852616 - RNA, 18 nt, Homo sapiens
uuacauuuuguauacccu

SEQ ID NO: 1852617 - RNA, 18 nt, Homo sapiens
cugccaaguccugccuuu

SEQ ID NO: 1852618 - RNA, 20 nt, Homo sapiens
agcaguucaugacccaggau

SEQ ID NO: 1852619 - RNA, 15 nt, Homo sapiens
cagugucuuccauaa

SEQ ID NO: 1852620 - RNA, 18 nt, Homo sapiens
cuucuaggguuauugcau

SEQ ID NO: 1852621 - RNA, 19 nt, Homo sapiens
uucccuuccaguuccggga

SEQ ID NO: 1852622 - RNA, 13 nt, Homo sapiens
auagcauacugug

SEQ ID NO: 1852623 - RNA, 13 nt, Homo sapiens
gaagggacuggga

SEQ ID NO: 1852624 - RNA, 22 nt, Homo sapiens
ugcuuugccucgaaagugucau

SEQ ID NO: 1852625 - RNA, 14 nt, Homo sapiens
caaggaaauaugag

SEQ ID NO: 1852626 - RNA, 17 nt, Homo sapiens
augaacuguuucaguag

SEQ ID NO: 1852627 - RNA, 21 nt, Homo sapiens
ugaccuggauacgcuuugguu

SEQ ID NO: 1852628 - RNA, 16 nt, Homo sapiens
caugugaaaucauuca

SEQ ID NO: 1852629 - RNA, 21 nt, Homo sapiens
aagaggaaggccucuguggca

SEQ ID NO: 1852630 - RNA, 18 nt, Homo sapiens
aagccaggguuccagaca

SEQ ID NO: 1852631 - RNA, 18 nt, Homo sapiens
cuuuguaagaguguagaa

SEQ ID NO: 1852632 - RNA, 23 nt, Homo sapiens
cuguugcuugucuugauuaacuu

SEQ ID NO: 1852633 - RNA, 19 nt, Homo sapiens
cccuucccuacuuccccaa

SEQ ID NO: 1852634 - RNA, 19 nt, Homo sapiens
agcaucugaccaucuguga

SEQ ID NO: 1852635 - RNA, 16 nt, Homo sapiens
gcacaaacaagcacau

SEQ ID NO: 1852636 - RNA, 15 nt, Homo sapiens
acucuuaacacuaag

SEQ ID NO: 1852637 - RNA, 20 nt, Homo sapiens
ugggccuccugacagcaaua

SEQ ID NO: 1852638 - RNA, 18 nt, Homo sapiens
guuuggggagacagguga

SEQ ID NO: 1852639 - RNA, 15 nt, Homo sapiens
ucugagugaauguua

SEQ ID NO: 1852640 - RNA, 17 nt, Homo sapiens
agaaaagucaggugcag

SEQ ID NO: 1852641 - RNA, 14 nt, Homo sapiens
aacaugaguuauuc

SEQ ID NO: 1852642 - RNA, 18 nt, Homo sapiens
ucaaagagcaaccaguau

SEQ ID NO: 1852643 - RNA, 18 nt, Homo sapiens
ccggaucauucacuguga

SEQ ID NO: 1852644 - RNA, 18 nt, Homo sapiens
aggggcaaccaacugccc

SEQ ID NO: 1852645 - RNA, 15 nt, Homo sapiens
ggcugacucagugca

SEQ ID NO: 1852646 - RNA, 21 nt, Homo sapiens
uuccuuuucacugcuguuaua

SEQ ID NO: 1852647 - RNA, 13 nt, Homo sapiens
uguagcuucugaa

SEQ ID NO: 1852648 - RNA, 16 nt, Homo sapiens
uggagacgaugcuuua

SEQ ID NO: 1852649 - RNA, 21 nt, Homo sapiens
ccuguccccuacccccaguaa

SEQ ID NO: 1852650 - RNA, 23 nt, Homo sapiens
aaguuagucaauccugucauaua

SEQ ID NO: 1852651 - RNA, 18 nt, Homo sapiens
caguggauggauucauca

SEQ ID NO: 1852652 - RNA, 22 nt, Homo sapiens
uacauagauggaccaguagaca

SEQ ID NO: 1852653 - RNA, 23 nt, Homo sapiens
acccuguugcuuuucacaaauca

SEQ ID NO: 1852654 - RNA, 16 nt, Homo sapiens
cucaucuggacuaugg

SEQ ID NO: 1852655 - RNA, 19 nt, Homo sapiens
auuagagaaugauuucaaa

SEQ ID NO: 1852656 - RNA, 18 nt, Homo sapiens
cagaagccccaacuguga

SEQ ID NO: 1852657 - RNA, 17 nt, Homo sapiens
ucccacacuugugccag

SEQ ID NO: 1852658 - RNA, 14 nt, Homo sapiens
ugcaccguccucag

SEQ ID NO: 1852659 - RNA, 14 nt, Homo sapiens
agugaacauucuga

SEQ ID NO: 1852660 - RNA, 15 nt, Homo sapiens
ccuaggcugcuuccg

SEQ ID NO: 1852661 - RNA, 15 nt, Homo sapiens
ccugccuagcacuca

SEQ ID NO: 1852662 - RNA, 15 nt, Homo sapiens
uggcauuagcacuac

SEQ ID NO: 1852663 - RNA, 14 nt, Homo sapiens
ucuccauacuuugg

SEQ ID NO: 1852664 - RNA, 17 nt, Homo sapiens
ugagaccgagucuugcu

SEQ ID NO: 1852665 - RNA, 18 nt, Homo sapiens
guaugucagcuacaugaa

SEQ ID NO: 1852666 - RNA, 22 nt, Homo sapiens
caucagacugaacuuacacugu

SEQ ID NO: 1852667 - RNA, 22 nt, Homo sapiens
accacuguccuggcugcucuca

SEQ ID NO: 1852668 - RNA, 18 nt, Homo sapiens
guucugggagcucaaggc

SEQ ID NO: 1852669 - RNA, 22 nt, Homo sapiens
gaaacccaaguuaugcaucccc

SEQ ID NO: 1852670 - RNA, 13 nt, Homo sapiens
cuaauuugugaaa

SEQ ID NO: 1852671 - RNA, 16 nt, Homo sapiens
uccuaaggacacacua

SEQ ID NO: 1852672 - RNA, 14 nt, Homo sapiens
aauuaaauacauaa

SEQ ID NO: 1852673 - RNA, 15 nt, Homo sapiens
acgcucaagaauccu

SEQ ID NO: 1852674 - RNA, 14 nt, Homo sapiens
uauugauaugugaa

SEQ ID NO: 1852675 - RNA, 16 nt, Homo sapiens
aggaaacugcacuguu

SEQ ID NO: 1852676 - RNA, 23 nt, Homo sapiens
gaccuuguuguuguuaaauauca

SEQ ID NO: 1852677 - RNA, 18 nt, Homo sapiens
gugguauauuuguguaug

SEQ ID NO: 1852678 - RNA, 21 nt, Homo sapiens
agaucaacuggaauggauggu

SEQ ID NO: 1852679 - RNA, 17 nt, Homo sapiens
aauacaauuaaagcaaa

SEQ ID NO: 1852680 - RNA, 19 nt, Homo sapiens
gcauuuuuacagcacacac

SEQ ID NO: 1852681 - RNA, 13 nt, Homo sapiens
acuggacucagga

SEQ ID NO: 1852682 - RNA, 19 nt, Homo sapiens
agaaucccucuacauggac

SEQ ID NO: 1852683 - RNA, 13 nt, Homo sapiens
uagauuuuguaau

SEQ ID NO: 1852684 - RNA, 17 nt, Homo sapiens
guauuccaccacaggaa

SEQ ID NO: 1852685 - RNA, 16 nt, Homo sapiens
gcagcgguaccccagg

SEQ ID NO: 1852686 - RNA, 23 nt, Homo sapiens
cggaagagagggcugagccaugg

SEQ ID NO: 1852687 - RNA, 16 nt, Homo sapiens
uacaaagauaugcuaa

SEQ ID NO: 1852688 - RNA, 23 nt, Homo sapiens
gaucuacuuuuugaacuuuucau

SEQ ID NO: 1852689 - RNA, 12 nt, Homo sapiens
ucuaaccauuca

SEQ ID NO: 1852690 - RNA, 17 nt, Homo sapiens
caguuugaagucaaaug

SEQ ID NO: 1852691 - RNA, 14 nt, Homo sapiens
gaugugucaucuaa

SEQ ID NO: 1852692 - RNA, 20 nt, Homo sapiens
ucuguaaggacgccuugaug

SEQ ID NO: 1852693 - RNA, 14 nt, Homo sapiens
ugacaacaguuuua

SEQ ID NO: 1852694 - RNA, 21 nt, Homo sapiens
agugcuccaguauauaaccuc

SEQ ID NO: 1852695 - RNA, 20 nt, Homo sapiens
gggagacacuggccccucaa

SEQ ID NO: 1852696 - RNA, 13 nt, Homo sapiens
agacaaacaugca

SEQ ID NO: 1852697 - RNA, 13 nt, Homo sapiens
augucaacagauc

SEQ ID NO: 1852698 - RNA, 15 nt, Homo sapiens
ugcuuugcaaagacc

SEQ ID NO: 1852699 - RNA, 15 nt, Homo sapiens
aggaaguggcucaga

SEQ ID NO: 1852700 - RNA, 16 nt, Homo sapiens
aacuugccugccuuuc

SEQ ID NO: 1852701 - RNA, 13 nt, Homo sapiens
acuccucugacug

SEQ ID NO: 1852702 - RNA, 14 nt, Homo sapiens
aguuguuugcuuau

SEQ ID NO: 1852703 - RNA, 14 nt, Homo sapiens
uagugucaguacua

SEQ ID NO: 1852704 - RNA, 17 nt, Homo sapiens
cugcccagacaagauuu

SEQ ID NO: 1852705 - RNA, 15 nt, Homo sapiens
cuaacuuaagacaga

SEQ ID NO: 1852706 - RNA, 18 nt, Homo sapiens
ucagaaauauaugcagcu

SEQ ID NO: 1852707 - RNA, 12 nt, Homo sapiens
uagcaagguguu

SEQ ID NO: 1852708 - RNA, 22 nt, Homo sapiens
cuuaaaguuuaaaguugcacau

SEQ ID NO: 1852709 - RNA, 16 nt, Homo sapiens
uaauuguccaugagga

SEQ ID NO: 1852710 - RNA, 12 nt, Homo sapiens
cugcguuuucau

SEQ ID NO: 1852711 - RNA, 23 nt, Homo sapiens
uuccacuuagaaauugcauuucc

SEQ ID NO: 1852712 - RNA, 15 nt, Homo sapiens
ucaaguugcuucuca

SEQ ID NO: 1852713 - RNA, 15 nt, Homo sapiens
cuuuuuccaucauuu

SEQ ID NO: 1852714 - RNA, 12 nt, Homo sapiens
aggcaucuuccc

SEQ ID NO: 1852715 - RNA, 14 nt, Homo sapiens
cauaacucugauua

SEQ ID NO: 1852716 - RNA, 23 nt, Homo sapiens
uuuauguaaaaccaacaaaaaga

SEQ ID NO: 1852717 - RNA, 15 nt, Homo sapiens
aggcugucuaccuga

SEQ ID NO: 1852718 - RNA, 22 nt, Homo sapiens
cuaggcaccucagaccaaucau

SEQ ID NO: 1852719 - RNA, 20 nt, Homo sapiens
uuuuagucuaauugaauccc

SEQ ID NO: 1852720 - RNA, 16 nt, Homo sapiens
cugggccaagucaaag

SEQ ID NO: 1852721 - RNA, 14 nt, Homo sapiens
aggcugagccagga

SEQ ID NO: 1852722 - RNA, 21 nt, Homo sapiens
uguccagauuauuggcugcuu

SEQ ID NO: 1852723 - RNA, 21 nt, Homo sapiens
ugggccccagccguggcguga

SEQ ID NO: 1852724 - RNA, 12 nt, Homo sapiens
caccauugcacu

SEQ ID NO: 1852725 - RNA, 22 nt, Homo sapiens
uucaauuugauucuaugacuga

SEQ ID NO: 1852726 - RNA, 13 nt, Homo sapiens
uggugccuggaaa

SEQ ID NO: 1852727 - RNA, 15 nt, Homo sapiens
aucuguucaauguuu

SEQ ID NO: 1852728 - RNA, 15 nt, Homo sapiens
cuguuuuuuccugag

SEQ ID NO: 1852729 - RNA, 22 nt, Homo sapiens
cauuuuuuucacuggaguuaca

SEQ ID NO: 1852730 - RNA, 20 nt, Homo sapiens
agccacugcagcacaggagg

SEQ ID NO: 1852731 - RNA, 22 nt, Homo sapiens
agccucagcggacaagcagcug

SEQ ID NO: 1852732 - RNA, 13 nt, Homo sapiens
aaguuucugugac

SEQ ID NO: 1852733 - RNA, 13 nt, Homo sapiens
cugcaaaugugca

SEQ ID NO: 1852734 - RNA, 13 nt, Homo sapiens
gugaaaaucugaa

SEQ ID NO: 1852735 - RNA, 17 nt, Homo sapiens
cacccucuguccccacg

SEQ ID NO: 1852736 - RNA, 15 nt, Homo sapiens
agcuuaauagcugua

SEQ ID NO: 1852737 - RNA, 21 nt, Homo sapiens
aggacucucuuucuuccacua

SEQ ID NO: 1852738 - RNA, 21 nt, Homo sapiens
aagcuucuugucauucuucau

SEQ ID NO: 1852739 - RNA, 17 nt, Homo sapiens
uaaaaacacuacaggug

SEQ ID NO: 1852740 - RNA, 14 nt, Homo sapiens
cuggcccugaggug

SEQ ID NO: 1852741 - RNA, 16 nt, Homo sapiens
aggacccuuucuccac

SEQ ID NO: 1852742 - RNA, 13 nt, Homo sapiens
caguccucaggca

SEQ ID NO: 1852743 - RNA, 16 nt, Homo sapiens
cuaauguuauuuuccu

SEQ ID NO: 1852744 - RNA, 15 nt, Homo sapiens
aagcugauuaccuga

SEQ ID NO: 1852745 - RNA, 18 nt, Homo sapiens
acucugaagaauccugua

SEQ ID NO: 1852746 - RNA, 12 nt, Homo sapiens
ggacuccaagcc

SEQ ID NO: 1852747 - RNA, 12 nt, Homo sapiens
ccucacagccag

SEQ ID NO: 1852748 - RNA, 22 nt, Homo sapiens
cuugugucugcggggaucagag

SEQ ID NO: 1852749 - RNA, 19 nt, Homo sapiens
aagcuaauaaaauucgcuu

SEQ ID NO: 1852750 - RNA, 14 nt, Homo sapiens
auccccaccacuga

SEQ ID NO: 1852751 - RNA, 21 nt, Homo sapiens
acacaacuaggaaguggcuga

SEQ ID NO: 1852752 - RNA, 16 nt, Homo sapiens
uauauaauaacuuuau

SEQ ID NO: 1852753 - RNA, 21 nt, Homo sapiens
gaaacaccaagugaggccaua

SEQ ID NO: 1852754 - RNA, 17 nt, Homo sapiens
cuauaagcccacuguua

SEQ ID NO: 1852755 - RNA, 13 nt, Homo sapiens
uuuuaucuuaucu

SEQ ID NO: 1852756 - RNA, 20 nt, Homo sapiens
aaccaagguuuugaaauccc

SEQ ID NO: 1852757 - RNA, 16 nt, Homo sapiens
cggccacucuaccuga

SEQ ID NO: 1852758 - RNA, 20 nt, Homo sapiens
aauuaaaauuacacacuugc

SEQ ID NO: 1852759 - RNA, 15 nt, Homo sapiens
uggaaacaccacugc

SEQ ID NO: 1852760 - RNA, 20 nt, Homo sapiens
augaaauucuugaaguucau

SEQ ID NO: 1852761 - RNA, 15 nt, Homo sapiens
cuucugacuacuggg

SEQ ID NO: 1852762 - RNA, 13 nt, Homo sapiens
gcugacauggcuu

SEQ ID NO: 1852763 - RNA, 22 nt, Homo sapiens
aauuauuuuuggggaucauagc

SEQ ID NO: 1852764 - RNA, 20 nt, Homo sapiens
caucccaugagcaguccaga

SEQ ID NO: 1852765 - RNA, 17 nt, Homo sapiens
cagccucuugacucuga

SEQ ID NO: 1852766 - RNA, 22 nt, Homo sapiens
agaguauuaaugaaaagcacaa

SEQ ID NO: 1852767 - RNA, 14 nt, Homo sapiens
ccagucuaguuccu

SEQ ID NO: 1852768 - RNA, 18 nt, Homo sapiens
uucaggaaugggccaagc

SEQ ID NO: 1852769 - RNA, 20 nt, Homo sapiens
aggccaggcacuguggcuca

SEQ ID NO: 1852770 - RNA, 15 nt, Homo sapiens
auauaaggcauucca

SEQ ID NO: 1852771 - RNA, 14 nt, Homo sapiens
cacaaaucugccaa

SEQ ID NO: 1852772 - RNA, 24 nt, Homo sapiens
caaguaaucuguugacagugccaa

SEQ ID NO: 1852773 - RNA, 20 nt, Homo sapiens
uaaauaauggugcauuuauu

SEQ ID NO: 1852774 - RNA, 12 nt, Homo sapiens
cuuuaccucagg

SEQ ID NO: 1852775 - RNA, 22 nt, Homo sapiens
aaacaccgagugaggccauagc

SEQ ID NO: 1852776 - RNA, 19 nt, Homo sapiens
uaugccuccauuucagaga

SEQ ID NO: 1852777 - RNA, 23 nt, Homo sapiens
accuggcacagaaagggcagcuu

SEQ ID NO: 1852778 - RNA, 14 nt, Homo sapiens
cauguuaguuaccu

SEQ ID NO: 1852779 - RNA, 14 nt, Homo sapiens
ccaugugcuaagaa

SEQ ID NO: 1852780 - RNA, 16 nt, Homo sapiens
aaggcaggacagagaa

SEQ ID NO: 1852781 - RNA, 17 nt, Homo sapiens
cagauggucacacagag

SEQ ID NO: 1852782 - RNA, 17 nt, Homo sapiens
acucugcuagacuccuc

SEQ ID NO: 1852783 - RNA, 21 nt, Homo sapiens
auaaucacagauuagcuguaa

SEQ ID NO: 1852784 - RNA, 16 nt, Homo sapiens
caagaucuuucaggaa

SEQ ID NO: 1852785 - RNA, 14 nt, Homo sapiens
gugagaugagggau

SEQ ID NO: 1852786 - RNA, 22 nt, Homo sapiens
caagugagcaaaccugccccau

SEQ ID NO: 1852787 - RNA, 19 nt, Homo sapiens
aaccagcaucccuugacca

SEQ ID NO: 1852788 - RNA, 19 nt, Homo sapiens
auaaaucuaacaguuacuc

SEQ ID NO: 1852789 - RNA, 19 nt, Homo sapiens
gggagaguaaaccuugaag

SEQ ID NO: 1852790 - RNA, 17 nt, Homo sapiens
uaaaacauaagccacag

SEQ ID NO: 1852791 - RNA, 21 nt, Homo sapiens
auguaucuuggugcugcugaa

SEQ ID NO: 1852792 - RNA, 17 nt, Homo sapiens
agugauggguuagugga

SEQ ID NO: 1852793 - RNA, 23 nt, Homo sapiens
agcucacuaggccgauccugcug

SEQ ID NO: 1852794 - RNA, 15 nt, Homo sapiens
auaguggcaagauca

SEQ ID NO: 1852795 - RNA, 15 nt, Homo sapiens
ugauauuuuccaaau

SEQ ID NO: 1852796 - RNA, 16 nt, Homo sapiens
cacaaggaaaaggagg

SEQ ID NO: 1852797 - RNA, 23 nt, Homo sapiens
caccaagcaggcaaauagcuuua

SEQ ID NO: 1852798 - RNA, 18 nt, Homo sapiens
uaaaauuaacaugugcca

SEQ ID NO: 1852799 - RNA, 23 nt, Homo sapiens
ccaaagauguuugaaaaugcucu

SEQ ID NO: 1852800 - RNA, 17 nt, Homo sapiens
aagaacauaaguuauca

SEQ ID NO: 1852801 - RNA, 13 nt, Homo sapiens
uuguuuugugcca

SEQ ID NO: 1852802 - RNA, 14 nt, Homo sapiens
uaguaaacuuugua

SEQ ID NO: 1852803 - RNA, 16 nt, Homo sapiens
cucuuucuucuuugaa

SEQ ID NO: 1852804 - RNA, 21 nt, Homo sapiens
acaggccccccagccaagaaa

SEQ ID NO: 1852805 - RNA, 18 nt, Homo sapiens
aaucaaggugacuaagaa

SEQ ID NO: 1852806 - RNA, 22 nt, Homo sapiens
uucugaaauaaacuucacugaa

SEQ ID NO: 1852807 - RNA, 20 nt, Homo sapiens
aaguauucugccuuugcaga

SEQ ID NO: 1852808 - RNA, 14 nt, Homo sapiens
guccaaucggagac

SEQ ID NO: 1852809 - RNA, 21 nt, Homo sapiens
uaaugaggugguacuaugauu

SEQ ID NO: 1852810 - RNA, 13 nt, Homo sapiens
aauucccaauccc

SEQ ID NO: 1852811 - RNA, 14 nt, Homo sapiens
cuuugcauagcuuu

SEQ ID NO: 1852812 - RNA, 11 nt, Homo sapiens
gggcucaggaa

SEQ ID NO: 1852813 - RNA, 11 nt, Homo sapiens
uaacucagugg

SEQ ID NO: 1852814 - RNA, 18 nt, Homo sapiens
uugagagauaaaaagcua

SEQ ID NO: 1852815 - RNA, 13 nt, Homo sapiens
aucuauacauacc

SEQ ID NO: 1852816 - RNA, 15 nt, Homo sapiens
cuccuucaauuccau

SEQ ID NO: 1852817 - RNA, 14 nt, Homo sapiens
ugacaacaaaaggg

SEQ ID NO: 1852818 - RNA, 22 nt, Homo sapiens
cagguaggccaagguguccuac

SEQ ID NO: 1852819 - RNA, 14 nt, Homo sapiens
guccugugauguca

SEQ ID NO: 1852820 - RNA, 15 nt, Homo sapiens
acaugggauugcuaa

SEQ ID NO: 1852821 - RNA, 21 nt, Homo sapiens
cuaucauuuauuuacaucuau

SEQ ID NO: 1852822 - RNA, 23 nt, Homo sapiens
guagcacuuaacagauugccaug

SEQ ID NO: 1852823 - RNA, 16 nt, Homo sapiens
ucagcucacuguucua

SEQ ID NO: 1852824 - RNA, 21 nt, Homo sapiens
ggucccuucccccugcuccau

SEQ ID NO: 1852825 - RNA, 13 nt, Homo sapiens
gggccugggacac

SEQ ID NO: 1852826 - RNA, 23 nt, Homo sapiens
caauuuuaauugauuauucugau

SEQ ID NO: 1852827 - RNA, 15 nt, Homo sapiens
cggaucauucacugu

SEQ ID NO: 1852828 - RNA, 18 nt, Homo sapiens
cuaagcaaaaagaacaaa

SEQ ID NO: 1852829 - RNA, 13 nt, Homo sapiens
cuugcacagccaa

SEQ ID NO: 1852830 - RNA, 22 nt, Homo sapiens
ugcuugcuaccaaucugugaga

SEQ ID NO: 1852831 - RNA, 21 nt, Homo sapiens
uaaggcuuguuccaaugccac

SEQ ID NO: 1852832 - RNA, 21 nt, Homo sapiens
cauccuugaccucauuuacaa

SEQ ID NO: 1852833 - RNA, 17 nt, Homo sapiens
ucaagugaaaccagcuu

SEQ ID NO: 1852834 - RNA, 23 nt, Homo sapiens
uguaaauauuuauuuauguguuc

SEQ ID NO: 1852835 - RNA, 14 nt, Homo sapiens
uccuccgucuuccu

SEQ ID NO: 1852836 - RNA, 21 nt, Homo sapiens
cccccacugcuaaggcugcug

SEQ ID NO: 1852837 - RNA, 12 nt, Homo sapiens
uucugaaagugu

SEQ ID NO: 1852838 - RNA, 17 nt, Homo sapiens
agcaguuugcacuuaaa

SEQ ID NO: 1852839 - RNA, 18 nt, Homo sapiens
uugcaccuccauggaaac

SEQ ID NO: 1852840 - RNA, 16 nt, Homo sapiens
cucacguccaucacug

SEQ ID NO: 1852841 - RNA, 15 nt, Homo sapiens
ugucugucaccagcu

SEQ ID NO: 1852842 - RNA, 19 nt, Homo sapiens
ggaagcuucuugcugccag

SEQ ID NO: 1852843 - RNA, 19 nt, Homo sapiens
ccuuucaauaggaaaaacu

SEQ ID NO: 1852844 - RNA, 20 nt, Homo sapiens
aagccagaaacguaacugug

SEQ ID NO: 1852845 - RNA, 16 nt, Homo sapiens
cagcuccagugccagc

SEQ ID NO: 1852846 - RNA, 13 nt, Homo sapiens
augacaaagcaga

SEQ ID NO: 1852847 - RNA, 17 nt, Homo sapiens
ccucugcacgugcacac

SEQ ID NO: 1852848 - RNA, 15 nt, Homo sapiens
uugcucugagugcua

SEQ ID NO: 1852849 - RNA, 16 nt, Homo sapiens
cuagcugucucaggag

SEQ ID NO: 1852850 - RNA, 17 nt, Homo sapiens
aggccucgccccaacac

SEQ ID NO: 1852851 - RNA, 20 nt, Homo sapiens
cacagaaauauauauacaua

SEQ ID NO: 1852852 - RNA, 22 nt, Homo sapiens
cagaauaaaagaugauuucuca

SEQ ID NO: 1852853 - RNA, 16 nt, Homo sapiens
caagcagcuggugcuc

SEQ ID NO: 1852854 - RNA, 20 nt, Homo sapiens
cucggacagcccaucugccu

SEQ ID NO: 1852855 - RNA, 15 nt, Homo sapiens
acuaauuugugguaa

SEQ ID NO: 1852856 - RNA, 16 nt, Homo sapiens
ucuaaauagcacuuuu

SEQ ID NO: 1852857 - RNA, 16 nt, Homo sapiens
gauauaauuaacauaa

SEQ ID NO: 1852858 - RNA, 13 nt, Homo sapiens
aauuaagugcaau

SEQ ID NO: 1852859 - RNA, 13 nt, Homo sapiens
gaaauaguacuua

SEQ ID NO: 1852860 - RNA, 23 nt, Homo sapiens
cuggaaggagugagaggggacaa

SEQ ID NO: 1852861 - RNA, 15 nt, Homo sapiens
cauacccucuaccug

SEQ ID NO: 1852862 - RNA, 21 nt, Homo sapiens
uguucuuuuuucuuaccaccu

SEQ ID NO: 1852863 - RNA, 16 nt, Homo sapiens
gauaaaugcaauauuc

SEQ ID NO: 1852864 - RNA, 22 nt, Homo sapiens
auuucucuacuugucauaucac

SEQ ID NO: 1852865 - RNA, 12 nt, Homo sapiens
cacugugcagcc

SEQ ID NO: 1852866 - RNA, 22 nt, Homo sapiens
uagcaugauuuuucaaggauug

SEQ ID NO: 1852867 - RNA, 12 nt, Homo sapiens
caauaauaucaa

SEQ ID NO: 1852868 - RNA, 12 nt, Homo sapiens
uaagaagacugc

SEQ ID NO: 1852869 - RNA, 12 nt, Homo sapiens
aagaauuccaaa

SEQ ID NO: 1852870 - RNA, 19 nt, Homo sapiens
ucuacagagcuucccugac

SEQ ID NO: 1852871 - RNA, 15 nt, Homo sapiens
aauaauaagugaugu

SEQ ID NO: 1852872 - RNA, 21 nt, Homo sapiens
gagcaaggaaacguaauuugg

SEQ ID NO: 1852873 - RNA, 13 nt, Homo sapiens
cuugcugccugaa

SEQ ID NO: 1852874 - RNA, 14 nt, Homo sapiens
ccucccuggcugca

SEQ ID NO: 1852875 - RNA, 15 nt, Homo sapiens
accaagucuacuuca

SEQ ID NO: 1852876 - RNA, 9 nt, Homo sapiens
ucuccucac

SEQ ID NO: 1852877 - RNA, 14 nt, Homo sapiens
caggcacuccugga

SEQ ID NO: 1852878 - RNA, 19 nt, Homo sapiens
gcagugaugcaaucuuggc

SEQ ID NO: 1852879 - RNA, 18 nt, Homo sapiens
gaacagauggcugugaaa

SEQ ID NO: 1852880 - RNA, 14 nt, Homo sapiens
ccuuuuacauauuu

SEQ ID NO: 1852881 - RNA, 14 nt, Homo sapiens
acacauaccuucau

SEQ ID NO: 1852882 - RNA, 21 nt, Homo sapiens
cucugagguuuccgaaaucag

SEQ ID NO: 1852883 - RNA, 21 nt, Homo sapiens
ccucucagaugggcagcagcu

SEQ ID NO: 1852884 - RNA, 21 nt, Homo sapiens
ucuuuauaaugggauauaguu

SEQ ID NO: 1852885 - RNA, 22 nt, Homo sapiens
ugcagagggugggguacuggag

SEQ ID NO: 1852886 - RNA, 22 nt, Homo sapiens
uggggacacagcaucagcucaa

SEQ ID NO: 1852887 - RNA, 18 nt, Homo sapiens
cuguuucgguugacccag

SEQ ID NO: 1852888 - RNA, 13 nt, Homo sapiens
cccagaucaugcc

SEQ ID NO: 1852889 - RNA, 16 nt, Homo sapiens
uggaaagaaagaccau

SEQ ID NO: 1852890 - RNA, 22 nt, Homo sapiens
uuacaccaguuugacugugcua

SEQ ID NO: 1852891 - RNA, 14 nt, Homo sapiens
uuaauacaugcaac

SEQ ID NO: 1852892 - RNA, 13 nt, Homo sapiens
auaagauuccaaa

SEQ ID NO: 1852893 - RNA, 14 nt, Homo sapiens
caccucugcaccuu

SEQ ID NO: 1852894 - RNA, 23 nt, Homo sapiens
cugugccuucagcuguugcagau

SEQ ID NO: 1852895 - RNA, 17 nt, Homo sapiens
uccaacccgaggcaaua

SEQ ID NO: 1852896 - RNA, 18 nt, Homo sapiens
auugaucacuuuguuaaa

SEQ ID NO: 1852897 - RNA, 12 nt, Homo sapiens
guaaaacuguau

SEQ ID NO: 1852898 - RNA, 17 nt, Homo sapiens
uggccugacucccaugc

SEQ ID NO: 1852899 - RNA, 17 nt, Homo sapiens
ucugaagucacugcaca

SEQ ID NO: 1852900 - RNA, 17 nt, Homo sapiens
ggccugaggugugaaag

SEQ ID NO: 1852901 - RNA, 16 nt, Homo sapiens
augcuuccuauacagu

SEQ ID NO: 1852902 - RNA, 16 nt, Homo sapiens
gagugauugguugcau

SEQ ID NO: 1852903 - RNA, 19 nt, Homo sapiens
cagagauaauucuagcuuu

SEQ ID NO: 1852904 - RNA, 23 nt, Homo sapiens
caucauuuaacugaacugugaac

SEQ ID NO: 1852905 - RNA, 14 nt, Homo sapiens
uaaaaauacacaaa

SEQ ID NO: 1852906 - RNA, 13 nt, Homo sapiens
uauucucauggcu

SEQ ID NO: 1852907 - RNA, 13 nt, Homo sapiens
uucugagcuguau

SEQ ID NO: 1852908 - RNA, 22 nt, Homo sapiens
uucaagugauucuccugccuca

SEQ ID NO: 1852909 - RNA, 21 nt, Homo sapiens
ccuuccaaauaauaaagucua

SEQ ID NO: 1852910 - RNA, 22 nt, Homo sapiens
aaaugauuccuggacaucacca

SEQ ID NO: 1852911 - RNA, 20 nt, Homo sapiens
cucugcccaaacauaaagag

SEQ ID NO: 1852912 - RNA, 17 nt, Homo sapiens
ccuucagugaacuaagu

SEQ ID NO: 1852913 - RNA, 20 nt, Homo sapiens
aauaaaaagucacaaugagu

SEQ ID NO: 1852914 - RNA, 13 nt, Homo sapiens
uuaguuugcuaag

SEQ ID NO: 1852915 - RNA, 18 nt, Homo sapiens
ccugcacgaaguggcuga

SEQ ID NO: 1852916 - RNA, 17 nt, Homo sapiens
aagguuuugaaauccca

SEQ ID NO: 1852917 - RNA, 17 nt, Homo sapiens
cccagaaagggacaggg

SEQ ID NO: 1852918 - RNA, 16 nt, Homo sapiens
augggagaguccaggc

SEQ ID NO: 1852919 - RNA, 17 nt, Homo sapiens
aaauaagcauguuuuca

SEQ ID NO: 1852920 - RNA, 18 nt, Homo sapiens
cucccugaagaccaaaau

SEQ ID NO: 1852921 - RNA, 21 nt, Homo sapiens
aaucacugaaccucucaggau

SEQ ID NO: 1852922 - RNA, 14 nt, Homo sapiens
gaaauacauaugca

SEQ ID NO: 1852923 - RNA, 15 nt, Homo sapiens
aucugugaccuguca

SEQ ID NO: 1852924 - RNA, 10 nt, Homo sapiens
agauguagag

SEQ ID NO: 1852925 - RNA, 23 nt, Homo sapiens
cccauugguguugucauuguaaa

SEQ ID NO: 1852926 - RNA, 15 nt, Homo sapiens
uacagccaaauugca

SEQ ID NO: 1852927 - RNA, 22 nt, Homo sapiens
ucgggaaccucacucuugccaa

SEQ ID NO: 1852928 - RNA, 16 nt, Homo sapiens
cagaguggacuguucc

SEQ ID NO: 1852929 - RNA, 14 nt, Homo sapiens
ugucuaucauauga

SEQ ID NO: 1852930 - RNA, 21 nt, Homo sapiens
gcacaagcugcggaagcugaa

SEQ ID NO: 1852931 - RNA, 20 nt, Homo sapiens
gaggauguguccaguuugug

SEQ ID NO: 1852932 - RNA, 15 nt, Homo sapiens
agaacugugugucuc

SEQ ID NO: 1852933 - RNA, 22 nt, Homo sapiens
cugucacaaccaagaauguuau

SEQ ID NO: 1852934 - RNA, 22 nt, Homo sapiens
ggaagccucccacgacugcccg

SEQ ID NO: 1852935 - RNA, 22 nt, Homo sapiens
uagccaaaccucaccaacuccu

SEQ ID NO: 1852936 - RNA, 18 nt, Homo sapiens
aggcugaggcagaacugc

SEQ ID NO: 1852937 - RNA, 21 nt, Homo sapiens
ugaccagugucuacauugcca

SEQ ID NO: 1852938 - RNA, 21 nt, Homo sapiens
cuuccuugcaggagugacuca

SEQ ID NO: 1852939 - RNA, 20 nt, Homo sapiens
agguucuaaaguucuaagau

SEQ ID NO: 1852940 - RNA, 20 nt, Homo sapiens
aaauaaucacaaaaucacaa

SEQ ID NO: 1852941 - RNA, 18 nt, Homo sapiens
ucagaaggguuaacucaa

SEQ ID NO: 1852942 - RNA, 17 nt, Homo sapiens
cuagaaaguaauacaau

SEQ ID NO: 1852943 - RNA, 21 nt, Homo sapiens
aaucauguuuuuucugcaaug

SEQ ID NO: 1852944 - RNA, 20 nt, Homo sapiens
ccuggugcacgcaggcacag

SEQ ID NO: 1852945 - RNA, 22 nt, Homo sapiens
cacccuccuuucaccacaugug

SEQ ID NO: 1852946 - RNA, 23 nt, Homo sapiens
uuuugcaaauaaaauacuaaaca

SEQ ID NO: 1852947 - RNA, 14 nt, Homo sapiens
cagcuuugcaguga

SEQ ID NO: 1852948 - RNA, 13 nt, Homo sapiens
cacacuuugcacu

SEQ ID NO: 1852949 - RNA, 20 nt, Homo sapiens
ccagccagggcucaaucucu

SEQ ID NO: 1852950 - RNA, 14 nt, Homo sapiens
cacacccacuccac

SEQ ID NO: 1852951 - RNA, 19 nt, Homo sapiens
gauguuauuagauguuaca

SEQ ID NO: 1852952 - RNA, 12 nt, Homo sapiens
cuccaaggcagu

SEQ ID NO: 1852953 - RNA, 19 nt, Homo sapiens
cucugccccaucauugcac

SEQ ID NO: 1852954 - RNA, 14 nt, Homo sapiens
uaauguauucccua

SEQ ID NO: 1852955 - RNA, 13 nt, Homo sapiens
uucaagcauuuag

SEQ ID NO: 1852956 - RNA, 17 nt, Homo sapiens
gauuguaguuauacuuu

SEQ ID NO: 1852957 - RNA, 16 nt, Homo sapiens
gugugugugcaauguu

SEQ ID NO: 1852958 - RNA, 18 nt, Homo sapiens
uccguccggaaaugaagg

SEQ ID NO: 1852959 - RNA, 18 nt, Homo sapiens
cuugcacacccacugccc

SEQ ID NO: 1852960 - RNA, 18 nt, Homo sapiens
ccaacugaucuguuauag

SEQ ID NO: 1852961 - RNA, 21 nt, Homo sapiens
uguaauaaguaucacacugua

SEQ ID NO: 1852962 - RNA, 22 nt, Homo sapiens
caaagcaacauggcagagcagu

SEQ ID NO: 1852963 - RNA, 17 nt, Homo sapiens
uuucauguaaauuuugu

SEQ ID NO: 1852964 - RNA, 15 nt, Homo sapiens
aacagguauauacuu

SEQ ID NO: 1852965 - RNA, 16 nt, Homo sapiens
ucugccgugugcccuc

SEQ ID NO: 1852966 - RNA, 18 nt, Homo sapiens
uuaucaauuuuucccagu

SEQ ID NO: 1852967 - RNA, 14 nt, Homo sapiens
ucuagacuaaaaga

SEQ ID NO: 1852968 - RNA, 19 nt, Homo sapiens
uugaacuuauuuacacaua

SEQ ID NO: 1852969 - RNA, 22 nt, Homo sapiens
cuuugggaagcucccacaccca

SEQ ID NO: 1852970 - RNA, 18 nt, Homo sapiens
ccuccaggauagacuuuu

SEQ ID NO: 1852971 - RNA, 16 nt, Homo sapiens
cucaggcagugcaaua

SEQ ID NO: 1852972 - RNA, 22 nt, Homo sapiens
gcccccaccgggcugcaggugc

SEQ ID NO: 1852973 - RNA, 14 nt, Homo sapiens
cuucauggggguga

SEQ ID NO: 1852974 - RNA, 16 nt, Homo sapiens
uaagcauacaacugga

SEQ ID NO: 1852975 - RNA, 11 nt, Homo sapiens
ucaucucugcc

SEQ ID NO: 1852976 - RNA, 16 nt, Homo sapiens
uagauggaguuucacu

SEQ ID NO: 1852977 - RNA, 15 nt, Homo sapiens
ugacuuuauguauua

SEQ ID NO: 1852978 - RNA, 21 nt, Homo sapiens
aauaccuagaccuaaacggcu

SEQ ID NO: 1852979 - RNA, 21 nt, Homo sapiens
cuugaagaggaaacucuguca

SEQ ID NO: 1852980 - RNA, 19 nt, Homo sapiens
acauaguagaacgcuaucu

SEQ ID NO: 1852981 - RNA, 12 nt, Homo sapiens
ccauaucuggca

SEQ ID NO: 1852982 - RNA, 21 nt, Homo sapiens
uccuuucugacugucccugcc

SEQ ID NO: 1852983 - RNA, 16 nt, Homo sapiens
cuuccaacguggccca

SEQ ID NO: 1852984 - RNA, 15 nt, Homo sapiens
gucaacuuucuuagc

SEQ ID NO: 1852985 - RNA, 18 nt, Homo sapiens
cuccuagaagaaccaaau

SEQ ID NO: 1852986 - RNA, 10 nt, Homo sapiens
uuuaaagggu

SEQ ID NO: 1852987 - RNA, 13 nt, Homo sapiens
agcaacacagagc

SEQ ID NO: 1852988 - RNA, 16 nt, Homo sapiens
gcuucugccacuuccc

SEQ ID NO: 1852989 - RNA, 13 nt, Homo sapiens
cacgccuguaauc

SEQ ID NO: 1852990 - RNA, 12 nt, Homo sapiens
aggauuacccac

SEQ ID NO: 1852991 - RNA, 19 nt, Homo sapiens
uggacaggagucagugucu

SEQ ID NO: 1852992 - RNA, 18 nt, Homo sapiens
aguauuuuaauccuguac

SEQ ID NO: 1852993 - RNA, 18 nt, Homo sapiens
cucaguagauacuaaagc

SEQ ID NO: 1852994 - RNA, 13 nt, Homo sapiens
caggaaaaaccaa

SEQ ID NO: 1852995 - RNA, 13 nt, Homo sapiens
auacuguuuauuu

SEQ ID NO: 1852996 - RNA, 21 nt, Homo sapiens
aggcuggggcugaccuuccuc

SEQ ID NO: 1852997 - RNA, 14 nt, Homo sapiens
aauggaccucucag

SEQ ID NO: 1852998 - RNA, 13 nt, Homo sapiens
aaaauaacuauca

SEQ ID NO: 1852999 - RNA, 11 nt, Homo sapiens
uguucugagaa

SEQ ID NO: 1853000 - RNA, 21 nt, Homo sapiens
uguaucaagccaaaugugcag

SEQ ID NO: 1853001 - RNA, 14 nt, Homo sapiens
uggaauucucucac

SEQ ID NO: 1853002 - RNA, 21 nt, Homo sapiens
gcugaguuccggggugcaaug

SEQ ID NO: 1853003 - RNA, 13 nt, Homo sapiens
acauuucuguaaa

SEQ ID NO: 1853004 - RNA, 21 nt, Homo sapiens
uaaaguagaauuaucucucau

SEQ ID NO: 1853005 - RNA, 20 nt, Homo sapiens
ccucgggaagccccauccaa

SEQ ID NO: 1853006 - RNA, 17 nt, Homo sapiens
aggccagccuuggcacg

SEQ ID NO: 1853007 - RNA, 16 nt, Homo sapiens
acauaaacaauucaug

SEQ ID NO: 1853008 - RNA, 16 nt, Homo sapiens
gauugaauugugccuu

SEQ ID NO: 1853009 - RNA, 13 nt, Homo sapiens
cuggaacaccagg

SEQ ID NO: 1853010 - RNA, 22 nt, Homo sapiens
aagaccaggccaaugucagggu

SEQ ID NO: 1853011 - RNA, 21 nt, Homo sapiens
cauaagcuaccugaauggaga

SEQ ID NO: 1853012 - RNA, 22 nt, Homo sapiens
uccugccacauuagaacuucuc

SEQ ID NO: 1853013 - RNA, 20 nt, Homo sapiens
uagcuggugguugugccuuu

SEQ ID NO: 1853014 - RNA, 19 nt, Homo sapiens
agucuugcucuguugccca

SEQ ID NO: 1853015 - RNA, 19 nt, Homo sapiens
ucucuaggguaagccagaa

SEQ ID NO: 1853016 - RNA, 19 nt, Homo sapiens
ucucugaagcgacucuccu

SEQ ID NO: 1853017 - RNA, 14 nt, Homo sapiens
aacaaaaaugacag

SEQ ID NO: 1853018 - RNA, 16 nt, Homo sapiens
auagcauuuguuuaag

SEQ ID NO: 1853019 - RNA, 20 nt, Homo sapiens
aaggaaaaaacuaguauucc

SEQ ID NO: 1853020 - RNA, 17 nt, Homo sapiens
ugcugucugcagccuug

SEQ ID NO: 1853021 - RNA, 22 nt, Homo sapiens
ggggaccucauuccugggacua

SEQ ID NO: 1853022 - RNA, 15 nt, Homo sapiens
cuggagugauuuaua

SEQ ID NO: 1853023 - RNA, 19 nt, Homo sapiens
acuugcuuuuaaaauccac

SEQ ID NO: 1853024 - RNA, 18 nt, Homo sapiens
uggcuguuauucuuccac

SEQ ID NO: 1853025 - RNA, 18 nt, Homo sapiens
ccugccuucacugugcuc

SEQ ID NO: 1853026 - RNA, 23 nt, Homo sapiens
aagccagaugugaaaacaucuca

SEQ ID NO: 1853027 - RNA, 18 nt, Homo sapiens
auauuuucugaguagcau

SEQ ID NO: 1853028 - RNA, 20 nt, Homo sapiens
accuccccagccccuagccc

SEQ ID NO: 1853029 - RNA, 13 nt, Homo sapiens
ucacuuaaaccac

SEQ ID NO: 1853030 - RNA, 20 nt, Homo sapiens
ggccagaagucaaggcuuag

SEQ ID NO: 1853031 - RNA, 15 nt, Homo sapiens
aggaaaaaccaacag

SEQ ID NO: 1853032 - RNA, 13 nt, Homo sapiens
cucucucaugaua

SEQ ID NO: 1853033 - RNA, 15 nt, Homo sapiens
aaagagcuccuguaa

SEQ ID NO: 1853034 - RNA, 15 nt, Homo sapiens
cauuuaaauuccaca

SEQ ID NO: 1853035 - RNA, 12 nt, Homo sapiens
caguaugucacu

SEQ ID NO: 1853036 - RNA, 18 nt, Homo sapiens
augguaaucaguuggaau

SEQ ID NO: 1853037 - RNA, 16 nt, Homo sapiens
uguagagagcagcauu

SEQ ID NO: 1853038 - RNA, 22 nt, Homo sapiens
auaccugcucuuguucuacuga

SEQ ID NO: 1853039 - RNA, 19 nt, Homo sapiens
gacaagcaagggcugugcu

SEQ ID NO: 1853040 - RNA, 21 nt, Homo sapiens
cucacagccagcgaacugaca

SEQ ID NO: 1853041 - RNA, 13 nt, Homo sapiens
gaacaccuccuag

SEQ ID NO: 1853042 - RNA, 14 nt, Homo sapiens
uaugacugauuacu

SEQ ID NO: 1853043 - RNA, 23 nt, Homo sapiens
caucauuacugguaaagccucau

SEQ ID NO: 1853044 - RNA, 20 nt, Homo sapiens
cugauuuacaggacuucucu

SEQ ID NO: 1853045 - RNA, 20 nt, Homo sapiens
aaaccaaauuuuaaaagcca

SEQ ID NO: 1853046 - RNA, 17 nt, Homo sapiens
aucucagccagccucca

SEQ ID NO: 1853047 - RNA, 17 nt, Homo sapiens
ccuuuuccgucuuugua

SEQ ID NO: 1853048 - RNA, 15 nt, Homo sapiens
agaccccaaggccca

SEQ ID NO: 1853049 - RNA, 22 nt, Homo sapiens
gguuucaccucccaaacccagc

SEQ ID NO: 1853050 - RNA, 13 nt, Homo sapiens
gucagaacuauaa

SEQ ID NO: 1853051 - RNA, 13 nt, Homo sapiens
ggcuagauguuua

SEQ ID NO: 1853052 - RNA, 12 nt, Homo sapiens
uacaaacaugug

SEQ ID NO: 1853053 - RNA, 13 nt, Homo sapiens
cauuucuguggau

SEQ ID NO: 1853054 - RNA, 22 nt, Homo sapiens
ugaaugaaagucuugugacuag

SEQ ID NO: 1853055 - RNA, 15 nt, Homo sapiens
ggccagaccagguga

SEQ ID NO: 1853056 - RNA, 12 nt, Homo sapiens
ccuuuuuugcca

SEQ ID NO: 1853057 - RNA, 14 nt, Homo sapiens
cuccauguuugaug

SEQ ID NO: 1853058 - RNA, 15 nt, Homo sapiens
ggcaaagccuaguga

SEQ ID NO: 1853059 - RNA, 18 nt, Homo sapiens
ucaccagcccuagcuguc

SEQ ID NO: 1853060 - RNA, 14 nt, Homo sapiens
caaauuaguacaga

SEQ ID NO: 1853061 - RNA, 15 nt, Homo sapiens
ugcggagacccugag

SEQ ID NO: 1853062 - RNA, 16 nt, Homo sapiens
ugucuaaagagcuuua

SEQ ID NO: 1853063 - RNA, 13 nt, Homo sapiens
cuccuuccagugu

SEQ ID NO: 1853064 - RNA, 14 nt, Homo sapiens
agcagccagcaccc

SEQ ID NO: 1853065 - RNA, 20 nt, Homo sapiens
accccauuucuacuaaaaau

SEQ ID NO: 1853066 - RNA, 19 nt, Homo sapiens
caaaauagagaaucccacu

SEQ ID NO: 1853067 - RNA, 16 nt, Homo sapiens
uucacaagacccaaaa

SEQ ID NO: 1853068 - RNA, 20 nt, Homo sapiens
aaacauaaacacauuuccau

SEQ ID NO: 1853069 - RNA, 23 nt, Homo sapiens
aggagagcacugccucuaugccc

SEQ ID NO: 1853070 - RNA, 21 nt, Homo sapiens
cuaaguauauuuaauucacuu

SEQ ID NO: 1853071 - RNA, 17 nt, Homo sapiens
auccagcuccccuucug

SEQ ID NO: 1853072 - RNA, 21 nt, Homo sapiens
caaaaacuugaucacaugcuu

SEQ ID NO: 1853073 - RNA, 14 nt, Homo sapiens
uggaaacugaaugc

SEQ ID NO: 1853074 - RNA, 21 nt, Homo sapiens
cuucuccucccagcgugugua

SEQ ID NO: 1853075 - RNA, 18 nt, Homo sapiens
gucacauggccuaugcac

SEQ ID NO: 1853076 - RNA, 19 nt, Homo sapiens
aaaacuuguuacuaaagaa

SEQ ID NO: 1853077 - RNA, 23 nt, Homo sapiens
gauccccccacagccccugguca

SEQ ID NO: 1853078 - RNA, 18 nt, Homo sapiens
cacuguaagacucauucc

SEQ ID NO: 1853079 - RNA, 14 nt, Homo sapiens
ucuauuaguuucaa

SEQ ID NO: 1853080 - RNA, 18 nt, Homo sapiens
uuccuaacaggaauuuuc

SEQ ID NO: 1853081 - RNA, 19 nt, Homo sapiens
auaugaaucugcucacuuu

SEQ ID NO: 1853082 - RNA, 16 nt, Homo sapiens
ugcuuagcucaucuua

SEQ ID NO: 1853083 - RNA, 13 nt, Homo sapiens
agaaguugcuuga

SEQ ID NO: 1853084 - RNA, 17 nt, Homo sapiens
uuggcguuuggacccag

SEQ ID NO: 1853085 - RNA, 21 nt, Homo sapiens
uucucaucaguaguucacaua

SEQ ID NO: 1853086 - RNA, 16 nt, Homo sapiens
ccuccuuggcuuuaug

SEQ ID NO: 1853087 - RNA, 18 nt, Homo sapiens
caagagcagcugggaacu

SEQ ID NO: 1853088 - RNA, 18 nt, Homo sapiens
uuauuuuggaacuaugaa

SEQ ID NO: 1853089 - RNA, 23 nt, Homo sapiens
uauugacacugacuagagugaug

SEQ ID NO: 1853090 - RNA, 17 nt, Homo sapiens
cagauuccccacucagc

SEQ ID NO: 1853091 - RNA, 12 nt, Homo sapiens
ucagcaugacaa

SEQ ID NO: 1853092 - RNA, 15 nt, Homo sapiens
ccaaacccaggcuau

SEQ ID NO: 1853093 - RNA, 20 nt, Homo sapiens
ggaaaacugagacucagaca

SEQ ID NO: 1853094 - RNA, 23 nt, Homo sapiens
ucuuuccuguaaagaaacauuuc

SEQ ID NO: 1853095 - RNA, 14 nt, Homo sapiens
acaugccaagcacu

SEQ ID NO: 1853096 - RNA, 18 nt, Homo sapiens
agccauaaagugccaguu

SEQ ID NO: 1853097 - RNA, 14 nt, Homo sapiens
uugcucucugucag

SEQ ID NO: 1853098 - RNA, 16 nt, Homo sapiens
gacugcucauacccag

SEQ ID NO: 1853099 - RNA, 23 nt, Homo sapiens
gcacuuacccacgugcuguucca

SEQ ID NO: 1853100 - RNA, 15 nt, Homo sapiens
ccugggcucaucagc

SEQ ID NO: 1853101 - RNA, 17 nt, Homo sapiens
ggauugaccugugugua

SEQ ID NO: 1853102 - RNA, 20 nt, Homo sapiens
cucuucuuuuucuuaccucc

SEQ ID NO: 1853103 - RNA, 17 nt, Homo sapiens
aauguguuuuucaguua

SEQ ID NO: 1853104 - RNA, 16 nt, Homo sapiens
cuucugccguugcugc

SEQ ID NO: 1853105 - RNA, 15 nt, Homo sapiens
uacaaaggaaaaagu

SEQ ID NO: 1853106 - RNA, 18 nt, Homo sapiens
ccgauuugggaaccaagc

SEQ ID NO: 1853107 - RNA, 12 nt, Homo sapiens
gccuacuuccuu

SEQ ID NO: 1853108 - RNA, 15 nt, Homo sapiens
ugaaucucuaaucaa

SEQ ID NO: 1853109 - RNA, 14 nt, Homo sapiens
acugguagcuauaa

SEQ ID NO: 1853110 - RNA, 15 nt, Homo sapiens
gcaaucugacccuau

SEQ ID NO: 1853111 - RNA, 18 nt, Homo sapiens
cauaucauuucacugucu

SEQ ID NO: 1853112 - RNA, 19 nt, Homo sapiens
aagcuguauuuauguaaua

SEQ ID NO: 1853113 - RNA, 19 nt, Homo sapiens
augagaaauuuuguugaua

SEQ ID NO: 1853114 - RNA, 21 nt, Homo sapiens
caauuuauaccuagcacuuua

SEQ ID NO: 1853115 - RNA, 20 nt, Homo sapiens
uaaaauauaacacaguuugu

SEQ ID NO: 1853116 - RNA, 13 nt, Homo sapiens
augaauaugaucc

SEQ ID NO: 1853117 - RNA, 23 nt, Homo sapiens
guuucuuucuaguggucuuugua

SEQ ID NO: 1853118 - RNA, 18 nt, Homo sapiens
gugcuuaaaaaucauuga

SEQ ID NO: 1853119 - RNA, 14 nt, Homo sapiens
aucugauaucuguu

SEQ ID NO: 1853120 - RNA, 16 nt, Homo sapiens
gagacuuggggccagc

SEQ ID NO: 1853121 - RNA, 15 nt, Homo sapiens
aauugcuuugugacu

SEQ ID NO: 1853122 - RNA, 15 nt, Homo sapiens
auaauuguugaccua

SEQ ID NO: 1853123 - RNA, 22 nt, Homo sapiens
ggacuuugcccaggaugacaua

SEQ ID NO: 1853124 - RNA, 18 nt, Homo sapiens
aaggaagggauacaugau

SEQ ID NO: 1853125 - RNA, 15 nt, Homo sapiens
aucccuuaccugcuu

SEQ ID NO: 1853126 - RNA, 13 nt, Homo sapiens
aggaggacagagg

SEQ ID NO: 1853127 - RNA, 19 nt, Homo sapiens
acaauugaacuuccaggaa

SEQ ID NO: 1853128 - RNA, 22 nt, Homo sapiens
cuuggccggauguccucagggc

SEQ ID NO: 1853129 - RNA, 18 nt, Homo sapiens
aucugcaccccacuucag

SEQ ID NO: 1853130 - RNA, 18 nt, Homo sapiens
agccguugaaucugggag

SEQ ID NO: 1853131 - RNA, 21 nt, Homo sapiens
cuugagauguggguauagcuc

SEQ ID NO: 1853132 - RNA, 20 nt, Homo sapiens
acucaugugacucuuuccaa

SEQ ID NO: 1853133 - RNA, 21 nt, Homo sapiens
cuaggaguagaaaaugguccu

SEQ ID NO: 1853134 - RNA, 20 nt, Homo sapiens
aaguuccuaauauaagugaa

SEQ ID NO: 1853135 - RNA, 21 nt, Homo sapiens
cucacgcucagcacacaugca

SEQ ID NO: 1853136 - RNA, 16 nt, Homo sapiens
auccacaauagcugac

SEQ ID NO: 1853137 - RNA, 22 nt, Homo sapiens
gcuggggcugagugaaaacauc

SEQ ID NO: 1853138 - RNA, 17 nt, Homo sapiens
gacacuauauauuucuu

SEQ ID NO: 1853139 - RNA, 16 nt, Homo sapiens
ccgucucuuaaguaau

SEQ ID NO: 1853140 - RNA, 20 nt, Homo sapiens
agauggcgcuauugcacucc

SEQ ID NO: 1853141 - RNA, 22 nt, Homo sapiens
aaaacaggaaaggagcaaugaa

SEQ ID NO: 1853142 - RNA, 19 nt, Homo sapiens
gagcacaauggucuuacau

SEQ ID NO: 1853143 - RNA, 11 nt, Homo sapiens
ccagugcaguc

SEQ ID NO: 1853144 - RNA, 14 nt, Homo sapiens
aauccuagcacuuu

SEQ ID NO: 1853145 - RNA, 15 nt, Homo sapiens
uuuguaaacuuugaa

SEQ ID NO: 1853146 - RNA, 17 nt, Homo sapiens
gccccugcacacucagu

SEQ ID NO: 1853147 - RNA, 13 nt, Homo sapiens
gcaugcucuggaa

SEQ ID NO: 1853148 - RNA, 22 nt, Homo sapiens
uacuuccaccuccaccacaucu

SEQ ID NO: 1853149 - RNA, 19 nt, Homo sapiens
ucaugccucgcucagucag

SEQ ID NO: 1853150 - RNA, 14 nt, Homo sapiens
acagaguuguuaca

SEQ ID NO: 1853151 - RNA, 21 nt, Homo sapiens
gagcagaauguuguacuugaa

SEQ ID NO: 1853152 - RNA, 23 nt, Homo sapiens
caggccagggggccagucccuga

SEQ ID NO: 1853153 - RNA, 15 nt, Homo sapiens
ugcgcucccaccuca

SEQ ID NO: 1853154 - RNA, 20 nt, Homo sapiens
aagcaccuuccccuccauuc

SEQ ID NO: 1853155 - RNA, 13 nt, Homo sapiens
uugccuaucugac

SEQ ID NO: 1853156 - RNA, 21 nt, Homo sapiens
uaaagucaggaguccaagacc

SEQ ID NO: 1853157 - RNA, 15 nt, Homo sapiens
ucuugaaauguagaa

SEQ ID NO: 1853158 - RNA, 14 nt, Homo sapiens
ugcauaggaaguau

SEQ ID NO: 1853159 - RNA, 13 nt, Homo sapiens
cucauuucaucuc

SEQ ID NO: 1853160 - RNA, 23 nt, Homo sapiens
gaacugucuuucauuuuugaacc

SEQ ID NO: 1853161 - RNA, 13 nt, Homo sapiens
aagaauaccugag

SEQ ID NO: 1853162 - RNA, 17 nt, Homo sapiens
augaugugaguauuuag

SEQ ID NO: 1853163 - RNA, 22 nt, Homo sapiens
acaagagugauucuugcugcua

SEQ ID NO: 1853164 - RNA, 22 nt, Homo sapiens
gaaucuuucuccuggugacuca

SEQ ID NO: 1853165 - RNA, 15 nt, Homo sapiens
auuccaucacaucac

SEQ ID NO: 1853166 - RNA, 14 nt, Homo sapiens
aggaaguauggcaa

SEQ ID NO: 1853167 - RNA, 19 nt, Homo sapiens
uggauuuucuuucuaugua

SEQ ID NO: 1853168 - RNA, 20 nt, Homo sapiens
ucugaguaccauuaucuuau

SEQ ID NO: 1853169 - RNA, 22 nt, Homo sapiens
ccaugaucccaccucccauuca

SEQ ID NO: 1853170 - RNA, 13 nt, Homo sapiens
cuggaucuaccug

SEQ ID NO: 1853171 - RNA, 18 nt, Homo sapiens
cacugccuguauacuuua

SEQ ID NO: 1853172 - RNA, 23 nt, Homo sapiens
gagugccuucaacacagcuuguc

SEQ ID NO: 1853173 - RNA, 13 nt, Homo sapiens
aagcaauccuccu

SEQ ID NO: 1853174 - RNA, 15 nt, Homo sapiens
cuggcuggaaaaagg

SEQ ID NO: 1853175 - RNA, 21 nt, Homo sapiens
agcauuguaaaauuauuucau

SEQ ID NO: 1853176 - RNA, 23 nt, Homo sapiens
uaaacaauauuacuaauugccca

SEQ ID NO: 1853177 - RNA, 23 nt, Homo sapiens
aaauuauguuuuaaacacaugcc

SEQ ID NO: 1853178 - RNA, 14 nt, Homo sapiens
cauucugcauuuag

SEQ ID NO: 1853179 - RNA, 15 nt, Homo sapiens
uuaacaucauugcau

SEQ ID NO: 1853180 - RNA, 22 nt, Homo sapiens
uucaguguuagaggugggccua

SEQ ID NO: 1853181 - RNA, 16 nt, Homo sapiens
caaagauucugcauuu

SEQ ID NO: 1853182 - RNA, 23 nt, Homo sapiens
cccuaacuuaacauugcaucaug

SEQ ID NO: 1853183 - RNA, 13 nt, Homo sapiens
ccuuuugaccaaa

SEQ ID NO: 1853184 - RNA, 19 nt, Homo sapiens
agagaaaccauccucuccc

SEQ ID NO: 1853185 - RNA, 22 nt, Homo sapiens
uuguugaaagcugaaaagcaua

SEQ ID NO: 1853186 - RNA, 17 nt, Homo sapiens
acucuucuaacacaaaa

SEQ ID NO: 1853187 - RNA, 19 nt, Homo sapiens
ggcuaagcaaaaugugaua

SEQ ID NO: 1853188 - RNA, 18 nt, Homo sapiens
cuagaaaaccagcuugcg

SEQ ID NO: 1853189 - RNA, 17 nt, Homo sapiens
auuuuaugccaguuguu

SEQ ID NO: 1853190 - RNA, 20 nt, Homo sapiens
cugaauuuuggggauuuuca

SEQ ID NO: 1853191 - RNA, 17 nt, Homo sapiens
accaguuggcagacagc

SEQ ID NO: 1853192 - RNA, 12 nt, Homo sapiens
uggacacauuau

SEQ ID NO: 1853193 - RNA, 11 nt, Homo sapiens
uaaagauguga

SEQ ID NO: 1853194 - RNA, 14 nt, Homo sapiens
caaauaggaugcuu

SEQ ID NO: 1853195 - RNA, 17 nt, Homo sapiens
aggugcucaugcugcuc

SEQ ID NO: 1853196 - RNA, 17 nt, Homo sapiens
ccaacacaaggugggca

SEQ ID NO: 1853197 - RNA, 22 nt, Homo sapiens
aagacugcugguugacaucaga

SEQ ID NO: 1853198 - RNA, 13 nt, Homo sapiens
uccucccauuucc

SEQ ID NO: 1853199 - RNA, 13 nt, Homo sapiens
uuuuuccaucccu

SEQ ID NO: 1853200 - RNA, 14 nt, Homo sapiens
cauugcucuaugaa

SEQ ID NO: 1853201 - RNA, 13 nt, Homo sapiens
uccuuccauuucu

SEQ ID NO: 1853202 - RNA, 17 nt, Homo sapiens
ggacuuguuuuccugug

SEQ ID NO: 1853203 - RNA, 13 nt, Homo sapiens
gacuggguggucc

SEQ ID NO: 1853204 - RNA, 18 nt, Homo sapiens
guaacacaagccacagaa

SEQ ID NO: 1853205 - RNA, 14 nt, Homo sapiens
agugcugaccccag

SEQ ID NO: 1853206 - RNA, 20 nt, Homo sapiens
aucaaaugucaguccuugac

SEQ ID NO: 1853207 - RNA, 22 nt, Homo sapiens
auuucagaucauauuucacaau

SEQ ID NO: 1853208 - RNA, 13 nt, Homo sapiens
cccaucaucaccc

SEQ ID NO: 1853209 - RNA, 15 nt, Homo sapiens
ccaccugcccaucac

SEQ ID NO: 1853210 - RNA, 20 nt, Homo sapiens
uuaaauaacaaaacugugcc

SEQ ID NO: 1853211 - RNA, 18 nt, Homo sapiens
acauguuacugaccagca

SEQ ID NO: 1853212 - RNA, 18 nt, Homo sapiens
acuuggcaccaauaaagg

SEQ ID NO: 1853213 - RNA, 14 nt, Homo sapiens
ccuccccuccugug

SEQ ID NO: 1853214 - RNA, 13 nt, Homo sapiens
ugaaauaugcaua

SEQ ID NO: 1853215 - RNA, 17 nt, Homo sapiens
caaacccaacucuaaug

SEQ ID NO: 1853216 - RNA, 14 nt, Homo sapiens
ccacaauggucuca

SEQ ID NO: 1853217 - RNA, 18 nt, Homo sapiens
uucuaaauuauaccauga

SEQ ID NO: 1853218 - RNA, 20 nt, Homo sapiens
gaucagagcuugaacacagg

SEQ ID NO: 1853219 - RNA, 18 nt, Homo sapiens
ucaccuccucugugauuu

SEQ ID NO: 1853220 - RNA, 13 nt, Homo sapiens
ucugcucucuuau

SEQ ID NO: 1853221 - RNA, 18 nt, Homo sapiens
acauuuuuccguuugcuu

SEQ ID NO: 1853222 - RNA, 20 nt, Homo sapiens
acagggucucacucugucac

SEQ ID NO: 1853223 - RNA, 16 nt, Homo sapiens
aggugugugugaacug

SEQ ID NO: 1853224 - RNA, 18 nt, Homo sapiens
ugcggguggguaucccac

SEQ ID NO: 1853225 - RNA, 21 nt, Homo sapiens
cuuuguuuagccugaaaaccu

SEQ ID NO: 1853226 - RNA, 13 nt, Homo sapiens
aaacauguggcuu

SEQ ID NO: 1853227 - RNA, 20 nt, Homo sapiens
aaucagacuucacacugcaa

SEQ ID NO: 1853228 - RNA, 14 nt, Homo sapiens
gaaagugauuugua

SEQ ID NO: 1853229 - RNA, 16 nt, Homo sapiens
aauguucacauaguga

SEQ ID NO: 1853230 - RNA, 17 nt, Homo sapiens
gaaagacugagcucaag

SEQ ID NO: 1853231 - RNA, 18 nt, Homo sapiens
uaucugagauuacagaga

SEQ ID NO: 1853232 - RNA, 16 nt, Homo sapiens
accccauccgcaucuc

SEQ ID NO: 1853233 - RNA, 18 nt, Homo sapiens
ugagugaauagcuuucag

SEQ ID NO: 1853234 - RNA, 14 nt, Homo sapiens
gccccccacuuuuu

SEQ ID NO: 1853235 - RNA, 19 nt, Homo sapiens
uuucauacccaugucagau

SEQ ID NO: 1853236 - RNA, 20 nt, Homo sapiens
ggaacagcagcagugccaua

SEQ ID NO: 1853237 - RNA, 22 nt, Homo sapiens
cauguuucugcuaugaccauga

SEQ ID NO: 1853238 - RNA, 20 nt, Homo sapiens
ucuaguucuuuucauuugga

SEQ ID NO: 1853239 - RNA, 13 nt, Homo sapiens
cuugaaugccaua

SEQ ID NO: 1853240 - RNA, 16 nt, Homo sapiens
agggcaauaaaugccc

SEQ ID NO: 1853241 - RNA, 15 nt, Homo sapiens
aucaagagccuuaaa

SEQ ID NO: 1853242 - RNA, 15 nt, Homo sapiens
cucugucagguguga

SEQ ID NO: 1853243 - RNA, 22 nt, Homo sapiens
auaugcagugauauggcagaag

SEQ ID NO: 1853244 - RNA, 22 nt, Homo sapiens
cuugguggcagaaugaaaauca

SEQ ID NO: 1853245 - RNA, 19 nt, Homo sapiens
gccucuuggguucaaguga

SEQ ID NO: 1853246 - RNA, 20 nt, Homo sapiens
agcugagauugugccacugu

SEQ ID NO: 1853247 - RNA, 20 nt, Homo sapiens
agcugagauugcgccacugc

SEQ ID NO: 1853248 - RNA, 17 nt, Homo sapiens
gccuggccagcacccca

SEQ ID NO: 1853249 - RNA, 12 nt, Homo sapiens
guugaguuugcu

SEQ ID NO: 1853250 - RNA, 17 nt, Homo sapiens
caggacaaaaugcaaac

SEQ ID NO: 1853251 - RNA, 15 nt, Homo sapiens
uugccacugcuguau

SEQ ID NO: 1853252 - RNA, 14 nt, Homo sapiens
uuaggagugucucu

SEQ ID NO: 1853253 - RNA, 15 nt, Homo sapiens
uugcugauacuaucu

SEQ ID NO: 1853254 - RNA, 22 nt, Homo sapiens
cacuaauuugauguuuacaggu

SEQ ID NO: 1853255 - RNA, 22 nt, Homo sapiens
agcuaaacccuucaacuaugca

SEQ ID NO: 1853256 - RNA, 22 nt, Homo sapiens
accagccugggcaacaugaugu

SEQ ID NO: 1853257 - RNA, 22 nt, Homo sapiens
gagacacuauuuaucugugcaa

SEQ ID NO: 1853258 - RNA, 19 nt, Homo sapiens
caucaguaacaguauucag

SEQ ID NO: 1853259 - RNA, 17 nt, Homo sapiens
uggaguuaucaguuauc

SEQ ID NO: 1853260 - RNA, 19 nt, Homo sapiens
gagcaaggcugcuaagugg

SEQ ID NO: 1853261 - RNA, 18 nt, Homo sapiens
caggccagaaaacauaug

SEQ ID NO: 1853262 - RNA, 14 nt, Homo sapiens
uaaacuaguuucca

SEQ ID NO: 1853263 - RNA, 16 nt, Homo sapiens
aggcucaagcccuaga

SEQ ID NO: 1853264 - RNA, 15 nt, Homo sapiens
aucccagcacuuugg

SEQ ID NO: 1853265 - RNA, 21 nt, Homo sapiens
ggguauccuacuacuuugugu

SEQ ID NO: 1853266 - RNA, 22 nt, Homo sapiens
gccaucuuccugccuacuggau

SEQ ID NO: 1853267 - RNA, 15 nt, Homo sapiens
agggguauguucccu

SEQ ID NO: 1853268 - RNA, 21 nt, Homo sapiens
auuucuacauuacagccauau

SEQ ID NO: 1853269 - RNA, 22 nt, Homo sapiens
ccugagugagaggggaggccaa

SEQ ID NO: 1853270 - RNA, 19 nt, Homo sapiens
aaaagggcugacauuuucu

SEQ ID NO: 1853271 - RNA, 19 nt, Homo sapiens
cugggaaaauccacuauga

SEQ ID NO: 1853272 - RNA, 17 nt, Homo sapiens
auucaugcaacuugauu

SEQ ID NO: 1853273 - RNA, 21 nt, Homo sapiens
ccaaagugacacagagcaaug

SEQ ID NO: 1853274 - RNA, 15 nt, Homo sapiens
aagggaccucuccau

SEQ ID NO: 1853275 - RNA, 16 nt, Homo sapiens
gucaacuuucauuuga

SEQ ID NO: 1853276 - RNA, 21 nt, Homo sapiens
cuucaaaacggggcagccaaa

SEQ ID NO: 1853277 - RNA, 18 nt, Homo sapiens
gugcccaggaagagccau

SEQ ID NO: 1853278 - RNA, 16 nt, Homo sapiens
aauauagacagugccc

SEQ ID NO: 1853279 - RNA, 17 nt, Homo sapiens
cugggaaggcaauuuca

SEQ ID NO: 1853280 - RNA, 19 nt, Homo sapiens
aguuucaaaagcaaaacau

SEQ ID NO: 1853281 - RNA, 18 nt, Homo sapiens
cucuguaguuacauuuag

SEQ ID NO: 1853282 - RNA, 17 nt, Homo sapiens
uaggugaggaagcaaaa

SEQ ID NO: 1853283 - RNA, 17 nt, Homo sapiens
acuugcguggacaguca

SEQ ID NO: 1853284 - RNA, 12 nt, Homo sapiens
uuggagcaagag

SEQ ID NO: 1853285 - RNA, 19 nt, Homo sapiens
acaaauacuaaaugugcaa

SEQ ID NO: 1853286 - RNA, 15 nt, Homo sapiens
caggcgacaaaaucu

SEQ ID NO: 1853287 - RNA, 14 nt, Homo sapiens
uaugauacguguau

SEQ ID NO: 1853288 - RNA, 16 nt, Homo sapiens
ucguuaaaaacagauu

SEQ ID NO: 1853289 - RNA, 14 nt, Homo sapiens
ugaauccugugaua

SEQ ID NO: 1853290 - RNA, 19 nt, Homo sapiens
acuggaccgcugacugcac

SEQ ID NO: 1853291 - RNA, 23 nt, Homo sapiens
aggagggcgugacucacccaagc

SEQ ID NO: 1853292 - RNA, 15 nt, Homo sapiens
cccacaguaggcacu

SEQ ID NO: 1853293 - RNA, 13 nt, Homo sapiens
ggcagcugcuccu

SEQ ID NO: 1853294 - RNA, 16 nt, Homo sapiens
gaaaacaugucuguga

SEQ ID NO: 1853295 - RNA, 15 nt, Homo sapiens
ucagcucagacauau

SEQ ID NO: 1853296 - RNA, 15 nt, Homo sapiens
cuuggcccucaguuu

SEQ ID NO: 1853297 - RNA, 13 nt, Homo sapiens
ugcaaaccuuccu

SEQ ID NO: 1853298 - RNA, 13 nt, Homo sapiens
gcguauauacuua

SEQ ID NO: 1853299 - RNA, 16 nt, Homo sapiens
gagauacgcaaacaca

SEQ ID NO: 1853300 - RNA, 17 nt, Homo sapiens
caucucaugugugcuca

SEQ ID NO: 1853301 - RNA, 16 nt, Homo sapiens
aauuugugccacuuua

SEQ ID NO: 1853302 - RNA, 20 nt, Homo sapiens
auuuucagcaaaacuuucca

SEQ ID NO: 1853303 - RNA, 18 nt, Homo sapiens
gcuaauguuacuagagaa

SEQ ID NO: 1853304 - RNA, 15 nt, Homo sapiens
aaucuucaccucaga

SEQ ID NO: 1853305 - RNA, 15 nt, Homo sapiens
aaaaugcaccaaaua

SEQ ID NO: 1853306 - RNA, 21 nt, Homo sapiens
ccuauugugacagagccaugg

SEQ ID NO: 1853307 - RNA, 23 nt, Homo sapiens
acccacuuaguccacucugaguc

SEQ ID NO: 1853308 - RNA, 22 nt, Homo sapiens
aaccguccccuccuucccucac

SEQ ID NO: 1853309 - RNA, 14 nt, Homo sapiens
auaaaaaauagaca

SEQ ID NO: 1853310 - RNA, 18 nt, Homo sapiens
agaaguaauuccucugau

SEQ ID NO: 1853311 - RNA, 13 nt, Homo sapiens
cgugauggucuga

SEQ ID NO: 1853312 - RNA, 16 nt, Homo sapiens
caaaugcucucucaaa

SEQ ID NO: 1853313 - RNA, 19 nt, Homo sapiens
aaaacaccgcuucugccuu

SEQ ID NO: 1853314 - RNA, 12 nt, Homo sapiens
ccugugacaugg

SEQ ID NO: 1853315 - RNA, 15 nt, Homo sapiens
aacaugggcugugau

SEQ ID NO: 1853316 - RNA, 23 nt, Homo sapiens
aguucuuucccagccucuuccau

SEQ ID NO: 1853317 - RNA, 15 nt, Homo sapiens
gccacaacacccagc

SEQ ID NO: 1853318 - RNA, 22 nt, Homo sapiens
gcugaaaacccgaaucugagaa

SEQ ID NO: 1853319 - RNA, 13 nt, Homo sapiens
acaauaaaagaca

SEQ ID NO: 1853320 - RNA, 20 nt, Homo sapiens
cugggaaauguuuuaaugcc

SEQ ID NO: 1853321 - RNA, 19 nt, Homo sapiens
uuaucuuuuguauaucuaa

SEQ ID NO: 1853322 - RNA, 17 nt, Homo sapiens
ccagaaaagcaguggcu

SEQ ID NO: 1853323 - RNA, 13 nt, Homo sapiens
uacaaagaaauaa

SEQ ID NO: 1853324 - RNA, 18 nt, Homo sapiens
cagaacucuccuaucuga

SEQ ID NO: 1853325 - RNA, 22 nt, Homo sapiens
cuucuauauauuguauguauau

SEQ ID NO: 1853326 - RNA, 17 nt, Homo sapiens
ucuuauuugcuauagaa

SEQ ID NO: 1853327 - RNA, 23 nt, Homo sapiens
uccaacagaccuggugcucuaau

SEQ ID NO: 1853328 - RNA, 22 nt, Homo sapiens
uugaacuguaccaugugcuaca

SEQ ID NO: 1853329 - RNA, 13 nt, Homo sapiens
uccuuguuccuag

SEQ ID NO: 1853330 - RNA, 23 nt, Homo sapiens
agcuaauccacaaccuguuacca

SEQ ID NO: 1853331 - RNA, 21 nt, Homo sapiens
ccaagaacuuuucccccaaag

SEQ ID NO: 1853332 - RNA, 16 nt, Homo sapiens
agcucaguguguucug

SEQ ID NO: 1853333 - RNA, 18 nt, Homo sapiens
ugcucuuucagaacaaac

SEQ ID NO: 1853334 - RNA, 22 nt, Homo sapiens
aagugacuugaauguacaaaga

SEQ ID NO: 1853335 - RNA, 23 nt, Homo sapiens
cucaacacgacugcaagcuccau

SEQ ID NO: 1853336 - RNA, 14 nt, Homo sapiens
gccuuaccaggaga

SEQ ID NO: 1853337 - RNA, 16 nt, Homo sapiens
gauauaggaaaauaca

SEQ ID NO: 1853338 - RNA, 16 nt, Homo sapiens
aaauuguuuagugaua

SEQ ID NO: 1853339 - RNA, 22 nt, Homo sapiens
cucagcgcugcccacaccaccg

SEQ ID NO: 1853340 - RNA, 17 nt, Homo sapiens
uaaaacauuggcauuug

SEQ ID NO: 1853341 - RNA, 17 nt, Homo sapiens
aagcaaugcugaugaau

SEQ ID NO: 1853342 - RNA, 21 nt, Homo sapiens
agugacaaguagggcacaaaa

SEQ ID NO: 1853343 - RNA, 14 nt, Homo sapiens
cuccuaccugguca

SEQ ID NO: 1853344 - RNA, 15 nt, Homo sapiens
auugacuuccuccaa

SEQ ID NO: 1853345 - RNA, 23 nt, Homo sapiens
uguuuaaagaaucuacuauacuu

SEQ ID NO: 1853346 - RNA, 12 nt, Homo sapiens
gaaggugcuguu

SEQ ID NO: 1853347 - RNA, 23 nt, Homo sapiens
gcauuaggaguguuucauuugau

SEQ ID NO: 1853348 - RNA, 15 nt, Homo sapiens
caaugcacacacaca

SEQ ID NO: 1853349 - RNA, 15 nt, Homo sapiens
uguauuaaauguaac

SEQ ID NO: 1853350 - RNA, 19 nt, Homo sapiens
uaccuucuggcugugcuac

SEQ ID NO: 1853351 - RNA, 17 nt, Homo sapiens
guaguuuaaaacaucag

SEQ ID NO: 1853352 - RNA, 17 nt, Homo sapiens
acccuggaccagugguc

SEQ ID NO: 1853353 - RNA, 21 nt, Homo sapiens
aucugaguuagguuccagcau

SEQ ID NO: 1853354 - RNA, 15 nt, Homo sapiens
accucugagcacaua

SEQ ID NO: 1853355 - RNA, 21 nt, Homo sapiens
acagaugcuuuucugucucug

SEQ ID NO: 1853356 - RNA, 14 nt, Homo sapiens
auucccugucacua

SEQ ID NO: 1853357 - RNA, 22 nt, Homo sapiens
cuuuuuuuuuuuuuugguugca

SEQ ID NO: 1853358 - RNA, 21 nt, Homo sapiens
ccagaaaacaaaacugcauuu

SEQ ID NO: 1853359 - RNA, 19 nt, Homo sapiens
agaucagcgacccugagga

SEQ ID NO: 1853360 - RNA, 19 nt, Homo sapiens
acugaggugguggacaucg

SEQ ID NO: 1853361 - RNA, 20 nt, Homo sapiens
auucacaagcuaacuuccac

SEQ ID NO: 1853362 - RNA, 18 nt, Homo sapiens
uuucaaaauuaagucgau

SEQ ID NO: 1853363 - RNA, 16 nt, Homo sapiens
cauccagccucagaga

SEQ ID NO: 1853364 - RNA, 20 nt, Homo sapiens
gcuccuuguuuuugccaaag

SEQ ID NO: 1853365 - RNA, 19 nt, Homo sapiens
uugauuaaacuguaugucu

SEQ ID NO: 1853366 - RNA, 13 nt, Homo sapiens
uuaacuauaacaa

SEQ ID NO: 1853367 - RNA, 21 nt, Homo sapiens
ccugugcccacccgucuucaa

SEQ ID NO: 1853368 - RNA, 11 nt, Homo sapiens
ucucacacucc

SEQ ID NO: 1853369 - RNA, 16 nt, Homo sapiens
aaucacuucugagaac

SEQ ID NO: 1853370 - RNA, 17 nt, Homo sapiens
acaucaaagagcacauu

SEQ ID NO: 1853371 - RNA, 21 nt, Homo sapiens
agaaaauauuacuuauuuauc

SEQ ID NO: 1853372 - RNA, 22 nt, Homo sapiens
ccuccagcccgggagccuagga

SEQ ID NO: 1853373 - RNA, 15 nt, Homo sapiens
aauguauuuguucau

SEQ ID NO: 1853374 - RNA, 14 nt, Homo sapiens
ugaccagugcugcu

SEQ ID NO: 1853375 - RNA, 19 nt, Homo sapiens
ucacugagugauacuuuaa

SEQ ID NO: 1853376 - RNA, 11 nt, Homo sapiens
ucaaaugcagu

SEQ ID NO: 1853377 - RNA, 18 nt, Homo sapiens
cacgugagccacagggcu

SEQ ID NO: 1853378 - RNA, 18 nt, Homo sapiens
auauuuaaagucuugaau

SEQ ID NO: 1853379 - RNA, 13 nt, Homo sapiens
uagggcuguaaaa

SEQ ID NO: 1853380 - RNA, 22 nt, Homo sapiens
auggaaugcuugcagagcauga

SEQ ID NO: 1853381 - RNA, 20 nt, Homo sapiens
cugagcccuugcacaggcca

SEQ ID NO: 1853382 - RNA, 15 nt, Homo sapiens
gcuaggaaagggaag

SEQ ID NO: 1853383 - RNA, 19 nt, Homo sapiens
cuuaaaaugaauuauguua

SEQ ID NO: 1853384 - RNA, 19 nt, Homo sapiens
gccaagagccgacaaugcc

SEQ ID NO: 1853385 - RNA, 18 nt, Homo sapiens
aucacuuuggcauucagu

SEQ ID NO: 1853386 - RNA, 16 nt, Homo sapiens
ggaaagauugugucug

SEQ ID NO: 1853387 - RNA, 16 nt, Homo sapiens
gcuccagaagaacaaa

SEQ ID NO: 1853388 - RNA, 18 nt, Homo sapiens
gcauggucaagccucuua

SEQ ID NO: 1853389 - RNA, 18 nt, Homo sapiens
cagguagacagaccucca

SEQ ID NO: 1853390 - RNA, 19 nt, Homo sapiens
uuagccaaucuuucuagau

SEQ ID NO: 1853391 - RNA, 17 nt, Homo sapiens
ugucauuacauagaaca

SEQ ID NO: 1853392 - RNA, 15 nt, Homo sapiens
aguccaguacuugac

SEQ ID NO: 1853393 - RNA, 16 nt, Homo sapiens
aagucggaucuagucc

SEQ ID NO: 1853394 - RNA, 17 nt, Homo sapiens
ugaaacacucgugugca

SEQ ID NO: 1853395 - RNA, 14 nt, Homo sapiens
ggcuccuccuuaug

SEQ ID NO: 1853396 - RNA, 17 nt, Homo sapiens
ucacuggggcagacaau

SEQ ID NO: 1853397 - RNA, 16 nt, Homo sapiens
ugaacuuuuaaugaac

SEQ ID NO: 1853398 - RNA, 17 nt, Homo sapiens
uucggacaaaauaucuc

SEQ ID NO: 1853399 - RNA, 21 nt, Homo sapiens
uucugucaagcuuacuacagu

SEQ ID NO: 1853400 - RNA, 15 nt, Homo sapiens
auuguaugucaagau

SEQ ID NO: 1853401 - RNA, 22 nt, Homo sapiens
aauaaaagcugaccccaaagac

SEQ ID NO: 1853402 - RNA, 14 nt, Homo sapiens
uaaacuuacauuua

SEQ ID NO: 1853403 - RNA, 14 nt, Homo sapiens
aaaaaguauaggau

SEQ ID NO: 1853404 - RNA, 15 nt, Homo sapiens
ccgaaugucacuggu

SEQ ID NO: 1853405 - RNA, 22 nt, Homo sapiens
gcaugggcgcaggcccagugac

SEQ ID NO: 1853406 - RNA, 13 nt, Homo sapiens
caaguuauauuga

SEQ ID NO: 1853407 - RNA, 15 nt, Homo sapiens
ugacuaauucuugca

SEQ ID NO: 1853408 - RNA, 15 nt, Homo sapiens
uaauauggacauuua

SEQ ID NO: 1853409 - RNA, 21 nt, Homo sapiens
ccaugccaucucaaccucuuc

SEQ ID NO: 1853410 - RNA, 15 nt, Homo sapiens
ggugaccaaugcauu

SEQ ID NO: 1853411 - RNA, 22 nt, Homo sapiens
ccauauuuuauuguauuuugau

SEQ ID NO: 1853412 - RNA, 14 nt, Homo sapiens
auaagacaagaaua

SEQ ID NO: 1853413 - RNA, 15 nt, Homo sapiens
ccuguaaucccagcu

SEQ ID NO: 1853414 - RNA, 13 nt, Homo sapiens
ccaaugagcuccu

SEQ ID NO: 1853415 - RNA, 21 nt, Homo sapiens
ugugaagauuauaaaagccaa

SEQ ID NO: 1853416 - RNA, 13 nt, Homo sapiens
gaaaggccaauaa

SEQ ID NO: 1853417 - RNA, 21 nt, Homo sapiens
guucuggacggcccagcagcu

SEQ ID NO: 1853418 - RNA, 16 nt, Homo sapiens
uuaucguguacaagaa

SEQ ID NO: 1853419 - RNA, 17 nt, Homo sapiens
cucccucuccauaucuc

SEQ ID NO: 1853420 - RNA, 14 nt, Homo sapiens
ccugcugagcugcc

SEQ ID NO: 1853421 - RNA, 19 nt, Homo sapiens
caagagccugagacuggaa

SEQ ID NO: 1853422 - RNA, 16 nt, Homo sapiens
guuguguugucacuaa

SEQ ID NO: 1853423 - RNA, 17 nt, Homo sapiens
aacacaauucuucuucc

SEQ ID NO: 1853424 - RNA, 17 nt, Homo sapiens
ucuagcauggcugccaa

SEQ ID NO: 1853425 - RNA, 23 nt, Homo sapiens
acaagggaagcuucuugcugcca

SEQ ID NO: 1853426 - RNA, 22 nt, Homo sapiens
cugagauuacagacaugagccu

SEQ ID NO: 1853427 - RNA, 21 nt, Homo sapiens
agaagucuggcuuugcucuau

SEQ ID NO: 1853428 - RNA, 13 nt, Homo sapiens
ugugugagcugcc

SEQ ID NO: 1853429 - RNA, 22 nt, Homo sapiens
ggccccucacccccagcuggaa

SEQ ID NO: 1853430 - RNA, 11 nt, Homo sapiens
aaaaugucaag

SEQ ID NO: 1853431 - RNA, 21 nt, Homo sapiens
gacgcugcccugcaugcugcc

SEQ ID NO: 1853432 - RNA, 21 nt, Homo sapiens
ugcuggccacagaaaggccac

SEQ ID NO: 1853433 - RNA, 14 nt, Homo sapiens
ucaggucaacugac

SEQ ID NO: 1853434 - RNA, 16 nt, Homo sapiens
agaaauucagcauuug

SEQ ID NO: 1853435 - RNA, 13 nt, Homo sapiens
ugggacagggcaa

SEQ ID NO: 1853436 - RNA, 13 nt, Homo sapiens
ugccaaaauauca

SEQ ID NO: 1853437 - RNA, 20 nt, Homo sapiens
ucuccucuggggaagaccuu

SEQ ID NO: 1853438 - RNA, 23 nt, Homo sapiens
uuaaagcagucacuucagacagg

SEQ ID NO: 1853439 - RNA, 14 nt, Homo sapiens
aaagacaccauuua

SEQ ID NO: 1853440 - RNA, 16 nt, Homo sapiens
cuguccuuucuugcag

SEQ ID NO: 1853441 - RNA, 22 nt, Homo sapiens
cucugcuuuuuccagauucuuc

SEQ ID NO: 1853442 - RNA, 14 nt, Homo sapiens
uguaccacaucugc

SEQ ID NO: 1853443 - RNA, 14 nt, Homo sapiens
ugcuguacauuacu

SEQ ID NO: 1853444 - RNA, 14 nt, Homo sapiens
cuccacacucagua

SEQ ID NO: 1853445 - RNA, 18 nt, Homo sapiens
cucacggaagggaugcua

SEQ ID NO: 1853446 - RNA, 15 nt, Homo sapiens
ccuauggacaacuua

SEQ ID NO: 1853447 - RNA, 20 nt, Homo sapiens
uauaaacuuuuuauucucag

SEQ ID NO: 1853448 - RNA, 19 nt, Homo sapiens
cugugguggccgugccuga

SEQ ID NO: 1853449 - RNA, 16 nt, Homo sapiens
cauugggacaacacuu

SEQ ID NO: 1853450 - RNA, 20 nt, Homo sapiens
uugugcucaauacacagaaa

SEQ ID NO: 1853451 - RNA, 22 nt, Homo sapiens
cacaagucuaaacaaugaauuc

SEQ ID NO: 1853452 - RNA, 14 nt, Homo sapiens
acagaacucacagu

SEQ ID NO: 1853453 - RNA, 19 nt, Homo sapiens
aaaguuacaguuugauaca

SEQ ID NO: 1853454 - RNA, 15 nt, Homo sapiens
ugagcugacaucuca

SEQ ID NO: 1853455 - RNA, 20 nt, Homo sapiens
aaaguggcagggaccggcag

SEQ ID NO: 1853456 - RNA, 17 nt, Homo sapiens
cgcaagucacagaaaau

SEQ ID NO: 1853457 - RNA, 19 nt, Homo sapiens
uaggguaauaucaucucaa

SEQ ID NO: 1853458 - RNA, 23 nt, Homo sapiens
gccuuaaaaaucaagacacuagu

SEQ ID NO: 1853459 - RNA, 16 nt, Homo sapiens
cauucagagacugccc

SEQ ID NO: 1853460 - RNA, 15 nt, Homo sapiens
gagcaggaagccgau

SEQ ID NO: 1853461 - RNA, 16 nt, Homo sapiens
cuuaggggaagccacu

SEQ ID NO: 1853462 - RNA, 20 nt, Homo sapiens
caggugccaugccugcuccc

SEQ ID NO: 1853463 - RNA, 12 nt, Homo sapiens
uggcuccaaacc

SEQ ID NO: 1853464 - RNA, 21 nt, Homo sapiens
aguguuggaaaaugugcaaua

SEQ ID NO: 1853465 - RNA, 21 nt, Homo sapiens
cuaaaguuuuauugaugugaa

SEQ ID NO: 1853466 - RNA, 23 nt, Homo sapiens
ccaacagaugagcgaaaauguau

SEQ ID NO: 1853467 - RNA, 21 nt, Homo sapiens
cuucuguggcaacuuguacug

SEQ ID NO: 1853468 - RNA, 17 nt, Homo sapiens
caguacuuuauuguaca

SEQ ID NO: 1853469 - RNA, 14 nt, Homo sapiens
uucaguacuuguga

SEQ ID NO: 1853470 - RNA, 16 nt, Homo sapiens
ucugcuuuaauuucau

SEQ ID NO: 1853471 - RNA, 19 nt, Homo sapiens
gcagaauagcaaggugcuc

SEQ ID NO: 1853472 - RNA, 19 nt, Homo sapiens
augcugcuuguuggcucca

SEQ ID NO: 1853473 - RNA, 17 nt, Homo sapiens
gauggcucgugggaugu

SEQ ID NO: 1853474 - RNA, 15 nt, Homo sapiens
cuucccaugcuggug

SEQ ID NO: 1853475 - RNA, 14 nt, Homo sapiens
uucuccugccucac

SEQ ID NO: 1853476 - RNA, 22 nt, Homo sapiens
acaaaucaccauguaacaacca

SEQ ID NO: 1853477 - RNA, 18 nt, Homo sapiens
uauaaaauuaacaugaua

SEQ ID NO: 1853478 - RNA, 14 nt, Homo sapiens
cuucuugguucuga

SEQ ID NO: 1853479 - RNA, 13 nt, Homo sapiens
auccucaaggaaa

SEQ ID NO: 1853480 - RNA, 21 nt, Homo sapiens
caguauuucauugccugugua

SEQ ID NO: 1853481 - RNA, 17 nt, Homo sapiens
uuuuaauuuuggaacaa

SEQ ID NO: 1853482 - RNA, 18 nt, Homo sapiens
ccucuuuucccucucuag

SEQ ID NO: 1853483 - RNA, 17 nt, Homo sapiens
gauguggggaagagcua

SEQ ID NO: 1853484 - RNA, 16 nt, Homo sapiens
ggaaacgaagcaccau

SEQ ID NO: 1853485 - RNA, 10 nt, Homo sapiens
cagaccucca

SEQ ID NO: 1853486 - RNA, 20 nt, Homo sapiens
auucugcuacuucacuguca

SEQ ID NO: 1853487 - RNA, 15 nt, Homo sapiens
cuuucuaaagacagg

SEQ ID NO: 1853488 - RNA, 18 nt, Homo sapiens
gaggauggccuggauuca

SEQ ID NO: 1853489 - RNA, 19 nt, Homo sapiens
auuucaaccgcuugccaua

SEQ ID NO: 1853490 - RNA, 20 nt, Homo sapiens
cugaagucucuucucucuua

SEQ ID NO: 1853491 - RNA, 21 nt, Homo sapiens
aacacacccaucaucugacau

SEQ ID NO: 1853492 - RNA, 14 nt, Homo sapiens
aucuuuugugagau

SEQ ID NO: 1853493 - RNA, 23 nt, Homo sapiens
gaauucguuucugacauaccuua

SEQ ID NO: 1853494 - RNA, 14 nt, Homo sapiens
gcagauacacugcu

SEQ ID NO: 1853495 - RNA, 18 nt, Homo sapiens
gcacugugccccaaguuc

SEQ ID NO: 1853496 - RNA, 15 nt, Homo sapiens
uuaugaaaccaacug

SEQ ID NO: 1853497 - RNA, 16 nt, Homo sapiens
guugucacuaagucag

SEQ ID NO: 1853498 - RNA, 21 nt, Homo sapiens
ggaagaccggcugguggagcu

SEQ ID NO: 1853499 - RNA, 17 nt, Homo sapiens
augugauauaaggauuu

SEQ ID NO: 1853500 - RNA, 16 nt, Homo sapiens
aacauggagcugucau

SEQ ID NO: 1853501 - RNA, 14 nt, Homo sapiens
aaauuaaaagcuau

SEQ ID NO: 1853502 - RNA, 21 nt, Homo sapiens
uguguguucuggggcaaccua

SEQ ID NO: 1853503 - RNA, 15 nt, Homo sapiens
augaaaacugaauca

SEQ ID NO: 1853504 - RNA, 16 nt, Homo sapiens
uggaagcccuccuucc

SEQ ID NO: 1853505 - RNA, 22 nt, Homo sapiens
agggcaaaugacaugcacugac

SEQ ID NO: 1853506 - RNA, 21 nt, Homo sapiens
uagguucuaaaguucuaagau

SEQ ID NO: 1853507 - RNA, 12 nt, Homo sapiens
ucaagccaggag

SEQ ID NO: 1853508 - RNA, 19 nt, Homo sapiens
auagugguaugacauugga

SEQ ID NO: 1853509 - RNA, 14 nt, Homo sapiens
ugggugaaggugac

SEQ ID NO: 1853510 - RNA, 18 nt, Homo sapiens
gaaauaaauauuguguug

SEQ ID NO: 1853511 - RNA, 22 nt, Homo sapiens
ugaggaggcuugccccacccaa

SEQ ID NO: 1853512 - RNA, 18 nt, Homo sapiens
gcagcuaucucucaguga

SEQ ID NO: 1853513 - RNA, 23 nt, Homo sapiens
uucugacaagauaaaggaaguca

SEQ ID NO: 1853514 - RNA, 15 nt, Homo sapiens
aguucaauggcugcu

SEQ ID NO: 1853515 - RNA, 14 nt, Homo sapiens
cagagggaagccau

SEQ ID NO: 1853516 - RNA, 20 nt, Homo sapiens
ucauaccucugaccaacagg

SEQ ID NO: 1853517 - RNA, 17 nt, Homo sapiens
cucagcaaucacaagcc

SEQ ID NO: 1853518 - RNA, 18 nt, Homo sapiens
cugcauggucaagccucu

SEQ ID NO: 1853519 - RNA, 22 nt, Homo sapiens
cccacucugcuucuugcuggug

SEQ ID NO: 1853520 - RNA, 17 nt, Homo sapiens
ccuuaaguauaucaugu

SEQ ID NO: 1853521 - RNA, 15 nt, Homo sapiens
aaacccccgcuccag

SEQ ID NO: 1853522 - RNA, 20 nt, Homo sapiens
uauccuauuuagauggccau

SEQ ID NO: 1853523 - RNA, 20 nt, Homo sapiens
ucuauggcacccaugcaccu

SEQ ID NO: 1853524 - RNA, 13 nt, Homo sapiens
uuccagauauuca

SEQ ID NO: 1853525 - RNA, 21 nt, Homo sapiens
aaaugauagauuugaccuccu

SEQ ID NO: 1853526 - RNA, 22 nt, Homo sapiens
cuggaauuugaaacacuuugca

SEQ ID NO: 1853527 - RNA, 15 nt, Homo sapiens
agccccaugccaugg

SEQ ID NO: 1853528 - RNA, 23 nt, Homo sapiens
auuacccucggucauuccuguca

SEQ ID NO: 1853529 - RNA, 14 nt, Homo sapiens
aggacccaggucug

SEQ ID NO: 1853530 - RNA, 16 nt, Homo sapiens
ugcaauagagacugua

SEQ ID NO: 1853531 - RNA, 20 nt, Homo sapiens
ucuaauuaauaaauuuucca

SEQ ID NO: 1853532 - RNA, 18 nt, Homo sapiens
acaaggcuuuaucucagg

SEQ ID NO: 1853533 - RNA, 13 nt, Homo sapiens
gcaguaguuuuca

SEQ ID NO: 1853534 - RNA, 22 nt, Homo sapiens
agaccccugggggaggcuucca

SEQ ID NO: 1853535 - RNA, 18 nt, Homo sapiens
agacaguaugagucaaug

SEQ ID NO: 1853536 - RNA, 13 nt, Homo sapiens
guuuugccaugua

SEQ ID NO: 1853537 - RNA, 16 nt, Homo sapiens
aggaggccaaacuguc

SEQ ID NO: 1853538 - RNA, 22 nt, Homo sapiens
caaauccauccugcucuuccau

SEQ ID NO: 1853539 - RNA, 16 nt, Homo sapiens
cauuuuaguuacugaa

SEQ ID NO: 1853540 - RNA, 15 nt, Homo sapiens
auaaacaaucuccca

SEQ ID NO: 1853541 - RNA, 14 nt, Homo sapiens
uucuccuggucacu

SEQ ID NO: 1853542 - RNA, 12 nt, Homo sapiens
cucugugccuug

SEQ ID NO: 1853543 - RNA, 14 nt, Homo sapiens
agcuguugggaaca

SEQ ID NO: 1853544 - RNA, 17 nt, Homo sapiens
gcaucucuguguaccca

SEQ ID NO: 1853545 - RNA, 23 nt, Homo sapiens
cagagcauuuccaacaccacaga

SEQ ID NO: 1853546 - RNA, 23 nt, Homo sapiens
gccugcccuccucucccgucucg

SEQ ID NO: 1853547 - RNA, 15 nt, Homo sapiens
cauuucuaagcagau

SEQ ID NO: 1853548 - RNA, 20 nt, Homo sapiens
cuuuaaagggauggcaagau

SEQ ID NO: 1853549 - RNA, 23 nt, Homo sapiens
cuucggggggggaggggguguua

SEQ ID NO: 1853550 - RNA, 14 nt, Homo sapiens
uuaucaguuaucug

SEQ ID NO: 1853551 - RNA, 22 nt, Homo sapiens
agcauaacaagguccaagauac

SEQ ID NO: 1853552 - RNA, 14 nt, Homo sapiens
uaauucaguacaac

SEQ ID NO: 1853553 - RNA, 14 nt, Homo sapiens
uaauuaaguacaaa

SEQ ID NO: 1853554 - RNA, 15 nt, Homo sapiens
uucauaugcuguaua

SEQ ID NO: 1853555 - RNA, 20 nt, Homo sapiens
caguggcaugaucauagcuc

SEQ ID NO: 1853556 - RNA, 12 nt, Homo sapiens
uguuaagcugcu

SEQ ID NO: 1853557 - RNA, 19 nt, Homo sapiens
uauggcuuuuaguacugaa

SEQ ID NO: 1853558 - RNA, 21 nt, Homo sapiens
uugucagccaucguccuggga

SEQ ID NO: 1853559 - RNA, 17 nt, Homo sapiens
aagcugaauccagauca

SEQ ID NO: 1853560 - RNA, 12 nt, Homo sapiens
ucgugcacacac

SEQ ID NO: 1853561 - RNA, 15 nt, Homo sapiens
gagguaaaaaacugu

SEQ ID NO: 1853562 - RNA, 15 nt, Homo sapiens
aaacaagugcuggca

SEQ ID NO: 1853563 - RNA, 19 nt, Homo sapiens
cuguggagccccagcauau

SEQ ID NO: 1853564 - RNA, 22 nt, Homo sapiens
ggcagcuguccugugaugucag

SEQ ID NO: 1853565 - RNA, 14 nt, Homo sapiens
augcaacagccaua

SEQ ID NO: 1853566 - RNA, 17 nt, Homo sapiens
ggcgugagacccagugc

SEQ ID NO: 1853567 - RNA, 14 nt, Homo sapiens
uggucuccacuggg

SEQ ID NO: 1853568 - RNA, 14 nt, Homo sapiens
agguggccucugcu

SEQ ID NO: 1853569 - RNA, 13 nt, Homo sapiens
agaaaagauucuu

SEQ ID NO: 1853570 - RNA, 17 nt, Homo sapiens
aagugcauauuuaucca

SEQ ID NO: 1853571 - RNA, 19 nt, Homo sapiens
gcccuccuucuugcccuga

SEQ ID NO: 1853572 - RNA, 19 nt, Homo sapiens
uaaggaauauccagucaaa

SEQ ID NO: 1853573 - RNA, 17 nt, Homo sapiens
uccaacagccagugugu

SEQ ID NO: 1853574 - RNA, 13 nt, Homo sapiens
ugaggcaugccca

SEQ ID NO: 1853575 - RNA, 12 nt, Homo sapiens
uaaaugcucaua

SEQ ID NO: 1853576 - RNA, 15 nt, Homo sapiens
ucagcacgaauguuc

SEQ ID NO: 1853577 - RNA, 11 nt, Homo sapiens
agaucaugccg

SEQ ID NO: 1853578 - RNA, 15 nt, Homo sapiens
ugucaaaaaccagaa

SEQ ID NO: 1853579 - RNA, 13 nt, Homo sapiens
gcuucaagugccu

SEQ ID NO: 1853580 - RNA, 12 nt, Homo sapiens
guauacaguccu

SEQ ID NO: 1853581 - RNA, 12 nt, Homo sapiens
uguggugacauu

SEQ ID NO: 1853582 - RNA, 15 nt, Homo sapiens
uuuugcaaucugugu

SEQ ID NO: 1853583 - RNA, 17 nt, Homo sapiens
cuacgccacuccacaaa

SEQ ID NO: 1853584 - RNA, 19 nt, Homo sapiens
gucuuccugacacuuuaau

SEQ ID NO: 1853585 - RNA, 14 nt, Homo sapiens
aaugucuauauuau

SEQ ID NO: 1853586 - RNA, 15 nt, Homo sapiens
caagagccugagagu

SEQ ID NO: 1853587 - RNA, 18 nt, Homo sapiens
ugcaaguuuucaguacaa

SEQ ID NO: 1853588 - RNA, 14 nt, Homo sapiens
gcacaaaguuuacu

SEQ ID NO: 1853589 - RNA, 22 nt, Homo sapiens
ggccaagaggaaaaacagggaa

SEQ ID NO: 1853590 - RNA, 17 nt, Homo sapiens
aaucauucuacugaaca

SEQ ID NO: 1853591 - RNA, 13 nt, Homo sapiens
aaaguaucuuuaa

SEQ ID NO: 1853592 - RNA, 22 nt, Homo sapiens
gaagugagggcucacucagcca

SEQ ID NO: 1853593 - RNA, 11 nt, Homo sapiens
uggacuuccaa

SEQ ID NO: 1853594 - RNA, 18 nt, Homo sapiens
gcagaaguauaaagugau

SEQ ID NO: 1853595 - RNA, 15 nt, Homo sapiens
ggcaguuuagugcau

SEQ ID NO: 1853596 - RNA, 15 nt, Homo sapiens
ugcaaacgcuguauu

SEQ ID NO: 1853597 - RNA, 18 nt, Homo sapiens
uggaaagaugaaugcaau

SEQ ID NO: 1853598 - RNA, 14 nt, Homo sapiens
cauuuccagacaaa

SEQ ID NO: 1853599 - RNA, 20 nt, Homo sapiens
agugacagagcaagacccca

SEQ ID NO: 1853600 - RNA, 18 nt, Homo sapiens
aagucuggagcacccuga

SEQ ID NO: 1853601 - RNA, 15 nt, Homo sapiens
uugcaggacccugau

SEQ ID NO: 1853602 - RNA, 19 nt, Homo sapiens
uacaugugccgaaugugca

SEQ ID NO: 1853603 - RNA, 21 nt, Homo sapiens
guuugcuuuggaaauccucua

SEQ ID NO: 1853604 - RNA, 14 nt, Homo sapiens
aguuuauccauccu

SEQ ID NO: 1853605 - RNA, 16 nt, Homo sapiens
acgggcaucauucucu

SEQ ID NO: 1853606 - RNA, 19 nt, Homo sapiens
agcaaaccgcccugcagca

SEQ ID NO: 1853607 - RNA, 14 nt, Homo sapiens
uguauuaugagcca

SEQ ID NO: 1853608 - RNA, 14 nt, Homo sapiens
uaagaaauacucau

SEQ ID NO: 1853609 - RNA, 17 nt, Homo sapiens
cugauuucaaaugcagu

SEQ ID NO: 1853610 - RNA, 23 nt, Homo sapiens
ucuguagacugaauucagcacca

SEQ ID NO: 1853611 - RNA, 15 nt, Homo sapiens
ggcucaacuagggag

SEQ ID NO: 1853612 - RNA, 15 nt, Homo sapiens
uuaaaaaauucuugu

SEQ ID NO: 1853613 - RNA, 23 nt, Homo sapiens
uguuauuauauuccguagguaga

SEQ ID NO: 1853614 - RNA, 12 nt, Homo sapiens
uuauuuacauuu

SEQ ID NO: 1853615 - RNA, 16 nt, Homo sapiens
gugcaaggaccaaagg

SEQ ID NO: 1853616 - RNA, 16 nt, Homo sapiens
gugccagcaccacagc

SEQ ID NO: 1853617 - RNA, 13 nt, Homo sapiens
caguacaguacuc

SEQ ID NO: 1853618 - RNA, 19 nt, Homo sapiens
uguaucuagccuggaacca

SEQ ID NO: 1853619 - RNA, 16 nt, Homo sapiens
auuuuagugacagagu

SEQ ID NO: 1853620 - RNA, 17 nt, Homo sapiens
gcacauuuuccacggaa

SEQ ID NO: 1853621 - RNA, 20 nt, Homo sapiens
acuuuauuguacagacuguu

SEQ ID NO: 1853622 - RNA, 22 nt, Homo sapiens
uuacuaacacgcauuguacacu

SEQ ID NO: 1853623 - RNA, 14 nt, Homo sapiens
aggcaacauuacaa

SEQ ID NO: 1853624 - RNA, 15 nt, Homo sapiens
caucacuguauccau

SEQ ID NO: 1853625 - RNA, 11 nt, Homo sapiens
uggagcuguca

SEQ ID NO: 1853626 - RNA, 21 nt, Homo sapiens
uuuaaacaugauuaucuugau

SEQ ID NO: 1853627 - RNA, 12 nt, Homo sapiens
aggcagcacaga

SEQ ID NO: 1853628 - RNA, 12 nt, Homo sapiens
aggaagcacagc

SEQ ID NO: 1853629 - RNA, 18 nt, Homo sapiens
ucuaauuaaacuaaagag

SEQ ID NO: 1853630 - RNA, 15 nt, Homo sapiens
uggauaaauagauac

SEQ ID NO: 1853631 - RNA, 21 nt, Homo sapiens
cuggggggacccagugcagaa

SEQ ID NO: 1853632 - RNA, 19 nt, Homo sapiens
gccgacugccugugaagug

SEQ ID NO: 1853633 - RNA, 22 nt, Homo sapiens
caaaugauccuuccuacuuugc

SEQ ID NO: 1853634 - RNA, 19 nt, Homo sapiens
cacuucuaaaugaagugca

SEQ ID NO: 1853635 - RNA, 18 nt, Homo sapiens
gaacaugcuuuuacuuua

SEQ ID NO: 1853636 - RNA, 15 nt, Homo sapiens
acagcccagagccug

SEQ ID NO: 1853637 - RNA, 15 nt, Homo sapiens
ccuaggcauuugcug

SEQ ID NO: 1853638 - RNA, 19 nt, Homo sapiens
agagcugcacagcaaaaga

SEQ ID NO: 1853639 - RNA, 14 nt, Homo sapiens
ucuuuggugaacau

SEQ ID NO: 1853640 - RNA, 21 nt, Homo sapiens
uguuuauggggcucucacaga

SEQ ID NO: 1853641 - RNA, 19 nt, Homo sapiens
accaaauauuugaaaggau

SEQ ID NO: 1853642 - RNA, 12 nt, Homo sapiens
auuuagugucuu

SEQ ID NO: 1853643 - RNA, 19 nt, Homo sapiens
cugagcagaauacuggucu

SEQ ID NO: 1853644 - RNA, 12 nt, Homo sapiens
ccagucuuccac

SEQ ID NO: 1853645 - RNA, 22 nt, Homo sapiens
gcccagccccuagaaacccaag

SEQ ID NO: 1853646 - RNA, 16 nt, Homo sapiens
aaugucacugccaacg

SEQ ID NO: 1853647 - RNA, 17 nt, Homo sapiens
auauaaaguaccgcuua

SEQ ID NO: 1853648 - RNA, 14 nt, Homo sapiens
uguuuaggugccuc

SEQ ID NO: 1853649 - RNA, 17 nt, Homo sapiens
gaucuugaauagucuca

SEQ ID NO: 1853650 - RNA, 16 nt, Homo sapiens
uauauguacagcucuc

SEQ ID NO: 1853651 - RNA, 16 nt, Homo sapiens
cauccagagaccaaau

SEQ ID NO: 1853652 - RNA, 16 nt, Homo sapiens
ucauauucgauguacu

SEQ ID NO: 1853653 - RNA, 19 nt, Homo sapiens
cuugcuagacacacuccau

SEQ ID NO: 1853654 - RNA, 24 nt, Homo sapiens
aacuuagaaggauggcaucuccau

SEQ ID NO: 1853655 - RNA, 14 nt, Homo sapiens
gucaguaauuuaua

SEQ ID NO: 1853656 - RNA, 21 nt, Homo sapiens
uuaacacgugaauauuuugcu

SEQ ID NO: 1853657 - RNA, 23 nt, Homo sapiens
uugcuucccguucagcgucacau

SEQ ID NO: 1853658 - RNA, 20 nt, Homo sapiens
ccuccgaaguagcugggauu

SEQ ID NO: 1853659 - RNA, 22 nt, Homo sapiens
augagucccauuugccuugcaa

SEQ ID NO: 1853660 - RNA, 23 nt, Homo sapiens
aaguaagcagaugggaacugaau

SEQ ID NO: 1853661 - RNA, 18 nt, Homo sapiens
acagggccaugugcugcc

SEQ ID NO: 1853662 - RNA, 17 nt, Homo sapiens
aaacuggaaaaucuucu

SEQ ID NO: 1853663 - RNA, 16 nt, Homo sapiens
uggagaaucuuacaga

SEQ ID NO: 1853664 - RNA, 19 nt, Homo sapiens
cuuggaguuugcauucuua

SEQ ID NO: 1853665 - RNA, 22 nt, Homo sapiens
aaaugcagucuuaccaaugacu

SEQ ID NO: 1853666 - RNA, 20 nt, Homo sapiens
cagccaggaaauagcgguga

SEQ ID NO: 1853667 - RNA, 22 nt, Homo sapiens
ucugagccccugggacugcugc

SEQ ID NO: 1853668 - RNA, 21 nt, Homo sapiens
ugucaauaaaaccacuguaca

SEQ ID NO: 1853669 - RNA, 17 nt, Homo sapiens
aaauucacuguugaaug

SEQ ID NO: 1853670 - RNA, 16 nt, Homo sapiens
gggagucccugggccu

SEQ ID NO: 1853671 - RNA, 17 nt, Homo sapiens
uuuuacucuuaugauca

SEQ ID NO: 1853672 - RNA, 13 nt, Homo sapiens
ugcucucugucag

SEQ ID NO: 1853673 - RNA, 23 nt, Homo sapiens
cccucggugaugcggacaucuca

SEQ ID NO: 1853674 - RNA, 14 nt, Homo sapiens
gcauuccugaaggg

SEQ ID NO: 1853675 - RNA, 19 nt, Homo sapiens
uaacuccuagcugacucag

SEQ ID NO: 1853676 - RNA, 15 nt, Homo sapiens
cuuaaucuguuuauu

SEQ ID NO: 1853677 - RNA, 23 nt, Homo sapiens
aauagacauauuaacaugcuuau

SEQ ID NO: 1853678 - RNA, 22 nt, Homo sapiens
caguaguauaauguaugaauuu

SEQ ID NO: 1853679 - RNA, 11 nt, Homo sapiens
uuuaugcauuu

SEQ ID NO: 1853680 - RNA, 11 nt, Homo sapiens
cacaugcacac

SEQ ID NO: 1853681 - RNA, 18 nt, Homo sapiens
acaggcgcugaguaugga

SEQ ID NO: 1853682 - RNA, 14 nt, Homo sapiens
cgcauuucucaugc

SEQ ID NO: 1853683 - RNA, 19 nt, Homo sapiens
cacgggguuacacuguuaa

SEQ ID NO: 1853684 - RNA, 13 nt, Homo sapiens
acucacaugacac

SEQ ID NO: 1853685 - RNA, 18 nt, Homo sapiens
gcucaaagaguggcuuga

SEQ ID NO: 1853686 - RNA, 12 nt, Homo sapiens
agaaacacuuga

SEQ ID NO: 1853687 - RNA, 16 nt, Homo sapiens
gccgccggcugugcag

SEQ ID NO: 1853688 - RNA, 18 nt, Homo sapiens
gaggcugucuucucaggc

SEQ ID NO: 1853689 - RNA, 14 nt, Homo sapiens
gacuuacuugcauu

SEQ ID NO: 1853690 - RNA, 20 nt, Homo sapiens
cagaaucccccaaagaacca

SEQ ID NO: 1853691 - RNA, 14 nt, Homo sapiens
acucagcauuguga

SEQ ID NO: 1853692 - RNA, 14 nt, Homo sapiens
caaagcauuugcaa

SEQ ID NO: 1853693 - RNA, 12 nt, Homo sapiens
ucuacagugaua

SEQ ID NO: 1853694 - RNA, 19 nt, Homo sapiens
cuuguucuggcugucacca

SEQ ID NO: 1853695 - RNA, 10 nt, Homo sapiens
ggggcuuccu

SEQ ID NO: 1853696 - RNA, 16 nt, Homo sapiens
accagagcgauguguu

SEQ ID NO: 1853697 - RNA, 20 nt, Homo sapiens
cuuaaguauugucaccagga

SEQ ID NO: 1853698 - RNA, 22 nt, Homo sapiens
uuuuaaccuaauaucacuuaaa

SEQ ID NO: 1853699 - RNA, 22 nt, Homo sapiens
ucaagcaauucuccugccuuag

SEQ ID NO: 1853700 - RNA, 16 nt, Homo sapiens
ucuuagauucagggga

SEQ ID NO: 1853701 - RNA, 13 nt, Homo sapiens
cugcucugcuaua

SEQ ID NO: 1853702 - RNA, 21 nt, Homo sapiens
cacaagacuggcccagugcca

SEQ ID NO: 1853703 - RNA, 14 nt, Homo sapiens
ggugggggugggca

SEQ ID NO: 1853704 - RNA, 19 nt, Homo sapiens
gcuuuaggcagagccauaa

SEQ ID NO: 1853705 - RNA, 16 nt, Homo sapiens
aaacuaguuacuaaac

SEQ ID NO: 1853706 - RNA, 22 nt, Homo sapiens
aacccugccugccgcugcaccu

SEQ ID NO: 1853707 - RNA, 23 nt, Homo sapiens
ugccugggaauccugcugccaga

SEQ ID NO: 1853708 - RNA, 14 nt, Homo sapiens
augaggccaugcaa

SEQ ID NO: 1853709 - RNA, 17 nt, Homo sapiens
auaagugcucaguauug

SEQ ID NO: 1853710 - RNA, 16 nt, Homo sapiens
aguaucacgauuugca

SEQ ID NO: 1853711 - RNA, 21 nt, Homo sapiens
guucccagcucagugccaaag

SEQ ID NO: 1853712 - RNA, 20 nt, Homo sapiens
cucaagccccauuuccucac

SEQ ID NO: 1853713 - RNA, 12 nt, Homo sapiens
aguugcuccuac

SEQ ID NO: 1853714 - RNA, 17 nt, Homo sapiens
caugccaguaacaggcu

SEQ ID NO: 1853715 - RNA, 23 nt, Homo sapiens
uuccugcgcauggugcagugccg

SEQ ID NO: 1853716 - RNA, 20 nt, Homo sapiens
agcacuuugaaauaccucau

SEQ ID NO: 1853717 - RNA, 13 nt, Homo sapiens
gcagacuaugaau

SEQ ID NO: 1853718 - RNA, 17 nt, Homo sapiens
cauaaaucugucugauu

SEQ ID NO: 1853719 - RNA, 16 nt, Homo sapiens
auaaaguguugaacau

SEQ ID NO: 1853720 - RNA, 21 nt, Homo sapiens
augggcgaugucacucagccc

SEQ ID NO: 1853721 - RNA, 16 nt, Homo sapiens
uuauacaaaagagcau

SEQ ID NO: 1853722 - RNA, 17 nt, Homo sapiens
cucaggggacacuggcc

SEQ ID NO: 1853723 - RNA, 14 nt, Homo sapiens
ugagaaugugccau

SEQ ID NO: 1853724 - RNA, 14 nt, Homo sapiens
auugcaugccaucu

SEQ ID NO: 1853725 - RNA, 22 nt, Homo sapiens
ucucuauuauguuaucauccuc

SEQ ID NO: 1853726 - RNA, 15 nt, Homo sapiens
aguagagcauaccac

SEQ ID NO: 1853727 - RNA, 19 nt, Homo sapiens
cuaccugcuuggucuuuca

SEQ ID NO: 1853728 - RNA, 17 nt, Homo sapiens
gcucucgggacuagcug

SEQ ID NO: 1853729 - RNA, 23 nt, Homo sapiens
uggguuaggguguguguucaccu

SEQ ID NO: 1853730 - RNA, 23 nt, Homo sapiens
auggcuuuuuuuuguagccaguc

SEQ ID NO: 1853731 - RNA, 15 nt, Homo sapiens
gcuaauaaaguccua

SEQ ID NO: 1853732 - RNA, 21 nt, Homo sapiens
gguaaggugugaaccuaccug

SEQ ID NO: 1853733 - RNA, 13 nt, Homo sapiens
ucuucacagucac

SEQ ID NO: 1853734 - RNA, 23 nt, Homo sapiens
uggauuacuauugcaaaagggaa

SEQ ID NO: 1853735 - RNA, 14 nt, Homo sapiens
caucagaaguuugc

SEQ ID NO: 1853736 - RNA, 14 nt, Homo sapiens
aagaagcgagaugu

SEQ ID NO: 1853737 - RNA, 21 nt, Homo sapiens
aauguuuucauuauguucaug

SEQ ID NO: 1853738 - RNA, 20 nt, Homo sapiens
accccaauuaacugaagcaa

SEQ ID NO: 1853739 - RNA, 14 nt, Homo sapiens
auauuugcugcaaa

SEQ ID NO: 1853740 - RNA, 17 nt, Homo sapiens
caaggcugcacagcuca

SEQ ID NO: 1853741 - RNA, 14 nt, Homo sapiens
gcagcaacucccac

SEQ ID NO: 1853742 - RNA, 19 nt, Homo sapiens
accaguuugcccauucucu

SEQ ID NO: 1853743 - RNA, 18 nt, Homo sapiens
cuucuaaguguacuucau

SEQ ID NO: 1853744 - RNA, 22 nt, Homo sapiens
uaaauaucccagagaacaauca

SEQ ID NO: 1853745 - RNA, 20 nt, Homo sapiens
ugcuuaucugaaaugcuuga

SEQ ID NO: 1853746 - RNA, 19 nt, Homo sapiens
ccuucaaaggccaagagaa

SEQ ID NO: 1853747 - RNA, 19 nt, Homo sapiens
aucccaugauuuuuccacu

SEQ ID NO: 1853748 - RNA, 20 nt, Homo sapiens
cugccucagcugcaucugau

SEQ ID NO: 1853749 - RNA, 15 nt, Homo sapiens
ccaaugaaauacuga

SEQ ID NO: 1853750 - RNA, 15 nt, Homo sapiens
acugaagaugcagcu

SEQ ID NO: 1853751 - RNA, 14 nt, Homo sapiens
ggcccccaccucug

SEQ ID NO: 1853752 - RNA, 17 nt, Homo sapiens
ugaagcucuaauuuaau

SEQ ID NO: 1853753 - RNA, 19 nt, Homo sapiens
accacagacucaaugugcu

SEQ ID NO: 1853754 - RNA, 21 nt, Homo sapiens
gagcaucuguuuaccuggcag

SEQ ID NO: 1853755 - RNA, 15 nt, Homo sapiens
ugugaccauuuauaa

SEQ ID NO: 1853756 - RNA, 14 nt, Homo sapiens
aagcgaacaucuuc

SEQ ID NO: 1853757 - RNA, 21 nt, Homo sapiens
aauaguauuugagaguucuaa

SEQ ID NO: 1853758 - RNA, 14 nt, Homo sapiens
ccaaucuuuccuac

SEQ ID NO: 1853759 - RNA, 14 nt, Homo sapiens
guguuaagugacau

SEQ ID NO: 1853760 - RNA, 13 nt, Homo sapiens
auucauguugccu

SEQ ID NO: 1853761 - RNA, 16 nt, Homo sapiens
gccuggggcaucccag

SEQ ID NO: 1853762 - RNA, 13 nt, Homo sapiens
uuuuaacgggaaa

SEQ ID NO: 1853763 - RNA, 18 nt, Homo sapiens
caugcaaagcaacgacua

SEQ ID NO: 1853764 - RNA, 15 nt, Homo sapiens
cuguggaaagcuuug

SEQ ID NO: 1853765 - RNA, 19 nt, Homo sapiens
caaaggagacuuaauuuca

SEQ ID NO: 1853766 - RNA, 16 nt, Homo sapiens
ucggauuaccaaaaca

SEQ ID NO: 1853767 - RNA, 14 nt, Homo sapiens
cgagcacccucauc

SEQ ID NO: 1853768 - RNA, 19 nt, Homo sapiens
ucucggggaugcauagauu

SEQ ID NO: 1853769 - RNA, 13 nt, Homo sapiens
aguauugagauac

SEQ ID NO: 1853770 - RNA, 20 nt, Homo sapiens
uacauguugggcaugauucu

SEQ ID NO: 1853771 - RNA, 10 nt, Homo sapiens
aaauugccau

SEQ ID NO: 1853772 - RNA, 13 nt, Homo sapiens
cagccaccaucug

SEQ ID NO: 1853773 - RNA, 12 nt, Homo sapiens
ucauucuagcac

SEQ ID NO: 1853774 - RNA, 12 nt, Homo sapiens
uaacucuagaau

SEQ ID NO: 1853775 - RNA, 22 nt, Homo sapiens
aaugcgcugaucguuucuucca

SEQ ID NO: 1853776 - RNA, 23 nt, Homo sapiens
agggcgccucaccugcucuucaa

SEQ ID NO: 1853777 - RNA, 15 nt, Homo sapiens
accuacugcacugag

SEQ ID NO: 1853778 - RNA, 14 nt, Homo sapiens
uaaugucaggguca

SEQ ID NO: 1853779 - RNA, 20 nt, Homo sapiens
guaaggcaggcccauucaga

SEQ ID NO: 1853780 - RNA, 13 nt, Homo sapiens
auccgggaggaca

SEQ ID NO: 1853781 - RNA, 17 nt, Homo sapiens
ugcccugcccaugggag

SEQ ID NO: 1853782 - RNA, 17 nt, Homo sapiens
gcagaguuacaguucug

SEQ ID NO: 1853783 - RNA, 16 nt, Homo sapiens
gaggcaggagggcaug

SEQ ID NO: 1853784 - RNA, 18 nt, Homo sapiens
cucuggcccuuugaauau

SEQ ID NO: 1853785 - RNA, 23 nt, Homo sapiens
ccauacuguuugcccauuuucau

SEQ ID NO: 1853786 - RNA, 23 nt, Homo sapiens
auaaagcauguuugguuuuccaa

SEQ ID NO: 1853787 - RNA, 20 nt, Homo sapiens
aggauggaagaaagaagcau

SEQ ID NO: 1853788 - RNA, 22 nt, Homo sapiens
aauuuaucuuuaccaaaaacca

SEQ ID NO: 1853789 - RNA, 13 nt, Homo sapiens
ugguacaauccuu

SEQ ID NO: 1853790 - RNA, 20 nt, Homo sapiens
agugcugggauuacaggugu

SEQ ID NO: 1853791 - RNA, 14 nt, Homo sapiens
ugggcaccagcuca

SEQ ID NO: 1853792 - RNA, 14 nt, Homo sapiens
aguauuuuugccaa

SEQ ID NO: 1853793 - RNA, 15 nt, Homo sapiens
caguucugcaaagau

SEQ ID NO: 1853794 - RNA, 15 nt, Homo sapiens
gcuauccagugacuu

SEQ ID NO: 1853795 - RNA, 16 nt, Homo sapiens
gccaggggaguuccug

SEQ ID NO: 1853796 - RNA, 14 nt, Homo sapiens
accuucugaugaag

SEQ ID NO: 1853797 - RNA, 16 nt, Homo sapiens
gucacugacacaaagg

SEQ ID NO: 1853798 - RNA, 20 nt, Homo sapiens
ucccuggugccucugugcac

SEQ ID NO: 1853799 - RNA, 13 nt, Homo sapiens
augaacacuuaau

SEQ ID NO: 1853800 - RNA, 19 nt, Homo sapiens
aacuuuuuuuucucucuuu

SEQ ID NO: 1853801 - RNA, 14 nt, Homo sapiens
caaaaaaccucacu

SEQ ID NO: 1853802 - RNA, 19 nt, Homo sapiens
ucagacagcugccugggau

SEQ ID NO: 1853803 - RNA, 22 nt, Homo sapiens
ucaucaagaauuuaaugauuaa

SEQ ID NO: 1853804 - RNA, 22 nt, Homo sapiens
auuauaugacaauccugaagaa

SEQ ID NO: 1853805 - RNA, 19 nt, Homo sapiens
gaccagggauuuccaugau

SEQ ID NO: 1853806 - RNA, 22 nt, Homo sapiens
aguacucauaaaggacacugga

SEQ ID NO: 1853807 - RNA, 18 nt, Homo sapiens
acuaguggggcuuaauga

SEQ ID NO: 1853808 - RNA, 15 nt, Homo sapiens
gaaaaguagagcaau

SEQ ID NO: 1853809 - RNA, 15 nt, Homo sapiens
guccagguugaucuu

SEQ ID NO: 1853810 - RNA, 14 nt, Homo sapiens
ucauccuagcaaau

SEQ ID NO: 1853811 - RNA, 21 nt, Homo sapiens
cccaaagauagacagguccug

SEQ ID NO: 1853812 - RNA, 23 nt, Homo sapiens
aucuuuguaauacauguaaauau

SEQ ID NO: 1853813 - RNA, 17 nt, Homo sapiens
aaagaaacuuuauucaa

SEQ ID NO: 1853814 - RNA, 13 nt, Homo sapiens
uccuuuugcaaag

SEQ ID NO: 1853815 - RNA, 22 nt, Homo sapiens
acaucaaagacagcaucuaaga

SEQ ID NO: 1853816 - RNA, 16 nt, Homo sapiens
uuguuuguacaguaau

SEQ ID NO: 1853817 - RNA, 19 nt, Homo sapiens
uucaggagggaaccagcuu

SEQ ID NO: 1853818 - RNA, 15 nt, Homo sapiens
cuggauauuuaguuc

SEQ ID NO: 1853819 - RNA, 17 nt, Homo sapiens
ccugccccugcccgaga

SEQ ID NO: 1853820 - RNA, 20 nt, Homo sapiens
agcucuugguucuacgugga

SEQ ID NO: 1853821 - RNA, 12 nt, Homo sapiens
acgagcagggau

SEQ ID NO: 1853822 - RNA, 16 nt, Homo sapiens
acugcauuuacagugu

SEQ ID NO: 1853823 - RNA, 23 nt, Homo sapiens
guccaaggcuauauuucugggau

SEQ ID NO: 1853824 - RNA, 18 nt, Homo sapiens
gacuagagcuuucuuuca

SEQ ID NO: 1853825 - RNA, 19 nt, Homo sapiens
cccagcgucugcaggguga

SEQ ID NO: 1853826 - RNA, 15 nt, Homo sapiens
cagauucagccucag

SEQ ID NO: 1853827 - RNA, 21 nt, Homo sapiens
auaucccuuucucucuugucc

SEQ ID NO: 1853828 - RNA, 17 nt, Homo sapiens
agggaugauucaagcca

SEQ ID NO: 1853829 - RNA, 22 nt, Homo sapiens
ggcaagucaccugcagcccaug

SEQ ID NO: 1853830 - RNA, 17 nt, Homo sapiens
uuguaccgcaaugugac

SEQ ID NO: 1853831 - RNA, 17 nt, Homo sapiens
ggcugaugguguggccu

SEQ ID NO: 1853832 - RNA, 14 nt, Homo sapiens
aagaucuacuacau

SEQ ID NO: 1853833 - RNA, 13 nt, Homo sapiens
gaggaaugcuccc

SEQ ID NO: 1853834 - RNA, 13 nt, Homo sapiens
cacgcauggugca

SEQ ID NO: 1853835 - RNA, 21 nt, Homo sapiens
cagccguccuucuaaugaaga

SEQ ID NO: 1853836 - RNA, 18 nt, Homo sapiens
acaguuuacuuugccaac

SEQ ID NO: 1853837 - RNA, 19 nt, Homo sapiens
ccucuccacgcacucagcu

SEQ ID NO: 1853838 - RNA, 16 nt, Homo sapiens
cacuggcugccuccac

SEQ ID NO: 1853839 - RNA, 13 nt, Homo sapiens
cgaucaguggugu

SEQ ID NO: 1853840 - RNA, 21 nt, Homo sapiens
cauccacuggguguaaacaca

SEQ ID NO: 1853841 - RNA, 13 nt, Homo sapiens
ggauauuugcacu

SEQ ID NO: 1853842 - RNA, 19 nt, Homo sapiens
acggugcguuuggccaaaa

SEQ ID NO: 1853843 - RNA, 18 nt, Homo sapiens
ggcaaaacaaaaguacau

SEQ ID NO: 1853844 - RNA, 12 nt, Homo sapiens
gcaucacugccu

SEQ ID NO: 1853845 - RNA, 12 nt, Homo sapiens
gccucacugcau

SEQ ID NO: 1853846 - RNA, 17 nt, Homo sapiens
uggugacugaaacauuc

SEQ ID NO: 1853847 - RNA, 23 nt, Homo sapiens
caggggagcccggagcuuugcaa

SEQ ID NO: 1853848 - RNA, 13 nt, Homo sapiens
aagcaacuggaaa

SEQ ID NO: 1853849 - RNA, 20 nt, Homo sapiens
uaagguguugguguauuugc

SEQ ID NO: 1853850 - RNA, 19 nt, Homo sapiens
caccugggacccugcacag

SEQ ID NO: 1853851 - RNA, 17 nt, Homo sapiens
agaucuaaucccuucaa

SEQ ID NO: 1853852 - RNA, 14 nt, Homo sapiens
auagccauuugccc

SEQ ID NO: 1853853 - RNA, 17 nt, Homo sapiens
gaccuaugagcacauag

SEQ ID NO: 1853854 - RNA, 15 nt, Homo sapiens
uuccuucacauuuaa

SEQ ID NO: 1853855 - RNA, 20 nt, Homo sapiens
ccaguugcccagagcacuuu

SEQ ID NO: 1853856 - RNA, 17 nt, Homo sapiens
uacaccauuaugugcgc

SEQ ID NO: 1853857 - RNA, 13 nt, Homo sapiens
auggauacauaaa

SEQ ID NO: 1853858 - RNA, 17 nt, Homo sapiens
gagacggccaagugaag

SEQ ID NO: 1853859 - RNA, 15 nt, Homo sapiens
augcuggcaaaucca

SEQ ID NO: 1853860 - RNA, 21 nt, Homo sapiens
gcacaaagcucaagaugacag

SEQ ID NO: 1853861 - RNA, 22 nt, Homo sapiens
uaaagacuaguuuacaaaggag

SEQ ID NO: 1853862 - RNA, 14 nt, Homo sapiens
ugaauguaccucua

SEQ ID NO: 1853863 - RNA, 14 nt, Homo sapiens
auuucugacucuau

SEQ ID NO: 1853864 - RNA, 18 nt, Homo sapiens
uggcagaacgaugccugc

SEQ ID NO: 1853865 - RNA, 15 nt, Homo sapiens
ggccaguagcugcca

SEQ ID NO: 1853866 - RNA, 19 nt, Homo sapiens
acaaacauagacagaugug

SEQ ID NO: 1853867 - RNA, 15 nt, Homo sapiens
auagauaagucaaua

SEQ ID NO: 1853868 - RNA, 15 nt, Homo sapiens
aggacucaccacugc

SEQ ID NO: 1853869 - RNA, 16 nt, Homo sapiens
caacacuugaacucag

SEQ ID NO: 1853870 - RNA, 14 nt, Homo sapiens
cuauauaagacaag

SEQ ID NO: 1853871 - RNA, 17 nt, Homo sapiens
acaucguugagacauca

SEQ ID NO: 1853872 - RNA, 16 nt, Homo sapiens
uuaggggaacccuguc

SEQ ID NO: 1853873 - RNA, 20 nt, Homo sapiens
uugcccauuguuuuucugau

SEQ ID NO: 1853874 - RNA, 17 nt, Homo sapiens
cauuuucaauaauguga

SEQ ID NO: 1853875 - RNA, 19 nt, Homo sapiens
ucauuaugcagcugagguc

SEQ ID NO: 1853876 - RNA, 16 nt, Homo sapiens
cugcaucagugacuga

SEQ ID NO: 1853877 - RNA, 16 nt, Homo sapiens
ugacaacaaccuaugc

SEQ ID NO: 1853878 - RNA, 19 nt, Homo sapiens
cccccagacagcugcucag

SEQ ID NO: 1853879 - RNA, 15 nt, Homo sapiens
cuuccugucuggccc

SEQ ID NO: 1853880 - RNA, 18 nt, Homo sapiens
aauguacuuaaauuacac

SEQ ID NO: 1853881 - RNA, 14 nt, Homo sapiens
uccugcggcucagc

SEQ ID NO: 1853882 - RNA, 14 nt, Homo sapiens
ucuaauggcuuuau

SEQ ID NO: 1853883 - RNA, 17 nt, Homo sapiens
uggcacuuauaaccaaa

SEQ ID NO: 1853884 - RNA, 15 nt, Homo sapiens
uccauuguguucucu

SEQ ID NO: 1853885 - RNA, 20 nt, Homo sapiens
ucugugguuuauaaucuugc

SEQ ID NO: 1853886 - RNA, 18 nt, Homo sapiens
ugcagauggcagugcagc

SEQ ID NO: 1853887 - RNA, 18 nt, Homo sapiens
cgaacauggcaugugaaa

SEQ ID NO: 1853888 - RNA, 17 nt, Homo sapiens
cugacugaguagcucau

SEQ ID NO: 1853889 - RNA, 13 nt, Homo sapiens
gacucuucagucu

SEQ ID NO: 1853890 - RNA, 16 nt, Homo sapiens
ccuguccccaccucca

SEQ ID NO: 1853891 - RNA, 16 nt, Homo sapiens
auuugaaacacugguu

SEQ ID NO: 1853892 - RNA, 23 nt, Homo sapiens
acccaagucugaacguggaauuc

SEQ ID NO: 1853893 - RNA, 22 nt, Homo sapiens
accacaccaaccaggccuucau

SEQ ID NO: 1853894 - RNA, 14 nt, Homo sapiens
uggacccugcugaa

SEQ ID NO: 1853895 - RNA, 16 nt, Homo sapiens
gaaaagaaagcugcuu

SEQ ID NO: 1853896 - RNA, 14 nt, Homo sapiens
aagcaugcauucua

SEQ ID NO: 1853897 - RNA, 20 nt, Homo sapiens
agggcagggugggcuuccuc

SEQ ID NO: 1853898 - RNA, 16 nt, Homo sapiens
ugaaaccucuguucuc

SEQ ID NO: 1853899 - RNA, 14 nt, Homo sapiens
ugcgacaggcauuu

SEQ ID NO: 1853900 - RNA, 22 nt, Homo sapiens
uccguaggccuuaaaucugccu

SEQ ID NO: 1853901 - RNA, 16 nt, Homo sapiens
uugcaacuaaggacaa

SEQ ID NO: 1853902 - RNA, 21 nt, Homo sapiens
uucacuuuuuacagugcuauu

SEQ ID NO: 1853903 - RNA, 22 nt, Homo sapiens
accucuguggucacccaugcau

SEQ ID NO: 1853904 - RNA, 19 nt, Homo sapiens
ugucugacuacaacaugca

SEQ ID NO: 1853905 - RNA, 14 nt, Homo sapiens
cugugcugcaugcg

SEQ ID NO: 1853906 - RNA, 22 nt, Homo sapiens
caauucccccauccuucaguga

SEQ ID NO: 1853907 - RNA, 16 nt, Homo sapiens
cgggauuuaugugcac

SEQ ID NO: 1853908 - RNA, 16 nt, Homo sapiens
agcggugccacugagg

SEQ ID NO: 1853909 - RNA, 15 nt, Homo sapiens
cagcuugaauuucaa

SEQ ID NO: 1853910 - RNA, 21 nt, Homo sapiens
cacaguagaacugucugugaa

SEQ ID NO: 1853911 - RNA, 16 nt, Homo sapiens
ugaucgggaagcccuu

SEQ ID NO: 1853912 - RNA, 19 nt, Homo sapiens
aaaucucccaugugcauaa

SEQ ID NO: 1853913 - RNA, 22 nt, Homo sapiens
ucccggcuccccucccagggga

SEQ ID NO: 1853914 - RNA, 23 nt, Homo sapiens
auucauccuuuaaguagggaugu

SEQ ID NO: 1853915 - RNA, 16 nt, Homo sapiens
gcuuagcugucucaga

SEQ ID NO: 1853916 - RNA, 17 nt, Homo sapiens
ccagucauuauguuaau

SEQ ID NO: 1853917 - RNA, 14 nt, Homo sapiens
uuuaucacuguugc

SEQ ID NO: 1853918 - RNA, 23 nt, Homo sapiens
aaggucucauuaucuccaugaua

SEQ ID NO: 1853919 - RNA, 14 nt, Homo sapiens
uacaggcacgugcc

SEQ ID NO: 1853920 - RNA, 20 nt, Homo sapiens
cuguuaccauucacaauaaa

SEQ ID NO: 1853921 - RNA, 19 nt, Homo sapiens
agccucucgaagugcugag

SEQ ID NO: 1853922 - RNA, 17 nt, Homo sapiens
uaucuugaauaauguaa

SEQ ID NO: 1853923 - RNA, 12 nt, Homo sapiens
gcaaacuggccg

SEQ ID NO: 1853924 - RNA, 23 nt, Homo sapiens
cugauccugcaaggggacauucc

SEQ ID NO: 1853925 - RNA, 17 nt, Homo sapiens
aaaaggagccugugaga

SEQ ID NO: 1853926 - RNA, 21 nt, Homo sapiens
gugccuagacuguuacuuugg

SEQ ID NO: 1853927 - RNA, 16 nt, Homo sapiens
uguacuguuacugugu

SEQ ID NO: 1853928 - RNA, 13 nt, Homo sapiens
acuuaugcugcug

SEQ ID NO: 1853929 - RNA, 20 nt, Homo sapiens
aucaugugggugagccagug

SEQ ID NO: 1853930 - RNA, 17 nt, Homo sapiens
agggcaggggugcugug

SEQ ID NO: 1853931 - RNA, 18 nt, Homo sapiens
gaccccgccugcucuuuc

SEQ ID NO: 1853932 - RNA, 18 nt, Homo sapiens
ggcuuuccucagcaccug

SEQ ID NO: 1853933 - RNA, 16 nt, Homo sapiens
cugcacuuugauguca

SEQ ID NO: 1853934 - RNA, 15 nt, Homo sapiens
cuccacaaccaccuc

SEQ ID NO: 1853935 - RNA, 20 nt, Homo sapiens
ccuggccaauacggcaaaac

SEQ ID NO: 1853936 - RNA, 18 nt, Homo sapiens
ccccacagacaacaguug

SEQ ID NO: 1853937 - RNA, 17 nt, Homo sapiens
gugaccaguggggcccu

SEQ ID NO: 1853938 - RNA, 17 nt, Homo sapiens
acaaugcugccaugccc

SEQ ID NO: 1853939 - RNA, 14 nt, Homo sapiens
acaucaaaugcuca

SEQ ID NO: 1853940 - RNA, 16 nt, Homo sapiens
uaccaguugguauuuc

SEQ ID NO: 1853941 - RNA, 18 nt, Homo sapiens
ugaucacuccagugcacu

SEQ ID NO: 1853942 - RNA, 21 nt, Homo sapiens
gagcugaguaggaggccucca

SEQ ID NO: 1853943 - RNA, 20 nt, Homo sapiens
agaauaaagccuugugauca

SEQ ID NO: 1853944 - RNA, 15 nt, Homo sapiens
caggaccaagccaca

SEQ ID NO: 1853945 - RNA, 14 nt, Homo sapiens
auccauaacugaac

SEQ ID NO: 1853946 - RNA, 22 nt, Homo sapiens
aaagccaucaaacacaaugccu

SEQ ID NO: 1853947 - RNA, 15 nt, Homo sapiens
uuuggugaauaaccu

SEQ ID NO: 1853948 - RNA, 23 nt, Homo sapiens
gcugcuuucuuguugcugcaucu

SEQ ID NO: 1853949 - RNA, 23 nt, Homo sapiens
gguaccuucccccagcuuuccau

SEQ ID NO: 1853950 - RNA, 22 nt, Homo sapiens
gcagaacagcuucauguuccca

SEQ ID NO: 1853951 - RNA, 12 nt, Homo sapiens
cuccaugcacag

SEQ ID NO: 1853952 - RNA, 17 nt, Homo sapiens
acaagauaacugagaau

SEQ ID NO: 1853953 - RNA, 17 nt, Homo sapiens
ucacugaucuugucauu

SEQ ID NO: 1853954 - RNA, 20 nt, Homo sapiens
aaaguggaaaggaucacaga

SEQ ID NO: 1853955 - RNA, 23 nt, Homo sapiens
uaagaacuugauauauuucauuc

SEQ ID NO: 1853956 - RNA, 16 nt, Homo sapiens
acuuuccuucccucuc

SEQ ID NO: 1853957 - RNA, 23 nt, Homo sapiens
ccaggaagcuuuggugagaaccu

SEQ ID NO: 1853958 - RNA, 13 nt, Homo sapiens
augaacccaaaaa

SEQ ID NO: 1853959 - RNA, 14 nt, Homo sapiens
cugagugaaugagu

SEQ ID NO: 1853960 - RNA, 13 nt, Homo sapiens
agaaaaguauuuu

SEQ ID NO: 1853961 - RNA, 17 nt, Homo sapiens
uaaaaguaaugcaauau

SEQ ID NO: 1853962 - RNA, 22 nt, Homo sapiens
cuauccuauuaggauaccacuu

SEQ ID NO: 1853963 - RNA, 17 nt, Homo sapiens
ugacaugggugugccag

SEQ ID NO: 1853964 - RNA, 20 nt, Homo sapiens
aaauguugagggcaagccac

SEQ ID NO: 1853965 - RNA, 21 nt, Homo sapiens
ugagaagaucggaacagcucc

SEQ ID NO: 1853966 - RNA, 17 nt, Homo sapiens
ggauagacuuuucccaa

SEQ ID NO: 1853967 - RNA, 21 nt, Homo sapiens
cuaggagucuucacugcucug

SEQ ID NO: 1853968 - RNA, 20 nt, Homo sapiens
cucuccuuccaacaaaagaa

SEQ ID NO: 1853969 - RNA, 17 nt, Homo sapiens
ccaggguuggcaugacu

SEQ ID NO: 1853970 - RNA, 15 nt, Homo sapiens
aaguccaacuacuaa

SEQ ID NO: 1853971 - RNA, 14 nt, Homo sapiens
agggcuggggccaa

SEQ ID NO: 1853972 - RNA, 16 nt, Homo sapiens
uaauauauacauauuc

SEQ ID NO: 1853973 - RNA, 16 nt, Homo sapiens
uucugcccaucuucca

SEQ ID NO: 1853974 - RNA, 13 nt, Homo sapiens
auuccauggugau

SEQ ID NO: 1853975 - RNA, 19 nt, Homo sapiens
gaaguucucagaauaacua

SEQ ID NO: 1853976 - RNA, 18 nt, Homo sapiens
cccauuucaggugugaga

SEQ ID NO: 1853977 - RNA, 15 nt, Homo sapiens
uucacaaugaaaugc

SEQ ID NO: 1853978 - RNA, 21 nt, Homo sapiens
uuucuuaauagaaagucagau

SEQ ID NO: 1853979 - RNA, 20 nt, Homo sapiens
auuaggaccugguucuggac

SEQ ID NO: 1853980 - RNA, 15 nt, Homo sapiens
ucucaagcuaguguu

SEQ ID NO: 1853981 - RNA, 21 nt, Homo sapiens
gaaacaccccucugucuagga

SEQ ID NO: 1853982 - RNA, 14 nt, Homo sapiens
guguaccacuggga

SEQ ID NO: 1853983 - RNA, 13 nt, Homo sapiens
cagcauaugcaaa

SEQ ID NO: 1853984 - RNA, 15 nt, Homo sapiens
cuggaagcugauuca

SEQ ID NO: 1853985 - RNA, 17 nt, Homo sapiens
cuuaaaagaaaacaaag

SEQ ID NO: 1853986 - RNA, 13 nt, Homo sapiens
aagccaguuuuca

SEQ ID NO: 1853987 - RNA, 17 nt, Homo sapiens
accugccagccaucaca

SEQ ID NO: 1853988 - RNA, 22 nt, Homo sapiens
acucauuugaaugcuuaauuca

SEQ ID NO: 1853989 - RNA, 17 nt, Homo sapiens
aaucuuuucauaauuaa

SEQ ID NO: 1853990 - RNA, 23 nt, Homo sapiens
ugacucacaagaagaccagacug

SEQ ID NO: 1853991 - RNA, 23 nt, Homo sapiens
uacagagaagccaucaccucaga

SEQ ID NO: 1853992 - RNA, 13 nt, Homo sapiens
ggaaaagcaaaac

SEQ ID NO: 1853993 - RNA, 15 nt, Homo sapiens
caaaacuugcaucua

SEQ ID NO: 1853994 - RNA, 22 nt, Homo sapiens
cuucuauuccauggcuaacugg

SEQ ID NO: 1853995 - RNA, 16 nt, Homo sapiens
agucauccucagauca

SEQ ID NO: 1853996 - RNA, 13 nt, Homo sapiens
gagucaacaaauu

SEQ ID NO: 1853997 - RNA, 15 nt, Homo sapiens
auugccaagucagau

SEQ ID NO: 1853998 - RNA, 18 nt, Homo sapiens
accagugugacaucuaca

SEQ ID NO: 1853999 - RNA, 21 nt, Homo sapiens
ucaacagaaguaucaagccau

SEQ ID NO: 1854000 - RNA, 20 nt, Homo sapiens
uacugugcgcgugugugugc

SEQ ID NO: 1854001 - RNA, 17 nt, Homo sapiens
aagggggaccaugggga

SEQ ID NO: 1854002 - RNA, 21 nt, Homo sapiens
auagcuccuucucucuuacau

SEQ ID NO: 1854003 - RNA, 20 nt, Homo sapiens
gucccacgugucuuccacuu

SEQ ID NO: 1854004 - RNA, 19 nt, Homo sapiens
caccuccuccugcugcuca

SEQ ID NO: 1854005 - RNA, 13 nt, Homo sapiens
gcacuaaagccag

SEQ ID NO: 1854006 - RNA, 19 nt, Homo sapiens
aauaaacagcuucaugccu

SEQ ID NO: 1854007 - RNA, 16 nt, Homo sapiens
aauguaauuauuuucc

SEQ ID NO: 1854008 - RNA, 16 nt, Homo sapiens
acauaacuucagauac

SEQ ID NO: 1854009 - RNA, 19 nt, Homo sapiens
gaugcuacucuaguauucc

SEQ ID NO: 1854010 - RNA, 18 nt, Homo sapiens
uaauauaaauaguguaca

SEQ ID NO: 1854011 - RNA, 14 nt, Homo sapiens
ggaauugauguuua

SEQ ID NO: 1854012 - RNA, 16 nt, Homo sapiens
ucacaccccauucuca

SEQ ID NO: 1854013 - RNA, 16 nt, Homo sapiens
uguuaccacagaguuu

SEQ ID NO: 1854014 - RNA, 15 nt, Homo sapiens
uccuggaaccacuga

SEQ ID NO: 1854015 - RNA, 18 nt, Homo sapiens
ucaccugcuggggaccuu

SEQ ID NO: 1854016 - RNA, 20 nt, Homo sapiens
cugcagucugggccccauca

SEQ ID NO: 1854017 - RNA, 20 nt, Homo sapiens
caacuucagaaagacaguga

SEQ ID NO: 1854018 - RNA, 14 nt, Homo sapiens
cuaugugagcucac

SEQ ID NO: 1854019 - RNA, 21 nt, Homo sapiens
aaauauagcaggguaauguaa

SEQ ID NO: 1854020 - RNA, 19 nt, Homo sapiens
ucucagagaccagcacuca

SEQ ID NO: 1854021 - RNA, 15 nt, Homo sapiens
aggagagagccagga

SEQ ID NO: 1854022 - RNA, 22 nt, Homo sapiens
uuggggguccuccuccagggac

SEQ ID NO: 1854023 - RNA, 13 nt, Homo sapiens
cacucagcacucu

SEQ ID NO: 1854024 - RNA, 17 nt, Homo sapiens
caaagccuuauccagca

SEQ ID NO: 1854025 - RNA, 16 nt, Homo sapiens
aaagaauuuuaccauu

SEQ ID NO: 1854026 - RNA, 17 nt, Homo sapiens
gauauuauguauagaaa

SEQ ID NO: 1854027 - RNA, 13 nt, Homo sapiens
cagcaaggccacc

SEQ ID NO: 1854028 - RNA, 16 nt, Homo sapiens
acuguaacaauacugg

SEQ ID NO: 1854029 - RNA, 21 nt, Homo sapiens
uaaaaucuuauaguucuaggc

SEQ ID NO: 1854030 - RNA, 17 nt, Homo sapiens
caucacccaagccacaa

SEQ ID NO: 1854031 - RNA, 14 nt, Homo sapiens
gcccaguguucucc

SEQ ID NO: 1854032 - RNA, 18 nt, Homo sapiens
guuaaguaucagcuacaa

SEQ ID NO: 1854033 - RNA, 13 nt, Homo sapiens
acugugucucaug

SEQ ID NO: 1854034 - RNA, 21 nt, Homo sapiens
cagcuuucucuuuguucuuca

SEQ ID NO: 1854035 - RNA, 22 nt, Homo sapiens
aauaaaucacaggcaucuggaa

SEQ ID NO: 1854036 - RNA, 13 nt, Homo sapiens
auuuuacauacac

SEQ ID NO: 1854037 - RNA, 11 nt, Homo sapiens
uuucuuugauu

SEQ ID NO: 1854038 - RNA, 11 nt, Homo sapiens
uaacuuugaaa

SEQ ID NO: 1854039 - RNA, 11 nt, Homo sapiens
agccuuugugc

SEQ ID NO: 1854040 - RNA, 11 nt, Homo sapiens
aggcuuugugg

SEQ ID NO: 1854041 - RNA, 18 nt, Homo sapiens
gcccgugcccuggugaau

SEQ ID NO: 1854042 - RNA, 14 nt, Homo sapiens
caaauaagaaaccu

SEQ ID NO: 1854043 - RNA, 19 nt, Homo sapiens
ugcuagcagggcauggcac

SEQ ID NO: 1854044 - RNA, 20 nt, Homo sapiens
caccaauucuaaaguagcuu

SEQ ID NO: 1854045 - RNA, 13 nt, Homo sapiens
uguaaagugcaau

SEQ ID NO: 1854046 - RNA, 17 nt, Homo sapiens
caacaugcgaccgugac

SEQ ID NO: 1854047 - RNA, 21 nt, Homo sapiens
aggguuuucaccuuagcaaca

SEQ ID NO: 1854048 - RNA, 15 nt, Homo sapiens
gacacacuguuacac

SEQ ID NO: 1854049 - RNA, 12 nt, Homo sapiens
aauuaugcuuuc

SEQ ID NO: 1854050 - RNA, 22 nt, Homo sapiens
guugaauccacccaaaucuauu

SEQ ID NO: 1854051 - RNA, 19 nt, Homo sapiens
caaaugucuaucaacuuua

SEQ ID NO: 1854052 - RNA, 20 nt, Homo sapiens
auugagcaccugcaggcgug

SEQ ID NO: 1854053 - RNA, 15 nt, Homo sapiens
ucugaauguauuuau

SEQ ID NO: 1854054 - RNA, 18 nt, Homo sapiens
agccugccucaguggcag

SEQ ID NO: 1854055 - RNA, 12 nt, Homo sapiens
uuuuucauggaa

SEQ ID NO: 1854056 - RNA, 20 nt, Homo sapiens
aauuuuuauuuuugcugaga

SEQ ID NO: 1854057 - RNA, 11 nt, Homo sapiens
gagcuuugcau

SEQ ID NO: 1854058 - RNA, 23 nt, Homo sapiens
ugagcaccuacuuacaugcauua

SEQ ID NO: 1854059 - RNA, 20 nt, Homo sapiens
uaauuucaaucaaccaaagu

SEQ ID NO: 1854060 - RNA, 13 nt, Homo sapiens
ccugagagucuga

SEQ ID NO: 1854061 - RNA, 17 nt, Homo sapiens
uacugccggucacccag

SEQ ID NO: 1854062 - RNA, 15 nt, Homo sapiens
gugauggacugggga

SEQ ID NO: 1854063 - RNA, 16 nt, Homo sapiens
ucaugucucacuucac

SEQ ID NO: 1854064 - RNA, 19 nt, Homo sapiens
ugcagauggcaagugcacc

SEQ ID NO: 1854065 - RNA, 19 nt, Homo sapiens
cuagccuauuuaccugcag

SEQ ID NO: 1854066 - RNA, 19 nt, Homo sapiens
uccccuuccuaaauaucca

SEQ ID NO: 1854067 - RNA, 12 nt, Homo sapiens
gaaaacuacagg

SEQ ID NO: 1854068 - RNA, 18 nt, Homo sapiens
ggauaaauugccauaaua

SEQ ID NO: 1854069 - RNA, 11 nt, Homo sapiens
uuugggguccc

SEQ ID NO: 1854070 - RNA, 22 nt, Homo sapiens
aagauguugauuuuuacugugu

SEQ ID NO: 1854071 - RNA, 15 nt, Homo sapiens
agaugcucacuuuau

SEQ ID NO: 1854072 - RNA, 19 nt, Homo sapiens
uaaaugugaaacaucuucu

SEQ ID NO: 1854073 - RNA, 22 nt, Homo sapiens
gcucuucuccauccuaccacaa

SEQ ID NO: 1854074 - RNA, 21 nt, Homo sapiens
ucuuuggggguuagaccacuu

SEQ ID NO: 1854075 - RNA, 14 nt, Homo sapiens
gcucacugcagccu

SEQ ID NO: 1854076 - RNA, 14 nt, Homo sapiens
cuagagucauguga

SEQ ID NO: 1854077 - RNA, 14 nt, Homo sapiens
cuggggucauauaa

SEQ ID NO: 1854078 - RNA, 17 nt, Homo sapiens
ccacuuucaaucuucaa

SEQ ID NO: 1854079 - RNA, 17 nt, Homo sapiens
ucagugcccauguguau

SEQ ID NO: 1854080 - RNA, 14 nt, Homo sapiens
cagaucugauuugu

SEQ ID NO: 1854081 - RNA, 12 nt, Homo sapiens
uaauuauauagu

SEQ ID NO: 1854082 - RNA, 17 nt, Homo sapiens
cucuuguaaauacaugu

SEQ ID NO: 1854083 - RNA, 23 nt, Homo sapiens
cugucuuaaaugagaaguacuug

SEQ ID NO: 1854084 - RNA, 14 nt, Homo sapiens
uucuagcuaccugu

SEQ ID NO: 1854085 - RNA, 22 nt, Homo sapiens
aagaagaggagaaaaaaacuuc

SEQ ID NO: 1854086 - RNA, 12 nt, Homo sapiens
auuaucauccca

SEQ ID NO: 1854087 - RNA, 15 nt, Homo sapiens
caaagggaauacuca

SEQ ID NO: 1854088 - RNA, 18 nt, Homo sapiens
auucaggcagcacugaca

SEQ ID NO: 1854089 - RNA, 23 nt, Homo sapiens
aaugacugaaagaagaacagcug

SEQ ID NO: 1854090 - RNA, 17 nt, Homo sapiens
gaaaucaguagaaagcu

SEQ ID NO: 1854091 - RNA, 18 nt, Homo sapiens
caagucccaaauucauug

SEQ ID NO: 1854092 - RNA, 15 nt, Homo sapiens
auauuggacugauaa

SEQ ID NO: 1854093 - RNA, 19 nt, Homo sapiens
cuaccucccgaccuaccac

SEQ ID NO: 1854094 - RNA, 21 nt, Homo sapiens
uguggagugacucaaaucagu

SEQ ID NO: 1854095 - RNA, 15 nt, Homo sapiens
ugcacugacugugaa

SEQ ID NO: 1854096 - RNA, 18 nt, Homo sapiens
aaauguugagaaucccaa

SEQ ID NO: 1854097 - RNA, 15 nt, Homo sapiens
guccacaugaccucc

SEQ ID NO: 1854098 - RNA, 21 nt, Homo sapiens
uguucucagugaaauaacuac

SEQ ID NO: 1854099 - RNA, 16 nt, Homo sapiens
ccagcuuguaggagcu

SEQ ID NO: 1854100 - RNA, 16 nt, Homo sapiens
cucaauaaacauuuca

SEQ ID NO: 1854101 - RNA, 19 nt, Homo sapiens
aagcuguuuccauagggug

SEQ ID NO: 1854102 - RNA, 16 nt, Homo sapiens
cccucagauuccaccu

SEQ ID NO: 1854103 - RNA, 19 nt, Homo sapiens
uaaggcuaaggauagggaa

SEQ ID NO: 1854104 - RNA, 22 nt, Homo sapiens
uacucucaaaaucuuuguauaa

SEQ ID NO: 1854105 - RNA, 21 nt, Homo sapiens
uaaauguaaauauguacacaa

SEQ ID NO: 1854106 - RNA, 14 nt, Homo sapiens
aaacuuucacugaa

SEQ ID NO: 1854107 - RNA, 20 nt, Homo sapiens
cugaagucaguuucuaucau

SEQ ID NO: 1854108 - RNA, 20 nt, Homo sapiens
acugucaagucaugauggag

SEQ ID NO: 1854109 - RNA, 11 nt, Homo sapiens
ccuuuugcaac

SEQ ID NO: 1854110 - RNA, 17 nt, Homo sapiens
acagaguggaucuggag

SEQ ID NO: 1854111 - RNA, 16 nt, Homo sapiens
ggacuuggcuucagac

SEQ ID NO: 1854112 - RNA, 12 nt, Homo sapiens
aauugcauuuaa

SEQ ID NO: 1854113 - RNA, 12 nt, Homo sapiens
uuuugcauaaaa

SEQ ID NO: 1854114 - RNA, 15 nt, Homo sapiens
cuggguguggggaca

SEQ ID NO: 1854115 - RNA, 19 nt, Homo sapiens
cucuccuugcuacccagaa

SEQ ID NO: 1854116 - RNA, 23 nt, Homo sapiens
gcauccuggacaacaacgcggcc

SEQ ID NO: 1854117 - RNA, 13 nt, Homo sapiens
cuuacggcaagaa

SEQ ID NO: 1854118 - RNA, 20 nt, Homo sapiens
accuccauguggacuuagga

SEQ ID NO: 1854119 - RNA, 12 nt, Homo sapiens
gagccacuaaga

SEQ ID NO: 1854120 - RNA, 14 nt, Homo sapiens
uucaagaaguauuu

SEQ ID NO: 1854121 - RNA, 21 nt, Homo sapiens
augacuaguaaacauguggga

SEQ ID NO: 1854122 - RNA, 11 nt, Homo sapiens
aauauuuggaa

SEQ ID NO: 1854123 - RNA, 19 nt, Homo sapiens
auggcuguggcauuguuga

SEQ ID NO: 1854124 - RNA, 11 nt, Homo sapiens
cucugccaguc

SEQ ID NO: 1854125 - RNA, 16 nt, Homo sapiens
uugggagacaugugac

SEQ ID NO: 1854126 - RNA, 20 nt, Homo sapiens
cuuuuaccaggccugcucug

SEQ ID NO: 1854127 - RNA, 15 nt, Homo sapiens
gcagaagucccaaga

SEQ ID NO: 1854128 - RNA, 17 nt, Homo sapiens
ugaggccaggaguucaa

SEQ ID NO: 1854129 - RNA, 15 nt, Homo sapiens
gcaaaaaaguacuua

SEQ ID NO: 1854130 - RNA, 20 nt, Homo sapiens
gagaagcucugaagaacucu

SEQ ID NO: 1854131 - RNA, 23 nt, Homo sapiens
agauaaccauauucacaauggaa

SEQ ID NO: 1854132 - RNA, 22 nt, Homo sapiens
cugcguccucaugguacuguag

SEQ ID NO: 1854133 - RNA, 15 nt, Homo sapiens
gaguagaaaauguga

SEQ ID NO: 1854134 - RNA, 23 nt, Homo sapiens
ugaacaggaauccuuacugauau

SEQ ID NO: 1854135 - RNA, 18 nt, Homo sapiens
gagauuguuguuugccau

SEQ ID NO: 1854136 - RNA, 22 nt, Homo sapiens
aaguguucaguguugacauagc

SEQ ID NO: 1854137 - RNA, 19 nt, Homo sapiens
uucaaguuuucagcuuuaa

SEQ ID NO: 1854138 - RNA, 20 nt, Homo sapiens
uucauuucuuuucauuguaa

SEQ ID NO: 1854139 - RNA, 15 nt, Homo sapiens
auugaaaacuagaua

SEQ ID NO: 1854140 - RNA, 15 nt, Homo sapiens
ccuuguaaacaugaa

SEQ ID NO: 1854141 - RNA, 18 nt, Homo sapiens
caauaguagucucuguga

SEQ ID NO: 1854142 - RNA, 23 nt, Homo sapiens
cagaaauuccaguaaauccucau

SEQ ID NO: 1854143 - RNA, 18 nt, Homo sapiens
cccaugcagacaugagug

SEQ ID NO: 1854144 - RNA, 19 nt, Homo sapiens
cgccuuuuuggccugugau

SEQ ID NO: 1854145 - RNA, 13 nt, Homo sapiens
uuaaauguggaag

SEQ ID NO: 1854146 - RNA, 15 nt, Homo sapiens
gucucaguccaccug

SEQ ID NO: 1854147 - RNA, 20 nt, Homo sapiens
cuaucuuugagcgcccacua

SEQ ID NO: 1854148 - RNA, 14 nt, Homo sapiens
cccagcaauagaga

SEQ ID NO: 1854149 - RNA, 16 nt, Homo sapiens
auuccacccuguuacu

SEQ ID NO: 1854150 - RNA, 21 nt, Homo sapiens
accucauaucuuccucaucag

SEQ ID NO: 1854151 - RNA, 15 nt, Homo sapiens
agccauacuuauuaa

SEQ ID NO: 1854152 - RNA, 20 nt, Homo sapiens
ucccuaguagcugggauuac

SEQ ID NO: 1854153 - RNA, 15 nt, Homo sapiens
aaugcaaaacuuuag

SEQ ID NO: 1854154 - RNA, 22 nt, Homo sapiens
ccaaaugcugacccaugcaaua

SEQ ID NO: 1854155 - RNA, 15 nt, Homo sapiens
cuauaccucacaaua

SEQ ID NO: 1854156 - RNA, 14 nt, Homo sapiens
agauugucagcucc

SEQ ID NO: 1854157 - RNA, 17 nt, Homo sapiens
agucccguggaggguag

SEQ ID NO: 1854158 - RNA, 19 nt, Homo sapiens
gggcugauuguauuuaccu

SEQ ID NO: 1854159 - RNA, 21 nt, Homo sapiens
ccauguggaguggacauucaa

SEQ ID NO: 1854160 - RNA, 23 nt, Homo sapiens
ccaaggaggcaggauucuuccca

SEQ ID NO: 1854161 - RNA, 15 nt, Homo sapiens
cuuccguccauccau

SEQ ID NO: 1854162 - RNA, 23 nt, Homo sapiens
ggacaaaggugauuuuccugugu

SEQ ID NO: 1854163 - RNA, 14 nt, Homo sapiens
agcugcacauuccu

SEQ ID NO: 1854164 - RNA, 22 nt, Homo sapiens
guucccugacuccuccaaggaa

SEQ ID NO: 1854165 - RNA, 23 nt, Homo sapiens
guuuuggaugaaugcaguauaaa

SEQ ID NO: 1854166 - RNA, 15 nt, Homo sapiens
ggaggugcgcagugg

SEQ ID NO: 1854167 - RNA, 15 nt, Homo sapiens
acuuggccaguuuuc

SEQ ID NO: 1854168 - RNA, 21 nt, Homo sapiens
cuugggaaacuauucaugaau

SEQ ID NO: 1854169 - RNA, 19 nt, Homo sapiens
gccuugaaaacaaacaaau

SEQ ID NO: 1854170 - RNA, 21 nt, Homo sapiens
cccucuccugcccagaugccc

SEQ ID NO: 1854171 - RNA, 15 nt, Homo sapiens
aacaugauaaaagac

SEQ ID NO: 1854172 - RNA, 18 nt, Homo sapiens
uuccugaauguaauuaua

SEQ ID NO: 1854173 - RNA, 17 nt, Homo sapiens
caagcagccaagggaug

SEQ ID NO: 1854174 - RNA, 21 nt, Homo sapiens
aguucauggcaucacaucuuu

SEQ ID NO: 1854175 - RNA, 22 nt, Homo sapiens
uucuuucgguuuucuuugucag

SEQ ID NO: 1854176 - RNA, 14 nt, Homo sapiens
cuauuugucaugua

SEQ ID NO: 1854177 - RNA, 14 nt, Homo sapiens
cccucucaugguca

SEQ ID NO: 1854178 - RNA, 20 nt, Homo sapiens
gccuuaaauuauaccaaaga

SEQ ID NO: 1854179 - RNA, 19 nt, Homo sapiens
aauauugcugaacuacuuu

SEQ ID NO: 1854180 - RNA, 14 nt, Homo sapiens
ugugggaaggcaaa

SEQ ID NO: 1854181 - RNA, 18 nt, Homo sapiens
aaagaaagccucagagaa

SEQ ID NO: 1854182 - RNA, 18 nt, Homo sapiens
cugcaaguuagugaaaca

SEQ ID NO: 1854183 - RNA, 13 nt, Homo sapiens
uucaaacugugaa

SEQ ID NO: 1854184 - RNA, 18 nt, Homo sapiens
uauagcguggguuaucag

SEQ ID NO: 1854185 - RNA, 21 nt, Homo sapiens
caaugcuuuguccaugauguc

SEQ ID NO: 1854186 - RNA, 16 nt, Homo sapiens
guuuaccuucagccau

SEQ ID NO: 1854187 - RNA, 20 nt, Homo sapiens
auuguguuuugagguuuccu

SEQ ID NO: 1854188 - RNA, 13 nt, Homo sapiens
aggaauauuucaa

SEQ ID NO: 1854189 - RNA, 13 nt, Homo sapiens
auuuguucagaga

SEQ ID NO: 1854190 - RNA, 18 nt, Homo sapiens
cuguagguucaugcccaa

SEQ ID NO: 1854191 - RNA, 14 nt, Homo sapiens
augauugccaacag

SEQ ID NO: 1854192 - RNA, 20 nt, Homo sapiens
uuuaaaaccugugugccauu

SEQ ID NO: 1854193 - RNA, 22 nt, Homo sapiens
agaguaaaccuugaagggcuuu

SEQ ID NO: 1854194 - RNA, 23 nt, Homo sapiens
uuccaagcagugccccacuucau

SEQ ID NO: 1854195 - RNA, 19 nt, Homo sapiens
agccaagcugguccuggga

SEQ ID NO: 1854196 - RNA, 18 nt, Homo sapiens
gucacauagagugaucuu

SEQ ID NO: 1854197 - RNA, 13 nt, Homo sapiens
aacccugggacgu

SEQ ID NO: 1854198 - RNA, 22 nt, Homo sapiens
auucaacugccauguuuugcca

SEQ ID NO: 1854199 - RNA, 22 nt, Homo sapiens
aaugaagcaaaugucaugcugc

SEQ ID NO: 1854200 - RNA, 15 nt, Homo sapiens
uaaaggcuacaggcu

SEQ ID NO: 1854201 - RNA, 12 nt, Homo sapiens
gcucagugcaac

SEQ ID NO: 1854202 - RNA, 12 nt, Homo sapiens
acucacugugcu

SEQ ID NO: 1854203 - RNA, 18 nt, Homo sapiens
aaccugucuccacugugc

SEQ ID NO: 1854204 - RNA, 12 nt, Homo sapiens
cuuauuccucua

SEQ ID NO: 1854205 - RNA, 12 nt, Homo sapiens
cccaucuaugag

SEQ ID NO: 1854206 - RNA, 23 nt, Homo sapiens
gcgcugggacggcccaucuuggc

SEQ ID NO: 1854207 - RNA, 21 nt, Homo sapiens
auguagcgcuuugaauaugaa

SEQ ID NO: 1854208 - RNA, 20 nt, Homo sapiens
ugggaacuuugggacucacu

SEQ ID NO: 1854209 - RNA, 21 nt, Homo sapiens
aaguugagaaggugccugcca

SEQ ID NO: 1854210 - RNA, 17 nt, Homo sapiens
uccugauaaacauuaaa

SEQ ID NO: 1854211 - RNA, 17 nt, Homo sapiens
uuguuccccaagacauu

SEQ ID NO: 1854212 - RNA, 15 nt, Homo sapiens
uucuacaacaugaua

SEQ ID NO: 1854213 - RNA, 13 nt, Homo sapiens
ugcuaugccauuu

SEQ ID NO: 1854214 - RNA, 14 nt, Homo sapiens
cuuuaagcugugau

SEQ ID NO: 1854215 - RNA, 22 nt, Homo sapiens
uugcccacacuugggagcaaaa

SEQ ID NO: 1854216 - RNA, 16 nt, Homo sapiens
acgggcagucugcucu

SEQ ID NO: 1854217 - RNA, 18 nt, Homo sapiens
aaggaagucagacuuuuu

SEQ ID NO: 1854218 - RNA, 16 nt, Homo sapiens
aaaggaaaaacugaug

SEQ ID NO: 1854219 - RNA, 20 nt, Homo sapiens
gagcugcccacaacuugcca

SEQ ID NO: 1854220 - RNA, 12 nt, Homo sapiens
gagcucagagag

SEQ ID NO: 1854221 - RNA, 18 nt, Homo sapiens
aagggacaccaagccuug

SEQ ID NO: 1854222 - RNA, 22 nt, Homo sapiens
ugaaaacugugcaauguauuaa

SEQ ID NO: 1854223 - RNA, 17 nt, Homo sapiens
uuacaucuguguucuau

SEQ ID NO: 1854224 - RNA, 14 nt, Homo sapiens
auagaaaugaucau

SEQ ID NO: 1854225 - RNA, 17 nt, Homo sapiens
ucaagcucaaaaggguu

SEQ ID NO: 1854226 - RNA, 13 nt, Homo sapiens
auauauuuauuga

SEQ ID NO: 1854227 - RNA, 14 nt, Homo sapiens
cuaacuaaccacau

SEQ ID NO: 1854228 - RNA, 16 nt, Homo sapiens
cuuaugaaaugugcac

SEQ ID NO: 1854229 - RNA, 14 nt, Homo sapiens
ccauuccauaauca

SEQ ID NO: 1854230 - RNA, 15 nt, Homo sapiens
aaugaaaugaguuuu

SEQ ID NO: 1854231 - RNA, 22 nt, Homo sapiens
gcaagagaggaugacacaucaa

SEQ ID NO: 1854232 - RNA, 23 nt, Homo sapiens
auccaggccagggcuccuguggc

SEQ ID NO: 1854233 - RNA, 20 nt, Homo sapiens
ccaccucugccuuacaaaau

SEQ ID NO: 1854234 - RNA, 15 nt, Homo sapiens
cuuaugcuacacaga

SEQ ID NO: 1854235 - RNA, 15 nt, Homo sapiens
gccaaggagugaaaa

SEQ ID NO: 1854236 - RNA, 19 nt, Homo sapiens
ccggaggcaaaaggcagug

SEQ ID NO: 1854237 - RNA, 21 nt, Homo sapiens
uuauuggaaacauuacuuuga

SEQ ID NO: 1854238 - RNA, 15 nt, Homo sapiens
auccacaaucugaca

SEQ ID NO: 1854239 - RNA, 23 nt, Homo sapiens
ccucagggacagagacaccugca

SEQ ID NO: 1854240 - RNA, 18 nt, Homo sapiens
accuuccaacuuccugug

SEQ ID NO: 1854241 - RNA, 13 nt, Homo sapiens
caauaaucucuau

SEQ ID NO: 1854242 - RNA, 16 nt, Homo sapiens
aagaaggagaugaaua

SEQ ID NO: 1854243 - RNA, 22 nt, Homo sapiens
gccagguaugggccagcaguuu

SEQ ID NO: 1854244 - RNA, 21 nt, Homo sapiens
uuacaagccuuauaagaaaua

SEQ ID NO: 1854245 - RNA, 18 nt, Homo sapiens
ugcccuucauucagccuu

SEQ ID NO: 1854246 - RNA, 15 nt, Homo sapiens
agccuuaugaguuag

SEQ ID NO: 1854247 - RNA, 21 nt, Homo sapiens
uaacauuuuguucuuacacau

SEQ ID NO: 1854248 - RNA, 20 nt, Homo sapiens
auaaauuacccccuccucca

SEQ ID NO: 1854249 - RNA, 12 nt, Homo sapiens
cagcuaacacac

SEQ ID NO: 1854250 - RNA, 19 nt, Homo sapiens
ccaugaaccaagaccauug

SEQ ID NO: 1854251 - RNA, 18 nt, Homo sapiens
uuaaugugcuguguaaag

SEQ ID NO: 1854252 - RNA, 16 nt, Homo sapiens
aauguuucacuaugau

SEQ ID NO: 1854253 - RNA, 15 nt, Homo sapiens
acuuacauaucugac

SEQ ID NO: 1854254 - RNA, 14 nt, Homo sapiens
uuaugaaauuucac

SEQ ID NO: 1854255 - RNA, 15 nt, Homo sapiens
uguaagugcugcuau

SEQ ID NO: 1854256 - RNA, 20 nt, Homo sapiens
agaaccaaggaaucauguca

SEQ ID NO: 1854257 - RNA, 17 nt, Homo sapiens
ggagcucaggucccagg

SEQ ID NO: 1854258 - RNA, 14 nt, Homo sapiens
gucacuagucucac

SEQ ID NO: 1854259 - RNA, 21 nt, Homo sapiens
aacagguuuaaaaauccccaa

SEQ ID NO: 1854260 - RNA, 18 nt, Homo sapiens
ucccacccccaucucucc

SEQ ID NO: 1854261 - RNA, 11 nt, Homo sapiens
ugaacugcugu

SEQ ID NO: 1854262 - RNA, 15 nt, Homo sapiens
ucuuuaaaauucacu

SEQ ID NO: 1854263 - RNA, 20 nt, Homo sapiens
ccacacuuugaagcaaauac

SEQ ID NO: 1854264 - RNA, 22 nt, Homo sapiens
acccgcauguacaaaaacacaa

SEQ ID NO: 1854265 - RNA, 22 nt, Homo sapiens
uggcuuuguuuuuugugcuauu

SEQ ID NO: 1854266 - RNA, 14 nt, Homo sapiens
ucucgaaaaaagag

SEQ ID NO: 1854267 - RNA, 23 nt, Homo sapiens
cagugcucacacaaucagaccaa

SEQ ID NO: 1854268 - RNA, 16 nt, Homo sapiens
ccuccuauaucacucu

SEQ ID NO: 1854269 - RNA, 20 nt, Homo sapiens
caccuguggccucucaguca

SEQ ID NO: 1854270 - RNA, 16 nt, Homo sapiens
acaaaaaaaccucuau

SEQ ID NO: 1854271 - RNA, 16 nt, Homo sapiens
uggaaugcuguguuaa

SEQ ID NO: 1854272 - RNA, 18 nt, Homo sapiens
uagcuaccucacuaugcu

SEQ ID NO: 1854273 - RNA, 16 nt, Homo sapiens
agauuucugucuacua

SEQ ID NO: 1854274 - RNA, 13 nt, Homo sapiens
ugcauuuauagca

SEQ ID NO: 1854275 - RNA, 18 nt, Homo sapiens
cucuauaaacaaauaucg

SEQ ID NO: 1854276 - RNA, 20 nt, Homo sapiens
aaugucaaugaguaauucau

SEQ ID NO: 1854277 - RNA, 20 nt, Homo sapiens
agauccagauccagacugua

SEQ ID NO: 1854278 - RNA, 18 nt, Homo sapiens
aucagaugcuuuccugca

SEQ ID NO: 1854279 - RNA, 17 nt, Homo sapiens
ucccacuauauugcaca

SEQ ID NO: 1854280 - RNA, 17 nt, Homo sapiens
gaggacacucgcuugcc

SEQ ID NO: 1854281 - RNA, 15 nt, Homo sapiens
gaacagcacugggga

SEQ ID NO: 1854282 - RNA, 17 nt, Homo sapiens
acguuaaguccaaggag

SEQ ID NO: 1854283 - RNA, 15 nt, Homo sapiens
acaacagacugcaua

SEQ ID NO: 1854284 - RNA, 15 nt, Homo sapiens
cacugucacaggcau

SEQ ID NO: 1854285 - RNA, 20 nt, Homo sapiens
agagagcaccuggugaucac

SEQ ID NO: 1854286 - RNA, 14 nt, Homo sapiens
aaaguugaggggag

SEQ ID NO: 1854287 - RNA, 11 nt, Homo sapiens
ccaucaagaaa

SEQ ID NO: 1854288 - RNA, 18 nt, Homo sapiens
augauaaauaaccaggaa

SEQ ID NO: 1854289 - RNA, 14 nt, Homo sapiens
aauucuugcauaua

SEQ ID NO: 1854290 - RNA, 13 nt, Homo sapiens
gucauccaaagaa

SEQ ID NO: 1854291 - RNA, 22 nt, Homo sapiens
cagcuuagaauuauuugcacua

SEQ ID NO: 1854292 - RNA, 13 nt, Homo sapiens
gcaguuuaaucuu

SEQ ID NO: 1854293 - RNA, 13 nt, Homo sapiens
ccucuaacccuca

SEQ ID NO: 1854294 - RNA, 13 nt, Homo sapiens
auauaaacauauu

SEQ ID NO: 1854295 - RNA, 14 nt, Homo sapiens
agccaggaccaccu

SEQ ID NO: 1854296 - RNA, 18 nt, Homo sapiens
acauacauucauacugua

SEQ ID NO: 1854297 - RNA, 18 nt, Homo sapiens
cucagcaaggaacauccc

SEQ ID NO: 1854298 - RNA, 15 nt, Homo sapiens
caggcauguucucug

SEQ ID NO: 1854299 - RNA, 14 nt, Homo sapiens
uuuaucaugauccu

SEQ ID NO: 1854300 - RNA, 17 nt, Homo sapiens
guuccuuggucuauuua

SEQ ID NO: 1854301 - RNA, 20 nt, Homo sapiens
cuaccuucuuuggccccuug

SEQ ID NO: 1854302 - RNA, 22 nt, Homo sapiens
aacuauuuauuaaaaacaugac

SEQ ID NO: 1854303 - RNA, 14 nt, Homo sapiens
cugauuugaugaua

SEQ ID NO: 1854304 - RNA, 23 nt, Homo sapiens
caucuuuuuccacuuugacuaca

SEQ ID NO: 1854305 - RNA, 20 nt, Homo sapiens
ucagacccuaccccaccacg

SEQ ID NO: 1854306 - RNA, 21 nt, Homo sapiens
caaaaugguaauuucuacuuu

SEQ ID NO: 1854307 - RNA, 20 nt, Homo sapiens
ugacagaucaagcugugaga

SEQ ID NO: 1854308 - RNA, 12 nt, Homo sapiens
cacuguuuccau

SEQ ID NO: 1854309 - RNA, 19 nt, Homo sapiens
gugaaagcacggacucuua

SEQ ID NO: 1854310 - RNA, 13 nt, Homo sapiens
cugugugaugaug

SEQ ID NO: 1854311 - RNA, 23 nt, Homo sapiens
gaggauaaaaccugcccaaccua

SEQ ID NO: 1854312 - RNA, 20 nt, Homo sapiens
uugugcugugggcagcaccc

SEQ ID NO: 1854313 - RNA, 20 nt, Homo sapiens
agagaagauagcagggcaug

SEQ ID NO: 1854314 - RNA, 16 nt, Homo sapiens
auuauaucuucaggac

SEQ ID NO: 1854315 - RNA, 16 nt, Homo sapiens
aagaaaacuaagcuca

SEQ ID NO: 1854316 - RNA, 14 nt, Homo sapiens
ggccacuugcucag

SEQ ID NO: 1854317 - RNA, 22 nt, Homo sapiens
ugacgacaagugcugaacagug

SEQ ID NO: 1854318 - RNA, 17 nt, Homo sapiens
uguugcauuuccagcug

SEQ ID NO: 1854319 - RNA, 21 nt, Homo sapiens
aacuugagcuucacugucauc

SEQ ID NO: 1854320 - RNA, 16 nt, Homo sapiens
ucugcuaauacagguc

SEQ ID NO: 1854321 - RNA, 17 nt, Homo sapiens
agggcagggauacaaag

SEQ ID NO: 1854322 - RNA, 23 nt, Homo sapiens
guucuucaagccagcucuaggcu

SEQ ID NO: 1854323 - RNA, 20 nt, Homo sapiens
ucuacacauugcuaccucag

SEQ ID NO: 1854324 - RNA, 21 nt, Homo sapiens
agcuucuuaauauaacugccu

SEQ ID NO: 1854325 - RNA, 18 nt, Homo sapiens
ucuuaccaugcauuucuc

SEQ ID NO: 1854326 - RNA, 21 nt, Homo sapiens
ccguaccucuucccaugacug

SEQ ID NO: 1854327 - RNA, 19 nt, Homo sapiens
ucuuugcuacugaaugugu

SEQ ID NO: 1854328 - RNA, 12 nt, Homo sapiens
cgugcauaaaaa

SEQ ID NO: 1854329 - RNA, 18 nt, Homo sapiens
uauacaggaugaugacua

SEQ ID NO: 1854330 - RNA, 13 nt, Homo sapiens
aagcauuagcuuu

SEQ ID NO: 1854331 - RNA, 16 nt, Homo sapiens
ucugcacacaaaacuc

SEQ ID NO: 1854332 - RNA, 20 nt, Homo sapiens
agagggaaaaucuucacuuu

SEQ ID NO: 1854333 - RNA, 20 nt, Homo sapiens
cuugaagacuauugguuuga

SEQ ID NO: 1854334 - RNA, 21 nt, Homo sapiens
aauaugggguugguguucuca

SEQ ID NO: 1854335 - RNA, 19 nt, Homo sapiens
ugcagucagcgccagcacu

SEQ ID NO: 1854336 - RNA, 20 nt, Homo sapiens
acuccauucaaaucuacggu

SEQ ID NO: 1854337 - RNA, 16 nt, Homo sapiens
gggccgcugggguccg

SEQ ID NO: 1854338 - RNA, 18 nt, Homo sapiens
agccuccgcggacugggg

SEQ ID NO: 1854339 - RNA, 17 nt, Homo sapiens
uuugauauuugcauuga

SEQ ID NO: 1854340 - RNA, 18 nt, Homo sapiens
uaucugggagaaaacugu

SEQ ID NO: 1854341 - RNA, 15 nt, Homo sapiens
ugcucaagacuggca

SEQ ID NO: 1854342 - RNA, 19 nt, Homo sapiens
cuagaagaaccaaauaccu

SEQ ID NO: 1854343 - RNA, 13 nt, Homo sapiens
gagaggaaaagca

SEQ ID NO: 1854344 - RNA, 17 nt, Homo sapiens
aacugaagcagagucaa

SEQ ID NO: 1854345 - RNA, 21 nt, Homo sapiens
aagaaacuuuggaagcacuuu

SEQ ID NO: 1854346 - RNA, 12 nt, Homo sapiens
ccaugggucugu

SEQ ID NO: 1854347 - RNA, 12 nt, Homo sapiens
uuuuucugcaau

SEQ ID NO: 1854348 - RNA, 18 nt, Homo sapiens
caggaauuuuuaaaccaa

SEQ ID NO: 1854349 - RNA, 19 nt, Homo sapiens
uaagccaguuuuacacuaa

SEQ ID NO: 1854350 - RNA, 20 nt, Homo sapiens
ucuacggaccucacauccau

SEQ ID NO: 1854351 - RNA, 20 nt, Homo sapiens
ggccucggacuuagcuggga

SEQ ID NO: 1854352 - RNA, 14 nt, Homo sapiens
cuguacaacuaccu

SEQ ID NO: 1854353 - RNA, 21 nt, Homo sapiens
gcuucggagugaauguggcag

SEQ ID NO: 1854354 - RNA, 14 nt, Homo sapiens
ccacuuguucugua

SEQ ID NO: 1854355 - RNA, 21 nt, Homo sapiens
aggccucaguguccucaucua

SEQ ID NO: 1854356 - RNA, 14 nt, Homo sapiens
augguuaauacuau

SEQ ID NO: 1854357 - RNA, 14 nt, Homo sapiens
gaaaaaagcaacuu

SEQ ID NO: 1854358 - RNA, 12 nt, Homo sapiens
cccugcauuuau

SEQ ID NO: 1854359 - RNA, 12 nt, Homo sapiens
ccaagcauuuca

SEQ ID NO: 1854360 - RNA, 24 nt, Homo sapiens
aaagcaaugcaauuccucuugggu

SEQ ID NO: 1854361 - RNA, 15 nt, Homo sapiens
uuauaacccagugag

SEQ ID NO: 1854362 - RNA, 19 nt, Homo sapiens
cucaagguggucaguaaau

SEQ ID NO: 1854363 - RNA, 17 nt, Homo sapiens
auauuuuaugaacauug

SEQ ID NO: 1854364 - RNA, 19 nt, Homo sapiens
aacugcaggaaugcugaca

SEQ ID NO: 1854365 - RNA, 19 nt, Homo sapiens
ugccuaggguccuguccau

SEQ ID NO: 1854366 - RNA, 22 nt, Homo sapiens
gggacauccugucaucugagaa

SEQ ID NO: 1854367 - RNA, 18 nt, Homo sapiens
gugccuacucuuugccaa

SEQ ID NO: 1854368 - RNA, 16 nt, Homo sapiens
ccggccuggagcuccu

SEQ ID NO: 1854369 - RNA, 15 nt, Homo sapiens
uucauucagccuuua

SEQ ID NO: 1854370 - RNA, 19 nt, Homo sapiens
accaggccgccccagccuc

SEQ ID NO: 1854371 - RNA, 13 nt, Homo sapiens
ucaugaacagcuc

SEQ ID NO: 1854372 - RNA, 18 nt, Homo sapiens
gcacacacagauaugcac

SEQ ID NO: 1854373 - RNA, 18 nt, Homo sapiens
cucugguguuugcaaagg

SEQ ID NO: 1854374 - RNA, 22 nt, Homo sapiens
cccuggauuugcauacauucuu

SEQ ID NO: 1854375 - RNA, 16 nt, Homo sapiens
uuccaggaaccaaaaa

SEQ ID NO: 1854376 - RNA, 12 nt, Homo sapiens
uagcccagccuu

SEQ ID NO: 1854377 - RNA, 19 nt, Homo sapiens
agaauuuggauacacucuc

SEQ ID NO: 1854378 - RNA, 15 nt, Homo sapiens
cuggcccucacucaa

SEQ ID NO: 1854379 - RNA, 13 nt, Homo sapiens
uuguuagcacuag

SEQ ID NO: 1854380 - RNA, 16 nt, Homo sapiens
uccaucaucacuguaa

SEQ ID NO: 1854381 - RNA, 21 nt, Homo sapiens
gugcaguugcuguuuacuuga

SEQ ID NO: 1854382 - RNA, 15 nt, Homo sapiens
uuuccuuagugccag

SEQ ID NO: 1854383 - RNA, 13 nt, Homo sapiens
ccaccugcacaaa

SEQ ID NO: 1854384 - RNA, 20 nt, Homo sapiens
aacaacgcaaaccucuccuu

SEQ ID NO: 1854385 - RNA, 14 nt, Homo sapiens
uuccagagcugaga

SEQ ID NO: 1854386 - RNA, 19 nt, Homo sapiens
aaauguaacugugccaguu

SEQ ID NO: 1854387 - RNA, 21 nt, Homo sapiens
gacauuuguggcagugcugaa

SEQ ID NO: 1854388 - RNA, 21 nt, Homo sapiens
caggcgcaguggcucaugccu

SEQ ID NO: 1854389 - RNA, 12 nt, Homo sapiens
gcucccaugacc

SEQ ID NO: 1854390 - RNA, 20 nt, Homo sapiens
cacuucuuuauuaauuacca

SEQ ID NO: 1854391 - RNA, 12 nt, Homo sapiens
aggcaguggccu

SEQ ID NO: 1854392 - RNA, 12 nt, Homo sapiens
uuagcugucacc

SEQ ID NO: 1854393 - RNA, 22 nt, Homo sapiens
ccaggagguggaggcugcagug

SEQ ID NO: 1854394 - RNA, 14 nt, Homo sapiens
guacccuucaccca

SEQ ID NO: 1854395 - RNA, 23 nt, Homo sapiens
uuuauagauggucacgcaccugg

SEQ ID NO: 1854396 - RNA, 18 nt, Homo sapiens
gggucucgcagccugaag

SEQ ID NO: 1854397 - RNA, 16 nt, Homo sapiens
uccccugaccugugag

SEQ ID NO: 1854398 - RNA, 15 nt, Homo sapiens
gacaaaaaggccaag

SEQ ID NO: 1854399 - RNA, 15 nt, Homo sapiens
ggcaaaaagaccaag

SEQ ID NO: 1854400 - RNA, 21 nt, Homo sapiens
uguuccacacccaaugcugcu

SEQ ID NO: 1854401 - RNA, 21 nt, Homo sapiens
uucugucuucccaaacccagu

SEQ ID NO: 1854402 - RNA, 12 nt, Homo sapiens
gccucaccucua

SEQ ID NO: 1854403 - RNA, 18 nt, Homo sapiens
aagggagagaaaagcugg

SEQ ID NO: 1854404 - RNA, 20 nt, Homo sapiens
aucaugauccuuguguucag

SEQ ID NO: 1854405 - RNA, 15 nt, Homo sapiens
ggcaggaaaauggac

SEQ ID NO: 1854406 - RNA, 18 nt, Homo sapiens
acguguauaguaucugua

SEQ ID NO: 1854407 - RNA, 16 nt, Homo sapiens
uguuuucaaaaccaag

SEQ ID NO: 1854408 - RNA, 19 nt, Homo sapiens
uggggcugaacaugccugc

SEQ ID NO: 1854409 - RNA, 17 nt, Homo sapiens
accugaaauuaacucag

SEQ ID NO: 1854410 - RNA, 14 nt, Homo sapiens
auuuaucugugcaa

SEQ ID NO: 1854411 - RNA, 13 nt, Homo sapiens
uuaauacuauuaa

SEQ ID NO: 1854412 - RNA, 13 nt, Homo sapiens
ucucuacuacaca

SEQ ID NO: 1854413 - RNA, 16 nt, Homo sapiens
uuacgaaaccucuuuu

SEQ ID NO: 1854414 - RNA, 16 nt, Homo sapiens
gggucuguguggugcc

SEQ ID NO: 1854415 - RNA, 22 nt, Homo sapiens
gcucaaccuacaguggagggag

SEQ ID NO: 1854416 - RNA, 20 nt, Homo sapiens
gacaccugccuucaaagcca

SEQ ID NO: 1854417 - RNA, 14 nt, Homo sapiens
cugaucaugcauug

SEQ ID NO: 1854418 - RNA, 16 nt, Homo sapiens
auuuaaccuaguucaa

SEQ ID NO: 1854419 - RNA, 17 nt, Homo sapiens
uuuaaaguauacucuua

SEQ ID NO: 1854420 - RNA, 16 nt, Homo sapiens
gauuuuauuugacaaa

SEQ ID NO: 1854421 - RNA, 21 nt, Homo sapiens
acuugaaagaaauggugaaug

SEQ ID NO: 1854422 - RNA, 14 nt, Homo sapiens
agcuuuccaguuag

SEQ ID NO: 1854423 - RNA, 20 nt, Homo sapiens
ggacacagaauuauagaugu

SEQ ID NO: 1854424 - RNA, 16 nt, Homo sapiens
auuauuuucuaugaca

SEQ ID NO: 1854425 - RNA, 18 nt, Homo sapiens
gucucuguugacuggcug

SEQ ID NO: 1854426 - RNA, 18 nt, Homo sapiens
ccugcacaaccuggauuu

SEQ ID NO: 1854427 - RNA, 19 nt, Homo sapiens
gcgccaugcuuccuauaca

SEQ ID NO: 1854428 - RNA, 15 nt, Homo sapiens
gcaucugacaugcau

SEQ ID NO: 1854429 - RNA, 21 nt, Homo sapiens
gaggcauuugcagcugugcca

SEQ ID NO: 1854430 - RNA, 15 nt, Homo sapiens
uucacagagugugcu

SEQ ID NO: 1854431 - RNA, 18 nt, Homo sapiens
auuuugggacuucuaccc

SEQ ID NO: 1854432 - RNA, 17 nt, Homo sapiens
gcugauuccagaacaaa

SEQ ID NO: 1854433 - RNA, 17 nt, Homo sapiens
uuucugcagaaaauucu

SEQ ID NO: 1854434 - RNA, 22 nt, Homo sapiens
caccuugugaaggaaaaacaug

SEQ ID NO: 1854435 - RNA, 19 nt, Homo sapiens
aaaugucuaagguaguaac

SEQ ID NO: 1854436 - RNA, 18 nt, Homo sapiens
uauuucuccuuugcaaua

SEQ ID NO: 1854437 - RNA, 16 nt, Homo sapiens
gccucauucacugucc

SEQ ID NO: 1854438 - RNA, 23 nt, Homo sapiens
gccuuucucccaggccaggcucc

SEQ ID NO: 1854439 - RNA, 21 nt, Homo sapiens
gucuguuucaaugaccuguau

SEQ ID NO: 1854440 - RNA, 22 nt, Homo sapiens
caaccugaaaguuccuucugua

SEQ ID NO: 1854441 - RNA, 14 nt, Homo sapiens
cacuauguuacaug

SEQ ID NO: 1854442 - RNA, 14 nt, Homo sapiens
ccuaugguucuuau

SEQ ID NO: 1854443 - RNA, 20 nt, Homo sapiens
acggaauaaugaguuagaac

SEQ ID NO: 1854444 - RNA, 21 nt, Homo sapiens
agccaccacauuuagaacuuu

SEQ ID NO: 1854445 - RNA, 10 nt, Homo sapiens
ccagcacuuc

SEQ ID NO: 1854446 - RNA, 18 nt, Homo sapiens
aauggcaccuucauucuc

SEQ ID NO: 1854447 - RNA, 13 nt, Homo sapiens
gaauuucccacau

SEQ ID NO: 1854448 - RNA, 18 nt, Homo sapiens
auagcaccuccacauacc

SEQ ID NO: 1854449 - RNA, 17 nt, Homo sapiens
gaaucuauuucacuuau

SEQ ID NO: 1854450 - RNA, 18 nt, Homo sapiens
auuaucuaugauaugcua

SEQ ID NO: 1854451 - RNA, 13 nt, Homo sapiens
caagcgcagggag

SEQ ID NO: 1854452 - RNA, 16 nt, Homo sapiens
acauguccuacaacag

SEQ ID NO: 1854453 - RNA, 18 nt, Homo sapiens
uuuaacuggcuucagccu

SEQ ID NO: 1854454 - RNA, 12 nt, Homo sapiens
uggaagugcaga

SEQ ID NO: 1854455 - RNA, 14 nt, Homo sapiens
ugucugugugauuu

SEQ ID NO: 1854456 - RNA, 16 nt, Homo sapiens
auguuguucuuacaaa

SEQ ID NO: 1854457 - RNA, 17 nt, Homo sapiens
gagcgcuaccucuccag

SEQ ID NO: 1854458 - RNA, 22 nt, Homo sapiens
uuauauauauaaagucagugac

SEQ ID NO: 1854459 - RNA, 21 nt, Homo sapiens
acagggucuugcuauauugcc

SEQ ID NO: 1854460 - RNA, 23 nt, Homo sapiens
cucuguuuugcauggaguauuau

SEQ ID NO: 1854461 - RNA, 16 nt, Homo sapiens
uccuacuccuaccugg

SEQ ID NO: 1854462 - RNA, 14 nt, Homo sapiens
uagcacauguguaa

SEQ ID NO: 1854463 - RNA, 14 nt, Homo sapiens
cugggcccuaggca

SEQ ID NO: 1854464 - RNA, 14 nt, Homo sapiens
cacugcccuucuca

SEQ ID NO: 1854465 - RNA, 12 nt, Homo sapiens
gauucucugggu

SEQ ID NO: 1854466 - RNA, 19 nt, Homo sapiens
gcacuuaacagauugccau

SEQ ID NO: 1854467 - RNA, 20 nt, Homo sapiens
ccacuuuucugcuguugccu

SEQ ID NO: 1854468 - RNA, 14 nt, Homo sapiens
uccaaauagcauua

SEQ ID NO: 1854469 - RNA, 16 nt, Homo sapiens
cgccacggcacuccag

SEQ ID NO: 1854470 - RNA, 22 nt, Homo sapiens
uaaccucgcucgaugacuguga

SEQ ID NO: 1854471 - RNA, 17 nt, Homo sapiens
auugacuaucaaacuga

SEQ ID NO: 1854472 - RNA, 20 nt, Homo sapiens
acuguucaguuuagcauuaa

SEQ ID NO: 1854473 - RNA, 22 nt, Homo sapiens
ugugacauacauauuaucucau

SEQ ID NO: 1854474 - RNA, 16 nt, Homo sapiens
aaauuguugggaggac

SEQ ID NO: 1854475 - RNA, 20 nt, Homo sapiens
agcauaaugcucccaucucc

SEQ ID NO: 1854476 - RNA, 14 nt, Homo sapiens
aagcacuagaucuc

SEQ ID NO: 1854477 - RNA, 13 nt, Homo sapiens
aucaccagagguc

SEQ ID NO: 1854478 - RNA, 20 nt, Homo sapiens
cuuugcagugaaagcuuuca

SEQ ID NO: 1854479 - RNA, 13 nt, Homo sapiens
ggcuacuaccugg

SEQ ID NO: 1854480 - RNA, 18 nt, Homo sapiens
gaacugaaagcacuagag

SEQ ID NO: 1854481 - RNA, 14 nt, Homo sapiens
aucucuugugcuuu

SEQ ID NO: 1854482 - RNA, 12 nt, Homo sapiens
gaauuacacuaa

SEQ ID NO: 1854483 - RNA, 17 nt, Homo sapiens
ucgaggggcccagggaa

SEQ ID NO: 1854484 - RNA, 21 nt, Homo sapiens
agauggauguuugucaaaaag

SEQ ID NO: 1854485 - RNA, 22 nt, Homo sapiens
gcauuuucuguuccagguuucu

SEQ ID NO: 1854486 - RNA, 19 nt, Homo sapiens
agguuguuaauguacaaaa

SEQ ID NO: 1854487 - RNA, 16 nt, Homo sapiens
uaacaaguaccaaagu

SEQ ID NO: 1854488 - RNA, 17 nt, Homo sapiens
uguugugcagcauuaaa

SEQ ID NO: 1854489 - RNA, 13 nt, Homo sapiens
agcccaguggaau

SEQ ID NO: 1854490 - RNA, 13 nt, Homo sapiens
guggaaaagccaa

SEQ ID NO: 1854491 - RNA, 14 nt, Homo sapiens
caaaccuuugccaa

SEQ ID NO: 1854492 - RNA, 16 nt, Homo sapiens
gcauucauaacagaac

SEQ ID NO: 1854493 - RNA, 16 nt, Homo sapiens
uuuucaaggccuucag

SEQ ID NO: 1854494 - RNA, 16 nt, Homo sapiens
aggcucacaguuacag

SEQ ID NO: 1854495 - RNA, 20 nt, Homo sapiens
ccucuggggcucagcccuga

SEQ ID NO: 1854496 - RNA, 23 nt, Homo sapiens
aagauuugcccauuuacacuuuu

SEQ ID NO: 1854497 - RNA, 18 nt, Homo sapiens
guaaguuuuugauucuac

SEQ ID NO: 1854498 - RNA, 17 nt, Homo sapiens
gccacagccacuaauca

SEQ ID NO: 1854499 - RNA, 21 nt, Homo sapiens
accccucuuucgucuacugca

SEQ ID NO: 1854500 - RNA, 15 nt, Homo sapiens
aagugccaguuugcu

SEQ ID NO: 1854501 - RNA, 15 nt, Homo sapiens
aaagcaggggcagau

SEQ ID NO: 1854502 - RNA, 12 nt, Homo sapiens
aaugcugagaag

SEQ ID NO: 1854503 - RNA, 14 nt, Homo sapiens
ugauaacagaguga

SEQ ID NO: 1854504 - RNA, 21 nt, Homo sapiens
gcacaccucagccccacugac

SEQ ID NO: 1854505 - RNA, 15 nt, Homo sapiens
agugucuuaguuuga

SEQ ID NO: 1854506 - RNA, 11 nt, Homo sapiens
ccaguuuauau

SEQ ID NO: 1854507 - RNA, 19 nt, Homo sapiens
augggaggacuccagaaga

SEQ ID NO: 1854508 - RNA, 16 nt, Homo sapiens
agcagccacaaccaaa

SEQ ID NO: 1854509 - RNA, 23 nt, Homo sapiens
caggugccuuguccucagggcua

SEQ ID NO: 1854510 - RNA, 13 nt, Homo sapiens
uccucacagcagu

SEQ ID NO: 1854511 - RNA, 16 nt, Homo sapiens
aucaaauguuacaguu

SEQ ID NO: 1854512 - RNA, 17 nt, Homo sapiens
caguguuaauacugaga

SEQ ID NO: 1854513 - RNA, 21 nt, Homo sapiens
gucaggcucugaaucucucaa

SEQ ID NO: 1854514 - RNA, 23 nt, Homo sapiens
cagaggaugcaacaaauguggcc

SEQ ID NO: 1854515 - RNA, 12 nt, Homo sapiens
guuuuauacaaa

SEQ ID NO: 1854516 - RNA, 19 nt, Homo sapiens
aguggguuagcuaccugcu

SEQ ID NO: 1854517 - RNA, 18 nt, Homo sapiens
ucaccagccucacaaucc

SEQ ID NO: 1854518 - RNA, 18 nt, Homo sapiens
caauuccaccaagacagu

SEQ ID NO: 1854519 - RNA, 14 nt, Homo sapiens
uguuacacauacac

SEQ ID NO: 1854520 - RNA, 22 nt, Homo sapiens
ugcuccauguuuccaccaaaug

SEQ ID NO: 1854521 - RNA, 16 nt, Homo sapiens
ugggaagugaagucau

SEQ ID NO: 1854522 - RNA, 20 nt, Homo sapiens
acacugaauugaaucuacaa

SEQ ID NO: 1854523 - RNA, 17 nt, Homo sapiens
augucuguucuaagucc

SEQ ID NO: 1854524 - RNA, 18 nt, Homo sapiens
ccucucauugucuuguua

SEQ ID NO: 1854525 - RNA, 14 nt, Homo sapiens
uauuuugaaguuua

SEQ ID NO: 1854526 - RNA, 17 nt, Homo sapiens
uaagacauucaccaaca

SEQ ID NO: 1854527 - RNA, 20 nt, Homo sapiens
aaaacaguccagacauuugu

SEQ ID NO: 1854528 - RNA, 16 nt, Homo sapiens
aguguucucacagugu

SEQ ID NO: 1854529 - RNA, 17 nt, Homo sapiens
uaaauacuuuuucccca

SEQ ID NO: 1854530 - RNA, 14 nt, Homo sapiens
ugaggagagcuuca

SEQ ID NO: 1854531 - RNA, 21 nt, Homo sapiens
cggccccucccccguccugga

SEQ ID NO: 1854532 - RNA, 23 nt, Homo sapiens
caguuggauuuauucugccaaac

SEQ ID NO: 1854533 - RNA, 20 nt, Homo sapiens
acacuaugaagauguuucaa

SEQ ID NO: 1854534 - RNA, 15 nt, Homo sapiens
ccagcuaacugugga

SEQ ID NO: 1854535 - RNA, 13 nt, Homo sapiens
acugaaggacaca

SEQ ID NO: 1854536 - RNA, 16 nt, Homo sapiens
cacauggaugcacaca

SEQ ID NO: 1854537 - RNA, 21 nt, Homo sapiens
agaaaauaguuuggauuacuu

SEQ ID NO: 1854538 - RNA, 21 nt, Homo sapiens
aacauuuuauuuuuaaaauau

SEQ ID NO: 1854539 - RNA, 16 nt, Homo sapiens
augaagcccuaaagaa

SEQ ID NO: 1854540 - RNA, 20 nt, Homo sapiens
auuuuuuaauuacaauggaa

SEQ ID NO: 1854541 - RNA, 14 nt, Homo sapiens
gcauauauguacua

SEQ ID NO: 1854542 - RNA, 15 nt, Homo sapiens
gagaugucuguucua

SEQ ID NO: 1854543 - RNA, 15 nt, Homo sapiens
ugaggauuuuguuga

SEQ ID NO: 1854544 - RNA, 18 nt, Homo sapiens
gauuguaaaguagcugua

SEQ ID NO: 1854545 - RNA, 19 nt, Homo sapiens
ccucucccuccuccaggaa

SEQ ID NO: 1854546 - RNA, 17 nt, Homo sapiens
cuuuuuaaacucacaua

SEQ ID NO: 1854547 - RNA, 14 nt, Homo sapiens
cccacccaccaaau

SEQ ID NO: 1854548 - RNA, 21 nt, Homo sapiens
gaugcugaccucaccuggucc

SEQ ID NO: 1854549 - RNA, 14 nt, Homo sapiens
uaaacccauacaau

SEQ ID NO: 1854550 - RNA, 19 nt, Homo sapiens
ggcccugaggaauaaagcu

SEQ ID NO: 1854551 - RNA, 15 nt, Homo sapiens
uuuccaaauucacaa

SEQ ID NO: 1854552 - RNA, 15 nt, Homo sapiens
uuucaaaauucaaaa

SEQ ID NO: 1854553 - RNA, 13 nt, Homo sapiens
cuccugggcucag

SEQ ID NO: 1854554 - RNA, 18 nt, Homo sapiens
gaguucccugaacaucug

SEQ ID NO: 1854555 - RNA, 19 nt, Homo sapiens
aguaaaguuguuguaaaaa

SEQ ID NO: 1854556 - RNA, 11 nt, Homo sapiens
cucacacuccu

SEQ ID NO: 1854557 - RNA, 13 nt, Homo sapiens
agaaaauucuaaa

SEQ ID NO: 1854558 - RNA, 17 nt, Homo sapiens
cauaauuuaaaaaguca

SEQ ID NO: 1854559 - RNA, 12 nt, Homo sapiens
cugagaccucaa

SEQ ID NO: 1854560 - RNA, 16 nt, Homo sapiens
guuuguaaugcaaaag

SEQ ID NO: 1854561 - RNA, 15 nt, Homo sapiens
ucccugcagacauga

SEQ ID NO: 1854562 - RNA, 16 nt, Homo sapiens
aaaauauuucagauau

SEQ ID NO: 1854563 - RNA, 21 nt, Homo sapiens
ugggagccugacagugcccag

SEQ ID NO: 1854564 - RNA, 22 nt, Homo sapiens
aagguaccccgauggccaagca

SEQ ID NO: 1854565 - RNA, 16 nt, Homo sapiens
accaggacuauagccc

SEQ ID NO: 1854566 - RNA, 11 nt, Homo sapiens
uugcacuccac

SEQ ID NO: 1854567 - RNA, 22 nt, Homo sapiens
agaccuggguugagccucagaa

SEQ ID NO: 1854568 - RNA, 18 nt, Homo sapiens
aauucuggacacauuauu

SEQ ID NO: 1854569 - RNA, 14 nt, Homo sapiens
ggcuagagugcagu

SEQ ID NO: 1854570 - RNA, 14 nt, Homo sapiens
ggcuggagugcaau

SEQ ID NO: 1854571 - RNA, 23 nt, Homo sapiens
caagcgccgcugugaggcugcuu

SEQ ID NO: 1854572 - RNA, 22 nt, Homo sapiens
cuaaagguagaucaucuugaau

SEQ ID NO: 1854573 - RNA, 23 nt, Homo sapiens
ugucauuuuggucuaagguugcc

SEQ ID NO: 1854574 - RNA, 20 nt, Homo sapiens
ugacucauccccacagcugg

SEQ ID NO: 1854575 - RNA, 21 nt, Homo sapiens
ccagcauauacugaagucuuu

SEQ ID NO: 1854576 - RNA, 22 nt, Homo sapiens
uuaaaaaaaaaaagaacacagg

SEQ ID NO: 1854577 - RNA, 17 nt, Homo sapiens
aaaauacauaucgcuga

SEQ ID NO: 1854578 - RNA, 18 nt, Homo sapiens
gacuguccucgcagagaa

SEQ ID NO: 1854579 - RNA, 13 nt, Homo sapiens
cagccuacugccu

SEQ ID NO: 1854580 - RNA, 13 nt, Homo sapiens
auuugauacuuau

SEQ ID NO: 1854581 - RNA, 16 nt, Homo sapiens
cugaaaccucugccuu

SEQ ID NO: 1854582 - RNA, 14 nt, Homo sapiens
ccacuugcucagac

SEQ ID NO: 1854583 - RNA, 23 nt, Homo sapiens
auuuguuuuucucuuuucacagc

SEQ ID NO: 1854584 - RNA, 23 nt, Homo sapiens
agccauaagaaagcacuauuaau

SEQ ID NO: 1854585 - RNA, 22 nt, Homo sapiens
gacgagugcuuccgcugcggug

SEQ ID NO: 1854586 - RNA, 11 nt, Homo sapiens
caacucagguu

SEQ ID NO: 1854587 - RNA, 11 nt, Homo sapiens
cuucucaggaa

SEQ ID NO: 1854588 - RNA, 18 nt, Homo sapiens
aggagggauguuccagug

SEQ ID NO: 1854589 - RNA, 15 nt, Homo sapiens
cagaucacagugucu

SEQ ID NO: 1854590 - RNA, 21 nt, Homo sapiens
agaccucggugggcauucaca

SEQ ID NO: 1854591 - RNA, 19 nt, Homo sapiens
gaacugguaaguuuuugca

SEQ ID NO: 1854592 - RNA, 14 nt, Homo sapiens
ucaguaaacaauga

SEQ ID NO: 1854593 - RNA, 19 nt, Homo sapiens
cuagagacucugugaucua

SEQ ID NO: 1854594 - RNA, 14 nt, Homo sapiens
aaugcuucuucuca

SEQ ID NO: 1854595 - RNA, 16 nt, Homo sapiens
gaugggccacacaagu

SEQ ID NO: 1854596 - RNA, 16 nt, Homo sapiens
cucuccugacuuuuaa

SEQ ID NO: 1854597 - RNA, 16 nt, Homo sapiens
gacaggaagcuggcag

SEQ ID NO: 1854598 - RNA, 18 nt, Homo sapiens
agaggccuuuaguuauaa

SEQ ID NO: 1854599 - RNA, 13 nt, Homo sapiens
agaugucauccca

SEQ ID NO: 1854600 - RNA, 14 nt, Homo sapiens
ccaagcagagcuca

SEQ ID NO: 1854601 - RNA, 22 nt, Homo sapiens
cuccccaccagucucacccacu

SEQ ID NO: 1854602 - RNA, 14 nt, Homo sapiens
aauuccaccaagac

SEQ ID NO: 1854603 - RNA, 21 nt, Homo sapiens
augagauuuuucuauccaaau

SEQ ID NO: 1854604 - RNA, 23 nt, Homo sapiens
aauucuaacccagguauccaaaa

SEQ ID NO: 1854605 - RNA, 15 nt, Homo sapiens
ccaccugcucacugg

SEQ ID NO: 1854606 - RNA, 15 nt, Homo sapiens
aggaggacuugcagg

SEQ ID NO: 1854607 - RNA, 19 nt, Homo sapiens
caagucucacagauugcug

SEQ ID NO: 1854608 - RNA, 22 nt, Homo sapiens
aacuuacacuguauauuuugca

SEQ ID NO: 1854609 - RNA, 13 nt, Homo sapiens
uucugagugacau

SEQ ID NO: 1854610 - RNA, 16 nt, Homo sapiens
aacauggcuacuugcu

SEQ ID NO: 1854611 - RNA, 17 nt, Homo sapiens
uauucauggauggcuca

SEQ ID NO: 1854612 - RNA, 22 nt, Homo sapiens
cuauaucaaaaaaccuuuacag

SEQ ID NO: 1854613 - RNA, 17 nt, Homo sapiens
ucaagaugacagcucuu

SEQ ID NO: 1854614 - RNA, 22 nt, Homo sapiens
ccauguuauuuauaguguugcu

SEQ ID NO: 1854615 - RNA, 16 nt, Homo sapiens
cucaacagcuacucaa

SEQ ID NO: 1854616 - RNA, 14 nt, Homo sapiens
aacaagaugcugga

SEQ ID NO: 1854617 - RNA, 12 nt, Homo sapiens
aacacugagaaa

SEQ ID NO: 1854618 - RNA, 13 nt, Homo sapiens
uuacuucuucuca

SEQ ID NO: 1854619 - RNA, 23 nt, Homo sapiens
uuuaaggugacccaaugauucag

SEQ ID NO: 1854620 - RNA, 20 nt, Homo sapiens
ccacacuacacacaccagau

SEQ ID NO: 1854621 - RNA, 23 nt, Homo sapiens
guaauaauaaaucguccucccag

SEQ ID NO: 1854622 - RNA, 12 nt, Homo sapiens
ugcuccagcacu

SEQ ID NO: 1854623 - RNA, 22 nt, Homo sapiens
uagaggcaugaacacacaugga

SEQ ID NO: 1854624 - RNA, 20 nt, Homo sapiens
ucagguauaccucacuuuac

SEQ ID NO: 1854625 - RNA, 16 nt, Homo sapiens
aggagacacauucaca

SEQ ID NO: 1854626 - RNA, 19 nt, Homo sapiens
ucagucucugagcagugaa

SEQ ID NO: 1854627 - RNA, 19 nt, Homo sapiens
caagauaucagcccaaaag

SEQ ID NO: 1854628 - RNA, 19 nt, Homo sapiens
caucuuggucacauacaau

SEQ ID NO: 1854629 - RNA, 20 nt, Homo sapiens
auuuuauagucucaaaucaa

SEQ ID NO: 1854630 - RNA, 22 nt, Homo sapiens
uaugggggauggugagcuguga

SEQ ID NO: 1854631 - RNA, 20 nt, Homo sapiens
ucagguggccagccuggauc

SEQ ID NO: 1854632 - RNA, 21 nt, Homo sapiens
cacuucucucuccccaucccc

SEQ ID NO: 1854633 - RNA, 18 nt, Homo sapiens
aacuuuauuuaaaugcau

SEQ ID NO: 1854634 - RNA, 15 nt, Homo sapiens
gggugaccagccacu

SEQ ID NO: 1854635 - RNA, 18 nt, Homo sapiens
acuaggagauaccaccga

SEQ ID NO: 1854636 - RNA, 17 nt, Homo sapiens
ucagcagguuccagugc

SEQ ID NO: 1854637 - RNA, 14 nt, Homo sapiens
ccugcccuuccucu

SEQ ID NO: 1854638 - RNA, 12 nt, Homo sapiens
uaaagugugagg

SEQ ID NO: 1854639 - RNA, 21 nt, Homo sapiens
gggagauuuuuuugagucaaa

SEQ ID NO: 1854640 - RNA, 20 nt, Homo sapiens
ugucauuuuggcaucugcaa

SEQ ID NO: 1854641 - RNA, 22 nt, Homo sapiens
uugagcuuucaugaguuuccca

SEQ ID NO: 1854642 - RNA, 12 nt, Homo sapiens
uuauuacugcuu

SEQ ID NO: 1854643 - RNA, 13 nt, Homo sapiens
uugacuucugaca

SEQ ID NO: 1854644 - RNA, 21 nt, Homo sapiens
cgggaaccucacucuugccaa

SEQ ID NO: 1854645 - RNA, 14 nt, Homo sapiens
uguacagagacucu

SEQ ID NO: 1854646 - RNA, 10 nt, Homo sapiens
uugugcuuua

SEQ ID NO: 1854647 - RNA, 21 nt, Homo sapiens
gauaauaaugaaggcauguaa

SEQ ID NO: 1854648 - RNA, 13 nt, Homo sapiens
uuuaaguaacuua

SEQ ID NO: 1854649 - RNA, 18 nt, Homo sapiens
ccauuucuuaccaugcau

SEQ ID NO: 1854650 - RNA, 17 nt, Homo sapiens
agaagccaggugcaaaa

SEQ ID NO: 1854651 - RNA, 16 nt, Homo sapiens
uccucaguuuuuccua

SEQ ID NO: 1854652 - RNA, 18 nt, Homo sapiens
caugcuauccaaucucau

SEQ ID NO: 1854653 - RNA, 18 nt, Homo sapiens
aggugaaugcacagugaa

SEQ ID NO: 1854654 - RNA, 22 nt, Homo sapiens
cacugacccauagagggcuccu

SEQ ID NO: 1854655 - RNA, 21 nt, Homo sapiens
aaaauguuuuuaaacaguguc

SEQ ID NO: 1854656 - RNA, 20 nt, Homo sapiens
caguuuuuguaaagcccuug

SEQ ID NO: 1854657 - RNA, 13 nt, Homo sapiens
aggcgggggagcc

SEQ ID NO: 1854658 - RNA, 13 nt, Homo sapiens
cuguugacauauu

SEQ ID NO: 1854659 - RNA, 21 nt, Homo sapiens
ugacuuccugaacaaccagcu

SEQ ID NO: 1854660 - RNA, 13 nt, Homo sapiens
guaauacuggaau

SEQ ID NO: 1854661 - RNA, 13 nt, Homo sapiens
ugccaacuuucca

SEQ ID NO: 1854662 - RNA, 23 nt, Homo sapiens
guagcagguuaccacucuggcag

SEQ ID NO: 1854663 - RNA, 21 nt, Homo sapiens
gguuugccaaaauucauuucu

SEQ ID NO: 1854664 - RNA, 17 nt, Homo sapiens
uacaauugcacugcugu

SEQ ID NO: 1854665 - RNA, 20 nt, Homo sapiens
agcuuacuggcaaacaugaa

SEQ ID NO: 1854666 - RNA, 23 nt, Homo sapiens
gcuuugugaaaacuacugauguu

SEQ ID NO: 1854667 - RNA, 17 nt, Homo sapiens
auucuuguucagauuaa

SEQ ID NO: 1854668 - RNA, 18 nt, Homo sapiens
cacaaguggguaccccca

SEQ ID NO: 1854669 - RNA, 20 nt, Homo sapiens
aguguaacucaccagccucu

SEQ ID NO: 1854670 - RNA, 22 nt, Homo sapiens
ucuuuucaagaaguucuuugau

SEQ ID NO: 1854671 - RNA, 22 nt, Homo sapiens
caagaaucagucuauccacaga

SEQ ID NO: 1854672 - RNA, 16 nt, Homo sapiens
aguccacuuuccucuc

SEQ ID NO: 1854673 - RNA, 17 nt, Homo sapiens
uauugguaggauuuaua

SEQ ID NO: 1854674 - RNA, 20 nt, Homo sapiens
uccuuuaaauccuuccauga

SEQ ID NO: 1854675 - RNA, 16 nt, Homo sapiens
cuuuugauuuuagcca

SEQ ID NO: 1854676 - RNA, 17 nt, Homo sapiens
uguucauccucauugcc

SEQ ID NO: 1854677 - RNA, 18 nt, Homo sapiens
guaagaguguuuauacag

SEQ ID NO: 1854678 - RNA, 17 nt, Homo sapiens
ggcaguggaugggugcu

SEQ ID NO: 1854679 - RNA, 16 nt, Homo sapiens
caccugaccucugcaa

SEQ ID NO: 1854680 - RNA, 17 nt, Homo sapiens
augucacucagccccuu

SEQ ID NO: 1854681 - RNA, 16 nt, Homo sapiens
acucuuguuugaugua

SEQ ID NO: 1854682 - RNA, 15 nt, Homo sapiens
uuuucuccucugcuu

SEQ ID NO: 1854683 - RNA, 23 nt, Homo sapiens
cagggcugcaucccgcagauggc

SEQ ID NO: 1854684 - RNA, 16 nt, Homo sapiens
augucagaacagagug

SEQ ID NO: 1854685 - RNA, 17 nt, Homo sapiens
ggugcuaauccaggaca

SEQ ID NO: 1854686 - RNA, 15 nt, Homo sapiens
auguuuucacaguca

SEQ ID NO: 1854687 - RNA, 22 nt, Homo sapiens
acaguggggagcauggagggau

SEQ ID NO: 1854688 - RNA, 18 nt, Homo sapiens
cagaagccagaugcucac

SEQ ID NO: 1854689 - RNA, 14 nt, Homo sapiens
uucugaaccauuac

SEQ ID NO: 1854690 - RNA, 18 nt, Homo sapiens
agacccauaccuuuccag

SEQ ID NO: 1854691 - RNA, 22 nt, Homo sapiens
aguacuugacccaugccccaac

SEQ ID NO: 1854692 - RNA, 15 nt, Homo sapiens
aaagaaaaguauugu

SEQ ID NO: 1854693 - RNA, 22 nt, Homo sapiens
ccaaagguaagucugagaccca

SEQ ID NO: 1854694 - RNA, 20 nt, Homo sapiens
ugguugaaaccccaucucua

SEQ ID NO: 1854695 - RNA, 12 nt, Homo sapiens
uucaccuaagag

SEQ ID NO: 1854696 - RNA, 23 nt, Homo sapiens
cugacccccaucgcucugagcau

SEQ ID NO: 1854697 - RNA, 15 nt, Homo sapiens
cacugcccaccaaag

SEQ ID NO: 1854698 - RNA, 15 nt, Homo sapiens
ugccgcaccauugaa

SEQ ID NO: 1854699 - RNA, 19 nt, Homo sapiens
gaauaucaucugucauuau

SEQ ID NO: 1854700 - RNA, 19 nt, Homo sapiens
cauggugccccuagcuuua

SEQ ID NO: 1854701 - RNA, 17 nt, Homo sapiens
aaaauugcuauguuacu

SEQ ID NO: 1854702 - RNA, 15 nt, Homo sapiens
agcucccauuucuac

SEQ ID NO: 1854703 - RNA, 21 nt, Homo sapiens
ccugaggugggagauguggaa

SEQ ID NO: 1854704 - RNA, 18 nt, Homo sapiens
agauaugaagaaucugcu

SEQ ID NO: 1854705 - RNA, 11 nt, Homo sapiens
agugugccaca

SEQ ID NO: 1854706 - RNA, 22 nt, Homo sapiens
ccuccugcaaaccucacagggu

SEQ ID NO: 1854707 - RNA, 19 nt, Homo sapiens
cagggaugcaaagguugca

SEQ ID NO: 1854708 - RNA, 12 nt, Homo sapiens
gagcaaauauca

SEQ ID NO: 1854709 - RNA, 21 nt, Homo sapiens
acacagacauccucuaugcca

SEQ ID NO: 1854710 - RNA, 17 nt, Homo sapiens
uugucuuugcuguaaac

SEQ ID NO: 1854711 - RNA, 23 nt, Homo sapiens
agcucagcgccagccugucccau

SEQ ID NO: 1854712 - RNA, 15 nt, Homo sapiens
acaugguuugacucu

SEQ ID NO: 1854713 - RNA, 15 nt, Homo sapiens
ugaaagaaaauaaca

SEQ ID NO: 1854714 - RNA, 18 nt, Homo sapiens
cuagaaccuggagagcua

SEQ ID NO: 1854715 - RNA, 21 nt, Homo sapiens
cuuggagggcaugaagacaga

SEQ ID NO: 1854716 - RNA, 16 nt, Homo sapiens
ugggacacccugugau

SEQ ID NO: 1854717 - RNA, 15 nt, Homo sapiens
uccugcccucuggga

SEQ ID NO: 1854718 - RNA, 16 nt, Homo sapiens
aguagugccugugauc

SEQ ID NO: 1854719 - RNA, 13 nt, Homo sapiens
cacacugugcuuu

SEQ ID NO: 1854720 - RNA, 19 nt, Homo sapiens
aguguuccccaucuggguc

SEQ ID NO: 1854721 - RNA, 19 nt, Homo sapiens
agagccacaguuccccuau

SEQ ID NO: 1854722 - RNA, 19 nt, Homo sapiens
cuuguauuuaacugaauaa

SEQ ID NO: 1854723 - RNA, 20 nt, Homo sapiens
cugaacuacauaacuuccua

SEQ ID NO: 1854724 - RNA, 15 nt, Homo sapiens
ucugaauuaauuaau

SEQ ID NO: 1854725 - RNA, 20 nt, Homo sapiens
gaaacaaaauccuuuucuca

SEQ ID NO: 1854726 - RNA, 21 nt, Homo sapiens
auuaugggauugcaaccagca

SEQ ID NO: 1854727 - RNA, 12 nt, Homo sapiens
ugaguaccaugg

SEQ ID NO: 1854728 - RNA, 15 nt, Homo sapiens
aggguggacuuagaa

SEQ ID NO: 1854729 - RNA, 19 nt, Homo sapiens
uccaacccaugagugcuaa

SEQ ID NO: 1854730 - RNA, 22 nt, Homo sapiens
ugggcagacacuguuugcccag

SEQ ID NO: 1854731 - RNA, 18 nt, Homo sapiens
aagguuaagccauaugac

SEQ ID NO: 1854732 - RNA, 20 nt, Homo sapiens
gaaaagauuauauauuauuu

SEQ ID NO: 1854733 - RNA, 13 nt, Homo sapiens
ucucuuccccaga

SEQ ID NO: 1854734 - RNA, 20 nt, Homo sapiens
auuacaucuuuauuaaccuc

SEQ ID NO: 1854735 - RNA, 23 nt, Homo sapiens
auacugccuuguuuaauguuaau

SEQ ID NO: 1854736 - RNA, 15 nt, Homo sapiens
cuggggacaccagcc

SEQ ID NO: 1854737 - RNA, 15 nt, Homo sapiens
caaagauguuuacau

SEQ ID NO: 1854738 - RNA, 15 nt, Homo sapiens
cacaucacuuaccac

SEQ ID NO: 1854739 - RNA, 20 nt, Homo sapiens
uugcaucuggguagcuguaa

SEQ ID NO: 1854740 - RNA, 17 nt, Homo sapiens
cuuggggaaauggggcu

SEQ ID NO: 1854741 - RNA, 19 nt, Homo sapiens
ccucccuguuccccagaga

SEQ ID NO: 1854742 - RNA, 15 nt, Homo sapiens
aauagaucuuaggca

SEQ ID NO: 1854743 - RNA, 14 nt, Homo sapiens
gcaugggucagggu

SEQ ID NO: 1854744 - RNA, 14 nt, Homo sapiens
uccagcucuaaguc

SEQ ID NO: 1854745 - RNA, 18 nt, Homo sapiens
cuuuuuuuuuaaggugaa

SEQ ID NO: 1854746 - RNA, 16 nt, Homo sapiens
ugucauguaauacuga

SEQ ID NO: 1854747 - RNA, 22 nt, Homo sapiens
caugaugagucugaaggcauuu

SEQ ID NO: 1854748 - RNA, 16 nt, Homo sapiens
gaguuguacacugugu

SEQ ID NO: 1854749 - RNA, 18 nt, Homo sapiens
auguauuguaaacaugug

SEQ ID NO: 1854750 - RNA, 16 nt, Homo sapiens
uaccuucaaacuuuag

SEQ ID NO: 1854751 - RNA, 18 nt, Homo sapiens
ucccuggacaggcagccu

SEQ ID NO: 1854752 - RNA, 15 nt, Homo sapiens
gauuucuguuuagau

SEQ ID NO: 1854753 - RNA, 17 nt, Homo sapiens
agacccuggugcugcca

SEQ ID NO: 1854754 - RNA, 14 nt, Homo sapiens
auagaugugagcca

SEQ ID NO: 1854755 - RNA, 15 nt, Homo sapiens
cuagucauaaccuua

SEQ ID NO: 1854756 - RNA, 15 nt, Homo sapiens
uuguucugucuuuag

SEQ ID NO: 1854757 - RNA, 19 nt, Homo sapiens
ugacugcauugccgcugua

SEQ ID NO: 1854758 - RNA, 13 nt, Homo sapiens
cacaauacaauaa

SEQ ID NO: 1854759 - RNA, 23 nt, Homo sapiens
gaugacaugguccaugucuaucc

SEQ ID NO: 1854760 - RNA, 23 nt, Homo sapiens
cgaugauguacagauucuuucag

SEQ ID NO: 1854761 - RNA, 20 nt, Homo sapiens
ugaaaucaguaaacacugug

SEQ ID NO: 1854762 - RNA, 20 nt, Homo sapiens
ccauagaggcccaggcacca

SEQ ID NO: 1854763 - RNA, 15 nt, Homo sapiens
aucugugcuggccau

SEQ ID NO: 1854764 - RNA, 20 nt, Homo sapiens
cccucuccagccugcuguau

SEQ ID NO: 1854765 - RNA, 20 nt, Homo sapiens
auggccccggugcggcugca

SEQ ID NO: 1854766 - RNA, 15 nt, Homo sapiens
gaaguuuacaaucaa

SEQ ID NO: 1854767 - RNA, 15 nt, Homo sapiens
ccagaggguugcugg

SEQ ID NO: 1854768 - RNA, 20 nt, Homo sapiens
caggagguuguggaugcucc

SEQ ID NO: 1854769 - RNA, 17 nt, Homo sapiens
uuuuaggggaagugaca

SEQ ID NO: 1854770 - RNA, 15 nt, Homo sapiens
gguccacgggacgau

SEQ ID NO: 1854771 - RNA, 12 nt, Homo sapiens
ggggaugcauag

SEQ ID NO: 1854772 - RNA, 14 nt, Homo sapiens
cuccuaaaacacac

SEQ ID NO: 1854773 - RNA, 18 nt, Homo sapiens
ugggcauucuuguuucaa

SEQ ID NO: 1854774 - RNA, 20 nt, Homo sapiens
gcuucuucccacaaagaaua

SEQ ID NO: 1854775 - RNA, 22 nt, Homo sapiens
uagggacucagggccaugccug

SEQ ID NO: 1854776 - RNA, 20 nt, Homo sapiens
aaccuccgccucucagguuc

SEQ ID NO: 1854777 - RNA, 15 nt, Homo sapiens
aagaaaaaaaccaua

SEQ ID NO: 1854778 - RNA, 14 nt, Homo sapiens
aaguuccaaaaaua

SEQ ID NO: 1854779 - RNA, 21 nt, Homo sapiens
auacaagugauaauacagauu

SEQ ID NO: 1854780 - RNA, 20 nt, Homo sapiens
gcacaagcagggcacucugu

SEQ ID NO: 1854781 - RNA, 14 nt, Homo sapiens
cugccaggcacucu

SEQ ID NO: 1854782 - RNA, 13 nt, Homo sapiens
ggaauacauugua

SEQ ID NO: 1854783 - RNA, 21 nt, Homo sapiens
ccaaaggacuugacuugcaau

SEQ ID NO: 1854784 - RNA, 16 nt, Homo sapiens
uccacgauucacucau

SEQ ID NO: 1854785 - RNA, 20 nt, Homo sapiens
uauaugugauuuacauuuca

SEQ ID NO: 1854786 - RNA, 16 nt, Homo sapiens
ugacaguuuguggcau

SEQ ID NO: 1854787 - RNA, 17 nt, Homo sapiens
caaaugcaguccaguga

SEQ ID NO: 1854788 - RNA, 21 nt, Homo sapiens
guguuuacuuuaaauccuuaa

SEQ ID NO: 1854789 - RNA, 13 nt, Homo sapiens
gcuccaagacuuu

SEQ ID NO: 1854790 - RNA, 17 nt, Homo sapiens
ccacacgcucacuccag

SEQ ID NO: 1854791 - RNA, 14 nt, Homo sapiens
ucccaccacugcac

SEQ ID NO: 1854792 - RNA, 23 nt, Homo sapiens
ucgauauuaauguauccaaugaa

SEQ ID NO: 1854793 - RNA, 20 nt, Homo sapiens
ugggcaucccagcuugcccc

SEQ ID NO: 1854794 - RNA, 16 nt, Homo sapiens
uaacuaaaugcucaua

SEQ ID NO: 1854795 - RNA, 20 nt, Homo sapiens
agaauugccuuaaggccaca

SEQ ID NO: 1854796 - RNA, 20 nt, Homo sapiens
uuaugaaaccuguacauaug

SEQ ID NO: 1854797 - RNA, 22 nt, Homo sapiens
uggugagaaucgaccucacugu

SEQ ID NO: 1854798 - RNA, 18 nt, Homo sapiens
cccagcacaaagcacugg

SEQ ID NO: 1854799 - RNA, 15 nt, Homo sapiens
gcagaugaucaggga

SEQ ID NO: 1854800 - RNA, 16 nt, Homo sapiens
aguguaccauucucag

SEQ ID NO: 1854801 - RNA, 13 nt, Homo sapiens
uguauugccaucc

SEQ ID NO: 1854802 - RNA, 18 nt, Homo sapiens
cuugacuuccugccaugg

SEQ ID NO: 1854803 - RNA, 15 nt, Homo sapiens
cccaaacaccaguca

SEQ ID NO: 1854804 - RNA, 19 nt, Homo sapiens
ccaggagcaaaugcuggau

SEQ ID NO: 1854805 - RNA, 14 nt, Homo sapiens
auauacucacuuuc

SEQ ID NO: 1854806 - RNA, 23 nt, Homo sapiens
aacaaauguuuauuaagcaucag

SEQ ID NO: 1854807 - RNA, 19 nt, Homo sapiens
uugcaaccuaguacuuuau

SEQ ID NO: 1854808 - RNA, 15 nt, Homo sapiens
aagguggucacuguu

SEQ ID NO: 1854809 - RNA, 17 nt, Homo sapiens
aacuaacaaccaaagac

SEQ ID NO: 1854810 - RNA, 17 nt, Homo sapiens
aaauaaaguaucaugca

SEQ ID NO: 1854811 - RNA, 20 nt, Homo sapiens
auccuugggagggugccauc

SEQ ID NO: 1854812 - RNA, 22 nt, Homo sapiens
gucuccucuuaaaaaauaaaaa

SEQ ID NO: 1854813 - RNA, 17 nt, Homo sapiens
ucagcugaauucacuua

SEQ ID NO: 1854814 - RNA, 13 nt, Homo sapiens
ccauucacaugcc

SEQ ID NO: 1854815 - RNA, 15 nt, Homo sapiens
uggcuguauuuagau

SEQ ID NO: 1854816 - RNA, 20 nt, Homo sapiens
ccauguagaacuugaacuaa

SEQ ID NO: 1854817 - RNA, 21 nt, Homo sapiens
agugcauuuuuaucugugagu

SEQ ID NO: 1854818 - RNA, 19 nt, Homo sapiens
aacuuggauguaccugccc

SEQ ID NO: 1854819 - RNA, 22 nt, Homo sapiens
ugugcaggcugcaguggcuccc

SEQ ID NO: 1854820 - RNA, 14 nt, Homo sapiens
aggacuaacaucuc

SEQ ID NO: 1854821 - RNA, 21 nt, Homo sapiens
gccauuacugcauaaaauaga

SEQ ID NO: 1854822 - RNA, 20 nt, Homo sapiens
ccccucccgccucgcugggc

SEQ ID NO: 1854823 - RNA, 18 nt, Homo sapiens
agcugagcugugacauug

SEQ ID NO: 1854824 - RNA, 18 nt, Homo sapiens
uugaggauuuagaagugu

SEQ ID NO: 1854825 - RNA, 15 nt, Homo sapiens
cagcagcaaacaaau

SEQ ID NO: 1854826 - RNA, 18 nt, Homo sapiens
cugagacacagcccagag

SEQ ID NO: 1854827 - RNA, 14 nt, Homo sapiens
gaaaggucauuaaa

SEQ ID NO: 1854828 - RNA, 15 nt, Homo sapiens
agccagucaagggca

SEQ ID NO: 1854829 - RNA, 23 nt, Homo sapiens
cucuacacccacccaaaagucac

SEQ ID NO: 1854830 - RNA, 20 nt, Homo sapiens
cuccccuugucugcacuguu

SEQ ID NO: 1854831 - RNA, 14 nt, Homo sapiens
aagucccagcauug

SEQ ID NO: 1854832 - RNA, 14 nt, Homo sapiens
gagacccaacaaug

SEQ ID NO: 1854833 - RNA, 11 nt, Homo sapiens
uaauguuauag

SEQ ID NO: 1854834 - RNA, 23 nt, Homo sapiens
gaagcagaaauacauauuuccaa

SEQ ID NO: 1854835 - RNA, 16 nt, Homo sapiens
uaauuuacagcuuuca

SEQ ID NO: 1854836 - RNA, 21 nt, Homo sapiens
ucuuucccuaaagaacauacc

SEQ ID NO: 1854837 - RNA, 15 nt, Homo sapiens
cccugaugacaccca

SEQ ID NO: 1854838 - RNA, 16 nt, Homo sapiens
uuccaguuucuguaag

SEQ ID NO: 1854839 - RNA, 14 nt, Homo sapiens
gaacuggagccaug

SEQ ID NO: 1854840 - RNA, 21 nt, Homo sapiens
ccuuccccagacuugcacugg

SEQ ID NO: 1854841 - RNA, 14 nt, Homo sapiens
acuuugcuggugua

SEQ ID NO: 1854842 - RNA, 15 nt, Homo sapiens
aguuaugacugugaa

SEQ ID NO: 1854843 - RNA, 20 nt, Homo sapiens
uacuuuucagaauugaagga

SEQ ID NO: 1854844 - RNA, 18 nt, Homo sapiens
caguccgccgcugcacau

SEQ ID NO: 1854845 - RNA, 21 nt, Homo sapiens
uauaaccuuguucucugcuug

SEQ ID NO: 1854846 - RNA, 14 nt, Homo sapiens
gcaaguagcacaug

SEQ ID NO: 1854847 - RNA, 21 nt, Homo sapiens
caaaacauauuuuacaucuga

SEQ ID NO: 1854848 - RNA, 16 nt, Homo sapiens
cagcuuucaaaagcaa

SEQ ID NO: 1854849 - RNA, 17 nt, Homo sapiens
uggcacucaacucugag

SEQ ID NO: 1854850 - RNA, 11 nt, Homo sapiens
uuacuacuauu

SEQ ID NO: 1854851 - RNA, 17 nt, Homo sapiens
aaagggaagccauuccg

SEQ ID NO: 1854852 - RNA, 15 nt, Homo sapiens
uggaacaacuuguag

SEQ ID NO: 1854853 - RNA, 20 nt, Homo sapiens
gucauccccuugugucagag

SEQ ID NO: 1854854 - RNA, 23 nt, Homo sapiens
cauggaggaauugggaccugguu

SEQ ID NO: 1854855 - RNA, 22 nt, Homo sapiens
ugcagacaucucuggagccaga

SEQ ID NO: 1854856 - RNA, 20 nt, Homo sapiens
cuauauuugcuaauaccaac

SEQ ID NO: 1854857 - RNA, 15 nt, Homo sapiens
ucuaaaaucugcuag

SEQ ID NO: 1854858 - RNA, 21 nt, Homo sapiens
caagaugcuggaugucugcca

SEQ ID NO: 1854859 - RNA, 21 nt, Homo sapiens
uggugagaacuacucagggaa

SEQ ID NO: 1854860 - RNA, 16 nt, Homo sapiens
cuuuugccaguauuau

SEQ ID NO: 1854861 - RNA, 16 nt, Homo sapiens
ugggaggaucacuuga

SEQ ID NO: 1854862 - RNA, 15 nt, Homo sapiens
ccccuuguguuugaa

SEQ ID NO: 1854863 - RNA, 18 nt, Homo sapiens
gguauauacaaguagauc

SEQ ID NO: 1854864 - RNA, 11 nt, Homo sapiens
acccacugugg

SEQ ID NO: 1854865 - RNA, 18 nt, Homo sapiens
cuucucugggcccagaga

SEQ ID NO: 1854866 - RNA, 22 nt, Homo sapiens
ccggauauauacauagcaugac

SEQ ID NO: 1854867 - RNA, 19 nt, Homo sapiens
acaggggcucucugugcaa

SEQ ID NO: 1854868 - RNA, 12 nt, Homo sapiens
uuacccauauau

SEQ ID NO: 1854869 - RNA, 15 nt, Homo sapiens
gauaccugcacuguc

SEQ ID NO: 1854870 - RNA, 20 nt, Homo sapiens
aagucucucaggcucucuga

SEQ ID NO: 1854871 - RNA, 22 nt, Homo sapiens
aaucaaaccgagcagggcugug

SEQ ID NO: 1854872 - RNA, 13 nt, Homo sapiens
caagaaugaaaca

SEQ ID NO: 1854873 - RNA, 13 nt, Homo sapiens
aaucuaugcaugu

SEQ ID NO: 1854874 - RNA, 17 nt, Homo sapiens
cuauacuuuguucuguu

SEQ ID NO: 1854875 - RNA, 20 nt, Homo sapiens
gagaugggugcaacucccuc

SEQ ID NO: 1854876 - RNA, 20 nt, Homo sapiens
ucccgagcaacccucugaag

SEQ ID NO: 1854877 - RNA, 20 nt, Homo sapiens
uccccagggcccuuguacaa

SEQ ID NO: 1854878 - RNA, 21 nt, Homo sapiens
accauaccuuagagacuuuga

SEQ ID NO: 1854879 - RNA, 17 nt, Homo sapiens
aggacuauagcccaggu

SEQ ID NO: 1854880 - RNA, 15 nt, Homo sapiens
uaauagcauucauaa

SEQ ID NO: 1854881 - RNA, 22 nt, Homo sapiens
agcuacuguagaaacaaagggu

SEQ ID NO: 1854882 - RNA, 15 nt, Homo sapiens
acuuaagaagccuua

SEQ ID NO: 1854883 - RNA, 13 nt, Homo sapiens
acacacacucacu

SEQ ID NO: 1854884 - RNA, 23 nt, Homo sapiens
cauggcugauugcagccuugacc

SEQ ID NO: 1854885 - RNA, 20 nt, Homo sapiens
uuaauggcucaugaccugga

SEQ ID NO: 1854886 - RNA, 22 nt, Homo sapiens
cucugacaagcuggccaaaguc

SEQ ID NO: 1854887 - RNA, 16 nt, Homo sapiens
aacuacagacuaaaga

SEQ ID NO: 1854888 - RNA, 16 nt, Homo sapiens
accuccgccauccacc

SEQ ID NO: 1854889 - RNA, 20 nt, Homo sapiens
agaggagcguguccuauccc

SEQ ID NO: 1854890 - RNA, 17 nt, Homo sapiens
aaaucaaucuggugcua

SEQ ID NO: 1854891 - RNA, 14 nt, Homo sapiens
uauagauuugaccu

SEQ ID NO: 1854892 - RNA, 18 nt, Homo sapiens
ugccagcugugugagaag

SEQ ID NO: 1854893 - RNA, 18 nt, Homo sapiens
agaugugcuuugcugcac

SEQ ID NO: 1854894 - RNA, 21 nt, Homo sapiens
ccccagggggcaacugacauu

SEQ ID NO: 1854895 - RNA, 17 nt, Homo sapiens
cagguuccagugccuga

SEQ ID NO: 1854896 - RNA, 18 nt, Homo sapiens
agcuccucucacucuuca

SEQ ID NO: 1854897 - RNA, 23 nt, Homo sapiens
agaaucacuugacuuugccacau

SEQ ID NO: 1854898 - RNA, 16 nt, Homo sapiens
gauggcaggugccugu

SEQ ID NO: 1854899 - RNA, 21 nt, Homo sapiens
aaaugcagaaguuacuaagua

SEQ ID NO: 1854900 - RNA, 20 nt, Homo sapiens
cuuccaacccgaggcaauaa

SEQ ID NO: 1854901 - RNA, 18 nt, Homo sapiens
uagaaucaagucugugaa

SEQ ID NO: 1854902 - RNA, 19 nt, Homo sapiens
aaguauugcgaaugugcag

SEQ ID NO: 1854903 - RNA, 18 nt, Homo sapiens
uccuuaacgcuagagauu

SEQ ID NO: 1854904 - RNA, 16 nt, Homo sapiens
cuguucuuuaguagca

SEQ ID NO: 1854905 - RNA, 14 nt, Homo sapiens
auacauggguagcu

SEQ ID NO: 1854906 - RNA, 22 nt, Homo sapiens
ucucugccuguacugaagcuga

SEQ ID NO: 1854907 - RNA, 21 nt, Homo sapiens
gagcauccuuaccuccaaaag

SEQ ID NO: 1854908 - RNA, 16 nt, Homo sapiens
uugauucuacucuuau

SEQ ID NO: 1854909 - RNA, 15 nt, Homo sapiens
acaagacaccaaauu

SEQ ID NO: 1854910 - RNA, 15 nt, Homo sapiens
ugugcaugccccuga

SEQ ID NO: 1854911 - RNA, 14 nt, Homo sapiens
acugcacacuucca

SEQ ID NO: 1854912 - RNA, 15 nt, Homo sapiens
cacagccucuagugu

SEQ ID NO: 1854913 - RNA, 20 nt, Homo sapiens
auacauucuuuaucuugaca

SEQ ID NO: 1854914 - RNA, 17 nt, Homo sapiens
uaaaaguauuugcuuaa

SEQ ID NO: 1854915 - RNA, 20 nt, Homo sapiens
ccucauccugagaaggccag

SEQ ID NO: 1854916 - RNA, 15 nt, Homo sapiens
uaagaaaagcuucca

SEQ ID NO: 1854917 - RNA, 23 nt, Homo sapiens
accacuagaaagugggcuuaaug

SEQ ID NO: 1854918 - RNA, 20 nt, Homo sapiens
cgaaugaaaagaaaugcaug

SEQ ID NO: 1854919 - RNA, 13 nt, Homo sapiens
augaaacuaugca

SEQ ID NO: 1854920 - RNA, 13 nt, Homo sapiens
guccaacugucaa

SEQ ID NO: 1854921 - RNA, 13 nt, Homo sapiens
cugcaacucugaa

SEQ ID NO: 1854922 - RNA, 13 nt, Homo sapiens
auuguguaugaga

SEQ ID NO: 1854923 - RNA, 20 nt, Homo sapiens
guaacagccaggaguguuaa

SEQ ID NO: 1854924 - RNA, 20 nt, Homo sapiens
accugggagaccagggacca

SEQ ID NO: 1854925 - RNA, 14 nt, Homo sapiens
agucugcuucugca

SEQ ID NO: 1854926 - RNA, 15 nt, Homo sapiens
gagccugcauuuccu

SEQ ID NO: 1854927 - RNA, 22 nt, Homo sapiens
gcccagggaagacacaugauua

SEQ ID NO: 1854928 - RNA, 19 nt, Homo sapiens
agaugaucgugccuauaaa

SEQ ID NO: 1854929 - RNA, 22 nt, Homo sapiens
gucaagagggggcaagucacau

SEQ ID NO: 1854930 - RNA, 22 nt, Homo sapiens
cugcacagauauuuccauuucu

SEQ ID NO: 1854931 - RNA, 18 nt, Homo sapiens
ugcaaacgcuguauucca

SEQ ID NO: 1854932 - RNA, 20 nt, Homo sapiens
cuggauuugcauacauucuu

SEQ ID NO: 1854933 - RNA, 21 nt, Homo sapiens
caccaacgagcuguacaugau

SEQ ID NO: 1854934 - RNA, 17 nt, Homo sapiens
agcuggaggcaucacgc

SEQ ID NO: 1854935 - RNA, 22 nt, Homo sapiens
agaaauuuagagucaauuugcu

SEQ ID NO: 1854936 - RNA, 19 nt, Homo sapiens
auauuuugcuuugugauuu

SEQ ID NO: 1854937 - RNA, 13 nt, Homo sapiens
guguguacaacac

SEQ ID NO: 1854938 - RNA, 20 nt, Homo sapiens
gagccagcuuggggccacca

SEQ ID NO: 1854939 - RNA, 18 nt, Homo sapiens
ucuucacucaaucucuga

SEQ ID NO: 1854940 - RNA, 21 nt, Homo sapiens
cucugcuguauugauaucacu

SEQ ID NO: 1854941 - RNA, 22 nt, Homo sapiens
uguaaacgacaagaauaauuca

SEQ ID NO: 1854942 - RNA, 19 nt, Homo sapiens
acagaugcacacacaccga

SEQ ID NO: 1854943 - RNA, 15 nt, Homo sapiens
caaaaaccuucccca

SEQ ID NO: 1854944 - RNA, 18 nt, Homo sapiens
uuguauuucucuuguccu

SEQ ID NO: 1854945 - RNA, 19 nt, Homo sapiens
guagcugggauuacaggug

SEQ ID NO: 1854946 - RNA, 18 nt, Homo sapiens
caguccuccgguugcaua

SEQ ID NO: 1854947 - RNA, 22 nt, Homo sapiens
agccacuaauugccuuacaagc

SEQ ID NO: 1854948 - RNA, 14 nt, Homo sapiens
aaauguauauacac

SEQ ID NO: 1854949 - RNA, 16 nt, Homo sapiens
gggucugagacugaaa

SEQ ID NO: 1854950 - RNA, 21 nt, Homo sapiens
aagcuuaauaugugcugaaca

SEQ ID NO: 1854951 - RNA, 13 nt, Homo sapiens
aguuugcacuuaa

SEQ ID NO: 1854952 - RNA, 16 nt, Homo sapiens
cuuuuagaucaacaau

SEQ ID NO: 1854953 - RNA, 22 nt, Homo sapiens
uucuggggcccaggaagcccac

SEQ ID NO: 1854954 - RNA, 17 nt, Homo sapiens
gaucauagcucacugua

SEQ ID NO: 1854955 - RNA, 16 nt, Homo sapiens
agaagcuggcccugca

SEQ ID NO: 1854956 - RNA, 15 nt, Homo sapiens
gagcugaagcuggga

SEQ ID NO: 1854957 - RNA, 11 nt, Homo sapiens
uaaacuagcac

SEQ ID NO: 1854958 - RNA, 15 nt, Homo sapiens
uguuccaugccugcu

SEQ ID NO: 1854959 - RNA, 20 nt, Homo sapiens
ccuuucagucauugucuuau

SEQ ID NO: 1854960 - RNA, 18 nt, Homo sapiens
uuacauacaugcuuugaa

SEQ ID NO: 1854961 - RNA, 21 nt, Homo sapiens
uagaacacucagcugcuucuu

SEQ ID NO: 1854962 - RNA, 12 nt, Homo sapiens
aagaaaguccac

SEQ ID NO: 1854963 - RNA, 17 nt, Homo sapiens
gucuccaggggccugca

SEQ ID NO: 1854964 - RNA, 14 nt, Homo sapiens
uucuucaucccacu

SEQ ID NO: 1854965 - RNA, 18 nt, Homo sapiens
uacuccacugcccuggca

SEQ ID NO: 1854966 - RNA, 20 nt, Homo sapiens
ugcaauuuuauuaaaugcau

SEQ ID NO: 1854967 - RNA, 18 nt, Homo sapiens
ggcaauuucaccaccaaa

SEQ ID NO: 1854968 - RNA, 18 nt, Homo sapiens
augguuuagauaaaggaa

SEQ ID NO: 1854969 - RNA, 22 nt, Homo sapiens
caugcagcaaggggacaucuua

SEQ ID NO: 1854970 - RNA, 20 nt, Homo sapiens
cuguauuugagacuaggaua

SEQ ID NO: 1854971 - RNA, 18 nt, Homo sapiens
aaucacaagaagauuccc

SEQ ID NO: 1854972 - RNA, 21 nt, Homo sapiens
acacagaggacccaggggaaa

SEQ ID NO: 1854973 - RNA, 11 nt, Homo sapiens
aaaaugggaug

SEQ ID NO: 1854974 - RNA, 20 nt, Homo sapiens
uggggggaagcacauaaucc

SEQ ID NO: 1854975 - RNA, 22 nt, Homo sapiens
guucuaggagaacugucaugag

SEQ ID NO: 1854976 - RNA, 18 nt, Homo sapiens
uuagaagccaacuaugau

SEQ ID NO: 1854977 - RNA, 15 nt, Homo sapiens
uaauguucugugaua

SEQ ID NO: 1854978 - RNA, 14 nt, Homo sapiens
caggacaaguggua

SEQ ID NO: 1854979 - RNA, 22 nt, Homo sapiens
acuuugaagagaugagcaguga

SEQ ID NO: 1854980 - RNA, 15 nt, Homo sapiens
cgccuaugaucccag

SEQ ID NO: 1854981 - RNA, 16 nt, Homo sapiens
uacauuuggaacagug

SEQ ID NO: 1854982 - RNA, 16 nt, Homo sapiens
aaucccgccccagggc

SEQ ID NO: 1854983 - RNA, 22 nt, Homo sapiens
caguugauuccuugaguuucau

SEQ ID NO: 1854984 - RNA, 20 nt, Homo sapiens
accucuucccaugacugcac

SEQ ID NO: 1854985 - RNA, 19 nt, Homo sapiens
cagugguuuuauacugaag

SEQ ID NO: 1854986 - RNA, 10 nt, Homo sapiens
caacacucca

SEQ ID NO: 1854987 - RNA, 19 nt, Homo sapiens
guuuccaauaaacgcaagc

SEQ ID NO: 1854988 - RNA, 11 nt, Homo sapiens
aacgccagucu

SEQ ID NO: 1854989 - RNA, 15 nt, Homo sapiens
aagacuugaugaaua

SEQ ID NO: 1854990 - RNA, 10 nt, Homo sapiens
ccaagcacag

SEQ ID NO: 1854991 - RNA, 14 nt, Homo sapiens
ucucuacagucucg

SEQ ID NO: 1854992 - RNA, 15 nt, Homo sapiens
ucuuuuauacuguac

SEQ ID NO: 1854993 - RNA, 17 nt, Homo sapiens
ccacagacagcuuagaa

SEQ ID NO: 1854994 - RNA, 12 nt, Homo sapiens
uucaagugccua

SEQ ID NO: 1854995 - RNA, 16 nt, Homo sapiens
auaucauaauguaaug

SEQ ID NO: 1854996 - RNA, 17 nt, Homo sapiens
uaugcacuucaaauaau

SEQ ID NO: 1854997 - RNA, 14 nt, Homo sapiens
aguucuccauuuca

SEQ ID NO: 1854998 - RNA, 12 nt, Homo sapiens
gcauagcacuug

SEQ ID NO: 1854999 - RNA, 12 nt, Homo sapiens
ccagagcaguuu

SEQ ID NO: 1855000 - RNA, 14 nt, Homo sapiens
gagcagcugaauaa

SEQ ID NO: 1855001 - RNA, 14 nt, Homo sapiens
ucuccuuaacacug

SEQ ID NO: 1855002 - RNA, 17 nt, Homo sapiens
uacagagaaaccagcuu

SEQ ID NO: 1855003 - RNA, 13 nt, Homo sapiens
gcaggaagccaaa

SEQ ID NO: 1855004 - RNA, 16 nt, Homo sapiens
gugcccuagacuggcu

SEQ ID NO: 1855005 - RNA, 20 nt, Homo sapiens
ugcuaaaggaaaaaaccauc

SEQ ID NO: 1855006 - RNA, 16 nt, Homo sapiens
uauuauaauagauuag

SEQ ID NO: 1855007 - RNA, 24 nt, Homo sapiens
ucuggcagguauccccagcaguca

SEQ ID NO: 1855008 - RNA, 15 nt, Homo sapiens
acaauauccuaugau

SEQ ID NO: 1855009 - RNA, 14 nt, Homo sapiens
ugcucacugcucac

SEQ ID NO: 1855010 - RNA, 20 nt, Homo sapiens
gacaguccaaccuugagaau

SEQ ID NO: 1855011 - RNA, 17 nt, Homo sapiens
aaaacuuuaaugaacua

SEQ ID NO: 1855012 - RNA, 21 nt, Homo sapiens
ucaccuugguuccuggggcau

SEQ ID NO: 1855013 - RNA, 20 nt, Homo sapiens
aaaggcaacauaauucuucc

SEQ ID NO: 1855014 - RNA, 12 nt, Homo sapiens
ugcagacugugg

SEQ ID NO: 1855015 - RNA, 13 nt, Homo sapiens
uuuuguuuggacc

SEQ ID NO: 1855016 - RNA, 15 nt, Homo sapiens
ggagccccgccaggu

SEQ ID NO: 1855017 - RNA, 21 nt, Homo sapiens
aucuccccucacacuuugcca

SEQ ID NO: 1855018 - RNA, 23 nt, Homo sapiens
uagcacccccagccaucuacugg

SEQ ID NO: 1855019 - RNA, 17 nt, Homo sapiens
acaacaucaagccugug

SEQ ID NO: 1855020 - RNA, 18 nt, Homo sapiens
gugauggacuggggagca

SEQ ID NO: 1855021 - RNA, 17 nt, Homo sapiens
caaauuucgagcauaag

SEQ ID NO: 1855022 - RNA, 18 nt, Homo sapiens
cauuuuguaacugccuac

SEQ ID NO: 1855023 - RNA, 22 nt, Homo sapiens
ccugcuggaucucccagggcua

SEQ ID NO: 1855024 - RNA, 14 nt, Homo sapiens
uaaacuccuacuaa

SEQ ID NO: 1855025 - RNA, 20 nt, Homo sapiens
auuuucaaguggaaaccuug

SEQ ID NO: 1855026 - RNA, 21 nt, Homo sapiens
gaaacuuugaggauaacuuuu

SEQ ID NO: 1855027 - RNA, 12 nt, Homo sapiens
ucuaucugcaau

SEQ ID NO: 1855028 - RNA, 14 nt, Homo sapiens
cgaacaauucauau

SEQ ID NO: 1855029 - RNA, 10 nt, Homo sapiens
cccuaaggga

SEQ ID NO: 1855030 - RNA, 22 nt, Homo sapiens
ucccaagagcaucaugccucug

SEQ ID NO: 1855031 - RNA, 21 nt, Homo sapiens
ugcuccauuucgugacuuuuu

SEQ ID NO: 1855032 - RNA, 19 nt, Homo sapiens
auaaccagccauuggcuau

SEQ ID NO: 1855033 - RNA, 13 nt, Homo sapiens
uguggcacuccaa

SEQ ID NO: 1855034 - RNA, 13 nt, Homo sapiens
cauuucuugugau

SEQ ID NO: 1855035 - RNA, 19 nt, Homo sapiens
gcccacugccugcccagug

SEQ ID NO: 1855036 - RNA, 15 nt, Homo sapiens
aacacuagacuguau

SEQ ID NO: 1855037 - RNA, 22 nt, Homo sapiens
aaagcaacuucaucccagcugc

SEQ ID NO: 1855038 - RNA, 16 nt, Homo sapiens
ucaaguuaacaaggaa

SEQ ID NO: 1855039 - RNA, 15 nt, Homo sapiens
uugugaugauagcac

SEQ ID NO: 1855040 - RNA, 12 nt, Homo sapiens
cuggguggacau

SEQ ID NO: 1855041 - RNA, 17 nt, Homo sapiens
cugcucagagcuuuaaa

SEQ ID NO: 1855042 - RNA, 21 nt, Homo sapiens
acaucuucucaaccuuaucaa

SEQ ID NO: 1855043 - RNA, 17 nt, Homo sapiens
cucaugggccuagcaua

SEQ ID NO: 1855044 - RNA, 12 nt, Homo sapiens
ucccugccucac

SEQ ID NO: 1855045 - RNA, 12 nt, Homo sapiens
ugcuugccugau

SEQ ID NO: 1855046 - RNA, 19 nt, Homo sapiens
uaaaaccccaucucuacua

SEQ ID NO: 1855047 - RNA, 21 nt, Homo sapiens
acuccaggaacaaaaagguaa

SEQ ID NO: 1855048 - RNA, 19 nt, Homo sapiens
agguucaagcgauucucau

SEQ ID NO: 1855049 - RNA, 14 nt, Homo sapiens
caauaaacauccuu

SEQ ID NO: 1855050 - RNA, 15 nt, Homo sapiens
uaccucaauguuuga

SEQ ID NO: 1855051 - RNA, 12 nt, Homo sapiens
ggggaugugcac

SEQ ID NO: 1855052 - RNA, 23 nt, Homo sapiens
gcugggcgcagcggcucacgccu

SEQ ID NO: 1855053 - RNA, 11 nt, Homo sapiens
accaguugaaa

SEQ ID NO: 1855054 - RNA, 13 nt, Homo sapiens
aaacucaccugcc

SEQ ID NO: 1855055 - RNA, 18 nt, Homo sapiens
auggugggcaggaucuca

SEQ ID NO: 1855056 - RNA, 19 nt, Homo sapiens
gucugccccacccucaaac

SEQ ID NO: 1855057 - RNA, 14 nt, Homo sapiens
uauauucuaagcca

SEQ ID NO: 1855058 - RNA, 17 nt, Homo sapiens
uuccuaacuagaauuag

SEQ ID NO: 1855059 - RNA, 16 nt, Homo sapiens
uggugugucaaugcca

SEQ ID NO: 1855060 - RNA, 20 nt, Homo sapiens
ugaacauguuuugagauuuu

SEQ ID NO: 1855061 - RNA, 13 nt, Homo sapiens
uccuauaagcuua

SEQ ID NO: 1855062 - RNA, 22 nt, Homo sapiens
cugaacaagcgcuuacgugaua

SEQ ID NO: 1855063 - RNA, 21 nt, Homo sapiens
caugugaaaaccugucacuug

SEQ ID NO: 1855064 - RNA, 16 nt, Homo sapiens
cacuaaagcauucaau

SEQ ID NO: 1855065 - RNA, 22 nt, Homo sapiens
gcuuaacacuaccaauuuccca

SEQ ID NO: 1855066 - RNA, 21 nt, Homo sapiens
ucugccauaucagugaaccuu

SEQ ID NO: 1855067 - RNA, 20 nt, Homo sapiens
accaauaaccuaauugucua

SEQ ID NO: 1855068 - RNA, 19 nt, Homo sapiens
aauauuucuucaaauaucu

SEQ ID NO: 1855069 - RNA, 13 nt, Homo sapiens
cacacucaaggga

SEQ ID NO: 1855070 - RNA, 13 nt, Homo sapiens
gcaggcaugcaug

SEQ ID NO: 1855071 - RNA, 15 nt, Homo sapiens
ucccugcagaugcca

SEQ ID NO: 1855072 - RNA, 14 nt, Homo sapiens
aauuuccuaaugag

SEQ ID NO: 1855073 - RNA, 18 nt, Homo sapiens
ugccagacgcucauucag

SEQ ID NO: 1855074 - RNA, 20 nt, Homo sapiens
uaacucauccguuugccaau

SEQ ID NO: 1855075 - RNA, 16 nt, Homo sapiens
cuagauguaacauucc

SEQ ID NO: 1855076 - RNA, 21 nt, Homo sapiens
guccuaggcucugggugcagu

SEQ ID NO: 1855077 - RNA, 15 nt, Homo sapiens
gcagagcuuccucag

SEQ ID NO: 1855078 - RNA, 14 nt, Homo sapiens
acaggaaaaugcca

SEQ ID NO: 1855079 - RNA, 15 nt, Homo sapiens
cucaacagagagcaa

SEQ ID NO: 1855080 - RNA, 16 nt, Homo sapiens
ugagucacuuguguca

SEQ ID NO: 1855081 - RNA, 21 nt, Homo sapiens
auauuuagaaaaacaucccaa

SEQ ID NO: 1855082 - RNA, 18 nt, Homo sapiens
gcgucaugcuuguguuau

SEQ ID NO: 1855083 - RNA, 21 nt, Homo sapiens
aggagaccagcgguccauggg

SEQ ID NO: 1855084 - RNA, 20 nt, Homo sapiens
uacuuacccuucuacaaaag

SEQ ID NO: 1855085 - RNA, 15 nt, Homo sapiens
ugugcagaaccuccu

SEQ ID NO: 1855086 - RNA, 16 nt, Homo sapiens
auaaacuauaaacuua

SEQ ID NO: 1855087 - RNA, 13 nt, Homo sapiens
caccugugacaaa

SEQ ID NO: 1855088 - RNA, 15 nt, Homo sapiens
gacaggcagugccau

SEQ ID NO: 1855089 - RNA, 21 nt, Homo sapiens
uugcugugggugcagcuguca

SEQ ID NO: 1855090 - RNA, 18 nt, Homo sapiens
cacagagcugaguccucu

SEQ ID NO: 1855091 - RNA, 22 nt, Homo sapiens
auuucugucucuaaccauucaa

SEQ ID NO: 1855092 - RNA, 21 nt, Homo sapiens
cuuggaggaccuuggccuguu

SEQ ID NO: 1855093 - RNA, 17 nt, Homo sapiens
ucgugcgaaacaccccc

SEQ ID NO: 1855094 - RNA, 21 nt, Homo sapiens
aauuccucagggggaacagcu

SEQ ID NO: 1855095 - RNA, 16 nt, Homo sapiens
agaaggcggaaaccca

SEQ ID NO: 1855096 - RNA, 18 nt, Homo sapiens
uguugaugaaguauacuu

SEQ ID NO: 1855097 - RNA, 22 nt, Homo sapiens
aauucugccuugguucuggcca

SEQ ID NO: 1855098 - RNA, 22 nt, Homo sapiens
acuggcacaguuuucugagaaa

SEQ ID NO: 1855099 - RNA, 22 nt, Homo sapiens
ccuacagcugucuucacaugua

SEQ ID NO: 1855100 - RNA, 20 nt, Homo sapiens
agaccaaaauuacuaauaaa

SEQ ID NO: 1855101 - RNA, 16 nt, Homo sapiens
aagcggcugccuccau

SEQ ID NO: 1855102 - RNA, 14 nt, Homo sapiens
ucaaaaucuuucca

SEQ ID NO: 1855103 - RNA, 18 nt, Homo sapiens
caucuggaaccaucagaa

SEQ ID NO: 1855104 - RNA, 22 nt, Homo sapiens
uucaaaugaugaagaccaaaga

SEQ ID NO: 1855105 - RNA, 22 nt, Homo sapiens
ccaggauugaccuguguguaag

SEQ ID NO: 1855106 - RNA, 20 nt, Homo sapiens
uguggcauuuccaaacaucc

SEQ ID NO: 1855107 - RNA, 14 nt, Homo sapiens
cucagacccaggag

SEQ ID NO: 1855108 - RNA, 17 nt, Homo sapiens
auguauggggaaucuaa

SEQ ID NO: 1855109 - RNA, 14 nt, Homo sapiens
auuagaagccaaga

SEQ ID NO: 1855110 - RNA, 12 nt, Homo sapiens
cagucaucucau

SEQ ID NO: 1855111 - RNA, 18 nt, Homo sapiens
gacaccuggacugagcca

SEQ ID NO: 1855112 - RNA, 14 nt, Homo sapiens
ugaggauugcugau

SEQ ID NO: 1855113 - RNA, 13 nt, Homo sapiens
auaugcacaugua

SEQ ID NO: 1855114 - RNA, 12 nt, Homo sapiens
uucccacugcca

SEQ ID NO: 1855115 - RNA, 13 nt, Homo sapiens
ucuguggccacau

SEQ ID NO: 1855116 - RNA, 23 nt, Homo sapiens
ucauucccauuuuguuacauuuc

SEQ ID NO: 1855117 - RNA, 17 nt, Homo sapiens
ucaccccccacacucac

SEQ ID NO: 1855118 - RNA, 19 nt, Homo sapiens
aucucggcucacugcaagu

SEQ ID NO: 1855119 - RNA, 9 nt, Homo sapiens
gcagcuuua

SEQ ID NO: 1855120 - RNA, 22 nt, Homo sapiens
gcuaaacagaugucuucuugca

SEQ ID NO: 1855121 - RNA, 14 nt, Homo sapiens
ugaacaacuccaaa

SEQ ID NO: 1855122 - RNA, 15 nt, Homo sapiens
ccaggcugcagugca

SEQ ID NO: 1855123 - RNA, 21 nt, Homo sapiens
ucauuccuuagauaccuugaa

SEQ ID NO: 1855124 - RNA, 18 nt, Homo sapiens
ccaggccaacaguagcca

SEQ ID NO: 1855125 - RNA, 20 nt, Homo sapiens
auuuaaucaccacucaaaaa

SEQ ID NO: 1855126 - RNA, 22 nt, Homo sapiens
augcuauuucagccaaucugga

SEQ ID NO: 1855127 - RNA, 14 nt, Homo sapiens
caccaaaugugcuu

SEQ ID NO: 1855128 - RNA, 17 nt, Homo sapiens
ugcagucacaucacaau

SEQ ID NO: 1855129 - RNA, 20 nt, Homo sapiens
aacagaagccaaaauacuuc

SEQ ID NO: 1855130 - RNA, 22 nt, Homo sapiens
ccuuccagcaaacguacgggaa

SEQ ID NO: 1855131 - RNA, 16 nt, Homo sapiens
ucaggagauggagacc

SEQ ID NO: 1855132 - RNA, 23 nt, Homo sapiens
aggcuucagugagccaugaucau

SEQ ID NO: 1855133 - RNA, 14 nt, Homo sapiens
ggauuuggggacca

SEQ ID NO: 1855134 - RNA, 17 nt, Homo sapiens
uuauuaagcaguacaaa

SEQ ID NO: 1855135 - RNA, 16 nt, Homo sapiens
agcaucugucuuguca

SEQ ID NO: 1855136 - RNA, 17 nt, Homo sapiens
agggaccuugucuccca

SEQ ID NO: 1855137 - RNA, 12 nt, Homo sapiens
agucuguaggga

SEQ ID NO: 1855138 - RNA, 22 nt, Homo sapiens
aacugauuauuacuucuguuuc

SEQ ID NO: 1855139 - RNA, 17 nt, Homo sapiens
ugcaauucaucccagag

SEQ ID NO: 1855140 - RNA, 18 nt, Homo sapiens
cuugcugcgagacuucag

SEQ ID NO: 1855141 - RNA, 18 nt, Homo sapiens
cucccaagccacauucau

SEQ ID NO: 1855142 - RNA, 21 nt, Homo sapiens
acuuuugaggacaaguuacac

SEQ ID NO: 1855143 - RNA, 20 nt, Homo sapiens
agcaggccauuggcuacuga

SEQ ID NO: 1855144 - RNA, 14 nt, Homo sapiens
cuuccuaagccugu

SEQ ID NO: 1855145 - RNA, 20 nt, Homo sapiens
gccuauaaucccagcuacug

SEQ ID NO: 1855146 - RNA, 21 nt, Homo sapiens
cacuaguccauaagcuuuacc

SEQ ID NO: 1855147 - RNA, 19 nt, Homo sapiens
cuuuuaaaaacauaacaua

SEQ ID NO: 1855148 - RNA, 17 nt, Homo sapiens
uuaacagaucuuuacuc

SEQ ID NO: 1855149 - RNA, 14 nt, Homo sapiens
agugggcaccucag

SEQ ID NO: 1855150 - RNA, 19 nt, Homo sapiens
acaguguuagaugugcaca

SEQ ID NO: 1855151 - RNA, 18 nt, Homo sapiens
guaaaaugucaauagcaa

SEQ ID NO: 1855152 - RNA, 14 nt, Homo sapiens
accuccgggacuga

SEQ ID NO: 1855153 - RNA, 13 nt, Homo sapiens
ccucacuccucag

SEQ ID NO: 1855154 - RNA, 19 nt, Homo sapiens
gucuguaaaagagccuagu

SEQ ID NO: 1855155 - RNA, 12 nt, Homo sapiens
aucccaaccagu

SEQ ID NO: 1855156 - RNA, 15 nt, Homo sapiens
accagcccugcacga

SEQ ID NO: 1855157 - RNA, 21 nt, Homo sapiens
cuucaacuuggaaaugacaca

SEQ ID NO: 1855158 - RNA, 16 nt, Homo sapiens
gcuaccugagcugacc

SEQ ID NO: 1855159 - RNA, 13 nt, Homo sapiens
aaaggcagguggg

SEQ ID NO: 1855160 - RNA, 19 nt, Homo sapiens
cuccccuuuuucuuccuca

SEQ ID NO: 1855161 - RNA, 14 nt, Homo sapiens
ucauccgcacugua

SEQ ID NO: 1855162 - RNA, 18 nt, Homo sapiens
gauauagaucacauaaca

SEQ ID NO: 1855163 - RNA, 12 nt, Homo sapiens
cugaaagguaau

SEQ ID NO: 1855164 - RNA, 13 nt, Homo sapiens
auagccaaaaagu

SEQ ID NO: 1855165 - RNA, 17 nt, Homo sapiens
aauaaaagaaucauuug

SEQ ID NO: 1855166 - RNA, 22 nt, Homo sapiens
guaagcauuuccagccuaucua

SEQ ID NO: 1855167 - RNA, 22 nt, Homo sapiens
cugcucaucuguacauacuguu

SEQ ID NO: 1855168 - RNA, 15 nt, Homo sapiens
gaaaugucaguugcu

SEQ ID NO: 1855169 - RNA, 21 nt, Homo sapiens
agaagaaguuugaccaucacc

SEQ ID NO: 1855170 - RNA, 17 nt, Homo sapiens
uuguugccaaggcagaa

SEQ ID NO: 1855171 - RNA, 15 nt, Homo sapiens
acaaaaauuagccag

SEQ ID NO: 1855172 - RNA, 18 nt, Homo sapiens
ucuauguagaacuguuca

SEQ ID NO: 1855173 - RNA, 13 nt, Homo sapiens
gugcacugaccug

SEQ ID NO: 1855174 - RNA, 18 nt, Homo sapiens
auacaauuaaagcuguua

SEQ ID NO: 1855175 - RNA, 19 nt, Homo sapiens
uaaagccuuauuuuucaaa

SEQ ID NO: 1855176 - RNA, 17 nt, Homo sapiens
agauacaaucagcugcu

SEQ ID NO: 1855177 - RNA, 14 nt, Homo sapiens
uucuagcuucccuu

SEQ ID NO: 1855178 - RNA, 14 nt, Homo sapiens
ccagcuuccugugu

SEQ ID NO: 1855179 - RNA, 19 nt, Homo sapiens
agacugaagauggaaaaag

SEQ ID NO: 1855180 - RNA, 20 nt, Homo sapiens
acaaagggacuuuggaaaac

SEQ ID NO: 1855181 - RNA, 12 nt, Homo sapiens
aguaucugagaa

SEQ ID NO: 1855182 - RNA, 14 nt, Homo sapiens
ccccuccuccagau

SEQ ID NO: 1855183 - RNA, 15 nt, Homo sapiens
uguugagugcacuga

SEQ ID NO: 1855184 - RNA, 20 nt, Homo sapiens
ccacuagaagcaacuaggaa

SEQ ID NO: 1855185 - RNA, 16 nt, Homo sapiens
gccccgccccccagag

SEQ ID NO: 1855186 - RNA, 17 nt, Homo sapiens
ccuaaacuuacauuuaa

SEQ ID NO: 1855187 - RNA, 14 nt, Homo sapiens
agaggucccaagga

SEQ ID NO: 1855188 - RNA, 16 nt, Homo sapiens
cuguaauuuuguagua

SEQ ID NO: 1855189 - RNA, 16 nt, Homo sapiens
caauccaacccgggga

SEQ ID NO: 1855190 - RNA, 19 nt, Homo sapiens
uaaauuauuagagauuuuc

SEQ ID NO: 1855191 - RNA, 14 nt, Homo sapiens
uuccagguguuacu

SEQ ID NO: 1855192 - RNA, 23 nt, Homo sapiens
uagcugcuuuaaaucuaucuaua

SEQ ID NO: 1855193 - RNA, 23 nt, Homo sapiens
ugugcacuuucuucucuuuccca

SEQ ID NO: 1855194 - RNA, 16 nt, Homo sapiens
uccacuacuuuacugu

SEQ ID NO: 1855195 - RNA, 14 nt, Homo sapiens
ucccccaaccaagg

SEQ ID NO: 1855196 - RNA, 15 nt, Homo sapiens
uuaaacccuuaccaa

SEQ ID NO: 1855197 - RNA, 18 nt, Homo sapiens
ucucuccaggagggcucg

SEQ ID NO: 1855198 - RNA, 13 nt, Homo sapiens
uguuucuaacuca

SEQ ID NO: 1855199 - RNA, 18 nt, Homo sapiens
aggugcucuggucugugg

SEQ ID NO: 1855200 - RNA, 19 nt, Homo sapiens
ggaagagcuguguggccug

SEQ ID NO: 1855201 - RNA, 22 nt, Homo sapiens
auuccuuuacuacgaaguauaa

SEQ ID NO: 1855202 - RNA, 15 nt, Homo sapiens
acaggcauagaguga

SEQ ID NO: 1855203 - RNA, 21 nt, Homo sapiens
uuugaauuuuuuagugacuaa

SEQ ID NO: 1855204 - RNA, 18 nt, Homo sapiens
cuuccagauuuccuuuca

SEQ ID NO: 1855205 - RNA, 20 nt, Homo sapiens
cuggaaaauuccagagcuau

SEQ ID NO: 1855206 - RNA, 18 nt, Homo sapiens
cuagcaaaauuacuacca

SEQ ID NO: 1855207 - RNA, 21 nt, Homo sapiens
aggcuuggcacacugccagug

SEQ ID NO: 1855208 - RNA, 14 nt, Homo sapiens
uuccagagcucuga

SEQ ID NO: 1855209 - RNA, 16 nt, Homo sapiens
cccaggaaguggcuca

SEQ ID NO: 1855210 - RNA, 20 nt, Homo sapiens
caguuuuuuucuuuguguag

SEQ ID NO: 1855211 - RNA, 23 nt, Homo sapiens
agcugaaugugauacaugccgaa

SEQ ID NO: 1855212 - RNA, 20 nt, Homo sapiens
acuuccuuuaggaucucagg

SEQ ID NO: 1855213 - RNA, 21 nt, Homo sapiens
aucaccccgugaagcaaucau

SEQ ID NO: 1855214 - RNA, 19 nt, Homo sapiens
cacucaacugguuugacau

SEQ ID NO: 1855215 - RNA, 11 nt, Homo sapiens
accaccaaagu

SEQ ID NO: 1855216 - RNA, 19 nt, Homo sapiens
acaggguggcccaaauaga

SEQ ID NO: 1855217 - RNA, 17 nt, Homo sapiens
aauguauaugucauuua

SEQ ID NO: 1855218 - RNA, 15 nt, Homo sapiens
agaaauugcaauaug

SEQ ID NO: 1855219 - RNA, 14 nt, Homo sapiens
auacaccuauguca

SEQ ID NO: 1855220 - RNA, 19 nt, Homo sapiens
cccuguaaccugacugguu

SEQ ID NO: 1855221 - RNA, 17 nt, Homo sapiens
ccaagagguacuguaau

SEQ ID NO: 1855222 - RNA, 21 nt, Homo sapiens
uuguaagaaagacaagacauu

SEQ ID NO: 1855223 - RNA, 12 nt, Homo sapiens
ugaucugggcau

SEQ ID NO: 1855224 - RNA, 12 nt, Homo sapiens
cucugauaccuc

SEQ ID NO: 1855225 - RNA, 22 nt, Homo sapiens
aaacauuaaaauauaaucucua

SEQ ID NO: 1855226 - RNA, 18 nt, Homo sapiens
aaaacccgacaacauuuc

SEQ ID NO: 1855227 - RNA, 15 nt, Homo sapiens
ccagccccacacagc

SEQ ID NO: 1855228 - RNA, 22 nt, Homo sapiens
ucaaaugacccaaagaccaaua

SEQ ID NO: 1855229 - RNA, 15 nt, Homo sapiens
gccaugcugggccac

SEQ ID NO: 1855230 - RNA, 19 nt, Homo sapiens
caauugucauugauacaug

SEQ ID NO: 1855231 - RNA, 23 nt, Homo sapiens
gccccagcacuaaagcaguggac

SEQ ID NO: 1855232 - RNA, 17 nt, Homo sapiens
ggcaagcccugcccaca

SEQ ID NO: 1855233 - RNA, 20 nt, Homo sapiens
accauugcugucaaguuccu

SEQ ID NO: 1855234 - RNA, 21 nt, Homo sapiens
agaagccagacugguuagaca

SEQ ID NO: 1855235 - RNA, 14 nt, Homo sapiens
ccugugaaugcuga

SEQ ID NO: 1855236 - RNA, 14 nt, Homo sapiens
caguaguaucaaau

SEQ ID NO: 1855237 - RNA, 20 nt, Homo sapiens
acuucuuguguguaugcaca

SEQ ID NO: 1855238 - RNA, 21 nt, Homo sapiens
aaagccaccagacugacaaau

SEQ ID NO: 1855239 - RNA, 17 nt, Homo sapiens
aagaaugugucuugcga

SEQ ID NO: 1855240 - RNA, 17 nt, Homo sapiens
aaaugaugauaguauaa

SEQ ID NO: 1855241 - RNA, 12 nt, Homo sapiens
agagcauuucaa

SEQ ID NO: 1855242 - RNA, 19 nt, Homo sapiens
uuuucaaaauccaaaaaga

SEQ ID NO: 1855243 - RNA, 12 nt, Homo sapiens
ccacaugcaugu

SEQ ID NO: 1855244 - RNA, 13 nt, Homo sapiens
uuuauacauucua

SEQ ID NO: 1855245 - RNA, 19 nt, Homo sapiens
gcccaaucauuugcaaugc

SEQ ID NO: 1855246 - RNA, 23 nt, Homo sapiens
cuaaauucuuucauuuuaggggu

SEQ ID NO: 1855247 - RNA, 21 nt, Homo sapiens
accauuuuguuauugacuaac

SEQ ID NO: 1855248 - RNA, 17 nt, Homo sapiens
cuagaagaugaauacaa

SEQ ID NO: 1855249 - RNA, 15 nt, Homo sapiens
aauauuuagcuguaa

SEQ ID NO: 1855250 - RNA, 22 nt, Homo sapiens
acugcugggcuccacuuggcuc

SEQ ID NO: 1855251 - RNA, 15 nt, Homo sapiens
cugauucagcauuuu

SEQ ID NO: 1855252 - RNA, 22 nt, Homo sapiens
gcauaguacuggcacaaaaaca

SEQ ID NO: 1855253 - RNA, 22 nt, Homo sapiens
gcauaaauccauccauccaaag

SEQ ID NO: 1855254 - RNA, 22 nt, Homo sapiens
cagcccuuccucccauuuccca

SEQ ID NO: 1855255 - RNA, 14 nt, Homo sapiens
acccagggguccag

SEQ ID NO: 1855256 - RNA, 17 nt, Homo sapiens
ucccagcguguguaucc

SEQ ID NO: 1855257 - RNA, 14 nt, Homo sapiens
acuuuucauugcaa

SEQ ID NO: 1855258 - RNA, 14 nt, Homo sapiens
ucuuuucaaugcaa

SEQ ID NO: 1855259 - RNA, 19 nt, Homo sapiens
cgagaauguauggauuuac

SEQ ID NO: 1855260 - RNA, 16 nt, Homo sapiens
uguagcaagaacugca

SEQ ID NO: 1855261 - RNA, 15 nt, Homo sapiens
gguuuuacugcagcu

SEQ ID NO: 1855262 - RNA, 19 nt, Homo sapiens
cuuucaccacaugugcaca

SEQ ID NO: 1855263 - RNA, 14 nt, Homo sapiens
ucuugucucugagg

SEQ ID NO: 1855264 - RNA, 14 nt, Homo sapiens
ccucugcagccuga

SEQ ID NO: 1855265 - RNA, 13 nt, Homo sapiens
gaugaguuugaca

SEQ ID NO: 1855266 - RNA, 20 nt, Homo sapiens
ucuuacacaggcuucaucaa

SEQ ID NO: 1855267 - RNA, 21 nt, Homo sapiens
auaugaucccuaauguguuuc

SEQ ID NO: 1855268 - RNA, 16 nt, Homo sapiens
aaguaauucucaagaa

SEQ ID NO: 1855269 - RNA, 14 nt, Homo sapiens
uuccucuuacugua

SEQ ID NO: 1855270 - RNA, 14 nt, Homo sapiens
cucugggguccuca

SEQ ID NO: 1855271 - RNA, 21 nt, Homo sapiens
ugugcccagcaggcccagcau

SEQ ID NO: 1855272 - RNA, 15 nt, Homo sapiens
uggccauguucucca

SEQ ID NO: 1855273 - RNA, 20 nt, Homo sapiens
cccuuucugugugaagauca

SEQ ID NO: 1855274 - RNA, 17 nt, Homo sapiens
ccaggugugguggcuca

SEQ ID NO: 1855275 - RNA, 17 nt, Homo sapiens
uugcccaguucauccca

SEQ ID NO: 1855276 - RNA, 19 nt, Homo sapiens
acugcacccccuccugcug

SEQ ID NO: 1855277 - RNA, 19 nt, Homo sapiens
cauugauuugcucuuacua

SEQ ID NO: 1855278 - RNA, 12 nt, Homo sapiens
auucaucuucau

SEQ ID NO: 1855279 - RNA, 15 nt, Homo sapiens
cagcugggauuacag

SEQ ID NO: 1855280 - RNA, 19 nt, Homo sapiens
ccuggggugggacagggag

SEQ ID NO: 1855281 - RNA, 21 nt, Homo sapiens
gauggccauguauuaccugaa

SEQ ID NO: 1855282 - RNA, 23 nt, Homo sapiens
gcccagcuuuuagaaaaugcagu

SEQ ID NO: 1855283 - RNA, 22 nt, Homo sapiens
gaaaaaaauucugauacauuag

SEQ ID NO: 1855284 - RNA, 18 nt, Homo sapiens
ccuuucuuuugaaaugcc

SEQ ID NO: 1855285 - RNA, 16 nt, Homo sapiens
aaugaauuucauguga

SEQ ID NO: 1855286 - RNA, 18 nt, Homo sapiens
ccaacuugaugugaaaag

SEQ ID NO: 1855287 - RNA, 13 nt, Homo sapiens
cuuguugcacugc

SEQ ID NO: 1855288 - RNA, 20 nt, Homo sapiens
ugaccucaggcaaucugccc

SEQ ID NO: 1855289 - RNA, 16 nt, Homo sapiens
acucauuagugacuuc

SEQ ID NO: 1855290 - RNA, 14 nt, Homo sapiens
gucccacacugugg

SEQ ID NO: 1855291 - RNA, 21 nt, Homo sapiens
ccacgcuagggcggggcacag

SEQ ID NO: 1855292 - RNA, 14 nt, Homo sapiens
cacgacaguggaug

SEQ ID NO: 1855293 - RNA, 14 nt, Homo sapiens
uauggcauuugcag

SEQ ID NO: 1855294 - RNA, 15 nt, Homo sapiens
uacugcuuaauucaa

SEQ ID NO: 1855295 - RNA, 11 nt, Homo sapiens
ucucugcaaaa

SEQ ID NO: 1855296 - RNA, 16 nt, Homo sapiens
acuauuaauacucugc

SEQ ID NO: 1855297 - RNA, 15 nt, Homo sapiens
ucagaaacacagauu

SEQ ID NO: 1855298 - RNA, 15 nt, Homo sapiens
uuaaaaucauaaaua

SEQ ID NO: 1855299 - RNA, 14 nt, Homo sapiens
auuccuucaauuca

SEQ ID NO: 1855300 - RNA, 16 nt, Homo sapiens
auagccauaugcaaua

SEQ ID NO: 1855301 - RNA, 11 nt, Homo sapiens
caugugaaauc

SEQ ID NO: 1855302 - RNA, 17 nt, Homo sapiens
uggauugcagacuguuc

SEQ ID NO: 1855303 - RNA, 19 nt, Homo sapiens
cacugccuucucaacucca

SEQ ID NO: 1855304 - RNA, 23 nt, Homo sapiens
accucccacugcccccuccacug

SEQ ID NO: 1855305 - RNA, 20 nt, Homo sapiens
augggaucuuucugacacac

SEQ ID NO: 1855306 - RNA, 21 nt, Homo sapiens
uuugcuuaccuuuuccuauuc

SEQ ID NO: 1855307 - RNA, 14 nt, Homo sapiens
agugaaaaguagag

SEQ ID NO: 1855308 - RNA, 15 nt, Homo sapiens
ugaguuuguacaguc

SEQ ID NO: 1855309 - RNA, 19 nt, Homo sapiens
gauacuguugcacgugugu

SEQ ID NO: 1855310 - RNA, 14 nt, Homo sapiens
agagaggaguucaa

SEQ ID NO: 1855311 - RNA, 17 nt, Homo sapiens
ucaguauccacacauaa

SEQ ID NO: 1855312 - RNA, 15 nt, Homo sapiens
auuuaucugugcaaa

SEQ ID NO: 1855313 - RNA, 21 nt, Homo sapiens
uaguggcaaaugaaagcauaa

SEQ ID NO: 1855314 - RNA, 15 nt, Homo sapiens
ggucauaguguauaa

SEQ ID NO: 1855315 - RNA, 16 nt, Homo sapiens
agcuaagacugauguc

SEQ ID NO: 1855316 - RNA, 11 nt, Homo sapiens
ugaauuugacu

SEQ ID NO: 1855317 - RNA, 19 nt, Homo sapiens
aaaagcaucacaugaacuu

SEQ ID NO: 1855318 - RNA, 14 nt, Homo sapiens
agccaacugucagg

SEQ ID NO: 1855319 - RNA, 17 nt, Homo sapiens
agauuuaaagcaucauc

SEQ ID NO: 1855320 - RNA, 15 nt, Homo sapiens
ccacugcaaauuuca

SEQ ID NO: 1855321 - RNA, 16 nt, Homo sapiens
ggaccacauguguucu

SEQ ID NO: 1855322 - RNA, 17 nt, Homo sapiens
uagucugccuucccagg

SEQ ID NO: 1855323 - RNA, 20 nt, Homo sapiens
caucuggaccugguacaaau

SEQ ID NO: 1855324 - RNA, 14 nt, Homo sapiens
gcacucuaaacugc

SEQ ID NO: 1855325 - RNA, 21 nt, Homo sapiens
acagucaguucucauuauuca

SEQ ID NO: 1855326 - RNA, 14 nt, Homo sapiens
caucuggugcucuu

SEQ ID NO: 1855327 - RNA, 14 nt, Homo sapiens
gggcaguggcacga

SEQ ID NO: 1855328 - RNA, 16 nt, Homo sapiens
cuuguucauucuguga

SEQ ID NO: 1855329 - RNA, 14 nt, Homo sapiens
gugaauuauucuga

SEQ ID NO: 1855330 - RNA, 18 nt, Homo sapiens
cagcuguuuuguugacau

SEQ ID NO: 1855331 - RNA, 18 nt, Homo sapiens
aaccuauauuucaauacu

SEQ ID NO: 1855332 - RNA, 15 nt, Homo sapiens
cucccccagaccucc

SEQ ID NO: 1855333 - RNA, 18 nt, Homo sapiens
aaucauguguugcagcuu

SEQ ID NO: 1855334 - RNA, 11 nt, Homo sapiens
accaccugguu

SEQ ID NO: 1855335 - RNA, 16 nt, Homo sapiens
acauuuuuuuguucuc

SEQ ID NO: 1855336 - RNA, 15 nt, Homo sapiens
ugacuuauguaauca

SEQ ID NO: 1855337 - RNA, 23 nt, Homo sapiens
ccgguuggagccugcucuuugaa

SEQ ID NO: 1855338 - RNA, 14 nt, Homo sapiens
cuuucucuuaacag

SEQ ID NO: 1855339 - RNA, 16 nt, Homo sapiens
caagaagucccaagac

SEQ ID NO: 1855340 - RNA, 12 nt, Homo sapiens
ugaagagcuaau

SEQ ID NO: 1855341 - RNA, 19 nt, Homo sapiens
uguccugggggaugcaaau

SEQ ID NO: 1855342 - RNA, 20 nt, Homo sapiens
acccaaacacuucugcuuuc

SEQ ID NO: 1855343 - RNA, 20 nt, Homo sapiens
uuugaaaauuugcugauucu

SEQ ID NO: 1855344 - RNA, 20 nt, Homo sapiens
acauagaugucuguaaccaa

SEQ ID NO: 1855345 - RNA, 15 nt, Homo sapiens
aaauuuaauuaauua

SEQ ID NO: 1855346 - RNA, 15 nt, Homo sapiens
caggcuucacagucu

SEQ ID NO: 1855347 - RNA, 19 nt, Homo sapiens
ucuagauguccaagugcca

SEQ ID NO: 1855348 - RNA, 18 nt, Homo sapiens
cauaauggauucacugag

SEQ ID NO: 1855349 - RNA, 17 nt, Homo sapiens
cuauacuaccaaaagag

SEQ ID NO: 1855350 - RNA, 18 nt, Homo sapiens
aggagggacaagaaucaa

SEQ ID NO: 1855351 - RNA, 15 nt, Homo sapiens
ucaaauggacuguua

SEQ ID NO: 1855352 - RNA, 15 nt, Homo sapiens
cacaccaggucuucc

SEQ ID NO: 1855353 - RNA, 19 nt, Homo sapiens
uauuucccucuacugagua

SEQ ID NO: 1855354 - RNA, 11 nt, Homo sapiens
cauuuaccaaa

SEQ ID NO: 1855355 - RNA, 22 nt, Homo sapiens
cuggaaaacucaggauucucac

SEQ ID NO: 1855356 - RNA, 23 nt, Homo sapiens
uuuaguaagagauuccugagcca

SEQ ID NO: 1855357 - RNA, 20 nt, Homo sapiens
ggccaguggaagaaacaccc

SEQ ID NO: 1855358 - RNA, 17 nt, Homo sapiens
auaucuggccacacugg

SEQ ID NO: 1855359 - RNA, 23 nt, Homo sapiens
guacucaguaaaucagugcagua

SEQ ID NO: 1855360 - RNA, 21 nt, Homo sapiens
caguuaacaggauauuagaca

SEQ ID NO: 1855361 - RNA, 14 nt, Homo sapiens
ccuguucaaaaagg

SEQ ID NO: 1855362 - RNA, 14 nt, Homo sapiens
gucauagacuccuu

SEQ ID NO: 1855363 - RNA, 15 nt, Homo sapiens
uaaguggacuguauu

SEQ ID NO: 1855364 - RNA, 11 nt, Homo sapiens
gauaacuaaaa

SEQ ID NO: 1855365 - RNA, 14 nt, Homo sapiens
gcaagaccaaauca

SEQ ID NO: 1855366 - RNA, 17 nt, Homo sapiens
acuacuuggaaaaaaua

SEQ ID NO: 1855367 - RNA, 18 nt, Homo sapiens
gccuugccuccucaccca

SEQ ID NO: 1855368 - RNA, 17 nt, Homo sapiens
gcugcaauaaagauuga

SEQ ID NO: 1855369 - RNA, 14 nt, Homo sapiens
ugaaacccacagau

SEQ ID NO: 1855370 - RNA, 23 nt, Homo sapiens
ugggaagccauauucacaccuca

SEQ ID NO: 1855371 - RNA, 17 nt, Homo sapiens
uucuaaggcucugagag

SEQ ID NO: 1855372 - RNA, 20 nt, Homo sapiens
ccagauguuaugcuccugcu

SEQ ID NO: 1855373 - RNA, 20 nt, Homo sapiens
cagaaaguaucacaaaugga

SEQ ID NO: 1855374 - RNA, 13 nt, Homo sapiens
auuugcugcuuaa

SEQ ID NO: 1855375 - RNA, 20 nt, Homo sapiens
agucauccagcugauacaca

SEQ ID NO: 1855376 - RNA, 19 nt, Homo sapiens
ccagacccaccacaccgca

SEQ ID NO: 1855377 - RNA, 15 nt, Homo sapiens
ggcucuaauguacaa

SEQ ID NO: 1855378 - RNA, 19 nt, Homo sapiens
gcugacaguuuguggcauc

SEQ ID NO: 1855379 - RNA, 17 nt, Homo sapiens
uggucugcccucugcau

SEQ ID NO: 1855380 - RNA, 22 nt, Homo sapiens
ggcuguuuuucagauacacugu

SEQ ID NO: 1855381 - RNA, 18 nt, Homo sapiens
agggaggcagcgugggcu

SEQ ID NO: 1855382 - RNA, 19 nt, Homo sapiens
gaaagcagaaaaucuacca

SEQ ID NO: 1855383 - RNA, 23 nt, Homo sapiens
agaacaaaaagaaaucuugucuu

SEQ ID NO: 1855384 - RNA, 15 nt, Homo sapiens
aacaagguccaguaa

SEQ ID NO: 1855385 - RNA, 15 nt, Homo sapiens
caagugccuuagcaa

SEQ ID NO: 1855386 - RNA, 21 nt, Homo sapiens
uacaaaauaaagcuguucuca

SEQ ID NO: 1855387 - RNA, 20 nt, Homo sapiens
uccugccugggccuuggcaa

SEQ ID NO: 1855388 - RNA, 16 nt, Homo sapiens
ggagggagaagaaaga

SEQ ID NO: 1855389 - RNA, 18 nt, Homo sapiens
gucucagugcuuuccaau

SEQ ID NO: 1855390 - RNA, 21 nt, Homo sapiens
gcuuaguuaagucauccacag

SEQ ID NO: 1855391 - RNA, 14 nt, Homo sapiens
augagcaccuacuu

SEQ ID NO: 1855392 - RNA, 18 nt, Homo sapiens
cuuaauucuccaagcgga

SEQ ID NO: 1855393 - RNA, 20 nt, Homo sapiens
ucaaagcuccucucuugauu

SEQ ID NO: 1855394 - RNA, 14 nt, Homo sapiens
gagcaacauaucag

SEQ ID NO: 1855395 - RNA, 21 nt, Homo sapiens
uugagguggugccuucucaca

SEQ ID NO: 1855396 - RNA, 13 nt, Homo sapiens
aaauaagugcauu

SEQ ID NO: 1855397 - RNA, 20 nt, Homo sapiens
aggccgagucuguccuggaa

SEQ ID NO: 1855398 - RNA, 16 nt, Homo sapiens
acaguauuuugguucu

SEQ ID NO: 1855399 - RNA, 20 nt, Homo sapiens
cauacagcuguccacacuga

SEQ ID NO: 1855400 - RNA, 22 nt, Homo sapiens
ugacauuugggagacaugugac

SEQ ID NO: 1855401 - RNA, 20 nt, Homo sapiens
cugugccugcugggcacugg

SEQ ID NO: 1855402 - RNA, 19 nt, Homo sapiens
ucuucaguguaaugugacu

SEQ ID NO: 1855403 - RNA, 20 nt, Homo sapiens
uuguauuccucacauucaca

SEQ ID NO: 1855404 - RNA, 18 nt, Homo sapiens
acuguggcuagugacaaa

SEQ ID NO: 1855405 - RNA, 22 nt, Homo sapiens
acuuuuguugaaauagcuuuac

SEQ ID NO: 1855406 - RNA, 15 nt, Homo sapiens
gagcaaguccucacu

SEQ ID NO: 1855407 - RNA, 21 nt, Homo sapiens
gccauaaaagccgcccagugg

SEQ ID NO: 1855408 - RNA, 19 nt, Homo sapiens
uagagucggccaccacaga

SEQ ID NO: 1855409 - RNA, 19 nt, Homo sapiens
cgcggccuuucgcugagcc

SEQ ID NO: 1855410 - RNA, 22 nt, Homo sapiens
agaaauuguugcuuuguuucuc

SEQ ID NO: 1855411 - RNA, 20 nt, Homo sapiens
ugcagccucacuucuaccug

SEQ ID NO: 1855412 - RNA, 21 nt, Homo sapiens
cuguguacacaucuauucuca

SEQ ID NO: 1855413 - RNA, 14 nt, Homo sapiens
cuucagcaagagag

SEQ ID NO: 1855414 - RNA, 23 nt, Homo sapiens
ggaaaagaaagaagagaagggga

SEQ ID NO: 1855415 - RNA, 18 nt, Homo sapiens
aggguugguaagggguug

SEQ ID NO: 1855416 - RNA, 22 nt, Homo sapiens
ccuccccuggguuaacaaauga

SEQ ID NO: 1855417 - RNA, 22 nt, Homo sapiens
gcacugggcucugauggcugcu

SEQ ID NO: 1855418 - RNA, 22 nt, Homo sapiens
acagccccuuauuugcacuuca

SEQ ID NO: 1855419 - RNA, 20 nt, Homo sapiens
cuggagugcaguggugccau

SEQ ID NO: 1855420 - RNA, 18 nt, Homo sapiens
ugcacccgcauguacaaa

SEQ ID NO: 1855421 - RNA, 14 nt, Homo sapiens
uaccccagguacau

SEQ ID NO: 1855422 - RNA, 15 nt, Homo sapiens
auagaccacuggguu

SEQ ID NO: 1855423 - RNA, 17 nt, Homo sapiens
uguagagagaacaggug

SEQ ID NO: 1855424 - RNA, 20 nt, Homo sapiens
ggauccugcacugacucugg

SEQ ID NO: 1855425 - RNA, 23 nt, Homo sapiens
guuuuggacuacauauuugcacu

SEQ ID NO: 1855426 - RNA, 20 nt, Homo sapiens
auaaaaccaagggauaucuu

SEQ ID NO: 1855427 - RNA, 16 nt, Homo sapiens
uuccccaucuucuaaa

SEQ ID NO: 1855428 - RNA, 15 nt, Homo sapiens
auauuaaaccuuuca

SEQ ID NO: 1855429 - RNA, 17 nt, Homo sapiens
cacuuuaacugacuuaa

SEQ ID NO: 1855430 - RNA, 14 nt, Homo sapiens
ggaagccuguggug

SEQ ID NO: 1855431 - RNA, 21 nt, Homo sapiens
uccuuuuuuguuuucaacagu

SEQ ID NO: 1855432 - RNA, 16 nt, Homo sapiens
uauuugaaaacauaua

SEQ ID NO: 1855433 - RNA, 18 nt, Homo sapiens
auuuagguuuuuauuagu

SEQ ID NO: 1855434 - RNA, 17 nt, Homo sapiens
cccuuaacugcauccag

SEQ ID NO: 1855435 - RNA, 22 nt, Homo sapiens
gaagcccagaauaaacuggcag

SEQ ID NO: 1855436 - RNA, 20 nt, Homo sapiens
aauuagagcaagaacauuca

SEQ ID NO: 1855437 - RNA, 23 nt, Homo sapiens
uuguaugcuuuuauaggccugug

SEQ ID NO: 1855438 - RNA, 14 nt, Homo sapiens
uucauagcuguaua

SEQ ID NO: 1855439 - RNA, 14 nt, Homo sapiens
ugaaagccagcaaa

SEQ ID NO: 1855440 - RNA, 14 nt, Homo sapiens
gccaucaagcacuu

SEQ ID NO: 1855441 - RNA, 19 nt, Homo sapiens
auuucuaucuugaauuuca

SEQ ID NO: 1855442 - RNA, 13 nt, Homo sapiens
uggcuccucucac

SEQ ID NO: 1855443 - RNA, 19 nt, Homo sapiens
ccccaggcgauggacaauu

SEQ ID NO: 1855444 - RNA, 18 nt, Homo sapiens
uggggcauauucaucuac

SEQ ID NO: 1855445 - RNA, 20 nt, Homo sapiens
cagggccaccucuugcuugg

SEQ ID NO: 1855446 - RNA, 20 nt, Homo sapiens
gacaaagucaacuuccacau

SEQ ID NO: 1855447 - RNA, 14 nt, Homo sapiens
cccagugcuugcaa

SEQ ID NO: 1855448 - RNA, 12 nt, Homo sapiens
uuuaaacagugu

SEQ ID NO: 1855449 - RNA, 20 nt, Homo sapiens
ugaccacagccuuaccaaag

SEQ ID NO: 1855450 - RNA, 16 nt, Homo sapiens
acauccccauccccuu

SEQ ID NO: 1855451 - RNA, 16 nt, Homo sapiens
uugggccagacaugcc

SEQ ID NO: 1855452 - RNA, 19 nt, Homo sapiens
gaaugggaagggucauaga

SEQ ID NO: 1855453 - RNA, 14 nt, Homo sapiens
caagcgauucuccu

SEQ ID NO: 1855454 - RNA, 14 nt, Homo sapiens
uaagcgauccuccu

SEQ ID NO: 1855455 - RNA, 20 nt, Homo sapiens
uauuuauccaaaauguguau

SEQ ID NO: 1855456 - RNA, 14 nt, Homo sapiens
auuacccuuuugca

SEQ ID NO: 1855457 - RNA, 20 nt, Homo sapiens
cugaggucaauggugcaaag

SEQ ID NO: 1855458 - RNA, 19 nt, Homo sapiens
ccagaaugcugcaggacuu

SEQ ID NO: 1855459 - RNA, 18 nt, Homo sapiens
agucgagauugcacugcu

SEQ ID NO: 1855460 - RNA, 12 nt, Homo sapiens
uucaaaguuuag

SEQ ID NO: 1855461 - RNA, 17 nt, Homo sapiens
cagaggagaugugguca

SEQ ID NO: 1855462 - RNA, 22 nt, Homo sapiens
ugagaggcaggaauggggguca

SEQ ID NO: 1855463 - RNA, 18 nt, Homo sapiens
uuuuucuagggucccuga

SEQ ID NO: 1855464 - RNA, 16 nt, Homo sapiens
uagaaagcaggggcua

SEQ ID NO: 1855465 - RNA, 20 nt, Homo sapiens
uccuaaaccauucaccaaga

SEQ ID NO: 1855466 - RNA, 15 nt, Homo sapiens
gaccaguacugggaa

SEQ ID NO: 1855467 - RNA, 20 nt, Homo sapiens
auuuccucccucacaugaua

SEQ ID NO: 1855468 - RNA, 15 nt, Homo sapiens
auuauuuugugaugc

SEQ ID NO: 1855469 - RNA, 22 nt, Homo sapiens
ggcgaccccgucacagccucaa

SEQ ID NO: 1855470 - RNA, 22 nt, Homo sapiens
cacacccuccagcacagacugu

SEQ ID NO: 1855471 - RNA, 14 nt, Homo sapiens
caugauacugcugc

SEQ ID NO: 1855472 - RNA, 21 nt, Homo sapiens
agacuccagugacugcugccu

SEQ ID NO: 1855473 - RNA, 22 nt, Homo sapiens
guuuauauauuuaaaaguguca

SEQ ID NO: 1855474 - RNA, 21 nt, Homo sapiens
caauucaucucagcaaucaca

SEQ ID NO: 1855475 - RNA, 14 nt, Homo sapiens
gaaaacauguacua

SEQ ID NO: 1855476 - RNA, 14 nt, Homo sapiens
uaauucuagagucu

SEQ ID NO: 1855477 - RNA, 19 nt, Homo sapiens
caucaguuuuguuuacuca

SEQ ID NO: 1855478 - RNA, 17 nt, Homo sapiens
ugguuucuuugcugcaa

SEQ ID NO: 1855479 - RNA, 18 nt, Homo sapiens
aguacagugagccaagau

SEQ ID NO: 1855480 - RNA, 12 nt, Homo sapiens
uaaaccaaaaac

SEQ ID NO: 1855481 - RNA, 18 nt, Homo sapiens
gagguugcugguacacac

SEQ ID NO: 1855482 - RNA, 18 nt, Homo sapiens
uguggaccaccccacaga

SEQ ID NO: 1855483 - RNA, 19 nt, Homo sapiens
uacuaaaaaguauaaaaua

SEQ ID NO: 1855484 - RNA, 20 nt, Homo sapiens
ucagucaugaggaaagacac

SEQ ID NO: 1855485 - RNA, 10 nt, Homo sapiens
cacuguaaug

SEQ ID NO: 1855486 - RNA, 15 nt, Homo sapiens
uguauauuuguacaa

SEQ ID NO: 1855487 - RNA, 17 nt, Homo sapiens
agcuggggcuacaggag

SEQ ID NO: 1855488 - RNA, 17 nt, Homo sapiens
agcugggacuacagggg

SEQ ID NO: 1855489 - RNA, 19 nt, Homo sapiens
uacuuccaguauccugaaa

SEQ ID NO: 1855490 - RNA, 18 nt, Homo sapiens
gaacugcacguucuauau

SEQ ID NO: 1855491 - RNA, 16 nt, Homo sapiens
gagccccacucucaga

SEQ ID NO: 1855492 - RNA, 18 nt, Homo sapiens
guuucugaguuuuaccaa

SEQ ID NO: 1855493 - RNA, 17 nt, Homo sapiens
uacuacccgagcccagc

SEQ ID NO: 1855494 - RNA, 18 nt, Homo sapiens
gauauauacacacagugg

SEQ ID NO: 1855495 - RNA, 16 nt, Homo sapiens
ucaacuagguauuuaa

SEQ ID NO: 1855496 - RNA, 22 nt, Homo sapiens
ccucugccuuuguucacuguga

SEQ ID NO: 1855497 - RNA, 22 nt, Homo sapiens
aaauguauuuugccucugggua

SEQ ID NO: 1855498 - RNA, 20 nt, Homo sapiens
auauuccgggugccauuccc

SEQ ID NO: 1855499 - RNA, 14 nt, Homo sapiens
uugaaguguucuga

SEQ ID NO: 1855500 - RNA, 13 nt, Homo sapiens
ccuuuaaaaaaca

SEQ ID NO: 1855501 - RNA, 20 nt, Homo sapiens
auugugugaguguaccauaa

SEQ ID NO: 1855502 - RNA, 19 nt, Homo sapiens
ugacuuaaggggcugggau

SEQ ID NO: 1855503 - RNA, 20 nt, Homo sapiens
uucccacuugcagucuugua

SEQ ID NO: 1855504 - RNA, 15 nt, Homo sapiens
ugguugagguuucaa

SEQ ID NO: 1855505 - RNA, 12 nt, Homo sapiens
uccucucugagu

SEQ ID NO: 1855506 - RNA, 16 nt, Homo sapiens
agucccaguauucuca

SEQ ID NO: 1855507 - RNA, 14 nt, Homo sapiens
cuugauaaacuagg

SEQ ID NO: 1855508 - RNA, 23 nt, Homo sapiens
uaccccagguucuagucaugugu

SEQ ID NO: 1855509 - RNA, 14 nt, Homo sapiens
uuuacaaagcaaaa

SEQ ID NO: 1855510 - RNA, 14 nt, Homo sapiens
acccuggggccaga

SEQ ID NO: 1855511 - RNA, 20 nt, Homo sapiens
guucuuugcuggaccaucaa

SEQ ID NO: 1855512 - RNA, 21 nt, Homo sapiens
agccauaugcaggacagcagu

SEQ ID NO: 1855513 - RNA, 21 nt, Homo sapiens
ugcucuuaauugccaccucua

SEQ ID NO: 1855514 - RNA, 18 nt, Homo sapiens
auucaagaggaauuccag

SEQ ID NO: 1855515 - RNA, 22 nt, Homo sapiens
ucuuagcccucaccacagccuu

SEQ ID NO: 1855516 - RNA, 14 nt, Homo sapiens
agcccuagcccuca

SEQ ID NO: 1855517 - RNA, 17 nt, Homo sapiens
ccaggcuucuuccuaca

SEQ ID NO: 1855518 - RNA, 17 nt, Homo sapiens
uccacuuguccauguga

SEQ ID NO: 1855519 - RNA, 16 nt, Homo sapiens
uaggacuuuagggauc

SEQ ID NO: 1855520 - RNA, 14 nt, Homo sapiens
uacuguaggcagcu

SEQ ID NO: 1855521 - RNA, 14 nt, Homo sapiens
gcaggaaguacuca

SEQ ID NO: 1855522 - RNA, 15 nt, Homo sapiens
aauucaguucugaag

SEQ ID NO: 1855523 - RNA, 16 nt, Homo sapiens
aauauaucaaguacaa

SEQ ID NO: 1855524 - RNA, 15 nt, Homo sapiens
caggaaguacuucca

SEQ ID NO: 1855525 - RNA, 20 nt, Homo sapiens
ccggcccagcaagaugaaac

SEQ ID NO: 1855526 - RNA, 21 nt, Homo sapiens
gugacccuucccaaucagcac

SEQ ID NO: 1855527 - RNA, 17 nt, Homo sapiens
gcaguaauuugcaauuu

SEQ ID NO: 1855528 - RNA, 13 nt, Homo sapiens
auacacaccugaa

SEQ ID NO: 1855529 - RNA, 14 nt, Homo sapiens
auagcacuggucac

SEQ ID NO: 1855530 - RNA, 23 nt, Homo sapiens
ggagcacguggagauagugccag

SEQ ID NO: 1855531 - RNA, 14 nt, Homo sapiens
caauucauccucac

SEQ ID NO: 1855532 - RNA, 17 nt, Homo sapiens
auguaucuaccaucuaa

SEQ ID NO: 1855533 - RNA, 16 nt, Homo sapiens
acacauguaucuaugc

SEQ ID NO: 1855534 - RNA, 14 nt, Homo sapiens
agugaacuaugaag

SEQ ID NO: 1855535 - RNA, 13 nt, Homo sapiens
cugcaacggaauu

SEQ ID NO: 1855536 - RNA, 16 nt, Homo sapiens
uguguaauugauuuau

SEQ ID NO: 1855537 - RNA, 17 nt, Homo sapiens
cugaauguuacaacgaa

SEQ ID NO: 1855538 - RNA, 15 nt, Homo sapiens
ccugugauccaccca

SEQ ID NO: 1855539 - RNA, 15 nt, Homo sapiens
uccaccugccaggga

SEQ ID NO: 1855540 - RNA, 21 nt, Homo sapiens
uccacucggagugcccugugu

SEQ ID NO: 1855541 - RNA, 22 nt, Homo sapiens
guggcugcaggugggacuuugu

SEQ ID NO: 1855542 - RNA, 16 nt, Homo sapiens
guggcuaagggggacc

SEQ ID NO: 1855543 - RNA, 21 nt, Homo sapiens
gagcucuucgguuucugagca

SEQ ID NO: 1855544 - RNA, 15 nt, Homo sapiens
uggaucacaccucag

SEQ ID NO: 1855545 - RNA, 14 nt, Homo sapiens
uacuccaugggcug

SEQ ID NO: 1855546 - RNA, 21 nt, Homo sapiens
acagguggccuagcaggcaca

SEQ ID NO: 1855547 - RNA, 23 nt, Homo sapiens
cauccugauuauugaauguuaua

SEQ ID NO: 1855548 - RNA, 13 nt, Homo sapiens
aauuuccugaugc

SEQ ID NO: 1855549 - RNA, 12 nt, Homo sapiens
aacugucucuca

SEQ ID NO: 1855550 - RNA, 15 nt, Homo sapiens
uacugaaaucuugua

SEQ ID NO: 1855551 - RNA, 12 nt, Homo sapiens
uggcacugcugu

SEQ ID NO: 1855552 - RNA, 13 nt, Homo sapiens
cuguucagccuuu

SEQ ID NO: 1855553 - RNA, 14 nt, Homo sapiens
acaucaaauuugcc

SEQ ID NO: 1855554 - RNA, 18 nt, Homo sapiens
uuucaucaccagacuuug

SEQ ID NO: 1855555 - RNA, 20 nt, Homo sapiens
cgagaucgugccauugcacu

SEQ ID NO: 1855556 - RNA, 19 nt, Homo sapiens
uccaccugaggaacugucu

SEQ ID NO: 1855557 - RNA, 17 nt, Homo sapiens
uaaaaugucuucuccca

SEQ ID NO: 1855558 - RNA, 15 nt, Homo sapiens
aaaagaauggaccaa

SEQ ID NO: 1855559 - RNA, 21 nt, Homo sapiens
uaauuuccuuuuugacacuga

SEQ ID NO: 1855560 - RNA, 13 nt, Homo sapiens
aaaaauaagagag

SEQ ID NO: 1855561 - RNA, 19 nt, Homo sapiens
auuuaaaacaagcugauag

SEQ ID NO: 1855562 - RNA, 20 nt, Homo sapiens
uuugccaccagaaaccacaa

SEQ ID NO: 1855563 - RNA, 13 nt, Homo sapiens
uaaacugugccau

SEQ ID NO: 1855564 - RNA, 16 nt, Homo sapiens
auuggcccaacacugu

SEQ ID NO: 1855565 - RNA, 15 nt, Homo sapiens
ugcauuucuccgugc

SEQ ID NO: 1855566 - RNA, 15 nt, Homo sapiens
cggaguccccggggu

SEQ ID NO: 1855567 - RNA, 23 nt, Homo sapiens
ccugcugucgucuuagcaagaag

SEQ ID NO: 1855568 - RNA, 18 nt, Homo sapiens
aggcugagagcaguggcu

SEQ ID NO: 1855569 - RNA, 18 nt, Homo sapiens
guccauggugucaugcca

SEQ ID NO: 1855570 - RNA, 22 nt, Homo sapiens
agccaaaauagagaguauacag

SEQ ID NO: 1855571 - RNA, 18 nt, Homo sapiens
cugugauuaacuugcuua

SEQ ID NO: 1855572 - RNA, 18 nt, Homo sapiens
caugaacccucuugccau

SEQ ID NO: 1855573 - RNA, 21 nt, Homo sapiens
ccuuguucuauugcacaggcu

SEQ ID NO: 1855574 - RNA, 21 nt, Homo sapiens
ugaaaccuguucuaccaauua

SEQ ID NO: 1855575 - RNA, 17 nt, Homo sapiens
acucagaagacacugau

SEQ ID NO: 1855576 - RNA, 17 nt, Homo sapiens
aaucuucuucagauuca

SEQ ID NO: 1855577 - RNA, 23 nt, Homo sapiens
gagauggccuggggaagcuguga

SEQ ID NO: 1855578 - RNA, 16 nt, Homo sapiens
uccaguuuaaguaauu

SEQ ID NO: 1855579 - RNA, 15 nt, Homo sapiens
cagagcaggggcucc

SEQ ID NO: 1855580 - RNA, 21 nt, Homo sapiens
cagauuugcaaaguuuaaugg

SEQ ID NO: 1855581 - RNA, 16 nt, Homo sapiens
ucagggggcacugucu

SEQ ID NO: 1855582 - RNA, 17 nt, Homo sapiens
gaaaccccaucucuacu

SEQ ID NO: 1855583 - RNA, 22 nt, Homo sapiens
uggagucacucuuaugcuguac

SEQ ID NO: 1855584 - RNA, 16 nt, Homo sapiens
gcauggucuuaugcac

SEQ ID NO: 1855585 - RNA, 18 nt, Homo sapiens
ucuacuccaugguucuca

SEQ ID NO: 1855586 - RNA, 21 nt, Homo sapiens
aucuuuccucuccuacaaaga

SEQ ID NO: 1855587 - RNA, 18 nt, Homo sapiens
aagucccccuucaaucuc

SEQ ID NO: 1855588 - RNA, 23 nt, Homo sapiens
gcaaauuuuagcguuaaagucag

SEQ ID NO: 1855589 - RNA, 18 nt, Homo sapiens
uggcaaaucaggggccag

SEQ ID NO: 1855590 - RNA, 22 nt, Homo sapiens
uuugccuuuccauaaucacuca

SEQ ID NO: 1855591 - RNA, 20 nt, Homo sapiens
agcugguccuguccagacac

SEQ ID NO: 1855592 - RNA, 21 nt, Homo sapiens
gcuccaaaggaaauccaaaaa

SEQ ID NO: 1855593 - RNA, 13 nt, Homo sapiens
uuuaaauguuacu

SEQ ID NO: 1855594 - RNA, 13 nt, Homo sapiens
uugaggccaaaca

SEQ ID NO: 1855595 - RNA, 13 nt, Homo sapiens
caguccauugcuc

SEQ ID NO: 1855596 - RNA, 23 nt, Homo sapiens
aucuauuccugccaccacugggc

SEQ ID NO: 1855597 - RNA, 22 nt, Homo sapiens
cugaacuggagccaugggcaca

SEQ ID NO: 1855598 - RNA, 21 nt, Homo sapiens
acacuaguuuugugccagccg

SEQ ID NO: 1855599 - RNA, 19 nt, Homo sapiens
ggaaacaguccaaacuguu

SEQ ID NO: 1855600 - RNA, 13 nt, Homo sapiens
guuaggauuacag

SEQ ID NO: 1855601 - RNA, 23 nt, Homo sapiens
aaggcuauuuuucagaacuguua

SEQ ID NO: 1855602 - RNA, 20 nt, Homo sapiens
cagccuccagggcauugcuc

SEQ ID NO: 1855603 - RNA, 17 nt, Homo sapiens
gaugugacgcacuguau

SEQ ID NO: 1855604 - RNA, 20 nt, Homo sapiens
gcuaaguugcaccaacuuug

SEQ ID NO: 1855605 - RNA, 16 nt, Homo sapiens
aucagcuuaggggcug

SEQ ID NO: 1855606 - RNA, 16 nt, Homo sapiens
gaccccucccaaccuc

SEQ ID NO: 1855607 - RNA, 20 nt, Homo sapiens
cauuuaaugaguuuuaucuu

SEQ ID NO: 1855608 - RNA, 16 nt, Homo sapiens
gacuaggugcuugcuu

SEQ ID NO: 1855609 - RNA, 13 nt, Homo sapiens
gcggaggcugugu

SEQ ID NO: 1855610 - RNA, 13 nt, Homo sapiens
gggcaggcucucu

SEQ ID NO: 1855611 - RNA, 18 nt, Homo sapiens
ucacucugggccugggga

SEQ ID NO: 1855612 - RNA, 17 nt, Homo sapiens
uaauucuguacauagcc

SEQ ID NO: 1855613 - RNA, 20 nt, Homo sapiens
auaucagggguacauucuag

SEQ ID NO: 1855614 - RNA, 22 nt, Homo sapiens
auucccuuuuaacccaguguac

SEQ ID NO: 1855615 - RNA, 20 nt, Homo sapiens
uaguuguaaauauagugaag

SEQ ID NO: 1855616 - RNA, 19 nt, Homo sapiens
cuguuuuacuguuacaaua

SEQ ID NO: 1855617 - RNA, 17 nt, Homo sapiens
auacugaccuaccucaa

SEQ ID NO: 1855618 - RNA, 15 nt, Homo sapiens
uacagguuugcauuu

SEQ ID NO: 1855619 - RNA, 14 nt, Homo sapiens
gcauguugauuucu

SEQ ID NO: 1855620 - RNA, 15 nt, Homo sapiens
aaaucuaaacauaaa

SEQ ID NO: 1855621 - RNA, 19 nt, Homo sapiens
augaaccacugcacccacc

SEQ ID NO: 1855622 - RNA, 21 nt, Homo sapiens
guuagcauuuucaaugugaua

SEQ ID NO: 1855623 - RNA, 15 nt, Homo sapiens
cacggaugcacacac

SEQ ID NO: 1855624 - RNA, 14 nt, Homo sapiens
aaccuuucccucac

SEQ ID NO: 1855625 - RNA, 12 nt, Homo sapiens
caacugccaaau

SEQ ID NO: 1855626 - RNA, 18 nt, Homo sapiens
cuccucgggaaacacaca

SEQ ID NO: 1855627 - RNA, 14 nt, Homo sapiens
gggacagcauaccu

SEQ ID NO: 1855628 - RNA, 23 nt, Homo sapiens
uccuugugcaaaauauuugacua

SEQ ID NO: 1855629 - RNA, 15 nt, Homo sapiens
agugggaacucugac

SEQ ID NO: 1855630 - RNA, 12 nt, Homo sapiens
uaaaugguggga

SEQ ID NO: 1855631 - RNA, 15 nt, Homo sapiens
cuaaaucuucagcau

SEQ ID NO: 1855632 - RNA, 17 nt, Homo sapiens
ugagcacuccuggugca

SEQ ID NO: 1855633 - RNA, 18 nt, Homo sapiens
cagagaaagaaagggaaa

SEQ ID NO: 1855634 - RNA, 21 nt, Homo sapiens
aucguucugggucagcuugaa

SEQ ID NO: 1855635 - RNA, 19 nt, Homo sapiens
gcgcagcgggagcgcacag

SEQ ID NO: 1855636 - RNA, 17 nt, Homo sapiens
cauaguuauuuacuuga

SEQ ID NO: 1855637 - RNA, 13 nt, Homo sapiens
auagacaccauag

SEQ ID NO: 1855638 - RNA, 19 nt, Homo sapiens
ucauuaaaauugugaugcu

SEQ ID NO: 1855639 - RNA, 16 nt, Homo sapiens
cccacaaaaguacaau

SEQ ID NO: 1855640 - RNA, 21 nt, Homo sapiens
uguagaguuuugucauucaga

SEQ ID NO: 1855641 - RNA, 23 nt, Homo sapiens
uacagacauacauuuaugcacau

SEQ ID NO: 1855642 - RNA, 13 nt, Homo sapiens
uaguuccaguuuc

SEQ ID NO: 1855643 - RNA, 17 nt, Homo sapiens
uugguaauuaaggcauc

SEQ ID NO: 1855644 - RNA, 12 nt, Homo sapiens
gcagacagagaa

SEQ ID NO: 1855645 - RNA, 15 nt, Homo sapiens
cagcccugucucaaa

SEQ ID NO: 1855646 - RNA, 14 nt, Homo sapiens
ccgaagugcaauga

SEQ ID NO: 1855647 - RNA, 18 nt, Homo sapiens
uccuugcccccauuucac

SEQ ID NO: 1855648 - RNA, 18 nt, Homo sapiens
gcuucucauggauggcac

SEQ ID NO: 1855649 - RNA, 16 nt, Homo sapiens
gcucagacaucuacua

SEQ ID NO: 1855650 - RNA, 20 nt, Homo sapiens
aagcgauccucccaccucag

SEQ ID NO: 1855651 - RNA, 16 nt, Homo sapiens
accaccagacagagag

SEQ ID NO: 1855652 - RNA, 15 nt, Homo sapiens
cugcagcugcugaag

SEQ ID NO: 1855653 - RNA, 23 nt, Homo sapiens
uucauuuuugauagcugucccau

SEQ ID NO: 1855654 - RNA, 12 nt, Homo sapiens
ccaaaagccagu

SEQ ID NO: 1855655 - RNA, 13 nt, Homo sapiens
gcuccacauugca

SEQ ID NO: 1855656 - RNA, 17 nt, Homo sapiens
caacaauaaaguacuuu

SEQ ID NO: 1855657 - RNA, 17 nt, Homo sapiens
aggcucugcuucuccaa

SEQ ID NO: 1855658 - RNA, 14 nt, Homo sapiens
uuauccugacauau

SEQ ID NO: 1855659 - RNA, 15 nt, Homo sapiens
cauggccacaauccc

SEQ ID NO: 1855660 - RNA, 13 nt, Homo sapiens
uugaaaacacuua

SEQ ID NO: 1855661 - RNA, 13 nt, Homo sapiens
ucuucaacaugac

SEQ ID NO: 1855662 - RNA, 20 nt, Homo sapiens
aguaggaaaggacugagagu

SEQ ID NO: 1855663 - RNA, 15 nt, Homo sapiens
agccuuuaucaagcu

SEQ ID NO: 1855664 - RNA, 21 nt, Homo sapiens
cucccugaagccuuugcauuu

SEQ ID NO: 1855665 - RNA, 23 nt, Homo sapiens
aucauuaaggucauuacucucaa

SEQ ID NO: 1855666 - RNA, 23 nt, Homo sapiens
uuuauugacugggcaacacugca

SEQ ID NO: 1855667 - RNA, 22 nt, Homo sapiens
aguugacuugacagaacacugu

SEQ ID NO: 1855668 - RNA, 20 nt, Homo sapiens
auucuauugaguggcagugu

SEQ ID NO: 1855669 - RNA, 21 nt, Homo sapiens
uugaaagugcuucaaggguaa

SEQ ID NO: 1855670 - RNA, 19 nt, Homo sapiens
uaggugagguuuauagaaa

SEQ ID NO: 1855671 - RNA, 20 nt, Homo sapiens
augucucacugagcacuguu

SEQ ID NO: 1855672 - RNA, 13 nt, Homo sapiens
uuuaggcucagaa

SEQ ID NO: 1855673 - RNA, 17 nt, Homo sapiens
cuuuuaaauaauaucca

SEQ ID NO: 1855674 - RNA, 22 nt, Homo sapiens
agauauuaauagauaauaugaa

SEQ ID NO: 1855675 - RNA, 20 nt, Homo sapiens
agcuccuccuugucuuggca

SEQ ID NO: 1855676 - RNA, 17 nt, Homo sapiens
agggcuagaaccuggaa

SEQ ID NO: 1855677 - RNA, 19 nt, Homo sapiens
caguguuccccccauagag

SEQ ID NO: 1855678 - RNA, 17 nt, Homo sapiens
auugucuuguuauguac

SEQ ID NO: 1855679 - RNA, 20 nt, Homo sapiens
aaauuguaucaaaugugaca

SEQ ID NO: 1855680 - RNA, 14 nt, Homo sapiens
uugucaccauugga

SEQ ID NO: 1855681 - RNA, 20 nt, Homo sapiens
cgcugagcugaguggccagc

SEQ ID NO: 1855682 - RNA, 14 nt, Homo sapiens
cccagcuucaucuu

SEQ ID NO: 1855683 - RNA, 18 nt, Homo sapiens
cuuuaggauuuauugcau

SEQ ID NO: 1855684 - RNA, 18 nt, Homo sapiens
aagaaaaaggcauuuuag

SEQ ID NO: 1855685 - RNA, 15 nt, Homo sapiens
caucaggacucugac

SEQ ID NO: 1855686 - RNA, 12 nt, Homo sapiens
cuaugaacacug

SEQ ID NO: 1855687 - RNA, 18 nt, Homo sapiens
ucaagacuuccucaugaa

SEQ ID NO: 1855688 - RNA, 23 nt, Homo sapiens
uaacauuucaccccacucuguac

SEQ ID NO: 1855689 - RNA, 19 nt, Homo sapiens
cagcuauuuucaacauaac

SEQ ID NO: 1855690 - RNA, 15 nt, Homo sapiens
uucugguuucuucca

SEQ ID NO: 1855691 - RNA, 23 nt, Homo sapiens
augccucgcucccuucaagacga

SEQ ID NO: 1855692 - RNA, 15 nt, Homo sapiens
agaauccccacaggg

SEQ ID NO: 1855693 - RNA, 21 nt, Homo sapiens
caaaggcugacauucacugag

SEQ ID NO: 1855694 - RNA, 15 nt, Homo sapiens
gucacuagucucacc

SEQ ID NO: 1855695 - RNA, 22 nt, Homo sapiens
caaugccacauacuugcagcuc

SEQ ID NO: 1855696 - RNA, 23 nt, Homo sapiens
agcuaccucaaccaaugccaaaa

SEQ ID NO: 1855697 - RNA, 15 nt, Homo sapiens
auugcagacucauga

SEQ ID NO: 1855698 - RNA, 21 nt, Homo sapiens
cuguccaugaagcacugagca

SEQ ID NO: 1855699 - RNA, 23 nt, Homo sapiens
ucagaguuuuuauuuuguuacaa

SEQ ID NO: 1855700 - RNA, 16 nt, Homo sapiens
accaaagucacaucca

SEQ ID NO: 1855701 - RNA, 21 nt, Homo sapiens
aucucauuucucaacaguuca

SEQ ID NO: 1855702 - RNA, 21 nt, Homo sapiens
gagcuugugcuccucuugauu

SEQ ID NO: 1855703 - RNA, 20 nt, Homo sapiens
aaugcacgcgugcauaugcu

SEQ ID NO: 1855704 - RNA, 12 nt, Homo sapiens
gugcugugacaa

SEQ ID NO: 1855705 - RNA, 19 nt, Homo sapiens
gugccauucccacuaagcu

SEQ ID NO: 1855706 - RNA, 16 nt, Homo sapiens
caucaggcuguuauua

SEQ ID NO: 1855707 - RNA, 20 nt, Homo sapiens
ccacagaggagggacucaga

SEQ ID NO: 1855708 - RNA, 18 nt, Homo sapiens
gaacugaugacacugaga

SEQ ID NO: 1855709 - RNA, 19 nt, Homo sapiens
cauuuuggcaucugcaaag

SEQ ID NO: 1855710 - RNA, 15 nt, Homo sapiens
agaggacuauuacau

SEQ ID NO: 1855711 - RNA, 14 nt, Homo sapiens
gcugauuucaaaug

SEQ ID NO: 1855712 - RNA, 15 nt, Homo sapiens
aagaaaaggauuuaa

SEQ ID NO: 1855713 - RNA, 22 nt, Homo sapiens
uuuccccugugguuuguuauca

SEQ ID NO: 1855714 - RNA, 14 nt, Homo sapiens
ugcugggaugacca

SEQ ID NO: 1855715 - RNA, 19 nt, Homo sapiens
aggucauggccacacugug

SEQ ID NO: 1855716 - RNA, 18 nt, Homo sapiens
gccuuaaaggaccuuccc

SEQ ID NO: 1855717 - RNA, 18 nt, Homo sapiens
gcaggaacuucuagcuca

SEQ ID NO: 1855718 - RNA, 18 nt, Homo sapiens
gccuaaagccagcauuuc

SEQ ID NO: 1855719 - RNA, 14 nt, Homo sapiens
uguuggagccugca

SEQ ID NO: 1855720 - RNA, 15 nt, Homo sapiens
auccuccugauagaa

SEQ ID NO: 1855721 - RNA, 15 nt, Homo sapiens
augugugauucaaug

SEQ ID NO: 1855722 - RNA, 18 nt, Homo sapiens
acugguccagcucugaca

SEQ ID NO: 1855723 - RNA, 20 nt, Homo sapiens
cauauauauaguuaugcaua

SEQ ID NO: 1855724 - RNA, 21 nt, Homo sapiens
uuugccagccuugaguuaucu

SEQ ID NO: 1855725 - RNA, 16 nt, Homo sapiens
gcaugaaacauuucag

SEQ ID NO: 1855726 - RNA, 13 nt, Homo sapiens
gugcugugacucg

SEQ ID NO: 1855727 - RNA, 14 nt, Homo sapiens
gucccaucuucacu

SEQ ID NO: 1855728 - RNA, 11 nt, Homo sapiens
gccaagccagu

SEQ ID NO: 1855729 - RNA, 22 nt, Homo sapiens
cuauucauccggggaggaaaca

SEQ ID NO: 1855730 - RNA, 14 nt, Homo sapiens
augcauggugcauc

SEQ ID NO: 1855731 - RNA, 20 nt, Homo sapiens
gaugggcauaugugucagug

SEQ ID NO: 1855732 - RNA, 17 nt, Homo sapiens
uguauuuuaaaugugac

SEQ ID NO: 1855733 - RNA, 15 nt, Homo sapiens
gggguccacugugag

SEQ ID NO: 1855734 - RNA, 15 nt, Homo sapiens
aguguuugagaguga

SEQ ID NO: 1855735 - RNA, 21 nt, Homo sapiens
gaaauuuuuaaaggaguagaa

SEQ ID NO: 1855736 - RNA, 14 nt, Homo sapiens
agccaucaccucag

SEQ ID NO: 1855737 - RNA, 14 nt, Homo sapiens
ccucagcaagccau

SEQ ID NO: 1855738 - RNA, 14 nt, Homo sapiens
auaucugagcucuu

SEQ ID NO: 1855739 - RNA, 17 nt, Homo sapiens
caugaauauuuaguguu

SEQ ID NO: 1855740 - RNA, 16 nt, Homo sapiens
acacaccgcugucucu

SEQ ID NO: 1855741 - RNA, 19 nt, Homo sapiens
uagaaaauuagacugugau

SEQ ID NO: 1855742 - RNA, 19 nt, Homo sapiens
cagucugucuacuguggug

SEQ ID NO: 1855743 - RNA, 16 nt, Homo sapiens
gccaaccuguaauaaa

SEQ ID NO: 1855744 - RNA, 18 nt, Homo sapiens
ucuccaacaccaccucuc

SEQ ID NO: 1855745 - RNA, 22 nt, Homo sapiens
ugccucagccuccugaguaguu

SEQ ID NO: 1855746 - RNA, 14 nt, Homo sapiens
uuuucucaugauga

SEQ ID NO: 1855747 - RNA, 17 nt, Homo sapiens
agagcuuugugcuuguc

SEQ ID NO: 1855748 - RNA, 14 nt, Homo sapiens
caaagaacuguaua

SEQ ID NO: 1855749 - RNA, 22 nt, Homo sapiens
uugggcccaagaacugcagaua

SEQ ID NO: 1855750 - RNA, 15 nt, Homo sapiens
agccccaagacucug

SEQ ID NO: 1855751 - RNA, 17 nt, Homo sapiens
ucaaauuaagugugcau

SEQ ID NO: 1855752 - RNA, 18 nt, Homo sapiens
caccaucaccagacaggu

SEQ ID NO: 1855753 - RNA, 18 nt, Homo sapiens
aguucagauagagauauu

SEQ ID NO: 1855754 - RNA, 16 nt, Homo sapiens
augccacaaaacugac

SEQ ID NO: 1855755 - RNA, 17 nt, Homo sapiens
cagguucagacugagcu

SEQ ID NO: 1855756 - RNA, 21 nt, Homo sapiens
gcuuccucccagacuugccuu

SEQ ID NO: 1855757 - RNA, 12 nt, Homo sapiens
ccaggcauuugc

SEQ ID NO: 1855758 - RNA, 13 nt, Homo sapiens
auguggacugugc

SEQ ID NO: 1855759 - RNA, 20 nt, Homo sapiens
gguaaagaaaccauggcaua

SEQ ID NO: 1855760 - RNA, 17 nt, Homo sapiens
aacugcuuuauuuuccc

SEQ ID NO: 1855761 - RNA, 18 nt, Homo sapiens
guuuauccugacauauuc

SEQ ID NO: 1855762 - RNA, 12 nt, Homo sapiens
cuuugguuaaua

SEQ ID NO: 1855763 - RNA, 21 nt, Homo sapiens
gaccaggcuggggccagggga

SEQ ID NO: 1855764 - RNA, 17 nt, Homo sapiens
agagggccuaaccgaga

SEQ ID NO: 1855765 - RNA, 12 nt, Homo sapiens
uaucucucugcc

SEQ ID NO: 1855766 - RNA, 22 nt, Homo sapiens
gucaucgggaggagcagccuga

SEQ ID NO: 1855767 - RNA, 21 nt, Homo sapiens
uggcaaauguagcccugcauc

SEQ ID NO: 1855768 - RNA, 17 nt, Homo sapiens
augucugauaaugauuu

SEQ ID NO: 1855769 - RNA, 15 nt, Homo sapiens
uacgaugacaguguu

SEQ ID NO: 1855770 - RNA, 21 nt, Homo sapiens
ucuccuggccaucccuucauu

SEQ ID NO: 1855771 - RNA, 18 nt, Homo sapiens
auguuuggaaaccacagu

SEQ ID NO: 1855772 - RNA, 20 nt, Homo sapiens
uucccagggaccagcaccuu

SEQ ID NO: 1855773 - RNA, 18 nt, Homo sapiens
gagugcuggucacacccc

SEQ ID NO: 1855774 - RNA, 18 nt, Homo sapiens
cccggugccaucuuccau

SEQ ID NO: 1855775 - RNA, 21 nt, Homo sapiens
cuggggaucuucccacaggag

SEQ ID NO: 1855776 - RNA, 13 nt, Homo sapiens
aauguuguucucu

SEQ ID NO: 1855777 - RNA, 19 nt, Homo sapiens
gugcaguggugcgaucucg

SEQ ID NO: 1855778 - RNA, 17 nt, Homo sapiens
gccagcagggcgggcca

SEQ ID NO: 1855779 - RNA, 21 nt, Homo sapiens
guucauggauuacuucucuau

SEQ ID NO: 1855780 - RNA, 15 nt, Homo sapiens
ggcagaaaauuacau

SEQ ID NO: 1855781 - RNA, 14 nt, Homo sapiens
cuugugacagauua

SEQ ID NO: 1855782 - RNA, 15 nt, Homo sapiens
ugacaacuguuuaau

SEQ ID NO: 1855783 - RNA, 19 nt, Homo sapiens
cccagccccuccaaagguc

SEQ ID NO: 1855784 - RNA, 14 nt, Homo sapiens
cuucuggucugugu

SEQ ID NO: 1855785 - RNA, 22 nt, Homo sapiens
gaaaauuaauaucacagcauaa

SEQ ID NO: 1855786 - RNA, 17 nt, Homo sapiens
acccaggagguggaggu

SEQ ID NO: 1855787 - RNA, 19 nt, Homo sapiens
agggagaucuuggggugca

SEQ ID NO: 1855788 - RNA, 20 nt, Homo sapiens
cuauagugaugaugaucuca

SEQ ID NO: 1855789 - RNA, 19 nt, Homo sapiens
uauucaagguaaaauucua

SEQ ID NO: 1855790 - RNA, 14 nt, Homo sapiens
uaauuguacaauac

SEQ ID NO: 1855791 - RNA, 21 nt, Homo sapiens
gccagccuucuuccaucccag

SEQ ID NO: 1855792 - RNA, 13 nt, Homo sapiens
aauagauggaauu

SEQ ID NO: 1855793 - RNA, 19 nt, Homo sapiens
cuuuagcugcugucuuccc

SEQ ID NO: 1855794 - RNA, 16 nt, Homo sapiens
agcagcgguaccccag

SEQ ID NO: 1855795 - RNA, 15 nt, Homo sapiens
cuucucgaauugaag

SEQ ID NO: 1855796 - RNA, 19 nt, Homo sapiens
cuggcucuucucucggggc

SEQ ID NO: 1855797 - RNA, 19 nt, Homo sapiens
cacucucuuccuuucauuc

SEQ ID NO: 1855798 - RNA, 19 nt, Homo sapiens
cagucuggccacugucaag

SEQ ID NO: 1855799 - RNA, 15 nt, Homo sapiens
acuggcagcuccucu

SEQ ID NO: 1855800 - RNA, 20 nt, Homo sapiens
uugauaguuaauuauuucaa

SEQ ID NO: 1855801 - RNA, 18 nt, Homo sapiens
gauagauccauuuggaca

SEQ ID NO: 1855802 - RNA, 16 nt, Homo sapiens
acauggacuacacaca

SEQ ID NO: 1855803 - RNA, 17 nt, Homo sapiens
gacuuggggaccagagg

SEQ ID NO: 1855804 - RNA, 16 nt, Homo sapiens
agagucaucuaccuga

SEQ ID NO: 1855805 - RNA, 23 nt, Homo sapiens
acugcuucaggaaggacauggac

SEQ ID NO: 1855806 - RNA, 18 nt, Homo sapiens
aguauggcuccuccauau

SEQ ID NO: 1855807 - RNA, 17 nt, Homo sapiens
acugaguuuauacucac

SEQ ID NO: 1855808 - RNA, 23 nt, Homo sapiens
agaccccacccugagguccugca

SEQ ID NO: 1855809 - RNA, 14 nt, Homo sapiens
uaguagccaugaca

SEQ ID NO: 1855810 - RNA, 22 nt, Homo sapiens
guguauuuucgauauuucagga

SEQ ID NO: 1855811 - RNA, 14 nt, Homo sapiens
aguuuauauucuga

SEQ ID NO: 1855812 - RNA, 12 nt, Homo sapiens
aaaagaaccaaa

SEQ ID NO: 1855813 - RNA, 12 nt, Homo sapiens
ggcaucuugcca

SEQ ID NO: 1855814 - RNA, 21 nt, Homo sapiens
ucccuguaggguccaaccaga

SEQ ID NO: 1855815 - RNA, 17 nt, Homo sapiens
aucagcgggucuccucc

SEQ ID NO: 1855816 - RNA, 18 nt, Homo sapiens
agcucccagccucuuccc

SEQ ID NO: 1855817 - RNA, 19 nt, Homo sapiens
uaaggugcaguucccccaa

SEQ ID NO: 1855818 - RNA, 12 nt, Homo sapiens
cagacuugccuu

SEQ ID NO: 1855819 - RNA, 21 nt, Homo sapiens
ugccucucaauucgcugaaaa

SEQ ID NO: 1855820 - RNA, 18 nt, Homo sapiens
acaugguaauuaugugau

SEQ ID NO: 1855821 - RNA, 21 nt, Homo sapiens
auuuccgugagagucaucuca

SEQ ID NO: 1855822 - RNA, 14 nt, Homo sapiens
ucauacucaaagag

SEQ ID NO: 1855823 - RNA, 22 nt, Homo sapiens
aggaagaugaagagaagcugag

SEQ ID NO: 1855824 - RNA, 11 nt, Homo sapiens
agguacaggag

SEQ ID NO: 1855825 - RNA, 20 nt, Homo sapiens
uucaaagugucucauucuca

SEQ ID NO: 1855826 - RNA, 14 nt, Homo sapiens
cuaggaguagaaaa

SEQ ID NO: 1855827 - RNA, 17 nt, Homo sapiens
augggugugccaggcua

SEQ ID NO: 1855828 - RNA, 23 nt, Homo sapiens
cagaccuggugcucuaaugccaa

SEQ ID NO: 1855829 - RNA, 23 nt, Homo sapiens
guccuccuuguucuacucauaua

SEQ ID NO: 1855830 - RNA, 14 nt, Homo sapiens
cuuaugugacaugg

SEQ ID NO: 1855831 - RNA, 12 nt, Homo sapiens
uucuauuccuau

SEQ ID NO: 1855832 - RNA, 21 nt, Homo sapiens
accucccucccuccccagugu

SEQ ID NO: 1855833 - RNA, 14 nt, Homo sapiens
ugccauugcacucc

SEQ ID NO: 1855834 - RNA, 18 nt, Homo sapiens
ugcggggggcaccagagg

SEQ ID NO: 1855835 - RNA, 14 nt, Homo sapiens
acacaguccaacuc

SEQ ID NO: 1855836 - RNA, 14 nt, Homo sapiens
aaaaucucccaaag

SEQ ID NO: 1855837 - RNA, 19 nt, Homo sapiens
accucaggagcuuuacuca

SEQ ID NO: 1855838 - RNA, 16 nt, Homo sapiens
acacauuguacauggu

SEQ ID NO: 1855839 - RNA, 20 nt, Homo sapiens
aagccacagcuggugguauc

SEQ ID NO: 1855840 - RNA, 16 nt, Homo sapiens
aauaucuuccacagag

SEQ ID NO: 1855841 - RNA, 22 nt, Homo sapiens
cuccacagagugagccagugag

SEQ ID NO: 1855842 - RNA, 21 nt, Homo sapiens
ucugccuagaaacaguguuug

SEQ ID NO: 1855843 - RNA, 18 nt, Homo sapiens
ccagggucuggggcagca

SEQ ID NO: 1855844 - RNA, 17 nt, Homo sapiens
caugcuuugaaaaauca

SEQ ID NO: 1855845 - RNA, 14 nt, Homo sapiens
cauacuaugaaaua

SEQ ID NO: 1855846 - RNA, 14 nt, Homo sapiens
ggugccagcugccc

SEQ ID NO: 1855847 - RNA, 23 nt, Homo sapiens
gaaaaggugguguugguauccaa

SEQ ID NO: 1855848 - RNA, 22 nt, Homo sapiens
aaccuaauucuuguagaugcau

SEQ ID NO: 1855849 - RNA, 16 nt, Homo sapiens
cuuacaaugugcacug

SEQ ID NO: 1855850 - RNA, 21 nt, Homo sapiens
caagggccauucaguacauca

SEQ ID NO: 1855851 - RNA, 19 nt, Homo sapiens
gacagagaaggcgcuuccc

SEQ ID NO: 1855852 - RNA, 16 nt, Homo sapiens
cuggcugccccgugac

SEQ ID NO: 1855853 - RNA, 23 nt, Homo sapiens
gaagcaucugucuugucauucca

SEQ ID NO: 1855854 - RNA, 14 nt, Homo sapiens
gaggacuaggguaa

SEQ ID NO: 1855855 - RNA, 19 nt, Homo sapiens
uucagaguuguacacugug

SEQ ID NO: 1855856 - RNA, 21 nt, Homo sapiens
ggaauuacaaaacucagagaa

SEQ ID NO: 1855857 - RNA, 21 nt, Homo sapiens
cuacuauuuuuagcaauguuu

SEQ ID NO: 1855858 - RNA, 14 nt, Homo sapiens
cucaacaacauguc

SEQ ID NO: 1855859 - RNA, 21 nt, Homo sapiens
uuuuucucacugaaaagugag

SEQ ID NO: 1855860 - RNA, 19 nt, Homo sapiens
acuccucaucaucacucau

SEQ ID NO: 1855861 - RNA, 16 nt, Homo sapiens
ugaccuuuuugcagug

SEQ ID NO: 1855862 - RNA, 15 nt, Homo sapiens
acacaagacagcaga

SEQ ID NO: 1855863 - RNA, 19 nt, Homo sapiens
uucccagacagcaguguga

SEQ ID NO: 1855864 - RNA, 22 nt, Homo sapiens
ccugagauggggaugagggcag

SEQ ID NO: 1855865 - RNA, 19 nt, Homo sapiens
uaaaauguuccuuuugaca

SEQ ID NO: 1855866 - RNA, 14 nt, Homo sapiens
cuggaaucagcuca

SEQ ID NO: 1855867 - RNA, 16 nt, Homo sapiens
caaggcccacuucuuc

SEQ ID NO: 1855868 - RNA, 22 nt, Homo sapiens
ccuagacuggauagugggggug

SEQ ID NO: 1855869 - RNA, 21 nt, Homo sapiens
aagauuauauaguacuuaaau

SEQ ID NO: 1855870 - RNA, 19 nt, Homo sapiens
ccuucuacauuugagggcc

SEQ ID NO: 1855871 - RNA, 14 nt, Homo sapiens
ucagccacugugau

SEQ ID NO: 1855872 - RNA, 14 nt, Homo sapiens
caacagaucugcag

SEQ ID NO: 1855873 - RNA, 14 nt, Homo sapiens
aaacaaauaugcaa

SEQ ID NO: 1855874 - RNA, 19 nt, Homo sapiens
ucauucuuuuggauugcua

SEQ ID NO: 1855875 - RNA, 20 nt, Homo sapiens
ggcuggacuccagaucugca

SEQ ID NO: 1855876 - RNA, 18 nt, Homo sapiens
guugugaaugucauucac

SEQ ID NO: 1855877 - RNA, 14 nt, Homo sapiens
cggacaguggcagg

SEQ ID NO: 1855878 - RNA, 14 nt, Homo sapiens
gaugagaagccaaa

SEQ ID NO: 1855879 - RNA, 23 nt, Homo sapiens
uucccggcuggacuuuugcagcu

SEQ ID NO: 1855880 - RNA, 13 nt, Homo sapiens
cucucaccucauu

SEQ ID NO: 1855881 - RNA, 22 nt, Homo sapiens
gaaagcuuacuguuuuugauaa

SEQ ID NO: 1855882 - RNA, 20 nt, Homo sapiens
uguguucaugcacacuugca

SEQ ID NO: 1855883 - RNA, 11 nt, Homo sapiens
agcaggagcag

SEQ ID NO: 1855884 - RNA, 17 nt, Homo sapiens
agcaagacccaucucaa

SEQ ID NO: 1855885 - RNA, 21 nt, Homo sapiens
agacaacaaaugggucccuca

SEQ ID NO: 1855886 - RNA, 15 nt, Homo sapiens
aauuuuacauauguc

SEQ ID NO: 1855887 - RNA, 16 nt, Homo sapiens
uaaugagugaauugaa

SEQ ID NO: 1855888 - RNA, 19 nt, Homo sapiens
caagcuccuggucuugaga

SEQ ID NO: 1855889 - RNA, 17 nt, Homo sapiens
uaaacuuguuuacaaag

SEQ ID NO: 1855890 - RNA, 17 nt, Homo sapiens
guucaaaaaacuuguaa

SEQ ID NO: 1855891 - RNA, 17 nt, Homo sapiens
ccuagauuacaucugcc

SEQ ID NO: 1855892 - RNA, 16 nt, Homo sapiens
uccuacccgcuuccca

SEQ ID NO: 1855893 - RNA, 14 nt, Homo sapiens
gauccuacucuucc

SEQ ID NO: 1855894 - RNA, 22 nt, Homo sapiens
cgucauuuccggacucucugcu

SEQ ID NO: 1855895 - RNA, 16 nt, Homo sapiens
cuggaaucgaggcugu

SEQ ID NO: 1855896 - RNA, 19 nt, Homo sapiens
uauagugucaugcagagua

SEQ ID NO: 1855897 - RNA, 21 nt, Homo sapiens
gucucucacccccacacuggg

SEQ ID NO: 1855898 - RNA, 16 nt, Homo sapiens
acuacucugucuucac

SEQ ID NO: 1855899 - RNA, 16 nt, Homo sapiens
cacacagaggaccucu

SEQ ID NO: 1855900 - RNA, 14 nt, Homo sapiens
aggagucuucacug

SEQ ID NO: 1855901 - RNA, 15 nt, Homo sapiens
gagaaucugcugcau

SEQ ID NO: 1855902 - RNA, 24 nt, Homo sapiens
aauuucuagccugcacuuugaugu

SEQ ID NO: 1855903 - RNA, 15 nt, Homo sapiens
ugugguuuaugucau

SEQ ID NO: 1855904 - RNA, 14 nt, Homo sapiens
aggggcccacagga

SEQ ID NO: 1855905 - RNA, 15 nt, Homo sapiens
gguaaaggucugugg

SEQ ID NO: 1855906 - RNA, 12 nt, Homo sapiens
auucagcuugag

SEQ ID NO: 1855907 - RNA, 17 nt, Homo sapiens
agucugcuuagagcaca

SEQ ID NO: 1855908 - RNA, 12 nt, Homo sapiens
cuccaagccaag

SEQ ID NO: 1855909 - RNA, 17 nt, Homo sapiens
uaggccuggcacagugu

SEQ ID NO: 1855910 - RNA, 15 nt, Homo sapiens
gguuggccugaguua

SEQ ID NO: 1855911 - RNA, 20 nt, Homo sapiens
gcugcagcugggccccaugc

SEQ ID NO: 1855912 - RNA, 19 nt, Homo sapiens
auuuuaguuguccucaggu

SEQ ID NO: 1855913 - RNA, 22 nt, Homo sapiens
gccaaagccaauaacacacagc

SEQ ID NO: 1855914 - RNA, 16 nt, Homo sapiens
ccugggggugccagga

SEQ ID NO: 1855915 - RNA, 14 nt, Homo sapiens
auugcuacuauaau

SEQ ID NO: 1855916 - RNA, 11 nt, Homo sapiens
gaaagcacuau

SEQ ID NO: 1855917 - RNA, 17 nt, Homo sapiens
cuuggaaagcugaugau

SEQ ID NO: 1855918 - RNA, 18 nt, Homo sapiens
cauaaaauagagugcauu

SEQ ID NO: 1855919 - RNA, 13 nt, Homo sapiens
uggaacuugccug

SEQ ID NO: 1855920 - RNA, 16 nt, Homo sapiens
cagaucugugccccau

SEQ ID NO: 1855921 - RNA, 20 nt, Homo sapiens
guaaucuguugacagugcca

SEQ ID NO: 1855922 - RNA, 14 nt, Homo sapiens
aucuaguucucaau

SEQ ID NO: 1855923 - RNA, 18 nt, Homo sapiens
auaauuguaccaaccuca

SEQ ID NO: 1855924 - RNA, 15 nt, Homo sapiens
acaauuaaagcaaaa

SEQ ID NO: 1855925 - RNA, 12 nt, Homo sapiens
cacucagauuua

SEQ ID NO: 1855926 - RNA, 17 nt, Homo sapiens
gcacacuuccaccauag

SEQ ID NO: 1855927 - RNA, 15 nt, Homo sapiens
gcacgcaagccucag

SEQ ID NO: 1855928 - RNA, 18 nt, Homo sapiens
ugugugauugacagcuuu

SEQ ID NO: 1855929 - RNA, 19 nt, Homo sapiens
uuaaagcauauuggugcua

SEQ ID NO: 1855930 - RNA, 13 nt, Homo sapiens
cgggagcacugcg

SEQ ID NO: 1855931 - RNA, 15 nt, Homo sapiens
gacacugcagacuug

SEQ ID NO: 1855932 - RNA, 13 nt, Homo sapiens
auuuugcuaaaaa

SEQ ID NO: 1855933 - RNA, 23 nt, Homo sapiens
accuuagcuuauugaucccacau

SEQ ID NO: 1855934 - RNA, 21 nt, Homo sapiens
aagcuggcugugcacuuaccc

SEQ ID NO: 1855935 - RNA, 13 nt, Homo sapiens
ccagcugaucaca

SEQ ID NO: 1855936 - RNA, 19 nt, Homo sapiens
gcccacgugugcagacugu

SEQ ID NO: 1855937 - RNA, 22 nt, Homo sapiens
uccuugauuuaucacacaaagc

SEQ ID NO: 1855938 - RNA, 15 nt, Homo sapiens
guuuagcagaacuca

SEQ ID NO: 1855939 - RNA, 15 nt, Homo sapiens
aagcccaauauuaua

SEQ ID NO: 1855940 - RNA, 21 nt, Homo sapiens
cgcucccauggcucuugcaac

SEQ ID NO: 1855941 - RNA, 12 nt, Homo sapiens
ucuaacugcugu

SEQ ID NO: 1855942 - RNA, 12 nt, Homo sapiens
ccagugucccca

SEQ ID NO: 1855943 - RNA, 13 nt, Homo sapiens
uaagguacuagca

SEQ ID NO: 1855944 - RNA, 11 nt, Homo sapiens
gcagcacuccc

SEQ ID NO: 1855945 - RNA, 21 nt, Homo sapiens
auauaccccaaauuguguaua

SEQ ID NO: 1855946 - RNA, 18 nt, Homo sapiens
cuuccugugcccugcaaa

SEQ ID NO: 1855947 - RNA, 13 nt, Homo sapiens
gagcccuccaggc

SEQ ID NO: 1855948 - RNA, 21 nt, Homo sapiens
accuacacagcuguuuccuca

SEQ ID NO: 1855949 - RNA, 22 nt, Homo sapiens
uaaagcagacaggugugcagau

SEQ ID NO: 1855950 - RNA, 16 nt, Homo sapiens
agccuaccaaugccaa

SEQ ID NO: 1855951 - RNA, 14 nt, Homo sapiens
guaucacucuaaaa

SEQ ID NO: 1855952 - RNA, 22 nt, Homo sapiens
cauuucuggaaagugcaauuau

SEQ ID NO: 1855953 - RNA, 22 nt, Homo sapiens
acugauuuaugaucacuuggaa

SEQ ID NO: 1855954 - RNA, 18 nt, Homo sapiens
aagacuuggcccaggaaa

SEQ ID NO: 1855955 - RNA, 12 nt, Homo sapiens
gagugagacuga

SEQ ID NO: 1855956 - RNA, 14 nt, Homo sapiens
uuguccaugauguc

SEQ ID NO: 1855957 - RNA, 16 nt, Homo sapiens
ucuagagucacugaua

SEQ ID NO: 1855958 - RNA, 18 nt, Homo sapiens
cagcauuuagucuugcca

SEQ ID NO: 1855959 - RNA, 15 nt, Homo sapiens
ugcccaaacuaauga

SEQ ID NO: 1855960 - RNA, 15 nt, Homo sapiens
ggcugcccucuccac

SEQ ID NO: 1855961 - RNA, 24 nt, Homo sapiens
cccucaaggccucccacagugacu

SEQ ID NO: 1855962 - RNA, 22 nt, Homo sapiens
uggccagaagggggccaugagg

SEQ ID NO: 1855963 - RNA, 21 nt, Homo sapiens
aguggggcagccuccuugccu

SEQ ID NO: 1855964 - RNA, 14 nt, Homo sapiens
agcaccgcugcuca

SEQ ID NO: 1855965 - RNA, 20 nt, Homo sapiens
gcaguguggaggccacuguu

SEQ ID NO: 1855966 - RNA, 22 nt, Homo sapiens
cuugccuagcccuuuggugaua

SEQ ID NO: 1855967 - RNA, 18 nt, Homo sapiens
ugggaauguccuguagag

SEQ ID NO: 1855968 - RNA, 16 nt, Homo sapiens
aacauuaguacuuuau

SEQ ID NO: 1855969 - RNA, 23 nt, Homo sapiens
gucaggcgcaguggcucaugccu

SEQ ID NO: 1855970 - RNA, 17 nt, Homo sapiens
uaagcaagugaacucau

SEQ ID NO: 1855971 - RNA, 17 nt, Homo sapiens
agauacuguugaucuuu

SEQ ID NO: 1855972 - RNA, 22 nt, Homo sapiens
acaagggacuagugagucagca

SEQ ID NO: 1855973 - RNA, 19 nt, Homo sapiens
gcuacacuauugcauuguu

SEQ ID NO: 1855974 - RNA, 19 nt, Homo sapiens
cccagcguggggguggcca

SEQ ID NO: 1855975 - RNA, 16 nt, Homo sapiens
agccaacuuggcuuuc

SEQ ID NO: 1855976 - RNA, 21 nt, Homo sapiens
aaucuuuccaucucauuacag

SEQ ID NO: 1855977 - RNA, 15 nt, Homo sapiens
aaugaguagacauug

SEQ ID NO: 1855978 - RNA, 14 nt, Homo sapiens
ugguccuguccaga

SEQ ID NO: 1855979 - RNA, 24 nt, Homo sapiens
cucuuccuccccaugucaccacaa

SEQ ID NO: 1855980 - RNA, 17 nt, Homo sapiens
gagcuauacauaugugc

SEQ ID NO: 1855981 - RNA, 13 nt, Homo sapiens
uaguaaguaauau

SEQ ID NO: 1855982 - RNA, 13 nt, Homo sapiens
agacaagauuuau

SEQ ID NO: 1855983 - RNA, 22 nt, Homo sapiens
caaugagcuccuuguuuuugcc

SEQ ID NO: 1855984 - RNA, 22 nt, Homo sapiens
aaucacaaaggcugacauucac

SEQ ID NO: 1855985 - RNA, 16 nt, Homo sapiens
uuuagaugccugugaa

SEQ ID NO: 1855986 - RNA, 20 nt, Homo sapiens
agaugcagacugauaccacc

SEQ ID NO: 1855987 - RNA, 15 nt, Homo sapiens
aagagaacaagcaaa

SEQ ID NO: 1855988 - RNA, 14 nt, Homo sapiens
guacaguugagcuc

SEQ ID NO: 1855989 - RNA, 11 nt, Homo sapiens
ccuuuccugug

SEQ ID NO: 1855990 - RNA, 12 nt, Homo sapiens
ggauaaaagccc

SEQ ID NO: 1855991 - RNA, 20 nt, Homo sapiens
gguauugaaucuaaaaccaa

SEQ ID NO: 1855992 - RNA, 21 nt, Homo sapiens
ccaggccugcauuacuccuuc

SEQ ID NO: 1855993 - RNA, 14 nt, Homo sapiens
ugcccccccagugg

SEQ ID NO: 1855994 - RNA, 21 nt, Homo sapiens
gaagcagugucgccgucccuc

SEQ ID NO: 1855995 - RNA, 16 nt, Homo sapiens
gucccaucgcucuuag

SEQ ID NO: 1855996 - RNA, 19 nt, Homo sapiens
caggcauggcgaggcugag

SEQ ID NO: 1855997 - RNA, 17 nt, Homo sapiens
guaaaucacacugaaac

SEQ ID NO: 1855998 - RNA, 23 nt, Homo sapiens
ccaggagaagucccaccagggac

SEQ ID NO: 1855999 - RNA, 15 nt, Homo sapiens
auuuguauuaugcug

SEQ ID NO: 1856000 - RNA, 18 nt, Homo sapiens
cgccaaggcuggagugca

SEQ ID NO: 1856001 - RNA, 17 nt, Homo sapiens
auuugagagcuaacuau

SEQ ID NO: 1856002 - RNA, 12 nt, Homo sapiens
agcauaauacuu

SEQ ID NO: 1856003 - RNA, 20 nt, Homo sapiens
agacgugcacugagagugaa

SEQ ID NO: 1856004 - RNA, 19 nt, Homo sapiens
acccgagcccagcuacauu

SEQ ID NO: 1856005 - RNA, 22 nt, Homo sapiens
ucagcaagcauuuucguuacau

SEQ ID NO: 1856006 - RNA, 14 nt, Homo sapiens
uucuuggagauuua

SEQ ID NO: 1856007 - RNA, 17 nt, Homo sapiens
uuacuaaaauggcagcu

SEQ ID NO: 1856008 - RNA, 16 nt, Homo sapiens
uaacacuuuguauuac

SEQ ID NO: 1856009 - RNA, 21 nt, Homo sapiens
ucaagagauucuccugccuca

SEQ ID NO: 1856010 - RNA, 17 nt, Homo sapiens
aguacuucccaacaacu

SEQ ID NO: 1856011 - RNA, 15 nt, Homo sapiens
cagauagccagacac

SEQ ID NO: 1856012 - RNA, 14 nt, Homo sapiens
ccacagaagacacg

SEQ ID NO: 1856013 - RNA, 16 nt, Homo sapiens
aaacuuugugauuuaa

SEQ ID NO: 1856014 - RNA, 21 nt, Homo sapiens
aaauagauuuccugugaguaa

SEQ ID NO: 1856015 - RNA, 15 nt, Homo sapiens
guguccgcuuucaug

SEQ ID NO: 1856016 - RNA, 21 nt, Homo sapiens
ugcuuaauaaauuguguuucc

SEQ ID NO: 1856017 - RNA, 23 nt, Homo sapiens
aaugugaacguccuuccuugacu

SEQ ID NO: 1856018 - RNA, 22 nt, Homo sapiens
cucuggaagccucuauugccau

SEQ ID NO: 1856019 - RNA, 13 nt, Homo sapiens
cacaaagacacag

SEQ ID NO: 1856020 - RNA, 13 nt, Homo sapiens
uauuuuaagcacu

SEQ ID NO: 1856021 - RNA, 14 nt, Homo sapiens
aguauauugaucca

SEQ ID NO: 1856022 - RNA, 18 nt, Homo sapiens
uugccaaggcaagaucua

SEQ ID NO: 1856023 - RNA, 13 nt, Homo sapiens
gcuauuugcaaac

SEQ ID NO: 1856024 - RNA, 12 nt, Homo sapiens
ggaacacugaga

SEQ ID NO: 1856025 - RNA, 19 nt, Homo sapiens
uaaauguaucaaucacuau

SEQ ID NO: 1856026 - RNA, 18 nt, Homo sapiens
gcuucaccagagcauuuc

SEQ ID NO: 1856027 - RNA, 14 nt, Homo sapiens
uaagacagcauuga

SEQ ID NO: 1856028 - RNA, 15 nt, Homo sapiens
cauaaucuguacaau

SEQ ID NO: 1856029 - RNA, 21 nt, Homo sapiens
acugaagaauuuugagugaau

SEQ ID NO: 1856030 - RNA, 14 nt, Homo sapiens
acauaauaagacuu

SEQ ID NO: 1856031 - RNA, 17 nt, Homo sapiens
cugucuuccuucauuau

SEQ ID NO: 1856032 - RNA, 19 nt, Homo sapiens
cccaacccccugcaagaag

SEQ ID NO: 1856033 - RNA, 22 nt, Homo sapiens
ccaagugcggguccggcagcuu

SEQ ID NO: 1856034 - RNA, 17 nt, Homo sapiens
cccaacuccucaugucu

SEQ ID NO: 1856035 - RNA, 18 nt, Homo sapiens
aaauaauaaccauggcaa

SEQ ID NO: 1856036 - RNA, 22 nt, Homo sapiens
guuaugcuccugcugauccaga

SEQ ID NO: 1856037 - RNA, 16 nt, Homo sapiens
aauaaggauuuauucu

SEQ ID NO: 1856038 - RNA, 13 nt, Homo sapiens
ucagcuauauacu

SEQ ID NO: 1856039 - RNA, 11 nt, Homo sapiens
uacucugucau

SEQ ID NO: 1856040 - RNA, 17 nt, Homo sapiens
uggccaggaaguagcac

SEQ ID NO: 1856041 - RNA, 17 nt, Homo sapiens
ugugagcuuacauugaa

SEQ ID NO: 1856042 - RNA, 18 nt, Homo sapiens
gcccugucauccagcuca

SEQ ID NO: 1856043 - RNA, 15 nt, Homo sapiens
aaaaguuaugguacu

SEQ ID NO: 1856044 - RNA, 23 nt, Homo sapiens
accaggggaggccugaggcuuca

SEQ ID NO: 1856045 - RNA, 21 nt, Homo sapiens
aaaucaaacacaacacaagaa

SEQ ID NO: 1856046 - RNA, 13 nt, Homo sapiens
gugguacuggcaa

SEQ ID NO: 1856047 - RNA, 19 nt, Homo sapiens
ucaaagauugaacacugcg

SEQ ID NO: 1856048 - RNA, 15 nt, Homo sapiens
uggcagccucaggag

SEQ ID NO: 1856049 - RNA, 15 nt, Homo sapiens
uacaugccuuuccag

SEQ ID NO: 1856050 - RNA, 18 nt, Homo sapiens
agcugaaaugcugcauuu

SEQ ID NO: 1856051 - RNA, 16 nt, Homo sapiens
agaaugcuuugccaua

SEQ ID NO: 1856052 - RNA, 14 nt, Homo sapiens
gacaguuaaacugg

SEQ ID NO: 1856053 - RNA, 20 nt, Homo sapiens
cuauaaauaguauuccaauc

SEQ ID NO: 1856054 - RNA, 22 nt, Homo sapiens
acguuuuucuggaccaagguga

SEQ ID NO: 1856055 - RNA, 15 nt, Homo sapiens
uuuugaaucuauaaa

SEQ ID NO: 1856056 - RNA, 16 nt, Homo sapiens
cacugucugacuuuag

SEQ ID NO: 1856057 - RNA, 16 nt, Homo sapiens
gccuugagcccuggcu

SEQ ID NO: 1856058 - RNA, 21 nt, Homo sapiens
ugacuuuccuaugacacucau

SEQ ID NO: 1856059 - RNA, 14 nt, Homo sapiens
gcauuaaaugcuuu

SEQ ID NO: 1856060 - RNA, 15 nt, Homo sapiens
agcccccacuacuaa

SEQ ID NO: 1856061 - RNA, 14 nt, Homo sapiens
acauugcauucuau

SEQ ID NO: 1856062 - RNA, 18 nt, Homo sapiens
uggcaaggaugcauacau

SEQ ID NO: 1856063 - RNA, 19 nt, Homo sapiens
aggucuuuccaagguuggg

SEQ ID NO: 1856064 - RNA, 18 nt, Homo sapiens
acauaguaaaugauucau

SEQ ID NO: 1856065 - RNA, 22 nt, Homo sapiens
agguuuuuuccuuucauuuuau

SEQ ID NO: 1856066 - RNA, 14 nt, Homo sapiens
acuagccaucucaa

SEQ ID NO: 1856067 - RNA, 15 nt, Homo sapiens
agagcugggacucag

SEQ ID NO: 1856068 - RNA, 14 nt, Homo sapiens
acaguuacagagug

SEQ ID NO: 1856069 - RNA, 18 nt, Homo sapiens
aagucaggugcaguccca

SEQ ID NO: 1856070 - RNA, 18 nt, Homo sapiens
caagugccuuauucucac

SEQ ID NO: 1856071 - RNA, 20 nt, Homo sapiens
gcuucccucugccugacccc

SEQ ID NO: 1856072 - RNA, 14 nt, Homo sapiens
uaaaaugaaauguc

SEQ ID NO: 1856073 - RNA, 23 nt, Homo sapiens
guuccuugguuguauaaagcaaa

SEQ ID NO: 1856074 - RNA, 13 nt, Homo sapiens
uacauucaaggag

SEQ ID NO: 1856075 - RNA, 13 nt, Homo sapiens
uguaauauucucc

SEQ ID NO: 1856076 - RNA, 18 nt, Homo sapiens
guacagaaagcugccugg

SEQ ID NO: 1856077 - RNA, 12 nt, Homo sapiens
cucucuucucag

SEQ ID NO: 1856078 - RNA, 22 nt, Homo sapiens
uuuauuaguuaauauaucccag

SEQ ID NO: 1856079 - RNA, 13 nt, Homo sapiens
cagaccacauaua

SEQ ID NO: 1856080 - RNA, 12 nt, Homo sapiens
aagcacuuugug

SEQ ID NO: 1856081 - RNA, 18 nt, Homo sapiens
gcagaagauacgugcaug

SEQ ID NO: 1856082 - RNA, 18 nt, Homo sapiens
cuggauguacuuaagagu

SEQ ID NO: 1856083 - RNA, 17 nt, Homo sapiens
ccagaggguugugauuu

SEQ ID NO: 1856084 - RNA, 20 nt, Homo sapiens
gccaguauaagcauuuccaa

SEQ ID NO: 1856085 - RNA, 19 nt, Homo sapiens
cccugcauugcugagucaa

SEQ ID NO: 1856086 - RNA, 18 nt, Homo sapiens
gccauccucaaacacugc

SEQ ID NO: 1856087 - RNA, 22 nt, Homo sapiens
cuccuuuccaaauaagugcauu

SEQ ID NO: 1856088 - RNA, 19 nt, Homo sapiens
cagaucuaccuuggugauu

SEQ ID NO: 1856089 - RNA, 16 nt, Homo sapiens
uuucuucaugcaauga

SEQ ID NO: 1856090 - RNA, 16 nt, Homo sapiens
cagaguugaagacaga

SEQ ID NO: 1856091 - RNA, 21 nt, Homo sapiens
gauucauauuuacuucuuaua

SEQ ID NO: 1856092 - RNA, 17 nt, Homo sapiens
cagguuccaucccgaaa

SEQ ID NO: 1856093 - RNA, 21 nt, Homo sapiens
gcucaauaaggcagugcagug

SEQ ID NO: 1856094 - RNA, 19 nt, Homo sapiens
ccagcugugcacuuucuuc

SEQ ID NO: 1856095 - RNA, 18 nt, Homo sapiens
ugguaaaaccccaucucu

SEQ ID NO: 1856096 - RNA, 19 nt, Homo sapiens
gacagaugaccgcaauaau

SEQ ID NO: 1856097 - RNA, 20 nt, Homo sapiens
uucacacggacuaaucuuuc

SEQ ID NO: 1856098 - RNA, 23 nt, Homo sapiens
uuguuaugugaauugagcacaua

SEQ ID NO: 1856099 - RNA, 19 nt, Homo sapiens
augggcucgcccaccagug

SEQ ID NO: 1856100 - RNA, 22 nt, Homo sapiens
gaucuaacuguuguuacuggaa

SEQ ID NO: 1856101 - RNA, 19 nt, Homo sapiens
ccggucagccaagugcaga

SEQ ID NO: 1856102 - RNA, 14 nt, Homo sapiens
uuugaucacacagc

SEQ ID NO: 1856103 - RNA, 17 nt, Homo sapiens
acaacaaacacugugau

SEQ ID NO: 1856104 - RNA, 17 nt, Homo sapiens
uugggcaggaacacaga

SEQ ID NO: 1856105 - RNA, 16 nt, Homo sapiens
ccacugggcaaacaga

SEQ ID NO: 1856106 - RNA, 16 nt, Homo sapiens
uccagccaguacagua

SEQ ID NO: 1856107 - RNA, 18 nt, Homo sapiens
uccugcagauacuuugaa

SEQ ID NO: 1856108 - RNA, 18 nt, Homo sapiens
guauuuuauaagcauuua

SEQ ID NO: 1856109 - RNA, 20 nt, Homo sapiens
gaacugaaggcagcauguau

SEQ ID NO: 1856110 - RNA, 20 nt, Homo sapiens
uauauaauaaagcuacugau

SEQ ID NO: 1856111 - RNA, 23 nt, Homo sapiens
ggagaagccccuacccugugagc

SEQ ID NO: 1856112 - RNA, 23 nt, Homo sapiens
gcuguaucaaacuagugcaugaa

SEQ ID NO: 1856113 - RNA, 15 nt, Homo sapiens
cgucuccuuugacau

SEQ ID NO: 1856114 - RNA, 16 nt, Homo sapiens
uccauagcuucaucca

SEQ ID NO: 1856115 - RNA, 21 nt, Homo sapiens
caguacagagccaugacucaa

SEQ ID NO: 1856116 - RNA, 16 nt, Homo sapiens
guucacacaaagccug

SEQ ID NO: 1856117 - RNA, 20 nt, Homo sapiens
ucagugucuuuccacuccuc

SEQ ID NO: 1856118 - RNA, 13 nt, Homo sapiens
uaauaacuuugcu

SEQ ID NO: 1856119 - RNA, 15 nt, Homo sapiens
ucagauuccaccuag

SEQ ID NO: 1856120 - RNA, 21 nt, Homo sapiens
gcaacucacugauucucuaca

SEQ ID NO: 1856121 - RNA, 23 nt, Homo sapiens
agaaaaaucuuuguuacucugua

SEQ ID NO: 1856122 - RNA, 23 nt, Homo sapiens
uccuucuuccccaauaugccugc

SEQ ID NO: 1856123 - RNA, 20 nt, Homo sapiens
caguagcuccgcgugucuca

SEQ ID NO: 1856124 - RNA, 14 nt, Homo sapiens
cuuucaaagugcac

SEQ ID NO: 1856125 - RNA, 15 nt, Homo sapiens
uaacuggagcagaga

SEQ ID NO: 1856126 - RNA, 15 nt, Homo sapiens
uucuuggaccaguuu

SEQ ID NO: 1856127 - RNA, 16 nt, Homo sapiens
caccuccaccugugag

SEQ ID NO: 1856128 - RNA, 21 nt, Homo sapiens
agggcaauaugaaguuacuuu

SEQ ID NO: 1856129 - RNA, 20 nt, Homo sapiens
auagugagauuuaaguuccu

SEQ ID NO: 1856130 - RNA, 21 nt, Homo sapiens
ugguuacaugaaugaaugaac

SEQ ID NO: 1856131 - RNA, 15 nt, Homo sapiens
ccuucaauggaagga

SEQ ID NO: 1856132 - RNA, 15 nt, Homo sapiens
gaugaguacccaaaa

SEQ ID NO: 1856133 - RNA, 15 nt, Homo sapiens
accugacaaauggaa

SEQ ID NO: 1856134 - RNA, 21 nt, Homo sapiens
uauugucgguuaccucugcau

SEQ ID NO: 1856135 - RNA, 15 nt, Homo sapiens
gagccuaacucccuc

SEQ ID NO: 1856136 - RNA, 17 nt, Homo sapiens
cuuucuuuuucuggaaa

SEQ ID NO: 1856137 - RNA, 22 nt, Homo sapiens
acccagcggcucuagccacuga

SEQ ID NO: 1856138 - RNA, 20 nt, Homo sapiens
acuaccccaggaugcaugca

SEQ ID NO: 1856139 - RNA, 23 nt, Homo sapiens
cagccucaccauacccuguugag

SEQ ID NO: 1856140 - RNA, 21 nt, Homo sapiens
ugagauguuuggguggguuaa

SEQ ID NO: 1856141 - RNA, 17 nt, Homo sapiens
gcaggagaaucacugca

SEQ ID NO: 1856142 - RNA, 13 nt, Homo sapiens
aauguacauuacc

SEQ ID NO: 1856143 - RNA, 20 nt, Homo sapiens
acuauucuuaagcacuuuga

SEQ ID NO: 1856144 - RNA, 18 nt, Homo sapiens
cagcaaaaugucuccuga

SEQ ID NO: 1856145 - RNA, 20 nt, Homo sapiens
aacagacaagugacuguauc

SEQ ID NO: 1856146 - RNA, 22 nt, Homo sapiens
uccucuguucuaucccacccaa

SEQ ID NO: 1856147 - RNA, 16 nt, Homo sapiens
cacugugggcuuuuau

SEQ ID NO: 1856148 - RNA, 13 nt, Homo sapiens
aagauacauuuca

SEQ ID NO: 1856149 - RNA, 22 nt, Homo sapiens
aaaagcuuaggcugauagacaa

SEQ ID NO: 1856150 - RNA, 14 nt, Homo sapiens
aguuuacccaugaa

SEQ ID NO: 1856151 - RNA, 16 nt, Homo sapiens
auauaacauguguaug

SEQ ID NO: 1856152 - RNA, 22 nt, Homo sapiens
gauccuccugucuaauuugcac

SEQ ID NO: 1856153 - RNA, 19 nt, Homo sapiens
cagaggagguuucaaagaa

SEQ ID NO: 1856154 - RNA, 14 nt, Homo sapiens
agucgguuagucau

SEQ ID NO: 1856155 - RNA, 14 nt, Homo sapiens
caggaguucagggu

SEQ ID NO: 1856156 - RNA, 13 nt, Homo sapiens
uuugagaacauuc

SEQ ID NO: 1856157 - RNA, 19 nt, Homo sapiens
cauaccccuggccaaggaa

SEQ ID NO: 1856158 - RNA, 20 nt, Homo sapiens
uucagcacuuaacuacuuug

SEQ ID NO: 1856159 - RNA, 18 nt, Homo sapiens
caagcucacccuucguca

SEQ ID NO: 1856160 - RNA, 23 nt, Homo sapiens
caaguaaaaaggcuaaauggaag

SEQ ID NO: 1856161 - RNA, 13 nt, Homo sapiens
uuuaaugcacuaa

SEQ ID NO: 1856162 - RNA, 19 nt, Homo sapiens
aguguaguggcaugaucuc

SEQ ID NO: 1856163 - RNA, 18 nt, Homo sapiens
cuuacaauacaauaguau

SEQ ID NO: 1856164 - RNA, 21 nt, Homo sapiens
uggaggaggggguacaguccu

SEQ ID NO: 1856165 - RNA, 23 nt, Homo sapiens
aacauggcaauugcacucaugug

SEQ ID NO: 1856166 - RNA, 18 nt, Homo sapiens
ggagagcaucugcucuga

SEQ ID NO: 1856167 - RNA, 13 nt, Homo sapiens
cagagguaaaaaa

SEQ ID NO: 1856168 - RNA, 15 nt, Homo sapiens
aagacauaauucaca

SEQ ID NO: 1856169 - RNA, 18 nt, Homo sapiens
gaggaugucccugaagug

SEQ ID NO: 1856170 - RNA, 18 nt, Homo sapiens
auauugugaugcauuuau

SEQ ID NO: 1856171 - RNA, 22 nt, Homo sapiens
acaauguggaauuacauaacag

SEQ ID NO: 1856172 - RNA, 15 nt, Homo sapiens
aguggggauccugcc

SEQ ID NO: 1856173 - RNA, 19 nt, Homo sapiens
aaucaugaaacuuguuuca

SEQ ID NO: 1856174 - RNA, 12 nt, Homo sapiens
uaaggucauuac

SEQ ID NO: 1856175 - RNA, 18 nt, Homo sapiens
agacacaggccgggacaa

SEQ ID NO: 1856176 - RNA, 23 nt, Homo sapiens
cauggaguugccaacuauucuca

SEQ ID NO: 1856177 - RNA, 15 nt, Homo sapiens
ugauuucaaggccau

SEQ ID NO: 1856178 - RNA, 16 nt, Homo sapiens
ccucuggcccagugaa

SEQ ID NO: 1856179 - RNA, 11 nt, Homo sapiens
ccuucaggcag

SEQ ID NO: 1856180 - RNA, 16 nt, Homo sapiens
aaaccgagugcaauga

SEQ ID NO: 1856181 - RNA, 17 nt, Homo sapiens
cauuacauuaacauuua

SEQ ID NO: 1856182 - RNA, 18 nt, Homo sapiens
cugagcaccucagccuuu

SEQ ID NO: 1856183 - RNA, 18 nt, Homo sapiens
cugcucacuaccuccuca

SEQ ID NO: 1856184 - RNA, 15 nt, Homo sapiens
gugaugcuguacaca

SEQ ID NO: 1856185 - RNA, 15 nt, Homo sapiens
aggggcuggggccaa

SEQ ID NO: 1856186 - RNA, 14 nt, Homo sapiens
uauaucacuaagcu

SEQ ID NO: 1856187 - RNA, 20 nt, Homo sapiens
acaaugccacuauaguuuaa

SEQ ID NO: 1856188 - RNA, 13 nt, Homo sapiens
acuauuuucauuc

SEQ ID NO: 1856189 - RNA, 19 nt, Homo sapiens
auuucauugaaauaauuga

SEQ ID NO: 1856190 - RNA, 22 nt, Homo sapiens
ucagcaucugaccaucugugac

SEQ ID NO: 1856191 - RNA, 17 nt, Homo sapiens
aacccucucucuuaccu

SEQ ID NO: 1856192 - RNA, 15 nt, Homo sapiens
ccugaaggucugggu

SEQ ID NO: 1856193 - RNA, 19 nt, Homo sapiens
aagacuuccccaagccugg

SEQ ID NO: 1856194 - RNA, 14 nt, Homo sapiens
agagcuaaggccaa

SEQ ID NO: 1856195 - RNA, 13 nt, Homo sapiens
acacacacuccuu

SEQ ID NO: 1856196 - RNA, 22 nt, Homo sapiens
acaucuggucuuccaggcacuc

SEQ ID NO: 1856197 - RNA, 14 nt, Homo sapiens
cuucucuccagugc

SEQ ID NO: 1856198 - RNA, 17 nt, Homo sapiens
cuuagcaugcacaaagu

SEQ ID NO: 1856199 - RNA, 13 nt, Homo sapiens
gcaggacucuauc

SEQ ID NO: 1856200 - RNA, 22 nt, Homo sapiens
cuagugccuugcccacaggugc

SEQ ID NO: 1856201 - RNA, 22 nt, Homo sapiens
ccucuaaaacuagaaaaggaag

SEQ ID NO: 1856202 - RNA, 21 nt, Homo sapiens
uucuuguuugucagcaucuga

SEQ ID NO: 1856203 - RNA, 17 nt, Homo sapiens
cuccaaugucugcugag

SEQ ID NO: 1856204 - RNA, 15 nt, Homo sapiens
uguagggcauaauga

SEQ ID NO: 1856205 - RNA, 17 nt, Homo sapiens
aaucuguaagcucuuug

SEQ ID NO: 1856206 - RNA, 16 nt, Homo sapiens
agcuuaaauugucaga

SEQ ID NO: 1856207 - RNA, 19 nt, Homo sapiens
agugaauccugaaacuggu

SEQ ID NO: 1856208 - RNA, 15 nt, Homo sapiens
aagagcuugcuccag

SEQ ID NO: 1856209 - RNA, 16 nt, Homo sapiens
cuggaaugggggccag

SEQ ID NO: 1856210 - RNA, 22 nt, Homo sapiens
cuuaagacgugauuuugcugua

SEQ ID NO: 1856211 - RNA, 20 nt, Homo sapiens
aagugaucugcccaccucag

SEQ ID NO: 1856212 - RNA, 20 nt, Homo sapiens
uacguuaaaauuacuuugaa

SEQ ID NO: 1856213 - RNA, 22 nt, Homo sapiens
aaaaccaccuuuucugcuucaa

SEQ ID NO: 1856214 - RNA, 12 nt, Homo sapiens
uaacuaaauaac

SEQ ID NO: 1856215 - RNA, 15 nt, Homo sapiens
uggucauuuggcagc

SEQ ID NO: 1856216 - RNA, 22 nt, Homo sapiens
ucuuucaaaguguaagcacuuc

SEQ ID NO: 1856217 - RNA, 22 nt, Homo sapiens
cucccgucugucuguccugucu

SEQ ID NO: 1856218 - RNA, 13 nt, Homo sapiens
aacagauuucuca

SEQ ID NO: 1856219 - RNA, 18 nt, Homo sapiens
uuccauuucgccccucau

SEQ ID NO: 1856220 - RNA, 18 nt, Homo sapiens
cacaugugccacacagug

SEQ ID NO: 1856221 - RNA, 17 nt, Homo sapiens
auuccuucuaaguguac

SEQ ID NO: 1856222 - RNA, 17 nt, Homo sapiens
aguagaaagcauaacaa

SEQ ID NO: 1856223 - RNA, 23 nt, Homo sapiens
cccaggcuggagugcaguagcac

SEQ ID NO: 1856224 - RNA, 13 nt, Homo sapiens
ucauccuaacaau

SEQ ID NO: 1856225 - RNA, 19 nt, Homo sapiens
cugugugugcccgugguga

SEQ ID NO: 1856226 - RNA, 15 nt, Homo sapiens
cccgaccaacaugga

SEQ ID NO: 1856227 - RNA, 22 nt, Homo sapiens
guacauucaauguuuaugcaag

SEQ ID NO: 1856228 - RNA, 12 nt, Homo sapiens
gacccuggucuc

SEQ ID NO: 1856229 - RNA, 23 nt, Homo sapiens
uggcagcucagcuuccccaacac

SEQ ID NO: 1856230 - RNA, 12 nt, Homo sapiens
accaugggcuac

SEQ ID NO: 1856231 - RNA, 16 nt, Homo sapiens
gagugcuaagcauuag

SEQ ID NO: 1856232 - RNA, 12 nt, Homo sapiens
ucuucucaagca

SEQ ID NO: 1856233 - RNA, 15 nt, Homo sapiens
ucuacuucagucuuc

SEQ ID NO: 1856234 - RNA, 17 nt, Homo sapiens
ccagagugaagcccaca

SEQ ID NO: 1856235 - RNA, 22 nt, Homo sapiens
uccaugguguagcgugcaucag

SEQ ID NO: 1856236 - RNA, 23 nt, Homo sapiens
agcacuccccagagcugugccag

SEQ ID NO: 1856237 - RNA, 23 nt, Homo sapiens
cugugcggugucaccaugagcac

SEQ ID NO: 1856238 - RNA, 22 nt, Homo sapiens
ccaguggaacagcgggagaccu

SEQ ID NO: 1856239 - RNA, 15 nt, Homo sapiens
gcucuccagaccuga

SEQ ID NO: 1856240 - RNA, 11 nt, Homo sapiens
cauaaagccaa

SEQ ID NO: 1856241 - RNA, 19 nt, Homo sapiens
uaagugcauuuguaauuca

SEQ ID NO: 1856242 - RNA, 18 nt, Homo sapiens
aaugugauauguguaaua

SEQ ID NO: 1856243 - RNA, 22 nt, Homo sapiens
uauauuuuuguacugaaucuca

SEQ ID NO: 1856244 - RNA, 22 nt, Homo sapiens
cugcucguuuacacugcacauu

SEQ ID NO: 1856245 - RNA, 18 nt, Homo sapiens
uguaggcacagagcugca

SEQ ID NO: 1856246 - RNA, 21 nt, Homo sapiens
ggaggcugcacuggagccaca

SEQ ID NO: 1856247 - RNA, 22 nt, Homo sapiens
agcugucccaucuccacuguua

SEQ ID NO: 1856248 - RNA, 15 nt, Homo sapiens
auccuauuuaucaga

SEQ ID NO: 1856249 - RNA, 17 nt, Homo sapiens
gaacuaacuuacugucc

SEQ ID NO: 1856250 - RNA, 19 nt, Homo sapiens
cacagagcacgccugccau

SEQ ID NO: 1856251 - RNA, 13 nt, Homo sapiens
uuaauaaacucac

SEQ ID NO: 1856252 - RNA, 19 nt, Homo sapiens
ucacuggaacucaguguga

SEQ ID NO: 1856253 - RNA, 22 nt, Homo sapiens
acaaaugaagacaaaacauaca

SEQ ID NO: 1856254 - RNA, 20 nt, Homo sapiens
cuuaaaguuuaaaguugcac

SEQ ID NO: 1856255 - RNA, 15 nt, Homo sapiens
cauacuuaacauuuc

SEQ ID NO: 1856256 - RNA, 14 nt, Homo sapiens
aggagcacuuccaa

SEQ ID NO: 1856257 - RNA, 22 nt, Homo sapiens
cagggcuuccucaaauacaugc

SEQ ID NO: 1856258 - RNA, 21 nt, Homo sapiens
aaugagguagcuauaguugca

SEQ ID NO: 1856259 - RNA, 17 nt, Homo sapiens
uuaaugucuaaccaaga

SEQ ID NO: 1856260 - RNA, 14 nt, Homo sapiens
auaucgaucucuua

SEQ ID NO: 1856261 - RNA, 14 nt, Homo sapiens
aaaucaaucacuug

SEQ ID NO: 1856262 - RNA, 22 nt, Homo sapiens
ugaaaaacagaaagcauccuaa

SEQ ID NO: 1856263 - RNA, 18 nt, Homo sapiens
uucuggauggcaucuagc

SEQ ID NO: 1856264 - RNA, 17 nt, Homo sapiens
auaaucauaggcacuug

SEQ ID NO: 1856265 - RNA, 18 nt, Homo sapiens
cuugauucuugugauuga

SEQ ID NO: 1856266 - RNA, 15 nt, Homo sapiens
caucuuucagcugcu

SEQ ID NO: 1856267 - RNA, 23 nt, Homo sapiens
ccaauauccaauuuuaaaaugaa

SEQ ID NO: 1856268 - RNA, 18 nt, Homo sapiens
uucuaucaaauacuagua

SEQ ID NO: 1856269 - RNA, 18 nt, Homo sapiens
acauggaucaacaaaauc

SEQ ID NO: 1856270 - RNA, 19 nt, Homo sapiens
uuccccacaauaggcuuag

SEQ ID NO: 1856271 - RNA, 20 nt, Homo sapiens
ccucuaagucaggcccugau

SEQ ID NO: 1856272 - RNA, 18 nt, Homo sapiens
augauuuuuguguaucca

SEQ ID NO: 1856273 - RNA, 16 nt, Homo sapiens
ugcuuaugacaucacu

SEQ ID NO: 1856274 - RNA, 23 nt, Homo sapiens
agccuccugcccagcacaggaau

SEQ ID NO: 1856275 - RNA, 18 nt, Homo sapiens
uaucuugauuucacugga

SEQ ID NO: 1856276 - RNA, 19 nt, Homo sapiens
ucacuuccuauaugcacuu

SEQ ID NO: 1856277 - RNA, 15 nt, Homo sapiens
auuaaacguaugcau

SEQ ID NO: 1856278 - RNA, 21 nt, Homo sapiens
ggucacauuacauuaacauuu

SEQ ID NO: 1856279 - RNA, 15 nt, Homo sapiens
ccagguuacauucua

SEQ ID NO: 1856280 - RNA, 15 nt, Homo sapiens
ucaugaaauaugcau

SEQ ID NO: 1856281 - RNA, 19 nt, Homo sapiens
uauauaugauuguuugcac

SEQ ID NO: 1856282 - RNA, 22 nt, Homo sapiens
ucccucuacauggacucagaga

SEQ ID NO: 1856283 - RNA, 18 nt, Homo sapiens
gaacacugucaauggacu

SEQ ID NO: 1856284 - RNA, 14 nt, Homo sapiens
ggucaguuacaaag

SEQ ID NO: 1856285 - RNA, 18 nt, Homo sapiens
gaucuaauuaaacuaaag

SEQ ID NO: 1856286 - RNA, 13 nt, Homo sapiens
ugcuaugugucac

SEQ ID NO: 1856287 - RNA, 17 nt, Homo sapiens
aguuacuauugcucaua

SEQ ID NO: 1856288 - RNA, 16 nt, Homo sapiens
cuguccugcacacccu

SEQ ID NO: 1856289 - RNA, 19 nt, Homo sapiens
cuuaaaguuuaaaguugca

SEQ ID NO: 1856290 - RNA, 22 nt, Homo sapiens
agcuuggaaacuggaugagguc

SEQ ID NO: 1856291 - RNA, 13 nt, Homo sapiens
gaaccauuacugu

SEQ ID NO: 1856292 - RNA, 16 nt, Homo sapiens
uaagaagagauuucuc

SEQ ID NO: 1856293 - RNA, 18 nt, Homo sapiens
gagagucccagagcucau

SEQ ID NO: 1856294 - RNA, 15 nt, Homo sapiens
aagguaaacaguuug

SEQ ID NO: 1856295 - RNA, 17 nt, Homo sapiens
uacaauauaucuugucu

SEQ ID NO: 1856296 - RNA, 16 nt, Homo sapiens
aaaccagcaucugcac

SEQ ID NO: 1856297 - RNA, 13 nt, Homo sapiens
uguuaugccauga

SEQ ID NO: 1856298 - RNA, 16 nt, Homo sapiens
aggccauuuguguuua

SEQ ID NO: 1856299 - RNA, 20 nt, Homo sapiens
cacgggguauuuuaggcagg

SEQ ID NO: 1856300 - RNA, 23 nt, Homo sapiens
uuaaucauuuccccauaacucaa

SEQ ID NO: 1856301 - RNA, 16 nt, Homo sapiens
auagagacccauguca

SEQ ID NO: 1856302 - RNA, 17 nt, Homo sapiens
acauccugucaguguca

SEQ ID NO: 1856303 - RNA, 22 nt, Homo sapiens
aguuaguggauaaccacagggc

SEQ ID NO: 1856304 - RNA, 14 nt, Homo sapiens
cccacaaagccaga

SEQ ID NO: 1856305 - RNA, 15 nt, Homo sapiens
cacuugacauuccuu

SEQ ID NO: 1856306 - RNA, 16 nt, Homo sapiens
ccugcagaagaagcug

SEQ ID NO: 1856307 - RNA, 22 nt, Homo sapiens
aauucuuauuuuuuaaaaagcu

SEQ ID NO: 1856308 - RNA, 18 nt, Homo sapiens
acuccaccucuaccaaaa

SEQ ID NO: 1856309 - RNA, 22 nt, Homo sapiens
gucucccugcacagccucuagu

SEQ ID NO: 1856310 - RNA, 14 nt, Homo sapiens
agcugcuccgugcu

SEQ ID NO: 1856311 - RNA, 23 nt, Homo sapiens
cacacggaugcacagagauaugc

SEQ ID NO: 1856312 - RNA, 17 nt, Homo sapiens
uguugcaaacucagugc

SEQ ID NO: 1856313 - RNA, 14 nt, Homo sapiens
cugcagagauccag

SEQ ID NO: 1856314 - RNA, 21 nt, Homo sapiens
aaaaucucuacugcuuuggau

SEQ ID NO: 1856315 - RNA, 13 nt, Homo sapiens
ugacaacacaaau

SEQ ID NO: 1856316 - RNA, 21 nt, Homo sapiens
ucaagacuugauacugcaaua

SEQ ID NO: 1856317 - RNA, 15 nt, Homo sapiens
uacacgcgugugcuc

SEQ ID NO: 1856318 - RNA, 12 nt, Homo sapiens
uaagagcuuuau

SEQ ID NO: 1856319 - RNA, 14 nt, Homo sapiens
gacguguggugugc

SEQ ID NO: 1856320 - RNA, 14 nt, Homo sapiens
aaauucuagucucu

SEQ ID NO: 1856321 - RNA, 13 nt, Homo sapiens
caauacaguacuc

SEQ ID NO: 1856322 - RNA, 20 nt, Homo sapiens
ugagaggugggggaugcuga

SEQ ID NO: 1856323 - RNA, 19 nt, Homo sapiens
cuucucauucccaugugga

SEQ ID NO: 1856324 - RNA, 21 nt, Homo sapiens
gguggggagucagucauguca

SEQ ID NO: 1856325 - RNA, 18 nt, Homo sapiens
gcccacccagauucugaa

SEQ ID NO: 1856326 - RNA, 14 nt, Homo sapiens
auauuuccauucau

SEQ ID NO: 1856327 - RNA, 17 nt, Homo sapiens
ugaaaacaaaauaucug

SEQ ID NO: 1856328 - RNA, 19 nt, Homo sapiens
gcuggcuggaggaaggaaa

SEQ ID NO: 1856329 - RNA, 23 nt, Homo sapiens
uggcacgcgccuguaaucccagc

SEQ ID NO: 1856330 - RNA, 15 nt, Homo sapiens
auaaagcacgugcaa

SEQ ID NO: 1856331 - RNA, 13 nt, Homo sapiens
augccugguacca

SEQ ID NO: 1856332 - RNA, 17 nt, Homo sapiens
uuaaacuggaacaugcu

SEQ ID NO: 1856333 - RNA, 14 nt, Homo sapiens
agcaaauaccaaag

SEQ ID NO: 1856334 - RNA, 15 nt, Homo sapiens
cauacccuguuacca

SEQ ID NO: 1856335 - RNA, 23 nt, Homo sapiens
aauugugucugcaggauugauua

SEQ ID NO: 1856336 - RNA, 15 nt, Homo sapiens
cacuuauccugacac

SEQ ID NO: 1856337 - RNA, 13 nt, Homo sapiens
aaacagaacugga

SEQ ID NO: 1856338 - RNA, 11 nt, Homo sapiens
aagaugcugcc

SEQ ID NO: 1856339 - RNA, 21 nt, Homo sapiens
uaauuugggaaaauaaauaca

SEQ ID NO: 1856340 - RNA, 13 nt, Homo sapiens
uauuccugauaug

SEQ ID NO: 1856341 - RNA, 23 nt, Homo sapiens
aaaauaagacuucuggugcugcu

SEQ ID NO: 1856342 - RNA, 18 nt, Homo sapiens
ucugcacucuaaacugca

SEQ ID NO: 1856343 - RNA, 21 nt, Homo sapiens
ggcucaggguuggccauuugc

SEQ ID NO: 1856344 - RNA, 13 nt, Homo sapiens
uaagaaagcacua

SEQ ID NO: 1856345 - RNA, 15 nt, Homo sapiens
auggagaggaacaca

SEQ ID NO: 1856346 - RNA, 10 nt, Homo sapiens
uuugccaaau

SEQ ID NO: 1856347 - RNA, 14 nt, Homo sapiens
gucaaaccaagaag

SEQ ID NO: 1856348 - RNA, 19 nt, Homo sapiens
caguaggggcuacugugac

SEQ ID NO: 1856349 - RNA, 17 nt, Homo sapiens
uccuuugccucugcuac

SEQ ID NO: 1856350 - RNA, 15 nt, Homo sapiens
aggaaauauaaacuu

SEQ ID NO: 1856351 - RNA, 20 nt, Homo sapiens
uuagcuuuagaaacagugca

SEQ ID NO: 1856352 - RNA, 16 nt, Homo sapiens
gcuuugugucuggcca

SEQ ID NO: 1856353 - RNA, 19 nt, Homo sapiens
ccucuggaaucuuccccaa

SEQ ID NO: 1856354 - RNA, 16 nt, Homo sapiens
cuugaaaacuucucau

SEQ ID NO: 1856355 - RNA, 22 nt, Homo sapiens
ucccaggccucugccccaagag

SEQ ID NO: 1856356 - RNA, 13 nt, Homo sapiens
aagcuccaucucu

SEQ ID NO: 1856357 - RNA, 20 nt, Homo sapiens
agugaucuuucccaagagaa

SEQ ID NO: 1856358 - RNA, 13 nt, Homo sapiens
uccauaggacaaa

SEQ ID NO: 1856359 - RNA, 23 nt, Homo sapiens
uaaaauuaaaugcauguccucaa

SEQ ID NO: 1856360 - RNA, 23 nt, Homo sapiens
cuuuuuaaaguguuucuguuauu

SEQ ID NO: 1856361 - RNA, 17 nt, Homo sapiens
ggccucaucugcuccua

SEQ ID NO: 1856362 - RNA, 15 nt, Homo sapiens
ucucacacacuggcu

SEQ ID NO: 1856363 - RNA, 14 nt, Homo sapiens
acugucugacuaca

SEQ ID NO: 1856364 - RNA, 14 nt, Homo sapiens
uucaaaauuccauu

SEQ ID NO: 1856365 - RNA, 16 nt, Homo sapiens
uaaaaucugauuuaca

SEQ ID NO: 1856366 - RNA, 20 nt, Homo sapiens
ucaaagaaaaagguccaugc

SEQ ID NO: 1856367 - RNA, 21 nt, Homo sapiens
accugcugcguccccacuccc

SEQ ID NO: 1856368 - RNA, 21 nt, Homo sapiens
gucaccagaauauuucuuuca

SEQ ID NO: 1856369 - RNA, 14 nt, Homo sapiens
gaccaaaacaaaca

SEQ ID NO: 1856370 - RNA, 14 nt, Homo sapiens
uggggacauuugcc

SEQ ID NO: 1856371 - RNA, 23 nt, Homo sapiens
auuaucaccaugacaccugccau

SEQ ID NO: 1856372 - RNA, 21 nt, Homo sapiens
cucauuuauagaugucaggaa

SEQ ID NO: 1856373 - RNA, 12 nt, Homo sapiens
cuacauucugua

SEQ ID NO: 1856374 - RNA, 15 nt, Homo sapiens
caauugcacugcugu

SEQ ID NO: 1856375 - RNA, 21 nt, Homo sapiens
agccacaggccugagauuuca

SEQ ID NO: 1856376 - RNA, 14 nt, Homo sapiens
ucauacauguuaca

SEQ ID NO: 1856377 - RNA, 13 nt, Homo sapiens
gcuuugccucuac

SEQ ID NO: 1856378 - RNA, 19 nt, Homo sapiens
uggagggcacuuccuccac

SEQ ID NO: 1856379 - RNA, 13 nt, Homo sapiens
ucuugacuaggua

SEQ ID NO: 1856380 - RNA, 20 nt, Homo sapiens
ucagauugcuuuugugcauu

SEQ ID NO: 1856381 - RNA, 18 nt, Homo sapiens
cucacagcacccuauaua

SEQ ID NO: 1856382 - RNA, 14 nt, Homo sapiens
aaaauagcuauaaa

SEQ ID NO: 1856383 - RNA, 16 nt, Homo sapiens
ccaaugccacagccaa

SEQ ID NO: 1856384 - RNA, 17 nt, Homo sapiens
ugugcucggacacaguu

SEQ ID NO: 1856385 - RNA, 22 nt, Homo sapiens
agucucugaagugaaacugcuu

SEQ ID NO: 1856386 - RNA, 17 nt, Homo sapiens
agaugacaacacacacc

SEQ ID NO: 1856387 - RNA, 23 nt, Homo sapiens
cuucauguucgagcuuaccuacu

SEQ ID NO: 1856388 - RNA, 14 nt, Homo sapiens
uggcgugcugagaa

SEQ ID NO: 1856389 - RNA, 14 nt, Homo sapiens
augacccuuuucau

SEQ ID NO: 1856390 - RNA, 22 nt, Homo sapiens
ggcccugugccaggccaaagau

SEQ ID NO: 1856391 - RNA, 23 nt, Homo sapiens
acauuuugcauuagacagaugac

SEQ ID NO: 1856392 - RNA, 12 nt, Homo sapiens
cugagugcagcc

SEQ ID NO: 1856393 - RNA, 15 nt, Homo sapiens
cuguggcugcuagca

SEQ ID NO: 1856394 - RNA, 13 nt, Homo sapiens
ccagccucuagaa

SEQ ID NO: 1856395 - RNA, 19 nt, Homo sapiens
guccccgaugcugaccuca

SEQ ID NO: 1856396 - RNA, 22 nt, Homo sapiens
augaacccuuccugagcuuuau

SEQ ID NO: 1856397 - RNA, 15 nt, Homo sapiens
auucugcaagcaauc

SEQ ID NO: 1856398 - RNA, 13 nt, Homo sapiens
aaaguuccagaaa

SEQ ID NO: 1856399 - RNA, 20 nt, Homo sapiens
agauugacuaacucaaauac

SEQ ID NO: 1856400 - RNA, 14 nt, Homo sapiens
gccaggcugugcua

SEQ ID NO: 1856401 - RNA, 18 nt, Homo sapiens
cagugagaaaaagcuccu

SEQ ID NO: 1856402 - RNA, 23 nt, Homo sapiens
ggcaaaacaaaauguaaugucag

SEQ ID NO: 1856403 - RNA, 16 nt, Homo sapiens
ccacuccaaccagaag

SEQ ID NO: 1856404 - RNA, 22 nt, Homo sapiens
cucucugucuuuuuucucucuu

SEQ ID NO: 1856405 - RNA, 14 nt, Homo sapiens
acuuugaguaccaa

SEQ ID NO: 1856406 - RNA, 18 nt, Homo sapiens
cagaaagggaacagucca

SEQ ID NO: 1856407 - RNA, 21 nt, Homo sapiens
auaaugucauuaaacaugaca

SEQ ID NO: 1856408 - RNA, 19 nt, Homo sapiens
ccccaauaaaccaguguga

SEQ ID NO: 1856409 - RNA, 20 nt, Homo sapiens
agaccgugaagauacuuugu

SEQ ID NO: 1856410 - RNA, 23 nt, Homo sapiens
gcucugacagccuagaaguccaa

SEQ ID NO: 1856411 - RNA, 12 nt, Homo sapiens
uuuuaauugauu

SEQ ID NO: 1856412 - RNA, 21 nt, Homo sapiens
cgcaaccaccaccaaccacug

SEQ ID NO: 1856413 - RNA, 13 nt, Homo sapiens
gcgggaggcggug

SEQ ID NO: 1856414 - RNA, 15 nt, Homo sapiens
ugguuugugucaaaa

SEQ ID NO: 1856415 - RNA, 16 nt, Homo sapiens
acucggcgugcuccuu

SEQ ID NO: 1856416 - RNA, 12 nt, Homo sapiens
aaacaagccuua

SEQ ID NO: 1856417 - RNA, 19 nt, Homo sapiens
gccauauggacacugugac

SEQ ID NO: 1856418 - RNA, 23 nt, Homo sapiens
uccacaaaaacucuuauuacugu

SEQ ID NO: 1856419 - RNA, 15 nt, Homo sapiens
aaaugaccuaucaaa

SEQ ID NO: 1856420 - RNA, 23 nt, Homo sapiens
uaguuuugauccuaaaucugccu

SEQ ID NO: 1856421 - RNA, 20 nt, Homo sapiens
ugagugaauguuaacaugcg

SEQ ID NO: 1856422 - RNA, 19 nt, Homo sapiens
gcccaaauguccgaucccc

SEQ ID NO: 1856423 - RNA, 17 nt, Homo sapiens
auuucuucucaaagggu

SEQ ID NO: 1856424 - RNA, 18 nt, Homo sapiens
cauauuuuuaaacaaaga

SEQ ID NO: 1856425 - RNA, 23 nt, Homo sapiens
aaacaguucugcacucuuguaca

SEQ ID NO: 1856426 - RNA, 19 nt, Homo sapiens
augugacuccuaugaucuc

SEQ ID NO: 1856427 - RNA, 22 nt, Homo sapiens
guuuauuguaguaaacuauucu

SEQ ID NO: 1856428 - RNA, 23 nt, Homo sapiens
ccugugagguuucccaauggugu

SEQ ID NO: 1856429 - RNA, 15 nt, Homo sapiens
gaacauugcauauaa

SEQ ID NO: 1856430 - RNA, 14 nt, Homo sapiens
uucacauugaucau

SEQ ID NO: 1856431 - RNA, 18 nt, Homo sapiens
uacccuuccucaccacuu

SEQ ID NO: 1856432 - RNA, 19 nt, Homo sapiens
acagagcgccucaccugca

SEQ ID NO: 1856433 - RNA, 15 nt, Homo sapiens
uaaaaccaccaaagu

SEQ ID NO: 1856434 - RNA, 21 nt, Homo sapiens
uaacauagauuuaagugaaua

SEQ ID NO: 1856435 - RNA, 18 nt, Homo sapiens
uacuaaccaccauuuccc

SEQ ID NO: 1856436 - RNA, 16 nt, Homo sapiens
uuacauuuugugcagu

SEQ ID NO: 1856437 - RNA, 22 nt, Homo sapiens
ggcaaagagagucgcaucucag

SEQ ID NO: 1856438 - RNA, 23 nt, Homo sapiens
cucaaauacgugggcauucaaau

SEQ ID NO: 1856439 - RNA, 17 nt, Homo sapiens
ucacugacucaagacac

SEQ ID NO: 1856440 - RNA, 23 nt, Homo sapiens
uccccagcccuggcucugcaaug

SEQ ID NO: 1856441 - RNA, 19 nt, Homo sapiens
cggacagcugcccagacac

SEQ ID NO: 1856442 - RNA, 17 nt, Homo sapiens
auuaacuuaaaagauuc

SEQ ID NO: 1856443 - RNA, 23 nt, Homo sapiens
uugcgcaaacuuuaacagguuuu

SEQ ID NO: 1856444 - RNA, 17 nt, Homo sapiens
agggccgaggaggugcc

SEQ ID NO: 1856445 - RNA, 19 nt, Homo sapiens
caucuggaggcucccaugg

SEQ ID NO: 1856446 - RNA, 18 nt, Homo sapiens
uuaaauguccguguaaaa

SEQ ID NO: 1856447 - RNA, 20 nt, Homo sapiens
gauuuccuuuggcaauauca

SEQ ID NO: 1856448 - RNA, 16 nt, Homo sapiens
accagcaauacaaaga

SEQ ID NO: 1856449 - RNA, 14 nt, Homo sapiens
ucaaauauuucaac

SEQ ID NO: 1856450 - RNA, 14 nt, Homo sapiens
cucuucauccauuu

SEQ ID NO: 1856451 - RNA, 14 nt, Homo sapiens
aggacccaggacag

SEQ ID NO: 1856452 - RNA, 18 nt, Homo sapiens
ugugagcuaugcaaacaa

SEQ ID NO: 1856453 - RNA, 15 nt, Homo sapiens
uacccaccugagcuu

SEQ ID NO: 1856454 - RNA, 13 nt, Homo sapiens
aacuaccucgcau

SEQ ID NO: 1856455 - RNA, 23 nt, Homo sapiens
gcccuggggacuguuccaaagcc

SEQ ID NO: 1856456 - RNA, 19 nt, Homo sapiens
uggacucaaaguauccucc

SEQ ID NO: 1856457 - RNA, 13 nt, Homo sapiens
ccccauugagauc

SEQ ID NO: 1856458 - RNA, 19 nt, Homo sapiens
guuccacagugacugggcc

SEQ ID NO: 1856459 - RNA, 18 nt, Homo sapiens
caaucagcccagugcaaa

SEQ ID NO: 1856460 - RNA, 16 nt, Homo sapiens
gccacggccacaguca

SEQ ID NO: 1856461 - RNA, 15 nt, Homo sapiens
agaacuugaagugaa

SEQ ID NO: 1856462 - RNA, 14 nt, Homo sapiens
gagaauuggcucaa

SEQ ID NO: 1856463 - RNA, 16 nt, Homo sapiens
uugaucaccaugaaag

SEQ ID NO: 1856464 - RNA, 23 nt, Homo sapiens
gagaccccuaaagaaauaaucuc

SEQ ID NO: 1856465 - RNA, 18 nt, Homo sapiens
ccucgcgacaucuucuca

SEQ ID NO: 1856466 - RNA, 20 nt, Homo sapiens
ucaaguuugaccagugcagu

SEQ ID NO: 1856467 - RNA, 20 nt, Homo sapiens
aaauguaguauggccugugu

SEQ ID NO: 1856468 - RNA, 16 nt, Homo sapiens
gagcagcuucugccac

SEQ ID NO: 1856469 - RNA, 21 nt, Homo sapiens
cugaggcggagaauugcuuga

SEQ ID NO: 1856470 - RNA, 14 nt, Homo sapiens
ugaugcucccuuga

SEQ ID NO: 1856471 - RNA, 19 nt, Homo sapiens
gaaucuaagugggagacaa

SEQ ID NO: 1856472 - RNA, 20 nt, Homo sapiens
cauuuggcauuccugaauaa

SEQ ID NO: 1856473 - RNA, 23 nt, Homo sapiens
aaauuauacuguagcugaugaaa

SEQ ID NO: 1856474 - RNA, 18 nt, Homo sapiens
caaaaggcugauuacuga

SEQ ID NO: 1856475 - RNA, 17 nt, Homo sapiens
ugcaacuuccuuugacu

SEQ ID NO: 1856476 - RNA, 21 nt, Homo sapiens
gggaauauuuuagaaccacaa

SEQ ID NO: 1856477 - RNA, 15 nt, Homo sapiens
uuguaaaggauauca

SEQ ID NO: 1856478 - RNA, 15 nt, Homo sapiens
ugcuuuuuugcaaua

SEQ ID NO: 1856479 - RNA, 16 nt, Homo sapiens
agugaaguugugcaac

SEQ ID NO: 1856480 - RNA, 13 nt, Homo sapiens
ucauggagaccuc

SEQ ID NO: 1856481 - RNA, 13 nt, Homo sapiens
gacugaguccucg

SEQ ID NO: 1856482 - RNA, 15 nt, Homo sapiens
auuuauuuaagcuua

SEQ ID NO: 1856483 - RNA, 21 nt, Homo sapiens
cacaguggcucaugccuguaa

SEQ ID NO: 1856484 - RNA, 20 nt, Homo sapiens
ccucagacuucaagaccauc

SEQ ID NO: 1856485 - RNA, 16 nt, Homo sapiens
aaaucucagauucuuc

SEQ ID NO: 1856486 - RNA, 20 nt, Homo sapiens
gucccuggcaagacugucuu

SEQ ID NO: 1856487 - RNA, 22 nt, Homo sapiens
agcggcccuaagggagugucua

SEQ ID NO: 1856488 - RNA, 14 nt, Homo sapiens
ucagucaacauuua

SEQ ID NO: 1856489 - RNA, 15 nt, Homo sapiens
agccauaugacaauu

SEQ ID NO: 1856490 - RNA, 22 nt, Homo sapiens
cuuccugacagguucugagaua

SEQ ID NO: 1856491 - RNA, 20 nt, Homo sapiens
uaaauauuauuagauuuauu

SEQ ID NO: 1856492 - RNA, 16 nt, Homo sapiens
acugauuaacucaguc

SEQ ID NO: 1856493 - RNA, 17 nt, Homo sapiens
uagcuuacccaauggga

SEQ ID NO: 1856494 - RNA, 17 nt, Homo sapiens
augucuuaacugucacc

SEQ ID NO: 1856495 - RNA, 17 nt, Homo sapiens
aggagcagcaucauuca

SEQ ID NO: 1856496 - RNA, 20 nt, Homo sapiens
uucauauauccgaacuacug

SEQ ID NO: 1856497 - RNA, 19 nt, Homo sapiens
cgccaaggcucacaugcuc

SEQ ID NO: 1856498 - RNA, 14 nt, Homo sapiens
guaggugauguuuc

SEQ ID NO: 1856499 - RNA, 18 nt, Homo sapiens
uggaguuugacauuguau

SEQ ID NO: 1856500 - RNA, 18 nt, Homo sapiens
aaaguaccacacugaguu

SEQ ID NO: 1856501 - RNA, 19 nt, Homo sapiens
ucuguaaaacgcaccaauc

SEQ ID NO: 1856502 - RNA, 24 nt, Homo sapiens
agcauggugccuauguagacaaua

SEQ ID NO: 1856503 - RNA, 20 nt, Homo sapiens
cauuagauagucaugcugcu

SEQ ID NO: 1856504 - RNA, 15 nt, Homo sapiens
agaaugaaaccacau

SEQ ID NO: 1856505 - RNA, 19 nt, Homo sapiens
gcugaauuuucacaugaac

SEQ ID NO: 1856506 - RNA, 16 nt, Homo sapiens
cagaugacccccaucc

SEQ ID NO: 1856507 - RNA, 18 nt, Homo sapiens
uucccaaaagauugcuga

SEQ ID NO: 1856508 - RNA, 15 nt, Homo sapiens
ccuuucuuuucuuag

SEQ ID NO: 1856509 - RNA, 15 nt, Homo sapiens
ccuugccccuaugcc

SEQ ID NO: 1856510 - RNA, 15 nt, Homo sapiens
acagcaucauugcau

SEQ ID NO: 1856511 - RNA, 19 nt, Homo sapiens
cucuagggaaucuggauua

SEQ ID NO: 1856512 - RNA, 21 nt, Homo sapiens
aaaccacaacugacacaggaa

SEQ ID NO: 1856513 - RNA, 20 nt, Homo sapiens
auggucaaugcuagcacaau

SEQ ID NO: 1856514 - RNA, 16 nt, Homo sapiens
auuugcacacugcacu

SEQ ID NO: 1856515 - RNA, 15 nt, Homo sapiens
cuuggaccucaguga

SEQ ID NO: 1856516 - RNA, 20 nt, Homo sapiens
agugaguguuucuaugagug

SEQ ID NO: 1856517 - RNA, 17 nt, Homo sapiens
uagcuuuuacuuuuuau

SEQ ID NO: 1856518 - RNA, 23 nt, Homo sapiens
guaucugagaccccaaacucucc

SEQ ID NO: 1856519 - RNA, 19 nt, Homo sapiens
auguggaaaacucacagau

SEQ ID NO: 1856520 - RNA, 19 nt, Homo sapiens
caccuccagguucaaguga

SEQ ID NO: 1856521 - RNA, 12 nt, Homo sapiens
gcauuugccacu

SEQ ID NO: 1856522 - RNA, 15 nt, Homo sapiens
caaucacaagccaag

SEQ ID NO: 1856523 - RNA, 15 nt, Homo sapiens
gugaagaaugcaugu

SEQ ID NO: 1856524 - RNA, 12 nt, Homo sapiens
gguuugcuccag

SEQ ID NO: 1856525 - RNA, 14 nt, Homo sapiens
aguuggcucaggca

SEQ ID NO: 1856526 - RNA, 14 nt, Homo sapiens
cucuugucacaugg

SEQ ID NO: 1856527 - RNA, 22 nt, Homo sapiens
cauuuuucaauaaaguacugca

SEQ ID NO: 1856528 - RNA, 23 nt, Homo sapiens
gcugucuuagugcaaaaaacaua

SEQ ID NO: 1856529 - RNA, 15 nt, Homo sapiens
aggacccuguccugc

SEQ ID NO: 1856530 - RNA, 22 nt, Homo sapiens
gauaucaggaaauaucugugaa

SEQ ID NO: 1856531 - RNA, 15 nt, Homo sapiens
gacguguauuuccau

SEQ ID NO: 1856532 - RNA, 13 nt, Homo sapiens
ccuuugcaaauca

SEQ ID NO: 1856533 - RNA, 16 nt, Homo sapiens
cuguaccgacuuugau

SEQ ID NO: 1856534 - RNA, 17 nt, Homo sapiens
caaaccacaauauccag

SEQ ID NO: 1856535 - RNA, 14 nt, Homo sapiens
uucucuaaccauuc

SEQ ID NO: 1856536 - RNA, 20 nt, Homo sapiens
cuggcagaggcacucaggua

SEQ ID NO: 1856537 - RNA, 17 nt, Homo sapiens
cagguguguguggaccc

SEQ ID NO: 1856538 - RNA, 17 nt, Homo sapiens
cugcagacucuggcaga

SEQ ID NO: 1856539 - RNA, 21 nt, Homo sapiens
acuugucccacuaucugggug

SEQ ID NO: 1856540 - RNA, 13 nt, Homo sapiens
cacaucuagugag

SEQ ID NO: 1856541 - RNA, 18 nt, Homo sapiens
uaguguuaauaucuugaa

SEQ ID NO: 1856542 - RNA, 15 nt, Homo sapiens
cuacauaacuuccua

SEQ ID NO: 1856543 - RNA, 15 nt, Homo sapiens
agaaauuaaguacuu

SEQ ID NO: 1856544 - RNA, 18 nt, Homo sapiens
caagugauggucauucau

SEQ ID NO: 1856545 - RNA, 21 nt, Homo sapiens
uaacacuaauaauaguacuau

SEQ ID NO: 1856546 - RNA, 22 nt, Homo sapiens
uaucauuaaccacuuaucagug

SEQ ID NO: 1856547 - RNA, 15 nt, Homo sapiens
aucuauuaaaccauc

SEQ ID NO: 1856548 - RNA, 20 nt, Homo sapiens
gcagccggaagucuguucuc

SEQ ID NO: 1856549 - RNA, 23 nt, Homo sapiens
acauuauuuuauuauaacaucca

SEQ ID NO: 1856550 - RNA, 20 nt, Homo sapiens
caugaaguuuaaagauucua

SEQ ID NO: 1856551 - RNA, 22 nt, Homo sapiens
uaggugcucuuccucaucucau

SEQ ID NO: 1856552 - RNA, 15 nt, Homo sapiens
cuugcuuacaggaau

SEQ ID NO: 1856553 - RNA, 15 nt, Homo sapiens
caucauuacugccau

SEQ ID NO: 1856554 - RNA, 17 nt, Homo sapiens
gcaccuucacucuccag

SEQ ID NO: 1856555 - RNA, 13 nt, Homo sapiens
gcuauugcugcug

SEQ ID NO: 1856556 - RNA, 20 nt, Homo sapiens
ucucacuauguugcccaggc

SEQ ID NO: 1856557 - RNA, 14 nt, Homo sapiens
uuuguauucaugaa

SEQ ID NO: 1856558 - RNA, 16 nt, Homo sapiens
cucccucccagaucca

SEQ ID NO: 1856559 - RNA, 22 nt, Homo sapiens
ccugcagccuccuccugaccac

SEQ ID NO: 1856560 - RNA, 17 nt, Homo sapiens
aauucacucaagcacug

SEQ ID NO: 1856561 - RNA, 18 nt, Homo sapiens
ccucagucgcauagacuu

SEQ ID NO: 1856562 - RNA, 20 nt, Homo sapiens
uuuaagaguaaaaagaaaua

SEQ ID NO: 1856563 - RNA, 13 nt, Homo sapiens
ugucugaaggauu

SEQ ID NO: 1856564 - RNA, 21 nt, Homo sapiens
ugcccacuccgccagccacag

SEQ ID NO: 1856565 - RNA, 18 nt, Homo sapiens
uuauauugcaagcuccau

SEQ ID NO: 1856566 - RNA, 14 nt, Homo sapiens
caguguuuggugua

SEQ ID NO: 1856567 - RNA, 23 nt, Homo sapiens
auccucaggcagguaaccccaga

SEQ ID NO: 1856568 - RNA, 17 nt, Homo sapiens
cagagguugcagugagu

SEQ ID NO: 1856569 - RNA, 14 nt, Homo sapiens
gugaacaaagcagc

SEQ ID NO: 1856570 - RNA, 20 nt, Homo sapiens
guuuuaucuccauacuuugg

SEQ ID NO: 1856571 - RNA, 19 nt, Homo sapiens
auaagugugaccaguuuug

SEQ ID NO: 1856572 - RNA, 13 nt, Homo sapiens
ucuguaauugaau

SEQ ID NO: 1856573 - RNA, 21 nt, Homo sapiens
gacauuuuguuuuuacuguau

SEQ ID NO: 1856574 - RNA, 14 nt, Homo sapiens
cucugaaucuguac

SEQ ID NO: 1856575 - RNA, 14 nt, Homo sapiens
accccacauuuuuc

SEQ ID NO: 1856576 - RNA, 17 nt, Homo sapiens
aguauuguggggcucau

SEQ ID NO: 1856577 - RNA, 18 nt, Homo sapiens
ugcaaagacaguauuuau

SEQ ID NO: 1856578 - RNA, 22 nt, Homo sapiens
uuuucaagagagugugacucau

SEQ ID NO: 1856579 - RNA, 21 nt, Homo sapiens
aacugucaaagaaucaaucca

SEQ ID NO: 1856580 - RNA, 23 nt, Homo sapiens
ucguuuucgcuggggauggaauu

SEQ ID NO: 1856581 - RNA, 20 nt, Homo sapiens
gugccccagcgcacacggga

SEQ ID NO: 1856582 - RNA, 14 nt, Homo sapiens
uaugugagcacaaa

SEQ ID NO: 1856583 - RNA, 16 nt, Homo sapiens
auaauucuguauuaac

SEQ ID NO: 1856584 - RNA, 14 nt, Homo sapiens
agaaaacauuccaa

SEQ ID NO: 1856585 - RNA, 23 nt, Homo sapiens
accaaggcaaggcaggugccucc

SEQ ID NO: 1856586 - RNA, 16 nt, Homo sapiens
acugguucaggcucaa

SEQ ID NO: 1856587 - RNA, 19 nt, Homo sapiens
aaucccuuccugaguaaua

SEQ ID NO: 1856588 - RNA, 11 nt, Homo sapiens
aaauguuggca

SEQ ID NO: 1856589 - RNA, 15 nt, Homo sapiens
aauaaacuccuacua

SEQ ID NO: 1856590 - RNA, 16 nt, Homo sapiens
ugggacagcaugacug

SEQ ID NO: 1856591 - RNA, 12 nt, Homo sapiens
cugugacauuuc

SEQ ID NO: 1856592 - RNA, 15 nt, Homo sapiens
ugccuguaucucuca

SEQ ID NO: 1856593 - RNA, 21 nt, Homo sapiens
auacugacuccaaccauucaa

SEQ ID NO: 1856594 - RNA, 22 nt, Homo sapiens
aaagacuuaucagaugcucauu

SEQ ID NO: 1856595 - RNA, 23 nt, Homo sapiens
guaagacucgggauuaguacaca

SEQ ID NO: 1856596 - RNA, 22 nt, Homo sapiens
cagacagguggaaaaacugaga

SEQ ID NO: 1856597 - RNA, 14 nt, Homo sapiens
ccaucagugcuccc

SEQ ID NO: 1856598 - RNA, 19 nt, Homo sapiens
uucacaugagcuauuucca

SEQ ID NO: 1856599 - RNA, 19 nt, Homo sapiens
aaauauuagaagccugcag

SEQ ID NO: 1856600 - RNA, 14 nt, Homo sapiens
ccgugcccuacccc

SEQ ID NO: 1856601 - RNA, 14 nt, Homo sapiens
aauccagugaaaau

SEQ ID NO: 1856602 - RNA, 13 nt, Homo sapiens
guaaugcaggacu

SEQ ID NO: 1856603 - RNA, 21 nt, Homo sapiens
gaugggcagcccaacagcacu

SEQ ID NO: 1856604 - RNA, 15 nt, Homo sapiens
auguuucauuuucau

SEQ ID NO: 1856605 - RNA, 21 nt, Homo sapiens
agucaggacuugaacccaggu

SEQ ID NO: 1856606 - RNA, 15 nt, Homo sapiens
auguugaucauguac

SEQ ID NO: 1856607 - RNA, 15 nt, Homo sapiens
uuccguggucagagu

SEQ ID NO: 1856608 - RNA, 22 nt, Homo sapiens
ggcuccaccccauccaguucau

SEQ ID NO: 1856609 - RNA, 20 nt, Homo sapiens
gaaaggguaguucaaagagu

SEQ ID NO: 1856610 - RNA, 17 nt, Homo sapiens
uagacucuugaagacaa

SEQ ID NO: 1856611 - RNA, 21 nt, Homo sapiens
acacuuguugauuaauggaaa

SEQ ID NO: 1856612 - RNA, 19 nt, Homo sapiens
gcagcggggcuggccauga

SEQ ID NO: 1856613 - RNA, 16 nt, Homo sapiens
uacaaucagcugcuuu

SEQ ID NO: 1856614 - RNA, 13 nt, Homo sapiens
caucccugugguc

SEQ ID NO: 1856615 - RNA, 23 nt, Homo sapiens
ugaaggcugucaggauucuucaa

SEQ ID NO: 1856616 - RNA, 20 nt, Homo sapiens
auguaauguuuuuauuucaa

SEQ ID NO: 1856617 - RNA, 13 nt, Homo sapiens
uagcaaaugacau

SEQ ID NO: 1856618 - RNA, 20 nt, Homo sapiens
uuacagagaggagaaacaca

SEQ ID NO: 1856619 - RNA, 17 nt, Homo sapiens
auucuaagucacaggau

SEQ ID NO: 1856620 - RNA, 21 nt, Homo sapiens
aaaugaaggcagaaaaauguc

SEQ ID NO: 1856621 - RNA, 19 nt, Homo sapiens
cuguuccacuucucuagag

SEQ ID NO: 1856622 - RNA, 18 nt, Homo sapiens
cuguucccuguccuacca

SEQ ID NO: 1856623 - RNA, 16 nt, Homo sapiens
aggcagcccccuccac

SEQ ID NO: 1856624 - RNA, 13 nt, Homo sapiens
acuuguguuacuu

SEQ ID NO: 1856625 - RNA, 17 nt, Homo sapiens
gcaggaccuugggcaca

SEQ ID NO: 1856626 - RNA, 12 nt, Homo sapiens
uugagacagggu

SEQ ID NO: 1856627 - RNA, 12 nt, Homo sapiens
cacgcuuucaug

SEQ ID NO: 1856628 - RNA, 19 nt, Homo sapiens
agaaacuccaaaguccaca

SEQ ID NO: 1856629 - RNA, 21 nt, Homo sapiens
auuuacugaauaaauacaaag

SEQ ID NO: 1856630 - RNA, 19 nt, Homo sapiens
ucacaaguuacagcuguga

SEQ ID NO: 1856631 - RNA, 21 nt, Homo sapiens
ugccugcagaguuuggauaaa

SEQ ID NO: 1856632 - RNA, 18 nt, Homo sapiens
ugcuucucuccuaucugu

SEQ ID NO: 1856633 - RNA, 16 nt, Homo sapiens
uuaaaugaacuugaua

SEQ ID NO: 1856634 - RNA, 16 nt, Homo sapiens
cgcaagagaacauuuc

SEQ ID NO: 1856635 - RNA, 19 nt, Homo sapiens
auuccuuuauguaucuaau

SEQ ID NO: 1856636 - RNA, 15 nt, Homo sapiens
cuccgccaagaucua

SEQ ID NO: 1856637 - RNA, 15 nt, Homo sapiens
ucucacuuuuuaccc

SEQ ID NO: 1856638 - RNA, 14 nt, Homo sapiens
uguuauaguugaag

SEQ ID NO: 1856639 - RNA, 22 nt, Homo sapiens
ggagucuucugccucuuaacuu

SEQ ID NO: 1856640 - RNA, 18 nt, Homo sapiens
ccaugguagacugugaca

SEQ ID NO: 1856641 - RNA, 14 nt, Homo sapiens
cagggucugcugag

SEQ ID NO: 1856642 - RNA, 17 nt, Homo sapiens
aauccucucagagucau

SEQ ID NO: 1856643 - RNA, 17 nt, Homo sapiens
cauacauuagugccaua

SEQ ID NO: 1856644 - RNA, 15 nt, Homo sapiens
aaagauuucucagua

SEQ ID NO: 1856645 - RNA, 23 nt, Homo sapiens
acucagccuuaagaaagcuauau

SEQ ID NO: 1856646 - RNA, 16 nt, Homo sapiens
gaaacaaaaagcccca

SEQ ID NO: 1856647 - RNA, 21 nt, Homo sapiens
gucaccgggaugaaccuaucc

SEQ ID NO: 1856648 - RNA, 12 nt, Homo sapiens
guggcuccugug

SEQ ID NO: 1856649 - RNA, 13 nt, Homo sapiens
uggaugcacacac

SEQ ID NO: 1856650 - RNA, 21 nt, Homo sapiens
cauucuguuuaucaagccaua

SEQ ID NO: 1856651 - RNA, 17 nt, Homo sapiens
aagauuuagaaacagug

SEQ ID NO: 1856652 - RNA, 19 nt, Homo sapiens
guuuuacugugaaacuggc

SEQ ID NO: 1856653 - RNA, 23 nt, Homo sapiens
uuguggaggagggagagcccugu

SEQ ID NO: 1856654 - RNA, 22 nt, Homo sapiens
gcaaggcugccggcugcacccu

SEQ ID NO: 1856655 - RNA, 14 nt, Homo sapiens
gauuuaagcauuuu

SEQ ID NO: 1856656 - RNA, 17 nt, Homo sapiens
uccugccccaaccacaa

SEQ ID NO: 1856657 - RNA, 21 nt, Homo sapiens
ucagaaaagagccacuuucaa

SEQ ID NO: 1856658 - RNA, 19 nt, Homo sapiens
ccagagaaccugcuuuacu

SEQ ID NO: 1856659 - RNA, 22 nt, Homo sapiens
cucauguuucugcuaugaccau

SEQ ID NO: 1856660 - RNA, 18 nt, Homo sapiens
uguguacccuccauguac

SEQ ID NO: 1856661 - RNA, 21 nt, Homo sapiens
ugcaggacuccccaggagcac

SEQ ID NO: 1856662 - RNA, 16 nt, Homo sapiens
aucuggucccuugcag

SEQ ID NO: 1856663 - RNA, 12 nt, Homo sapiens
gcuaaauaucac

SEQ ID NO: 1856664 - RNA, 14 nt, Homo sapiens
ccaaucccgugaaa

SEQ ID NO: 1856665 - RNA, 14 nt, Homo sapiens
aguggaaugcuucc

SEQ ID NO: 1856666 - RNA, 22 nt, Homo sapiens
uugcuuaaacccuuuagugcuu

SEQ ID NO: 1856667 - RNA, 23 nt, Homo sapiens
aagauuauuuuauuaugcggaaa

SEQ ID NO: 1856668 - RNA, 17 nt, Homo sapiens
aacugucugacuuauaa

SEQ ID NO: 1856669 - RNA, 16 nt, Homo sapiens
ugcaauauuuacauuu

SEQ ID NO: 1856670 - RNA, 14 nt, Homo sapiens
gucugccaugcucu

SEQ ID NO: 1856671 - RNA, 13 nt, Homo sapiens
acgucaucucagg

SEQ ID NO: 1856672 - RNA, 19 nt, Homo sapiens
acaaggccuguucaaaaac

SEQ ID NO: 1856673 - RNA, 20 nt, Homo sapiens
caacauauauuuauugagua

SEQ ID NO: 1856674 - RNA, 13 nt, Homo sapiens
uacauaacuaaua

SEQ ID NO: 1856675 - RNA, 22 nt, Homo sapiens
cuaggauaauguccaacuaaaa

SEQ ID NO: 1856676 - RNA, 14 nt, Homo sapiens
cgucucaagacuga

SEQ ID NO: 1856677 - RNA, 12 nt, Homo sapiens
cacucuccuugc

SEQ ID NO: 1856678 - RNA, 19 nt, Homo sapiens
agcuuuguuucaauaucac

SEQ ID NO: 1856679 - RNA, 15 nt, Homo sapiens
agucacaugugcucu

SEQ ID NO: 1856680 - RNA, 21 nt, Homo sapiens
auaaaauuaaagcugaaaacu

SEQ ID NO: 1856681 - RNA, 21 nt, Homo sapiens
gucguuuauauuguagcaguu

SEQ ID NO: 1856682 - RNA, 16 nt, Homo sapiens
auuuaugaugcacuua

SEQ ID NO: 1856683 - RNA, 21 nt, Homo sapiens
ucaccaacaacagucagccag

SEQ ID NO: 1856684 - RNA, 21 nt, Homo sapiens
ucccagcuccuuucaugcucc

SEQ ID NO: 1856685 - RNA, 22 nt, Homo sapiens
uggagaaacuguagucucagga

SEQ ID NO: 1856686 - RNA, 18 nt, Homo sapiens
ucaggcguuucugaagug

SEQ ID NO: 1856687 - RNA, 20 nt, Homo sapiens
ugcuuuugagagaacauaga

SEQ ID NO: 1856688 - RNA, 14 nt, Homo sapiens
ucuauacuguugau

SEQ ID NO: 1856689 - RNA, 17 nt, Homo sapiens
ugaaaaucaucacucaa

SEQ ID NO: 1856690 - RNA, 16 nt, Homo sapiens
aguaaaacuuguuaca

SEQ ID NO: 1856691 - RNA, 16 nt, Homo sapiens
aggcugugggccucaa

SEQ ID NO: 1856692 - RNA, 19 nt, Homo sapiens
ccaggcugcagaugaucag

SEQ ID NO: 1856693 - RNA, 20 nt, Homo sapiens
agcagcuuagacagcagggc

SEQ ID NO: 1856694 - RNA, 14 nt, Homo sapiens
aagguggucacugu

SEQ ID NO: 1856695 - RNA, 18 nt, Homo sapiens
cacacucaaggacaggag

SEQ ID NO: 1856696 - RNA, 17 nt, Homo sapiens
cuuucacaguaccaucu

SEQ ID NO: 1856697 - RNA, 17 nt, Homo sapiens
aggaugggaaggaggga

SEQ ID NO: 1856698 - RNA, 17 nt, Homo sapiens
cacccugcccugcugag

SEQ ID NO: 1856699 - RNA, 19 nt, Homo sapiens
ugguggcgcgugccuguaa

SEQ ID NO: 1856700 - RNA, 20 nt, Homo sapiens
aggcugacagcuucuacuug

SEQ ID NO: 1856701 - RNA, 20 nt, Homo sapiens
ucugggaagcugagggcaaa

SEQ ID NO: 1856702 - RNA, 22 nt, Homo sapiens
acucuggacuuucucuaauaau

SEQ ID NO: 1856703 - RNA, 18 nt, Homo sapiens
guccugaagugaccucac

SEQ ID NO: 1856704 - RNA, 21 nt, Homo sapiens
acaccucagaggcuguucuug

SEQ ID NO: 1856705 - RNA, 18 nt, Homo sapiens
accauguuaauacaucau

SEQ ID NO: 1856706 - RNA, 19 nt, Homo sapiens
gguuccuaauccucuagga

SEQ ID NO: 1856707 - RNA, 19 nt, Homo sapiens
caggacagucaaggugaua

SEQ ID NO: 1856708 - RNA, 19 nt, Homo sapiens
uuagucaguguacucugag

SEQ ID NO: 1856709 - RNA, 20 nt, Homo sapiens
auuugcuuuugaaacuugaa

SEQ ID NO: 1856710 - RNA, 16 nt, Homo sapiens
ccugaccaguugcagu

SEQ ID NO: 1856711 - RNA, 16 nt, Homo sapiens
aguaccccucuagcuu

SEQ ID NO: 1856712 - RNA, 21 nt, Homo sapiens
cgguuaaauacuguguggaac

SEQ ID NO: 1856713 - RNA, 20 nt, Homo sapiens
acuccacuuggacaugggcc

SEQ ID NO: 1856714 - RNA, 18 nt, Homo sapiens
cuaauugaacaugcaauu

SEQ ID NO: 1856715 - RNA, 17 nt, Homo sapiens
accagagcacagauuca

SEQ ID NO: 1856716 - RNA, 13 nt, Homo sapiens
ccaucaucugcug

SEQ ID NO: 1856717 - RNA, 15 nt, Homo sapiens
aaagaaauacuguau

SEQ ID NO: 1856718 - RNA, 15 nt, Homo sapiens
ccuuucuucaauaca

SEQ ID NO: 1856719 - RNA, 23 nt, Homo sapiens
ucauguucaucaauaccugcuga

SEQ ID NO: 1856720 - RNA, 17 nt, Homo sapiens
agccggucaucacccag

SEQ ID NO: 1856721 - RNA, 22 nt, Homo sapiens
aacaucaagccaucaaaccugg

SEQ ID NO: 1856722 - RNA, 20 nt, Homo sapiens
uaguaaucauauuguuacug

SEQ ID NO: 1856723 - RNA, 20 nt, Homo sapiens
cuuguauuaucuguccaaaa

SEQ ID NO: 1856724 - RNA, 15 nt, Homo sapiens
aagaaacuuaccaau

SEQ ID NO: 1856725 - RNA, 21 nt, Homo sapiens
aaauguauuuuagacuuccug

SEQ ID NO: 1856726 - RNA, 11 nt, Homo sapiens
caucugcaaua

SEQ ID NO: 1856727 - RNA, 12 nt, Homo sapiens
uaaaguauucca

SEQ ID NO: 1856728 - RNA, 11 nt, Homo sapiens
aaaauagccac

SEQ ID NO: 1856729 - RNA, 19 nt, Homo sapiens
ugaccaguggggcccuucu

SEQ ID NO: 1856730 - RNA, 19 nt, Homo sapiens
gacuuuauuucugagcaaa

SEQ ID NO: 1856731 - RNA, 19 nt, Homo sapiens
agcaaauaggcaaaagaca

SEQ ID NO: 1856732 - RNA, 23 nt, Homo sapiens
gcuucucuugaaaacuugguaua

SEQ ID NO: 1856733 - RNA, 22 nt, Homo sapiens
aagucuugccuugcugaacucc

SEQ ID NO: 1856734 - RNA, 19 nt, Homo sapiens
gagaguauagcaugaaugu

SEQ ID NO: 1856735 - RNA, 16 nt, Homo sapiens
gugggagagacacucc

SEQ ID NO: 1856736 - RNA, 18 nt, Homo sapiens
cuuauucuaggucuguaa

SEQ ID NO: 1856737 - RNA, 14 nt, Homo sapiens
accuccagcucuca

SEQ ID NO: 1856738 - RNA, 22 nt, Homo sapiens
cucaauucuuuguauaugcauu

SEQ ID NO: 1856739 - RNA, 19 nt, Homo sapiens
auguagaaagauacacuga

SEQ ID NO: 1856740 - RNA, 24 nt, Homo sapiens
augucagugaugacuauucucaaa

SEQ ID NO: 1856741 - RNA, 20 nt, Homo sapiens
ucccccuaagaggcagugag

SEQ ID NO: 1856742 - RNA, 23 nt, Homo sapiens
cccugagcuuuguccugaaggaa

SEQ ID NO: 1856743 - RNA, 19 nt, Homo sapiens
aagcgauucucaugccuca

SEQ ID NO: 1856744 - RNA, 19 nt, Homo sapiens
aagagauucuccugccuca

SEQ ID NO: 1856745 - RNA, 19 nt, Homo sapiens
uuauacaauauacuuguau

SEQ ID NO: 1856746 - RNA, 19 nt, Homo sapiens
ucaaugccaggcagugcag

SEQ ID NO: 1856747 - RNA, 15 nt, Homo sapiens
uaagucucaagguag

SEQ ID NO: 1856748 - RNA, 21 nt, Homo sapiens
uucuguaggaugugucacugu

SEQ ID NO: 1856749 - RNA, 14 nt, Homo sapiens
cucugcagcacuuu

SEQ ID NO: 1856750 - RNA, 17 nt, Homo sapiens
ugggaaugagaaugaau

SEQ ID NO: 1856751 - RNA, 18 nt, Homo sapiens
aguucccagacagcuuuu

SEQ ID NO: 1856752 - RNA, 17 nt, Homo sapiens
cgugaauuuauaguuaa

SEQ ID NO: 1856753 - RNA, 16 nt, Homo sapiens
gcuggcuugagggaau

SEQ ID NO: 1856754 - RNA, 20 nt, Homo sapiens
uguggguuucucugugcucu

SEQ ID NO: 1856755 - RNA, 14 nt, Homo sapiens
cagaaggaaagggc

SEQ ID NO: 1856756 - RNA, 13 nt, Homo sapiens
ugaccauaucaca

SEQ ID NO: 1856757 - RNA, 15 nt, Homo sapiens
gcuuacaaaugucua

SEQ ID NO: 1856758 - RNA, 18 nt, Homo sapiens
gacaccuucugugcucau

SEQ ID NO: 1856759 - RNA, 13 nt, Homo sapiens
cugcaagaccacg

SEQ ID NO: 1856760 - RNA, 22 nt, Homo sapiens
ucuaacaaaaccaaugugcaga

SEQ ID NO: 1856761 - RNA, 18 nt, Homo sapiens
ucuuaaauauuuccauca

SEQ ID NO: 1856762 - RNA, 12 nt, Homo sapiens
gguugccaugga

SEQ ID NO: 1856763 - RNA, 20 nt, Homo sapiens
uguuuugauauggguaguau

SEQ ID NO: 1856764 - RNA, 17 nt, Homo sapiens
caugcgggccaccaagu

SEQ ID NO: 1856765 - RNA, 13 nt, Homo sapiens
caagaggcucccu

SEQ ID NO: 1856766 - RNA, 15 nt, Homo sapiens
cuugugaaaccacag

SEQ ID NO: 1856767 - RNA, 18 nt, Homo sapiens
aaauccaaggaaacaugc

SEQ ID NO: 1856768 - RNA, 22 nt, Homo sapiens
uugccaaacagcccaaacugua

SEQ ID NO: 1856769 - RNA, 18 nt, Homo sapiens
uugugccuggcucagagc

SEQ ID NO: 1856770 - RNA, 10 nt, Homo sapiens
gccaaacaaa

SEQ ID NO: 1856771 - RNA, 19 nt, Homo sapiens
gucuggcugaggauuucaa

SEQ ID NO: 1856772 - RNA, 15 nt, Homo sapiens
aaaaaugaaguuuau

SEQ ID NO: 1856773 - RNA, 18 nt, Homo sapiens
uuaguuuuaaaaagggaa

SEQ ID NO: 1856774 - RNA, 12 nt, Homo sapiens
ucaggugugaua

SEQ ID NO: 1856775 - RNA, 21 nt, Homo sapiens
caggcagagaacagaacugga

SEQ ID NO: 1856776 - RNA, 21 nt, Homo sapiens
cucuacuaaaaauacaaaaau

SEQ ID NO: 1856777 - RNA, 19 nt, Homo sapiens
gacuacugcccacaccaac

SEQ ID NO: 1856778 - RNA, 22 nt, Homo sapiens
gcacucccuaauuuaugugcua

SEQ ID NO: 1856779 - RNA, 16 nt, Homo sapiens
auuccagggaaccaga

SEQ ID NO: 1856780 - RNA, 20 nt, Homo sapiens
caauuuguucagucuuucau

SEQ ID NO: 1856781 - RNA, 14 nt, Homo sapiens
uaaaguugccuuua

SEQ ID NO: 1856782 - RNA, 17 nt, Homo sapiens
uccaacuacuccuagac

SEQ ID NO: 1856783 - RNA, 11 nt, Homo sapiens
uacugcugcug

SEQ ID NO: 1856784 - RNA, 12 nt, Homo sapiens
ugucgcccagug

SEQ ID NO: 1856785 - RNA, 23 nt, Homo sapiens
agaccaaggaacaaaaaaaccac

SEQ ID NO: 1856786 - RNA, 20 nt, Homo sapiens
uaaagacuuuuaugugagau

SEQ ID NO: 1856787 - RNA, 20 nt, Homo sapiens
uguucuugcugagcacccuc

SEQ ID NO: 1856788 - RNA, 20 nt, Homo sapiens
uggcagcagaguguggccuu

SEQ ID NO: 1856789 - RNA, 15 nt, Homo sapiens
gaaugaacgucauug

SEQ ID NO: 1856790 - RNA, 15 nt, Homo sapiens
auuggaacugcaaug

SEQ ID NO: 1856791 - RNA, 17 nt, Homo sapiens
uagaaucugaguauaaa

SEQ ID NO: 1856792 - RNA, 17 nt, Homo sapiens
uugaauaaauguaucug

SEQ ID NO: 1856793 - RNA, 13 nt, Homo sapiens
uauaaaggauaaa

SEQ ID NO: 1856794 - RNA, 20 nt, Homo sapiens
uccuccauggugcugcauug

SEQ ID NO: 1856795 - RNA, 19 nt, Homo sapiens
cugacaugcaucaucucau

SEQ ID NO: 1856796 - RNA, 22 nt, Homo sapiens
aaugaauaaauccucucuauca

SEQ ID NO: 1856797 - RNA, 16 nt, Homo sapiens
aucuagaauggauuca

SEQ ID NO: 1856798 - RNA, 15 nt, Homo sapiens
caagacacuaguuca

SEQ ID NO: 1856799 - RNA, 21 nt, Homo sapiens
auaaauauuauuagauuuauu

SEQ ID NO: 1856800 - RNA, 21 nt, Homo sapiens
ucuuuuuuaauaaacuacucu

SEQ ID NO: 1856801 - RNA, 14 nt, Homo sapiens
accugcugugauga

SEQ ID NO: 1856802 - RNA, 17 nt, Homo sapiens
cagcaagcaauucugcc

SEQ ID NO: 1856803 - RNA, 13 nt, Homo sapiens
uaugauuagcuuu

SEQ ID NO: 1856804 - RNA, 16 nt, Homo sapiens
aacacagaacucagcc

SEQ ID NO: 1856805 - RNA, 19 nt, Homo sapiens
gucacaauuuucugugcca

SEQ ID NO: 1856806 - RNA, 19 nt, Homo sapiens
uuuagcguagcuaagugaa

SEQ ID NO: 1856807 - RNA, 17 nt, Homo sapiens
cacugccagucacgagc

SEQ ID NO: 1856808 - RNA, 23 nt, Homo sapiens
guggguugguuuugguguaacau

SEQ ID NO: 1856809 - RNA, 15 nt, Homo sapiens
aauaaaguuuggacu

SEQ ID NO: 1856810 - RNA, 16 nt, Homo sapiens
ucacaaacucauccau

SEQ ID NO: 1856811 - RNA, 18 nt, Homo sapiens
aggaauaaagcuucucuc

SEQ ID NO: 1856812 - RNA, 17 nt, Homo sapiens
uaaucccuggaugauau

SEQ ID NO: 1856813 - RNA, 21 nt, Homo sapiens
ugacucggucugagaagauuc

SEQ ID NO: 1856814 - RNA, 16 nt, Homo sapiens
auaaacagucacugga

SEQ ID NO: 1856815 - RNA, 17 nt, Homo sapiens
gguacacagauggcagu

SEQ ID NO: 1856816 - RNA, 22 nt, Homo sapiens
accuggcuucccaggacccugg

SEQ ID NO: 1856817 - RNA, 20 nt, Homo sapiens
aauuugauacaaaaugcuga

SEQ ID NO: 1856818 - RNA, 13 nt, Homo sapiens
ggagcaggacuga

SEQ ID NO: 1856819 - RNA, 23 nt, Homo sapiens
cacccccaaaaaaagagaaaaag

SEQ ID NO: 1856820 - RNA, 23 nt, Homo sapiens
aucuagcuccauaauugcaaggg

SEQ ID NO: 1856821 - RNA, 16 nt, Homo sapiens
acuauuuacaaggaug

SEQ ID NO: 1856822 - RNA, 16 nt, Homo sapiens
gaauguuaagacuuga

SEQ ID NO: 1856823 - RNA, 14 nt, Homo sapiens
uacaaccuauguaa

SEQ ID NO: 1856824 - RNA, 15 nt, Homo sapiens
uucagagccagugaa

SEQ ID NO: 1856825 - RNA, 18 nt, Homo sapiens
uagaaauuuuaucucuuc

SEQ ID NO: 1856826 - RNA, 13 nt, Homo sapiens
auagcuucaucca

SEQ ID NO: 1856827 - RNA, 20 nt, Homo sapiens
ggcagccuggacauagagag

SEQ ID NO: 1856828 - RNA, 13 nt, Homo sapiens
cggagcuugccug

SEQ ID NO: 1856829 - RNA, 16 nt, Homo sapiens
gcaccugccuagcucu

SEQ ID NO: 1856830 - RNA, 16 nt, Homo sapiens
ccugcccaccaagaag

SEQ ID NO: 1856831 - RNA, 17 nt, Homo sapiens
acauacauacauauaua

SEQ ID NO: 1856832 - RNA, 17 nt, Homo sapiens
caguguuacagugcuaa

SEQ ID NO: 1856833 - RNA, 17 nt, Homo sapiens
gugugcauguguguaua

SEQ ID NO: 1856834 - RNA, 18 nt, Homo sapiens
gaacaagagaccaggugu

SEQ ID NO: 1856835 - RNA, 19 nt, Homo sapiens
caaggcaggggcacggugg

SEQ ID NO: 1856836 - RNA, 20 nt, Homo sapiens
cuuauuuuauuuuuuaccau

SEQ ID NO: 1856837 - RNA, 21 nt, Homo sapiens
gacgucacccuccauucugca

SEQ ID NO: 1856838 - RNA, 21 nt, Homo sapiens
cauuacuuuaaccucccucaa

SEQ ID NO: 1856839 - RNA, 17 nt, Homo sapiens
ugaaaaauggcaaagaa

SEQ ID NO: 1856840 - RNA, 17 nt, Homo sapiens
gacugaauuaaugagaa

SEQ ID NO: 1856841 - RNA, 16 nt, Homo sapiens
caucaugaugcucaug

SEQ ID NO: 1856842 - RNA, 18 nt, Homo sapiens
aauuaaaacacuuucaaa

SEQ ID NO: 1856843 - RNA, 14 nt, Homo sapiens
ucuaagugcugcug

SEQ ID NO: 1856844 - RNA, 17 nt, Homo sapiens
cauuugccaucacccca

SEQ ID NO: 1856845 - RNA, 17 nt, Homo sapiens
accucgcuggacucuca

SEQ ID NO: 1856846 - RNA, 14 nt, Homo sapiens
aaugugaaugugag

SEQ ID NO: 1856847 - RNA, 16 nt, Homo sapiens
acacuuccugauuuca

SEQ ID NO: 1856848 - RNA, 19 nt, Homo sapiens
ugggucuaccacucagaga

SEQ ID NO: 1856849 - RNA, 16 nt, Homo sapiens
augagacagacauuca

SEQ ID NO: 1856850 - RNA, 12 nt, Homo sapiens
gacuugcucaag

SEQ ID NO: 1856851 - RNA, 20 nt, Homo sapiens
uccugggggaugugcacggc

SEQ ID NO: 1856852 - RNA, 15 nt, Homo sapiens
guauuugaacacuug

SEQ ID NO: 1856853 - RNA, 15 nt, Homo sapiens
gccucacaaucccac

SEQ ID NO: 1856854 - RNA, 13 nt, Homo sapiens
cugguggggcuga

SEQ ID NO: 1856855 - RNA, 14 nt, Homo sapiens
gugcaggacacugg

SEQ ID NO: 1856856 - RNA, 23 nt, Homo sapiens
cuuggcucugccaguggaucccc

SEQ ID NO: 1856857 - RNA, 19 nt, Homo sapiens
cccaaaacccugaagccau

SEQ ID NO: 1856858 - RNA, 14 nt, Homo sapiens
uccuggcugggaac

SEQ ID NO: 1856859 - RNA, 20 nt, Homo sapiens
uucacaaaaaggcauaugca

SEQ ID NO: 1856860 - RNA, 17 nt, Homo sapiens
acugcagcaguggcuua

SEQ ID NO: 1856861 - RNA, 16 nt, Homo sapiens
uccacuccacucaggu

SEQ ID NO: 1856862 - RNA, 15 nt, Homo sapiens
uuugccucauaauag

SEQ ID NO: 1856863 - RNA, 22 nt, Homo sapiens
cuccauucauccuuccauccau

SEQ ID NO: 1856864 - RNA, 20 nt, Homo sapiens
agggugcagcccucuugccc

SEQ ID NO: 1856865 - RNA, 23 nt, Homo sapiens
gcaaacggaguacagacgucuca

SEQ ID NO: 1856866 - RNA, 14 nt, Homo sapiens
ucccuguuugccua

SEQ ID NO: 1856867 - RNA, 24 nt, Homo sapiens
acagaauugcuuguuugcuucaac

SEQ ID NO: 1856868 - RNA, 14 nt, Homo sapiens
ugcgagacucugau

SEQ ID NO: 1856869 - RNA, 15 nt, Homo sapiens
uuuguauuuauuaau

SEQ ID NO: 1856870 - RNA, 18 nt, Homo sapiens
gauuccccccaucuccau

SEQ ID NO: 1856871 - RNA, 18 nt, Homo sapiens
cgaggccucucucaggag

SEQ ID NO: 1856872 - RNA, 14 nt, Homo sapiens
aagucuauugaaua

SEQ ID NO: 1856873 - RNA, 23 nt, Homo sapiens
auaccuuauuuauuuuuguguag

SEQ ID NO: 1856874 - RNA, 18 nt, Homo sapiens
acuauucuuaacuauuca

SEQ ID NO: 1856875 - RNA, 20 nt, Homo sapiens
gcauaggcuggggacacagg

SEQ ID NO: 1856876 - RNA, 23 nt, Homo sapiens
uaugagucucuaugaucuuggca

SEQ ID NO: 1856877 - RNA, 12 nt, Homo sapiens
uaaaaccaaaga

SEQ ID NO: 1856878 - RNA, 21 nt, Homo sapiens
aucuaagaaaauuuacuguaa

SEQ ID NO: 1856879 - RNA, 13 nt, Homo sapiens
uaaauacccauau

SEQ ID NO: 1856880 - RNA, 18 nt, Homo sapiens
acacaguccccagacuca

SEQ ID NO: 1856881 - RNA, 17 nt, Homo sapiens
uaaucccauacucucaa

SEQ ID NO: 1856882 - RNA, 15 nt, Homo sapiens
gccgggaaccucauc

SEQ ID NO: 1856883 - RNA, 14 nt, Homo sapiens
uuguaaacauacau

SEQ ID NO: 1856884 - RNA, 17 nt, Homo sapiens
uguucaguucauuccca

SEQ ID NO: 1856885 - RNA, 20 nt, Homo sapiens
cucuucuaaucagagcgcaa

SEQ ID NO: 1856886 - RNA, 18 nt, Homo sapiens
ucauugggccauguuuaa

SEQ ID NO: 1856887 - RNA, 18 nt, Homo sapiens
gaagcaaacuaagccccc

SEQ ID NO: 1856888 - RNA, 15 nt, Homo sapiens
ugucaccaugaucac

SEQ ID NO: 1856889 - RNA, 13 nt, Homo sapiens
uugaaaagccaug

SEQ ID NO: 1856890 - RNA, 13 nt, Homo sapiens
caauuuugcacug

SEQ ID NO: 1856891 - RNA, 18 nt, Homo sapiens
ugugaugguacacagugg

SEQ ID NO: 1856892 - RNA, 18 nt, Homo sapiens
cuacugaggagcaaagca

SEQ ID NO: 1856893 - RNA, 14 nt, Homo sapiens
ucuucuacacagca

SEQ ID NO: 1856894 - RNA, 14 nt, Homo sapiens
aaauuuacuaugua

SEQ ID NO: 1856895 - RNA, 16 nt, Homo sapiens
agugcacugacuguga

SEQ ID NO: 1856896 - RNA, 19 nt, Homo sapiens
acauuuagccuucaaugga

SEQ ID NO: 1856897 - RNA, 18 nt, Homo sapiens
cugaaucuauggcuuuaa

SEQ ID NO: 1856898 - RNA, 14 nt, Homo sapiens
uggugacugggaaa

SEQ ID NO: 1856899 - RNA, 21 nt, Homo sapiens
ugggaaugauaguguaucuca

SEQ ID NO: 1856900 - RNA, 20 nt, Homo sapiens
aggccaguaaucccagugac

SEQ ID NO: 1856901 - RNA, 16 nt, Homo sapiens
cucuuuaaucagcuua

SEQ ID NO: 1856902 - RNA, 16 nt, Homo sapiens
aggggacccauguaau

SEQ ID NO: 1856903 - RNA, 17 nt, Homo sapiens
agauccucuugccacau

SEQ ID NO: 1856904 - RNA, 16 nt, Homo sapiens
acaacacugagccauu

SEQ ID NO: 1856905 - RNA, 14 nt, Homo sapiens
acuauagcccaggu

SEQ ID NO: 1856906 - RNA, 12 nt, Homo sapiens
acugaacauguu

SEQ ID NO: 1856907 - RNA, 14 nt, Homo sapiens
cauuuuaaaacuua

SEQ ID NO: 1856908 - RNA, 16 nt, Homo sapiens
uacauacuauggaauu

SEQ ID NO: 1856909 - RNA, 18 nt, Homo sapiens
agagaccccaggaacaau

SEQ ID NO: 1856910 - RNA, 18 nt, Homo sapiens
uaaagccuuuaaaaccag

SEQ ID NO: 1856911 - RNA, 13 nt, Homo sapiens
ugaugugcacgua

SEQ ID NO: 1856912 - RNA, 20 nt, Homo sapiens
agucuccccaccucuucccu

SEQ ID NO: 1856913 - RNA, 20 nt, Homo sapiens
cucaccaauacacggacaca

SEQ ID NO: 1856914 - RNA, 15 nt, Homo sapiens
cccagauugcugcaa

SEQ ID NO: 1856915 - RNA, 22 nt, Homo sapiens
accuuugcuacuacuaugugca

SEQ ID NO: 1856916 - RNA, 22 nt, Homo sapiens
uccuuguuuucuaacuuuauga

SEQ ID NO: 1856917 - RNA, 21 nt, Homo sapiens
ucuggaguuccaaaugcaaua

SEQ ID NO: 1856918 - RNA, 12 nt, Homo sapiens
ucaaccagagaa

SEQ ID NO: 1856919 - RNA, 16 nt, Homo sapiens
ugcaguuucauguaug

SEQ ID NO: 1856920 - RNA, 17 nt, Homo sapiens
ugcuccccuacuucuca

SEQ ID NO: 1856921 - RNA, 19 nt, Homo sapiens
guuauuaacagcugauaca

SEQ ID NO: 1856922 - RNA, 13 nt, Homo sapiens
uugcaggugccaa

SEQ ID NO: 1856923 - RNA, 15 nt, Homo sapiens
agccacaggacccca

SEQ ID NO: 1856924 - RNA, 16 nt, Homo sapiens
ucaaacacacaguauu

SEQ ID NO: 1856925 - RNA, 16 nt, Homo sapiens
uggaauggagauuuca

SEQ ID NO: 1856926 - RNA, 16 nt, Homo sapiens
uuauauggaugauuca

SEQ ID NO: 1856927 - RNA, 13 nt, Homo sapiens
aacagaggccaug

SEQ ID NO: 1856928 - RNA, 16 nt, Homo sapiens
uauggacugcucagga

SEQ ID NO: 1856929 - RNA, 21 nt, Homo sapiens
auaggauggcuggcucugcac

SEQ ID NO: 1856930 - RNA, 20 nt, Homo sapiens
auugguuugagaacuucucu

SEQ ID NO: 1856931 - RNA, 13 nt, Homo sapiens
acuaggccuucag

SEQ ID NO: 1856932 - RNA, 16 nt, Homo sapiens
caagagaucuacacau

SEQ ID NO: 1856933 - RNA, 17 nt, Homo sapiens
ugucccuugcuugccug

SEQ ID NO: 1856934 - RNA, 17 nt, Homo sapiens
agcgaacuuguauacuu

SEQ ID NO: 1856935 - RNA, 20 nt, Homo sapiens
agagcacuguagcacuuaac

SEQ ID NO: 1856936 - RNA, 20 nt, Homo sapiens
agcccaggaccaccacuuau

SEQ ID NO: 1856937 - RNA, 12 nt, Homo sapiens
cuguugcuuguc

SEQ ID NO: 1856938 - RNA, 21 nt, Homo sapiens
augccaugggcccucucagca

SEQ ID NO: 1856939 - RNA, 17 nt, Homo sapiens
gauucccagaaauacaa

SEQ ID NO: 1856940 - RNA, 14 nt, Homo sapiens
ccuagagacaguga

SEQ ID NO: 1856941 - RNA, 12 nt, Homo sapiens
uaggagccagug

SEQ ID NO: 1856942 - RNA, 15 nt, Homo sapiens
aguccauugcaaaag

SEQ ID NO: 1856943 - RNA, 23 nt, Homo sapiens
aucucccuggugcuuaugcucuu

SEQ ID NO: 1856944 - RNA, 22 nt, Homo sapiens
cauccuuuacuauuaagggaaa

SEQ ID NO: 1856945 - RNA, 19 nt, Homo sapiens
aucuucacucuucacuuga

SEQ ID NO: 1856946 - RNA, 17 nt, Homo sapiens
gucacugccacuuugca

SEQ ID NO: 1856947 - RNA, 15 nt, Homo sapiens
augcgcagugccuug

SEQ ID NO: 1856948 - RNA, 15 nt, Homo sapiens
uggccuucauaucau

SEQ ID NO: 1856949 - RNA, 13 nt, Homo sapiens
ccucuccacucau

SEQ ID NO: 1856950 - RNA, 20 nt, Homo sapiens
ccugccagcaguuacuguga

SEQ ID NO: 1856951 - RNA, 18 nt, Homo sapiens
cagaccuuuuauccacuu

SEQ ID NO: 1856952 - RNA, 15 nt, Homo sapiens
gaugaccugccuuau

SEQ ID NO: 1856953 - RNA, 12 nt, Homo sapiens
ucacuucacccu

SEQ ID NO: 1856954 - RNA, 21 nt, Homo sapiens
cccuucuuuaccuucauuuca

SEQ ID NO: 1856955 - RNA, 15 nt, Homo sapiens
caccuccuaccccuu

SEQ ID NO: 1856956 - RNA, 15 nt, Homo sapiens
gguucagucacugcu

SEQ ID NO: 1856957 - RNA, 22 nt, Homo sapiens
uauaaaguugguucacuucaaa

SEQ ID NO: 1856958 - RNA, 16 nt, Homo sapiens
uccuccgcaugccaac

SEQ ID NO: 1856959 - RNA, 19 nt, Homo sapiens
guuagaaaaaggacucugc

SEQ ID NO: 1856960 - RNA, 12 nt, Homo sapiens
cacaccucuaaa

SEQ ID NO: 1856961 - RNA, 15 nt, Homo sapiens
ugcacacacaugcau

SEQ ID NO: 1856962 - RNA, 13 nt, Homo sapiens
accaucugauguu

SEQ ID NO: 1856963 - RNA, 16 nt, Homo sapiens
uauugcagugugaaug

SEQ ID NO: 1856964 - RNA, 16 nt, Homo sapiens
aaucugcagugaugca

SEQ ID NO: 1856965 - RNA, 16 nt, Homo sapiens
ccuaacuaucacuggu

SEQ ID NO: 1856966 - RNA, 18 nt, Homo sapiens
cugcuauaggucagagau

SEQ ID NO: 1856967 - RNA, 21 nt, Homo sapiens
accugucacauugcauucuau

SEQ ID NO: 1856968 - RNA, 22 nt, Homo sapiens
gacuuuucuccucucagugggu

SEQ ID NO: 1856969 - RNA, 16 nt, Homo sapiens
uuauauuuguuuuaga

SEQ ID NO: 1856970 - RNA, 15 nt, Homo sapiens
uggcauuacauugag

SEQ ID NO: 1856971 - RNA, 13 nt, Homo sapiens
agcuggauuuccu

SEQ ID NO: 1856972 - RNA, 16 nt, Homo sapiens
uguugcuuuucacaaa

SEQ ID NO: 1856973 - RNA, 13 nt, Homo sapiens
agaaaucaugccu

SEQ ID NO: 1856974 - RNA, 21 nt, Homo sapiens
ccacauaauacauuccaucac

SEQ ID NO: 1856975 - RNA, 15 nt, Homo sapiens
ggcuuucacugcuga

SEQ ID NO: 1856976 - RNA, 14 nt, Homo sapiens
ggguggggagcaaa

SEQ ID NO: 1856977 - RNA, 13 nt, Homo sapiens
aaaucucuaauau

SEQ ID NO: 1856978 - RNA, 13 nt, Homo sapiens
ucauuucuucuac

SEQ ID NO: 1856979 - RNA, 13 nt, Homo sapiens
ugaauucuuguuc

SEQ ID NO: 1856980 - RNA, 15 nt, Homo sapiens
cuuagauuaaaucuc

SEQ ID NO: 1856981 - RNA, 14 nt, Homo sapiens
gagcuagaacauuc

SEQ ID NO: 1856982 - RNA, 16 nt, Homo sapiens
uccauccccaaacugu

SEQ ID NO: 1856983 - RNA, 15 nt, Homo sapiens
gaaagcaguggcuca

SEQ ID NO: 1856984 - RNA, 15 nt, Homo sapiens
cggaccccagagccc

SEQ ID NO: 1856985 - RNA, 16 nt, Homo sapiens
agccggacacuucuca

SEQ ID NO: 1856986 - RNA, 16 nt, Homo sapiens
ugcagaaauuugaaug

SEQ ID NO: 1856987 - RNA, 10 nt, Homo sapiens
gagcucaggc

SEQ ID NO: 1856988 - RNA, 23 nt, Homo sapiens
caagguucugguuccauuuuucc

SEQ ID NO: 1856989 - RNA, 13 nt, Homo sapiens
ugcucuugucggg

SEQ ID NO: 1856990 - RNA, 22 nt, Homo sapiens
cuuugucauucaagccugugaa

SEQ ID NO: 1856991 - RNA, 18 nt, Homo sapiens
caggcaguggaagcaguu

SEQ ID NO: 1856992 - RNA, 14 nt, Homo sapiens
accugcgcucucag

SEQ ID NO: 1856993 - RNA, 17 nt, Homo sapiens
agaccaguguaucaggu

SEQ ID NO: 1856994 - RNA, 14 nt, Homo sapiens
ugcuuuguauccau

SEQ ID NO: 1856995 - RNA, 12 nt, Homo sapiens
cggcacauuccc

SEQ ID NO: 1856996 - RNA, 13 nt, Homo sapiens
cuaggagaccaag

SEQ ID NO: 1856997 - RNA, 18 nt, Homo sapiens
gaauuucauaugacauuc

SEQ ID NO: 1856998 - RNA, 20 nt, Homo sapiens
gaagcauugccuggacugac

SEQ ID NO: 1856999 - RNA, 23 nt, Homo sapiens
cuggauuuuauuuuaaguucucu

SEQ ID NO: 1857000 - RNA, 16 nt, Homo sapiens
caauagaacaguuuac

SEQ ID NO: 1857001 - RNA, 16 nt, Homo sapiens
aagauuccaaaaagca

SEQ ID NO: 1857002 - RNA, 21 nt, Homo sapiens
cuuuagagaauaccaguguua

SEQ ID NO: 1857003 - RNA, 15 nt, Homo sapiens
aggccugggaccucc

SEQ ID NO: 1857004 - RNA, 17 nt, Homo sapiens
acgccauugcacuccag

SEQ ID NO: 1857005 - RNA, 18 nt, Homo sapiens
gccaccacugggcaaaca

SEQ ID NO: 1857006 - RNA, 17 nt, Homo sapiens
gaaaguuucagauuugc

SEQ ID NO: 1857007 - RNA, 19 nt, Homo sapiens
gcagacauagaagagccaa

SEQ ID NO: 1857008 - RNA, 21 nt, Homo sapiens
uaugaaccaaguaguauucau

SEQ ID NO: 1857009 - RNA, 15 nt, Homo sapiens
gagggccucaaucuc

SEQ ID NO: 1857010 - RNA, 23 nt, Homo sapiens
uuacuaguacagguuuugcccug

SEQ ID NO: 1857011 - RNA, 15 nt, Homo sapiens
gcgauggagcagucu

SEQ ID NO: 1857012 - RNA, 13 nt, Homo sapiens
uuuacacugggag

SEQ ID NO: 1857013 - RNA, 20 nt, Homo sapiens
cccuuaauauugaggcugca

SEQ ID NO: 1857014 - RNA, 18 nt, Homo sapiens
gacaauacaguaagcaua

SEQ ID NO: 1857015 - RNA, 20 nt, Homo sapiens
guuuaguaaucauauuguua

SEQ ID NO: 1857016 - RNA, 16 nt, Homo sapiens
cauuuacuugaucauu

SEQ ID NO: 1857017 - RNA, 19 nt, Homo sapiens
ccaggaauauaugucagug

SEQ ID NO: 1857018 - RNA, 15 nt, Homo sapiens
aucauggcucacugc

SEQ ID NO: 1857019 - RNA, 23 nt, Homo sapiens
uuguaauaaaaugguacauuucu

SEQ ID NO: 1857020 - RNA, 12 nt, Homo sapiens
uccugucugcug

SEQ ID NO: 1857021 - RNA, 19 nt, Homo sapiens
aacuauaaaacuaggugcu

SEQ ID NO: 1857022 - RNA, 20 nt, Homo sapiens
ccucccccuuucacacugga

SEQ ID NO: 1857023 - RNA, 13 nt, Homo sapiens
cccucccauggca

SEQ ID NO: 1857024 - RNA, 20 nt, Homo sapiens
agugcuggggaacaaccaga

SEQ ID NO: 1857025 - RNA, 23 nt, Homo sapiens
gguaacuuuuuuuuaaagcucau

SEQ ID NO: 1857026 - RNA, 22 nt, Homo sapiens
uuucacaaaaaggcauaugcaa

SEQ ID NO: 1857027 - RNA, 13 nt, Homo sapiens
aggagcuguuacu

SEQ ID NO: 1857028 - RNA, 17 nt, Homo sapiens
uaugauguauauuuaau

SEQ ID NO: 1857029 - RNA, 17 nt, Homo sapiens
auauuaauuaugaagau

SEQ ID NO: 1857030 - RNA, 19 nt, Homo sapiens
uauaacuguggcuaauuca

SEQ ID NO: 1857031 - RNA, 21 nt, Homo sapiens
cuauccugugcuugaugcuag

SEQ ID NO: 1857032 - RNA, 22 nt, Homo sapiens
ucuguaauuguguccccucuca

SEQ ID NO: 1857033 - RNA, 19 nt, Homo sapiens
accuguaaucccagcacuu

SEQ ID NO: 1857034 - RNA, 18 nt, Homo sapiens
ucuuagggugaaccacuu

SEQ ID NO: 1857035 - RNA, 16 nt, Homo sapiens
aaacaggguaccucaa

SEQ ID NO: 1857036 - RNA, 13 nt, Homo sapiens
gccgaaugugcag

SEQ ID NO: 1857037 - RNA, 20 nt, Homo sapiens
ugauuucuugcuaagcucca

SEQ ID NO: 1857038 - RNA, 16 nt, Homo sapiens
guaacuugucaaggaa

SEQ ID NO: 1857039 - RNA, 22 nt, Homo sapiens
cccagcucugcuuuuuccagau

SEQ ID NO: 1857040 - RNA, 16 nt, Homo sapiens
gugcaggacacugguc

SEQ ID NO: 1857041 - RNA, 14 nt, Homo sapiens
caugcccacugccg

SEQ ID NO: 1857042 - RNA, 20 nt, Homo sapiens
agaaauaaacaggaguucag

SEQ ID NO: 1857043 - RNA, 18 nt, Homo sapiens
aaaucacuucaauccuca

SEQ ID NO: 1857044 - RNA, 21 nt, Homo sapiens
auccuaauaaaaaggugacca

SEQ ID NO: 1857045 - RNA, 20 nt, Homo sapiens
gagccggccgccuucucccc

SEQ ID NO: 1857046 - RNA, 18 nt, Homo sapiens
cugcccacucaccugccc

SEQ ID NO: 1857047 - RNA, 21 nt, Homo sapiens
cguacgggaaugugcuuucaa

SEQ ID NO: 1857048 - RNA, 23 nt, Homo sapiens
uaagucaaaaugugaaaauaaua

SEQ ID NO: 1857049 - RNA, 23 nt, Homo sapiens
cuaauuaaucuggaauaugcaac

SEQ ID NO: 1857050 - RNA, 13 nt, Homo sapiens
aaagcuucaggga

SEQ ID NO: 1857051 - RNA, 16 nt, Homo sapiens
uguuucuuucauauga

SEQ ID NO: 1857052 - RNA, 19 nt, Homo sapiens
cucccagugaacuccugcc

SEQ ID NO: 1857053 - RNA, 12 nt, Homo sapiens
ugcaguggcaca

SEQ ID NO: 1857054 - RNA, 19 nt, Homo sapiens
ucaacccccuuaacuguau

SEQ ID NO: 1857055 - RNA, 13 nt, Homo sapiens
aacacauuuccau

SEQ ID NO: 1857056 - RNA, 16 nt, Homo sapiens
auuugaaugacaagau

SEQ ID NO: 1857057 - RNA, 15 nt, Homo sapiens
ucugaugaucauugc

SEQ ID NO: 1857058 - RNA, 22 nt, Homo sapiens
ccggugucuggaaaagcacuuu

SEQ ID NO: 1857059 - RNA, 19 nt, Homo sapiens
gauaaacacagagguuuua

SEQ ID NO: 1857060 - RNA, 16 nt, Homo sapiens
uucuguuaucuagaaa

SEQ ID NO: 1857061 - RNA, 15 nt, Homo sapiens
ucucuauaccaauaa

SEQ ID NO: 1857062 - RNA, 13 nt, Homo sapiens
accagggcuccag

SEQ ID NO: 1857063 - RNA, 17 nt, Homo sapiens
gagucagcagaacuggg

SEQ ID NO: 1857064 - RNA, 21 nt, Homo sapiens
uugcuaccaaaaacuagacau

SEQ ID NO: 1857065 - RNA, 15 nt, Homo sapiens
aaaugacucuacuaa

SEQ ID NO: 1857066 - RNA, 20 nt, Homo sapiens
gaaugagccaaaaugacuuu

SEQ ID NO: 1857067 - RNA, 16 nt, Homo sapiens
cauagaaagaugacaa

SEQ ID NO: 1857068 - RNA, 22 nt, Homo sapiens
gauuccuuuuuucaaaauccaa

SEQ ID NO: 1857069 - RNA, 11 nt, Homo sapiens
aaccuuuucaa

SEQ ID NO: 1857070 - RNA, 20 nt, Homo sapiens
ucccaagagcaucaugccuc

SEQ ID NO: 1857071 - RNA, 20 nt, Homo sapiens
caaggaagucugugucuacc

SEQ ID NO: 1857072 - RNA, 18 nt, Homo sapiens
aagcccaugaguccuuga

SEQ ID NO: 1857073 - RNA, 13 nt, Homo sapiens
aaugcacuuucua

SEQ ID NO: 1857074 - RNA, 22 nt, Homo sapiens
gauccauuuaaaacaagcugau

SEQ ID NO: 1857075 - RNA, 19 nt, Homo sapiens
auaauuuucuggcacuggu

SEQ ID NO: 1857076 - RNA, 13 nt, Homo sapiens
cacacagcuaaca

SEQ ID NO: 1857077 - RNA, 14 nt, Homo sapiens
aacccaaugccugu

SEQ ID NO: 1857078 - RNA, 20 nt, Homo sapiens
uuccuccucaggcacacagc

SEQ ID NO: 1857079 - RNA, 17 nt, Homo sapiens
cauuaaaccugucucca

SEQ ID NO: 1857080 - RNA, 17 nt, Homo sapiens
caugcgucgcaaacucu

SEQ ID NO: 1857081 - RNA, 20 nt, Homo sapiens
gcaugcugcccagccacucc

SEQ ID NO: 1857082 - RNA, 22 nt, Homo sapiens
gguggggagcaaaucaucugca

SEQ ID NO: 1857083 - RNA, 21 nt, Homo sapiens
cucauuaaaauugugaugcuc

SEQ ID NO: 1857084 - RNA, 19 nt, Homo sapiens
augaucauuaggacauaac

SEQ ID NO: 1857085 - RNA, 15 nt, Homo sapiens
acccagccccacaaa

SEQ ID NO: 1857086 - RNA, 13 nt, Homo sapiens
uacagagccacag

SEQ ID NO: 1857087 - RNA, 16 nt, Homo sapiens
aagcuagaacuggaag

SEQ ID NO: 1857088 - RNA, 18 nt, Homo sapiens
cugcaagcagaacuucca

SEQ ID NO: 1857089 - RNA, 21 nt, Homo sapiens
uugacacugaauaaaauauug

SEQ ID NO: 1857090 - RNA, 22 nt, Homo sapiens
guguguaucgcugccuugccau

SEQ ID NO: 1857091 - RNA, 17 nt, Homo sapiens
uucacgugcagcagcaa

SEQ ID NO: 1857092 - RNA, 22 nt, Homo sapiens
augcaaaccaaaccauuauuca

SEQ ID NO: 1857093 - RNA, 19 nt, Homo sapiens
aacacugucugcauaucca

SEQ ID NO: 1857094 - RNA, 13 nt, Homo sapiens
cauuuuaguuacu

SEQ ID NO: 1857095 - RNA, 23 nt, Homo sapiens
cugauucaauaaaaugcacugac

SEQ ID NO: 1857096 - RNA, 23 nt, Homo sapiens
agccuuguaaaugggaaaauaua

SEQ ID NO: 1857097 - RNA, 20 nt, Homo sapiens
uggaagugauuucagcacau

SEQ ID NO: 1857098 - RNA, 20 nt, Homo sapiens
agcauuuuuggcuuacucau

SEQ ID NO: 1857099 - RNA, 19 nt, Homo sapiens
gaaaacuucacugugcuca

SEQ ID NO: 1857100 - RNA, 14 nt, Homo sapiens
aguuggugcugcuu

SEQ ID NO: 1857101 - RNA, 18 nt, Homo sapiens
auuuguuugugacaacua

SEQ ID NO: 1857102 - RNA, 17 nt, Homo sapiens
accuuuuucauaaucug

SEQ ID NO: 1857103 - RNA, 13 nt, Homo sapiens
cacuccuucagga

SEQ ID NO: 1857104 - RNA, 17 nt, Homo sapiens
gugggcagagccuucca

SEQ ID NO: 1857105 - RNA, 13 nt, Homo sapiens
ugaauguggacuc

SEQ ID NO: 1857106 - RNA, 13 nt, Homo sapiens
ugccuccaccagc

SEQ ID NO: 1857107 - RNA, 21 nt, Homo sapiens
cuugaauuuauaaagugcugg

SEQ ID NO: 1857108 - RNA, 16 nt, Homo sapiens
gcuuuaugcaaauaca

SEQ ID NO: 1857109 - RNA, 14 nt, Homo sapiens
acaauaaacuauuu

SEQ ID NO: 1857110 - RNA, 15 nt, Homo sapiens
aauccaaaugcauuc

SEQ ID NO: 1857111 - RNA, 19 nt, Homo sapiens
ucuuaggcacuuuuuaaca

SEQ ID NO: 1857112 - RNA, 21 nt, Homo sapiens
agucuccucacucugucccug

SEQ ID NO: 1857113 - RNA, 18 nt, Homo sapiens
acauuuauccaagaccug

SEQ ID NO: 1857114 - RNA, 15 nt, Homo sapiens
ccagauaugugccaa

SEQ ID NO: 1857115 - RNA, 17 nt, Homo sapiens
aaguacuguacuuuccc

SEQ ID NO: 1857116 - RNA, 17 nt, Homo sapiens
ugucaucugucacuaua

SEQ ID NO: 1857117 - RNA, 18 nt, Homo sapiens
augacagcugucccuguc

SEQ ID NO: 1857118 - RNA, 17 nt, Homo sapiens
cuuuucuauauugcagu

SEQ ID NO: 1857119 - RNA, 18 nt, Homo sapiens
accaacaaacaaugccau

SEQ ID NO: 1857120 - RNA, 18 nt, Homo sapiens
ggacacaucaggaaguua

SEQ ID NO: 1857121 - RNA, 13 nt, Homo sapiens
aagagacugcuug

SEQ ID NO: 1857122 - RNA, 14 nt, Homo sapiens
ucaacaaaccaagc

SEQ ID NO: 1857123 - RNA, 18 nt, Homo sapiens
ugacugaaggacaucuga

SEQ ID NO: 1857124 - RNA, 17 nt, Homo sapiens
gaucauggucagcucac

SEQ ID NO: 1857125 - RNA, 17 nt, Homo sapiens
aagcacucucugcaguc

SEQ ID NO: 1857126 - RNA, 11 nt, Homo sapiens
ccaggacacca

SEQ ID NO: 1857127 - RNA, 11 nt, Homo sapiens
agaggacaaga

SEQ ID NO: 1857128 - RNA, 23 nt, Homo sapiens
ugugaaccgaggggcucaggaaa

SEQ ID NO: 1857129 - RNA, 15 nt, Homo sapiens
aggaaguuaugccaa

SEQ ID NO: 1857130 - RNA, 23 nt, Homo sapiens
auuauccuauuucaguacuucag

SEQ ID NO: 1857131 - RNA, 19 nt, Homo sapiens
aaauagcacccaaacacau

SEQ ID NO: 1857132 - RNA, 16 nt, Homo sapiens
aauucuucacauguaa

SEQ ID NO: 1857133 - RNA, 11 nt, Homo sapiens
gugugucucau

SEQ ID NO: 1857134 - RNA, 17 nt, Homo sapiens
ucccacucagcagugag

SEQ ID NO: 1857135 - RNA, 12 nt, Homo sapiens
ccucagcuuucc

SEQ ID NO: 1857136 - RNA, 21 nt, Homo sapiens
ugagaugggaggaucacuuga

SEQ ID NO: 1857137 - RNA, 21 nt, Homo sapiens
cacuuuauauuuuccucuuag

SEQ ID NO: 1857138 - RNA, 11 nt, Homo sapiens
uaccuguuauu

SEQ ID NO: 1857139 - RNA, 16 nt, Homo sapiens
aguuguggugugccau

SEQ ID NO: 1857140 - RNA, 16 nt, Homo sapiens
auuaaagcauuuccua

SEQ ID NO: 1857141 - RNA, 16 nt, Homo sapiens
aacuuuuuauucucag

SEQ ID NO: 1857142 - RNA, 23 nt, Homo sapiens
aagucuugguaacaaauaaccua

SEQ ID NO: 1857143 - RNA, 17 nt, Homo sapiens
agauuccccugugucau

SEQ ID NO: 1857144 - RNA, 20 nt, Homo sapiens
cagagaaaggguaauuuccu

SEQ ID NO: 1857145 - RNA, 12 nt, Homo sapiens
agcauuugcacc

SEQ ID NO: 1857146 - RNA, 19 nt, Homo sapiens
uuccagcacaccauugcau

SEQ ID NO: 1857147 - RNA, 14 nt, Homo sapiens
acaagucuuuccag

SEQ ID NO: 1857148 - RNA, 21 nt, Homo sapiens
guguacaacuccacgagguga

SEQ ID NO: 1857149 - RNA, 23 nt, Homo sapiens
aaagacauuuauauggguuuauu

SEQ ID NO: 1857150 - RNA, 14 nt, Homo sapiens
cucgaaucacucau

SEQ ID NO: 1857151 - RNA, 16 nt, Homo sapiens
cuggacugaccaaaga

SEQ ID NO: 1857152 - RNA, 17 nt, Homo sapiens
gcacgcucgcugccauc

SEQ ID NO: 1857153 - RNA, 12 nt, Homo sapiens
aucacacugaaa

SEQ ID NO: 1857154 - RNA, 12 nt, Homo sapiens
aacacacuguaa

SEQ ID NO: 1857155 - RNA, 23 nt, Homo sapiens
cagguggauuuuguggaggugag

SEQ ID NO: 1857156 - RNA, 22 nt, Homo sapiens
gccuccugcccugcuaaagaca

SEQ ID NO: 1857157 - RNA, 18 nt, Homo sapiens
guauuguccgggcucaga

SEQ ID NO: 1857158 - RNA, 16 nt, Homo sapiens
gaaucaaaugcaauuu

SEQ ID NO: 1857159 - RNA, 14 nt, Homo sapiens
auccugcaaaggcc

SEQ ID NO: 1857160 - RNA, 22 nt, Homo sapiens
augucuuaaaaugggaucucau

SEQ ID NO: 1857161 - RNA, 14 nt, Homo sapiens
cucccagcugacca

SEQ ID NO: 1857162 - RNA, 22 nt, Homo sapiens
aguguuugcuccaccuucauau

SEQ ID NO: 1857163 - RNA, 22 nt, Homo sapiens
acucuugggugaaggugcaucu

SEQ ID NO: 1857164 - RNA, 14 nt, Homo sapiens
gcaauaggacaaaa

SEQ ID NO: 1857165 - RNA, 16 nt, Homo sapiens
aaaauaauauccaugc

SEQ ID NO: 1857166 - RNA, 12 nt, Homo sapiens
ccuugucugcua

SEQ ID NO: 1857167 - RNA, 12 nt, Homo sapiens
gacagucucacu

SEQ ID NO: 1857168 - RNA, 17 nt, Homo sapiens
agacauuucucuaacuc

SEQ ID NO: 1857169 - RNA, 17 nt, Homo sapiens
ugcucacguuaccuuga

SEQ ID NO: 1857170 - RNA, 18 nt, Homo sapiens
ggagccugugguggccug

SEQ ID NO: 1857171 - RNA, 16 nt, Homo sapiens
gaauuaggaagaccaa

SEQ ID NO: 1857172 - RNA, 14 nt, Homo sapiens
auccuuacauuuca

SEQ ID NO: 1857173 - RNA, 23 nt, Homo sapiens
acuuugggggaggagaacaugag

SEQ ID NO: 1857174 - RNA, 22 nt, Homo sapiens
auaauuccuauauccugugacu

SEQ ID NO: 1857175 - RNA, 15 nt, Homo sapiens
ucucuagagugagaa

SEQ ID NO: 1857176 - RNA, 16 nt, Homo sapiens
gaacaauuaugaacau

SEQ ID NO: 1857177 - RNA, 21 nt, Homo sapiens
uccgaagaaugaagucuuucc

SEQ ID NO: 1857178 - RNA, 18 nt, Homo sapiens
acccuggggcgugcagca

SEQ ID NO: 1857179 - RNA, 12 nt, Homo sapiens
aguacaaaaaca

SEQ ID NO: 1857180 - RNA, 21 nt, Homo sapiens
uccucagcugccaagcacucg

SEQ ID NO: 1857181 - RNA, 19 nt, Homo sapiens
gauguguauauauauguga

SEQ ID NO: 1857182 - RNA, 19 nt, Homo sapiens
uggauaaaauaaaugcaau

SEQ ID NO: 1857183 - RNA, 18 nt, Homo sapiens
aaccauuguaacuauuaa

SEQ ID NO: 1857184 - RNA, 21 nt, Homo sapiens
cccagacaccaugugcaauaa

SEQ ID NO: 1857185 - RNA, 17 nt, Homo sapiens
acuuuuuaaaacacaac

SEQ ID NO: 1857186 - RNA, 13 nt, Homo sapiens
acugcccuaagcc

SEQ ID NO: 1857187 - RNA, 12 nt, Homo sapiens
uucuacaaccua

SEQ ID NO: 1857188 - RNA, 16 nt, Homo sapiens
aaucaauucauugugu

SEQ ID NO: 1857189 - RNA, 12 nt, Homo sapiens
auaaacaucaca

SEQ ID NO: 1857190 - RNA, 20 nt, Homo sapiens
aggaagggacugguccaggc

SEQ ID NO: 1857191 - RNA, 16 nt, Homo sapiens
accuggaacacaaaac

SEQ ID NO: 1857192 - RNA, 20 nt, Homo sapiens
gacuccucuacucacagcug

SEQ ID NO: 1857193 - RNA, 16 nt, Homo sapiens
gagcucuuugugaaug

SEQ ID NO: 1857194 - RNA, 21 nt, Homo sapiens
uauauuuucccucucuugccu

SEQ ID NO: 1857195 - RNA, 15 nt, Homo sapiens
auaccuccaacccug

SEQ ID NO: 1857196 - RNA, 22 nt, Homo sapiens
acgaauuaauuaccuggcacca

SEQ ID NO: 1857197 - RNA, 22 nt, Homo sapiens
guuaaauugaauaaaauacucu

SEQ ID NO: 1857198 - RNA, 15 nt, Homo sapiens
aauuaaacuaugaug

SEQ ID NO: 1857199 - RNA, 16 nt, Homo sapiens
aucaguguugcaacau

SEQ ID NO: 1857200 - RNA, 16 nt, Homo sapiens
aaagacagaagcuuaa

SEQ ID NO: 1857201 - RNA, 19 nt, Homo sapiens
auuggcucacaguucugca

SEQ ID NO: 1857202 - RNA, 13 nt, Homo sapiens
ugaaucacuucug

SEQ ID NO: 1857203 - RNA, 18 nt, Homo sapiens
gcaaagguggcucuccag

SEQ ID NO: 1857204 - RNA, 10 nt, Homo sapiens
aaagcauuuc

SEQ ID NO: 1857205 - RNA, 15 nt, Homo sapiens
ucacugggucugcug

SEQ ID NO: 1857206 - RNA, 15 nt, Homo sapiens
cuugccugaggcuca

SEQ ID NO: 1857207 - RNA, 12 nt, Homo sapiens
caccaguagcag

SEQ ID NO: 1857208 - RNA, 16 nt, Homo sapiens
gaagacuagaggccag

SEQ ID NO: 1857209 - RNA, 23 nt, Homo sapiens
uccuggcuccuuaucagugccau

SEQ ID NO: 1857210 - RNA, 20 nt, Homo sapiens
gacaaagugugucucaaaaa

SEQ ID NO: 1857211 - RNA, 12 nt, Homo sapiens
ugaagugcaaau

SEQ ID NO: 1857212 - RNA, 22 nt, Homo sapiens
uuccuggccuucugaacuccau

SEQ ID NO: 1857213 - RNA, 12 nt, Homo sapiens
gaaacuugggaa

SEQ ID NO: 1857214 - RNA, 22 nt, Homo sapiens
aucuagccuggaaccaagguua

SEQ ID NO: 1857215 - RNA, 20 nt, Homo sapiens
gcaaaguauuguaaauuaua

SEQ ID NO: 1857216 - RNA, 21 nt, Homo sapiens
augaacaucuuuagugucuga

SEQ ID NO: 1857217 - RNA, 18 nt, Homo sapiens
uuugaagaacaugugaga

SEQ ID NO: 1857218 - RNA, 20 nt, Homo sapiens
guugacucuaguacugugaa

SEQ ID NO: 1857219 - RNA, 17 nt, Homo sapiens
cacucccuaaagcccuc

SEQ ID NO: 1857220 - RNA, 17 nt, Homo sapiens
cucauccccaccugucu

SEQ ID NO: 1857221 - RNA, 23 nt, Homo sapiens
aaaguguaacggccaacacuuug

SEQ ID NO: 1857222 - RNA, 15 nt, Homo sapiens
ccccagagcuccgau

SEQ ID NO: 1857223 - RNA, 23 nt, Homo sapiens
acuucugaagggccccuugcaaa

SEQ ID NO: 1857224 - RNA, 20 nt, Homo sapiens
agaugaugugauggaacaca

SEQ ID NO: 1857225 - RNA, 12 nt, Homo sapiens
auagcuaaaaaa

SEQ ID NO: 1857226 - RNA, 16 nt, Homo sapiens
cuuuggcuuaauucca

SEQ ID NO: 1857227 - RNA, 15 nt, Homo sapiens
gacugaccugccccu

SEQ ID NO: 1857228 - RNA, 21 nt, Homo sapiens
gccuggagaaggugacagucc

SEQ ID NO: 1857229 - RNA, 15 nt, Homo sapiens
uuugaacuccucuca

SEQ ID NO: 1857230 - RNA, 21 nt, Homo sapiens
ccugcauuguuucaagacuga

SEQ ID NO: 1857231 - RNA, 14 nt, Homo sapiens
gaagucaccaaaau

SEQ ID NO: 1857232 - RNA, 18 nt, Homo sapiens
aguuauuauuuaauugca

SEQ ID NO: 1857233 - RNA, 15 nt, Homo sapiens
uccccuucccuccaa

SEQ ID NO: 1857234 - RNA, 20 nt, Homo sapiens
ccaagcuagacugugucuga

SEQ ID NO: 1857235 - RNA, 19 nt, Homo sapiens
cuucaaaguuaaugggaug

SEQ ID NO: 1857236 - RNA, 23 nt, Homo sapiens
uucucagauguugaaacuuugaa

SEQ ID NO: 1857237 - RNA, 22 nt, Homo sapiens
acagugcagugaauuggaagac

SEQ ID NO: 1857238 - RNA, 12 nt, Homo sapiens
caaaguuugcaa

SEQ ID NO: 1857239 - RNA, 12 nt, Homo sapiens
cugcucacuccc

SEQ ID NO: 1857240 - RNA, 18 nt, Homo sapiens
agcauauguguuacuuca

SEQ ID NO: 1857241 - RNA, 15 nt, Homo sapiens
caggugcagccagag

SEQ ID NO: 1857242 - RNA, 16 nt, Homo sapiens
gaggccuuuuuugcca

SEQ ID NO: 1857243 - RNA, 15 nt, Homo sapiens
guguuugacuguaau

SEQ ID NO: 1857244 - RNA, 15 nt, Homo sapiens
aguuucuggugccau

SEQ ID NO: 1857245 - RNA, 14 nt, Homo sapiens
ugcucucaaaaugu

SEQ ID NO: 1857246 - RNA, 18 nt, Homo sapiens
gcuccaagggacaggugg

SEQ ID NO: 1857247 - RNA, 14 nt, Homo sapiens
uacaaggacaaugc

SEQ ID NO: 1857248 - RNA, 17 nt, Homo sapiens
aggcuggaaugcagugg

SEQ ID NO: 1857249 - RNA, 17 nt, Homo sapiens
ggccugugauccaggaa

SEQ ID NO: 1857250 - RNA, 17 nt, Homo sapiens
aggcuggagugcaguga

SEQ ID NO: 1857251 - RNA, 13 nt, Homo sapiens
uguaauaaaguga

SEQ ID NO: 1857252 - RNA, 16 nt, Homo sapiens
uucccacaggacauuu

SEQ ID NO: 1857253 - RNA, 13 nt, Homo sapiens
caaaaacuuugga

SEQ ID NO: 1857254 - RNA, 13 nt, Homo sapiens
caaacacuuuggc

SEQ ID NO: 1857255 - RNA, 18 nt, Homo sapiens
ugaacaagauuucccuaa

SEQ ID NO: 1857256 - RNA, 13 nt, Homo sapiens
gauauuugaugua

SEQ ID NO: 1857257 - RNA, 14 nt, Homo sapiens
gcaccagugccuca

SEQ ID NO: 1857258 - RNA, 10 nt, Homo sapiens
agcuauuuaa

SEQ ID NO: 1857259 - RNA, 20 nt, Homo sapiens
aaggggagccagaaaugggc

SEQ ID NO: 1857260 - RNA, 14 nt, Homo sapiens
ccuugauucacaau

SEQ ID NO: 1857261 - RNA, 16 nt, Homo sapiens
aucaaggggucacuua

SEQ ID NO: 1857262 - RNA, 19 nt, Homo sapiens
uaggugaucucaguucucu

SEQ ID NO: 1857263 - RNA, 18 nt, Homo sapiens
ccaacugguucaggcuca

SEQ ID NO: 1857264 - RNA, 18 nt, Homo sapiens
cagugccauggauuucca

SEQ ID NO: 1857265 - RNA, 13 nt, Homo sapiens
uuuugaaaguaau

SEQ ID NO: 1857266 - RNA, 20 nt, Homo sapiens
aagugaucuucccacaccag

SEQ ID NO: 1857267 - RNA, 18 nt, Homo sapiens
ugggaauguucuuucugc

SEQ ID NO: 1857268 - RNA, 22 nt, Homo sapiens
aggccugcacagcuaagugugg

SEQ ID NO: 1857269 - RNA, 15 nt, Homo sapiens
uuugaugcauuucca

SEQ ID NO: 1857270 - RNA, 15 nt, Homo sapiens
aaaaugcaacaacau

SEQ ID NO: 1857271 - RNA, 18 nt, Homo sapiens
ugaaguuggaagccauuu

SEQ ID NO: 1857272 - RNA, 21 nt, Homo sapiens
caggacccgcacgccucuucc

SEQ ID NO: 1857273 - RNA, 23 nt, Homo sapiens
guccugggguauaaaacuuuccu

SEQ ID NO: 1857274 - RNA, 21 nt, Homo sapiens
aggagcucuccacccacucac

SEQ ID NO: 1857275 - RNA, 14 nt, Homo sapiens
auauauuuaauuga

SEQ ID NO: 1857276 - RNA, 14 nt, Homo sapiens
gagucgacuuugag

SEQ ID NO: 1857277 - RNA, 17 nt, Homo sapiens
uauggcuucacauucau

SEQ ID NO: 1857278 - RNA, 19 nt, Homo sapiens
cuuuuaagguuucaacaaa

SEQ ID NO: 1857279 - RNA, 22 nt, Homo sapiens
auacuauuuaagaugugaaaau

SEQ ID NO: 1857280 - RNA, 14 nt, Homo sapiens
gcuuuacagcacug

SEQ ID NO: 1857281 - RNA, 19 nt, Homo sapiens
gagacaggacgaggcagaa

SEQ ID NO: 1857282 - RNA, 15 nt, Homo sapiens
cuaaguccacucuag

SEQ ID NO: 1857283 - RNA, 14 nt, Homo sapiens
ugccucacuucuuc

SEQ ID NO: 1857284 - RNA, 14 nt, Homo sapiens
agacacacauauac

SEQ ID NO: 1857285 - RNA, 16 nt, Homo sapiens
cagguuaaugcugaaa

SEQ ID NO: 1857286 - RNA, 22 nt, Homo sapiens
aauguacucuugaacuucuuac

SEQ ID NO: 1857287 - RNA, 21 nt, Homo sapiens
guaacccgcucaucacuggau

SEQ ID NO: 1857288 - RNA, 13 nt, Homo sapiens
uuuaacguugaug

SEQ ID NO: 1857289 - RNA, 20 nt, Homo sapiens
ugguccauagagagcaagac

SEQ ID NO: 1857290 - RNA, 20 nt, Homo sapiens
ucaacaaccugaauguccca

SEQ ID NO: 1857291 - RNA, 15 nt, Homo sapiens
augugucaucuagca

SEQ ID NO: 1857292 - RNA, 15 nt, Homo sapiens
aacucucaagcagac

SEQ ID NO: 1857293 - RNA, 13 nt, Homo sapiens
uuugggaugacca

SEQ ID NO: 1857294 - RNA, 15 nt, Homo sapiens
uugcagaugugccua

SEQ ID NO: 1857295 - RNA, 21 nt, Homo sapiens
uuaauaguuucugauucacua

SEQ ID NO: 1857296 - RNA, 18 nt, Homo sapiens
aagauuagauaaagagaa

SEQ ID NO: 1857297 - RNA, 17 nt, Homo sapiens
uuccugaucaaggugcu

SEQ ID NO: 1857298 - RNA, 19 nt, Homo sapiens
auacaacauuaaggaauuu

SEQ ID NO: 1857299 - RNA, 17 nt, Homo sapiens
aguccuguacucugggg

SEQ ID NO: 1857300 - RNA, 13 nt, Homo sapiens
gaagaaagugaaa

SEQ ID NO: 1857301 - RNA, 13 nt, Homo sapiens
gaaggaagugaag

SEQ ID NO: 1857302 - RNA, 13 nt, Homo sapiens
ucgcccaugagag

SEQ ID NO: 1857303 - RNA, 13 nt, Homo sapiens
gaccccauuccag

SEQ ID NO: 1857304 - RNA, 16 nt, Homo sapiens
acaacaccccacagga

SEQ ID NO: 1857305 - RNA, 21 nt, Homo sapiens
uaagggccggggauggaucuu

SEQ ID NO: 1857306 - RNA, 21 nt, Homo sapiens
acaauaccguguggugaaaau

SEQ ID NO: 1857307 - RNA, 16 nt, Homo sapiens
cacaccaguuacuguu

SEQ ID NO: 1857308 - RNA, 14 nt, Homo sapiens
uguccaaaacugcc

SEQ ID NO: 1857309 - RNA, 16 nt, Homo sapiens
cacccucaaaugucag

SEQ ID NO: 1857310 - RNA, 14 nt, Homo sapiens
gaguucagguugcc

SEQ ID NO: 1857311 - RNA, 13 nt, Homo sapiens
auguaaccacugc

SEQ ID NO: 1857312 - RNA, 20 nt, Homo sapiens
aaaguaauuucuuugaucug

SEQ ID NO: 1857313 - RNA, 16 nt, Homo sapiens
gagugcuuacacuuau

SEQ ID NO: 1857314 - RNA, 19 nt, Homo sapiens
gaugucacgucuugaaaag

SEQ ID NO: 1857315 - RNA, 15 nt, Homo sapiens
uuuuuaaauuaugca

SEQ ID NO: 1857316 - RNA, 14 nt, Homo sapiens
auaagguaugugcu

SEQ ID NO: 1857317 - RNA, 18 nt, Homo sapiens
gccaaagagaaugccauu

SEQ ID NO: 1857318 - RNA, 14 nt, Homo sapiens
auuugauuagggua

SEQ ID NO: 1857319 - RNA, 18 nt, Homo sapiens
ccuccgccagauccugca

SEQ ID NO: 1857320 - RNA, 19 nt, Homo sapiens
ucugcacccacgugcauuc

SEQ ID NO: 1857321 - RNA, 17 nt, Homo sapiens
auuauguuuugugauuc

SEQ ID NO: 1857322 - RNA, 21 nt, Homo sapiens
ccaauaaaccuuccuucuuaa

SEQ ID NO: 1857323 - RNA, 20 nt, Homo sapiens
uucauauauggacauggaaa

SEQ ID NO: 1857324 - RNA, 17 nt, Homo sapiens
ucaccucacaaaccuga

SEQ ID NO: 1857325 - RNA, 23 nt, Homo sapiens
agcuugaaacauagagggagaga

SEQ ID NO: 1857326 - RNA, 20 nt, Homo sapiens
ugucccuuugcucccggcaa

SEQ ID NO: 1857327 - RNA, 14 nt, Homo sapiens
ugaaauaauuugug

SEQ ID NO: 1857328 - RNA, 14 nt, Homo sapiens
ugaauaacauuuaa

SEQ ID NO: 1857329 - RNA, 17 nt, Homo sapiens
ccaagaguuugagacca

SEQ ID NO: 1857330 - RNA, 20 nt, Homo sapiens
cagacacuacaugaugacuc

SEQ ID NO: 1857331 - RNA, 11 nt, Homo sapiens
aggacccugaa

SEQ ID NO: 1857332 - RNA, 11 nt, Homo sapiens
aaagugcagua

SEQ ID NO: 1857333 - RNA, 18 nt, Homo sapiens
uuuaugguguguuccuaa

SEQ ID NO: 1857334 - RNA, 18 nt, Homo sapiens
gagaaacaguuccauuca

SEQ ID NO: 1857335 - RNA, 16 nt, Homo sapiens
ccuuucuucaccaaau

SEQ ID NO: 1857336 - RNA, 17 nt, Homo sapiens
uccuuuuuaaaugacuu

SEQ ID NO: 1857337 - RNA, 18 nt, Homo sapiens
cugcucaggcccaugcua

SEQ ID NO: 1857338 - RNA, 18 nt, Homo sapiens
guacccccuucugggcau

SEQ ID NO: 1857339 - RNA, 15 nt, Homo sapiens
ggaguggccacuaag

SEQ ID NO: 1857340 - RNA, 17 nt, Homo sapiens
uaugaagaaaaaguaca

SEQ ID NO: 1857341 - RNA, 20 nt, Homo sapiens
acauucucugaccuacucga

SEQ ID NO: 1857342 - RNA, 23 nt, Homo sapiens
cugaaaaaguguuuuuacauaua

SEQ ID NO: 1857343 - RNA, 14 nt, Homo sapiens
ccucaagugccuua

SEQ ID NO: 1857344 - RNA, 18 nt, Homo sapiens
gaggagggggcccggcug

SEQ ID NO: 1857345 - RNA, 20 nt, Homo sapiens
gguuucugagcugcucugaa

SEQ ID NO: 1857346 - RNA, 18 nt, Homo sapiens
uccuaauuccacagcugc

SEQ ID NO: 1857347 - RNA, 15 nt, Homo sapiens
uaaucaaugcaauau

SEQ ID NO: 1857348 - RNA, 23 nt, Homo sapiens
gcugagauuacagacaugagccu

SEQ ID NO: 1857349 - RNA, 20 nt, Homo sapiens
aacggguagcagcagaugua

SEQ ID NO: 1857350 - RNA, 16 nt, Homo sapiens
aacugagagucauaua

SEQ ID NO: 1857351 - RNA, 22 nt, Homo sapiens
uaaacuuucccuauacuuaggc

SEQ ID NO: 1857352 - RNA, 16 nt, Homo sapiens
agccccugaaagccau

SEQ ID NO: 1857353 - RNA, 20 nt, Homo sapiens
ccacuucuaagaaaagccua

SEQ ID NO: 1857354 - RNA, 17 nt, Homo sapiens
cagugccagcaccugcc

SEQ ID NO: 1857355 - RNA, 14 nt, Homo sapiens
gcuacaacauguga

SEQ ID NO: 1857356 - RNA, 14 nt, Homo sapiens
auaugaaagucuua

SEQ ID NO: 1857357 - RNA, 18 nt, Homo sapiens
auuauuggauucacaccc

SEQ ID NO: 1857358 - RNA, 19 nt, Homo sapiens
uacuguaggaacaagcaug

SEQ ID NO: 1857359 - RNA, 22 nt, Homo sapiens
agguucacucauugacaugaua

SEQ ID NO: 1857360 - RNA, 14 nt, Homo sapiens
ccuggggcuucuga

SEQ ID NO: 1857361 - RNA, 17 nt, Homo sapiens
uccuaucccaucccauc

SEQ ID NO: 1857362 - RNA, 23 nt, Homo sapiens
cuguuuguugccccauuccuaag

SEQ ID NO: 1857363 - RNA, 15 nt, Homo sapiens
ccacauugcacuucu

SEQ ID NO: 1857364 - RNA, 22 nt, Homo sapiens
ucaaauauguagauugccuuug

SEQ ID NO: 1857365 - RNA, 14 nt, Homo sapiens
acuagccuggccag

SEQ ID NO: 1857366 - RNA, 19 nt, Homo sapiens
uuaauccuguuuuuagugc

SEQ ID NO: 1857367 - RNA, 20 nt, Homo sapiens
ggcucuaggacccccagugc

SEQ ID NO: 1857368 - RNA, 16 nt, Homo sapiens
uaaucuucucucuuga

SEQ ID NO: 1857369 - RNA, 17 nt, Homo sapiens
caugaauccaguccaga

SEQ ID NO: 1857370 - RNA, 16 nt, Homo sapiens
ggagaguucaauggcu

SEQ ID NO: 1857371 - RNA, 21 nt, Homo sapiens
agugcuguccaugcuucucau

SEQ ID NO: 1857372 - RNA, 15 nt, Homo sapiens
gaaugccacugccuu

SEQ ID NO: 1857373 - RNA, 19 nt, Homo sapiens
aucacucucaccuuccaaa

SEQ ID NO: 1857374 - RNA, 18 nt, Homo sapiens
caguguaaauucagucuu

SEQ ID NO: 1857375 - RNA, 15 nt, Homo sapiens
caaggugggggagcc

SEQ ID NO: 1857376 - RNA, 15 nt, Homo sapiens
cgcacggcagccaca

SEQ ID NO: 1857377 - RNA, 13 nt, Homo sapiens
gcagcacugugag

SEQ ID NO: 1857378 - RNA, 21 nt, Homo sapiens
gccuuuaguuuuaacaguuca

SEQ ID NO: 1857379 - RNA, 23 nt, Homo sapiens
aacccuuucauaaagucuugccu

SEQ ID NO: 1857380 - RNA, 17 nt, Homo sapiens
aaggucccaugcuccac

SEQ ID NO: 1857381 - RNA, 14 nt, Homo sapiens
gacucagccuugca

SEQ ID NO: 1857382 - RNA, 22 nt, Homo sapiens
ccauccagccgcugcacaucac

SEQ ID NO: 1857383 - RNA, 22 nt, Homo sapiens
ugaacacuugaagccaucuaaa

SEQ ID NO: 1857384 - RNA, 16 nt, Homo sapiens
aaggucucuaaagcau

SEQ ID NO: 1857385 - RNA, 20 nt, Homo sapiens
uuugaguagauauuacuuua

SEQ ID NO: 1857386 - RNA, 18 nt, Homo sapiens
ggcccugccguuuccccu

SEQ ID NO: 1857387 - RNA, 13 nt, Homo sapiens
augacccaaagac

SEQ ID NO: 1857388 - RNA, 13 nt, Homo sapiens
uuaaaccauaaaa

SEQ ID NO: 1857389 - RNA, 20 nt, Homo sapiens
gcaggugcuggagcacuggg

SEQ ID NO: 1857390 - RNA, 16 nt, Homo sapiens
uccuuaccgugggcac

SEQ ID NO: 1857391 - RNA, 14 nt, Homo sapiens
agcaggucaccuag

SEQ ID NO: 1857392 - RNA, 14 nt, Homo sapiens
cuuugaagccucag

SEQ ID NO: 1857393 - RNA, 14 nt, Homo sapiens
cuccagagcccuga

SEQ ID NO: 1857394 - RNA, 18 nt, Homo sapiens
aaauaaaacauuuucucu

SEQ ID NO: 1857395 - RNA, 14 nt, Homo sapiens
cacacguccauguu

SEQ ID NO: 1857396 - RNA, 22 nt, Homo sapiens
gugcaguacuuugugcauucug

SEQ ID NO: 1857397 - RNA, 19 nt, Homo sapiens
cgaagucccggcuuccacc

SEQ ID NO: 1857398 - RNA, 14 nt, Homo sapiens
acauaacauaagcu

SEQ ID NO: 1857399 - RNA, 16 nt, Homo sapiens
ccauggcccccaauaa

SEQ ID NO: 1857400 - RNA, 15 nt, Homo sapiens
auaauuggaguagau

SEQ ID NO: 1857401 - RNA, 13 nt, Homo sapiens
gucucccuaaaaa

SEQ ID NO: 1857402 - RNA, 17 nt, Homo sapiens
agccuguccugucauca

SEQ ID NO: 1857403 - RNA, 17 nt, Homo sapiens
ggccuugaagaggccaa

SEQ ID NO: 1857404 - RNA, 20 nt, Homo sapiens
ucucaacccaggagcaucca

SEQ ID NO: 1857405 - RNA, 14 nt, Homo sapiens
auacaaucauguga

SEQ ID NO: 1857406 - RNA, 19 nt, Homo sapiens
cucaaguuuuuguuuugua

SEQ ID NO: 1857407 - RNA, 19 nt, Homo sapiens
cauggacuccaggauccuc

SEQ ID NO: 1857408 - RNA, 20 nt, Homo sapiens
ucucaaauccugaugcuguu

SEQ ID NO: 1857409 - RNA, 16 nt, Homo sapiens
uauaaauuuaagcaaa

SEQ ID NO: 1857410 - RNA, 14 nt, Homo sapiens
agcuccaguggaag

SEQ ID NO: 1857411 - RNA, 20 nt, Homo sapiens
cugcagccuggcugguccuc

SEQ ID NO: 1857412 - RNA, 23 nt, Homo sapiens
aauaucguuagggugaagcauua

SEQ ID NO: 1857413 - RNA, 16 nt, Homo sapiens
auguuacucucuugca

SEQ ID NO: 1857414 - RNA, 16 nt, Homo sapiens
cagccuggaugccauc

SEQ ID NO: 1857415 - RNA, 22 nt, Homo sapiens
ccggccgccgccaggacugugu

SEQ ID NO: 1857416 - RNA, 17 nt, Homo sapiens
cacuagguuucaccucc

SEQ ID NO: 1857417 - RNA, 19 nt, Homo sapiens
aaccauucacagugcaaga

SEQ ID NO: 1857418 - RNA, 18 nt, Homo sapiens
aagagaaccaugugcuac

SEQ ID NO: 1857419 - RNA, 23 nt, Homo sapiens
ucccuccagauauacuugguucu

SEQ ID NO: 1857420 - RNA, 21 nt, Homo sapiens
cuuuaagcagcgccagugaca

SEQ ID NO: 1857421 - RNA, 20 nt, Homo sapiens
agaaaagaccccagacucag

SEQ ID NO: 1857422 - RNA, 16 nt, Homo sapiens
guuuaugcugugcuaa

SEQ ID NO: 1857423 - RNA, 20 nt, Homo sapiens
aaugcacagugaagggugau

SEQ ID NO: 1857424 - RNA, 16 nt, Homo sapiens
aaugacauuuugccaa

SEQ ID NO: 1857425 - RNA, 24 nt, Homo sapiens
cuuguuuacagcacuacucugugc

SEQ ID NO: 1857426 - RNA, 18 nt, Homo sapiens
cccacaugccaauuucag

SEQ ID NO: 1857427 - RNA, 18 nt, Homo sapiens
ugcauucguaaacaccaa

SEQ ID NO: 1857428 - RNA, 12 nt, Homo sapiens
cuggaagaugua

SEQ ID NO: 1857429 - RNA, 16 nt, Homo sapiens
ucuaggcaacauagua

SEQ ID NO: 1857430 - RNA, 16 nt, Homo sapiens
auauauuauuuaguca

SEQ ID NO: 1857431 - RNA, 15 nt, Homo sapiens
aauagcacaugauuu

SEQ ID NO: 1857432 - RNA, 13 nt, Homo sapiens
ccucuaccucucu

SEQ ID NO: 1857433 - RNA, 13 nt, Homo sapiens
uacagacccacag

SEQ ID NO: 1857434 - RNA, 16 nt, Homo sapiens
uuccucugauuugaag

SEQ ID NO: 1857435 - RNA, 22 nt, Homo sapiens
cccauccuagagaaaacuugaa

SEQ ID NO: 1857436 - RNA, 13 nt, Homo sapiens
cacagcacagcca

SEQ ID NO: 1857437 - RNA, 15 nt, Homo sapiens
ugaagcagucuugcu

SEQ ID NO: 1857438 - RNA, 14 nt, Homo sapiens
aaugagccuuacca

SEQ ID NO: 1857439 - RNA, 21 nt, Homo sapiens
ucuuugaauuuaggugauacc

SEQ ID NO: 1857440 - RNA, 23 nt, Homo sapiens
augggaucuguaaggaacuggaa

SEQ ID NO: 1857441 - RNA, 11 nt, Homo sapiens
auggcacuggc

SEQ ID NO: 1857442 - RNA, 18 nt, Homo sapiens
aaagaagggggcuuucuu

SEQ ID NO: 1857443 - RNA, 15 nt, Homo sapiens
uccagggaguccccu

SEQ ID NO: 1857444 - RNA, 15 nt, Homo sapiens
ugguccccuccucag

SEQ ID NO: 1857445 - RNA, 15 nt, Homo sapiens
ucuucccagcaauua

SEQ ID NO: 1857446 - RNA, 12 nt, Homo sapiens
accgaaggugac

SEQ ID NO: 1857447 - RNA, 14 nt, Homo sapiens
gcacacagucaccu

SEQ ID NO: 1857448 - RNA, 18 nt, Homo sapiens
ccagcuaagaaccuggaa

SEQ ID NO: 1857449 - RNA, 20 nt, Homo sapiens
cagcacgaguggccaguuca

SEQ ID NO: 1857450 - RNA, 22 nt, Homo sapiens
aagaguugcuuugccagagcag

SEQ ID NO: 1857451 - RNA, 17 nt, Homo sapiens
ugcccacccgucuucaa

SEQ ID NO: 1857452 - RNA, 16 nt, Homo sapiens
gacaagcauguugauu

SEQ ID NO: 1857453 - RNA, 16 nt, Homo sapiens
uaguguccggggaccu

SEQ ID NO: 1857454 - RNA, 17 nt, Homo sapiens
ccagaggggcggggcca

SEQ ID NO: 1857455 - RNA, 14 nt, Homo sapiens
caggagaagaacaa

SEQ ID NO: 1857456 - RNA, 15 nt, Homo sapiens
ucaauccucuaagcu

SEQ ID NO: 1857457 - RNA, 16 nt, Homo sapiens
gaaagaccuaugagca

SEQ ID NO: 1857458 - RNA, 13 nt, Homo sapiens
uccacacacagcu

SEQ ID NO: 1857459 - RNA, 11 nt, Homo sapiens
agaauggagcu

SEQ ID NO: 1857460 - RNA, 18 nt, Homo sapiens
uugcuaauuugccacagg

SEQ ID NO: 1857461 - RNA, 19 nt, Homo sapiens
cagccuaagagacugguga

SEQ ID NO: 1857462 - RNA, 14 nt, Homo sapiens
cucacaguguugcc

SEQ ID NO: 1857463 - RNA, 15 nt, Homo sapiens
ugcuauguauuugca

SEQ ID NO: 1857464 - RNA, 18 nt, Homo sapiens
uugauuuccuauguauuc

SEQ ID NO: 1857465 - RNA, 17 nt, Homo sapiens
cccuuugauucuccagu

SEQ ID NO: 1857466 - RNA, 22 nt, Homo sapiens
ucaguaggagaggaugcacagu

SEQ ID NO: 1857467 - RNA, 23 nt, Homo sapiens
cuagcuucuacccuuugucccug

SEQ ID NO: 1857468 - RNA, 19 nt, Homo sapiens
uaaaauucagaugcuguua

SEQ ID NO: 1857469 - RNA, 20 nt, Homo sapiens
cuggagugcaguggugugau

SEQ ID NO: 1857470 - RNA, 22 nt, Homo sapiens
uuaauuuccuuuuugacacuga

SEQ ID NO: 1857471 - RNA, 17 nt, Homo sapiens
acuuagauuuggcaucu

SEQ ID NO: 1857472 - RNA, 19 nt, Homo sapiens
acucucacuaugcugcuau

SEQ ID NO: 1857473 - RNA, 19 nt, Homo sapiens
aaguacaucucuacuaaaa

SEQ ID NO: 1857474 - RNA, 21 nt, Homo sapiens
uugguuuuguuuucuucacua

SEQ ID NO: 1857475 - RNA, 14 nt, Homo sapiens
cucuacucuaggga

SEQ ID NO: 1857476 - RNA, 15 nt, Homo sapiens
aaagacugagucaag

SEQ ID NO: 1857477 - RNA, 15 nt, Homo sapiens
cacgaaucuguuacc

SEQ ID NO: 1857478 - RNA, 18 nt, Homo sapiens
acgugaccucugcaagac

SEQ ID NO: 1857479 - RNA, 23 nt, Homo sapiens
gagcuggguacugacugagauaa

SEQ ID NO: 1857480 - RNA, 21 nt, Homo sapiens
gcuccuccccacuagcauuuu

SEQ ID NO: 1857481 - RNA, 14 nt, Homo sapiens
agggagagguggca

SEQ ID NO: 1857482 - RNA, 19 nt, Homo sapiens
ugagcugccuguaacuuga

SEQ ID NO: 1857483 - RNA, 15 nt, Homo sapiens
cuuugugaaucugaa

SEQ ID NO: 1857484 - RNA, 17 nt, Homo sapiens
cuggccuggaugggcuu

SEQ ID NO: 1857485 - RNA, 12 nt, Homo sapiens
gauuauucugua

SEQ ID NO: 1857486 - RNA, 19 nt, Homo sapiens
auacuuaaaaugacaaagc

SEQ ID NO: 1857487 - RNA, 16 nt, Homo sapiens
gucuuucuaacugaau

SEQ ID NO: 1857488 - RNA, 15 nt, Homo sapiens
cugaauugucuuccg

SEQ ID NO: 1857489 - RNA, 22 nt, Homo sapiens
accugaaauaaaauucauuagu

SEQ ID NO: 1857490 - RNA, 14 nt, Homo sapiens
agucuguucucaca

SEQ ID NO: 1857491 - RNA, 13 nt, Homo sapiens
ucgggcuuuucac

SEQ ID NO: 1857492 - RNA, 23 nt, Homo sapiens
cugggcaaggaggccacgugaug

SEQ ID NO: 1857493 - RNA, 17 nt, Homo sapiens
guucacuucagcuuaau

SEQ ID NO: 1857494 - RNA, 15 nt, Homo sapiens
ugggccccaucauua

SEQ ID NO: 1857495 - RNA, 10 nt, Homo sapiens
caaugaauua

SEQ ID NO: 1857496 - RNA, 21 nt, Homo sapiens
cgaucuuccucacaccacaaa

SEQ ID NO: 1857497 - RNA, 22 nt, Homo sapiens
cgaauggaagaggcaccugucc

SEQ ID NO: 1857498 - RNA, 18 nt, Homo sapiens
ccuucccucucaugacuu

SEQ ID NO: 1857499 - RNA, 15 nt, Homo sapiens
aauggugggaacccu

SEQ ID NO: 1857500 - RNA, 22 nt, Homo sapiens
aaauccuagcagacacugccuu

SEQ ID NO: 1857501 - RNA, 17 nt, Homo sapiens
augugagguguugcuaa

SEQ ID NO: 1857502 - RNA, 21 nt, Homo sapiens
ggaggucccugccaguguuua

SEQ ID NO: 1857503 - RNA, 19 nt, Homo sapiens
uucugggguugcuccgggg

SEQ ID NO: 1857504 - RNA, 15 nt, Homo sapiens
ggagguggcuguuaa

SEQ ID NO: 1857505 - RNA, 22 nt, Homo sapiens
uaguuccccaaauacaaaguua

SEQ ID NO: 1857506 - RNA, 21 nt, Homo sapiens
guucccagaaaacacauuucu

SEQ ID NO: 1857507 - RNA, 18 nt, Homo sapiens
gccugagaugcaggugau

SEQ ID NO: 1857508 - RNA, 23 nt, Homo sapiens
ggacaagcagcuggugcuccaag

SEQ ID NO: 1857509 - RNA, 16 nt, Homo sapiens
cuaaaaggaaaagguu

SEQ ID NO: 1857510 - RNA, 20 nt, Homo sapiens
aucuuuaucaugaagcacau

SEQ ID NO: 1857511 - RNA, 15 nt, Homo sapiens
cugagugacggcaac

SEQ ID NO: 1857512 - RNA, 23 nt, Homo sapiens
cuggcaaaugccugacucaguga

SEQ ID NO: 1857513 - RNA, 13 nt, Homo sapiens
uagauaaagagaa

SEQ ID NO: 1857514 - RNA, 17 nt, Homo sapiens
gcccaguuagcccggcc

SEQ ID NO: 1857515 - RNA, 21 nt, Homo sapiens
auuuaaugaaacccuauggag

SEQ ID NO: 1857516 - RNA, 23 nt, Homo sapiens
uaggauugacguaccgugcaucu

SEQ ID NO: 1857517 - RNA, 17 nt, Homo sapiens
uaugagaugccugaagc

SEQ ID NO: 1857518 - RNA, 14 nt, Homo sapiens
aaaacuauguucag

SEQ ID NO: 1857519 - RNA, 15 nt, Homo sapiens
uucucgccacugggg

SEQ ID NO: 1857520 - RNA, 23 nt, Homo sapiens
agcugucuuccuguguaccucua

SEQ ID NO: 1857521 - RNA, 18 nt, Homo sapiens
ugcccagacaaaaagcua

SEQ ID NO: 1857522 - RNA, 22 nt, Homo sapiens
cuacccuuccucaccacuuccc

SEQ ID NO: 1857523 - RNA, 13 nt, Homo sapiens
ucagugcccagca

SEQ ID NO: 1857524 - RNA, 18 nt, Homo sapiens
uauucuaaguuagacucu

SEQ ID NO: 1857525 - RNA, 17 nt, Homo sapiens
agaacuuuucgacauau

SEQ ID NO: 1857526 - RNA, 18 nt, Homo sapiens
gcuggcgucugucuucaa

SEQ ID NO: 1857527 - RNA, 21 nt, Homo sapiens
uuaaagacuuuuaugauacuu

SEQ ID NO: 1857528 - RNA, 16 nt, Homo sapiens
gcuggaaacauucacu

SEQ ID NO: 1857529 - RNA, 13 nt, Homo sapiens
guggcgugaucuc

SEQ ID NO: 1857530 - RNA, 17 nt, Homo sapiens
cuaacaauaauauuuca

SEQ ID NO: 1857531 - RNA, 20 nt, Homo sapiens
cacugccuuaccuucacuua

SEQ ID NO: 1857532 - RNA, 18 nt, Homo sapiens
agucauugaggcccugcu

SEQ ID NO: 1857533 - RNA, 16 nt, Homo sapiens
ucuugcauucccagug

SEQ ID NO: 1857534 - RNA, 12 nt, Homo sapiens
ucaaaauacuuc

SEQ ID NO: 1857535 - RNA, 18 nt, Homo sapiens
auuugauaccauggcacu

SEQ ID NO: 1857536 - RNA, 16 nt, Homo sapiens
agcugccguagcuuca

SEQ ID NO: 1857537 - RNA, 14 nt, Homo sapiens
cagaugagaguaca

SEQ ID NO: 1857538 - RNA, 15 nt, Homo sapiens
cuccucaaucauagc

SEQ ID NO: 1857539 - RNA, 14 nt, Homo sapiens
auuacauauuugac

SEQ ID NO: 1857540 - RNA, 23 nt, Homo sapiens
aauguaauacuccuaagacuuau

SEQ ID NO: 1857541 - RNA, 14 nt, Homo sapiens
auucauuuugcaac

SEQ ID NO: 1857542 - RNA, 15 nt, Homo sapiens
uugcccauuuacacu

SEQ ID NO: 1857543 - RNA, 20 nt, Homo sapiens
gcuuaggauugcaaugucaa

SEQ ID NO: 1857544 - RNA, 22 nt, Homo sapiens
cuuaaggacaaagugccaaaga

SEQ ID NO: 1857545 - RNA, 20 nt, Homo sapiens
gagagccgacuccacuuuca

SEQ ID NO: 1857546 - RNA, 17 nt, Homo sapiens
aggaacccagcucucag

SEQ ID NO: 1857547 - RNA, 18 nt, Homo sapiens
gguacauaggcuucuauu

SEQ ID NO: 1857548 - RNA, 17 nt, Homo sapiens
cagugcuauuuugugcc

SEQ ID NO: 1857549 - RNA, 17 nt, Homo sapiens
uguaggcauugcaugaa

SEQ ID NO: 1857550 - RNA, 17 nt, Homo sapiens
uaaaguacaagagcuua

SEQ ID NO: 1857551 - RNA, 16 nt, Homo sapiens
gagagcauucugcucu

SEQ ID NO: 1857552 - RNA, 22 nt, Homo sapiens
agcucagugccacaaagcucaa

SEQ ID NO: 1857553 - RNA, 13 nt, Homo sapiens
cuugagagcugcu

SEQ ID NO: 1857554 - RNA, 20 nt, Homo sapiens
agaauugaggaugucccuga

SEQ ID NO: 1857555 - RNA, 13 nt, Homo sapiens
accuccucucuac

SEQ ID NO: 1857556 - RNA, 21 nt, Homo sapiens
uucccguggcuuugugcuuau

SEQ ID NO: 1857557 - RNA, 22 nt, Homo sapiens
cauuguguggucauaucuaguc

SEQ ID NO: 1857558 - RNA, 22 nt, Homo sapiens
cgagagggcuguggaggagcuc

SEQ ID NO: 1857559 - RNA, 13 nt, Homo sapiens
caaccuaugguau

SEQ ID NO: 1857560 - RNA, 22 nt, Homo sapiens
caagauggaugcgacccaagac

SEQ ID NO: 1857561 - RNA, 12 nt, Homo sapiens
cacccaggcaau

SEQ ID NO: 1857562 - RNA, 18 nt, Homo sapiens
uccuauaccggagcucca

SEQ ID NO: 1857563 - RNA, 14 nt, Homo sapiens
accuuaaucugcca

SEQ ID NO: 1857564 - RNA, 13 nt, Homo sapiens
augaguugguucu

SEQ ID NO: 1857565 - RNA, 22 nt, Homo sapiens
accauacuauauuaaacacauu

SEQ ID NO: 1857566 - RNA, 17 nt, Homo sapiens
agccgggcaugguggca

SEQ ID NO: 1857567 - RNA, 16 nt, Homo sapiens
uauugcgaaugugcag

SEQ ID NO: 1857568 - RNA, 18 nt, Homo sapiens
cuugaucaugaaucacug

SEQ ID NO: 1857569 - RNA, 16 nt, Homo sapiens
gggcaacuauucauga

SEQ ID NO: 1857570 - RNA, 16 nt, Homo sapiens
acgugccuaccucuua

SEQ ID NO: 1857571 - RNA, 20 nt, Homo sapiens
ucccuauuagauacacuucu

SEQ ID NO: 1857572 - RNA, 23 nt, Homo sapiens
guaacuugcuuaaauuucuuaug

SEQ ID NO: 1857573 - RNA, 22 nt, Homo sapiens
cucccuauuaaccuagagauug

SEQ ID NO: 1857574 - RNA, 17 nt, Homo sapiens
ccaaggcuccugaccua

SEQ ID NO: 1857575 - RNA, 14 nt, Homo sapiens
gcugguacuaagag

SEQ ID NO: 1857576 - RNA, 14 nt, Homo sapiens
aauaaugauaguua

SEQ ID NO: 1857577 - RNA, 23 nt, Homo sapiens
uugaaauguuuaauaaagcuuua

SEQ ID NO: 1857578 - RNA, 18 nt, Homo sapiens
gaauauuuauaggccagg

SEQ ID NO: 1857579 - RNA, 15 nt, Homo sapiens
cuugcucugucuccc

SEQ ID NO: 1857580 - RNA, 14 nt, Homo sapiens
agugaaggauuuau

SEQ ID NO: 1857581 - RNA, 16 nt, Homo sapiens
cccugacucuuagccc

SEQ ID NO: 1857582 - RNA, 17 nt, Homo sapiens
gcacaaagaugugcaaa

SEQ ID NO: 1857583 - RNA, 19 nt, Homo sapiens
ugugaggcggcccugacca

SEQ ID NO: 1857584 - RNA, 20 nt, Homo sapiens
aaccaaaccaaaucauacuu

SEQ ID NO: 1857585 - RNA, 22 nt, Homo sapiens
cuucucuugggaacuccacucu

SEQ ID NO: 1857586 - RNA, 15 nt, Homo sapiens
uguggcugauuucaa

SEQ ID NO: 1857587 - RNA, 21 nt, Homo sapiens
guggcccccugugccagcuca

SEQ ID NO: 1857588 - RNA, 12 nt, Homo sapiens
cuuacagaauua

SEQ ID NO: 1857589 - RNA, 21 nt, Homo sapiens
ugucuccagggcccccaccga

SEQ ID NO: 1857590 - RNA, 20 nt, Homo sapiens
caaagggagcagaacugaac

SEQ ID NO: 1857591 - RNA, 12 nt, Homo sapiens
aacuccaucuca

SEQ ID NO: 1857592 - RNA, 20 nt, Homo sapiens
gacugaccccagugguaucc

SEQ ID NO: 1857593 - RNA, 21 nt, Homo sapiens
auguguguuucuguccuguaa

SEQ ID NO: 1857594 - RNA, 18 nt, Homo sapiens
cuccuccaaaggcccccu

SEQ ID NO: 1857595 - RNA, 18 nt, Homo sapiens
ggaggucagcacaagaua

SEQ ID NO: 1857596 - RNA, 14 nt, Homo sapiens
agcuguuuccauag

SEQ ID NO: 1857597 - RNA, 22 nt, Homo sapiens
uuguucaggccaucgacaugua

SEQ ID NO: 1857598 - RNA, 20 nt, Homo sapiens
uacaaaacugcuuugugcau

SEQ ID NO: 1857599 - RNA, 21 nt, Homo sapiens
ugcccccuguggaugcugcug

SEQ ID NO: 1857600 - RNA, 16 nt, Homo sapiens
auuauccuguuacuga

SEQ ID NO: 1857601 - RNA, 16 nt, Homo sapiens
cauuaggaaacacuga

SEQ ID NO: 1857602 - RNA, 22 nt, Homo sapiens
uagaauacuaauaaaauacaua

SEQ ID NO: 1857603 - RNA, 16 nt, Homo sapiens
auggcuucacauucau

SEQ ID NO: 1857604 - RNA, 18 nt, Homo sapiens
gucccucacguuucuucc

SEQ ID NO: 1857605 - RNA, 16 nt, Homo sapiens
ugagggagaugccaug

SEQ ID NO: 1857606 - RNA, 12 nt, Homo sapiens
uaccaaagccca

SEQ ID NO: 1857607 - RNA, 21 nt, Homo sapiens
gcauauuauaucagacugcuu

SEQ ID NO: 1857608 - RNA, 16 nt, Homo sapiens
cagauuuuacaaaaga

SEQ ID NO: 1857609 - RNA, 15 nt, Homo sapiens
ucccuauucugccau

SEQ ID NO: 1857610 - RNA, 23 nt, Homo sapiens
gcccacccccagucuccagggac

SEQ ID NO: 1857611 - RNA, 14 nt, Homo sapiens
caugucacaugcca

SEQ ID NO: 1857612 - RNA, 17 nt, Homo sapiens
aaauguguauaaaguaa

SEQ ID NO: 1857613 - RNA, 13 nt, Homo sapiens
cguggcagugcuu

SEQ ID NO: 1857614 - RNA, 23 nt, Homo sapiens
aauuagccaguaauccuguagga

SEQ ID NO: 1857615 - RNA, 22 nt, Homo sapiens
uuucacuuugggauauggucuu

SEQ ID NO: 1857616 - RNA, 16 nt, Homo sapiens
caacuuugagaacaaa

SEQ ID NO: 1857617 - RNA, 21 nt, Homo sapiens
caaaggcuuauuaauuugacu

SEQ ID NO: 1857618 - RNA, 20 nt, Homo sapiens
ugggaccgaugcaguaucag

SEQ ID NO: 1857619 - RNA, 20 nt, Homo sapiens
cuaaagcagggaagugacag

SEQ ID NO: 1857620 - RNA, 16 nt, Homo sapiens
ucaggccagugcaccc

SEQ ID NO: 1857621 - RNA, 21 nt, Homo sapiens
cacugacuauuacaguugcau

SEQ ID NO: 1857622 - RNA, 21 nt, Homo sapiens
cucuccacaaggggauuuugc

SEQ ID NO: 1857623 - RNA, 19 nt, Homo sapiens
uggccuuccacgucuuccu

SEQ ID NO: 1857624 - RNA, 17 nt, Homo sapiens
uccaaauguggccucca

SEQ ID NO: 1857625 - RNA, 12 nt, Homo sapiens
gguagcacuuua

SEQ ID NO: 1857626 - RNA, 14 nt, Homo sapiens
aguaugugccagga

SEQ ID NO: 1857627 - RNA, 19 nt, Homo sapiens
uucuccaggcccucagaug

SEQ ID NO: 1857628 - RNA, 18 nt, Homo sapiens
uaaaauguuuaaugguga

SEQ ID NO: 1857629 - RNA, 19 nt, Homo sapiens
gugggcuccugacaauacu

SEQ ID NO: 1857630 - RNA, 21 nt, Homo sapiens
cauaguuugaauucaugccuc

SEQ ID NO: 1857631 - RNA, 15 nt, Homo sapiens
uuggcuggacuguag

SEQ ID NO: 1857632 - RNA, 16 nt, Homo sapiens
cugggucucugcaaac

SEQ ID NO: 1857633 - RNA, 17 nt, Homo sapiens
ugacauuuaaacucagc

SEQ ID NO: 1857634 - RNA, 23 nt, Homo sapiens
ccugggguuguucacaccacagg

SEQ ID NO: 1857635 - RNA, 12 nt, Homo sapiens
ucauggauuuuc

SEQ ID NO: 1857636 - RNA, 15 nt, Homo sapiens
caaaggagacauauc

SEQ ID NO: 1857637 - RNA, 20 nt, Homo sapiens
ugguuuuauuucaaagggaa

SEQ ID NO: 1857638 - RNA, 12 nt, Homo sapiens
ugaagucuggaa

SEQ ID NO: 1857639 - RNA, 23 nt, Homo sapiens
uggaugcugagagaccucaggga

SEQ ID NO: 1857640 - RNA, 20 nt, Homo sapiens
aaagcuaccaucacuuccuc

SEQ ID NO: 1857641 - RNA, 23 nt, Homo sapiens
cccucagaaacccuucagugcua

SEQ ID NO: 1857642 - RNA, 21 nt, Homo sapiens
ugggaauagggagacagggua

SEQ ID NO: 1857643 - RNA, 19 nt, Homo sapiens
gaauaaaguacuacaucag

SEQ ID NO: 1857644 - RNA, 15 nt, Homo sapiens
agagugaauuugacc

SEQ ID NO: 1857645 - RNA, 19 nt, Homo sapiens
acuccacuuggacaugggc

SEQ ID NO: 1857646 - RNA, 22 nt, Homo sapiens
gacugcuauucuagagcuuuua

SEQ ID NO: 1857647 - RNA, 22 nt, Homo sapiens
acaguaguaccaaaugcuuuaa

SEQ ID NO: 1857648 - RNA, 13 nt, Homo sapiens
auucuagagucuc

SEQ ID NO: 1857649 - RNA, 17 nt, Homo sapiens
ucuaauuuauuaaucua

SEQ ID NO: 1857650 - RNA, 18 nt, Homo sapiens
agccuccggcggggaccc

SEQ ID NO: 1857651 - RNA, 23 nt, Homo sapiens
agacuguuuauuaccagauucac

SEQ ID NO: 1857652 - RNA, 19 nt, Homo sapiens
uggcaaagaugaucaguau

SEQ ID NO: 1857653 - RNA, 19 nt, Homo sapiens
auacuaaauaaaacaaugu

SEQ ID NO: 1857654 - RNA, 22 nt, Homo sapiens
aauugacuucuauuuuccuuaa

SEQ ID NO: 1857655 - RNA, 18 nt, Homo sapiens
uugagucauauugaggca

SEQ ID NO: 1857656 - RNA, 14 nt, Homo sapiens
acauuuaaauucca

SEQ ID NO: 1857657 - RNA, 21 nt, Homo sapiens
gcagccuccucugugacuccc

SEQ ID NO: 1857658 - RNA, 13 nt, Homo sapiens
cauagagugugau

SEQ ID NO: 1857659 - RNA, 18 nt, Homo sapiens
uagaauaggcuguguauu

SEQ ID NO: 1857660 - RNA, 16 nt, Homo sapiens
gagcucuugcuaucuc

SEQ ID NO: 1857661 - RNA, 22 nt, Homo sapiens
aggaggugcuaucgcaccacug

SEQ ID NO: 1857662 - RNA, 16 nt, Homo sapiens
uaugcagcugugauac

SEQ ID NO: 1857663 - RNA, 21 nt, Homo sapiens
uauugaggaaaauuaauauca

SEQ ID NO: 1857664 - RNA, 18 nt, Homo sapiens
uuccuucuuuaaacacuc

SEQ ID NO: 1857665 - RNA, 20 nt, Homo sapiens
gauggagcaggucuuuggga

SEQ ID NO: 1857666 - RNA, 16 nt, Homo sapiens
ucuccccgcuaaggaa

SEQ ID NO: 1857667 - RNA, 22 nt, Homo sapiens
auucuuguuugaauuccuccuc

SEQ ID NO: 1857668 - RNA, 19 nt, Homo sapiens
uucacgacaguacuuucaa

SEQ ID NO: 1857669 - RNA, 20 nt, Homo sapiens
uagcaucuucucauucccau

SEQ ID NO: 1857670 - RNA, 16 nt, Homo sapiens
ugagggaugcuggaac

SEQ ID NO: 1857671 - RNA, 18 nt, Homo sapiens
ucaugccuguaaucccag

SEQ ID NO: 1857672 - RNA, 18 nt, Homo sapiens
ccuguucucagcauccac

SEQ ID NO: 1857673 - RNA, 17 nt, Homo sapiens
gaggccaagauccccuc

SEQ ID NO: 1857674 - RNA, 16 nt, Homo sapiens
acaucaaaacuuaaga

SEQ ID NO: 1857675 - RNA, 20 nt, Homo sapiens
aguuaaacuugaugccagug

SEQ ID NO: 1857676 - RNA, 23 nt, Homo sapiens
gcugugcccagcaggcccagcau

SEQ ID NO: 1857677 - RNA, 17 nt, Homo sapiens
auuuucugugccaaagc

SEQ ID NO: 1857678 - RNA, 13 nt, Homo sapiens
agaacaguaggau

SEQ ID NO: 1857679 - RNA, 13 nt, Homo sapiens
aaugcaugauaau

SEQ ID NO: 1857680 - RNA, 22 nt, Homo sapiens
gucauagcaagcuuuugcucaa

SEQ ID NO: 1857681 - RNA, 22 nt, Homo sapiens
uccugcugcccuuaggccacau

SEQ ID NO: 1857682 - RNA, 15 nt, Homo sapiens
ccugguacaaaugca

SEQ ID NO: 1857683 - RNA, 23 nt, Homo sapiens
agaaucuguugaguugcugccac

SEQ ID NO: 1857684 - RNA, 16 nt, Homo sapiens
uccaggguaccuuuga

SEQ ID NO: 1857685 - RNA, 16 nt, Homo sapiens
aucuguuuuucaugua

SEQ ID NO: 1857686 - RNA, 14 nt, Homo sapiens
uacuuacuucuggc

SEQ ID NO: 1857687 - RNA, 16 nt, Homo sapiens
ccuuaaaccugcaaaa

SEQ ID NO: 1857688 - RNA, 20 nt, Homo sapiens
gauuuccauuugcaacagga

SEQ ID NO: 1857689 - RNA, 16 nt, Homo sapiens
aacauaucuuuaucuu

SEQ ID NO: 1857690 - RNA, 23 nt, Homo sapiens
guggucacagcuguauagcugcu

SEQ ID NO: 1857691 - RNA, 16 nt, Homo sapiens
uaaaauggcauuuagc

SEQ ID NO: 1857692 - RNA, 20 nt, Homo sapiens
ucagaauggaaagaaacuca

SEQ ID NO: 1857693 - RNA, 19 nt, Homo sapiens
aaacaaucuuagacauuua

SEQ ID NO: 1857694 - RNA, 15 nt, Homo sapiens
ucugcuguugauucc

SEQ ID NO: 1857695 - RNA, 20 nt, Homo sapiens
ugaguagcucugccuuugcu

SEQ ID NO: 1857696 - RNA, 15 nt, Homo sapiens
ccucgcuucagccac

SEQ ID NO: 1857697 - RNA, 14 nt, Homo sapiens
cuuuguacagacaa

SEQ ID NO: 1857698 - RNA, 12 nt, Homo sapiens
caaucacaaaag

SEQ ID NO: 1857699 - RNA, 22 nt, Homo sapiens
cauuucaaaagguauuuauuga

SEQ ID NO: 1857700 - RNA, 16 nt, Homo sapiens
acuaugacuacacaga

SEQ ID NO: 1857701 - RNA, 12 nt, Homo sapiens
caaaugcucaag

SEQ ID NO: 1857702 - RNA, 14 nt, Homo sapiens
caaaagggguaauu

SEQ ID NO: 1857703 - RNA, 15 nt, Homo sapiens
aaccccauuccugug

SEQ ID NO: 1857704 - RNA, 16 nt, Homo sapiens
gaauguuaacagguau

SEQ ID NO: 1857705 - RNA, 12 nt, Homo sapiens
accuccuugacu

SEQ ID NO: 1857706 - RNA, 14 nt, Homo sapiens
ugcuuccauuugac

SEQ ID NO: 1857707 - RNA, 14 nt, Homo sapiens
ugcuuacauuugaa

SEQ ID NO: 1857708 - RNA, 18 nt, Homo sapiens
cacccugucuaggcacau

SEQ ID NO: 1857709 - RNA, 17 nt, Homo sapiens
ugugugggcacgugugg

SEQ ID NO: 1857710 - RNA, 21 nt, Homo sapiens
gcaccaccaggagcagcagcc

SEQ ID NO: 1857711 - RNA, 15 nt, Homo sapiens
agugggguagguugg

SEQ ID NO: 1857712 - RNA, 19 nt, Homo sapiens
uauuucauugccuguguau

SEQ ID NO: 1857713 - RNA, 22 nt, Homo sapiens
gaaauuauuacucugucauaau

SEQ ID NO: 1857714 - RNA, 22 nt, Homo sapiens
caguauuuacucugcuccaaag

SEQ ID NO: 1857715 - RNA, 22 nt, Homo sapiens
ucaugaggaccaggguggagcu

SEQ ID NO: 1857716 - RNA, 21 nt, Homo sapiens
ugucuaggcuggaagagccaa

SEQ ID NO: 1857717 - RNA, 20 nt, Homo sapiens
cuagauguguucuaagcaau

SEQ ID NO: 1857718 - RNA, 13 nt, Homo sapiens
augcuauacugga

SEQ ID NO: 1857719 - RNA, 21 nt, Homo sapiens
cucgggaagggaagauggaug

SEQ ID NO: 1857720 - RNA, 22 nt, Homo sapiens
cucugaaguuaaaaugauuuac

SEQ ID NO: 1857721 - RNA, 14 nt, Homo sapiens
agucaauguacuug

SEQ ID NO: 1857722 - RNA, 15 nt, Homo sapiens
gucaaggaaccucaa

SEQ ID NO: 1857723 - RNA, 12 nt, Homo sapiens
uuaguaauuucu

SEQ ID NO: 1857724 - RNA, 17 nt, Homo sapiens
gggagcccccaccacaa

SEQ ID NO: 1857725 - RNA, 14 nt, Homo sapiens
ugcugcugcugcaa

SEQ ID NO: 1857726 - RNA, 18 nt, Homo sapiens
gcucaugagcgucugugg

SEQ ID NO: 1857727 - RNA, 12 nt, Homo sapiens
cagcccuuucag

SEQ ID NO: 1857728 - RNA, 22 nt, Homo sapiens
auguaaagcgggaaggacauua

SEQ ID NO: 1857729 - RNA, 16 nt, Homo sapiens
ggaaaucugaauguau

SEQ ID NO: 1857730 - RNA, 21 nt, Homo sapiens
augauggccuuacacugaaaa

SEQ ID NO: 1857731 - RNA, 19 nt, Homo sapiens
gcugccucuaccugacacu

SEQ ID NO: 1857732 - RNA, 20 nt, Homo sapiens
ugcuuacaaagaaagcacuu

SEQ ID NO: 1857733 - RNA, 16 nt, Homo sapiens
cucccaugcacacaaa

SEQ ID NO: 1857734 - RNA, 13 nt, Homo sapiens
agcacauguguaa

SEQ ID NO: 1857735 - RNA, 13 nt, Homo sapiens
uuuuaaugaucuc

SEQ ID NO: 1857736 - RNA, 24 nt, Homo sapiens
ccacgucuggccaggcacugccuu

SEQ ID NO: 1857737 - RNA, 22 nt, Homo sapiens
acuccauggcuaagaccacaga

SEQ ID NO: 1857738 - RNA, 14 nt, Homo sapiens
uccagguugaucuu

SEQ ID NO: 1857739 - RNA, 11 nt, Homo sapiens
guagggcugcu

SEQ ID NO: 1857740 - RNA, 13 nt, Homo sapiens
caugcacacagau

SEQ ID NO: 1857741 - RNA, 19 nt, Homo sapiens
uuggucacauauaugccua

SEQ ID NO: 1857742 - RNA, 13 nt, Homo sapiens
aauaugaccauuu

SEQ ID NO: 1857743 - RNA, 19 nt, Homo sapiens
cauuccaggaaaacuggga

SEQ ID NO: 1857744 - RNA, 13 nt, Homo sapiens
ucaauggugcaaa

SEQ ID NO: 1857745 - RNA, 22 nt, Homo sapiens
gagaagaaaauggaaccaggcu

SEQ ID NO: 1857746 - RNA, 16 nt, Homo sapiens
cuucagugggagaaaa

SEQ ID NO: 1857747 - RNA, 17 nt, Homo sapiens
ucuuucacuggaaugaa

SEQ ID NO: 1857748 - RNA, 19 nt, Homo sapiens
acugcaaacacaccuugga

SEQ ID NO: 1857749 - RNA, 15 nt, Homo sapiens
auguaaguacuucca

SEQ ID NO: 1857750 - RNA, 17 nt, Homo sapiens
uguacauguaguugaau

SEQ ID NO: 1857751 - RNA, 21 nt, Homo sapiens
gugagccccaggcacuuugca

SEQ ID NO: 1857752 - RNA, 15 nt, Homo sapiens
guagguagacacaaa

SEQ ID NO: 1857753 - RNA, 13 nt, Homo sapiens
auggccacugggu

SEQ ID NO: 1857754 - RNA, 23 nt, Homo sapiens
gacggacguugguucugcacuaa

SEQ ID NO: 1857755 - RNA, 16 nt, Homo sapiens
ucuuaucucagucaug

SEQ ID NO: 1857756 - RNA, 22 nt, Homo sapiens
aauuauccauuacgugcauuua

SEQ ID NO: 1857757 - RNA, 14 nt, Homo sapiens
caaaaauucaggaa

SEQ ID NO: 1857758 - RNA, 17 nt, Homo sapiens
uuacccucuuugcugca

SEQ ID NO: 1857759 - RNA, 19 nt, Homo sapiens
ggaacaggguuacuguaua

SEQ ID NO: 1857760 - RNA, 17 nt, Homo sapiens
cuacauuuugcucugug

SEQ ID NO: 1857761 - RNA, 23 nt, Homo sapiens
cugaggugugugccacucagaga

SEQ ID NO: 1857762 - RNA, 16 nt, Homo sapiens
cacugucacaggcaua

SEQ ID NO: 1857763 - RNA, 15 nt, Homo sapiens
gauaggaaaaaucca

SEQ ID NO: 1857764 - RNA, 13 nt, Homo sapiens
ugucugcaauggu

SEQ ID NO: 1857765 - RNA, 18 nt, Homo sapiens
uucacacacacaguuuga

SEQ ID NO: 1857766 - RNA, 19 nt, Homo sapiens
cacaguuuugguugcuuua

SEQ ID NO: 1857767 - RNA, 23 nt, Homo sapiens
ucauccagaacuaccaccugaca

SEQ ID NO: 1857768 - RNA, 16 nt, Homo sapiens
uuuguuggucacaugg

SEQ ID NO: 1857769 - RNA, 16 nt, Homo sapiens
ucaguuccuuucaucc

SEQ ID NO: 1857770 - RNA, 17 nt, Homo sapiens
cagacucuccuucaggg

SEQ ID NO: 1857771 - RNA, 12 nt, Homo sapiens
ucugcuuguauu

SEQ ID NO: 1857772 - RNA, 15 nt, Homo sapiens
auaaugcucauacuu

SEQ ID NO: 1857773 - RNA, 20 nt, Homo sapiens
auuauugucaaagaagucau

SEQ ID NO: 1857774 - RNA, 19 nt, Homo sapiens
cacauuuuaagugcuucac

SEQ ID NO: 1857775 - RNA, 20 nt, Homo sapiens
ggcaucucccccacccugug

SEQ ID NO: 1857776 - RNA, 14 nt, Homo sapiens
auagugccuaaaau

SEQ ID NO: 1857777 - RNA, 15 nt, Homo sapiens
uuguauuaagccaau

SEQ ID NO: 1857778 - RNA, 16 nt, Homo sapiens
gagagaggagccagac

SEQ ID NO: 1857779 - RNA, 22 nt, Homo sapiens
uuauugaggaaaauuaauauca

SEQ ID NO: 1857780 - RNA, 14 nt, Homo sapiens
uaccuauaugcagu

SEQ ID NO: 1857781 - RNA, 14 nt, Homo sapiens
uccucuugccacug

SEQ ID NO: 1857782 - RNA, 19 nt, Homo sapiens
uuacugguagaaaggcagu

SEQ ID NO: 1857783 - RNA, 20 nt, Homo sapiens
ucuucccuaucuuugccacc

SEQ ID NO: 1857784 - RNA, 11 nt, Homo sapiens
aaugaauuuau

SEQ ID NO: 1857785 - RNA, 15 nt, Homo sapiens
uccauucugcaccuc

SEQ ID NO: 1857786 - RNA, 18 nt, Homo sapiens
cccauguuggccaggcug

SEQ ID NO: 1857787 - RNA, 15 nt, Homo sapiens
aguucuaguuugcau

SEQ ID NO: 1857788 - RNA, 22 nt, Homo sapiens
gcuuggacugaagggguucuca

SEQ ID NO: 1857789 - RNA, 15 nt, Homo sapiens
ucuuuaacuguguga

SEQ ID NO: 1857790 - RNA, 17 nt, Homo sapiens
cauaugccaaaauauca

SEQ ID NO: 1857791 - RNA, 18 nt, Homo sapiens
uuuucuaagaaccaaaaa

SEQ ID NO: 1857792 - RNA, 20 nt, Homo sapiens
ugacggcgcaagaccagcuu

SEQ ID NO: 1857793 - RNA, 21 nt, Homo sapiens
gagccgguccuugcugcaccu

SEQ ID NO: 1857794 - RNA, 22 nt, Homo sapiens
gcuugauauuuuccaaauggau

SEQ ID NO: 1857795 - RNA, 17 nt, Homo sapiens
gcucggaacacauucuc

SEQ ID NO: 1857796 - RNA, 19 nt, Homo sapiens
ccagcaucccuugaccagg

SEQ ID NO: 1857797 - RNA, 15 nt, Homo sapiens
cagaggucacuucau

SEQ ID NO: 1857798 - RNA, 21 nt, Homo sapiens
aaccugaauuaucuauuucau

SEQ ID NO: 1857799 - RNA, 20 nt, Homo sapiens
agcaggcccagcaugcaggu

SEQ ID NO: 1857800 - RNA, 13 nt, Homo sapiens
uuugcaguugaug

SEQ ID NO: 1857801 - RNA, 21 nt, Homo sapiens
ggauauuuacugcucuuuauu

SEQ ID NO: 1857802 - RNA, 17 nt, Homo sapiens
cuagcauuccucaggaa

SEQ ID NO: 1857803 - RNA, 17 nt, Homo sapiens
cuuuuuacaauguauca

SEQ ID NO: 1857804 - RNA, 21 nt, Homo sapiens
ugaaaacuuagagagguacaa

SEQ ID NO: 1857805 - RNA, 19 nt, Homo sapiens
aaaaccaggccuuaucucc

SEQ ID NO: 1857806 - RNA, 16 nt, Homo sapiens
ggccuguggaucaaau

SEQ ID NO: 1857807 - RNA, 21 nt, Homo sapiens
uuauauuucacccaucucuca

SEQ ID NO: 1857808 - RNA, 23 nt, Homo sapiens
agcgcgcgcgcccucuggcugcu

SEQ ID NO: 1857809 - RNA, 22 nt, Homo sapiens
ccagguggagguggcaucccca

SEQ ID NO: 1857810 - RNA, 19 nt, Homo sapiens
cauggagaacagcaugaca

SEQ ID NO: 1857811 - RNA, 17 nt, Homo sapiens
aaaccuaccacauucac

SEQ ID NO: 1857812 - RNA, 21 nt, Homo sapiens
cuccgaccacuuccaggggaa

SEQ ID NO: 1857813 - RNA, 16 nt, Homo sapiens
gcaaaauaguucugca

SEQ ID NO: 1857814 - RNA, 17 nt, Homo sapiens
ugucucuauccaucaga

SEQ ID NO: 1857815 - RNA, 12 nt, Homo sapiens
aaaguacuuucu

SEQ ID NO: 1857816 - RNA, 21 nt, Homo sapiens
cuaggcaaagacuggccugau

SEQ ID NO: 1857817 - RNA, 19 nt, Homo sapiens
agcucucuucaaugacaua

SEQ ID NO: 1857818 - RNA, 19 nt, Homo sapiens
aucucuucuuuuaaaccau

SEQ ID NO: 1857819 - RNA, 21 nt, Homo sapiens
acuguuaagaauagaaaacug

SEQ ID NO: 1857820 - RNA, 14 nt, Homo sapiens
ucuggguaucuuug

SEQ ID NO: 1857821 - RNA, 15 nt, Homo sapiens
uccaaagaaauggaa

SEQ ID NO: 1857822 - RNA, 13 nt, Homo sapiens
uauuuucacauga

SEQ ID NO: 1857823 - RNA, 13 nt, Homo sapiens
aaaaaauacagua

SEQ ID NO: 1857824 - RNA, 22 nt, Homo sapiens
acagcccuggaggccgcugcug

SEQ ID NO: 1857825 - RNA, 10 nt, Homo sapiens
acacuggguu

SEQ ID NO: 1857826 - RNA, 23 nt, Homo sapiens
uccacauggguacugucucggca

SEQ ID NO: 1857827 - RNA, 12 nt, Homo sapiens
agguaugcauuu

SEQ ID NO: 1857828 - RNA, 23 nt, Homo sapiens
cuguuaaauuuguaaacaaucua

SEQ ID NO: 1857829 - RNA, 22 nt, Homo sapiens
caaugguuugugucaaaacugg

SEQ ID NO: 1857830 - RNA, 19 nt, Homo sapiens
gcacggccaccucucaggg

SEQ ID NO: 1857831 - RNA, 16 nt, Homo sapiens
cauguauuuguuauau

SEQ ID NO: 1857832 - RNA, 13 nt, Homo sapiens
gauacucuuuaau

SEQ ID NO: 1857833 - RNA, 13 nt, Homo sapiens
uguucacugugag

SEQ ID NO: 1857834 - RNA, 19 nt, Homo sapiens
gcaaagugugucagacgag

SEQ ID NO: 1857835 - RNA, 17 nt, Homo sapiens
uuguucuaaucuuguca

SEQ ID NO: 1857836 - RNA, 14 nt, Homo sapiens
uauuauguccugug

SEQ ID NO: 1857837 - RNA, 14 nt, Homo sapiens
aucuguaugcugac

SEQ ID NO: 1857838 - RNA, 15 nt, Homo sapiens
gaagaauaaauucua

SEQ ID NO: 1857839 - RNA, 20 nt, Homo sapiens
ugcaagaucuuauuuauuaa

SEQ ID NO: 1857840 - RNA, 19 nt, Homo sapiens
aauuuuaaauuauaacuua

SEQ ID NO: 1857841 - RNA, 16 nt, Homo sapiens
cgcuagcaguacuaau

SEQ ID NO: 1857842 - RNA, 18 nt, Homo sapiens
gagcaggaccuacuagga

SEQ ID NO: 1857843 - RNA, 17 nt, Homo sapiens
ugccaggacacugccuu

SEQ ID NO: 1857844 - RNA, 13 nt, Homo sapiens
ccauacacauucu

SEQ ID NO: 1857845 - RNA, 18 nt, Homo sapiens
cuuggcuagucacauauc

SEQ ID NO: 1857846 - RNA, 17 nt, Homo sapiens
gugccauuacacuccag

SEQ ID NO: 1857847 - RNA, 13 nt, Homo sapiens
ggcaauucacaag

SEQ ID NO: 1857848 - RNA, 18 nt, Homo sapiens
gaagagaguauggugcug

SEQ ID NO: 1857849 - RNA, 18 nt, Homo sapiens
acuuacauuuacaaacug

SEQ ID NO: 1857850 - RNA, 12 nt, Homo sapiens
gcccugcugagu

SEQ ID NO: 1857851 - RNA, 17 nt, Homo sapiens
cucugagacacacccca

SEQ ID NO: 1857852 - RNA, 17 nt, Homo sapiens
caagcugugacccucaa

SEQ ID NO: 1857853 - RNA, 14 nt, Homo sapiens
uucaugccagguua

SEQ ID NO: 1857854 - RNA, 16 nt, Homo sapiens
uaacgccauccaggcu

SEQ ID NO: 1857855 - RNA, 12 nt, Homo sapiens
aucuucuuugca

SEQ ID NO: 1857856 - RNA, 19 nt, Homo sapiens
gcucccggagggcccugag

SEQ ID NO: 1857857 - RNA, 19 nt, Homo sapiens
uauggcuaauaccugucaa

SEQ ID NO: 1857858 - RNA, 17 nt, Homo sapiens
agauccggcagcacaag

SEQ ID NO: 1857859 - RNA, 16 nt, Homo sapiens
acugcagaucaagaaa

SEQ ID NO: 1857860 - RNA, 20 nt, Homo sapiens
gaacugccauaaaaucucac

SEQ ID NO: 1857861 - RNA, 17 nt, Homo sapiens
aaugcuucugcaucaaa

SEQ ID NO: 1857862 - RNA, 22 nt, Homo sapiens
agccacacucugggcuccagag

SEQ ID NO: 1857863 - RNA, 14 nt, Homo sapiens
gagaaaagcacuua

SEQ ID NO: 1857864 - RNA, 21 nt, Homo sapiens
uuguccaccaugcucucucac

SEQ ID NO: 1857865 - RNA, 20 nt, Homo sapiens
auggaaaaaaaacauugcaa

SEQ ID NO: 1857866 - RNA, 15 nt, Homo sapiens
acacuaaagagaaau

SEQ ID NO: 1857867 - RNA, 21 nt, Homo sapiens
ucaguguugacauagccuuug

SEQ ID NO: 1857868 - RNA, 18 nt, Homo sapiens
cucccaggaccuggagac

SEQ ID NO: 1857869 - RNA, 17 nt, Homo sapiens
caaaggagcuuucucaa

SEQ ID NO: 1857870 - RNA, 18 nt, Homo sapiens
aacauaaagguuauuuuc

SEQ ID NO: 1857871 - RNA, 23 nt, Homo sapiens
cagucuuuucucugaaaagcaaa

SEQ ID NO: 1857872 - RNA, 20 nt, Homo sapiens
cauugaugcugacagucaug

SEQ ID NO: 1857873 - RNA, 16 nt, Homo sapiens
cacuuugauaccauug

SEQ ID NO: 1857874 - RNA, 18 nt, Homo sapiens
ggaguugaaacugcuaua

SEQ ID NO: 1857875 - RNA, 21 nt, Homo sapiens
agagacuuggggaaauugcuu

SEQ ID NO: 1857876 - RNA, 19 nt, Homo sapiens
uuggaagaagugugugacc

SEQ ID NO: 1857877 - RNA, 11 nt, Homo sapiens
uugaauuugca

SEQ ID NO: 1857878 - RNA, 16 nt, Homo sapiens
gggagccaagggaugg

SEQ ID NO: 1857879 - RNA, 23 nt, Homo sapiens
uuauaaaauauuguuaaugccua

SEQ ID NO: 1857880 - RNA, 14 nt, Homo sapiens
ugcaacagcacuug

SEQ ID NO: 1857881 - RNA, 14 nt, Homo sapiens
aaauuuacagugau

SEQ ID NO: 1857882 - RNA, 12 nt, Homo sapiens
gcauguauucca

SEQ ID NO: 1857883 - RNA, 22 nt, Homo sapiens
cauccuuuacaccaacuccuaa

SEQ ID NO: 1857884 - RNA, 23 nt, Homo sapiens
caaccuccccgcagagcucccuu

SEQ ID NO: 1857885 - RNA, 21 nt, Homo sapiens
accuugacuugauuagugccu

SEQ ID NO: 1857886 - RNA, 20 nt, Homo sapiens
auggugggagagacugugag

SEQ ID NO: 1857887 - RNA, 20 nt, Homo sapiens
auggcagggggcugcugcug

SEQ ID NO: 1857888 - RNA, 14 nt, Homo sapiens
cugggugaucacca

SEQ ID NO: 1857889 - RNA, 18 nt, Homo sapiens
cagcugccagagaagcau

SEQ ID NO: 1857890 - RNA, 17 nt, Homo sapiens
ucugugcuuugacucac

SEQ ID NO: 1857891 - RNA, 21 nt, Homo sapiens
acuguccuaccaguugcccua

SEQ ID NO: 1857892 - RNA, 17 nt, Homo sapiens
gacccaagggaguguca

SEQ ID NO: 1857893 - RNA, 16 nt, Homo sapiens
uaccaccaugcacugu

SEQ ID NO: 1857894 - RNA, 15 nt, Homo sapiens
cugagcccuugcaca

SEQ ID NO: 1857895 - RNA, 15 nt, Homo sapiens
aaugaacugugacag

SEQ ID NO: 1857896 - RNA, 14 nt, Homo sapiens
auccuguauguaau

SEQ ID NO: 1857897 - RNA, 19 nt, Homo sapiens
uauucucaaagaugcauuu

SEQ ID NO: 1857898 - RNA, 16 nt, Homo sapiens
gacucaggacaucccc

SEQ ID NO: 1857899 - RNA, 15 nt, Homo sapiens
cuggcacuacaggca

SEQ ID NO: 1857900 - RNA, 19 nt, Homo sapiens
aucuucaaacuuucacuuu

SEQ ID NO: 1857901 - RNA, 22 nt, Homo sapiens
agcagugugucuccugcaugca

SEQ ID NO: 1857902 - RNA, 20 nt, Homo sapiens
acggugaaaccccaucucua

SEQ ID NO: 1857903 - RNA, 20 nt, Homo sapiens
uacacugcacuuuguuuaga

SEQ ID NO: 1857904 - RNA, 17 nt, Homo sapiens
uagcagaggcccugugg

SEQ ID NO: 1857905 - RNA, 18 nt, Homo sapiens
gguucucucucucugucu

SEQ ID NO: 1857906 - RNA, 22 nt, Homo sapiens
agcaagaucugcucgcugagaa

SEQ ID NO: 1857907 - RNA, 19 nt, Homo sapiens
acacugcauguuugugauu

SEQ ID NO: 1857908 - RNA, 12 nt, Homo sapiens
aaggcaaaaauc

SEQ ID NO: 1857909 - RNA, 16 nt, Homo sapiens
gauuuuuaugaugaug

SEQ ID NO: 1857910 - RNA, 15 nt, Homo sapiens
gaugagacuacuuca

SEQ ID NO: 1857911 - RNA, 16 nt, Homo sapiens
cuuuaugugagaucuc

SEQ ID NO: 1857912 - RNA, 18 nt, Homo sapiens
aacauaccagaccacucu

SEQ ID NO: 1857913 - RNA, 19 nt, Homo sapiens
ucaguaaaucagugcagua

SEQ ID NO: 1857914 - RNA, 14 nt, Homo sapiens
caugaguucaaaua

SEQ ID NO: 1857915 - RNA, 22 nt, Homo sapiens
auucacucauguuucgugugua

SEQ ID NO: 1857916 - RNA, 21 nt, Homo sapiens
agaaacaccacccauuucuac

SEQ ID NO: 1857917 - RNA, 14 nt, Homo sapiens
ucaaucuuugccua

SEQ ID NO: 1857918 - RNA, 15 nt, Homo sapiens
cuuucccgaugcgug

SEQ ID NO: 1857919 - RNA, 11 nt, Homo sapiens
gugccuuccac

SEQ ID NO: 1857920 - RNA, 14 nt, Homo sapiens
uaccuuacugaaaa

SEQ ID NO: 1857921 - RNA, 21 nt, Homo sapiens
uaggaaccuucucccuucuug

SEQ ID NO: 1857922 - RNA, 15 nt, Homo sapiens
gcauaauaaggggaa

SEQ ID NO: 1857923 - RNA, 19 nt, Homo sapiens
aauuuucuucacacuauca

SEQ ID NO: 1857924 - RNA, 16 nt, Homo sapiens
aaaggaauacauugca

SEQ ID NO: 1857925 - RNA, 16 nt, Homo sapiens
ucccaaguggugccua

SEQ ID NO: 1857926 - RNA, 13 nt, Homo sapiens
uccccagagcugu

SEQ ID NO: 1857927 - RNA, 17 nt, Homo sapiens
ggugggacucguggcug

SEQ ID NO: 1857928 - RNA, 12 nt, Homo sapiens
caauuacauuca

SEQ ID NO: 1857929 - RNA, 12 nt, Homo sapiens
accagagauuuu

SEQ ID NO: 1857930 - RNA, 13 nt, Homo sapiens
acagccucuuccu

SEQ ID NO: 1857931 - RNA, 15 nt, Homo sapiens
caaauaaguuacccu

SEQ ID NO: 1857932 - RNA, 16 nt, Homo sapiens
agauuuagcuauuuau

SEQ ID NO: 1857933 - RNA, 16 nt, Homo sapiens
acuucaauguaguuuu

SEQ ID NO: 1857934 - RNA, 17 nt, Homo sapiens
uaugcagggagcacugu

SEQ ID NO: 1857935 - RNA, 22 nt, Homo sapiens
ucaaacuuccauauuugccuug

SEQ ID NO: 1857936 - RNA, 20 nt, Homo sapiens
aggccgggcaugguggcuca

SEQ ID NO: 1857937 - RNA, 18 nt, Homo sapiens
aggagacaaagcaggagu

SEQ ID NO: 1857938 - RNA, 23 nt, Homo sapiens
uaccauggcacugacaaugggca

SEQ ID NO: 1857939 - RNA, 13 nt, Homo sapiens
gaaagacuaccuc

SEQ ID NO: 1857940 - RNA, 12 nt, Homo sapiens
agacccuaucau

SEQ ID NO: 1857941 - RNA, 17 nt, Homo sapiens
gcaucugccucuauuca

SEQ ID NO: 1857942 - RNA, 20 nt, Homo sapiens
cuaagaugagggcgcaagaa

SEQ ID NO: 1857943 - RNA, 14 nt, Homo sapiens
auuaaauggccuag

SEQ ID NO: 1857944 - RNA, 21 nt, Homo sapiens
aaaucucagaacagucugaaa

SEQ ID NO: 1857945 - RNA, 20 nt, Homo sapiens
acagugaagcagcacuguga

SEQ ID NO: 1857946 - RNA, 15 nt, Homo sapiens
caggccacccaggga

SEQ ID NO: 1857947 - RNA, 16 nt, Homo sapiens
agugagacaucaggga

SEQ ID NO: 1857948 - RNA, 20 nt, Homo sapiens
cucccauaaacacugaauua

SEQ ID NO: 1857949 - RNA, 14 nt, Homo sapiens
agcuuuccaaggaa

SEQ ID NO: 1857950 - RNA, 15 nt, Homo sapiens
uguugaccauuccaa

SEQ ID NO: 1857951 - RNA, 13 nt, Homo sapiens
acaggagauucca

SEQ ID NO: 1857952 - RNA, 14 nt, Homo sapiens
aggggugacacaga

SEQ ID NO: 1857953 - RNA, 12 nt, Homo sapiens
ugaaccauaaag

SEQ ID NO: 1857954 - RNA, 15 nt, Homo sapiens
auaaaccauaaaaua

SEQ ID NO: 1857955 - RNA, 19 nt, Homo sapiens
cuuucguaauagcucagau

SEQ ID NO: 1857956 - RNA, 21 nt, Homo sapiens
cagacacuguuugcccagugu

SEQ ID NO: 1857957 - RNA, 22 nt, Homo sapiens
uuuuaaaaaaaacuauuuaaca

SEQ ID NO: 1857958 - RNA, 15 nt, Homo sapiens
gacugaugacuuuau

SEQ ID NO: 1857959 - RNA, 18 nt, Homo sapiens
uucugcuagagcagacag

SEQ ID NO: 1857960 - RNA, 21 nt, Homo sapiens
cagaauuguucaacuuuucac

SEQ ID NO: 1857961 - RNA, 19 nt, Homo sapiens
ccauuauaaacauguuuua

SEQ ID NO: 1857962 - RNA, 18 nt, Homo sapiens
gacaugaaauacuuuaaa

SEQ ID NO: 1857963 - RNA, 14 nt, Homo sapiens
cauacauugccaau

SEQ ID NO: 1857964 - RNA, 17 nt, Homo sapiens
auguauaaagacaccuu

SEQ ID NO: 1857965 - RNA, 23 nt, Homo sapiens
accggaguuaugacaagcuuucc

SEQ ID NO: 1857966 - RNA, 17 nt, Homo sapiens
ugauguuaaccaaugua

SEQ ID NO: 1857967 - RNA, 14 nt, Homo sapiens
uuggagaaaggauu

SEQ ID NO: 1857968 - RNA, 22 nt, Homo sapiens
aacagagaagcccuuacuccug

SEQ ID NO: 1857969 - RNA, 15 nt, Homo sapiens
acugaucacuucccc

SEQ ID NO: 1857970 - RNA, 17 nt, Homo sapiens
ucugcaguacagucuua

SEQ ID NO: 1857971 - RNA, 17 nt, Homo sapiens
uaaucagucauuucuuc

SEQ ID NO: 1857972 - RNA, 16 nt, Homo sapiens
uagaucugaacuccuu

SEQ ID NO: 1857973 - RNA, 14 nt, Homo sapiens
agaaucaacauuuc

SEQ ID NO: 1857974 - RNA, 22 nt, Homo sapiens
cauaauucaggaagcagcuuuc

SEQ ID NO: 1857975 - RNA, 16 nt, Homo sapiens
auuacuuuucaucuaa

SEQ ID NO: 1857976 - RNA, 16 nt, Homo sapiens
agacccguagaugcca

SEQ ID NO: 1857977 - RNA, 14 nt, Homo sapiens
ugacuucaugcuau

SEQ ID NO: 1857978 - RNA, 21 nt, Homo sapiens
cucacuuuuuccaaaugaucc

SEQ ID NO: 1857979 - RNA, 21 nt, Homo sapiens
ucaaauacacauuugcuacug

SEQ ID NO: 1857980 - RNA, 15 nt, Homo sapiens
auucuaagucuucca

SEQ ID NO: 1857981 - RNA, 15 nt, Homo sapiens
auuucaagucucuca

SEQ ID NO: 1857982 - RNA, 14 nt, Homo sapiens
ucaccauaaccucu

SEQ ID NO: 1857983 - RNA, 13 nt, Homo sapiens
acucagcugagaa

SEQ ID NO: 1857984 - RNA, 18 nt, Homo sapiens
agaggucuucagggcucu

SEQ ID NO: 1857985 - RNA, 21 nt, Homo sapiens
guaaggccaaguacacugaga

SEQ ID NO: 1857986 - RNA, 18 nt, Homo sapiens
ucaccuggcuaacugaug

SEQ ID NO: 1857987 - RNA, 12 nt, Homo sapiens
aucugacauauu

SEQ ID NO: 1857988 - RNA, 22 nt, Homo sapiens
uuacuuuagauggcaagcaugu

SEQ ID NO: 1857989 - RNA, 11 nt, Homo sapiens
agcacaggugg

SEQ ID NO: 1857990 - RNA, 23 nt, Homo sapiens
gcaucuaagacauucaccaacaa

SEQ ID NO: 1857991 - RNA, 14 nt, Homo sapiens
accuucaacaugug

SEQ ID NO: 1857992 - RNA, 16 nt, Homo sapiens
gaaaaugcaccaaaua

SEQ ID NO: 1857993 - RNA, 21 nt, Homo sapiens
aacucuguccacgauucacuc

SEQ ID NO: 1857994 - RNA, 12 nt, Homo sapiens
acaauuccauga

SEQ ID NO: 1857995 - RNA, 16 nt, Homo sapiens
aaugaaaucuucccag

SEQ ID NO: 1857996 - RNA, 16 nt, Homo sapiens
cuuuggacauggcuca

SEQ ID NO: 1857997 - RNA, 18 nt, Homo sapiens
caaaaagccuuuuccaga

SEQ ID NO: 1857998 - RNA, 12 nt, Homo sapiens
ugaaauucucag

SEQ ID NO: 1857999 - RNA, 15 nt, Homo sapiens
agaugcuuggagcaa

SEQ ID NO: 1858000 - RNA, 12 nt, Homo sapiens
acccaaccuggc

SEQ ID NO: 1858001 - RNA, 14 nt, Homo sapiens
accaggugcucagc

SEQ ID NO: 1858002 - RNA, 11 nt, Homo sapiens
uaauccuuaac

SEQ ID NO: 1858003 - RNA, 14 nt, Homo sapiens
auaaauaugcagug

SEQ ID NO: 1858004 - RNA, 16 nt, Homo sapiens
gaggcccagcugcuca

SEQ ID NO: 1858005 - RNA, 17 nt, Homo sapiens
uugcuuaaaauugugag

SEQ ID NO: 1858006 - RNA, 10 nt, Homo sapiens
gaaaagcagg

SEQ ID NO: 1858007 - RNA, 22 nt, Homo sapiens
auugaauuuuuaagcuacuuau

SEQ ID NO: 1858008 - RNA, 20 nt, Homo sapiens
agcuuuggaauauuuuaucc

SEQ ID NO: 1858009 - RNA, 15 nt, Homo sapiens
gggaaggagugugca

SEQ ID NO: 1858010 - RNA, 14 nt, Homo sapiens
ucauugcacuuuga

SEQ ID NO: 1858011 - RNA, 21 nt, Homo sapiens
acaggugacuacccuaguuca

SEQ ID NO: 1858012 - RNA, 23 nt, Homo sapiens
ucaaacuagauuuauaaaugcac

SEQ ID NO: 1858013 - RNA, 15 nt, Homo sapiens
cugggcaauauagca

SEQ ID NO: 1858014 - RNA, 15 nt, Homo sapiens
uuuaaaaacaggaaa

SEQ ID NO: 1858015 - RNA, 23 nt, Homo sapiens
agcugcagguuuguaaugcaaaa

SEQ ID NO: 1858016 - RNA, 20 nt, Homo sapiens
auuguuaggagugguucuca

SEQ ID NO: 1858017 - RNA, 15 nt, Homo sapiens
agcuggcaggagggu

SEQ ID NO: 1858018 - RNA, 20 nt, Homo sapiens
uucucuaauguuguaucaua

SEQ ID NO: 1858019 - RNA, 13 nt, Homo sapiens
cugccccacuucu

SEQ ID NO: 1858020 - RNA, 12 nt, Homo sapiens
gaggaaaagccc

SEQ ID NO: 1858021 - RNA, 21 nt, Homo sapiens
gcuggagguugagcucuucuu

SEQ ID NO: 1858022 - RNA, 16 nt, Homo sapiens
guccauucacuuucag

SEQ ID NO: 1858023 - RNA, 22 nt, Homo sapiens
cugacaaggccagcacccaaag

SEQ ID NO: 1858024 - RNA, 17 nt, Homo sapiens
auauauuuacagaagaa

SEQ ID NO: 1858025 - RNA, 11 nt, Homo sapiens
cucaauggagu

SEQ ID NO: 1858026 - RNA, 14 nt, Homo sapiens
accccugacucauc

SEQ ID NO: 1858027 - RNA, 21 nt, Homo sapiens
guuuuaaacguuaaaagugua

SEQ ID NO: 1858028 - RNA, 22 nt, Homo sapiens
guuaaguguuuccuuccuuugu

SEQ ID NO: 1858029 - RNA, 12 nt, Homo sapiens
aaagcuaccugu

SEQ ID NO: 1858030 - RNA, 18 nt, Homo sapiens
uguggguuuuuauuuccu

SEQ ID NO: 1858031 - RNA, 19 nt, Homo sapiens
aauuuaccuaagauuacaa

SEQ ID NO: 1858032 - RNA, 19 nt, Homo sapiens
auuuauucacauauaucaa

SEQ ID NO: 1858033 - RNA, 23 nt, Homo sapiens
aacaagagcgaaacuccaucuca

SEQ ID NO: 1858034 - RNA, 15 nt, Homo sapiens
auaaacagcauuuau

SEQ ID NO: 1858035 - RNA, 21 nt, Homo sapiens
ugcacuuuagauauacauauc

SEQ ID NO: 1858036 - RNA, 22 nt, Homo sapiens
ggacuauuuacaagacugcuga

SEQ ID NO: 1858037 - RNA, 18 nt, Homo sapiens
uaaaguuuuaacuuuuau

SEQ ID NO: 1858038 - RNA, 19 nt, Homo sapiens
ccauccuucccgcagcacc

SEQ ID NO: 1858039 - RNA, 18 nt, Homo sapiens
uacugacacuuccugucc

SEQ ID NO: 1858040 - RNA, 18 nt, Homo sapiens
uuccuaaguuuaagggaa

SEQ ID NO: 1858041 - RNA, 18 nt, Homo sapiens
caacuaaaguagaauuau

SEQ ID NO: 1858042 - RNA, 21 nt, Homo sapiens
caaaccccauuagucuagccu

SEQ ID NO: 1858043 - RNA, 22 nt, Homo sapiens
guaucaggacugugaccaaagc

SEQ ID NO: 1858044 - RNA, 23 nt, Homo sapiens
uagaauagccuguggccuuugca

SEQ ID NO: 1858045 - RNA, 18 nt, Homo sapiens
uguaaugcacuccugccc

SEQ ID NO: 1858046 - RNA, 20 nt, Homo sapiens
aggcuucagugagccaugau

SEQ ID NO: 1858047 - RNA, 19 nt, Homo sapiens
ugaacucccagaaccacua

SEQ ID NO: 1858048 - RNA, 16 nt, Homo sapiens
uuguaccgcaauguga

SEQ ID NO: 1858049 - RNA, 20 nt, Homo sapiens
uauuuacucuauaaccaaau

SEQ ID NO: 1858050 - RNA, 23 nt, Homo sapiens
aacaauauuacuuugucuuuuca

SEQ ID NO: 1858051 - RNA, 14 nt, Homo sapiens
ugaaucuacauuug

SEQ ID NO: 1858052 - RNA, 17 nt, Homo sapiens
uuugagagaaauaugaa

SEQ ID NO: 1858053 - RNA, 19 nt, Homo sapiens
aaacagauuuguucauucc

SEQ ID NO: 1858054 - RNA, 21 nt, Homo sapiens
ggcuauccuggagacuuaaua

SEQ ID NO: 1858055 - RNA, 12 nt, Homo sapiens
ccuguugaagcu

SEQ ID NO: 1858056 - RNA, 20 nt, Homo sapiens
uuuccuggucagcauguacu

SEQ ID NO: 1858057 - RNA, 16 nt, Homo sapiens
caacagcauaacuaaa

SEQ ID NO: 1858058 - RNA, 21 nt, Homo sapiens
uguuaagcaaaggaaaccaaa

SEQ ID NO: 1858059 - RNA, 15 nt, Homo sapiens
ccauuggauuacuuu

SEQ ID NO: 1858060 - RNA, 15 nt, Homo sapiens
cuuuugcaauaauaa

SEQ ID NO: 1858061 - RNA, 15 nt, Homo sapiens
acagccaugcccuug

SEQ ID NO: 1858062 - RNA, 16 nt, Homo sapiens
aaggcguauguauuaa

SEQ ID NO: 1858063 - RNA, 21 nt, Homo sapiens
caugccuccaaaaauucacau

SEQ ID NO: 1858064 - RNA, 21 nt, Homo sapiens
cuccaccuuguuacacauuau

SEQ ID NO: 1858065 - RNA, 17 nt, Homo sapiens
uucaaaaacacaguguu

SEQ ID NO: 1858066 - RNA, 21 nt, Homo sapiens
caacuugugauagguaccuga

SEQ ID NO: 1858067 - RNA, 17 nt, Homo sapiens
aaauauuuaugaccuca

SEQ ID NO: 1858068 - RNA, 14 nt, Homo sapiens
cucagaaguacuuu

SEQ ID NO: 1858069 - RNA, 19 nt, Homo sapiens
cuucccuuaaaucauggua

SEQ ID NO: 1858070 - RNA, 23 nt, Homo sapiens
cucuaauucuguaggacuuugaa

SEQ ID NO: 1858071 - RNA, 22 nt, Homo sapiens
auguaugucuuggacacuguac

SEQ ID NO: 1858072 - RNA, 23 nt, Homo sapiens
ugagaaaaccuguucuaccaagc

SEQ ID NO: 1858073 - RNA, 20 nt, Homo sapiens
caccauucacauuugaugua

SEQ ID NO: 1858074 - RNA, 22 nt, Homo sapiens
auugaaaaugugaauugcauga

SEQ ID NO: 1858075 - RNA, 15 nt, Homo sapiens
augugccauagugca

SEQ ID NO: 1858076 - RNA, 21 nt, Homo sapiens
auacauaacuaaauuugauac

SEQ ID NO: 1858077 - RNA, 20 nt, Homo sapiens
agaucgaagccaaagcagcu

SEQ ID NO: 1858078 - RNA, 20 nt, Homo sapiens
caggcaugagccaccaugcc

SEQ ID NO: 1858079 - RNA, 16 nt, Homo sapiens
uauaccuuuugcauuu

SEQ ID NO: 1858080 - RNA, 19 nt, Homo sapiens
uccauauggaggccucaca

SEQ ID NO: 1858081 - RNA, 15 nt, Homo sapiens
gacaacuuagcucag

SEQ ID NO: 1858082 - RNA, 22 nt, Homo sapiens
cgugggccucccaaaacgcugg

SEQ ID NO: 1858083 - RNA, 17 nt, Homo sapiens
ucagaccaguacuggga

SEQ ID NO: 1858084 - RNA, 20 nt, Homo sapiens
uccugaggcuccacuugguc

SEQ ID NO: 1858085 - RNA, 20 nt, Homo sapiens
cuaauguggcagcugucuca

SEQ ID NO: 1858086 - RNA, 20 nt, Homo sapiens
cgucaguccaagucuucuca

SEQ ID NO: 1858087 - RNA, 16 nt, Homo sapiens
aacugcucuacuuuga

SEQ ID NO: 1858088 - RNA, 16 nt, Homo sapiens
agaaaaaaagcacaaa

SEQ ID NO: 1858089 - RNA, 20 nt, Homo sapiens
caugucuuuucuuccacugc

SEQ ID NO: 1858090 - RNA, 15 nt, Homo sapiens
ggccuccugugacug

SEQ ID NO: 1858091 - RNA, 21 nt, Homo sapiens
uguugcugccacucuacaggu

SEQ ID NO: 1858092 - RNA, 13 nt, Homo sapiens
aaauuucauagcu

SEQ ID NO: 1858093 - RNA, 23 nt, Homo sapiens
augugaauuguuaguuucugagu

SEQ ID NO: 1858094 - RNA, 15 nt, Homo sapiens
uaauucauaguaauu

SEQ ID NO: 1858095 - RNA, 18 nt, Homo sapiens
ggauuauaaacaacagaa

SEQ ID NO: 1858096 - RNA, 21 nt, Homo sapiens
aucugaguagucuguagcuug

SEQ ID NO: 1858097 - RNA, 16 nt, Homo sapiens
aggaagagcaggcacc

SEQ ID NO: 1858098 - RNA, 19 nt, Homo sapiens
caguuggacucucagggau

SEQ ID NO: 1858099 - RNA, 16 nt, Homo sapiens
augcuuacuccacuuc

SEQ ID NO: 1858100 - RNA, 18 nt, Homo sapiens
cuguaugaaugucugugg

SEQ ID NO: 1858101 - RNA, 13 nt, Homo sapiens
cuguaugucuuau

SEQ ID NO: 1858102 - RNA, 18 nt, Homo sapiens
ugaaauuguagugcaaaa

SEQ ID NO: 1858103 - RNA, 16 nt, Homo sapiens
aagccaaggucaugcc

SEQ ID NO: 1858104 - RNA, 21 nt, Homo sapiens
guugaagaagaguuugcaaau

SEQ ID NO: 1858105 - RNA, 18 nt, Homo sapiens
uugguuugcaaccucuuu

SEQ ID NO: 1858106 - RNA, 19 nt, Homo sapiens
uuguuaagugcagucugau

SEQ ID NO: 1858107 - RNA, 21 nt, Homo sapiens
uccucacccugauuucuugcu

SEQ ID NO: 1858108 - RNA, 23 nt, Homo sapiens
uuuggaaaacagcgaacagccuu

SEQ ID NO: 1858109 - RNA, 15 nt, Homo sapiens
aggccagaugcacau

SEQ ID NO: 1858110 - RNA, 16 nt, Homo sapiens
uuauagaccucuagua

SEQ ID NO: 1858111 - RNA, 14 nt, Homo sapiens
cucuggaagccucu

SEQ ID NO: 1858112 - RNA, 18 nt, Homo sapiens
cucaaagcuuccauucca

SEQ ID NO: 1858113 - RNA, 18 nt, Homo sapiens
auuaaugcuaucaaucau

SEQ ID NO: 1858114 - RNA, 20 nt, Homo sapiens
agcaccuccuaagaaggcac

SEQ ID NO: 1858115 - RNA, 19 nt, Homo sapiens
aagcuaaagccuuguugcc

SEQ ID NO: 1858116 - RNA, 18 nt, Homo sapiens
auuagccggguguggcac

SEQ ID NO: 1858117 - RNA, 21 nt, Homo sapiens
auauguauuacuuacacuaua

SEQ ID NO: 1858118 - RNA, 21 nt, Homo sapiens
ugcucugguuagaaaaaggac

SEQ ID NO: 1858119 - RNA, 15 nt, Homo sapiens
ugagaccaaccuggg

SEQ ID NO: 1858120 - RNA, 17 nt, Homo sapiens
acagcguguaaacacau

SEQ ID NO: 1858121 - RNA, 21 nt, Homo sapiens
acuacguagcuaguaagcauu

SEQ ID NO: 1858122 - RNA, 17 nt, Homo sapiens
accuguuuccuggacca

SEQ ID NO: 1858123 - RNA, 12 nt, Homo sapiens
ucauacauccua

SEQ ID NO: 1858124 - RNA, 15 nt, Homo sapiens
acaaugauacaguug

SEQ ID NO: 1858125 - RNA, 21 nt, Homo sapiens
cuguuccagguuucuuccacc

SEQ ID NO: 1858126 - RNA, 23 nt, Homo sapiens
cugugagacgaggcaggggcucu

SEQ ID NO: 1858127 - RNA, 16 nt, Homo sapiens
cacacucaguucugcu

SEQ ID NO: 1858128 - RNA, 22 nt, Homo sapiens
accaaagacuuguuaaauguau

SEQ ID NO: 1858129 - RNA, 20 nt, Homo sapiens
agcccgaacucgcggcaaaa

SEQ ID NO: 1858130 - RNA, 18 nt, Homo sapiens
ucucaugggaaggggagg

SEQ ID NO: 1858131 - RNA, 21 nt, Homo sapiens
aaugcucauuuucugguuugg

SEQ ID NO: 1858132 - RNA, 12 nt, Homo sapiens
uucuugccucau

SEQ ID NO: 1858133 - RNA, 12 nt, Homo sapiens
ucaaugccuuca

SEQ ID NO: 1858134 - RNA, 22 nt, Homo sapiens
auagaaacacuuucucacuuac

SEQ ID NO: 1858135 - RNA, 19 nt, Homo sapiens
ucaaucuuauuacugagag

SEQ ID NO: 1858136 - RNA, 18 nt, Homo sapiens
acugugugucucguguca

SEQ ID NO: 1858137 - RNA, 13 nt, Homo sapiens
caugaacaggguc

SEQ ID NO: 1858138 - RNA, 14 nt, Homo sapiens
uaaauguacaguau

SEQ ID NO: 1858139 - RNA, 22 nt, Homo sapiens
gugaucaguguugcaacauaau

SEQ ID NO: 1858140 - RNA, 16 nt, Homo sapiens
ccuucaagugccaaac

SEQ ID NO: 1858141 - RNA, 19 nt, Homo sapiens
cuuuggauacacacauagu

SEQ ID NO: 1858142 - RNA, 16 nt, Homo sapiens
gcuagggggcguuauu

SEQ ID NO: 1858143 - RNA, 22 nt, Homo sapiens
uggucccugcccucaucucucu

SEQ ID NO: 1858144 - RNA, 18 nt, Homo sapiens
cugugugucucgugucag

SEQ ID NO: 1858145 - RNA, 11 nt, Homo sapiens
gaaucauucug

SEQ ID NO: 1858146 - RNA, 13 nt, Homo sapiens
ucaacaaaucuca

SEQ ID NO: 1858147 - RNA, 21 nt, Homo sapiens
agaaaaccucuggcacauuga

SEQ ID NO: 1858148 - RNA, 14 nt, Homo sapiens
agugugaugcaauu

SEQ ID NO: 1858149 - RNA, 21 nt, Homo sapiens
auuaacuaugugauguuaacu

SEQ ID NO: 1858150 - RNA, 17 nt, Homo sapiens
ccacucauuucaucuca

SEQ ID NO: 1858151 - RNA, 19 nt, Homo sapiens
cagccuccugggacuguga

SEQ ID NO: 1858152 - RNA, 12 nt, Homo sapiens
acuacugcaguc

SEQ ID NO: 1858153 - RNA, 16 nt, Homo sapiens
uggaauguuuuaacug

SEQ ID NO: 1858154 - RNA, 14 nt, Homo sapiens
auuacguuuuacaa

SEQ ID NO: 1858155 - RNA, 18 nt, Homo sapiens
caucacuuguaccuucca

SEQ ID NO: 1858156 - RNA, 16 nt, Homo sapiens
aaguggaauccagugu

SEQ ID NO: 1858157 - RNA, 12 nt, Homo sapiens
aaugaaugacau

SEQ ID NO: 1858158 - RNA, 18 nt, Homo sapiens
ucccaaauucuaccucug

SEQ ID NO: 1858159 - RNA, 11 nt, Homo sapiens
gcauacuucua

SEQ ID NO: 1858160 - RNA, 19 nt, Homo sapiens
aaccagauggaacacugga

SEQ ID NO: 1858161 - RNA, 14 nt, Homo sapiens
accugcucugcuga

SEQ ID NO: 1858162 - RNA, 21 nt, Homo sapiens
cuaccaaagggaguguugaaa

SEQ ID NO: 1858163 - RNA, 22 nt, Homo sapiens
ugaacuggguacuuguggacac

SEQ ID NO: 1858164 - RNA, 17 nt, Homo sapiens
ccuguguugugcuggga

SEQ ID NO: 1858165 - RNA, 15 nt, Homo sapiens
uuccucugcaaaaag

SEQ ID NO: 1858166 - RNA, 15 nt, Homo sapiens
uaguuuaaaaugcag

SEQ ID NO: 1858167 - RNA, 21 nt, Homo sapiens
aucccggaagggacuuacuua

SEQ ID NO: 1858168 - RNA, 18 nt, Homo sapiens
cagccuggcgacaagagu

SEQ ID NO: 1858169 - RNA, 16 nt, Homo sapiens
acaaggcccugagcuu

SEQ ID NO: 1858170 - RNA, 14 nt, Homo sapiens
uguugcccuaauaa

SEQ ID NO: 1858171 - RNA, 19 nt, Homo sapiens
uuagaacacacacacuuac

SEQ ID NO: 1858172 - RNA, 22 nt, Homo sapiens
cuguuucugggcugucuauucu

SEQ ID NO: 1858173 - RNA, 17 nt, Homo sapiens
ggcuggcuccugaucca

SEQ ID NO: 1858174 - RNA, 15 nt, Homo sapiens
auaaaaaagaacuuu

SEQ ID NO: 1858175 - RNA, 13 nt, Homo sapiens
acaucauggacug

SEQ ID NO: 1858176 - RNA, 17 nt, Homo sapiens
gcuuggguucacagugc

SEQ ID NO: 1858177 - RNA, 22 nt, Homo sapiens
ugaaauacuuaaugccaaguaa

SEQ ID NO: 1858178 - RNA, 24 nt, Homo sapiens
auaaacacacagaucugcaucuga

SEQ ID NO: 1858179 - RNA, 21 nt, Homo sapiens
cccaugggcucccacugcagc

SEQ ID NO: 1858180 - RNA, 13 nt, Homo sapiens
uguaacugucagu

SEQ ID NO: 1858181 - RNA, 18 nt, Homo sapiens
aacuguuagcacuguuga

SEQ ID NO: 1858182 - RNA, 14 nt, Homo sapiens
accagaaauuccag

SEQ ID NO: 1858183 - RNA, 14 nt, Homo sapiens
aaugccuacugagu

SEQ ID NO: 1858184 - RNA, 15 nt, Homo sapiens
cugcagccaagcaaa

SEQ ID NO: 1858185 - RNA, 23 nt, Homo sapiens
ggggaacauuucuguaaauacca

SEQ ID NO: 1858186 - RNA, 15 nt, Homo sapiens
ucuccaaauacugau

SEQ ID NO: 1858187 - RNA, 15 nt, Homo sapiens
uggaaaaugugcaau

SEQ ID NO: 1858188 - RNA, 23 nt, Homo sapiens
ccuuucuacaacugauugcaaca

SEQ ID NO: 1858189 - RNA, 18 nt, Homo sapiens
cuaagagauuugcuuuuu

SEQ ID NO: 1858190 - RNA, 20 nt, Homo sapiens
uacauuuguauuuugugaug

SEQ ID NO: 1858191 - RNA, 17 nt, Homo sapiens
aucucucaaaacaauau

SEQ ID NO: 1858192 - RNA, 21 nt, Homo sapiens
guucucucucucugucucucu

SEQ ID NO: 1858193 - RNA, 17 nt, Homo sapiens
cacaccccagacgaugu

SEQ ID NO: 1858194 - RNA, 21 nt, Homo sapiens
gcagucgaugcguucacucca

SEQ ID NO: 1858195 - RNA, 15 nt, Homo sapiens
uauuaauuuccacua

SEQ ID NO: 1858196 - RNA, 14 nt, Homo sapiens
ugaaaaauguauau

SEQ ID NO: 1858197 - RNA, 21 nt, Homo sapiens
aaacagcagauuucagaucau

SEQ ID NO: 1858198 - RNA, 13 nt, Homo sapiens
cuaccacaguccg

SEQ ID NO: 1858199 - RNA, 13 nt, Homo sapiens
ccaagacagccac

SEQ ID NO: 1858200 - RNA, 14 nt, Homo sapiens
cagauggauugaua

SEQ ID NO: 1858201 - RNA, 18 nt, Homo sapiens
caagcagcauucagcaca

SEQ ID NO: 1858202 - RNA, 20 nt, Homo sapiens
caguaccuccugccccaugc

SEQ ID NO: 1858203 - RNA, 15 nt, Homo sapiens
cacacucuucaguga

SEQ ID NO: 1858204 - RNA, 11 nt, Homo sapiens
auaguauuaag

SEQ ID NO: 1858205 - RNA, 19 nt, Homo sapiens
gcuggagugcaguggcaca

SEQ ID NO: 1858206 - RNA, 13 nt, Homo sapiens
ggccccugugcag

SEQ ID NO: 1858207 - RNA, 15 nt, Homo sapiens
ggacugguuugggga

SEQ ID NO: 1858208 - RNA, 17 nt, Homo sapiens
gacacugccacucuccc

SEQ ID NO: 1858209 - RNA, 15 nt, Homo sapiens
cugugccagcacaaa

SEQ ID NO: 1858210 - RNA, 17 nt, Homo sapiens
cuucuaccuuccugcaa

SEQ ID NO: 1858211 - RNA, 16 nt, Homo sapiens
aucuggugcucaauaa

SEQ ID NO: 1858212 - RNA, 17 nt, Homo sapiens
uaaauagaacaaccugc

SEQ ID NO: 1858213 - RNA, 18 nt, Homo sapiens
auauuauaaauaaaugcc

SEQ ID NO: 1858214 - RNA, 18 nt, Homo sapiens
ccuauuuucuuuuccauu

SEQ ID NO: 1858215 - RNA, 23 nt, Homo sapiens
cagcagcuauuugaaugagauga

SEQ ID NO: 1858216 - RNA, 13 nt, Homo sapiens
cucccaagcacuu

SEQ ID NO: 1858217 - RNA, 13 nt, Homo sapiens
uaccuaaguucuc

SEQ ID NO: 1858218 - RNA, 14 nt, Homo sapiens
aucagcugcuacua

SEQ ID NO: 1858219 - RNA, 18 nt, Homo sapiens
aaauuaaauugcagaugg

SEQ ID NO: 1858220 - RNA, 21 nt, Homo sapiens
cacuugucacugacacaaagg

SEQ ID NO: 1858221 - RNA, 19 nt, Homo sapiens
gugauaaauuugaucccaa

SEQ ID NO: 1858222 - RNA, 17 nt, Homo sapiens
gaaaaacagaacauuuc

SEQ ID NO: 1858223 - RNA, 21 nt, Homo sapiens
ugagaguggguaaaucaggga

SEQ ID NO: 1858224 - RNA, 21 nt, Homo sapiens
caauccuagcccucauuuuaa

SEQ ID NO: 1858225 - RNA, 16 nt, Homo sapiens
cuaaccuugaaugcug

SEQ ID NO: 1858226 - RNA, 19 nt, Homo sapiens
aggcauaggcuuauucuga

SEQ ID NO: 1858227 - RNA, 16 nt, Homo sapiens
gggaauaauagcacau

SEQ ID NO: 1858228 - RNA, 20 nt, Homo sapiens
cagagacuaucugauuuccu

SEQ ID NO: 1858229 - RNA, 21 nt, Homo sapiens
ccagauucuucgcacaguguc

SEQ ID NO: 1858230 - RNA, 23 nt, Homo sapiens
uucacaaacagaaaacauguaaa

SEQ ID NO: 1858231 - RNA, 17 nt, Homo sapiens
acugaguugauauucua

SEQ ID NO: 1858232 - RNA, 19 nt, Homo sapiens
ugccaccaggcacugccug

SEQ ID NO: 1858233 - RNA, 21 nt, Homo sapiens
agcucuauguuuacaaaugga

SEQ ID NO: 1858234 - RNA, 12 nt, Homo sapiens
gaaaauuuacaa

SEQ ID NO: 1858235 - RNA, 19 nt, Homo sapiens
uuuggaggugcuugaucua

SEQ ID NO: 1858236 - RNA, 12 nt, Homo sapiens
uuccuguaagac

SEQ ID NO: 1858237 - RNA, 20 nt, Homo sapiens
gaaacaauguggagucuccc

SEQ ID NO: 1858238 - RNA, 22 nt, Homo sapiens
cauguguacuuauuacagucuu

SEQ ID NO: 1858239 - RNA, 13 nt, Homo sapiens
ccucagggccaag

SEQ ID NO: 1858240 - RNA, 11 nt, Homo sapiens
acuucuugucu

SEQ ID NO: 1858241 - RNA, 19 nt, Homo sapiens
ccauucauccuuccaucca

SEQ ID NO: 1858242 - RNA, 13 nt, Homo sapiens
guaacuacugcua

SEQ ID NO: 1858243 - RNA, 19 nt, Homo sapiens
auuuuaucugccuuagaca

SEQ ID NO: 1858244 - RNA, 15 nt, Homo sapiens
aaccccccuccccaa

SEQ ID NO: 1858245 - RNA, 12 nt, Homo sapiens
aacucucuaggg

SEQ ID NO: 1858246 - RNA, 23 nt, Homo sapiens
gaaagugugugauuucucuccca

SEQ ID NO: 1858247 - RNA, 18 nt, Homo sapiens
guucacuggagucuugua

SEQ ID NO: 1858248 - RNA, 23 nt, Homo sapiens
ugagaauugaggggagguggcca

SEQ ID NO: 1858249 - RNA, 16 nt, Homo sapiens
gaagcaguuucagaga

SEQ ID NO: 1858250 - RNA, 16 nt, Homo sapiens
uaaaauguauucuuaa

SEQ ID NO: 1858251 - RNA, 15 nt, Homo sapiens
caauggcacgcuccu

SEQ ID NO: 1858252 - RNA, 15 nt, Homo sapiens
ugggauuuucuacaa

SEQ ID NO: 1858253 - RNA, 12 nt, Homo sapiens
agaguucaggga

SEQ ID NO: 1858254 - RNA, 22 nt, Homo sapiens
uccugggcucaagcaauccucc

SEQ ID NO: 1858255 - RNA, 13 nt, Homo sapiens
cauccgcacugua

SEQ ID NO: 1858256 - RNA, 15 nt, Homo sapiens
cccaucccugucauu

SEQ ID NO: 1858257 - RNA, 23 nt, Homo sapiens
uguaauaaaucuaggaugugaug

SEQ ID NO: 1858258 - RNA, 20 nt, Homo sapiens
cagugcuccuguaagucaaa

SEQ ID NO: 1858259 - RNA, 16 nt, Homo sapiens
gauauaguaguaccuu

SEQ ID NO: 1858260 - RNA, 16 nt, Homo sapiens
aauggugauccaccca

SEQ ID NO: 1858261 - RNA, 17 nt, Homo sapiens
accuugacggcauugcu

SEQ ID NO: 1858262 - RNA, 20 nt, Homo sapiens
ccuggugggcucaaccacac

SEQ ID NO: 1858263 - RNA, 14 nt, Homo sapiens
cagucuaguuccug

SEQ ID NO: 1858264 - RNA, 19 nt, Homo sapiens
uaaaguucauccuuugacu

SEQ ID NO: 1858265 - RNA, 18 nt, Homo sapiens
uaggugcgcaguggcaug

SEQ ID NO: 1858266 - RNA, 15 nt, Homo sapiens
acaacgccuggugcc

SEQ ID NO: 1858267 - RNA, 16 nt, Homo sapiens
ggcggagguugcagua

SEQ ID NO: 1858268 - RNA, 18 nt, Homo sapiens
cugugagcauggggccag

SEQ ID NO: 1858269 - RNA, 22 nt, Homo sapiens
caggaaaaacaaaugggaaaug

SEQ ID NO: 1858270 - RNA, 19 nt, Homo sapiens
aucuuuguuguucuugaau

SEQ ID NO: 1858271 - RNA, 15 nt, Homo sapiens
auucgguaauaucau

SEQ ID NO: 1858272 - RNA, 16 nt, Homo sapiens
uuaaauuuuuccuuag

SEQ ID NO: 1858273 - RNA, 17 nt, Homo sapiens
gaguugucaagucucug

SEQ ID NO: 1858274 - RNA, 18 nt, Homo sapiens
auuaggauuuugauguga

SEQ ID NO: 1858275 - RNA, 14 nt, Homo sapiens
guagaaacucagca

SEQ ID NO: 1858276 - RNA, 14 nt, Homo sapiens
guguacagugaauu

SEQ ID NO: 1858277 - RNA, 21 nt, Homo sapiens
agacauaaccacugcuuccau

SEQ ID NO: 1858278 - RNA, 21 nt, Homo sapiens
gccauccuaggcuuaaaugca

SEQ ID NO: 1858279 - RNA, 14 nt, Homo sapiens
accaaauaccucaa

SEQ ID NO: 1858280 - RNA, 20 nt, Homo sapiens
aaugcccugccuugcugccu

SEQ ID NO: 1858281 - RNA, 16 nt, Homo sapiens
uccagaaaaugaacac

SEQ ID NO: 1858282 - RNA, 23 nt, Homo sapiens
ucacuguugcuuaauugugaaca

SEQ ID NO: 1858283 - RNA, 20 nt, Homo sapiens
auuaugauuaaucugauuau

SEQ ID NO: 1858284 - RNA, 19 nt, Homo sapiens
agagaaggacaugugcuau

SEQ ID NO: 1858285 - RNA, 18 nt, Homo sapiens
ucaggaaggggugugcug

SEQ ID NO: 1858286 - RNA, 21 nt, Homo sapiens
acuuugguucucuccaggaag

SEQ ID NO: 1858287 - RNA, 22 nt, Homo sapiens
gauuuagaaaaaaacaugaauu

SEQ ID NO: 1858288 - RNA, 16 nt, Homo sapiens
acauugguucuuucau

SEQ ID NO: 1858289 - RNA, 16 nt, Homo sapiens
uaaaagguaauaacau

SEQ ID NO: 1858290 - RNA, 18 nt, Homo sapiens
aaauuaaagggcagauau

SEQ ID NO: 1858291 - RNA, 16 nt, Homo sapiens
ccaacuggaaauucca

SEQ ID NO: 1858292 - RNA, 22 nt, Homo sapiens
cugcucccugacagcaccugaa

SEQ ID NO: 1858293 - RNA, 21 nt, Homo sapiens
augguguggccuguggcuguc

SEQ ID NO: 1858294 - RNA, 19 nt, Homo sapiens
uuaaauaccaguacuugag

SEQ ID NO: 1858295 - RNA, 15 nt, Homo sapiens
cuaugcacaccaaau

SEQ ID NO: 1858296 - RNA, 18 nt, Homo sapiens
cuuacagauccugcaguc

SEQ ID NO: 1858297 - RNA, 14 nt, Homo sapiens
cacauccagccuaa

SEQ ID NO: 1858298 - RNA, 20 nt, Homo sapiens
acaauaaauuuuuuuugguc

SEQ ID NO: 1858299 - RNA, 18 nt, Homo sapiens
cccugaaacuacacacca

SEQ ID NO: 1858300 - RNA, 16 nt, Homo sapiens
aacaugguuaccucug

SEQ ID NO: 1858301 - RNA, 15 nt, Homo sapiens
aggaaauauuuccau

SEQ ID NO: 1858302 - RNA, 18 nt, Homo sapiens
uggugcgucuaagaugag

SEQ ID NO: 1858303 - RNA, 15 nt, Homo sapiens
gugauuuccacaggu

SEQ ID NO: 1858304 - RNA, 13 nt, Homo sapiens
caaguuccagugc

SEQ ID NO: 1858305 - RNA, 14 nt, Homo sapiens
acaacacacaccaa

SEQ ID NO: 1858306 - RNA, 14 nt, Homo sapiens
ccaaaacaaaccca

SEQ ID NO: 1858307 - RNA, 12 nt, Homo sapiens
ucacacauucca

SEQ ID NO: 1858308 - RNA, 19 nt, Homo sapiens
guauuuaauacacaaugca

SEQ ID NO: 1858309 - RNA, 18 nt, Homo sapiens
uacauuuuucagacuuca

SEQ ID NO: 1858310 - RNA, 23 nt, Homo sapiens
caacuuauuguauuccucauguc

SEQ ID NO: 1858311 - RNA, 17 nt, Homo sapiens
caccuccuggguucaag

SEQ ID NO: 1858312 - RNA, 17 nt, Homo sapiens
cgccuccugaguucaag

SEQ ID NO: 1858313 - RNA, 12 nt, Homo sapiens
uuaucaucugaa

SEQ ID NO: 1858314 - RNA, 14 nt, Homo sapiens
uggaaccccagcuu

SEQ ID NO: 1858315 - RNA, 14 nt, Homo sapiens
caccucccugcaau

SEQ ID NO: 1858316 - RNA, 20 nt, Homo sapiens
accucauuguucuguacaaa

SEQ ID NO: 1858317 - RNA, 17 nt, Homo sapiens
ucucccuccaguccucu

SEQ ID NO: 1858318 - RNA, 17 nt, Homo sapiens
uggucuuuauuccuccc

SEQ ID NO: 1858319 - RNA, 13 nt, Homo sapiens
cauuagagucagc

SEQ ID NO: 1858320 - RNA, 13 nt, Homo sapiens
uguugaacaauag

SEQ ID NO: 1858321 - RNA, 13 nt, Homo sapiens
aaaugaacugaag

SEQ ID NO: 1858322 - RNA, 21 nt, Homo sapiens
augcacgcacaugccaaugca

SEQ ID NO: 1858323 - RNA, 14 nt, Homo sapiens
gaauuuggcccaga

SEQ ID NO: 1858324 - RNA, 22 nt, Homo sapiens
gaaccauguggcagaagggaua

SEQ ID NO: 1858325 - RNA, 19 nt, Homo sapiens
agggauggagcugaaaaag

SEQ ID NO: 1858326 - RNA, 14 nt, Homo sapiens
cuuuugcauugcca

SEQ ID NO: 1858327 - RNA, 16 nt, Homo sapiens
ucccugaccuucugag

SEQ ID NO: 1858328 - RNA, 16 nt, Homo sapiens
aaggguguucacccau

SEQ ID NO: 1858329 - RNA, 14 nt, Homo sapiens
cucguggguccuuu

SEQ ID NO: 1858330 - RNA, 16 nt, Homo sapiens
gucacugacaguuaau

SEQ ID NO: 1858331 - RNA, 16 nt, Homo sapiens
cacacagacaguuucu

SEQ ID NO: 1858332 - RNA, 17 nt, Homo sapiens
acucggcuuccuguggg

SEQ ID NO: 1858333 - RNA, 14 nt, Homo sapiens
cagccaggggcugc

SEQ ID NO: 1858334 - RNA, 15 nt, Homo sapiens
aucauauauauacau

SEQ ID NO: 1858335 - RNA, 18 nt, Homo sapiens
uaccuccaacccugccgu

SEQ ID NO: 1858336 - RNA, 17 nt, Homo sapiens
gaaaguuguauucucau

SEQ ID NO: 1858337 - RNA, 20 nt, Homo sapiens
gucucucuaaacccaaauaa

SEQ ID NO: 1858338 - RNA, 11 nt, Homo sapiens
aucugaauaua

SEQ ID NO: 1858339 - RNA, 20 nt, Homo sapiens
uucuggcuucagcccccacc

SEQ ID NO: 1858340 - RNA, 13 nt, Homo sapiens
ucagaugucucug

SEQ ID NO: 1858341 - RNA, 13 nt, Homo sapiens
ucagauguuucca

SEQ ID NO: 1858342 - RNA, 16 nt, Homo sapiens
ugggaagccugugcca

SEQ ID NO: 1858343 - RNA, 21 nt, Homo sapiens
aauguauuuguuugcaauuuu

SEQ ID NO: 1858344 - RNA, 17 nt, Homo sapiens
augucuugguacuugcu

SEQ ID NO: 1858345 - RNA, 13 nt, Homo sapiens
aauguccauuuau

SEQ ID NO: 1858346 - RNA, 17 nt, Homo sapiens
ccauccugucaccauga

SEQ ID NO: 1858347 - RNA, 14 nt, Homo sapiens
gucaugcaaaggcu

SEQ ID NO: 1858348 - RNA, 20 nt, Homo sapiens
aagcagaagaccagauccaa

SEQ ID NO: 1858349 - RNA, 23 nt, Homo sapiens
ggcugggcuagaaagaccacugg

SEQ ID NO: 1858350 - RNA, 14 nt, Homo sapiens
gagaggcuuuccaa

SEQ ID NO: 1858351 - RNA, 21 nt, Homo sapiens
uaaaaaaugagcuuccauuaa

SEQ ID NO: 1858352 - RNA, 21 nt, Homo sapiens
accauuccaggaaaacuggga

SEQ ID NO: 1858353 - RNA, 16 nt, Homo sapiens
aacauauuuaagagau

SEQ ID NO: 1858354 - RNA, 15 nt, Homo sapiens
ccugggccacuggca

SEQ ID NO: 1858355 - RNA, 12 nt, Homo sapiens
uaaccacugugg

SEQ ID NO: 1858356 - RNA, 23 nt, Homo sapiens
caaugccuuuuugauuacagugu

SEQ ID NO: 1858357 - RNA, 16 nt, Homo sapiens
aagagccugacugugu

SEQ ID NO: 1858358 - RNA, 20 nt, Homo sapiens
aaacaccaagugaggccaua

SEQ ID NO: 1858359 - RNA, 16 nt, Homo sapiens
aaccauccagugacaa

SEQ ID NO: 1858360 - RNA, 19 nt, Homo sapiens
auaaggugccucaguuuuc

SEQ ID NO: 1858361 - RNA, 21 nt, Homo sapiens
uagauucucugugucuaagau

SEQ ID NO: 1858362 - RNA, 22 nt, Homo sapiens
cauccucacugccguccucagg

SEQ ID NO: 1858363 - RNA, 13 nt, Homo sapiens
acugcagcugucu

SEQ ID NO: 1858364 - RNA, 21 nt, Homo sapiens
agaaaauguaaaggagggaga

SEQ ID NO: 1858365 - RNA, 17 nt, Homo sapiens
gcaagacuucacugcag

SEQ ID NO: 1858366 - RNA, 17 nt, Homo sapiens
aggaucuuuauugguga

SEQ ID NO: 1858367 - RNA, 20 nt, Homo sapiens
uucgagaccagccuggccaa

SEQ ID NO: 1858368 - RNA, 15 nt, Homo sapiens
ggcucccagggccau

SEQ ID NO: 1858369 - RNA, 23 nt, Homo sapiens
ugccccaguagaguuagcugaua

SEQ ID NO: 1858370 - RNA, 14 nt, Homo sapiens
cauggccaccacca

SEQ ID NO: 1858371 - RNA, 14 nt, Homo sapiens
gacaacuuccucuc

SEQ ID NO: 1858372 - RNA, 21 nt, Homo sapiens
cguggaccacccgcccuggca

SEQ ID NO: 1858373 - RNA, 21 nt, Homo sapiens
uugcauggauuucuuugaaaa

SEQ ID NO: 1858374 - RNA, 11 nt, Homo sapiens
ugucaguucuc

SEQ ID NO: 1858375 - RNA, 18 nt, Homo sapiens
ucacaggacaugcuuugu

SEQ ID NO: 1858376 - RNA, 19 nt, Homo sapiens
gggcugaguggucugacac

SEQ ID NO: 1858377 - RNA, 14 nt, Homo sapiens
ucucaguccucaaa

SEQ ID NO: 1858378 - RNA, 15 nt, Homo sapiens
acaccuacucuauca

SEQ ID NO: 1858379 - RNA, 15 nt, Homo sapiens
agaaauguauccuga

SEQ ID NO: 1858380 - RNA, 19 nt, Homo sapiens
uugcccccagauacauggu

SEQ ID NO: 1858381 - RNA, 20 nt, Homo sapiens
uuuucagcaaaguacaaaaa

SEQ ID NO: 1858382 - RNA, 17 nt, Homo sapiens
aagauucagcagugucu

SEQ ID NO: 1858383 - RNA, 16 nt, Homo sapiens
uucauugccagugucu

SEQ ID NO: 1858384 - RNA, 21 nt, Homo sapiens
uccaugcccccgccaccuccc

SEQ ID NO: 1858385 - RNA, 19 nt, Homo sapiens
cccugaccucacugugacc

SEQ ID NO: 1858386 - RNA, 18 nt, Homo sapiens
cauuucacaaaaacagca

SEQ ID NO: 1858387 - RNA, 13 nt, Homo sapiens
guguguaugcuga

SEQ ID NO: 1858388 - RNA, 20 nt, Homo sapiens
ugaaccagugauccaugucc

SEQ ID NO: 1858389 - RNA, 18 nt, Homo sapiens
augccacgcacuuccucu

SEQ ID NO: 1858390 - RNA, 11 nt, Homo sapiens
ggccaucucaa

SEQ ID NO: 1858391 - RNA, 22 nt, Homo sapiens
ugcuguugucccucugcuacgu

SEQ ID NO: 1858392 - RNA, 20 nt, Homo sapiens
acugcgccacggcacuccag

SEQ ID NO: 1858393 - RNA, 16 nt, Homo sapiens
ccacacggaggcaucu

SEQ ID NO: 1858394 - RNA, 16 nt, Homo sapiens
aucuuggcucacuaca

SEQ ID NO: 1858395 - RNA, 19 nt, Homo sapiens
gcauagaauucacaaugca

SEQ ID NO: 1858396 - RNA, 20 nt, Homo sapiens
ugagccgugaacugugcaua

SEQ ID NO: 1858397 - RNA, 17 nt, Homo sapiens
gagggauugcugugaaa

SEQ ID NO: 1858398 - RNA, 23 nt, Homo sapiens
agguuuuuaguuuguucuucaga

SEQ ID NO: 1858399 - RNA, 20 nt, Homo sapiens
auuaaucaaaccacuguuau

SEQ ID NO: 1858400 - RNA, 21 nt, Homo sapiens
cuuuaaaaaauacacauagca

SEQ ID NO: 1858401 - RNA, 19 nt, Homo sapiens
gcucaggguuaauguagug

SEQ ID NO: 1858402 - RNA, 17 nt, Homo sapiens
cuguaaaauggagacac

SEQ ID NO: 1858403 - RNA, 19 nt, Homo sapiens
cuaucuggccuuugcaugg

SEQ ID NO: 1858404 - RNA, 18 nt, Homo sapiens
auuagauacacuucuuaa

SEQ ID NO: 1858405 - RNA, 13 nt, Homo sapiens
ucuugaauagucu

SEQ ID NO: 1858406 - RNA, 12 nt, Homo sapiens
aauuuagcucuc

SEQ ID NO: 1858407 - RNA, 13 nt, Homo sapiens
ggaaaaccaaaca

SEQ ID NO: 1858408 - RNA, 15 nt, Homo sapiens
agucgcuugccaaag

SEQ ID NO: 1858409 - RNA, 13 nt, Homo sapiens
gacaaugccaaua

SEQ ID NO: 1858410 - RNA, 17 nt, Homo sapiens
caauagcuaagcaucuc

SEQ ID NO: 1858411 - RNA, 17 nt, Homo sapiens
uacgcugcgugccauga

SEQ ID NO: 1858412 - RNA, 13 nt, Homo sapiens
cugguucuugccu

SEQ ID NO: 1858413 - RNA, 13 nt, Homo sapiens
uuugucugacaaa

SEQ ID NO: 1858414 - RNA, 15 nt, Homo sapiens
gaaaaccauucugga

SEQ ID NO: 1858415 - RNA, 13 nt, Homo sapiens
uaauaggcauuuu

SEQ ID NO: 1858416 - RNA, 15 nt, Homo sapiens
aagugggacauucaa

SEQ ID NO: 1858417 - RNA, 19 nt, Homo sapiens
aguguggaaccacugacua

SEQ ID NO: 1858418 - RNA, 19 nt, Homo sapiens
uuuuacauuuccuauauca

SEQ ID NO: 1858419 - RNA, 19 nt, Homo sapiens
cuuucuguguaccacuggg

SEQ ID NO: 1858420 - RNA, 21 nt, Homo sapiens
ucgcugcgcagccuccagggc

SEQ ID NO: 1858421 - RNA, 23 nt, Homo sapiens
agcagagccuacagaagggcagu

SEQ ID NO: 1858422 - RNA, 17 nt, Homo sapiens
aacccuugugccucuca

SEQ ID NO: 1858423 - RNA, 19 nt, Homo sapiens
uccuucccauuucucuaca

SEQ ID NO: 1858424 - RNA, 12 nt, Homo sapiens
cuagagggccca

SEQ ID NO: 1858425 - RNA, 19 nt, Homo sapiens
ugcuuccaccucaccccac

SEQ ID NO: 1858426 - RNA, 23 nt, Homo sapiens
gcgauccucuugggcucuccuag

SEQ ID NO: 1858427 - RNA, 12 nt, Homo sapiens
uauccagaugac

SEQ ID NO: 1858428 - RNA, 20 nt, Homo sapiens
agauaaaguuuuuauuuucc

SEQ ID NO: 1858429 - RNA, 21 nt, Homo sapiens
aagggccagauuucauucuca

SEQ ID NO: 1858430 - RNA, 15 nt, Homo sapiens
cagaugcuuugccca

SEQ ID NO: 1858431 - RNA, 18 nt, Homo sapiens
gacauagucucuaccuau

SEQ ID NO: 1858432 - RNA, 18 nt, Homo sapiens
ucagggcauugccuguga

SEQ ID NO: 1858433 - RNA, 15 nt, Homo sapiens
gugagggugcugacu

SEQ ID NO: 1858434 - RNA, 16 nt, Homo sapiens
uauugguguugcccua

SEQ ID NO: 1858435 - RNA, 21 nt, Homo sapiens
guccuccagggcgagcacuuu

SEQ ID NO: 1858436 - RNA, 22 nt, Homo sapiens
ugauuaaagcuaaggaccuuaa

SEQ ID NO: 1858437 - RNA, 15 nt, Homo sapiens
ccgaggucccugcug

SEQ ID NO: 1858438 - RNA, 16 nt, Homo sapiens
cuggggcauccugugc

SEQ ID NO: 1858439 - RNA, 22 nt, Homo sapiens
aggcaugugccaucauacccag

SEQ ID NO: 1858440 - RNA, 18 nt, Homo sapiens
gaucucagagcauuucaa

SEQ ID NO: 1858441 - RNA, 17 nt, Homo sapiens
gucugccuaugcacuga

SEQ ID NO: 1858442 - RNA, 16 nt, Homo sapiens
auaauguagcagcuca

SEQ ID NO: 1858443 - RNA, 13 nt, Homo sapiens
uuccuguuuccau

SEQ ID NO: 1858444 - RNA, 15 nt, Homo sapiens
auuuucagccaaagg

SEQ ID NO: 1858445 - RNA, 23 nt, Homo sapiens
cuucaacuuuuuuaaaaacuaga

SEQ ID NO: 1858446 - RNA, 22 nt, Homo sapiens
cacaugggaguuuagugugaua

SEQ ID NO: 1858447 - RNA, 23 nt, Homo sapiens
ucaacucuccaauguucuauuaa

SEQ ID NO: 1858448 - RNA, 21 nt, Homo sapiens
guuuauuuccuagacuguuau

SEQ ID NO: 1858449 - RNA, 20 nt, Homo sapiens
auguccuuccaagaauggaa

SEQ ID NO: 1858450 - RNA, 19 nt, Homo sapiens
ccacacagcacaugcacac

SEQ ID NO: 1858451 - RNA, 15 nt, Homo sapiens
accccccuaccacac

SEQ ID NO: 1858452 - RNA, 18 nt, Homo sapiens
ccuccugggugccagucc

SEQ ID NO: 1858453 - RNA, 15 nt, Homo sapiens
cgcacaagccagacc

SEQ ID NO: 1858454 - RNA, 22 nt, Homo sapiens
uagcccacaguucuccauuuca

SEQ ID NO: 1858455 - RNA, 13 nt, Homo sapiens
ucucuccaucaga

SEQ ID NO: 1858456 - RNA, 17 nt, Homo sapiens
cuggggggcaccccagc

SEQ ID NO: 1858457 - RNA, 22 nt, Homo sapiens
cccuuggcccaucugugcagua

SEQ ID NO: 1858458 - RNA, 22 nt, Homo sapiens
ccagcauugaagagaacugcaa

SEQ ID NO: 1858459 - RNA, 13 nt, Homo sapiens
ggugguggcacau

SEQ ID NO: 1858460 - RNA, 19 nt, Homo sapiens
auuugaagaggagaacaaa

SEQ ID NO: 1858461 - RNA, 17 nt, Homo sapiens
uacgugccaggcacugu

SEQ ID NO: 1858462 - RNA, 21 nt, Homo sapiens
uaccauuucuugagguaaaag

SEQ ID NO: 1858463 - RNA, 16 nt, Homo sapiens
gcuuccagaccaccug

SEQ ID NO: 1858464 - RNA, 16 nt, Homo sapiens
cugugcaggagccagu

SEQ ID NO: 1858465 - RNA, 12 nt, Homo sapiens
guccuuaccucg

SEQ ID NO: 1858466 - RNA, 16 nt, Homo sapiens
ccccugccuaaugcug

SEQ ID NO: 1858467 - RNA, 12 nt, Homo sapiens
cgcaaagggcau

SEQ ID NO: 1858468 - RNA, 15 nt, Homo sapiens
uagccauugaucaua

SEQ ID NO: 1858469 - RNA, 23 nt, Homo sapiens
ugucugaggaguaaguguacaau

SEQ ID NO: 1858470 - RNA, 15 nt, Homo sapiens
aguaaaaagguggua

SEQ ID NO: 1858471 - RNA, 18 nt, Homo sapiens
uucaucaugucaguucca

SEQ ID NO: 1858472 - RNA, 13 nt, Homo sapiens
uggaagcacuugc

SEQ ID NO: 1858473 - RNA, 13 nt, Homo sapiens
caaauacaugaua

SEQ ID NO: 1858474 - RNA, 18 nt, Homo sapiens
auaagcuaguugaauacu

SEQ ID NO: 1858475 - RNA, 21 nt, Homo sapiens
gaggugcagcuggaggcugcu

SEQ ID NO: 1858476 - RNA, 17 nt, Homo sapiens
ugcuucauaugacaaag

SEQ ID NO: 1858477 - RNA, 12 nt, Homo sapiens
ggaccugaugac

SEQ ID NO: 1858478 - RNA, 14 nt, Homo sapiens
ugggggcuggcaga

SEQ ID NO: 1858479 - RNA, 19 nt, Homo sapiens
uaaauuuaucaacugucaa

SEQ ID NO: 1858480 - RNA, 15 nt, Homo sapiens
acaaagauaugcuaa

SEQ ID NO: 1858481 - RNA, 12 nt, Homo sapiens
uaauuauuuucc

SEQ ID NO: 1858482 - RNA, 20 nt, Homo sapiens
acuuauuauuccagaucugc

SEQ ID NO: 1858483 - RNA, 18 nt, Homo sapiens
cuuguguacaaacccaga

SEQ ID NO: 1858484 - RNA, 19 nt, Homo sapiens
acagugccaauaaaugaua

SEQ ID NO: 1858485 - RNA, 17 nt, Homo sapiens
guuuccuguguuaguca

SEQ ID NO: 1858486 - RNA, 16 nt, Homo sapiens
uaucagccuugcuaaa

SEQ ID NO: 1858487 - RNA, 21 nt, Homo sapiens
ccuugguccugccucuuugag

SEQ ID NO: 1858488 - RNA, 21 nt, Homo sapiens
cuaagcaguuauggugaugac

SEQ ID NO: 1858489 - RNA, 15 nt, Homo sapiens
guuuuaugcuacuga

SEQ ID NO: 1858490 - RNA, 17 nt, Homo sapiens
uaccauauacagcucag

SEQ ID NO: 1858491 - RNA, 22 nt, Homo sapiens
gugcugguguggucuacuaaau

SEQ ID NO: 1858492 - RNA, 15 nt, Homo sapiens
cucauccucauaccc

SEQ ID NO: 1858493 - RNA, 13 nt, Homo sapiens
ugccagacugaag

SEQ ID NO: 1858494 - RNA, 15 nt, Homo sapiens
aagcucuaucugcaa

SEQ ID NO: 1858495 - RNA, 17 nt, Homo sapiens
aaggggauggacuucau

SEQ ID NO: 1858496 - RNA, 12 nt, Homo sapiens
aaaaaccaaagu

SEQ ID NO: 1858497 - RNA, 19 nt, Homo sapiens
gguucagcuaagcuaggaa

SEQ ID NO: 1858498 - RNA, 19 nt, Homo sapiens
ccaugaggaaggaacagca

SEQ ID NO: 1858499 - RNA, 16 nt, Homo sapiens
ugcucggcuugaucac

SEQ ID NO: 1858500 - RNA, 19 nt, Homo sapiens
ggugggcugucacugcuug

SEQ ID NO: 1858501 - RNA, 19 nt, Homo sapiens
cugaauuuggggcuacuua

SEQ ID NO: 1858502 - RNA, 17 nt, Homo sapiens
gugcaugccgggaccau

SEQ ID NO: 1858503 - RNA, 16 nt, Homo sapiens
aaauauucaaguaaca

SEQ ID NO: 1858504 - RNA, 21 nt, Homo sapiens
caacuggggggcaauuuugca

SEQ ID NO: 1858505 - RNA, 19 nt, Homo sapiens
cccaggcaucugcuuuacu

SEQ ID NO: 1858506 - RNA, 18 nt, Homo sapiens
ucaucuugaugaugauag

SEQ ID NO: 1858507 - RNA, 15 nt, Homo sapiens
uggcaggaugcgcug

SEQ ID NO: 1858508 - RNA, 21 nt, Homo sapiens
cagguaauccgccugccuugg

SEQ ID NO: 1858509 - RNA, 17 nt, Homo sapiens
cagacugaaccagucca

SEQ ID NO: 1858510 - RNA, 21 nt, Homo sapiens
agauuucaaaguuaauuuucc

SEQ ID NO: 1858511 - RNA, 18 nt, Homo sapiens
aaauaugcaccaaaucau

SEQ ID NO: 1858512 - RNA, 13 nt, Homo sapiens
cucauaagcaaua

SEQ ID NO: 1858513 - RNA, 14 nt, Homo sapiens
ggagucacacagug

SEQ ID NO: 1858514 - RNA, 15 nt, Homo sapiens
caggggcucuguggc

SEQ ID NO: 1858515 - RNA, 22 nt, Homo sapiens
cuguaaggcaggcccauucaga

SEQ ID NO: 1858516 - RNA, 22 nt, Homo sapiens
ccacuuaaucuucucucuugau

SEQ ID NO: 1858517 - RNA, 19 nt, Homo sapiens
cugcuacccagaaccuuuu

SEQ ID NO: 1858518 - RNA, 19 nt, Homo sapiens
guccuccauuucaacucca

SEQ ID NO: 1858519 - RNA, 12 nt, Homo sapiens
cgugcacucugc

SEQ ID NO: 1858520 - RNA, 19 nt, Homo sapiens
acugaucauccaggccuca

SEQ ID NO: 1858521 - RNA, 12 nt, Homo sapiens
agcaagagccac

SEQ ID NO: 1858522 - RNA, 18 nt, Homo sapiens
ugcccaagguugcacagc

SEQ ID NO: 1858523 - RNA, 15 nt, Homo sapiens
aucggccuccaugac

SEQ ID NO: 1858524 - RNA, 16 nt, Homo sapiens
auccccugcacuaggc

SEQ ID NO: 1858525 - RNA, 14 nt, Homo sapiens
ugaacugcugccaa

SEQ ID NO: 1858526 - RNA, 18 nt, Homo sapiens
ucuaucggagaacaugaa

SEQ ID NO: 1858527 - RNA, 21 nt, Homo sapiens
aauaauaaagaauagcuuuaa

SEQ ID NO: 1858528 - RNA, 17 nt, Homo sapiens
agauuuuaagggggaaa

SEQ ID NO: 1858529 - RNA, 17 nt, Homo sapiens
aacuccaaacauccucu

SEQ ID NO: 1858530 - RNA, 22 nt, Homo sapiens
caucucaacaauauauguccua

SEQ ID NO: 1858531 - RNA, 14 nt, Homo sapiens
aagaaaaaguacaa

SEQ ID NO: 1858532 - RNA, 13 nt, Homo sapiens
cagauugcugcaa

SEQ ID NO: 1858533 - RNA, 13 nt, Homo sapiens
ccaaaauccgacu

SEQ ID NO: 1858534 - RNA, 17 nt, Homo sapiens
cacagauguaauuaugu

SEQ ID NO: 1858535 - RNA, 23 nt, Homo sapiens
uaaauauuaggagacacagggaa

SEQ ID NO: 1858536 - RNA, 20 nt, Homo sapiens
uucccugggcugccaccagc

SEQ ID NO: 1858537 - RNA, 15 nt, Homo sapiens
uuccuccaucuccaa

SEQ ID NO: 1858538 - RNA, 19 nt, Homo sapiens
cugccccaccccaccucca

SEQ ID NO: 1858539 - RNA, 15 nt, Homo sapiens
augaagcacugagca

SEQ ID NO: 1858540 - RNA, 18 nt, Homo sapiens
gugguguauguauggaaa

SEQ ID NO: 1858541 - RNA, 24 nt, Homo sapiens
caauaugaaccaaguaguauucau

SEQ ID NO: 1858542 - RNA, 16 nt, Homo sapiens
ugccaggcagugcagc

SEQ ID NO: 1858543 - RNA, 16 nt, Homo sapiens
uccccaguacugaggu

SEQ ID NO: 1858544 - RNA, 19 nt, Homo sapiens
accagguaugaccuuuuaa

SEQ ID NO: 1858545 - RNA, 16 nt, Homo sapiens
uaaaauguuuaggaaa

SEQ ID NO: 1858546 - RNA, 22 nt, Homo sapiens
aaucuuuccuuccucucauccu

SEQ ID NO: 1858547 - RNA, 18 nt, Homo sapiens
uauggaaaaaaugaacuu

SEQ ID NO: 1858548 - RNA, 15 nt, Homo sapiens
uaaacgucacagcag

SEQ ID NO: 1858549 - RNA, 19 nt, Homo sapiens
gcccagcuccugacacugc

SEQ ID NO: 1858550 - RNA, 16 nt, Homo sapiens
uauaaaucaacaccuu

SEQ ID NO: 1858551 - RNA, 19 nt, Homo sapiens
cgcuggugcccaccagcug

SEQ ID NO: 1858552 - RNA, 18 nt, Homo sapiens
guccauuuaugguaccua

SEQ ID NO: 1858553 - RNA, 17 nt, Homo sapiens
uugccagugacaugaga

SEQ ID NO: 1858554 - RNA, 22 nt, Homo sapiens
ucaucugaaauguuacaaaaau

SEQ ID NO: 1858555 - RNA, 19 nt, Homo sapiens
ucauuucacuguagcucua

SEQ ID NO: 1858556 - RNA, 17 nt, Homo sapiens
gugggugugugugggca

SEQ ID NO: 1858557 - RNA, 16 nt, Homo sapiens
auaaggugcuaucugu

SEQ ID NO: 1858558 - RNA, 15 nt, Homo sapiens
cuguaucacugccuu

SEQ ID NO: 1858559 - RNA, 13 nt, Homo sapiens
caugucaccucag

SEQ ID NO: 1858560 - RNA, 20 nt, Homo sapiens
auuuagauaugcaaaagcug

SEQ ID NO: 1858561 - RNA, 16 nt, Homo sapiens
aagacuugaaggcauu

SEQ ID NO: 1858562 - RNA, 14 nt, Homo sapiens
guuuuuaaucucca

SEQ ID NO: 1858563 - RNA, 19 nt, Homo sapiens
ggccgggcgcgguggcuca

SEQ ID NO: 1858564 - RNA, 20 nt, Homo sapiens
cuguauuuuuaaauugccaa

SEQ ID NO: 1858565 - RNA, 12 nt, Homo sapiens
ucaaaaucugca

SEQ ID NO: 1858566 - RNA, 19 nt, Homo sapiens
agaaccagggcucuucuca

SEQ ID NO: 1858567 - RNA, 20 nt, Homo sapiens
augcaccaaaucaucucuca

SEQ ID NO: 1858568 - RNA, 21 nt, Homo sapiens
agcuaucauuucuuuuccaaa

SEQ ID NO: 1858569 - RNA, 18 nt, Homo sapiens
ccuuacuugcacuguuac

SEQ ID NO: 1858570 - RNA, 14 nt, Homo sapiens
ucccaauauccaau

SEQ ID NO: 1858571 - RNA, 19 nt, Homo sapiens
cuucagaugacaaggauua

SEQ ID NO: 1858572 - RNA, 19 nt, Homo sapiens
cauggugaauuaaucacuu

SEQ ID NO: 1858573 - RNA, 16 nt, Homo sapiens
acuauuaaaacuaaua

SEQ ID NO: 1858574 - RNA, 21 nt, Homo sapiens
uggcuucaaauuguaagcaug

SEQ ID NO: 1858575 - RNA, 23 nt, Homo sapiens
gcuaccagguguucuacacucau

SEQ ID NO: 1858576 - RNA, 23 nt, Homo sapiens
aaaauuauuuaaaccgcuaaaag

SEQ ID NO: 1858577 - RNA, 23 nt, Homo sapiens
aguuccuuaucccucucuucccc

SEQ ID NO: 1858578 - RNA, 16 nt, Homo sapiens
auucuuguauuauaau

SEQ ID NO: 1858579 - RNA, 19 nt, Homo sapiens
uggagugugucagagccca

SEQ ID NO: 1858580 - RNA, 16 nt, Homo sapiens
uggaucagagcauuua

SEQ ID NO: 1858581 - RNA, 16 nt, Homo sapiens
cagucuuguacuguga

SEQ ID NO: 1858582 - RNA, 15 nt, Homo sapiens
gccuccugcaccgag

SEQ ID NO: 1858583 - RNA, 15 nt, Homo sapiens
gggagaaaagccaga

SEQ ID NO: 1858584 - RNA, 20 nt, Homo sapiens
aauauuucagagcagaggca

SEQ ID NO: 1858585 - RNA, 11 nt, Homo sapiens
gagucacugua

SEQ ID NO: 1858586 - RNA, 16 nt, Homo sapiens
gaauuccuucuaagau

SEQ ID NO: 1858587 - RNA, 13 nt, Homo sapiens
ucaacuugcaaaa

SEQ ID NO: 1858588 - RNA, 22 nt, Homo sapiens
ccugaacauggcagucuagggu

SEQ ID NO: 1858589 - RNA, 15 nt, Homo sapiens
agccugagaugggga

SEQ ID NO: 1858590 - RNA, 21 nt, Homo sapiens
acccuggugggccaacaaaga

SEQ ID NO: 1858591 - RNA, 18 nt, Homo sapiens
ucccccaaauuaacauca

SEQ ID NO: 1858592 - RNA, 18 nt, Homo sapiens
uauugagggugacagcca

SEQ ID NO: 1858593 - RNA, 22 nt, Homo sapiens
accagguugcuugugagggaug

SEQ ID NO: 1858594 - RNA, 20 nt, Homo sapiens
cacauagaugucuguaacca

SEQ ID NO: 1858595 - RNA, 12 nt, Homo sapiens
aggcuaagcaug

SEQ ID NO: 1858596 - RNA, 12 nt, Homo sapiens
uaaaaugauguu

SEQ ID NO: 1858597 - RNA, 18 nt, Homo sapiens
uccuugacaccuuacuuu

SEQ ID NO: 1858598 - RNA, 16 nt, Homo sapiens
uaaagugcccagcaca

SEQ ID NO: 1858599 - RNA, 20 nt, Homo sapiens
guccucaccugguugaccca

SEQ ID NO: 1858600 - RNA, 19 nt, Homo sapiens
aacaaucuuagacauuuau

SEQ ID NO: 1858601 - RNA, 20 nt, Homo sapiens
ugcugcuccucucuugggua

SEQ ID NO: 1858602 - RNA, 19 nt, Homo sapiens
uaagucaccuaaguacuua

SEQ ID NO: 1858603 - RNA, 12 nt, Homo sapiens
aacuuucuugcu

SEQ ID NO: 1858604 - RNA, 17 nt, Homo sapiens
ugaacacauuugcccaa

SEQ ID NO: 1858605 - RNA, 22 nt, Homo sapiens
gcuggcaaagauagagaaugcc

SEQ ID NO: 1858606 - RNA, 16 nt, Homo sapiens
aauaaagucucuuccu

SEQ ID NO: 1858607 - RNA, 16 nt, Homo sapiens
cucaaagaaauuucca

SEQ ID NO: 1858608 - RNA, 13 nt, Homo sapiens
ucaaaacauauca

SEQ ID NO: 1858609 - RNA, 13 nt, Homo sapiens
aaaauacaacucu

SEQ ID NO: 1858610 - RNA, 22 nt, Homo sapiens
cacugguggccgugguggggcc

SEQ ID NO: 1858611 - RNA, 17 nt, Homo sapiens
ucaguuguuuugcauaa

SEQ ID NO: 1858612 - RNA, 14 nt, Homo sapiens
cucuuuaaguauuu

SEQ ID NO: 1858613 - RNA, 21 nt, Homo sapiens
gggcaauaaaggcaccucccc

SEQ ID NO: 1858614 - RNA, 13 nt, Homo sapiens
aaggacugugaca

SEQ ID NO: 1858615 - RNA, 17 nt, Homo sapiens
aggcugcuggagugcag

SEQ ID NO: 1858616 - RNA, 19 nt, Homo sapiens
uaagcuguagaacucugca

SEQ ID NO: 1858617 - RNA, 12 nt, Homo sapiens
ucugaacacauu

SEQ ID NO: 1858618 - RNA, 20 nt, Homo sapiens
gcaccugccagggaggccau

SEQ ID NO: 1858619 - RNA, 18 nt, Homo sapiens
guaucuaauuucauucaa

SEQ ID NO: 1858620 - RNA, 13 nt, Homo sapiens
ccaugacuuccuc

SEQ ID NO: 1858621 - RNA, 18 nt, Homo sapiens
acacacacccacuaagga

SEQ ID NO: 1858622 - RNA, 12 nt, Homo sapiens
ugguaugugcua

SEQ ID NO: 1858623 - RNA, 17 nt, Homo sapiens
guucaauggcugcugaa

SEQ ID NO: 1858624 - RNA, 12 nt, Homo sapiens
guauacaggugg

SEQ ID NO: 1858625 - RNA, 12 nt, Homo sapiens
ggggacagggau

SEQ ID NO: 1858626 - RNA, 20 nt, Homo sapiens
uccucuugguggguguggcc

SEQ ID NO: 1858627 - RNA, 19 nt, Homo sapiens
gucaggugccucaagagaa

SEQ ID NO: 1858628 - RNA, 19 nt, Homo sapiens
cugggauuacaggcaccca

SEQ ID NO: 1858629 - RNA, 16 nt, Homo sapiens
aacaucaugcauucac

SEQ ID NO: 1858630 - RNA, 18 nt, Homo sapiens
auauuucauuuagcuuuu

SEQ ID NO: 1858631 - RNA, 15 nt, Homo sapiens
aauaaggcccagagc

SEQ ID NO: 1858632 - RNA, 22 nt, Homo sapiens
aaaccacacacacaaggugcuc

SEQ ID NO: 1858633 - RNA, 22 nt, Homo sapiens
gagcaucccccaccuacucuca

SEQ ID NO: 1858634 - RNA, 13 nt, Homo sapiens
gacagaaagcaga

SEQ ID NO: 1858635 - RNA, 16 nt, Homo sapiens
gggcuagugacuugug

SEQ ID NO: 1858636 - RNA, 14 nt, Homo sapiens
cuguggccccaaga

SEQ ID NO: 1858637 - RNA, 22 nt, Homo sapiens
uggagacuguccacuucuagcu

SEQ ID NO: 1858638 - RNA, 22 nt, Homo sapiens
uaaucuccucagacaguaacca

SEQ ID NO: 1858639 - RNA, 17 nt, Homo sapiens
uucauuagcugcucuga

SEQ ID NO: 1858640 - RNA, 19 nt, Homo sapiens
gcuguugguaaagcacaug

SEQ ID NO: 1858641 - RNA, 20 nt, Homo sapiens
cuuauuaauuugacuagaaa

SEQ ID NO: 1858642 - RNA, 18 nt, Homo sapiens
aacaccgcuucugccuuu

SEQ ID NO: 1858643 - RNA, 19 nt, Homo sapiens
cugaaggguggaugugcug

SEQ ID NO: 1858644 - RNA, 21 nt, Homo sapiens
agauaaagauguuacauuguc

SEQ ID NO: 1858645 - RNA, 15 nt, Homo sapiens
ggcccagaccucagg

SEQ ID NO: 1858646 - RNA, 15 nt, Homo sapiens
uauuugguaccaugg

SEQ ID NO: 1858647 - RNA, 22 nt, Homo sapiens
aaccaagaggcugguuuuggca

SEQ ID NO: 1858648 - RNA, 22 nt, Homo sapiens
gcugucccucauggagaccuca

SEQ ID NO: 1858649 - RNA, 13 nt, Homo sapiens
cuauaugcuuacu

SEQ ID NO: 1858650 - RNA, 17 nt, Homo sapiens
uagaaauuuuguuaaca

SEQ ID NO: 1858651 - RNA, 12 nt, Homo sapiens
cucuuaucucag

SEQ ID NO: 1858652 - RNA, 19 nt, Homo sapiens
accugcagggacuccaugc

SEQ ID NO: 1858653 - RNA, 14 nt, Homo sapiens
acuguuucuuggua

SEQ ID NO: 1858654 - RNA, 22 nt, Homo sapiens
aauuccacacuauucucugccu

SEQ ID NO: 1858655 - RNA, 20 nt, Homo sapiens
cucccaccucugugaccuca

SEQ ID NO: 1858656 - RNA, 14 nt, Homo sapiens
ggaaaauucuuaaa

SEQ ID NO: 1858657 - RNA, 17 nt, Homo sapiens
aguguucaguaaacaaa

SEQ ID NO: 1858658 - RNA, 18 nt, Homo sapiens
uaagcucuaucugcaaug

SEQ ID NO: 1858659 - RNA, 15 nt, Homo sapiens
cuaucauucugcucu

SEQ ID NO: 1858660 - RNA, 18 nt, Homo sapiens
acaucuccaggcuuucaa

SEQ ID NO: 1858661 - RNA, 16 nt, Homo sapiens
auuucccagcacauga

SEQ ID NO: 1858662 - RNA, 16 nt, Homo sapiens
auuuacacuacauugu

SEQ ID NO: 1858663 - RNA, 11 nt, Homo sapiens
cuucauuucau

SEQ ID NO: 1858664 - RNA, 16 nt, Homo sapiens
aaggggcccaagagag

SEQ ID NO: 1858665 - RNA, 22 nt, Homo sapiens
acugcugcgcugugcuggucuc

SEQ ID NO: 1858666 - RNA, 13 nt, Homo sapiens
caucuccacagga

SEQ ID NO: 1858667 - RNA, 11 nt, Homo sapiens
uaagugucacc

SEQ ID NO: 1858668 - RNA, 20 nt, Homo sapiens
cuggggaagagaaaagccca

SEQ ID NO: 1858669 - RNA, 13 nt, Homo sapiens
ccauccuagucac

SEQ ID NO: 1858670 - RNA, 19 nt, Homo sapiens
aaauucuaaagagcacuua

SEQ ID NO: 1858671 - RNA, 11 nt, Homo sapiens
ggauccaguga

SEQ ID NO: 1858672 - RNA, 19 nt, Homo sapiens
aauagggaaguaacaguaa

SEQ ID NO: 1858673 - RNA, 17 nt, Homo sapiens
gacaguuuuugacauuu

SEQ ID NO: 1858674 - RNA, 15 nt, Homo sapiens
cauggcagugaugaa

SEQ ID NO: 1858675 - RNA, 23 nt, Homo sapiens
uguugaagaaacuacuaaucuca

SEQ ID NO: 1858676 - RNA, 21 nt, Homo sapiens
agccucacuggggcagacaau

SEQ ID NO: 1858677 - RNA, 18 nt, Homo sapiens
ggcuucccaaaugugugc

SEQ ID NO: 1858678 - RNA, 22 nt, Homo sapiens
ugccaggacucucuuucuucca

SEQ ID NO: 1858679 - RNA, 13 nt, Homo sapiens
aggaggcaagcaa

SEQ ID NO: 1858680 - RNA, 23 nt, Homo sapiens
ggaauugaagacacguucuugcc

SEQ ID NO: 1858681 - RNA, 20 nt, Homo sapiens
aaacuauccuucucuuucaa

SEQ ID NO: 1858682 - RNA, 13 nt, Homo sapiens
acccuagcaaaag

SEQ ID NO: 1858683 - RNA, 23 nt, Homo sapiens
uggaugggaggagagccacuggg

SEQ ID NO: 1858684 - RNA, 21 nt, Homo sapiens
agccucccccucagaugaucu

SEQ ID NO: 1858685 - RNA, 22 nt, Homo sapiens
uauaaaugaauuugcauaccag

SEQ ID NO: 1858686 - RNA, 14 nt, Homo sapiens
cuuauucuacugaa

SEQ ID NO: 1858687 - RNA, 20 nt, Homo sapiens
aagaaauuagggcucuaauu

SEQ ID NO: 1858688 - RNA, 22 nt, Homo sapiens
cagcauaauacuugcuuuggaa

SEQ ID NO: 1858689 - RNA, 19 nt, Homo sapiens
caaaugaugauuaugaguu

SEQ ID NO: 1858690 - RNA, 18 nt, Homo sapiens
uaguuaccuuauaguuac

SEQ ID NO: 1858691 - RNA, 21 nt, Homo sapiens
accacgggcgaggacgugaag

SEQ ID NO: 1858692 - RNA, 14 nt, Homo sapiens
aaaaccugagccau

SEQ ID NO: 1858693 - RNA, 19 nt, Homo sapiens
acaaucaaagaaaagacuu

SEQ ID NO: 1858694 - RNA, 19 nt, Homo sapiens
ugcuggaauuacaggcgug

SEQ ID NO: 1858695 - RNA, 16 nt, Homo sapiens
ugaagccgucucaugc

SEQ ID NO: 1858696 - RNA, 17 nt, Homo sapiens
guacugauuacugccua

SEQ ID NO: 1858697 - RNA, 14 nt, Homo sapiens
caucugaggaauga

SEQ ID NO: 1858698 - RNA, 17 nt, Homo sapiens
uuaacuguucaguauug

SEQ ID NO: 1858699 - RNA, 20 nt, Homo sapiens
ucagaaugaugaguccagaa

SEQ ID NO: 1858700 - RNA, 13 nt, Homo sapiens
aagugacuugaau

SEQ ID NO: 1858701 - RNA, 13 nt, Homo sapiens
uguuuuucuucag

SEQ ID NO: 1858702 - RNA, 21 nt, Homo sapiens
gucuauuccaggcaugcacaa

SEQ ID NO: 1858703 - RNA, 12 nt, Homo sapiens
ccugaccucacu

SEQ ID NO: 1858704 - RNA, 23 nt, Homo sapiens
cuguagcccuggcccggucccag

SEQ ID NO: 1858705 - RNA, 22 nt, Homo sapiens
uucuugugccucagccucccaa

SEQ ID NO: 1858706 - RNA, 16 nt, Homo sapiens
uuaucuauucugagaa

SEQ ID NO: 1858707 - RNA, 23 nt, Homo sapiens
acaugaccuccguguagugucug

SEQ ID NO: 1858708 - RNA, 14 nt, Homo sapiens
uauccgaagagauc

SEQ ID NO: 1858709 - RNA, 18 nt, Homo sapiens
gaagacauugcaccagau

SEQ ID NO: 1858710 - RNA, 14 nt, Homo sapiens
caagucagcuccag

SEQ ID NO: 1858711 - RNA, 17 nt, Homo sapiens
gagggacuucccuagaa

SEQ ID NO: 1858712 - RNA, 12 nt, Homo sapiens
gauaaaccaguu

SEQ ID NO: 1858713 - RNA, 13 nt, Homo sapiens
uugcuugcaaugu

SEQ ID NO: 1858714 - RNA, 18 nt, Homo sapiens
acugggcgugguggcuca

SEQ ID NO: 1858715 - RNA, 10 nt, Homo sapiens
ccaccagaga

SEQ ID NO: 1858716 - RNA, 13 nt, Homo sapiens
ucagaaaccugca

SEQ ID NO: 1858717 - RNA, 17 nt, Homo sapiens
caguaguggugacugug

SEQ ID NO: 1858718 - RNA, 16 nt, Homo sapiens
aacuacggauugcugc

SEQ ID NO: 1858719 - RNA, 14 nt, Homo sapiens
agguucaagagauu

SEQ ID NO: 1858720 - RNA, 21 nt, Homo sapiens
ggacccagccucagauccagg

SEQ ID NO: 1858721 - RNA, 13 nt, Homo sapiens
augaguacccaaa

SEQ ID NO: 1858722 - RNA, 20 nt, Homo sapiens
aggguauguuuuauauagca

SEQ ID NO: 1858723 - RNA, 16 nt, Homo sapiens
uacuuggaacuaggcu

SEQ ID NO: 1858724 - RNA, 14 nt, Homo sapiens
cuuuccaauccuuu

SEQ ID NO: 1858725 - RNA, 15 nt, Homo sapiens
gcuucuccaaauaca

SEQ ID NO: 1858726 - RNA, 17 nt, Homo sapiens
cagagggggcgugccug

SEQ ID NO: 1858727 - RNA, 11 nt, Homo sapiens
cagggcuguga

SEQ ID NO: 1858728 - RNA, 15 nt, Homo sapiens
uaaagaaaggaacua

SEQ ID NO: 1858729 - RNA, 14 nt, Homo sapiens
gcaacaaaugaauu

SEQ ID NO: 1858730 - RNA, 19 nt, Homo sapiens
augcaguauucuugcacug

SEQ ID NO: 1858731 - RNA, 12 nt, Homo sapiens
uggcuauaccug

SEQ ID NO: 1858732 - RNA, 18 nt, Homo sapiens
cucagaugaacaauuaug

SEQ ID NO: 1858733 - RNA, 14 nt, Homo sapiens
gccaggcugcucuc

SEQ ID NO: 1858734 - RNA, 22 nt, Homo sapiens
acccauuucaggaggugccggu

SEQ ID NO: 1858735 - RNA, 21 nt, Homo sapiens
caucaaaaaaacaaguuuaga

SEQ ID NO: 1858736 - RNA, 17 nt, Homo sapiens
uaaacgugaugugcuca

SEQ ID NO: 1858737 - RNA, 20 nt, Homo sapiens
acaaacaugggugguaacaa

SEQ ID NO: 1858738 - RNA, 21 nt, Homo sapiens
cuucuuagcacuguugagagg

SEQ ID NO: 1858739 - RNA, 18 nt, Homo sapiens
gucuaaagcuuuggggga

SEQ ID NO: 1858740 - RNA, 21 nt, Homo sapiens
uaaguaccucagcauuuaauc

SEQ ID NO: 1858741 - RNA, 15 nt, Homo sapiens
caugcgcacucucau

SEQ ID NO: 1858742 - RNA, 21 nt, Homo sapiens
caaucugugucauggacugua

SEQ ID NO: 1858743 - RNA, 17 nt, Homo sapiens
cccacuucucaucacac

SEQ ID NO: 1858744 - RNA, 12 nt, Homo sapiens
aagccuuugacc

SEQ ID NO: 1858745 - RNA, 14 nt, Homo sapiens
gagcgagacucugu

SEQ ID NO: 1858746 - RNA, 12 nt, Homo sapiens
aggacuuuggca

SEQ ID NO: 1858747 - RNA, 14 nt, Homo sapiens
cguagcacagccaa

SEQ ID NO: 1858748 - RNA, 19 nt, Homo sapiens
cuccaccacccaacccaaa

SEQ ID NO: 1858749 - RNA, 22 nt, Homo sapiens
cucaguaagaagagcuuggaaa

SEQ ID NO: 1858750 - RNA, 18 nt, Homo sapiens
aaagguuucauguucacu

SEQ ID NO: 1858751 - RNA, 19 nt, Homo sapiens
aaaggaagcuccacuguca

SEQ ID NO: 1858752 - RNA, 17 nt, Homo sapiens
uugcauauguaugacuc

SEQ ID NO: 1858753 - RNA, 23 nt, Homo sapiens
agacaaacuccugaaaugccaag

SEQ ID NO: 1858754 - RNA, 19 nt, Homo sapiens
auguauguuuuaaguaguc

SEQ ID NO: 1858755 - RNA, 19 nt, Homo sapiens
cuauaaauuuacucuguug

SEQ ID NO: 1858756 - RNA, 19 nt, Homo sapiens
agcugccugggaggcagau

SEQ ID NO: 1858757 - RNA, 20 nt, Homo sapiens
cuggagggggagcaccagcg

SEQ ID NO: 1858758 - RNA, 11 nt, Homo sapiens
ccgccucacac

SEQ ID NO: 1858759 - RNA, 18 nt, Homo sapiens
aauuuauuaacuaaucaa

SEQ ID NO: 1858760 - RNA, 11 nt, Homo sapiens
acugcagugac

SEQ ID NO: 1858761 - RNA, 15 nt, Homo sapiens
auaggcaacuuggua

SEQ ID NO: 1858762 - RNA, 15 nt, Homo sapiens
ccuucagggacucaa

SEQ ID NO: 1858763 - RNA, 15 nt, Homo sapiens
gcuccuagcacccug

SEQ ID NO: 1858764 - RNA, 13 nt, Homo sapiens
guccaccuuucag

SEQ ID NO: 1858765 - RNA, 18 nt, Homo sapiens
ggaccaugcgacacuggg

SEQ ID NO: 1858766 - RNA, 20 nt, Homo sapiens
gugugucugguggguggagu

SEQ ID NO: 1858767 - RNA, 18 nt, Homo sapiens
caaagugauucacugugc

SEQ ID NO: 1858768 - RNA, 21 nt, Homo sapiens
uuuuguugaaauugucaaaga

SEQ ID NO: 1858769 - RNA, 15 nt, Homo sapiens
uucuagucuuggcca

SEQ ID NO: 1858770 - RNA, 21 nt, Homo sapiens
acaggggccgcccuuggcucc

SEQ ID NO: 1858771 - RNA, 17 nt, Homo sapiens
uaacagcauuaacuguc

SEQ ID NO: 1858772 - RNA, 13 nt, Homo sapiens
gaaagcuaucucu

SEQ ID NO: 1858773 - RNA, 14 nt, Homo sapiens
caaaugagccacaa

SEQ ID NO: 1858774 - RNA, 18 nt, Homo sapiens
uaugauucagauuguuau

SEQ ID NO: 1858775 - RNA, 19 nt, Homo sapiens
acacuguggccaggccuua

SEQ ID NO: 1858776 - RNA, 15 nt, Homo sapiens
uucugaauuguccuu

SEQ ID NO: 1858777 - RNA, 19 nt, Homo sapiens
guuggcucacaucauguaa

SEQ ID NO: 1858778 - RNA, 13 nt, Homo sapiens
gggcuaaagucau

SEQ ID NO: 1858779 - RNA, 21 nt, Homo sapiens
ugcaacaauaaaguacuuuac

SEQ ID NO: 1858780 - RNA, 22 nt, Homo sapiens
cugaguagcugggccugugcac

SEQ ID NO: 1858781 - RNA, 19 nt, Homo sapiens
ggucacuuauccugacaca

SEQ ID NO: 1858782 - RNA, 21 nt, Homo sapiens
auuuuuguauccaaggaaaua

SEQ ID NO: 1858783 - RNA, 18 nt, Homo sapiens
guggacucucauguggcc

SEQ ID NO: 1858784 - RNA, 20 nt, Homo sapiens
gcuacaaaaaacugcaguuu

SEQ ID NO: 1858785 - RNA, 20 nt, Homo sapiens
uauauaaaauacacguguau

SEQ ID NO: 1858786 - RNA, 20 nt, Homo sapiens
auuacuggaaggcuuccacu

SEQ ID NO: 1858787 - RNA, 23 nt, Homo sapiens
uugauuuuuucaucuaauguaau

SEQ ID NO: 1858788 - RNA, 20 nt, Homo sapiens
gcaggaggaucacagugacc

SEQ ID NO: 1858789 - RNA, 23 nt, Homo sapiens
gcaguuucugacacuuguuguug

SEQ ID NO: 1858790 - RNA, 12 nt, Homo sapiens
gagccaaccucg

SEQ ID NO: 1858791 - RNA, 22 nt, Homo sapiens
gaacuagugguggcucugagaa

SEQ ID NO: 1858792 - RNA, 19 nt, Homo sapiens
gaaucaccccucugccccu

SEQ ID NO: 1858793 - RNA, 18 nt, Homo sapiens
auaaauuuaucaucucga

SEQ ID NO: 1858794 - RNA, 22 nt, Homo sapiens
cuaucaaaugaaacucuuucau

SEQ ID NO: 1858795 - RNA, 19 nt, Homo sapiens
acacuagaauucaugugag

SEQ ID NO: 1858796 - RNA, 18 nt, Homo sapiens
uaugaacauuagaaaaau

SEQ ID NO: 1858797 - RNA, 19 nt, Homo sapiens
uacauuuuugaauguagua

SEQ ID NO: 1858798 - RNA, 21 nt, Homo sapiens
uggaauaacaacuuucagugg

SEQ ID NO: 1858799 - RNA, 23 nt, Homo sapiens
aaaauaaauguuuuggaauucaa

SEQ ID NO: 1858800 - RNA, 17 nt, Homo sapiens
auacccaaaugucccug

SEQ ID NO: 1858801 - RNA, 20 nt, Homo sapiens
acauaucacgcgcacagccu

SEQ ID NO: 1858802 - RNA, 18 nt, Homo sapiens
uacgcugcucuccugaca

SEQ ID NO: 1858803 - RNA, 18 nt, Homo sapiens
cccaaucauuugcaaugc

SEQ ID NO: 1858804 - RNA, 15 nt, Homo sapiens
gacuccuaagggacu

SEQ ID NO: 1858805 - RNA, 22 nt, Homo sapiens
ccgcccagugggacccacaguc

SEQ ID NO: 1858806 - RNA, 14 nt, Homo sapiens
guguucagaggcag

SEQ ID NO: 1858807 - RNA, 15 nt, Homo sapiens
gugcucaaugcaaau

SEQ ID NO: 1858808 - RNA, 16 nt, Homo sapiens
uauaguauauuaacaa

SEQ ID NO: 1858809 - RNA, 17 nt, Homo sapiens
ccuuuuuguuuguacug

SEQ ID NO: 1858810 - RNA, 21 nt, Homo sapiens
ggaagcaauaagccauucuaa

SEQ ID NO: 1858811 - RNA, 19 nt, Homo sapiens
ucacagugacccuucccaa

SEQ ID NO: 1858812 - RNA, 21 nt, Homo sapiens
uaauccagcgacaauuugaau

SEQ ID NO: 1858813 - RNA, 18 nt, Homo sapiens
ucacccuguccaaacugc

SEQ ID NO: 1858814 - RNA, 23 nt, Homo sapiens
accauguuggccaggcuguucuc

SEQ ID NO: 1858815 - RNA, 21 nt, Homo sapiens
caaaccaaaccccguagcucc

SEQ ID NO: 1858816 - RNA, 15 nt, Homo sapiens
ugggagagagugcau

SEQ ID NO: 1858817 - RNA, 21 nt, Homo sapiens
agacuaucuuacuauuucaca

SEQ ID NO: 1858818 - RNA, 12 nt, Homo sapiens
gaaggagggaga

SEQ ID NO: 1858819 - RNA, 15 nt, Homo sapiens
cuacacauacaugua

SEQ ID NO: 1858820 - RNA, 17 nt, Homo sapiens
ugacuaauagagcucca

SEQ ID NO: 1858821 - RNA, 19 nt, Homo sapiens
gaaguccccuuccauccca

SEQ ID NO: 1858822 - RNA, 17 nt, Homo sapiens
aagaaaauaagagcuca

SEQ ID NO: 1858823 - RNA, 14 nt, Homo sapiens
ggaguucuccucag

SEQ ID NO: 1858824 - RNA, 14 nt, Homo sapiens
cgugacagccguuu

SEQ ID NO: 1858825 - RNA, 21 nt, Homo sapiens
gucugauuggcucacccaagc

SEQ ID NO: 1858826 - RNA, 16 nt, Homo sapiens
ccuugcccaucagcca

SEQ ID NO: 1858827 - RNA, 22 nt, Homo sapiens
acaaaugccuccaaaguauugu

SEQ ID NO: 1858828 - RNA, 18 nt, Homo sapiens
cuguauucucagcacuuu

SEQ ID NO: 1858829 - RNA, 18 nt, Homo sapiens
cacaggcacauuaacugu

SEQ ID NO: 1858830 - RNA, 19 nt, Homo sapiens
auuuuuaaggauguugcca

SEQ ID NO: 1858831 - RNA, 15 nt, Homo sapiens
acccccagcuuugag

SEQ ID NO: 1858832 - RNA, 18 nt, Homo sapiens
acccgagggccagguuag

SEQ ID NO: 1858833 - RNA, 14 nt, Homo sapiens
caaauaaaaaccca

SEQ ID NO: 1858834 - RNA, 14 nt, Homo sapiens
uacuggguucuuag

SEQ ID NO: 1858835 - RNA, 21 nt, Homo sapiens
gaaaggaaauaguaccuucaa

SEQ ID NO: 1858836 - RNA, 15 nt, Homo sapiens
uuuuucuuuuuccac

SEQ ID NO: 1858837 - RNA, 23 nt, Homo sapiens
cacauguagaauuauaacuaauu

SEQ ID NO: 1858838 - RNA, 17 nt, Homo sapiens
cuuggaaucaugcaaaa

SEQ ID NO: 1858839 - RNA, 18 nt, Homo sapiens
ugggaguucuaacaaaac

SEQ ID NO: 1858840 - RNA, 16 nt, Homo sapiens
caggcagagggccuuu

SEQ ID NO: 1858841 - RNA, 12 nt, Homo sapiens
ccugcugcucag

SEQ ID NO: 1858842 - RNA, 15 nt, Homo sapiens
aaacaucacauucca

SEQ ID NO: 1858843 - RNA, 14 nt, Homo sapiens
gcaaccacuaagaa

SEQ ID NO: 1858844 - RNA, 23 nt, Homo sapiens
ggcgccgcacgcuccaucccuuu

SEQ ID NO: 1858845 - RNA, 14 nt, Homo sapiens
cccagccugcucag

SEQ ID NO: 1858846 - RNA, 15 nt, Homo sapiens
caacuuaaugcucug

SEQ ID NO: 1858847 - RNA, 14 nt, Homo sapiens
uggcugcuuuccua

SEQ ID NO: 1858848 - RNA, 19 nt, Homo sapiens
agcaucagagaguguacau

SEQ ID NO: 1858849 - RNA, 24 nt, Homo sapiens
gaaaaccuggagcagcugcugaaa

SEQ ID NO: 1858850 - RNA, 15 nt, Homo sapiens
cauacacugugaacu

SEQ ID NO: 1858851 - RNA, 21 nt, Homo sapiens
ggaacugcuugugcacuggau

SEQ ID NO: 1858852 - RNA, 19 nt, Homo sapiens
agccccucacacugcaagg

SEQ ID NO: 1858853 - RNA, 20 nt, Homo sapiens
auggugcucacgacucuucc

SEQ ID NO: 1858854 - RNA, 16 nt, Homo sapiens
ggagguugcagugagc

SEQ ID NO: 1858855 - RNA, 13 nt, Homo sapiens
agguugcagugag

SEQ ID NO: 1858856 - RNA, 19 nt, Homo sapiens
cccccaccuacucucaggu

SEQ ID NO: 1858857 - RNA, 18 nt, Homo sapiens
cucuggaggaaguucucc

SEQ ID NO: 1858858 - RNA, 23 nt, Homo sapiens
uauaaaacuauguguucaaugaa

SEQ ID NO: 1858859 - RNA, 17 nt, Homo sapiens
gcaguuguuauauucau

SEQ ID NO: 1858860 - RNA, 16 nt, Homo sapiens
gccuccugcccagucc

SEQ ID NO: 1858861 - RNA, 14 nt, Homo sapiens
gaacuauguacuuu

SEQ ID NO: 1858862 - RNA, 13 nt, Homo sapiens
caaaaaacagaaa

SEQ ID NO: 1858863 - RNA, 13 nt, Homo sapiens
ccaccccaagaga

SEQ ID NO: 1858864 - RNA, 16 nt, Homo sapiens
aacauguauguauaca

SEQ ID NO: 1858865 - RNA, 14 nt, Homo sapiens
cacaaugccucauc

SEQ ID NO: 1858866 - RNA, 18 nt, Homo sapiens
agaaugguugaguuacau

SEQ ID NO: 1858867 - RNA, 19 nt, Homo sapiens
uccucugcugacuccauau

SEQ ID NO: 1858868 - RNA, 17 nt, Homo sapiens
guuacuugaaauaccag

SEQ ID NO: 1858869 - RNA, 12 nt, Homo sapiens
uugggagauuca

SEQ ID NO: 1858870 - RNA, 19 nt, Homo sapiens
uacauaaaguaugugcaua

SEQ ID NO: 1858871 - RNA, 22 nt, Homo sapiens
gcuggugggauaggagggugcc

SEQ ID NO: 1858872 - RNA, 12 nt, Homo sapiens
augaucagggau

SEQ ID NO: 1858873 - RNA, 23 nt, Homo sapiens
cuuaguccaauuccuugcacaua

SEQ ID NO: 1858874 - RNA, 19 nt, Homo sapiens
aggcacaagucaccaugcc

SEQ ID NO: 1858875 - RNA, 22 nt, Homo sapiens
gugaugccagguucuauuugga

SEQ ID NO: 1858876 - RNA, 12 nt, Homo sapiens
gagacagucuca

SEQ ID NO: 1858877 - RNA, 21 nt, Homo sapiens
uacaaauuguuucuggaauug

SEQ ID NO: 1858878 - RNA, 19 nt, Homo sapiens
uggaucuggggacugagug

SEQ ID NO: 1858879 - RNA, 14 nt, Homo sapiens
uagcgaaugcacuc

SEQ ID NO: 1858880 - RNA, 12 nt, Homo sapiens
ggagcccaguga

SEQ ID NO: 1858881 - RNA, 19 nt, Homo sapiens
aaaugccaggacagcugca

SEQ ID NO: 1858882 - RNA, 20 nt, Homo sapiens
uuauauauguacuagcauuu

SEQ ID NO: 1858883 - RNA, 20 nt, Homo sapiens
guacgaugcauccauuucag

SEQ ID NO: 1858884 - RNA, 12 nt, Homo sapiens
uugggggcucca

SEQ ID NO: 1858885 - RNA, 18 nt, Homo sapiens
uuguauccuccauuguau

SEQ ID NO: 1858886 - RNA, 15 nt, Homo sapiens
gauuuuaaagacaaa

SEQ ID NO: 1858887 - RNA, 15 nt, Homo sapiens
cagauaaguguaaau

SEQ ID NO: 1858888 - RNA, 14 nt, Homo sapiens
uucguuuaccaaau

SEQ ID NO: 1858889 - RNA, 18 nt, Homo sapiens
uaauuugcugguguuuua

SEQ ID NO: 1858890 - RNA, 18 nt, Homo sapiens
cauuucuacugugacuga

SEQ ID NO: 1858891 - RNA, 14 nt, Homo sapiens
ugauaagauugaaa

SEQ ID NO: 1858892 - RNA, 22 nt, Homo sapiens
aggccccgcgggccgggcucca

SEQ ID NO: 1858893 - RNA, 12 nt, Homo sapiens
ugauguuucaua

SEQ ID NO: 1858894 - RNA, 14 nt, Homo sapiens
gcgcagaaaacaaa

SEQ ID NO: 1858895 - RNA, 20 nt, Homo sapiens
accaaggggcugcuaguaua

SEQ ID NO: 1858896 - RNA, 13 nt, Homo sapiens
ugacuuguugcug

SEQ ID NO: 1858897 - RNA, 20 nt, Homo sapiens
ugggcagcuacaagugcagc

SEQ ID NO: 1858898 - RNA, 20 nt, Homo sapiens
caggggccugcccagugcac

SEQ ID NO: 1858899 - RNA, 22 nt, Homo sapiens
ugacggcagcugguucugcaau

SEQ ID NO: 1858900 - RNA, 16 nt, Homo sapiens
agccugaaaucaucuu

SEQ ID NO: 1858901 - RNA, 14 nt, Homo sapiens
uuuauccagaugac

SEQ ID NO: 1858902 - RNA, 22 nt, Homo sapiens
acaugucaaagcugcaugugua

SEQ ID NO: 1858903 - RNA, 21 nt, Homo sapiens
cauaauucaggggcugacacu

SEQ ID NO: 1858904 - RNA, 20 nt, Homo sapiens
uagauaagugcucaguauug

SEQ ID NO: 1858905 - RNA, 21 nt, Homo sapiens
aucuuacauauaauaaacuuu

SEQ ID NO: 1858906 - RNA, 17 nt, Homo sapiens
auuuagauauaacacua

SEQ ID NO: 1858907 - RNA, 17 nt, Homo sapiens
gaaaaguuauguagaaa

SEQ ID NO: 1858908 - RNA, 17 nt, Homo sapiens
gccagaugugguggcac

SEQ ID NO: 1858909 - RNA, 19 nt, Homo sapiens
gggaggaagccagaaucaa

SEQ ID NO: 1858910 - RNA, 21 nt, Homo sapiens
ugagggcaguucugcacccag

SEQ ID NO: 1858911 - RNA, 13 nt, Homo sapiens
gcuggucuucaau

SEQ ID NO: 1858912 - RNA, 15 nt, Homo sapiens
ugccucaacagcagg

SEQ ID NO: 1858913 - RNA, 11 nt, Homo sapiens
gagucuguucu

SEQ ID NO: 1858914 - RNA, 17 nt, Homo sapiens
auuuugugaauugccag

SEQ ID NO: 1858915 - RNA, 24 nt, Homo sapiens
aggcagcuucuacuccugccucau

SEQ ID NO: 1858916 - RNA, 14 nt, Homo sapiens
ugaaauacauauga

SEQ ID NO: 1858917 - RNA, 22 nt, Homo sapiens
gcaccuggcuaguuucuaacau

SEQ ID NO: 1858918 - RNA, 21 nt, Homo sapiens
gugaauuaggcuguaacuacu

SEQ ID NO: 1858919 - RNA, 13 nt, Homo sapiens
uaguagaaacggg

SEQ ID NO: 1858920 - RNA, 12 nt, Homo sapiens
caggcacugggc

SEQ ID NO: 1858921 - RNA, 15 nt, Homo sapiens
auuucaguucacugu

SEQ ID NO: 1858922 - RNA, 22 nt, Homo sapiens
agucccuuucagcugcugcuua

SEQ ID NO: 1858923 - RNA, 15 nt, Homo sapiens
uuauuagaagccaag

SEQ ID NO: 1858924 - RNA, 15 nt, Homo sapiens
aucuguugauggaga

SEQ ID NO: 1858925 - RNA, 20 nt, Homo sapiens
uccugggccacguaucaaca

SEQ ID NO: 1858926 - RNA, 13 nt, Homo sapiens
cuuucccagugag

SEQ ID NO: 1858927 - RNA, 16 nt, Homo sapiens
uuacaaguuugcuaaa

SEQ ID NO: 1858928 - RNA, 16 nt, Homo sapiens
aaacgaaaugcuauga

SEQ ID NO: 1858929 - RNA, 17 nt, Homo sapiens
ucacccccuccuucaua

SEQ ID NO: 1858930 - RNA, 20 nt, Homo sapiens
gugccugugggccugggaua

SEQ ID NO: 1858931 - RNA, 23 nt, Homo sapiens
gcaauaccauauggaaugccaaa

SEQ ID NO: 1858932 - RNA, 14 nt, Homo sapiens
ugagccaucauuuc

SEQ ID NO: 1858933 - RNA, 12 nt, Homo sapiens
uaaaagccauga

SEQ ID NO: 1858934 - RNA, 22 nt, Homo sapiens
cucagggagcagggaaggccug

SEQ ID NO: 1858935 - RNA, 20 nt, Homo sapiens
gauaucaguuaucaauguua

SEQ ID NO: 1858936 - RNA, 12 nt, Homo sapiens
auccaacuuuca

SEQ ID NO: 1858937 - RNA, 17 nt, Homo sapiens
caauucccucuacugug

SEQ ID NO: 1858938 - RNA, 23 nt, Homo sapiens
aaauuauaagcauacaacuggac

SEQ ID NO: 1858939 - RNA, 17 nt, Homo sapiens
cuuauacuguauaugau

SEQ ID NO: 1858940 - RNA, 19 nt, Homo sapiens
ugaaggugcuggaaaggga

SEQ ID NO: 1858941 - RNA, 22 nt, Homo sapiens
cuuugcagugaaagcuuucaug

SEQ ID NO: 1858942 - RNA, 19 nt, Homo sapiens
cuguuccugcaguagaaug

SEQ ID NO: 1858943 - RNA, 18 nt, Homo sapiens
guaucaaccaaauggagu

SEQ ID NO: 1858944 - RNA, 14 nt, Homo sapiens
uagcccaucuuccu

SEQ ID NO: 1858945 - RNA, 19 nt, Homo sapiens
uauugcagcuuauauucau

SEQ ID NO: 1858946 - RNA, 20 nt, Homo sapiens
aaugaacccccaugauguaa

SEQ ID NO: 1858947 - RNA, 11 nt, Homo sapiens
aaaaaaccaca

SEQ ID NO: 1858948 - RNA, 22 nt, Homo sapiens
cacaccugggcauuuggugaga

SEQ ID NO: 1858949 - RNA, 21 nt, Homo sapiens
ucaagcaauccuccugccuca

SEQ ID NO: 1858950 - RNA, 20 nt, Homo sapiens
auagcuacuuuggaggacaa

SEQ ID NO: 1858951 - RNA, 23 nt, Homo sapiens
aauggcacgaucucagcucacca

SEQ ID NO: 1858952 - RNA, 21 nt, Homo sapiens
acguccaguguacagugaauc

SEQ ID NO: 1858953 - RNA, 15 nt, Homo sapiens
agaaaaaacaccacc

SEQ ID NO: 1858954 - RNA, 15 nt, Homo sapiens
cuuacacaucuucca

SEQ ID NO: 1858955 - RNA, 20 nt, Homo sapiens
uuagaguuucaaccaugaag

SEQ ID NO: 1858956 - RNA, 19 nt, Homo sapiens
ucccuuucuugagggaguu

SEQ ID NO: 1858957 - RNA, 18 nt, Homo sapiens
ugcaggagcuaguucuca

SEQ ID NO: 1858958 - RNA, 14 nt, Homo sapiens
aaugcauggugcag

SEQ ID NO: 1858959 - RNA, 14 nt, Homo sapiens
acccuccuucccac

SEQ ID NO: 1858960 - RNA, 15 nt, Homo sapiens
aucuguguugucucu

SEQ ID NO: 1858961 - RNA, 14 nt, Homo sapiens
cguggaaggcugua

SEQ ID NO: 1858962 - RNA, 13 nt, Homo sapiens
guuaggaguuaau

SEQ ID NO: 1858963 - RNA, 13 nt, Homo sapiens
uuuauaaauuacu

SEQ ID NO: 1858964 - RNA, 22 nt, Homo sapiens
aacuaucuuuuuuuuauuccac

SEQ ID NO: 1858965 - RNA, 17 nt, Homo sapiens
ugcugggauuacaggug

SEQ ID NO: 1858966 - RNA, 16 nt, Homo sapiens
uuuauaucacaauuua

SEQ ID NO: 1858967 - RNA, 17 nt, Homo sapiens
cugcugccucccuuuca

SEQ ID NO: 1858968 - RNA, 23 nt, Homo sapiens
cucuccuuucugugcauucaugc

SEQ ID NO: 1858969 - RNA, 19 nt, Homo sapiens
ccugauagaagugcauucu

SEQ ID NO: 1858970 - RNA, 15 nt, Homo sapiens
gcccuuccugaagaa

SEQ ID NO: 1858971 - RNA, 11 nt, Homo sapiens
cagcaucaggg

SEQ ID NO: 1858972 - RNA, 18 nt, Homo sapiens
cccaggcuagagugcagu

SEQ ID NO: 1858973 - RNA, 18 nt, Homo sapiens
cccaggcuggagugcaau

SEQ ID NO: 1858974 - RNA, 21 nt, Homo sapiens
ugcuuuggucacuuuuagaug

SEQ ID NO: 1858975 - RNA, 22 nt, Homo sapiens
gaaaggagguuaggucuuagga

SEQ ID NO: 1858976 - RNA, 19 nt, Homo sapiens
gcaugagcuacgccugccu

SEQ ID NO: 1858977 - RNA, 21 nt, Homo sapiens
acuccagcuugggcaacagag

SEQ ID NO: 1858978 - RNA, 18 nt, Homo sapiens
aaucauaugguugacagu

SEQ ID NO: 1858979 - RNA, 14 nt, Homo sapiens
gcauugcacaggga

SEQ ID NO: 1858980 - RNA, 14 nt, Homo sapiens
acuucuguuuccau

SEQ ID NO: 1858981 - RNA, 16 nt, Homo sapiens
ucaacagauaaaugac

SEQ ID NO: 1858982 - RNA, 19 nt, Homo sapiens
cccagaaaagaaagcuaca

SEQ ID NO: 1858983 - RNA, 21 nt, Homo sapiens
gcagagccucccaaggagaac

SEQ ID NO: 1858984 - RNA, 21 nt, Homo sapiens
gaacaaauguguuuuucuaua

SEQ ID NO: 1858985 - RNA, 20 nt, Homo sapiens
agugcaguggcaugauguca

SEQ ID NO: 1858986 - RNA, 15 nt, Homo sapiens
aaugauacugugaga

SEQ ID NO: 1858987 - RNA, 16 nt, Homo sapiens
aaaucauuuucauuaa

SEQ ID NO: 1858988 - RNA, 21 nt, Homo sapiens
aauauccagugagcucuuuag

SEQ ID NO: 1858989 - RNA, 18 nt, Homo sapiens
cgagcuccagagcaacga

SEQ ID NO: 1858990 - RNA, 21 nt, Homo sapiens
uaaaucaguguuugauugccc

SEQ ID NO: 1858991 - RNA, 15 nt, Homo sapiens
gcugauacuaucucu

SEQ ID NO: 1858992 - RNA, 16 nt, Homo sapiens
aaacauuuaacucaga

SEQ ID NO: 1858993 - RNA, 16 nt, Homo sapiens
ggccguggcacagcug

SEQ ID NO: 1858994 - RNA, 19 nt, Homo sapiens
cauauauuuaauaugucaa

SEQ ID NO: 1858995 - RNA, 15 nt, Homo sapiens
uguuguacauuucac

SEQ ID NO: 1858996 - RNA, 13 nt, Homo sapiens
uuaaaacagaagc

SEQ ID NO: 1858997 - RNA, 13 nt, Homo sapiens
uauuaaugcuuug

SEQ ID NO: 1858998 - RNA, 16 nt, Homo sapiens
cugcaagucacauaaa

SEQ ID NO: 1858999 - RNA, 12 nt, Homo sapiens
uagaaaaaccac

SEQ ID NO: 1859000 - RNA, 23 nt, Homo sapiens
aacguccagcucguucucugggc

SEQ ID NO: 1859001 - RNA, 21 nt, Homo sapiens
gcacagggagugcacauaucc

SEQ ID NO: 1859002 - RNA, 19 nt, Homo sapiens
aacaccgcuucugccuuuu

SEQ ID NO: 1859003 - RNA, 18 nt, Homo sapiens
uuucaggaccuuaguucc

SEQ ID NO: 1859004 - RNA, 15 nt, Homo sapiens
cucaagacaaaugac

SEQ ID NO: 1859005 - RNA, 18 nt, Homo sapiens
aacugacuuaaguggcau

SEQ ID NO: 1859006 - RNA, 16 nt, Homo sapiens
uuaaauaaaagcacaa

SEQ ID NO: 1859007 - RNA, 22 nt, Homo sapiens
aaauugaugguggccacagugu

SEQ ID NO: 1859008 - RNA, 13 nt, Homo sapiens
gcccagacccacu

SEQ ID NO: 1859009 - RNA, 17 nt, Homo sapiens
ccccucuggauucccuu

SEQ ID NO: 1859010 - RNA, 20 nt, Homo sapiens
guaacuuauuaucacuuugg

SEQ ID NO: 1859011 - RNA, 10 nt, Homo sapiens
gaaccaaaga

SEQ ID NO: 1859012 - RNA, 16 nt, Homo sapiens
ucagcauccaguguga

SEQ ID NO: 1859013 - RNA, 15 nt, Homo sapiens
uccaucccgaaaauc

SEQ ID NO: 1859014 - RNA, 18 nt, Homo sapiens
aggagccaccaguucuca

SEQ ID NO: 1859015 - RNA, 16 nt, Homo sapiens
gucaucuucaauuuau

SEQ ID NO: 1859016 - RNA, 23 nt, Homo sapiens
gcaacaagaaacucaaugcacaa

SEQ ID NO: 1859017 - RNA, 20 nt, Homo sapiens
acaugguaaacuuuugguuu

SEQ ID NO: 1859018 - RNA, 15 nt, Homo sapiens
cagguggaaugugua

SEQ ID NO: 1859019 - RNA, 21 nt, Homo sapiens
acauaaaauaagagauccuuu

SEQ ID NO: 1859020 - RNA, 20 nt, Homo sapiens
aacccagcggcucuagccac

SEQ ID NO: 1859021 - RNA, 17 nt, Homo sapiens
cccacaccugcagugcc

SEQ ID NO: 1859022 - RNA, 17 nt, Homo sapiens
agacugaagacugcaca

SEQ ID NO: 1859023 - RNA, 22 nt, Homo sapiens
aauuaccuuuaaugcaaugcau

SEQ ID NO: 1859024 - RNA, 20 nt, Homo sapiens
cgugugacucgccagcucau

SEQ ID NO: 1859025 - RNA, 14 nt, Homo sapiens
ccaauaaaauuucu

SEQ ID NO: 1859026 - RNA, 15 nt, Homo sapiens
ugaggaugagcugga

SEQ ID NO: 1859027 - RNA, 17 nt, Homo sapiens
uaaguguauuuugaaau

SEQ ID NO: 1859028 - RNA, 12 nt, Homo sapiens
cuagagcuccau

SEQ ID NO: 1859029 - RNA, 14 nt, Homo sapiens
cagcaucugaccau

SEQ ID NO: 1859030 - RNA, 14 nt, Homo sapiens
gucucacucuguca

SEQ ID NO: 1859031 - RNA, 21 nt, Homo sapiens
cacuaugaaucuauuauacug

SEQ ID NO: 1859032 - RNA, 20 nt, Homo sapiens
acaccuggcccuugcaaucu

SEQ ID NO: 1859033 - RNA, 13 nt, Homo sapiens
ucagaacaaggua

SEQ ID NO: 1859034 - RNA, 23 nt, Homo sapiens
gaaauauuuccauuaacagcaau

SEQ ID NO: 1859035 - RNA, 13 nt, Homo sapiens
ucacccaucagga

SEQ ID NO: 1859036 - RNA, 17 nt, Homo sapiens
gaaugcacaguacuguu

SEQ ID NO: 1859037 - RNA, 17 nt, Homo sapiens
caggcacugaagcuccu

SEQ ID NO: 1859038 - RNA, 22 nt, Homo sapiens
acguguccguccacccuuccau

SEQ ID NO: 1859039 - RNA, 13 nt, Homo sapiens
accaaaaagggau

SEQ ID NO: 1859040 - RNA, 14 nt, Homo sapiens
cugcccaccucucu

SEQ ID NO: 1859041 - RNA, 16 nt, Homo sapiens
gagcaaaggcugagaa

SEQ ID NO: 1859042 - RNA, 22 nt, Homo sapiens
gcccacagcaggggcuggccca

SEQ ID NO: 1859043 - RNA, 14 nt, Homo sapiens
ggagucuugcucug

SEQ ID NO: 1859044 - RNA, 15 nt, Homo sapiens
agaacugcagggccu

SEQ ID NO: 1859045 - RNA, 15 nt, Homo sapiens
aucaugauaauucag

SEQ ID NO: 1859046 - RNA, 12 nt, Homo sapiens
cuacaugcacuu

SEQ ID NO: 1859047 - RNA, 21 nt, Homo sapiens
agguucugcccuuauggagcu

SEQ ID NO: 1859048 - RNA, 11 nt, Homo sapiens
augaagacacu

SEQ ID NO: 1859049 - RNA, 22 nt, Homo sapiens
cacauaaccucucugugccauc

SEQ ID NO: 1859050 - RNA, 18 nt, Homo sapiens
uucaaggauaggcuuuau

SEQ ID NO: 1859051 - RNA, 20 nt, Homo sapiens
auuucugagagugaaaccau

SEQ ID NO: 1859052 - RNA, 23 nt, Homo sapiens
uggccaggcuggucuaaaacucc

SEQ ID NO: 1859053 - RNA, 15 nt, Homo sapiens
cgauccguuugcaag

SEQ ID NO: 1859054 - RNA, 16 nt, Homo sapiens
cuucuauaaaugcaaa

SEQ ID NO: 1859055 - RNA, 22 nt, Homo sapiens
acuuuuguguaucguaaccagc

SEQ ID NO: 1859056 - RNA, 16 nt, Homo sapiens
cugaccccgccaugca

SEQ ID NO: 1859057 - RNA, 14 nt, Homo sapiens
auguuuccagaaaa

SEQ ID NO: 1859058 - RNA, 20 nt, Homo sapiens
ucauggaaaagccuucuuau

SEQ ID NO: 1859059 - RNA, 22 nt, Homo sapiens
cuaauagaauaaaggcaguuuu

SEQ ID NO: 1859060 - RNA, 14 nt, Homo sapiens
acauucacacuggg

SEQ ID NO: 1859061 - RNA, 20 nt, Homo sapiens
ucaucgggguggugcaggcu

SEQ ID NO: 1859062 - RNA, 19 nt, Homo sapiens
cccagagcacccagaucag

SEQ ID NO: 1859063 - RNA, 17 nt, Homo sapiens
uucuuaacagucuccaa

SEQ ID NO: 1859064 - RNA, 16 nt, Homo sapiens
uguaaaagggcucucu

SEQ ID NO: 1859065 - RNA, 13 nt, Homo sapiens
cugcaucuaagca

SEQ ID NO: 1859066 - RNA, 13 nt, Homo sapiens
aacaaucucucaa

SEQ ID NO: 1859067 - RNA, 14 nt, Homo sapiens
ggacucucuaagga

SEQ ID NO: 1859068 - RNA, 14 nt, Homo sapiens
uaagagaaggccuu

SEQ ID NO: 1859069 - RNA, 19 nt, Homo sapiens
cagugauagaacaaaagag

SEQ ID NO: 1859070 - RNA, 17 nt, Homo sapiens
gguuuuccuguugagau

SEQ ID NO: 1859071 - RNA, 16 nt, Homo sapiens
ugugggagaccgagga

SEQ ID NO: 1859072 - RNA, 17 nt, Homo sapiens
auuguuuccugagcaua

SEQ ID NO: 1859073 - RNA, 16 nt, Homo sapiens
ucauauuuauagccag

SEQ ID NO: 1859074 - RNA, 19 nt, Homo sapiens
cuuccaacccgaggcaaua

SEQ ID NO: 1859075 - RNA, 16 nt, Homo sapiens
ucugugcagucacugg

SEQ ID NO: 1859076 - RNA, 23 nt, Homo sapiens
cucucaaaccugugcugaccaaa

SEQ ID NO: 1859077 - RNA, 16 nt, Homo sapiens
ugccagcauaugcaga

SEQ ID NO: 1859078 - RNA, 14 nt, Homo sapiens
cagacgcucauuca

SEQ ID NO: 1859079 - RNA, 16 nt, Homo sapiens
accacagucuuagggg

SEQ ID NO: 1859080 - RNA, 19 nt, Homo sapiens
gucaaccugccugacauuu

SEQ ID NO: 1859081 - RNA, 23 nt, Homo sapiens
ugaggggaggaguuccacagauu

SEQ ID NO: 1859082 - RNA, 19 nt, Homo sapiens
agaaaaguguaaugcaaga

SEQ ID NO: 1859083 - RNA, 17 nt, Homo sapiens
ggagggcagguccagcu

SEQ ID NO: 1859084 - RNA, 15 nt, Homo sapiens
ucuuuucaucuggga

SEQ ID NO: 1859085 - RNA, 14 nt, Homo sapiens
gacguuaggccagg

SEQ ID NO: 1859086 - RNA, 18 nt, Homo sapiens
cugucacuacacacuaaa

SEQ ID NO: 1859087 - RNA, 16 nt, Homo sapiens
agucacugcucuucag

SEQ ID NO: 1859088 - RNA, 17 nt, Homo sapiens
acaugcauugcucuuau

SEQ ID NO: 1859089 - RNA, 16 nt, Homo sapiens
ugauuugauaccaugg

SEQ ID NO: 1859090 - RNA, 12 nt, Homo sapiens
acaggugccuug

SEQ ID NO: 1859091 - RNA, 15 nt, Homo sapiens
cucaagaucaaugaa

SEQ ID NO: 1859092 - RNA, 23 nt, Homo sapiens
ucuggcaauggaugaacugaaag

SEQ ID NO: 1859093 - RNA, 20 nt, Homo sapiens
uccuccuggaacagaagaca

SEQ ID NO: 1859094 - RNA, 15 nt, Homo sapiens
uuuccucccugcuua

SEQ ID NO: 1859095 - RNA, 19 nt, Homo sapiens
cagggauuuagcccaugac

SEQ ID NO: 1859096 - RNA, 11 nt, Homo sapiens
uuccccggagc

SEQ ID NO: 1859097 - RNA, 11 nt, Homo sapiens
ugccccggcug

SEQ ID NO: 1859098 - RNA, 21 nt, Homo sapiens
cccaggcugcuggagugcagu

SEQ ID NO: 1859099 - RNA, 20 nt, Homo sapiens
uuuaauuccaugucagauaa

SEQ ID NO: 1859100 - RNA, 21 nt, Homo sapiens
guacaaguauauaauauguca

SEQ ID NO: 1859101 - RNA, 18 nt, Homo sapiens
augucagucucucaccac

SEQ ID NO: 1859102 - RNA, 13 nt, Homo sapiens
cgcagcacaagcu

SEQ ID NO: 1859103 - RNA, 23 nt, Homo sapiens
augccaauacuagucaccccaag

SEQ ID NO: 1859104 - RNA, 21 nt, Homo sapiens
caagauuuccuacuuucuccu

SEQ ID NO: 1859105 - RNA, 21 nt, Homo sapiens
auguuggccuccaguccuuaa

SEQ ID NO: 1859106 - RNA, 22 nt, Homo sapiens
ucccuccccuccccguccacag

SEQ ID NO: 1859107 - RNA, 21 nt, Homo sapiens
aguaacacaguggacuuccua

SEQ ID NO: 1859108 - RNA, 14 nt, Homo sapiens
aaccacacacaccu

SEQ ID NO: 1859109 - RNA, 17 nt, Homo sapiens
aucccagcuacucaaga

SEQ ID NO: 1859110 - RNA, 19 nt, Homo sapiens
gccuucugauaguauuccu

SEQ ID NO: 1859111 - RNA, 12 nt, Homo sapiens
aaccaggguuca

SEQ ID NO: 1859112 - RNA, 20 nt, Homo sapiens
augccucucucaggccaaac

SEQ ID NO: 1859113 - RNA, 15 nt, Homo sapiens
aagcucagacuugcc

SEQ ID NO: 1859114 - RNA, 23 nt, Homo sapiens
agugaacagguucuccaggugau

SEQ ID NO: 1859115 - RNA, 15 nt, Homo sapiens
aaugcaucacaugau

SEQ ID NO: 1859116 - RNA, 22 nt, Homo sapiens
gccuccaaggaaacuuugccaa

SEQ ID NO: 1859117 - RNA, 19 nt, Homo sapiens
uccuuucuccaggaccaau

SEQ ID NO: 1859118 - RNA, 21 nt, Homo sapiens
ccuccucuccuacuuugggac

SEQ ID NO: 1859119 - RNA, 16 nt, Homo sapiens
guccuacugcugugag

SEQ ID NO: 1859120 - RNA, 14 nt, Homo sapiens
augugguacuugag

SEQ ID NO: 1859121 - RNA, 19 nt, Homo sapiens
ucuggaauugauauugaau

SEQ ID NO: 1859122 - RNA, 14 nt, Homo sapiens
auaaaaugaaauac

SEQ ID NO: 1859123 - RNA, 13 nt, Homo sapiens
gagcaacugcugu

SEQ ID NO: 1859124 - RNA, 18 nt, Homo sapiens
agcugcugcuggaucaca

SEQ ID NO: 1859125 - RNA, 18 nt, Homo sapiens
gggagcauggagggaugg

SEQ ID NO: 1859126 - RNA, 22 nt, Homo sapiens
ccugaguaauaagcaugguguc

SEQ ID NO: 1859127 - RNA, 20 nt, Homo sapiens
ccagccguauuuuacaugaa

SEQ ID NO: 1859128 - RNA, 21 nt, Homo sapiens
aggcuggagugcaguggcuca

SEQ ID NO: 1859129 - RNA, 23 nt, Homo sapiens
cugcacagccuagacauccaggu

SEQ ID NO: 1859130 - RNA, 13 nt, Homo sapiens
uggcccuccgccc

SEQ ID NO: 1859131 - RNA, 12 nt, Homo sapiens
cccagacagcuc

SEQ ID NO: 1859132 - RNA, 18 nt, Homo sapiens
ccaaauaaaauguucccu

SEQ ID NO: 1859133 - RNA, 19 nt, Homo sapiens
uaacgacuucuccaucucc

SEQ ID NO: 1859134 - RNA, 19 nt, Homo sapiens
aacaaaaagaaaaacaaau

SEQ ID NO: 1859135 - RNA, 15 nt, Homo sapiens
uguaaagacacaucu

SEQ ID NO: 1859136 - RNA, 23 nt, Homo sapiens
aaacaauuaauugagcagcauga

SEQ ID NO: 1859137 - RNA, 14 nt, Homo sapiens
aguuaagcaugacu

SEQ ID NO: 1859138 - RNA, 18 nt, Homo sapiens
gcacauagagauaugcac

SEQ ID NO: 1859139 - RNA, 12 nt, Homo sapiens
ggaggccaccuc

SEQ ID NO: 1859140 - RNA, 15 nt, Homo sapiens
gaaaggcuucuggga

SEQ ID NO: 1859141 - RNA, 18 nt, Homo sapiens
agaaaauuuccuccacau

SEQ ID NO: 1859142 - RNA, 22 nt, Homo sapiens
aggccugcaccaaaugucagaa

SEQ ID NO: 1859143 - RNA, 13 nt, Homo sapiens
cauuaaugccaca

SEQ ID NO: 1859144 - RNA, 20 nt, Homo sapiens
ugacagcuuucuaacucaca

SEQ ID NO: 1859145 - RNA, 20 nt, Homo sapiens
aaccuccgcauccgggguuc

SEQ ID NO: 1859146 - RNA, 18 nt, Homo sapiens
uguuuuaggucuagccua

SEQ ID NO: 1859147 - RNA, 22 nt, Homo sapiens
ugcugccucccuuucauacaau

SEQ ID NO: 1859148 - RNA, 13 nt, Homo sapiens
gggagacucugaa

SEQ ID NO: 1859149 - RNA, 17 nt, Homo sapiens
cucuaugccaggcugug

SEQ ID NO: 1859150 - RNA, 19 nt, Homo sapiens
caaaaaccuauuccacuua

SEQ ID NO: 1859151 - RNA, 17 nt, Homo sapiens
ccugacacggacugugc

SEQ ID NO: 1859152 - RNA, 17 nt, Homo sapiens
ggugagucacacucaga

SEQ ID NO: 1859153 - RNA, 15 nt, Homo sapiens
agaacagagugcaac

SEQ ID NO: 1859154 - RNA, 20 nt, Homo sapiens
guuuuuaauuuaucagagac

SEQ ID NO: 1859155 - RNA, 22 nt, Homo sapiens
ugacaauaaaggaacuaauccu

SEQ ID NO: 1859156 - RNA, 22 nt, Homo sapiens
cagcugcauuaaaacaaaggaa

SEQ ID NO: 1859157 - RNA, 16 nt, Homo sapiens
ucagcugaacacccuc

SEQ ID NO: 1859158 - RNA, 19 nt, Homo sapiens
gucaucaucacccuuucau

SEQ ID NO: 1859159 - RNA, 13 nt, Homo sapiens
ugcucccaucauu

SEQ ID NO: 1859160 - RNA, 15 nt, Homo sapiens
ggauugacucugcau

SEQ ID NO: 1859161 - RNA, 22 nt, Homo sapiens
ugaagacaugggugaacuuacu

SEQ ID NO: 1859162 - RNA, 18 nt, Homo sapiens
ugaaggugcugacaaaga

SEQ ID NO: 1859163 - RNA, 17 nt, Homo sapiens
ugauucucagcacuugg

SEQ ID NO: 1859164 - RNA, 15 nt, Homo sapiens
cuuuauauauggaca

SEQ ID NO: 1859165 - RNA, 22 nt, Homo sapiens
acaauucucucuuauaugugua

SEQ ID NO: 1859166 - RNA, 17 nt, Homo sapiens
cccaaguucaagugauu

SEQ ID NO: 1859167 - RNA, 16 nt, Homo sapiens
gcgcagcgcgugcaca

SEQ ID NO: 1859168 - RNA, 15 nt, Homo sapiens
agccacauacuagca

SEQ ID NO: 1859169 - RNA, 12 nt, Homo sapiens
gucuuagcuuua

SEQ ID NO: 1859170 - RNA, 14 nt, Homo sapiens
aauauagguaaaua

SEQ ID NO: 1859171 - RNA, 20 nt, Homo sapiens
cagcugaagccagcucccug

SEQ ID NO: 1859172 - RNA, 20 nt, Homo sapiens
gugcuguggcccaggccaga

SEQ ID NO: 1859173 - RNA, 22 nt, Homo sapiens
uuugcuaaugcaauuagcauua

SEQ ID NO: 1859174 - RNA, 19 nt, Homo sapiens
acagaggauuguauugcaa

SEQ ID NO: 1859175 - RNA, 14 nt, Homo sapiens
ugaggccucucauu

SEQ ID NO: 1859176 - RNA, 21 nt, Homo sapiens
cacugggggaacagaugcuaa

SEQ ID NO: 1859177 - RNA, 20 nt, Homo sapiens
gcauaucaacuugaggccag

SEQ ID NO: 1859178 - RNA, 15 nt, Homo sapiens
gcucagucagacaug

SEQ ID NO: 1859179 - RNA, 16 nt, Homo sapiens
ucagcucuuugacaac

SEQ ID NO: 1859180 - RNA, 15 nt, Homo sapiens
cagcagcaacaacug

SEQ ID NO: 1859181 - RNA, 20 nt, Homo sapiens
uucccaagcucuagugggaa

SEQ ID NO: 1859182 - RNA, 20 nt, Homo sapiens
ucuuggccggauguccucag

SEQ ID NO: 1859183 - RNA, 16 nt, Homo sapiens
gggcugggccaggucu

SEQ ID NO: 1859184 - RNA, 15 nt, Homo sapiens
caugaauuccuuaaa

SEQ ID NO: 1859185 - RNA, 21 nt, Homo sapiens
cucauaacugggugguuugag

SEQ ID NO: 1859186 - RNA, 14 nt, Homo sapiens
acgcaaggugugcu

SEQ ID NO: 1859187 - RNA, 16 nt, Homo sapiens
aucccuuaccucggug

SEQ ID NO: 1859188 - RNA, 16 nt, Homo sapiens
ccuuguagcaaagcac

SEQ ID NO: 1859189 - RNA, 16 nt, Homo sapiens
agcaaauuugugguug

SEQ ID NO: 1859190 - RNA, 23 nt, Homo sapiens
gucccucaauuacagaggguagg

SEQ ID NO: 1859191 - RNA, 15 nt, Homo sapiens
caggggaagcucuca

SEQ ID NO: 1859192 - RNA, 23 nt, Homo sapiens
guaacauacuggccuggacuguu

SEQ ID NO: 1859193 - RNA, 15 nt, Homo sapiens
uaagauguguuccuu

SEQ ID NO: 1859194 - RNA, 16 nt, Homo sapiens
guauuaacuauuggua

SEQ ID NO: 1859195 - RNA, 13 nt, Homo sapiens
uaaaccaccaucu

SEQ ID NO: 1859196 - RNA, 13 nt, Homo sapiens
aucugcaaugugg

SEQ ID NO: 1859197 - RNA, 15 nt, Homo sapiens
cuauccuggagacuu

SEQ ID NO: 1859198 - RNA, 16 nt, Homo sapiens
ccaaaaauacagccua

SEQ ID NO: 1859199 - RNA, 22 nt, Homo sapiens
cuaagauauuuugaacuaagca

SEQ ID NO: 1859200 - RNA, 14 nt, Homo sapiens
gcccccaucaccca

SEQ ID NO: 1859201 - RNA, 19 nt, Homo sapiens
cauuucauugcagauaugg

SEQ ID NO: 1859202 - RNA, 19 nt, Homo sapiens
guacuguuuuccaguucau

SEQ ID NO: 1859203 - RNA, 13 nt, Homo sapiens
aaacuguauauaa

SEQ ID NO: 1859204 - RNA, 15 nt, Homo sapiens
ugcaggugaugccau

SEQ ID NO: 1859205 - RNA, 13 nt, Homo sapiens
caguuuagcaaga

SEQ ID NO: 1859206 - RNA, 14 nt, Homo sapiens
uguggaaaaaucca

SEQ ID NO: 1859207 - RNA, 13 nt, Homo sapiens
uagaaaaaccacc

SEQ ID NO: 1859208 - RNA, 16 nt, Homo sapiens
acuauaaaaaucaugu

SEQ ID NO: 1859209 - RNA, 17 nt, Homo sapiens
uucuuguagaugcauua

SEQ ID NO: 1859210 - RNA, 21 nt, Homo sapiens
gucuaacauauucaaugcaag

SEQ ID NO: 1859211 - RNA, 22 nt, Homo sapiens
cugccucugacagcagccugug

SEQ ID NO: 1859212 - RNA, 17 nt, Homo sapiens
auauguacaauuguggg

SEQ ID NO: 1859213 - RNA, 17 nt, Homo sapiens
uucauguugccuugcau

SEQ ID NO: 1859214 - RNA, 15 nt, Homo sapiens
cucagcuacugccaa

SEQ ID NO: 1859215 - RNA, 21 nt, Homo sapiens
aaucauaucuuuuaauugugu

SEQ ID NO: 1859216 - RNA, 21 nt, Homo sapiens
agucuuggaaaaaaaccacag

SEQ ID NO: 1859217 - RNA, 20 nt, Homo sapiens
acaauguucuggcacuauua

SEQ ID NO: 1859218 - RNA, 22 nt, Homo sapiens
gcugcuucuccucccagcgugu

SEQ ID NO: 1859219 - RNA, 23 nt, Homo sapiens
ccuaucuaacccucccauggcac

SEQ ID NO: 1859220 - RNA, 14 nt, Homo sapiens
acagaaaccaagga

SEQ ID NO: 1859221 - RNA, 16 nt, Homo sapiens
guuugcuuaaugccag

SEQ ID NO: 1859222 - RNA, 13 nt, Homo sapiens
gcucuaguuuuca

SEQ ID NO: 1859223 - RNA, 23 nt, Homo sapiens
agguuauuuuccgccagaccuca

SEQ ID NO: 1859224 - RNA, 18 nt, Homo sapiens
ugagaaggaacuuuguca

SEQ ID NO: 1859225 - RNA, 19 nt, Homo sapiens
uccacucaauaugugauuu

SEQ ID NO: 1859226 - RNA, 19 nt, Homo sapiens
uucaagucaacaugcauau

SEQ ID NO: 1859227 - RNA, 20 nt, Homo sapiens
ugggggaucagcagggcagu

SEQ ID NO: 1859228 - RNA, 12 nt, Homo sapiens
ccuguugggaga

SEQ ID NO: 1859229 - RNA, 18 nt, Homo sapiens
cauugagaucacuacuca

SEQ ID NO: 1859230 - RNA, 22 nt, Homo sapiens
gccuugggccucaucugcuccu

SEQ ID NO: 1859231 - RNA, 14 nt, Homo sapiens
cacucccauggcuc

SEQ ID NO: 1859232 - RNA, 19 nt, Homo sapiens
aaagaacuuuagcauggua

SEQ ID NO: 1859233 - RNA, 19 nt, Homo sapiens
guaugaguggcuucuggga

SEQ ID NO: 1859234 - RNA, 18 nt, Homo sapiens
cuuaugggcccagccagc

SEQ ID NO: 1859235 - RNA, 14 nt, Homo sapiens
ggcacuugggacaa

SEQ ID NO: 1859236 - RNA, 18 nt, Homo sapiens
aauguggacucaaucccu

SEQ ID NO: 1859237 - RNA, 23 nt, Homo sapiens
gcugccuucccuagcuuuagacc

SEQ ID NO: 1859238 - RNA, 17 nt, Homo sapiens
guuuuguuugcuaucuu

SEQ ID NO: 1859239 - RNA, 14 nt, Homo sapiens
cauuacuauucacu

SEQ ID NO: 1859240 - RNA, 14 nt, Homo sapiens
gcuagcagaaguau

SEQ ID NO: 1859241 - RNA, 17 nt, Homo sapiens
auucucaguauccacug

SEQ ID NO: 1859242 - RNA, 13 nt, Homo sapiens
cugcacugugaac

SEQ ID NO: 1859243 - RNA, 16 nt, Homo sapiens
aguguacagaguggaa

SEQ ID NO: 1859244 - RNA, 15 nt, Homo sapiens
uccaucaucacugua

SEQ ID NO: 1859245 - RNA, 16 nt, Homo sapiens
agaaaaucacugugcu

SEQ ID NO: 1859246 - RNA, 18 nt, Homo sapiens
ucuaucaggggugcauuc

SEQ ID NO: 1859247 - RNA, 13 nt, Homo sapiens
acaucucugggaa

SEQ ID NO: 1859248 - RNA, 24 nt, Homo sapiens
auguucccaguucaacucauggag

SEQ ID NO: 1859249 - RNA, 11 nt, Homo sapiens
cuaacaaaguu

SEQ ID NO: 1859250 - RNA, 19 nt, Homo sapiens
ccccgccuccacucuaguu

SEQ ID NO: 1859251 - RNA, 19 nt, Homo sapiens
cagagguugcagugagcug

SEQ ID NO: 1859252 - RNA, 21 nt, Homo sapiens
cggacucacuauggccagaaa

SEQ ID NO: 1859253 - RNA, 15 nt, Homo sapiens
aggcuggagugcagu

SEQ ID NO: 1859254 - RNA, 15 nt, Homo sapiens
aggcuagagugcaau

SEQ ID NO: 1859255 - RNA, 23 nt, Homo sapiens
agcaaaaugguuuuuaaguacuu

SEQ ID NO: 1859256 - RNA, 21 nt, Homo sapiens
aaagaagcugucuuggaaguc

SEQ ID NO: 1859257 - RNA, 16 nt, Homo sapiens
guuucuccaaguacuu

SEQ ID NO: 1859258 - RNA, 19 nt, Homo sapiens
ucggauuugccauagccuu

SEQ ID NO: 1859259 - RNA, 13 nt, Homo sapiens
aggacaaagugcc

SEQ ID NO: 1859260 - RNA, 22 nt, Homo sapiens
uggucaccaaggcagugcaugc

SEQ ID NO: 1859261 - RNA, 19 nt, Homo sapiens
aguguucccagagcacuuu

SEQ ID NO: 1859262 - RNA, 12 nt, Homo sapiens
cuuuguucucau

SEQ ID NO: 1859263 - RNA, 13 nt, Homo sapiens
augcaugugcugu

SEQ ID NO: 1859264 - RNA, 19 nt, Homo sapiens
uuacaguggcaguauugac

SEQ ID NO: 1859265 - RNA, 17 nt, Homo sapiens
gucccagagcagaggaa

SEQ ID NO: 1859266 - RNA, 17 nt, Homo sapiens
ccucacugccguccuca

SEQ ID NO: 1859267 - RNA, 14 nt, Homo sapiens
uaugugauguggca

SEQ ID NO: 1859268 - RNA, 13 nt, Homo sapiens
cucucaaugcugu

SEQ ID NO: 1859269 - RNA, 16 nt, Homo sapiens
accccuaggaacucag

SEQ ID NO: 1859270 - RNA, 20 nt, Homo sapiens
gagaaauuugccuuguucaa

SEQ ID NO: 1859271 - RNA, 19 nt, Homo sapiens
cauucugaaucaagcacac

SEQ ID NO: 1859272 - RNA, 16 nt, Homo sapiens
gcaaggcugcccuguc

SEQ ID NO: 1859273 - RNA, 21 nt, Homo sapiens
guauucuguuugcguacuugu

SEQ ID NO: 1859274 - RNA, 14 nt, Homo sapiens
cacacucagcacaa

SEQ ID NO: 1859275 - RNA, 17 nt, Homo sapiens
ggaaacugcuccagcuc

SEQ ID NO: 1859276 - RNA, 23 nt, Homo sapiens
auaaauaugguuaauuucaugua

SEQ ID NO: 1859277 - RNA, 19 nt, Homo sapiens
cuccuuguggccuaugaaa

SEQ ID NO: 1859278 - RNA, 20 nt, Homo sapiens
ccuacuuauuucagauucac

SEQ ID NO: 1859279 - RNA, 19 nt, Homo sapiens
agcgggcuugacugcauug

SEQ ID NO: 1859280 - RNA, 15 nt, Homo sapiens
acuuugcacauuuug

SEQ ID NO: 1859281 - RNA, 15 nt, Homo sapiens
cacaagcaaccaaug

SEQ ID NO: 1859282 - RNA, 13 nt, Homo sapiens
aacuucaccugca

SEQ ID NO: 1859283 - RNA, 18 nt, Homo sapiens
gaaggaacuuugucacau

SEQ ID NO: 1859284 - RNA, 15 nt, Homo sapiens
aaguaauucuuuucc

SEQ ID NO: 1859285 - RNA, 12 nt, Homo sapiens
agcagugcagua

SEQ ID NO: 1859286 - RNA, 21 nt, Homo sapiens
gcagaggccggcccuggccau

SEQ ID NO: 1859287 - RNA, 23 nt, Homo sapiens
ugggcucugugcagucacuggag

SEQ ID NO: 1859288 - RNA, 19 nt, Homo sapiens
ggcagcuuuuucauaccaa

SEQ ID NO: 1859289 - RNA, 14 nt, Homo sapiens
aggggccugggaaa

SEQ ID NO: 1859290 - RNA, 20 nt, Homo sapiens
ucuuccuaccaaauauaaac

SEQ ID NO: 1859291 - RNA, 17 nt, Homo sapiens
acauauguaaacauaag

SEQ ID NO: 1859292 - RNA, 21 nt, Homo sapiens
uucauuagugagccaugaaau

SEQ ID NO: 1859293 - RNA, 22 nt, Homo sapiens
gcccagacacagacuggcaaua

SEQ ID NO: 1859294 - RNA, 20 nt, Homo sapiens
acauucaggagcuuccuguc

SEQ ID NO: 1859295 - RNA, 22 nt, Homo sapiens
uacaggugcgcgccaccgugcc

SEQ ID NO: 1859296 - RNA, 15 nt, Homo sapiens
agaugaucauuugcc

SEQ ID NO: 1859297 - RNA, 14 nt, Homo sapiens
cugccacaauguga

SEQ ID NO: 1859298 - RNA, 22 nt, Homo sapiens
cacagucacaugcccauucaca

SEQ ID NO: 1859299 - RNA, 13 nt, Homo sapiens
ccugaucaccucu

SEQ ID NO: 1859300 - RNA, 16 nt, Homo sapiens
cuucugccucuuaacu

SEQ ID NO: 1859301 - RNA, 14 nt, Homo sapiens
ucuauuaacuacca

SEQ ID NO: 1859302 - RNA, 19 nt, Homo sapiens
aguuggagugcaauggugc

SEQ ID NO: 1859303 - RNA, 18 nt, Homo sapiens
gcucacguguccuuaaca

SEQ ID NO: 1859304 - RNA, 14 nt, Homo sapiens
acucugagcccaua

SEQ ID NO: 1859305 - RNA, 18 nt, Homo sapiens
caacauggugaaacccug

SEQ ID NO: 1859306 - RNA, 16 nt, Homo sapiens
cugucuuuuuccucaa

SEQ ID NO: 1859307 - RNA, 17 nt, Homo sapiens
gugguugcuguccucuc

SEQ ID NO: 1859308 - RNA, 22 nt, Homo sapiens
uuuuauggacaguaaguccagu

SEQ ID NO: 1859309 - RNA, 15 nt, Homo sapiens
ggcaaaacucaguag

SEQ ID NO: 1859310 - RNA, 14 nt, Homo sapiens
uggcaaagccuuca

SEQ ID NO: 1859311 - RNA, 14 nt, Homo sapiens
ccucagaguggucg

SEQ ID NO: 1859312 - RNA, 18 nt, Homo sapiens
aagauaagcacgcauuuu

SEQ ID NO: 1859313 - RNA, 18 nt, Homo sapiens
gaaugaucccacucacca

SEQ ID NO: 1859314 - RNA, 23 nt, Homo sapiens
uuccaacaauggggugggcccau

SEQ ID NO: 1859315 - RNA, 15 nt, Homo sapiens
cacauagauucaccu

SEQ ID NO: 1859316 - RNA, 22 nt, Homo sapiens
aaaguagucauggauaacuaca

SEQ ID NO: 1859317 - RNA, 14 nt, Homo sapiens
uaagucauggaauu

SEQ ID NO: 1859318 - RNA, 12 nt, Homo sapiens
cuuuggcaauau

SEQ ID NO: 1859319 - RNA, 11 nt, Homo sapiens
cuucuugccuc

SEQ ID NO: 1859320 - RNA, 13 nt, Homo sapiens
ucccagaccagga

SEQ ID NO: 1859321 - RNA, 19 nt, Homo sapiens
acugcucccugaagccagc

SEQ ID NO: 1859322 - RNA, 22 nt, Homo sapiens
cuuagaaaauaaauacaaguuu

SEQ ID NO: 1859323 - RNA, 14 nt, Homo sapiens
uuuaaaaaugcacc

SEQ ID NO: 1859324 - RNA, 15 nt, Homo sapiens
cuuacuucuuagcac

SEQ ID NO: 1859325 - RNA, 17 nt, Homo sapiens
guaacucccaucaccuc

SEQ ID NO: 1859326 - RNA, 16 nt, Homo sapiens
ugaagcccacccugca

SEQ ID NO: 1859327 - RNA, 15 nt, Homo sapiens
auuccagcugucacu

SEQ ID NO: 1859328 - RNA, 23 nt, Homo sapiens
ugaacuuccugcagguaaacagu

SEQ ID NO: 1859329 - RNA, 18 nt, Homo sapiens
gcuuuaacaaaacaagaa

SEQ ID NO: 1859330 - RNA, 15 nt, Homo sapiens
auucaugacuaugga

SEQ ID NO: 1859331 - RNA, 15 nt, Homo sapiens
gcuugcacugauguc

SEQ ID NO: 1859332 - RNA, 18 nt, Homo sapiens
aaauuguuuaccauagaa

SEQ ID NO: 1859333 - RNA, 17 nt, Homo sapiens
gcaucauuaauaccuaa

SEQ ID NO: 1859334 - RNA, 19 nt, Homo sapiens
agcuauaacuuacuucugu

SEQ ID NO: 1859335 - RNA, 20 nt, Homo sapiens
uaaacaagaguuuucuuccu

SEQ ID NO: 1859336 - RNA, 20 nt, Homo sapiens
uccauuuauggaacuucccu

SEQ ID NO: 1859337 - RNA, 18 nt, Homo sapiens
cucucuaaaaauaaaaug

SEQ ID NO: 1859338 - RNA, 15 nt, Homo sapiens
gagacccccaucucu

SEQ ID NO: 1859339 - RNA, 16 nt, Homo sapiens
uugaaacuuugaaugu

SEQ ID NO: 1859340 - RNA, 20 nt, Homo sapiens
guggcaucaucucagcucac

SEQ ID NO: 1859341 - RNA, 23 nt, Homo sapiens
cuccaagcccgcucccugcucag

SEQ ID NO: 1859342 - RNA, 17 nt, Homo sapiens
aagcuccuucaguuuga

SEQ ID NO: 1859343 - RNA, 17 nt, Homo sapiens
gaucuccaacagccagu

SEQ ID NO: 1859344 - RNA, 13 nt, Homo sapiens
aguacaugcucug

SEQ ID NO: 1859345 - RNA, 18 nt, Homo sapiens
cccggcuacaucagccuu

SEQ ID NO: 1859346 - RNA, 23 nt, Homo sapiens
acacugcagcagaaaggcucuga

SEQ ID NO: 1859347 - RNA, 22 nt, Homo sapiens
aacugugcguuaaauaagcaaa

SEQ ID NO: 1859348 - RNA, 14 nt, Homo sapiens
cuguggaaucugga

SEQ ID NO: 1859349 - RNA, 19 nt, Homo sapiens
ucacuugaauccauugaaa

SEQ ID NO: 1859350 - RNA, 20 nt, Homo sapiens
uaagaaauauauuugauaaa

SEQ ID NO: 1859351 - RNA, 12 nt, Homo sapiens
uacaauugucau

SEQ ID NO: 1859352 - RNA, 18 nt, Homo sapiens
ccucuaaguguugugaaa

SEQ ID NO: 1859353 - RNA, 17 nt, Homo sapiens
uaggcuuuaaaaaagca

SEQ ID NO: 1859354 - RNA, 17 nt, Homo sapiens
agagugcuaagcauuag

SEQ ID NO: 1859355 - RNA, 21 nt, Homo sapiens
uuggcagugugucacacugag

SEQ ID NO: 1859356 - RNA, 19 nt, Homo sapiens
aacucaucuauccaggcag

SEQ ID NO: 1859357 - RNA, 19 nt, Homo sapiens
aaucccauuuaugcaauuu

SEQ ID NO: 1859358 - RNA, 22 nt, Homo sapiens
ccuugauggagauauuuacaug

SEQ ID NO: 1859359 - RNA, 22 nt, Homo sapiens
ucccaaaugcagcuucagguga

SEQ ID NO: 1859360 - RNA, 11 nt, Homo sapiens
cucucauuucc

SEQ ID NO: 1859361 - RNA, 15 nt, Homo sapiens
acuagaaguacgugu

SEQ ID NO: 1859362 - RNA, 15 nt, Homo sapiens
gcccagacugaugag

SEQ ID NO: 1859363 - RNA, 20 nt, Homo sapiens
aacaugaaguuggaagccau

SEQ ID NO: 1859364 - RNA, 14 nt, Homo sapiens
cucagugaccagug

SEQ ID NO: 1859365 - RNA, 13 nt, Homo sapiens
cuaguguucuguc

SEQ ID NO: 1859366 - RNA, 14 nt, Homo sapiens
acauaugacauaua

SEQ ID NO: 1859367 - RNA, 22 nt, Homo sapiens
guggcuucuuuugaacuguuag

SEQ ID NO: 1859368 - RNA, 20 nt, Homo sapiens
gcccaggcuggagcgcagug

SEQ ID NO: 1859369 - RNA, 16 nt, Homo sapiens
aaagggaaacauagua

SEQ ID NO: 1859370 - RNA, 21 nt, Homo sapiens
uucaaaaagggaaguaagcaa

SEQ ID NO: 1859371 - RNA, 14 nt, Homo sapiens
ucagccuguggauu

SEQ ID NO: 1859372 - RNA, 16 nt, Homo sapiens
ucuaaucccaacaagc

SEQ ID NO: 1859373 - RNA, 19 nt, Homo sapiens
ugcacucuagccuggcaac

SEQ ID NO: 1859374 - RNA, 21 nt, Homo sapiens
augccugagaaugccuaggcc

SEQ ID NO: 1859375 - RNA, 19 nt, Homo sapiens
uuacaaucagccacauucu

SEQ ID NO: 1859376 - RNA, 12 nt, Homo sapiens
aggugggcacug

SEQ ID NO: 1859377 - RNA, 12 nt, Homo sapiens
agacuccaucuc

SEQ ID NO: 1859378 - RNA, 20 nt, Homo sapiens
guagggccccugcacacuca

SEQ ID NO: 1859379 - RNA, 22 nt, Homo sapiens
ggguacucaauggaguaugucu

SEQ ID NO: 1859380 - RNA, 18 nt, Homo sapiens
ccccaaagugcugggauu

SEQ ID NO: 1859381 - RNA, 13 nt, Homo sapiens
cuggucauacauu

SEQ ID NO: 1859382 - RNA, 19 nt, Homo sapiens
auuucacgggcaacacuca

SEQ ID NO: 1859383 - RNA, 23 nt, Homo sapiens
cagcacguguggccuguucuucu

SEQ ID NO: 1859384 - RNA, 14 nt, Homo sapiens
aauacauugcagca

SEQ ID NO: 1859385 - RNA, 15 nt, Homo sapiens
uggcaggugaugucc

SEQ ID NO: 1859386 - RNA, 11 nt, Homo sapiens
aagaccaaaga

SEQ ID NO: 1859387 - RNA, 11 nt, Homo sapiens
agaaccaaaag

SEQ ID NO: 1859388 - RNA, 17 nt, Homo sapiens
cgaggagcuccugggaa

SEQ ID NO: 1859389 - RNA, 23 nt, Homo sapiens
uaacauuaaugccugcuuuuugg

SEQ ID NO: 1859390 - RNA, 12 nt, Homo sapiens
ucucaucacuca

SEQ ID NO: 1859391 - RNA, 15 nt, Homo sapiens
ucaagucugggaaca

SEQ ID NO: 1859392 - RNA, 23 nt, Homo sapiens
caaagcuuuccuguuuccagggu

SEQ ID NO: 1859393 - RNA, 23 nt, Homo sapiens
cagucccuaaagaaaaaaaauca

SEQ ID NO: 1859394 - RNA, 12 nt, Homo sapiens
aggaacaagacc

SEQ ID NO: 1859395 - RNA, 15 nt, Homo sapiens
acuguauagacaguu

SEQ ID NO: 1859396 - RNA, 21 nt, Homo sapiens
uauacauagucuuuguuuaca

SEQ ID NO: 1859397 - RNA, 22 nt, Homo sapiens
agcaauuccaggcugagccaug

SEQ ID NO: 1859398 - RNA, 15 nt, Homo sapiens
cagguguguauuuac

SEQ ID NO: 1859399 - RNA, 17 nt, Homo sapiens
ugaucuugauugugggu

SEQ ID NO: 1859400 - RNA, 20 nt, Homo sapiens
guuuguuuucaaaauacuuc

SEQ ID NO: 1859401 - RNA, 20 nt, Homo sapiens
uggagacaaggugcuaacau

SEQ ID NO: 1859402 - RNA, 21 nt, Homo sapiens
ccagcaggagggacagucuca

SEQ ID NO: 1859403 - RNA, 23 nt, Homo sapiens
auuaagcagaaauccugcaauga

SEQ ID NO: 1859404 - RNA, 15 nt, Homo sapiens
cucugagcccccuga

SEQ ID NO: 1859405 - RNA, 22 nt, Homo sapiens
ggcugaagcgagcccucaggag

SEQ ID NO: 1859406 - RNA, 16 nt, Homo sapiens
uguguuugacauguga

SEQ ID NO: 1859407 - RNA, 19 nt, Homo sapiens
ugugugaaauucucuuucc

SEQ ID NO: 1859408 - RNA, 18 nt, Homo sapiens
aacuguaaaauacuucuu

SEQ ID NO: 1859409 - RNA, 14 nt, Homo sapiens
aaaagcaccucuug

SEQ ID NO: 1859410 - RNA, 14 nt, Homo sapiens
agauaggaucacuu

SEQ ID NO: 1859411 - RNA, 14 nt, Homo sapiens
cagaagaaaucaua

SEQ ID NO: 1859412 - RNA, 18 nt, Homo sapiens
cuacuuccucugcaaaaa

SEQ ID NO: 1859413 - RNA, 21 nt, Homo sapiens
aaaauaaaaaggaaaacagac

SEQ ID NO: 1859414 - RNA, 23 nt, Homo sapiens
aauacaguuacuuaaugaccaug

SEQ ID NO: 1859415 - RNA, 21 nt, Homo sapiens
acacugaaaaaauacuaccua

SEQ ID NO: 1859416 - RNA, 12 nt, Homo sapiens
auaaacuuugaa

SEQ ID NO: 1859417 - RNA, 22 nt, Homo sapiens
auacaauuauuuuuacaguucu

SEQ ID NO: 1859418 - RNA, 19 nt, Homo sapiens
agaguugcuuuucuaaucu

SEQ ID NO: 1859419 - RNA, 14 nt, Homo sapiens
acuauuaacaugau

SEQ ID NO: 1859420 - RNA, 17 nt, Homo sapiens
ugguccuuccuaccucu

SEQ ID NO: 1859421 - RNA, 17 nt, Homo sapiens
gccuucagcaugccuga

SEQ ID NO: 1859422 - RNA, 21 nt, Homo sapiens
gacaagaauuguuaccuguca

SEQ ID NO: 1859423 - RNA, 21 nt, Homo sapiens
ggaaucacuguuuagaacaca

SEQ ID NO: 1859424 - RNA, 21 nt, Homo sapiens
ucccuuccccacaauaggcuu

SEQ ID NO: 1859425 - RNA, 17 nt, Homo sapiens
ccugaucccagagagcc

SEQ ID NO: 1859426 - RNA, 16 nt, Homo sapiens
uaugucuauguguaua

SEQ ID NO: 1859427 - RNA, 22 nt, Homo sapiens
acugaccuugaugagcugugca

SEQ ID NO: 1859428 - RNA, 18 nt, Homo sapiens
ccuguccucuacauacca

SEQ ID NO: 1859429 - RNA, 10 nt, Homo sapiens
aaaacaaagg

SEQ ID NO: 1859430 - RNA, 18 nt, Homo sapiens
cauggugugaguccaaag

SEQ ID NO: 1859431 - RNA, 19 nt, Homo sapiens
cuggggggacccagugcag

SEQ ID NO: 1859432 - RNA, 22 nt, Homo sapiens
cagccaugcaaugccaaauaau

SEQ ID NO: 1859433 - RNA, 15 nt, Homo sapiens
aagugacuucacaga

SEQ ID NO: 1859434 - RNA, 17 nt, Homo sapiens
gaucucagcagccagcu

SEQ ID NO: 1859435 - RNA, 22 nt, Homo sapiens
acagugacggcugcgccuccac

SEQ ID NO: 1859436 - RNA, 18 nt, Homo sapiens
uggccuggccauuuccaa

SEQ ID NO: 1859437 - RNA, 19 nt, Homo sapiens
aagaauaaacaacuaaaua

SEQ ID NO: 1859438 - RNA, 16 nt, Homo sapiens
cagugccuuccauaau

SEQ ID NO: 1859439 - RNA, 12 nt, Homo sapiens
uggugggaaccc

SEQ ID NO: 1859440 - RNA, 13 nt, Homo sapiens
uggaauauuccac

SEQ ID NO: 1859441 - RNA, 14 nt, Homo sapiens
cuuuuuuauacuca

SEQ ID NO: 1859442 - RNA, 14 nt, Homo sapiens
aacugcuugugcac

SEQ ID NO: 1859443 - RNA, 18 nt, Homo sapiens
guucaguuccacuaucua

SEQ ID NO: 1859444 - RNA, 15 nt, Homo sapiens
caaauuacaaaaggc

SEQ ID NO: 1859445 - RNA, 18 nt, Homo sapiens
gugccuccccccagaccc

SEQ ID NO: 1859446 - RNA, 21 nt, Homo sapiens
cuuccacacucaccucuaaaa

SEQ ID NO: 1859447 - RNA, 14 nt, Homo sapiens
uuuaagaacgaagg

SEQ ID NO: 1859448 - RNA, 23 nt, Homo sapiens
gaaaugugucuugucuccauuug

SEQ ID NO: 1859449 - RNA, 14 nt, Homo sapiens
guagauaccagcuu

SEQ ID NO: 1859450 - RNA, 14 nt, Homo sapiens
uaauucucuuucaa

SEQ ID NO: 1859451 - RNA, 19 nt, Homo sapiens
aggccucucucaccucucc

SEQ ID NO: 1859452 - RNA, 24 nt, Homo sapiens
acuuucuaauuagagagcaucugc

SEQ ID NO: 1859453 - RNA, 15 nt, Homo sapiens
auacguguagcuaua

SEQ ID NO: 1859454 - RNA, 14 nt, Homo sapiens
acugauuaccuccu

SEQ ID NO: 1859455 - RNA, 19 nt, Homo sapiens
auuagccuugaacaaccag

SEQ ID NO: 1859456 - RNA, 12 nt, Homo sapiens
uccuuguaaaau

SEQ ID NO: 1859457 - RNA, 15 nt, Homo sapiens
ugaaugacaugaccu

SEQ ID NO: 1859458 - RNA, 15 nt, Homo sapiens
ugcacuuggccucug

SEQ ID NO: 1859459 - RNA, 14 nt, Homo sapiens
uggauagucugucc

SEQ ID NO: 1859460 - RNA, 23 nt, Homo sapiens
ucauggacugaguuuauacucac

SEQ ID NO: 1859461 - RNA, 15 nt, Homo sapiens
gaugcacccaccuca

SEQ ID NO: 1859462 - RNA, 15 nt, Homo sapiens
cuugcaccguccuca

SEQ ID NO: 1859463 - RNA, 19 nt, Homo sapiens
caacgagugaaacuccguc

SEQ ID NO: 1859464 - RNA, 12 nt, Homo sapiens
cucaagcacuga

SEQ ID NO: 1859465 - RNA, 16 nt, Homo sapiens
gaccauugucuuccaa

SEQ ID NO: 1859466 - RNA, 17 nt, Homo sapiens
ugauucucaugccucag

SEQ ID NO: 1859467 - RNA, 16 nt, Homo sapiens
agggagccgagaucac

SEQ ID NO: 1859468 - RNA, 18 nt, Homo sapiens
guaccagcagcuggaauc

SEQ ID NO: 1859469 - RNA, 17 nt, Homo sapiens
guuccccacacagggca

SEQ ID NO: 1859470 - RNA, 20 nt, Homo sapiens
cacauuuuaagugcuucaca

SEQ ID NO: 1859471 - RNA, 16 nt, Homo sapiens
gcaaaucaggggccag

SEQ ID NO: 1859472 - RNA, 20 nt, Homo sapiens
cuggaguacaguggugccau

SEQ ID NO: 1859473 - RNA, 16 nt, Homo sapiens
ccucuuuaacagcuuu

SEQ ID NO: 1859474 - RNA, 19 nt, Homo sapiens
uaaaauagaguguaguuua

SEQ ID NO: 1859475 - RNA, 17 nt, Homo sapiens
gccuucugguuauuuau

SEQ ID NO: 1859476 - RNA, 17 nt, Homo sapiens
acgccacucccugggac

SEQ ID NO: 1859477 - RNA, 17 nt, Homo sapiens
caaccccgcccuaggcc

SEQ ID NO: 1859478 - RNA, 16 nt, Homo sapiens
ucaccucagcugauau

SEQ ID NO: 1859479 - RNA, 21 nt, Homo sapiens
uuaaaauaaugaauacauuuc

SEQ ID NO: 1859480 - RNA, 14 nt, Homo sapiens
auucaaacugacaa

SEQ ID NO: 1859481 - RNA, 11 nt, Homo sapiens
gcacuaugaca

SEQ ID NO: 1859482 - RNA, 13 nt, Homo sapiens
uugucuguguugc

SEQ ID NO: 1859483 - RNA, 18 nt, Homo sapiens
ucagccacaaccaaaaaa

SEQ ID NO: 1859484 - RNA, 19 nt, Homo sapiens
caacagaaacuucucaguu

SEQ ID NO: 1859485 - RNA, 23 nt, Homo sapiens
cuuaugccucgcuuauuuagccc

SEQ ID NO: 1859486 - RNA, 17 nt, Homo sapiens
cccuugcccuuccagcc

SEQ ID NO: 1859487 - RNA, 17 nt, Homo sapiens
cauucuguuagauacua

SEQ ID NO: 1859488 - RNA, 17 nt, Homo sapiens
cuaaggucccugggggu

SEQ ID NO: 1859489 - RNA, 14 nt, Homo sapiens
aggagucucugcca

SEQ ID NO: 1859490 - RNA, 19 nt, Homo sapiens
ccagaaauacuacugugua

SEQ ID NO: 1859491 - RNA, 15 nt, Homo sapiens
aauccuuucugccca

SEQ ID NO: 1859492 - RNA, 15 nt, Homo sapiens
aauugcuucugugua

SEQ ID NO: 1859493 - RNA, 22 nt, Homo sapiens
agacucggaaucuauuuucuca

SEQ ID NO: 1859494 - RNA, 21 nt, Homo sapiens
auaucccacugggagcacuuu

SEQ ID NO: 1859495 - RNA, 20 nt, Homo sapiens
ugcagaauuguuuuuugcuc

SEQ ID NO: 1859496 - RNA, 18 nt, Homo sapiens
cugggaaccagcaucuca

SEQ ID NO: 1859497 - RNA, 16 nt, Homo sapiens
gacagugaccccaguc

SEQ ID NO: 1859498 - RNA, 15 nt, Homo sapiens
uccuccguggcacau

SEQ ID NO: 1859499 - RNA, 16 nt, Homo sapiens
gauaaacuaacuacug

SEQ ID NO: 1859500 - RNA, 12 nt, Homo sapiens
agcucacugaau

SEQ ID NO: 1859501 - RNA, 14 nt, Homo sapiens
uaauucagcuugag

SEQ ID NO: 1859502 - RNA, 11 nt, Homo sapiens
gagaucccaac

SEQ ID NO: 1859503 - RNA, 15 nt, Homo sapiens
guaacagacauuguu

SEQ ID NO: 1859504 - RNA, 15 nt, Homo sapiens
gaaugagacuuacuu

SEQ ID NO: 1859505 - RNA, 17 nt, Homo sapiens
acauuuaaaauugcuau

SEQ ID NO: 1859506 - RNA, 20 nt, Homo sapiens
uaggagagagaucaugagaa

SEQ ID NO: 1859507 - RNA, 23 nt, Homo sapiens
cuuucagaaucuuuucaaugggu

SEQ ID NO: 1859508 - RNA, 17 nt, Homo sapiens
ggaaaugacccaaacau

SEQ ID NO: 1859509 - RNA, 11 nt, Homo sapiens
gauaugcacac

SEQ ID NO: 1859510 - RNA, 16 nt, Homo sapiens
cagacucucacaugca

SEQ ID NO: 1859511 - RNA, 14 nt, Homo sapiens
uggccccaaauguu

SEQ ID NO: 1859512 - RNA, 19 nt, Homo sapiens
aguaaaggccucaucuccu

SEQ ID NO: 1859513 - RNA, 13 nt, Homo sapiens
uaaauacauuucc

SEQ ID NO: 1859514 - RNA, 13 nt, Homo sapiens
cuuuuuucucuga

SEQ ID NO: 1859515 - RNA, 19 nt, Homo sapiens
gucucugauuaguugacag

SEQ ID NO: 1859516 - RNA, 23 nt, Homo sapiens
cagcggcucuuccuggacaguga

SEQ ID NO: 1859517 - RNA, 12 nt, Homo sapiens
acacgcauuaau

SEQ ID NO: 1859518 - RNA, 16 nt, Homo sapiens
guugauuacuuuucag

SEQ ID NO: 1859519 - RNA, 20 nt, Homo sapiens
acaucaggguagcugaagga

SEQ ID NO: 1859520 - RNA, 21 nt, Homo sapiens
aucagugaagccaaagggacu

SEQ ID NO: 1859521 - RNA, 19 nt, Homo sapiens
aguagaaauaaaagugaau

SEQ ID NO: 1859522 - RNA, 16 nt, Homo sapiens
gccaggcuggucucaa

SEQ ID NO: 1859523 - RNA, 18 nt, Homo sapiens
cuuuuauggaccaauuag

SEQ ID NO: 1859524 - RNA, 18 nt, Homo sapiens
auucaaauggcuuaagca

SEQ ID NO: 1859525 - RNA, 22 nt, Homo sapiens
cuuccgcacccucccuagcucu

SEQ ID NO: 1859526 - RNA, 18 nt, Homo sapiens
ccugacccagagccuagg

SEQ ID NO: 1859527 - RNA, 18 nt, Homo sapiens
agaucuguaauucacuag

SEQ ID NO: 1859528 - RNA, 18 nt, Homo sapiens
cucuccugcgugugccca

SEQ ID NO: 1859529 - RNA, 19 nt, Homo sapiens
cgauggaggccuaccucuc

SEQ ID NO: 1859530 - RNA, 23 nt, Homo sapiens
ucaguuucacaagugagcccucu

SEQ ID NO: 1859531 - RNA, 13 nt, Homo sapiens
cagccuccagagu

SEQ ID NO: 1859532 - RNA, 12 nt, Homo sapiens
uauuuuugccaa

SEQ ID NO: 1859533 - RNA, 13 nt, Homo sapiens
gaagucucuucca

SEQ ID NO: 1859534 - RNA, 13 nt, Homo sapiens
ugugauuagucaa

SEQ ID NO: 1859535 - RNA, 21 nt, Homo sapiens
gaauaaaauuaggaacaguaa

SEQ ID NO: 1859536 - RNA, 23 nt, Homo sapiens
gccaggacagcuggcugcugaca

SEQ ID NO: 1859537 - RNA, 19 nt, Homo sapiens
ggaucuuguaauccagugc

SEQ ID NO: 1859538 - RNA, 14 nt, Homo sapiens
cucaccuacuccag

SEQ ID NO: 1859539 - RNA, 14 nt, Homo sapiens
acagaguucuggga

SEQ ID NO: 1859540 - RNA, 15 nt, Homo sapiens
ucgcccaacuccacc

SEQ ID NO: 1859541 - RNA, 19 nt, Homo sapiens
gaacacaugugcagucacu

SEQ ID NO: 1859542 - RNA, 20 nt, Homo sapiens
guaucucaacaacaugucaa

SEQ ID NO: 1859543 - RNA, 17 nt, Homo sapiens
ucccuauagaccacugg

SEQ ID NO: 1859544 - RNA, 16 nt, Homo sapiens
caaaugggaucaauuu

SEQ ID NO: 1859545 - RNA, 13 nt, Homo sapiens
uuuaugcauacag

SEQ ID NO: 1859546 - RNA, 15 nt, Homo sapiens
aggagaagggucuca

SEQ ID NO: 1859547 - RNA, 14 nt, Homo sapiens
uaaaauaaaugcaa

SEQ ID NO: 1859548 - RNA, 15 nt, Homo sapiens
agcaaaugcuuaaaa

SEQ ID NO: 1859549 - RNA, 16 nt, Homo sapiens
uacaguaacugugacu

SEQ ID NO: 1859550 - RNA, 17 nt, Homo sapiens
agcaucugacaggugaa

SEQ ID NO: 1859551 - RNA, 19 nt, Homo sapiens
ucagacauuauaaguacuu

SEQ ID NO: 1859552 - RNA, 13 nt, Homo sapiens
aagcauggcucau

SEQ ID NO: 1859553 - RNA, 14 nt, Homo sapiens
cuuguuuaaauuca

SEQ ID NO: 1859554 - RNA, 15 nt, Homo sapiens
ugcucaauuccaaga

SEQ ID NO: 1859555 - RNA, 20 nt, Homo sapiens
agacaaacuuguucaaaaga

SEQ ID NO: 1859556 - RNA, 23 nt, Homo sapiens
gcaggaggagaaaagaaaugcac

SEQ ID NO: 1859557 - RNA, 22 nt, Homo sapiens
uuuugauaacaaugacacuaga

SEQ ID NO: 1859558 - RNA, 22 nt, Homo sapiens
uucuugucagacauaaagccau

SEQ ID NO: 1859559 - RNA, 20 nt, Homo sapiens
auggcagaggugcaagaccu

SEQ ID NO: 1859560 - RNA, 16 nt, Homo sapiens
cacuuagcccaagagg

SEQ ID NO: 1859561 - RNA, 16 nt, Homo sapiens
gccaggacgaauugag

SEQ ID NO: 1859562 - RNA, 19 nt, Homo sapiens
uuguaacucacaugccuuc

SEQ ID NO: 1859563 - RNA, 19 nt, Homo sapiens
aucgcacaaccugcaucuu

SEQ ID NO: 1859564 - RNA, 14 nt, Homo sapiens
uuggacuucuugaa

SEQ ID NO: 1859565 - RNA, 13 nt, Homo sapiens
ugcacagcuuccu

SEQ ID NO: 1859566 - RNA, 20 nt, Homo sapiens
aucuaguucucaaucacugc

SEQ ID NO: 1859567 - RNA, 23 nt, Homo sapiens
ucuaacacgcacagcugaaaguu

SEQ ID NO: 1859568 - RNA, 21 nt, Homo sapiens
guucucauuuuuaucccauug

SEQ ID NO: 1859569 - RNA, 19 nt, Homo sapiens
ggaaauuguuuauguguua

SEQ ID NO: 1859570 - RNA, 17 nt, Homo sapiens
ccuuuacuugucuuucu

SEQ ID NO: 1859571 - RNA, 17 nt, Homo sapiens
aauaugguguacauucu

SEQ ID NO: 1859572 - RNA, 17 nt, Homo sapiens
cuuuagagaagccauaa

SEQ ID NO: 1859573 - RNA, 19 nt, Homo sapiens
uauugaaucuaaaaccaaa

SEQ ID NO: 1859574 - RNA, 14 nt, Homo sapiens
aucaguccaguuug

SEQ ID NO: 1859575 - RNA, 21 nt, Homo sapiens
caauacuugcauuccagaguu

SEQ ID NO: 1859576 - RNA, 22 nt, Homo sapiens
cgaagaccuucugaagaucuca

SEQ ID NO: 1859577 - RNA, 13 nt, Homo sapiens
caucuucuauuca

SEQ ID NO: 1859578 - RNA, 23 nt, Homo sapiens
gaagaccucguuuucuaaaggcu

SEQ ID NO: 1859579 - RNA, 17 nt, Homo sapiens
aggcuucugugugcugc

SEQ ID NO: 1859580 - RNA, 20 nt, Homo sapiens
auuacuaggagauaccaccg

SEQ ID NO: 1859581 - RNA, 16 nt, Homo sapiens
guccauccauucucac

SEQ ID NO: 1859582 - RNA, 21 nt, Homo sapiens
ggagagagcagcuucugccac

SEQ ID NO: 1859583 - RNA, 19 nt, Homo sapiens
ccagugccuucugucugcu

SEQ ID NO: 1859584 - RNA, 16 nt, Homo sapiens
aagcugacucaaaaau

SEQ ID NO: 1859585 - RNA, 16 nt, Homo sapiens
gugcuagccacuggaa

SEQ ID NO: 1859586 - RNA, 15 nt, Homo sapiens
auacauucacccaga

SEQ ID NO: 1859587 - RNA, 22 nt, Homo sapiens
aaauuuaugcauuucauucaaa

SEQ ID NO: 1859588 - RNA, 19 nt, Homo sapiens
cucauaugcauguagucac

SEQ ID NO: 1859589 - RNA, 13 nt, Homo sapiens
gcucgaugccuuu

SEQ ID NO: 1859590 - RNA, 17 nt, Homo sapiens
aguccaacaaaccacac

SEQ ID NO: 1859591 - RNA, 19 nt, Homo sapiens
guagacuguuaauuacuua

SEQ ID NO: 1859592 - RNA, 21 nt, Homo sapiens
gcaguugucaucaaacauaau

SEQ ID NO: 1859593 - RNA, 24 nt, Homo sapiens
aaauucucagucaguaauugccaa

SEQ ID NO: 1859594 - RNA, 13 nt, Homo sapiens
gagaggcuguguc

SEQ ID NO: 1859595 - RNA, 18 nt, Homo sapiens
agcuggagucugucaaug

SEQ ID NO: 1859596 - RNA, 12 nt, Homo sapiens
cuuuuaagaaag

SEQ ID NO: 1859597 - RNA, 17 nt, Homo sapiens
ucacaacucuucuuucc

SEQ ID NO: 1859598 - RNA, 17 nt, Homo sapiens
uucagccuuaauggaag

SEQ ID NO: 1859599 - RNA, 17 nt, Homo sapiens
caccgugugccauagaa

SEQ ID NO: 1859600 - RNA, 16 nt, Homo sapiens
ugaagugcuguggcug

SEQ ID NO: 1859601 - RNA, 21 nt, Homo sapiens
ccaccccugaggacacccagg

SEQ ID NO: 1859602 - RNA, 15 nt, Homo sapiens
caccuggggaucccc

SEQ ID NO: 1859603 - RNA, 17 nt, Homo sapiens
ccgugaccagugcugcu

SEQ ID NO: 1859604 - RNA, 17 nt, Homo sapiens
cauaacucauugucugu

SEQ ID NO: 1859605 - RNA, 17 nt, Homo sapiens
auauuuccucaugugau

SEQ ID NO: 1859606 - RNA, 17 nt, Homo sapiens
auccccuuuacuaucau

SEQ ID NO: 1859607 - RNA, 23 nt, Homo sapiens
caagcagagcggguaaagugcaa

SEQ ID NO: 1859608 - RNA, 13 nt, Homo sapiens
uuacuuauucuuc

SEQ ID NO: 1859609 - RNA, 17 nt, Homo sapiens
gcagaaagccacaaacu

SEQ ID NO: 1859610 - RNA, 13 nt, Homo sapiens
ggccuuguaagac

SEQ ID NO: 1859611 - RNA, 21 nt, Homo sapiens
aggcugcucuugaacuccuga

SEQ ID NO: 1859612 - RNA, 16 nt, Homo sapiens
auauccagucaaagac

SEQ ID NO: 1859613 - RNA, 17 nt, Homo sapiens
guaaaagcaacaucagc

SEQ ID NO: 1859614 - RNA, 17 nt, Homo sapiens
acagucaucugccacca

SEQ ID NO: 1859615 - RNA, 15 nt, Homo sapiens
ucuuggaagugugug

SEQ ID NO: 1859616 - RNA, 19 nt, Homo sapiens
ucuguaugugacaacauuu

SEQ ID NO: 1859617 - RNA, 20 nt, Homo sapiens
augaggcaaacagcaagagu

SEQ ID NO: 1859618 - RNA, 17 nt, Homo sapiens
guguggucaacgaauac

SEQ ID NO: 1859619 - RNA, 14 nt, Homo sapiens
cccagauccucugc

SEQ ID NO: 1859620 - RNA, 15 nt, Homo sapiens
ugccagcaacugaau

SEQ ID NO: 1859621 - RNA, 14 nt, Homo sapiens
cucaccccugggca

SEQ ID NO: 1859622 - RNA, 14 nt, Homo sapiens
gcuucacuguauaa

SEQ ID NO: 1859623 - RNA, 14 nt, Homo sapiens
guagaccugcugcc

SEQ ID NO: 1859624 - RNA, 14 nt, Homo sapiens
gcaccucuguucau

SEQ ID NO: 1859625 - RNA, 14 nt, Homo sapiens
uuugcucuucagau

SEQ ID NO: 1859626 - RNA, 22 nt, Homo sapiens
gagguuugucaacacaaagaca

SEQ ID NO: 1859627 - RNA, 17 nt, Homo sapiens
agaaguaaaagcuaauu

SEQ ID NO: 1859628 - RNA, 16 nt, Homo sapiens
gcucacggcacgcuug

SEQ ID NO: 1859629 - RNA, 13 nt, Homo sapiens
ccagacacagaag

SEQ ID NO: 1859630 - RNA, 14 nt, Homo sapiens
ucaaaauugcaauc

SEQ ID NO: 1859631 - RNA, 18 nt, Homo sapiens
cuugaguuuaaauuguaa

SEQ ID NO: 1859632 - RNA, 18 nt, Homo sapiens
cucugguuagguuaggac

SEQ ID NO: 1859633 - RNA, 19 nt, Homo sapiens
agaucuugaauagucucau

SEQ ID NO: 1859634 - RNA, 15 nt, Homo sapiens
agcauucuggcaguu

SEQ ID NO: 1859635 - RNA, 13 nt, Homo sapiens
auauucauuucaa

SEQ ID NO: 1859636 - RNA, 13 nt, Homo sapiens
uaauacauaacau

SEQ ID NO: 1859637 - RNA, 13 nt, Homo sapiens
ugcuucauagaaa

SEQ ID NO: 1859638 - RNA, 13 nt, Homo sapiens
gagagauggcuca

SEQ ID NO: 1859639 - RNA, 16 nt, Homo sapiens
agcuagaugugucuua

SEQ ID NO: 1859640 - RNA, 17 nt, Homo sapiens
auuguucagacauucca

SEQ ID NO: 1859641 - RNA, 11 nt, Homo sapiens
cagaggugcug

SEQ ID NO: 1859642 - RNA, 16 nt, Homo sapiens
uaguaugcucugagua

SEQ ID NO: 1859643 - RNA, 13 nt, Homo sapiens
gcaugacaaaaau

SEQ ID NO: 1859644 - RNA, 21 nt, Homo sapiens
uauacacuauuugugagcaaa

SEQ ID NO: 1859645 - RNA, 15 nt, Homo sapiens
caaagagguguacag

SEQ ID NO: 1859646 - RNA, 15 nt, Homo sapiens
aaaugcagccuuaaa

SEQ ID NO: 1859647 - RNA, 17 nt, Homo sapiens
aggauauuuucuuccaa

SEQ ID NO: 1859648 - RNA, 17 nt, Homo sapiens
uccucuggauugagaua

SEQ ID NO: 1859649 - RNA, 22 nt, Homo sapiens
cuccacugcuggacaugagaug

SEQ ID NO: 1859650 - RNA, 20 nt, Homo sapiens
cuagagugcaauggcgcgau

SEQ ID NO: 1859651 - RNA, 20 nt, Homo sapiens
cuggaguacaguggcacgau

SEQ ID NO: 1859652 - RNA, 20 nt, Homo sapiens
cuggagugcgguggcgcaau

SEQ ID NO: 1859653 - RNA, 20 nt, Homo sapiens
cuggagugcaguggcgcgau

SEQ ID NO: 1859654 - RNA, 15 nt, Homo sapiens
aguucugaucuguac

SEQ ID NO: 1859655 - RNA, 19 nt, Homo sapiens
auacaccaccucacuccug

SEQ ID NO: 1859656 - RNA, 14 nt, Homo sapiens
gacaaaggaaucaa

SEQ ID NO: 1859657 - RNA, 18 nt, Homo sapiens
ugagauuaagaaugccag

SEQ ID NO: 1859658 - RNA, 18 nt, Homo sapiens
uccaaaacuaaauuugaa

SEQ ID NO: 1859659 - RNA, 14 nt, Homo sapiens
acuuguuugcacug

SEQ ID NO: 1859660 - RNA, 16 nt, Homo sapiens
acuuugguaguggaau

SEQ ID NO: 1859661 - RNA, 20 nt, Homo sapiens
accccagccucgccugucac

SEQ ID NO: 1859662 - RNA, 19 nt, Homo sapiens
cacguggccgcugcccacg

SEQ ID NO: 1859663 - RNA, 20 nt, Homo sapiens
aaacuucuugucagacauaa

SEQ ID NO: 1859664 - RNA, 17 nt, Homo sapiens
cucaaagagaauuguau

SEQ ID NO: 1859665 - RNA, 12 nt, Homo sapiens
acaaaaucagcc

SEQ ID NO: 1859666 - RNA, 15 nt, Homo sapiens
aggcauacugacacu

SEQ ID NO: 1859667 - RNA, 18 nt, Homo sapiens
ccguucugugcacaaaac

SEQ ID NO: 1859668 - RNA, 18 nt, Homo sapiens
uacagagaaaagacauaa

SEQ ID NO: 1859669 - RNA, 19 nt, Homo sapiens
acuaccauguggccauuaa

SEQ ID NO: 1859670 - RNA, 19 nt, Homo sapiens
aaggaacuuuuaaacugca

SEQ ID NO: 1859671 - RNA, 14 nt, Homo sapiens
cgguguuuugccau

SEQ ID NO: 1859672 - RNA, 14 nt, Homo sapiens
ggaagggucccuuu

SEQ ID NO: 1859673 - RNA, 22 nt, Homo sapiens
cauaaaacggugcuuucuguga

SEQ ID NO: 1859674 - RNA, 20 nt, Homo sapiens
aacccguuucccgguucagg

SEQ ID NO: 1859675 - RNA, 14 nt, Homo sapiens
acuuuaucucacag

SEQ ID NO: 1859676 - RNA, 17 nt, Homo sapiens
cuaggcuuaaaugcaau

SEQ ID NO: 1859677 - RNA, 20 nt, Homo sapiens
uauagcuaauaacaugugaa

SEQ ID NO: 1859678 - RNA, 18 nt, Homo sapiens
aguuugcuucuacaugau

SEQ ID NO: 1859679 - RNA, 23 nt, Homo sapiens
augcacaccaaaaaaauacuuga

SEQ ID NO: 1859680 - RNA, 22 nt, Homo sapiens
gcaguacauacgucugccaggg

SEQ ID NO: 1859681 - RNA, 12 nt, Homo sapiens
ccacucuaauau

SEQ ID NO: 1859682 - RNA, 16 nt, Homo sapiens
auugucucauugccag

SEQ ID NO: 1859683 - RNA, 20 nt, Homo sapiens
gacucccggagccugugcag

SEQ ID NO: 1859684 - RNA, 16 nt, Homo sapiens
aaacauuuacuuuugc

SEQ ID NO: 1859685 - RNA, 21 nt, Homo sapiens
aaauaugaugagauucacuua

SEQ ID NO: 1859686 - RNA, 20 nt, Homo sapiens
augcugccaaccagcuuguc

SEQ ID NO: 1859687 - RNA, 19 nt, Homo sapiens
gagaaaauuugaaaauguc

SEQ ID NO: 1859688 - RNA, 15 nt, Homo sapiens
gcucauuccaugacu

SEQ ID NO: 1859689 - RNA, 20 nt, Homo sapiens
gcuggagccuggugcccuaa

SEQ ID NO: 1859690 - RNA, 18 nt, Homo sapiens
gccuugacaaguacauca

SEQ ID NO: 1859691 - RNA, 17 nt, Homo sapiens
gaucauagcucacugca

SEQ ID NO: 1859692 - RNA, 15 nt, Homo sapiens
caucauaacccauga

SEQ ID NO: 1859693 - RNA, 14 nt, Homo sapiens
ucugugaaauacug

SEQ ID NO: 1859694 - RNA, 16 nt, Homo sapiens
aauaaaagccucuggu

SEQ ID NO: 1859695 - RNA, 18 nt, Homo sapiens
acuuugguuccugugaua

SEQ ID NO: 1859696 - RNA, 12 nt, Homo sapiens
uacuuuugccaa

SEQ ID NO: 1859697 - RNA, 16 nt, Homo sapiens
gcugaacauugcauau

SEQ ID NO: 1859698 - RNA, 19 nt, Homo sapiens
gucugguugggcagccaga

SEQ ID NO: 1859699 - RNA, 21 nt, Homo sapiens
aaucaaaauugucucuucuga

SEQ ID NO: 1859700 - RNA, 16 nt, Homo sapiens
aagugccauucauccu

SEQ ID NO: 1859701 - RNA, 18 nt, Homo sapiens
augcuuucccacucucag

SEQ ID NO: 1859702 - RNA, 22 nt, Homo sapiens
aguugcuugauuuuaguggcuc

SEQ ID NO: 1859703 - RNA, 22 nt, Homo sapiens
ugcucgauuauucccuguacaa

SEQ ID NO: 1859704 - RNA, 22 nt, Homo sapiens
cugagcagaagcuggaggcaca

SEQ ID NO: 1859705 - RNA, 22 nt, Homo sapiens
gcgacuccccaacggcuacuac

SEQ ID NO: 1859706 - RNA, 11 nt, Homo sapiens
aaauuugcaac

SEQ ID NO: 1859707 - RNA, 15 nt, Homo sapiens
cccagcuacucugga

SEQ ID NO: 1859708 - RNA, 21 nt, Homo sapiens
cuaacuugaaaagaaaaccac

SEQ ID NO: 1859709 - RNA, 23 nt, Homo sapiens
uaguuuuagcuguagaucaagcu

SEQ ID NO: 1859710 - RNA, 20 nt, Homo sapiens
acucgcaccucuuggcuuug

SEQ ID NO: 1859711 - RNA, 13 nt, Homo sapiens
cugcaacuguauu

SEQ ID NO: 1859712 - RNA, 22 nt, Homo sapiens
gcacguggccucuugagcagug

SEQ ID NO: 1859713 - RNA, 12 nt, Homo sapiens
agucuuucccaa

SEQ ID NO: 1859714 - RNA, 19 nt, Homo sapiens
guccgccgcaccagccacc

SEQ ID NO: 1859715 - RNA, 13 nt, Homo sapiens
uaaacaaauuccu

SEQ ID NO: 1859716 - RNA, 12 nt, Homo sapiens
aaaauccacuca

SEQ ID NO: 1859717 - RNA, 17 nt, Homo sapiens
ucuugcaaaauuccuga

SEQ ID NO: 1859718 - RNA, 22 nt, Homo sapiens
gaccuuuuuuaggaagcaagcu

SEQ ID NO: 1859719 - RNA, 20 nt, Homo sapiens
uaagagaagaggcuggccaa

SEQ ID NO: 1859720 - RNA, 21 nt, Homo sapiens
auuagagagggcuaaacaagg

SEQ ID NO: 1859721 - RNA, 20 nt, Homo sapiens
aaguuccugcugccugggua

SEQ ID NO: 1859722 - RNA, 16 nt, Homo sapiens
cuguaauccuagcacu

SEQ ID NO: 1859723 - RNA, 20 nt, Homo sapiens
acaugaccagaaaacaaauc

SEQ ID NO: 1859724 - RNA, 21 nt, Homo sapiens
ugaccugcugaccugugcaca

SEQ ID NO: 1859725 - RNA, 17 nt, Homo sapiens
uaaaacacagcuuuaca

SEQ ID NO: 1859726 - RNA, 19 nt, Homo sapiens
uauuuauugagcaccugca

SEQ ID NO: 1859727 - RNA, 17 nt, Homo sapiens
aggaauguccagacugu

SEQ ID NO: 1859728 - RNA, 13 nt, Homo sapiens
uuaaucacuacug

SEQ ID NO: 1859729 - RNA, 23 nt, Homo sapiens
caagccaaaugugcagaugcuaa

SEQ ID NO: 1859730 - RNA, 15 nt, Homo sapiens
acauccagucacuuu

SEQ ID NO: 1859731 - RNA, 16 nt, Homo sapiens
auucuggagucacugu

SEQ ID NO: 1859732 - RNA, 18 nt, Homo sapiens
gaaccacauagacuuuau

SEQ ID NO: 1859733 - RNA, 18 nt, Homo sapiens
uggaagagggcugcaaau

SEQ ID NO: 1859734 - RNA, 15 nt, Homo sapiens
ccugcagggugaccu

SEQ ID NO: 1859735 - RNA, 20 nt, Homo sapiens
uugucuguuuguuucaagaa

SEQ ID NO: 1859736 - RNA, 14 nt, Homo sapiens
uuaccagaauguug

SEQ ID NO: 1859737 - RNA, 21 nt, Homo sapiens
gcucuucuacguauaaauaug

SEQ ID NO: 1859738 - RNA, 21 nt, Homo sapiens
aaaaauauauaugcauaccug

SEQ ID NO: 1859739 - RNA, 15 nt, Homo sapiens
ucccuggaccucaga

SEQ ID NO: 1859740 - RNA, 15 nt, Homo sapiens
uuuccgaaaucagaa

SEQ ID NO: 1859741 - RNA, 15 nt, Homo sapiens
guggccggcacucca

SEQ ID NO: 1859742 - RNA, 16 nt, Homo sapiens
gcgcagggacaugggg

SEQ ID NO: 1859743 - RNA, 12 nt, Homo sapiens
aacacacuggcc

SEQ ID NO: 1859744 - RNA, 21 nt, Homo sapiens
agccgggcguguuggugugca

SEQ ID NO: 1859745 - RNA, 18 nt, Homo sapiens
gaaaaaaacuucauucuc

SEQ ID NO: 1859746 - RNA, 19 nt, Homo sapiens
agacaguguuuucugggau

SEQ ID NO: 1859747 - RNA, 13 nt, Homo sapiens
agucuuuccuuag

SEQ ID NO: 1859748 - RNA, 13 nt, Homo sapiens
acucccaguuugc

SEQ ID NO: 1859749 - RNA, 18 nt, Homo sapiens
gccagagcaaagggccag

SEQ ID NO: 1859750 - RNA, 16 nt, Homo sapiens
auugggaggcacaagu

SEQ ID NO: 1859751 - RNA, 20 nt, Homo sapiens
cguguaacacccuuccucug

SEQ ID NO: 1859752 - RNA, 17 nt, Homo sapiens
acucuuuaaacaguuuu

SEQ ID NO: 1859753 - RNA, 17 nt, Homo sapiens
agcugugaccugcugag

SEQ ID NO: 1859754 - RNA, 15 nt, Homo sapiens
accuuaaaauuagca

SEQ ID NO: 1859755 - RNA, 19 nt, Homo sapiens
cucuacuaaaaauacaaaa

SEQ ID NO: 1859756 - RNA, 16 nt, Homo sapiens
gcguguuggugugcac

SEQ ID NO: 1859757 - RNA, 20 nt, Homo sapiens
cuuauccaggacucugucaa

SEQ ID NO: 1859758 - RNA, 12 nt, Homo sapiens
caggcacgugcc

SEQ ID NO: 1859759 - RNA, 15 nt, Homo sapiens
gaauucacacaacua

SEQ ID NO: 1859760 - RNA, 13 nt, Homo sapiens
accuccuguggac

SEQ ID NO: 1859761 - RNA, 13 nt, Homo sapiens
aaucaaaugauuu

SEQ ID NO: 1859762 - RNA, 15 nt, Homo sapiens
gagccuggaacugca

SEQ ID NO: 1859763 - RNA, 16 nt, Homo sapiens
cucagccuggggcucu

SEQ ID NO: 1859764 - RNA, 23 nt, Homo sapiens
augaacgcacaacaugcacauuc

SEQ ID NO: 1859765 - RNA, 16 nt, Homo sapiens
agcaguggcaaaauau

SEQ ID NO: 1859766 - RNA, 17 nt, Homo sapiens
ugaguugcaccauucuu

SEQ ID NO: 1859767 - RNA, 18 nt, Homo sapiens
gggcugaaagaacaugga

SEQ ID NO: 1859768 - RNA, 16 nt, Homo sapiens
aacaguguuggcuuuc

SEQ ID NO: 1859769 - RNA, 22 nt, Homo sapiens
cuugacucaacgagagcacuug

SEQ ID NO: 1859770 - RNA, 12 nt, Homo sapiens
aaugacauccag

SEQ ID NO: 1859771 - RNA, 15 nt, Homo sapiens
augaagauacacauu

SEQ ID NO: 1859772 - RNA, 17 nt, Homo sapiens
acgauucuuaacaauaa

SEQ ID NO: 1859773 - RNA, 21 nt, Homo sapiens
gccacaaagaagauucuuacc

SEQ ID NO: 1859774 - RNA, 15 nt, Homo sapiens
ccugccgagugcucu

SEQ ID NO: 1859775 - RNA, 15 nt, Homo sapiens
cuggcagucucaguc

SEQ ID NO: 1859776 - RNA, 15 nt, Homo sapiens
aaacuuccacuaccu

SEQ ID NO: 1859777 - RNA, 21 nt, Homo sapiens
cgagcaucccccuccucuccc

SEQ ID NO: 1859778 - RNA, 21 nt, Homo sapiens
ugaaaauaaagugucauccaa

SEQ ID NO: 1859779 - RNA, 18 nt, Homo sapiens
acuguauauauaauacug

SEQ ID NO: 1859780 - RNA, 22 nt, Homo sapiens
uacacugccuuaccuucacuua

SEQ ID NO: 1859781 - RNA, 15 nt, Homo sapiens
uggagagagccuuau

SEQ ID NO: 1859782 - RNA, 14 nt, Homo sapiens
uccagccacuuccc

SEQ ID NO: 1859783 - RNA, 23 nt, Homo sapiens
uaacucagaaacaucaguuacuc

SEQ ID NO: 1859784 - RNA, 21 nt, Homo sapiens
gguagcuuaccugacacaaga

SEQ ID NO: 1859785 - RNA, 15 nt, Homo sapiens
caaggaauaaaugag

SEQ ID NO: 1859786 - RNA, 16 nt, Homo sapiens
ucauguaaaugcucaa

SEQ ID NO: 1859787 - RNA, 13 nt, Homo sapiens
uugaaaaacacua

SEQ ID NO: 1859788 - RNA, 18 nt, Homo sapiens
uaaaucguaaccuaugaa

SEQ ID NO: 1859789 - RNA, 17 nt, Homo sapiens
ggggguauccugugcau

SEQ ID NO: 1859790 - RNA, 15 nt, Homo sapiens
aagcauuuguagcaa

SEQ ID NO: 1859791 - RNA, 23 nt, Homo sapiens
cuuuugggauguuaccuucacau

SEQ ID NO: 1859792 - RNA, 15 nt, Homo sapiens
ugaucgggaagcccu

SEQ ID NO: 1859793 - RNA, 19 nt, Homo sapiens
accauuguacccugcugua

SEQ ID NO: 1859794 - RNA, 22 nt, Homo sapiens
acuguaacugcucagagcuuua

SEQ ID NO: 1859795 - RNA, 14 nt, Homo sapiens
gauugagcucucug

SEQ ID NO: 1859796 - RNA, 15 nt, Homo sapiens
gcacagucacugcuc

SEQ ID NO: 1859797 - RNA, 20 nt, Homo sapiens
caccucugccucaaugugaa

SEQ ID NO: 1859798 - RNA, 15 nt, Homo sapiens
agucuguuggcaauu

SEQ ID NO: 1859799 - RNA, 12 nt, Homo sapiens
uccuucaucacc

SEQ ID NO: 1859800 - RNA, 14 nt, Homo sapiens
ccaguaagugauaa

SEQ ID NO: 1859801 - RNA, 19 nt, Homo sapiens
acucugccuacagaacuuc

SEQ ID NO: 1859802 - RNA, 14 nt, Homo sapiens
guguggagacuuga

SEQ ID NO: 1859803 - RNA, 13 nt, Homo sapiens
cuuuucaaaaccu

SEQ ID NO: 1859804 - RNA, 16 nt, Homo sapiens
aagguaguguaucauu

SEQ ID NO: 1859805 - RNA, 16 nt, Homo sapiens
aagacaagcuccuccc

SEQ ID NO: 1859806 - RNA, 16 nt, Homo sapiens
uggcccggacaugucu

SEQ ID NO: 1859807 - RNA, 16 nt, Homo sapiens
gaagucaucauuccuc

SEQ ID NO: 1859808 - RNA, 12 nt, Homo sapiens
ccauuguaauau

SEQ ID NO: 1859809 - RNA, 15 nt, Homo sapiens
aaugucucacuguuc

SEQ ID NO: 1859810 - RNA, 17 nt, Homo sapiens
uccuggagaguaucuga

SEQ ID NO: 1859811 - RNA, 18 nt, Homo sapiens
gcucaauuuaauuuugca

SEQ ID NO: 1859812 - RNA, 13 nt, Homo sapiens
agaacaccugccu

SEQ ID NO: 1859813 - RNA, 13 nt, Homo sapiens
ucccccaugcucu

SEQ ID NO: 1859814 - RNA, 22 nt, Homo sapiens
gaaagguuggccuuacuguuga

SEQ ID NO: 1859815 - RNA, 23 nt, Homo sapiens
gcaaacaaauggcuuacuuacaa

SEQ ID NO: 1859816 - RNA, 20 nt, Homo sapiens
cucuugugaauuauucugau

SEQ ID NO: 1859817 - RNA, 13 nt, Homo sapiens
ccccggaacaagc

SEQ ID NO: 1859818 - RNA, 20 nt, Homo sapiens
auuuauuugacucagcacug

SEQ ID NO: 1859819 - RNA, 18 nt, Homo sapiens
uuccacuaucauucccau

SEQ ID NO: 1859820 - RNA, 16 nt, Homo sapiens
auucuuucccagugag

SEQ ID NO: 1859821 - RNA, 15 nt, Homo sapiens
caguucagauucaua

SEQ ID NO: 1859822 - RNA, 16 nt, Homo sapiens
ugagcagaagaucaag

SEQ ID NO: 1859823 - RNA, 16 nt, Homo sapiens
ugcgggggagcuggaa

SEQ ID NO: 1859824 - RNA, 20 nt, Homo sapiens
aggcagcaccugauucucac

SEQ ID NO: 1859825 - RNA, 23 nt, Homo sapiens
ugaaacuuaggaaggauccucuu

SEQ ID NO: 1859826 - RNA, 22 nt, Homo sapiens
aaaguucugacuugacuuuagu

SEQ ID NO: 1859827 - RNA, 13 nt, Homo sapiens
ugggaaugcaaua

SEQ ID NO: 1859828 - RNA, 17 nt, Homo sapiens
ggcugugguuuggggga

SEQ ID NO: 1859829 - RNA, 12 nt, Homo sapiens
uggggcuuccau

SEQ ID NO: 1859830 - RNA, 14 nt, Homo sapiens
gccacagggagcuc

SEQ ID NO: 1859831 - RNA, 17 nt, Homo sapiens
cuuuuaugcaaccauaa

SEQ ID NO: 1859832 - RNA, 17 nt, Homo sapiens
gagccgauggaucugug

SEQ ID NO: 1859833 - RNA, 16 nt, Homo sapiens
guuguacacagucugu

SEQ ID NO: 1859834 - RNA, 15 nt, Homo sapiens
uggaagaggagcaac

SEQ ID NO: 1859835 - RNA, 23 nt, Homo sapiens
aaugcuagacagaaaccaagcca

SEQ ID NO: 1859836 - RNA, 21 nt, Homo sapiens
aguaacacaguguagugcuca

SEQ ID NO: 1859837 - RNA, 14 nt, Homo sapiens
uaaagaaagccaca

SEQ ID NO: 1859838 - RNA, 23 nt, Homo sapiens
accuccagcuaaacaccaacccc

SEQ ID NO: 1859839 - RNA, 22 nt, Homo sapiens
uccuuuagacuaagggcaggaa

SEQ ID NO: 1859840 - RNA, 15 nt, Homo sapiens
ugacucuugacucuu

SEQ ID NO: 1859841 - RNA, 13 nt, Homo sapiens
caaaacauuccaa

SEQ ID NO: 1859842 - RNA, 13 nt, Homo sapiens
caaaucauuccau

SEQ ID NO: 1859843 - RNA, 14 nt, Homo sapiens
ugccucucccaugg

SEQ ID NO: 1859844 - RNA, 17 nt, Homo sapiens
uccugaagcugcuggag

SEQ ID NO: 1859845 - RNA, 21 nt, Homo sapiens
uuuggaccaccguucagucau

SEQ ID NO: 1859846 - RNA, 15 nt, Homo sapiens
cauauuuaacaugua

SEQ ID NO: 1859847 - RNA, 17 nt, Homo sapiens
cuuuauuaauaaaaccu

SEQ ID NO: 1859848 - RNA, 15 nt, Homo sapiens
cagaaaguccagcua

SEQ ID NO: 1859849 - RNA, 16 nt, Homo sapiens
gauguggaaaagccaa

SEQ ID NO: 1859850 - RNA, 21 nt, Homo sapiens
ucagucuuugggggauucaaa

SEQ ID NO: 1859851 - RNA, 22 nt, Homo sapiens
ggcuggagauccuuucucucaa

SEQ ID NO: 1859852 - RNA, 17 nt, Homo sapiens
auuaaucaucuauaaag

SEQ ID NO: 1859853 - RNA, 22 nt, Homo sapiens
agucuccagggacccuugccug

SEQ ID NO: 1859854 - RNA, 18 nt, Homo sapiens
auuuuauaagcacagaca

SEQ ID NO: 1859855 - RNA, 16 nt, Homo sapiens
gugaugauagcacugg

SEQ ID NO: 1859856 - RNA, 14 nt, Homo sapiens
guccaucacuggcu

SEQ ID NO: 1859857 - RNA, 12 nt, Homo sapiens
uggcuacugcac

SEQ ID NO: 1859858 - RNA, 20 nt, Homo sapiens
cauuuuacuuccaugauacu

SEQ ID NO: 1859859 - RNA, 17 nt, Homo sapiens
caguugaucagacugaa

SEQ ID NO: 1859860 - RNA, 18 nt, Homo sapiens
aucccuaacaucaugcau

SEQ ID NO: 1859861 - RNA, 24 nt, Homo sapiens
gcucuggacaggcacuaucugggu

SEQ ID NO: 1859862 - RNA, 16 nt, Homo sapiens
agacuccagccugaau

SEQ ID NO: 1859863 - RNA, 16 nt, Homo sapiens
ugaccuugacuugcca

SEQ ID NO: 1859864 - RNA, 13 nt, Homo sapiens
ggauggcacuguu

SEQ ID NO: 1859865 - RNA, 11 nt, Homo sapiens
uguacuuucau

SEQ ID NO: 1859866 - RNA, 15 nt, Homo sapiens
uagaaauagauuuaa

SEQ ID NO: 1859867 - RNA, 16 nt, Homo sapiens
cugguucuaacugcug

SEQ ID NO: 1859868 - RNA, 15 nt, Homo sapiens
ugaacauucaagaga

SEQ ID NO: 1859869 - RNA, 15 nt, Homo sapiens
cagaaaaccuguuca

SEQ ID NO: 1859870 - RNA, 14 nt, Homo sapiens
uacauauauguaua

SEQ ID NO: 1859871 - RNA, 23 nt, Homo sapiens
aaacacagcugcuuucuucuuac

SEQ ID NO: 1859872 - RNA, 15 nt, Homo sapiens
uuagcccacugccug

SEQ ID NO: 1859873 - RNA, 19 nt, Homo sapiens
uuggcaccugcacacucca

SEQ ID NO: 1859874 - RNA, 20 nt, Homo sapiens
ggaauauuugcaagacauag

SEQ ID NO: 1859875 - RNA, 15 nt, Homo sapiens
aagccauguaucuca

SEQ ID NO: 1859876 - RNA, 14 nt, Homo sapiens
ucucaaaguuaaaa

SEQ ID NO: 1859877 - RNA, 24 nt, Homo sapiens
cagcaaucaaaggcaaugcucaaa

SEQ ID NO: 1859878 - RNA, 24 nt, Homo sapiens
gaguuguuuuaacagaugccaauu

SEQ ID NO: 1859879 - RNA, 13 nt, Homo sapiens
gcaugaaucuucc

SEQ ID NO: 1859880 - RNA, 17 nt, Homo sapiens
uuccuaaacucugaaau

SEQ ID NO: 1859881 - RNA, 21 nt, Homo sapiens
gaggccuuucuagaauuuucu

SEQ ID NO: 1859882 - RNA, 14 nt, Homo sapiens
gccccucucaccaa

SEQ ID NO: 1859883 - RNA, 17 nt, Homo sapiens
gccaccaacagccacuc

SEQ ID NO: 1859884 - RNA, 23 nt, Homo sapiens
cugaggguugggguggggaagca

SEQ ID NO: 1859885 - RNA, 16 nt, Homo sapiens
cugcuugugaucucac

SEQ ID NO: 1859886 - RNA, 21 nt, Homo sapiens
uuacaggugcccgccaccacg

SEQ ID NO: 1859887 - RNA, 13 nt, Homo sapiens
uccuucugagcuc

SEQ ID NO: 1859888 - RNA, 13 nt, Homo sapiens
acuaccuguguau

SEQ ID NO: 1859889 - RNA, 20 nt, Homo sapiens
agugguugcuguccucucau

SEQ ID NO: 1859890 - RNA, 13 nt, Homo sapiens
aggccauagcaac

SEQ ID NO: 1859891 - RNA, 14 nt, Homo sapiens
cuauguuacuauuu

SEQ ID NO: 1859892 - RNA, 18 nt, Homo sapiens
ccuuucugcagggaugau

SEQ ID NO: 1859893 - RNA, 13 nt, Homo sapiens
agaauaccaauau

SEQ ID NO: 1859894 - RNA, 13 nt, Homo sapiens
agugaaccaaaga

SEQ ID NO: 1859895 - RNA, 13 nt, Homo sapiens
aguaaaccaaaaa

SEQ ID NO: 1859896 - RNA, 18 nt, Homo sapiens
guugauuauuuucugcua

SEQ ID NO: 1859897 - RNA, 14 nt, Homo sapiens
uuaugaggaaacaa

SEQ ID NO: 1859898 - RNA, 22 nt, Homo sapiens
acauuuugaaauaaaaauggau

SEQ ID NO: 1859899 - RNA, 19 nt, Homo sapiens
cugagggcuuguaguucuu

SEQ ID NO: 1859900 - RNA, 19 nt, Homo sapiens
gugcucaaauuacuaauga

SEQ ID NO: 1859901 - RNA, 16 nt, Homo sapiens
auuucaaauuaaucuu

SEQ ID NO: 1859902 - RNA, 15 nt, Homo sapiens
aaaugccaguuuugu

SEQ ID NO: 1859903 - RNA, 21 nt, Homo sapiens
aagugcugagauuacaggugu

SEQ ID NO: 1859904 - RNA, 16 nt, Homo sapiens
auaugucuaauucuau

SEQ ID NO: 1859905 - RNA, 18 nt, Homo sapiens
acccaguaaaaauccacu

SEQ ID NO: 1859906 - RNA, 18 nt, Homo sapiens
caagcaaugagaagacca

SEQ ID NO: 1859907 - RNA, 16 nt, Homo sapiens
aaaccuguacauaugu

SEQ ID NO: 1859908 - RNA, 15 nt, Homo sapiens
aacuugaacaccaag

SEQ ID NO: 1859909 - RNA, 15 nt, Homo sapiens
aggagaaucacuuga

SEQ ID NO: 1859910 - RNA, 15 nt, Homo sapiens
agguuggagugcagu

SEQ ID NO: 1859911 - RNA, 21 nt, Homo sapiens
uuaauucccuuuuaacccagu

SEQ ID NO: 1859912 - RNA, 20 nt, Homo sapiens
auugaaacuaagagcucuca

SEQ ID NO: 1859913 - RNA, 22 nt, Homo sapiens
gacagccacggccaggccagag

SEQ ID NO: 1859914 - RNA, 14 nt, Homo sapiens
auuguuuugucucc

SEQ ID NO: 1859915 - RNA, 15 nt, Homo sapiens
uaugcuacccuuaau

SEQ ID NO: 1859916 - RNA, 16 nt, Homo sapiens
cuuaacuaagacuccc

SEQ ID NO: 1859917 - RNA, 18 nt, Homo sapiens
cuccucugcagugccuug

SEQ ID NO: 1859918 - RNA, 15 nt, Homo sapiens
caacauuaaacacaa

SEQ ID NO: 1859919 - RNA, 14 nt, Homo sapiens
ggacagacuggccg

SEQ ID NO: 1859920 - RNA, 18 nt, Homo sapiens
uacuccuuaaaaauguau

SEQ ID NO: 1859921 - RNA, 21 nt, Homo sapiens
cgccugugaggggugcagaga

SEQ ID NO: 1859922 - RNA, 21 nt, Homo sapiens
aagaaguuaaaaaacagcugc

SEQ ID NO: 1859923 - RNA, 15 nt, Homo sapiens
ccacauaauguucca

SEQ ID NO: 1859924 - RNA, 20 nt, Homo sapiens
ucuaccagagugauggauuu

SEQ ID NO: 1859925 - RNA, 23 nt, Homo sapiens
ucagucacauggcaugguuuugu

SEQ ID NO: 1859926 - RNA, 19 nt, Homo sapiens
gcuggcugggggcaggaca

SEQ ID NO: 1859927 - RNA, 23 nt, Homo sapiens
uugcucauaagcaauaccagcaa

SEQ ID NO: 1859928 - RNA, 15 nt, Homo sapiens
aaugauuuagaauuu

SEQ ID NO: 1859929 - RNA, 18 nt, Homo sapiens
agaaggugccgauuucau

SEQ ID NO: 1859930 - RNA, 16 nt, Homo sapiens
cugaaaugacauuuca

SEQ ID NO: 1859931 - RNA, 22 nt, Homo sapiens
aacacacuuggaugcaggguuu

SEQ ID NO: 1859932 - RNA, 13 nt, Homo sapiens
caccuccauuugc

SEQ ID NO: 1859933 - RNA, 19 nt, Homo sapiens
ucugugccuuggucucucc

SEQ ID NO: 1859934 - RNA, 15 nt, Homo sapiens
gcacauuugacucca

SEQ ID NO: 1859935 - RNA, 14 nt, Homo sapiens
ggccccucaggguc

SEQ ID NO: 1859936 - RNA, 15 nt, Homo sapiens
gcgccugugcugagg

SEQ ID NO: 1859937 - RNA, 13 nt, Homo sapiens
cugcacacacaug

SEQ ID NO: 1859938 - RNA, 17 nt, Homo sapiens
aaggagucccugguuca

SEQ ID NO: 1859939 - RNA, 20 nt, Homo sapiens
cggacuccucucguacuuga

SEQ ID NO: 1859940 - RNA, 14 nt, Homo sapiens
cugggugaccucac

SEQ ID NO: 1859941 - RNA, 17 nt, Homo sapiens
uuaucaagugucuucca

SEQ ID NO: 1859942 - RNA, 20 nt, Homo sapiens
gcccauggugagcucuggga

SEQ ID NO: 1859943 - RNA, 18 nt, Homo sapiens
acugggugguccaaagaa

SEQ ID NO: 1859944 - RNA, 16 nt, Homo sapiens
gugugcaccuauagcc

SEQ ID NO: 1859945 - RNA, 14 nt, Homo sapiens
aauguaacacuggc

SEQ ID NO: 1859946 - RNA, 21 nt, Homo sapiens
ugacaugugacaucuaccucc

SEQ ID NO: 1859947 - RNA, 13 nt, Homo sapiens
caucaacugaucu

SEQ ID NO: 1859948 - RNA, 15 nt, Homo sapiens
uucaccuccauuaac

SEQ ID NO: 1859949 - RNA, 18 nt, Homo sapiens
acugcuauauaauucucu

SEQ ID NO: 1859950 - RNA, 14 nt, Homo sapiens
cccgcggguucuag

SEQ ID NO: 1859951 - RNA, 18 nt, Homo sapiens
uccagucaugugugcauc

SEQ ID NO: 1859952 - RNA, 15 nt, Homo sapiens
ugggagaguucucca

SEQ ID NO: 1859953 - RNA, 14 nt, Homo sapiens
uacaauccugcauu

SEQ ID NO: 1859954 - RNA, 19 nt, Homo sapiens
cccaagugaggagugccag

SEQ ID NO: 1859955 - RNA, 22 nt, Homo sapiens
gcacauguauguccauucacuu

SEQ ID NO: 1859956 - RNA, 21 nt, Homo sapiens
ugaaguguuagagugucuuaa

SEQ ID NO: 1859957 - RNA, 19 nt, Homo sapiens
aaaauagaauguuacuuug

SEQ ID NO: 1859958 - RNA, 17 nt, Homo sapiens
aguugauggugaugaaa

SEQ ID NO: 1859959 - RNA, 12 nt, Homo sapiens
gguuaagagcuc

SEQ ID NO: 1859960 - RNA, 23 nt, Homo sapiens
caaaaaugugcugccuagaaaca

SEQ ID NO: 1859961 - RNA, 16 nt, Homo sapiens
ccaggaugugcuauua

SEQ ID NO: 1859962 - RNA, 13 nt, Homo sapiens
aucaacucugaaa

SEQ ID NO: 1859963 - RNA, 15 nt, Homo sapiens
ccagcccagagccac

SEQ ID NO: 1859964 - RNA, 17 nt, Homo sapiens
gcucuuuuccagaucaa

SEQ ID NO: 1859965 - RNA, 13 nt, Homo sapiens
uuacaaacugcaa

SEQ ID NO: 1859966 - RNA, 14 nt, Homo sapiens
ugugcugcuguaag

SEQ ID NO: 1859967 - RNA, 20 nt, Homo sapiens
auaggucauuuucuauucac

SEQ ID NO: 1859968 - RNA, 20 nt, Homo sapiens
agauaaucuuagcugccaag

SEQ ID NO: 1859969 - RNA, 17 nt, Homo sapiens
guuucaaaaaaucugac

SEQ ID NO: 1859970 - RNA, 15 nt, Homo sapiens
ccacgugcuguucca

SEQ ID NO: 1859971 - RNA, 17 nt, Homo sapiens
agccgauggggagggga

SEQ ID NO: 1859972 - RNA, 12 nt, Homo sapiens
aggaggggccag

SEQ ID NO: 1859973 - RNA, 17 nt, Homo sapiens
aauugcuagugauuuca

SEQ ID NO: 1859974 - RNA, 13 nt, Homo sapiens
uggcucacagcca

SEQ ID NO: 1859975 - RNA, 19 nt, Homo sapiens
uuaaaaccauaucagagau

SEQ ID NO: 1859976 - RNA, 13 nt, Homo sapiens
gcugaccacuuua

SEQ ID NO: 1859977 - RNA, 18 nt, Homo sapiens
caaacacugcaguuuccu

SEQ ID NO: 1859978 - RNA, 13 nt, Homo sapiens
ugaagguuuuuga

SEQ ID NO: 1859979 - RNA, 23 nt, Homo sapiens
cccagagguggguuaaacuguaa

SEQ ID NO: 1859980 - RNA, 15 nt, Homo sapiens
uuuagucuugucuca

SEQ ID NO: 1859981 - RNA, 17 nt, Homo sapiens
ugcagugagcugugauu

SEQ ID NO: 1859982 - RNA, 13 nt, Homo sapiens
aaaauauucugua

SEQ ID NO: 1859983 - RNA, 21 nt, Homo sapiens
augcuaaaccuuaguacugag

SEQ ID NO: 1859984 - RNA, 20 nt, Homo sapiens
ugcugcaucuuauagcacuu

SEQ ID NO: 1859985 - RNA, 17 nt, Homo sapiens
ggcaccagcucaugcca

SEQ ID NO: 1859986 - RNA, 16 nt, Homo sapiens
ugcaacccuuaccccu

SEQ ID NO: 1859987 - RNA, 16 nt, Homo sapiens
agucucgcuacauuuc

SEQ ID NO: 1859988 - RNA, 12 nt, Homo sapiens
uccaugugcaaa

SEQ ID NO: 1859989 - RNA, 12 nt, Homo sapiens
aucucuguaauc

SEQ ID NO: 1859990 - RNA, 18 nt, Homo sapiens
uauuuugguacugugaug

SEQ ID NO: 1859991 - RNA, 17 nt, Homo sapiens
uuacaaaagcagcuuuu

SEQ ID NO: 1859992 - RNA, 15 nt, Homo sapiens
aggcagacucuuuau

SEQ ID NO: 1859993 - RNA, 17 nt, Homo sapiens
cuuuggccccacuuuga

SEQ ID NO: 1859994 - RNA, 12 nt, Homo sapiens
gcucggggucca

SEQ ID NO: 1859995 - RNA, 13 nt, Homo sapiens
aaagcaauaagcu

SEQ ID NO: 1859996 - RNA, 19 nt, Homo sapiens
aaaacaauuguaauaaugc

SEQ ID NO: 1859997 - RNA, 14 nt, Homo sapiens
ugcacugacuguga

SEQ ID NO: 1859998 - RNA, 22 nt, Homo sapiens
aacacaucccggcacuguuuuc

SEQ ID NO: 1859999 - RNA, 12 nt, Homo sapiens
caaaaaauuaca

SEQ ID NO: 1860000 - RNA, 17 nt, Homo sapiens
gaccuuucugagugaca

SEQ ID NO: 1860001 - RNA, 13 nt, Homo sapiens
uagucaaaccaua

SEQ ID NO: 1860002 - RNA, 20 nt, Homo sapiens
aggccuggacgggcccuccu

SEQ ID NO: 1860003 - RNA, 16 nt, Homo sapiens
caguggccaggugccg

SEQ ID NO: 1860004 - RNA, 16 nt, Homo sapiens
aguuguuuugcuucuu

SEQ ID NO: 1860005 - RNA, 18 nt, Homo sapiens
auucccaccacuaaaaaa

SEQ ID NO: 1860006 - RNA, 13 nt, Homo sapiens
uaggaagaauuac

SEQ ID NO: 1860007 - RNA, 17 nt, Homo sapiens
uuucuccuuuuacuuca

SEQ ID NO: 1860008 - RNA, 22 nt, Homo sapiens
auuuuuauuucauucacauuaa

SEQ ID NO: 1860009 - RNA, 18 nt, Homo sapiens
uaauaucccuacauguau

SEQ ID NO: 1860010 - RNA, 20 nt, Homo sapiens
uuugcugccucuaaaaggcc

SEQ ID NO: 1860011 - RNA, 15 nt, Homo sapiens
aaguugguuacaaac

SEQ ID NO: 1860012 - RNA, 17 nt, Homo sapiens
uaggccuuuccucugca

SEQ ID NO: 1860013 - RNA, 15 nt, Homo sapiens
ucucaccugugagac

SEQ ID NO: 1860014 - RNA, 21 nt, Homo sapiens
ugccuucuagcuguguccuca

SEQ ID NO: 1860015 - RNA, 15 nt, Homo sapiens
cuaacaccaacauaa

SEQ ID NO: 1860016 - RNA, 12 nt, Homo sapiens
ggcuuccaugcu

SEQ ID NO: 1860017 - RNA, 23 nt, Homo sapiens
ucacauuccaagccucaugucca

SEQ ID NO: 1860018 - RNA, 15 nt, Homo sapiens
gcucgcccuccuuuc

SEQ ID NO: 1860019 - RNA, 13 nt, Homo sapiens
auuaauucacaug

SEQ ID NO: 1860020 - RNA, 16 nt, Homo sapiens
auauccaguggaugga

SEQ ID NO: 1860021 - RNA, 23 nt, Homo sapiens
uagaguguaggugaaaugaauga

SEQ ID NO: 1860022 - RNA, 14 nt, Homo sapiens
auguaacauuaauu

SEQ ID NO: 1860023 - RNA, 21 nt, Homo sapiens
gccauucacugauuggaagag

SEQ ID NO: 1860024 - RNA, 17 nt, Homo sapiens
ugucgcugaaccugucu

SEQ ID NO: 1860025 - RNA, 15 nt, Homo sapiens
ucaucuagaugaggu

SEQ ID NO: 1860026 - RNA, 18 nt, Homo sapiens
uugcagugagcugagauc

SEQ ID NO: 1860027 - RNA, 17 nt, Homo sapiens
agagaaggaggggagca

SEQ ID NO: 1860028 - RNA, 14 nt, Homo sapiens
ccucugccugaccc

SEQ ID NO: 1860029 - RNA, 14 nt, Homo sapiens
uuuaaaaaggccuu

SEQ ID NO: 1860030 - RNA, 14 nt, Homo sapiens
guucuaaaugcaau

SEQ ID NO: 1860031 - RNA, 20 nt, Homo sapiens
uaacuaugagcuugcucauu

SEQ ID NO: 1860032 - RNA, 14 nt, Homo sapiens
acccuucacacugu

SEQ ID NO: 1860033 - RNA, 18 nt, Homo sapiens
cugaaguggaaugacuga

SEQ ID NO: 1860034 - RNA, 19 nt, Homo sapiens
uuguaccuaaguggauaua

SEQ ID NO: 1860035 - RNA, 15 nt, Homo sapiens
uguaagaagagccau

SEQ ID NO: 1860036 - RNA, 20 nt, Homo sapiens
gaaacacacaagcaacaaac

SEQ ID NO: 1860037 - RNA, 14 nt, Homo sapiens
uuacgacagguuug

SEQ ID NO: 1860038 - RNA, 23 nt, Homo sapiens
cuuaccagcagagcaccuuagac

SEQ ID NO: 1860039 - RNA, 20 nt, Homo sapiens
acuaacgaaauaucaaaguc

SEQ ID NO: 1860040 - RNA, 18 nt, Homo sapiens
acauuccaucacagccag

SEQ ID NO: 1860041 - RNA, 18 nt, Homo sapiens
ggaguuugacgagcucac

SEQ ID NO: 1860042 - RNA, 12 nt, Homo sapiens
uguaccagagaa

SEQ ID NO: 1860043 - RNA, 22 nt, Homo sapiens
augccuuguugaugaagcacau

SEQ ID NO: 1860044 - RNA, 18 nt, Homo sapiens
agaguaacgagaagacaa

SEQ ID NO: 1860045 - RNA, 20 nt, Homo sapiens
aauauaccaacccacuggca

SEQ ID NO: 1860046 - RNA, 19 nt, Homo sapiens
gcuccagcaagcccagggc

SEQ ID NO: 1860047 - RNA, 16 nt, Homo sapiens
aggccagugagccacu

SEQ ID NO: 1860048 - RNA, 18 nt, Homo sapiens
ucaagaugagagaacugg

SEQ ID NO: 1860049 - RNA, 18 nt, Homo sapiens
cuuaaaaaaaacucuuua

SEQ ID NO: 1860050 - RNA, 16 nt, Homo sapiens
uuccccccaucuccau

SEQ ID NO: 1860051 - RNA, 15 nt, Homo sapiens
caaaaguuacuauug

SEQ ID NO: 1860052 - RNA, 17 nt, Homo sapiens
gaaguggagauuuacac

SEQ ID NO: 1860053 - RNA, 15 nt, Homo sapiens
ucaccuccucuguga

SEQ ID NO: 1860054 - RNA, 15 nt, Homo sapiens
acagcuccacucuga

SEQ ID NO: 1860055 - RNA, 17 nt, Homo sapiens
caugaggacagaccaca

SEQ ID NO: 1860056 - RNA, 16 nt, Homo sapiens
guguccguggaaccag

SEQ ID NO: 1860057 - RNA, 23 nt, Homo sapiens
gauccauuuaaaacaagcugaua

SEQ ID NO: 1860058 - RNA, 18 nt, Homo sapiens
caaacugcugccugauuu

SEQ ID NO: 1860059 - RNA, 15 nt, Homo sapiens
gccuucacuuuacaa

SEQ ID NO: 1860060 - RNA, 18 nt, Homo sapiens
auuugacaaaacuaaccu

SEQ ID NO: 1860061 - RNA, 19 nt, Homo sapiens
ggugaccuccguccucucc

SEQ ID NO: 1860062 - RNA, 15 nt, Homo sapiens
ucuggcccacugagc

SEQ ID NO: 1860063 - RNA, 16 nt, Homo sapiens
ugagggaaaaugagua

SEQ ID NO: 1860064 - RNA, 15 nt, Homo sapiens
cauagauauaucuuu

SEQ ID NO: 1860065 - RNA, 24 nt, Homo sapiens
acaccugucauugagccaagaaag

SEQ ID NO: 1860066 - RNA, 11 nt, Homo sapiens
gccccuggacg

SEQ ID NO: 1860067 - RNA, 19 nt, Homo sapiens
agaugugaaaauaaagcag

SEQ ID NO: 1860068 - RNA, 15 nt, Homo sapiens
uugguagauauucag

SEQ ID NO: 1860069 - RNA, 14 nt, Homo sapiens
uccagagcugagau

SEQ ID NO: 1860070 - RNA, 19 nt, Homo sapiens
uugaauauauacauucuau

SEQ ID NO: 1860071 - RNA, 14 nt, Homo sapiens
uuaacucgcugaug

SEQ ID NO: 1860072 - RNA, 17 nt, Homo sapiens
aggaaugccgcuagucu

SEQ ID NO: 1860073 - RNA, 15 nt, Homo sapiens
ucccuuuuccaucau

SEQ ID NO: 1860074 - RNA, 23 nt, Homo sapiens
uggguccucggcccaucugucca

SEQ ID NO: 1860075 - RNA, 12 nt, Homo sapiens
cauuccauuugc

SEQ ID NO: 1860076 - RNA, 17 nt, Homo sapiens
agagcaagaacauucaa

SEQ ID NO: 1860077 - RNA, 15 nt, Homo sapiens
ucuccugaacuccca

SEQ ID NO: 1860078 - RNA, 18 nt, Homo sapiens
uacaaucucaaauucuca

SEQ ID NO: 1860079 - RNA, 22 nt, Homo sapiens
aaccuugaaaaaaaacagugga

SEQ ID NO: 1860080 - RNA, 13 nt, Homo sapiens
acacagucagauu

SEQ ID NO: 1860081 - RNA, 13 nt, Homo sapiens
ucuguaaauggaa

SEQ ID NO: 1860082 - RNA, 14 nt, Homo sapiens
ucccugacuccucc

SEQ ID NO: 1860083 - RNA, 23 nt, Homo sapiens
agccagugugacacugcuuuaaa

SEQ ID NO: 1860084 - RNA, 20 nt, Homo sapiens
caacauccugccagccccac

SEQ ID NO: 1860085 - RNA, 23 nt, Homo sapiens
gaaacagcggcuccacuaaagac

SEQ ID NO: 1860086 - RNA, 22 nt, Homo sapiens
uguuaugauuuguaacauucac

SEQ ID NO: 1860087 - RNA, 19 nt, Homo sapiens
acauuuaguuaacacacau

SEQ ID NO: 1860088 - RNA, 16 nt, Homo sapiens
uagaguaacacauaac

SEQ ID NO: 1860089 - RNA, 19 nt, Homo sapiens
cagucucccgaguagcugg

SEQ ID NO: 1860090 - RNA, 19 nt, Homo sapiens
caccucugcacaagcugca

SEQ ID NO: 1860091 - RNA, 14 nt, Homo sapiens
gaaaggcucauuua

SEQ ID NO: 1860092 - RNA, 14 nt, Homo sapiens
ucagucuggugcuc

SEQ ID NO: 1860093 - RNA, 15 nt, Homo sapiens
gcuaucuccuaacuu

SEQ ID NO: 1860094 - RNA, 20 nt, Homo sapiens
cacagagcaggacugcacag

SEQ ID NO: 1860095 - RNA, 20 nt, Homo sapiens
auuguauccuuuauuucuga

SEQ ID NO: 1860096 - RNA, 21 nt, Homo sapiens
cuaauccagcgacaauuugaa

SEQ ID NO: 1860097 - RNA, 15 nt, Homo sapiens
acauuauauugcaau

SEQ ID NO: 1860098 - RNA, 20 nt, Homo sapiens
aggaggcucccgaggggaag

SEQ ID NO: 1860099 - RNA, 22 nt, Homo sapiens
auguuaaaaaaauaagaagaau

SEQ ID NO: 1860100 - RNA, 16 nt, Homo sapiens
uucagcccuaacauag

SEQ ID NO: 1860101 - RNA, 24 nt, Homo sapiens
uggacaucauguuuucuggugaug

SEQ ID NO: 1860102 - RNA, 11 nt, Homo sapiens
uuaacaugucg

SEQ ID NO: 1860103 - RNA, 14 nt, Homo sapiens
cauuugaggggcca

SEQ ID NO: 1860104 - RNA, 18 nt, Homo sapiens
cauuuugcccuuccauag

SEQ ID NO: 1860105 - RNA, 13 nt, Homo sapiens
ugucacugccaac

SEQ ID NO: 1860106 - RNA, 17 nt, Homo sapiens
ccuuuguaaaacagccu

SEQ ID NO: 1860107 - RNA, 17 nt, Homo sapiens
aaccuagcaucuuacaa

SEQ ID NO: 1860108 - RNA, 18 nt, Homo sapiens
uuagacguccuccgucca

SEQ ID NO: 1860109 - RNA, 22 nt, Homo sapiens
ucauccuaaaaaguuccaugaa

SEQ ID NO: 1860110 - RNA, 12 nt, Homo sapiens
ucauauguucuc

SEQ ID NO: 1860111 - RNA, 22 nt, Homo sapiens
accaguguccccuccacuguca

SEQ ID NO: 1860112 - RNA, 21 nt, Homo sapiens
cagaaguuugcaaauaggcag

SEQ ID NO: 1860113 - RNA, 18 nt, Homo sapiens
cuagcuuauuuugaggcu

SEQ ID NO: 1860114 - RNA, 18 nt, Homo sapiens
uugagaaagaaugagcau

SEQ ID NO: 1860115 - RNA, 17 nt, Homo sapiens
augcacaaaguguauuc

SEQ ID NO: 1860116 - RNA, 19 nt, Homo sapiens
acagguuaaugugguguua

SEQ ID NO: 1860117 - RNA, 20 nt, Homo sapiens
cuauauuugagcacuggucu

SEQ ID NO: 1860118 - RNA, 16 nt, Homo sapiens
ccaaaugaaacucaaa

SEQ ID NO: 1860119 - RNA, 21 nt, Homo sapiens
cauucuguuuuuucuguacac

SEQ ID NO: 1860120 - RNA, 14 nt, Homo sapiens
uacuguggcuucuu

SEQ ID NO: 1860121 - RNA, 18 nt, Homo sapiens
cagagaggaggggaccaa

SEQ ID NO: 1860122 - RNA, 21 nt, Homo sapiens
gugcaaucacagcucacugca

SEQ ID NO: 1860123 - RNA, 23 nt, Homo sapiens
caagauaaaggaagucaccaaaa

SEQ ID NO: 1860124 - RNA, 12 nt, Homo sapiens
acuuucugccag

SEQ ID NO: 1860125 - RNA, 22 nt, Homo sapiens
uugaccaaauaaaguaccauua

SEQ ID NO: 1860126 - RNA, 12 nt, Homo sapiens
uucacccugugc

SEQ ID NO: 1860127 - RNA, 18 nt, Homo sapiens
aggagagagugagugcau

SEQ ID NO: 1860128 - RNA, 13 nt, Homo sapiens
auguuucuauucu

SEQ ID NO: 1860129 - RNA, 13 nt, Homo sapiens
ccucuugcuauug

SEQ ID NO: 1860130 - RNA, 13 nt, Homo sapiens
ucacuugccaaug

SEQ ID NO: 1860131 - RNA, 20 nt, Homo sapiens
gucauugauagaacuacuuu

SEQ ID NO: 1860132 - RNA, 23 nt, Homo sapiens
aauucagggucccuggagaucau

SEQ ID NO: 1860133 - RNA, 17 nt, Homo sapiens
caguggcugugaaggag

SEQ ID NO: 1860134 - RNA, 16 nt, Homo sapiens
cacccacgugcauuca

SEQ ID NO: 1860135 - RNA, 11 nt, Homo sapiens
aaaaacauuca

SEQ ID NO: 1860136 - RNA, 17 nt, Homo sapiens
augguaugccucugugu

SEQ ID NO: 1860137 - RNA, 23 nt, Homo sapiens
uuuguauucauguucaugugauu

SEQ ID NO: 1860138 - RNA, 19 nt, Homo sapiens
aucagccugucucuuccau

SEQ ID NO: 1860139 - RNA, 17 nt, Homo sapiens
cucaucuuugacgugga

SEQ ID NO: 1860140 - RNA, 23 nt, Homo sapiens
cacaggggcccuguacagugaau

SEQ ID NO: 1860141 - RNA, 19 nt, Homo sapiens
agcaaaggugcacuccaga

SEQ ID NO: 1860142 - RNA, 17 nt, Homo sapiens
uuucagaagcaagccag

SEQ ID NO: 1860143 - RNA, 17 nt, Homo sapiens
uguuucgucauguuggc

SEQ ID NO: 1860144 - RNA, 20 nt, Homo sapiens
aggagaggcgcugaguggaa

SEQ ID NO: 1860145 - RNA, 20 nt, Homo sapiens
agccuuccacagugaaugug

SEQ ID NO: 1860146 - RNA, 21 nt, Homo sapiens
gccacagcuggugguaucuga

SEQ ID NO: 1860147 - RNA, 21 nt, Homo sapiens
uucgggcaguccugugugagg

SEQ ID NO: 1860148 - RNA, 17 nt, Homo sapiens
gccagaucucaugagaa

SEQ ID NO: 1860149 - RNA, 17 nt, Homo sapiens
aauauccaaaccaaaua

SEQ ID NO: 1860150 - RNA, 20 nt, Homo sapiens
acuauuccuuacaacuggag

SEQ ID NO: 1860151 - RNA, 15 nt, Homo sapiens
uuugacucuggcaaa

SEQ ID NO: 1860152 - RNA, 19 nt, Homo sapiens
uacuuuccugauguugaua

SEQ ID NO: 1860153 - RNA, 17 nt, Homo sapiens
ucaggaguucgagacca

SEQ ID NO: 1860154 - RNA, 13 nt, Homo sapiens
uuugucauaccuu

SEQ ID NO: 1860155 - RNA, 21 nt, Homo sapiens
aaauaaaaugauaaacaaguc

SEQ ID NO: 1860156 - RNA, 20 nt, Homo sapiens
agcccuguguauaaagccau

SEQ ID NO: 1860157 - RNA, 24 nt, Homo sapiens
gcgaaugauuuaaauagaacuuga

SEQ ID NO: 1860158 - RNA, 23 nt, Homo sapiens
agccaucaccuugauaaugggau

SEQ ID NO: 1860159 - RNA, 12 nt, Homo sapiens
cgcucugccauu

SEQ ID NO: 1860160 - RNA, 16 nt, Homo sapiens
uagugcuucagaguuu

SEQ ID NO: 1860161 - RNA, 17 nt, Homo sapiens
ggagaaugaagacuguu

SEQ ID NO: 1860162 - RNA, 12 nt, Homo sapiens
ucaugugccugg

SEQ ID NO: 1860163 - RNA, 15 nt, Homo sapiens
aaugguccaguacaa

SEQ ID NO: 1860164 - RNA, 14 nt, Homo sapiens
guguauugcaaugg

SEQ ID NO: 1860165 - RNA, 18 nt, Homo sapiens
ucucaaaugauacaguca

SEQ ID NO: 1860166 - RNA, 21 nt, Homo sapiens
gccuuguuucaaaauucucau

SEQ ID NO: 1860167 - RNA, 15 nt, Homo sapiens
caguauuuaaugaaa

SEQ ID NO: 1860168 - RNA, 17 nt, Homo sapiens
uggaaagacaagcucaa

SEQ ID NO: 1860169 - RNA, 22 nt, Homo sapiens
uguguguauucuuaaaaugcaa

SEQ ID NO: 1860170 - RNA, 18 nt, Homo sapiens
ugcuuuguaggugucuca

SEQ ID NO: 1860171 - RNA, 21 nt, Homo sapiens
gcucccucuauuuauguuugc

SEQ ID NO: 1860172 - RNA, 18 nt, Homo sapiens
uugugagagccugugauc

SEQ ID NO: 1860173 - RNA, 14 nt, Homo sapiens
aggugccugccaua

SEQ ID NO: 1860174 - RNA, 15 nt, Homo sapiens
gaagauccaagcaaa

SEQ ID NO: 1860175 - RNA, 14 nt, Homo sapiens
cagcuccagggcca

SEQ ID NO: 1860176 - RNA, 21 nt, Homo sapiens
uaaagcguccucucaguaaug

SEQ ID NO: 1860177 - RNA, 21 nt, Homo sapiens
auaaugugaauaugccaguga

SEQ ID NO: 1860178 - RNA, 17 nt, Homo sapiens
gcacugacugggaccag

SEQ ID NO: 1860179 - RNA, 22 nt, Homo sapiens
aauauuugugaaagugccaaaa

SEQ ID NO: 1860180 - RNA, 14 nt, Homo sapiens
uccaucgugugugc

SEQ ID NO: 1860181 - RNA, 23 nt, Homo sapiens
uggccccucaaccuccuguggaa

SEQ ID NO: 1860182 - RNA, 17 nt, Homo sapiens
cucuaagccaacuuuaa

SEQ ID NO: 1860183 - RNA, 12 nt, Homo sapiens
uuuuuaaaccaa

SEQ ID NO: 1860184 - RNA, 23 nt, Homo sapiens
ucaugcccccaccccugcucucc

SEQ ID NO: 1860185 - RNA, 13 nt, Homo sapiens
ucccauccuugau

SEQ ID NO: 1860186 - RNA, 20 nt, Homo sapiens
ggacucucuguggucccuuc

SEQ ID NO: 1860187 - RNA, 23 nt, Homo sapiens
uuauucaauaacuauugcugcuu

SEQ ID NO: 1860188 - RNA, 12 nt, Homo sapiens
uuuguauuuccc

SEQ ID NO: 1860189 - RNA, 21 nt, Homo sapiens
ccgcgcucugccccuccgucc

SEQ ID NO: 1860190 - RNA, 13 nt, Homo sapiens
cucaggugaucca

SEQ ID NO: 1860191 - RNA, 13 nt, Homo sapiens
uaguuacuugagu

SEQ ID NO: 1860192 - RNA, 20 nt, Homo sapiens
uacucaggaggcugaggcag

SEQ ID NO: 1860193 - RNA, 22 nt, Homo sapiens
acccucugcuucccucucucuu

SEQ ID NO: 1860194 - RNA, 20 nt, Homo sapiens
ggaguggcucgccaggccaa

SEQ ID NO: 1860195 - RNA, 18 nt, Homo sapiens
cucaagugucaccuccuu

SEQ ID NO: 1860196 - RNA, 15 nt, Homo sapiens
gcaacagcacuggcu

SEQ ID NO: 1860197 - RNA, 13 nt, Homo sapiens
agaucagcaaagg

SEQ ID NO: 1860198 - RNA, 21 nt, Homo sapiens
agcugcugcuggaucacagcu

SEQ ID NO: 1860199 - RNA, 18 nt, Homo sapiens
uuucugccuucuccugca

SEQ ID NO: 1860200 - RNA, 16 nt, Homo sapiens
cucccuggccaucuca

SEQ ID NO: 1860201 - RNA, 17 nt, Homo sapiens
auggaacacagaacuga

SEQ ID NO: 1860202 - RNA, 13 nt, Homo sapiens
uggcuuuccucuc

SEQ ID NO: 1860203 - RNA, 17 nt, Homo sapiens
aggugaucuaccugccu

SEQ ID NO: 1860204 - RNA, 18 nt, Homo sapiens
guaacuuucauaccacuu

SEQ ID NO: 1860205 - RNA, 20 nt, Homo sapiens
augaauagagaguauguaau

SEQ ID NO: 1860206 - RNA, 17 nt, Homo sapiens
uccugguauuauuuaca

SEQ ID NO: 1860207 - RNA, 14 nt, Homo sapiens
gcacccucuccaga

SEQ ID NO: 1860208 - RNA, 13 nt, Homo sapiens
uguuauuguggaa

SEQ ID NO: 1860209 - RNA, 13 nt, Homo sapiens
agagacaaauagu

SEQ ID NO: 1860210 - RNA, 21 nt, Homo sapiens
acauacaaaaaaaaucuuuaa

SEQ ID NO: 1860211 - RNA, 19 nt, Homo sapiens
auaaauagaaagaguucua

SEQ ID NO: 1860212 - RNA, 16 nt, Homo sapiens
auuuaauauuuugcac

SEQ ID NO: 1860213 - RNA, 17 nt, Homo sapiens
gaaaaaaaagugucuca

SEQ ID NO: 1860214 - RNA, 16 nt, Homo sapiens
agacccacaaacugcc

SEQ ID NO: 1860215 - RNA, 22 nt, Homo sapiens
gccaaagccccaugugccuugu

SEQ ID NO: 1860216 - RNA, 14 nt, Homo sapiens
ucuuugacacucaa

SEQ ID NO: 1860217 - RNA, 16 nt, Homo sapiens
uaguacagguuacuca

SEQ ID NO: 1860218 - RNA, 11 nt, Homo sapiens
aaccucacaaa

SEQ ID NO: 1860219 - RNA, 15 nt, Homo sapiens
uugaaucugagugaa

SEQ ID NO: 1860220 - RNA, 17 nt, Homo sapiens
auugcaauacauuucaa

SEQ ID NO: 1860221 - RNA, 21 nt, Homo sapiens
aauaauauugccuugauguuu

SEQ ID NO: 1860222 - RNA, 17 nt, Homo sapiens
gcuccuacuuucaggaa

SEQ ID NO: 1860223 - RNA, 23 nt, Homo sapiens
ugcaaccgggcccucucucugcg

SEQ ID NO: 1860224 - RNA, 16 nt, Homo sapiens
guucguggagucucau

SEQ ID NO: 1860225 - RNA, 12 nt, Homo sapiens
uggcuuacuuac

SEQ ID NO: 1860226 - RNA, 13 nt, Homo sapiens
ccuggaccagccg

SEQ ID NO: 1860227 - RNA, 19 nt, Homo sapiens
ugucagggcaguacaaugu

SEQ ID NO: 1860228 - RNA, 12 nt, Homo sapiens
cuggcugccagg

SEQ ID NO: 1860229 - RNA, 12 nt, Homo sapiens
caaacugccuaa

SEQ ID NO: 1860230 - RNA, 12 nt, Homo sapiens
cucccugccacc

SEQ ID NO: 1860231 - RNA, 13 nt, Homo sapiens
ugaucccaaagau

SEQ ID NO: 1860232 - RNA, 20 nt, Homo sapiens
uuaaaacugaguccaugaaa

SEQ ID NO: 1860233 - RNA, 18 nt, Homo sapiens
uaaauuagacuuccugua

SEQ ID NO: 1860234 - RNA, 23 nt, Homo sapiens
aaagauauuucagagagcuucuu

SEQ ID NO: 1860235 - RNA, 12 nt, Homo sapiens
aagcaacaauac

SEQ ID NO: 1860236 - RNA, 12 nt, Homo sapiens
aagaaacaauaa

SEQ ID NO: 1860237 - RNA, 16 nt, Homo sapiens
acuccaggacagugga

SEQ ID NO: 1860238 - RNA, 12 nt, Homo sapiens
ugccuaccuggg

SEQ ID NO: 1860239 - RNA, 18 nt, Homo sapiens
auuuccuuagugccagga

SEQ ID NO: 1860240 - RNA, 13 nt, Homo sapiens
gugucugcagcuc

SEQ ID NO: 1860241 - RNA, 16 nt, Homo sapiens
cucccuaccuugccuc

SEQ ID NO: 1860242 - RNA, 16 nt, Homo sapiens
aaugacuuaaccauau

SEQ ID NO: 1860243 - RNA, 12 nt, Homo sapiens
cccaucaucucu

SEQ ID NO: 1860244 - RNA, 23 nt, Homo sapiens
uacugaaacuauuuacaaugugu

SEQ ID NO: 1860245 - RNA, 20 nt, Homo sapiens
caauccagaggaacaagcau

SEQ ID NO: 1860246 - RNA, 16 nt, Homo sapiens
uucuaauccaugugcu

SEQ ID NO: 1860247 - RNA, 13 nt, Homo sapiens
ggaauccgugugu

SEQ ID NO: 1860248 - RNA, 11 nt, Homo sapiens
aaaaugcugcu

SEQ ID NO: 1860249 - RNA, 17 nt, Homo sapiens
gcagccacuuucugcca

SEQ ID NO: 1860250 - RNA, 11 nt, Homo sapiens
acaaugcugau

SEQ ID NO: 1860251 - RNA, 13 nt, Homo sapiens
acacuugugccag

SEQ ID NO: 1860252 - RNA, 15 nt, Homo sapiens
uguacacacacagau

SEQ ID NO: 1860253 - RNA, 14 nt, Homo sapiens
acuuccuaaugauu

SEQ ID NO: 1860254 - RNA, 18 nt, Homo sapiens
uauuaauacauucaccca

SEQ ID NO: 1860255 - RNA, 14 nt, Homo sapiens
uucagacaccuguu

SEQ ID NO: 1860256 - RNA, 16 nt, Homo sapiens
auccuuuauuucugau

SEQ ID NO: 1860257 - RNA, 22 nt, Homo sapiens
acuccaucugacaaauucaaaa

SEQ ID NO: 1860258 - RNA, 15 nt, Homo sapiens
cacuauggugccaau

SEQ ID NO: 1860259 - RNA, 13 nt, Homo sapiens
ggaaaacacugcc

SEQ ID NO: 1860260 - RNA, 17 nt, Homo sapiens
gacacuguuggggaccu

SEQ ID NO: 1860261 - RNA, 16 nt, Homo sapiens
uccagaugugugcaau

SEQ ID NO: 1860262 - RNA, 21 nt, Homo sapiens
acaggaugaaaguucccccau

SEQ ID NO: 1860263 - RNA, 20 nt, Homo sapiens
gauauuuauuuaugcuaaua

SEQ ID NO: 1860264 - RNA, 13 nt, Homo sapiens
aaacuccgucuca

SEQ ID NO: 1860265 - RNA, 17 nt, Homo sapiens
cacuuauccuguucucu

SEQ ID NO: 1860266 - RNA, 21 nt, Homo sapiens
ccuuauuucucaucacaucau

SEQ ID NO: 1860267 - RNA, 17 nt, Homo sapiens
uguagaggguagcugug

SEQ ID NO: 1860268 - RNA, 20 nt, Homo sapiens
gacaccgucgaccaggaaag

SEQ ID NO: 1860269 - RNA, 15 nt, Homo sapiens
cgacuacugcuccug

SEQ ID NO: 1860270 - RNA, 22 nt, Homo sapiens
cuuaaagcccgccugacagaaa

SEQ ID NO: 1860271 - RNA, 15 nt, Homo sapiens
aucaaauacauacaa

SEQ ID NO: 1860272 - RNA, 19 nt, Homo sapiens
uccgugccuccaccaccac

SEQ ID NO: 1860273 - RNA, 19 nt, Homo sapiens
agccucuucugucccaagu

SEQ ID NO: 1860274 - RNA, 15 nt, Homo sapiens
uacauuuacugaaau

SEQ ID NO: 1860275 - RNA, 18 nt, Homo sapiens
ugaaauucuucaacuugg

SEQ ID NO: 1860276 - RNA, 20 nt, Homo sapiens
aguggagaugggguuucacc

SEQ ID NO: 1860277 - RNA, 14 nt, Homo sapiens
ugaaaagguggugu

SEQ ID NO: 1860278 - RNA, 19 nt, Homo sapiens
caguuuccucaucugucac

SEQ ID NO: 1860279 - RNA, 15 nt, Homo sapiens
uugaguaccuacugu

SEQ ID NO: 1860280 - RNA, 19 nt, Homo sapiens
aauggcagcuagugccuuu

SEQ ID NO: 1860281 - RNA, 20 nt, Homo sapiens
augacaaugugaaaccauca

SEQ ID NO: 1860282 - RNA, 20 nt, Homo sapiens
accgggcugcaggugcugcu

SEQ ID NO: 1860283 - RNA, 19 nt, Homo sapiens
ucugauuucacauauugca

SEQ ID NO: 1860284 - RNA, 21 nt, Homo sapiens
uagcaacuccccuacaucaaa

SEQ ID NO: 1860285 - RNA, 18 nt, Homo sapiens
accccccagcacugagga

SEQ ID NO: 1860286 - RNA, 15 nt, Homo sapiens
auuuugcagaugaag

SEQ ID NO: 1860287 - RNA, 22 nt, Homo sapiens
gagcugagguuuagaugugcaa

SEQ ID NO: 1860288 - RNA, 11 nt, Homo sapiens
aaauugcugac

SEQ ID NO: 1860289 - RNA, 20 nt, Homo sapiens
cuccugagcucaagugaucc

SEQ ID NO: 1860290 - RNA, 16 nt, Homo sapiens
cugcugucccugucag

SEQ ID NO: 1860291 - RNA, 11 nt, Homo sapiens
aagacagagca

SEQ ID NO: 1860292 - RNA, 15 nt, Homo sapiens
aaccaagcacuacca

SEQ ID NO: 1860293 - RNA, 16 nt, Homo sapiens
ugggaguagcauggac

SEQ ID NO: 1860294 - RNA, 15 nt, Homo sapiens
ucagauccugaucuu

SEQ ID NO: 1860295 - RNA, 17 nt, Homo sapiens
ccaugauccaaucaccu

SEQ ID NO: 1860296 - RNA, 14 nt, Homo sapiens
aacccaucacugug

SEQ ID NO: 1860297 - RNA, 21 nt, Homo sapiens
gccuuuuuuccugggccagaa

SEQ ID NO: 1860298 - RNA, 19 nt, Homo sapiens
guacacugacaccuuugca

SEQ ID NO: 1860299 - RNA, 18 nt, Homo sapiens
augucaacagagcaagga

SEQ ID NO: 1860300 - RNA, 19 nt, Homo sapiens
auguugacauaccuuuuau

SEQ ID NO: 1860301 - RNA, 13 nt, Homo sapiens
gugacacauaugc

SEQ ID NO: 1860302 - RNA, 16 nt, Homo sapiens
gugcaguagccguuug

SEQ ID NO: 1860303 - RNA, 23 nt, Homo sapiens
ucuuccuaacagggcacauauuc

SEQ ID NO: 1860304 - RNA, 12 nt, Homo sapiens
cauauuaucuca

SEQ ID NO: 1860305 - RNA, 13 nt, Homo sapiens
aguaaaacacaga

SEQ ID NO: 1860306 - RNA, 14 nt, Homo sapiens
gcagguugcuuugc

SEQ ID NO: 1860307 - RNA, 23 nt, Homo sapiens
uccuuccugcuugaguucccaga

SEQ ID NO: 1860308 - RNA, 14 nt, Homo sapiens
uugauuaaaacauu

SEQ ID NO: 1860309 - RNA, 20 nt, Homo sapiens
gccuguuugccgucugugac

SEQ ID NO: 1860310 - RNA, 21 nt, Homo sapiens
cugaagaaaccuucagauuug

SEQ ID NO: 1860311 - RNA, 22 nt, Homo sapiens
cuugggucucauuuagaacuug

SEQ ID NO: 1860312 - RNA, 14 nt, Homo sapiens
ugucaaaugcagua

SEQ ID NO: 1860313 - RNA, 21 nt, Homo sapiens
ugcagaacagugagccaaaua

SEQ ID NO: 1860314 - RNA, 19 nt, Homo sapiens
ucccuaccaaaaauugcca

SEQ ID NO: 1860315 - RNA, 20 nt, Homo sapiens
cucaggggagcaagcuuaca

SEQ ID NO: 1860316 - RNA, 23 nt, Homo sapiens
cauuccuguagucaaaaucuggu

SEQ ID NO: 1860317 - RNA, 19 nt, Homo sapiens
gauacaugcauugcucuua

SEQ ID NO: 1860318 - RNA, 17 nt, Homo sapiens
cuuugccacacuguggu

SEQ ID NO: 1860319 - RNA, 18 nt, Homo sapiens
agaaaacucccaauacaa

SEQ ID NO: 1860320 - RNA, 17 nt, Homo sapiens
ugugauuuuuaucacaa

SEQ ID NO: 1860321 - RNA, 12 nt, Homo sapiens
auccacuucuug

SEQ ID NO: 1860322 - RNA, 17 nt, Homo sapiens
ucuacuuccccauuuca

SEQ ID NO: 1860323 - RNA, 16 nt, Homo sapiens
gaauccccaacaugca

SEQ ID NO: 1860324 - RNA, 23 nt, Homo sapiens
aaaucugaauaaauaauucuuuc

SEQ ID NO: 1860325 - RNA, 16 nt, Homo sapiens
acauuacaauccugca

SEQ ID NO: 1860326 - RNA, 14 nt, Homo sapiens
ccuuuuaugugguc

SEQ ID NO: 1860327 - RNA, 21 nt, Homo sapiens
uauuaaaaauaaacaagcauu

SEQ ID NO: 1860328 - RNA, 20 nt, Homo sapiens
cacuaagcuccuccuuuacu

SEQ ID NO: 1860329 - RNA, 22 nt, Homo sapiens
caauguauacuucagugcucac

SEQ ID NO: 1860330 - RNA, 18 nt, Homo sapiens
gucaaaaauuaaaccgga

SEQ ID NO: 1860331 - RNA, 13 nt, Homo sapiens
aaugaaccauggc

SEQ ID NO: 1860332 - RNA, 20 nt, Homo sapiens
agcauucuugucacaauaaa

SEQ ID NO: 1860333 - RNA, 14 nt, Homo sapiens
cugugcugggggaa

SEQ ID NO: 1860334 - RNA, 13 nt, Homo sapiens
ugaaucccuuuag

SEQ ID NO: 1860335 - RNA, 14 nt, Homo sapiens
auuacuucugcuac

SEQ ID NO: 1860336 - RNA, 17 nt, Homo sapiens
cucagugggacucugau

SEQ ID NO: 1860337 - RNA, 21 nt, Homo sapiens
auguaaaaagaucuacauaca

SEQ ID NO: 1860338 - RNA, 22 nt, Homo sapiens
acaucaauuucuaaauacuuuu

SEQ ID NO: 1860339 - RNA, 14 nt, Homo sapiens
ugcaccuucugacg

SEQ ID NO: 1860340 - RNA, 16 nt, Homo sapiens
ucugccuucugcugaa

SEQ ID NO: 1860341 - RNA, 19 nt, Homo sapiens
aucucauaccucugaccaa

SEQ ID NO: 1860342 - RNA, 20 nt, Homo sapiens
ggauccuauugaaccauguu

SEQ ID NO: 1860343 - RNA, 18 nt, Homo sapiens
cagaacucaaaugagccc

SEQ ID NO: 1860344 - RNA, 14 nt, Homo sapiens
gcucagccuugcac

SEQ ID NO: 1860345 - RNA, 16 nt, Homo sapiens
aggagccucacugggg

SEQ ID NO: 1860346 - RNA, 19 nt, Homo sapiens
uggccacauccaacauuuc

SEQ ID NO: 1860347 - RNA, 14 nt, Homo sapiens
agcuguugcagaug

SEQ ID NO: 1860348 - RNA, 21 nt, Homo sapiens
uuaagaagcucagcuaugaaa

SEQ ID NO: 1860349 - RNA, 11 nt, Homo sapiens
acauacucaau

SEQ ID NO: 1860350 - RNA, 20 nt, Homo sapiens
uaaaauauacccaucaguau

SEQ ID NO: 1860351 - RNA, 22 nt, Homo sapiens
guuggaaaugugcaaccacugc

SEQ ID NO: 1860352 - RNA, 15 nt, Homo sapiens
aucuauaaacagaca

SEQ ID NO: 1860353 - RNA, 18 nt, Homo sapiens
uuaguuuuuaaucucucc

SEQ ID NO: 1860354 - RNA, 15 nt, Homo sapiens
gaaucacuugcacuc

SEQ ID NO: 1860355 - RNA, 21 nt, Homo sapiens
cucuagguacgaugacagugu

SEQ ID NO: 1860356 - RNA, 18 nt, Homo sapiens
auaaaugaagaaagggag

SEQ ID NO: 1860357 - RNA, 15 nt, Homo sapiens
aucauaguauaugau

SEQ ID NO: 1860358 - RNA, 16 nt, Homo sapiens
uaaaugauaguuuuca

SEQ ID NO: 1860359 - RNA, 19 nt, Homo sapiens
agcaccuccuccaugcagg

SEQ ID NO: 1860360 - RNA, 16 nt, Homo sapiens
gccauguccaaagagg

SEQ ID NO: 1860361 - RNA, 18 nt, Homo sapiens
acccaugaaacagcagcu

SEQ ID NO: 1860362 - RNA, 19 nt, Homo sapiens
agaccagucuggccaauau

SEQ ID NO: 1860363 - RNA, 23 nt, Homo sapiens
ccaagcagccuggagacuuccua

SEQ ID NO: 1860364 - RNA, 17 nt, Homo sapiens
aucauguaaaugcucaa

SEQ ID NO: 1860365 - RNA, 21 nt, Homo sapiens
caguccugggauguggcugca

SEQ ID NO: 1860366 - RNA, 20 nt, Homo sapiens
cagcaggacuguccccuuga

SEQ ID NO: 1860367 - RNA, 16 nt, Homo sapiens
gagaaagcagccauug

SEQ ID NO: 1860368 - RNA, 16 nt, Homo sapiens
uuccacagcugcucaa

SEQ ID NO: 1860369 - RNA, 17 nt, Homo sapiens
ugccacugcacuccagg

SEQ ID NO: 1860370 - RNA, 20 nt, Homo sapiens
aguaggucugcacacauaac

SEQ ID NO: 1860371 - RNA, 20 nt, Homo sapiens
caaacuguacaguuucuucc

SEQ ID NO: 1860372 - RNA, 19 nt, Homo sapiens
ggcagcuccagugccagca

SEQ ID NO: 1860373 - RNA, 21 nt, Homo sapiens
cauguuucauugccugaauaa

SEQ ID NO: 1860374 - RNA, 19 nt, Homo sapiens
ccaaggcuggagugcagug

SEQ ID NO: 1860375 - RNA, 19 nt, Homo sapiens
cccaggcuggcgugcagug

SEQ ID NO: 1860376 - RNA, 22 nt, Homo sapiens
cagccuuggaggaucguggcca

SEQ ID NO: 1860377 - RNA, 12 nt, Homo sapiens
uaaaacuaucca

SEQ ID NO: 1860378 - RNA, 22 nt, Homo sapiens
aggcugcccaaucugagcaaac

SEQ ID NO: 1860379 - RNA, 15 nt, Homo sapiens
cauguaucuaugcau

SEQ ID NO: 1860380 - RNA, 13 nt, Homo sapiens
gacucaguauuau

SEQ ID NO: 1860381 - RNA, 23 nt, Homo sapiens
cuccccucuccugcgugugccca

SEQ ID NO: 1860382 - RNA, 23 nt, Homo sapiens
uuauagaaugaacuugcauaauu

SEQ ID NO: 1860383 - RNA, 21 nt, Homo sapiens
cucucuuucuuccacuacccu

SEQ ID NO: 1860384 - RNA, 13 nt, Homo sapiens
cagggcuugucac

SEQ ID NO: 1860385 - RNA, 21 nt, Homo sapiens
cccuaaaaauccagacucuuu

SEQ ID NO: 1860386 - RNA, 14 nt, Homo sapiens
ugcccccaacagca

SEQ ID NO: 1860387 - RNA, 20 nt, Homo sapiens
cuaaaaucccuggaucacga

SEQ ID NO: 1860388 - RNA, 15 nt, Homo sapiens
ggcucuaucuuccuc

SEQ ID NO: 1860389 - RNA, 11 nt, Homo sapiens
ucauagcucau

SEQ ID NO: 1860390 - RNA, 11 nt, Homo sapiens
caucuuagucu

SEQ ID NO: 1860391 - RNA, 23 nt, Homo sapiens
aggaccccucgccuucaggagaa

SEQ ID NO: 1860392 - RNA, 19 nt, Homo sapiens
ccacauugcuucauuaaaa

SEQ ID NO: 1860393 - RNA, 17 nt, Homo sapiens
uguaauaauucuaugca

SEQ ID NO: 1860394 - RNA, 15 nt, Homo sapiens
cuuagcuuuccacag

SEQ ID NO: 1860395 - RNA, 14 nt, Homo sapiens
ccuggaucuccuca

SEQ ID NO: 1860396 - RNA, 23 nt, Homo sapiens
auucccuguuaaaauuuaaccua

SEQ ID NO: 1860397 - RNA, 16 nt, Homo sapiens
agguugggagccaaau

SEQ ID NO: 1860398 - RNA, 21 nt, Homo sapiens
gggcccucugugcucuucucu

SEQ ID NO: 1860399 - RNA, 21 nt, Homo sapiens
ugcaguuuccucaucugucac

SEQ ID NO: 1860400 - RNA, 19 nt, Homo sapiens
caugccuauuuacuggaaa

SEQ ID NO: 1860401 - RNA, 18 nt, Homo sapiens
cauuuuccuguucaguga

SEQ ID NO: 1860402 - RNA, 20 nt, Homo sapiens
cuuguuauugccucuacuuu

SEQ ID NO: 1860403 - RNA, 18 nt, Homo sapiens
aacaacaacuuaaugugc

SEQ ID NO: 1860404 - RNA, 14 nt, Homo sapiens
accuguggugaccc

SEQ ID NO: 1860405 - RNA, 16 nt, Homo sapiens
aggagaggacugggcc

SEQ ID NO: 1860406 - RNA, 18 nt, Homo sapiens
aacaccagggacacauuu

SEQ ID NO: 1860407 - RNA, 19 nt, Homo sapiens
aggaauccucugugucuuc

SEQ ID NO: 1860408 - RNA, 19 nt, Homo sapiens
augucguuugaaucacagu

SEQ ID NO: 1860409 - RNA, 22 nt, Homo sapiens
ccagcaccuauugaauuaccau

SEQ ID NO: 1860410 - RNA, 18 nt, Homo sapiens
gaucuguguuaaucugag

SEQ ID NO: 1860411 - RNA, 17 nt, Homo sapiens
cguugggagccuagcuc

SEQ ID NO: 1860412 - RNA, 14 nt, Homo sapiens
aauuuuuccaugaa

SEQ ID NO: 1860413 - RNA, 18 nt, Homo sapiens
acccaggaccaagccaca

SEQ ID NO: 1860414 - RNA, 23 nt, Homo sapiens
ugcacuuuugaaauaaaguauuu

SEQ ID NO: 1860415 - RNA, 14 nt, Homo sapiens
auggacaccaucca

SEQ ID NO: 1860416 - RNA, 21 nt, Homo sapiens
uagucuccacuuucucaaugc

SEQ ID NO: 1860417 - RNA, 17 nt, Homo sapiens
ugccccagccccggcca

SEQ ID NO: 1860418 - RNA, 16 nt, Homo sapiens
aaauucaaauuauucu

SEQ ID NO: 1860419 - RNA, 14 nt, Homo sapiens
gaaaaauccuguca

SEQ ID NO: 1860420 - RNA, 15 nt, Homo sapiens
gaauuauaaaggcca

SEQ ID NO: 1860421 - RNA, 18 nt, Homo sapiens
aagaaauauauacuugag

SEQ ID NO: 1860422 - RNA, 17 nt, Homo sapiens
auuauacacaaagaaua

SEQ ID NO: 1860423 - RNA, 20 nt, Homo sapiens
agacagagauggcagagcca

SEQ ID NO: 1860424 - RNA, 22 nt, Homo sapiens
ugaagaaggucucauuaucucc

SEQ ID NO: 1860425 - RNA, 16 nt, Homo sapiens
gugucacaaagcuaaa

SEQ ID NO: 1860426 - RNA, 15 nt, Homo sapiens
acugcacuccaggcu

SEQ ID NO: 1860427 - RNA, 12 nt, Homo sapiens
agccccgucucu

SEQ ID NO: 1860428 - RNA, 13 nt, Homo sapiens
agcaacaacaaca

SEQ ID NO: 1860429 - RNA, 21 nt, Homo sapiens
auaaccauaaaucaauucauu

SEQ ID NO: 1860430 - RNA, 21 nt, Homo sapiens
ggugcaggggugaggggucca

SEQ ID NO: 1860431 - RNA, 17 nt, Homo sapiens
ccagugccuucugggaa

SEQ ID NO: 1860432 - RNA, 16 nt, Homo sapiens
acuucaauaaagcuau

SEQ ID NO: 1860433 - RNA, 18 nt, Homo sapiens
ggaaucucaugauuccau

SEQ ID NO: 1860434 - RNA, 14 nt, Homo sapiens
cugggccucccaaa

SEQ ID NO: 1860435 - RNA, 13 nt, Homo sapiens
ugucaaagugaua

SEQ ID NO: 1860436 - RNA, 14 nt, Homo sapiens
agauagauuuggaa

SEQ ID NO: 1860437 - RNA, 22 nt, Homo sapiens
augcuguucucaaucauuguca

SEQ ID NO: 1860438 - RNA, 19 nt, Homo sapiens
uggagaaauaaaaauaccu

SEQ ID NO: 1860439 - RNA, 14 nt, Homo sapiens
uguggcccaagaca

SEQ ID NO: 1860440 - RNA, 13 nt, Homo sapiens
cgcacacauggac

SEQ ID NO: 1860441 - RNA, 14 nt, Homo sapiens
ucagccaaacugua

SEQ ID NO: 1860442 - RNA, 21 nt, Homo sapiens
gcuauuuaauaucuggcacug

SEQ ID NO: 1860443 - RNA, 21 nt, Homo sapiens
uaugcaaaucaaacauauucu

SEQ ID NO: 1860444 - RNA, 22 nt, Homo sapiens
acacccagugcgugaagaccaa

SEQ ID NO: 1860445 - RNA, 17 nt, Homo sapiens
cuaccugguguaugaaa

SEQ ID NO: 1860446 - RNA, 23 nt, Homo sapiens
uaccuuagugcaguuauuugcuu

SEQ ID NO: 1860447 - RNA, 15 nt, Homo sapiens
auguauauugucuag

SEQ ID NO: 1860448 - RNA, 17 nt, Homo sapiens
gagcagaaagcugugaa

SEQ ID NO: 1860449 - RNA, 15 nt, Homo sapiens
gugggcagcagcuca

SEQ ID NO: 1860450 - RNA, 16 nt, Homo sapiens
cuauauuucagugaca

SEQ ID NO: 1860451 - RNA, 13 nt, Homo sapiens
caaauacacuuua

SEQ ID NO: 1860452 - RNA, 18 nt, Homo sapiens
cagucuugucuuugauau

SEQ ID NO: 1860453 - RNA, 23 nt, Homo sapiens
ugugcauuaucuagauacuguau

SEQ ID NO: 1860454 - RNA, 13 nt, Homo sapiens
accaaauuuguau

SEQ ID NO: 1860455 - RNA, 13 nt, Homo sapiens
augaacuuugucc

SEQ ID NO: 1860456 - RNA, 21 nt, Homo sapiens
ucugguaguuguggcuuuuau

SEQ ID NO: 1860457 - RNA, 16 nt, Homo sapiens
ucacugugaccugcuc

SEQ ID NO: 1860458 - RNA, 17 nt, Homo sapiens
ucccugucuauugccuu

SEQ ID NO: 1860459 - RNA, 15 nt, Homo sapiens
augguuaaauaucac

SEQ ID NO: 1860460 - RNA, 18 nt, Homo sapiens
aaucucagccagccucca

SEQ ID NO: 1860461 - RNA, 21 nt, Homo sapiens
auuuucuuuaaagaaugcugg

SEQ ID NO: 1860462 - RNA, 19 nt, Homo sapiens
cuugccaguugggggaaaa

SEQ ID NO: 1860463 - RNA, 16 nt, Homo sapiens
cccgcaggguccaaag

SEQ ID NO: 1860464 - RNA, 14 nt, Homo sapiens
uccaguuaaccaag

SEQ ID NO: 1860465 - RNA, 14 nt, Homo sapiens
accguucugugcac

SEQ ID NO: 1860466 - RNA, 15 nt, Homo sapiens
aggaacaagagaaaa

SEQ ID NO: 1860467 - RNA, 16 nt, Homo sapiens
agagaugucaucagag

SEQ ID NO: 1860468 - RNA, 16 nt, Homo sapiens
uucaggacuggcucac

SEQ ID NO: 1860469 - RNA, 14 nt, Homo sapiens
cucaguacagggca

SEQ ID NO: 1860470 - RNA, 13 nt, Homo sapiens
agaggcuagucuc

SEQ ID NO: 1860471 - RNA, 23 nt, Homo sapiens
ugcacacgcacauagagauaugc

SEQ ID NO: 1860472 - RNA, 19 nt, Homo sapiens
caaaagauucaaaucuccu

SEQ ID NO: 1860473 - RNA, 10 nt, Homo sapiens
gggggaaaug

SEQ ID NO: 1860474 - RNA, 20 nt, Homo sapiens
caccaagcgugauuccugcu

SEQ ID NO: 1860475 - RNA, 12 nt, Homo sapiens
aaaaugugagug

SEQ ID NO: 1860476 - RNA, 12 nt, Homo sapiens
ucaguccagaug

SEQ ID NO: 1860477 - RNA, 14 nt, Homo sapiens
guaaacgacacucu

SEQ ID NO: 1860478 - RNA, 12 nt, Homo sapiens
gaaauccaucua

SEQ ID NO: 1860479 - RNA, 19 nt, Homo sapiens
uguagagcuuagauuuccc

SEQ ID NO: 1860480 - RNA, 18 nt, Homo sapiens
cugaugcuguuaaccaaa

SEQ ID NO: 1860481 - RNA, 17 nt, Homo sapiens
ugguucaacauggaaau

SEQ ID NO: 1860482 - RNA, 21 nt, Homo sapiens
auauauauguauaauuucaca

SEQ ID NO: 1860483 - RNA, 21 nt, Homo sapiens
gaaucaacagaucaaugacau

SEQ ID NO: 1860484 - RNA, 16 nt, Homo sapiens
ugguguggguguccug

SEQ ID NO: 1860485 - RNA, 17 nt, Homo sapiens
gccugggccucuacccc

SEQ ID NO: 1860486 - RNA, 21 nt, Homo sapiens
uaccagcuaacuccagucucc

SEQ ID NO: 1860487 - RNA, 16 nt, Homo sapiens
ugauacugcagugacu

SEQ ID NO: 1860488 - RNA, 15 nt, Homo sapiens
gaaauggggaacuac

SEQ ID NO: 1860489 - RNA, 13 nt, Homo sapiens
auuaaaugcauca

SEQ ID NO: 1860490 - RNA, 24 nt, Homo sapiens
cuugaguuauuaaaaucauaggaa

SEQ ID NO: 1860491 - RNA, 16 nt, Homo sapiens
cacucaaugccaacuu

SEQ ID NO: 1860492 - RNA, 14 nt, Homo sapiens
auaggcaagaagca

SEQ ID NO: 1860493 - RNA, 21 nt, Homo sapiens
aacauuucagaagguaucagu

SEQ ID NO: 1860494 - RNA, 20 nt, Homo sapiens
aucuucaggacuauuucacu

SEQ ID NO: 1860495 - RNA, 20 nt, Homo sapiens
auuaucuaguaggucugcac

SEQ ID NO: 1860496 - RNA, 15 nt, Homo sapiens
uaacuugcaguauau

SEQ ID NO: 1860497 - RNA, 15 nt, Homo sapiens
uguccuaagcacuuu

SEQ ID NO: 1860498 - RNA, 14 nt, Homo sapiens
ccuccccaacuccc

SEQ ID NO: 1860499 - RNA, 14 nt, Homo sapiens
augagccacugagc

SEQ ID NO: 1860500 - RNA, 14 nt, Homo sapiens
cgagaucaagagau

SEQ ID NO: 1860501 - RNA, 17 nt, Homo sapiens
ccucaccugguaccugg

SEQ ID NO: 1860502 - RNA, 14 nt, Homo sapiens
gcauuuaggagaua

SEQ ID NO: 1860503 - RNA, 17 nt, Homo sapiens
aaggaagaucaggccaa

SEQ ID NO: 1860504 - RNA, 19 nt, Homo sapiens
ucucuucaauaaaccacaa

SEQ ID NO: 1860505 - RNA, 14 nt, Homo sapiens
ccucuucaaaauga

SEQ ID NO: 1860506 - RNA, 16 nt, Homo sapiens
ugccaagagccgacaa

SEQ ID NO: 1860507 - RNA, 22 nt, Homo sapiens
ccaagcaggcugguuugcaaga

SEQ ID NO: 1860508 - RNA, 23 nt, Homo sapiens
aaaaauagauuugaaacauuuau

SEQ ID NO: 1860509 - RNA, 19 nt, Homo sapiens
agcugcccuccuuguccac

SEQ ID NO: 1860510 - RNA, 18 nt, Homo sapiens
ccuguuuucgcaccuacc

SEQ ID NO: 1860511 - RNA, 20 nt, Homo sapiens
aaggaaaaaaaacacaaaac

SEQ ID NO: 1860512 - RNA, 15 nt, Homo sapiens
cuguccucucagaac

SEQ ID NO: 1860513 - RNA, 14 nt, Homo sapiens
caccuacacaggag

SEQ ID NO: 1860514 - RNA, 13 nt, Homo sapiens
cggagcuuugcaa

SEQ ID NO: 1860515 - RNA, 23 nt, Homo sapiens
uucaccuccagguucaagugauu

SEQ ID NO: 1860516 - RNA, 20 nt, Homo sapiens
aggaagaucccuuuguccac

SEQ ID NO: 1860517 - RNA, 11 nt, Homo sapiens
aaccacagggc

SEQ ID NO: 1860518 - RNA, 22 nt, Homo sapiens
gccauauucuguuggccagugu

SEQ ID NO: 1860519 - RNA, 13 nt, Homo sapiens
uuuaaaaacacaa

SEQ ID NO: 1860520 - RNA, 20 nt, Homo sapiens
ucugucuuuaagaacuaauu

SEQ ID NO: 1860521 - RNA, 17 nt, Homo sapiens
cucuucauuuucccauu

SEQ ID NO: 1860522 - RNA, 21 nt, Homo sapiens
cuucaucugugggaugcugaa

SEQ ID NO: 1860523 - RNA, 18 nt, Homo sapiens
ccgagucugucucuguca

SEQ ID NO: 1860524 - RNA, 20 nt, Homo sapiens
cuuauaaacagaagugacug

SEQ ID NO: 1860525 - RNA, 19 nt, Homo sapiens
gcaaugggcagcuauccag

SEQ ID NO: 1860526 - RNA, 14 nt, Homo sapiens
ucccgcaugcugcc

SEQ ID NO: 1860527 - RNA, 15 nt, Homo sapiens
ccacucccuuugcca

SEQ ID NO: 1860528 - RNA, 15 nt, Homo sapiens
cuagccccucucuca

SEQ ID NO: 1860529 - RNA, 15 nt, Homo sapiens
acucuuuugggcaac

SEQ ID NO: 1860530 - RNA, 21 nt, Homo sapiens
ccaacuccauacuccacucca

SEQ ID NO: 1860531 - RNA, 23 nt, Homo sapiens
caggaucacaagaaucaccucaa

SEQ ID NO: 1860532 - RNA, 18 nt, Homo sapiens
caggaagcccaaggcagu

SEQ ID NO: 1860533 - RNA, 15 nt, Homo sapiens
ucuugugccucuaau

SEQ ID NO: 1860534 - RNA, 20 nt, Homo sapiens
uggaaauuugggagagccau

SEQ ID NO: 1860535 - RNA, 23 nt, Homo sapiens
acugucaagaagaggaaagggag

SEQ ID NO: 1860536 - RNA, 17 nt, Homo sapiens
acuuuuuuacacugaua

SEQ ID NO: 1860537 - RNA, 20 nt, Homo sapiens
ucccugucaggacacaugga

SEQ ID NO: 1860538 - RNA, 19 nt, Homo sapiens
aaaauuuaccacagacuau

SEQ ID NO: 1860539 - RNA, 14 nt, Homo sapiens
guaauggugaaaac

SEQ ID NO: 1860540 - RNA, 21 nt, Homo sapiens
gcuccgccuggcacccacucc

SEQ ID NO: 1860541 - RNA, 23 nt, Homo sapiens
ccagaaaauaugauauauaugua

SEQ ID NO: 1860542 - RNA, 23 nt, Homo sapiens
uuugcacaaaaagauaccuuaaa

SEQ ID NO: 1860543 - RNA, 13 nt, Homo sapiens
guauugauaucac

SEQ ID NO: 1860544 - RNA, 12 nt, Homo sapiens
aucucaauuuaa

SEQ ID NO: 1860545 - RNA, 22 nt, Homo sapiens
uggcgaccgggcaagcuuucuu

SEQ ID NO: 1860546 - RNA, 21 nt, Homo sapiens
uugugggacacaacacagaua

SEQ ID NO: 1860547 - RNA, 18 nt, Homo sapiens
aucccuaacuaaagggga

SEQ ID NO: 1860548 - RNA, 16 nt, Homo sapiens
cuuccuccccauguga

SEQ ID NO: 1860549 - RNA, 13 nt, Homo sapiens
gaggguccaccug

SEQ ID NO: 1860550 - RNA, 18 nt, Homo sapiens
agucuacuucacuaauga

SEQ ID NO: 1860551 - RNA, 22 nt, Homo sapiens
accucaggguauugcuugccac

SEQ ID NO: 1860552 - RNA, 15 nt, Homo sapiens
ggucagagcccagga

SEQ ID NO: 1860553 - RNA, 14 nt, Homo sapiens
aagaaugcauucaa

SEQ ID NO: 1860554 - RNA, 19 nt, Homo sapiens
cuuuuaaaaggagcacauu

SEQ ID NO: 1860555 - RNA, 18 nt, Homo sapiens
accgagagagauggaaua

SEQ ID NO: 1860556 - RNA, 16 nt, Homo sapiens
ucaggcagugcaguac

SEQ ID NO: 1860557 - RNA, 19 nt, Homo sapiens
agaaauaaagcaucucauu

SEQ ID NO: 1860558 - RNA, 18 nt, Homo sapiens
auucuuuauacauucuag

SEQ ID NO: 1860559 - RNA, 17 nt, Homo sapiens
cagaagaaaauucuccu

SEQ ID NO: 1860560 - RNA, 21 nt, Homo sapiens
uuggaagaaagaauuucaaaa

SEQ ID NO: 1860561 - RNA, 17 nt, Homo sapiens
cugaagaacuuggcaca

SEQ ID NO: 1860562 - RNA, 18 nt, Homo sapiens
cucagcagccagcuccug

SEQ ID NO: 1860563 - RNA, 17 nt, Homo sapiens
auucagugauuacuguc

SEQ ID NO: 1860564 - RNA, 11 nt, Homo sapiens
ucauaggcacu

SEQ ID NO: 1860565 - RNA, 21 nt, Homo sapiens
cacauuugaaagaaaguguua

SEQ ID NO: 1860566 - RNA, 17 nt, Homo sapiens
ucacccagaaucccucu

SEQ ID NO: 1860567 - RNA, 23 nt, Homo sapiens
guccccuccacugucacauugua

SEQ ID NO: 1860568 - RNA, 16 nt, Homo sapiens
gcaaggaaacuaugua

SEQ ID NO: 1860569 - RNA, 16 nt, Homo sapiens
acucgcuagcacucaa

SEQ ID NO: 1860570 - RNA, 18 nt, Homo sapiens
ucucacucuguugcccag

SEQ ID NO: 1860571 - RNA, 13 nt, Homo sapiens
gcuugaccaaaga

SEQ ID NO: 1860572 - RNA, 20 nt, Homo sapiens
cacaaaauacagcacuuuga

SEQ ID NO: 1860573 - RNA, 13 nt, Homo sapiens
ccgucgugcaguc

SEQ ID NO: 1860574 - RNA, 21 nt, Homo sapiens
uuuuaaccaguucugucuuca

SEQ ID NO: 1860575 - RNA, 21 nt, Homo sapiens
uggagaucagaaagugacauu

SEQ ID NO: 1860576 - RNA, 15 nt, Homo sapiens
aucucccauguguag

SEQ ID NO: 1860577 - RNA, 16 nt, Homo sapiens
auuacaggcuccugcc

SEQ ID NO: 1860578 - RNA, 20 nt, Homo sapiens
ccagauuuaaaaaaagaaca

SEQ ID NO: 1860579 - RNA, 15 nt, Homo sapiens
auuaaaaaccugaug

SEQ ID NO: 1860580 - RNA, 19 nt, Homo sapiens
cacuucugagaacucaucc

SEQ ID NO: 1860581 - RNA, 19 nt, Homo sapiens
ccaagcccugaggccugag

SEQ ID NO: 1860582 - RNA, 15 nt, Homo sapiens
gaaagccucagccau

SEQ ID NO: 1860583 - RNA, 15 nt, Homo sapiens
ccagcgucaaggugg

SEQ ID NO: 1860584 - RNA, 18 nt, Homo sapiens
cuuugauuuuauaugcua

SEQ ID NO: 1860585 - RNA, 15 nt, Homo sapiens
ugcagcaaccagagc

SEQ ID NO: 1860586 - RNA, 14 nt, Homo sapiens
gcaauucauucucu

SEQ ID NO: 1860587 - RNA, 17 nt, Homo sapiens
acuguucuuugccagaa

SEQ ID NO: 1860588 - RNA, 21 nt, Homo sapiens
uguaauuuaaaaagugcuaua

SEQ ID NO: 1860589 - RNA, 12 nt, Homo sapiens
cuuugcuaaaau

SEQ ID NO: 1860590 - RNA, 16 nt, Homo sapiens
cagagggccucaucuc

SEQ ID NO: 1860591 - RNA, 23 nt, Homo sapiens
cuaaaaacacaaaaauuagccag

SEQ ID NO: 1860592 - RNA, 13 nt, Homo sapiens
cauaauuaaugua

SEQ ID NO: 1860593 - RNA, 19 nt, Homo sapiens
auacagucaagauacauag

SEQ ID NO: 1860594 - RNA, 20 nt, Homo sapiens
uaaaaggaagguauuggcug

SEQ ID NO: 1860595 - RNA, 19 nt, Homo sapiens
cucaguaacacagugcagu

SEQ ID NO: 1860596 - RNA, 13 nt, Homo sapiens
gcccgaaaagcau

SEQ ID NO: 1860597 - RNA, 18 nt, Homo sapiens
agauuuugucgggacaga

SEQ ID NO: 1860598 - RNA, 23 nt, Homo sapiens
agguacugaguggggaguguaca

SEQ ID NO: 1860599 - RNA, 23 nt, Homo sapiens
acaggauugaagcuuuagugaaa

SEQ ID NO: 1860600 - RNA, 16 nt, Homo sapiens
auguaaaggccuuuaa

SEQ ID NO: 1860601 - RNA, 17 nt, Homo sapiens
acgaauauuaugcccag

SEQ ID NO: 1860602 - RNA, 16 nt, Homo sapiens
agcaagucauucagcu

SEQ ID NO: 1860603 - RNA, 16 nt, Homo sapiens
gaaacacugugcaaag

SEQ ID NO: 1860604 - RNA, 16 nt, Homo sapiens
gacguccuccguccau

SEQ ID NO: 1860605 - RNA, 22 nt, Homo sapiens
cagcugaagaaaaugagcacac

SEQ ID NO: 1860606 - RNA, 13 nt, Homo sapiens
ugcuacacaaaag

SEQ ID NO: 1860607 - RNA, 18 nt, Homo sapiens
auaacaugauacuauuca

SEQ ID NO: 1860608 - RNA, 17 nt, Homo sapiens
caagcuuguguacuuga

SEQ ID NO: 1860609 - RNA, 21 nt, Homo sapiens
gaguucauggauauguuauac

SEQ ID NO: 1860610 - RNA, 21 nt, Homo sapiens
cgauucuccugccucagucuc

SEQ ID NO: 1860611 - RNA, 20 nt, Homo sapiens
aaguaauuuugcuccuugau

SEQ ID NO: 1860612 - RNA, 14 nt, Homo sapiens
accaaggaacaaga

SEQ ID NO: 1860613 - RNA, 20 nt, Homo sapiens
uggaaguaaaggcauuccac

SEQ ID NO: 1860614 - RNA, 13 nt, Homo sapiens
aggaaaacagacu

SEQ ID NO: 1860615 - RNA, 19 nt, Homo sapiens
ucuucccgccucagccucu

SEQ ID NO: 1860616 - RNA, 21 nt, Homo sapiens
uccaugugcuagucacuggca

SEQ ID NO: 1860617 - RNA, 19 nt, Homo sapiens
gucuacuggacaaucuuau

SEQ ID NO: 1860618 - RNA, 14 nt, Homo sapiens
ccgcuuucucugag

SEQ ID NO: 1860619 - RNA, 19 nt, Homo sapiens
gcaacagccacuacauuac

SEQ ID NO: 1860620 - RNA, 23 nt, Homo sapiens
agcuugccaauggcggacucaaa

SEQ ID NO: 1860621 - RNA, 23 nt, Homo sapiens
ucuccauaaaugacacuacuuga

SEQ ID NO: 1860622 - RNA, 22 nt, Homo sapiens
gauuucaaaguccagauaccaa

SEQ ID NO: 1860623 - RNA, 15 nt, Homo sapiens
ugaggcugggcuccc

SEQ ID NO: 1860624 - RNA, 17 nt, Homo sapiens
uauauaauguugccagc

SEQ ID NO: 1860625 - RNA, 17 nt, Homo sapiens
cuccagaccugauccug

SEQ ID NO: 1860626 - RNA, 18 nt, Homo sapiens
cugucccccacucucuca

SEQ ID NO: 1860627 - RNA, 14 nt, Homo sapiens
aauggagauuucau

SEQ ID NO: 1860628 - RNA, 18 nt, Homo sapiens
auuccuuuuucuaugaaa

SEQ ID NO: 1860629 - RNA, 22 nt, Homo sapiens
aaauuacagcuuuuauggauga

SEQ ID NO: 1860630 - RNA, 23 nt, Homo sapiens
ccugaacccuccaaauuugucua

SEQ ID NO: 1860631 - RNA, 12 nt, Homo sapiens
acccaaagacca

SEQ ID NO: 1860632 - RNA, 20 nt, Homo sapiens
ccccuuuacucauagcacuu

SEQ ID NO: 1860633 - RNA, 22 nt, Homo sapiens
gcccucuacagccugacuuucu

SEQ ID NO: 1860634 - RNA, 14 nt, Homo sapiens
uucccaaaacugau

SEQ ID NO: 1860635 - RNA, 20 nt, Homo sapiens
ugcaaagacugaguguucaa

SEQ ID NO: 1860636 - RNA, 14 nt, Homo sapiens
uuuguaauugcuua

SEQ ID NO: 1860637 - RNA, 13 nt, Homo sapiens
agguuaacagaua

SEQ ID NO: 1860638 - RNA, 23 nt, Homo sapiens
aaguugccauuauucuauguagu

SEQ ID NO: 1860639 - RNA, 19 nt, Homo sapiens
cauaggaggggucuggaca

SEQ ID NO: 1860640 - RNA, 19 nt, Homo sapiens
gcaccacucaagaccaaau

SEQ ID NO: 1860641 - RNA, 15 nt, Homo sapiens
cuggcauuugcugca

SEQ ID NO: 1860642 - RNA, 12 nt, Homo sapiens
acugagagcaga

SEQ ID NO: 1860643 - RNA, 19 nt, Homo sapiens
uuaaucuccucugaaaugu

SEQ ID NO: 1860644 - RNA, 21 nt, Homo sapiens
ccuguucuuccuaccaaauau

SEQ ID NO: 1860645 - RNA, 20 nt, Homo sapiens
ugagaguacucacuuuucac

SEQ ID NO: 1860646 - RNA, 13 nt, Homo sapiens
guccagcaccuug

SEQ ID NO: 1860647 - RNA, 19 nt, Homo sapiens
agguguuggcugcacgugc

SEQ ID NO: 1860648 - RNA, 17 nt, Homo sapiens
uagugguuuuaggauac

SEQ ID NO: 1860649 - RNA, 13 nt, Homo sapiens
ccugccucagcuu

SEQ ID NO: 1860650 - RNA, 16 nt, Homo sapiens
guacaauuuucauccc

SEQ ID NO: 1860651 - RNA, 22 nt, Homo sapiens
acucuccccucccucuuccuuc

SEQ ID NO: 1860652 - RNA, 13 nt, Homo sapiens
gaauacugugcau

SEQ ID NO: 1860653 - RNA, 21 nt, Homo sapiens
gcggccucgugccaugaucug

SEQ ID NO: 1860654 - RNA, 15 nt, Homo sapiens
uguccugaagcugcu

SEQ ID NO: 1860655 - RNA, 20 nt, Homo sapiens
aagcuggaugcaguggcuca

SEQ ID NO: 1860656 - RNA, 20 nt, Homo sapiens
aauguugauggugcuagaag

SEQ ID NO: 1860657 - RNA, 12 nt, Homo sapiens
cugauaugaguu

SEQ ID NO: 1860658 - RNA, 18 nt, Homo sapiens
gagcagggauuaaccucu

SEQ ID NO: 1860659 - RNA, 18 nt, Homo sapiens
uuaugaugccacuuuucu

SEQ ID NO: 1860660 - RNA, 14 nt, Homo sapiens
ugggcacaugccuu

SEQ ID NO: 1860661 - RNA, 12 nt, Homo sapiens
aaguaucuuucc

SEQ ID NO: 1860662 - RNA, 15 nt, Homo sapiens
ggccuguacccagua

SEQ ID NO: 1860663 - RNA, 20 nt, Homo sapiens
caauguuuuauguaaaaagu

SEQ ID NO: 1860664 - RNA, 17 nt, Homo sapiens
ugguauacaggugguuu

SEQ ID NO: 1860665 - RNA, 23 nt, Homo sapiens
auuagagguuaaugcagggacug

SEQ ID NO: 1860666 - RNA, 19 nt, Homo sapiens
ccgaaccccccacucccug

SEQ ID NO: 1860667 - RNA, 15 nt, Homo sapiens
cuccccagagcugcc

SEQ ID NO: 1860668 - RNA, 15 nt, Homo sapiens
ccagaagcugggaaa

SEQ ID NO: 1860669 - RNA, 15 nt, Homo sapiens
aucugcacauuucau

SEQ ID NO: 1860670 - RNA, 15 nt, Homo sapiens
ccugccuccccggaa

SEQ ID NO: 1860671 - RNA, 13 nt, Homo sapiens
auguaaacuuuaa

SEQ ID NO: 1860672 - RNA, 13 nt, Homo sapiens
auucuuagcauac

SEQ ID NO: 1860673 - RNA, 21 nt, Homo sapiens
aagcuguuucuugaugggaga

SEQ ID NO: 1860674 - RNA, 21 nt, Homo sapiens
cuuuuccccggucccuugaga

SEQ ID NO: 1860675 - RNA, 16 nt, Homo sapiens
uauauucauccaugcc

SEQ ID NO: 1860676 - RNA, 20 nt, Homo sapiens
aguugcaacuuaaguauauu

SEQ ID NO: 1860677 - RNA, 20 nt, Homo sapiens
acucuuagcuaaaucccucc

SEQ ID NO: 1860678 - RNA, 15 nt, Homo sapiens
uggacaacaagccuu

SEQ ID NO: 1860679 - RNA, 20 nt, Homo sapiens
agccaggguccugaguggcu

SEQ ID NO: 1860680 - RNA, 19 nt, Homo sapiens
ccuaaagacuaacuugaaa

SEQ ID NO: 1860681 - RNA, 17 nt, Homo sapiens
ccugacuguaaaugcuc

SEQ ID NO: 1860682 - RNA, 9 nt, Homo sapiens
acaggguuu

SEQ ID NO: 1860683 - RNA, 12 nt, Homo sapiens
accucuccauga

SEQ ID NO: 1860684 - RNA, 16 nt, Homo sapiens
uuaagccauaugacaa

SEQ ID NO: 1860685 - RNA, 16 nt, Homo sapiens
caugccugaugaaagc

SEQ ID NO: 1860686 - RNA, 22 nt, Homo sapiens
cuugaguggagguuuauaguua

SEQ ID NO: 1860687 - RNA, 16 nt, Homo sapiens
caaaggaauccaugua

SEQ ID NO: 1860688 - RNA, 16 nt, Homo sapiens
cacagaggugcuguag

SEQ ID NO: 1860689 - RNA, 19 nt, Homo sapiens
ucacauuguuugcugcuau

SEQ ID NO: 1860690 - RNA, 16 nt, Homo sapiens
cuuccaaaccucaaua

SEQ ID NO: 1860691 - RNA, 20 nt, Homo sapiens
ugaauaugaacggugagcau

SEQ ID NO: 1860692 - RNA, 19 nt, Homo sapiens
uaucacuucacuguucucu

SEQ ID NO: 1860693 - RNA, 16 nt, Homo sapiens
gcugcacauggccuga

SEQ ID NO: 1860694 - RNA, 20 nt, Homo sapiens
accuccaacaacgacacauu

SEQ ID NO: 1860695 - RNA, 17 nt, Homo sapiens
guacguuuuugcauuau

SEQ ID NO: 1860696 - RNA, 22 nt, Homo sapiens
uaacucagugaaggcccaugaa

SEQ ID NO: 1860697 - RNA, 15 nt, Homo sapiens
uagcaccauugcacu

SEQ ID NO: 1860698 - RNA, 15 nt, Homo sapiens
cagccccacugcccu

SEQ ID NO: 1860699 - RNA, 14 nt, Homo sapiens
uaagaucucagugg

SEQ ID NO: 1860700 - RNA, 16 nt, Homo sapiens
ucuucaauaaaccaca

SEQ ID NO: 1860701 - RNA, 22 nt, Homo sapiens
auucugaaucagaaucucgcag

SEQ ID NO: 1860702 - RNA, 20 nt, Homo sapiens
augugccuuucuuugccucu

SEQ ID NO: 1860703 - RNA, 23 nt, Homo sapiens
ucauggugguggacaccuguaau

SEQ ID NO: 1860704 - RNA, 22 nt, Homo sapiens
aaacaagcuuacuuccauugca

SEQ ID NO: 1860705 - RNA, 20 nt, Homo sapiens
caaaucuguccucuguagua

SEQ ID NO: 1860706 - RNA, 17 nt, Homo sapiens
caugauguauuguugcu

SEQ ID NO: 1860707 - RNA, 23 nt, Homo sapiens
agccuagaaauauagagcauuaa

SEQ ID NO: 1860708 - RNA, 14 nt, Homo sapiens
gcccugacuccugg

SEQ ID NO: 1860709 - RNA, 21 nt, Homo sapiens
auguaucaugauugauugaau

SEQ ID NO: 1860710 - RNA, 20 nt, Homo sapiens
ugggauagagaauguuccag

SEQ ID NO: 1860711 - RNA, 22 nt, Homo sapiens
gcaaucugggugguaacugcca

SEQ ID NO: 1860712 - RNA, 18 nt, Homo sapiens
ggcacugugccugagcuc

SEQ ID NO: 1860713 - RNA, 13 nt, Homo sapiens
cacagguguugaa

SEQ ID NO: 1860714 - RNA, 16 nt, Homo sapiens
uacugaaugucauuga

SEQ ID NO: 1860715 - RNA, 14 nt, Homo sapiens
agcuuauagaauaa

SEQ ID NO: 1860716 - RNA, 17 nt, Homo sapiens
gacagcuaggcugagau

SEQ ID NO: 1860717 - RNA, 19 nt, Homo sapiens
uggcagaaccaaagcucaa

SEQ ID NO: 1860718 - RNA, 23 nt, Homo sapiens
cuggaauuaagggagcugagcca

SEQ ID NO: 1860719 - RNA, 17 nt, Homo sapiens
accaagucaaacuugga

SEQ ID NO: 1860720 - RNA, 15 nt, Homo sapiens
agaauucuucauccu

SEQ ID NO: 1860721 - RNA, 22 nt, Homo sapiens
ccuugaacaaccagauggugac

SEQ ID NO: 1860722 - RNA, 21 nt, Homo sapiens
uaccauacauuuaaaguuuug

SEQ ID NO: 1860723 - RNA, 15 nt, Homo sapiens
cagagcccaagggaa

SEQ ID NO: 1860724 - RNA, 23 nt, Homo sapiens
uugagccaagcuucaacccucag

SEQ ID NO: 1860725 - RNA, 23 nt, Homo sapiens
aaaagguaccgcugugugcauuc

SEQ ID NO: 1860726 - RNA, 21 nt, Homo sapiens
gcugguucugcaaugacugca

SEQ ID NO: 1860727 - RNA, 21 nt, Homo sapiens
aucuccagcugaucacagaca

SEQ ID NO: 1860728 - RNA, 14 nt, Homo sapiens
caaaucauacuuuc

SEQ ID NO: 1860729 - RNA, 16 nt, Homo sapiens
cauuugcaaaauggaa

SEQ ID NO: 1860730 - RNA, 22 nt, Homo sapiens
gcagaaaggaaaagauuccugu

SEQ ID NO: 1860731 - RNA, 14 nt, Homo sapiens
agguauuuuggaau

SEQ ID NO: 1860732 - RNA, 14 nt, Homo sapiens
auacacaugugcac

SEQ ID NO: 1860733 - RNA, 17 nt, Homo sapiens
gaauguagcagaucccc

SEQ ID NO: 1860734 - RNA, 16 nt, Homo sapiens
uccauuuuacuuccau

SEQ ID NO: 1860735 - RNA, 22 nt, Homo sapiens
acaaggaaggugaugugugagu

SEQ ID NO: 1860736 - RNA, 14 nt, Homo sapiens
cucccuguccuccu

SEQ ID NO: 1860737 - RNA, 14 nt, Homo sapiens
auuauuguaccauu

SEQ ID NO: 1860738 - RNA, 15 nt, Homo sapiens
cuuaaacacuugcaa

SEQ ID NO: 1860739 - RNA, 14 nt, Homo sapiens
gcagggauucuucc

SEQ ID NO: 1860740 - RNA, 15 nt, Homo sapiens
gaacauggacuuucu

SEQ ID NO: 1860741 - RNA, 18 nt, Homo sapiens
caugauuuuacucauaug

SEQ ID NO: 1860742 - RNA, 12 nt, Homo sapiens
cacaugugcucu

SEQ ID NO: 1860743 - RNA, 17 nt, Homo sapiens
acaggauucucuucuca

SEQ ID NO: 1860744 - RNA, 12 nt, Homo sapiens
acauguauugca

SEQ ID NO: 1860745 - RNA, 21 nt, Homo sapiens
ucuccccggcaggccugagaa

SEQ ID NO: 1860746 - RNA, 23 nt, Homo sapiens
gcuuaguucuucuccugccuaau

SEQ ID NO: 1860747 - RNA, 20 nt, Homo sapiens
augcucuuuugcacaaggaa

SEQ ID NO: 1860748 - RNA, 19 nt, Homo sapiens
ggaauacuggccaugccug

SEQ ID NO: 1860749 - RNA, 16 nt, Homo sapiens
aucaaccaaauggagu

SEQ ID NO: 1860750 - RNA, 20 nt, Homo sapiens
aacuuguggccucaagcaau

SEQ ID NO: 1860751 - RNA, 22 nt, Homo sapiens
cuuaauuuaacuuuccagucuu

SEQ ID NO: 1860752 - RNA, 17 nt, Homo sapiens
gcagacaauaaacccuc

SEQ ID NO: 1860753 - RNA, 21 nt, Homo sapiens
aagagucuuguuuuuuauuca

SEQ ID NO: 1860754 - RNA, 16 nt, Homo sapiens
guguucgcuggcugau

SEQ ID NO: 1860755 - RNA, 21 nt, Homo sapiens
ugcucugguuguuucuguucc

SEQ ID NO: 1860756 - RNA, 17 nt, Homo sapiens
cagcuaaguguggagcu

SEQ ID NO: 1860757 - RNA, 19 nt, Homo sapiens
aaguaacacuaacuuugaa

SEQ ID NO: 1860758 - RNA, 13 nt, Homo sapiens
auugucaccucug

SEQ ID NO: 1860759 - RNA, 17 nt, Homo sapiens
ugaucaauuauaguuuc

SEQ ID NO: 1860760 - RNA, 14 nt, Homo sapiens
cccaggaggaccug

SEQ ID NO: 1860761 - RNA, 18 nt, Homo sapiens
ccugaaaccagugacuca

SEQ ID NO: 1860762 - RNA, 15 nt, Homo sapiens
cugggggaguggaau

SEQ ID NO: 1860763 - RNA, 14 nt, Homo sapiens
gaggagaccuuuga

SEQ ID NO: 1860764 - RNA, 12 nt, Homo sapiens
ccagaggcaccu

SEQ ID NO: 1860765 - RNA, 17 nt, Homo sapiens
aauuugauacugaccuu

SEQ ID NO: 1860766 - RNA, 13 nt, Homo sapiens
agggccaggugcu

SEQ ID NO: 1860767 - RNA, 13 nt, Homo sapiens
gugcucagagggc

SEQ ID NO: 1860768 - RNA, 20 nt, Homo sapiens
gaaguucccugaaccuuccu

SEQ ID NO: 1860769 - RNA, 22 nt, Homo sapiens
auuuucucuuuguaugucuguu

SEQ ID NO: 1860770 - RNA, 18 nt, Homo sapiens
ucagcagccucacugcau

SEQ ID NO: 1860771 - RNA, 11 nt, Homo sapiens
cuguuccucaa

SEQ ID NO: 1860772 - RNA, 18 nt, Homo sapiens
uuccuccuugucacugaa

SEQ ID NO: 1860773 - RNA, 23 nt, Homo sapiens
uucucaggaagcccccaaguuga

SEQ ID NO: 1860774 - RNA, 21 nt, Homo sapiens
gucacauaaugcucauacuua

SEQ ID NO: 1860775 - RNA, 18 nt, Homo sapiens
agaauugaguaucacuuu

SEQ ID NO: 1860776 - RNA, 19 nt, Homo sapiens
ucaucuucuagaaucucgu

SEQ ID NO: 1860777 - RNA, 24 nt, Homo sapiens
aacucaugaucaagauauaugugu

SEQ ID NO: 1860778 - RNA, 17 nt, Homo sapiens
ugagaugcagcuggaaa

SEQ ID NO: 1860779 - RNA, 18 nt, Homo sapiens
caaagccucaauuacuaa

SEQ ID NO: 1860780 - RNA, 18 nt, Homo sapiens
aucccugucauuuuuaac

SEQ ID NO: 1860781 - RNA, 18 nt, Homo sapiens
guauuuugguacugugau

SEQ ID NO: 1860782 - RNA, 13 nt, Homo sapiens
uauguuuggcugc

SEQ ID NO: 1860783 - RNA, 22 nt, Homo sapiens
uaggucucaugcccacuccccc

SEQ ID NO: 1860784 - RNA, 13 nt, Homo sapiens
ucaagaacacaug

SEQ ID NO: 1860785 - RNA, 13 nt, Homo sapiens
auuccaaaaacau

SEQ ID NO: 1860786 - RNA, 12 nt, Homo sapiens
uggcccaagacc

SEQ ID NO: 1860787 - RNA, 14 nt, Homo sapiens
gggauguugaacug

SEQ ID NO: 1860788 - RNA, 13 nt, Homo sapiens
ucauugcuaccuc

SEQ ID NO: 1860789 - RNA, 22 nt, Homo sapiens
acccaauuaaguccuacuuuac

SEQ ID NO: 1860790 - RNA, 21 nt, Homo sapiens
gcuacaagucaccuggugcua

SEQ ID NO: 1860791 - RNA, 15 nt, Homo sapiens
uguaggauucaaguc

SEQ ID NO: 1860792 - RNA, 22 nt, Homo sapiens
acauuuuauuuuuucuugcaaa

SEQ ID NO: 1860793 - RNA, 14 nt, Homo sapiens
cuauguuuauuuac

SEQ ID NO: 1860794 - RNA, 16 nt, Homo sapiens
aauuuagcaaccuaga

SEQ ID NO: 1860795 - RNA, 16 nt, Homo sapiens
auggcgaccaccaaag

SEQ ID NO: 1860796 - RNA, 19 nt, Homo sapiens
caaaaaaaaaaaaaugcac

SEQ ID NO: 1860797 - RNA, 19 nt, Homo sapiens
aaccugugaagcugaaaag

SEQ ID NO: 1860798 - RNA, 18 nt, Homo sapiens
cucaguuggugcugcuuu

SEQ ID NO: 1860799 - RNA, 17 nt, Homo sapiens
ccacaaaguaucuaaca

SEQ ID NO: 1860800 - RNA, 20 nt, Homo sapiens
aggaauuggcauguguaugu

SEQ ID NO: 1860801 - RNA, 23 nt, Homo sapiens
ucggcgccuuaaggauguucuag

SEQ ID NO: 1860802 - RNA, 19 nt, Homo sapiens
ugauugguuuaaaagucac

SEQ ID NO: 1860803 - RNA, 21 nt, Homo sapiens
uccuugguuguauaaagcaaa

SEQ ID NO: 1860804 - RNA, 19 nt, Homo sapiens
cuuaaaauaauauacaugc

SEQ ID NO: 1860805 - RNA, 17 nt, Homo sapiens
ccuacccugccccaauu

SEQ ID NO: 1860806 - RNA, 16 nt, Homo sapiens
gcgacuaucauucucu

SEQ ID NO: 1860807 - RNA, 14 nt, Homo sapiens
ucccagagaccuca

SEQ ID NO: 1860808 - RNA, 17 nt, Homo sapiens
agucagcaguccuagcc

SEQ ID NO: 1860809 - RNA, 15 nt, Homo sapiens
ccaaacacugaggca

SEQ ID NO: 1860810 - RNA, 14 nt, Homo sapiens
cugcuggaugugag

SEQ ID NO: 1860811 - RNA, 12 nt, Homo sapiens
uuuuugccaaaa

SEQ ID NO: 1860812 - RNA, 17 nt, Homo sapiens
caugaaaauuaugucag

SEQ ID NO: 1860813 - RNA, 21 nt, Homo sapiens
augcaucaauauguauuacaa

SEQ ID NO: 1860814 - RNA, 14 nt, Homo sapiens
uguggauaagggag

SEQ ID NO: 1860815 - RNA, 13 nt, Homo sapiens
aacuucaagcaaa

SEQ ID NO: 1860816 - RNA, 20 nt, Homo sapiens
gagggacuugagccaguuac

SEQ ID NO: 1860817 - RNA, 17 nt, Homo sapiens
accacauuucuaagccu

SEQ ID NO: 1860818 - RNA, 16 nt, Homo sapiens
gauguaccauguuaaa

SEQ ID NO: 1860819 - RNA, 13 nt, Homo sapiens
gcugaaaagugau

SEQ ID NO: 1860820 - RNA, 15 nt, Homo sapiens
cccucuaacaucucc

SEQ ID NO: 1860821 - RNA, 16 nt, Homo sapiens
uaauuccugaucuucc

SEQ ID NO: 1860822 - RNA, 18 nt, Homo sapiens
uucuacuuuuaacuaaua

SEQ ID NO: 1860823 - RNA, 15 nt, Homo sapiens
ugaauagacacuuca

SEQ ID NO: 1860824 - RNA, 22 nt, Homo sapiens
gaaauaagugcccucucccacc

SEQ ID NO: 1860825 - RNA, 18 nt, Homo sapiens
cagaugcuuuucugucuc

SEQ ID NO: 1860826 - RNA, 18 nt, Homo sapiens
uccgugaaggugaccuca

SEQ ID NO: 1860827 - RNA, 11 nt, Homo sapiens
cuuaagccaua

SEQ ID NO: 1860828 - RNA, 20 nt, Homo sapiens
cgccugaguaacgacaugga

SEQ ID NO: 1860829 - RNA, 23 nt, Homo sapiens
aguaucucuucagucucuauacc

SEQ ID NO: 1860830 - RNA, 16 nt, Homo sapiens
ccaaaugucaucaggu

SEQ ID NO: 1860831 - RNA, 14 nt, Homo sapiens
uacaucuuucacau

SEQ ID NO: 1860832 - RNA, 14 nt, Homo sapiens
gagucauugaaggg

SEQ ID NO: 1860833 - RNA, 15 nt, Homo sapiens
guuuauaaugcaaug

SEQ ID NO: 1860834 - RNA, 18 nt, Homo sapiens
uaaacaguuuuggagaaa

SEQ ID NO: 1860835 - RNA, 15 nt, Homo sapiens
ugauuuguagcacug

SEQ ID NO: 1860836 - RNA, 21 nt, Homo sapiens
cuauuuaauuauuucacuuua

SEQ ID NO: 1860837 - RNA, 14 nt, Homo sapiens
uuacugaauaaaua

SEQ ID NO: 1860838 - RNA, 17 nt, Homo sapiens
augugcaaccacugcuu

SEQ ID NO: 1860839 - RNA, 20 nt, Homo sapiens
uugcugugucuccucucaga

SEQ ID NO: 1860840 - RNA, 13 nt, Homo sapiens
aacaugaagcaca

SEQ ID NO: 1860841 - RNA, 22 nt, Homo sapiens
uuuucaucccguaucacagugu

SEQ ID NO: 1860842 - RNA, 12 nt, Homo sapiens
aacucacugugc

SEQ ID NO: 1860843 - RNA, 22 nt, Homo sapiens
caaaaaugaacugaaguuucac

SEQ ID NO: 1860844 - RNA, 17 nt, Homo sapiens
gagucaggggagcucag

SEQ ID NO: 1860845 - RNA, 23 nt, Homo sapiens
agucuaguuauuggaucagugaa

SEQ ID NO: 1860846 - RNA, 13 nt, Homo sapiens
uuucccauugcca

SEQ ID NO: 1860847 - RNA, 13 nt, Homo sapiens
cagccucacggag

SEQ ID NO: 1860848 - RNA, 13 nt, Homo sapiens
caccuggcugcua

SEQ ID NO: 1860849 - RNA, 21 nt, Homo sapiens
acucagucugugggagcucag

SEQ ID NO: 1860850 - RNA, 21 nt, Homo sapiens
gccugggauuucuaugcagug

SEQ ID NO: 1860851 - RNA, 23 nt, Homo sapiens
gaaagacuuggguugaacuauaa

SEQ ID NO: 1860852 - RNA, 20 nt, Homo sapiens
uaccaagaacagagucucag

SEQ ID NO: 1860853 - RNA, 20 nt, Homo sapiens
ucaccugugacuccuguugc

SEQ ID NO: 1860854 - RNA, 15 nt, Homo sapiens
uuugguaugugcuag

SEQ ID NO: 1860855 - RNA, 14 nt, Homo sapiens
uaacccuccaccuc

SEQ ID NO: 1860856 - RNA, 14 nt, Homo sapiens
caaucuucuacuuu

SEQ ID NO: 1860857 - RNA, 23 nt, Homo sapiens
cagauaaugcuuuuacuaagcac

SEQ ID NO: 1860858 - RNA, 23 nt, Homo sapiens
caagucauucagcuaauacaaag

SEQ ID NO: 1860859 - RNA, 17 nt, Homo sapiens
gcuacuauaaucaaaug

SEQ ID NO: 1860860 - RNA, 16 nt, Homo sapiens
gcaggcccuguccuaa

SEQ ID NO: 1860861 - RNA, 14 nt, Homo sapiens
auaugucuagcuca

SEQ ID NO: 1860862 - RNA, 16 nt, Homo sapiens
augucagcagcuuuaa

SEQ ID NO: 1860863 - RNA, 21 nt, Homo sapiens
uagccagauuugucuuuuugu

SEQ ID NO: 1860864 - RNA, 12 nt, Homo sapiens
ucaaaaagccac

SEQ ID NO: 1860865 - RNA, 23 nt, Homo sapiens
uguugccuaccuagcugcaucua

SEQ ID NO: 1860866 - RNA, 14 nt, Homo sapiens
ucuucugagugaau

SEQ ID NO: 1860867 - RNA, 13 nt, Homo sapiens
uccgcucagccaa

SEQ ID NO: 1860868 - RNA, 13 nt, Homo sapiens
ucaagucucucac

SEQ ID NO: 1860869 - RNA, 15 nt, Homo sapiens
ccaauccaacaucca

SEQ ID NO: 1860870 - RNA, 18 nt, Homo sapiens
agccaaagagaaugccau

SEQ ID NO: 1860871 - RNA, 17 nt, Homo sapiens
ucuuacaauugcacugc

SEQ ID NO: 1860872 - RNA, 22 nt, Homo sapiens
agaaaagaugugcagauaucac

SEQ ID NO: 1860873 - RNA, 14 nt, Homo sapiens
ucucuauguaucaa

SEQ ID NO: 1860874 - RNA, 20 nt, Homo sapiens
aaugagauuuuagacugcca

SEQ ID NO: 1860875 - RNA, 18 nt, Homo sapiens
cauggugaccaggcucuu

SEQ ID NO: 1860876 - RNA, 14 nt, Homo sapiens
cucgggguaaaaag

SEQ ID NO: 1860877 - RNA, 16 nt, Homo sapiens
ccuccgccuccugggu

SEQ ID NO: 1860878 - RNA, 15 nt, Homo sapiens
aaaguggaaacaaua

SEQ ID NO: 1860879 - RNA, 20 nt, Homo sapiens
agaguguuggaaauaggcaa

SEQ ID NO: 1860880 - RNA, 18 nt, Homo sapiens
ggguaugggaagccauau

SEQ ID NO: 1860881 - RNA, 18 nt, Homo sapiens
agcaauucuccugccuca

SEQ ID NO: 1860882 - RNA, 23 nt, Homo sapiens
ggacgcacgcucgcugccaucac

SEQ ID NO: 1860883 - RNA, 21 nt, Homo sapiens
uguggcacucagggagcauuu

SEQ ID NO: 1860884 - RNA, 13 nt, Homo sapiens
cgagcacugugag

SEQ ID NO: 1860885 - RNA, 18 nt, Homo sapiens
acacaggccugcucucuu

SEQ ID NO: 1860886 - RNA, 20 nt, Homo sapiens
ucugacucacaagaagacca

SEQ ID NO: 1860887 - RNA, 16 nt, Homo sapiens
caucccuggaugugga

SEQ ID NO: 1860888 - RNA, 21 nt, Homo sapiens
gacauucuggggaacugggca

SEQ ID NO: 1860889 - RNA, 20 nt, Homo sapiens
ugcucauuguaaccauuucu

SEQ ID NO: 1860890 - RNA, 20 nt, Homo sapiens
gacaaccccagccaaucaca

SEQ ID NO: 1860891 - RNA, 17 nt, Homo sapiens
ugcacccagccaaacac

SEQ ID NO: 1860892 - RNA, 22 nt, Homo sapiens
acgcgugauugguaacugccug

SEQ ID NO: 1860893 - RNA, 23 nt, Homo sapiens
uauuggcgcaccaagaucuccaa

SEQ ID NO: 1860894 - RNA, 20 nt, Homo sapiens
aacagugccauuguuuugcc

SEQ ID NO: 1860895 - RNA, 22 nt, Homo sapiens
gagcagcuuuaaacucagggac

SEQ ID NO: 1860896 - RNA, 21 nt, Homo sapiens
gagaaugagagacacacugaa

SEQ ID NO: 1860897 - RNA, 17 nt, Homo sapiens
auggguuaagagcucac

SEQ ID NO: 1860898 - RNA, 17 nt, Homo sapiens
ugccuugggccugggaa

SEQ ID NO: 1860899 - RNA, 22 nt, Homo sapiens
augagucugcauaaacuucauc

SEQ ID NO: 1860900 - RNA, 17 nt, Homo sapiens
aagcaaaagucagucuu

SEQ ID NO: 1860901 - RNA, 15 nt, Homo sapiens
uuggaaucaugcaaa

SEQ ID NO: 1860902 - RNA, 15 nt, Homo sapiens
aaugauacuaucauu

SEQ ID NO: 1860903 - RNA, 18 nt, Homo sapiens
acacagggugcaugugag

SEQ ID NO: 1860904 - RNA, 13 nt, Homo sapiens
ucucauucagaag

SEQ ID NO: 1860905 - RNA, 17 nt, Homo sapiens
gccaaaacaagccaaag

SEQ ID NO: 1860906 - RNA, 14 nt, Homo sapiens
cugugaagccuuua

SEQ ID NO: 1860907 - RNA, 14 nt, Homo sapiens
auguuaagacuuga

SEQ ID NO: 1860908 - RNA, 17 nt, Homo sapiens
auaucuugaaagggguu

SEQ ID NO: 1860909 - RNA, 21 nt, Homo sapiens
gaucuauuguuuguugcacua

SEQ ID NO: 1860910 - RNA, 20 nt, Homo sapiens
gguauaccugggaagauacc

SEQ ID NO: 1860911 - RNA, 13 nt, Homo sapiens
uuaagugauguca

SEQ ID NO: 1860912 - RNA, 22 nt, Homo sapiens
auccauaacacccccaccccaa

SEQ ID NO: 1860913 - RNA, 18 nt, Homo sapiens
ugaauagcucucugugug

SEQ ID NO: 1860914 - RNA, 18 nt, Homo sapiens
aauuuagaaugaauauua

SEQ ID NO: 1860915 - RNA, 14 nt, Homo sapiens
cucagcaauccacc

SEQ ID NO: 1860916 - RNA, 16 nt, Homo sapiens
cugugcuuaccuguga

SEQ ID NO: 1860917 - RNA, 19 nt, Homo sapiens
uacuuaacuauucaggaga

SEQ ID NO: 1860918 - RNA, 20 nt, Homo sapiens
ugccaggcccccaccacaca

SEQ ID NO: 1860919 - RNA, 21 nt, Homo sapiens
aaagguaaaucagacuaugaa

SEQ ID NO: 1860920 - RNA, 15 nt, Homo sapiens
agccaagccagucaa

SEQ ID NO: 1860921 - RNA, 14 nt, Homo sapiens
aaucaaguuuccaa

SEQ ID NO: 1860922 - RNA, 16 nt, Homo sapiens
agaaaucuuucuggaa

SEQ ID NO: 1860923 - RNA, 16 nt, Homo sapiens
gugauggacacuccag

SEQ ID NO: 1860924 - RNA, 16 nt, Homo sapiens
auuuuaggauuaccca

SEQ ID NO: 1860925 - RNA, 17 nt, Homo sapiens
auuaaauggcaccugua

SEQ ID NO: 1860926 - RNA, 14 nt, Homo sapiens
cauuaaaugcuuug

SEQ ID NO: 1860927 - RNA, 16 nt, Homo sapiens
cuuggugagucugugu

SEQ ID NO: 1860928 - RNA, 16 nt, Homo sapiens
ugucuuagucauacca

SEQ ID NO: 1860929 - RNA, 22 nt, Homo sapiens
uuucccucucccaguccauuuc

SEQ ID NO: 1860930 - RNA, 12 nt, Homo sapiens
guaccauuuaau

SEQ ID NO: 1860931 - RNA, 18 nt, Homo sapiens
ucucugcuccaccacauc

SEQ ID NO: 1860932 - RNA, 17 nt, Homo sapiens
cuuccucagccuccaaa

SEQ ID NO: 1860933 - RNA, 17 nt, Homo sapiens
cagcaugguaguggcaa

SEQ ID NO: 1860934 - RNA, 17 nt, Homo sapiens
ugugaacaugauaguua

SEQ ID NO: 1860935 - RNA, 14 nt, Homo sapiens
gacgccaugugaug

SEQ ID NO: 1860936 - RNA, 14 nt, Homo sapiens
cacaugaucuggcc

SEQ ID NO: 1860937 - RNA, 12 nt, Homo sapiens
acaucugucacg

SEQ ID NO: 1860938 - RNA, 16 nt, Homo sapiens
ugcagaguugugcaug

SEQ ID NO: 1860939 - RNA, 18 nt, Homo sapiens
aacugacugccuugcuaa

SEQ ID NO: 1860940 - RNA, 14 nt, Homo sapiens
cuauuccaaagugc

SEQ ID NO: 1860941 - RNA, 23 nt, Homo sapiens
ucagcagggacuguaaacacaga

SEQ ID NO: 1860942 - RNA, 20 nt, Homo sapiens
accugcuucccccacuucac

SEQ ID NO: 1860943 - RNA, 19 nt, Homo sapiens
ucuucuuggggcccagugc

SEQ ID NO: 1860944 - RNA, 14 nt, Homo sapiens
acaaaccauuuugu

SEQ ID NO: 1860945 - RNA, 21 nt, Homo sapiens
cugaauaaagcacgugcaagg

SEQ ID NO: 1860946 - RNA, 21 nt, Homo sapiens
uuuucaaauaggaugcauucg

SEQ ID NO: 1860947 - RNA, 16 nt, Homo sapiens
cauaagaaagcacuau

SEQ ID NO: 1860948 - RNA, 20 nt, Homo sapiens
aaacaaaaaaacccaggggc

SEQ ID NO: 1860949 - RNA, 19 nt, Homo sapiens
gcagauacaggaaaagcug

SEQ ID NO: 1860950 - RNA, 21 nt, Homo sapiens
acaugugucccagccacagug

SEQ ID NO: 1860951 - RNA, 14 nt, Homo sapiens
cuucacaccauuca

SEQ ID NO: 1860952 - RNA, 17 nt, Homo sapiens
aaacauguaugugcauu

SEQ ID NO: 1860953 - RNA, 18 nt, Homo sapiens
caucccuuuuucugcuaa

SEQ ID NO: 1860954 - RNA, 20 nt, Homo sapiens
agaauuagaaacaacauagc

SEQ ID NO: 1860955 - RNA, 12 nt, Homo sapiens
caauacagugaa

SEQ ID NO: 1860956 - RNA, 14 nt, Homo sapiens
accagaugaugucc

SEQ ID NO: 1860957 - RNA, 22 nt, Homo sapiens
guuagaagcaaugaauguauau

SEQ ID NO: 1860958 - RNA, 16 nt, Homo sapiens
guccugccccaggugu

SEQ ID NO: 1860959 - RNA, 21 nt, Homo sapiens
uggcaccucagacaauccacu

SEQ ID NO: 1860960 - RNA, 14 nt, Homo sapiens
aaacuguacagugu

SEQ ID NO: 1860961 - RNA, 10 nt, Homo sapiens
aaagcacagc

SEQ ID NO: 1860962 - RNA, 19 nt, Homo sapiens
ggagcuucuuguuuccuug

SEQ ID NO: 1860963 - RNA, 16 nt, Homo sapiens
ugagacagaguuucac

SEQ ID NO: 1860964 - RNA, 21 nt, Homo sapiens
uaaacuuccaauuucuagcca

SEQ ID NO: 1860965 - RNA, 20 nt, Homo sapiens
uugagcaucacagaauguga

SEQ ID NO: 1860966 - RNA, 16 nt, Homo sapiens
agugauuugccucaac

SEQ ID NO: 1860967 - RNA, 17 nt, Homo sapiens
cauaccaaauauuugaa

SEQ ID NO: 1860968 - RNA, 15 nt, Homo sapiens
guacuucuguguuca

SEQ ID NO: 1860969 - RNA, 24 nt, Homo sapiens
uggcccucccagugccuccuagcc

SEQ ID NO: 1860970 - RNA, 14 nt, Homo sapiens
uuuggguaccugua

SEQ ID NO: 1860971 - RNA, 22 nt, Homo sapiens
caccuuggcaccagacacccag

SEQ ID NO: 1860972 - RNA, 14 nt, Homo sapiens
cagacaucagaaca

SEQ ID NO: 1860973 - RNA, 22 nt, Homo sapiens
aagauauggagaauugcugaag

SEQ ID NO: 1860974 - RNA, 15 nt, Homo sapiens
aggcugacuuuucca

SEQ ID NO: 1860975 - RNA, 16 nt, Homo sapiens
agacagaaaacauguu

SEQ ID NO: 1860976 - RNA, 16 nt, Homo sapiens
auccuauuauguguuc

SEQ ID NO: 1860977 - RNA, 15 nt, Homo sapiens
aauuuuuaaugcuua

SEQ ID NO: 1860978 - RNA, 19 nt, Homo sapiens
cgaggacagggaggugacc

SEQ ID NO: 1860979 - RNA, 22 nt, Homo sapiens
uuuucgccaaggcucacaugcu

SEQ ID NO: 1860980 - RNA, 17 nt, Homo sapiens
aguggugcgaucuuggc

SEQ ID NO: 1860981 - RNA, 19 nt, Homo sapiens
uaaucccaacacuuugaga

SEQ ID NO: 1860982 - RNA, 16 nt, Homo sapiens
gaccccuggucucagu

SEQ ID NO: 1860983 - RNA, 14 nt, Homo sapiens
aaaaaagcauauau

SEQ ID NO: 1860984 - RNA, 22 nt, Homo sapiens
uaaagguccacaggucuagacu

SEQ ID NO: 1860985 - RNA, 20 nt, Homo sapiens
gaagaacaguaacugccauc

SEQ ID NO: 1860986 - RNA, 23 nt, Homo sapiens
gcgcaggguggugguauucuguc

SEQ ID NO: 1860987 - RNA, 15 nt, Homo sapiens
accauaaccaagaaa

SEQ ID NO: 1860988 - RNA, 15 nt, Homo sapiens
aacucuagaagacca

SEQ ID NO: 1860989 - RNA, 13 nt, Homo sapiens
cagcuaacugugg

SEQ ID NO: 1860990 - RNA, 13 nt, Homo sapiens
ugugauauggagc

SEQ ID NO: 1860991 - RNA, 11 nt, Homo sapiens
aaauaagcaaa

SEQ ID NO: 1860992 - RNA, 15 nt, Homo sapiens
cuccuaagacaccug

SEQ ID NO: 1860993 - RNA, 23 nt, Homo sapiens
ugagugcucuggggcacuguuga

SEQ ID NO: 1860994 - RNA, 18 nt, Homo sapiens
uuuuaaggguacaguuug

SEQ ID NO: 1860995 - RNA, 20 nt, Homo sapiens
cauuugggagaagaucucaa

SEQ ID NO: 1860996 - RNA, 17 nt, Homo sapiens
aaacccauuuacuuagg

SEQ ID NO: 1860997 - RNA, 14 nt, Homo sapiens
ugguuaacaucuca

SEQ ID NO: 1860998 - RNA, 22 nt, Homo sapiens
cuuguucaucauccagaugugg

SEQ ID NO: 1860999 - RNA, 22 nt, Homo sapiens
aaaucaaaaacuuuucauuuca

SEQ ID NO: 1861000 - RNA, 17 nt, Homo sapiens
aaaguucacauuaacuc

SEQ ID NO: 1861001 - RNA, 20 nt, Homo sapiens
agccacucagucucuuccac

SEQ ID NO: 1861002 - RNA, 18 nt, Homo sapiens
uaaaaagugacacagcag

SEQ ID NO: 1861003 - RNA, 20 nt, Homo sapiens
ugugaaauaguccugaaguu

SEQ ID NO: 1861004 - RNA, 22 nt, Homo sapiens
ccucagccucccaaagugcagg

SEQ ID NO: 1861005 - RNA, 15 nt, Homo sapiens
agaauuauaacugua

SEQ ID NO: 1861006 - RNA, 15 nt, Homo sapiens
cccuggcaaccagga

SEQ ID NO: 1861007 - RNA, 21 nt, Homo sapiens
cucccauggaauuggaacucc

SEQ ID NO: 1861008 - RNA, 16 nt, Homo sapiens
acagcuuaacauuuac

SEQ ID NO: 1861009 - RNA, 14 nt, Homo sapiens
ucuuaaaucuguga

SEQ ID NO: 1861010 - RNA, 23 nt, Homo sapiens
cugagaacaaauacaauucaguc

SEQ ID NO: 1861011 - RNA, 18 nt, Homo sapiens
ugcccuggcugugaugag

SEQ ID NO: 1861012 - RNA, 20 nt, Homo sapiens
aggcuggagugcaacggcau

SEQ ID NO: 1861013 - RNA, 13 nt, Homo sapiens
aaaauagcaaaag

SEQ ID NO: 1861014 - RNA, 17 nt, Homo sapiens
cagugaaggaagaaccu

SEQ ID NO: 1861015 - RNA, 13 nt, Homo sapiens
gcaggaccaaggg

SEQ ID NO: 1861016 - RNA, 16 nt, Homo sapiens
agcccuggccagcccu

SEQ ID NO: 1861017 - RNA, 15 nt, Homo sapiens
cuuacauaugcaaaa

SEQ ID NO: 1861018 - RNA, 14 nt, Homo sapiens
ggccagagccaugc

SEQ ID NO: 1861019 - RNA, 14 nt, Homo sapiens
cuggcgcugugcua

SEQ ID NO: 1861020 - RNA, 16 nt, Homo sapiens
caugcgaugacacuug

SEQ ID NO: 1861021 - RNA, 18 nt, Homo sapiens
gccaugaggaacaaggca

SEQ ID NO: 1861022 - RNA, 19 nt, Homo sapiens
uuucauguuuugugacuau

SEQ ID NO: 1861023 - RNA, 22 nt, Homo sapiens
cuugcaucguggagacagggca

SEQ ID NO: 1861024 - RNA, 15 nt, Homo sapiens
ucugaaugagccuuu

SEQ ID NO: 1861025 - RNA, 15 nt, Homo sapiens
uucagaggaagcaca

SEQ ID NO: 1861026 - RNA, 14 nt, Homo sapiens
cuguguguugccug

SEQ ID NO: 1861027 - RNA, 16 nt, Homo sapiens
guaaagauaaaaggau

SEQ ID NO: 1861028 - RNA, 15 nt, Homo sapiens
aaagacugucuuaau

SEQ ID NO: 1861029 - RNA, 17 nt, Homo sapiens
agaugucuuaaaagacu

SEQ ID NO: 1861030 - RNA, 21 nt, Homo sapiens
agaugccagcauauacugaag

SEQ ID NO: 1861031 - RNA, 13 nt, Homo sapiens
uucugaacagcug

SEQ ID NO: 1861032 - RNA, 13 nt, Homo sapiens
auaaucacuacua

SEQ ID NO: 1861033 - RNA, 19 nt, Homo sapiens
uguccaacugccuguucaa
